United States Patent 12,394,502 (METHOD FOR PREDICTING HLA-BINDING PEPTIDES USING PROTEIN STRUCTURAL FEATURES) - sequence listing, part 3

SEQ ID NO: 83899 - protein, 8 aa, Homo Sapiens
DEVYAPGL

SEQ ID NO: 83900 - protein, 8 aa, Homo Sapiens
DEWKAQVA

SEQ ID NO: 83901 - protein, 8 aa, Homo Sapiens
DEWKGMVL

SEQ ID NO: 83902 - protein, 8 aa, Homo Sapiens
DEWRETAW

SEQ ID NO: 83903 - protein, 8 aa, Homo Sapiens
DEWTSQAH

SEQ ID NO: 83904 - protein, 8 aa, Homo Sapiens
DEWWAQQF

SEQ ID NO: 83905 - protein, 8 aa, Homo Sapiens
DEYCVQQL

SEQ ID NO: 83906 - protein, 8 aa, Homo Sapiens
DEYKIPSS

SEQ ID NO: 83907 - protein, 8 aa, Homo Sapiens
DEYKPPKF

SEQ ID NO: 83908 - protein, 8 aa, Homo Sapiens
DEYKVTAF

SEQ ID NO: 83909 - protein, 8 aa, Homo Sapiens
DEYLVTSI

SEQ ID NO: 83910 - protein, 8 aa, Homo Sapiens
DEYQVAQL

SEQ ID NO: 83911 - protein, 8 aa, Homo Sapiens
DEYRSMTM

SEQ ID NO: 83912 - protein, 8 aa, Homo Sapiens
DEYYQVVY

SEQ ID NO: 83913 - protein, 8 aa, Homo Sapiens
DGMKIPTY

SEQ ID NO: 83914 - protein, 8 aa, Homo Sapiens
DGVVVQVM

SEQ ID NO: 83915 - protein, 8 aa, Homo Sapiens
DMAEIEKF

SEQ ID NO: 83916 - protein, 8 aa, Homo Sapiens
DMIILPEM

SEQ ID NO: 83917 - protein, 8 aa, Homo Sapiens
DQFILYLG

SEQ ID NO: 83918 - protein, 8 aa, Homo Sapiens
DQVKFNVF

SEQ ID NO: 83919 - protein, 8 aa, Homo Sapiens
DSVVVHVY

SEQ ID NO: 83920 - protein, 8 aa, Homo Sapiens
DVPLVVEY

SEQ ID NO: 83921 - protein, 8 aa, Homo Sapiens
EDIVVPVY

SEQ ID NO: 83922 - protein, 8 aa, Homo Sapiens
EDRVIEHY

SEQ ID NO: 83923 - protein, 8 aa, Homo Sapiens
EEAFVSHY

SEQ ID NO: 83924 - protein, 8 aa, Homo Sapiens
EEAIIYSY

SEQ ID NO: 83925 - protein, 8 aa, Homo Sapiens
EEAIRPQM

SEQ ID NO: 83926 - protein, 8 aa, Homo Sapiens
EEAKELLL

SEQ ID NO: 83927 - protein, 8 aa, Homo Sapiens
EEALAKKF

SEQ ID NO: 83928 - protein, 8 aa, Homo Sapiens
EEALRLVY

SEQ ID NO: 83929 - protein, 8 aa, Homo Sapiens
EEARKFSY

SEQ ID NO: 83930 - protein, 8 aa, Homo Sapiens
EEFAAALY

SEQ ID NO: 83931 - protein, 8 aa, Homo Sapiens
EEFDFKEY

SEQ ID NO: 83932 - protein, 8 aa, Homo Sapiens
EEFNGYLY

SEQ ID NO: 83933 - protein, 8 aa, Homo Sapiens
EEFQIHVF

SEQ ID NO: 83934 - protein, 8 aa, Homo Sapiens
EEFTVARL

SEQ ID NO: 83935 - protein, 8 aa, Homo Sapiens
EEGLVSQY

SEQ ID NO: 83936 - protein, 8 aa, Homo Sapiens
EEGRVFVY

SEQ ID NO: 83937 - protein, 8 aa, Homo Sapiens
EEHEVAVL

SEQ ID NO: 83938 - protein, 8 aa, Homo Sapiens
EEHGVYVY

SEQ ID NO: 83939 - protein, 8 aa, Homo Sapiens
EEIARLLM

SEQ ID NO: 83940 - protein, 8 aa, Homo Sapiens
EEIEGFRY

SEQ ID NO: 83941 - protein, 8 aa, Homo Sapiens
EEIHATGF

SEQ ID NO: 83942 - protein, 8 aa, Homo Sapiens
EEIIKYAH

SEQ ID NO: 83943 - protein, 8 aa, Homo Sapiens
EEIILVSF

SEQ ID NO: 83944 - protein, 8 aa, Homo Sapiens
EEIIVKAM

SEQ ID NO: 83945 - protein, 8 aa, Homo Sapiens
EEIKKTTL

SEQ ID NO: 83946 - protein, 8 aa, Homo Sapiens
EEILLNSY

SEQ ID NO: 83947 - protein, 8 aa, Homo Sapiens
EEILSVAY

SEQ ID NO: 83948 - protein, 8 aa, Homo Sapiens
EEIMRNQF

SEQ ID NO: 83949 - protein, 8 aa, Homo Sapiens
EEIPTHSF

SEQ ID NO: 83950 - protein, 8 aa, Homo Sapiens
EEIQKHNL

SEQ ID NO: 83951 - protein, 8 aa, Homo Sapiens
EEIQSFIY

SEQ ID NO: 83952 - protein, 8 aa, Homo Sapiens
EEIRAEVF

SEQ ID NO: 83953 - protein, 8 aa, Homo Sapiens
EEIVKVTF

SEQ ID NO: 83954 - protein, 8 aa, Homo Sapiens
EEIVRFGF

SEQ ID NO: 83955 - protein, 8 aa, Homo Sapiens
EELKFDRY

SEQ ID NO: 83956 - protein, 8 aa, Homo Sapiens
EELLLVAY

SEQ ID NO: 83957 - protein, 8 aa, Homo Sapiens
EELQVANY

SEQ ID NO: 83958 - protein, 8 aa, Homo Sapiens
EELRVDHY

SEQ ID NO: 83959 - protein, 8 aa, Homo Sapiens
EELVRMVL

SEQ ID NO: 83960 - protein, 8 aa, Homo Sapiens
EEMEAYRM

SEQ ID NO: 83961 - protein, 8 aa, Homo Sapiens
EEMEFQRF

SEQ ID NO: 83962 - protein, 8 aa, Homo Sapiens
EEMFASRF

SEQ ID NO: 83963 - protein, 8 aa, Homo Sapiens
EEMKFHEF

SEQ ID NO: 83964 - protein, 8 aa, Homo Sapiens
EEMLVEKL

SEQ ID NO: 83965 - protein, 8 aa, Homo Sapiens
EEMMVPGM

SEQ ID NO: 83966 - protein, 8 aa, Homo Sapiens
EEQIAYAM

SEQ ID NO: 83967 - protein, 8 aa, Homo Sapiens
EEQLQQIR

SEQ ID NO: 83968 - protein, 8 aa, Homo Sapiens
EERIVELF

SEQ ID NO: 83969 - protein, 8 aa, Homo Sapiens
EERQIEEL

SEQ ID NO: 83970 - protein, 8 aa, Homo Sapiens
EERYFISH

SEQ ID NO: 83971 - protein, 8 aa, Homo Sapiens
EESIAHHY

SEQ ID NO: 83972 - protein, 8 aa, Homo Sapiens
EETVFYGL

SEQ ID NO: 83973 - protein, 8 aa, Homo Sapiens
EEVETFAF

SEQ ID NO: 83974 - protein, 8 aa, Homo Sapiens
EEVLSCLY

SEQ ID NO: 83975 - protein, 8 aa, Homo Sapiens
EEWKFDTL

SEQ ID NO: 83976 - protein, 8 aa, Homo Sapiens
EEWLRPVM

SEQ ID NO: 83977 - protein, 8 aa, Homo Sapiens
EEWSVKTY

SEQ ID NO: 83978 - protein, 8 aa, Homo Sapiens
EEWVRPVM

SEQ ID NO: 83979 - protein, 8 aa, Homo Sapiens
EEYKVACL

SEQ ID NO: 83980 - protein, 8 aa, Homo Sapiens
EEYLKPVL

SEQ ID NO: 83981 - protein, 8 aa, Homo Sapiens
EEYYSSRY

SEQ ID NO: 83982 - protein, 8 aa, Homo Sapiens
EITLLQEF

SEQ ID NO: 83983 - protein, 8 aa, Homo Sapiens
ELAILDRL

SEQ ID NO: 83984 - protein, 8 aa, Homo Sapiens
ELQRVEEL

SEQ ID NO: 83985 - protein, 8 aa, Homo Sapiens
ENIAAVVF

SEQ ID NO: 83986 - protein, 8 aa, Homo Sapiens
ETAVLPKL

SEQ ID NO: 83987 - protein, 8 aa, Homo Sapiens
ETIKNGIY

SEQ ID NO: 83988 - protein, 8 aa, Homo Sapiens
ETPILARY

SEQ ID NO: 83989 - protein, 8 aa, Homo Sapiens
FEHIVTQF

SEQ ID NO: 83990 - protein, 8 aa, Homo Sapiens
FEHKASRF

SEQ ID NO: 83991 - protein, 8 aa, Homo Sapiens
FEHMATNY

SEQ ID NO: 83992 - protein, 8 aa, Homo Sapiens
FEHQFETL

SEQ ID NO: 83993 - protein, 8 aa, Homo Sapiens
FEHTFEVY

SEQ ID NO: 83994 - protein, 8 aa, Homo Sapiens
FEIIVHQY

SEQ ID NO: 83995 - protein, 8 aa, Homo Sapiens
FEIPAQRF

SEQ ID NO: 83996 - protein, 8 aa, Homo Sapiens
FEIVLNDY

SEQ ID NO: 83997 - protein, 8 aa, Homo Sapiens
FEKEAAEM

SEQ ID NO: 83998 - protein, 8 aa, Homo Sapiens
FEKLKPKY

SEQ ID NO: 83999 - protein, 8 aa, Homo Sapiens
FEKQVELY

SEQ ID NO: 84000 - protein, 8 aa, Homo Sapiens
FELVQHEY

SEQ ID NO: 84001 - protein, 8 aa, Homo Sapiens
FEMTIPQF

SEQ ID NO: 84002 - protein, 8 aa, Homo Sapiens
FENIVAVL

SEQ ID NO: 84003 - protein, 8 aa, Homo Sapiens
FEQAFYTY

SEQ ID NO: 84004 - protein, 8 aa, Homo Sapiens
FERTVEAL

SEQ ID NO: 84005 - protein, 8 aa, Homo Sapiens
FESHITSY

SEQ ID NO: 84006 - protein, 8 aa, Homo Sapiens
FETIIHSY

SEQ ID NO: 84007 - protein, 8 aa, Homo Sapiens
FEVEKELF

SEQ ID NO: 84008 - protein, 8 aa, Homo Sapiens
FEVLVEKY

SEQ ID NO: 84009 - protein, 8 aa, Homo Sapiens
GEFIFTEM

SEQ ID NO: 84010 - protein, 8 aa, Homo Sapiens
GEFYVIEY

SEQ ID NO: 84011 - protein, 8 aa, Homo Sapiens
GEIRATAF

SEQ ID NO: 84012 - protein, 8 aa, Homo Sapiens
GETFSHVF

SEQ ID NO: 84013 - protein, 8 aa, Homo Sapiens
HEAAKEVF

SEQ ID NO: 84014 - protein, 8 aa, Homo Sapiens
HEAPIPTF

SEQ ID NO: 84015 - protein, 8 aa, Homo Sapiens
HEAQIQEM

SEQ ID NO: 84016 - protein, 8 aa, Homo Sapiens
HEATLRCW

SEQ ID NO: 84017 - protein, 8 aa, Homo Sapiens
HEAVLVQY

SEQ ID NO: 84018 - protein, 8 aa, Homo Sapiens
HEAYVTVL

SEQ ID NO: 84019 - protein, 8 aa, Homo Sapiens
HECMVNKF

SEQ ID NO: 84020 - protein, 8 aa, Homo Sapiens
HEDTRHLL

SEQ ID NO: 84021 - protein, 8 aa, Homo Sapiens
HEEKVAAY

SEQ ID NO: 84022 - protein, 8 aa, Homo Sapiens
HEFGAITF

SEQ ID NO: 84023 - protein, 8 aa, Homo Sapiens
HEFIATFF

SEQ ID NO: 84024 - protein, 8 aa, Homo Sapiens
HEFLEFEF

SEQ ID NO: 84025 - protein, 8 aa, Homo Sapiens
HEFLIAAL

SEQ ID NO: 84026 - protein, 8 aa, Homo Sapiens
HEFLTSAY

SEQ ID NO: 84027 - protein, 8 aa, Homo Sapiens
HEFLTWVL

SEQ ID NO: 84028 - protein, 8 aa, Homo Sapiens
HEFLVNTL

SEQ ID NO: 84029 - protein, 8 aa, Homo Sapiens
HEFQSEVF

SEQ ID NO: 84030 - protein, 8 aa, Homo Sapiens
HEFTVYRM

SEQ ID NO: 84031 - protein, 8 aa, Homo Sapiens
HEFVMAQY

SEQ ID NO: 84032 - protein, 8 aa, Homo Sapiens
HEFVVKAV

SEQ ID NO: 84033 - protein, 8 aa, Homo Sapiens
HEGPALYY

SEQ ID NO: 84034 - protein, 8 aa, Homo Sapiens
HEHQANLL

SEQ ID NO: 84035 - protein, 8 aa, Homo Sapiens
HEHQVMLM

SEQ ID NO: 84036 - protein, 8 aa, Homo Sapiens
HEIARPQI

SEQ ID NO: 84037 - protein, 8 aa, Homo Sapiens
HEIEGTVF

SEQ ID NO: 84038 - protein, 8 aa, Homo Sapiens
HEIEVETI

SEQ ID NO: 84039 - protein, 8 aa, Homo Sapiens
HEIILAAF

SEQ ID NO: 84040 - protein, 8 aa, Homo Sapiens
HEILREAY

SEQ ID NO: 84041 - protein, 8 aa, Homo Sapiens
HEILTKSY

SEQ ID NO: 84042 - protein, 8 aa, Homo Sapiens
HEILVSDF

SEQ ID NO: 84043 - protein, 8 aa, Homo Sapiens
HEIPYYEF

SEQ ID NO: 84044 - protein, 8 aa, Homo Sapiens
HEKKAYSF

SEQ ID NO: 84045 - protein, 8 aa, Homo Sapiens
HEKLVQLY

SEQ ID NO: 84046 - protein, 8 aa, Homo Sapiens
HELFLQAF

SEQ ID NO: 84047 - protein, 8 aa, Homo Sapiens
HELIFSSF

SEQ ID NO: 84048 - protein, 8 aa, Homo Sapiens
HELIIPQW

SEQ ID NO: 84049 - protein, 8 aa, Homo Sapiens
HELKIEEY

SEQ ID NO: 84050 - protein, 8 aa, Homo Sapiens
HELLISTL

SEQ ID NO: 84051 - protein, 8 aa, Homo Sapiens
HELLLTEL

SEQ ID NO: 84052 - protein, 8 aa, Homo Sapiens
HELMQTVY

SEQ ID NO: 84053 - protein, 8 aa, Homo Sapiens
HELQANCY

SEQ ID NO: 84054 - protein, 8 aa, Homo Sapiens
HELTFQAM

SEQ ID NO: 84055 - protein, 8 aa, Homo Sapiens
HEMIILKL

SEQ ID NO: 84056 - protein, 8 aa, Homo Sapiens
HEMVIYEA

SEQ ID NO: 84057 - protein, 8 aa, Homo Sapiens
HEMVVYEA

SEQ ID NO: 84058 - protein, 8 aa, Homo Sapiens
HENIAELY

SEQ ID NO: 84059 - protein, 8 aa, Homo Sapiens
HENVVEMY

SEQ ID NO: 84060 - protein, 8 aa, Homo Sapiens
HENVVEVL

SEQ ID NO: 84061 - protein, 8 aa, Homo Sapiens
HEPIVNKF

SEQ ID NO: 84062 - protein, 8 aa, Homo Sapiens
HERPAYLY

SEQ ID NO: 84063 - protein, 8 aa, Homo Sapiens
HESLSHEL

SEQ ID NO: 84064 - protein, 8 aa, Homo Sapiens
HESVIKEY

SEQ ID NO: 84065 - protein, 8 aa, Homo Sapiens
HETIRVAV

SEQ ID NO: 84066 - protein, 8 aa, Homo Sapiens
HETVAYEF

SEQ ID NO: 84067 - protein, 8 aa, Homo Sapiens
HEVEVQYY

SEQ ID NO: 84068 - protein, 8 aa, Homo Sapiens
HEVGVVAF

SEQ ID NO: 84069 - protein, 8 aa, Homo Sapiens
HEVIRTTA

SEQ ID NO: 84070 - protein, 8 aa, Homo Sapiens
HEVIVSAA

SEQ ID NO: 84071 - protein, 8 aa, Homo Sapiens
HEVKKVTL

SEQ ID NO: 84072 - protein, 8 aa, Homo Sapiens
HEVLLPQY

SEQ ID NO: 84073 - protein, 8 aa, Homo Sapiens
HEVTICNY

SEQ ID NO: 84074 - protein, 8 aa, Homo Sapiens
HEWTIPSH

SEQ ID NO: 84075 - protein, 8 aa, Homo Sapiens
HEYIFEGF

SEQ ID NO: 84076 - protein, 8 aa, Homo Sapiens
HEYLVACI

SEQ ID NO: 84077 - protein, 8 aa, Homo Sapiens
IEAAKAVY

SEQ ID NO: 84078 - protein, 8 aa, Homo Sapiens
IEAAVATF

SEQ ID NO: 84079 - protein, 8 aa, Homo Sapiens
IEAEKAEL

SEQ ID NO: 84080 - protein, 8 aa, Homo Sapiens
IEAEVPAV

SEQ ID NO: 84081 - protein, 8 aa, Homo Sapiens
IEAFSQRY

SEQ ID NO: 84082 - protein, 8 aa, Homo Sapiens
IEAIRVEL

SEQ ID NO: 84083 - protein, 8 aa, Homo Sapiens
IEARVQEY

SEQ ID NO: 84084 - protein, 8 aa, Homo Sapiens
IEDKSTVF

SEQ ID NO: 84085 - protein, 8 aa, Homo Sapiens
IEDVAHRM

SEQ ID NO: 84086 - protein, 8 aa, Homo Sapiens
IEDYTHRF

SEQ ID NO: 84087 - protein, 8 aa, Homo Sapiens
IEERVNIL

SEQ ID NO: 84088 - protein, 8 aa, Homo Sapiens
IEFIRSEY

SEQ ID NO: 84089 - protein, 8 aa, Homo Sapiens
IEFQREAL

SEQ ID NO: 84090 - protein, 8 aa, Homo Sapiens
IEGLAPKL

SEQ ID NO: 84091 - protein, 8 aa, Homo Sapiens
IEGLTAEF

SEQ ID NO: 84092 - protein, 8 aa, Homo Sapiens
IEHAFILY

SEQ ID NO: 84093 - protein, 8 aa, Homo Sapiens
IEHLLPLF

SEQ ID NO: 84094 - protein, 8 aa, Homo Sapiens
IEIERSLY

SEQ ID NO: 84095 - protein, 8 aa, Homo Sapiens
IEIQVAVH

SEQ ID NO: 84096 - protein, 8 aa, Homo Sapiens
IEIVIREY

SEQ ID NO: 84097 - protein, 8 aa, Homo Sapiens
IEKEAEIL

SEQ ID NO: 84098 - protein, 8 aa, Homo Sapiens
IEKERPQL

SEQ ID NO: 84099 - protein, 8 aa, Homo Sapiens
IEKETEEY

SEQ ID NO: 84100 - protein, 8 aa, Homo Sapiens
IEKETKEY

SEQ ID NO: 84101 - protein, 8 aa, Homo Sapiens
IEKEVEEY

SEQ ID NO: 84102 - protein, 8 aa, Homo Sapiens
IELLLPKL

SEQ ID NO: 84103 - protein, 8 aa, Homo Sapiens
IEMELSKY

SEQ ID NO: 84104 - protein, 8 aa, Homo Sapiens
IENEIAVL

SEQ ID NO: 84105 - protein, 8 aa, Homo Sapiens
IENIVAVT

SEQ ID NO: 84106 - protein, 8 aa, Homo Sapiens
IENKTTVY

SEQ ID NO: 84107 - protein, 8 aa, Homo Sapiens
IENRVLEL

SEQ ID NO: 84108 - protein, 8 aa, Homo Sapiens
IENVKAKI

SEQ ID NO: 84109 - protein, 8 aa, Homo Sapiens
IEQIIRNY

SEQ ID NO: 84110 - protein, 8 aa, Homo Sapiens
IEQISKVY

SEQ ID NO: 84111 - protein, 8 aa, Homo Sapiens
IEQIVYVI

SEQ ID NO: 84112 - protein, 8 aa, Homo Sapiens
IEQKIKEY

SEQ ID NO: 84113 - protein, 8 aa, Homo Sapiens
IEQQIQTY

SEQ ID NO: 84114 - protein, 8 aa, Homo Sapiens
IERAVQEL

SEQ ID NO: 84115 - protein, 8 aa, Homo Sapiens
IEREVNIL

SEQ ID NO: 84116 - protein, 8 aa, Homo Sapiens
IERMVQEA

SEQ ID NO: 84117 - protein, 8 aa, Homo Sapiens
IERPFETY

SEQ ID NO: 84118 - protein, 8 aa, Homo Sapiens
IESIVHAF

SEQ ID NO: 84119 - protein, 8 aa, Homo Sapiens
IESKFYKM

SEQ ID NO: 84120 - protein, 8 aa, Homo Sapiens
IESLAHAL

SEQ ID NO: 84121 - protein, 8 aa, Homo Sapiens
IESTFHMY

SEQ ID NO: 84122 - protein, 8 aa, Homo Sapiens
IETDIAAY

SEQ ID NO: 84123 - protein, 8 aa, Homo Sapiens
IETIANEF

SEQ ID NO: 84124 - protein, 8 aa, Homo Sapiens
IETIANEY

SEQ ID NO: 84125 - protein, 8 aa, Homo Sapiens
IETIVAAM

SEQ ID NO: 84126 - protein, 8 aa, Homo Sapiens
IETLIVHY

SEQ ID NO: 84127 - protein, 8 aa, Homo Sapiens
IEVEVRKF

SEQ ID NO: 84128 - protein, 8 aa, Homo Sapiens
IEVKTDEF

SEQ ID NO: 84129 - protein, 8 aa, Homo Sapiens
IEVLIREY

SEQ ID NO: 84130 - protein, 8 aa, Homo Sapiens
IEVSVPRF

SEQ ID NO: 84131 - protein, 8 aa, Homo Sapiens
IEYTVKSH

SEQ ID NO: 84132 - protein, 8 aa, Homo Sapiens
IFESENFF

SEQ ID NO: 84133 - protein, 8 aa, Homo Sapiens
KEFKVEVY

SEQ ID NO: 84134 - protein, 8 aa, Homo Sapiens
KEILIPVF

SEQ ID NO: 84135 - protein, 8 aa, Homo Sapiens
KELEVPHF

SEQ ID NO: 84136 - protein, 8 aa, Homo Sapiens
KEVEAVVY

SEQ ID NO: 84137 - protein, 8 aa, Homo Sapiens
KTVEAIEI

SEQ ID NO: 84138 - protein, 8 aa, Homo Sapiens
LAEDLAAL

SEQ ID NO: 84139 - protein, 8 aa, Homo Sapiens
LDIERPTY

SEQ ID NO: 84140 - protein, 8 aa, Homo Sapiens
LDMEIHAY

SEQ ID NO: 84141 - protein, 8 aa, Homo Sapiens
LEAERAQL

SEQ ID NO: 84142 - protein, 8 aa, Homo Sapiens
LEAFVAKF

SEQ ID NO: 84143 - protein, 8 aa, Homo Sapiens
LEALIAHF

SEQ ID NO: 84144 - protein, 8 aa, Homo Sapiens
LEALRDIL

SEQ ID NO: 84145 - protein, 8 aa, Homo Sapiens
LEAMFTAM

SEQ ID NO: 84146 - protein, 8 aa, Homo Sapiens
LEAPARAF

SEQ ID NO: 84147 - protein, 8 aa, Homo Sapiens
LEAQIYEY

SEQ ID NO: 84148 - protein, 8 aa, Homo Sapiens
LEAQTSRY

SEQ ID NO: 84149 - protein, 8 aa, Homo Sapiens
LECIARSF

SEQ ID NO: 84150 - protein, 8 aa, Homo Sapiens
LEDLVTEY

SEQ ID NO: 84151 - protein, 8 aa, Homo Sapiens
LEFKAKAF

SEQ ID NO: 84152 - protein, 8 aa, Homo Sapiens
LEFPAQEL

SEQ ID NO: 84153 - protein, 8 aa, Homo Sapiens
LEFRALLF

SEQ ID NO: 84154 - protein, 8 aa, Homo Sapiens
LEGLTVVY

SEQ ID NO: 84155 - protein, 8 aa, Homo Sapiens
LEGLVVQY

SEQ ID NO: 84156 - protein, 8 aa, Homo Sapiens
LEHEGYKY

SEQ ID NO: 84157 - protein, 8 aa, Homo Sapiens
LEHITSEY

SEQ ID NO: 84158 - protein, 8 aa, Homo Sapiens
LEHLITEL

SEQ ID NO: 84159 - protein, 8 aa, Homo Sapiens
LEHLQSKY

SEQ ID NO: 84160 - protein, 8 aa, Homo Sapiens
LEHLVTEL

SEQ ID NO: 84161 - protein, 8 aa, Homo Sapiens
LEHRIATM

SEQ ID NO: 84162 - protein, 8 aa, Homo Sapiens
LEHTAQTY

SEQ ID NO: 84163 - protein, 8 aa, Homo Sapiens
LEHVAPQL

SEQ ID NO: 84164 - protein, 8 aa, Homo Sapiens
LEHVFWVV

SEQ ID NO: 84165 - protein, 8 aa, Homo Sapiens
LEHVVPEL

SEQ ID NO: 84166 - protein, 8 aa, Homo Sapiens
LEHYFHAV

SEQ ID NO: 84167 - protein, 8 aa, Homo Sapiens
LEIERPIL

SEQ ID NO: 84168 - protein, 8 aa, Homo Sapiens
LEIVQAIY

SEQ ID NO: 84169 - protein, 8 aa, Homo Sapiens
LEKDFSSM

SEQ ID NO: 84170 - protein, 8 aa, Homo Sapiens
LEKEGIVF

SEQ ID NO: 84171 - protein, 8 aa, Homo Sapiens
LEKESALF

SEQ ID NO: 84172 - protein, 8 aa, Homo Sapiens
LEKETTMY

SEQ ID NO: 84173 - protein, 8 aa, Homo Sapiens
LEKKVETF

SEQ ID NO: 84174 - protein, 8 aa, Homo Sapiens
LEKLQPAY

SEQ ID NO: 84175 - protein, 8 aa, Homo Sapiens
LEKQVVTF

SEQ ID NO: 84176 - protein, 8 aa, Homo Sapiens
LEKSFYQF

SEQ ID NO: 84177 - protein, 8 aa, Homo Sapiens
LELAKETF

SEQ ID NO: 84178 - protein, 8 aa, Homo Sapiens
LELEVARL

SEQ ID NO: 84179 - protein, 8 aa, Homo Sapiens
LELIMSKY

SEQ ID NO: 84180 - protein, 8 aa, Homo Sapiens
LELRAAVM

SEQ ID NO: 84181 - protein, 8 aa, Homo Sapiens
LEMIKTEF

SEQ ID NO: 84182 - protein, 8 aa, Homo Sapiens
LEMLVERL

SEQ ID NO: 84183 - protein, 8 aa, Homo Sapiens
LENGAHAY

SEQ ID NO: 84184 - protein, 8 aa, Homo Sapiens
LENIRPVL

SEQ ID NO: 84185 - protein, 8 aa, Homo Sapiens
LENLVQEY

SEQ ID NO: 84186 - protein, 8 aa, Homo Sapiens
LENRVAVL

SEQ ID NO: 84187 - protein, 8 aa, Homo Sapiens
LENRVCEY

SEQ ID NO: 84188 - protein, 8 aa, Homo Sapiens
LENVVHHF

SEQ ID NO: 84189 - protein, 8 aa, Homo Sapiens
LENVVRKY

SEQ ID NO: 84190 - protein, 8 aa, Homo Sapiens
LEQETHLF

SEQ ID NO: 84191 - protein, 8 aa, Homo Sapiens
LEQLFQEH

SEQ ID NO: 84192 - protein, 8 aa, Homo Sapiens
LEQLILKY

SEQ ID NO: 84193 - protein, 8 aa, Homo Sapiens
LEQRFESY

SEQ ID NO: 84194 - protein, 8 aa, Homo Sapiens
LEQVFSKY

SEQ ID NO: 84195 - protein, 8 aa, Homo Sapiens
LERAIESL

SEQ ID NO: 84196 - protein, 8 aa, Homo Sapiens
LERAVEAL

SEQ ID NO: 84197 - protein, 8 aa, Homo Sapiens
LEREVAQM

SEQ ID NO: 84198 - protein, 8 aa, Homo Sapiens
LERKVESL

SEQ ID NO: 84199 - protein, 8 aa, Homo Sapiens
LERLTRLF

SEQ ID NO: 84200 - protein, 8 aa, Homo Sapiens
LERQIEKL

SEQ ID NO: 84201 - protein, 8 aa, Homo Sapiens
LERQVEEL

SEQ ID NO: 84202 - protein, 8 aa, Homo Sapiens
LERQVETI

SEQ ID NO: 84203 - protein, 8 aa, Homo Sapiens
LERVIDLL

SEQ ID NO: 84204 - protein, 8 aa, Homo Sapiens
LESFVSTF

SEQ ID NO: 84205 - protein, 8 aa, Homo Sapiens
LESLGYVL

SEQ ID NO: 84206 - protein, 8 aa, Homo Sapiens
LESVFSRF

SEQ ID NO: 84207 - protein, 8 aa, Homo Sapiens
LESYAFNM

SEQ ID NO: 84208 - protein, 8 aa, Homo Sapiens
LETLITKF

SEQ ID NO: 84209 - protein, 8 aa, Homo Sapiens
LETRHLSY

SEQ ID NO: 84210 - protein, 8 aa, Homo Sapiens
LETVAAYY

SEQ ID NO: 84211 - protein, 8 aa, Homo Sapiens
LETVVRVY

SEQ ID NO: 84212 - protein, 8 aa, Homo Sapiens
LEVERQTI

SEQ ID NO: 84213 - protein, 8 aa, Homo Sapiens
LEVEVHQL

SEQ ID NO: 84214 - protein, 8 aa, Homo Sapiens
LEVTKEAF

SEQ ID NO: 84215 - protein, 8 aa, Homo Sapiens
LEWAIKEY

SEQ ID NO: 84216 - protein, 8 aa, Homo Sapiens
LEWEATEL

SEQ ID NO: 84217 - protein, 8 aa, Homo Sapiens
LEYEKTEV

SEQ ID NO: 84218 - protein, 8 aa, Homo Sapiens
LEYEKTRY

SEQ ID NO: 84219 - protein, 8 aa, Homo Sapiens
LEYFVEEY

SEQ ID NO: 84220 - protein, 8 aa, Homo Sapiens
LEYLKPQY

SEQ ID NO: 84221 - protein, 8 aa, Homo Sapiens
LNVGDVVM

SEQ ID NO: 84222 - protein, 8 aa, Homo Sapiens
MDKLVVEY

SEQ ID NO: 84223 - protein, 8 aa, Homo Sapiens
MEAFAQRY

SEQ ID NO: 84224 - protein, 8 aa, Homo Sapiens
MEAFASRY

SEQ ID NO: 84225 - protein, 8 aa, Homo Sapiens
MEAFATRY

SEQ ID NO: 84226 - protein, 8 aa, Homo Sapiens
MEAPTTAY

SEQ ID NO: 84227 - protein, 8 aa, Homo Sapiens
MEAVAVAA

SEQ ID NO: 84228 - protein, 8 aa, Homo Sapiens
MEAYVPGF

SEQ ID NO: 84229 - protein, 8 aa, Homo Sapiens
MEEFVKQY

SEQ ID NO: 84230 - protein, 8 aa, Homo Sapiens
MEFAKNMY

SEQ ID NO: 84231 - protein, 8 aa, Homo Sapiens
MEGAVQAY

SEQ ID NO: 84232 - protein, 8 aa, Homo Sapiens
MEHEVACL

SEQ ID NO: 84233 - protein, 8 aa, Homo Sapiens
MEHGVPVY

SEQ ID NO: 84234 - protein, 8 aa, Homo Sapiens
MEHLIHVL

SEQ ID NO: 84235 - protein, 8 aa, Homo Sapiens
MEHPFFTL

SEQ ID NO: 84236 - protein, 8 aa, Homo Sapiens
MEIKVKDY

SEQ ID NO: 84237 - protein, 8 aa, Homo Sapiens
MEKAAEVY

SEQ ID NO: 84238 - protein, 8 aa, Homo Sapiens
MEKFLVEY

SEQ ID NO: 84239 - protein, 8 aa, Homo Sapiens
MEKIQPAL

SEQ ID NO: 84240 - protein, 8 aa, Homo Sapiens
MELYTHVY

SEQ ID NO: 84241 - protein, 8 aa, Homo Sapiens
MENRVQSF

SEQ ID NO: 84242 - protein, 8 aa, Homo Sapiens
MENSRQVL

SEQ ID NO: 84243 - protein, 8 aa, Homo Sapiens
MEQVIFKY

SEQ ID NO: 84244 - protein, 8 aa, Homo Sapiens
MEQVVFKY

SEQ ID NO: 84245 - protein, 8 aa, Homo Sapiens
MERAAESY

SEQ ID NO: 84246 - protein, 8 aa, Homo Sapiens
MERQGDVY

SEQ ID NO: 84247 - protein, 8 aa, Homo Sapiens
MERTVQSF

SEQ ID NO: 84248 - protein, 8 aa, Homo Sapiens
MESLGYVL

SEQ ID NO: 84249 - protein, 8 aa, Homo Sapiens
MESRVKTF

SEQ ID NO: 84250 - protein, 8 aa, Homo Sapiens
MESVMVKY

SEQ ID NO: 84251 - protein, 8 aa, Homo Sapiens
METKIKNY

SEQ ID NO: 84252 - protein, 8 aa, Homo Sapiens
MEVELPAA

SEQ ID NO: 84253 - protein, 8 aa, Homo Sapiens
MEVHATVY

SEQ ID NO: 84254 - protein, 8 aa, Homo Sapiens
MEVKRESY

SEQ ID NO: 84255 - protein, 8 aa, Homo Sapiens
MEVVVITH

SEQ ID NO: 84256 - protein, 8 aa, Homo Sapiens
MEWLVETL

SEQ ID NO: 84257 - protein, 8 aa, Homo Sapiens
MPEQLFKY

SEQ ID NO: 84258 - protein, 8 aa, Homo Sapiens
MQRLIEKY

SEQ ID NO: 84259 - protein, 8 aa, Homo Sapiens
NDVTAIIF

SEQ ID NO: 84260 - protein, 8 aa, Homo Sapiens
NEAIMHQY

SEQ ID NO: 84261 - protein, 8 aa, Homo Sapiens
NEALAALL

SEQ ID NO: 84262 - protein, 8 aa, Homo Sapiens
NEALIALL

SEQ ID NO: 84263 - protein, 8 aa, Homo Sapiens
NEALIEKL

SEQ ID NO: 84264 - protein, 8 aa, Homo Sapiens
NEALKYHF

SEQ ID NO: 84265 - protein, 8 aa, Homo Sapiens
NEAQRVKL

SEQ ID NO: 84266 - protein, 8 aa, Homo Sapiens
NEAVAPEF

SEQ ID NO: 84267 - protein, 8 aa, Homo Sapiens
NEAVFIAH

SEQ ID NO: 84268 - protein, 8 aa, Homo Sapiens
NEDFSFHY

SEQ ID NO: 84269 - protein, 8 aa, Homo Sapiens
NEDLAKKY

SEQ ID NO: 84270 - protein, 8 aa, Homo Sapiens
NEFAQPAF

SEQ ID NO: 84271 - protein, 8 aa, Homo Sapiens
NEFFFSHF

SEQ ID NO: 84272 - protein, 8 aa, Homo Sapiens
NEFILYAV

SEQ ID NO: 84273 - protein, 8 aa, Homo Sapiens
NEFLAQTL

SEQ ID NO: 84274 - protein, 8 aa, Homo Sapiens
NEFLRNVF

SEQ ID NO: 84275 - protein, 8 aa, Homo Sapiens
NEFLTREL

SEQ ID NO: 84276 - protein, 8 aa, Homo Sapiens
NEFTTHIL

SEQ ID NO: 84277 - protein, 8 aa, Homo Sapiens
NEFTTHVM

SEQ ID NO: 84278 - protein, 8 aa, Homo Sapiens
NEFTVLEL

SEQ ID NO: 84279 - protein, 8 aa, Homo Sapiens
NEFVVKFY

SEQ ID NO: 84280 - protein, 8 aa, Homo Sapiens
NEGLVKEY

SEQ ID NO: 84281 - protein, 8 aa, Homo Sapiens
NEGTVFTF

SEQ ID NO: 84282 - protein, 8 aa, Homo Sapiens
NEGVSYEF

SEQ ID NO: 84283 - protein, 8 aa, Homo Sapiens
NEHFSNVF

SEQ ID NO: 84284 - protein, 8 aa, Homo Sapiens
NEHNVALF

SEQ ID NO: 84285 - protein, 8 aa, Homo Sapiens
NEHWMPVY

SEQ ID NO: 84286 - protein, 8 aa, Homo Sapiens
NEIASVAY

SEQ ID NO: 84287 - protein, 8 aa, Homo Sapiens
NEIIHARF

SEQ ID NO: 84288 - protein, 8 aa, Homo Sapiens
NEIKKWQL

SEQ ID NO: 84289 - protein, 8 aa, Homo Sapiens
NEIKSYCY

SEQ ID NO: 84290 - protein, 8 aa, Homo Sapiens
NEIKVAKA

SEQ ID NO: 84291 - protein, 8 aa, Homo Sapiens
NEILFEEY

SEQ ID NO: 84292 - protein, 8 aa, Homo Sapiens
NEILFSEF

SEQ ID NO: 84293 - protein, 8 aa, Homo Sapiens
NEILQAAY

SEQ ID NO: 84294 - protein, 8 aa, Homo Sapiens
NEILTVHY

SEQ ID NO: 84295 - protein, 8 aa, Homo Sapiens
NEISRTEY

SEQ ID NO: 84296 - protein, 8 aa, Homo Sapiens
NEITGHTY

SEQ ID NO: 84297 - protein, 8 aa, Homo Sapiens
NEIVVTDF

SEQ ID NO: 84298 - protein, 8 aa, Homo Sapiens
NEIYTVKF

SEQ ID NO: 84299 - protein, 8 aa, Homo Sapiens
NEKEIALM

SEQ ID NO: 84300 - protein, 8 aa, Homo Sapiens
NEKIVETY

SEQ ID NO: 84301 - protein, 8 aa, Homo Sapiens
NEKIVVLL

SEQ ID NO: 84302 - protein, 8 aa, Homo Sapiens
NEKLLTVF

SEQ ID NO: 84303 - protein, 8 aa, Homo Sapiens
NEKLQQIF

SEQ ID NO: 84304 - protein, 8 aa, Homo Sapiens
NEKVAQLY

SEQ ID NO: 84305 - protein, 8 aa, Homo Sapiens
NELELTKM

SEQ ID NO: 84306 - protein, 8 aa, Homo Sapiens
NELESYAY

SEQ ID NO: 84307 - protein, 8 aa, Homo Sapiens
NELILKTL

SEQ ID NO: 84308 - protein, 8 aa, Homo Sapiens
NELITNAL

SEQ ID NO: 84309 - protein, 8 aa, Homo Sapiens
NELKFHYM

SEQ ID NO: 84310 - protein, 8 aa, Homo Sapiens
NELKRSFF

SEQ ID NO: 84311 - protein, 8 aa, Homo Sapiens
NELLIASF

SEQ ID NO: 84312 - protein, 8 aa, Homo Sapiens
NELLKKTL

SEQ ID NO: 84313 - protein, 8 aa, Homo Sapiens
NELLKSKF

SEQ ID NO: 84314 - protein, 8 aa, Homo Sapiens
NELLRQQI

SEQ ID NO: 84315 - protein, 8 aa, Homo Sapiens
NELLVKAL

SEQ ID NO: 84316 - protein, 8 aa, Homo Sapiens
NELPTVAF

SEQ ID NO: 84317 - protein, 8 aa, Homo Sapiens
NELPVSKY

SEQ ID NO: 84318 - protein, 8 aa, Homo Sapiens
NELSAWKF

SEQ ID NO: 84319 - protein, 8 aa, Homo Sapiens
NELVVRAY

SEQ ID NO: 84320 - protein, 8 aa, Homo Sapiens
NEMKLNVH

SEQ ID NO: 84321 - protein, 8 aa, Homo Sapiens
NEMPKAEY

SEQ ID NO: 84322 - protein, 8 aa, Homo Sapiens
NEMTTIHY

SEQ ID NO: 84323 - protein, 8 aa, Homo Sapiens
NENARQQL

SEQ ID NO: 84324 - protein, 8 aa, Homo Sapiens
NENLAANF

SEQ ID NO: 84325 - protein, 8 aa, Homo Sapiens
NENLSAKF

SEQ ID NO: 84326 - protein, 8 aa, Homo Sapiens
NENLVERF

SEQ ID NO: 84327 - protein, 8 aa, Homo Sapiens
NENMVAKV

SEQ ID NO: 84328 - protein, 8 aa, Homo Sapiens
NENYQPKY

SEQ ID NO: 84329 - protein, 8 aa, Homo Sapiens
NEPEVVSV

SEQ ID NO: 84330 - protein, 8 aa, Homo Sapiens
NEQLKTSF

SEQ ID NO: 84331 - protein, 8 aa, Homo Sapiens
NEQVMYRF

SEQ ID NO: 84332 - protein, 8 aa, Homo Sapiens
NEQVVFSH

SEQ ID NO: 84333 - protein, 8 aa, Homo Sapiens
NERFVNLM

SEQ ID NO: 84334 - protein, 8 aa, Homo Sapiens
NERLQEEL

SEQ ID NO: 84335 - protein, 8 aa, Homo Sapiens
NERLTESL

SEQ ID NO: 84336 - protein, 8 aa, Homo Sapiens
NERMLESY

SEQ ID NO: 84337 - protein, 8 aa, Homo Sapiens
NERPVTLY

SEQ ID NO: 84338 - protein, 8 aa, Homo Sapiens
NERSIPSM

SEQ ID NO: 84339 - protein, 8 aa, Homo Sapiens
NERVQQAV

SEQ ID NO: 84340 - protein, 8 aa, Homo Sapiens
NERVVQHF

SEQ ID NO: 84341 - protein, 8 aa, Homo Sapiens
NESFGFTA

SEQ ID NO: 84342 - protein, 8 aa, Homo Sapiens
NESPAVVL

SEQ ID NO: 84343 - protein, 8 aa, Homo Sapiens
NESTRSVL

SEQ ID NO: 84344 - protein, 8 aa, Homo Sapiens
NESTSYKF

SEQ ID NO: 84345 - protein, 8 aa, Homo Sapiens
NETGAFFF

SEQ ID NO: 84346 - protein, 8 aa, Homo Sapiens
NETRAQLL

SEQ ID NO: 84347 - protein, 8 aa, Homo Sapiens
NETTAVAL

SEQ ID NO: 84348 - protein, 8 aa, Homo Sapiens
NETVFTVH

SEQ ID NO: 84349 - protein, 8 aa, Homo Sapiens
NETVLTVW

SEQ ID NO: 84350 - protein, 8 aa, Homo Sapiens
NEVDFQEY

SEQ ID NO: 84351 - protein, 8 aa, Homo Sapiens
NEVDRMVL

SEQ ID NO: 84352 - protein, 8 aa, Homo Sapiens
NEVEIEKL

SEQ ID NO: 84353 - protein, 8 aa, Homo Sapiens
NEVELLVM

SEQ ID NO: 84354 - protein, 8 aa, Homo Sapiens
NEVGANAV

SEQ ID NO: 84355 - protein, 8 aa, Homo Sapiens
NEVHLVVM

SEQ ID NO: 84356 - protein, 8 aa, Homo Sapiens
NEVIATVL

SEQ ID NO: 84357 - protein, 8 aa, Homo Sapiens
NEVISKLY

SEQ ID NO: 84358 - protein, 8 aa, Homo Sapiens
NEVKIYSL

SEQ ID NO: 84359 - protein, 8 aa, Homo Sapiens
NEVKLWTF

SEQ ID NO: 84360 - protein, 8 aa, Homo Sapiens
NEVLASKY

SEQ ID NO: 84361 - protein, 8 aa, Homo Sapiens
NEVLTKTY

SEQ ID NO: 84362 - protein, 8 aa, Homo Sapiens
NEVMVEHF

SEQ ID NO: 84363 - protein, 8 aa, Homo Sapiens
NEVQGFLF

SEQ ID NO: 84364 - protein, 8 aa, Homo Sapiens
NEVQRTML

SEQ ID NO: 84365 - protein, 8 aa, Homo Sapiens
NEVQVADF

SEQ ID NO: 84366 - protein, 8 aa, Homo Sapiens
NEVRNAVF

SEQ ID NO: 84367 - protein, 8 aa, Homo Sapiens
NEVSSATF

SEQ ID NO: 84368 - protein, 8 aa, Homo Sapiens
NEVVGLIF

SEQ ID NO: 84369 - protein, 8 aa, Homo Sapiens
NEVVRSDL

SEQ ID NO: 84370 - protein, 8 aa, Homo Sapiens
NEVVTQQY

SEQ ID NO: 84371 - protein, 8 aa, Homo Sapiens
NEVVTREY

SEQ ID NO: 84372 - protein, 8 aa, Homo Sapiens
NEWFVSAF

SEQ ID NO: 84373 - protein, 8 aa, Homo Sapiens
NEYKGWVL

SEQ ID NO: 84374 - protein, 8 aa, Homo Sapiens
NEYLNPEL

SEQ ID NO: 84375 - protein, 8 aa, Homo Sapiens
NEYRSVVY

SEQ ID NO: 84376 - protein, 8 aa, Homo Sapiens
NEYRVPEL

SEQ ID NO: 84377 - protein, 8 aa, Homo Sapiens
QDVATVLL

SEQ ID NO: 84378 - protein, 8 aa, Homo Sapiens
QEALAHAL

SEQ ID NO: 84379 - protein, 8 aa, Homo Sapiens
QEAPSNVY

SEQ ID NO: 84380 - protein, 8 aa, Homo Sapiens
QEFIRVGY

SEQ ID NO: 84381 - protein, 8 aa, Homo Sapiens
QEFPAHSL

SEQ ID NO: 84382 - protein, 8 aa, Homo Sapiens
QEGLASKF

SEQ ID NO: 84383 - protein, 8 aa, Homo Sapiens
QEHLIEKY

SEQ ID NO: 84384 - protein, 8 aa, Homo Sapiens
QEHQFEAL

SEQ ID NO: 84385 - protein, 8 aa, Homo Sapiens
QEIHRHAL

SEQ ID NO: 84386 - protein, 8 aa, Homo Sapiens
QELIIPCL

SEQ ID NO: 84387 - protein, 8 aa, Homo Sapiens
QELLAEHY

SEQ ID NO: 84388 - protein, 8 aa, Homo Sapiens
QELQVETY

SEQ ID NO: 84389 - protein, 8 aa, Homo Sapiens
QELRVNCY

SEQ ID NO: 84390 - protein, 8 aa, Homo Sapiens
QEMEFLQF

SEQ ID NO: 84391 - protein, 8 aa, Homo Sapiens
QEPVAHTV

SEQ ID NO: 84392 - protein, 8 aa, Homo Sapiens
QETEVELY

SEQ ID NO: 84393 - protein, 8 aa, Homo Sapiens
QEVDRAVF

SEQ ID NO: 84394 - protein, 8 aa, Homo Sapiens
QEVIITKF

SEQ ID NO: 84395 - protein, 8 aa, Homo Sapiens
QEVNFQEY

SEQ ID NO: 84396 - protein, 8 aa, Homo Sapiens
QEWEVKAL

SEQ ID NO: 84397 - protein, 8 aa, Homo Sapiens
QEYPAIRY

SEQ ID NO: 84398 - protein, 8 aa, Homo Sapiens
REFAFIDM

SEQ ID NO: 84399 - protein, 8 aa, Homo Sapiens
REILANVF

SEQ ID NO: 84400 - protein, 8 aa, Homo Sapiens
RELERYVL

SEQ ID NO: 84401 - protein, 8 aa, Homo Sapiens
REQIVAQY

SEQ ID NO: 84402 - protein, 8 aa, Homo Sapiens
REWEFQKY

SEQ ID NO: 84403 - protein, 8 aa, Homo Sapiens
SEAASYEF

SEQ ID NO: 84404 - protein, 8 aa, Homo Sapiens
SEAFATVV

SEQ ID NO: 84405 - protein, 8 aa, Homo Sapiens
SEALFKSF

SEQ ID NO: 84406 - protein, 8 aa, Homo Sapiens
SEAQVQKF

SEQ ID NO: 84407 - protein, 8 aa, Homo Sapiens
SEASGFCY

SEQ ID NO: 84408 - protein, 8 aa, Homo Sapiens
SEAVIAQF

SEQ ID NO: 84409 - protein, 8 aa, Homo Sapiens
SEAVLPTM

SEQ ID NO: 84410 - protein, 8 aa, Homo Sapiens
SECEFQEY

SEQ ID NO: 84411 - protein, 8 aa, Homo Sapiens
SECKVAKF

SEQ ID NO: 84412 - protein, 8 aa, Homo Sapiens
SECRLLAY

SEQ ID NO: 84413 - protein, 8 aa, Homo Sapiens
SEEFAQVY

SEQ ID NO: 84414 - protein, 8 aa, Homo Sapiens
SEELVQKY

SEQ ID NO: 84415 - protein, 8 aa, Homo Sapiens
SEERVWEY

SEQ ID NO: 84416 - protein, 8 aa, Homo Sapiens
SEFEFTDF

SEQ ID NO: 84417 - protein, 8 aa, Homo Sapiens
SEFEMKVY

SEQ ID NO: 84418 - protein, 8 aa, Homo Sapiens
SEFLINTY

SEQ ID NO: 84419 - protein, 8 aa, Homo Sapiens
SEFNRYLF

SEQ ID NO: 84420 - protein, 8 aa, Homo Sapiens
SEFVLPRF

SEQ ID NO: 84421 - protein, 8 aa, Homo Sapiens
SEGGANVF

SEQ ID NO: 84422 - protein, 8 aa, Homo Sapiens
SEHVVSEF

SEQ ID NO: 84423 - protein, 8 aa, Homo Sapiens
SEIERQHF

SEQ ID NO: 84424 - protein, 8 aa, Homo Sapiens
SEIEVAQA

SEQ ID NO: 84425 - protein, 8 aa, Homo Sapiens
SEIKHEAF

SEQ ID NO: 84426 - protein, 8 aa, Homo Sapiens
SEILLKEF

SEQ ID NO: 84427 - protein, 8 aa, Homo Sapiens
SEIQRLTY

SEQ ID NO: 84428 - protein, 8 aa, Homo Sapiens
SEIYTNTY

SEQ ID NO: 84429 - protein, 8 aa, Homo Sapiens
SEKEFKAY

SEQ ID NO: 84430 - protein, 8 aa, Homo Sapiens
SEKVSHVL

SEQ ID NO: 84431 - protein, 8 aa, Homo Sapiens
SELFMSSF

SEQ ID NO: 84432 - protein, 8 aa, Homo Sapiens
SELIVYTY

SEQ ID NO: 84433 - protein, 8 aa, Homo Sapiens
SELLIHVF

SEQ ID NO: 84434 - protein, 8 aa, Homo Sapiens
SELLKCEF

SEQ ID NO: 84435 - protein, 8 aa, Homo Sapiens
SELLVEQY

SEQ ID NO: 84436 - protein, 8 aa, Homo Sapiens
SELQAFAH

SEQ ID NO: 84437 - protein, 8 aa, Homo Sapiens
SELTRPEF

SEQ ID NO: 84438 - protein, 8 aa, Homo Sapiens
SEMASNKF

SEQ ID NO: 84439 - protein, 8 aa, Homo Sapiens
SEMELKAF

SEQ ID NO: 84440 - protein, 8 aa, Homo Sapiens
SEMLAFTL

SEQ ID NO: 84441 - protein, 8 aa, Homo Sapiens
SENLIYTY

SEQ ID NO: 84442 - protein, 8 aa, Homo Sapiens
SENPTSVF

SEQ ID NO: 84443 - protein, 8 aa, Homo Sapiens
SEPVAQVF

SEQ ID NO: 84444 - protein, 8 aa, Homo Sapiens
SERIVHDY

SEQ ID NO: 84445 - protein, 8 aa, Homo Sapiens
SERLIHTY

SEQ ID NO: 84446 - protein, 8 aa, Homo Sapiens
SERTLECY

SEQ ID NO: 84447 - protein, 8 aa, Homo Sapiens
SERVVDLL

SEQ ID NO: 84448 - protein, 8 aa, Homo Sapiens
SESIRALF

SEQ ID NO: 84449 - protein, 8 aa, Homo Sapiens
SETDFKVM

SEQ ID NO: 84450 - protein, 8 aa, Homo Sapiens
SETFLHIY

SEQ ID NO: 84451 - protein, 8 aa, Homo Sapiens
SETLLRVM

SEQ ID NO: 84452 - protein, 8 aa, Homo Sapiens
SETQFSHL

SEQ ID NO: 84453 - protein, 8 aa, Homo Sapiens
SETVQPIM

SEQ ID NO: 84454 - protein, 8 aa, Homo Sapiens
SETYKYLY

SEQ ID NO: 84455 - protein, 8 aa, Homo Sapiens
SEVAAYEF

SEQ ID NO: 84456 - protein, 8 aa, Homo Sapiens
SEVEKPLM

SEQ ID NO: 84457 - protein, 8 aa, Homo Sapiens
SEVESTEY

SEQ ID NO: 84458 - protein, 8 aa, Homo Sapiens
SEVEVFEY

SEQ ID NO: 84459 - protein, 8 aa, Homo Sapiens
SEVLAVVM

SEQ ID NO: 84460 - protein, 8 aa, Homo Sapiens
SEVLLATM

SEQ ID NO: 84461 - protein, 8 aa, Homo Sapiens
SEVLSWQF

SEQ ID NO: 84462 - protein, 8 aa, Homo Sapiens
SEVPTSVF

SEQ ID NO: 84463 - protein, 8 aa, Homo Sapiens
SEVQRTML

SEQ ID NO: 84464 - protein, 8 aa, Homo Sapiens
SEVRVYNY

SEQ ID NO: 84465 - protein, 8 aa, Homo Sapiens
SEWELPKY

SEQ ID NO: 84466 - protein, 8 aa, Homo Sapiens
SEYISNTF

SEQ ID NO: 84467 - protein, 8 aa, Homo Sapiens
TDFISHLF

SEQ ID NO: 84468 - protein, 8 aa, Homo Sapiens
TEAIKACF

SEQ ID NO: 84469 - protein, 8 aa, Homo Sapiens
TEALTQAF

SEQ ID NO: 84470 - protein, 8 aa, Homo Sapiens
TEAPPIIF

SEQ ID NO: 84471 - protein, 8 aa, Homo Sapiens
TEAVLIAH

SEQ ID NO: 84472 - protein, 8 aa, Homo Sapiens
TECMVEQY

SEQ ID NO: 84473 - protein, 8 aa, Homo Sapiens
TECSAVQF

SEQ ID NO: 84474 - protein, 8 aa, Homo Sapiens
TEELAYLK

SEQ ID NO: 84475 - protein, 8 aa, Homo Sapiens
TEELVHMF

SEQ ID NO: 84476 - protein, 8 aa, Homo Sapiens
TEEVAREY

SEQ ID NO: 84477 - protein, 8 aa, Homo Sapiens
TEFESFSF

SEQ ID NO: 84478 - protein, 8 aa, Homo Sapiens
TEFFFHAM

SEQ ID NO: 84479 - protein, 8 aa, Homo Sapiens
TEFFFHTM

SEQ ID NO: 84480 - protein, 8 aa, Homo Sapiens
TEFGGSIY

SEQ ID NO: 84481 - protein, 8 aa, Homo Sapiens
TEFGHPAA

SEQ ID NO: 84482 - protein, 8 aa, Homo Sapiens
TEFIFTTI

SEQ ID NO: 84483 - protein, 8 aa, Homo Sapiens
TEFIMNEY

SEQ ID NO: 84484 - protein, 8 aa, Homo Sapiens
TEFKATMY

SEQ ID NO: 84485 - protein, 8 aa, Homo Sapiens
TEFLFHTA

SEQ ID NO: 84486 - protein, 8 aa, Homo Sapiens
TEFLKKEF

SEQ ID NO: 84487 - protein, 8 aa, Homo Sapiens
TEFPAKAV

SEQ ID NO: 84488 - protein, 8 aa, Homo Sapiens
TEFPGVVV

SEQ ID NO: 84489 - protein, 8 aa, Homo Sapiens
TEFPNFKY

SEQ ID NO: 84490 - protein, 8 aa, Homo Sapiens
TEFQHPCF

SEQ ID NO: 84491 - protein, 8 aa, Homo Sapiens
TEFSFTDY

SEQ ID NO: 84492 - protein, 8 aa, Homo Sapiens
TEIEKLQM

SEQ ID NO: 84493 - protein, 8 aa, Homo Sapiens
TEIKGSVY

SEQ ID NO: 84494 - protein, 8 aa, Homo Sapiens
TEIKKTEV

SEQ ID NO: 84495 - protein, 8 aa, Homo Sapiens
TEILLRKL

SEQ ID NO: 84496 - protein, 8 aa, Homo Sapiens
TEILRSML

SEQ ID NO: 84497 - protein, 8 aa, Homo Sapiens
TEINKKIY

SEQ ID NO: 84498 - protein, 8 aa, Homo Sapiens
TEKMIEKY

SEQ ID NO: 84499 - protein, 8 aa, Homo Sapiens
TEKPAVCY

SEQ ID NO: 84500 - protein, 8 aa, Homo Sapiens
TELEAIMY

SEQ ID NO: 84501 - protein, 8 aa, Homo Sapiens
TELHVISY

SEQ ID NO: 84502 - protein, 8 aa, Homo Sapiens
TELLAERF

SEQ ID NO: 84503 - protein, 8 aa, Homo Sapiens
TELLAQVY

SEQ ID NO: 84504 - protein, 8 aa, Homo Sapiens
TELLRDTF

SEQ ID NO: 84505 - protein, 8 aa, Homo Sapiens
TELLRHDM

SEQ ID NO: 84506 - protein, 8 aa, Homo Sapiens
TELLVKAY

SEQ ID NO: 84507 - protein, 8 aa, Homo Sapiens
TELMFEHY

SEQ ID NO: 84508 - protein, 8 aa, Homo Sapiens
TEMEVHEL

SEQ ID NO: 84509 - protein, 8 aa, Homo Sapiens
TENIRLVF

SEQ ID NO: 84510 - protein, 8 aa, Homo Sapiens
TENIRRVF

SEQ ID NO: 84511 - protein, 8 aa, Homo Sapiens
TENKISPY

SEQ ID NO: 84512 - protein, 8 aa, Homo Sapiens
TENKRWAL

SEQ ID NO: 84513 - protein, 8 aa, Homo Sapiens
TENLVVEH

SEQ ID NO: 84514 - protein, 8 aa, Homo Sapiens
TEQFTHAF

SEQ ID NO: 84515 - protein, 8 aa, Homo Sapiens
TERIVTTY

SEQ ID NO: 84516 - protein, 8 aa, Homo Sapiens
TERLAQEL

SEQ ID NO: 84517 - protein, 8 aa, Homo Sapiens
TERLIEIA

SEQ ID NO: 84518 - protein, 8 aa, Homo Sapiens
TERLIQEL

SEQ ID NO: 84519 - protein, 8 aa, Homo Sapiens
TESEFTEF

SEQ ID NO: 84520 - protein, 8 aa, Homo Sapiens
TESEVTAF

SEQ ID NO: 84521 - protein, 8 aa, Homo Sapiens
TESKVTEF

SEQ ID NO: 84522 - protein, 8 aa, Homo Sapiens
TESSVAVY

SEQ ID NO: 84523 - protein, 8 aa, Homo Sapiens
TESVRYVY

SEQ ID NO: 84524 - protein, 8 aa, Homo Sapiens
TETKTITY

SEQ ID NO: 84525 - protein, 8 aa, Homo Sapiens
TETVFEAF

SEQ ID NO: 84526 - protein, 8 aa, Homo Sapiens
TETVLCAL

SEQ ID NO: 84527 - protein, 8 aa, Homo Sapiens
TETVRSIL

SEQ ID NO: 84528 - protein, 8 aa, Homo Sapiens
TETVVCAL

SEQ ID NO: 84529 - protein, 8 aa, Homo Sapiens
TETVVTEY

SEQ ID NO: 84530 - protein, 8 aa, Homo Sapiens
TEVEVNKF

SEQ ID NO: 84531 - protein, 8 aa, Homo Sapiens
TEVKSVEM

SEQ ID NO: 84532 - protein, 8 aa, Homo Sapiens
TEVKVEPM

SEQ ID NO: 84533 - protein, 8 aa, Homo Sapiens
TEVQAHPY

SEQ ID NO: 84534 - protein, 8 aa, Homo Sapiens
TEVVKNTL

SEQ ID NO: 84535 - protein, 8 aa, Homo Sapiens
TEWQHKAF

SEQ ID NO: 84536 - protein, 8 aa, Homo Sapiens
TEYGLSVY

SEQ ID NO: 84537 - protein, 8 aa, Homo Sapiens
TEYISTEF

SEQ ID NO: 84538 - protein, 8 aa, Homo Sapiens
TEYVHAYF

SEQ ID NO: 84539 - protein, 8 aa, Homo Sapiens
TLEQIVTY

SEQ ID NO: 84540 - protein, 8 aa, Homo Sapiens
VEAEAMNY

SEQ ID NO: 84541 - protein, 8 aa, Homo Sapiens
VEAFAATF

SEQ ID NO: 84542 - protein, 8 aa, Homo Sapiens
VEAIFSKY

SEQ ID NO: 84543 - protein, 8 aa, Homo Sapiens
VEAIRTNY

SEQ ID NO: 84544 - protein, 8 aa, Homo Sapiens
VEAKVVCF

SEQ ID NO: 84545 - protein, 8 aa, Homo Sapiens
VEAQATHF

SEQ ID NO: 84546 - protein, 8 aa, Homo Sapiens
VEAVAHIL

SEQ ID NO: 84547 - protein, 8 aa, Homo Sapiens
VEAVVRSF

SEQ ID NO: 84548 - protein, 8 aa, Homo Sapiens
VEEYVYEF

SEQ ID NO: 84549 - protein, 8 aa, Homo Sapiens
VEFLIVHY

SEQ ID NO: 84550 - protein, 8 aa, Homo Sapiens
VEFLRPSF

SEQ ID NO: 84551 - protein, 8 aa, Homo Sapiens
VEGHSNVY

SEQ ID NO: 84552 - protein, 8 aa, Homo Sapiens
VEGPNFEF

SEQ ID NO: 84553 - protein, 8 aa, Homo Sapiens
VEHDAFIF

SEQ ID NO: 84554 - protein, 8 aa, Homo Sapiens
VEHKVETF

SEQ ID NO: 84555 - protein, 8 aa, Homo Sapiens
VEHLVQKM

SEQ ID NO: 84556 - protein, 8 aa, Homo Sapiens
VEHQAISF

SEQ ID NO: 84557 - protein, 8 aa, Homo Sapiens
VEHSGRVF

SEQ ID NO: 84558 - protein, 8 aa, Homo Sapiens
VEIAAVTH

SEQ ID NO: 84559 - protein, 8 aa, Homo Sapiens
VEIAKQSV

SEQ ID NO: 84560 - protein, 8 aa, Homo Sapiens
VEIAREAL

SEQ ID NO: 84561 - protein, 8 aa, Homo Sapiens
VEIEREVL

SEQ ID NO: 84562 - protein, 8 aa, Homo Sapiens
VEIERTAF

SEQ ID NO: 84563 - protein, 8 aa, Homo Sapiens
VEIILHVV

SEQ ID NO: 84564 - protein, 8 aa, Homo Sapiens
VEIITKEF

SEQ ID NO: 84565 - protein, 8 aa, Homo Sapiens
VEIVRQSL

SEQ ID NO: 84566 - protein, 8 aa, Homo Sapiens
VEKDAPLF

SEQ ID NO: 84567 - protein, 8 aa, Homo Sapiens
VEKGVPLY

SEQ ID NO: 84568 - protein, 8 aa, Homo Sapiens
VEKIHYPH

SEQ ID NO: 84569 - protein, 8 aa, Homo Sapiens
VEKKIDKY

SEQ ID NO: 84570 - protein, 8 aa, Homo Sapiens
VEKKLAEY

SEQ ID NO: 84571 - protein, 8 aa, Homo Sapiens
VEKLRFTY

SEQ ID NO: 84572 - protein, 8 aa, Homo Sapiens
VEKTIQKY

SEQ ID NO: 84573 - protein, 8 aa, Homo Sapiens
VEKVTNEY

SEQ ID NO: 84574 - protein, 8 aa, Homo Sapiens
VELLARKF

SEQ ID NO: 84575 - protein, 8 aa, Homo Sapiens
VELTSSLF

SEQ ID NO: 84576 - protein, 8 aa, Homo Sapiens
VEMEIVSM

SEQ ID NO: 84577 - protein, 8 aa, Homo Sapiens
VEMLVAGH

SEQ ID NO: 84578 - protein, 8 aa, Homo Sapiens
VEMTVSKF

SEQ ID NO: 84579 - protein, 8 aa, Homo Sapiens
VENQFREF

SEQ ID NO: 84580 - protein, 8 aa, Homo Sapiens
VEPKVTVY

SEQ ID NO: 84581 - protein, 8 aa, Homo Sapiens
VEQHVELY

SEQ ID NO: 84582 - protein, 8 aa, Homo Sapiens
VEQILAEF

SEQ ID NO: 84583 - protein, 8 aa, Homo Sapiens
VEQILPTL

SEQ ID NO: 84584 - protein, 8 aa, Homo Sapiens
VEQIRNIL

SEQ ID NO: 84585 - protein, 8 aa, Homo Sapiens
VEQLAVRF

SEQ ID NO: 84586 - protein, 8 aa, Homo Sapiens
VEQLFQVM

SEQ ID NO: 84587 - protein, 8 aa, Homo Sapiens
VERLIEAF

SEQ ID NO: 84588 - protein, 8 aa, Homo Sapiens
VERVITIM

SEQ ID NO: 84589 - protein, 8 aa, Homo Sapiens
VERYLEEF

SEQ ID NO: 84590 - protein, 8 aa, Homo Sapiens
VESIKTVY

SEQ ID NO: 84591 - protein, 8 aa, Homo Sapiens
VETESVRY

SEQ ID NO: 84592 - protein, 8 aa, Homo Sapiens
VETFAFQA

SEQ ID NO: 84593 - protein, 8 aa, Homo Sapiens
VETIFSKY

SEQ ID NO: 84594 - protein, 8 aa, Homo Sapiens
VETYFHEF

SEQ ID NO: 84595 - protein, 8 aa, Homo Sapiens
VEVGRVAY

SEQ ID NO: 84596 - protein, 8 aa, Homo Sapiens
VEVIKPLV

SEQ ID NO: 84597 - protein, 8 aa, Homo Sapiens
VEVKRPKY

SEQ ID NO: 84598 - protein, 8 aa, Homo Sapiens
VEVYIPQF

SEQ ID NO: 84599 - protein, 8 aa, Homo Sapiens
WEVVTHGY

SEQ ID NO: 84600 - protein, 8 aa, Homo Sapiens
YDRLVDEY

SEQ ID NO: 84601 - protein, 8 aa, Homo Sapiens
YEAEKIEY

SEQ ID NO: 84602 - protein, 8 aa, Homo Sapiens
YEAIADHY

SEQ ID NO: 84603 - protein, 8 aa, Homo Sapiens
YEAKRNEF

SEQ ID NO: 84604 - protein, 8 aa, Homo Sapiens
YEALTPVH

SEQ ID NO: 84605 - protein, 8 aa, Homo Sapiens
YEAPAYHL

SEQ ID NO: 84606 - protein, 8 aa, Homo Sapiens
YEAPRCVY

SEQ ID NO: 84607 - protein, 8 aa, Homo Sapiens
YEAVREVL

SEQ ID NO: 84608 - protein, 8 aa, Homo Sapiens
YEAYVQAL

SEQ ID NO: 84609 - protein, 8 aa, Homo Sapiens
YEFEQQRY

SEQ ID NO: 84610 - protein, 8 aa, Homo Sapiens
YEFIVRHF

SEQ ID NO: 84611 - protein, 8 aa, Homo Sapiens
YEGHVNEY

SEQ ID NO: 84612 - protein, 8 aa, Homo Sapiens
YEIKMTKM

SEQ ID NO: 84613 - protein, 8 aa, Homo Sapiens
YEINAHKY

SEQ ID NO: 84614 - protein, 8 aa, Homo Sapiens
YEKDIAAY

SEQ ID NO: 84615 - protein, 8 aa, Homo Sapiens
YEKKIFEY

SEQ ID NO: 84616 - protein, 8 aa, Homo Sapiens
YEKTVEVL

SEQ ID NO: 84617 - protein, 8 aa, Homo Sapiens
YELGRPAA

SEQ ID NO: 84618 - protein, 8 aa, Homo Sapiens
YELHVFTF

SEQ ID NO: 84619 - protein, 8 aa, Homo Sapiens
YELIITRY

SEQ ID NO: 84620 - protein, 8 aa, Homo Sapiens
YEMILHEF

SEQ ID NO: 84621 - protein, 8 aa, Homo Sapiens
YEMVSRVM

SEQ ID NO: 84622 - protein, 8 aa, Homo Sapiens
YENCFHIL

SEQ ID NO: 84623 - protein, 8 aa, Homo Sapiens
YENLVVAL

SEQ ID NO: 84624 - protein, 8 aa, Homo Sapiens
YENPTYKF

SEQ ID NO: 84625 - protein, 8 aa, Homo Sapiens
YENRIRAY

SEQ ID NO: 84626 - protein, 8 aa, Homo Sapiens
YEQIVKAH

SEQ ID NO: 84627 - protein, 8 aa, Homo Sapiens
YEQLMQLY

SEQ ID NO: 84628 - protein, 8 aa, Homo Sapiens
YEQVKQVL

SEQ ID NO: 84629 - protein, 8 aa, Homo Sapiens
YERAIECY

SEQ ID NO: 84630 - protein, 8 aa, Homo Sapiens
YERAVEFF

SEQ ID NO: 84631 - protein, 8 aa, Homo Sapiens
YERLVAQF

SEQ ID NO: 84632 - protein, 8 aa, Homo Sapiens
YESLFREY

SEQ ID NO: 84633 - protein, 8 aa, Homo Sapiens
YETLTRPF

SEQ ID NO: 84634 - protein, 8 aa, Homo Sapiens
YEVEVHRL

SEQ ID NO: 84635 - protein, 8 aa, Homo Sapiens
YEVFKVLY

SEQ ID NO: 84636 - protein, 8 aa, Homo Sapiens
YEVTSTKY

SEQ ID NO: 84637 - protein, 8 aa, Homo Sapiens
YEYEFYHY

SEQ ID NO: 84638 - protein, 8 aa, Homo Sapiens
YEYRFLEF

SEQ ID NO: 84639 - protein, 8 aa, Homo Sapiens
YEYVVERF

SEQ ID NO: 84640 - protein, 8 aa, Homo Sapiens
YPVEIHEY

SEQ ID NO: 84641 - protein, 9 aa, Homo Sapiens
AEFELPKTM

SEQ ID NO: 84642 - protein, 9 aa, Homo Sapiens
AEFEVHEVY

SEQ ID NO: 84643 - protein, 9 aa, Homo Sapiens
AEMLRSISF

SEQ ID NO: 84644 - protein, 9 aa, Homo Sapiens
AENVFFVAH

SEQ ID NO: 84645 - protein, 9 aa, Homo Sapiens
AEWDQVTVY

SEQ ID NO: 84646 - protein, 9 aa, Homo Sapiens
AEYLIKEGY

SEQ ID NO: 84647 - protein, 9 aa, Homo Sapiens
AVEAKQVAL

SEQ ID NO: 84648 - protein, 9 aa, Homo Sapiens
CAPRRKVAL

SEQ ID NO: 84649 - protein, 9 aa, Homo Sapiens
CEFKIPLAI

SEQ ID NO: 84650 - protein, 9 aa, Homo Sapiens
CEHDFQMLF

SEQ ID NO: 84651 - protein, 9 aa, Homo Sapiens
CEHGGFVTY

SEQ ID NO: 84652 - protein, 9 aa, Homo Sapiens
CEISPLISY

SEQ ID NO: 84653 - protein, 9 aa, Homo Sapiens
CEISPLVSY

SEQ ID NO: 84654 - protein, 9 aa, Homo Sapiens
CENVYHLVY

SEQ ID NO: 84655 - protein, 9 aa, Homo Sapiens
CESVLKEVY

SEQ ID NO: 84656 - protein, 9 aa, Homo Sapiens
CETDTLINY

SEQ ID NO: 84657 - protein, 9 aa, Homo Sapiens
CETIMPLAL

SEQ ID NO: 84658 - protein, 9 aa, Homo Sapiens
CETQLPVSF

SEQ ID NO: 84659 - protein, 9 aa, Homo Sapiens
CEVLYNIAF

SEQ ID NO: 84660 - protein, 9 aa, Homo Sapiens
DAWKLTTQY

SEQ ID NO: 84661 - protein, 9 aa, Homo Sapiens
DCPELIEAF

SEQ ID NO: 84662 - protein, 9 aa, Homo Sapiens
DDFESKYSF

SEQ ID NO: 84663 - protein, 9 aa, Homo Sapiens
DDFLNRIAL

SEQ ID NO: 84664 - protein, 9 aa, Homo Sapiens
DDFRFKDRF

SEQ ID NO: 84665 - protein, 9 aa, Homo Sapiens
DDFRVLTAV

SEQ ID NO: 84666 - protein, 9 aa, Homo Sapiens
DDISLPKSA

SEQ ID NO: 84667 - protein, 9 aa, Homo Sapiens
DDLEWKIIY

SEQ ID NO: 84668 - protein, 9 aa, Homo Sapiens
DDVILKEEF

SEQ ID NO: 84669 - protein, 9 aa, Homo Sapiens
DDVKVVEKY

SEQ ID NO: 84670 - protein, 9 aa, Homo Sapiens
DDWRIAMTY

SEQ ID NO: 84671 - protein, 9 aa, Homo Sapiens
DDYPRDYQY

SEQ ID NO: 84672 - protein, 9 aa, Homo Sapiens
DDYQLPEIL

SEQ ID NO: 84673 - protein, 9 aa, Homo Sapiens
DDYTIPDEY

SEQ ID NO: 84674 - protein, 9 aa, Homo Sapiens
DEAAISKLY

SEQ ID NO: 84675 - protein, 9 aa, Homo Sapiens
DEAEVHLKF

SEQ ID NO: 84676 - protein, 9 aa, Homo Sapiens
DEAHLASVY

SEQ ID NO: 84677 - protein, 9 aa, Homo Sapiens
DEAKVCMVY

SEQ ID NO: 84678 - protein, 9 aa, Homo Sapiens
DEAPLYEIF

SEQ ID NO: 84679 - protein, 9 aa, Homo Sapiens
DEAPPEHSF

SEQ ID NO: 84680 - protein, 9 aa, Homo Sapiens
DEARSLKAY

SEQ ID NO: 84681 - protein, 9 aa, Homo Sapiens
DEATLLRAL

SEQ ID NO: 84682 - protein, 9 aa, Homo Sapiens
DEAVMLVNH

SEQ ID NO: 84683 - protein, 9 aa, Homo Sapiens
DECGKAFSY

SEQ ID NO: 84684 - protein, 9 aa, Homo Sapiens
DECPHLIAL

SEQ ID NO: 84685 - protein, 9 aa, Homo Sapiens
DECPVVNAY

SEQ ID NO: 84686 - protein, 9 aa, Homo Sapiens
DEDVLRYQF

SEQ ID NO: 84687 - protein, 9 aa, Homo Sapiens
DEEGLPEKL

SEQ ID NO: 84688 - protein, 9 aa, Homo Sapiens
DEEIIVKAM

SEQ ID NO: 84689 - protein, 9 aa, Homo Sapiens
DEEKFITIF

SEQ ID NO: 84690 - protein, 9 aa, Homo Sapiens
DEETVYNVF

SEQ ID NO: 84691 - protein, 9 aa, Homo Sapiens
DEFAKLQDY

SEQ ID NO: 84692 - protein, 9 aa, Homo Sapiens
DEFANLIQH

SEQ ID NO: 84693 - protein, 9 aa, Homo Sapiens
DEFDGKVTY

SEQ ID NO: 84694 - protein, 9 aa, Homo Sapiens
DEFDLFAHH

SEQ ID NO: 84695 - protein, 9 aa, Homo Sapiens
DEFDQRILY

SEQ ID NO: 84696 - protein, 9 aa, Homo Sapiens
DEFEFLEKA

SEQ ID NO: 84697 - protein, 9 aa, Homo Sapiens
DEFEKEETF

SEQ ID NO: 84698 - protein, 9 aa, Homo Sapiens
DEFGEFGGF

SEQ ID NO: 84699 - protein, 9 aa, Homo Sapiens
DEFGHTSQL

SEQ ID NO: 84700 - protein, 9 aa, Homo Sapiens
DEFHNPLAY

SEQ ID NO: 84701 - protein, 9 aa, Homo Sapiens
DEFHPFIEA

SEQ ID NO: 84702 - protein, 9 aa, Homo Sapiens
DEFIIKTVM

SEQ ID NO: 84703 - protein, 9 aa, Homo Sapiens
DEFILPTGA

SEQ ID NO: 84704 - protein, 9 aa, Homo Sapiens
DEFITVHSM

SEQ ID NO: 84705 - protein, 9 aa, Homo Sapiens
DEFKIGELF

SEQ ID NO: 84706 - protein, 9 aa, Homo Sapiens
DEFKSFCHF

SEQ ID NO: 84707 - protein, 9 aa, Homo Sapiens
DEFKSVSKF

SEQ ID NO: 84708 - protein, 9 aa, Homo Sapiens
DEFLHINDF

SEQ ID NO: 84709 - protein, 9 aa, Homo Sapiens
DEFLLLTTH

SEQ ID NO: 84710 - protein, 9 aa, Homo Sapiens
DEFLRISTA

SEQ ID NO: 84711 - protein, 9 aa, Homo Sapiens
DEFLWREQF

SEQ ID NO: 84712 - protein, 9 aa, Homo Sapiens
DEFNGVPSY

SEQ ID NO: 84713 - protein, 9 aa, Homo Sapiens
DEFQLHTNV

SEQ ID NO: 84714 - protein, 9 aa, Homo Sapiens
DEFRKAESV

SEQ ID NO: 84715 - protein, 9 aa, Homo Sapiens
DEFSNPYRY

SEQ ID NO: 84716 - protein, 9 aa, Homo Sapiens
DEFTHLYTL

SEQ ID NO: 84717 - protein, 9 aa, Homo Sapiens
DEFYKTPSL

SEQ ID NO: 84718 - protein, 9 aa, Homo Sapiens
DEGILWQMF

SEQ ID NO: 84719 - protein, 9 aa, Homo Sapiens
DEGKLLIGF

SEQ ID NO: 84720 - protein, 9 aa, Homo Sapiens
DEGRLVLEF

SEQ ID NO: 84721 - protein, 9 aa, Homo Sapiens
DEGTAFLVY

SEQ ID NO: 84722 - protein, 9 aa, Homo Sapiens
DEHAGVISV

SEQ ID NO: 84723 - protein, 9 aa, Homo Sapiens
DEHALIQQY

SEQ ID NO: 84724 - protein, 9 aa, Homo Sapiens
DEHEGPALY

SEQ ID NO: 84725 - protein, 9 aa, Homo Sapiens
DEHELLEHL

SEQ ID NO: 84726 - protein, 9 aa, Homo Sapiens
DEHGFDNCL

SEQ ID NO: 84727 - protein, 9 aa, Homo Sapiens
DEHGLHTKY

SEQ ID NO: 84728 - protein, 9 aa, Homo Sapiens
DEHIYPYMY

SEQ ID NO: 84729 - protein, 9 aa, Homo Sapiens
DEHLLIQHY

SEQ ID NO: 84730 - protein, 9 aa, Homo Sapiens
DEHLQLISL

SEQ ID NO: 84731 - protein, 9 aa, Homo Sapiens
DEHLSVVRY

SEQ ID NO: 84732 - protein, 9 aa, Homo Sapiens
DEHPNVIRY

SEQ ID NO: 84733 - protein, 9 aa, Homo Sapiens
DEHQLYNEF

SEQ ID NO: 84734 - protein, 9 aa, Homo Sapiens
DEHVQFLVY

SEQ ID NO: 84735 - protein, 9 aa, Homo Sapiens
DEIFHDVAY

SEQ ID NO: 84736 - protein, 9 aa, Homo Sapiens
DEIGIPVAL

SEQ ID NO: 84737 - protein, 9 aa, Homo Sapiens
DEIGLPKIF

SEQ ID NO: 84738 - protein, 9 aa, Homo Sapiens
DEIIKNVPL

SEQ ID NO: 84739 - protein, 9 aa, Homo Sapiens
DEIILPRGL

SEQ ID NO: 84740 - protein, 9 aa, Homo Sapiens
DEIKIGTSC

SEQ ID NO: 84741 - protein, 9 aa, Homo Sapiens
DEILIRDTF

SEQ ID NO: 84742 - protein, 9 aa, Homo Sapiens
DEINKQLIF

SEQ ID NO: 84743 - protein, 9 aa, Homo Sapiens
DEIRLLKSV

SEQ ID NO: 84744 - protein, 9 aa, Homo Sapiens
DEKAFVFSV

SEQ ID NO: 84745 - protein, 9 aa, Homo Sapiens
DEKEFQVPM

SEQ ID NO: 84746 - protein, 9 aa, Homo Sapiens
DEKEFTVQI

SEQ ID NO: 84747 - protein, 9 aa, Homo Sapiens
DEKELIEKM

SEQ ID NO: 84748 - protein, 9 aa, Homo Sapiens
DEKELRTSF

SEQ ID NO: 84749 - protein, 9 aa, Homo Sapiens
DEKFLSEVF

SEQ ID NO: 84750 - protein, 9 aa, Homo Sapiens
DEKKFDEAL

SEQ ID NO: 84751 - protein, 9 aa, Homo Sapiens
DEKLLYDTF

SEQ ID NO: 84752 - protein, 9 aa, Homo Sapiens
DEKLNNAKY

SEQ ID NO: 84753 - protein, 9 aa, Homo Sapiens
DEKNFVVVM

SEQ ID NO: 84754 - protein, 9 aa, Homo Sapiens
DEKPRIVVF

SEQ ID NO: 84755 - protein, 9 aa, Homo Sapiens
DEKQLIEKM

SEQ ID NO: 84756 - protein, 9 aa, Homo Sapiens
DEKQQHIVY

SEQ ID NO: 84757 - protein, 9 aa, Homo Sapiens
DEKRDFRTY

SEQ ID NO: 84758 - protein, 9 aa, Homo Sapiens
DEKRFLVTV

SEQ ID NO: 84759 - protein, 9 aa, Homo Sapiens
DEKVLIEAY

SEQ ID NO: 84760 - protein, 9 aa, Homo Sapiens
DELEIKAYY

SEQ ID NO: 84761 - protein, 9 aa, Homo Sapiens
DELELHQRF

SEQ ID NO: 84762 - protein, 9 aa, Homo Sapiens
DELEQKRAL

SEQ ID NO: 84763 - protein, 9 aa, Homo Sapiens
DELERITKL

SEQ ID NO: 84764 - protein, 9 aa, Homo Sapiens
DELGIILAH

SEQ ID NO: 84765 - protein, 9 aa, Homo Sapiens
DELHYLEVY

SEQ ID NO: 84766 - protein, 9 aa, Homo Sapiens
DELIFSNEY

SEQ ID NO: 84767 - protein, 9 aa, Homo Sapiens
DELIKPTSL

SEQ ID NO: 84768 - protein, 9 aa, Homo Sapiens
DELIQQSQW

SEQ ID NO: 84769 - protein, 9 aa, Homo Sapiens
DELIRNVKF

SEQ ID NO: 84770 - protein, 9 aa, Homo Sapiens
DELIRSIEL

SEQ ID NO: 84771 - protein, 9 aa, Homo Sapiens
DELKKEVSM

SEQ ID NO: 84772 - protein, 9 aa, Homo Sapiens
DELPFLHEV

SEQ ID NO: 84773 - protein, 9 aa, Homo Sapiens
DELPKFHQY

SEQ ID NO: 84774 - protein, 9 aa, Homo Sapiens
DELQFLEKI

SEQ ID NO: 84775 - protein, 9 aa, Homo Sapiens
DELQIPVKW

SEQ ID NO: 84776 - protein, 9 aa, Homo Sapiens
DELQQPLEL

SEQ ID NO: 84777 - protein, 9 aa, Homo Sapiens
DELQSVISH

SEQ ID NO: 84778 - protein, 9 aa, Homo Sapiens
DELQVLEKF

SEQ ID NO: 84779 - protein, 9 aa, Homo Sapiens
DELTKIWKI

SEQ ID NO: 84780 - protein, 9 aa, Homo Sapiens
DELVKKYSL

SEQ ID NO: 84781 - protein, 9 aa, Homo Sapiens
DELYTPHSW

SEQ ID NO: 84782 - protein, 9 aa, Homo Sapiens
DEMAAVMGF

SEQ ID NO: 84783 - protein, 9 aa, Homo Sapiens
DEMDLHLVM

SEQ ID NO: 84784 - protein, 9 aa, Homo Sapiens
DEMNILATY

SEQ ID NO: 84785 - protein, 9 aa, Homo Sapiens
DEMRSPEGY

SEQ ID NO: 84786 - protein, 9 aa, Homo Sapiens
DEMTSLSEY

SEQ ID NO: 84787 - protein, 9 aa, Homo Sapiens
DEMVSLKDY

SEQ ID NO: 84788 - protein, 9 aa, Homo Sapiens
DENCFKVMF

SEQ ID NO: 84789 - protein, 9 aa, Homo Sapiens
DENDVITCF

SEQ ID NO: 84790 - protein, 9 aa, Homo Sapiens
DENEHQLSL

SEQ ID NO: 84791 - protein, 9 aa, Homo Sapiens
DENELKEFF

SEQ ID NO: 84792 - protein, 9 aa, Homo Sapiens
DENEPNVPY

SEQ ID NO: 84793 - protein, 9 aa, Homo Sapiens
DENEVRTLF

SEQ ID NO: 84794 - protein, 9 aa, Homo Sapiens
DENFISRAF

SEQ ID NO: 84795 - protein, 9 aa, Homo Sapiens
DENGKISRL

SEQ ID NO: 84796 - protein, 9 aa, Homo Sapiens
DENKFVSRL

SEQ ID NO: 84797 - protein, 9 aa, Homo Sapiens
DENKSLSTY

SEQ ID NO: 84798 - protein, 9 aa, Homo Sapiens
DENNVLIQY

SEQ ID NO: 84799 - protein, 9 aa, Homo Sapiens
DENPQQLKL

SEQ ID NO: 84800 - protein, 9 aa, Homo Sapiens
DENRKPVSF

SEQ ID NO: 84801 - protein, 9 aa, Homo Sapiens
DENSLEYKY

SEQ ID NO: 84802 - protein, 9 aa, Homo Sapiens
DENSVIKSF

SEQ ID NO: 84803 - protein, 9 aa, Homo Sapiens
DEQALEDHF

SEQ ID NO: 84804 - protein, 9 aa, Homo Sapiens
DEQFVVKAF

SEQ ID NO: 84805 - protein, 9 aa, Homo Sapiens
DEQMFPCRF

SEQ ID NO: 84806 - protein, 9 aa, Homo Sapiens
DEQRLRDEY

SEQ ID NO: 84807 - protein, 9 aa, Homo Sapiens
DEQVLQRDF

SEQ ID NO: 84808 - protein, 9 aa, Homo Sapiens
DERCQPRSF

SEQ ID NO: 84809 - protein, 9 aa, Homo Sapiens
DERELAAEM

SEQ ID NO: 84810 - protein, 9 aa, Homo Sapiens
DEREREEFY

SEQ ID NO: 84811 - protein, 9 aa, Homo Sapiens
DERIREYFY

SEQ ID NO: 84812 - protein, 9 aa, Homo Sapiens
DERKIEETL

SEQ ID NO: 84813 - protein, 9 aa, Homo Sapiens
DERKLRTFY

SEQ ID NO: 84814 - protein, 9 aa, Homo Sapiens
DERLLQEAL

SEQ ID NO: 84815 - protein, 9 aa, Homo Sapiens
DERNRQVTF

SEQ ID NO: 84816 - protein, 9 aa, Homo Sapiens
DERQCLQKY

SEQ ID NO: 84817 - protein, 9 aa, Homo Sapiens
DERQINTEY

SEQ ID NO: 84818 - protein, 9 aa, Homo Sapiens
DERRFQDAV

SEQ ID NO: 84819 - protein, 9 aa, Homo Sapiens
DERRKLIRY

SEQ ID NO: 84820 - protein, 9 aa, Homo Sapiens
DERVFVALY

SEQ ID NO: 84821 - protein, 9 aa, Homo Sapiens
DERVITEEM

SEQ ID NO: 84822 - protein, 9 aa, Homo Sapiens
DESDYALRY

SEQ ID NO: 84823 - protein, 9 aa, Homo Sapiens
DESGPSIVH

SEQ ID NO: 84824 - protein, 9 aa, Homo Sapiens
DESPLGAPY

SEQ ID NO: 84825 - protein, 9 aa, Homo Sapiens
DESQVVTRY

SEQ ID NO: 84826 - protein, 9 aa, Homo Sapiens
DESSVSISH

SEQ ID NO: 84827 - protein, 9 aa, Homo Sapiens
DESVLTNVF

SEQ ID NO: 84828 - protein, 9 aa, Homo Sapiens
DETAKKIQY

SEQ ID NO: 84829 - protein, 9 aa, Homo Sapiens
DETIRVVSM

SEQ ID NO: 84830 - protein, 9 aa, Homo Sapiens
DETLVHSSF

SEQ ID NO: 84831 - protein, 9 aa, Homo Sapiens
DETQIFSYF

SEQ ID NO: 84832 - protein, 9 aa, Homo Sapiens
DETTVSQNY

SEQ ID NO: 84833 - protein, 9 aa, Homo Sapiens
DETVLPSSY

SEQ ID NO: 84834 - protein, 9 aa, Homo Sapiens
DETVTHFIY

SEQ ID NO: 84835 - protein, 9 aa, Homo Sapiens
DEVERTQTL

SEQ ID NO: 84836 - protein, 9 aa, Homo Sapiens
DEVERVITI

SEQ ID NO: 84837 - protein, 9 aa, Homo Sapiens
DEVFHDIAY

SEQ ID NO: 84838 - protein, 9 aa, Homo Sapiens
DEVIFPLTV

SEQ ID NO: 84839 - protein, 9 aa, Homo Sapiens
DEVIKVYRY

SEQ ID NO: 84840 - protein, 9 aa, Homo Sapiens
DEVKSTIKF

SEQ ID NO: 84841 - protein, 9 aa, Homo Sapiens
DEVLQTHSV

SEQ ID NO: 84842 - protein, 9 aa, Homo Sapiens
DEVNGLISM

SEQ ID NO: 84843 - protein, 9 aa, Homo Sapiens
DEVPRPQAL

SEQ ID NO: 84844 - protein, 9 aa, Homo Sapiens
DEVPVGVEM

SEQ ID NO: 84845 - protein, 9 aa, Homo Sapiens
DEVQLKTTY

SEQ ID NO: 84846 - protein, 9 aa, Homo Sapiens
DEVVKIQSL

SEQ ID NO: 84847 - protein, 9 aa, Homo Sapiens
DEVYQVTVY

SEQ ID NO: 84848 - protein, 9 aa, Homo Sapiens
DEWITIDKF

SEQ ID NO: 84849 - protein, 9 aa, Homo Sapiens
DEWKELKQH

SEQ ID NO: 84850 - protein, 9 aa, Homo Sapiens
DEWLKPELF

SEQ ID NO: 84851 - protein, 9 aa, Homo Sapiens
DEWLRPEDL

SEQ ID NO: 84852 - protein, 9 aa, Homo Sapiens
DEYDDIVVH

SEQ ID NO: 84853 - protein, 9 aa, Homo Sapiens
DEYDFYRSF

SEQ ID NO: 84854 - protein, 9 aa, Homo Sapiens
DEYDGHSTY

SEQ ID NO: 84855 - protein, 9 aa, Homo Sapiens
DEYEDENLY

SEQ ID NO: 84856 - protein, 9 aa, Homo Sapiens
DEYEKFKLY

SEQ ID NO: 84857 - protein, 9 aa, Homo Sapiens
DEYEKLQVL

SEQ ID NO: 84858 - protein, 9 aa, Homo Sapiens
DEYELLMPH

SEQ ID NO: 84859 - protein, 9 aa, Homo Sapiens
DEYENLFNM

SEQ ID NO: 84860 - protein, 9 aa, Homo Sapiens
DEYGVSQAL

SEQ ID NO: 84861 - protein, 9 aa, Homo Sapiens
DEYIMSKTL

SEQ ID NO: 84862 - protein, 9 aa, Homo Sapiens
DEYIQSHNF

SEQ ID NO: 84863 - protein, 9 aa, Homo Sapiens
DEYIYRHFF

SEQ ID NO: 84864 - protein, 9 aa, Homo Sapiens
DEYKIGQLY

SEQ ID NO: 84865 - protein, 9 aa, Homo Sapiens
DEYKIPSSH

SEQ ID NO: 84866 - protein, 9 aa, Homo Sapiens
DEYKYNVEA

SEQ ID NO: 84867 - protein, 9 aa, Homo Sapiens
DEYNFVRAY

SEQ ID NO: 84868 - protein, 9 aa, Homo Sapiens
DEYNFVRSY

SEQ ID NO: 84869 - protein, 9 aa, Homo Sapiens
DEYQFVERL

SEQ ID NO: 84870 - protein, 9 aa, Homo Sapiens
DEYQVAQLY

SEQ ID NO: 84871 - protein, 9 aa, Homo Sapiens
DEYQVGQLY

SEQ ID NO: 84872 - protein, 9 aa, Homo Sapiens
DEYSLVREL

SEQ ID NO: 84873 - protein, 9 aa, Homo Sapiens
DEYSMQYSA

SEQ ID NO: 84874 - protein, 9 aa, Homo Sapiens
DEYVNVKDF

SEQ ID NO: 84875 - protein, 9 aa, Homo Sapiens
DEYYQVVYY

SEQ ID NO: 84876 - protein, 9 aa, Homo Sapiens
DFLLRPRSH

SEQ ID NO: 84877 - protein, 9 aa, Homo Sapiens
DGHLFQVEY

SEQ ID NO: 84878 - protein, 9 aa, Homo Sapiens
DLFEEKITH

SEQ ID NO: 84879 - protein, 9 aa, Homo Sapiens
DLWLEREVF

SEQ ID NO: 84880 - protein, 9 aa, Homo Sapiens
DSFIRPVTF

SEQ ID NO: 84881 - protein, 9 aa, Homo Sapiens
EEAAFTCEY

SEQ ID NO: 84882 - protein, 9 aa, Homo Sapiens
EEAHLNTSF

SEQ ID NO: 84883 - protein, 9 aa, Homo Sapiens
EEAPKFLAF

SEQ ID NO: 84884 - protein, 9 aa, Homo Sapiens
EEASLLHQF

SEQ ID NO: 84885 - protein, 9 aa, Homo Sapiens
EEAVKWISY

SEQ ID NO: 84886 - protein, 9 aa, Homo Sapiens
EEEILLNSY

SEQ ID NO: 84887 - protein, 9 aa, Homo Sapiens
EEEVFPLAM

SEQ ID NO: 84888 - protein, 9 aa, Homo Sapiens
EEFDLFMRM

SEQ ID NO: 84889 - protein, 9 aa, Homo Sapiens
EEFDRFTGY

SEQ ID NO: 84890 - protein, 9 aa, Homo Sapiens
EEFDSFRIF

SEQ ID NO: 84891 - protein, 9 aa, Homo Sapiens
EEFETIERF

SEQ ID NO: 84892 - protein, 9 aa, Homo Sapiens
EEFEYQRSY

SEQ ID NO: 84893 - protein, 9 aa, Homo Sapiens
EEFEYRHVM

SEQ ID NO: 84894 - protein, 9 aa, Homo Sapiens
EEFGQAFSF

SEQ ID NO: 84895 - protein, 9 aa, Homo Sapiens
EEFGRFASF

SEQ ID NO: 84896 - protein, 9 aa, Homo Sapiens
EEFKDFNKY

SEQ ID NO: 84897 - protein, 9 aa, Homo Sapiens
EEFLAFPAY

SEQ ID NO: 84898 - protein, 9 aa, Homo Sapiens
EEFLFRTAL

SEQ ID NO: 84899 - protein, 9 aa, Homo Sapiens
EEFLSKVSI

SEQ ID NO: 84900 - protein, 9 aa, Homo Sapiens
EEFPNTCKM

SEQ ID NO: 84901 - protein, 9 aa, Homo Sapiens
EEFREFNKY

SEQ ID NO: 84902 - protein, 9 aa, Homo Sapiens
EEFRHVIAW

SEQ ID NO: 84903 - protein, 9 aa, Homo Sapiens
EEFRNFSRY

SEQ ID NO: 84904 - protein, 9 aa, Homo Sapiens
EEFTVRDGY

SEQ ID NO: 84905 - protein, 9 aa, Homo Sapiens
EEFVFIHAV

SEQ ID NO: 84906 - protein, 9 aa, Homo Sapiens
EEFVLVPQY

SEQ ID NO: 84907 - protein, 9 aa, Homo Sapiens
EEGYVPTSY

SEQ ID NO: 84908 - protein, 9 aa, Homo Sapiens
EEHEVIVSF

SEQ ID NO: 84909 - protein, 9 aa, Homo Sapiens
EEHPLVFLF

SEQ ID NO: 84910 - protein, 9 aa, Homo Sapiens
EEHRLIARY

SEQ ID NO: 84911 - protein, 9 aa, Homo Sapiens
EEIKKNYRY

SEQ ID NO: 84912 - protein, 9 aa, Homo Sapiens
EEIPFEQSF

SEQ ID NO: 84913 - protein, 9 aa, Homo Sapiens
EEIPKRETY

SEQ ID NO: 84914 - protein, 9 aa, Homo Sapiens
EEISHLISF

SEQ ID NO: 84915 - protein, 9 aa, Homo Sapiens
EEKDWKTAY

SEQ ID NO: 84916 - protein, 9 aa, Homo Sapiens
EELEQKYTY

SEQ ID NO: 84917 - protein, 9 aa, Homo Sapiens
EELERPLHY

SEQ ID NO: 84918 - protein, 9 aa, Homo Sapiens
EELEWQNRF

SEQ ID NO: 84919 - protein, 9 aa, Homo Sapiens
EELGHTETY

SEQ ID NO: 84920 - protein, 9 aa, Homo Sapiens
EELIFHCGF

SEQ ID NO: 84921 - protein, 9 aa, Homo Sapiens
EELKRVASF

SEQ ID NO: 84922 - protein, 9 aa, Homo Sapiens
EELPHIHAF

SEQ ID NO: 84923 - protein, 9 aa, Homo Sapiens
EELQQKVSY

SEQ ID NO: 84924 - protein, 9 aa, Homo Sapiens
EEMEWFNNY

SEQ ID NO: 84925 - protein, 9 aa, Homo Sapiens
EEMGLTSSF

SEQ ID NO: 84926 - protein, 9 aa, Homo Sapiens
EEMLFIYGH

SEQ ID NO: 84927 - protein, 9 aa, Homo Sapiens
EEMRRLVAY

SEQ ID NO: 84928 - protein, 9 aa, Homo Sapiens
EENPIVLEF

SEQ ID NO: 84929 - protein, 9 aa, Homo Sapiens
EENQIVSSY

SEQ ID NO: 84930 - protein, 9 aa, Homo Sapiens
EEQAFHVSY

SEQ ID NO: 84931 - protein, 9 aa, Homo Sapiens
EERADLIAY

SEQ ID NO: 84932 - protein, 9 aa, Homo Sapiens
EEREIKERI

SEQ ID NO: 84933 - protein, 9 aa, Homo Sapiens
EERVINEEY

SEQ ID NO: 84934 - protein, 9 aa, Homo Sapiens
EETDKIINY

SEQ ID NO: 84935 - protein, 9 aa, Homo Sapiens
EETVVPKTF

SEQ ID NO: 84936 - protein, 9 aa, Homo Sapiens
EEVDVTPTF

SEQ ID NO: 84937 - protein, 9 aa, Homo Sapiens
EEVIFPNNF

SEQ ID NO: 84938 - protein, 9 aa, Homo Sapiens
EEVKIAEAY

SEQ ID NO: 84939 - protein, 9 aa, Homo Sapiens
EEWLRLHTY

SEQ ID NO: 84940 - protein, 9 aa, Homo Sapiens
EEWPFKCEF

SEQ ID NO: 84941 - protein, 9 aa, Homo Sapiens
EEYEARENF

SEQ ID NO: 84942 - protein, 9 aa, Homo Sapiens
EEYEKLPAY

SEQ ID NO: 84943 - protein, 9 aa, Homo Sapiens
EEYERATRY

SEQ ID NO: 84944 - protein, 9 aa, Homo Sapiens
EEYLLRQVF

SEQ ID NO: 84945 - protein, 9 aa, Homo Sapiens
EEYMKYLAY

SEQ ID NO: 84946 - protein, 9 aa, Homo Sapiens
EEYPLTRAF

SEQ ID NO: 84947 - protein, 9 aa, Homo Sapiens
EEYQAFLVY

SEQ ID NO: 84948 - protein, 9 aa, Homo Sapiens
EEYQSLIRY

SEQ ID NO: 84949 - protein, 9 aa, Homo Sapiens
EEYSNTRAY

SEQ ID NO: 84950 - protein, 9 aa, Homo Sapiens
EEYSVPCAH

SEQ ID NO: 84951 - protein, 9 aa, Homo Sapiens
FEAPIKLVF

SEQ ID NO: 84952 - protein, 9 aa, Homo Sapiens
FEFEYQTKV

SEQ ID NO: 84953 - protein, 9 aa, Homo Sapiens
FEFIIPESY

SEQ ID NO: 84954 - protein, 9 aa, Homo Sapiens
FEFKHIKAF

SEQ ID NO: 84955 - protein, 9 aa, Homo Sapiens
FEFTPKPEY

SEQ ID NO: 84956 - protein, 9 aa, Homo Sapiens
FEFTYVNVY

SEQ ID NO: 84957 - protein, 9 aa, Homo Sapiens
FEHITPMQY

SEQ ID NO: 84958 - protein, 9 aa, Homo Sapiens
FELECPVKY

SEQ ID NO: 84959 - protein, 9 aa, Homo Sapiens
FEQALREYF

SEQ ID NO: 84960 - protein, 9 aa, Homo Sapiens
FEQILKAEY

SEQ ID NO: 84961 - protein, 9 aa, Homo Sapiens
FESGDFVSF

SEQ ID NO: 84962 - protein, 9 aa, Homo Sapiens
FESKVSASE

SEQ ID NO: 84963 - protein, 9 aa, Homo Sapiens
FESVFPLSH

SEQ ID NO: 84964 - protein, 9 aa, Homo Sapiens
FETRMNEAF

SEQ ID NO: 84965 - protein, 9 aa, Homo Sapiens
FEVMLPEKL

SEQ ID NO: 84966 - protein, 9 aa, Homo Sapiens
FEVPKLVQY

SEQ ID NO: 84967 - protein, 9 aa, Homo Sapiens
FEVTRPCSY

SEQ ID NO: 84968 - protein, 9 aa, Homo Sapiens
FEWENKVTV

SEQ ID NO: 84969 - protein, 9 aa, Homo Sapiens
FEYEFIYKH

SEQ ID NO: 84970 - protein, 9 aa, Homo Sapiens
FEYEYSQRW

SEQ ID NO: 84971 - protein, 9 aa, Homo Sapiens
FEYIRSETY

SEQ ID NO: 84972 - protein, 9 aa, Homo Sapiens
GEFEGFVAV

SEQ ID NO: 84973 - protein, 9 aa, Homo Sapiens
GEFGGFGSV

SEQ ID NO: 84974 - protein, 9 aa, Homo Sapiens
GEFRFRHGY

SEQ ID NO: 84975 - protein, 9 aa, Homo Sapiens
GIETIANEF

SEQ ID NO: 84976 - protein, 9 aa, Homo Sapiens
GIETIANEY

SEQ ID NO: 84977 - protein, 9 aa, Homo Sapiens
GVEVKRPKY

SEQ ID NO: 84978 - protein, 9 aa, Homo Sapiens
HDITVPLEV

SEQ ID NO: 84979 - protein, 9 aa, Homo Sapiens
HEAAFPIAV

SEQ ID NO: 84980 - protein, 9 aa, Homo Sapiens
HEADVDVLM

SEQ ID NO: 84981 - protein, 9 aa, Homo Sapiens
HEAERNIAL

SEQ ID NO: 84982 - protein, 9 aa, Homo Sapiens
HEAFSPVSY

SEQ ID NO: 84983 - protein, 9 aa, Homo Sapiens
HEAVPLSVF

SEQ ID NO: 84984 - protein, 9 aa, Homo Sapiens
HEESIHAAY

SEQ ID NO: 84985 - protein, 9 aa, Homo Sapiens
HEFDGDEEF

SEQ ID NO: 84986 - protein, 9 aa, Homo Sapiens
HEFDPWFNY

SEQ ID NO: 84987 - protein, 9 aa, Homo Sapiens
HEFLHEVPA

SEQ ID NO: 84988 - protein, 9 aa, Homo Sapiens
HEFLVKPSF

SEQ ID NO: 84989 - protein, 9 aa, Homo Sapiens
HEFPLILIF

SEQ ID NO: 84990 - protein, 9 aa, Homo Sapiens
HEFQQDLGY

SEQ ID NO: 84991 - protein, 9 aa, Homo Sapiens
HEFTVEQCF

SEQ ID NO: 84992 - protein, 9 aa, Homo Sapiens
HEFVLTEEL

SEQ ID NO: 84993 - protein, 9 aa, Homo Sapiens
HEFVSFEDF

SEQ ID NO: 84994 - protein, 9 aa, Homo Sapiens
HEGEILQAF

SEQ ID NO: 84995 - protein, 9 aa, Homo Sapiens
HEHIHSCQF

SEQ ID NO: 84996 - protein, 9 aa, Homo Sapiens
HEHRLPHVL

SEQ ID NO: 84997 - protein, 9 aa, Homo Sapiens
HEIAHNAAF

SEQ ID NO: 84998 - protein, 9 aa, Homo Sapiens
HEIEALKSF

SEQ ID NO: 84999 - protein, 9 aa, Homo Sapiens
HEIGEFPVF

SEQ ID NO: 85000 - protein, 9 aa, Homo Sapiens
HEIITLEQY

SEQ ID NO: 85001 - protein, 9 aa, Homo Sapiens
HEIITPEQF

SEQ ID NO: 85002 - protein, 9 aa, Homo Sapiens
HEIIWPAGF

SEQ ID NO: 85003 - protein, 9 aa, Homo Sapiens
HEIPVFIAM

SEQ ID NO: 85004 - protein, 9 aa, Homo Sapiens
HEIVLKVAY

SEQ ID NO: 85005 - protein, 9 aa, Homo Sapiens
HELIHGSSF

SEQ ID NO: 85006 - protein, 9 aa, Homo Sapiens
HEMEKAFAF

SEQ ID NO: 85007 - protein, 9 aa, Homo Sapiens
HEMPKTFTF

SEQ ID NO: 85008 - protein, 9 aa, Homo Sapiens
HENDTIAKY

SEQ ID NO: 85009 - protein, 9 aa, Homo Sapiens
HEQALLLEY

SEQ ID NO: 85010 - protein, 9 aa, Homo Sapiens
HEREMAEQF

SEQ ID NO: 85011 - protein, 9 aa, Homo Sapiens
HERPEFIAY

SEQ ID NO: 85012 - protein, 9 aa, Homo Sapiens
HEVLTRTAF

SEQ ID NO: 85013 - protein, 9 aa, Homo Sapiens
HEVPLRIGF

SEQ ID NO: 85014 - protein, 9 aa, Homo Sapiens
HEVPSLPAF

SEQ ID NO: 85015 - protein, 9 aa, Homo Sapiens
HEVPYTTSF

SEQ ID NO: 85016 - protein, 9 aa, Homo Sapiens
HEVSVPYAM

SEQ ID NO: 85017 - protein, 9 aa, Homo Sapiens
HEWHKRVAL

SEQ ID NO: 85018 - protein, 9 aa, Homo Sapiens
HEWMYTEAL

SEQ ID NO: 85019 - protein, 9 aa, Homo Sapiens
HEWTVKHRY

SEQ ID NO: 85020 - protein, 9 aa, Homo Sapiens
HEYALAVCL

SEQ ID NO: 85021 - protein, 9 aa, Homo Sapiens
HEYFNVPVY

SEQ ID NO: 85022 - protein, 9 aa, Homo Sapiens
IEAALRESL

SEQ ID NO: 85023 - protein, 9 aa, Homo Sapiens
IEALFPQKF

SEQ ID NO: 85024 - protein, 9 aa, Homo Sapiens
IEALMEKPF

SEQ ID NO: 85025 - protein, 9 aa, Homo Sapiens
IEALQKAGI

SEQ ID NO: 85026 - protein, 9 aa, Homo Sapiens
IEAVLLNSL

SEQ ID NO: 85027 - protein, 9 aa, Homo Sapiens
IECAHGIGY

SEQ ID NO: 85028 - protein, 9 aa, Homo Sapiens
IECDIVKDY

SEQ ID NO: 85029 - protein, 9 aa, Homo Sapiens
IEDEKLVRY

SEQ ID NO: 85030 - protein, 9 aa, Homo Sapiens
IEDFAHSSF

SEQ ID NO: 85031 - protein, 9 aa, Homo Sapiens
IEEMLQTAY

SEQ ID NO: 85032 - protein, 9 aa, Homo Sapiens
IEESIDRVY

SEQ ID NO: 85033 - protein, 9 aa, Homo Sapiens
IEFARKNVY

SEQ ID NO: 85034 - protein, 9 aa, Homo Sapiens
IEFDIPITY

SEQ ID NO: 85035 - protein, 9 aa, Homo Sapiens
IEFGMIPEF

SEQ ID NO: 85036 - protein, 9 aa, Homo Sapiens
IEFIFSDTH

SEQ ID NO: 85037 - protein, 9 aa, Homo Sapiens
IEFISKMSY

SEQ ID NO: 85038 - protein, 9 aa, Homo Sapiens
IEFMAPSEY

SEQ ID NO: 85039 - protein, 9 aa, Homo Sapiens
IEFSIPDSL

SEQ ID NO: 85040 - protein, 9 aa, Homo Sapiens
IEFTSIDAH

SEQ ID NO: 85041 - protein, 9 aa, Homo Sapiens
IEFVELPQY

SEQ ID NO: 85042 - protein, 9 aa, Homo Sapiens
IEHSVEVAH

SEQ ID NO: 85043 - protein, 9 aa, Homo Sapiens
IEIENFKSY

SEQ ID NO: 85044 - protein, 9 aa, Homo Sapiens
IEILQKAEF

SEQ ID NO: 85045 - protein, 9 aa, Homo Sapiens
IEINFPAEY

SEQ ID NO: 85046 - protein, 9 aa, Homo Sapiens
IEKEIKDVF

SEQ ID NO: 85047 - protein, 9 aa, Homo Sapiens
IELTFDEHY

SEQ ID NO: 85048 - protein, 9 aa, Homo Sapiens
IEMPCHHLF

SEQ ID NO: 85049 - protein, 9 aa, Homo Sapiens
IEMPSHQTY

SEQ ID NO: 85050 - protein, 9 aa, Homo Sapiens
IEMPYVIEF

SEQ ID NO: 85051 - protein, 9 aa, Homo Sapiens
IENAHVLLY

SEQ ID NO: 85052 - protein, 9 aa, Homo Sapiens
IENFLPLHY

SEQ ID NO: 85053 - protein, 9 aa, Homo Sapiens
IENPFGETF

SEQ ID NO: 85054 - protein, 9 aa, Homo Sapiens
IEQAYDNPH

SEQ ID NO: 85055 - protein, 9 aa, Homo Sapiens
IEQRLILQY

SEQ ID NO: 85056 - protein, 9 aa, Homo Sapiens
IERLVIQSY

SEQ ID NO: 85057 - protein, 9 aa, Homo Sapiens
IETELIYKY

SEQ ID NO: 85058 - protein, 9 aa, Homo Sapiens
IETIIKEQF

SEQ ID NO: 85059 - protein, 9 aa, Homo Sapiens
IEVEDLPQF

SEQ ID NO: 85060 - protein, 9 aa, Homo Sapiens
IEVEQALAH

SEQ ID NO: 85061 - protein, 9 aa, Homo Sapiens
IEVSLPEAA

SEQ ID NO: 85062 - protein, 9 aa, Homo Sapiens
IEWEKPEHY

SEQ ID NO: 85063 - protein, 9 aa, Homo Sapiens
IEWLIEHKY

SEQ ID NO: 85064 - protein, 9 aa, Homo Sapiens
IEYQFVERL

SEQ ID NO: 85065 - protein, 9 aa, Homo Sapiens
IRLENEIQT

SEQ ID NO: 85066 - protein, 9 aa, Homo Sapiens
KEYERFSKY

SEQ ID NO: 85067 - protein, 9 aa, Homo Sapiens
LEAPGVYVF

SEQ ID NO: 85068 - protein, 9 aa, Homo Sapiens
LEDVLPLAF

SEQ ID NO: 85069 - protein, 9 aa, Homo Sapiens
LEEPLASTY

SEQ ID NO: 85070 - protein, 9 aa, Homo Sapiens
LEFIKEIGY

SEQ ID NO: 85071 - protein, 9 aa, Homo Sapiens
LEFLHENEY

SEQ ID NO: 85072 - protein, 9 aa, Homo Sapiens
LEFPARDVY

SEQ ID NO: 85073 - protein, 9 aa, Homo Sapiens
LEFPQTSQY

SEQ ID NO: 85074 - protein, 9 aa, Homo Sapiens
LEFPSGYPY

SEQ ID NO: 85075 - protein, 9 aa, Homo Sapiens
LEFPTREVY

SEQ ID NO: 85076 - protein, 9 aa, Homo Sapiens
LEGPPLDAY

SEQ ID NO: 85077 - protein, 9 aa, Homo Sapiens
LEGPPLEAY

SEQ ID NO: 85078 - protein, 9 aa, Homo Sapiens
LEHEYIHNF

SEQ ID NO: 85079 - protein, 9 aa, Homo Sapiens
LEHEYIQNF

SEQ ID NO: 85080 - protein, 9 aa, Homo Sapiens
LEHGVVYEY

SEQ ID NO: 85081 - protein, 9 aa, Homo Sapiens
LEHNFSAIY

SEQ ID NO: 85082 - protein, 9 aa, Homo Sapiens
LEHPFVSSI

SEQ ID NO: 85083 - protein, 9 aa, Homo Sapiens
LEHSFIKRY

SEQ ID NO: 85084 - protein, 9 aa, Homo Sapiens
LEHVLPLMF

SEQ ID NO: 85085 - protein, 9 aa, Homo Sapiens
LEIKIPETY

SEQ ID NO: 85086 - protein, 9 aa, Homo Sapiens
LEILLRNGY

SEQ ID NO: 85087 - protein, 9 aa, Homo Sapiens
LEIYFPSQY

SEQ ID NO: 85088 - protein, 9 aa, Homo Sapiens
LELFLPEEY

SEQ ID NO: 85089 - protein, 9 aa, Homo Sapiens
LELLLPIRY

SEQ ID NO: 85090 - protein, 9 aa, Homo Sapiens
LELLQPHVF

SEQ ID NO: 85091 - protein, 9 aa, Homo Sapiens
LEMARTAVY

SEQ ID NO: 85092 - protein, 9 aa, Homo Sapiens
LEMEFKERF

SEQ ID NO: 85093 - protein, 9 aa, Homo Sapiens
LEMIQQECY

SEQ ID NO: 85094 - protein, 9 aa, Homo Sapiens
LEMRLQNAL

SEQ ID NO: 85095 - protein, 9 aa, Homo Sapiens
LENANPLIY

SEQ ID NO: 85096 - protein, 9 aa, Homo Sapiens
LENIFTKSY

SEQ ID NO: 85097 - protein, 9 aa, Homo Sapiens
LENLLLVHY

SEQ ID NO: 85098 - protein, 9 aa, Homo Sapiens
LENVFTPMF

SEQ ID NO: 85099 - protein, 9 aa, Homo Sapiens
LENVLAEKF

SEQ ID NO: 85100 - protein, 9 aa, Homo Sapiens
LEQEFTEHF

SEQ ID NO: 85101 - protein, 9 aa, Homo Sapiens
LEQEKRLPF

SEQ ID NO: 85102 - protein, 9 aa, Homo Sapiens
LEQELIERF

SEQ ID NO: 85103 - protein, 9 aa, Homo Sapiens
LEQEMPVQF

SEQ ID NO: 85104 - protein, 9 aa, Homo Sapiens
LEQKVVELY

SEQ ID NO: 85105 - protein, 9 aa, Homo Sapiens
LEQQVPENY

SEQ ID NO: 85106 - protein, 9 aa, Homo Sapiens
LERFVEECF

SEQ ID NO: 85107 - protein, 9 aa, Homo Sapiens
LERVLPASL

SEQ ID NO: 85108 - protein, 9 aa, Homo Sapiens
LESQFTDRY

SEQ ID NO: 85109 - protein, 9 aa, Homo Sapiens
LESVFKTEF

SEQ ID NO: 85110 - protein, 9 aa, Homo Sapiens
LETCHFQAF

SEQ ID NO: 85111 - protein, 9 aa, Homo Sapiens
LETLFVHRF

SEQ ID NO: 85112 - protein, 9 aa, Homo Sapiens
LEVIIPERY

SEQ ID NO: 85113 - protein, 9 aa, Homo Sapiens
LEVILPSVH

SEQ ID NO: 85114 - protein, 9 aa, Homo Sapiens
LEVLRVTAF

SEQ ID NO: 85115 - protein, 9 aa, Homo Sapiens
LEVMTAKYE

SEQ ID NO: 85116 - protein, 9 aa, Homo Sapiens
LEVSLLEKY

SEQ ID NO: 85117 - protein, 9 aa, Homo Sapiens
LEWLMPNRF

SEQ ID NO: 85118 - protein, 9 aa, Homo Sapiens
LEYDFPEKF

SEQ ID NO: 85119 - protein, 9 aa, Homo Sapiens
LEYIHEHEY

SEQ ID NO: 85120 - protein, 9 aa, Homo Sapiens
LEYIHENEY

SEQ ID NO: 85121 - protein, 9 aa, Homo Sapiens
LEYLIKHNY

SEQ ID NO: 85122 - protein, 9 aa, Homo Sapiens
LEYQYMLEH

SEQ ID NO: 85123 - protein, 9 aa, Homo Sapiens
LFAGELNPV

SEQ ID NO: 85124 - protein, 9 aa, Homo Sapiens
LIEFIRSEY

SEQ ID NO: 85125 - protein, 9 aa, Homo Sapiens
LMEALIISK

SEQ ID NO: 85126 - protein, 9 aa, Homo Sapiens
LQIDNARLA

SEQ ID NO: 85127 - protein, 9 aa, Homo Sapiens
LSGNNVVEY

SEQ ID NO: 85128 - protein, 9 aa, Homo Sapiens
MEAFHFVSY

SEQ ID NO: 85129 - protein, 9 aa, Homo Sapiens
MEAKVENEY

SEQ ID NO: 85130 - protein, 9 aa, Homo Sapiens
MEALLQTRY

SEQ ID NO: 85131 - protein, 9 aa, Homo Sapiens
MEAPAAGLF

SEQ ID NO: 85132 - protein, 9 aa, Homo Sapiens
MEDEMKEYY

SEQ ID NO: 85133 - protein, 9 aa, Homo Sapiens
MEDLIHEIY

SEQ ID NO: 85134 - protein, 9 aa, Homo Sapiens
MEELFQSSF

SEQ ID NO: 85135 - protein, 9 aa, Homo Sapiens
MEFERQAEI

SEQ ID NO: 85136 - protein, 9 aa, Homo Sapiens
MEFQNTQSY

SEQ ID NO: 85137 - protein, 9 aa, Homo Sapiens
MEFSLKDLY

SEQ ID NO: 85138 - protein, 9 aa, Homo Sapiens
MEHPYFYTV

SEQ ID NO: 85139 - protein, 9 aa, Homo Sapiens
MEIDIPHVW

SEQ ID NO: 85140 - protein, 9 aa, Homo Sapiens
MEIGKTETF

SEQ ID NO: 85141 - protein, 9 aa, Homo Sapiens
MEIGMKVAL

SEQ ID NO: 85142 - protein, 9 aa, Homo Sapiens
MEKIWHHTF

SEQ ID NO: 85143 - protein, 9 aa, Homo Sapiens
MEKSFLEYY

SEQ ID NO: 85144 - protein, 9 aa, Homo Sapiens
MEKSFSDLF

SEQ ID NO: 85145 - protein, 9 aa, Homo Sapiens
MELEAMSRY

SEQ ID NO: 85146 - protein, 9 aa, Homo Sapiens
MELQQKAEF

SEQ ID NO: 85147 - protein, 9 aa, Homo Sapiens
MEMPSFYSH

SEQ ID NO: 85148 - protein, 9 aa, Homo Sapiens
MENLFINRF

SEQ ID NO: 85149 - protein, 9 aa, Homo Sapiens
MENLPLPEY

SEQ ID NO: 85150 - protein, 9 aa, Homo Sapiens
MENPFVQSM

SEQ ID NO: 85151 - protein, 9 aa, Homo Sapiens
MENRPVETY

SEQ ID NO: 85152 - protein, 9 aa, Homo Sapiens
MENTFVNSL

SEQ ID NO: 85153 - protein, 9 aa, Homo Sapiens
MERLIEFAY

SEQ ID NO: 85154 - protein, 9 aa, Homo Sapiens
MERSLPLCL

SEQ ID NO: 85155 - protein, 9 aa, Homo Sapiens
MESMLISGY

SEQ ID NO: 85156 - protein, 9 aa, Homo Sapiens
MESNLIITY

SEQ ID NO: 85157 - protein, 9 aa, Homo Sapiens
MESVVVSEY

SEQ ID NO: 85158 - protein, 9 aa, Homo Sapiens
METAVPVYF

SEQ ID NO: 85159 - protein, 9 aa, Homo Sapiens
METPSIAAH

SEQ ID NO: 85160 - protein, 9 aa, Homo Sapiens
MEVELPAAA

SEQ ID NO: 85161 - protein, 9 aa, Homo Sapiens
MEVELPYRY

SEQ ID NO: 85162 - protein, 9 aa, Homo Sapiens
MEVETICRY

SEQ ID NO: 85163 - protein, 9 aa, Homo Sapiens
MEVFLPQSY

SEQ ID NO: 85164 - protein, 9 aa, Homo Sapiens
MEVPTYLNF

SEQ ID NO: 85165 - protein, 9 aa, Homo Sapiens
MEWDKIWAF

SEQ ID NO: 85166 - protein, 9 aa, Homo Sapiens
MEYGDFVRY

SEQ ID NO: 85167 - protein, 9 aa, Homo Sapiens
MEYPNFEET

SEQ ID NO: 85168 - protein, 9 aa, Homo Sapiens
MPYLEHESF

SEQ ID NO: 85169 - protein, 9 aa, Homo Sapiens
MTAAEISKY

SEQ ID NO: 85170 - protein, 9 aa, Homo Sapiens
NAFEELVAF

SEQ ID NO: 85171 - protein, 9 aa, Homo Sapiens
NAWDKEPVL

SEQ ID NO: 85172 - protein, 9 aa, Homo Sapiens
NDVLVPKPF

SEQ ID NO: 85173 - protein, 9 aa, Homo Sapiens
NEAAYPQSF

SEQ ID NO: 85174 - protein, 9 aa, Homo Sapiens
NEADRTLIY

SEQ ID NO: 85175 - protein, 9 aa, Homo Sapiens
NEALLGELF

SEQ ID NO: 85176 - protein, 9 aa, Homo Sapiens
NEALYDICF

SEQ ID NO: 85177 - protein, 9 aa, Homo Sapiens
NEAPVYSVY

SEQ ID NO: 85178 - protein, 9 aa, Homo Sapiens
NEAQCNTAY

SEQ ID NO: 85179 - protein, 9 aa, Homo Sapiens
NEAVLHLRF

SEQ ID NO: 85180 - protein, 9 aa, Homo Sapiens
NEAVYLVRF

SEQ ID NO: 85181 - protein, 9 aa, Homo Sapiens
NECERHVIF

SEQ ID NO: 85182 - protein, 9 aa, Homo Sapiens
NECGKAFSY

SEQ ID NO: 85183 - protein, 9 aa, Homo Sapiens
NECGKAFTY

SEQ ID NO: 85184 - protein, 9 aa, Homo Sapiens
NECGKAFVY

SEQ ID NO: 85185 - protein, 9 aa, Homo Sapiens
NEEMLCQEF

SEQ ID NO: 85186 - protein, 9 aa, Homo Sapiens
NEERLVISH

SEQ ID NO: 85187 - protein, 9 aa, Homo Sapiens
NEFDRTIAE

SEQ ID NO: 85188 - protein, 9 aa, Homo Sapiens
NEFGKALLY

SEQ ID NO: 85189 - protein, 9 aa, Homo Sapiens
NEFGLVENY

SEQ ID NO: 85190 - protein, 9 aa, Homo Sapiens
NEFIFCHDF

SEQ ID NO: 85191 - protein, 9 aa, Homo Sapiens
NEFKEWQYF

SEQ ID NO: 85192 - protein, 9 aa, Homo Sapiens
NEFKNRDKY

SEQ ID NO: 85193 - protein, 9 aa, Homo Sapiens
NEFLLKNNY

SEQ ID NO: 85194 - protein, 9 aa, Homo Sapiens
NEFLLLHAF

SEQ ID NO: 85195 - protein, 9 aa, Homo Sapiens
NEFLRELSF

SEQ ID NO: 85196 - protein, 9 aa, Homo Sapiens
NEFLSPEVF

SEQ ID NO: 85197 - protein, 9 aa, Homo Sapiens
NEFNFPDPY

SEQ ID NO: 85198 - protein, 9 aa, Homo Sapiens
NEFPNPAAH

SEQ ID NO: 85199 - protein, 9 aa, Homo Sapiens
NEFPVFDEF

SEQ ID NO: 85200 - protein, 9 aa, Homo Sapiens
NEFPVPEQF

SEQ ID NO: 85201 - protein, 9 aa, Homo Sapiens
NEFQGAEAM

SEQ ID NO: 85202 - protein, 9 aa, Homo Sapiens
NEFTAEQCF

SEQ ID NO: 85203 - protein, 9 aa, Homo Sapiens
NEFVRQLEF

SEQ ID NO: 85204 - protein, 9 aa, Homo Sapiens
NEHGMETAL

SEQ ID NO: 85205 - protein, 9 aa, Homo Sapiens
NEHVLSAGF

SEQ ID NO: 85206 - protein, 9 aa, Homo Sapiens
NEIAFINTL

SEQ ID NO: 85207 - protein, 9 aa, Homo Sapiens
NEIAQCEVF

SEQ ID NO: 85208 - protein, 9 aa, Homo Sapiens
NEIGIPMVF

SEQ ID NO: 85209 - protein, 9 aa, Homo Sapiens
NEIIFPHCA

SEQ ID NO: 85210 - protein, 9 aa, Homo Sapiens
NEIIKPAKY

SEQ ID NO: 85211 - protein, 9 aa, Homo Sapiens
NEILVADTY

SEQ ID NO: 85212 - protein, 9 aa, Homo Sapiens
NEITIPVTF

SEQ ID NO: 85213 - protein, 9 aa, Homo Sapiens
NEIVLKVNY

SEQ ID NO: 85214 - protein, 9 aa, Homo Sapiens
NEKALEAVF

SEQ ID NO: 85215 - protein, 9 aa, Homo Sapiens
NEKTTKVSY

SEQ ID NO: 85216 - protein, 9 aa, Homo Sapiens
NEKVLPLAY

SEQ ID NO: 85217 - protein, 9 aa, Homo Sapiens
NELEIPGQY

SEQ ID NO: 85218 - protein, 9 aa, Homo Sapiens
NELERNITI

SEQ ID NO: 85219 - protein, 9 aa, Homo Sapiens
NELGVVVAH

SEQ ID NO: 85220 - protein, 9 aa, Homo Sapiens
NELIIPCIH

SEQ ID NO: 85221 - protein, 9 aa, Homo Sapiens
NELLEPNSF

SEQ ID NO: 85222 - protein, 9 aa, Homo Sapiens
NELNIIHKF

SEQ ID NO: 85223 - protein, 9 aa, Homo Sapiens
NELQRKDAL

SEQ ID NO: 85224 - protein, 9 aa, Homo Sapiens
NELRIVVEH

SEQ ID NO: 85225 - protein, 9 aa, Homo Sapiens
NELVRISSM

SEQ ID NO: 85226 - protein, 9 aa, Homo Sapiens
NELVSTHGY

SEQ ID NO: 85227 - protein, 9 aa, Homo Sapiens
NEMALVQEL

SEQ ID NO: 85228 - protein, 9 aa, Homo Sapiens
NEMIVTGQY

SEQ ID NO: 85229 - protein, 9 aa, Homo Sapiens
NEMLVKSQF

SEQ ID NO: 85230 - protein, 9 aa, Homo Sapiens
NENARLLTF

SEQ ID NO: 85231 - protein, 9 aa, Homo Sapiens
NENCFLVQH

SEQ ID NO: 85232 - protein, 9 aa, Homo Sapiens
NENDIITHF

SEQ ID NO: 85233 - protein, 9 aa, Homo Sapiens
NENDIRVMF

SEQ ID NO: 85234 - protein, 9 aa, Homo Sapiens
NENGHTPLM

SEQ ID NO: 85235 - protein, 9 aa, Homo Sapiens
NENHFPVIY

SEQ ID NO: 85236 - protein, 9 aa, Homo Sapiens
NENKFYNVH

SEQ ID NO: 85237 - protein, 9 aa, Homo Sapiens
NENLKKVAF

SEQ ID NO: 85238 - protein, 9 aa, Homo Sapiens
NENPLRALY

SEQ ID NO: 85239 - protein, 9 aa, Homo Sapiens
NEPELLVAH

SEQ ID NO: 85240 - protein, 9 aa, Homo Sapiens
NEQAFEEVF

SEQ ID NO: 85241 - protein, 9 aa, Homo Sapiens
NEQDLGIQY

SEQ ID NO: 85242 - protein, 9 aa, Homo Sapiens
NEQRLSNQF

SEQ ID NO: 85243 - protein, 9 aa, Homo Sapiens
NERLELEAY

SEQ ID NO: 85244 - protein, 9 aa, Homo Sapiens
NERLFDEKY

SEQ ID NO: 85245 - protein, 9 aa, Homo Sapiens
NERLISMAY

SEQ ID NO: 85246 - protein, 9 aa, Homo Sapiens
NESAERLLY

SEQ ID NO: 85247 - protein, 9 aa, Homo Sapiens
NESEEVRQF

SEQ ID NO: 85248 - protein, 9 aa, Homo Sapiens
NESEPIVVY

SEQ ID NO: 85249 - protein, 9 aa, Homo Sapiens
NESGVLLHF

SEQ ID NO: 85250 - protein, 9 aa, Homo Sapiens
NESKQEVSY

SEQ ID NO: 85251 - protein, 9 aa, Homo Sapiens
NESLVPDAY

SEQ ID NO: 85252 - protein, 9 aa, Homo Sapiens
NESSYLISH

SEQ ID NO: 85253 - protein, 9 aa, Homo Sapiens
NETDILSQY

SEQ ID NO: 85254 - protein, 9 aa, Homo Sapiens
NETLIVSKF

SEQ ID NO: 85255 - protein, 9 aa, Homo Sapiens
NETRSIIEF

SEQ ID NO: 85256 - protein, 9 aa, Homo Sapiens
NETVMPSAL

SEQ ID NO: 85257 - protein, 9 aa, Homo Sapiens
NEVDSTLTF

SEQ ID NO: 85258 - protein, 9 aa, Homo Sapiens
NEVEALRAM

SEQ ID NO: 85259 - protein, 9 aa, Homo Sapiens
NEVEKCTKY

SEQ ID NO: 85260 - protein, 9 aa, Homo Sapiens
NEVEKQWRL

SEQ ID NO: 85261 - protein, 9 aa, Homo Sapiens
NEVEQLLYY

SEQ ID NO: 85262 - protein, 9 aa, Homo Sapiens
NEVEQRHTL

SEQ ID NO: 85263 - protein, 9 aa, Homo Sapiens
NEVERTQAL

SEQ ID NO: 85264 - protein, 9 aa, Homo Sapiens
NEVIMTIGF

SEQ ID NO: 85265 - protein, 9 aa, Homo Sapiens
NEVLSITAM

SEQ ID NO: 85266 - protein, 9 aa, Homo Sapiens
NEVPEVTVF

SEQ ID NO: 85267 - protein, 9 aa, Homo Sapiens
NEWARYLYY

SEQ ID NO: 85268 - protein, 9 aa, Homo Sapiens
NEWDKIPSM

SEQ ID NO: 85269 - protein, 9 aa, Homo Sapiens
NEWSLKAEY

SEQ ID NO: 85270 - protein, 9 aa, Homo Sapiens
NEWSVPHCF

SEQ ID NO: 85271 - protein, 9 aa, Homo Sapiens
NEYESRSLW

SEQ ID NO: 85272 - protein, 9 aa, Homo Sapiens
NEYLLPESV

SEQ ID NO: 85273 - protein, 9 aa, Homo Sapiens
NEYPSRVAF

SEQ ID NO: 85274 - protein, 9 aa, Homo Sapiens
NEYPTPRSY

SEQ ID NO: 85275 - protein, 9 aa, Homo Sapiens
NEYRSVVYY

SEQ ID NO: 85276 - protein, 9 aa, Homo Sapiens
NEYSKVLQF

SEQ ID NO: 85277 - protein, 9 aa, Homo Sapiens
NEYSNIEEF

SEQ ID NO: 85278 - protein, 9 aa, Homo Sapiens
NQVIFPVSY

SEQ ID NO: 85279 - protein, 9 aa, Homo Sapiens
NVYKDEYNS

SEQ ID NO: 85280 - protein, 9 aa, Homo Sapiens
PEFMLPVHF

SEQ ID NO: 85281 - protein, 9 aa, Homo Sapiens
QECDKAFKY

SEQ ID NO: 85282 - protein, 9 aa, Homo Sapiens
QEDPLPLAF

SEQ ID NO: 85283 - protein, 9 aa, Homo Sapiens
QEEILRVPF

SEQ ID NO: 85284 - protein, 9 aa, Homo Sapiens
QEFDFIKSY

SEQ ID NO: 85285 - protein, 9 aa, Homo Sapiens
QEFGVPHQY

SEQ ID NO: 85286 - protein, 9 aa, Homo Sapiens
QEFLTKLAF

SEQ ID NO: 85287 - protein, 9 aa, Homo Sapiens
QEFNLPVRY

SEQ ID NO: 85288 - protein, 9 aa, Homo Sapiens
QEFPGSPAF

SEQ ID NO: 85289 - protein, 9 aa, Homo Sapiens
QEFPWEEEY

SEQ ID NO: 85290 - protein, 9 aa, Homo Sapiens
QEHELIESM

SEQ ID NO: 85291 - protein, 9 aa, Homo Sapiens
QEHFLIVPF

SEQ ID NO: 85292 - protein, 9 aa, Homo Sapiens
QELEIPQAY

SEQ ID NO: 85293 - protein, 9 aa, Homo Sapiens
QELLIYEAF

SEQ ID NO: 85294 - protein, 9 aa, Homo Sapiens
QELLLGKEF

SEQ ID NO: 85295 - protein, 9 aa, Homo Sapiens
QENIFPNRY

SEQ ID NO: 85296 - protein, 9 aa, Homo Sapiens
QENSVYLSY

SEQ ID NO: 85297 - protein, 9 aa, Homo Sapiens
QETQLIHVY

SEQ ID NO: 85298 - protein, 9 aa, Homo Sapiens
QEVETSVTY

SEQ ID NO: 85299 - protein, 9 aa, Homo Sapiens
QEVPIIIVF

SEQ ID NO: 85300 - protein, 9 aa, Homo Sapiens
QEVQPITSY

SEQ ID NO: 85301 - protein, 9 aa, Homo Sapiens
QEYEFEKQF

SEQ ID NO: 85302 - protein, 9 aa, Homo Sapiens
QEYLFQEQY

SEQ ID NO: 85303 - protein, 9 aa, Homo Sapiens
QEYPAIVEF

SEQ ID NO: 85304 - protein, 9 aa, Homo Sapiens
QLAGVKQQL

SEQ ID NO: 85305 - protein, 9 aa, Homo Sapiens
REFELEESY

SEQ ID NO: 85306 - protein, 9 aa, Homo Sapiens
REFNKYLAY

SEQ ID NO: 85307 - protein, 9 aa, Homo Sapiens
REFPKFFTF

SEQ ID NO: 85308 - protein, 9 aa, Homo Sapiens
RENDTITIY

SEQ ID NO: 85309 - protein, 9 aa, Homo Sapiens
REVELGLEY

SEQ ID NO: 85310 - protein, 9 aa, Homo Sapiens
REVQLPTCH

SEQ ID NO: 85311 - protein, 9 aa, Homo Sapiens
SDVEVPASV

SEQ ID NO: 85312 - protein, 9 aa, Homo Sapiens
SEAAYKEAF

SEQ ID NO: 85313 - protein, 9 aa, Homo Sapiens
SEASVFDAY

SEQ ID NO: 85314 - protein, 9 aa, Homo Sapiens
SECSFPFKY

SEQ ID NO: 85315 - protein, 9 aa, Homo Sapiens
SEDEIKKAY

SEQ ID NO: 85316 - protein, 9 aa, Homo Sapiens
SEDLLKEHY

SEQ ID NO: 85317 - protein, 9 aa, Homo Sapiens
SEEEIREAF

SEQ ID NO: 85318 - protein, 9 aa, Homo Sapiens
SEEELKKAY

SEQ ID NO: 85319 - protein, 9 aa, Homo Sapiens
SEELLREHY

SEQ ID NO: 85320 - protein, 9 aa, Homo Sapiens
SEFALRPTF

SEQ ID NO: 85321 - protein, 9 aa, Homo Sapiens
SEFELLRSY

SEQ ID NO: 85322 - protein, 9 aa, Homo Sapiens
SEFEMKVYY

SEQ ID NO: 85323 - protein, 9 aa, Homo Sapiens
SEFESKVSA

SEQ ID NO: 85324 - protein, 9 aa, Homo Sapiens
SEFGLKISF

SEQ ID NO: 85325 - protein, 9 aa, Homo Sapiens
SEFGNHYLY

SEQ ID NO: 85326 - protein, 9 aa, Homo Sapiens
SEFICRNTF

SEQ ID NO: 85327 - protein, 9 aa, Homo Sapiens
SEFLGFTSY

SEQ ID NO: 85328 - protein, 9 aa, Homo Sapiens
SEFPGAQHY

SEQ ID NO: 85329 - protein, 9 aa, Homo Sapiens
SEFQRLLGF

SEQ ID NO: 85330 - protein, 9 aa, Homo Sapiens
SEFRAFSSF

SEQ ID NO: 85331 - protein, 9 aa, Homo Sapiens
SEFTGVWKY

SEQ ID NO: 85332 - protein, 9 aa, Homo Sapiens
SEFVIPSVY

SEQ ID NO: 85333 - protein, 9 aa, Homo Sapiens
SEFWLPDTF

SEQ ID NO: 85334 - protein, 9 aa, Homo Sapiens
SEGPPLTSF

SEQ ID NO: 85335 - protein, 9 aa, Homo Sapiens
SEHAQMVAF

SEQ ID NO: 85336 - protein, 9 aa, Homo Sapiens
SEHEHFTDF

SEQ ID NO: 85337 - protein, 9 aa, Homo Sapiens
SEHELDVAL

SEQ ID NO: 85338 - protein, 9 aa, Homo Sapiens
SEHMLPTAL

SEQ ID NO: 85339 - protein, 9 aa, Homo Sapiens
SEHSIIKDF

SEQ ID NO: 85340 - protein, 9 aa, Homo Sapiens
SEHVFDHPW

SEQ ID NO: 85341 - protein, 9 aa, Homo Sapiens
SEHVFQILF

SEQ ID NO: 85342 - protein, 9 aa, Homo Sapiens
SEIEAKVRY

SEQ ID NO: 85343 - protein, 9 aa, Homo Sapiens
SEIELFRVF

SEQ ID NO: 85344 - protein, 9 aa, Homo Sapiens
SEIFLHESY

SEQ ID NO: 85345 - protein, 9 aa, Homo Sapiens
SELHEHAAY

SEQ ID NO: 85346 - protein, 9 aa, Homo Sapiens
SELLWQVAY

SEQ ID NO: 85347 - protein, 9 aa, Homo Sapiens
SELSDLHAH

SEQ ID NO: 85348 - protein, 9 aa, Homo Sapiens
SEMEMAHLY

SEQ ID NO: 85349 - protein, 9 aa, Homo Sapiens
SEMILVLEY

SEQ ID NO: 85350 - protein, 9 aa, Homo Sapiens
SEMLQLCSY

SEQ ID NO: 85351 - protein, 9 aa, Homo Sapiens
SENDMRFVY

SEQ ID NO: 85352 - protein, 9 aa, Homo Sapiens
SENELKKAY

SEQ ID NO: 85353 - protein, 9 aa, Homo Sapiens
SENKLPAEL

SEQ ID NO: 85354 - protein, 9 aa, Homo Sapiens
SENPMTETF

SEQ ID NO: 85355 - protein, 9 aa, Homo Sapiens
SEREAIEVF

SEQ ID NO: 85356 - protein, 9 aa, Homo Sapiens
SESPIVVVL

SEQ ID NO: 85357 - protein, 9 aa, Homo Sapiens
SESTAIISY

SEQ ID NO: 85358 - protein, 9 aa, Homo Sapiens
SETALETTY

SEQ ID NO: 85359 - protein, 9 aa, Homo Sapiens
SETALPGAF

SEQ ID NO: 85360 - protein, 9 aa, Homo Sapiens
SETAMFSVY

SEQ ID NO: 85361 - protein, 9 aa, Homo Sapiens
SETELKDTY

SEQ ID NO: 85362 - protein, 9 aa, Homo Sapiens
SETTLQSTY

SEQ ID NO: 85363 - protein, 9 aa, Homo Sapiens
SETVLNLAF

SEQ ID NO: 85364 - protein, 9 aa, Homo Sapiens
SEVALQTAL

SEQ ID NO: 85365 - protein, 9 aa, Homo Sapiens
SEVILHHEY

SEQ ID NO: 85366 - protein, 9 aa, Homo Sapiens
SEVILPVPA

SEQ ID NO: 85367 - protein, 9 aa, Homo Sapiens
SEWDGIVTV

SEQ ID NO: 85368 - protein, 9 aa, Homo Sapiens
SEYFYQEEF

SEQ ID NO: 85369 - protein, 9 aa, Homo Sapiens
SEYGSIIAF

SEQ ID NO: 85370 - protein, 9 aa, Homo Sapiens
SEYLYQEQY

SEQ ID NO: 85371 - protein, 9 aa, Homo Sapiens
SEYNNFKSM

SEQ ID NO: 85372 - protein, 9 aa, Homo Sapiens
SEYQRFAVM

SEQ ID NO: 85373 - protein, 9 aa, Homo Sapiens
SEYRFPEEL

SEQ ID NO: 85374 - protein, 9 aa, Homo Sapiens
SEYRWHINF

SEQ ID NO: 85375 - protein, 9 aa, Homo Sapiens
STPTLIPAF

SEQ ID NO: 85376 - protein, 9 aa, Homo Sapiens
TEAMLYEKF

SEQ ID NO: 85377 - protein, 9 aa, Homo Sapiens
TEEAIIYSY

SEQ ID NO: 85378 - protein, 9 aa, Homo Sapiens
TEEELKVAH

SEQ ID NO: 85379 - protein, 9 aa, Homo Sapiens
TEEILEKAF

SEQ ID NO: 85380 - protein, 9 aa, Homo Sapiens
TEEPLKQSF

SEQ ID NO: 85381 - protein, 9 aa, Homo Sapiens
TEETLKESF

SEQ ID NO: 85382 - protein, 9 aa, Homo Sapiens
TEETLQEVF

SEQ ID NO: 85383 - protein, 9 aa, Homo Sapiens
TEFDSTVTH

SEQ ID NO: 85384 - protein, 9 aa, Homo Sapiens
TEFGAFVGH

SEQ ID NO: 85385 - protein, 9 aa, Homo Sapiens
TEFGGVTQH

SEQ ID NO: 85386 - protein, 9 aa, Homo Sapiens
TEFNGIRDY

SEQ ID NO: 85387 - protein, 9 aa, Homo Sapiens
TEFPIIKMY

SEQ ID NO: 85388 - protein, 9 aa, Homo Sapiens
TEFPSKQVF

SEQ ID NO: 85389 - protein, 9 aa, Homo Sapiens
TEFQFRGGF

SEQ ID NO: 85390 - protein, 9 aa, Homo Sapiens
TEFRNFIVW

SEQ ID NO: 85391 - protein, 9 aa, Homo Sapiens
TEFSLPKFY

SEQ ID NO: 85392 - protein, 9 aa, Homo Sapiens
TEHDVNVAF

SEQ ID NO: 85393 - protein, 9 aa, Homo Sapiens
TEHEIQEWY

SEQ ID NO: 85394 - protein, 9 aa, Homo Sapiens
TEHWLVRIY

SEQ ID NO: 85395 - protein, 9 aa, Homo Sapiens
TEIDPICAL

SEQ ID NO: 85396 - protein, 9 aa, Homo Sapiens
TEIEHKVAF

SEQ ID NO: 85397 - protein, 9 aa, Homo Sapiens
TEIEKGSSY

SEQ ID NO: 85398 - protein, 9 aa, Homo Sapiens
TEIERLITW

SEQ ID NO: 85399 - protein, 9 aa, Homo Sapiens
TEIKVGVAY

SEQ ID NO: 85400 - protein, 9 aa, Homo Sapiens
TEILIPEAL

SEQ ID NO: 85401 - protein, 9 aa, Homo Sapiens
TEIQLVQSL

SEQ ID NO: 85402 - protein, 9 aa, Homo Sapiens
TEIRHEVSF

SEQ ID NO: 85403 - protein, 9 aa, Homo Sapiens
TEITKGWLY

SEQ ID NO: 85404 - protein, 9 aa, Homo Sapiens
TELERKLTF

SEQ ID NO: 85405 - protein, 9 aa, Homo Sapiens
TELERSLEY

SEQ ID NO: 85406 - protein, 9 aa, Homo Sapiens
TELLLKEGF

SEQ ID NO: 85407 - protein, 9 aa, Homo Sapiens
TELPLTVSY

SEQ ID NO: 85408 - protein, 9 aa, Homo Sapiens
TELPLVEKF

SEQ ID NO: 85409 - protein, 9 aa, Homo Sapiens
TELPQFVSY

SEQ ID NO: 85410 - protein, 9 aa, Homo Sapiens
TELQLHEAF

SEQ ID NO: 85411 - protein, 9 aa, Homo Sapiens
TELSFSREY

SEQ ID NO: 85412 - protein, 9 aa, Homo Sapiens
TEMIHEAAY

SEQ ID NO: 85413 - protein, 9 aa, Homo Sapiens
TENDHVLLF

SEQ ID NO: 85414 - protein, 9 aa, Homo Sapiens
TENDIRVMF

SEQ ID NO: 85415 - protein, 9 aa, Homo Sapiens
TENKLYLVF

SEQ ID NO: 85416 - protein, 9 aa, Homo Sapiens
TENVVVCQY

SEQ ID NO: 85417 - protein, 9 aa, Homo Sapiens
TEPELLVAH

SEQ ID NO: 85418 - protein, 9 aa, Homo Sapiens
TEQDLKEYF

SEQ ID NO: 85419 - protein, 9 aa, Homo Sapiens
TEQTVKVAF

SEQ ID NO: 85420 - protein, 9 aa, Homo Sapiens
TESELQQSY

SEQ ID NO: 85421 - protein, 9 aa, Homo Sapiens
TETETIAKY

SEQ ID NO: 85422 - protein, 9 aa, Homo Sapiens
TETLIKAVY

SEQ ID NO: 85423 - protein, 9 aa, Homo Sapiens
TETQVKIWF

SEQ ID NO: 85424 - protein, 9 aa, Homo Sapiens
TEVAIVVKY

SEQ ID NO: 85425 - protein, 9 aa, Homo Sapiens
TEVEMKEIY

SEQ ID NO: 85426 - protein, 9 aa, Homo Sapiens
TEVNMARVY

SEQ ID NO: 85427 - protein, 9 aa, Homo Sapiens
TFEIIVHQY

SEQ ID NO: 85428 - protein, 9 aa, Homo Sapiens
VAPGKDLTK

SEQ ID NO: 85429 - protein, 9 aa, Homo Sapiens
VDVQIPECF

SEQ ID NO: 85430 - protein, 9 aa, Homo Sapiens
VEAETTTTF

SEQ ID NO: 85431 - protein, 9 aa, Homo Sapiens
VEAPMREEY

SEQ ID NO: 85432 - protein, 9 aa, Homo Sapiens
VEDIIHESY

SEQ ID NO: 85433 - protein, 9 aa, Homo Sapiens
VEEILSVAY

SEQ ID NO: 85434 - protein, 9 aa, Homo Sapiens
VEELERWVY

SEQ ID NO: 85435 - protein, 9 aa, Homo Sapiens
VEFESQTYY

SEQ ID NO: 85436 - protein, 9 aa, Homo Sapiens
VEFHDLVTF

SEQ ID NO: 85437 - protein, 9 aa, Homo Sapiens
VEFILEPLY

SEQ ID NO: 85438 - protein, 9 aa, Homo Sapiens
VEFNHAINY

SEQ ID NO: 85439 - protein, 9 aa, Homo Sapiens
VEFPYQYDF

SEQ ID NO: 85440 - protein, 9 aa, Homo Sapiens
VEFQEAQAY

SEQ ID NO: 85441 - protein, 9 aa, Homo Sapiens
VEFSGKPAA

SEQ ID NO: 85442 - protein, 9 aa, Homo Sapiens
VEFTCHTAF

SEQ ID NO: 85443 - protein, 9 aa, Homo Sapiens
VEHIIREDY

SEQ ID NO: 85444 - protein, 9 aa, Homo Sapiens
VEHILKIGY

SEQ ID NO: 85445 - protein, 9 aa, Homo Sapiens
VEIEFLPVY

SEQ ID NO: 85446 - protein, 9 aa, Homo Sapiens
VEIEYVEKY

SEQ ID NO: 85447 - protein, 9 aa, Homo Sapiens
VEISLGRVF

SEQ ID NO: 85448 - protein, 9 aa, Homo Sapiens
VEIYDRREY

SEQ ID NO: 85449 - protein, 9 aa, Homo Sapiens
VEKALQAAY

SEQ ID NO: 85450 - protein, 9 aa, Homo Sapiens
VELKNGETY

SEQ ID NO: 85451 - protein, 9 aa, Homo Sapiens
VELLMHNDY

SEQ ID NO: 85452 - protein, 9 aa, Homo Sapiens
VENIFHVSF

SEQ ID NO: 85453 - protein, 9 aa, Homo Sapiens
VENLLHRTY

SEQ ID NO: 85454 - protein, 9 aa, Homo Sapiens
VERIMSETY

SEQ ID NO: 85455 - protein, 9 aa, Homo Sapiens
VERKFVDKY

SEQ ID NO: 85456 - protein, 9 aa, Homo Sapiens
VERVIVVSM

SEQ ID NO: 85457 - protein, 9 aa, Homo Sapiens
VESELLHTY

SEQ ID NO: 85458 - protein, 9 aa, Homo Sapiens
VESPLSVSF

SEQ ID NO: 85459 - protein, 9 aa, Homo Sapiens
VETDGFISY

SEQ ID NO: 85460 - protein, 9 aa, Homo Sapiens
VETKIDVSY

SEQ ID NO: 85461 - protein, 9 aa, Homo Sapiens
VETNLPLAM

SEQ ID NO: 85462 - protein, 9 aa, Homo Sapiens
VEVQLPELF

SEQ ID NO: 85463 - protein, 9 aa, Homo Sapiens
VEWEGTTPY

SEQ ID NO: 85464 - protein, 9 aa, Homo Sapiens
VEYQMKSVL

SEQ ID NO: 85465 - protein, 9 aa, Homo Sapiens
WENSFVSVY

SEQ ID NO: 85466 - protein, 9 aa, Homo Sapiens
YEANLPENF

SEQ ID NO: 85467 - protein, 9 aa, Homo Sapiens
YEAVPVEAY

SEQ ID NO: 85468 - protein, 9 aa, Homo Sapiens
YEAYLPETF

SEQ ID NO: 85469 - protein, 9 aa, Homo Sapiens
YEDGSIRIF

SEQ ID NO: 85470 - protein, 9 aa, Homo Sapiens
YEEMLKEGY

SEQ ID NO: 85471 - protein, 9 aa, Homo Sapiens
YEEQFVTLF

SEQ ID NO: 85472 - protein, 9 aa, Homo Sapiens
YEFDLIDGY

SEQ ID NO: 85473 - protein, 9 aa, Homo Sapiens
YEFERTTSI

SEQ ID NO: 85474 - protein, 9 aa, Homo Sapiens
YEFFNEQKY

SEQ ID NO: 85475 - protein, 9 aa, Homo Sapiens
YEFPHLQNF

SEQ ID NO: 85476 - protein, 9 aa, Homo Sapiens
YEHAQTYYY

SEQ ID NO: 85477 - protein, 9 aa, Homo Sapiens
YEHFYEVAY

SEQ ID NO: 85478 - protein, 9 aa, Homo Sapiens
YEHLQQYSY

SEQ ID NO: 85479 - protein, 9 aa, Homo Sapiens
YEHNFQIMY

SEQ ID NO: 85480 - protein, 9 aa, Homo Sapiens
YEHRYVELF

SEQ ID NO: 85481 - protein, 9 aa, Homo Sapiens
YEKDFQSCF

SEQ ID NO: 85482 - protein, 9 aa, Homo Sapiens
YELEKLWTL

SEQ ID NO: 85483 - protein, 9 aa, Homo Sapiens
YELLMPHRI

SEQ ID NO: 85484 - protein, 9 aa, Homo Sapiens
YELPWVEKY

SEQ ID NO: 85485 - protein, 9 aa, Homo Sapiens
YENIIVHTY

SEQ ID NO: 85486 - protein, 9 aa, Homo Sapiens
YERALDVDY

SEQ ID NO: 85487 - protein, 9 aa, Homo Sapiens
YERRLIEKY

SEQ ID NO: 85488 - protein, 9 aa, Homo Sapiens
YESPRKICY

SEQ ID NO: 85489 - protein, 9 aa, Homo Sapiens
YETCYVTSH

SEQ ID NO: 85490 - protein, 9 aa, Homo Sapiens
YEWVNPAAY

SEQ ID NO: 85491 - protein, 9 aa, Homo Sapiens
YEYCIKEGY

SEQ ID NO: 85492 - protein, 10 aa, Homo Sapiens
DEAKSLIERY

SEQ ID NO: 85493 - protein, 10 aa, Homo Sapiens
DEAPVLDVRY

SEQ ID NO: 85494 - protein, 10 aa, Homo Sapiens
DEDTGTFRIY

SEQ ID NO: 85495 - protein, 10 aa, Homo Sapiens
DEEAGGRPAM

SEQ ID NO: 85496 - protein, 10 aa, Homo Sapiens
DEFEQGTYIY

SEQ ID NO: 85497 - protein, 10 aa, Homo Sapiens
DEFPGSSATY

SEQ ID NO: 85498 - protein, 10 aa, Homo Sapiens
DEFQLLQAQY

SEQ ID NO: 85499 - protein, 10 aa, Homo Sapiens
DEFQRGDQLF

SEQ ID NO: 85500 - protein, 10 aa, Homo Sapiens
DEIELTGIYH

SEQ ID NO: 85501 - protein, 10 aa, Homo Sapiens
DEIGLPKIFY

SEQ ID NO: 85502 - protein, 10 aa, Homo Sapiens
DEIQTVHSEY

SEQ ID NO: 85503 - protein, 10 aa, Homo Sapiens
DEISFADFKF

SEQ ID NO: 85504 - protein, 10 aa, Homo Sapiens
DELGVKALTY

SEQ ID NO: 85505 - protein, 10 aa, Homo Sapiens
DELQIPVKWI

SEQ ID NO: 85506 - protein, 10 aa, Homo Sapiens
DEPLLKHWEF

SEQ ID NO: 85507 - protein, 10 aa, Homo Sapiens
DEQKITEMVY

SEQ ID NO: 85508 - protein, 10 aa, Homo Sapiens
DEVQPNGKIF

SEQ ID NO: 85509 - protein, 10 aa, Homo Sapiens
DEVQVVRGHY

SEQ ID NO: 85510 - protein, 10 aa, Homo Sapiens
DEYDFKCKTL

SEQ ID NO: 85511 - protein, 10 aa, Homo Sapiens
DEYKVHKEGY

SEQ ID NO: 85512 - protein, 10 aa, Homo Sapiens
DEYKVNKEGY

SEQ ID NO: 85513 - protein, 10 aa, Homo Sapiens
DEYMYYLIEH

SEQ ID NO: 85514 - protein, 10 aa, Homo Sapiens
DEYSIFPQTY

SEQ ID NO: 85515 - protein, 10 aa, Homo Sapiens
EEALILDNKY

SEQ ID NO: 85516 - protein, 10 aa, Homo Sapiens
EEARPLVEFY

SEQ ID NO: 85517 - protein, 10 aa, Homo Sapiens
EEFDARWVTY

SEQ ID NO: 85518 - protein, 10 aa, Homo Sapiens
EEFELLGKAY

SEQ ID NO: 85519 - protein, 10 aa, Homo Sapiens
EEQLQQIRAE

SEQ ID NO: 85520 - protein, 10 aa, Homo Sapiens
EEVLIHGVSY

SEQ ID NO: 85521 - protein, 10 aa, Homo Sapiens
EEVLIPDQKY

SEQ ID NO: 85522 - protein, 10 aa, Homo Sapiens
EPRKQAGSLA

SEQ ID NO: 85523 - protein, 10 aa, Homo Sapiens
HEAFIEEGTF

SEQ ID NO: 85524 - protein, 10 aa, Homo Sapiens
HEAVIEKHVF

SEQ ID NO: 85525 - protein, 10 aa, Homo Sapiens
HECASINRIY

SEQ ID NO: 85526 - protein, 10 aa, Homo Sapiens
HESGHAIIAY

SEQ ID NO: 85527 - protein, 10 aa, Homo Sapiens
HETALQGNVF

SEQ ID NO: 85528 - protein, 10 aa, Homo Sapiens
HEVQLFSSQY

SEQ ID NO: 85529 - protein, 10 aa, Homo Sapiens
IAGDTLSKVF

SEQ ID NO: 85530 - protein, 10 aa, Homo Sapiens
IEYSFSRHLY

SEQ ID NO: 85531 - protein, 10 aa, Homo Sapiens
IRLENEIQTY

SEQ ID NO: 85532 - protein, 10 aa, Homo Sapiens
LEDFLYHEGY

SEQ ID NO: 85533 - protein, 10 aa, Homo Sapiens
MEFPCNINVF

SEQ ID NO: 85534 - protein, 10 aa, Homo Sapiens
MEVEVDGQKF

SEQ ID NO: 85535 - protein, 10 aa, Homo Sapiens
NEARLRNLTY

SEQ ID NO: 85536 - protein, 10 aa, Homo Sapiens
NEFSLKGVDF

SEQ ID NO: 85537 - protein, 10 aa, Homo Sapiens
NEHDYAKAAF

SEQ ID NO: 85538 - protein, 10 aa, Homo Sapiens
NEIEDTFRQF

SEQ ID NO: 85539 - protein, 10 aa, Homo Sapiens
NEIESGKIIF

SEQ ID NO: 85540 - protein, 10 aa, Homo Sapiens
NEIVMMNHVY

SEQ ID NO: 85541 - protein, 10 aa, Homo Sapiens
NELDLKLVSF

SEQ ID NO: 85542 - protein, 10 aa, Homo Sapiens
NELSYKTIVH

SEQ ID NO: 85543 - protein, 10 aa, Homo Sapiens
NEMEAPTTAY

SEQ ID NO: 85544 - protein, 10 aa, Homo Sapiens
NEMHSLLERY

SEQ ID NO: 85545 - protein, 10 aa, Homo Sapiens
NEVLIHSSQY

SEQ ID NO: 85546 - protein, 10 aa, Homo Sapiens
NEVSVHEQEY

SEQ ID NO: 85547 - protein, 10 aa, Homo Sapiens
NEYEAEKIEY

SEQ ID NO: 85548 - protein, 10 aa, Homo Sapiens
QAKADLQEAL

SEQ ID NO: 85549 - protein, 10 aa, Homo Sapiens
SQTEKPAVCY

SEQ ID NO: 85550 - protein, 10 aa, Homo Sapiens
TEKDYREIIH

SEQ ID NO: 85551 - protein, 10 aa, Homo Sapiens
VDAGPPTHAF

SEQ ID NO: 85552 - protein, 10 aa, Homo Sapiens
VEHDFIMATY

SEQ ID NO: 85553 - protein, 10 aa, Homo Sapiens
YEADVAQLEY

SEQ ID NO: 85554 - protein, 10 aa, Homo Sapiens
YEAPSLATGY

SEQ ID NO: 85555 - protein, 10 aa, Homo Sapiens
YEVEIDGKTY

SEQ ID NO: 85556 - protein, 10 aa, Homo Sapiens
YGPPGTGKTL

SEQ ID NO: 85557 - protein, 11 aa, Homo Sapiens
AEQRGELAIKD

SEQ ID NO: 85558 - protein, 11 aa, Homo Sapiens
DDFQLQPPVTF

SEQ ID NO: 85559 - protein, 11 aa, Homo Sapiens
DDILIKQDQTL

SEQ ID NO: 85560 - protein, 11 aa, Homo Sapiens
DEELLGDGHSY

SEQ ID NO: 85561 - protein, 11 aa, Homo Sapiens
DEFESGISQAL

SEQ ID NO: 85562 - protein, 11 aa, Homo Sapiens
DEHGIDPTGTY

SEQ ID NO: 85563 - protein, 11 aa, Homo Sapiens
DEHKFRKPTAL

SEQ ID NO: 85564 - protein, 11 aa, Homo Sapiens
DEIILPRGLEY

SEQ ID NO: 85565 - protein, 11 aa, Homo Sapiens
DEISLRPAQSF

SEQ ID NO: 85566 - protein, 11 aa, Homo Sapiens
DELEIIEGMKF

SEQ ID NO: 85567 - protein, 11 aa, Homo Sapiens
DESQVVTRYAY

SEQ ID NO: 85568 - protein, 11 aa, Homo Sapiens
DEYEMKDRVTY

SEQ ID NO: 85569 - protein, 11 aa, Homo Sapiens
DIDAFEFHEAF

SEQ ID NO: 85570 - protein, 11 aa, Homo Sapiens
EEAKVIGMSVY

SEQ ID NO: 85571 - protein, 11 aa, Homo Sapiens
FEGGEFIFTEM

SEQ ID NO: 85572 - protein, 11 aa, Homo Sapiens
IEYPTGSGNVY

SEQ ID NO: 85573 - protein, 11 aa, Homo Sapiens
ISATVVEIAGY

SEQ ID NO: 85574 - protein, 11 aa, Homo Sapiens
KKDVDNAYMIK

SEQ ID NO: 85575 - protein, 11 aa, Homo Sapiens
LEAAQRAVGVG

SEQ ID NO: 85576 - protein, 11 aa, Homo Sapiens
LEKPNGATPVF

SEQ ID NO: 85577 - protein, 11 aa, Homo Sapiens
MEVDSGKKMVF

SEQ ID NO: 85578 - protein, 11 aa, Homo Sapiens
NDIQLSRDMTM

SEQ ID NO: 85579 - protein, 11 aa, Homo Sapiens
NELFLPGRMAY

SEQ ID NO: 85580 - protein, 11 aa, Homo Sapiens
NEMIIGGGMAF

SEQ ID NO: 85581 - protein, 11 aa, Homo Sapiens
NEYQLIDCAQY

SEQ ID NO: 85582 - protein, 11 aa, Homo Sapiens
QSGAVAAGPLL

SEQ ID NO: 85583 - protein, 11 aa, Homo Sapiens
SEFLYDKALTF

SEQ ID NO: 85584 - protein, 11 aa, Homo Sapiens
TEFQLGSKLVY

SEQ ID NO: 85585 - protein, 11 aa, Homo Sapiens
TEFYLGKRCAY

SEQ ID NO: 85586 - protein, 11 aa, Homo Sapiens
TELALTMNHVY

SEQ ID NO: 85587 - protein, 11 aa, Homo Sapiens
TEYAFSLDSKY

SEQ ID NO: 85588 - protein, 11 aa, Homo Sapiens
TEYPCGSGNVY

SEQ ID NO: 85589 - protein, 11 aa, Homo Sapiens
VAPGKDLTKTL

SEQ ID NO: 85590 - protein, 11 aa, Homo Sapiens
VEANLGTAMTY

SEQ ID NO: 85591 - protein, 11 aa, Homo Sapiens
VEFSYDENTVY

SEQ ID NO: 85592 - protein, 11 aa, Homo Sapiens
VELELQQIEQK

SEQ ID NO: 85593 - protein, 11 aa, Homo Sapiens
YVDAGPPTHAF

SEQ ID NO: 85594 - protein, 8 aa, Homo Sapiens
FSPVGSVL

SEQ ID NO: 85595 - protein, 8 aa, Homo Sapiens
IVKWDRDM

SEQ ID NO: 85596 - protein, 8 aa, Homo Sapiens
RIDKPILK

SEQ ID NO: 85597 - protein, 8 aa, Homo Sapiens
RLFGIRAK

SEQ ID NO: 85598 - protein, 8 aa, Homo Sapiens
RYNGLIHR

SEQ ID NO: 85599 - protein, 9 aa, Homo Sapiens
ALRRLLLLL

SEQ ID NO: 85600 - protein, 9 aa, Homo Sapiens
ARAANMFKM

SEQ ID NO: 85601 - protein, 9 aa, Homo Sapiens
ARAELEMRL

SEQ ID NO: 85602 - protein, 9 aa, Homo Sapiens
ARAFIILSV

SEQ ID NO: 85603 - protein, 9 aa, Homo Sapiens
ARAFPMPGF

SEQ ID NO: 85604 - protein, 9 aa, Homo Sapiens
ARAGALFQL

SEQ ID NO: 85605 - protein, 9 aa, Homo Sapiens
ARAKFIPLI

SEQ ID NO: 85606 - protein, 9 aa, Homo Sapiens
ARAKIPLGF

SEQ ID NO: 85607 - protein, 9 aa, Homo Sapiens
ARALLLPLL

SEQ ID NO: 85608 - protein, 9 aa, Homo Sapiens
ARANLRLTL

SEQ ID NO: 85609 - protein, 9 aa, Homo Sapiens
ARARFALGL

SEQ ID NO: 85610 - protein, 9 aa, Homo Sapiens
ARARLLTEI

SEQ ID NO: 85611 - protein, 9 aa, Homo Sapiens
ARASLIPEF

SEQ ID NO: 85612 - protein, 9 aa, Homo Sapiens
ARFALTVVR

SEQ ID NO: 85613 - protein, 9 aa, Homo Sapiens
ARFEGDFKL

SEQ ID NO: 85614 - protein, 9 aa, Homo Sapiens
ARFEQLISR

SEQ ID NO: 85615 - protein, 9 aa, Homo Sapiens
ARFETQVRL

SEQ ID NO: 85616 - protein, 9 aa, Homo Sapiens
ARFFKLHER

SEQ ID NO: 85617 - protein, 9 aa, Homo Sapiens
ARFFKQPTF

SEQ ID NO: 85618 - protein, 9 aa, Homo Sapiens
ARFGLIQSM

SEQ ID NO: 85619 - protein, 9 aa, Homo Sapiens
ARFGSVNEL

SEQ ID NO: 85620 - protein, 9 aa, Homo Sapiens
ARFKERVGY

SEQ ID NO: 85621 - protein, 9 aa, Homo Sapiens
ARFKLWYTL

SEQ ID NO: 85622 - protein, 9 aa, Homo Sapiens
ARFLFTTGF

SEQ ID NO: 85623 - protein, 9 aa, Homo Sapiens
ARFPETPAF

SEQ ID NO: 85624 - protein, 9 aa, Homo Sapiens
ARFPSTFSI

SEQ ID NO: 85625 - protein, 9 aa, Homo Sapiens
ARFRNISRI

SEQ ID NO: 85626 - protein, 9 aa, Homo Sapiens
ARFSGNLLV

SEQ ID NO: 85627 - protein, 9 aa, Homo Sapiens
ARFSPKVSL

SEQ ID NO: 85628 - protein, 9 aa, Homo Sapiens
ARFVNVLGY

SEQ ID NO: 85629 - protein, 9 aa, Homo Sapiens
ARFYAVQKL

SEQ ID NO: 85630 - protein, 9 aa, Homo Sapiens
ARGMFVFGY

SEQ ID NO: 85631 - protein, 9 aa, Homo Sapiens
ARHDLLPHL

SEQ ID NO: 85632 - protein, 9 aa, Homo Sapiens
ARHEHQVML

SEQ ID NO: 85633 - protein, 9 aa, Homo Sapiens
ARHEYTFSI

SEQ ID NO: 85634 - protein, 9 aa, Homo Sapiens
ARHFQPFAR

SEQ ID NO: 85635 - protein, 9 aa, Homo Sapiens
ARHGEKLLL

SEQ ID NO: 85636 - protein, 9 aa, Homo Sapiens
ARHNLIINI

SEQ ID NO: 85637 - protein, 9 aa, Homo Sapiens
ARHSLLQTL

SEQ ID NO: 85638 - protein, 9 aa, Homo Sapiens
ARHVVAVVL

SEQ ID NO: 85639 - protein, 9 aa, Homo Sapiens
ARHYYFLGR

SEQ ID NO: 85640 - protein, 9 aa, Homo Sapiens
ARIAKGLRL

SEQ ID NO: 85641 - protein, 9 aa, Homo Sapiens
ARIEIGLHY

SEQ ID NO: 85642 - protein, 9 aa, Homo Sapiens
ARIFKAWAV

SEQ ID NO: 85643 - protein, 9 aa, Homo Sapiens
ARIFLEESL

SEQ ID NO: 85644 - protein, 9 aa, Homo Sapiens
ARIFQFQNF

SEQ ID NO: 85645 - protein, 9 aa, Homo Sapiens
ARIKINEEF

SEQ ID NO: 85646 - protein, 9 aa, Homo Sapiens
ARILFLLQL

SEQ ID NO: 85647 - protein, 9 aa, Homo Sapiens
ARILIQERY

SEQ ID NO: 85648 - protein, 9 aa, Homo Sapiens
ARINLLVAI

SEQ ID NO: 85649 - protein, 9 aa, Homo Sapiens
ARIPLNPVL

SEQ ID NO: 85650 - protein, 9 aa, Homo Sapiens
ARIQPMPYF

SEQ ID NO: 85651 - protein, 9 aa, Homo Sapiens
ARIWLFVGF

SEQ ID NO: 85652 - protein, 9 aa, Homo Sapiens
ARKDIVARL

SEQ ID NO: 85653 - protein, 9 aa, Homo Sapiens
ARKDNVIRL

SEQ ID NO: 85654 - protein, 9 aa, Homo Sapiens
ARKHFVLLL

SEQ ID NO: 85655 - protein, 9 aa, Homo Sapiens
ARKQIVINL

SEQ ID NO: 85656 - protein, 9 aa, Homo Sapiens
ARLAQRIDF

SEQ ID NO: 85657 - protein, 9 aa, Homo Sapiens
ARLASLMNL

SEQ ID NO: 85658 - protein, 9 aa, Homo Sapiens
ARLDFVVRY

SEQ ID NO: 85659 - protein, 9 aa, Homo Sapiens
ARLDHKFDL

SEQ ID NO: 85660 - protein, 9 aa, Homo Sapiens
ARLDLLYRL

SEQ ID NO: 85661 - protein, 9 aa, Homo Sapiens
ARLEINVLK

SEQ ID NO: 85662 - protein, 9 aa, Homo Sapiens
ARLEKAIAF

SEQ ID NO: 85663 - protein, 9 aa, Homo Sapiens
ARLFGIRAK

SEQ ID NO: 85664 - protein, 9 aa, Homo Sapiens
ARLFGLAQR

SEQ ID NO: 85665 - protein, 9 aa, Homo Sapiens
ARLFIFETF

SEQ ID NO: 85666 - protein, 9 aa, Homo Sapiens
ARLGITMKA

SEQ ID NO: 85667 - protein, 9 aa, Homo Sapiens
ARLGVISKV

SEQ ID NO: 85668 - protein, 9 aa, Homo Sapiens
ARLGVVTGL

SEQ ID NO: 85669 - protein, 9 aa, Homo Sapiens
ARLGYKIKF

SEQ ID NO: 85670 - protein, 9 aa, Homo Sapiens
ARLKDIIVM

SEQ ID NO: 85671 - protein, 9 aa, Homo Sapiens
ARLKEVLEY

SEQ ID NO: 85672 - protein, 9 aa, Homo Sapiens
ARLKILETL

SEQ ID NO: 85673 - protein, 9 aa, Homo Sapiens
ARLLLIFDY

SEQ ID NO: 85674 - protein, 9 aa, Homo Sapiens
ARLNWILHF

SEQ ID NO: 85675 - protein, 9 aa, Homo Sapiens
ARLNYLLRV

SEQ ID NO: 85676 - protein, 9 aa, Homo Sapiens
ARLPLRLFL

SEQ ID NO: 85677 - protein, 9 aa, Homo Sapiens
ARLPLVNSY

SEQ ID NO: 85678 - protein, 9 aa, Homo Sapiens
ARLPSLNKL

SEQ ID NO: 85679 - protein, 9 aa, Homo Sapiens
ARLPWAGQL

SEQ ID NO: 85680 - protein, 9 aa, Homo Sapiens
ARLQLQLAY

SEQ ID NO: 85681 - protein, 9 aa, Homo Sapiens
ARLQTALLV

SEQ ID NO: 85682 - protein, 9 aa, Homo Sapiens
ARLREFWMR

SEQ ID NO: 85683 - protein, 9 aa, Homo Sapiens
ARLSALYKL

SEQ ID NO: 85684 - protein, 9 aa, Homo Sapiens
ARLSIRPGL

SEQ ID NO: 85685 - protein, 9 aa, Homo Sapiens
ARLTDYVAF

SEQ ID NO: 85686 - protein, 9 aa, Homo Sapiens
ARLVLLKKL

SEQ ID NO: 85687 - protein, 9 aa, Homo Sapiens
ARLWFHSNF

SEQ ID NO: 85688 - protein, 9 aa, Homo Sapiens
ARLYLLQQI

SEQ ID NO: 85689 - protein, 9 aa, Homo Sapiens
ARLYYYWER

SEQ ID NO: 85690 - protein, 9 aa, Homo Sapiens
ARMNLAIAL

SEQ ID NO: 85691 - protein, 9 aa, Homo Sapiens
ARMWKTLTF

SEQ ID NO: 85692 - protein, 9 aa, Homo Sapiens
ARNALQVDL

SEQ ID NO: 85693 - protein, 9 aa, Homo Sapiens
ARNDYLLTL

SEQ ID NO: 85694 - protein, 9 aa, Homo Sapiens
ARNEYLLNL

SEQ ID NO: 85695 - protein, 9 aa, Homo Sapiens
ARNEYLLSL

SEQ ID NO: 85696 - protein, 9 aa, Homo Sapiens
ARNLISPRM

SEQ ID NO: 85697 - protein, 9 aa, Homo Sapiens
ARNLIYFGF

SEQ ID NO: 85698 - protein, 9 aa, Homo Sapiens
ARNNVVWAL

SEQ ID NO: 85699 - protein, 9 aa, Homo Sapiens
ARNQLRMYL

SEQ ID NO: 85700 - protein, 9 aa, Homo Sapiens
ARNQLTFLL

SEQ ID NO: 85701 - protein, 9 aa, Homo Sapiens
ARSELLTTV

SEQ ID NO: 85702 - protein, 9 aa, Homo Sapiens
ARSEQFINL

SEQ ID NO: 85703 - protein, 9 aa, Homo Sapiens
ARSLQKLGF

SEQ ID NO: 85704 - protein, 9 aa, Homo Sapiens
ARSVPRTLL

SEQ ID NO: 85705 - protein, 9 aa, Homo Sapiens
ARTLFNQVM

SEQ ID NO: 85706 - protein, 9 aa, Homo Sapiens
ARTLLAILR

SEQ ID NO: 85707 - protein, 9 aa, Homo Sapiens
ARTSLLLLR

SEQ ID NO: 85708 - protein, 9 aa, Homo Sapiens
ARTSVFLVR

SEQ ID NO: 85709 - protein, 9 aa, Homo Sapiens
ARTTLLPGL

SEQ ID NO: 85710 - protein, 9 aa, Homo Sapiens
ARTVMLFNL

SEQ ID NO: 85711 - protein, 9 aa, Homo Sapiens
ARVAITIYC

SEQ ID NO: 85712 - protein, 9 aa, Homo Sapiens
ARVEVKATF

SEQ ID NO: 85713 - protein, 9 aa, Homo Sapiens
ARVFLQNLL

SEQ ID NO: 85714 - protein, 9 aa, Homo Sapiens
ARVFVILSV

SEQ ID NO: 85715 - protein, 9 aa, Homo Sapiens
ARVIFITEY

SEQ ID NO: 85716 - protein, 9 aa, Homo Sapiens
ARVIIEKYY

SEQ ID NO: 85717 - protein, 9 aa, Homo Sapiens
ARVKMQVTM

SEQ ID NO: 85718 - protein, 9 aa, Homo Sapiens
ARVKVFSKF

SEQ ID NO: 85719 - protein, 9 aa, Homo Sapiens
ARVLLISKL

SEQ ID NO: 85720 - protein, 9 aa, Homo Sapiens
ARVLQDFYL

SEQ ID NO: 85721 - protein, 9 aa, Homo Sapiens
ARVSIVNQY

SEQ ID NO: 85722 - protein, 9 aa, Homo Sapiens
ARVSVEVRF

SEQ ID NO: 85723 - protein, 9 aa, Homo Sapiens
ARVTKVLGR

SEQ ID NO: 85724 - protein, 9 aa, Homo Sapiens
ARVVQKLGF

SEQ ID NO: 85725 - protein, 9 aa, Homo Sapiens
ARVWSLMRF

SEQ ID NO: 85726 - protein, 9 aa, Homo Sapiens
ARWDLISNL

SEQ ID NO: 85727 - protein, 9 aa, Homo Sapiens
ARWELPLTV

SEQ ID NO: 85728 - protein, 9 aa, Homo Sapiens
ARWLTQEEF

SEQ ID NO: 85729 - protein, 9 aa, Homo Sapiens
ARWQQVWLL

SEQ ID NO: 85730 - protein, 9 aa, Homo Sapiens
ARWTYPVLL

SEQ ID NO: 85731 - protein, 9 aa, Homo Sapiens
ARWWAVVVL

SEQ ID NO: 85732 - protein, 9 aa, Homo Sapiens
ARYFPLLAK

SEQ ID NO: 85733 - protein, 9 aa, Homo Sapiens
ARYGLHVRF

SEQ ID NO: 85734 - protein, 9 aa, Homo Sapiens
ARYLMLLVF

SEQ ID NO: 85735 - protein, 9 aa, Homo Sapiens
ARYLVNEGF

SEQ ID NO: 85736 - protein, 9 aa, Homo Sapiens
CRFEGQFSI

SEQ ID NO: 85737 - protein, 9 aa, Homo Sapiens
CRFPELPAR

SEQ ID NO: 85738 - protein, 9 aa, Homo Sapiens
CRSIIQVYL

SEQ ID NO: 85739 - protein, 9 aa, Homo Sapiens
CRTFHTIGF

SEQ ID NO: 85740 - protein, 9 aa, Homo Sapiens
CRVAIRLYL

SEQ ID NO: 85741 - protein, 9 aa, Homo Sapiens
ERADLIAYL

SEQ ID NO: 85742 - protein, 9 aa, Homo Sapiens
ERLQYVFGY

SEQ ID NO: 85743 - protein, 9 aa, Homo Sapiens
ERNPAVYNF

SEQ ID NO: 85744 - protein, 9 aa, Homo Sapiens
ERVKLQEAL

SEQ ID NO: 85745 - protein, 9 aa, Homo Sapiens
ERWEVVLHF

SEQ ID NO: 85746 - protein, 9 aa, Homo Sapiens
FIVEETLPL

SEQ ID NO: 85747 - protein, 9 aa, Homo Sapiens
FRAEINILL

SEQ ID NO: 85748 - protein, 9 aa, Homo Sapiens
FRFAGSENL

SEQ ID NO: 85749 - protein, 9 aa, Homo Sapiens
FRFDGVTSM

SEQ ID NO: 85750 - protein, 9 aa, Homo Sapiens
FRFENVNGY

SEQ ID NO: 85751 - protein, 9 aa, Homo Sapiens
FRGPLVINR

SEQ ID NO: 85752 - protein, 9 aa, Homo Sapiens
FRIEGLAPK

SEQ ID NO: 85753 - protein, 9 aa, Homo Sapiens
FRIHLRNEF

SEQ ID NO: 85754 - protein, 9 aa, Homo Sapiens
FRLDTPLYF

SEQ ID NO: 85755 - protein, 9 aa, Homo Sapiens
FRLINIIHV

SEQ ID NO: 85756 - protein, 9 aa, Homo Sapiens
FRLLWIDTK

SEQ ID NO: 85757 - protein, 9 aa, Homo Sapiens
FRLQNIIGR

SEQ ID NO: 85758 - protein, 9 aa, Homo Sapiens
FRMKLRNLF

SEQ ID NO: 85759 - protein, 9 aa, Homo Sapiens
FRSFVVSKF

SEQ ID NO: 85760 - protein, 9 aa, Homo Sapiens
FRVDYILSV

SEQ ID NO: 85761 - protein, 9 aa, Homo Sapiens
FRVLVVSAK

SEQ ID NO: 85762 - protein, 9 aa, Homo Sapiens
FRYLMGERL

SEQ ID NO: 85763 - protein, 9 aa, Homo Sapiens
FRYNGLIHR

SEQ ID NO: 85764 - protein, 9 aa, Homo Sapiens
FRYPQDYQF

SEQ ID NO: 85765 - protein, 9 aa, Homo Sapiens
FSPFHASVL

SEQ ID NO: 85766 - protein, 9 aa, Homo Sapiens
GRAFIFPSY

SEQ ID NO: 85767 - protein, 9 aa, Homo Sapiens
GRANHFFTV

SEQ ID NO: 85768 - protein, 9 aa, Homo Sapiens
GRAPVLVAL

SEQ ID NO: 85769 - protein, 9 aa, Homo Sapiens
GRDLTDYLM

SEQ ID NO: 85770 - protein, 9 aa, Homo Sapiens
GRFDMQVTV

SEQ ID NO: 85771 - protein, 9 aa, Homo Sapiens
GRFDREFLF

SEQ ID NO: 85772 - protein, 9 aa, Homo Sapiens
GRFDVKIEV

SEQ ID NO: 85773 - protein, 9 aa, Homo Sapiens
GRFDVRWIF

SEQ ID NO: 85774 - protein, 9 aa, Homo Sapiens
GRFEDVYQL

SEQ ID NO: 85775 - protein, 9 aa, Homo Sapiens
GRFFLSSGL

SEQ ID NO: 85776 - protein, 9 aa, Homo Sapiens
GRFFWIVRV

SEQ ID NO: 85777 - protein, 9 aa, Homo Sapiens
GRFHGGNLF

SEQ ID NO: 85778 - protein, 9 aa, Homo Sapiens
GRFITVMKF

SEQ ID NO: 85779 - protein, 9 aa, Homo Sapiens
GRFKDVLVL

SEQ ID NO: 85780 - protein, 9 aa, Homo Sapiens
GRFLEIGKF

SEQ ID NO: 85781 - protein, 9 aa, Homo Sapiens
GRFLIDFSY

SEQ ID NO: 85782 - protein, 9 aa, Homo Sapiens
GRFLVHESF

SEQ ID NO: 85783 - protein, 9 aa, Homo Sapiens
GRFPQVQAF

SEQ ID NO: 85784 - protein, 9 aa, Homo Sapiens
GRFSGLLGR

SEQ ID NO: 85785 - protein, 9 aa, Homo Sapiens
GRFSHRIYV

SEQ ID NO: 85786 - protein, 9 aa, Homo Sapiens
GRFVWRVNL

SEQ ID NO: 85787 - protein, 9 aa, Homo Sapiens
GRGSFMLGL

SEQ ID NO: 85788 - protein, 9 aa, Homo Sapiens
GRHGVFLEL

SEQ ID NO: 85789 - protein, 9 aa, Homo Sapiens
GRHYWEVEV

SEQ ID NO: 85790 - protein, 9 aa, Homo Sapiens
GRIASYYYL

SEQ ID NO: 85791 - protein, 9 aa, Homo Sapiens
GRIAVNICY

SEQ ID NO: 85792 - protein, 9 aa, Homo Sapiens
GRICLDIRL

SEQ ID NO: 85793 - protein, 9 aa, Homo Sapiens
GRIDILINC

SEQ ID NO: 85794 - protein, 9 aa, Homo Sapiens
GRIDKPILK

SEQ ID NO: 85795 - protein, 9 aa, Homo Sapiens
GRIFIGTFK

SEQ ID NO: 85796 - protein, 9 aa, Homo Sapiens
GRIGNFIVK

SEQ ID NO: 85797 - protein, 9 aa, Homo Sapiens
GRIGQVGKF

SEQ ID NO: 85798 - protein, 9 aa, Homo Sapiens
GRIGRLVTR

SEQ ID NO: 85799 - protein, 9 aa, Homo Sapiens
GRIGVFPSV

SEQ ID NO: 85800 - protein, 9 aa, Homo Sapiens
GRIGVITNR

SEQ ID NO: 85801 - protein, 9 aa, Homo Sapiens
GRIPGIYGR

SEQ ID NO: 85802 - protein, 9 aa, Homo Sapiens
GRIQIALKR

SEQ ID NO: 85803 - protein, 9 aa, Homo Sapiens
GRISIMQFF

SEQ ID NO: 85804 - protein, 9 aa, Homo Sapiens
GRIVAFFEF

SEQ ID NO: 85805 - protein, 9 aa, Homo Sapiens
GRIVAFFSF

SEQ ID NO: 85806 - protein, 9 aa, Homo Sapiens
GRIVTIFAF

SEQ ID NO: 85807 - protein, 9 aa, Homo Sapiens
GRIVTLISF

SEQ ID NO: 85808 - protein, 9 aa, Homo Sapiens
GRIYLYLTK

SEQ ID NO: 85809 - protein, 9 aa, Homo Sapiens
GRKGVAINF

SEQ ID NO: 85810 - protein, 9 aa, Homo Sapiens
GRLAAIVAK

SEQ ID NO: 85811 - protein, 9 aa, Homo Sapiens
GRLAPRLGL

SEQ ID NO: 85812 - protein, 9 aa, Homo Sapiens
GRLAWAQQL

SEQ ID NO: 85813 - protein, 9 aa, Homo Sapiens
GRLDAVLQR

SEQ ID NO: 85814 - protein, 9 aa, Homo Sapiens
GRLFAVVHF

SEQ ID NO: 85815 - protein, 9 aa, Homo Sapiens
GRLGISLTR

SEQ ID NO: 85816 - protein, 9 aa, Homo Sapiens
GRLGLVTSR

SEQ ID NO: 85817 - protein, 9 aa, Homo Sapiens
GRLGSFHEL

SEQ ID NO: 85818 - protein, 9 aa, Homo Sapiens
GRLGSFPVR

SEQ ID NO: 85819 - protein, 9 aa, Homo Sapiens
GRLHLGHTF

SEQ ID NO: 85820 - protein, 9 aa, Homo Sapiens
GRLLLAANV

SEQ ID NO: 85821 - protein, 9 aa, Homo Sapiens
GRLLVATTF

SEQ ID NO: 85822 - protein, 9 aa, Homo Sapiens
GRLLWEQEL

SEQ ID NO: 85823 - protein, 9 aa, Homo Sapiens
GRLNLHYAV

SEQ ID NO: 85824 - protein, 9 aa, Homo Sapiens
GRLNSHPIF

SEQ ID NO: 85825 - protein, 9 aa, Homo Sapiens
GRLPFSIRV

SEQ ID NO: 85826 - protein, 9 aa, Homo Sapiens
GRLPRTYRL

SEQ ID NO: 85827 - protein, 9 aa, Homo Sapiens
GRLPSSWAL

SEQ ID NO: 85828 - protein, 9 aa, Homo Sapiens
GRLPVGLSL

SEQ ID NO: 85829 - protein, 9 aa, Homo Sapiens
GRLQLQVTV

SEQ ID NO: 85830 - protein, 9 aa, Homo Sapiens
GRLQLVNKL

SEQ ID NO: 85831 - protein, 9 aa, Homo Sapiens
GRLQPSPLF

SEQ ID NO: 85832 - protein, 9 aa, Homo Sapiens
GRLRSVIQR

SEQ ID NO: 85833 - protein, 9 aa, Homo Sapiens
GRLRVGLRL

SEQ ID NO: 85834 - protein, 9 aa, Homo Sapiens
GRLSDVLKR

SEQ ID NO: 85835 - protein, 9 aa, Homo Sapiens
GRLSNISHL

SEQ ID NO: 85836 - protein, 9 aa, Homo Sapiens
GRLTSQLLR

SEQ ID NO: 85837 - protein, 9 aa, Homo Sapiens
GRLVKDMKI

SEQ ID NO: 85838 - protein, 9 aa, Homo Sapiens
GRLVTRAAF

SEQ ID NO: 85839 - protein, 9 aa, Homo Sapiens
GRLWISVAR

SEQ ID NO: 85840 - protein, 9 aa, Homo Sapiens
GRMESVFNH

SEQ ID NO: 85841 - protein, 9 aa, Homo Sapiens
GRMHGKFSL

SEQ ID NO: 85842 - protein, 9 aa, Homo Sapiens
GRMPFPVNH

SEQ ID NO: 85843 - protein, 9 aa, Homo Sapiens
GRMSIKAYV

SEQ ID NO: 85844 - protein, 9 aa, Homo Sapiens
GRMVQVHEL

SEQ ID NO: 85845 - protein, 9 aa, Homo Sapiens
GRNALEIVM

SEQ ID NO: 85846 - protein, 9 aa, Homo Sapiens
GRNFWVSGL

SEQ ID NO: 85847 - protein, 9 aa, Homo Sapiens
GRNSFEVRV

SEQ ID NO: 85848 - protein, 9 aa, Homo Sapiens
GRNVYRMLF

SEQ ID NO: 85849 - protein, 9 aa, Homo Sapiens
GRQEIFLQR

SEQ ID NO: 85850 - protein, 9 aa, Homo Sapiens
GRQKVSFSF

SEQ ID NO: 85851 - protein, 9 aa, Homo Sapiens
GRSDLIPTI

SEQ ID NO: 85852 - protein, 9 aa, Homo Sapiens
GRSGYNYFF

SEQ ID NO: 85853 - protein, 9 aa, Homo Sapiens
GRSLIINHL

SEQ ID NO: 85854 - protein, 9 aa, Homo Sapiens
GRSLIKLNF

SEQ ID NO: 85855 - protein, 9 aa, Homo Sapiens
GRSLPRFQV

SEQ ID NO: 85856 - protein, 9 aa, Homo Sapiens
GRTDLLRLR

SEQ ID NO: 85857 - protein, 9 aa, Homo Sapiens
GRTELAIKL

SEQ ID NO: 85858 - protein, 9 aa, Homo Sapiens
GRTEVSFTL

SEQ ID NO: 85859 - protein, 9 aa, Homo Sapiens
GRTFIQPNM

SEQ ID NO: 85860 - protein, 9 aa, Homo Sapiens
GRTIKLWVL

SEQ ID NO: 85861 - protein, 9 aa, Homo Sapiens
GRTKIFIRF

SEQ ID NO: 85862 - protein, 9 aa, Homo Sapiens
GRTLIGFLR

SEQ ID NO: 85863 - protein, 9 aa, Homo Sapiens
GRTNLIVNY

SEQ ID NO: 85864 - protein, 9 aa, Homo Sapiens
GRTQMTLTF

SEQ ID NO: 85865 - protein, 9 aa, Homo Sapiens
GRTSLTNLL

SEQ ID NO: 85866 - protein, 9 aa, Homo Sapiens
GRTVILYKV

SEQ ID NO: 85867 - protein, 9 aa, Homo Sapiens
GRTVLVIAH

SEQ ID NO: 85868 - protein, 9 aa, Homo Sapiens
GRVDFAYKF

SEQ ID NO: 85869 - protein, 9 aa, Homo Sapiens
GRVFIIKSY

SEQ ID NO: 85870 - protein, 9 aa, Homo Sapiens
GRVFVLPCI

SEQ ID NO: 85871 - protein, 9 aa, Homo Sapiens
GRVGVFPSL

SEQ ID NO: 85872 - protein, 9 aa, Homo Sapiens
GRVNLNVLR

SEQ ID NO: 85873 - protein, 9 aa, Homo Sapiens
GRVVALFYF

SEQ ID NO: 85874 - protein, 9 aa, Homo Sapiens
GRVVTLVTF

SEQ ID NO: 85875 - protein, 9 aa, Homo Sapiens
GRVYVGFTV

SEQ ID NO: 85876 - protein, 9 aa, Homo Sapiens
GRWDQQYVI

SEQ ID NO: 85877 - protein, 9 aa, Homo Sapiens
GRWPGSSLY

SEQ ID NO: 85878 - protein, 9 aa, Homo Sapiens
GRWQYPLIY

SEQ ID NO: 85879 - protein, 9 aa, Homo Sapiens
GRWRDILSH

SEQ ID NO: 85880 - protein, 9 aa, Homo Sapiens
GRWRSEWKF

SEQ ID NO: 85881 - protein, 9 aa, Homo Sapiens
GRWSGTLNL

SEQ ID NO: 85882 - protein, 9 aa, Homo Sapiens
GRYEITVKL

SEQ ID NO: 85883 - protein, 9 aa, Homo Sapiens
GRYEVAVPL

SEQ ID NO: 85884 - protein, 9 aa, Homo Sapiens
GRYLRRELL

SEQ ID NO: 85885 - protein, 9 aa, Homo Sapiens
GRYQVSWSL

SEQ ID NO: 85886 - protein, 9 aa, Homo Sapiens
GRYTIKVLF

SEQ ID NO: 85887 - protein, 9 aa, Homo Sapiens
GRYTILIKY

SEQ ID NO: 85888 - protein, 9 aa, Homo Sapiens
GSLRVLVLR

SEQ ID NO: 85889 - protein, 9 aa, Homo Sapiens
HAPLTNIPL

SEQ ID NO: 85890 - protein, 9 aa, Homo Sapiens
HRAQLQIRI

SEQ ID NO: 85891 - protein, 9 aa, Homo Sapiens
HRFFTEILR

SEQ ID NO: 85892 - protein, 9 aa, Homo Sapiens
HRFFYSKSF

SEQ ID NO: 85893 - protein, 9 aa, Homo Sapiens
HRFWKTELF

SEQ ID NO: 85894 - protein, 9 aa, Homo Sapiens
HRFYMFHSF

SEQ ID NO: 85895 - protein, 9 aa, Homo Sapiens
HRFYMIQSF

SEQ ID NO: 85896 - protein, 9 aa, Homo Sapiens
HRIDLKTKI

SEQ ID NO: 85897 - protein, 9 aa, Homo Sapiens
HRIEIPFKF

SEQ ID NO: 85898 - protein, 9 aa, Homo Sapiens
HRITIKKRF

SEQ ID NO: 85899 - protein, 9 aa, Homo Sapiens
HRIVEAFRF

SEQ ID NO: 85900 - protein, 9 aa, Homo Sapiens
HRLEELYTK

SEQ ID NO: 85901 - protein, 9 aa, Homo Sapiens
HRLFPKLQF

SEQ ID NO: 85902 - protein, 9 aa, Homo Sapiens
HRLGLIPLI

SEQ ID NO: 85903 - protein, 9 aa, Homo Sapiens
HRLLLIQAF

SEQ ID NO: 85904 - protein, 9 aa, Homo Sapiens
HRLPPVTSF

SEQ ID NO: 85905 - protein, 9 aa, Homo Sapiens
HRNSMKVFL

SEQ ID NO: 85906 - protein, 9 aa, Homo Sapiens
HRSTIITLY

SEQ ID NO: 85907 - protein, 9 aa, Homo Sapiens
HRVALSVQL

SEQ ID NO: 85908 - protein, 9 aa, Homo Sapiens
HRWTMQPRL

SEQ ID NO: 85909 - protein, 9 aa, Homo Sapiens
IPTFQPLLK

SEQ ID NO: 85910 - protein, 9 aa, Homo Sapiens
IQRTPKIQV

SEQ ID NO: 85911 - protein, 9 aa, Homo Sapiens
IRAAPPPLF

SEQ ID NO: 85912 - protein, 9 aa, Homo Sapiens
IRAGLIPKF

SEQ ID NO: 85913 - protein, 9 aa, Homo Sapiens
IRFFGTTNF

SEQ ID NO: 85914 - protein, 9 aa, Homo Sapiens
IRFILIQNR

SEQ ID NO: 85915 - protein, 9 aa, Homo Sapiens
IRGAIILAK

SEQ ID NO: 85916 - protein, 9 aa, Homo Sapiens
IRIVLFLQK

SEQ ID NO: 85917 - protein, 9 aa, Homo Sapiens
IRLPSQYNF

SEQ ID NO: 85918 - protein, 9 aa, Homo Sapiens
IRNDYYLNL

SEQ ID NO: 85919 - protein, 9 aa, Homo Sapiens
IRNIPIPTL

SEQ ID NO: 85920 - protein, 9 aa, Homo Sapiens
IRNSFQPLI

SEQ ID NO: 85921 - protein, 9 aa, Homo Sapiens
IRSAVSVHL

SEQ ID NO: 85922 - protein, 9 aa, Homo Sapiens
IRSKLKLLL

SEQ ID NO: 85923 - protein, 9 aa, Homo Sapiens
IRSSLLLGF

SEQ ID NO: 85924 - protein, 9 aa, Homo Sapiens
IRTGLVRLL

SEQ ID NO: 85925 - protein, 9 aa, Homo Sapiens
IRTITVVQR

SEQ ID NO: 85926 - protein, 9 aa, Homo Sapiens
IRTVIQIHM

SEQ ID NO: 85927 - protein, 9 aa, Homo Sapiens
IRWEKNITL

SEQ ID NO: 85928 - protein, 9 aa, Homo Sapiens
IRWGFIPLV

SEQ ID NO: 85929 - protein, 9 aa, Homo Sapiens
IRYFVSEGF

SEQ ID NO: 85930 - protein, 9 aa, Homo Sapiens
IRYPDPLIK

SEQ ID NO: 85931 - protein, 9 aa, Homo Sapiens
KIIRVTLSK

SEQ ID NO: 85932 - protein, 9 aa, Homo Sapiens
KIVKWDRDM

SEQ ID NO: 85933 - protein, 9 aa, Homo Sapiens
KRAAILTKL

SEQ ID NO: 85934 - protein, 9 aa, Homo Sapiens
KRALVILAK

SEQ ID NO: 85935 - protein, 9 aa, Homo Sapiens
KRASYILRL

SEQ ID NO: 85936 - protein, 9 aa, Homo Sapiens
KRCDIILVM

SEQ ID NO: 85937 - protein, 9 aa, Homo Sapiens
KRDGTVLRL

SEQ ID NO: 85938 - protein, 9 aa, Homo Sapiens
KRFDMAVMF

SEQ ID NO: 85939 - protein, 9 aa, Homo Sapiens
KRFEGLTAR

SEQ ID NO: 85940 - protein, 9 aa, Homo Sapiens
KRFEGLTQR

SEQ ID NO: 85941 - protein, 9 aa, Homo Sapiens
KRFGLNIDR

SEQ ID NO: 85942 - protein, 9 aa, Homo Sapiens
KRFHWTAYL

SEQ ID NO: 85943 - protein, 9 aa, Homo Sapiens
KRFMWRDSF

SEQ ID NO: 85944 - protein, 9 aa, Homo Sapiens
KRFQVAVNL

SEQ ID NO: 85945 - protein, 9 aa, Homo Sapiens
KRFSGTVRL

SEQ ID NO: 85946 - protein, 9 aa, Homo Sapiens
KRFSLDFNL

SEQ ID NO: 85947 - protein, 9 aa, Homo Sapiens
KRFSVPVQH

SEQ ID NO: 85948 - protein, 9 aa, Homo Sapiens
KRIDIIHNL

SEQ ID NO: 85949 - protein, 9 aa, Homo Sapiens
KRINWRTVL

SEQ ID NO: 85950 - protein, 9 aa, Homo Sapiens
KRIVEGILK

SEQ ID NO: 85951 - protein, 9 aa, Homo Sapiens
KRKDFGIMF

SEQ ID NO: 85952 - protein, 9 aa, Homo Sapiens
KRLASSVLR

SEQ ID NO: 85953 - protein, 9 aa, Homo Sapiens
KRLGASLAF

SEQ ID NO: 85954 - protein, 9 aa, Homo Sapiens
KRLGILVVF

SEQ ID NO: 85955 - protein, 9 aa, Homo Sapiens
KRLVVFDAR

SEQ ID NO: 85956 - protein, 9 aa, Homo Sapiens
KRMGMSFGL

SEQ ID NO: 85957 - protein, 9 aa, Homo Sapiens
KRMLEKLGV

SEQ ID NO: 85958 - protein, 9 aa, Homo Sapiens
KRMSGMIRL

SEQ ID NO: 85959 - protein, 9 aa, Homo Sapiens
KRNELVIRV

SEQ ID NO: 85960 - protein, 9 aa, Homo Sapiens
KRNLPLKLL

SEQ ID NO: 85961 - protein, 9 aa, Homo Sapiens
KRNYIRLSF

SEQ ID NO: 85962 - protein, 9 aa, Homo Sapiens
KRQEAIFEL

SEQ ID NO: 85963 - protein, 9 aa, Homo Sapiens
KRVFPKWTY

SEQ ID NO: 85964 - protein, 9 aa, Homo Sapiens
KRVTWIVEF

SEQ ID NO: 85965 - protein, 9 aa, Homo Sapiens
KRWEGLVHI

SEQ ID NO: 85966 - protein, 9 aa, Homo Sapiens
KRYDREFLL

SEQ ID NO: 85967 - protein, 9 aa, Homo Sapiens
LAPLTYISL

SEQ ID NO: 85968 - protein, 9 aa, Homo Sapiens
LPINGNGKQ

SEQ ID NO: 85969 - protein, 9 aa, Homo Sapiens
LRAQILAYK

SEQ ID NO: 85970 - protein, 9 aa, Homo Sapiens
LRFAFRASL

SEQ ID NO: 85971 - protein, 9 aa, Homo Sapiens
LRFDGALNV

SEQ ID NO: 85972 - protein, 9 aa, Homo Sapiens
LRFEVVPSK

SEQ ID NO: 85973 - protein, 9 aa, Homo Sapiens
LRFFQPWGL

SEQ ID NO: 85974 - protein, 9 aa, Homo Sapiens
LRFFWDNKF

SEQ ID NO: 85975 - protein, 9 aa, Homo Sapiens
LRFLFENKL

SEQ ID NO: 85976 - protein, 9 aa, Homo Sapiens
LRFNGRVLF

SEQ ID NO: 85977 - protein, 9 aa, Homo Sapiens
LRFPEILQK

SEQ ID NO: 85978 - protein, 9 aa, Homo Sapiens
LRFPGQLNA

SEQ ID NO: 85979 - protein, 9 aa, Homo Sapiens
LRFQSSAVM

SEQ ID NO: 85980 - protein, 9 aa, Homo Sapiens
LRHEIELRM

SEQ ID NO: 85981 - protein, 9 aa, Homo Sapiens
LRHPNILRL

SEQ ID NO: 85982 - protein, 9 aa, Homo Sapiens
LRIYISNTF

SEQ ID NO: 85983 - protein, 9 aa, Homo Sapiens
LRLDIINSL

SEQ ID NO: 85984 - protein, 9 aa, Homo Sapiens
LRLEAGLNR

SEQ ID NO: 85985 - protein, 9 aa, Homo Sapiens
LRLWLPKSL

SEQ ID NO: 85986 - protein, 9 aa, Homo Sapiens
LRNHMAVAF

SEQ ID NO: 85987 - protein, 9 aa, Homo Sapiens
LRNPLIAGK

SEQ ID NO: 85988 - protein, 9 aa, Homo Sapiens
LRNQSVFNF

SEQ ID NO: 85989 - protein, 9 aa, Homo Sapiens
LRSALQILF

SEQ ID NO: 85990 - protein, 9 aa, Homo Sapiens
LRSDLVLLY

SEQ ID NO: 85991 - protein, 9 aa, Homo Sapiens
LRSGVIVRL

SEQ ID NO: 85992 - protein, 9 aa, Homo Sapiens
LRSNVLLSF

SEQ ID NO: 85993 - protein, 9 aa, Homo Sapiens
LRSSIREFL

SEQ ID NO: 85994 - protein, 9 aa, Homo Sapiens
LRVTPFILK

SEQ ID NO: 85995 - protein, 9 aa, Homo Sapiens
LRWLGANAF

SEQ ID NO: 85996 - protein, 9 aa, Homo Sapiens
LRYLNFFTK

SEQ ID NO: 85997 - protein, 9 aa, Homo Sapiens
LRYPMAVGL

SEQ ID NO: 85998 - protein, 9 aa, Homo Sapiens
LTLPETASL

SEQ ID NO: 85999 - protein, 9 aa, Homo Sapiens
MAPLKMLAL

SEQ ID NO: 86000 - protein, 9 aa, Homo Sapiens
MRANITAIR

SEQ ID NO: 86001 - protein, 9 aa, Homo Sapiens
MRFDGLLGF

SEQ ID NO: 86002 - protein, 9 aa, Homo Sapiens
MRFDGRLGF

SEQ ID NO: 86003 - protein, 9 aa, Homo Sapiens
MRFLAATFL

SEQ ID NO: 86004 - protein, 9 aa, Homo Sapiens
MRLGSIFGL

SEQ ID NO: 86005 - protein, 9 aa, Homo Sapiens
MRLLPRLLL

SEQ ID NO: 86006 - protein, 9 aa, Homo Sapiens
MRLSLPLLL

SEQ ID NO: 86007 - protein, 9 aa, Homo Sapiens
MRMATPLLM

SEQ ID NO: 86008 - protein, 9 aa, Homo Sapiens
MRMSVGLSL

SEQ ID NO: 86009 - protein, 9 aa, Homo Sapiens
MRQKAVSLF

SEQ ID NO: 86010 - protein, 9 aa, Homo Sapiens
MRTSVKISY

SEQ ID NO: 86011 - protein, 9 aa, Homo Sapiens
MRYAVNVAL

SEQ ID NO: 86012 - protein, 9 aa, Homo Sapiens
MRYVASYLL

SEQ ID NO: 86013 - protein, 9 aa, Homo Sapiens
NRFTMEVPK

SEQ ID NO: 86014 - protein, 9 aa, Homo Sapiens
NRIKFVIKR

SEQ ID NO: 86015 - protein, 9 aa, Homo Sapiens
NRLDLLITY

SEQ ID NO: 86016 - protein, 9 aa, Homo Sapiens
NRLPLVVSF

SEQ ID NO: 86017 - protein, 9 aa, Homo Sapiens
NRLSFFFDF

SEQ ID NO: 86018 - protein, 9 aa, Homo Sapiens
NRSIVLLLK

SEQ ID NO: 86019 - protein, 9 aa, Homo Sapiens
NSIRFSIQL

SEQ ID NO: 86020 - protein, 9 aa, Homo Sapiens
PIRLLAAAA

SEQ ID NO: 86021 - protein, 9 aa, Homo Sapiens
QDHRGAFLI

SEQ ID NO: 86022 - protein, 9 aa, Homo Sapiens
QQLYWSHPR

SEQ ID NO: 86023 - protein, 9 aa, Homo Sapiens
QRAAIILGY

SEQ ID NO: 86024 - protein, 9 aa, Homo Sapiens
QRAAVIERF

SEQ ID NO: 86025 - protein, 9 aa, Homo Sapiens
QRAFILTVK

SEQ ID NO: 86026 - protein, 9 aa, Homo Sapiens
QRFASIVAK

SEQ ID NO: 86027 - protein, 9 aa, Homo Sapiens
QRFESYYNY

SEQ ID NO: 86028 - protein, 9 aa, Homo Sapiens
QRFFYTKSF

SEQ ID NO: 86029 - protein, 9 aa, Homo Sapiens
QRFGPPVSR

SEQ ID NO: 86030 - protein, 9 aa, Homo Sapiens
QRFKFLFNL

SEQ ID NO: 86031 - protein, 9 aa, Homo Sapiens
QRFPLSFGF

SEQ ID NO: 86032 - protein, 9 aa, Homo Sapiens
QRFRQFILL

SEQ ID NO: 86033 - protein, 9 aa, Homo Sapiens
QRFVFPVQF

SEQ ID NO: 86034 - protein, 9 aa, Homo Sapiens
QRGPVRVGF

SEQ ID NO: 86035 - protein, 9 aa, Homo Sapiens
QRHDGAFLI

SEQ ID NO: 86036 - protein, 9 aa, Homo Sapiens
QRHSFQISL

SEQ ID NO: 86037 - protein, 9 aa, Homo Sapiens
QRIDLAVLL

SEQ ID NO: 86038 - protein, 9 aa, Homo Sapiens
QRIHLRFMF

SEQ ID NO: 86039 - protein, 9 aa, Homo Sapiens
QRILSQPTF

SEQ ID NO: 86040 - protein, 9 aa, Homo Sapiens
QRINRIMGF

SEQ ID NO: 86041 - protein, 9 aa, Homo Sapiens
QRIQLAEKF

SEQ ID NO: 86042 - protein, 9 aa, Homo Sapiens
QRIYLVTTY

SEQ ID NO: 86043 - protein, 9 aa, Homo Sapiens
QRLDLQIKL

SEQ ID NO: 86044 - protein, 9 aa, Homo Sapiens
QRLEFDINI

SEQ ID NO: 86045 - protein, 9 aa, Homo Sapiens
QRLEMNLGL

SEQ ID NO: 86046 - protein, 9 aa, Homo Sapiens
QRLGFTPSV

SEQ ID NO: 86047 - protein, 9 aa, Homo Sapiens
QRLGIRISM

SEQ ID NO: 86048 - protein, 9 aa, Homo Sapiens
QRLKFRLNL

SEQ ID NO: 86049 - protein, 9 aa, Homo Sapiens
QRLKIMEYY

SEQ ID NO: 86050 - protein, 9 aa, Homo Sapiens
QRLLFRIGY

SEQ ID NO: 86051 - protein, 9 aa, Homo Sapiens
QRLLLVTVF

SEQ ID NO: 86052 - protein, 9 aa, Homo Sapiens
QRLSFLLEK

SEQ ID NO: 86053 - protein, 9 aa, Homo Sapiens
QRLSFSVSR

SEQ ID NO: 86054 - protein, 9 aa, Homo Sapiens
QRMDLVEAF

SEQ ID NO: 86055 - protein, 9 aa, Homo Sapiens
QRMNFLVTL

SEQ ID NO: 86056 - protein, 9 aa, Homo Sapiens
QRMSTRVLL

SEQ ID NO: 86057 - protein, 9 aa, Homo Sapiens
QRNEVVVEL

SEQ ID NO: 86058 - protein, 9 aa, Homo Sapiens
QRNLFILAY

SEQ ID NO: 86059 - protein, 9 aa, Homo Sapiens
QRNLYIAGF

SEQ ID NO: 86060 - protein, 9 aa, Homo Sapiens
QRNVNIFKF

SEQ ID NO: 86061 - protein, 9 aa, Homo Sapiens
QRQDIAFAY

SEQ ID NO: 86062 - protein, 9 aa, Homo Sapiens
QRQSILILK

SEQ ID NO: 86063 - protein, 9 aa, Homo Sapiens
QRSLVLFSV

SEQ ID NO: 86064 - protein, 9 aa, Homo Sapiens
QRTFVLEVM

SEQ ID NO: 86065 - protein, 9 aa, Homo Sapiens
QRTNLDVNL

SEQ ID NO: 86066 - protein, 9 aa, Homo Sapiens
QRTPVQMMY

SEQ ID NO: 86067 - protein, 9 aa, Homo Sapiens
QRTSILQTL

SEQ ID NO: 86068 - protein, 9 aa, Homo Sapiens
QRTSLIVHV

SEQ ID NO: 86069 - protein, 9 aa, Homo Sapiens
QRTVITEEF

SEQ ID NO: 86070 - protein, 9 aa, Homo Sapiens
QRVFPHAEF

SEQ ID NO: 86071 - protein, 9 aa, Homo Sapiens
QRVPLSVQL

SEQ ID NO: 86072 - protein, 9 aa, Homo Sapiens
QRVSIFFDY

SEQ ID NO: 86073 - protein, 9 aa, Homo Sapiens
QRWQSLLNF

SEQ ID NO: 86074 - protein, 9 aa, Homo Sapiens
QRWTVQTCL

SEQ ID NO: 86075 - protein, 9 aa, Homo Sapiens
QRYHFIMAY

SEQ ID NO: 86076 - protein, 9 aa, Homo Sapiens
RQTGIVLNR

SEQ ID NO: 86077 - protein, 9 aa, Homo Sapiens
RRAASLLRF

SEQ ID NO: 86078 - protein, 9 aa, Homo Sapiens
RRAEVELEY

SEQ ID NO: 86079 - protein, 9 aa, Homo Sapiens
RRAFVPQLR

SEQ ID NO: 86080 - protein, 9 aa, Homo Sapiens
RRAHIFPMA

SEQ ID NO: 86081 - protein, 9 aa, Homo Sapiens
RRAPVVVRL

SEQ ID NO: 86082 - protein, 9 aa, Homo Sapiens
RRAQPLVTL

SEQ ID NO: 86083 - protein, 9 aa, Homo Sapiens
RRASYEFMR

SEQ ID NO: 86084 - protein, 9 aa, Homo Sapiens
RRATVFLAM

SEQ ID NO: 86085 - protein, 9 aa, Homo Sapiens
RRDFNHINV

SEQ ID NO: 86086 - protein, 9 aa, Homo Sapiens
RRDILRVQL

SEQ ID NO: 86087 - protein, 9 aa, Homo Sapiens
RRFDLLKRI

SEQ ID NO: 86088 - protein, 9 aa, Homo Sapiens
RRFDTAFFL

SEQ ID NO: 86089 - protein, 9 aa, Homo Sapiens
RRFESFNLF

SEQ ID NO: 86090 - protein, 9 aa, Homo Sapiens
RRFFPYYVY

SEQ ID NO: 86091 - protein, 9 aa, Homo Sapiens
RRFGDKLNF

SEQ ID NO: 86092 - protein, 9 aa, Homo Sapiens
RRFHFSQSL

SEQ ID NO: 86093 - protein, 9 aa, Homo Sapiens
RRFIVVEGL

SEQ ID NO: 86094 - protein, 9 aa, Homo Sapiens
RRFKEPWFL

SEQ ID NO: 86095 - protein, 9 aa, Homo Sapiens
RRFLAARAL

SEQ ID NO: 86096 - protein, 9 aa, Homo Sapiens
RRFLAARTL

SEQ ID NO: 86097 - protein, 9 aa, Homo Sapiens
RRFLGRFGL

SEQ ID NO: 86098 - protein, 9 aa, Homo Sapiens
RRFLKLLRF

SEQ ID NO: 86099 - protein, 9 aa, Homo Sapiens
RRFLRTLRL

SEQ ID NO: 86100 - protein, 9 aa, Homo Sapiens
RRFLTQPQV

SEQ ID NO: 86101 - protein, 9 aa, Homo Sapiens
RRFLVTLRI

SEQ ID NO: 86102 - protein, 9 aa, Homo Sapiens
RRFLYIVNL

SEQ ID NO: 86103 - protein, 9 aa, Homo Sapiens
RRFMQTFVL

SEQ ID NO: 86104 - protein, 9 aa, Homo Sapiens
RRFNYVVKL

SEQ ID NO: 86105 - protein, 9 aa, Homo Sapiens
RRFPDLNRL

SEQ ID NO: 86106 - protein, 9 aa, Homo Sapiens
RRFPEQVRV

SEQ ID NO: 86107 - protein, 9 aa, Homo Sapiens
RRFQFLQKA

SEQ ID NO: 86108 - protein, 9 aa, Homo Sapiens
RRFQSMPVR

SEQ ID NO: 86109 - protein, 9 aa, Homo Sapiens
RRFREQPLL

SEQ ID NO: 86110 - protein, 9 aa, Homo Sapiens
RRFRGDVTL

SEQ ID NO: 86111 - protein, 9 aa, Homo Sapiens
RRFTEIYEF

SEQ ID NO: 86112 - protein, 9 aa, Homo Sapiens
RRFTTSVVR

SEQ ID NO: 86113 - protein, 9 aa, Homo Sapiens
RRFWNSIVM

SEQ ID NO: 86114 - protein, 9 aa, Homo Sapiens
RRGDFIHVM

SEQ ID NO: 86115 - protein, 9 aa, Homo Sapiens
RRGDITIKL

SEQ ID NO: 86116 - protein, 9 aa, Homo Sapiens
RRGEFIQEI

SEQ ID NO: 86117 - protein, 9 aa, Homo Sapiens
RRGLPRLAV

SEQ ID NO: 86118 - protein, 9 aa, Homo Sapiens
RRHEGLPGL

SEQ ID NO: 86119 - protein, 9 aa, Homo Sapiens
RRHFVQVQV

SEQ ID NO: 86120 - protein, 9 aa, Homo Sapiens
RRHIVAAGF

SEQ ID NO: 86121 - protein, 9 aa, Homo Sapiens
RRHMKVAFF

SEQ ID NO: 86122 - protein, 9 aa, Homo Sapiens
RRHNINIGI

SEQ ID NO: 86123 - protein, 9 aa, Homo Sapiens
RRHSIPTGL

SEQ ID NO: 86124 - protein, 9 aa, Homo Sapiens
RRIDFVLVY

SEQ ID NO: 86125 - protein, 9 aa, Homo Sapiens
RRIDITAKL

SEQ ID NO: 86126 - protein, 9 aa, Homo Sapiens
RRIDLNLDI

SEQ ID NO: 86127 - protein, 9 aa, Homo Sapiens
RRIEIAHTL

SEQ ID NO: 86128 - protein, 9 aa, Homo Sapiens
RRIEVNVEL

SEQ ID NO: 86129 - protein, 9 aa, Homo Sapiens
RRILVATNL

SEQ ID NO: 86130 - protein, 9 aa, Homo Sapiens
RRIQFPIEM

SEQ ID NO: 86131 - protein, 9 aa, Homo Sapiens
RRIQVVHAF

SEQ ID NO: 86132 - protein, 9 aa, Homo Sapiens
RRIYLILEY

SEQ ID NO: 86133 - protein, 9 aa, Homo Sapiens
RRKDLVLKY

SEQ ID NO: 86134 - protein, 9 aa, Homo Sapiens
RRKEFETNL

SEQ ID NO: 86135 - protein, 9 aa, Homo Sapiens
RRKEIMLGL

SEQ ID NO: 86136 - protein, 9 aa, Homo Sapiens
RRKEVVVYL

SEQ ID NO: 86137 - protein, 9 aa, Homo Sapiens
RRLDIVRSL

SEQ ID NO: 86138 - protein, 9 aa, Homo Sapiens
RRLDLPIER

SEQ ID NO: 86139 - protein, 9 aa, Homo Sapiens
RRLDLPSNL

SEQ ID NO: 86140 - protein, 9 aa, Homo Sapiens
RRLDLVHTA

SEQ ID NO: 86141 - protein, 9 aa, Homo Sapiens
RRLDPIPQL

SEQ ID NO: 86142 - protein, 9 aa, Homo Sapiens
RRLFPYSQY

SEQ ID NO: 86143 - protein, 9 aa, Homo Sapiens
RRLGLALGL

SEQ ID NO: 86144 - protein, 9 aa, Homo Sapiens
RRLGLAQKL

SEQ ID NO: 86145 - protein, 9 aa, Homo Sapiens
RRLGVQQSL

SEQ ID NO: 86146 - protein, 9 aa, Homo Sapiens
RRLHLVFEY

SEQ ID NO: 86147 - protein, 9 aa, Homo Sapiens
RRLKAELGI

SEQ ID NO: 86148 - protein, 9 aa, Homo Sapiens
RRLLLLLGF

SEQ ID NO: 86149 - protein, 9 aa, Homo Sapiens
RRLLLLPLL

SEQ ID NO: 86150 - protein, 9 aa, Homo Sapiens
RRLNFVRLL

SEQ ID NO: 86151 - protein, 9 aa, Homo Sapiens
RRLNVAITR

SEQ ID NO: 86152 - protein, 9 aa, Homo Sapiens
RRLPQAFRP

SEQ ID NO: 86153 - protein, 9 aa, Homo Sapiens
RRLQVQERL

SEQ ID NO: 86154 - protein, 9 aa, Homo Sapiens
RRLSADIRL

SEQ ID NO: 86155 - protein, 9 aa, Homo Sapiens
RRLSELLRY

SEQ ID NO: 86156 - protein, 9 aa, Homo Sapiens
RRLSFRSTI

SEQ ID NO: 86157 - protein, 9 aa, Homo Sapiens
RRLSLFLNV

SEQ ID NO: 86158 - protein, 9 aa, Homo Sapiens
RRLSVYRQI

SEQ ID NO: 86159 - protein, 9 aa, Homo Sapiens
RRLVFDNQL

SEQ ID NO: 86160 - protein, 9 aa, Homo Sapiens
RRLVGEIVR

SEQ ID NO: 86161 - protein, 9 aa, Homo Sapiens
RRMAEEFRL

SEQ ID NO: 86162 - protein, 9 aa, Homo Sapiens
RRMETIVFL

SEQ ID NO: 86163 - protein, 9 aa, Homo Sapiens
RRMEVYNEF

SEQ ID NO: 86164 - protein, 9 aa, Homo Sapiens
RRMFPFLSF

SEQ ID NO: 86165 - protein, 9 aa, Homo Sapiens
RRMPPPANL

SEQ ID NO: 86166 - protein, 9 aa, Homo Sapiens
RRMTVVGRL

SEQ ID NO: 86167 - protein, 9 aa, Homo Sapiens
RRMWPLAFG

SEQ ID NO: 86168 - protein, 9 aa, Homo Sapiens
RRMYPPPLI

SEQ ID NO: 86169 - protein, 9 aa, Homo Sapiens
RRNDKIIVF

SEQ ID NO: 86170 - protein, 9 aa, Homo Sapiens
RRNLELPRL

SEQ ID NO: 86171 - protein, 9 aa, Homo Sapiens
RRNPEPLRF

SEQ ID NO: 86172 - protein, 9 aa, Homo Sapiens
RRNQLLLEF

SEQ ID NO: 86173 - protein, 9 aa, Homo Sapiens
RRNVGRVLL

SEQ ID NO: 86174 - protein, 9 aa, Homo Sapiens
RRNYIIQNI

SEQ ID NO: 86175 - protein, 9 aa, Homo Sapiens
RRREFVMQV

SEQ ID NO: 86176 - protein, 9 aa, Homo Sapiens
RRSFIIQNI

SEQ ID NO: 86177 - protein, 9 aa, Homo Sapiens
RRSIISPNF

SEQ ID NO: 86178 - protein, 9 aa, Homo Sapiens
RRSNVLTGL

SEQ ID NO: 86179 - protein, 9 aa, Homo Sapiens
RRSPFLQVF

SEQ ID NO: 86180 - protein, 9 aa, Homo Sapiens
RRSQLLMLF

SEQ ID NO: 86181 - protein, 9 aa, Homo Sapiens
RRSQPLISL

SEQ ID NO: 86182 - protein, 9 aa, Homo Sapiens
RRSSIGLRV

SEQ ID NO: 86183 - protein, 9 aa, Homo Sapiens
RRSSINILL

SEQ ID NO: 86184 - protein, 9 aa, Homo Sapiens
RRSSIPITV

SEQ ID NO: 86185 - protein, 9 aa, Homo Sapiens
RRSVPFQML

SEQ ID NO: 86186 - protein, 9 aa, Homo Sapiens
RRSWKILLF

SEQ ID NO: 86187 - protein, 9 aa, Homo Sapiens
RRTEIIEDL

SEQ ID NO: 86188 - protein, 9 aa, Homo Sapiens
RRTGIPISM

SEQ ID NO: 86189 - protein, 9 aa, Homo Sapiens
RRVEIAHAL

SEQ ID NO: 86190 - protein, 9 aa, Homo Sapiens
RRVEKHWRL

SEQ ID NO: 86191 - protein, 9 aa, Homo Sapiens
RRVFIIETM

SEQ ID NO: 86192 - protein, 9 aa, Homo Sapiens
RRVLVQVSY

SEQ ID NO: 86193 - protein, 9 aa, Homo Sapiens
RRVNVELQL

SEQ ID NO: 86194 - protein, 9 aa, Homo Sapiens
RRVQPRVNV

SEQ ID NO: 86195 - protein, 9 aa, Homo Sapiens
RRVQVLLHF

SEQ ID NO: 86196 - protein, 9 aa, Homo Sapiens
RRVYEILRL

SEQ ID NO: 86197 - protein, 9 aa, Homo Sapiens
RRWDDDVVF

SEQ ID NO: 86198 - protein, 9 aa, Homo Sapiens
RRWEQALTF

SEQ ID NO: 86199 - protein, 9 aa, Homo Sapiens
RRWFIQQEM

SEQ ID NO: 86200 - protein, 9 aa, Homo Sapiens
RRWKGLERV

SEQ ID NO: 86201 - protein, 9 aa, Homo Sapiens
RRYEIAVNL

SEQ ID NO: 86202 - protein, 9 aa, Homo Sapiens
RRYGDFFIR

SEQ ID NO: 86203 - protein, 9 aa, Homo Sapiens
RRYNIIPVL

SEQ ID NO: 86204 - protein, 9 aa, Homo Sapiens
RRYQDAIRV

SEQ ID NO: 86205 - protein, 9 aa, Homo Sapiens
RRYVFKLGV

SEQ ID NO: 86206 - protein, 9 aa, Homo Sapiens
RRYWIFPSI

SEQ ID NO: 86207 - protein, 9 aa, Homo Sapiens
RRYWVLPYL

SEQ ID NO: 86208 - protein, 9 aa, Homo Sapiens
RSLSRIFEL

SEQ ID NO: 86209 - protein, 9 aa, Homo Sapiens
SIRFPLFNF

SEQ ID NO: 86210 - protein, 9 aa, Homo Sapiens
SLIEQTTAL

SEQ ID NO: 86211 - protein, 9 aa, Homo Sapiens
SRAKVKFNV

SEQ ID NO: 86212 - protein, 9 aa, Homo Sapiens
SRANSLFAF

SEQ ID NO: 86213 - protein, 9 aa, Homo Sapiens
SRAQFFLHL

SEQ ID NO: 86214 - protein, 9 aa, Homo Sapiens
SRAVTIFIR

SEQ ID NO: 86215 - protein, 9 aa, Homo Sapiens
SRDDNMFQI

SEQ ID NO: 86216 - protein, 9 aa, Homo Sapiens
SRFAQIVQK

SEQ ID NO: 86217 - protein, 9 aa, Homo Sapiens
SRFDIPLGL

SEQ ID NO: 86218 - protein, 9 aa, Homo Sapiens
SRFDLLWLI

SEQ ID NO: 86219 - protein, 9 aa, Homo Sapiens
SRFDMIFIV

SEQ ID NO: 86220 - protein, 9 aa, Homo Sapiens
SRFEKEFSF

SEQ ID NO: 86221 - protein, 9 aa, Homo Sapiens
SRFGKFIQV

SEQ ID NO: 86222 - protein, 9 aa, Homo Sapiens
SRFGKFIRI

SEQ ID NO: 86223 - protein, 9 aa, Homo Sapiens
SRFGKYFEI

SEQ ID NO: 86224 - protein, 9 aa, Homo Sapiens
SRFGNAFHL

SEQ ID NO: 86225 - protein, 9 aa, Homo Sapiens
SRFGSKLGL

SEQ ID NO: 86226 - protein, 9 aa, Homo Sapiens
SRFGTLVNL

SEQ ID NO: 86227 - protein, 9 aa, Homo Sapiens
SRFIFNYVY

SEQ ID NO: 86228 - protein, 9 aa, Homo Sapiens
SRFIKFQEM

SEQ ID NO: 86229 - protein, 9 aa, Homo Sapiens
SRFLIINAM

SEQ ID NO: 86230 - protein, 9 aa, Homo Sapiens
SRFLKSDLF

SEQ ID NO: 86231 - protein, 9 aa, Homo Sapiens
SRFLMPEAY

SEQ ID NO: 86232 - protein, 9 aa, Homo Sapiens
SRFLPRPVF

SEQ ID NO: 86233 - protein, 9 aa, Homo Sapiens
SRFLWVTLL

SEQ ID NO: 86234 - protein, 9 aa, Homo Sapiens
SRFPEALRL

SEQ ID NO: 86235 - protein, 9 aa, Homo Sapiens
SRFQGTLYL

SEQ ID NO: 86236 - protein, 9 aa, Homo Sapiens
SRFQTYITY

SEQ ID NO: 86237 - protein, 9 aa, Homo Sapiens
SRFSLENNF

SEQ ID NO: 86238 - protein, 9 aa, Homo Sapiens
SRFSNVYHL

SEQ ID NO: 86239 - protein, 9 aa, Homo Sapiens
SRHRLLLLL

SEQ ID NO: 86240 - protein, 9 aa, Homo Sapiens
SRHSLDMKF

SEQ ID NO: 86241 - protein, 9 aa, Homo Sapiens
SRIDICLRK

SEQ ID NO: 86242 - protein, 9 aa, Homo Sapiens
SRIDLIPSL

SEQ ID NO: 86243 - protein, 9 aa, Homo Sapiens
SRIDVMVHF

SEQ ID NO: 86244 - protein, 9 aa, Homo Sapiens
SRIFILAHF

SEQ ID NO: 86245 - protein, 9 aa, Homo Sapiens
SRIFVKIFF

SEQ ID NO: 86246 - protein, 9 aa, Homo Sapiens
SRIGLLTRI

SEQ ID NO: 86247 - protein, 9 aa, Homo Sapiens
SRIHVCLYF

SEQ ID NO: 86248 - protein, 9 aa, Homo Sapiens
SRIPFNQAL

SEQ ID NO: 86249 - protein, 9 aa, Homo Sapiens
SRIRKLFNL

SEQ ID NO: 86250 - protein, 9 aa, Homo Sapiens
SRIWPLYLR

SEQ ID NO: 86251 - protein, 9 aa, Homo Sapiens
SRKLVSFTL

SEQ ID NO: 86252 - protein, 9 aa, Homo Sapiens
SRLAIRNEF

SEQ ID NO: 86253 - protein, 9 aa, Homo Sapiens
SRLDQELKL

SEQ ID NO: 86254 - protein, 9 aa, Homo Sapiens
SRLFAVIRF

SEQ ID NO: 86255 - protein, 9 aa, Homo Sapiens
SRLFLFVAL

SEQ ID NO: 86256 - protein, 9 aa, Homo Sapiens
SRLKAAFVK

SEQ ID NO: 86257 - protein, 9 aa, Homo Sapiens
SRLKESFLV

SEQ ID NO: 86258 - protein, 9 aa, Homo Sapiens
SRLKIHFTK

SEQ ID NO: 86259 - protein, 9 aa, Homo Sapiens
SRLKSILKL

SEQ ID NO: 86260 - protein, 9 aa, Homo Sapiens
SRLLLIWQH

SEQ ID NO: 86261 - protein, 9 aa, Homo Sapiens
SRLPFLFTL

SEQ ID NO: 86262 - protein, 9 aa, Homo Sapiens
SRLPRQLFL

SEQ ID NO: 86263 - protein, 9 aa, Homo Sapiens
SRLQIDPVM

SEQ ID NO: 86264 - protein, 9 aa, Homo Sapiens
SRLQPFLQR

SEQ ID NO: 86265 - protein, 9 aa, Homo Sapiens
SRLQYYVPR

SEQ ID NO: 86266 - protein, 9 aa, Homo Sapiens
SRLYIAYQF

SEQ ID NO: 86267 - protein, 9 aa, Homo Sapiens
SRLYLIFEF

SEQ ID NO: 86268 - protein, 9 aa, Homo Sapiens
SRMQLSAEL

SEQ ID NO: 86269 - protein, 9 aa, Homo Sapiens
SRMYFTQTL

SEQ ID NO: 86270 - protein, 9 aa, Homo Sapiens
SRNALLFNL

SEQ ID NO: 86271 - protein, 9 aa, Homo Sapiens
SRNAQTFGF

SEQ ID NO: 86272 - protein, 9 aa, Homo Sapiens
SRNLFVLGF

SEQ ID NO: 86273 - protein, 9 aa, Homo Sapiens
SRNQQIFLR

SEQ ID NO: 86274 - protein, 9 aa, Homo Sapiens
SRSLLQTTF

SEQ ID NO: 86275 - protein, 9 aa, Homo Sapiens
SRSLVNIVK

SEQ ID NO: 86276 - protein, 9 aa, Homo Sapiens
SRSVIRPPF

SEQ ID NO: 86277 - protein, 9 aa, Homo Sapiens
SRTPVLMNF

SEQ ID NO: 86278 - protein, 9 aa, Homo Sapiens
SRTPYHVNL

SEQ ID NO: 86279 - protein, 9 aa, Homo Sapiens
SRVAEMFLF

SEQ ID NO: 86280 - protein, 9 aa, Homo Sapiens
SRVKFSPSL

SEQ ID NO: 86281 - protein, 9 aa, Homo Sapiens
SRVKLILEY

SEQ ID NO: 86282 - protein, 9 aa, Homo Sapiens
SRVLIFSQM

SEQ ID NO: 86283 - protein, 9 aa, Homo Sapiens
SRVLQNVAF

SEQ ID NO: 86284 - protein, 9 aa, Homo Sapiens
SRVPLFPVF

SEQ ID NO: 86285 - protein, 9 aa, Homo Sapiens
SRVWWDSSF

SEQ ID NO: 86286 - protein, 9 aa, Homo Sapiens
SRWEKVVQR

SEQ ID NO: 86287 - protein, 9 aa, Homo Sapiens
SRWLAQPYY

SEQ ID NO: 86288 - protein, 9 aa, Homo Sapiens
SRWLGLLSV

SEQ ID NO: 86289 - protein, 9 aa, Homo Sapiens
SRWPAFPAF

SEQ ID NO: 86290 - protein, 9 aa, Homo Sapiens
SRYFGVLQR

SEQ ID NO: 86291 - protein, 9 aa, Homo Sapiens
SRYLYTLVI

SEQ ID NO: 86292 - protein, 9 aa, Homo Sapiens
SRYQDILVF

SEQ ID NO: 86293 - protein, 9 aa, Homo Sapiens
SRYQGVNLY

SEQ ID NO: 86294 - protein, 9 aa, Homo Sapiens
SRYSFIQAL

SEQ ID NO: 86295 - protein, 9 aa, Homo Sapiens
SRYTGINQF

SEQ ID NO: 86296 - protein, 9 aa, Homo Sapiens
SVPAFASSL

SEQ ID NO: 86297 - protein, 9 aa, Homo Sapiens
SVPVSLQTL

SEQ ID NO: 86298 - protein, 9 aa, Homo Sapiens
TCPRTLLEL

SEQ ID NO: 86299 - protein, 9 aa, Homo Sapiens
TRADLIFTV

SEQ ID NO: 86300 - protein, 9 aa, Homo Sapiens
TRAFLPLLK

SEQ ID NO: 86301 - protein, 9 aa, Homo Sapiens
TRCQFQTKF

SEQ ID NO: 86302 - protein, 9 aa, Homo Sapiens
TRFDQVMKF

SEQ ID NO: 86303 - protein, 9 aa, Homo Sapiens
TRFFQSHYF

SEQ ID NO: 86304 - protein, 9 aa, Homo Sapiens
TRFNKQFLY

SEQ ID NO: 86305 - protein, 9 aa, Homo Sapiens
TRFTITLNY

SEQ ID NO: 86306 - protein, 9 aa, Homo Sapiens
TRISNIFVI

SEQ ID NO: 86307 - protein, 9 aa, Homo Sapiens
TRLFAPWKR

SEQ ID NO: 86308 - protein, 9 aa, Homo Sapiens
TRLFAVLRF

SEQ ID NO: 86309 - protein, 9 aa, Homo Sapiens
TRLFLILNI

SEQ ID NO: 86310 - protein, 9 aa, Homo Sapiens
TRLGFFTTY

SEQ ID NO: 86311 - protein, 9 aa, Homo Sapiens
TRLGIQLDF

SEQ ID NO: 86312 - protein, 9 aa, Homo Sapiens
TRMAIVLRF

SEQ ID NO: 86313 - protein, 9 aa, Homo Sapiens
TRMAVQFEL

SEQ ID NO: 86314 - protein, 9 aa, Homo Sapiens
TRMGPLINR

SEQ ID NO: 86315 - protein, 9 aa, Homo Sapiens
TRMRHVISY

SEQ ID NO: 86316 - protein, 9 aa, Homo Sapiens
TRSAIILHL

SEQ ID NO: 86317 - protein, 9 aa, Homo Sapiens
TRTIYQFHY

SEQ ID NO: 86318 - protein, 9 aa, Homo Sapiens
TRVDTILEF

SEQ ID NO: 86319 - protein, 9 aa, Homo Sapiens
TRVFSLVGK

SEQ ID NO: 86320 - protein, 9 aa, Homo Sapiens
TRVGLDIGK

SEQ ID NO: 86321 - protein, 9 aa, Homo Sapiens
TRVYLILEY

SEQ ID NO: 86322 - protein, 9 aa, Homo Sapiens
TRWDYLTQV

SEQ ID NO: 86323 - protein, 9 aa, Homo Sapiens
TRWNKIVLK

SEQ ID NO: 86324 - protein, 9 aa, Homo Sapiens
TRYHFLILL

SEQ ID NO: 86325 - protein, 9 aa, Homo Sapiens
TRYLIKLLL

SEQ ID NO: 86326 - protein, 9 aa, Homo Sapiens
TRYMFSRPF

SEQ ID NO: 86327 - protein, 9 aa, Homo Sapiens
TRYPTILQL

SEQ ID NO: 86328 - protein, 9 aa, Homo Sapiens
TRYQGVNLY

SEQ ID NO: 86329 - protein, 9 aa, Homo Sapiens
TRYQTFVNF

SEQ ID NO: 86330 - protein, 9 aa, Homo Sapiens
TSRTPLLSM

SEQ ID NO: 86331 - protein, 9 aa, Homo Sapiens
VGRTKLEVK

SEQ ID NO: 86332 - protein, 9 aa, Homo Sapiens
VIPTNVPEL

SEQ ID NO: 86333 - protein, 9 aa, Homo Sapiens
VRAAFQLRL

SEQ ID NO: 86334 - protein, 9 aa, Homo Sapiens
VRAQIRLQF

SEQ ID NO: 86335 - protein, 9 aa, Homo Sapiens
VRAWVVFKL

SEQ ID NO: 86336 - protein, 9 aa, Homo Sapiens
VRFLLGLRF

SEQ ID NO: 86337 - protein, 9 aa, Homo Sapiens
VRLLILILK

SEQ ID NO: 86338 - protein, 9 aa, Homo Sapiens
VRLNIISNL

SEQ ID NO: 86339 - protein, 9 aa, Homo Sapiens
VRLPPITKF

SEQ ID NO: 86340 - protein, 9 aa, Homo Sapiens
VRNDIYITL

SEQ ID NO: 86341 - protein, 9 aa, Homo Sapiens
VRNLSTILK

SEQ ID NO: 86342 - protein, 9 aa, Homo Sapiens
VRNNVIIVM

SEQ ID NO: 86343 - protein, 9 aa, Homo Sapiens
VRNPFTVTV

SEQ ID NO: 86344 - protein, 9 aa, Homo Sapiens
VRSTVRIGL

SEQ ID NO: 86345 - protein, 9 aa, Homo Sapiens
VRVSIAISR

SEQ ID NO: 86346 - protein, 9 aa, Homo Sapiens
VVPPFLQPE

SEQ ID NO: 86347 - protein, 9 aa, Homo Sapiens
WRFKPIEQL

SEQ ID NO: 86348 - protein, 9 aa, Homo Sapiens
WRSDLELQF

SEQ ID NO: 86349 - protein, 9 aa, Homo Sapiens
WRSDVLVEY

SEQ ID NO: 86350 - protein, 9 aa, Homo Sapiens
WRYMGGFAK

SEQ ID NO: 86351 - protein, 9 aa, Homo Sapiens
YIPHGYMEL

SEQ ID NO: 86352 - protein, 9 aa, Homo Sapiens
YRANVIANI

SEQ ID NO: 86353 - protein, 9 aa, Homo Sapiens
YRFETVQKL

SEQ ID NO: 86354 - protein, 9 aa, Homo Sapiens
YRFFLGNQF

SEQ ID NO: 86355 - protein, 9 aa, Homo Sapiens
YRFHEHWRF

SEQ ID NO: 86356 - protein, 9 aa, Homo Sapiens
YRHFLQITL

SEQ ID NO: 86357 - protein, 9 aa, Homo Sapiens
YRHLGRYLF

SEQ ID NO: 86358 - protein, 9 aa, Homo Sapiens
YRIESYWTY

SEQ ID NO: 86359 - protein, 9 aa, Homo Sapiens
YRIKFKESF

SEQ ID NO: 86360 - protein, 9 aa, Homo Sapiens
YRINLQMRL

SEQ ID NO: 86361 - protein, 9 aa, Homo Sapiens
YRIPLNPYL

SEQ ID NO: 86362 - protein, 9 aa, Homo Sapiens
YRKFFETKL

SEQ ID NO: 86363 - protein, 9 aa, Homo Sapiens
YRLGPLLGK

SEQ ID NO: 86364 - protein, 9 aa, Homo Sapiens
YRQPPVPQY

SEQ ID NO: 86365 - protein, 9 aa, Homo Sapiens
YRTDMIQAL

SEQ ID NO: 86366 - protein, 9 aa, Homo Sapiens
YRVTIHKTF

SEQ ID NO: 86367 - protein, 9 aa, Homo Sapiens
YRVYQPVRY

SEQ ID NO: 86368 - protein, 9 aa, Homo Sapiens
YRYPIVLGY

SEQ ID NO: 86369 - protein, 9 aa, Homo Sapiens
YRYRDIVVR

SEQ ID NO: 86370 - protein, 9 aa, Homo Sapiens
YRYYQQLKL

SEQ ID NO: 86371 - protein, 10 aa, Homo Sapiens
ARAALTGLLH

SEQ ID NO: 86372 - protein, 10 aa, Homo Sapiens
ARADLIEVVM

SEQ ID NO: 86373 - protein, 10 aa, Homo Sapiens
ARALFIRPFM

SEQ ID NO: 86374 - protein, 10 aa, Homo Sapiens
ARARLSNLAL

SEQ ID NO: 86375 - protein, 10 aa, Homo Sapiens
ARFALTVVRH

SEQ ID NO: 86376 - protein, 10 aa, Homo Sapiens
ARFAVGTAGL

SEQ ID NO: 86377 - protein, 10 aa, Homo Sapiens
ARFDAYFHQK

SEQ ID NO: 86378 - protein, 10 aa, Homo Sapiens
ARFEGDFKLF

SEQ ID NO: 86379 - protein, 10 aa, Homo Sapiens
ARFEQLISRR

SEQ ID NO: 86380 - protein, 10 aa, Homo Sapiens
ARFGEAVVAR

SEQ ID NO: 86381 - protein, 10 aa, Homo Sapiens
ARFGESIVNL

SEQ ID NO: 86382 - protein, 10 aa, Homo Sapiens
ARFKGQDLKL

SEQ ID NO: 86383 - protein, 10 aa, Homo Sapiens
ARFLLEGQVF

SEQ ID NO: 86384 - protein, 10 aa, Homo Sapiens
ARFRNISRIM

SEQ ID NO: 86385 - protein, 10 aa, Homo Sapiens
ARFSPDGQYL

SEQ ID NO: 86386 - protein, 10 aa, Homo Sapiens
ARFTGAPLKV

SEQ ID NO: 86387 - protein, 10 aa, Homo Sapiens
ARFTGIKTAI

SEQ ID NO: 86388 - protein, 10 aa, Homo Sapiens
ARFTGVGVSK

SEQ ID NO: 86389 - protein, 10 aa, Homo Sapiens
ARFYAVQKLA

SEQ ID NO: 86390 - protein, 10 aa, Homo Sapiens
ARFYGNVSRF

SEQ ID NO: 86391 - protein, 10 aa, Homo Sapiens
ARGFLPYVGM

SEQ ID NO: 86392 - protein, 10 aa, Homo Sapiens
ARHDVIKGLL

SEQ ID NO: 86393 - protein, 10 aa, Homo Sapiens
ARHFQPFARL

SEQ ID NO: 86394 - protein, 10 aa, Homo Sapiens
ARHGEKLLLF

SEQ ID NO: 86395 - protein, 10 aa, Homo Sapiens
ARIKLGDYHF

SEQ ID NO: 86396 - protein, 10 aa, Homo Sapiens
ARIKQIKPLL

SEQ ID NO: 86397 - protein, 10 aa, Homo Sapiens
ARILLDNDHY

SEQ ID NO: 86398 - protein, 10 aa, Homo Sapiens
ARIPPVAVRL

SEQ ID NO: 86399 - protein, 10 aa, Homo Sapiens
ARIRLDQDRL

SEQ ID NO: 86400 - protein, 10 aa, Homo Sapiens
ARISMADVKF

SEQ ID NO: 86401 - protein, 10 aa, Homo Sapiens
ARKQIVINLM

SEQ ID NO: 86402 - protein, 10 aa, Homo Sapiens
ARLAQLLEGY

SEQ ID NO: 86403 - protein, 10 aa, Homo Sapiens
ARLDHKFDLM

SEQ ID NO: 86404 - protein, 10 aa, Homo Sapiens
ARLDWELEQR

SEQ ID NO: 86405 - protein, 10 aa, Homo Sapiens
ARLGILPVGR

SEQ ID NO: 86406 - protein, 10 aa, Homo Sapiens
ARLKDALVRM

SEQ ID NO: 86407 - protein, 10 aa, Homo Sapiens
ARLLLPVAEY

SEQ ID NO: 86408 - protein, 10 aa, Homo Sapiens
ARLNFIWKGF

SEQ ID NO: 86409 - protein, 10 aa, Homo Sapiens
ARLPYLRTWF

SEQ ID NO: 86410 - protein, 10 aa, Homo Sapiens
ARLQIEIGKL

SEQ ID NO: 86411 - protein, 10 aa, Homo Sapiens
ARLQLQGLDL

SEQ ID NO: 86412 - protein, 10 aa, Homo Sapiens
ARLQQMSERF

SEQ ID NO: 86413 - protein, 10 aa, Homo Sapiens
ARLSLTYERL

SEQ ID NO: 86414 - protein, 10 aa, Homo Sapiens
ARLTPIPFGL

SEQ ID NO: 86415 - protein, 10 aa, Homo Sapiens
ARMAQPIVAF

SEQ ID NO: 86416 - protein, 10 aa, Homo Sapiens
ARMKIDPEAF

SEQ ID NO: 86417 - protein, 10 aa, Homo Sapiens
ARMRVLSKAF

SEQ ID NO: 86418 - protein, 10 aa, Homo Sapiens
ARNKEIVHTF

SEQ ID NO: 86419 - protein, 10 aa, Homo Sapiens
ARNSFRYNGL

SEQ ID NO: 86420 - protein, 10 aa, Homo Sapiens
ARNSVLMSGF

SEQ ID NO: 86421 - protein, 10 aa, Homo Sapiens
ARSLFNRMDF

SEQ ID NO: 86422 - protein, 10 aa, Homo Sapiens
ARTLLAILRL

SEQ ID NO: 86423 - protein, 10 aa, Homo Sapiens
ARVFFVHEGY

SEQ ID NO: 86424 - protein, 10 aa, Homo Sapiens
ARVHIGQVIM

SEQ ID NO: 86425 - protein, 10 aa, Homo Sapiens
ARVTGVPLSY

SEQ ID NO: 86426 - protein, 10 aa, Homo Sapiens
ARWLALGSLF

SEQ ID NO: 86427 - protein, 10 aa, Homo Sapiens
ARWLPLGLGL

SEQ ID NO: 86428 - protein, 10 aa, Homo Sapiens
ARWLVRPKEK

SEQ ID NO: 86429 - protein, 10 aa, Homo Sapiens
ARYQLSAIFK

SEQ ID NO: 86430 - protein, 10 aa, Homo Sapiens
ATPAGDIMEL

SEQ ID NO: 86431 - protein, 10 aa, Homo Sapiens
CRFQIVQVLK

SEQ ID NO: 86432 - protein, 10 aa, Homo Sapiens
CRHFVGILNK

SEQ ID NO: 86433 - protein, 10 aa, Homo Sapiens
CRSVAGLLPR

SEQ ID NO: 86434 - protein, 10 aa, Homo Sapiens
FMGNTIIIVM

SEQ ID NO: 86435 - protein, 10 aa, Homo Sapiens
FRFGESTTGF

SEQ ID NO: 86436 - protein, 10 aa, Homo Sapiens
FRFSGLLLGY

SEQ ID NO: 86437 - protein, 10 aa, Homo Sapiens
FRFSGRILGL

SEQ ID NO: 86438 - protein, 10 aa, Homo Sapiens
FRLRYLVGGL

SEQ ID NO: 86439 - protein, 10 aa, Homo Sapiens
FRNIPGITLL

SEQ ID NO: 86440 - protein, 10 aa, Homo Sapiens
FRQYAKDIGF

SEQ ID NO: 86441 - protein, 10 aa, Homo Sapiens
FRYNGLIHRK

SEQ ID NO: 86442 - protein, 10 aa, Homo Sapiens
GQYGNPLNKY

SEQ ID NO: 86443 - protein, 10 aa, Homo Sapiens
GRAEKVTFQF

SEQ ID NO: 86444 - protein, 10 aa, Homo Sapiens
GRALLSLQKF

SEQ ID NO: 86445 - protein, 10 aa, Homo Sapiens
GRAPISNPGM

SEQ ID NO: 86446 - protein, 10 aa, Homo Sapiens
GRDGRLRVGL

SEQ ID NO: 86447 - protein, 10 aa, Homo Sapiens
GRFAPQFSGY

SEQ ID NO: 86448 - protein, 10 aa, Homo Sapiens
GRFDEAYIYM

SEQ ID NO: 86449 - protein, 10 aa, Homo Sapiens
GRFDITIGPK

SEQ ID NO: 86450 - protein, 10 aa, Homo Sapiens
GRFDSSIIRI

SEQ ID NO: 86451 - protein, 10 aa, Homo Sapiens
GRFFSENSSL

SEQ ID NO: 86452 - protein, 10 aa, Homo Sapiens
GRFGGNPGGF

SEQ ID NO: 86453 - protein, 10 aa, Homo Sapiens
GRFGNTPFLF

SEQ ID NO: 86454 - protein, 10 aa, Homo Sapiens
GRFGPLASVK

SEQ ID NO: 86455 - protein, 10 aa, Homo Sapiens
GRFGQDFSTF

SEQ ID NO: 86456 - protein, 10 aa, Homo Sapiens
GRFIVIIPRT

SEQ ID NO: 86457 - protein, 10 aa, Homo Sapiens
GRFKDVLVLL

SEQ ID NO: 86458 - protein, 10 aa, Homo Sapiens
GRFLTGPLNL

SEQ ID NO: 86459 - protein, 10 aa, Homo Sapiens
GRFNGQFKTY

SEQ ID NO: 86460 - protein, 10 aa, Homo Sapiens
GRFPYPQIQK

SEQ ID NO: 86461 - protein, 10 aa, Homo Sapiens
GRFSQLYPER

SEQ ID NO: 86462 - protein, 10 aa, Homo Sapiens
GRFYAFGRVF

SEQ ID NO: 86463 - protein, 10 aa, Homo Sapiens
GRHDIAFVEF

SEQ ID NO: 86464 - protein, 10 aa, Homo Sapiens
GRIAHIPLYF

SEQ ID NO: 86465 - protein, 10 aa, Homo Sapiens
GRIDQVNQLL

SEQ ID NO: 86466 - protein, 10 aa, Homo Sapiens
GRIGNFIVKK

SEQ ID NO: 86467 - protein, 10 aa, Homo Sapiens
GRIKAIQLEY

SEQ ID NO: 86468 - protein, 10 aa, Homo Sapiens
GRIKEIFCPK

SEQ ID NO: 86469 - protein, 10 aa, Homo Sapiens
GRIKLQKALL

SEQ ID NO: 86470 - protein, 10 aa, Homo Sapiens
GRIKVNGIDY

SEQ ID NO: 86471 - protein, 10 aa, Homo Sapiens
GRIRDIDLKR

SEQ ID NO: 86472 - protein, 10 aa, Homo Sapiens
GRISDFHETY

SEQ ID NO: 86473 - protein, 10 aa, Homo Sapiens
GRKDVVEHLL

SEQ ID NO: 86474 - protein, 10 aa, Homo Sapiens
GRKVFVEIPK

SEQ ID NO: 86475 - protein, 10 aa, Homo Sapiens
GRLAAIVAKQ

SEQ ID NO: 86476 - protein, 10 aa, Homo Sapiens
GRLDAVLQRI

SEQ ID NO: 86477 - protein, 10 aa, Homo Sapiens
GRLDLQYAKL

SEQ ID NO: 86478 - protein, 10 aa, Homo Sapiens
GRLFGISLSY

SEQ ID NO: 86479 - protein, 10 aa, Homo Sapiens
GRLLWEQELY

SEQ ID NO: 86480 - protein, 10 aa, Homo Sapiens
GRLPLFGLGR

SEQ ID NO: 86481 - protein, 10 aa, Homo Sapiens
GRLQLFGQDF

SEQ ID NO: 86482 - protein, 10 aa, Homo Sapiens
GRLQQVLTGL

SEQ ID NO: 86483 - protein, 10 aa, Homo Sapiens
GRLSGIEERY

SEQ ID NO: 86484 - protein, 10 aa, Homo Sapiens
GRLTQIKGLF

SEQ ID NO: 86485 - protein, 10 aa, Homo Sapiens
GRMALEFNRL

SEQ ID NO: 86486 - protein, 10 aa, Homo Sapiens
GRMFKQFNKL

SEQ ID NO: 86487 - protein, 10 aa, Homo Sapiens
GRMGIEILSF

SEQ ID NO: 86488 - protein, 10 aa, Homo Sapiens
GRMKFTRPLF

SEQ ID NO: 86489 - protein, 10 aa, Homo Sapiens
GRMKIETNRL

SEQ ID NO: 86490 - protein, 10 aa, Homo Sapiens
GRSAFIGIGF

SEQ ID NO: 86491 - protein, 10 aa, Homo Sapiens
GRSQVSTPRF

SEQ ID NO: 86492 - protein, 10 aa, Homo Sapiens
GRTQLIDAVL

SEQ ID NO: 86493 - protein, 10 aa, Homo Sapiens
GRTYPVQEYF

SEQ ID NO: 86494 - protein, 10 aa, Homo Sapiens
GRVALADIAF

SEQ ID NO: 86495 - protein, 10 aa, Homo Sapiens
GRVGDVYIPR

SEQ ID NO: 86496 - protein, 10 aa, Homo Sapiens
GRVGLLGNTY

SEQ ID NO: 86497 - protein, 10 aa, Homo Sapiens
GRVKGVTIVK

SEQ ID NO: 86498 - protein, 10 aa, Homo Sapiens
GRVLFPATGY

SEQ ID NO: 86499 - protein, 10 aa, Homo Sapiens
GRVLLQNTSF

SEQ ID NO: 86500 - protein, 10 aa, Homo Sapiens
GRVPYPRIPL

SEQ ID NO: 86501 - protein, 10 aa, Homo Sapiens
GRVSLYQPKF

SEQ ID NO: 86502 - protein, 10 aa, Homo Sapiens
GRVYPQAVYF

SEQ ID NO: 86503 - protein, 10 aa, Homo Sapiens
GRWEAAEGLL

SEQ ID NO: 86504 - protein, 10 aa, Homo Sapiens
GRWPGSSLYY

SEQ ID NO: 86505 - protein, 10 aa, Homo Sapiens
GRYDGLVGMF

SEQ ID NO: 86506 - protein, 10 aa, Homo Sapiens
GRYDKTQLRF

SEQ ID NO: 86507 - protein, 10 aa, Homo Sapiens
GRYDMAQLRF

SEQ ID NO: 86508 - protein, 10 aa, Homo Sapiens
GRYFQVEVEK

SEQ ID NO: 86509 - protein, 10 aa, Homo Sapiens
GRYLGKKVQF

SEQ ID NO: 86510 - protein, 10 aa, Homo Sapiens
HPGRVLLQNL

SEQ ID NO: 86511 - protein, 10 aa, Homo Sapiens
HRFEQAFYTY

SEQ ID NO: 86512 - protein, 10 aa, Homo Sapiens
HRFFTEILRM

SEQ ID NO: 86513 - protein, 10 aa, Homo Sapiens
HRFPFSRPEL

SEQ ID NO: 86514 - protein, 10 aa, Homo Sapiens
HRFPSPLAPR

SEQ ID NO: 86515 - protein, 10 aa, Homo Sapiens
HRFYGKNSSY

SEQ ID NO: 86516 - protein, 10 aa, Homo Sapiens
HRFYPDKIDY

SEQ ID NO: 86517 - protein, 10 aa, Homo Sapiens
HRISVFRPGL

SEQ ID NO: 86518 - protein, 10 aa, Homo Sapiens
HRLEELYTKK

SEQ ID NO: 86519 - protein, 10 aa, Homo Sapiens
HRLIIKPYLR

SEQ ID NO: 86520 - protein, 10 aa, Homo Sapiens
HRMWGRLVGL

SEQ ID NO: 86521 - protein, 10 aa, Homo Sapiens
HRWLKGGVVL

SEQ ID NO: 86522 - protein, 10 aa, Homo Sapiens
IQRTPKIQVY

SEQ ID NO: 86523 - protein, 10 aa, Homo Sapiens
IRAFPNKQGY

SEQ ID NO: 86524 - protein, 10 aa, Homo Sapiens
IRFDSSFSRL

SEQ ID NO: 86525 - protein, 10 aa, Homo Sapiens
IRFSNISAAK

SEQ ID NO: 86526 - protein, 10 aa, Homo Sapiens
IRHTVNKITF

SEQ ID NO: 86527 - protein, 10 aa, Homo Sapiens
IRVMLYPSRI

SEQ ID NO: 86528 - protein, 10 aa, Homo Sapiens
IRYPDSHQLF

SEQ ID NO: 86529 - protein, 10 aa, Homo Sapiens
KRFDDPGLML

SEQ ID NO: 86530 - protein, 10 aa, Homo Sapiens
KRFEELGVKF

SEQ ID NO: 86531 - protein, 10 aa, Homo Sapiens
KRFEELTNLI

SEQ ID NO: 86532 - protein, 10 aa, Homo Sapiens
KRFEQKGFRL

SEQ ID NO: 86533 - protein, 10 aa, Homo Sapiens
KRFGLNIDRW

SEQ ID NO: 86534 - protein, 10 aa, Homo Sapiens
KRFHITENSY

SEQ ID NO: 86535 - protein, 10 aa, Homo Sapiens
KRFNADNKLL

SEQ ID NO: 86536 - protein, 10 aa, Homo Sapiens
KRFQAIISRM

SEQ ID NO: 86537 - protein, 10 aa, Homo Sapiens
KRFSVPVQHF

SEQ ID NO: 86538 - protein, 10 aa, Homo Sapiens
KRFYEFSIRL

SEQ ID NO: 86539 - protein, 10 aa, Homo Sapiens
KRFYLPGTSR

SEQ ID NO: 86540 - protein, 10 aa, Homo Sapiens
KRHDLVKLGF

SEQ ID NO: 86541 - protein, 10 aa, Homo Sapiens
KRHNLAIDLM

SEQ ID NO: 86542 - protein, 10 aa, Homo Sapiens
KRHNVFGLDL

SEQ ID NO: 86543 - protein, 10 aa, Homo Sapiens
KRHRPIGIGV

SEQ ID NO: 86544 - protein, 10 aa, Homo Sapiens
KRIDMVPELL

SEQ ID NO: 86545 - protein, 10 aa, Homo Sapiens
KRIEAIVKNY

SEQ ID NO: 86546 - protein, 10 aa, Homo Sapiens
KRIEEFLAQF

SEQ ID NO: 86547 - protein, 10 aa, Homo Sapiens
KRIKPRPERF

SEQ ID NO: 86548 - protein, 10 aa, Homo Sapiens
KRLCEIFTRM

SEQ ID NO: 86549 - protein, 10 aa, Homo Sapiens
KRLDVTVQSF

SEQ ID NO: 86550 - protein, 10 aa, Homo Sapiens
KRLDYITAEI

SEQ ID NO: 86551 - protein, 10 aa, Homo Sapiens
KRLEFLYDKL

SEQ ID NO: 86552 - protein, 10 aa, Homo Sapiens
KRLERVIIGY

SEQ ID NO: 86553 - protein, 10 aa, Homo Sapiens
KRLGYVVRRF

SEQ ID NO: 86554 - protein, 10 aa, Homo Sapiens
KRLNVTPLAR

SEQ ID NO: 86555 - protein, 10 aa, Homo Sapiens
KRLSFHDMNL

SEQ ID NO: 86556 - protein, 10 aa, Homo Sapiens
KRMEHFYLNF

SEQ ID NO: 86557 - protein, 10 aa, Homo Sapiens
KRNGVIIAGY

SEQ ID NO: 86558 - protein, 10 aa, Homo Sapiens
KRVAFNVSKM

SEQ ID NO: 86559 - protein, 10 aa, Homo Sapiens
KRVAVILNEF

SEQ ID NO: 86560 - protein, 10 aa, Homo Sapiens
KRVYLGALKY

SEQ ID NO: 86561 - protein, 10 aa, Homo Sapiens
KRVYNIPVRF

SEQ ID NO: 86562 - protein, 10 aa, Homo Sapiens
KRWGPNYNLM

SEQ ID NO: 86563 - protein, 10 aa, Homo Sapiens
KRWQAIYKQF

SEQ ID NO: 86564 - protein, 10 aa, Homo Sapiens
KRWQNEKLGL

SEQ ID NO: 86565 - protein, 10 aa, Homo Sapiens
KRYAVPSAGL

SEQ ID NO: 86566 - protein, 10 aa, Homo Sapiens
KRYDNVTILF

SEQ ID NO: 86567 - protein, 10 aa, Homo Sapiens
KRYPSLWRRL

SEQ ID NO: 86568 - protein, 10 aa, Homo Sapiens
KRYQDIIHSI

SEQ ID NO: 86569 - protein, 10 aa, Homo Sapiens
KRYWTKTIEK

SEQ ID NO: 86570 - protein, 10 aa, Homo Sapiens
KTIQDLVSLK

SEQ ID NO: 86571 - protein, 10 aa, Homo Sapiens
KVGCKLIPVI

SEQ ID NO: 86572 - protein, 10 aa, Homo Sapiens
LQLRAAALQP

SEQ ID NO: 86573 - protein, 10 aa, Homo Sapiens
LRFDKEVALF

SEQ ID NO: 86574 - protein, 10 aa, Homo Sapiens
LRFEVVPSKF

SEQ ID NO: 86575 - protein, 10 aa, Homo Sapiens
LRFSEIPMKL

SEQ ID NO: 86576 - protein, 10 aa, Homo Sapiens
LRIQINPQNK

SEQ ID NO: 86577 - protein, 10 aa, Homo Sapiens
LRLDSRLWPK

SEQ ID NO: 86578 - protein, 10 aa, Homo Sapiens
LRTALIFGGF

SEQ ID NO: 86579 - protein, 10 aa, Homo Sapiens
LRVDQIIMAK

SEQ ID NO: 86580 - protein, 10 aa, Homo Sapiens
LRVKELEVRK

SEQ ID NO: 86581 - protein, 10 aa, Homo Sapiens
LRVTSVVTGF

SEQ ID NO: 86582 - protein, 10 aa, Homo Sapiens
LSPSSLFSAL

SEQ ID NO: 86583 - protein, 10 aa, Homo Sapiens
LSSDPIALGV

SEQ ID NO: 86584 - protein, 10 aa, Homo Sapiens
MIDRKPRLLF

SEQ ID NO: 86585 - protein, 10 aa, Homo Sapiens
MRANITAIRR

SEQ ID NO: 86586 - protein, 10 aa, Homo Sapiens
MRFSYPDIHF

SEQ ID NO: 86587 - protein, 10 aa, Homo Sapiens
MRLKIGFILR

SEQ ID NO: 86588 - protein, 10 aa, Homo Sapiens
MRLPSGKVGF

SEQ ID NO: 86589 - protein, 10 aa, Homo Sapiens
MRLSLPLLLL

SEQ ID NO: 86590 - protein, 10 aa, Homo Sapiens
MRQKAVSLFL

SEQ ID NO: 86591 - protein, 10 aa, Homo Sapiens
MVLAGRAPGL

SEQ ID NO: 86592 - protein, 10 aa, Homo Sapiens
NLPINGNGKQ

SEQ ID NO: 86593 - protein, 10 aa, Homo Sapiens
NRFAGFGIGL

SEQ ID NO: 86594 - protein, 10 aa, Homo Sapiens
NRFEDILSLF

SEQ ID NO: 86595 - protein, 10 aa, Homo Sapiens
NRLFVGSIPK

SEQ ID NO: 86596 - protein, 10 aa, Homo Sapiens
NRMEPLWTGF

SEQ ID NO: 86597 - protein, 10 aa, Homo Sapiens
PKIVKWDRDM

SEQ ID NO: 86598 - protein, 10 aa, Homo Sapiens
QRFDRPLVTF

SEQ ID NO: 86599 - protein, 10 aa, Homo Sapiens
QRFGELMRKL

SEQ ID NO: 86600 - protein, 10 aa, Homo Sapiens
QRFSHQGVQL

SEQ ID NO: 86601 - protein, 10 aa, Homo Sapiens
QRLDLQIKLS

SEQ ID NO: 86602 - protein, 10 aa, Homo Sapiens
QRLEQLVEAK

SEQ ID NO: 86603 - protein, 10 aa, Homo Sapiens
QRLGTQPYFF

SEQ ID NO: 86604 - protein, 10 aa, Homo Sapiens
QRLIFAGKQL

SEQ ID NO: 86605 - protein, 10 aa, Homo Sapiens
QRMAIQVDKF

SEQ ID NO: 86606 - protein, 10 aa, Homo Sapiens
QRTGLSPLKF

SEQ ID NO: 86607 - protein, 10 aa, Homo Sapiens
QRVQLHIAMF

SEQ ID NO: 86608 - protein, 10 aa, Homo Sapiens
QRWDEAFRKF

SEQ ID NO: 86609 - protein, 10 aa, Homo Sapiens
QRYDSVINRL

SEQ ID NO: 86610 - protein, 10 aa, Homo Sapiens
RDYVVPILII

SEQ ID NO: 86611 - protein, 10 aa, Homo Sapiens
RMFLSFPTTK

SEQ ID NO: 86612 - protein, 10 aa, Homo Sapiens
RQASVIIQRF

SEQ ID NO: 86613 - protein, 10 aa, Homo Sapiens
RQLSVLFRKL

SEQ ID NO: 86614 - protein, 10 aa, Homo Sapiens
RRACYGVLRF

SEQ ID NO: 86615 - protein, 10 aa, Homo Sapiens
RRADLTYAEF

SEQ ID NO: 86616 - protein, 10 aa, Homo Sapiens
RRAKFKFPGR

SEQ ID NO: 86617 - protein, 10 aa, Homo Sapiens
RRALLHYLDF

SEQ ID NO: 86618 - protein, 10 aa, Homo Sapiens
RRAQLPKYQR

SEQ ID NO: 86619 - protein, 10 aa, Homo Sapiens
RRASYEFMRR

SEQ ID NO: 86620 - protein, 10 aa, Homo Sapiens
RRDPLGRDFL

SEQ ID NO: 86621 - protein, 10 aa, Homo Sapiens
RRDVQKVVGF

SEQ ID NO: 86622 - protein, 10 aa, Homo Sapiens
RRFDAMPFTL

SEQ ID NO: 86623 - protein, 10 aa, Homo Sapiens
RRFDLLKRIL

SEQ ID NO: 86624 - protein, 10 aa, Homo Sapiens
RRFDLRFVVI

SEQ ID NO: 86625 - protein, 10 aa, Homo Sapiens
RRFEFQADAF

SEQ ID NO: 86626 - protein, 10 aa, Homo Sapiens
RRFFLEYDRL

SEQ ID NO: 86627 - protein, 10 aa, Homo Sapiens
RRFFMGNQVL

SEQ ID NO: 86628 - protein, 10 aa, Homo Sapiens
RRFGDKLNFR

SEQ ID NO: 86629 - protein, 10 aa, Homo Sapiens
RRFKEFLRQY

SEQ ID NO: 86630 - protein, 10 aa, Homo Sapiens
RRFNIKLWKT

SEQ ID NO: 86631 - protein, 10 aa, Homo Sapiens
RRFQSMPVRL

SEQ ID NO: 86632 - protein, 10 aa, Homo Sapiens
RRFSDIQIRR

SEQ ID NO: 86633 - protein, 10 aa, Homo Sapiens
RRFSILFTMF

SEQ ID NO: 86634 - protein, 10 aa, Homo Sapiens
RRFTTSVVRR

SEQ ID NO: 86635 - protein, 10 aa, Homo Sapiens
RRFVIFPIEY

SEQ ID NO: 86636 - protein, 10 aa, Homo Sapiens
RRFVNVVPTF

SEQ ID NO: 86637 - protein, 10 aa, Homo Sapiens
RRHALIVQGF

SEQ ID NO: 86638 - protein, 10 aa, Homo Sapiens
RRHGLLFLHL

SEQ ID NO: 86639 - protein, 10 aa, Homo Sapiens
RRHVFIWISF

SEQ ID NO: 86640 - protein, 10 aa, Homo Sapiens
RRIANLIKEL

SEQ ID NO: 86641 - protein, 10 aa, Homo Sapiens
RRIAQEVQRF

SEQ ID NO: 86642 - protein, 10 aa, Homo Sapiens
RRIDEINKEL

SEQ ID NO: 86643 - protein, 10 aa, Homo Sapiens
RRIDQLNREL

SEQ ID NO: 86644 - protein, 10 aa, Homo Sapiens
RRIKLYAVEK

SEQ ID NO: 86645 - protein, 10 aa, Homo Sapiens
RRILDGSLGF

SEQ ID NO: 86646 - protein, 10 aa, Homo Sapiens
RRILGLLDAY

SEQ ID NO: 86647 - protein, 10 aa, Homo Sapiens
RRILMGSTLR

SEQ ID NO: 86648 - protein, 10 aa, Homo Sapiens
RRILVATNLF

SEQ ID NO: 86649 - protein, 10 aa, Homo Sapiens
RRINLLVKSF

SEQ ID NO: 86650 - protein, 10 aa, Homo Sapiens
RRIQDPLIEF

SEQ ID NO: 86651 - protein, 10 aa, Homo Sapiens
RRIQFPIEMS

SEQ ID NO: 86652 - protein, 10 aa, Homo Sapiens
RRISGVDRYY

SEQ ID NO: 86653 - protein, 10 aa, Homo Sapiens
RRISIVENCF

SEQ ID NO: 86654 - protein, 10 aa, Homo Sapiens
RRISIVGFGL

SEQ ID NO: 86655 - protein, 10 aa, Homo Sapiens
RRKDGVFLYF

SEQ ID NO: 86656 - protein, 10 aa, Homo Sapiens
RRKDHSFLGF

SEQ ID NO: 86657 - protein, 10 aa, Homo Sapiens
RRKDWIGIFR

SEQ ID NO: 86658 - protein, 10 aa, Homo Sapiens
RRLALFPGVA

SEQ ID NO: 86659 - protein, 10 aa, Homo Sapiens
RRLDFDYKKK

SEQ ID NO: 86660 - protein, 10 aa, Homo Sapiens
RRLDIAGRDI

SEQ ID NO: 86661 - protein, 10 aa, Homo Sapiens
RRLDIEAERL

SEQ ID NO: 86662 - protein, 10 aa, Homo Sapiens
RRLDLLHQQL

SEQ ID NO: 86663 - protein, 10 aa, Homo Sapiens
RRLDTSSLKL

SEQ ID NO: 86664 - protein, 10 aa, Homo Sapiens
RRLEDLIQGL

SEQ ID NO: 86665 - protein, 10 aa, Homo Sapiens
RRLEELITIF

SEQ ID NO: 86666 - protein, 10 aa, Homo Sapiens
RRLEELLRQM

SEQ ID NO: 86667 - protein, 10 aa, Homo Sapiens
RRLENLENLL

SEQ ID NO: 86668 - protein, 10 aa, Homo Sapiens
RRLENNRPLL

SEQ ID NO: 86669 - protein, 10 aa, Homo Sapiens
RRLENVENLL

SEQ ID NO: 86670 - protein, 10 aa, Homo Sapiens
RRLEPAIQKF

SEQ ID NO: 86671 - protein, 10 aa, Homo Sapiens
RRLFEQNVQR

SEQ ID NO: 86672 - protein, 10 aa, Homo Sapiens
RRLGELVKKL

SEQ ID NO: 86673 - protein, 10 aa, Homo Sapiens
RRLGLALGLL

SEQ ID NO: 86674 - protein, 10 aa, Homo Sapiens
RRLIDLGVGL

SEQ ID NO: 86675 - protein, 10 aa, Homo Sapiens
RRLILQGNRI

SEQ ID NO: 86676 - protein, 10 aa, Homo Sapiens
RRLLDTTITF

SEQ ID NO: 86677 - protein, 10 aa, Homo Sapiens
RRLLLLPLLL

SEQ ID NO: 86678 - protein, 10 aa, Homo Sapiens
RRLLPSLIGR

SEQ ID NO: 86679 - protein, 10 aa, Homo Sapiens
RRLLSIKEAF

SEQ ID NO: 86680 - protein, 10 aa, Homo Sapiens
RRLNFLESKF

SEQ ID NO: 86681 - protein, 10 aa, Homo Sapiens
RRLPDQFSKL

SEQ ID NO: 86682 - protein, 10 aa, Homo Sapiens
RRLPILPTLL

SEQ ID NO: 86683 - protein, 10 aa, Homo Sapiens
RRLPTVLLKL

SEQ ID NO: 86684 - protein, 10 aa, Homo Sapiens
RRLPVPRPSF

SEQ ID NO: 86685 - protein, 10 aa, Homo Sapiens
RRLQIEDFEA

SEQ ID NO: 86686 - protein, 10 aa, Homo Sapiens
RRLQYLSSKF

SEQ ID NO: 86687 - protein, 10 aa, Homo Sapiens
RRLSAIFLRL

SEQ ID NO: 86688 - protein, 10 aa, Homo Sapiens
RRLSFLVSYI

SEQ ID NO: 86689 - protein, 10 aa, Homo Sapiens
RRLSIHLNKY

SEQ ID NO: 86690 - protein, 10 aa, Homo Sapiens
RRLVGLASLR

SEQ ID NO: 86691 - protein, 10 aa, Homo Sapiens
RRLVKLVVNF

SEQ ID NO: 86692 - protein, 10 aa, Homo Sapiens
RRLYPLAIQI

SEQ ID NO: 86693 - protein, 10 aa, Homo Sapiens
RRMEIQVKDL

SEQ ID NO: 86694 - protein, 10 aa, Homo Sapiens
RRMLLAHVDL

SEQ ID NO: 86695 - protein, 10 aa, Homo Sapiens
RRMQEMIARM

SEQ ID NO: 86696 - protein, 10 aa, Homo Sapiens
RRMQSINAGF

SEQ ID NO: 86697 - protein, 10 aa, Homo Sapiens
RRMWATQGLA

SEQ ID NO: 86698 - protein, 10 aa, Homo Sapiens
RRMWPLAFGS

SEQ ID NO: 86699 - protein, 10 aa, Homo Sapiens
RRNAVLEADF

SEQ ID NO: 86700 - protein, 10 aa, Homo Sapiens
RRNDDIINFF

SEQ ID NO: 86701 - protein, 10 aa, Homo Sapiens
RRNELKRSFF

SEQ ID NO: 86702 - protein, 10 aa, Homo Sapiens
RRNGPLPLKY

SEQ ID NO: 86703 - protein, 10 aa, Homo Sapiens
RRNGTLPWLR

SEQ ID NO: 86704 - protein, 10 aa, Homo Sapiens
RRNLILNLGL

SEQ ID NO: 86705 - protein, 10 aa, Homo Sapiens
RRNSINFERL

SEQ ID NO: 86706 - protein, 10 aa, Homo Sapiens
RRNSVFQQGM

SEQ ID NO: 86707 - protein, 10 aa, Homo Sapiens
RRNVFFPKRR

SEQ ID NO: 86708 - protein, 10 aa, Homo Sapiens
RRNVNLLEKL

SEQ ID NO: 86709 - protein, 10 aa, Homo Sapiens
RRRIFDAVGF

SEQ ID NO: 86710 - protein, 10 aa, Homo Sapiens
RRSDVEILGY

SEQ ID NO: 86711 - protein, 10 aa, Homo Sapiens
RRSELVFWRW

SEQ ID NO: 86712 - protein, 10 aa, Homo Sapiens
RRSGYITIGY

SEQ ID NO: 86713 - protein, 10 aa, Homo Sapiens
RRSINQPVAF

SEQ ID NO: 86714 - protein, 10 aa, Homo Sapiens
RRSLLFRNAF

SEQ ID NO: 86715 - protein, 10 aa, Homo Sapiens
RRSSIPITVR

SEQ ID NO: 86716 - protein, 10 aa, Homo Sapiens
RRSSLWPMTF

SEQ ID NO: 86717 - protein, 10 aa, Homo Sapiens
RRVFIAGLGL

SEQ ID NO: 86718 - protein, 10 aa, Homo Sapiens
RRVLLLAGRL

SEQ ID NO: 86719 - protein, 10 aa, Homo Sapiens
RRVNQAIWLL

SEQ ID NO: 86720 - protein, 10 aa, Homo Sapiens
RRVVLVNNIL

SEQ ID NO: 86721 - protein, 10 aa, Homo Sapiens
RRWDDSQKYL

SEQ ID NO: 86722 - protein, 10 aa, Homo Sapiens
RRWEQALTFR

SEQ ID NO: 86723 - protein, 10 aa, Homo Sapiens
RRWEQSLRAL

SEQ ID NO: 86724 - protein, 10 aa, Homo Sapiens
RRWGDSVLLV

SEQ ID NO: 86725 - protein, 10 aa, Homo Sapiens
RRWLPAGDAL

SEQ ID NO: 86726 - protein, 10 aa, Homo Sapiens
RRWREPGVGA

SEQ ID NO: 86727 - protein, 10 aa, Homo Sapiens
RRWYPEEYEF

SEQ ID NO: 86728 - protein, 10 aa, Homo Sapiens
RRYDFFVSRF

SEQ ID NO: 86729 - protein, 10 aa, Homo Sapiens
RRYFTQIVGF

SEQ ID NO: 86730 - protein, 10 aa, Homo Sapiens
RRYGLPYVVR

SEQ ID NO: 86731 - protein, 10 aa, Homo Sapiens
RRYHGYIFGF

SEQ ID NO: 86732 - protein, 10 aa, Homo Sapiens
RRYHILGNEM

SEQ ID NO: 86733 - protein, 10 aa, Homo Sapiens
RRYLPKLKAF

SEQ ID NO: 86734 - protein, 10 aa, Homo Sapiens
RRYLSPKYIK

SEQ ID NO: 86735 - protein, 10 aa, Homo Sapiens
RRYNIKLWKT

SEQ ID NO: 86736 - protein, 10 aa, Homo Sapiens
RRYQDAIRVF

SEQ ID NO: 86737 - protein, 10 aa, Homo Sapiens
RRYYKPGLLM

SEQ ID NO: 86738 - protein, 10 aa, Homo Sapiens
SRFAGASIKI

SEQ ID NO: 86739 - protein, 10 aa, Homo Sapiens
SRFDASFFGV

SEQ ID NO: 86740 - protein, 10 aa, Homo Sapiens
SRFDMIFIVK

SEQ ID NO: 86741 - protein, 10 aa, Homo Sapiens
SRFEALNLSF

SEQ ID NO: 86742 - protein, 10 aa, Homo Sapiens
SRFFLQGIQL

SEQ ID NO: 86743 - protein, 10 aa, Homo Sapiens
SRFFMTPPRL

SEQ ID NO: 86744 - protein, 10 aa, Homo Sapiens
SRFGNAFLNR

SEQ ID NO: 86745 - protein, 10 aa, Homo Sapiens
SRFKDRIVSM

SEQ ID NO: 86746 - protein, 10 aa, Homo Sapiens
SRFSLENNFL

SEQ ID NO: 86747 - protein, 10 aa, Homo Sapiens
SRFVDGLTFK

SEQ ID NO: 86748 - protein, 10 aa, Homo Sapiens
SRFYGDLMEK

SEQ ID NO: 86749 - protein, 10 aa, Homo Sapiens
SRHSGPFFTF

SEQ ID NO: 86750 - protein, 10 aa, Homo Sapiens
SRIQQIIEGK

SEQ ID NO: 86751 - protein, 10 aa, Homo Sapiens
SRIWPLYLRF

SEQ ID NO: 86752 - protein, 10 aa, Homo Sapiens
SRLDLIAQQM

SEQ ID NO: 86753 - protein, 10 aa, Homo Sapiens
SRLDQPFIPR

SEQ ID NO: 86754 - protein, 10 aa, Homo Sapiens
SRLDWPVRTL

SEQ ID NO: 86755 - protein, 10 aa, Homo Sapiens
SRLGLRYNRL

SEQ ID NO: 86756 - protein, 10 aa, Homo Sapiens
SRLGNSLLLK

SEQ ID NO: 86757 - protein, 10 aa, Homo Sapiens
SRLKALNATF

SEQ ID NO: 86758 - protein, 10 aa, Homo Sapiens
SRLKYPPFAK

SEQ ID NO: 86759 - protein, 10 aa, Homo Sapiens
SRLPSLGAGF

SEQ ID NO: 86760 - protein, 10 aa, Homo Sapiens
SRLQPFLQRY

SEQ ID NO: 86761 - protein, 10 aa, Homo Sapiens
SRLRYPINGF

SEQ ID NO: 86762 - protein, 10 aa, Homo Sapiens
SRLWPKIQGL

SEQ ID NO: 86763 - protein, 10 aa, Homo Sapiens
SRLYLNVLNR

SEQ ID NO: 86764 - protein, 10 aa, Homo Sapiens
SRMLSGGFGY

SEQ ID NO: 86765 - protein, 10 aa, Homo Sapiens
SRNSFMVIPK

SEQ ID NO: 86766 - protein, 10 aa, Homo Sapiens
SRQGGLLVNF

SEQ ID NO: 86767 - protein, 10 aa, Homo Sapiens
SRTDILSLKM

SEQ ID NO: 86768 - protein, 10 aa, Homo Sapiens
SRTPYHVNLL

SEQ ID NO: 86769 - protein, 10 aa, Homo Sapiens
SRTSVTDVKF

SEQ ID NO: 86770 - protein, 10 aa, Homo Sapiens
SRVILAGNLL

SEQ ID NO: 86771 - protein, 10 aa, Homo Sapiens
SRVNIPKVLR

SEQ ID NO: 86772 - protein, 10 aa, Homo Sapiens
SRWEKVVQRL

SEQ ID NO: 86773 - protein, 10 aa, Homo Sapiens
SRWLAQPYYL

SEQ ID NO: 86774 - protein, 10 aa, Homo Sapiens
TRFFGEALEF

SEQ ID NO: 86775 - protein, 10 aa, Homo Sapiens
TRFYLVFEKL

SEQ ID NO: 86776 - protein, 10 aa, Homo Sapiens
TRIEGLLAAF

SEQ ID NO: 86777 - protein, 10 aa, Homo Sapiens
TRILFFNTPK

SEQ ID NO: 86778 - protein, 10 aa, Homo Sapiens
TRISIFGLGY

SEQ ID NO: 86779 - protein, 10 aa, Homo Sapiens
TRLKLQGAKF

SEQ ID NO: 86780 - protein, 10 aa, Homo Sapiens
TRLSLLNMTF

SEQ ID NO: 86781 - protein, 10 aa, Homo Sapiens
TRMVLVNAVY

SEQ ID NO: 86782 - protein, 10 aa, Homo Sapiens
TRTFIVGAQM

SEQ ID NO: 86783 - protein, 10 aa, Homo Sapiens
VRAIPVDIGF

SEQ ID NO: 86784 - protein, 10 aa, Homo Sapiens
VRFIGELTKF

SEQ ID NO: 86785 - protein, 10 aa, Homo Sapiens
VRFNVLKVTK

SEQ ID NO: 86786 - protein, 10 aa, Homo Sapiens
VRFSPDGNRF

SEQ ID NO: 86787 - protein, 10 aa, Homo Sapiens
VRFYIESISY

SEQ ID NO: 86788 - protein, 10 aa, Homo Sapiens
VRGGVAVPLR

SEQ ID NO: 86789 - protein, 10 aa, Homo Sapiens
VRMNVLADAL

SEQ ID NO: 86790 - protein, 10 aa, Homo Sapiens
VRNGYGFINR

SEQ ID NO: 86791 - protein, 10 aa, Homo Sapiens
VRVKLVSAGF

SEQ ID NO: 86792 - protein, 10 aa, Homo Sapiens
VRWAPNENKF

SEQ ID NO: 86793 - protein, 10 aa, Homo Sapiens
VRWFDPKSSF

SEQ ID NO: 86794 - protein, 10 aa, Homo Sapiens
WRFSGQIERV

SEQ ID NO: 86795 - protein, 10 aa, Homo Sapiens
WRVSLDVNHF

SEQ ID NO: 86796 - protein, 10 aa, Homo Sapiens
YRADIKEMGL

SEQ ID NO: 86797 - protein, 10 aa, Homo Sapiens
YRFATDRNDF

SEQ ID NO: 86798 - protein, 10 aa, Homo Sapiens
YRFDTVIARI

SEQ ID NO: 86799 - protein, 10 aa, Homo Sapiens
YRFEVPTAKF

SEQ ID NO: 86800 - protein, 10 aa, Homo Sapiens
YRFGEMQLDF

SEQ ID NO: 86801 - protein, 10 aa, Homo Sapiens
YRFLPQKIIY

SEQ ID NO: 86802 - protein, 10 aa, Homo Sapiens
YRFNGQYSSL

SEQ ID NO: 86803 - protein, 10 aa, Homo Sapiens
YRGDFETFIK

SEQ ID NO: 86804 - protein, 10 aa, Homo Sapiens
YRIQLKPEQF

SEQ ID NO: 86805 - protein, 10 aa, Homo Sapiens
YRLDLEGNEY

SEQ ID NO: 86806 - protein, 10 aa, Homo Sapiens
YRNEFTAWYR

SEQ ID NO: 86807 - protein, 10 aa, Homo Sapiens
YRNWALKESF

SEQ ID NO: 86808 - protein, 10 aa, Homo Sapiens
YRTEIRMARM

SEQ ID NO: 86809 - protein, 10 aa, Homo Sapiens
YRVLLRYEGF

SEQ ID NO: 86810 - protein, 10 aa, Homo Sapiens
YRWFPSGKVV

SEQ ID NO: 86811 - protein, 10 aa, Homo Sapiens
YRWHINFTTF

SEQ ID NO: 86812 - protein, 10 aa, Homo Sapiens
YRYGIKPEWM

SEQ ID NO: 86813 - protein, 10 aa, Homo Sapiens
YRYIGKTMDY

SEQ ID NO: 86814 - protein, 10 aa, Homo Sapiens
YRYYNKYINV

SEQ ID NO: 86815 - protein, 11 aa, Homo Sapiens
ARAALQELLSK

SEQ ID NO: 86816 - protein, 11 aa, Homo Sapiens
ARAKFIPLITV

SEQ ID NO: 86817 - protein, 11 aa, Homo Sapiens
ARALFIRPFML

SEQ ID NO: 86818 - protein, 11 aa, Homo Sapiens
ARAVVTGLLAL

SEQ ID NO: 86819 - protein, 11 aa, Homo Sapiens
ARDEIEAMIKR

SEQ ID NO: 86820 - protein, 11 aa, Homo Sapiens
ARFDGAEGSWF

SEQ ID NO: 86821 - protein, 11 aa, Homo Sapiens
ARFDPYGKNKF

SEQ ID NO: 86822 - protein, 11 aa, Homo Sapiens
ARFDSKDEILL

SEQ ID NO: 86823 - protein, 11 aa, Homo Sapiens
ARFGPGGQLIK

SEQ ID NO: 86824 - protein, 11 aa, Homo Sapiens
ARFNDLRFVGR

SEQ ID NO: 86825 - protein, 11 aa, Homo Sapiens
ARFPQLDSTSF

SEQ ID NO: 86826 - protein, 11 aa, Homo Sapiens
ARFRNISRIMR

SEQ ID NO: 86827 - protein, 11 aa, Homo Sapiens
ARFRYLMGERL

SEQ ID NO: 86828 - protein, 11 aa, Homo Sapiens
ARFSGNLLVSL

SEQ ID NO: 86829 - protein, 11 aa, Homo Sapiens
ARFSPDGQYLV

SEQ ID NO: 86830 - protein, 11 aa, Homo Sapiens
ARGGFVQILTK

SEQ ID NO: 86831 - protein, 11 aa, Homo Sapiens
ARHGHVDTLKF

SEQ ID NO: 86832 - protein, 11 aa, Homo Sapiens
ARHSNVNLTIF

SEQ ID NO: 86833 - protein, 11 aa, Homo Sapiens
ARIKQIKPLLS

SEQ ID NO: 86834 - protein, 11 aa, Homo Sapiens
ARIQILEGWKK

SEQ ID NO: 86835 - protein, 11 aa, Homo Sapiens
ARLDHKFDLMY

SEQ ID NO: 86836 - protein, 11 aa, Homo Sapiens
ARLDILKIHSR

SEQ ID NO: 86837 - protein, 11 aa, Homo Sapiens
ARLDLPYELLF

SEQ ID NO: 86838 - protein, 11 aa, Homo Sapiens
ARLDWELEQRK

SEQ ID NO: 86839 - protein, 11 aa, Homo Sapiens
ARLEALDYLQK

SEQ ID NO: 86840 - protein, 11 aa, Homo Sapiens
ARLKQQTIPLK

SEQ ID NO: 86841 - protein, 11 aa, Homo Sapiens
ARLLQDHPWLL

SEQ ID NO: 86842 - protein, 11 aa, Homo Sapiens
ARLLQTSNITK

SEQ ID NO: 86843 - protein, 11 aa, Homo Sapiens
ARLNPQYPMFR

SEQ ID NO: 86844 - protein, 11 aa, Homo Sapiens
ARLSAIYGGTY

SEQ ID NO: 86845 - protein, 11 aa, Homo Sapiens
ARLVALNSLKK

SEQ ID NO: 86846 - protein, 11 aa, Homo Sapiens
ARLVQGSILKK

SEQ ID NO: 86847 - protein, 11 aa, Homo Sapiens
ARMLELPTIYR

SEQ ID NO: 86848 - protein, 11 aa, Homo Sapiens
ARMQLSEIMER

SEQ ID NO: 86849 - protein, 11 aa, Homo Sapiens
ARNPSLKQQLF

SEQ ID NO: 86850 - protein, 11 aa, Homo Sapiens
ARSELLTTVSL

SEQ ID NO: 86851 - protein, 11 aa, Homo Sapiens
ARSMVSTIMKF

SEQ ID NO: 86852 - protein, 11 aa, Homo Sapiens
ARSSVVTAVKF

SEQ ID NO: 86853 - protein, 11 aa, Homo Sapiens
ARTTIINEIQY

SEQ ID NO: 86854 - protein, 11 aa, Homo Sapiens
ARWLGTLDKKL

SEQ ID NO: 86855 - protein, 11 aa, Homo Sapiens
ARYFIDSTNLK

SEQ ID NO: 86856 - protein, 11 aa, Homo Sapiens
ARYMPQNPHII

SEQ ID NO: 86857 - protein, 11 aa, Homo Sapiens
ARYQLSAIFKK

SEQ ID NO: 86858 - protein, 11 aa, Homo Sapiens
ARYRSDGALLL

SEQ ID NO: 86859 - protein, 11 aa, Homo Sapiens
ARYVPSTPWFL

SEQ ID NO: 86860 - protein, 11 aa, Homo Sapiens
ASFGERIKNTF

SEQ ID NO: 86861 - protein, 11 aa, Homo Sapiens
CRWAGLPRQGF

SEQ ID NO: 86862 - protein, 11 aa, Homo Sapiens
ERMNLKVPIYF

SEQ ID NO: 86863 - protein, 11 aa, Homo Sapiens
FRFSLEINVNR

SEQ ID NO: 86864 - protein, 11 aa, Homo Sapiens
FRLFPVPGSGL

SEQ ID NO: 86865 - protein, 11 aa, Homo Sapiens
FRVIFTGGVGK

SEQ ID NO: 86866 - protein, 11 aa, Homo Sapiens
FYPHVEVVLTI

SEQ ID NO: 86867 - protein, 11 aa, Homo Sapiens
GRFKIDLGIFR

SEQ ID NO: 86868 - protein, 11 aa, Homo Sapiens
GRFQKDISQGL

SEQ ID NO: 86869 - protein, 11 aa, Homo Sapiens
GRFSHRIYVAY

SEQ ID NO: 86870 - protein, 11 aa, Homo Sapiens
GRFSLPGATCL

SEQ ID NO: 86871 - protein, 11 aa, Homo Sapiens
GRFSSTTGLFY

SEQ ID NO: 86872 - protein, 11 aa, Homo Sapiens
GRFTAAELLSF

SEQ ID NO: 86873 - protein, 11 aa, Homo Sapiens
GRFTGLESIFR

SEQ ID NO: 86874 - protein, 11 aa, Homo Sapiens
GRGAFGEATLY

SEQ ID NO: 86875 - protein, 11 aa, Homo Sapiens
GRGVIPSTLAF

SEQ ID NO: 86876 - protein, 11 aa, Homo Sapiens
GRHSLYKMLGY

SEQ ID NO: 86877 - protein, 11 aa, Homo Sapiens
GRIDIKQLIAK

SEQ ID NO: 86878 - protein, 11 aa, Homo Sapiens
GRIFIGTFKAF

SEQ ID NO: 86879 - protein, 11 aa, Homo Sapiens
GRILSGVVTKM

SEQ ID NO: 86880 - protein, 11 aa, Homo Sapiens
GRIQVPFPTQR

SEQ ID NO: 86881 - protein, 11 aa, Homo Sapiens
GRLAAIVAKQV

SEQ ID NO: 86882 - protein, 11 aa, Homo Sapiens
GRLAHEVGWKY

SEQ ID NO: 86883 - protein, 11 aa, Homo Sapiens
GRLIYTGNMAR

SEQ ID NO: 86884 - protein, 11 aa, Homo Sapiens
GRLLIQPGPRF

SEQ ID NO: 86885 - protein, 11 aa, Homo Sapiens
GRLPQGIVREL

SEQ ID NO: 86886 - protein, 11 aa, Homo Sapiens
GRMGSQVIIPY

SEQ ID NO: 86887 - protein, 11 aa, Homo Sapiens
GRSDLIPTIKF

SEQ ID NO: 86888 - protein, 11 aa, Homo Sapiens
GRSTGEAFVQF

SEQ ID NO: 86889 - protein, 11 aa, Homo Sapiens
GRVDLKEYVGY

SEQ ID NO: 86890 - protein, 11 aa, Homo Sapiens
GRVESVKILPK

SEQ ID NO: 86891 - protein, 11 aa, Homo Sapiens
GRWFPEGPTHM

SEQ ID NO: 86892 - protein, 11 aa, Homo Sapiens
GRWGPTFPSSY

SEQ ID NO: 86893 - protein, 11 aa, Homo Sapiens
GRYDPSVKPPF

SEQ ID NO: 86894 - protein, 11 aa, Homo Sapiens
GRYGAISGFGL

SEQ ID NO: 86895 - protein, 11 aa, Homo Sapiens
GRYGISGELAM

SEQ ID NO: 86896 - protein, 11 aa, Homo Sapiens
HRFLLTPKVNM

SEQ ID NO: 86897 - protein, 11 aa, Homo Sapiens
HRFVSVSKLKY

SEQ ID NO: 86898 - protein, 11 aa, Homo Sapiens
HRLDHLVEIDF

SEQ ID NO: 86899 - protein, 11 aa, Homo Sapiens
HRVGPIEATSF

SEQ ID NO: 86900 - protein, 11 aa, Homo Sapiens
HRWNFDDLLEK

SEQ ID NO: 86901 - protein, 11 aa, Homo Sapiens
IETKSASVAPF

SEQ ID NO: 86902 - protein, 11 aa, Homo Sapiens
IRIPRTVGQEK

SEQ ID NO: 86903 - protein, 11 aa, Homo Sapiens
KPINTTGTLKP

SEQ ID NO: 86904 - protein, 11 aa, Homo Sapiens
KRAFIITGQTY

SEQ ID NO: 86905 - protein, 11 aa, Homo Sapiens
KRFADAASLLL

SEQ ID NO: 86906 - protein, 11 aa, Homo Sapiens
KRFEQKGFRLV

SEQ ID NO: 86907 - protein, 11 aa, Homo Sapiens
KRFGNAVILLY

SEQ ID NO: 86908 - protein, 11 aa, Homo Sapiens
KRFGPNVPALL

SEQ ID NO: 86909 - protein, 11 aa, Homo Sapiens
KRFKVSDEVGF

SEQ ID NO: 86910 - protein, 11 aa, Homo Sapiens
KRFNADNKLLL

SEQ ID NO: 86911 - protein, 11 aa, Homo Sapiens
KRFQQAGFNLR

SEQ ID NO: 86912 - protein, 11 aa, Homo Sapiens
KRIGKVLDNAI

SEQ ID NO: 86913 - protein, 11 aa, Homo Sapiens
KRIQDIVGILR

SEQ ID NO: 86914 - protein, 11 aa, Homo Sapiens
KRISEQFTAMF

SEQ ID NO: 86915 - protein, 11 aa, Homo Sapiens
KRLESLGALTH

SEQ ID NO: 86916 - protein, 11 aa, Homo Sapiens
KRLGLLAGFAF

SEQ ID NO: 86917 - protein, 11 aa, Homo Sapiens
KRLKTVLELQY

SEQ ID NO: 86918 - protein, 11 aa, Homo Sapiens
KRLLPVFAQTF

SEQ ID NO: 86919 - protein, 11 aa, Homo Sapiens
KRMNLSPAKQF

SEQ ID NO: 86920 - protein, 11 aa, Homo Sapiens
KRNAVIGLNLY

SEQ ID NO: 86921 - protein, 11 aa, Homo Sapiens
KRWESERVLSF

SEQ ID NO: 86922 - protein, 11 aa, Homo Sapiens
KRWFWSIVEKM

SEQ ID NO: 86923 - protein, 11 aa, Homo Sapiens
KRYDPDILLGY

SEQ ID NO: 86924 - protein, 11 aa, Homo Sapiens
KRYDREFLLGF

SEQ ID NO: 86925 - protein, 11 aa, Homo Sapiens
KRYLNSQQQYF

SEQ ID NO: 86926 - protein, 11 aa, Homo Sapiens
LRDEINAILQK

SEQ ID NO: 86927 - protein, 11 aa, Homo Sapiens
LRFGPNGGLVF

SEQ ID NO: 86928 - protein, 11 aa, Homo Sapiens
LRFQSSAVMAL

SEQ ID NO: 86929 - protein, 11 aa, Homo Sapiens
LRLDFHAHGRH

SEQ ID NO: 86930 - protein, 11 aa, Homo Sapiens
LRLRQIFNGTF

SEQ ID NO: 86931 - protein, 11 aa, Homo Sapiens
LRSLLEGLLQR

SEQ ID NO: 86932 - protein, 11 aa, Homo Sapiens
LRVDPVNFKLL

SEQ ID NO: 86933 - protein, 11 aa, Homo Sapiens
LRWIGDKEATY

SEQ ID NO: 86934 - protein, 11 aa, Homo Sapiens
LRYLEVEPVSR

SEQ ID NO: 86935 - protein, 11 aa, Homo Sapiens
LRYPMAVGLNK

SEQ ID NO: 86936 - protein, 11 aa, Homo Sapiens
LYPNGVPFKVI

SEQ ID NO: 86937 - protein, 11 aa, Homo Sapiens
MRLGSIFGLGL

SEQ ID NO: 86938 - protein, 11 aa, Homo Sapiens
MRLSLPLLLLL

SEQ ID NO: 86939 - protein, 11 aa, Homo Sapiens
MRLSQLKQLLK

SEQ ID NO: 86940 - protein, 11 aa, Homo Sapiens
MRQKAVSLFLC

SEQ ID NO: 86941 - protein, 11 aa, Homo Sapiens
MRWKALIEMEK

SEQ ID NO: 86942 - protein, 11 aa, Homo Sapiens
MRYIPPIPVHR

SEQ ID NO: 86943 - protein, 11 aa, Homo Sapiens
QRAGLQFPVGR

SEQ ID NO: 86944 - protein, 11 aa, Homo Sapiens
QRFDARQKIGL

SEQ ID NO: 86945 - protein, 11 aa, Homo Sapiens
QRFQLPGNIGF

SEQ ID NO: 86946 - protein, 11 aa, Homo Sapiens
QRLEGIVNKMF

SEQ ID NO: 86947 - protein, 11 aa, Homo Sapiens
QRLGCGGVLTF

SEQ ID NO: 86948 - protein, 11 aa, Homo Sapiens
QRMDILDVLTL

SEQ ID NO: 86949 - protein, 11 aa, Homo Sapiens
QRNKAAALLRL

SEQ ID NO: 86950 - protein, 11 aa, Homo Sapiens
RRAALGLLPLL

SEQ ID NO: 86951 - protein, 11 aa, Homo Sapiens
RRAEVLALPFK

SEQ ID NO: 86952 - protein, 11 aa, Homo Sapiens
RRAFIITINSF

SEQ ID NO: 86953 - protein, 11 aa, Homo Sapiens
RRAGADIIITY

SEQ ID NO: 86954 - protein, 11 aa, Homo Sapiens
RRAPFDLFENK

SEQ ID NO: 86955 - protein, 11 aa, Homo Sapiens
RRDQKEALLRF

SEQ ID NO: 86956 - protein, 11 aa, Homo Sapiens
RRFDAMPFTLR

SEQ ID NO: 86957 - protein, 11 aa, Homo Sapiens
RRFDGVQDPRI

SEQ ID NO: 86958 - protein, 11 aa, Homo Sapiens
RRFDLQNPSRM

SEQ ID NO: 86959 - protein, 11 aa, Homo Sapiens
RRFDPARGMEY

SEQ ID NO: 86960 - protein, 11 aa, Homo Sapiens
RRFDPKLFLVF

SEQ ID NO: 86961 - protein, 11 aa, Homo Sapiens
RRFEEALQTIF

SEQ ID NO: 86962 - protein, 11 aa, Homo Sapiens
RRFGDKLNFRQ

SEQ ID NO: 86963 - protein, 11 aa, Homo Sapiens
RRFGSVPHGGF

SEQ ID NO: 86964 - protein, 11 aa, Homo Sapiens
RRFLCGVVEGF

SEQ ID NO: 86965 - protein, 11 aa, Homo Sapiens
RRFLIDNGVSL

SEQ ID NO: 86966 - protein, 11 aa, Homo Sapiens
RRFLSQLIQKF

SEQ ID NO: 86967 - protein, 11 aa, Homo Sapiens
RRFLTQPQVVA

SEQ ID NO: 86968 - protein, 11 aa, Homo Sapiens
RRFNIKLWKTF

SEQ ID NO: 86969 - protein, 11 aa, Homo Sapiens
RRFQTIPLYYI

SEQ ID NO: 86970 - protein, 11 aa, Homo Sapiens
RRFSDIQIRRL

SEQ ID NO: 86971 - protein, 11 aa, Homo Sapiens
RRFSQKPNLTR

SEQ ID NO: 86972 - protein, 11 aa, Homo Sapiens
RRFVEVGRVAY

SEQ ID NO: 86973 - protein, 11 aa, Homo Sapiens
RRFVGHTKDVL

SEQ ID NO: 86974 - protein, 11 aa, Homo Sapiens
RRFVGPRVQRL

SEQ ID NO: 86975 - protein, 11 aa, Homo Sapiens
RRFVNVVPTFG

SEQ ID NO: 86976 - protein, 11 aa, Homo Sapiens
RRFWNSIVMQR

SEQ ID NO: 86977 - protein, 11 aa, Homo Sapiens
RRGDLPFVVPR

SEQ ID NO: 86978 - protein, 11 aa, Homo Sapiens
RRGLFTGLTPR

SEQ ID NO: 86979 - protein, 11 aa, Homo Sapiens
RRHLNIAKEGF

SEQ ID NO: 86980 - protein, 11 aa, Homo Sapiens
RRIEYIEARVT

SEQ ID NO: 86981 - protein, 11 aa, Homo Sapiens
RRILDSAEFIK

SEQ ID NO: 86982 - protein, 11 aa, Homo Sapiens
RRILLAEVPTM

SEQ ID NO: 86983 - protein, 11 aa, Homo Sapiens
RRILMGSTLRK

SEQ ID NO: 86984 - protein, 11 aa, Homo Sapiens
RRIPAEGRVAL

SEQ ID NO: 86985 - protein, 11 aa, Homo Sapiens
RRISPPVDLEY

SEQ ID NO: 86986 - protein, 11 aa, Homo Sapiens
RRITSDFRIGF

SEQ ID NO: 86987 - protein, 11 aa, Homo Sapiens
RRKGAEDLLRF

SEQ ID NO: 86988 - protein, 11 aa, Homo Sapiens
RRKIATEKDFL

SEQ ID NO: 86989 - protein, 11 aa, Homo Sapiens
RRLALFPGVAL

SEQ ID NO: 86990 - protein, 11 aa, Homo Sapiens
RRLDIVRSLYE

SEQ ID NO: 86991 - protein, 11 aa, Homo Sapiens
RRLDLVHTAAL

SEQ ID NO: 86992 - protein, 11 aa, Homo Sapiens
RRLDSIVGPQL

SEQ ID NO: 86993 - protein, 11 aa, Homo Sapiens
RRLENVENLLR

SEQ ID NO: 86994 - protein, 11 aa, Homo Sapiens
RRLGLALGLLL

SEQ ID NO: 86995 - protein, 11 aa, Homo Sapiens
RRLKPFGVQRF

SEQ ID NO: 86996 - protein, 11 aa, Homo Sapiens
RRLKSLLIDFF

SEQ ID NO: 86997 - protein, 11 aa, Homo Sapiens
RRLLEEEIIAF

SEQ ID NO: 86998 - protein, 11 aa, Homo Sapiens
RRLLLEDLVKK

SEQ ID NO: 86999 - protein, 11 aa, Homo Sapiens
RRLLLLPLLLF

SEQ ID NO: 87000 - protein, 11 aa, Homo Sapiens
RRLLVDSKVSL

SEQ ID NO: 87001 - protein, 11 aa, Homo Sapiens
RRLPATLLNAF

SEQ ID NO: 87002 - protein, 11 aa, Homo Sapiens
RRLPSDVVTGY

SEQ ID NO: 87003 - protein, 11 aa, Homo Sapiens
RRLRNHMAVAF

SEQ ID NO: 87004 - protein, 11 aa, Homo Sapiens
RRLSAVNSIFL

SEQ ID NO: 87005 - protein, 11 aa, Homo Sapiens
RRLTVLPFAGL

SEQ ID NO: 87006 - protein, 11 aa, Homo Sapiens
RRLVPDSDVRF

SEQ ID NO: 87007 - protein, 11 aa, Homo Sapiens
RRMGNPALSVR

SEQ ID NO: 87008 - protein, 11 aa, Homo Sapiens
RRMGTSLLFQL

SEQ ID NO: 87009 - protein, 11 aa, Homo Sapiens
RRMWPLAFGSG

SEQ ID NO: 87010 - protein, 11 aa, Homo Sapiens
RRNPDTQWITK

SEQ ID NO: 87011 - protein, 11 aa, Homo Sapiens
RRSSEMLVKKL

SEQ ID NO: 87012 - protein, 11 aa, Homo Sapiens
RRSWASLVLAF

SEQ ID NO: 87013 - protein, 11 aa, Homo Sapiens
RRTASALFAGF

SEQ ID NO: 87014 - protein, 11 aa, Homo Sapiens
RRTGPPMGSRF

SEQ ID NO: 87015 - protein, 11 aa, Homo Sapiens
RRVLHLGVQML

SEQ ID NO: 87016 - protein, 11 aa, Homo Sapiens
RRVLQALEGLK

SEQ ID NO: 87017 - protein, 11 aa, Homo Sapiens
RRVSLRVLSER

SEQ ID NO: 87018 - protein, 11 aa, Homo Sapiens
RRVSVTAVAAL

SEQ ID NO: 87019 - protein, 11 aa, Homo Sapiens
RRVVYPLEKLL

SEQ ID NO: 87020 - protein, 11 aa, Homo Sapiens
RRWGDSVLLVD

SEQ ID NO: 87021 - protein, 11 aa, Homo Sapiens
RRWLPAGDALL

SEQ ID NO: 87022 - protein, 11 aa, Homo Sapiens
RRWTLGGMVNR

SEQ ID NO: 87023 - protein, 11 aa, Homo Sapiens
RRYCDPVVLTY

SEQ ID NO: 87024 - protein, 11 aa, Homo Sapiens
RRYFGGTEDRL

SEQ ID NO: 87025 - protein, 11 aa, Homo Sapiens
RRYGELTKLIR

SEQ ID NO: 87026 - protein, 11 aa, Homo Sapiens
RRYLSPKYIKM

SEQ ID NO: 87027 - protein, 11 aa, Homo Sapiens
RRYNIKLWKTF

SEQ ID NO: 87028 - protein, 11 aa, Homo Sapiens
RRYSNLILNLF

SEQ ID NO: 87029 - protein, 11 aa, Homo Sapiens
SRAGLQFPVGR

SEQ ID NO: 87030 - protein, 11 aa, Homo Sapiens
SRFGKFIRINF

SEQ ID NO: 87031 - protein, 11 aa, Homo Sapiens
SRFGNAFLNRF

SEQ ID NO: 87032 - protein, 11 aa, Homo Sapiens
SRFKPRVPVIK

SEQ ID NO: 87033 - protein, 11 aa, Homo Sapiens
SRFLKSDLFLK

SEQ ID NO: 87034 - protein, 11 aa, Homo Sapiens
SRFLPRPVFSK

SEQ ID NO: 87035 - protein, 11 aa, Homo Sapiens
SRFQAEIPLMR

SEQ ID NO: 87036 - protein, 11 aa, Homo Sapiens
SRFRHPNIVDF

SEQ ID NO: 87037 - protein, 11 aa, Homo Sapiens
SRFTGSIFIGR

SEQ ID NO: 87038 - protein, 11 aa, Homo Sapiens
SRIHPVSTMVK

SEQ ID NO: 87039 - protein, 11 aa, Homo Sapiens
SRIPFNQALVF

SEQ ID NO: 87040 - protein, 11 aa, Homo Sapiens
SRISLADIAQK

SEQ ID NO: 87041 - protein, 11 aa, Homo Sapiens
SRLGVAGQWRF

SEQ ID NO: 87042 - protein, 11 aa, Homo Sapiens
SRLKYPPFAKK

SEQ ID NO: 87043 - protein, 11 aa, Homo Sapiens
SRLLKPGGMVL

SEQ ID NO: 87044 - protein, 11 aa, Homo Sapiens
SRLNITYPMLF

SEQ ID NO: 87045 - protein, 11 aa, Homo Sapiens
SRLQETGLLSK

SEQ ID NO: 87046 - protein, 11 aa, Homo Sapiens
SRLRNQSVFNF

SEQ ID NO: 87047 - protein, 11 aa, Homo Sapiens
SRLSVASDMRF

SEQ ID NO: 87048 - protein, 11 aa, Homo Sapiens
SRMDGEGQLTL

SEQ ID NO: 87049 - protein, 11 aa, Homo Sapiens
SRMSASILLSK

SEQ ID NO: 87050 - protein, 11 aa, Homo Sapiens
SRNALLFNLGF

SEQ ID NO: 87051 - protein, 11 aa, Homo Sapiens
SRNSNTVVFVK

SEQ ID NO: 87052 - protein, 11 aa, Homo Sapiens
SRSLLAAALLY

SEQ ID NO: 87053 - protein, 11 aa, Homo Sapiens
SRVDSLIPWIK

SEQ ID NO: 87054 - protein, 11 aa, Homo Sapiens
SRWSASFTVTK

SEQ ID NO: 87055 - protein, 11 aa, Homo Sapiens
TPVTVSAVKPA

SEQ ID NO: 87056 - protein, 11 aa, Homo Sapiens
TRFLAEEGFYK

SEQ ID NO: 87057 - protein, 11 aa, Homo Sapiens
TRIGVMSLIRK

SEQ ID NO: 87058 - protein, 11 aa, Homo Sapiens
TRLPLISGFYK

SEQ ID NO: 87059 - protein, 11 aa, Homo Sapiens
TRLPPTPLLLF

SEQ ID NO: 87060 - protein, 11 aa, Homo Sapiens
TRLSNIFVIGK

SEQ ID NO: 87061 - protein, 11 aa, Homo Sapiens
VRFVTGNKILR

SEQ ID NO: 87062 - protein, 11 aa, Homo Sapiens
VRIDPFVRTFL

SEQ ID NO: 87063 - protein, 11 aa, Homo Sapiens
VRIGGISGIFK

SEQ ID NO: 87064 - protein, 11 aa, Homo Sapiens
VRLLLPGELAK

SEQ ID NO: 87065 - protein, 11 aa, Homo Sapiens
VRMNVLADALK

SEQ ID NO: 87066 - protein, 11 aa, Homo Sapiens
VRWSPVRPLVF

SEQ ID NO: 87067 - protein, 11 aa, Homo Sapiens
WRKKQSDVMRF

SEQ ID NO: 87068 - protein, 11 aa, Homo Sapiens
WRLGSSDILNY

SEQ ID NO: 87069 - protein, 11 aa, Homo Sapiens
YRFLPQKIIYL

SEQ ID NO: 87070 - protein, 11 aa, Homo Sapiens
YRFVQGKDWGF

SEQ ID NO: 87071 - protein, 11 aa, Homo Sapiens
YRLPLRVVKHF

SEQ ID NO: 87072 - protein, 11 aa, Homo Sapiens
YRVTLNPPGTF

SEQ ID NO: 87073 - protein, 11 aa, Homo Sapiens
YRWAVSSVMTR

SEQ ID NO: 87074 - protein, 11 aa, Homo Sapiens
YRWFPSGKVVF

SEQ ID NO: 87075 - protein, 11 aa, Homo Sapiens
YRYKMPRLIAK

SEQ ID NO: 87076 - protein, 11 aa, Homo Sapiens
YRYYNKYINVK

SEQ ID NO: 87077 - protein, 8 aa, Homo Sapiens
AVFLLDDK

SEQ ID NO: 87078 - protein, 8 aa, Homo Sapiens
DALVITHY

SEQ ID NO: 87079 - protein, 8 aa, Homo Sapiens
FPAEPLEL

SEQ ID NO: 87080 - protein, 8 aa, Homo Sapiens
FPGPIFHL

SEQ ID NO: 87081 - protein, 8 aa, Homo Sapiens
FPGPSKPF

SEQ ID NO: 87082 - protein, 8 aa, Homo Sapiens
FPMEIRQY

SEQ ID NO: 87083 - protein, 8 aa, Homo Sapiens
FPTISLEF

SEQ ID NO: 87084 - protein, 8 aa, Homo Sapiens
IPAESYTF

SEQ ID NO: 87085 - protein, 8 aa, Homo Sapiens
IPFLPLEY

SEQ ID NO: 87086 - protein, 8 aa, Homo Sapiens
LPIVTPAL

SEQ ID NO: 87087 - protein, 8 aa, Homo Sapiens
LPLISVAL

SEQ ID NO: 87088 - protein, 8 aa, Homo Sapiens
LPRTDYSF

SEQ ID NO: 87089 - protein, 8 aa, Homo Sapiens
LVIEDDVR

SEQ ID NO: 87090 - protein, 8 aa, Homo Sapiens
MPTVHYEF

SEQ ID NO: 87091 - protein, 8 aa, Homo Sapiens
WPLVAALL

SEQ ID NO: 87092 - protein, 8 aa, Homo Sapiens
YPVEIHEY

SEQ ID NO: 87093 - protein, 9 aa, Homo Sapiens
AAIGLVIYY

SEQ ID NO: 87094 - protein, 9 aa, Homo Sapiens
AANPHSFVF

SEQ ID NO: 87095 - protein, 9 aa, Homo Sapiens
APAFLYDIY

SEQ ID NO: 87096 - protein, 9 aa, Homo Sapiens
APALPGPQF

SEQ ID NO: 87097 - protein, 9 aa, Homo Sapiens
APAPTAVVL

SEQ ID NO: 87098 - protein, 9 aa, Homo Sapiens
APATSILEY

SEQ ID NO: 87099 - protein, 9 aa, Homo Sapiens
APFDWKILY

SEQ ID NO: 87100 - protein, 9 aa, Homo Sapiens
APFSKVITF

SEQ ID NO: 87101 - protein, 9 aa, Homo Sapiens
APFTEGISF

SEQ ID NO: 87102 - protein, 9 aa, Homo Sapiens
APLKLQMEF

SEQ ID NO: 87103 - protein, 9 aa, Homo Sapiens
APSVVKISY

SEQ ID NO: 87104 - protein, 9 aa, Homo Sapiens
APWEVLVTY

SEQ ID NO: 87105 - protein, 9 aa, Homo Sapiens
APWFDPAIF

SEQ ID NO: 87106 - protein, 9 aa, Homo Sapiens
APWQVVPEL

SEQ ID NO: 87107 - protein, 9 aa, Homo Sapiens
ATADTVIIY

SEQ ID NO: 87108 - protein, 9 aa, Homo Sapiens
AVHDITVAY

SEQ ID NO: 87109 - protein, 9 aa, Homo Sapiens
DAADIRFVY

SEQ ID NO: 87110 - protein, 9 aa, Homo Sapiens
DAFEFHEAF

SEQ ID NO: 87111 - protein, 9 aa, Homo Sapiens
DAFPLAFDY

SEQ ID NO: 87112 - protein, 9 aa, Homo Sapiens
DAIPAVEVF

SEQ ID NO: 87113 - protein, 9 aa, Homo Sapiens
DASKVVTVF

SEQ ID NO: 87114 - protein, 9 aa, Homo Sapiens
DASPVQAVF

SEQ ID NO: 87115 - protein, 9 aa, Homo Sapiens
DAVAIVLTY

SEQ ID NO: 87116 - protein, 9 aa, Homo Sapiens
DAWIEHDVW

SEQ ID NO: 87117 - protein, 9 aa, Homo Sapiens
DAYPEIEKF

SEQ ID NO: 87118 - protein, 9 aa, Homo Sapiens
DLWLEREVF

SEQ ID NO: 87119 - protein, 9 aa, Homo Sapiens
DPFIDLNYM

SEQ ID NO: 87120 - protein, 9 aa, Homo Sapiens
DPFKDIILY

SEQ ID NO: 87121 - protein, 9 aa, Homo Sapiens
DPFPAAIIL

SEQ ID NO: 87122 - protein, 9 aa, Homo Sapiens
DPFPDHVVF

SEQ ID NO: 87123 - protein, 9 aa, Homo Sapiens
DPFRDLHSL

SEQ ID NO: 87124 - protein, 9 aa, Homo Sapiens
DPFVDRIGY

SEQ ID NO: 87125 - protein, 9 aa, Homo Sapiens
DPNLEFVAM

SEQ ID NO: 87126 - protein, 9 aa, Homo Sapiens
DVIRLIMQY

SEQ ID NO: 87127 - protein, 9 aa, Homo Sapiens
EAASVPVVY

SEQ ID NO: 87128 - protein, 9 aa, Homo Sapiens
EAFLNNQEY

SEQ ID NO: 87129 - protein, 9 aa, Homo Sapiens
EAFSPVYKY

SEQ ID NO: 87130 - protein, 9 aa, Homo Sapiens
EAIEQILKY

SEQ ID NO: 87131 - protein, 9 aa, Homo Sapiens
EAIGAVIHY

SEQ ID NO: 87132 - protein, 9 aa, Homo Sapiens
EPDFVAKFY

SEQ ID NO: 87133 - protein, 9 aa, Homo Sapiens
EVFPLAMNY

SEQ ID NO: 87134 - protein, 9 aa, Homo Sapiens
EVIPYTPAM

SEQ ID NO: 87135 - protein, 9 aa, Homo Sapiens
EVLGLILRY

SEQ ID NO: 87136 - protein, 9 aa, Homo Sapiens
EVNAVVLLY

SEQ ID NO: 87137 - protein, 9 aa, Homo Sapiens
FAADIISVL

SEQ ID NO: 87138 - protein, 9 aa, Homo Sapiens
FAANVYEAF

SEQ ID NO: 87139 - protein, 9 aa, Homo Sapiens
FAFDPSVNY

SEQ ID NO: 87140 - protein, 9 aa, Homo Sapiens
FAFEHSEEY

SEQ ID NO: 87141 - protein, 9 aa, Homo Sapiens
FAFFDPVMY

SEQ ID NO: 87142 - protein, 9 aa, Homo Sapiens
FALVFPLMY

SEQ ID NO: 87143 - protein, 9 aa, Homo Sapiens
FIDASRLVY

SEQ ID NO: 87144 - protein, 9 aa, Homo Sapiens
FLWPEAFLY

SEQ ID NO: 87145 - protein, 9 aa, Homo Sapiens
FPAAPAPKM

SEQ ID NO: 87146 - protein, 9 aa, Homo Sapiens
FPAAPIPTL

SEQ ID NO: 87147 - protein, 9 aa, Homo Sapiens
FPAELGIVF

SEQ ID NO: 87148 - protein, 9 aa, Homo Sapiens
FPAGKVPAF

SEQ ID NO: 87149 - protein, 9 aa, Homo Sapiens
FPAKVTAHW

SEQ ID NO: 87150 - protein, 9 aa, Homo Sapiens
FPALAPLTY

SEQ ID NO: 87151 - protein, 9 aa, Homo Sapiens
FPALPGSSY

SEQ ID NO: 87152 - protein, 9 aa, Homo Sapiens
FPANNIVKF

SEQ ID NO: 87153 - protein, 9 aa, Homo Sapiens
FPASPPKGY

SEQ ID NO: 87154 - protein, 9 aa, Homo Sapiens
FPATPLLDY

SEQ ID NO: 87155 - protein, 9 aa, Homo Sapiens
FPDKPITQY

SEQ ID NO: 87156 - protein, 9 aa, Homo Sapiens
FPDLFSEQL

SEQ ID NO: 87157 - protein, 9 aa, Homo Sapiens
FPDQVAIQL

SEQ ID NO: 87158 - protein, 9 aa, Homo Sapiens
FPEELTQTF

SEQ ID NO: 87159 - protein, 9 aa, Homo Sapiens
FPEEVIATI

SEQ ID NO: 87160 - protein, 9 aa, Homo Sapiens
FPEGLFYEF

SEQ ID NO: 87161 - protein, 9 aa, Homo Sapiens
FPEGSVELY

SEQ ID NO: 87162 - protein, 9 aa, Homo Sapiens
FPEHIFPAL

SEQ ID NO: 87163 - protein, 9 aa, Homo Sapiens
FPEIDLEKY

SEQ ID NO: 87164 - protein, 9 aa, Homo Sapiens
FPEIHVAQY

SEQ ID NO: 87165 - protein, 9 aa, Homo Sapiens
FPELDSPQL

SEQ ID NO: 87166 - protein, 9 aa, Homo Sapiens
FPFEDITQH

SEQ ID NO: 87167 - protein, 9 aa, Homo Sapiens
FPFFDIAHY

SEQ ID NO: 87168 - protein, 9 aa, Homo Sapiens
FPFKPPSIY

SEQ ID NO: 87169 - protein, 9 aa, Homo Sapiens
FPIAEVFTL

SEQ ID NO: 87170 - protein, 9 aa, Homo Sapiens
FPIEYHDIW

SEQ ID NO: 87171 - protein, 9 aa, Homo Sapiens
FPIHVQTSL

SEQ ID NO: 87172 - protein, 9 aa, Homo Sapiens
FPIPGEPGF

SEQ ID NO: 87173 - protein, 9 aa, Homo Sapiens
FPLAPLLAL

SEQ ID NO: 87174 - protein, 9 aa, Homo Sapiens
FPLEAITAF

SEQ ID NO: 87175 - protein, 9 aa, Homo Sapiens
FPLPGLPDF

SEQ ID NO: 87176 - protein, 9 aa, Homo Sapiens
FPMEIRQYL

SEQ ID NO: 87177 - protein, 9 aa, Homo Sapiens
FPMELRQFL

SEQ ID NO: 87178 - protein, 9 aa, Homo Sapiens
FPNAIEHTL

SEQ ID NO: 87179 - protein, 9 aa, Homo Sapiens
FPNALFVVY

SEQ ID NO: 87180 - protein, 9 aa, Homo Sapiens
FPNIPGKSL

SEQ ID NO: 87181 - protein, 9 aa, Homo Sapiens
FPNKQGYVL

SEQ ID NO: 87182 - protein, 9 aa, Homo Sapiens
FPNVSSFEW

SEQ ID NO: 87183 - protein, 9 aa, Homo Sapiens
FPPDAILFY

SEQ ID NO: 87184 - protein, 9 aa, Homo Sapiens
FPPEANYLF

SEQ ID NO: 87185 - protein, 9 aa, Homo Sapiens
FPQEFIICF

SEQ ID NO: 87186 - protein, 9 aa, Homo Sapiens
FPQFEPQRY

SEQ ID NO: 87187 - protein, 9 aa, Homo Sapiens
FPQIEINKM

SEQ ID NO: 87188 - protein, 9 aa, Homo Sapiens
FPQLDSTSF

SEQ ID NO: 87189 - protein, 9 aa, Homo Sapiens
FPQTALVSF

SEQ ID NO: 87190 - protein, 9 aa, Homo Sapiens
FPRHIEPEL

SEQ ID NO: 87191 - protein, 9 aa, Homo Sapiens
FPSAKDPTW

SEQ ID NO: 87192 - protein, 9 aa, Homo Sapiens
FPSEDILLV

SEQ ID NO: 87193 - protein, 9 aa, Homo Sapiens
FPSIYDVKY

SEQ ID NO: 87194 - protein, 9 aa, Homo Sapiens
FPSLQRLVY

SEQ ID NO: 87195 - protein, 9 aa, Homo Sapiens
FPSNFIKEL

SEQ ID NO: 87196 - protein, 9 aa, Homo Sapiens
FPSPIRLEF

SEQ ID NO: 87197 - protein, 9 aa, Homo Sapiens
FPTYPVPHY

SEQ ID NO: 87198 - protein, 9 aa, Homo Sapiens
FPVEIKSFY

SEQ ID NO: 87199 - protein, 9 aa, Homo Sapiens
FPVEVNTVL

SEQ ID NO: 87200 - protein, 9 aa, Homo Sapiens
FPVFATVIL

SEQ ID NO: 87201 - protein, 9 aa, Homo Sapiens
FPVGDVNNF

SEQ ID NO: 87202 - protein, 9 aa, Homo Sapiens
FPVIYDVKY

SEQ ID NO: 87203 - protein, 9 aa, Homo Sapiens
FPVPKPIDY

SEQ ID NO: 87204 - protein, 9 aa, Homo Sapiens
FPVSIPAVL

SEQ ID NO: 87205 - protein, 9 aa, Homo Sapiens
FPVTPVSTL

SEQ ID NO: 87206 - protein, 9 aa, Homo Sapiens
FPWDIDEAL

SEQ ID NO: 87207 - protein, 9 aa, Homo Sapiens
FPWELDPDW

SEQ ID NO: 87208 - protein, 9 aa, Homo Sapiens
FPYPFQVVY

SEQ ID NO: 87209 - protein, 9 aa, Homo Sapiens
FVNPGVVEF

SEQ ID NO: 87210 - protein, 9 aa, Homo Sapiens
GAAAIILTY

SEQ ID NO: 87211 - protein, 9 aa, Homo Sapiens
GAAGVHFIY

SEQ ID NO: 87212 - protein, 9 aa, Homo Sapiens
GAHGIIVVY

SEQ ID NO: 87213 - protein, 9 aa, Homo Sapiens
GAMGIMLVY

SEQ ID NO: 87214 - protein, 9 aa, Homo Sapiens
GNPQKAILY

SEQ ID NO: 87215 - protein, 9 aa, Homo Sapiens
HACGVIATI

SEQ ID NO: 87216 - protein, 9 aa, Homo Sapiens
HAFVELHEF

SEQ ID NO: 87217 - protein, 9 aa, Homo Sapiens
HAIPPTLAM

SEQ ID NO: 87218 - protein, 9 aa, Homo Sapiens
HALALAWTF

SEQ ID NO: 87219 - protein, 9 aa, Homo Sapiens
HAMVILLTL

SEQ ID NO: 87220 - protein, 9 aa, Homo Sapiens
HAVEWPVVM

SEQ ID NO: 87221 - protein, 9 aa, Homo Sapiens
HAVIDINAF

SEQ ID NO: 87222 - protein, 9 aa, Homo Sapiens
HAVVNLINY

SEQ ID NO: 87223 - protein, 9 aa, Homo Sapiens
HGVLLEVQY

SEQ ID NO: 87224 - protein, 9 aa, Homo Sapiens
HIMEIFSTY

SEQ ID NO: 87225 - protein, 9 aa, Homo Sapiens
HPALAIPEL

SEQ ID NO: 87226 - protein, 9 aa, Homo Sapiens
HPDEPLYSF

SEQ ID NO: 87227 - protein, 9 aa, Homo Sapiens
HPDGVIPVL

SEQ ID NO: 87228 - protein, 9 aa, Homo Sapiens
HPDVLPFAL

SEQ ID NO: 87229 - protein, 9 aa, Homo Sapiens
HPEKLATVL

SEQ ID NO: 87230 - protein, 9 aa, Homo Sapiens
HPFKFSDHY

SEQ ID NO: 87231 - protein, 9 aa, Homo Sapiens
HPILNDPIY

SEQ ID NO: 87232 - protein, 9 aa, Homo Sapiens
HPLGDIVAF

SEQ ID NO: 87233 - protein, 9 aa, Homo Sapiens
HPLGIVQGF

SEQ ID NO: 87234 - protein, 9 aa, Homo Sapiens
HPLPGTQLL

SEQ ID NO: 87235 - protein, 9 aa, Homo Sapiens
HPMAYQLQL

SEQ ID NO: 87236 - protein, 9 aa, Homo Sapiens
HPQIIIRAF

SEQ ID NO: 87237 - protein, 9 aa, Homo Sapiens
HPQPGAVEL

SEQ ID NO: 87238 - protein, 9 aa, Homo Sapiens
HPSNVLHFF

SEQ ID NO: 87239 - protein, 9 aa, Homo Sapiens
HPSQTVELF

SEQ ID NO: 87240 - protein, 9 aa, Homo Sapiens
HPTDPLTSF

SEQ ID NO: 87241 - protein, 9 aa, Homo Sapiens
HPTIISESF

SEQ ID NO: 87242 - protein, 9 aa, Homo Sapiens
HPTVVISAY

SEQ ID NO: 87243 - protein, 9 aa, Homo Sapiens
HPVDFLDAF

SEQ ID NO: 87244 - protein, 9 aa, Homo Sapiens
HPVWALIYY

SEQ ID NO: 87245 - protein, 9 aa, Homo Sapiens
HVGPFIDSY

SEQ ID NO: 87246 - protein, 9 aa, Homo Sapiens
HVIDVKFLY

SEQ ID NO: 87247 - protein, 9 aa, Homo Sapiens
IAFFDVRTF

SEQ ID NO: 87248 - protein, 9 aa, Homo Sapiens
IAIDVIDAY

SEQ ID NO: 87249 - protein, 9 aa, Homo Sapiens
IAIPVTVAF

SEQ ID NO: 87250 - protein, 9 aa, Homo Sapiens
IAMALEVTY

SEQ ID NO: 87251 - protein, 9 aa, Homo Sapiens
IAMDLILKM

SEQ ID NO: 87252 - protein, 9 aa, Homo Sapiens
IPAATTIAY

SEQ ID NO: 87253 - protein, 9 aa, Homo Sapiens
IPAAVKLTY

SEQ ID NO: 87254 - protein, 9 aa, Homo Sapiens
IPAESYTFF

SEQ ID NO: 87255 - protein, 9 aa, Homo Sapiens
IPDDLKQLY

SEQ ID NO: 87256 - protein, 9 aa, Homo Sapiens
IPDQVIRVF

SEQ ID NO: 87257 - protein, 9 aa, Homo Sapiens
IPFAAPTAL

SEQ ID NO: 87258 - protein, 9 aa, Homo Sapiens
IPFEFPLHL

SEQ ID NO: 87259 - protein, 9 aa, Homo Sapiens
IPFNQALVF

SEQ ID NO: 87260 - protein, 9 aa, Homo Sapiens
IPFRPSIQF

SEQ ID NO: 87261 - protein, 9 aa, Homo Sapiens
IPHMDIEAL

SEQ ID NO: 87262 - protein, 9 aa, Homo Sapiens
IPIEPDYKF

SEQ ID NO: 87263 - protein, 9 aa, Homo Sapiens
IPISLHTSL

SEQ ID NO: 87264 - protein, 9 aa, Homo Sapiens
IPLPLIKSY

SEQ ID NO: 87265 - protein, 9 aa, Homo Sapiens
IPNEIIHAL

SEQ ID NO: 87266 - protein, 9 aa, Homo Sapiens
IPNENELQF

SEQ ID NO: 87267 - protein, 9 aa, Homo Sapiens
IPNGVQIFF

SEQ ID NO: 87268 - protein, 9 aa, Homo Sapiens
IPQNFIADY

SEQ ID NO: 87269 - protein, 9 aa, Homo Sapiens
IPSELFSSF

SEQ ID NO: 87270 - protein, 9 aa, Homo Sapiens
IPTPPLPSY

SEQ ID NO: 87271 - protein, 9 aa, Homo Sapiens
IPVIVTEQY

SEQ ID NO: 87272 - protein, 9 aa, Homo Sapiens
IPVPINAEL

SEQ ID NO: 87273 - protein, 9 aa, Homo Sapiens
IPVTIITGY

SEQ ID NO: 87274 - protein, 9 aa, Homo Sapiens
IPVTIMDVF

SEQ ID NO: 87275 - protein, 9 aa, Homo Sapiens
IPWDDLIAL

SEQ ID NO: 87276 - protein, 9 aa, Homo Sapiens
IPWKHIDYF

SEQ ID NO: 87277 - protein, 9 aa, Homo Sapiens
IPWLNEPSF

SEQ ID NO: 87278 - protein, 9 aa, Homo Sapiens
IPWVIEPVY

SEQ ID NO: 87279 - protein, 9 aa, Homo Sapiens
IPYEGFASL

SEQ ID NO: 87280 - protein, 9 aa, Homo Sapiens
IPYPLPPNY

SEQ ID NO: 87281 - protein, 9 aa, Homo Sapiens
IVSQIAVAY

SEQ ID NO: 87282 - protein, 9 aa, Homo Sapiens
LAIPITNTY

SEQ ID NO: 87283 - protein, 9 aa, Homo Sapiens
LALEPGVAY

SEQ ID NO: 87284 - protein, 9 aa, Homo Sapiens
LALFSETAY

SEQ ID NO: 87285 - protein, 9 aa, Homo Sapiens
LAQQYYLVY

SEQ ID NO: 87286 - protein, 9 aa, Homo Sapiens
LAWLDEHTL

SEQ ID NO: 87287 - protein, 9 aa, Homo Sapiens
LDPVLQNPL

SEQ ID NO: 87288 - protein, 9 aa, Homo Sapiens
LLTDIIAAY

SEQ ID NO: 87289 - protein, 9 aa, Homo Sapiens
LPADWAPLF

SEQ ID NO: 87290 - protein, 9 aa, Homo Sapiens
LPAEFFEVL

SEQ ID NO: 87291 - protein, 9 aa, Homo Sapiens
LPAGIVAVL

SEQ ID NO: 87292 - protein, 9 aa, Homo Sapiens
LPAKILVEF

SEQ ID NO: 87293 - protein, 9 aa, Homo Sapiens
LPALPLAEL

SEQ ID NO: 87294 - protein, 9 aa, Homo Sapiens
LPALPTQAL

SEQ ID NO: 87295 - protein, 9 aa, Homo Sapiens
LPAPGVPAW

SEQ ID NO: 87296 - protein, 9 aa, Homo Sapiens
LPAPPKIYF

SEQ ID NO: 87297 - protein, 9 aa, Homo Sapiens
LPAPPTQNM

SEQ ID NO: 87298 - protein, 9 aa, Homo Sapiens
LPAVVVETF

SEQ ID NO: 87299 - protein, 9 aa, Homo Sapiens
LPAYPTENF

SEQ ID NO: 87300 - protein, 9 aa, Homo Sapiens
LPDEIYHVY

SEQ ID NO: 87301 - protein, 9 aa, Homo Sapiens
LPDPNLITF

SEQ ID NO: 87302 - protein, 9 aa, Homo Sapiens
LPDTLKVTY

SEQ ID NO: 87303 - protein, 9 aa, Homo Sapiens
LPDVSLQEF

SEQ ID NO: 87304 - protein, 9 aa, Homo Sapiens
LPELNTRAF

SEQ ID NO: 87305 - protein, 9 aa, Homo Sapiens
LPFATPEEF

SEQ ID NO: 87306 - protein, 9 aa, Homo Sapiens
LPFDCTQAL

SEQ ID NO: 87307 - protein, 9 aa, Homo Sapiens
LPFDKETGF

SEQ ID NO: 87308 - protein, 9 aa, Homo Sapiens
LPFDLRIPF

SEQ ID NO: 87309 - protein, 9 aa, Homo Sapiens
LPFFNDRPW

SEQ ID NO: 87310 - protein, 9 aa, Homo Sapiens
LPFFPIATY

SEQ ID NO: 87311 - protein, 9 aa, Homo Sapiens
LPFHFPGSF

SEQ ID NO: 87312 - protein, 9 aa, Homo Sapiens
LPFPIIQQY

SEQ ID NO: 87313 - protein, 9 aa, Homo Sapiens
LPFPKIDPY

SEQ ID NO: 87314 - protein, 9 aa, Homo Sapiens
LPGEDWVFV

SEQ ID NO: 87315 - protein, 9 aa, Homo Sapiens
LPGLPAPSM

SEQ ID NO: 87316 - protein, 9 aa, Homo Sapiens
LPHAPGVQM

SEQ ID NO: 87317 - protein, 9 aa, Homo Sapiens
LPHDPDLAY

SEQ ID NO: 87318 - protein, 9 aa, Homo Sapiens
LPHEIVVNL

SEQ ID NO: 87319 - protein, 9 aa, Homo Sapiens
LPHFFPWSF

SEQ ID NO: 87320 - protein, 9 aa, Homo Sapiens
LPHGLIESF

SEQ ID NO: 87321 - protein, 9 aa, Homo Sapiens
LPHQPLATY

SEQ ID NO: 87322 - protein, 9 aa, Homo Sapiens
LPKNDLITY

SEQ ID NO: 87323 - protein, 9 aa, Homo Sapiens
LPLDIQIFY

SEQ ID NO: 87324 - protein, 9 aa, Homo Sapiens
LPLDLEDIF

SEQ ID NO: 87325 - protein, 9 aa, Homo Sapiens
LPLEEAYRF

SEQ ID NO: 87326 - protein, 9 aa, Homo Sapiens
LPLHVLPLY

SEQ ID NO: 87327 - protein, 9 aa, Homo Sapiens
LPLLLLLPM

SEQ ID NO: 87328 - protein, 9 aa, Homo Sapiens
LPLLPNVSY

SEQ ID NO: 87329 - protein, 9 aa, Homo Sapiens
LPLLSPVTF

SEQ ID NO: 87330 - protein, 9 aa, Homo Sapiens
LPLNSVYVY

SEQ ID NO: 87331 - protein, 9 aa, Homo Sapiens
LPLPLPMAL

SEQ ID NO: 87332 - protein, 9 aa, Homo Sapiens
LPLPVVQLL

SEQ ID NO: 87333 - protein, 9 aa, Homo Sapiens
LPLTHFELY

SEQ ID NO: 87334 - protein, 9 aa, Homo Sapiens
LPMGVVVDY

SEQ ID NO: 87335 - protein, 9 aa, Homo Sapiens
LPMVPIVAL

SEQ ID NO: 87336 - protein, 9 aa, Homo Sapiens
LPNDVISSL

SEQ ID NO: 87337 - protein, 9 aa, Homo Sapiens
LPNFGFVVF

SEQ ID NO: 87338 - protein, 9 aa, Homo Sapiens
LPNGLDVTF

SEQ ID NO: 87339 - protein, 9 aa, Homo Sapiens
LPNNIVDVW

SEQ ID NO: 87340 - protein, 9 aa, Homo Sapiens
LPNTDVPIL

SEQ ID NO: 87341 - protein, 9 aa, Homo Sapiens
LPNWLINSY

SEQ ID NO: 87342 - protein, 9 aa, Homo Sapiens
LPPEELVPY

SEQ ID NO: 87343 - protein, 9 aa, Homo Sapiens
LPPGVHISY

SEQ ID NO: 87344 - protein, 9 aa, Homo Sapiens
LPPKIVIGY

SEQ ID NO: 87345 - protein, 9 aa, Homo Sapiens
LPPPVHVDY

SEQ ID NO: 87346 - protein, 9 aa, Homo Sapiens
LPQDVILKF

SEQ ID NO: 87347 - protein, 9 aa, Homo Sapiens
LPQEAFEKY

SEQ ID NO: 87348 - protein, 9 aa, Homo Sapiens
LPQEDLEAL

SEQ ID NO: 87349 - protein, 9 aa, Homo Sapiens
LPSDVSILY

SEQ ID NO: 87350 - protein, 9 aa, Homo Sapiens
LPSEHQTIL

SEQ ID NO: 87351 - protein, 9 aa, Homo Sapiens
LPSEIEVKY

SEQ ID NO: 87352 - protein, 9 aa, Homo Sapiens
LPSHLNISY

SEQ ID NO: 87353 - protein, 9 aa, Homo Sapiens
LPSHVVTML

SEQ ID NO: 87354 - protein, 9 aa, Homo Sapiens
LPSLSAHEL

SEQ ID NO: 87355 - protein, 9 aa, Homo Sapiens
LPSSEVVKF

SEQ ID NO: 87356 - protein, 9 aa, Homo Sapiens
LPTAVIANL

SEQ ID NO: 87357 - protein, 9 aa, Homo Sapiens
LPTEEEWEF

SEQ ID NO: 87358 - protein, 9 aa, Homo Sapiens
LPTFQSPEF

SEQ ID NO: 87359 - protein, 9 aa, Homo Sapiens
LPTGVYLNF

SEQ ID NO: 87360 - protein, 9 aa, Homo Sapiens
LPVDFVECL

SEQ ID NO: 87361 - protein, 9 aa, Homo Sapiens
LPVDLAEEL

SEQ ID NO: 87362 - protein, 9 aa, Homo Sapiens
LPVEEFNEL

SEQ ID NO: 87363 - protein, 9 aa, Homo Sapiens
LPVEQGFTF

SEQ ID NO: 87364 - protein, 9 aa, Homo Sapiens
LPVIIFTTF

SEQ ID NO: 87365 - protein, 9 aa, Homo Sapiens
LPVLERLIY

SEQ ID NO: 87366 - protein, 9 aa, Homo Sapiens
LPVPAFNVI

SEQ ID NO: 87367 - protein, 9 aa, Homo Sapiens
LPVPVIPSF

SEQ ID NO: 87368 - protein, 9 aa, Homo Sapiens
LPWNITVHF

SEQ ID NO: 87369 - protein, 9 aa, Homo Sapiens
LPWVGKELY

SEQ ID NO: 87370 - protein, 9 aa, Homo Sapiens
LPYNDYFEY

SEQ ID NO: 87371 - protein, 9 aa, Homo Sapiens
LPYPDLETY

SEQ ID NO: 87372 - protein, 9 aa, Homo Sapiens
LPYTVVIHY

SEQ ID NO: 87373 - protein, 9 aa, Homo Sapiens
LVYNGVYQY

SEQ ID NO: 87374 - protein, 9 aa, Homo Sapiens
MAAMPQTVY

SEQ ID NO: 87375 - protein, 9 aa, Homo Sapiens
MALAVRVVY

SEQ ID NO: 87376 - protein, 9 aa, Homo Sapiens
MALLVPLVY

SEQ ID NO: 87377 - protein, 9 aa, Homo Sapiens
MANIPLPEY

SEQ ID NO: 87378 - protein, 9 aa, Homo Sapiens
MAVIDGNVM

SEQ ID NO: 87379 - protein, 9 aa, Homo Sapiens
MAWLVDHVY

SEQ ID NO: 87380 - protein, 9 aa, Homo Sapiens
MPADIATLL

SEQ ID NO: 87381 - protein, 9 aa, Homo Sapiens
MPAEIVELH

SEQ ID NO: 87382 - protein, 9 aa, Homo Sapiens
MPAPEIVSY

SEQ ID NO: 87383 - protein, 9 aa, Homo Sapiens
MPAVKAIIY

SEQ ID NO: 87384 - protein, 9 aa, Homo Sapiens
MPDDLLTTL

SEQ ID NO: 87385 - protein, 9 aa, Homo Sapiens
MPDSAAALL

SEQ ID NO: 87386 - protein, 9 aa, Homo Sapiens
MPEDVKNFY

SEQ ID NO: 87387 - protein, 9 aa, Homo Sapiens
MPIGPDVSL

SEQ ID NO: 87388 - protein, 9 aa, Homo Sapiens
MPIKLKIGL

SEQ ID NO: 87389 - protein, 9 aa, Homo Sapiens
MPLEDMNEF

SEQ ID NO: 87390 - protein, 9 aa, Homo Sapiens
MPLGARILF

SEQ ID NO: 87391 - protein, 9 aa, Homo Sapiens
MPLQLLLLL

SEQ ID NO: 87392 - protein, 9 aa, Homo Sapiens
MPNENIPEL

SEQ ID NO: 87393 - protein, 9 aa, Homo Sapiens
MPNQIVQIL

SEQ ID NO: 87394 - protein, 9 aa, Homo Sapiens
MPNSPAPHF

SEQ ID NO: 87395 - protein, 9 aa, Homo Sapiens
MPNVKVAVF

SEQ ID NO: 87396 - protein, 9 aa, Homo Sapiens
MPQFSTIEY

SEQ ID NO: 87397 - protein, 9 aa, Homo Sapiens
MPQGAPRLY

SEQ ID NO: 87398 - protein, 9 aa, Homo Sapiens
MPQGLVISF

SEQ ID NO: 87399 - protein, 9 aa, Homo Sapiens
MPQVAPDLY

SEQ ID NO: 87400 - protein, 9 aa, Homo Sapiens
MPSDVLEVT

SEQ ID NO: 87401 - protein, 9 aa, Homo Sapiens
MPSPVSPKL

SEQ ID NO: 87402 - protein, 9 aa, Homo Sapiens
MPSVKVSVF

SEQ ID NO: 87403 - protein, 9 aa, Homo Sapiens
MPTDVLEVT

SEQ ID NO: 87404 - protein, 9 aa, Homo Sapiens
MPTIQITAL

SEQ ID NO: 87405 - protein, 9 aa, Homo Sapiens
MPVLEQSVL

SEQ ID NO: 87406 - protein, 9 aa, Homo Sapiens
MPYLEHESF

SEQ ID NO: 87407 - protein, 9 aa, Homo Sapiens
MSFEWPWQY

SEQ ID NO: 87408 - protein, 9 aa, Homo Sapiens
MVHSLIEAY

SEQ ID NO: 87409 - protein, 9 aa, Homo Sapiens
MVNHFIAEF

SEQ ID NO: 87410 - protein, 9 aa, Homo Sapiens
MVQPINLIF

SEQ ID NO: 87411 - protein, 9 aa, Homo Sapiens
MVVDIVQEL

SEQ ID NO: 87412 - protein, 9 aa, Homo Sapiens
NAAFPFLAY

SEQ ID NO: 87413 - protein, 9 aa, Homo Sapiens
NAAKVFNLY

SEQ ID NO: 87414 - protein, 9 aa, Homo Sapiens
NADTLALVF

SEQ ID NO: 87415 - protein, 9 aa, Homo Sapiens
NAFASVILF

SEQ ID NO: 87416 - protein, 9 aa, Homo Sapiens
NAFDVFAAY

SEQ ID NO: 87417 - protein, 9 aa, Homo Sapiens
NAFEELVAF

SEQ ID NO: 87418 - protein, 9 aa, Homo Sapiens
NAFKEITTM

SEQ ID NO: 87419 - protein, 9 aa, Homo Sapiens
NAFWTIPVY

SEQ ID NO: 87420 - protein, 9 aa, Homo Sapiens
NAISVTTSY

SEQ ID NO: 87421 - protein, 9 aa, Homo Sapiens
NAITLPEEF

SEQ ID NO: 87422 - protein, 9 aa, Homo Sapiens
NAIVAVISY

SEQ ID NO: 87423 - protein, 9 aa, Homo Sapiens
NALPALLIY

SEQ ID NO: 87424 - protein, 9 aa, Homo Sapiens
NAMDVVVQF

SEQ ID NO: 87425 - protein, 9 aa, Homo Sapiens
NAVNLAIKY

SEQ ID NO: 87426 - protein, 9 aa, Homo Sapiens
NAWADIERF

SEQ ID NO: 87427 - protein, 9 aa, Homo Sapiens
NAWNNLEKY

SEQ ID NO: 87428 - protein, 9 aa, Homo Sapiens
NIITILESY

SEQ ID NO: 87429 - protein, 9 aa, Homo Sapiens
NIPEIVAVY

SEQ ID NO: 87430 - protein, 9 aa, Homo Sapiens
NPADITVLF

SEQ ID NO: 87431 - protein, 9 aa, Homo Sapiens
NPDDVFREF

SEQ ID NO: 87432 - protein, 9 aa, Homo Sapiens
NPFELAFSL

SEQ ID NO: 87433 - protein, 9 aa, Homo Sapiens
NPFEYYIFF

SEQ ID NO: 87434 - protein, 9 aa, Homo Sapiens
NPGEIFIIL

SEQ ID NO: 87435 - protein, 9 aa, Homo Sapiens
NPISTVTEL

SEQ ID NO: 87436 - protein, 9 aa, Homo Sapiens
NPLDEQHIF

SEQ ID NO: 87437 - protein, 9 aa, Homo Sapiens
NPSPYHLYY

SEQ ID NO: 87438 - protein, 9 aa, Homo Sapiens
NPTDAFTVF

SEQ ID NO: 87439 - protein, 9 aa, Homo Sapiens
NPTDISYVY

SEQ ID NO: 87440 - protein, 9 aa, Homo Sapiens
NPVDIVSTL

SEQ ID NO: 87441 - protein, 9 aa, Homo Sapiens
NPVEYSIVM

SEQ ID NO: 87442 - protein, 9 aa, Homo Sapiens
NPVGGLLEY

SEQ ID NO: 87443 - protein, 9 aa, Homo Sapiens
NPVQALSEF

SEQ ID NO: 87444 - protein, 9 aa, Homo Sapiens
NPVSWVESF

SEQ ID NO: 87445 - protein, 9 aa, Homo Sapiens
NPVSWVQTF

SEQ ID NO: 87446 - protein, 9 aa, Homo Sapiens
NPWDDKLIF

SEQ ID NO: 87447 - protein, 9 aa, Homo Sapiens
NPYHVVILF

SEQ ID NO: 87448 - protein, 9 aa, Homo Sapiens
NVADVVIKF

SEQ ID NO: 87449 - protein, 9 aa, Homo Sapiens
NVHDIMVSF

SEQ ID NO: 87450 - protein, 9 aa, Homo Sapiens
NVIHNLATY

SEQ ID NO: 87451 - protein, 9 aa, Homo Sapiens
NVIRDAVTY

SEQ ID NO: 87452 - protein, 9 aa, Homo Sapiens
NVVAVIVAF

SEQ ID NO: 87453 - protein, 9 aa, Homo Sapiens
PVATVLTDM

SEQ ID NO: 87454 - protein, 9 aa, Homo Sapiens
QAAMPQVSY

SEQ ID NO: 87455 - protein, 9 aa, Homo Sapiens
QAITLVTQY

SEQ ID NO: 87456 - protein, 9 aa, Homo Sapiens
QALEILFTY

SEQ ID NO: 87457 - protein, 9 aa, Homo Sapiens
QPFQVAEVF

SEQ ID NO: 87458 - protein, 9 aa, Homo Sapiens
QPINLIFRY

SEQ ID NO: 87459 - protein, 9 aa, Homo Sapiens
QPLEEIITY

SEQ ID NO: 87460 - protein, 9 aa, Homo Sapiens
QPMSFVLEF

SEQ ID NO: 87461 - protein, 9 aa, Homo Sapiens
RPFAGFEDF

SEQ ID NO: 87462 - protein, 9 aa, Homo Sapiens
RPIFIITEY

SEQ ID NO: 87463 - protein, 9 aa, Homo Sapiens
RPTDVAISF

SEQ ID NO: 87464 - protein, 9 aa, Homo Sapiens
RPVNVVNVY

SEQ ID NO: 87465 - protein, 9 aa, Homo Sapiens
SAADFFSHY

SEQ ID NO: 87466 - protein, 9 aa, Homo Sapiens
SAANIQPIF

SEQ ID NO: 87467 - protein, 9 aa, Homo Sapiens
SAAPFFVLF

SEQ ID NO: 87468 - protein, 9 aa, Homo Sapiens
SADQVALVY

SEQ ID NO: 87469 - protein, 9 aa, Homo Sapiens
SAFPYAHRF

SEQ ID NO: 87470 - protein, 9 aa, Homo Sapiens
SALPLYNLY

SEQ ID NO: 87471 - protein, 9 aa, Homo Sapiens
SALPTVVAY

SEQ ID NO: 87472 - protein, 9 aa, Homo Sapiens
SAMEVVPAL

SEQ ID NO: 87473 - protein, 9 aa, Homo Sapiens
SAVDVHINM

SEQ ID NO: 87474 - protein, 9 aa, Homo Sapiens
SAVEVCVVY

SEQ ID NO: 87475 - protein, 9 aa, Homo Sapiens
SAWSFITTF

SEQ ID NO: 87476 - protein, 9 aa, Homo Sapiens
SPAPVPVTY

SEQ ID NO: 87477 - protein, 9 aa, Homo Sapiens
SPDATIRIW

SEQ ID NO: 87478 - protein, 9 aa, Homo Sapiens
SPEELYRVF

SEQ ID NO: 87479 - protein, 9 aa, Homo Sapiens
SPFQPHVPY

SEQ ID NO: 87480 - protein, 9 aa, Homo Sapiens
SPFRFEISF

SEQ ID NO: 87481 - protein, 9 aa, Homo Sapiens
SPIDVVEKY

SEQ ID NO: 87482 - protein, 9 aa, Homo Sapiens
SPIQFESAW

SEQ ID NO: 87483 - protein, 9 aa, Homo Sapiens
SPLAFEHVM

SEQ ID NO: 87484 - protein, 9 aa, Homo Sapiens
SPLPAQLVY

SEQ ID NO: 87485 - protein, 9 aa, Homo Sapiens
SPMDIFDMF

SEQ ID NO: 87486 - protein, 9 aa, Homo Sapiens
SPNAEIHIL

SEQ ID NO: 87487 - protein, 9 aa, Homo Sapiens
SPTCLTLIY

SEQ ID NO: 87488 - protein, 9 aa, Homo Sapiens
SPVALNVQY

SEQ ID NO: 87489 - protein, 9 aa, Homo Sapiens
SPVDSVLFY

SEQ ID NO: 87490 - protein, 9 aa, Homo Sapiens
SPVDVLQIF

SEQ ID NO: 87491 - protein, 9 aa, Homo Sapiens
SPVFMQPVY

SEQ ID NO: 87492 - protein, 9 aa, Homo Sapiens
SPVSFIATY

SEQ ID NO: 87493 - protein, 9 aa, Homo Sapiens
SPVYIAIFY

SEQ ID NO: 87494 - protein, 9 aa, Homo Sapiens
SPWADNTAL

SEQ ID NO: 87495 - protein, 9 aa, Homo Sapiens
SVLPFQIYY

SEQ ID NO: 87496 - protein, 9 aa, Homo Sapiens
SVSEVIEGY

SEQ ID NO: 87497 - protein, 9 aa, Homo Sapiens
TAAAVGAVF

SEQ ID NO: 87498 - protein, 9 aa, Homo Sapiens
TAAPVVPEL

SEQ ID NO: 87499 - protein, 9 aa, Homo Sapiens
TAEGIILLF

SEQ ID NO: 87500 - protein, 9 aa, Homo Sapiens
TAFYLIENY

SEQ ID NO: 87501 - protein, 9 aa, Homo Sapiens
TAIRALETY

SEQ ID NO: 87502 - protein, 9 aa, Homo Sapiens
TAISLFYEL

SEQ ID NO: 87503 - protein, 9 aa, Homo Sapiens
TALAAFLSY

SEQ ID NO: 87504 - protein, 9 aa, Homo Sapiens
TALASVVAM

SEQ ID NO: 87505 - protein, 9 aa, Homo Sapiens
TASELKILY

SEQ ID NO: 87506 - protein, 9 aa, Homo Sapiens
TASPVAVSL

SEQ ID NO: 87507 - protein, 9 aa, Homo Sapiens
TAVKIAPRY

SEQ ID NO: 87508 - protein, 9 aa, Homo Sapiens
TAVPTLLKY

SEQ ID NO: 87509 - protein, 9 aa, Homo Sapiens
TAWEDYIWF

SEQ ID NO: 87510 - protein, 9 aa, Homo Sapiens
TIPYLTALL

SEQ ID NO: 87511 - protein, 9 aa, Homo Sapiens
TPADVFIVF

SEQ ID NO: 87512 - protein, 9 aa, Homo Sapiens
TPAGVQVIL

SEQ ID NO: 87513 - protein, 9 aa, Homo Sapiens
TPFAFVIDL

SEQ ID NO: 87514 - protein, 9 aa, Homo Sapiens
TPFLYDLVM

SEQ ID NO: 87515 - protein, 9 aa, Homo Sapiens
TPFVDPRVY

SEQ ID NO: 87516 - protein, 9 aa, Homo Sapiens
TPFVEGLSY

SEQ ID NO: 87517 - protein, 9 aa, Homo Sapiens
TPHSEIIFY

SEQ ID NO: 87518 - protein, 9 aa, Homo Sapiens
TPIKDGILY

SEQ ID NO: 87519 - protein, 9 aa, Homo Sapiens
TPIPGTIEM

SEQ ID NO: 87520 - protein, 9 aa, Homo Sapiens
TPLDFLHIF

SEQ ID NO: 87521 - protein, 9 aa, Homo Sapiens
TPLVDPSVY

SEQ ID NO: 87522 - protein, 9 aa, Homo Sapiens
TPMFVVKAY

SEQ ID NO: 87523 - protein, 9 aa, Homo Sapiens
TPSPIIQQL

SEQ ID NO: 87524 - protein, 9 aa, Homo Sapiens
TPTEISLVL

SEQ ID NO: 87525 - protein, 9 aa, Homo Sapiens
TPTGIKVVM

SEQ ID NO: 87526 - protein, 9 aa, Homo Sapiens
TPTPFFHTF

SEQ ID NO: 87527 - protein, 9 aa, Homo Sapiens
TPWPHIVEF

SEQ ID NO: 87528 - protein, 9 aa, Homo Sapiens
TVFDLVEEY

SEQ ID NO: 87529 - protein, 9 aa, Homo Sapiens
TVSDAILRY

SEQ ID NO: 87530 - protein, 9 aa, Homo Sapiens
TVTEVLLKY

SEQ ID NO: 87531 - protein, 9 aa, Homo Sapiens
VAAPLFELY

SEQ ID NO: 87532 - protein, 9 aa, Homo Sapiens
VADPYVVIM

SEQ ID NO: 87533 - protein, 9 aa, Homo Sapiens
VALNFIISY

SEQ ID NO: 87534 - protein, 9 aa, Homo Sapiens
VPAEVTVIL

SEQ ID NO: 87535 - protein, 9 aa, Homo Sapiens
VPASLPVEF

SEQ ID NO: 87536 - protein, 9 aa, Homo Sapiens
VPFDQFIQL

SEQ ID NO: 87537 - protein, 9 aa, Homo Sapiens
VPHSIINGY

SEQ ID NO: 87538 - protein, 9 aa, Homo Sapiens
VPHSLETLY

SEQ ID NO: 87539 - protein, 9 aa, Homo Sapiens
VPLEIMIKF

SEQ ID NO: 87540 - protein, 9 aa, Homo Sapiens
VPLGMTVTF

SEQ ID NO: 87541 - protein, 9 aa, Homo Sapiens
VPNFIFDEF

SEQ ID NO: 87542 - protein, 9 aa, Homo Sapiens
VPPLFVIEF

SEQ ID NO: 87543 - protein, 9 aa, Homo Sapiens
VPQVSTPTL

SEQ ID NO: 87544 - protein, 9 aa, Homo Sapiens
VPRIQLEEY

SEQ ID NO: 87545 - protein, 9 aa, Homo Sapiens
VPSGLIVDY

SEQ ID NO: 87546 - protein, 9 aa, Homo Sapiens
VPSPAQIMY

SEQ ID NO: 87547 - protein, 9 aa, Homo Sapiens
VPTELALLY

SEQ ID NO: 87548 - protein, 9 aa, Homo Sapiens
VPVDLQHQF

SEQ ID NO: 87549 - protein, 9 aa, Homo Sapiens
VPVDVVVNM

SEQ ID NO: 87550 - protein, 9 aa, Homo Sapiens
VPVEEPIAF

SEQ ID NO: 87551 - protein, 9 aa, Homo Sapiens
VPVPPNVAF

SEQ ID NO: 87552 - protein, 9 aa, Homo Sapiens
VPVSVVECF

SEQ ID NO: 87553 - protein, 9 aa, Homo Sapiens
VPVWIIHYY

SEQ ID NO: 87554 - protein, 9 aa, Homo Sapiens
VPWLSSVRY

SEQ ID NO: 87555 - protein, 9 aa, Homo Sapiens
VVPTAILAF

SEQ ID NO: 87556 - protein, 9 aa, Homo Sapiens
WPAEYIIVF

SEQ ID NO: 87557 - protein, 9 aa, Homo Sapiens
YAFDFARQS

SEQ ID NO: 87558 - protein, 9 aa, Homo Sapiens
YAFPKEFPY

SEQ ID NO: 87559 - protein, 9 aa, Homo Sapiens
YAIDNPLHY

SEQ ID NO: 87560 - protein, 9 aa, Homo Sapiens
YATFIVTNY

SEQ ID NO: 87561 - protein, 9 aa, Homo Sapiens
YGFQEKEAF

SEQ ID NO: 87562 - protein, 9 aa, Homo Sapiens
YMFVDENTF

SEQ ID NO: 87563 - protein, 9 aa, Homo Sapiens
YPAAVPQAL

SEQ ID NO: 87564 - protein, 9 aa, Homo Sapiens
YPAEITLTW

SEQ ID NO: 87565 - protein, 9 aa, Homo Sapiens
YPAGFPMGY

SEQ ID NO: 87566 - protein, 9 aa, Homo Sapiens
YPAQITPKM

SEQ ID NO: 87567 - protein, 9 aa, Homo Sapiens
YPASTVQIL

SEQ ID NO: 87568 - protein, 9 aa, Homo Sapiens
YPDTDVILM

SEQ ID NO: 87569 - protein, 9 aa, Homo Sapiens
YPENIVPSF

SEQ ID NO: 87570 - protein, 9 aa, Homo Sapiens
YPFSSEQKW

SEQ ID NO: 87571 - protein, 9 aa, Homo Sapiens
YPGPGNHFW

SEQ ID NO: 87572 - protein, 9 aa, Homo Sapiens
YPLDLLLKL

SEQ ID NO: 87573 - protein, 9 aa, Homo Sapiens
YPLEDLPSL

SEQ ID NO: 87574 - protein, 9 aa, Homo Sapiens
YPLWGGIMY

SEQ ID NO: 87575 - protein, 9 aa, Homo Sapiens
YPNVNIHNF

SEQ ID NO: 87576 - protein, 9 aa, Homo Sapiens
YPQDWFQVL

SEQ ID NO: 87577 - protein, 9 aa, Homo Sapiens
YPQEVIPTF

SEQ ID NO: 87578 - protein, 9 aa, Homo Sapiens
YPSEFATYL

SEQ ID NO: 87579 - protein, 9 aa, Homo Sapiens
YPSNIFISF

SEQ ID NO: 87580 - protein, 9 aa, Homo Sapiens
YPVDLGDKF

SEQ ID NO: 87581 - protein, 9 aa, Homo Sapiens
YPVEIHEYL

SEQ ID NO: 87582 - protein, 9 aa, Homo Sapiens
YSFLDKMSF

SEQ ID NO: 87583 - protein, 10 aa, Homo Sapiens
APIRPDIVNF

SEQ ID NO: 87584 - protein, 10 aa, Homo Sapiens
DAFLEQAVSY

SEQ ID NO: 87585 - protein, 10 aa, Homo Sapiens
DAWLEMNPGY

SEQ ID NO: 87586 - protein, 10 aa, Homo Sapiens
DPFVDRIGYF

SEQ ID NO: 87587 - protein, 10 aa, Homo Sapiens
EALAGLLVTY

SEQ ID NO: 87588 - protein, 10 aa, Homo Sapiens
EAWHELAELY

SEQ ID NO: 87589 - protein, 10 aa, Homo Sapiens
EAWLEMNPGY

SEQ ID NO: 87590 - protein, 10 aa, Homo Sapiens
EENSRISITF

SEQ ID NO: 87591 - protein, 10 aa, Homo Sapiens
EPWPENATLY

SEQ ID NO: 87592 - protein, 10 aa, Homo Sapiens
FANPEDCVAF

SEQ ID NO: 87593 - protein, 10 aa, Homo Sapiens
FAVDLEHHSY

SEQ ID NO: 87594 - protein, 10 aa, Homo Sapiens
FPAPAKAVVY

SEQ ID NO: 87595 - protein, 10 aa, Homo Sapiens
FPASFPNRQY

SEQ ID NO: 87596 - protein, 10 aa, Homo Sapiens
FPEAYKPTVY

SEQ ID NO: 87597 - protein, 10 aa, Homo Sapiens
FPEDVVRVIF

SEQ ID NO: 87598 - protein, 10 aa, Homo Sapiens
FPEEVIATIF

SEQ ID NO: 87599 - protein, 10 aa, Homo Sapiens
FPEPLIIPVL

SEQ ID NO: 87600 - protein, 10 aa, Homo Sapiens
FPEVYVPTVF

SEQ ID NO: 87601 - protein, 10 aa, Homo Sapiens
FPFHEVIQEF

SEQ ID NO: 87602 - protein, 10 aa, Homo Sapiens
FPHPVNQVTF

SEQ ID NO: 87603 - protein, 10 aa, Homo Sapiens
FPMTHGNTGF

SEQ ID NO: 87604 - protein, 10 aa, Homo Sapiens
FPSEYVPTVF

SEQ ID NO: 87605 - protein, 10 aa, Homo Sapiens
FPTQALNFAF

SEQ ID NO: 87606 - protein, 10 aa, Homo Sapiens
FPVAGQKLIY

SEQ ID NO: 87607 - protein, 10 aa, Homo Sapiens
FPVEIKSFYM

SEQ ID NO: 87608 - protein, 10 aa, Homo Sapiens
FPVPGSGLVL

SEQ ID NO: 87609 - protein, 10 aa, Homo Sapiens
FPWGDGNHTL

SEQ ID NO: 87610 - protein, 10 aa, Homo Sapiens
FPYKNCKTDF

SEQ ID NO: 87611 - protein, 10 aa, Homo Sapiens
FPYQDKLVGY

SEQ ID NO: 87612 - protein, 10 aa, Homo Sapiens
HAIQDLLVFY

SEQ ID NO: 87613 - protein, 10 aa, Homo Sapiens
HPDPTRLLLF

SEQ ID NO: 87614 - protein, 10 aa, Homo Sapiens
HPEASIQAVF

SEQ ID NO: 87615 - protein, 10 aa, Homo Sapiens
HPIDGFLQSL

SEQ ID NO: 87616 - protein, 10 aa, Homo Sapiens
HPIEGSTTVF

SEQ ID NO: 87617 - protein, 10 aa, Homo Sapiens
HPLSVLGINY

SEQ ID NO: 87618 - protein, 10 aa, Homo Sapiens
HPNLVVGGTY

SEQ ID NO: 87619 - protein, 10 aa, Homo Sapiens
HPTLGPKITY

SEQ ID NO: 87620 - protein, 10 aa, Homo Sapiens
HPVYILKGGY

SEQ ID NO: 87621 - protein, 10 aa, Homo Sapiens
HPWEVMPDLY

SEQ ID NO: 87622 - protein, 10 aa, Homo Sapiens
HPWFGMEQEY

SEQ ID NO: 87623 - protein, 10 aa, Homo Sapiens
IPAPGSGVSF

SEQ ID NO: 87624 - protein, 10 aa, Homo Sapiens
IPFDPKFITY

SEQ ID NO: 87625 - protein, 10 aa, Homo Sapiens
IPHSFALISY

SEQ ID NO: 87626 - protein, 10 aa, Homo Sapiens
IPICHGNLIF

SEQ ID NO: 87627 - protein, 10 aa, Homo Sapiens
IPIPFYLSVY

SEQ ID NO: 87628 - protein, 10 aa, Homo Sapiens
IPISPISPAF

SEQ ID NO: 87629 - protein, 10 aa, Homo Sapiens
IPIWGTLIQY

SEQ ID NO: 87630 - protein, 10 aa, Homo Sapiens
IPLDGETWSY

SEQ ID NO: 87631 - protein, 10 aa, Homo Sapiens
IPVFLRHAEL

SEQ ID NO: 87632 - protein, 10 aa, Homo Sapiens
LAAADISAYY

SEQ ID NO: 87633 - protein, 10 aa, Homo Sapiens
LGAPDELLAF

SEQ ID NO: 87634 - protein, 10 aa, Homo Sapiens
LPADITEDEF

SEQ ID NO: 87635 - protein, 10 aa, Homo Sapiens
LPEARGRAGL

SEQ ID NO: 87636 - protein, 10 aa, Homo Sapiens
LPFSSMPTAY

SEQ ID NO: 87637 - protein, 10 aa, Homo Sapiens
LPHPYAIAVF

SEQ ID NO: 87638 - protein, 10 aa, Homo Sapiens
LPIDPNEPTY

SEQ ID NO: 87639 - protein, 10 aa, Homo Sapiens
LPIGDVATQY

SEQ ID NO: 87640 - protein, 10 aa, Homo Sapiens
LPIPDPGVSV

SEQ ID NO: 87641 - protein, 10 aa, Homo Sapiens
LPIPSKLLEF

SEQ ID NO: 87642 - protein, 10 aa, Homo Sapiens
LPLPAPHAQY

SEQ ID NO: 87643 - protein, 10 aa, Homo Sapiens
LPPEIFGDAL

SEQ ID NO: 87644 - protein, 10 aa, Homo Sapiens
LPQPDVFPLF

SEQ ID NO: 87645 - protein, 10 aa, Homo Sapiens
LPSDFTPAVH

SEQ ID NO: 87646 - protein, 10 aa, Homo Sapiens
LPSPVTAQKY

SEQ ID NO: 87647 - protein, 10 aa, Homo Sapiens
LPTEPPYTAY

SEQ ID NO: 87648 - protein, 10 aa, Homo Sapiens
LPYNDYFEYF

SEQ ID NO: 87649 - protein, 10 aa, Homo Sapiens
LPYNHQHEYF

SEQ ID NO: 87650 - protein, 10 aa, Homo Sapiens
LPYSEYFEYF

SEQ ID NO: 87651 - protein, 10 aa, Homo Sapiens
MAFQNDVYEW

SEQ ID NO: 87652 - protein, 10 aa, Homo Sapiens
MPELVDFRQY

SEQ ID NO: 87653 - protein, 10 aa, Homo Sapiens
MPEPDAQRFF

SEQ ID NO: 87654 - protein, 10 aa, Homo Sapiens
MPFEIRLPEF

SEQ ID NO: 87655 - protein, 10 aa, Homo Sapiens
MPLGSAVDIL

SEQ ID NO: 87656 - protein, 10 aa, Homo Sapiens
MPLHTIIPLL

SEQ ID NO: 87657 - protein, 10 aa, Homo Sapiens
MPSSDTTVTF

SEQ ID NO: 87658 - protein, 10 aa, Homo Sapiens
MPSVVGVLVF

SEQ ID NO: 87659 - protein, 10 aa, Homo Sapiens
NAFPEENMNY

SEQ ID NO: 87660 - protein, 10 aa, Homo Sapiens
NAVDALIDSM

SEQ ID NO: 87661 - protein, 10 aa, Homo Sapiens
NAYQELLQHY

SEQ ID NO: 87662 - protein, 10 aa, Homo Sapiens
NPFHWGEVEY

SEQ ID NO: 87663 - protein, 10 aa, Homo Sapiens
NVVQLIMDAY

SEQ ID NO: 87664 - protein, 10 aa, Homo Sapiens
QPAQDIFSVY

SEQ ID NO: 87665 - protein, 10 aa, Homo Sapiens
QPWEEIKTSY

SEQ ID NO: 87666 - protein, 10 aa, Homo Sapiens
SPASDTYIVF

SEQ ID NO: 87667 - protein, 10 aa, Homo Sapiens
SPIEFLENAY

SEQ ID NO: 87668 - protein, 10 aa, Homo Sapiens
SPIPFPPLSY

SEQ ID NO: 87669 - protein, 10 aa, Homo Sapiens
TAAAVVGLLY

SEQ ID NO: 87670 - protein, 10 aa, Homo Sapiens
TAFTLAHIHY

SEQ ID NO: 87671 - protein, 10 aa, Homo Sapiens
TANPFPVPSL

SEQ ID NO: 87672 - protein, 10 aa, Homo Sapiens
TAWDEADVRF

SEQ ID NO: 87673 - protein, 10 aa, Homo Sapiens
TAWLEIMTKY

SEQ ID NO: 87674 - protein, 10 aa, Homo Sapiens
TPLSLFGDTY

SEQ ID NO: 87675 - protein, 10 aa, Homo Sapiens
TVFGSLIIGY

SEQ ID NO: 87676 - protein, 10 aa, Homo Sapiens
VALPGVAVSM

SEQ ID NO: 87677 - protein, 10 aa, Homo Sapiens
VPWHEEVVQF

SEQ ID NO: 87678 - protein, 10 aa, Homo Sapiens
VPYPDDLVGF

SEQ ID NO: 87679 - protein, 10 aa, Homo Sapiens
YAFQDDRYLY

SEQ ID NO: 87680 - protein, 10 aa, Homo Sapiens
YALEEGIVRY

SEQ ID NO: 87681 - protein, 10 aa, Homo Sapiens
YAQDEHLITF

SEQ ID NO: 87682 - protein, 10 aa, Homo Sapiens
YAWRPVFDEY

SEQ ID NO: 87683 - protein, 10 aa, Homo Sapiens
YPFKPPKITF

SEQ ID NO: 87684 - protein, 10 aa, Homo Sapiens
YPFKPPKVAF

SEQ ID NO: 87685 - protein, 10 aa, Homo Sapiens
YPFKPPKVTF

SEQ ID NO: 87686 - protein, 10 aa, Homo Sapiens
YPFLLVGDLM

SEQ ID NO: 87687 - protein, 10 aa, Homo Sapiens
YPFPTFQPAF

SEQ ID NO: 87688 - protein, 10 aa, Homo Sapiens
YPIALTRAEM

SEQ ID NO: 87689 - protein, 10 aa, Homo Sapiens
YPIDPVTQEF

SEQ ID NO: 87690 - protein, 10 aa, Homo Sapiens
YPLEVTKLIY

SEQ ID NO: 87691 - protein, 10 aa, Homo Sapiens
YPTSIASLAF

SEQ ID NO: 87692 - protein, 10 aa, Homo Sapiens
YPYNAPTVKF

SEQ ID NO: 87693 - protein, 10 aa, Homo Sapiens
YPYPPPPPEF

SEQ ID NO: 87694 - protein, 11 aa, Homo Sapiens
APWIESQDWAY

SEQ ID NO: 87695 - protein, 11 aa, Homo Sapiens
DPFSFDGPEIM

SEQ ID NO: 87696 - protein, 11 aa, Homo Sapiens
EAFDELLASKY

SEQ ID NO: 87697 - protein, 11 aa, Homo Sapiens
EPIYPEVVHMF

SEQ ID NO: 87698 - protein, 11 aa, Homo Sapiens
FAGDDAPRAVF

SEQ ID NO: 87699 - protein, 11 aa, Homo Sapiens
FAKSVSFSDVF

SEQ ID NO: 87700 - protein, 11 aa, Homo Sapiens
FALPSELERSY

SEQ ID NO: 87701 - protein, 11 aa, Homo Sapiens
FAVTEYPTLKF

SEQ ID NO: 87702 - protein, 11 aa, Homo Sapiens
FIWVDGSHVDY

SEQ ID NO: 87703 - protein, 11 aa, Homo Sapiens
FPAGSVHVNVY

SEQ ID NO: 87704 - protein, 11 aa, Homo Sapiens
FPASPPKGYFL

SEQ ID NO: 87705 - protein, 11 aa, Homo Sapiens
FPDFPTPGVVF

SEQ ID NO: 87706 - protein, 11 aa, Homo Sapiens
FPEPLIIPVLY

SEQ ID NO: 87707 - protein, 11 aa, Homo Sapiens
FPEPNPRVIEL

SEQ ID NO: 87708 - protein, 11 aa, Homo Sapiens
FPFLSGDNQHY

SEQ ID NO: 87709 - protein, 11 aa, Homo Sapiens
FPFNPLDFESF

SEQ ID NO: 87710 - protein, 11 aa, Homo Sapiens
FPHLPGKTFVY

SEQ ID NO: 87711 - protein, 11 aa, Homo Sapiens
FPLDVGSIVGY

SEQ ID NO: 87712 - protein, 11 aa, Homo Sapiens
FPLIEVNKVYY

SEQ ID NO: 87713 - protein, 11 aa, Homo Sapiens
FPLLPQDVHLL

SEQ ID NO: 87714 - protein, 11 aa, Homo Sapiens
FPNIVIKGSEL

SEQ ID NO: 87715 - protein, 11 aa, Homo Sapiens
FPVYVLPKVEY

SEQ ID NO: 87716 - protein, 11 aa, Homo Sapiens
FPWEVPKKLKY

SEQ ID NO: 87717 - protein, 11 aa, Homo Sapiens
FPWGDGNHTLF

SEQ ID NO: 87718 - protein, 11 aa, Homo Sapiens
FPYYPSPGVLF

SEQ ID NO: 87719 - protein, 11 aa, Homo Sapiens
HPLPETAVRGY

SEQ ID NO: 87720 - protein, 11 aa, Homo Sapiens
HPNIVSLQDVL

SEQ ID NO: 87721 - protein, 11 aa, Homo Sapiens
IPEGEILVITY

SEQ ID NO: 87722 - protein, 11 aa, Homo Sapiens
IPIALSGRDIL

SEQ ID NO: 87723 - protein, 11 aa, Homo Sapiens
IPIGGGTSVSY

SEQ ID NO: 87724 - protein, 11 aa, Homo Sapiens
IPLALEGKDLL

SEQ ID NO: 87725 - protein, 11 aa, Homo Sapiens
IPYHSEVPVSL

SEQ ID NO: 87726 - protein, 11 aa, Homo Sapiens
IPYSEPMPLSF

SEQ ID NO: 87727 - protein, 11 aa, Homo Sapiens
ISFNELNDLFK

SEQ ID NO: 87728 - protein, 11 aa, Homo Sapiens
LPAAGVGDMVM

SEQ ID NO: 87729 - protein, 11 aa, Homo Sapiens
LPFLPSTEDVY

SEQ ID NO: 87730 - protein, 11 aa, Homo Sapiens
LPFPDETHERY

SEQ ID NO: 87731 - protein, 11 aa, Homo Sapiens
LPFSAGSLLVY

SEQ ID NO: 87732 - protein, 11 aa, Homo Sapiens
LPIGDVATQYF

SEQ ID NO: 87733 - protein, 11 aa, Homo Sapiens
LPIGIPYSISF

SEQ ID NO: 87734 - protein, 11 aa, Homo Sapiens
LPINDPLQTVY

SEQ ID NO: 87735 - protein, 11 aa, Homo Sapiens
LPLFPEPLHVF

SEQ ID NO: 87736 - protein, 11 aa, Homo Sapiens
LPLNTNIRLAY

SEQ ID NO: 87737 - protein, 11 aa, Homo Sapiens
LPLPNDKTLLY

SEQ ID NO: 87738 - protein, 11 aa, Homo Sapiens
LPMGALPQGPM

SEQ ID NO: 87739 - protein, 11 aa, Homo Sapiens
LPYKITAEEMY

SEQ ID NO: 87740 - protein, 11 aa, Homo Sapiens
LPYPDPAIAQF

SEQ ID NO: 87741 - protein, 11 aa, Homo Sapiens
LPYRATENDIY

SEQ ID NO: 87742 - protein, 11 aa, Homo Sapiens
MAAAAAAAAEQ

SEQ ID NO: 87743 - protein, 11 aa, Homo Sapiens
MPAAQEGAVAF

SEQ ID NO: 87744 - protein, 11 aa, Homo Sapiens
MPAVKAIIYQY

SEQ ID NO: 87745 - protein, 11 aa, Homo Sapiens
MPVGPDAILRY

SEQ ID NO: 87746 - protein, 11 aa, Homo Sapiens
MPWVQETLAAN

SEQ ID NO: 87747 - protein, 11 aa, Homo Sapiens
NAFAEPGRVPF

SEQ ID NO: 87748 - protein, 11 aa, Homo Sapiens
NAFEHGGEFTY

SEQ ID NO: 87749 - protein, 11 aa, Homo Sapiens
NALPDTLKVTY

SEQ ID NO: 87750 - protein, 11 aa, Homo Sapiens
NPADSISHVAY

SEQ ID NO: 87751 - protein, 11 aa, Homo Sapiens
NPENLATLERY

SEQ ID NO: 87752 - protein, 11 aa, Homo Sapiens
RAFDQGADAIY

SEQ ID NO: 87753 - protein, 11 aa, Homo Sapiens
RPFADLLGTAF

SEQ ID NO: 87754 - protein, 11 aa, Homo Sapiens
RPFASGANFEY

SEQ ID NO: 87755 - protein, 11 aa, Homo Sapiens
SPEGRLYQVEY

SEQ ID NO: 87756 - protein, 11 aa, Homo Sapiens
SPFFERSGLAY

SEQ ID NO: 87757 - protein, 11 aa, Homo Sapiens
TPALVNAAVTY

SEQ ID NO: 87758 - protein, 11 aa, Homo Sapiens
VPDSSGPERIL

SEQ ID NO: 87759 - protein, 11 aa, Homo Sapiens
VPFTEQIIQTF

SEQ ID NO: 87760 - protein, 11 aa, Homo Sapiens
VPVTLIGEAVF

SEQ ID NO: 87761 - protein, 11 aa, Homo Sapiens
YAWESSAGGSF

SEQ ID NO: 87762 - protein, 11 aa, Homo Sapiens
YPDPVSIIQKY

SEQ ID NO: 87763 - protein, 11 aa, Homo Sapiens
YPETLGRLLIL

SEQ ID NO: 87764 - protein, 11 aa, Homo Sapiens
YPFESAEAQLL

SEQ ID NO: 87765 - protein, 11 aa, Homo Sapiens
YPGPASLTQIY

SEQ ID NO: 87766 - protein, 11 aa, Homo Sapiens
YPIDLAGLLQY

SEQ ID NO: 87767 - protein, 11 aa, Homo Sapiens
YPLDLEGGSEY

SEQ ID NO: 87768 - protein, 11 aa, Homo Sapiens
YPLEDATHIAL

SEQ ID NO: 87769 - protein, 11 aa, Homo Sapiens
YPLEDLPSLLY

SEQ ID NO: 87770 - protein, 11 aa, Homo Sapiens
YPSETTVKYVF

SEQ ID NO: 87771 - protein, 11 aa, Homo Sapiens
YPVFPWIIHDY

SEQ ID NO: 87772 - protein, 11 aa, Homo Sapiens
YPVTPELLERY

SEQ ID NO: 87773 - protein, 8 aa, Homo Sapiens
DAHKGVAL

SEQ ID NO: 87774 - protein, 8 aa, Homo Sapiens
EPGPAEEL

SEQ ID NO: 87775 - protein, 8 aa, Homo Sapiens
FNEKSKEL

SEQ ID NO: 87776 - protein, 8 aa, Homo Sapiens
FPAEPLEL

SEQ ID NO: 87777 - protein, 8 aa, Homo Sapiens
FPAPNVIL

SEQ ID NO: 87778 - protein, 8 aa, Homo Sapiens
FPAPSHVV

SEQ ID NO: 87779 - protein, 8 aa, Homo Sapiens
FPDEDEIL

SEQ ID NO: 87780 - protein, 8 aa, Homo Sapiens
FPDTPLAL

SEQ ID NO: 87781 - protein, 8 aa, Homo Sapiens
FPELGAAL

SEQ ID NO: 87782 - protein, 8 aa, Homo Sapiens
FPFYDKPM

SEQ ID NO: 87783 - protein, 8 aa, Homo Sapiens
FPGLASEL

SEQ ID NO: 87784 - protein, 8 aa, Homo Sapiens
FPGPIFHL

SEQ ID NO: 87785 - protein, 8 aa, Homo Sapiens
FPGPSKPF

SEQ ID NO: 87786 - protein, 8 aa, Homo Sapiens
FPHTTPSM

SEQ ID NO: 87787 - protein, 8 aa, Homo Sapiens
FPIKDVPL

SEQ ID NO: 87788 - protein, 8 aa, Homo Sapiens
FPIVGEPL

SEQ ID NO: 87789 - protein, 8 aa, Homo Sapiens
FPLDGHVL

SEQ ID NO: 87790 - protein, 8 aa, Homo Sapiens
FPSQDPVL

SEQ ID NO: 87791 - protein, 8 aa, Homo Sapiens
FPVPTPEM

SEQ ID NO: 87792 - protein, 8 aa, Homo Sapiens
IPVEDNQM

SEQ ID NO: 87793 - protein, 8 aa, Homo Sapiens
LAATHEPT

SEQ ID NO: 87794 - protein, 8 aa, Homo Sapiens
LEEYAATL

SEQ ID NO: 87795 - protein, 8 aa, Homo Sapiens
LPAETMRI

SEQ ID NO: 87796 - protein, 8 aa, Homo Sapiens
LPAFSPLM

SEQ ID NO: 87797 - protein, 8 aa, Homo Sapiens
LPDEKNVL

SEQ ID NO: 87798 - protein, 8 aa, Homo Sapiens
LPGPAPCL

SEQ ID NO: 87799 - protein, 8 aa, Homo Sapiens
LPHKGNIL

SEQ ID NO: 87800 - protein, 8 aa, Homo Sapiens
LPHSTAAL

SEQ ID NO: 87801 - protein, 8 aa, Homo Sapiens
LPHTDFTL

SEQ ID NO: 87802 - protein, 8 aa, Homo Sapiens
LPIVTPAL

SEQ ID NO: 87803 - protein, 8 aa, Homo Sapiens
LPLTEHEL

SEQ ID NO: 87804 - protein, 8 aa, Homo Sapiens
LPMTTEVL

SEQ ID NO: 87805 - protein, 8 aa, Homo Sapiens
LPQEDPPT

SEQ ID NO: 87806 - protein, 8 aa, Homo Sapiens
MPAETEEL

SEQ ID NO: 87807 - protein, 8 aa, Homo Sapiens
MPDEETPL

SEQ ID NO: 87808 - protein, 8 aa, Homo Sapiens
MPDLAHVM

SEQ ID NO: 87809 - protein, 8 aa, Homo Sapiens
MPDLPHLL

SEQ ID NO: 87810 - protein, 8 aa, Homo Sapiens
MPESGVAL

SEQ ID NO: 87811 - protein, 8 aa, Homo Sapiens
MPIKDNAL

SEQ ID NO: 87812 - protein, 8 aa, Homo Sapiens
MPSDQYEL

SEQ ID NO: 87813 - protein, 8 aa, Homo Sapiens
MPTEPESV

SEQ ID NO: 87814 - protein, 8 aa, Homo Sapiens
PEKEPSVL

SEQ ID NO: 87815 - protein, 8 aa, Homo Sapiens
PIHADPRL

SEQ ID NO: 87816 - protein, 8 aa, Homo Sapiens
PNAIEHTL

SEQ ID NO: 87817 - protein, 8 aa, Homo Sapiens
PSEPHPVL

SEQ ID NO: 87818 - protein, 8 aa, Homo Sapiens
PVEIHEYL

SEQ ID NO: 87819 - protein, 8 aa, Homo Sapiens
PVGRVHRL

SEQ ID NO: 87820 - protein, 8 aa, Homo Sapiens
PYPEPSKL

SEQ ID NO: 87821 - protein, 8 aa, Homo Sapiens
VPAPNFAM

SEQ ID NO: 87822 - protein, 8 aa, Homo Sapiens
VPAPTNVL

SEQ ID NO: 87823 - protein, 8 aa, Homo Sapiens
WGPLPGIP

SEQ ID NO: 87824 - protein, 8 aa, Homo Sapiens
WPAAGFEL

SEQ ID NO: 87825 - protein, 8 aa, Homo Sapiens
WPAPSLSL

SEQ ID NO: 87826 - protein, 8 aa, Homo Sapiens
WPGPLADM

SEQ ID NO: 87827 - protein, 8 aa, Homo Sapiens
YPDTDVIL

SEQ ID NO: 87828 - protein, 8 aa, Homo Sapiens
YPGPAVVL

SEQ ID NO: 87829 - protein, 9 aa, Homo Sapiens
AANPIQFTL

SEQ ID NO: 87830 - protein, 9 aa, Homo Sapiens
APAPKAYVL

SEQ ID NO: 87831 - protein, 9 aa, Homo Sapiens
APAPTAVVL

SEQ ID NO: 87832 - protein, 9 aa, Homo Sapiens
APAPVQPPM

SEQ ID NO: 87833 - protein, 9 aa, Homo Sapiens
APEERPAAL

SEQ ID NO: 87834 - protein, 9 aa, Homo Sapiens
APEPRAALL

SEQ ID NO: 87835 - protein, 9 aa, Homo Sapiens
APHAPGPPA

SEQ ID NO: 87836 - protein, 9 aa, Homo Sapiens
APLEDEATL

SEQ ID NO: 87837 - protein, 9 aa, Homo Sapiens
APSPEDPEL

SEQ ID NO: 87838 - protein, 9 aa, Homo Sapiens
APTDYCFVL

SEQ ID NO: 87839 - protein, 9 aa, Homo Sapiens
APVFRDYVF

SEQ ID NO: 87840 - protein, 9 aa, Homo Sapiens
APVKYDHIL

SEQ ID NO: 87841 - protein, 9 aa, Homo Sapiens
APYPHSNEL

SEQ ID NO: 87842 - protein, 9 aa, Homo Sapiens
AQDPLLLQM

SEQ ID NO: 87843 - protein, 9 aa, Homo Sapiens
ASAPPGPPA

SEQ ID NO: 87844 - protein, 9 aa, Homo Sapiens
CPDALFNEL

SEQ ID NO: 87845 - protein, 9 aa, Homo Sapiens
CPDEVYQLM

SEQ ID NO: 87846 - protein, 9 aa, Homo Sapiens
CPDPRPLEL

SEQ ID NO: 87847 - protein, 9 aa, Homo Sapiens
CPDPSSRSL

SEQ ID NO: 87848 - protein, 9 aa, Homo Sapiens
CPIAVTHFL

SEQ ID NO: 87849 - protein, 9 aa, Homo Sapiens
CPIKEEIAI

SEQ ID NO: 87850 - protein, 9 aa, Homo Sapiens
CPLAGSAVL

SEQ ID NO: 87851 - protein, 9 aa, Homo Sapiens
CPNSKAPVL

SEQ ID NO: 87852 - protein, 9 aa, Homo Sapiens
CPYHSDRQL

SEQ ID NO: 87853 - protein, 9 aa, Homo Sapiens
DAFSKDHQL

SEQ ID NO: 87854 - protein, 9 aa, Homo Sapiens
DAIARDAEL

SEQ ID NO: 87855 - protein, 9 aa, Homo Sapiens
DAQLQIYTL

SEQ ID NO: 87856 - protein, 9 aa, Homo Sapiens
DASGPDPQL

SEQ ID NO: 87857 - protein, 9 aa, Homo Sapiens
DASPVQAVF

SEQ ID NO: 87858 - protein, 9 aa, Homo Sapiens
DAYALNHTL

SEQ ID NO: 87859 - protein, 9 aa, Homo Sapiens
DNPIQTVSL

SEQ ID NO: 87860 - protein, 9 aa, Homo Sapiens
DPASLDHKL

SEQ ID NO: 87861 - protein, 9 aa, Homo Sapiens
DPEAFLVQI

SEQ ID NO: 87862 - protein, 9 aa, Homo Sapiens
DPFRDLHSL

SEQ ID NO: 87863 - protein, 9 aa, Homo Sapiens
DPIYKENIM

SEQ ID NO: 87864 - protein, 9 aa, Homo Sapiens
DPNLEFVAM

SEQ ID NO: 87865 - protein, 9 aa, Homo Sapiens
DPTAVGPVL

SEQ ID NO: 87866 - protein, 9 aa, Homo Sapiens
DPVEPHGEM

SEQ ID NO: 87867 - protein, 9 aa, Homo Sapiens
DPYQGTIVL

SEQ ID NO: 87868 - protein, 9 aa, Homo Sapiens
DSAPGILVL

SEQ ID NO: 87869 - protein, 9 aa, Homo Sapiens
EAAPDGPAL

SEQ ID NO: 87870 - protein, 9 aa, Homo Sapiens
EACGVIVEL

SEQ ID NO: 87871 - protein, 9 aa, Homo Sapiens
EACPGAVAM

SEQ ID NO: 87872 - protein, 9 aa, Homo Sapiens
EAFPHDSQL

SEQ ID NO: 87873 - protein, 9 aa, Homo Sapiens
EAITGDFAL

SEQ ID NO: 87874 - protein, 9 aa, Homo Sapiens
EASPAPLVL

SEQ ID NO: 87875 - protein, 9 aa, Homo Sapiens
EASPFSRSL

SEQ ID NO: 87876 - protein, 9 aa, Homo Sapiens
EASPVEPQL

SEQ ID NO: 87877 - protein, 9 aa, Homo Sapiens
EATKINLSL

SEQ ID NO: 87878 - protein, 9 aa, Homo Sapiens
EAYIDPIAM

SEQ ID NO: 87879 - protein, 9 aa, Homo Sapiens
EGSPIKVTL

SEQ ID NO: 87880 - protein, 9 aa, Homo Sapiens
EPAPEAEAL

SEQ ID NO: 87881 - protein, 9 aa, Homo Sapiens
EPCKNVHVL

SEQ ID NO: 87882 - protein, 9 aa, Homo Sapiens
EPEPSPKAL

SEQ ID NO: 87883 - protein, 9 aa, Homo Sapiens
EPFPDGAEL

SEQ ID NO: 87884 - protein, 9 aa, Homo Sapiens
EPFQDGYSL

SEQ ID NO: 87885 - protein, 9 aa, Homo Sapiens
EPNPDDPLM

SEQ ID NO: 87886 - protein, 9 aa, Homo Sapiens
EPNPESLEL

SEQ ID NO: 87887 - protein, 9 aa, Homo Sapiens
EPSAVALEL

SEQ ID NO: 87888 - protein, 9 aa, Homo Sapiens
EPVLINPVL

SEQ ID NO: 87889 - protein, 9 aa, Homo Sapiens
EPVQLTFAL

SEQ ID NO: 87890 - protein, 9 aa, Homo Sapiens
FAADIISVL

SEQ ID NO: 87891 - protein, 9 aa, Homo Sapiens
FADGHVLEL

SEQ ID NO: 87892 - protein, 9 aa, Homo Sapiens
FAMEIDPSL

SEQ ID NO: 87893 - protein, 9 aa, Homo Sapiens
FANDDRHVM

SEQ ID NO: 87894 - protein, 9 aa, Homo Sapiens
FASEVSNVL

SEQ ID NO: 87895 - protein, 9 aa, Homo Sapiens
FASEYPLIL

SEQ ID NO: 87896 - protein, 9 aa, Homo Sapiens
FASHVSPEV

SEQ ID NO: 87897 - protein, 9 aa, Homo Sapiens
FASLPDPVL

SEQ ID NO: 87898 - protein, 9 aa, Homo Sapiens
FATSTEPVL

SEQ ID NO: 87899 - protein, 9 aa, Homo Sapiens
FAVLEDHTL

SEQ ID NO: 87900 - protein, 9 aa, Homo Sapiens
FPAAIEHTI

SEQ ID NO: 87901 - protein, 9 aa, Homo Sapiens
FPAAPAPKM

SEQ ID NO: 87902 - protein, 9 aa, Homo Sapiens
FPAAPIPTL

SEQ ID NO: 87903 - protein, 9 aa, Homo Sapiens
FPAEDWAGL

SEQ ID NO: 87904 - protein, 9 aa, Homo Sapiens
FPAHILDCL

SEQ ID NO: 87905 - protein, 9 aa, Homo Sapiens
FPAPILRAV

SEQ ID NO: 87906 - protein, 9 aa, Homo Sapiens
FPASVHDSL

SEQ ID NO: 87907 - protein, 9 aa, Homo Sapiens
FPATGCQKL

SEQ ID NO: 87908 - protein, 9 aa, Homo Sapiens
FPAVGMHSL

SEQ ID NO: 87909 - protein, 9 aa, Homo Sapiens
FPAVHAAEM

SEQ ID NO: 87910 - protein, 9 aa, Homo Sapiens
FPAYERVLL

SEQ ID NO: 87911 - protein, 9 aa, Homo Sapiens
FPCFDEPAF

SEQ ID NO: 87912 - protein, 9 aa, Homo Sapiens
FPCQNDINL

SEQ ID NO: 87913 - protein, 9 aa, Homo Sapiens
FPDAGEDEL

SEQ ID NO: 87914 - protein, 9 aa, Homo Sapiens
FPDDATSPL

SEQ ID NO: 87915 - protein, 9 aa, Homo Sapiens
FPDDVPTSL

SEQ ID NO: 87916 - protein, 9 aa, Homo Sapiens
FPDEGFSGL

SEQ ID NO: 87917 - protein, 9 aa, Homo Sapiens
FPDEGILAV

SEQ ID NO: 87918 - protein, 9 aa, Homo Sapiens
FPDEKEDNL

SEQ ID NO: 87919 - protein, 9 aa, Homo Sapiens
FPDEKIPTL

SEQ ID NO: 87920 - protein, 9 aa, Homo Sapiens
FPDELEEML

SEQ ID NO: 87921 - protein, 9 aa, Homo Sapiens
FPDKVAIQL

SEQ ID NO: 87922 - protein, 9 aa, Homo Sapiens
FPDLFSEQL

SEQ ID NO: 87923 - protein, 9 aa, Homo Sapiens
FPDQNFEVM

SEQ ID NO: 87924 - protein, 9 aa, Homo Sapiens
FPDQVAIQL

SEQ ID NO: 87925 - protein, 9 aa, Homo Sapiens
FPDSGHFNV

SEQ ID NO: 87926 - protein, 9 aa, Homo Sapiens
FPDSTKSSL

SEQ ID NO: 87927 - protein, 9 aa, Homo Sapiens
FPEADAEKL

SEQ ID NO: 87928 - protein, 9 aa, Homo Sapiens
FPEAIIVKP

SEQ ID NO: 87929 - protein, 9 aa, Homo Sapiens
FPEALARLL

SEQ ID NO: 87930 - protein, 9 aa, Homo Sapiens
FPEALRLAL

SEQ ID NO: 87931 - protein, 9 aa, Homo Sapiens
FPEDHDPTI

SEQ ID NO: 87932 - protein, 9 aa, Homo Sapiens
FPEEDAEQL

SEQ ID NO: 87933 - protein, 9 aa, Homo Sapiens
FPEEPHVPL

SEQ ID NO: 87934 - protein, 9 aa, Homo Sapiens
FPEERPEVL

SEQ ID NO: 87935 - protein, 9 aa, Homo Sapiens
FPEEVIATI

SEQ ID NO: 87936 - protein, 9 aa, Homo Sapiens
FPEHIFPAL

SEQ ID NO: 87937 - protein, 9 aa, Homo Sapiens
FPEHRAAEI

SEQ ID NO: 87938 - protein, 9 aa, Homo Sapiens
FPELDSPQL

SEQ ID NO: 87939 - protein, 9 aa, Homo Sapiens
FPEPNPRVI

SEQ ID NO: 87940 - protein, 9 aa, Homo Sapiens
FPEPSRPPL

SEQ ID NO: 87941 - protein, 9 aa, Homo Sapiens
FPEQIAEKL

SEQ ID NO: 87942 - protein, 9 aa, Homo Sapiens
FPESQTKEL

SEQ ID NO: 87943 - protein, 9 aa, Homo Sapiens
FPEVEDVVM

SEQ ID NO: 87944 - protein, 9 aa, Homo Sapiens
FPEYELPEL

SEQ ID NO: 87945 - protein, 9 aa, Homo Sapiens
FPFAVANQL

SEQ ID NO: 87946 - protein, 9 aa, Homo Sapiens
FPFERLYDL

SEQ ID NO: 87947 - protein, 9 aa, Homo Sapiens
FPFHSAPAL

SEQ ID NO: 87948 - protein, 9 aa, Homo Sapiens
FPFLDENVV

SEQ ID NO: 87949 - protein, 9 aa, Homo Sapiens
FPFRKDLRM

SEQ ID NO: 87950 - protein, 9 aa, Homo Sapiens
FPFSRPELL

SEQ ID NO: 87951 - protein, 9 aa, Homo Sapiens
FPFTREEAL

SEQ ID NO: 87952 - protein, 9 aa, Homo Sapiens
FPFVDDNEV

SEQ ID NO: 87953 - protein, 9 aa, Homo Sapiens
FPFWPAKAL

SEQ ID NO: 87954 - protein, 9 aa, Homo Sapiens
FPGPFEEEM

SEQ ID NO: 87955 - protein, 9 aa, Homo Sapiens
FPGQLNADL

SEQ ID NO: 87956 - protein, 9 aa, Homo Sapiens
FPGSEDVKL

SEQ ID NO: 87957 - protein, 9 aa, Homo Sapiens
FPHAVDHIL

SEQ ID NO: 87958 - protein, 9 aa, Homo Sapiens
FPHDNVEDL

SEQ ID NO: 87959 - protein, 9 aa, Homo Sapiens
FPHEQKIKL

SEQ ID NO: 87960 - protein, 9 aa, Homo Sapiens
FPHHEFVAL

SEQ ID NO: 87961 - protein, 9 aa, Homo Sapiens
FPHKFEISF

SEQ ID NO: 87962 - protein, 9 aa, Homo Sapiens
FPHLLQPVL

SEQ ID NO: 87963 - protein, 9 aa, Homo Sapiens
FPHLQDAQV

SEQ ID NO: 87964 - protein, 9 aa, Homo Sapiens
FPHSMEPQL

SEQ ID NO: 87965 - protein, 9 aa, Homo Sapiens
FPHVGEPSL

SEQ ID NO: 87966 - protein, 9 aa, Homo Sapiens
FPHVQTDVL

SEQ ID NO: 87967 - protein, 9 aa, Homo Sapiens
FPIANGPNL

SEQ ID NO: 87968 - protein, 9 aa, Homo Sapiens
FPIAPEIAL

SEQ ID NO: 87969 - protein, 9 aa, Homo Sapiens
FPIDHFTHI

SEQ ID NO: 87970 - protein, 9 aa, Homo Sapiens
FPIEVRHYL

SEQ ID NO: 87971 - protein, 9 aa, Homo Sapiens
FPIHLTDQL

SEQ ID NO: 87972 - protein, 9 aa, Homo Sapiens
FPIHVQTSL

SEQ ID NO: 87973 - protein, 9 aa, Homo Sapiens
FPIKDLVHL

SEQ ID NO: 87974 - protein, 9 aa, Homo Sapiens
FPIPEEYTF

SEQ ID NO: 87975 - protein, 9 aa, Homo Sapiens
FPIPGEPGF

SEQ ID NO: 87976 - protein, 9 aa, Homo Sapiens
FPIPLINRL

SEQ ID NO: 87977 - protein, 9 aa, Homo Sapiens
FPITDVLQM

SEQ ID NO: 87978 - protein, 9 aa, Homo Sapiens
FPLDKDELL

SEQ ID NO: 87979 - protein, 9 aa, Homo Sapiens
FPLDKMTYL

SEQ ID NO: 87980 - protein, 9 aa, Homo Sapiens
FPLDKSLLL

SEQ ID NO: 87981 - protein, 9 aa, Homo Sapiens
FPLDLDVKM

SEQ ID NO: 87982 - protein, 9 aa, Homo Sapiens
FPLEQEADL

SEQ ID NO: 87983 - protein, 9 aa, Homo Sapiens
FPLSESQTL

SEQ ID NO: 87984 - protein, 9 aa, Homo Sapiens
FPLTEDQKL

SEQ ID NO: 87985 - protein, 9 aa, Homo Sapiens
FPLTKVYVV

SEQ ID NO: 87986 - protein, 9 aa, Homo Sapiens
FPLTTESAM

SEQ ID NO: 87987 - protein, 9 aa, Homo Sapiens
FPMAHPPNL

SEQ ID NO: 87988 - protein, 9 aa, Homo Sapiens
FPMEIRQYL

SEQ ID NO: 87989 - protein, 9 aa, Homo Sapiens
FPMELRQFL

SEQ ID NO: 87990 - protein, 9 aa, Homo Sapiens
FPNADSKAL

SEQ ID NO: 87991 - protein, 9 aa, Homo Sapiens
FPNAIEHTL

SEQ ID NO: 87992 - protein, 9 aa, Homo Sapiens
FPNALVTKL

SEQ ID NO: 87993 - protein, 9 aa, Homo Sapiens
FPNENQVVF

SEQ ID NO: 87994 - protein, 9 aa, Homo Sapiens
FPNIPGKSL

SEQ ID NO: 87995 - protein, 9 aa, Homo Sapiens
FPNKQGYVL

SEQ ID NO: 87996 - protein, 9 aa, Homo Sapiens
FPNNVATVL

SEQ ID NO: 87997 - protein, 9 aa, Homo Sapiens
FPNQGEVKL

SEQ ID NO: 87998 - protein, 9 aa, Homo Sapiens
FPNRLNLEA

SEQ ID NO: 87999 - protein, 9 aa, Homo Sapiens
FPNSVENIL

SEQ ID NO: 88000 - protein, 9 aa, Homo Sapiens
FPPKDDHTL

SEQ ID NO: 88001 - protein, 9 aa, Homo Sapiens
FPQDQLTAL

SEQ ID NO: 88002 - protein, 9 aa, Homo Sapiens
FPQDRVFML

SEQ ID NO: 88003 - protein, 9 aa, Homo Sapiens
FPQEGMHQM

SEQ ID NO: 88004 - protein, 9 aa, Homo Sapiens
FPQHTIASL

SEQ ID NO: 88005 - protein, 9 aa, Homo Sapiens
FPQIEINKM

SEQ ID NO: 88006 - protein, 9 aa, Homo Sapiens
FPQLDSTSF

SEQ ID NO: 88007 - protein, 9 aa, Homo Sapiens
FPQLDVSRL

SEQ ID NO: 88008 - protein, 9 aa, Homo Sapiens
FPQMGRFTL

SEQ ID NO: 88009 - protein, 9 aa, Homo Sapiens
FPQQGQISL

SEQ ID NO: 88010 - protein, 9 aa, Homo Sapiens
FPQYPDKEL

SEQ ID NO: 88011 - protein, 9 aa, Homo Sapiens
FPRDPEIEM

SEQ ID NO: 88012 - protein, 9 aa, Homo Sapiens
FPRHIEPEL

SEQ ID NO: 88013 - protein, 9 aa, Homo Sapiens
FPSAPDVKA

SEQ ID NO: 88014 - protein, 9 aa, Homo Sapiens
FPSDTFHTM

SEQ ID NO: 88015 - protein, 9 aa, Homo Sapiens
FPSEAPISL

SEQ ID NO: 88016 - protein, 9 aa, Homo Sapiens
FPSEDILLV

SEQ ID NO: 88017 - protein, 9 aa, Homo Sapiens
FPSEITDTV

SEQ ID NO: 88018 - protein, 9 aa, Homo Sapiens
FPSEVVGKM

SEQ ID NO: 88019 - protein, 9 aa, Homo Sapiens
FPSEYVPTV

SEQ ID NO: 88020 - protein, 9 aa, Homo Sapiens
FPSFLTNSL

SEQ ID NO: 88021 - protein, 9 aa, Homo Sapiens
FPSGETIVM

SEQ ID NO: 88022 - protein, 9 aa, Homo Sapiens
FPSGSVHSF

SEQ ID NO: 88023 - protein, 9 aa, Homo Sapiens
FPSKQDILL

SEQ ID NO: 88024 - protein, 9 aa, Homo Sapiens
FPSLEVKEL

SEQ ID NO: 88025 - protein, 9 aa, Homo Sapiens
FPSMPSPRL

SEQ ID NO: 88026 - protein, 9 aa, Homo Sapiens
FPSNFIKEL

SEQ ID NO: 88027 - protein, 9 aa, Homo Sapiens
FPSNLVTEM

SEQ ID NO: 88028 - protein, 9 aa, Homo Sapiens
FPSPDPSGL

SEQ ID NO: 88029 - protein, 9 aa, Homo Sapiens
FPSPEYETF

SEQ ID NO: 88030 - protein, 9 aa, Homo Sapiens
FPSPGPVAL

SEQ ID NO: 88031 - protein, 9 aa, Homo Sapiens
FPSPIRLEF

SEQ ID NO: 88032 - protein, 9 aa, Homo Sapiens
FPSPNQITL

SEQ ID NO: 88033 - protein, 9 aa, Homo Sapiens
FPSSCVREL

SEQ ID NO: 88034 - protein, 9 aa, Homo Sapiens
FPSSGSVSL

SEQ ID NO: 88035 - protein, 9 aa, Homo Sapiens
FPSSSVYPT

SEQ ID NO: 88036 - protein, 9 aa, Homo Sapiens
FPSTAEHTL

SEQ ID NO: 88037 - protein, 9 aa, Homo Sapiens
FPSTETATL

SEQ ID NO: 88038 - protein, 9 aa, Homo Sapiens
FPSTPGPEL

SEQ ID NO: 88039 - protein, 9 aa, Homo Sapiens
FPSVLVEEL

SEQ ID NO: 88040 - protein, 9 aa, Homo Sapiens
FPSWTDSEL

SEQ ID NO: 88041 - protein, 9 aa, Homo Sapiens
FPTAEEPHL

SEQ ID NO: 88042 - protein, 9 aa, Homo Sapiens
FPTGDANSL

SEQ ID NO: 88043 - protein, 9 aa, Homo Sapiens
FPTIGDVHL

SEQ ID NO: 88044 - protein, 9 aa, Homo Sapiens
FPTPDPAAL

SEQ ID NO: 88045 - protein, 9 aa, Homo Sapiens
FPTSTPREL

SEQ ID NO: 88046 - protein, 9 aa, Homo Sapiens
FPTTDGNHL

SEQ ID NO: 88047 - protein, 9 aa, Homo Sapiens
FPTVQHQEL

SEQ ID NO: 88048 - protein, 9 aa, Homo Sapiens
FPVAEDISL

SEQ ID NO: 88049 - protein, 9 aa, Homo Sapiens
FPVEHVQLL

SEQ ID NO: 88050 - protein, 9 aa, Homo Sapiens
FPVEIANEI

SEQ ID NO: 88051 - protein, 9 aa, Homo Sapiens
FPVEKQLDL

SEQ ID NO: 88052 - protein, 9 aa, Homo Sapiens
FPVESEAVM

SEQ ID NO: 88053 - protein, 9 aa, Homo Sapiens
FPVEVEVPM

SEQ ID NO: 88054 - protein, 9 aa, Homo Sapiens
FPVEVNTVL

SEQ ID NO: 88055 - protein, 9 aa, Homo Sapiens
FPVGRVHRL

SEQ ID NO: 88056 - protein, 9 aa, Homo Sapiens
FPVGVFVVA

SEQ ID NO: 88057 - protein, 9 aa, Homo Sapiens
FPVIETSTL

SEQ ID NO: 88058 - protein, 9 aa, Homo Sapiens
FPVNKDVTL

SEQ ID NO: 88059 - protein, 9 aa, Homo Sapiens
FPVPPERAL

SEQ ID NO: 88060 - protein, 9 aa, Homo Sapiens
FPVQGVHTV

SEQ ID NO: 88061 - protein, 9 aa, Homo Sapiens
FPVRDGVVL

SEQ ID NO: 88062 - protein, 9 aa, Homo Sapiens
FPVSIPAVL

SEQ ID NO: 88063 - protein, 9 aa, Homo Sapiens
FPVSKTLVL

SEQ ID NO: 88064 - protein, 9 aa, Homo Sapiens
FPVSRNANL

SEQ ID NO: 88065 - protein, 9 aa, Homo Sapiens
FPVSWDNEV

SEQ ID NO: 88066 - protein, 9 aa, Homo Sapiens
FPVTPVSTL

SEQ ID NO: 88067 - protein, 9 aa, Homo Sapiens
FPWEKPTTL

SEQ ID NO: 88068 - protein, 9 aa, Homo Sapiens
FPYAQRQFL

SEQ ID NO: 88069 - protein, 9 aa, Homo Sapiens
FPYEEHLEM

SEQ ID NO: 88070 - protein, 9 aa, Homo Sapiens
FPYEGPLRL

SEQ ID NO: 88071 - protein, 9 aa, Homo Sapiens
FPYEYSYGL

SEQ ID NO: 88072 - protein, 9 aa, Homo Sapiens
FPYPEDVRV

SEQ ID NO: 88073 - protein, 9 aa, Homo Sapiens
FPYPTQAEL

SEQ ID NO: 88074 - protein, 9 aa, Homo Sapiens
FPYPYAERL

SEQ ID NO: 88075 - protein, 9 aa, Homo Sapiens
FVNPVQVVL

SEQ ID NO: 88076 - protein, 9 aa, Homo Sapiens
FVTEVAYKM

SEQ ID NO: 88077 - protein, 9 aa, Homo Sapiens
FVVEHDFIM

SEQ ID NO: 88078 - protein, 9 aa, Homo Sapiens
GPYPYTLKL

SEQ ID NO: 88079 - protein, 9 aa, Homo Sapiens
HAAASFETL

SEQ ID NO: 88080 - protein, 9 aa, Homo Sapiens
HAAPFQNIL

SEQ ID NO: 88081 - protein, 9 aa, Homo Sapiens
HAASTVQIL

SEQ ID NO: 88082 - protein, 9 aa, Homo Sapiens
HAASVFLTL

SEQ ID NO: 88083 - protein, 9 aa, Homo Sapiens
HACALAASL

SEQ ID NO: 88084 - protein, 9 aa, Homo Sapiens
HACGVIATI

SEQ ID NO: 88085 - protein, 9 aa, Homo Sapiens
HACTHQISL

SEQ ID NO: 88086 - protein, 9 aa, Homo Sapiens
HADDSFLVL

SEQ ID NO: 88087 - protein, 9 aa, Homo Sapiens
HADHSSLTL

SEQ ID NO: 88088 - protein, 9 aa, Homo Sapiens
HADPTELAL

SEQ ID NO: 88089 - protein, 9 aa, Homo Sapiens
HADSNIVIM

SEQ ID NO: 88090 - protein, 9 aa, Homo Sapiens
HAELTVPVL

SEQ ID NO: 88091 - protein, 9 aa, Homo Sapiens
HAFSEDPML

SEQ ID NO: 88092 - protein, 9 aa, Homo Sapiens
HAFVQDTTL

SEQ ID NO: 88093 - protein, 9 aa, Homo Sapiens
HAGEAIPAL

SEQ ID NO: 88094 - protein, 9 aa, Homo Sapiens
HAGPTAHEL

SEQ ID NO: 88095 - protein, 9 aa, Homo Sapiens
HAGPVINTL

SEQ ID NO: 88096 - protein, 9 aa, Homo Sapiens
HAIEDKETI

SEQ ID NO: 88097 - protein, 9 aa, Homo Sapiens
HAIEESVVL

SEQ ID NO: 88098 - protein, 9 aa, Homo Sapiens
HAQNQNYTL

SEQ ID NO: 88099 - protein, 9 aa, Homo Sapiens
HASDRIIAL

SEQ ID NO: 88100 - protein, 9 aa, Homo Sapiens
HASIVEVLL

SEQ ID NO: 88101 - protein, 9 aa, Homo Sapiens
HASQFSTCL

SEQ ID NO: 88102 - protein, 9 aa, Homo Sapiens
HATFNDPVM

SEQ ID NO: 88103 - protein, 9 aa, Homo Sapiens
HATIIPKVL

SEQ ID NO: 88104 - protein, 9 aa, Homo Sapiens
HATVTSVTL

SEQ ID NO: 88105 - protein, 9 aa, Homo Sapiens
HAVHVALVL

SEQ ID NO: 88106 - protein, 9 aa, Homo Sapiens
HAVKDAVAM

SEQ ID NO: 88107 - protein, 9 aa, Homo Sapiens
HGYDKDPVL

SEQ ID NO: 88108 - protein, 9 aa, Homo Sapiens
HINEGETAM

SEQ ID NO: 88109 - protein, 9 aa, Homo Sapiens
HPAAKMIVM

SEQ ID NO: 88110 - protein, 9 aa, Homo Sapiens
HPADKDYGL

SEQ ID NO: 88111 - protein, 9 aa, Homo Sapiens
HPADMQLVL

SEQ ID NO: 88112 - protein, 9 aa, Homo Sapiens
HPAPSISSL

SEQ ID NO: 88113 - protein, 9 aa, Homo Sapiens
HPASAEFVL

SEQ ID NO: 88114 - protein, 9 aa, Homo Sapiens
HPASSDPRF

SEQ ID NO: 88115 - protein, 9 aa, Homo Sapiens
HPASVIFTV

SEQ ID NO: 88116 - protein, 9 aa, Homo Sapiens
HPCTEEKAL

SEQ ID NO: 88117 - protein, 9 aa, Homo Sapiens
HPDAFDNEL

SEQ ID NO: 88118 - protein, 9 aa, Homo Sapiens
HPDAMNQQL

SEQ ID NO: 88119 - protein, 9 aa, Homo Sapiens
HPDCVQLLL

SEQ ID NO: 88120 - protein, 9 aa, Homo Sapiens
HPDDSVKIL

SEQ ID NO: 88121 - protein, 9 aa, Homo Sapiens
HPDGVIPVL

SEQ ID NO: 88122 - protein, 9 aa, Homo Sapiens
HPDKDVRLL

SEQ ID NO: 88123 - protein, 9 aa, Homo Sapiens
HPDKMHLVL

SEQ ID NO: 88124 - protein, 9 aa, Homo Sapiens
HPDPTRLLL

SEQ ID NO: 88125 - protein, 9 aa, Homo Sapiens
HPDQAQAIL

SEQ ID NO: 88126 - protein, 9 aa, Homo Sapiens
HPDSSNTPL

SEQ ID NO: 88127 - protein, 9 aa, Homo Sapiens
HPDSVNASL

SEQ ID NO: 88128 - protein, 9 aa, Homo Sapiens
HPDVDEHSV

SEQ ID NO: 88129 - protein, 9 aa, Homo Sapiens
HPDVLPFAL

SEQ ID NO: 88130 - protein, 9 aa, Homo Sapiens
HPDVTEAML

SEQ ID NO: 88131 - protein, 9 aa, Homo Sapiens
HPEDVEPAL

SEQ ID NO: 88132 - protein, 9 aa, Homo Sapiens
HPEGVASLL

SEQ ID NO: 88133 - protein, 9 aa, Homo Sapiens
HPEINAVQL

SEQ ID NO: 88134 - protein, 9 aa, Homo Sapiens
HPEIYPLVL

SEQ ID NO: 88135 - protein, 9 aa, Homo Sapiens
HPEKLATVL

SEQ ID NO: 88136 - protein, 9 aa, Homo Sapiens
HPEPTDHVL

SEQ ID NO: 88137 - protein, 9 aa, Homo Sapiens
HPEQCIKVL

SEQ ID NO: 88138 - protein, 9 aa, Homo Sapiens
HPESERISM

SEQ ID NO: 88139 - protein, 9 aa, Homo Sapiens
HPESTPKSL

SEQ ID NO: 88140 - protein, 9 aa, Homo Sapiens
HPESVSQSL

SEQ ID NO: 88141 - protein, 9 aa, Homo Sapiens
HPETRSAFL

SEQ ID NO: 88142 - protein, 9 aa, Homo Sapiens
HPFDQRIIL

SEQ ID NO: 88143 - protein, 9 aa, Homo Sapiens
HPFEDGAKL

SEQ ID NO: 88144 - protein, 9 aa, Homo Sapiens
HPFFKDMSL

SEQ ID NO: 88145 - protein, 9 aa, Homo Sapiens
HPFHILIAL

SEQ ID NO: 88146 - protein, 9 aa, Homo Sapiens
HPGEADSVL

SEQ ID NO: 88147 - protein, 9 aa, Homo Sapiens
HPHDLVILM

SEQ ID NO: 88148 - protein, 9 aa, Homo Sapiens
HPHPLITVL

SEQ ID NO: 88149 - protein, 9 aa, Homo Sapiens
HPIDDLQSA

SEQ ID NO: 88150 - protein, 9 aa, Homo Sapiens
HPIDIETSV

SEQ ID NO: 88151 - protein, 9 aa, Homo Sapiens
HPIEGSTTV

SEQ ID NO: 88152 - protein, 9 aa, Homo Sapiens
HPIEIARQL

SEQ ID NO: 88153 - protein, 9 aa, Homo Sapiens
HPIHADNCL

SEQ ID NO: 88154 - protein, 9 aa, Homo Sapiens
HPIKQVDVL

SEQ ID NO: 88155 - protein, 9 aa, Homo Sapiens
HPIPGEYKF

SEQ ID NO: 88156 - protein, 9 aa, Homo Sapiens
HPIQQAKAL

SEQ ID NO: 88157 - protein, 9 aa, Homo Sapiens
HPIRLGLAL

SEQ ID NO: 88158 - protein, 9 aa, Homo Sapiens
HPIRVVNAL

SEQ ID NO: 88159 - protein, 9 aa, Homo Sapiens
HPISNNNSL

SEQ ID NO: 88160 - protein, 9 aa, Homo Sapiens
HPISSEELL

SEQ ID NO: 88161 - protein, 9 aa, Homo Sapiens
HPLDLQSAL

SEQ ID NO: 88162 - protein, 9 aa, Homo Sapiens
HPLEDRNTI

SEQ ID NO: 88163 - protein, 9 aa, Homo Sapiens
HPLEGTHEL

SEQ ID NO: 88164 - protein, 9 aa, Homo Sapiens
HPLGDIVAF

SEQ ID NO: 88165 - protein, 9 aa, Homo Sapiens
HPLHNDPNL

SEQ ID NO: 88166 - protein, 9 aa, Homo Sapiens
HPLPGTQLL

SEQ ID NO: 88167 - protein, 9 aa, Homo Sapiens
HPLSNPAEL

SEQ ID NO: 88168 - protein, 9 aa, Homo Sapiens
HPLTLDHCL

SEQ ID NO: 88169 - protein, 9 aa, Homo Sapiens
HPLTQSAVM

SEQ ID NO: 88170 - protein, 9 aa, Homo Sapiens
HPMAYQLQL

SEQ ID NO: 88171 - protein, 9 aa, Homo Sapiens
HPMNSISSL

SEQ ID NO: 88172 - protein, 9 aa, Homo Sapiens
HPNALNLQL

SEQ ID NO: 88173 - protein, 9 aa, Homo Sapiens
HPNEGALVL

SEQ ID NO: 88174 - protein, 9 aa, Homo Sapiens
HPNEICVPM

SEQ ID NO: 88175 - protein, 9 aa, Homo Sapiens
HPNGNITEL

SEQ ID NO: 88176 - protein, 9 aa, Homo Sapiens
HPNIDTASL

SEQ ID NO: 88177 - protein, 9 aa, Homo Sapiens
HPNQAELIV

SEQ ID NO: 88178 - protein, 9 aa, Homo Sapiens
HPNQEAHSL

SEQ ID NO: 88179 - protein, 9 aa, Homo Sapiens
HPNSAVLMV

SEQ ID NO: 88180 - protein, 9 aa, Homo Sapiens
HPNVQKVVL

SEQ ID NO: 88181 - protein, 9 aa, Homo Sapiens
HPNYVDCYL

SEQ ID NO: 88182 - protein, 9 aa, Homo Sapiens
HPQGFEVAL

SEQ ID NO: 88183 - protein, 9 aa, Homo Sapiens
HPQPFEEGL

SEQ ID NO: 88184 - protein, 9 aa, Homo Sapiens
HPQPGAVEL

SEQ ID NO: 88185 - protein, 9 aa, Homo Sapiens
HPQPGSQAL

SEQ ID NO: 88186 - protein, 9 aa, Homo Sapiens
HPQPIDPLL

SEQ ID NO: 88187 - protein, 9 aa, Homo Sapiens
HPQQFQYTL

SEQ ID NO: 88188 - protein, 9 aa, Homo Sapiens
HPQTHETAL

SEQ ID NO: 88189 - protein, 9 aa, Homo Sapiens
HPQYEVVEI

SEQ ID NO: 88190 - protein, 9 aa, Homo Sapiens
HPSASYNQL

SEQ ID NO: 88191 - protein, 9 aa, Homo Sapiens
HPSDIEVDL

SEQ ID NO: 88192 - protein, 9 aa, Homo Sapiens
HPSEGGQVL

SEQ ID NO: 88193 - protein, 9 aa, Homo Sapiens
HPSELIAEM

SEQ ID NO: 88194 - protein, 9 aa, Homo Sapiens
HPSESDFSL

SEQ ID NO: 88195 - protein, 9 aa, Homo Sapiens
HPSFDDYEL

SEQ ID NO: 88196 - protein, 9 aa, Homo Sapiens
HPSGATPTL

SEQ ID NO: 88197 - protein, 9 aa, Homo Sapiens
HPSQLVLTL

SEQ ID NO: 88198 - protein, 9 aa, Homo Sapiens
HPSVDSSVL

SEQ ID NO: 88199 - protein, 9 aa, Homo Sapiens
HPTAHAPMM

SEQ ID NO: 88200 - protein, 9 aa, Homo Sapiens
HPTDDTTTL

SEQ ID NO: 88201 - protein, 9 aa, Homo Sapiens
HPTDERVAL

SEQ ID NO: 88202 - protein, 9 aa, Homo Sapiens
HPTDVDYRV

SEQ ID NO: 88203 - protein, 9 aa, Homo Sapiens
HPTERCFVF

SEQ ID NO: 88204 - protein, 9 aa, Homo Sapiens
HPTEVLCLM

SEQ ID NO: 88205 - protein, 9 aa, Homo Sapiens
HPTGKMFIL

SEQ ID NO: 88206 - protein, 9 aa, Homo Sapiens
HPTIISESF

SEQ ID NO: 88207 - protein, 9 aa, Homo Sapiens
HPTPQVDEL

SEQ ID NO: 88208 - protein, 9 aa, Homo Sapiens
HPTSHVSLL

SEQ ID NO: 88209 - protein, 9 aa, Homo Sapiens
HPVDQANTL

SEQ ID NO: 88210 - protein, 9 aa, Homo Sapiens
HPVEAAQTL

SEQ ID NO: 88211 - protein, 9 aa, Homo Sapiens
HPVEKPVVL

SEQ ID NO: 88212 - protein, 9 aa, Homo Sapiens
HPVGEASIL

SEQ ID NO: 88213 - protein, 9 aa, Homo Sapiens
HPVHPDIKL

SEQ ID NO: 88214 - protein, 9 aa, Homo Sapiens
HPVSGKHIL

SEQ ID NO: 88215 - protein, 9 aa, Homo Sapiens
HPVSLEQYL

SEQ ID NO: 88216 - protein, 9 aa, Homo Sapiens
HPVSREWTL

SEQ ID NO: 88217 - protein, 9 aa, Homo Sapiens
HPVVSSVPL

SEQ ID NO: 88218 - protein, 9 aa, Homo Sapiens
HPYILADRM

SEQ ID NO: 88219 - protein, 9 aa, Homo Sapiens
HPYIQYNVL

SEQ ID NO: 88220 - protein, 9 aa, Homo Sapiens
HPYLAQNEL

SEQ ID NO: 88221 - protein, 9 aa, Homo Sapiens
HPYPHNHYM

SEQ ID NO: 88222 - protein, 9 aa, Homo Sapiens
HPYQPDPKM

SEQ ID NO: 88223 - protein, 9 aa, Homo Sapiens
HVAPSDTVL

SEQ ID NO: 88224 - protein, 9 aa, Homo Sapiens
HVSLVQLTL

SEQ ID NO: 88225 - protein, 9 aa, Homo Sapiens
HVTQEDFEM

SEQ ID NO: 88226 - protein, 9 aa, Homo Sapiens
IAHLEITAL

SEQ ID NO: 88227 - protein, 9 aa, Homo Sapiens
IANPTATLL

SEQ ID NO: 88228 - protein, 9 aa, Homo Sapiens
IAQLDPEAL

SEQ ID NO: 88229 - protein, 9 aa, Homo Sapiens
IASPVQPVL

SEQ ID NO: 88230 - protein, 9 aa, Homo Sapiens
IPAASAAAM

SEQ ID NO: 88231 - protein, 9 aa, Homo Sapiens
IPADTFAAL

SEQ ID NO: 88232 - protein, 9 aa, Homo Sapiens
IPAEGRVAL

SEQ ID NO: 88233 - protein, 9 aa, Homo Sapiens
IPAPPSSPL

SEQ ID NO: 88234 - protein, 9 aa, Homo Sapiens
IPASEQETL

SEQ ID NO: 88235 - protein, 9 aa, Homo Sapiens
IPCEEGDKL

SEQ ID NO: 88236 - protein, 9 aa, Homo Sapiens
IPCKSSPEL

SEQ ID NO: 88237 - protein, 9 aa, Homo Sapiens
IPCPEPIML

SEQ ID NO: 88238 - protein, 9 aa, Homo Sapiens
IPCPTVVLL

SEQ ID NO: 88239 - protein, 9 aa, Homo Sapiens
IPDEQIVVM

SEQ ID NO: 88240 - protein, 9 aa, Homo Sapiens
IPDQETTSL

SEQ ID NO: 88241 - protein, 9 aa, Homo Sapiens
IPDQVIRVF

SEQ ID NO: 88242 - protein, 9 aa, Homo Sapiens
IPDSHEITL

SEQ ID NO: 88243 - protein, 9 aa, Homo Sapiens
IPDSHIVLM

SEQ ID NO: 88244 - protein, 9 aa, Homo Sapiens
IPDSSKISL

SEQ ID NO: 88245 - protein, 9 aa, Homo Sapiens
IPDSTAETL

SEQ ID NO: 88246 - protein, 9 aa, Homo Sapiens
IPENVDITL

SEQ ID NO: 88247 - protein, 9 aa, Homo Sapiens
IPEPEAAVL

SEQ ID NO: 88248 - protein, 9 aa, Homo Sapiens
IPEPIDPLF

SEQ ID NO: 88249 - protein, 9 aa, Homo Sapiens
IPEPVVRIL

SEQ ID NO: 88250 - protein, 9 aa, Homo Sapiens
IPEQTYITL

SEQ ID NO: 88251 - protein, 9 aa, Homo Sapiens
IPFAAPTAL

SEQ ID NO: 88252 - protein, 9 aa, Homo Sapiens
IPFEFPLHL

SEQ ID NO: 88253 - protein, 9 aa, Homo Sapiens
IPFSGALEL

SEQ ID NO: 88254 - protein, 9 aa, Homo Sapiens
IPHMDIEAL

SEQ ID NO: 88255 - protein, 9 aa, Homo Sapiens
IPIAVGGAL

SEQ ID NO: 88256 - protein, 9 aa, Homo Sapiens
IPIEPDYKF

SEQ ID NO: 88257 - protein, 9 aa, Homo Sapiens
IPIFTDVAL

SEQ ID NO: 88258 - protein, 9 aa, Homo Sapiens
IPIGIDKAL

SEQ ID NO: 88259 - protein, 9 aa, Homo Sapiens
IPIHADPRL

SEQ ID NO: 88260 - protein, 9 aa, Homo Sapiens
IPIKKSDPV

SEQ ID NO: 88261 - protein, 9 aa, Homo Sapiens
IPILYEHQL

SEQ ID NO: 88262 - protein, 9 aa, Homo Sapiens
IPITDTGRM

SEQ ID NO: 88263 - protein, 9 aa, Homo Sapiens
IPKSSDPEM

SEQ ID NO: 88264 - protein, 9 aa, Homo Sapiens
IPLQDLVAA

SEQ ID NO: 88265 - protein, 9 aa, Homo Sapiens
IPLRSSWVM

SEQ ID NO: 88266 - protein, 9 aa, Homo Sapiens
IPMEFVNKM

SEQ ID NO: 88267 - protein, 9 aa, Homo Sapiens
IPMSDPQVL

SEQ ID NO: 88268 - protein, 9 aa, Homo Sapiens
IPNEIIHAL

SEQ ID NO: 88269 - protein, 9 aa, Homo Sapiens
IPNSIMTIL

SEQ ID NO: 88270 - protein, 9 aa, Homo Sapiens
IPQPTPASL

SEQ ID NO: 88271 - protein, 9 aa, Homo Sapiens
IPSAATLII

SEQ ID NO: 88272 - protein, 9 aa, Homo Sapiens
IPSEDHQVL

SEQ ID NO: 88273 - protein, 9 aa, Homo Sapiens
IPSPVLVKL

SEQ ID NO: 88274 - protein, 9 aa, Homo Sapiens
IPSSHPVSL

SEQ ID NO: 88275 - protein, 9 aa, Homo Sapiens
IPSSVAEAL

SEQ ID NO: 88276 - protein, 9 aa, Homo Sapiens
IPTEQVNEL

SEQ ID NO: 88277 - protein, 9 aa, Homo Sapiens
IPTGEGPPL

SEQ ID NO: 88278 - protein, 9 aa, Homo Sapiens
IPVAIRTQI

SEQ ID NO: 88279 - protein, 9 aa, Homo Sapiens
IPVDTVLTM

SEQ ID NO: 88280 - protein, 9 aa, Homo Sapiens
IPVHDGYVL

SEQ ID NO: 88281 - protein, 9 aa, Homo Sapiens
IPVHEEFIL

SEQ ID NO: 88282 - protein, 9 aa, Homo Sapiens
IPVNEKDTL

SEQ ID NO: 88283 - protein, 9 aa, Homo Sapiens
IPVNEKETL

SEQ ID NO: 88284 - protein, 9 aa, Homo Sapiens
IPVPINAEL

SEQ ID NO: 88285 - protein, 9 aa, Homo Sapiens
IPVPVVSAL

SEQ ID NO: 88286 - protein, 9 aa, Homo Sapiens
IPVSRDWEL

SEQ ID NO: 88287 - protein, 9 aa, Homo Sapiens
IPYARDAVI

SEQ ID NO: 88288 - protein, 9 aa, Homo Sapiens
IPYEGFASL

SEQ ID NO: 88289 - protein, 9 aa, Homo Sapiens
IPYGERITL

SEQ ID NO: 88290 - protein, 9 aa, Homo Sapiens
IPYMGDEVL

SEQ ID NO: 88291 - protein, 9 aa, Homo Sapiens
IPYSKDVDL

SEQ ID NO: 88292 - protein, 9 aa, Homo Sapiens
IPYSPDVQI

SEQ ID NO: 88293 - protein, 9 aa, Homo Sapiens
KPCPVQIVL

SEQ ID NO: 88294 - protein, 9 aa, Homo Sapiens
KPIEVDELL

SEQ ID NO: 88295 - protein, 9 aa, Homo Sapiens
KPVGPDLEL

SEQ ID NO: 88296 - protein, 9 aa, Homo Sapiens
LAADCAHEL

SEQ ID NO: 88297 - protein, 9 aa, Homo Sapiens
LACGVAKVL

SEQ ID NO: 88298 - protein, 9 aa, Homo Sapiens
LANEVKVLL

SEQ ID NO: 88299 - protein, 9 aa, Homo Sapiens
LASPVSPEL

SEQ ID NO: 88300 - protein, 9 aa, Homo Sapiens
LATVVAETL

SEQ ID NO: 88301 - protein, 9 aa, Homo Sapiens
LDPVLQNPL

SEQ ID NO: 88302 - protein, 9 aa, Homo Sapiens
LPADECNKL

SEQ ID NO: 88303 - protein, 9 aa, Homo Sapiens
LPAEEDSVL

SEQ ID NO: 88304 - protein, 9 aa, Homo Sapiens
LPAEEEATL

SEQ ID NO: 88305 - protein, 9 aa, Homo Sapiens
LPAEEVDVL

SEQ ID NO: 88306 - protein, 9 aa, Homo Sapiens
LPAEFFEVL

SEQ ID NO: 88307 - protein, 9 aa, Homo Sapiens
LPAGIVAVL

SEQ ID NO: 88308 - protein, 9 aa, Homo Sapiens
LPALPTQAL

SEQ ID NO: 88309 - protein, 9 aa, Homo Sapiens
LPAPFEESL

SEQ ID NO: 88310 - protein, 9 aa, Homo Sapiens
LPAPPTQNM

SEQ ID NO: 88311 - protein, 9 aa, Homo Sapiens
LPAQSAATL

SEQ ID NO: 88312 - protein, 9 aa, Homo Sapiens
LPARDSPSL

SEQ ID NO: 88313 - protein, 9 aa, Homo Sapiens
LPASPAHQL

SEQ ID NO: 88314 - protein, 9 aa, Homo Sapiens
LPASVHPQL

SEQ ID NO: 88315 - protein, 9 aa, Homo Sapiens
LPCDLGAAL

SEQ ID NO: 88316 - protein, 9 aa, Homo Sapiens
LPCEVKVVA

SEQ ID NO: 88317 - protein, 9 aa, Homo Sapiens
LPCGASVIL

SEQ ID NO: 88318 - protein, 9 aa, Homo Sapiens
LPCKDAPEL

SEQ ID NO: 88319 - protein, 9 aa, Homo Sapiens
LPCPDSQKL

SEQ ID NO: 88320 - protein, 9 aa, Homo Sapiens
LPCPGKATL

SEQ ID NO: 88321 - protein, 9 aa, Homo Sapiens
LPCSKDALL

SEQ ID NO: 88322 - protein, 9 aa, Homo Sapiens
LPDDIGAAL

SEQ ID NO: 88323 - protein, 9 aa, Homo Sapiens
LPDDTVSTL

SEQ ID NO: 88324 - protein, 9 aa, Homo Sapiens
LPDDVRRRL

SEQ ID NO: 88325 - protein, 9 aa, Homo Sapiens
LPDEIFKEL

SEQ ID NO: 88326 - protein, 9 aa, Homo Sapiens
LPDFERESL

SEQ ID NO: 88327 - protein, 9 aa, Homo Sapiens
LPDFGGNVL

SEQ ID NO: 88328 - protein, 9 aa, Homo Sapiens
LPDGPDAPA

SEQ ID NO: 88329 - protein, 9 aa, Homo Sapiens
LPDGQVITI

SEQ ID NO: 88330 - protein, 9 aa, Homo Sapiens
LPDHINIVL

SEQ ID NO: 88331 - protein, 9 aa, Homo Sapiens
LPDINIYQL

SEQ ID NO: 88332 - protein, 9 aa, Homo Sapiens
LPDKGAQRL

SEQ ID NO: 88333 - protein, 9 aa, Homo Sapiens
LPDKTIASL

SEQ ID NO: 88334 - protein, 9 aa, Homo Sapiens
LPDNSILVV

SEQ ID NO: 88335 - protein, 9 aa, Homo Sapiens
LPDPIIIHL

SEQ ID NO: 88336 - protein, 9 aa, Homo Sapiens
LPDPQNISL

SEQ ID NO: 88337 - protein, 9 aa, Homo Sapiens
LPDSFSPEL

SEQ ID NO: 88338 - protein, 9 aa, Homo Sapiens
LPDSGDSML

SEQ ID NO: 88339 - protein, 9 aa, Homo Sapiens
LPDSNYNTL

SEQ ID NO: 88340 - protein, 9 aa, Homo Sapiens
LPDSVVSIL

SEQ ID NO: 88341 - protein, 9 aa, Homo Sapiens
LPEAFPITL

SEQ ID NO: 88342 - protein, 9 aa, Homo Sapiens
LPEDSKAVL

SEQ ID NO: 88343 - protein, 9 aa, Homo Sapiens
LPEEISSCL

SEQ ID NO: 88344 - protein, 9 aa, Homo Sapiens
LPEENYQVL

SEQ ID NO: 88345 - protein, 9 aa, Homo Sapiens
LPEGGCYEL

SEQ ID NO: 88346 - protein, 9 aa, Homo Sapiens
LPEGGETPI

SEQ ID NO: 88347 - protein, 9 aa, Homo Sapiens
LPEKKGNTL

SEQ ID NO: 88348 - protein, 9 aa, Homo Sapiens
LPEPSCPQL

SEQ ID NO: 88349 - protein, 9 aa, Homo Sapiens
LPEYNPRTL

SEQ ID NO: 88350 - protein, 9 aa, Homo Sapiens
LPFCKGDVL

SEQ ID NO: 88351 - protein, 9 aa, Homo Sapiens
LPFDCTQAL

SEQ ID NO: 88352 - protein, 9 aa, Homo Sapiens
LPFDDDNVM

SEQ ID NO: 88353 - protein, 9 aa, Homo Sapiens
LPFGKVTNI

SEQ ID NO: 88354 - protein, 9 aa, Homo Sapiens
LPFLEASTL

SEQ ID NO: 88355 - protein, 9 aa, Homo Sapiens
LPFPKDASL

SEQ ID NO: 88356 - protein, 9 aa, Homo Sapiens
LPFQFAHHL

SEQ ID NO: 88357 - protein, 9 aa, Homo Sapiens
LPFSDQVVL

SEQ ID NO: 88358 - protein, 9 aa, Homo Sapiens
LPHAPGVQM

SEQ ID NO: 88359 - protein, 9 aa, Homo Sapiens
LPHGSSYSL

SEQ ID NO: 88360 - protein, 9 aa, Homo Sapiens
LPHISDVVL

SEQ ID NO: 88361 - protein, 9 aa, Homo Sapiens
LPHLESQSL

SEQ ID NO: 88362 - protein, 9 aa, Homo Sapiens
LPHSATVTL

SEQ ID NO: 88363 - protein, 9 aa, Homo Sapiens
LPHSGEAQL

SEQ ID NO: 88364 - protein, 9 aa, Homo Sapiens
LPIAASSSL

SEQ ID NO: 88365 - protein, 9 aa, Homo Sapiens
LPIATVEEL

SEQ ID NO: 88366 - protein, 9 aa, Homo Sapiens
LPIDCSPAL

SEQ ID NO: 88367 - protein, 9 aa, Homo Sapiens
LPIDEDEEM

SEQ ID NO: 88368 - protein, 9 aa, Homo Sapiens
LPIDESNTI

SEQ ID NO: 88369 - protein, 9 aa, Homo Sapiens
LPIDGANDL

SEQ ID NO: 88370 - protein, 9 aa, Homo Sapiens
LPIEDSQDL

SEQ ID NO: 88371 - protein, 9 aa, Homo Sapiens
LPIEVYCHL

SEQ ID NO: 88372 - protein, 9 aa, Homo Sapiens
LPIHCIYQL

SEQ ID NO: 88373 - protein, 9 aa, Homo Sapiens
LPISQESLL

SEQ ID NO: 88374 - protein, 9 aa, Homo Sapiens
LPLAGEEEL

SEQ ID NO: 88375 - protein, 9 aa, Homo Sapiens
LPLAHVLEL

SEQ ID NO: 88376 - protein, 9 aa, Homo Sapiens
LPLASDPLL

SEQ ID NO: 88377 - protein, 9 aa, Homo Sapiens
LPLDNPSVL

SEQ ID NO: 88378 - protein, 9 aa, Homo Sapiens
LPLEKVYSL

SEQ ID NO: 88379 - protein, 9 aa, Homo Sapiens
LPLENASIL

SEQ ID NO: 88380 - protein, 9 aa, Homo Sapiens
LPLMSWMKM

SEQ ID NO: 88381 - protein, 9 aa, Homo Sapiens
LPLPEEPQL

SEQ ID NO: 88382 - protein, 9 aa, Homo Sapiens
LPLQTSHAL

SEQ ID NO: 88383 - protein, 9 aa, Homo Sapiens
LPMPTEPLL

SEQ ID NO: 88384 - protein, 9 aa, Homo Sapiens
LPNADSECL

SEQ ID NO: 88385 - protein, 9 aa, Homo Sapiens
LPNASADSL

SEQ ID NO: 88386 - protein, 9 aa, Homo Sapiens
LPNAVITRI

SEQ ID NO: 88387 - protein, 9 aa, Homo Sapiens
LPNDFPTCL

SEQ ID NO: 88388 - protein, 9 aa, Homo Sapiens
LPNDVISSL

SEQ ID NO: 88389 - protein, 9 aa, Homo Sapiens
LPNFGSHVL

SEQ ID NO: 88390 - protein, 9 aa, Homo Sapiens
LPNGMIVTL

SEQ ID NO: 88391 - protein, 9 aa, Homo Sapiens
LPNGQPTVL

SEQ ID NO: 88392 - protein, 9 aa, Homo Sapiens
LPNIHPELL

SEQ ID NO: 88393 - protein, 9 aa, Homo Sapiens
LPNKVDPLV

SEQ ID NO: 88394 - protein, 9 aa, Homo Sapiens
LPNNAKLEM

SEQ ID NO: 88395 - protein, 9 aa, Homo Sapiens
LPNPTLVTI

SEQ ID NO: 88396 - protein, 9 aa, Homo Sapiens
LPNSGDSTL

SEQ ID NO: 88397 - protein, 9 aa, Homo Sapiens
LPNVNAAIL

SEQ ID NO: 88398 - protein, 9 aa, Homo Sapiens
LPQEDLEAL

SEQ ID NO: 88399 - protein, 9 aa, Homo Sapiens
LPQHEEICL

SEQ ID NO: 88400 - protein, 9 aa, Homo Sapiens
LPQHPDVEM

SEQ ID NO: 88401 - protein, 9 aa, Homo Sapiens
LPQKGDVEM

SEQ ID NO: 88402 - protein, 9 aa, Homo Sapiens
LPQPDVFPL

SEQ ID NO: 88403 - protein, 9 aa, Homo Sapiens
LPQPSSIVL

SEQ ID NO: 88404 - protein, 9 aa, Homo Sapiens
LPQTGEQEL

SEQ ID NO: 88405 - protein, 9 aa, Homo Sapiens
LPSDATVVL

SEQ ID NO: 88406 - protein, 9 aa, Homo Sapiens
LPSDFTPAV

SEQ ID NO: 88407 - protein, 9 aa, Homo Sapiens
LPSDIAAEA

SEQ ID NO: 88408 - protein, 9 aa, Homo Sapiens
LPSDKALVL

SEQ ID NO: 88409 - protein, 9 aa, Homo Sapiens
LPSDMAVAL

SEQ ID NO: 88410 - protein, 9 aa, Homo Sapiens
LPSEHQTIL

SEQ ID NO: 88411 - protein, 9 aa, Homo Sapiens
LPSEVDKAL

SEQ ID NO: 88412 - protein, 9 aa, Homo Sapiens
LPSEVEPEL

SEQ ID NO: 88413 - protein, 9 aa, Homo Sapiens
LPSEYDTPL

SEQ ID NO: 88414 - protein, 9 aa, Homo Sapiens
LPSGAVFVI

SEQ ID NO: 88415 - protein, 9 aa, Homo Sapiens
LPSGEDYNL

SEQ ID NO: 88416 - protein, 9 aa, Homo Sapiens
LPSGLDSVL

SEQ ID NO: 88417 - protein, 9 aa, Homo Sapiens
LPSGVSAKL

SEQ ID NO: 88418 - protein, 9 aa, Homo Sapiens
LPSHVVTML

SEQ ID NO: 88419 - protein, 9 aa, Homo Sapiens
LPSIVNEVL

SEQ ID NO: 88420 - protein, 9 aa, Homo Sapiens
LPSKDVQSL

SEQ ID NO: 88421 - protein, 9 aa, Homo Sapiens
LPSKVPTTL

SEQ ID NO: 88422 - protein, 9 aa, Homo Sapiens
LPSLSAHEL

SEQ ID NO: 88423 - protein, 9 aa, Homo Sapiens
LPSMPEPAL

SEQ ID NO: 88424 - protein, 9 aa, Homo Sapiens
LPSNDEPIL

SEQ ID NO: 88425 - protein, 9 aa, Homo Sapiens
LPSQEDMPH

SEQ ID NO: 88426 - protein, 9 aa, Homo Sapiens
LPSQEVQAL

SEQ ID NO: 88427 - protein, 9 aa, Homo Sapiens
LPSRVIEEL

SEQ ID NO: 88428 - protein, 9 aa, Homo Sapiens
LPSSFVEKL

SEQ ID NO: 88429 - protein, 9 aa, Homo Sapiens
LPSTEAVAL

SEQ ID NO: 88430 - protein, 9 aa, Homo Sapiens
LPSTTIVSM

SEQ ID NO: 88431 - protein, 9 aa, Homo Sapiens
LPTAVEPLM

SEQ ID NO: 88432 - protein, 9 aa, Homo Sapiens
LPTAVIANL

SEQ ID NO: 88433 - protein, 9 aa, Homo Sapiens
LPTDSAIIM

SEQ ID NO: 88434 - protein, 9 aa, Homo Sapiens
LPTDSHASL

SEQ ID NO: 88435 - protein, 9 aa, Homo Sapiens
LPTDTLQEL

SEQ ID NO: 88436 - protein, 9 aa, Homo Sapiens
LPTEEEWEF

SEQ ID NO: 88437 - protein, 9 aa, Homo Sapiens
LPTEISQSL

SEQ ID NO: 88438 - protein, 9 aa, Homo Sapiens
LPTEKEVAL

SEQ ID NO: 88439 - protein, 9 aa, Homo Sapiens
LPTENVDKM

SEQ ID NO: 88440 - protein, 9 aa, Homo Sapiens
LPTSPGPAL

SEQ ID NO: 88441 - protein, 9 aa, Homo Sapiens
LPTSVVTIT

SEQ ID NO: 88442 - protein, 9 aa, Homo Sapiens
LPVALQTRL

SEQ ID NO: 88443 - protein, 9 aa, Homo Sapiens
LPVASSSTL

SEQ ID NO: 88444 - protein, 9 aa, Homo Sapiens
LPVATDFEF

SEQ ID NO: 88445 - protein, 9 aa, Homo Sapiens
LPVDFVECL

SEQ ID NO: 88446 - protein, 9 aa, Homo Sapiens
LPVDIRQYL

SEQ ID NO: 88447 - protein, 9 aa, Homo Sapiens
LPVDKAQEL

SEQ ID NO: 88448 - protein, 9 aa, Homo Sapiens
LPVDLAEEL

SEQ ID NO: 88449 - protein, 9 aa, Homo Sapiens
LPVEDDIDL

SEQ ID NO: 88450 - protein, 9 aa, Homo Sapiens
LPVEEFNEL

SEQ ID NO: 88451 - protein, 9 aa, Homo Sapiens
LPVESVHIL

SEQ ID NO: 88452 - protein, 9 aa, Homo Sapiens
LPVFDKEEL

SEQ ID NO: 88453 - protein, 9 aa, Homo Sapiens
LPVGSSQVL

SEQ ID NO: 88454 - protein, 9 aa, Homo Sapiens
LPVGTTATL

SEQ ID NO: 88455 - protein, 9 aa, Homo Sapiens
LPVHGEQAL

SEQ ID NO: 88456 - protein, 9 aa, Homo Sapiens
LPVHVFEAL

SEQ ID NO: 88457 - protein, 9 aa, Homo Sapiens
LPVPMDAAL

SEQ ID NO: 88458 - protein, 9 aa, Homo Sapiens
LPVQPENAL

SEQ ID NO: 88459 - protein, 9 aa, Homo Sapiens
LPVQPEVAL

SEQ ID NO: 88460 - protein, 9 aa, Homo Sapiens
LPVSVSREL

SEQ ID NO: 88461 - protein, 9 aa, Homo Sapiens
LPVVDFNEM

SEQ ID NO: 88462 - protein, 9 aa, Homo Sapiens
LPWASTHSL

SEQ ID NO: 88463 - protein, 9 aa, Homo Sapiens
LPWGGGTAL

SEQ ID NO: 88464 - protein, 9 aa, Homo Sapiens
LPYAGDVSM

SEQ ID NO: 88465 - protein, 9 aa, Homo Sapiens
LPYGREDVL

SEQ ID NO: 88466 - protein, 9 aa, Homo Sapiens
MAATGDVAL

SEQ ID NO: 88467 - protein, 9 aa, Homo Sapiens
MADPNIRFL

SEQ ID NO: 88468 - protein, 9 aa, Homo Sapiens
MAHADPTEL

SEQ ID NO: 88469 - protein, 9 aa, Homo Sapiens
MANGAVIHL

SEQ ID NO: 88470 - protein, 9 aa, Homo Sapiens
MANPTALLL

SEQ ID NO: 88471 - protein, 9 aa, Homo Sapiens
MAVEGDHSM

SEQ ID NO: 88472 - protein, 9 aa, Homo Sapiens
MAVIDGNVM

SEQ ID NO: 88473 - protein, 9 aa, Homo Sapiens
MAYGVEPAL

SEQ ID NO: 88474 - protein, 9 aa, Homo Sapiens
MIAFHDPEL

SEQ ID NO: 88475 - protein, 9 aa, Homo Sapiens
MIFQDPTAM

SEQ ID NO: 88476 - protein, 9 aa, Homo Sapiens
MPADIATLL

SEQ ID NO: 88477 - protein, 9 aa, Homo Sapiens
MPADSGYPA

SEQ ID NO: 88478 - protein, 9 aa, Homo Sapiens
MPADVSEAL

SEQ ID NO: 88479 - protein, 9 aa, Homo Sapiens
MPAEEFREL

SEQ ID NO: 88480 - protein, 9 aa, Homo Sapiens
MPANSGLAL

SEQ ID NO: 88481 - protein, 9 aa, Homo Sapiens
MPAPADPTA

SEQ ID NO: 88482 - protein, 9 aa, Homo Sapiens
MPCEALVRM

SEQ ID NO: 88483 - protein, 9 aa, Homo Sapiens
MPCEDDHHL

SEQ ID NO: 88484 - protein, 9 aa, Homo Sapiens
MPCQALVRM

SEQ ID NO: 88485 - protein, 9 aa, Homo Sapiens
MPCVFVTEV

SEQ ID NO: 88486 - protein, 9 aa, Homo Sapiens
MPDDLLTTL

SEQ ID NO: 88487 - protein, 9 aa, Homo Sapiens
MPDELLTSL

SEQ ID NO: 88488 - protein, 9 aa, Homo Sapiens
MPDHTDVSL

SEQ ID NO: 88489 - protein, 9 aa, Homo Sapiens
MPDHVIPEI

SEQ ID NO: 88490 - protein, 9 aa, Homo Sapiens
MPDIIIKAL

SEQ ID NO: 88491 - protein, 9 aa, Homo Sapiens
MPDNNFHSL

SEQ ID NO: 88492 - protein, 9 aa, Homo Sapiens
MPDPTPFLL

SEQ ID NO: 88493 - protein, 9 aa, Homo Sapiens
MPDSAAALL

SEQ ID NO: 88494 - protein, 9 aa, Homo Sapiens
MPDSELFEL

SEQ ID NO: 88495 - protein, 9 aa, Homo Sapiens
MPDVVVRSF

SEQ ID NO: 88496 - protein, 9 aa, Homo Sapiens
MPEDLVEAL

SEQ ID NO: 88497 - protein, 9 aa, Homo Sapiens
MPEDSDTYL

SEQ ID NO: 88498 - protein, 9 aa, Homo Sapiens
MPEEAIETL

SEQ ID NO: 88499 - protein, 9 aa, Homo Sapiens
MPEEDPATL

SEQ ID NO: 88500 - protein, 9 aa, Homo Sapiens
MPEEESAKV

SEQ ID NO: 88501 - protein, 9 aa, Homo Sapiens
MPEKEPSVL

SEQ ID NO: 88502 - protein, 9 aa, Homo Sapiens
MPEKLSHKL

SEQ ID NO: 88503 - protein, 9 aa, Homo Sapiens
MPEPASRCL

SEQ ID NO: 88504 - protein, 9 aa, Homo Sapiens
MPEPTVLSL

SEQ ID NO: 88505 - protein, 9 aa, Homo Sapiens
MPEQWARLL

SEQ ID NO: 88506 - protein, 9 aa, Homo Sapiens
MPETTETVL

SEQ ID NO: 88507 - protein, 9 aa, Homo Sapiens
MPETYQARL

SEQ ID NO: 88508 - protein, 9 aa, Homo Sapiens
MPEYNAPAL

SEQ ID NO: 88509 - protein, 9 aa, Homo Sapiens
MPFGNVISA

SEQ ID NO: 88510 - protein, 9 aa, Homo Sapiens
MPFGNVVSA

SEQ ID NO: 88511 - protein, 9 aa, Homo Sapiens
MPFQQWEAL

SEQ ID NO: 88512 - protein, 9 aa, Homo Sapiens
MPFRGDTVI

SEQ ID NO: 88513 - protein, 9 aa, Homo Sapiens
MPFRGYAVL

SEQ ID NO: 88514 - protein, 9 aa, Homo Sapiens
MPFTTVSEL

SEQ ID NO: 88515 - protein, 9 aa, Homo Sapiens
MPFYNPAQL

SEQ ID NO: 88516 - protein, 9 aa, Homo Sapiens
MPGKTAIEL

SEQ ID NO: 88517 - protein, 9 aa, Homo Sapiens
MPGRVEPIL

SEQ ID NO: 88518 - protein, 9 aa, Homo Sapiens
MPHDAIILL

SEQ ID NO: 88519 - protein, 9 aa, Homo Sapiens
MPHDLITQL

SEQ ID NO: 88520 - protein, 9 aa, Homo Sapiens
MPHEDCITA

SEQ ID NO: 88521 - protein, 9 aa, Homo Sapiens
MPHEKHYTL

SEQ ID NO: 88522 - protein, 9 aa, Homo Sapiens
MPHHTPHQL

SEQ ID NO: 88523 - protein, 9 aa, Homo Sapiens
MPHNQFIKM

SEQ ID NO: 88524 - protein, 9 aa, Homo Sapiens
MPHSSSAKL

SEQ ID NO: 88525 - protein, 9 aa, Homo Sapiens
MPHVPITTL

SEQ ID NO: 88526 - protein, 9 aa, Homo Sapiens
MPHYDIDSA

SEQ ID NO: 88527 - protein, 9 aa, Homo Sapiens
MPIGPDVSL

SEQ ID NO: 88528 - protein, 9 aa, Homo Sapiens
MPIKLKIGL

SEQ ID NO: 88529 - protein, 9 aa, Homo Sapiens
MPISSHVDL

SEQ ID NO: 88530 - protein, 9 aa, Homo Sapiens
MPKMDQDSL

SEQ ID NO: 88531 - protein, 9 aa, Homo Sapiens
MPLAEAGAL

SEQ ID NO: 88532 - protein, 9 aa, Homo Sapiens
MPLDKHMEM

SEQ ID NO: 88533 - protein, 9 aa, Homo Sapiens
MPLEDMNEF

SEQ ID NO: 88534 - protein, 9 aa, Homo Sapiens
MPLHVAPLL

SEQ ID NO: 88535 - protein, 9 aa, Homo Sapiens
MPLNVADLI

SEQ ID NO: 88536 - protein, 9 aa, Homo Sapiens
MPLPGTKAL

SEQ ID NO: 88537 - protein, 9 aa, Homo Sapiens
MPLQDSISL

SEQ ID NO: 88538 - protein, 9 aa, Homo Sapiens
MPLRDAAKL

SEQ ID NO: 88539 - protein, 9 aa, Homo Sapiens
MPLTADPTL

SEQ ID NO: 88540 - protein, 9 aa, Homo Sapiens
MPLVEETSL

SEQ ID NO: 88541 - protein, 9 aa, Homo Sapiens
MPMNVADLI

SEQ ID NO: 88542 - protein, 9 aa, Homo Sapiens
MPMPEPCEL

SEQ ID NO: 88543 - protein, 9 aa, Homo Sapiens
MPMVTDNKM

SEQ ID NO: 88544 - protein, 9 aa, Homo Sapiens
MPNENIPEL

SEQ ID NO: 88545 - protein, 9 aa, Homo Sapiens
MPNGTVQRF

SEQ ID NO: 88546 - protein, 9 aa, Homo Sapiens
MPNLDSVTL

SEQ ID NO: 88547 - protein, 9 aa, Homo Sapiens
MPNLYGDIL

SEQ ID NO: 88548 - protein, 9 aa, Homo Sapiens
MPNLYGNII

SEQ ID NO: 88549 - protein, 9 aa, Homo Sapiens
MPNQHACKL

SEQ ID NO: 88550 - protein, 9 aa, Homo Sapiens
MPNQIVQIL

SEQ ID NO: 88551 - protein, 9 aa, Homo Sapiens
MPQDLSEAL

SEQ ID NO: 88552 - protein, 9 aa, Homo Sapiens
MPQEEVELL

SEQ ID NO: 88553 - protein, 9 aa, Homo Sapiens
MPQGNPLLL

SEQ ID NO: 88554 - protein, 9 aa, Homo Sapiens
MPQHIMAIL

SEQ ID NO: 88555 - protein, 9 aa, Homo Sapiens
MPQLDPRVL

SEQ ID NO: 88556 - protein, 9 aa, Homo Sapiens
MPSDVLEVT

SEQ ID NO: 88557 - protein, 9 aa, Homo Sapiens
MPSEDVVSL

SEQ ID NO: 88558 - protein, 9 aa, Homo Sapiens
MPSKTELIV

SEQ ID NO: 88559 - protein, 9 aa, Homo Sapiens
MPSLQPVVM

SEQ ID NO: 88560 - protein, 9 aa, Homo Sapiens
MPSPMPEYL

SEQ ID NO: 88561 - protein, 9 aa, Homo Sapiens
MPSPVSPKL

SEQ ID NO: 88562 - protein, 9 aa, Homo Sapiens
MPSQFRDIL

SEQ ID NO: 88563 - protein, 9 aa, Homo Sapiens
MPSRELASM

SEQ ID NO: 88564 - protein, 9 aa, Homo Sapiens
MPSSAVRVL

SEQ ID NO: 88565 - protein, 9 aa, Homo Sapiens
MPSVFQNVL

SEQ ID NO: 88566 - protein, 9 aa, Homo Sapiens
MPTDSQDSL

SEQ ID NO: 88567 - protein, 9 aa, Homo Sapiens
MPTDVLEVT

SEQ ID NO: 88568 - protein, 9 aa, Homo Sapiens
MPTGAGKSL

SEQ ID NO: 88569 - protein, 9 aa, Homo Sapiens
MPTGGGKSL

SEQ ID NO: 88570 - protein, 9 aa, Homo Sapiens
MPTIQITAL

SEQ ID NO: 88571 - protein, 9 aa, Homo Sapiens
MPTKETTKL

SEQ ID NO: 88572 - protein, 9 aa, Homo Sapiens
MPTKTIEVL

SEQ ID NO: 88573 - protein, 9 aa, Homo Sapiens
MPTQEVQEL

SEQ ID NO: 88574 - protein, 9 aa, Homo Sapiens
MPTSTILRL

SEQ ID NO: 88575 - protein, 9 aa, Homo Sapiens
MPTTERVTL

SEQ ID NO: 88576 - protein, 9 aa, Homo Sapiens
MPVDLELVA

SEQ ID NO: 88577 - protein, 9 aa, Homo Sapiens
MPVDSFNSM

SEQ ID NO: 88578 - protein, 9 aa, Homo Sapiens
MPVEKNITL

SEQ ID NO: 88579 - protein, 9 aa, Homo Sapiens
MPVEVQTEL

SEQ ID NO: 88580 - protein, 9 aa, Homo Sapiens
MPVFPDFKM

SEQ ID NO: 88581 - protein, 9 aa, Homo Sapiens
MPVGMTHGL

SEQ ID NO: 88582 - protein, 9 aa, Homo Sapiens
MPVGPAPGM

SEQ ID NO: 88583 - protein, 9 aa, Homo Sapiens
MPVGPDAIL

SEQ ID NO: 88584 - protein, 9 aa, Homo Sapiens
MPVHAAVQM

SEQ ID NO: 88585 - protein, 9 aa, Homo Sapiens
MPVKQPYYL

SEQ ID NO: 88586 - protein, 9 aa, Homo Sapiens
MPVKVEAAI

SEQ ID NO: 88587 - protein, 9 aa, Homo Sapiens
MPVLEQSVL

SEQ ID NO: 88588 - protein, 9 aa, Homo Sapiens
MPVMEQSVL

SEQ ID NO: 88589 - protein, 9 aa, Homo Sapiens
MPVPEILQL

SEQ ID NO: 88590 - protein, 9 aa, Homo Sapiens
MPVPTTPEF

SEQ ID NO: 88591 - protein, 9 aa, Homo Sapiens
MPVQDLPRL

SEQ ID NO: 88592 - protein, 9 aa, Homo Sapiens
MPVRAADKL

SEQ ID NO: 88593 - protein, 9 aa, Homo Sapiens
MPVRWVTGL

SEQ ID NO: 88594 - protein, 9 aa, Homo Sapiens
MPVTARVVF

SEQ ID NO: 88595 - protein, 9 aa, Homo Sapiens
MPVVAGAVF

SEQ ID NO: 88596 - protein, 9 aa, Homo Sapiens
MPYLEHESF

SEQ ID NO: 88597 - protein, 9 aa, Homo Sapiens
MPYNYPVLL

SEQ ID NO: 88598 - protein, 9 aa, Homo Sapiens
MPYPDETNL

SEQ ID NO: 88599 - protein, 9 aa, Homo Sapiens
MVADPDNPL

SEQ ID NO: 88600 - protein, 9 aa, Homo Sapiens
MVLEYDHPL

SEQ ID NO: 88601 - protein, 9 aa, Homo Sapiens
MVNHFIAEF

SEQ ID NO: 88602 - protein, 9 aa, Homo Sapiens
MVTAVAYRL

SEQ ID NO: 88603 - protein, 9 aa, Homo Sapiens
MVVDIVQEL

SEQ ID NO: 88604 - protein, 9 aa, Homo Sapiens
NAAFKDVAL

SEQ ID NO: 88605 - protein, 9 aa, Homo Sapiens
NAAFPDTSM

SEQ ID NO: 88606 - protein, 9 aa, Homo Sapiens
NAAPVDPTL

SEQ ID NO: 88607 - protein, 9 aa, Homo Sapiens
NADPQAVTM

SEQ ID NO: 88608 - protein, 9 aa, Homo Sapiens
NAEPEPRSL

SEQ ID NO: 88609 - protein, 9 aa, Homo Sapiens
NAFKEITTM

SEQ ID NO: 88610 - protein, 9 aa, Homo Sapiens
NAILVDTPL

SEQ ID NO: 88611 - protein, 9 aa, Homo Sapiens
NAIREVLEL

SEQ ID NO: 88612 - protein, 9 aa, Homo Sapiens
NAMEDAQTL

SEQ ID NO: 88613 - protein, 9 aa, Homo Sapiens
NAMRADPAL

SEQ ID NO: 88614 - protein, 9 aa, Homo Sapiens
NANHPDFPM

SEQ ID NO: 88615 - protein, 9 aa, Homo Sapiens
NASEVPMVL

SEQ ID NO: 88616 - protein, 9 aa, Homo Sapiens
NATGPDLEF

SEQ ID NO: 88617 - protein, 9 aa, Homo Sapiens
NAVGDGIVL

SEQ ID NO: 88618 - protein, 9 aa, Homo Sapiens
NAWDKEPVL

SEQ ID NO: 88619 - protein, 9 aa, Homo Sapiens
NIAGPDAAL

SEQ ID NO: 88620 - protein, 9 aa, Homo Sapiens
NPCSEQDVL

SEQ ID NO: 88621 - protein, 9 aa, Homo Sapiens
NPDDVFREF

SEQ ID NO: 88622 - protein, 9 aa, Homo Sapiens
NPDEAEKAL

SEQ ID NO: 88623 - protein, 9 aa, Homo Sapiens
NPDPAVYQL

SEQ ID NO: 88624 - protein, 9 aa, Homo Sapiens
NPDTHSWEM

SEQ ID NO: 88625 - protein, 9 aa, Homo Sapiens
NPHDRVVAL

SEQ ID NO: 88626 - protein, 9 aa, Homo Sapiens
NPIEDEAVI

SEQ ID NO: 88627 - protein, 9 aa, Homo Sapiens
NPIEEISVL

SEQ ID NO: 88628 - protein, 9 aa, Homo Sapiens
NPISTVTEL

SEQ ID NO: 88629 - protein, 9 aa, Homo Sapiens
NPLHLDYVM

SEQ ID NO: 88630 - protein, 9 aa, Homo Sapiens
NPQFLDPVL

SEQ ID NO: 88631 - protein, 9 aa, Homo Sapiens
NPTEIDKVL

SEQ ID NO: 88632 - protein, 9 aa, Homo Sapiens
NPTEPDHAI

SEQ ID NO: 88633 - protein, 9 aa, Homo Sapiens
NPVDIVSTL

SEQ ID NO: 88634 - protein, 9 aa, Homo Sapiens
NPVEYSIVM

SEQ ID NO: 88635 - protein, 9 aa, Homo Sapiens
NVFATDAIL

SEQ ID NO: 88636 - protein, 9 aa, Homo Sapiens
PALHEGPPL

SEQ ID NO: 88637 - protein, 9 aa, Homo Sapiens
PARSFGPAI

SEQ ID NO: 88638 - protein, 9 aa, Homo Sapiens
QADPTKLEL

SEQ ID NO: 88639 - protein, 9 aa, Homo Sapiens
QADTTRLEL

SEQ ID NO: 88640 - protein, 9 aa, Homo Sapiens
QAFIDLHSA

SEQ ID NO: 88641 - protein, 9 aa, Homo Sapiens
QAIENAHVL

SEQ ID NO: 88642 - protein, 9 aa, Homo Sapiens
QPADAERAL

SEQ ID NO: 88643 - protein, 9 aa, Homo Sapiens
QPAEMAAEL

SEQ ID NO: 88644 - protein, 9 aa, Homo Sapiens
QPAPISPHL

SEQ ID NO: 88645 - protein, 9 aa, Homo Sapiens
QPCADNAVL

SEQ ID NO: 88646 - protein, 9 aa, Homo Sapiens
QPDNIVYVM

SEQ ID NO: 88647 - protein, 9 aa, Homo Sapiens
QPDPESVVL

SEQ ID NO: 88648 - protein, 9 aa, Homo Sapiens
QPHPFDPIL

SEQ ID NO: 88649 - protein, 9 aa, Homo Sapiens
QPINSTHEL

SEQ ID NO: 88650 - protein, 9 aa, Homo Sapiens
QPMDIHVEL

SEQ ID NO: 88651 - protein, 9 aa, Homo Sapiens
QPNPLPLRL

SEQ ID NO: 88652 - protein, 9 aa, Homo Sapiens
QPQSHETAL

SEQ ID NO: 88653 - protein, 9 aa, Homo Sapiens
QPTCPDHML

SEQ ID NO: 88654 - protein, 9 aa, Homo Sapiens
QPTEVVNIL

SEQ ID NO: 88655 - protein, 9 aa, Homo Sapiens
QPYSKDSPF

SEQ ID NO: 88656 - protein, 9 aa, Homo Sapiens
RPEEIAALL

SEQ ID NO: 88657 - protein, 9 aa, Homo Sapiens
RPFEDQTSL

SEQ ID NO: 88658 - protein, 9 aa, Homo Sapiens
RPITDSPVL

SEQ ID NO: 88659 - protein, 9 aa, Homo Sapiens
RPLDVDWTL

SEQ ID NO: 88660 - protein, 9 aa, Homo Sapiens
RPLEEDCTL

SEQ ID NO: 88661 - protein, 9 aa, Homo Sapiens
RPNSIDPAL

SEQ ID NO: 88662 - protein, 9 aa, Homo Sapiens
RPSEVSEAL

SEQ ID NO: 88663 - protein, 9 aa, Homo Sapiens
RPTSVDPAL

SEQ ID NO: 88664 - protein, 9 aa, Homo Sapiens
RPWLDPAAA

SEQ ID NO: 88665 - protein, 9 aa, Homo Sapiens
SAAPPEPAV

SEQ ID NO: 88666 - protein, 9 aa, Homo Sapiens
SACGHTAVL

SEQ ID NO: 88667 - protein, 9 aa, Homo Sapiens
SACHVSNTL

SEQ ID NO: 88668 - protein, 9 aa, Homo Sapiens
SADPGILVL

SEQ ID NO: 88669 - protein, 9 aa, Homo Sapiens
SADPNVVDL

SEQ ID NO: 88670 - protein, 9 aa, Homo Sapiens
SAGPADAEM

SEQ ID NO: 88671 - protein, 9 aa, Homo Sapiens
SAIFPDVAL

SEQ ID NO: 88672 - protein, 9 aa, Homo Sapiens
SAIGYIHSL

SEQ ID NO: 88673 - protein, 9 aa, Homo Sapiens
SASALAVAL

SEQ ID NO: 88674 - protein, 9 aa, Homo Sapiens
SASGVLFSL

SEQ ID NO: 88675 - protein, 9 aa, Homo Sapiens
SAVPSDPAM

SEQ ID NO: 88676 - protein, 9 aa, Homo Sapiens
SPAPTHNSL

SEQ ID NO: 88677 - protein, 9 aa, Homo Sapiens
SPCSVVNDL

SEQ ID NO: 88678 - protein, 9 aa, Homo Sapiens
SPDEHEPLL

SEQ ID NO: 88679 - protein, 9 aa, Homo Sapiens
SPDGSDPKL

SEQ ID NO: 88680 - protein, 9 aa, Homo Sapiens
SPDHTIILL

SEQ ID NO: 88681 - protein, 9 aa, Homo Sapiens
SPDSGVYEM

SEQ ID NO: 88682 - protein, 9 aa, Homo Sapiens
SPEAQPKTL

SEQ ID NO: 88683 - protein, 9 aa, Homo Sapiens
SPEPGAVVL

SEQ ID NO: 88684 - protein, 9 aa, Homo Sapiens
SPEPSPVTL

SEQ ID NO: 88685 - protein, 9 aa, Homo Sapiens
SPFKADIEM

SEQ ID NO: 88686 - protein, 9 aa, Homo Sapiens
SPFNDRFPL

SEQ ID NO: 88687 - protein, 9 aa, Homo Sapiens
SPFPASQAL

SEQ ID NO: 88688 - protein, 9 aa, Homo Sapiens
SPFPTSTPL

SEQ ID NO: 88689 - protein, 9 aa, Homo Sapiens
SPFSFHHVL

SEQ ID NO: 88690 - protein, 9 aa, Homo Sapiens
SPHDISNVL

SEQ ID NO: 88691 - protein, 9 aa, Homo Sapiens
SPHDVSSVL

SEQ ID NO: 88692 - protein, 9 aa, Homo Sapiens
SPHEESISL

SEQ ID NO: 88693 - protein, 9 aa, Homo Sapiens
SPHSAAYVL

SEQ ID NO: 88694 - protein, 9 aa, Homo Sapiens
SPIEKSGVL

SEQ ID NO: 88695 - protein, 9 aa, Homo Sapiens
SPIERNEQL

SEQ ID NO: 88696 - protein, 9 aa, Homo Sapiens
SPIGDDVQL

SEQ ID NO: 88697 - protein, 9 aa, Homo Sapiens
SPIGRDGKL

SEQ ID NO: 88698 - protein, 9 aa, Homo Sapiens
SPIKDQPVM

SEQ ID NO: 88699 - protein, 9 aa, Homo Sapiens
SPIPHDPEF

SEQ ID NO: 88700 - protein, 9 aa, Homo Sapiens
SPISSDQSL

SEQ ID NO: 88701 - protein, 9 aa, Homo Sapiens
SPLAFEHVM

SEQ ID NO: 88702 - protein, 9 aa, Homo Sapiens
SPLEDSWCL

SEQ ID NO: 88703 - protein, 9 aa, Homo Sapiens
SPLESDVSL

SEQ ID NO: 88704 - protein, 9 aa, Homo Sapiens
SPMSVNAVM

SEQ ID NO: 88705 - protein, 9 aa, Homo Sapiens
SPNAEIHIL

SEQ ID NO: 88706 - protein, 9 aa, Homo Sapiens
SPNANEPPL

SEQ ID NO: 88707 - protein, 9 aa, Homo Sapiens
SPNDFSVSL

SEQ ID NO: 88708 - protein, 9 aa, Homo Sapiens
SPNHLYLVM

SEQ ID NO: 88709 - protein, 9 aa, Homo Sapiens
SPNSDDTVL

SEQ ID NO: 88710 - protein, 9 aa, Homo Sapiens
SPNSYVVIM

SEQ ID NO: 88711 - protein, 9 aa, Homo Sapiens
SPNYDHVVL

SEQ ID NO: 88712 - protein, 9 aa, Homo Sapiens
SPQDFGLVL

SEQ ID NO: 88713 - protein, 9 aa, Homo Sapiens
SPSDADREL

SEQ ID NO: 88714 - protein, 9 aa, Homo Sapiens
SPSDFSVSL

SEQ ID NO: 88715 - protein, 9 aa, Homo Sapiens
SPSEILQEL

SEQ ID NO: 88716 - protein, 9 aa, Homo Sapiens
SPSELMLTL

SEQ ID NO: 88717 - protein, 9 aa, Homo Sapiens
SPSKADPAL

SEQ ID NO: 88718 - protein, 9 aa, Homo Sapiens
SPSPMDPHM

SEQ ID NO: 88719 - protein, 9 aa, Homo Sapiens
SPSPSDPVL

SEQ ID NO: 88720 - protein, 9 aa, Homo Sapiens
SPTCTNKEL

SEQ ID NO: 88721 - protein, 9 aa, Homo Sapiens
SPTDSDVSL

SEQ ID NO: 88722 - protein, 9 aa, Homo Sapiens
SPTENSFTL

SEQ ID NO: 88723 - protein, 9 aa, Homo Sapiens
SPTSPDYSL

SEQ ID NO: 88724 - protein, 9 aa, Homo Sapiens
SPVDVLQIF

SEQ ID NO: 88725 - protein, 9 aa, Homo Sapiens
SPVGVNHRL

SEQ ID NO: 88726 - protein, 9 aa, Homo Sapiens
SPVSFSPVL

SEQ ID NO: 88727 - protein, 9 aa, Homo Sapiens
SPVTQEPEL

SEQ ID NO: 88728 - protein, 9 aa, Homo Sapiens
SPYPEAVEL

SEQ ID NO: 88729 - protein, 9 aa, Homo Sapiens
SSLLEKGLD

SEQ ID NO: 88730 - protein, 9 aa, Homo Sapiens
TAAAVGAVF

SEQ ID NO: 88731 - protein, 9 aa, Homo Sapiens
TAAERDEIL

SEQ ID NO: 88732 - protein, 9 aa, Homo Sapiens
TAAMIDAVL

SEQ ID NO: 88733 - protein, 9 aa, Homo Sapiens
TAAPPAQPL

SEQ ID NO: 88734 - protein, 9 aa, Homo Sapiens
TAAPTIGVL

SEQ ID NO: 88735 - protein, 9 aa, Homo Sapiens
TAAPVPTTL

SEQ ID NO: 88736 - protein, 9 aa, Homo Sapiens
TAAPVQETL

SEQ ID NO: 88737 - protein, 9 aa, Homo Sapiens
TAAQVAYVL

SEQ ID NO: 88738 - protein, 9 aa, Homo Sapiens
TAASPTIAL

SEQ ID NO: 88739 - protein, 9 aa, Homo Sapiens
TACAINKVL

SEQ ID NO: 88740 - protein, 9 aa, Homo Sapiens
TACDIQTHM

SEQ ID NO: 88741 - protein, 9 aa, Homo Sapiens
TADGAHFEL

SEQ ID NO: 88742 - protein, 9 aa, Homo Sapiens
TADPSHQTM

SEQ ID NO: 88743 - protein, 9 aa, Homo Sapiens
TAFDRDRAM

SEQ ID NO: 88744 - protein, 9 aa, Homo Sapiens
TAIDDRCEL

SEQ ID NO: 88745 - protein, 9 aa, Homo Sapiens
TAIEAQHLL

SEQ ID NO: 88746 - protein, 9 aa, Homo Sapiens
TAIESTPTL

SEQ ID NO: 88747 - protein, 9 aa, Homo Sapiens
TAIMEKHSM

SEQ ID NO: 88748 - protein, 9 aa, Homo Sapiens
TAISLFYEL

SEQ ID NO: 88749 - protein, 9 aa, Homo Sapiens
TAKDSDPEL

SEQ ID NO: 88750 - protein, 9 aa, Homo Sapiens
TALQEVYTL

SEQ ID NO: 88751 - protein, 9 aa, Homo Sapiens
TAMEQLYTL

SEQ ID NO: 88752 - protein, 9 aa, Homo Sapiens
TANALALAM

SEQ ID NO: 88753 - protein, 9 aa, Homo Sapiens
TANNDHTVL

SEQ ID NO: 88754 - protein, 9 aa, Homo Sapiens
TANNVEIHI

SEQ ID NO: 88755 - protein, 9 aa, Homo Sapiens
TASEMILVL

SEQ ID NO: 88756 - protein, 9 aa, Homo Sapiens
TASPVAVSL

SEQ ID NO: 88757 - protein, 9 aa, Homo Sapiens
TASQVYETL

SEQ ID NO: 88758 - protein, 9 aa, Homo Sapiens
TATATNHVL

SEQ ID NO: 88759 - protein, 9 aa, Homo Sapiens
TAVENMPSL

SEQ ID NO: 88760 - protein, 9 aa, Homo Sapiens
TAVKNDYEM

SEQ ID NO: 88761 - protein, 9 aa, Homo Sapiens
TAVSVCPVL

SEQ ID NO: 88762 - protein, 9 aa, Homo Sapiens
TAYYNDPAF

SEQ ID NO: 88763 - protein, 9 aa, Homo Sapiens
TPADVFIVF

SEQ ID NO: 88764 - protein, 9 aa, Homo Sapiens
TPAEVRQVL

SEQ ID NO: 88765 - protein, 9 aa, Homo Sapiens
TPAGVQVIL

SEQ ID NO: 88766 - protein, 9 aa, Homo Sapiens
TPAPPDLTL

SEQ ID NO: 88767 - protein, 9 aa, Homo Sapiens
TPAPPTHAL

SEQ ID NO: 88768 - protein, 9 aa, Homo Sapiens
TPAVVSERL

SEQ ID NO: 88769 - protein, 9 aa, Homo Sapiens
TPDEIDHVF

SEQ ID NO: 88770 - protein, 9 aa, Homo Sapiens
TPDGAVRVL

SEQ ID NO: 88771 - protein, 9 aa, Homo Sapiens
TPEEGAQAL

SEQ ID NO: 88772 - protein, 9 aa, Homo Sapiens
TPEEVIAKL

SEQ ID NO: 88773 - protein, 9 aa, Homo Sapiens
TPENLPQIL

SEQ ID NO: 88774 - protein, 9 aa, Homo Sapiens
TPEQQAAIL

SEQ ID NO: 88775 - protein, 9 aa, Homo Sapiens
TPFHEIMSL

SEQ ID NO: 88776 - protein, 9 aa, Homo Sapiens
TPFLYDLVM

SEQ ID NO: 88777 - protein, 9 aa, Homo Sapiens
TPFYGDEAL

SEQ ID NO: 88778 - protein, 9 aa, Homo Sapiens
TPGGSHPAL

SEQ ID NO: 88779 - protein, 9 aa, Homo Sapiens
TPINQNVSL

SEQ ID NO: 88780 - protein, 9 aa, Homo Sapiens
TPIREQHVL

SEQ ID NO: 88781 - protein, 9 aa, Homo Sapiens
TPISAGDLL

SEQ ID NO: 88782 - protein, 9 aa, Homo Sapiens
TPISNEVEM

SEQ ID NO: 88783 - protein, 9 aa, Homo Sapiens
TPLPEDNSM

SEQ ID NO: 88784 - protein, 9 aa, Homo Sapiens
TPLPEEFEL

SEQ ID NO: 88785 - protein, 9 aa, Homo Sapiens
TPLSSTVTL

SEQ ID NO: 88786 - protein, 9 aa, Homo Sapiens
TPMDLAVAL

SEQ ID NO: 88787 - protein, 9 aa, Homo Sapiens
TPMFREYSL

SEQ ID NO: 88788 - protein, 9 aa, Homo Sapiens
TPQDHEVAL

SEQ ID NO: 88789 - protein, 9 aa, Homo Sapiens
TPQFPDMIL

SEQ ID NO: 88790 - protein, 9 aa, Homo Sapiens
TPSDIFMVM

SEQ ID NO: 88791 - protein, 9 aa, Homo Sapiens
TPSEPHPVL

SEQ ID NO: 88792 - protein, 9 aa, Homo Sapiens
TPSNIAIVL

SEQ ID NO: 88793 - protein, 9 aa, Homo Sapiens
TPSPDIIVL

SEQ ID NO: 88794 - protein, 9 aa, Homo Sapiens
TPSPIIQQL

SEQ ID NO: 88795 - protein, 9 aa, Homo Sapiens
TPSPSADLL

SEQ ID NO: 88796 - protein, 9 aa, Homo Sapiens
TPSQIGVIL

SEQ ID NO: 88797 - protein, 9 aa, Homo Sapiens
TPSSDVLVF

SEQ ID NO: 88798 - protein, 9 aa, Homo Sapiens
TPSVHEPVL

SEQ ID NO: 88799 - protein, 9 aa, Homo Sapiens
TPTEISLVL

SEQ ID NO: 88800 - protein, 9 aa, Homo Sapiens
TPTIANPIL

SEQ ID NO: 88801 - protein, 9 aa, Homo Sapiens
TPVAGSQSL

SEQ ID NO: 88802 - protein, 9 aa, Homo Sapiens
TPVDDRISL

SEQ ID NO: 88803 - protein, 9 aa, Homo Sapiens
TPVEEVEAL

SEQ ID NO: 88804 - protein, 9 aa, Homo Sapiens
TPVENSHSL

SEQ ID NO: 88805 - protein, 9 aa, Homo Sapiens
TPVPDSHKL

SEQ ID NO: 88806 - protein, 9 aa, Homo Sapiens
TPVPSVNEL

SEQ ID NO: 88807 - protein, 9 aa, Homo Sapiens
TPVSFDETL

SEQ ID NO: 88808 - protein, 9 aa, Homo Sapiens
TPYKDIFAA

SEQ ID NO: 88809 - protein, 9 aa, Homo Sapiens
TPYNGTEAL

SEQ ID NO: 88810 - protein, 9 aa, Homo Sapiens
TPYPSSASL

SEQ ID NO: 88811 - protein, 9 aa, Homo Sapiens
TSSPPDKVL

SEQ ID NO: 88812 - protein, 9 aa, Homo Sapiens
TVAPAQVAL

SEQ ID NO: 88813 - protein, 9 aa, Homo Sapiens
VAPGKDLTK

SEQ ID NO: 88814 - protein, 9 aa, Homo Sapiens
VPAESAAVL

SEQ ID NO: 88815 - protein, 9 aa, Homo Sapiens
VPAEVTVIL

SEQ ID NO: 88816 - protein, 9 aa, Homo Sapiens
VPCALLLEL

SEQ ID NO: 88817 - protein, 9 aa, Homo Sapiens
VPDPNVIKL

SEQ ID NO: 88818 - protein, 9 aa, Homo Sapiens
VPEEKAAEL

SEQ ID NO: 88819 - protein, 9 aa, Homo Sapiens
VPIESDKTL

SEQ ID NO: 88820 - protein, 9 aa, Homo Sapiens
VPIPKDHQV

SEQ ID NO: 88821 - protein, 9 aa, Homo Sapiens
VPIQSSVVL

SEQ ID NO: 88822 - protein, 9 aa, Homo Sapiens
VPISKSEAL

SEQ ID NO: 88823 - protein, 9 aa, Homo Sapiens
VPIYEGYAL

SEQ ID NO: 88824 - protein, 9 aa, Homo Sapiens
VPNDIQSEL

SEQ ID NO: 88825 - protein, 9 aa, Homo Sapiens
VPNEEDPSL

SEQ ID NO: 88826 - protein, 9 aa, Homo Sapiens
VPQDTKLVL

SEQ ID NO: 88827 - protein, 9 aa, Homo Sapiens
VPQLHGEVL

SEQ ID NO: 88828 - protein, 9 aa, Homo Sapiens
VPQSGVPAL

SEQ ID NO: 88829 - protein, 9 aa, Homo Sapiens
VPSAVALVL

SEQ ID NO: 88830 - protein, 9 aa, Homo Sapiens
VPSSIDPIL

SEQ ID NO: 88831 - protein, 9 aa, Homo Sapiens
VPVDSAPVM

SEQ ID NO: 88832 - protein, 9 aa, Homo Sapiens
VPVGNSPAL

SEQ ID NO: 88833 - protein, 9 aa, Homo Sapiens
VPVPRVDVL

SEQ ID NO: 88834 - protein, 9 aa, Homo Sapiens
VPVSRDFTL

SEQ ID NO: 88835 - protein, 9 aa, Homo Sapiens
VPYEKGFAL

SEQ ID NO: 88836 - protein, 9 aa, Homo Sapiens
VPYWPEVGM

SEQ ID NO: 88837 - protein, 9 aa, Homo Sapiens
VTIKKDVDG

SEQ ID NO: 88838 - protein, 9 aa, Homo Sapiens
WPDDKVHKL

SEQ ID NO: 88839 - protein, 9 aa, Homo Sapiens
WPDEDSRLL

SEQ ID NO: 88840 - protein, 9 aa, Homo Sapiens
WPLSEGKAL

SEQ ID NO: 88841 - protein, 9 aa, Homo Sapiens
WPNSKCPLL

SEQ ID NO: 88842 - protein, 9 aa, Homo Sapiens
YAECYPATM

SEQ ID NO: 88843 - protein, 9 aa, Homo Sapiens
YAFGGGCEL

SEQ ID NO: 88844 - protein, 9 aa, Homo Sapiens
YAFPLAHSL

SEQ ID NO: 88845 - protein, 9 aa, Homo Sapiens
YAFSGVEEL

SEQ ID NO: 88846 - protein, 9 aa, Homo Sapiens
YAIEVDPVL

SEQ ID NO: 88847 - protein, 9 aa, Homo Sapiens
YAIGVSHPL

SEQ ID NO: 88848 - protein, 9 aa, Homo Sapiens
YAVRDTIAL

SEQ ID NO: 88849 - protein, 9 aa, Homo Sapiens
YAVTGDVKM

SEQ ID NO: 88850 - protein, 9 aa, Homo Sapiens
YPAAVPQAL

SEQ ID NO: 88851 - protein, 9 aa, Homo Sapiens
YPASAGTSL

SEQ ID NO: 88852 - protein, 9 aa, Homo Sapiens
YPASTVQIL

SEQ ID NO: 88853 - protein, 9 aa, Homo Sapiens
YPCIPNHEL

SEQ ID NO: 88854 - protein, 9 aa, Homo Sapiens
YPDATPEEL

SEQ ID NO: 88855 - protein, 9 aa, Homo Sapiens
YPDEKSVCL

SEQ ID NO: 88856 - protein, 9 aa, Homo Sapiens
YPDFTNPTM

SEQ ID NO: 88857 - protein, 9 aa, Homo Sapiens
YPDINFNRL

SEQ ID NO: 88858 - protein, 9 aa, Homo Sapiens
YPDPVIQEL

SEQ ID NO: 88859 - protein, 9 aa, Homo Sapiens
YPDRIMNTF

SEQ ID NO: 88860 - protein, 9 aa, Homo Sapiens
YPDSKDLTM

SEQ ID NO: 88861 - protein, 9 aa, Homo Sapiens
YPDTDVILM

SEQ ID NO: 88862 - protein, 9 aa, Homo Sapiens
YPECEIRTM

SEQ ID NO: 88863 - protein, 9 aa, Homo Sapiens
YPEDVAEEL

SEQ ID NO: 88864 - protein, 9 aa, Homo Sapiens
YPEDVSEEL

SEQ ID NO: 88865 - protein, 9 aa, Homo Sapiens
YPEEITPLL

SEQ ID NO: 88866 - protein, 9 aa, Homo Sapiens
YPEELKPVL

SEQ ID NO: 88867 - protein, 9 aa, Homo Sapiens
YPEGAPAVL

SEQ ID NO: 88868 - protein, 9 aa, Homo Sapiens
YPENGVVQM

SEQ ID NO: 88869 - protein, 9 aa, Homo Sapiens
YPENIVPSF

SEQ ID NO: 88870 - protein, 9 aa, Homo Sapiens
YPEPAPAAL

SEQ ID NO: 88871 - protein, 9 aa, Homo Sapiens
YPEPLGERL

SEQ ID NO: 88872 - protein, 9 aa, Homo Sapiens
YPESGYSML

SEQ ID NO: 88873 - protein, 9 aa, Homo Sapiens
YPETGVFVI

SEQ ID NO: 88874 - protein, 9 aa, Homo Sapiens
YPETLGRLL

SEQ ID NO: 88875 - protein, 9 aa, Homo Sapiens
YPFDSPQVM

SEQ ID NO: 88876 - protein, 9 aa, Homo Sapiens
YPFEDHNPP

SEQ ID NO: 88877 - protein, 9 aa, Homo Sapiens
YPFELEKDL

SEQ ID NO: 88878 - protein, 9 aa, Homo Sapiens
YPFIIDAHL

SEQ ID NO: 88879 - protein, 9 aa, Homo Sapiens
YPFPLSHSV

SEQ ID NO: 88880 - protein, 9 aa, Homo Sapiens
YPGLADPVF

SEQ ID NO: 88881 - protein, 9 aa, Homo Sapiens
YPGQPHPAL

SEQ ID NO: 88882 - protein, 9 aa, Homo Sapiens
YPHAAVNGL

SEQ ID NO: 88883 - protein, 9 aa, Homo Sapiens
YPHLHNAEL

SEQ ID NO: 88884 - protein, 9 aa, Homo Sapiens
YPHQVPLVL

SEQ ID NO: 88885 - protein, 9 aa, Homo Sapiens
YPIADLVKM

SEQ ID NO: 88886 - protein, 9 aa, Homo Sapiens
YPIGTNAIV

SEQ ID NO: 88887 - protein, 9 aa, Homo Sapiens
YPITRTQQL

SEQ ID NO: 88888 - protein, 9 aa, Homo Sapiens
YPLDLLLKL

SEQ ID NO: 88889 - protein, 9 aa, Homo Sapiens
YPLEDHTEF

SEQ ID NO: 88890 - protein, 9 aa, Homo Sapiens
YPLEDLPSL

SEQ ID NO: 88891 - protein, 9 aa, Homo Sapiens
YPLLKDPSL

SEQ ID NO: 88892 - protein, 9 aa, Homo Sapiens
YPMGSAEAL

SEQ ID NO: 88893 - protein, 9 aa, Homo Sapiens
YPNERFELL

SEQ ID NO: 88894 - protein, 9 aa, Homo Sapiens
YPNGTSAAL

SEQ ID NO: 88895 - protein, 9 aa, Homo Sapiens
YPNKYESVI

SEQ ID NO: 88896 - protein, 9 aa, Homo Sapiens
YPNPKPEVL

SEQ ID NO: 88897 - protein, 9 aa, Homo Sapiens
YPNTYIFDL

SEQ ID NO: 88898 - protein, 9 aa, Homo Sapiens
YPQDLPRPL

SEQ ID NO: 88899 - protein, 9 aa, Homo Sapiens
YPQDWFQVL

SEQ ID NO: 88900 - protein, 9 aa, Homo Sapiens
YPQDYQFYI

SEQ ID NO: 88901 - protein, 9 aa, Homo Sapiens
YPQEDYESF

SEQ ID NO: 88902 - protein, 9 aa, Homo Sapiens
YPQGQAPPL

SEQ ID NO: 88903 - protein, 9 aa, Homo Sapiens
YPQNPDHVL

SEQ ID NO: 88904 - protein, 9 aa, Homo Sapiens
YPQNPDSVL

SEQ ID NO: 88905 - protein, 9 aa, Homo Sapiens
YPSEFATYL

SEQ ID NO: 88906 - protein, 9 aa, Homo Sapiens
YPSEFSTYL

SEQ ID NO: 88907 - protein, 9 aa, Homo Sapiens
YPSETFTRV

SEQ ID NO: 88908 - protein, 9 aa, Homo Sapiens
YPSINPPTL

SEQ ID NO: 88909 - protein, 9 aa, Homo Sapiens
YPSKQFDVL

SEQ ID NO: 88910 - protein, 9 aa, Homo Sapiens
YPSLPTPLL

SEQ ID NO: 88911 - protein, 9 aa, Homo Sapiens
YPSMSDPYL

SEQ ID NO: 88912 - protein, 9 aa, Homo Sapiens
YPSQDPQRM

SEQ ID NO: 88913 - protein, 9 aa, Homo Sapiens
YPTEKVNCL

SEQ ID NO: 88914 - protein, 9 aa, Homo Sapiens
YPTIATGIL

SEQ ID NO: 88915 - protein, 9 aa, Homo Sapiens
YPTISLHAL

SEQ ID NO: 88916 - protein, 9 aa, Homo Sapiens
YPTPYPDEL

SEQ ID NO: 88917 - protein, 9 aa, Homo Sapiens
YPTVDSNSL

SEQ ID NO: 88918 - protein, 9 aa, Homo Sapiens
YPTVGDVAL

SEQ ID NO: 88919 - protein, 9 aa, Homo Sapiens
YPVDKDMEL

SEQ ID NO: 88920 - protein, 9 aa, Homo Sapiens
YPVDLGDKF

SEQ ID NO: 88921 - protein, 9 aa, Homo Sapiens
YPVEIHEYL

SEQ ID NO: 88922 - protein, 9 aa, Homo Sapiens
YPVNSVNIL

SEQ ID NO: 88923 - protein, 9 aa, Homo Sapiens
YPVSSPKSM

SEQ ID NO: 88924 - protein, 9 aa, Homo Sapiens
YPWEGLNAL

SEQ ID NO: 88925 - protein, 9 aa, Homo Sapiens
YPYEHSYGL

SEQ ID NO: 88926 - protein, 9 aa, Homo Sapiens
YPYPYPHTL

SEQ ID NO: 88927 - protein, 9 aa, Homo Sapiens
YVLPEHMSM

SEQ ID NO: 88928 - protein, 10 aa, Homo Sapiens
APAPAEKTPV

SEQ ID NO: 88929 - protein, 10 aa, Homo Sapiens
CPAPGPHPAL

SEQ ID NO: 88930 - protein, 10 aa, Homo Sapiens
EPIMDNNISL

SEQ ID NO: 88931 - protein, 10 aa, Homo Sapiens
FADPVDVNPF

SEQ ID NO: 88932 - protein, 10 aa, Homo Sapiens
FPAEAGRDTL

SEQ ID NO: 88933 - protein, 10 aa, Homo Sapiens
FPAEGVESAL

SEQ ID NO: 88934 - protein, 10 aa, Homo Sapiens
FPAESDKDAL

SEQ ID NO: 88935 - protein, 10 aa, Homo Sapiens
FPAKPGSLTL

SEQ ID NO: 88936 - protein, 10 aa, Homo Sapiens
FPALDGGDAL

SEQ ID NO: 88937 - protein, 10 aa, Homo Sapiens
FPAPVQPVSL

SEQ ID NO: 88938 - protein, 10 aa, Homo Sapiens
FPDEFHLQTL

SEQ ID NO: 88939 - protein, 10 aa, Homo Sapiens
FPDPEKPCKM

SEQ ID NO: 88940 - protein, 10 aa, Homo Sapiens
FPDPNVKYVF

SEQ ID NO: 88941 - protein, 10 aa, Homo Sapiens
FPDSRTNVDL

SEQ ID NO: 88942 - protein, 10 aa, Homo Sapiens
FPDTSTPRPF

SEQ ID NO: 88943 - protein, 10 aa, Homo Sapiens
FPEADKVRTM

SEQ ID NO: 88944 - protein, 10 aa, Homo Sapiens
FPEDVVRVIF

SEQ ID NO: 88945 - protein, 10 aa, Homo Sapiens
FPEHMANVEL

SEQ ID NO: 88946 - protein, 10 aa, Homo Sapiens
FPEPSRPPLF

SEQ ID NO: 88947 - protein, 10 aa, Homo Sapiens
FPESSAIEAL

SEQ ID NO: 88948 - protein, 10 aa, Homo Sapiens
FPFSDKLGEL

SEQ ID NO: 88949 - protein, 10 aa, Homo Sapiens
FPHELEVPAL

SEQ ID NO: 88950 - protein, 10 aa, Homo Sapiens
FPHISQCEEL

SEQ ID NO: 88951 - protein, 10 aa, Homo Sapiens
FPHPGFNMSL

SEQ ID NO: 88952 - protein, 10 aa, Homo Sapiens
FPIEDASNKL

SEQ ID NO: 88953 - protein, 10 aa, Homo Sapiens
FPIQMEGVKL

SEQ ID NO: 88954 - protein, 10 aa, Homo Sapiens
FPISEETIKL

SEQ ID NO: 88955 - protein, 10 aa, Homo Sapiens
FPLSESQTLL

SEQ ID NO: 88956 - protein, 10 aa, Homo Sapiens
FPQSLPKLLL

SEQ ID NO: 88957 - protein, 10 aa, Homo Sapiens
FPQYSPKMQL

SEQ ID NO: 88958 - protein, 10 aa, Homo Sapiens
FPSGDIQEQL

SEQ ID NO: 88959 - protein, 10 aa, Homo Sapiens
FPVEIKSFYM

SEQ ID NO: 88960 - protein, 10 aa, Homo Sapiens
FPVGGPGTSL

SEQ ID NO: 88961 - protein, 10 aa, Homo Sapiens
FPVNSDVGVL

SEQ ID NO: 88962 - protein, 10 aa, Homo Sapiens
FPVPGSGLVL

SEQ ID NO: 88963 - protein, 10 aa, Homo Sapiens
FPVRDGKIKL

SEQ ID NO: 88964 - protein, 10 aa, Homo Sapiens
FPVSEAQVHL

SEQ ID NO: 88965 - protein, 10 aa, Homo Sapiens
FPWGDGNHTL

SEQ ID NO: 88966 - protein, 10 aa, Homo Sapiens
FPYARDDLSL

SEQ ID NO: 88967 - protein, 10 aa, Homo Sapiens
FPYEKDLIEA

SEQ ID NO: 88968 - protein, 10 aa, Homo Sapiens
FPYQTQEEPL

SEQ ID NO: 88969 - protein, 10 aa, Homo Sapiens
FVDPNGKISL

SEQ ID NO: 88970 - protein, 10 aa, Homo Sapiens
HAAEYGAEAL

SEQ ID NO: 88971 - protein, 10 aa, Homo Sapiens
HACDVVAVTL

SEQ ID NO: 88972 - protein, 10 aa, Homo Sapiens
HPDPFANKSL

SEQ ID NO: 88973 - protein, 10 aa, Homo Sapiens
HPDPTRLLLF

SEQ ID NO: 88974 - protein, 10 aa, Homo Sapiens
HPDTGEKMIL

SEQ ID NO: 88975 - protein, 10 aa, Homo Sapiens
HPESGCRTVL

SEQ ID NO: 88976 - protein, 10 aa, Homo Sapiens
HPFPESKPVL

SEQ ID NO: 88977 - protein, 10 aa, Homo Sapiens
HPFPGPGLAI

SEQ ID NO: 88978 - protein, 10 aa, Homo Sapiens
HPHAVNEIAL

SEQ ID NO: 88979 - protein, 10 aa, Homo Sapiens
HPIDGFLQSL

SEQ ID NO: 88980 - protein, 10 aa, Homo Sapiens
HPIEGSTTVF

SEQ ID NO: 88981 - protein, 10 aa, Homo Sapiens
HPIHADNCLL

SEQ ID NO: 88982 - protein, 10 aa, Homo Sapiens
HPIHQGITEL

SEQ ID NO: 88983 - protein, 10 aa, Homo Sapiens
HPISDHEATL

SEQ ID NO: 88984 - protein, 10 aa, Homo Sapiens
HPISSGLEAM

SEQ ID NO: 88985 - protein, 10 aa, Homo Sapiens
HPIYPDPARL

SEQ ID NO: 88986 - protein, 10 aa, Homo Sapiens
HPNYLGDLIM

SEQ ID NO: 88987 - protein, 10 aa, Homo Sapiens
HPQPGSANSL

SEQ ID NO: 88988 - protein, 10 aa, Homo Sapiens
HPSDIEVDLL

SEQ ID NO: 88989 - protein, 10 aa, Homo Sapiens
HPVLLTEAPL

SEQ ID NO: 88990 - protein, 10 aa, Homo Sapiens
HPVPCEQPAL

SEQ ID NO: 88991 - protein, 10 aa, Homo Sapiens
HPVSDHEATL

SEQ ID NO: 88992 - protein, 10 aa, Homo Sapiens
HPYDSGHIAM

SEQ ID NO: 88993 - protein, 10 aa, Homo Sapiens
HPYRNSDPVI

SEQ ID NO: 88994 - protein, 10 aa, Homo Sapiens
IPAPAEKTPV

SEQ ID NO: 88995 - protein, 10 aa, Homo Sapiens
IPFDGDLLSM

SEQ ID NO: 88996 - protein, 10 aa, Homo Sapiens
IPLEEGELEL

SEQ ID NO: 88997 - protein, 10 aa, Homo Sapiens
IPSSVIHPAM

SEQ ID NO: 88998 - protein, 10 aa, Homo Sapiens
IPVEEHFQTL

SEQ ID NO: 88999 - protein, 10 aa, Homo Sapiens
IPYPKEELPL

SEQ ID NO: 89000 - protein, 10 aa, Homo Sapiens
LPAHIPYQEL

SEQ ID NO: 89001 - protein, 10 aa, Homo Sapiens
LPANVGGQIL

SEQ ID NO: 89002 - protein, 10 aa, Homo Sapiens
LPAPADFLSL

SEQ ID NO: 89003 - protein, 10 aa, Homo Sapiens
LPAPPHIDVM

SEQ ID NO: 89004 - protein, 10 aa, Homo Sapiens
LPEEEQQRVL

SEQ ID NO: 89005 - protein, 10 aa, Homo Sapiens
LPFAKEIVSL

SEQ ID NO: 89006 - protein, 10 aa, Homo Sapiens
LPIAEAPGKL

SEQ ID NO: 89007 - protein, 10 aa, Homo Sapiens
LPIDKEEVSL

SEQ ID NO: 89008 - protein, 10 aa, Homo Sapiens
LPIPRPGEVL

SEQ ID NO: 89009 - protein, 10 aa, Homo Sapiens
LPLEEGQAVL

SEQ ID NO: 89010 - protein, 10 aa, Homo Sapiens
LPLPAERVTL

SEQ ID NO: 89011 - protein, 10 aa, Homo Sapiens
LPSPSPRISL

SEQ ID NO: 89012 - protein, 10 aa, Homo Sapiens
LPSQDPEVAL

SEQ ID NO: 89013 - protein, 10 aa, Homo Sapiens
LPVNDEHVTV

SEQ ID NO: 89014 - protein, 10 aa, Homo Sapiens
LPYPKDVYSV

SEQ ID NO: 89015 - protein, 10 aa, Homo Sapiens
MPAEEREKKL

SEQ ID NO: 89016 - protein, 10 aa, Homo Sapiens
MPANGETVTL

SEQ ID NO: 89017 - protein, 10 aa, Homo Sapiens
MPAPHTSITM

SEQ ID NO: 89018 - protein, 10 aa, Homo Sapiens
MPCPVPPARM

SEQ ID NO: 89019 - protein, 10 aa, Homo Sapiens
MPDPLLTREL

SEQ ID NO: 89020 - protein, 10 aa, Homo Sapiens
MPEDVKNFYL

SEQ ID NO: 89021 - protein, 10 aa, Homo Sapiens
MPEEKLVEAL

SEQ ID NO: 89022 - protein, 10 aa, Homo Sapiens
MPEEQAFCVL

SEQ ID NO: 89023 - protein, 10 aa, Homo Sapiens
MPEQIVIHAL

SEQ ID NO: 89024 - protein, 10 aa, Homo Sapiens
MPEQIVVQAL

SEQ ID NO: 89025 - protein, 10 aa, Homo Sapiens
MPEQNPTHAL

SEQ ID NO: 89026 - protein, 10 aa, Homo Sapiens
MPETSHIVAL

SEQ ID NO: 89027 - protein, 10 aa, Homo Sapiens
MPFAPAIQTF

SEQ ID NO: 89028 - protein, 10 aa, Homo Sapiens
MPHEDCITAL

SEQ ID NO: 89029 - protein, 10 aa, Homo Sapiens
MPHSYPYVAL

SEQ ID NO: 89030 - protein, 10 aa, Homo Sapiens
MPIDQGFASL

SEQ ID NO: 89031 - protein, 10 aa, Homo Sapiens
MPIGGDVPAL

SEQ ID NO: 89032 - protein, 10 aa, Homo Sapiens
MPIKACADKL

SEQ ID NO: 89033 - protein, 10 aa, Homo Sapiens
MPLGSAVDIL

SEQ ID NO: 89034 - protein, 10 aa, Homo Sapiens
MPLPGVGEEL

SEQ ID NO: 89035 - protein, 10 aa, Homo Sapiens
MPNHSASIQL

SEQ ID NO: 89036 - protein, 10 aa, Homo Sapiens
MPQKERESIM

SEQ ID NO: 89037 - protein, 10 aa, Homo Sapiens
MPQSMPEYAL

SEQ ID NO: 89038 - protein, 10 aa, Homo Sapiens
MPSPAPEVPL

SEQ ID NO: 89039 - protein, 10 aa, Homo Sapiens
MPVDDVIGTL

SEQ ID NO: 89040 - protein, 10 aa, Homo Sapiens
MPVEVQTELL

SEQ ID NO: 89041 - protein, 10 aa, Homo Sapiens
MPVHMVPTEL

SEQ ID NO: 89042 - protein, 10 aa, Homo Sapiens
MPVSELTDKL

SEQ ID NO: 89043 - protein, 10 aa, Homo Sapiens
MPVSGPGLSL

SEQ ID NO: 89044 - protein, 10 aa, Homo Sapiens
MPVTKGDFEL

SEQ ID NO: 89045 - protein, 10 aa, Homo Sapiens
MPYDSNRVVL

SEQ ID NO: 89046 - protein, 10 aa, Homo Sapiens
MPYGSRENSL

SEQ ID NO: 89047 - protein, 10 aa, Homo Sapiens
NAAGVPKQSL

SEQ ID NO: 89048 - protein, 10 aa, Homo Sapiens
NAESGRGQVM

SEQ ID NO: 89049 - protein, 10 aa, Homo Sapiens
QIPELPDPSL

SEQ ID NO: 89050 - protein, 10 aa, Homo Sapiens
QPEGMISESL

SEQ ID NO: 89051 - protein, 10 aa, Homo Sapiens
SPMDDGFVSL

SEQ ID NO: 89052 - protein, 10 aa, Homo Sapiens
TANPFPVPSL

SEQ ID NO: 89053 - protein, 10 aa, Homo Sapiens
TPDPSANISL

SEQ ID NO: 89054 - protein, 10 aa, Homo Sapiens
TPFNTREPVM

SEQ ID NO: 89055 - protein, 10 aa, Homo Sapiens
TPLDEKSLAL

SEQ ID NO: 89056 - protein, 10 aa, Homo Sapiens
TPSDVKELVL

SEQ ID NO: 89057 - protein, 10 aa, Homo Sapiens
VPDPNKPQKL

SEQ ID NO: 89058 - protein, 10 aa, Homo Sapiens
VPTIYPLETL

SEQ ID NO: 89059 - protein, 10 aa, Homo Sapiens
YADPTKRLEL

SEQ ID NO: 89060 - protein, 10 aa, Homo Sapiens
YGPPGTGKTL

SEQ ID NO: 89061 - protein, 10 aa, Homo Sapiens
YPDEQTSRTL

SEQ ID NO: 89062 - protein, 10 aa, Homo Sapiens
YPDPSKQKPM

SEQ ID NO: 89063 - protein, 10 aa, Homo Sapiens
YPEEVSSMVL

SEQ ID NO: 89064 - protein, 10 aa, Homo Sapiens
YPEPSTSTTM

SEQ ID NO: 89065 - protein, 10 aa, Homo Sapiens
YPFESAEAQL

SEQ ID NO: 89066 - protein, 10 aa, Homo Sapiens
YPFIGDVHSL

SEQ ID NO: 89067 - protein, 10 aa, Homo Sapiens
YPFQDSEPVL

SEQ ID NO: 89068 - protein, 10 aa, Homo Sapiens
YPIALTRAEM

SEQ ID NO: 89069 - protein, 10 aa, Homo Sapiens
YPIDDVYTGM

SEQ ID NO: 89070 - protein, 10 aa, Homo Sapiens
YPLEEGSTSL

SEQ ID NO: 89071 - protein, 10 aa, Homo Sapiens
YPLPAVKVSM

SEQ ID NO: 89072 - protein, 10 aa, Homo Sapiens
YPNPYSKHVL

SEQ ID NO: 89073 - protein, 10 aa, Homo Sapiens
YPSPYPIRSL

SEQ ID NO: 89074 - protein, 10 aa, Homo Sapiens
YPVHAQMPSL

SEQ ID NO: 89075 - protein, 11 aa, Homo Sapiens
EPYKTNKGDEL

SEQ ID NO: 89076 - protein, 11 aa, Homo Sapiens
FAEDITTGQVL

SEQ ID NO: 89077 - protein, 11 aa, Homo Sapiens
FPADEASIQAL

SEQ ID NO: 89078 - protein, 11 aa, Homo Sapiens
FPDFKSAGVTL

SEQ ID NO: 89079 - protein, 11 aa, Homo Sapiens
FPDGLAHSDLM

SEQ ID NO: 89080 - protein, 11 aa, Homo Sapiens
FPEPNPRVIEL

SEQ ID NO: 89081 - protein, 11 aa, Homo Sapiens
FPFSDKEKNKL

SEQ ID NO: 89082 - protein, 11 aa, Homo Sapiens
FPHFDLSHGSA

SEQ ID NO: 89083 - protein, 11 aa, Homo Sapiens
FPIPAAEVDRL

SEQ ID NO: 89084 - protein, 11 aa, Homo Sapiens
FPIPGEPGFPL

SEQ ID NO: 89085 - protein, 11 aa, Homo Sapiens
FPISDDRNSSV

SEQ ID NO: 89086 - protein, 11 aa, Homo Sapiens
FPISEETIKLL

SEQ ID NO: 89087 - protein, 11 aa, Homo Sapiens
FPITQDREQLM

SEQ ID NO: 89088 - protein, 11 aa, Homo Sapiens
FPLQPEAQRAL

SEQ ID NO: 89089 - protein, 11 aa, Homo Sapiens
FPNAIEHTLQW

SEQ ID NO: 89090 - protein, 11 aa, Homo Sapiens
FPNIVIKGSEL

SEQ ID NO: 89091 - protein, 11 aa, Homo Sapiens
FPSVPMKEEVL

SEQ ID NO: 89092 - protein, 11 aa, Homo Sapiens
FPSYVDKNLEL

SEQ ID NO: 89093 - protein, 11 aa, Homo Sapiens
FPVREDVLNSL

SEQ ID NO: 89094 - protein, 11 aa, Homo Sapiens
HAVAEGAKNVL

SEQ ID NO: 89095 - protein, 11 aa, Homo Sapiens
HPAPLCTIRTL

SEQ ID NO: 89096 - protein, 11 aa, Homo Sapiens
HPCFWIDGQYL

SEQ ID NO: 89097 - protein, 11 aa, Homo Sapiens
HPDTGISSKAM

SEQ ID NO: 89098 - protein, 11 aa, Homo Sapiens
HPEGSLPDLTM

SEQ ID NO: 89099 - protein, 11 aa, Homo Sapiens
HPETIVLDPLP

SEQ ID NO: 89100 - protein, 11 aa, Homo Sapiens
HPISSEELLSL

SEQ ID NO: 89101 - protein, 11 aa, Homo Sapiens
HPLCEGSSATL

SEQ ID NO: 89102 - protein, 11 aa, Homo Sapiens
HPQIEPANQEL

SEQ ID NO: 89103 - protein, 11 aa, Homo Sapiens
IPEEILGKITL

SEQ ID NO: 89104 - protein, 11 aa, Homo Sapiens
IPIALSGRDIL

SEQ ID NO: 89105 - protein, 11 aa, Homo Sapiens
IPIPSTGSVEM

SEQ ID NO: 89106 - protein, 11 aa, Homo Sapiens
IPNPQERTLTL

SEQ ID NO: 89107 - protein, 11 aa, Homo Sapiens
IPYHSEVPVSL

SEQ ID NO: 89108 - protein, 11 aa, Homo Sapiens
KKDVDNAYMIK

SEQ ID NO: 89109 - protein, 11 aa, Homo Sapiens
LPAAGVGDMVM

SEQ ID NO: 89110 - protein, 11 aa, Homo Sapiens
LPAPALEYETL

SEQ ID NO: 89111 - protein, 11 aa, Homo Sapiens
LPDGTSLTQTF

SEQ ID NO: 89112 - protein, 11 aa, Homo Sapiens
LPEDEGHTRTL

SEQ ID NO: 89113 - protein, 11 aa, Homo Sapiens
LPFFTEREQTL

SEQ ID NO: 89114 - protein, 11 aa, Homo Sapiens
LPFSGPREPSL

SEQ ID NO: 89115 - protein, 11 aa, Homo Sapiens
LPFYESSPQVL

SEQ ID NO: 89116 - protein, 11 aa, Homo Sapiens
LPIDESNTIHL

SEQ ID NO: 89117 - protein, 11 aa, Homo Sapiens
LPIEDRETIIM

SEQ ID NO: 89118 - protein, 11 aa, Homo Sapiens
LPIGDSASNLL

SEQ ID NO: 89119 - protein, 11 aa, Homo Sapiens
LPLDDGAAHVM

SEQ ID NO: 89120 - protein, 11 aa, Homo Sapiens
LPLWVDKEASL

SEQ ID NO: 89121 - protein, 11 aa, Homo Sapiens
LPQLTGAENVL

SEQ ID NO: 89122 - protein, 11 aa, Homo Sapiens
LPSFDAHLTEL

SEQ ID NO: 89123 - protein, 11 aa, Homo Sapiens
LPYDVTPEQAL

SEQ ID NO: 89124 - protein, 11 aa, Homo Sapiens
MPAPEEIVEEL

SEQ ID NO: 89125 - protein, 11 aa, Homo Sapiens
MPAPSDQSETL

SEQ ID NO: 89126 - protein, 11 aa, Homo Sapiens
MPCSEEPAHGL

SEQ ID NO: 89127 - protein, 11 aa, Homo Sapiens
MPDGQFKDISL

SEQ ID NO: 89128 - protein, 11 aa, Homo Sapiens
MPEEESAKVCL

SEQ ID NO: 89129 - protein, 11 aa, Homo Sapiens
MPEGGQGAPPM

SEQ ID NO: 89130 - protein, 11 aa, Homo Sapiens
MPEPASRCLLL

SEQ ID NO: 89131 - protein, 11 aa, Homo Sapiens
MPFEDDNRTRL

SEQ ID NO: 89132 - protein, 11 aa, Homo Sapiens
MPFQDGKPFNL

SEQ ID NO: 89133 - protein, 11 aa, Homo Sapiens
MPGTTDTIQVL

SEQ ID NO: 89134 - protein, 11 aa, Homo Sapiens
MPIREGDTVTL

SEQ ID NO: 89135 - protein, 11 aa, Homo Sapiens
MPISSHVDLGL

SEQ ID NO: 89136 - protein, 11 aa, Homo Sapiens
MPMGSLEHEGL

SEQ ID NO: 89137 - protein, 11 aa, Homo Sapiens
MPSPIMHPLIL

SEQ ID NO: 89138 - protein, 11 aa, Homo Sapiens
MPVGLIAGASL

SEQ ID NO: 89139 - protein, 11 aa, Homo Sapiens
NALQESANSIL

SEQ ID NO: 89140 - protein, 11 aa, Homo Sapiens
QPIPILYEHQL

SEQ ID NO: 89141 - protein, 11 aa, Homo Sapiens
QPIRENDDQVL

SEQ ID NO: 89142 - protein, 11 aa, Homo Sapiens
TPIEGMLSHQL

SEQ ID NO: 89143 - protein, 11 aa, Homo Sapiens
TPLDEKSLALL

SEQ ID NO: 89144 - protein, 11 aa, Homo Sapiens
VPDSSGPERIL

SEQ ID NO: 89145 - protein, 11 aa, Homo Sapiens
VPLDEKLLPQL

SEQ ID NO: 89146 - protein, 11 aa, Homo Sapiens
YALEEHENQRL

SEQ ID NO: 89147 - protein, 11 aa, Homo Sapiens
YPDPNYLQNVL

SEQ ID NO: 89148 - protein, 11 aa, Homo Sapiens
YPETLGRLLIL

SEQ ID NO: 89149 - protein, 11 aa, Homo Sapiens
YPFESAEAQLL

SEQ ID NO: 89150 - protein, 11 aa, Homo Sapiens
YPFSSSNDEEL

SEQ ID NO: 89151 - protein, 11 aa, Homo Sapiens
YPFTGDHKQKF

SEQ ID NO: 89152 - protein, 11 aa, Homo Sapiens
YPLEDATHIAL

SEQ ID NO: 89153 - protein, 11 aa, Homo Sapiens
YPLPEHRSTAL

SEQ ID NO: 89154 - protein, 11 aa, Homo Sapiens
YPLQDPKNLIL

SEQ ID NO: 89155 - protein, 11 aa, Homo Sapiens
YPYDGIHPDDL

SEQ ID NO: 89156 - protein, 11 aa, Homo Sapiens
YPYPYPHTLYL

SEQ ID NO: 89157 - protein, 11 aa, Homo Sapiens
YPYTPRKEDEL

SEQ ID NO: 89158 - protein, 8 aa, Homo Sapiens
DAFKASVY

SEQ ID NO: 89159 - protein, 8 aa, Homo Sapiens
DALVITHY

SEQ ID NO: 89160 - protein, 8 aa, Homo Sapiens
DAVVSQVL

SEQ ID NO: 89161 - protein, 8 aa, Homo Sapiens
DSHLPMLL

SEQ ID NO: 89162 - protein, 8 aa, Homo Sapiens
EALKSHIM

SEQ ID NO: 89163 - protein, 8 aa, Homo Sapiens
EVPKKLKY

SEQ ID NO: 89164 - protein, 8 aa, Homo Sapiens
FALVSQAY

SEQ ID NO: 89165 - protein, 8 aa, Homo Sapiens
FPAEPLEL

SEQ ID NO: 89166 - protein, 8 aa, Homo Sapiens
FPGIKLIY

SEQ ID NO: 89167 - protein, 8 aa, Homo Sapiens
FPGPIFHL

SEQ ID NO: 89168 - protein, 8 aa, Homo Sapiens
FPGPLQAF

SEQ ID NO: 89169 - protein, 8 aa, Homo Sapiens
FPGPSKPF

SEQ ID NO: 89170 - protein, 8 aa, Homo Sapiens
FPHESARL

SEQ ID NO: 89171 - protein, 8 aa, Homo Sapiens
FPHTTPSM

SEQ ID NO: 89172 - protein, 8 aa, Homo Sapiens
FPLKVFGY

SEQ ID NO: 89173 - protein, 8 aa, Homo Sapiens
FPLLATAY

SEQ ID NO: 89174 - protein, 8 aa, Homo Sapiens
FPMEIRQY

SEQ ID NO: 89175 - protein, 8 aa, Homo Sapiens
FPQPAAVY

SEQ ID NO: 89176 - protein, 8 aa, Homo Sapiens
FPTISLEF

SEQ ID NO: 89177 - protein, 8 aa, Homo Sapiens
FPVCLLAS

SEQ ID NO: 89178 - protein, 8 aa, Homo Sapiens
HPGLILKY

SEQ ID NO: 89179 - protein, 8 aa, Homo Sapiens
HPITSIEY

SEQ ID NO: 89180 - protein, 8 aa, Homo Sapiens
HPVQHISF

SEQ ID NO: 89181 - protein, 8 aa, Homo Sapiens
IPAESYTF

SEQ ID NO: 89182 - protein, 8 aa, Homo Sapiens
IPALAVEM

SEQ ID NO: 89183 - protein, 8 aa, Homo Sapiens
IPCVSHVW

SEQ ID NO: 89184 - protein, 8 aa, Homo Sapiens
IPHEAFVY

SEQ ID NO: 89185 - protein, 8 aa, Homo Sapiens
IPHESQVY

SEQ ID NO: 89186 - protein, 8 aa, Homo Sapiens
IPVHPHVY

SEQ ID NO: 89187 - protein, 8 aa, Homo Sapiens
LEEYAATL

SEQ ID NO: 89188 - protein, 8 aa, Homo Sapiens
LPAETMRI

SEQ ID NO: 89189 - protein, 8 aa, Homo Sapiens
LPAVSWKM

SEQ ID NO: 89190 - protein, 8 aa, Homo Sapiens
LPGEVLEY

SEQ ID NO: 89191 - protein, 8 aa, Homo Sapiens
LPGVAVSM

SEQ ID NO: 89192 - protein, 8 aa, Homo Sapiens
LPHEILEM

SEQ ID NO: 89193 - protein, 8 aa, Homo Sapiens
LPHQPLAT

SEQ ID NO: 89194 - protein, 8 aa, Homo Sapiens
LPIVTPAL

SEQ ID NO: 89195 - protein, 8 aa, Homo Sapiens
LPLISVAL

SEQ ID NO: 89196 - protein, 8 aa, Homo Sapiens
LPMESAIL

SEQ ID NO: 89197 - protein, 8 aa, Homo Sapiens
LPRTDYSF

SEQ ID NO: 89198 - protein, 8 aa, Homo Sapiens
LPVASSVM

SEQ ID NO: 89199 - protein, 8 aa, Homo Sapiens
LPWKAFTY

SEQ ID NO: 89200 - protein, 8 aa, Homo Sapiens
LQEVCVLY

SEQ ID NO: 89201 - protein, 8 aa, Homo Sapiens
MPDLAHVM

SEQ ID NO: 89202 - protein, 8 aa, Homo Sapiens
MPDLPHLL

SEQ ID NO: 89203 - protein, 8 aa, Homo Sapiens
MPDSAAAL

SEQ ID NO: 89204 - protein, 8 aa, Homo Sapiens
MPIHSDIL

SEQ ID NO: 89205 - protein, 8 aa, Homo Sapiens
MPKVHIEF

SEQ ID NO: 89206 - protein, 8 aa, Homo Sapiens
MPLTVDEY

SEQ ID NO: 89207 - protein, 8 aa, Homo Sapiens
MPSGAYVY

SEQ ID NO: 89208 - protein, 8 aa, Homo Sapiens
MPTVHYEF

SEQ ID NO: 89209 - protein, 8 aa, Homo Sapiens
MVGKTFTY

SEQ ID NO: 89210 - protein, 8 aa, Homo Sapiens
PHADTIIY

SEQ ID NO: 89211 - protein, 8 aa, Homo Sapiens
TPHVAPVM

SEQ ID NO: 89212 - protein, 8 aa, Homo Sapiens
TPMEVAVY

SEQ ID NO: 89213 - protein, 8 aa, Homo Sapiens
VHFPMVVY

SEQ ID NO: 89214 - protein, 8 aa, Homo Sapiens
VPAESHIY

SEQ ID NO: 89215 - protein, 8 aa, Homo Sapiens
VPGPAAAL

SEQ ID NO: 89216 - protein, 8 aa, Homo Sapiens
VPYRIFPY

SEQ ID NO: 89217 - protein, 8 aa, Homo Sapiens
YALQVHCY

SEQ ID NO: 89218 - protein, 8 aa, Homo Sapiens
YPGPAVVL

SEQ ID NO: 89219 - protein, 8 aa, Homo Sapiens
YPVEIHEY

SEQ ID NO: 89220 - protein, 9 aa, Homo Sapiens
AAAPAIMSY

SEQ ID NO: 89221 - protein, 9 aa, Homo Sapiens
AAAPVIKAY

SEQ ID NO: 89222 - protein, 9 aa, Homo Sapiens
AANPHSFVF

SEQ ID NO: 89223 - protein, 9 aa, Homo Sapiens
AMNPTNTVF

SEQ ID NO: 89224 - protein, 9 aa, Homo Sapiens
APAPIHNQF

SEQ ID NO: 89225 - protein, 9 aa, Homo Sapiens
APAPPASQY

SEQ ID NO: 89226 - protein, 9 aa, Homo Sapiens
APAPTAVVL

SEQ ID NO: 89227 - protein, 9 aa, Homo Sapiens
APAPVQPPM

SEQ ID NO: 89228 - protein, 9 aa, Homo Sapiens
APARPQPAY

SEQ ID NO: 89229 - protein, 9 aa, Homo Sapiens
APATSILEY

SEQ ID NO: 89230 - protein, 9 aa, Homo Sapiens
APFEEQENY

SEQ ID NO: 89231 - protein, 9 aa, Homo Sapiens
APFGEKEAY

SEQ ID NO: 89232 - protein, 9 aa, Homo Sapiens
APFGMEAEY

SEQ ID NO: 89233 - protein, 9 aa, Homo Sapiens
APFGNFPHY

SEQ ID NO: 89234 - protein, 9 aa, Homo Sapiens
APFRSEVCF

SEQ ID NO: 89235 - protein, 9 aa, Homo Sapiens
APFSKVITF

SEQ ID NO: 89236 - protein, 9 aa, Homo Sapiens
APFTEGISF

SEQ ID NO: 89237 - protein, 9 aa, Homo Sapiens
APHAPGPPA

SEQ ID NO: 89238 - protein, 9 aa, Homo Sapiens
APIASIHSF

SEQ ID NO: 89239 - protein, 9 aa, Homo Sapiens
APIQVFSTY

SEQ ID NO: 89240 - protein, 9 aa, Homo Sapiens
APLKSKMIY

SEQ ID NO: 89241 - protein, 9 aa, Homo Sapiens
APTDCVSSF

SEQ ID NO: 89242 - protein, 9 aa, Homo Sapiens
APVALVVHM

SEQ ID NO: 89243 - protein, 9 aa, Homo Sapiens
APVEVTHNF

SEQ ID NO: 89244 - protein, 9 aa, Homo Sapiens
APVPLYNSF

SEQ ID NO: 89245 - protein, 9 aa, Homo Sapiens
APVPTGEVY

SEQ ID NO: 89246 - protein, 9 aa, Homo Sapiens
APVQILQEY

SEQ ID NO: 89247 - protein, 9 aa, Homo Sapiens
APWEVLVTY

SEQ ID NO: 89248 - protein, 9 aa, Homo Sapiens
AQNAVRLHY

SEQ ID NO: 89249 - protein, 9 aa, Homo Sapiens
ATADTVIIY

SEQ ID NO: 89250 - protein, 9 aa, Homo Sapiens
ATAQPPAPL

SEQ ID NO: 89251 - protein, 9 aa, Homo Sapiens
AVHDITVAY

SEQ ID NO: 89252 - protein, 9 aa, Homo Sapiens
AVIAPKSSY

SEQ ID NO: 89253 - protein, 9 aa, Homo Sapiens
AVNALQSVY

SEQ ID NO: 89254 - protein, 9 aa, Homo Sapiens
AVSAVVHEY

SEQ ID NO: 89255 - protein, 9 aa, Homo Sapiens
CADPVYKVY

SEQ ID NO: 89256 - protein, 9 aa, Homo Sapiens
CAHFGAYVY

SEQ ID NO: 89257 - protein, 9 aa, Homo Sapiens
CPAGIFQAM

SEQ ID NO: 89258 - protein, 9 aa, Homo Sapiens
CPATAVIIY

SEQ ID NO: 89259 - protein, 9 aa, Homo Sapiens
CPFGENAEF

SEQ ID NO: 89260 - protein, 9 aa, Homo Sapiens
CPFQGTVAF

SEQ ID NO: 89261 - protein, 9 aa, Homo Sapiens
CPHTIGVEF

SEQ ID NO: 89262 - protein, 9 aa, Homo Sapiens
CPLEEFSVY

SEQ ID NO: 89263 - protein, 9 aa, Homo Sapiens
CPLMAAVTY

SEQ ID NO: 89264 - protein, 9 aa, Homo Sapiens
CPNSKAPVL

SEQ ID NO: 89265 - protein, 9 aa, Homo Sapiens
CPTDKTMEF

SEQ ID NO: 89266 - protein, 9 aa, Homo Sapiens
CPYHYVEVM

SEQ ID NO: 89267 - protein, 9 aa, Homo Sapiens
CPYIEFESF

SEQ ID NO: 89268 - protein, 9 aa, Homo Sapiens
CVAPTIHVY

SEQ ID NO: 89269 - protein, 9 aa, Homo Sapiens
DAADIRFVY

SEQ ID NO: 89270 - protein, 9 aa, Homo Sapiens
DAARLQAAY

SEQ ID NO: 89271 - protein, 9 aa, Homo Sapiens
DACRYLQTY

SEQ ID NO: 89272 - protein, 9 aa, Homo Sapiens
DAFEFHEAF

SEQ ID NO: 89273 - protein, 9 aa, Homo Sapiens
DAFNQIMGY

SEQ ID NO: 89274 - protein, 9 aa, Homo Sapiens
DAFPLAFDY

SEQ ID NO: 89275 - protein, 9 aa, Homo Sapiens
DAFPLLSAY

SEQ ID NO: 89276 - protein, 9 aa, Homo Sapiens
DAGPPTHAF

SEQ ID NO: 89277 - protein, 9 aa, Homo Sapiens
DAHPTLVTY

SEQ ID NO: 89278 - protein, 9 aa, Homo Sapiens
DAIRLAVSY

SEQ ID NO: 89279 - protein, 9 aa, Homo Sapiens
DAIRLFAAY

SEQ ID NO: 89280 - protein, 9 aa, Homo Sapiens
DAISKTYSY

SEQ ID NO: 89281 - protein, 9 aa, Homo Sapiens
DALGHFFQY

SEQ ID NO: 89282 - protein, 9 aa, Homo Sapiens
DAMDISCAY

SEQ ID NO: 89283 - protein, 9 aa, Homo Sapiens
DASKVVTVF

SEQ ID NO: 89284 - protein, 9 aa, Homo Sapiens
DASPVQAVF

SEQ ID NO: 89285 - protein, 9 aa, Homo Sapiens
DAWIEHDVW

SEQ ID NO: 89286 - protein, 9 aa, Homo Sapiens
DAYPEIEKF

SEQ ID NO: 89287 - protein, 9 aa, Homo Sapiens
DAYTHLETF

SEQ ID NO: 89288 - protein, 9 aa, Homo Sapiens
DLWLEREVF

SEQ ID NO: 89289 - protein, 9 aa, Homo Sapiens
DPFIDLNYM

SEQ ID NO: 89290 - protein, 9 aa, Homo Sapiens
DPFKDIILY

SEQ ID NO: 89291 - protein, 9 aa, Homo Sapiens
DPFPDHVVF

SEQ ID NO: 89292 - protein, 9 aa, Homo Sapiens
DPFRDLHSL

SEQ ID NO: 89293 - protein, 9 aa, Homo Sapiens
DPFVDRIGY

SEQ ID NO: 89294 - protein, 9 aa, Homo Sapiens
DPFVGSDPF

SEQ ID NO: 89295 - protein, 9 aa, Homo Sapiens
DPHQQIYTF

SEQ ID NO: 89296 - protein, 9 aa, Homo Sapiens
DPHTVTVSM

SEQ ID NO: 89297 - protein, 9 aa, Homo Sapiens
DPNLEFVAM

SEQ ID NO: 89298 - protein, 9 aa, Homo Sapiens
DPVEPHGEM

SEQ ID NO: 89299 - protein, 9 aa, Homo Sapiens
DPWIGKLLY

SEQ ID NO: 89300 - protein, 9 aa, Homo Sapiens
DPYCFVEFY

SEQ ID NO: 89301 - protein, 9 aa, Homo Sapiens
DSNGAILVY

SEQ ID NO: 89302 - protein, 9 aa, Homo Sapiens
DVSPVVSTY

SEQ ID NO: 89303 - protein, 9 aa, Homo Sapiens
EAAPHDIGY

SEQ ID NO: 89304 - protein, 9 aa, Homo Sapiens
EAAPPGELY

SEQ ID NO: 89305 - protein, 9 aa, Homo Sapiens
EAASVPVVY

SEQ ID NO: 89306 - protein, 9 aa, Homo Sapiens
EAAVAIKAM

SEQ ID NO: 89307 - protein, 9 aa, Homo Sapiens
EAFLDVGEY

SEQ ID NO: 89308 - protein, 9 aa, Homo Sapiens
EAFLNNQEY

SEQ ID NO: 89309 - protein, 9 aa, Homo Sapiens
EAFRGVHRY

SEQ ID NO: 89310 - protein, 9 aa, Homo Sapiens
EAFSPVYKY

SEQ ID NO: 89311 - protein, 9 aa, Homo Sapiens
EAIGAVIHY

SEQ ID NO: 89312 - protein, 9 aa, Homo Sapiens
EALDHMVEY

SEQ ID NO: 89313 - protein, 9 aa, Homo Sapiens
EALSLAHTY

SEQ ID NO: 89314 - protein, 9 aa, Homo Sapiens
EANAIALKY

SEQ ID NO: 89315 - protein, 9 aa, Homo Sapiens
EAQPIVTKY

SEQ ID NO: 89316 - protein, 9 aa, Homo Sapiens
EASAVTVRF

SEQ ID NO: 89317 - protein, 9 aa, Homo Sapiens
EAVDVTPVM

SEQ ID NO: 89318 - protein, 9 aa, Homo Sapiens
EAVKPTVGM

SEQ ID NO: 89319 - protein, 9 aa, Homo Sapiens
EAVKQYSSY

SEQ ID NO: 89320 - protein, 9 aa, Homo Sapiens
EAYIDPIAM

SEQ ID NO: 89321 - protein, 9 aa, Homo Sapiens
EAYNAVVRY

SEQ ID NO: 89322 - protein, 9 aa, Homo Sapiens
EAYPDHTQF

SEQ ID NO: 89323 - protein, 9 aa, Homo Sapiens
EAYTDHATY

SEQ ID NO: 89324 - protein, 9 aa, Homo Sapiens
EPCPSNYKY

SEQ ID NO: 89325 - protein, 9 aa, Homo Sapiens
EPFHLIVSY

SEQ ID NO: 89326 - protein, 9 aa, Homo Sapiens
EPFLFVDEF

SEQ ID NO: 89327 - protein, 9 aa, Homo Sapiens
EPFNFQMVY

SEQ ID NO: 89328 - protein, 9 aa, Homo Sapiens
EPFQDGYSL

SEQ ID NO: 89329 - protein, 9 aa, Homo Sapiens
EPIYIITEY

SEQ ID NO: 89330 - protein, 9 aa, Homo Sapiens
EPIYIVTEY

SEQ ID NO: 89331 - protein, 9 aa, Homo Sapiens
EPNPDDPLM

SEQ ID NO: 89332 - protein, 9 aa, Homo Sapiens
EPNSYAISF

SEQ ID NO: 89333 - protein, 9 aa, Homo Sapiens
EPSFITESY

SEQ ID NO: 89334 - protein, 9 aa, Homo Sapiens
EPTAAAIAY

SEQ ID NO: 89335 - protein, 9 aa, Homo Sapiens
EPVDISTAM

SEQ ID NO: 89336 - protein, 9 aa, Homo Sapiens
EPVELAQEF

SEQ ID NO: 89337 - protein, 9 aa, Homo Sapiens
ESSSVVLRY

SEQ ID NO: 89338 - protein, 9 aa, Homo Sapiens
EVFPLAMNY

SEQ ID NO: 89339 - protein, 9 aa, Homo Sapiens
EVIPYTPAM

SEQ ID NO: 89340 - protein, 9 aa, Homo Sapiens
EVLGILRYI

SEQ ID NO: 89341 - protein, 9 aa, Homo Sapiens
EVYAGSHQY

SEQ ID NO: 89342 - protein, 9 aa, Homo Sapiens
FAADIISVL

SEQ ID NO: 89343 - protein, 9 aa, Homo Sapiens
FAAHLRCTY

SEQ ID NO: 89344 - protein, 9 aa, Homo Sapiens
FAANVYEAF

SEQ ID NO: 89345 - protein, 9 aa, Homo Sapiens
FADGFVLVY

SEQ ID NO: 89346 - protein, 9 aa, Homo Sapiens
FADPHGKVF

SEQ ID NO: 89347 - protein, 9 aa, Homo Sapiens
FAEMIQPEY

SEQ ID NO: 89348 - protein, 9 aa, Homo Sapiens
FAFDPSVNY

SEQ ID NO: 89349 - protein, 9 aa, Homo Sapiens
FAFEHSEEY

SEQ ID NO: 89350 - protein, 9 aa, Homo Sapiens
FAFQEDDSF

SEQ ID NO: 89351 - protein, 9 aa, Homo Sapiens
FAHDDSVMY

SEQ ID NO: 89352 - protein, 9 aa, Homo Sapiens
FANIDQETY

SEQ ID NO: 89353 - protein, 9 aa, Homo Sapiens
FANVEEHSF

SEQ ID NO: 89354 - protein, 9 aa, Homo Sapiens
FAQPGSFEY

SEQ ID NO: 89355 - protein, 9 aa, Homo Sapiens
FASHVSPEV

SEQ ID NO: 89356 - protein, 9 aa, Homo Sapiens
FAYKDYLSF

SEQ ID NO: 89357 - protein, 9 aa, Homo Sapiens
FLWCEVEKY

SEQ ID NO: 89358 - protein, 9 aa, Homo Sapiens
FPAAPAPKM

SEQ ID NO: 89359 - protein, 9 aa, Homo Sapiens
FPAAPIPTL

SEQ ID NO: 89360 - protein, 9 aa, Homo Sapiens
FPAEKESEW

SEQ ID NO: 89361 - protein, 9 aa, Homo Sapiens
FPAELGIVF

SEQ ID NO: 89362 - protein, 9 aa, Homo Sapiens
FPAEQYYRF

SEQ ID NO: 89363 - protein, 9 aa, Homo Sapiens
FPAGIVRVF

SEQ ID NO: 89364 - protein, 9 aa, Homo Sapiens
FPAGKVPAF

SEQ ID NO: 89365 - protein, 9 aa, Homo Sapiens
FPAHILDCL

SEQ ID NO: 89366 - protein, 9 aa, Homo Sapiens
FPAKVTAHW

SEQ ID NO: 89367 - protein, 9 aa, Homo Sapiens
FPALAPLTY

SEQ ID NO: 89368 - protein, 9 aa, Homo Sapiens
FPALPGSSY

SEQ ID NO: 89369 - protein, 9 aa, Homo Sapiens
FPANIQVVY

SEQ ID NO: 89370 - protein, 9 aa, Homo Sapiens
FPANNIVKF

SEQ ID NO: 89371 - protein, 9 aa, Homo Sapiens
FPASPPKGY

SEQ ID NO: 89372 - protein, 9 aa, Homo Sapiens
FPASSGVSH

SEQ ID NO: 89373 - protein, 9 aa, Homo Sapiens
FPASVHDSL

SEQ ID NO: 89374 - protein, 9 aa, Homo Sapiens
FPATPLLDY

SEQ ID NO: 89375 - protein, 9 aa, Homo Sapiens
FPDETHERY

SEQ ID NO: 89376 - protein, 9 aa, Homo Sapiens
FPDHSLLAI

SEQ ID NO: 89377 - protein, 9 aa, Homo Sapiens
FPDKPITQY

SEQ ID NO: 89378 - protein, 9 aa, Homo Sapiens
FPDQNFEVM

SEQ ID NO: 89379 - protein, 9 aa, Homo Sapiens
FPEEDKKTY

SEQ ID NO: 89380 - protein, 9 aa, Homo Sapiens
FPEELTQTF

SEQ ID NO: 89381 - protein, 9 aa, Homo Sapiens
FPEEVIATI

SEQ ID NO: 89382 - protein, 9 aa, Homo Sapiens
FPEGLFYEF

SEQ ID NO: 89383 - protein, 9 aa, Homo Sapiens
FPEGSVELY

SEQ ID NO: 89384 - protein, 9 aa, Homo Sapiens
FPEHIFPAL

SEQ ID NO: 89385 - protein, 9 aa, Homo Sapiens
FPEIDLEKY

SEQ ID NO: 89386 - protein, 9 aa, Homo Sapiens
FPEIHVAQY

SEQ ID NO: 89387 - protein, 9 aa, Homo Sapiens
FPEIVAPLL

SEQ ID NO: 89388 - protein, 9 aa, Homo Sapiens
FPEPEHSSF

SEQ ID NO: 89389 - protein, 9 aa, Homo Sapiens
FPEPNPRVI

SEQ ID NO: 89390 - protein, 9 aa, Homo Sapiens
FPESCNHVF

SEQ ID NO: 89391 - protein, 9 aa, Homo Sapiens
FPETKAEKY

SEQ ID NO: 89392 - protein, 9 aa, Homo Sapiens
FPFAVANQL

SEQ ID NO: 89393 - protein, 9 aa, Homo Sapiens
FPFDVAVKF

SEQ ID NO: 89394 - protein, 9 aa, Homo Sapiens
FPFEDITQH

SEQ ID NO: 89395 - protein, 9 aa, Homo Sapiens
FPFEQQSEF

SEQ ID NO: 89396 - protein, 9 aa, Homo Sapiens
FPFFDIAHY

SEQ ID NO: 89397 - protein, 9 aa, Homo Sapiens
FPFHSAPAL

SEQ ID NO: 89398 - protein, 9 aa, Homo Sapiens
FPFKPPSIY

SEQ ID NO: 89399 - protein, 9 aa, Homo Sapiens
FPFLDENVV

SEQ ID NO: 89400 - protein, 9 aa, Homo Sapiens
FPGACGLRY

SEQ ID NO: 89401 - protein, 9 aa, Homo Sapiens
FPGPFEEEM

SEQ ID NO: 89402 - protein, 9 aa, Homo Sapiens
FPHDNVEDL

SEQ ID NO: 89403 - protein, 9 aa, Homo Sapiens
FPHGDLTEF

SEQ ID NO: 89404 - protein, 9 aa, Homo Sapiens
FPHHEFVAL

SEQ ID NO: 89405 - protein, 9 aa, Homo Sapiens
FPHLLQPVL

SEQ ID NO: 89406 - protein, 9 aa, Homo Sapiens
FPHLQQPSF

SEQ ID NO: 89407 - protein, 9 aa, Homo Sapiens
FPHPHIHEY

SEQ ID NO: 89408 - protein, 9 aa, Homo Sapiens
FPHRQPLRY

SEQ ID NO: 89409 - protein, 9 aa, Homo Sapiens
FPHSAHQKY

SEQ ID NO: 89410 - protein, 9 aa, Homo Sapiens
FPHSMEPQL

SEQ ID NO: 89411 - protein, 9 aa, Homo Sapiens
FPHVPHPSM

SEQ ID NO: 89412 - protein, 9 aa, Homo Sapiens
FPHVQTDVL

SEQ ID NO: 89413 - protein, 9 aa, Homo Sapiens
FPHYGFPTY

SEQ ID NO: 89414 - protein, 9 aa, Homo Sapiens
FPIDKPPSF

SEQ ID NO: 89415 - protein, 9 aa, Homo Sapiens
FPIEVRHYL

SEQ ID NO: 89416 - protein, 9 aa, Homo Sapiens
FPIEYHDIW

SEQ ID NO: 89417 - protein, 9 aa, Homo Sapiens
FPIHLTDQL

SEQ ID NO: 89418 - protein, 9 aa, Homo Sapiens
FPIHVQTSL

SEQ ID NO: 89419 - protein, 9 aa, Homo Sapiens
FPIPDLQKY

SEQ ID NO: 89420 - protein, 9 aa, Homo Sapiens
FPIPGEPGF

SEQ ID NO: 89421 - protein, 9 aa, Homo Sapiens
FPIPLINRL

SEQ ID NO: 89422 - protein, 9 aa, Homo Sapiens
FPITDVLQM

SEQ ID NO: 89423 - protein, 9 aa, Homo Sapiens
FPLDKAVAY

SEQ ID NO: 89424 - protein, 9 aa, Homo Sapiens
FPLEAITAF

SEQ ID NO: 89425 - protein, 9 aa, Homo Sapiens
FPLHLPLEL

SEQ ID NO: 89426 - protein, 9 aa, Homo Sapiens
FPLIPQEAF

SEQ ID NO: 89427 - protein, 9 aa, Homo Sapiens
FPLMTIEEF

SEQ ID NO: 89428 - protein, 9 aa, Homo Sapiens
FPLPGLPDF

SEQ ID NO: 89429 - protein, 9 aa, Homo Sapiens
FPLSHLDAL

SEQ ID NO: 89430 - protein, 9 aa, Homo Sapiens
FPMEIRQYL

SEQ ID NO: 89431 - protein, 9 aa, Homo Sapiens
FPMTMDEKY

SEQ ID NO: 89432 - protein, 9 aa, Homo Sapiens
FPNAIEHTL

SEQ ID NO: 89433 - protein, 9 aa, Homo Sapiens
FPNDPHVQY

SEQ ID NO: 89434 - protein, 9 aa, Homo Sapiens
FPNEFIVET

SEQ ID NO: 89435 - protein, 9 aa, Homo Sapiens
FPNENQVVF

SEQ ID NO: 89436 - protein, 9 aa, Homo Sapiens
FPNIGVEKF

SEQ ID NO: 89437 - protein, 9 aa, Homo Sapiens
FPNIPGKSL

SEQ ID NO: 89438 - protein, 9 aa, Homo Sapiens
FPNKQGYVL

SEQ ID NO: 89439 - protein, 9 aa, Homo Sapiens
FPNVSSFEW

SEQ ID NO: 89440 - protein, 9 aa, Homo Sapiens
FPPREIVTY

SEQ ID NO: 89441 - protein, 9 aa, Homo Sapiens
FPQEGMHQM

SEQ ID NO: 89442 - protein, 9 aa, Homo Sapiens
FPQIEINKM

SEQ ID NO: 89443 - protein, 9 aa, Homo Sapiens
FPQIGQIQY

SEQ ID NO: 89444 - protein, 9 aa, Homo Sapiens
FPQKPIQRY

SEQ ID NO: 89445 - protein, 9 aa, Homo Sapiens
FPQLDSTSF

SEQ ID NO: 89446 - protein, 9 aa, Homo Sapiens
FPQPEKESF

SEQ ID NO: 89447 - protein, 9 aa, Homo Sapiens
FPQTALVSF

SEQ ID NO: 89448 - protein, 9 aa, Homo Sapiens
FPRDPEIEM

SEQ ID NO: 89449 - protein, 9 aa, Homo Sapiens
FPRHIEPEL

SEQ ID NO: 89450 - protein, 9 aa, Homo Sapiens
FPSAKDPTW

SEQ ID NO: 89451 - protein, 9 aa, Homo Sapiens
FPSGETIVM

SEQ ID NO: 89452 - protein, 9 aa, Homo Sapiens
FPSGSVHSF

SEQ ID NO: 89453 - protein, 9 aa, Homo Sapiens
FPSIYDVKY

SEQ ID NO: 89454 - protein, 9 aa, Homo Sapiens
FPSNFIKEL

SEQ ID NO: 89455 - protein, 9 aa, Homo Sapiens
FPSPIRLEF

SEQ ID NO: 89456 - protein, 9 aa, Homo Sapiens
FPSPNQITL

SEQ ID NO: 89457 - protein, 9 aa, Homo Sapiens
FPSTAEHTL

SEQ ID NO: 89458 - protein, 9 aa, Homo Sapiens
FPTVQHQEL

SEQ ID NO: 89459 - protein, 9 aa, Homo Sapiens
FPTYPVPHY

SEQ ID NO: 89460 - protein, 9 aa, Homo Sapiens
FPVEHVQLL

SEQ ID NO: 89461 - protein, 9 aa, Homo Sapiens
FPVEIKSFY

SEQ ID NO: 89462 - protein, 9 aa, Homo Sapiens
FPVEKQLDL

SEQ ID NO: 89463 - protein, 9 aa, Homo Sapiens
FPVELNTVY

SEQ ID NO: 89464 - protein, 9 aa, Homo Sapiens
FPVEVNTVL

SEQ ID NO: 89465 - protein, 9 aa, Homo Sapiens
FPVGDVNNF

SEQ ID NO: 89466 - protein, 9 aa, Homo Sapiens
FPVGPGTGF

SEQ ID NO: 89467 - protein, 9 aa, Homo Sapiens
FPVGRVHRL

SEQ ID NO: 89468 - protein, 9 aa, Homo Sapiens
FPVIYDVKY

SEQ ID NO: 89469 - protein, 9 aa, Homo Sapiens
FPVLNVTRY

SEQ ID NO: 89470 - protein, 9 aa, Homo Sapiens
FPVPKPIDY

SEQ ID NO: 89471 - protein, 9 aa, Homo Sapiens
FPVPKPILY

SEQ ID NO: 89472 - protein, 9 aa, Homo Sapiens
FPVSKTLVL

SEQ ID NO: 89473 - protein, 9 aa, Homo Sapiens
FPVTPVSTL

SEQ ID NO: 89474 - protein, 9 aa, Homo Sapiens
FPWDIDEAL

SEQ ID NO: 89475 - protein, 9 aa, Homo Sapiens
FPWPSLRTY

SEQ ID NO: 89476 - protein, 9 aa, Homo Sapiens
FPYGDASKF

SEQ ID NO: 89477 - protein, 9 aa, Homo Sapiens
FPYGTTVTY

SEQ ID NO: 89478 - protein, 9 aa, Homo Sapiens
FPYPFQVVY

SEQ ID NO: 89479 - protein, 9 aa, Homo Sapiens
FSNPYSIEY

SEQ ID NO: 89480 - protein, 9 aa, Homo Sapiens
FVAEQKVEY

SEQ ID NO: 89481 - protein, 9 aa, Homo Sapiens
FVNDDRHVM

SEQ ID NO: 89482 - protein, 9 aa, Homo Sapiens
FVNDYILYY

SEQ ID NO: 89483 - protein, 9 aa, Homo Sapiens
FVNPGVVEF

SEQ ID NO: 89484 - protein, 9 aa, Homo Sapiens
FVNPHVSSF

SEQ ID NO: 89485 - protein, 9 aa, Homo Sapiens
FVNPTSFVY

SEQ ID NO: 89486 - protein, 9 aa, Homo Sapiens
FVSGVKIFY

SEQ ID NO: 89487 - protein, 9 aa, Homo Sapiens
FVVEQVESY

SEQ ID NO: 89488 - protein, 9 aa, Homo Sapiens
GAAGVHFIY

SEQ ID NO: 89489 - protein, 9 aa, Homo Sapiens
GAHGIIVVY

SEQ ID NO: 89490 - protein, 9 aa, Homo Sapiens
GQKPWSQHY

SEQ ID NO: 89491 - protein, 9 aa, Homo Sapiens
GQNPFELAF

SEQ ID NO: 89492 - protein, 9 aa, Homo Sapiens
GQTKPVVVY

SEQ ID NO: 89493 - protein, 9 aa, Homo Sapiens
GVTHICPVY

SEQ ID NO: 89494 - protein, 9 aa, Homo Sapiens
HAADVFEAY

SEQ ID NO: 89495 - protein, 9 aa, Homo Sapiens
HAAGFAYTY

SEQ ID NO: 89496 - protein, 9 aa, Homo Sapiens
HAAHIISEL

SEQ ID NO: 89497 - protein, 9 aa, Homo Sapiens
HAAMLGLMY

SEQ ID NO: 89498 - protein, 9 aa, Homo Sapiens
HAAPCMLFM

SEQ ID NO: 89499 - protein, 9 aa, Homo Sapiens
HAAPFQNIL

SEQ ID NO: 89500 - protein, 9 aa, Homo Sapiens
HAAVDRWQY

SEQ ID NO: 89501 - protein, 9 aa, Homo Sapiens
HAAVPTPGY

SEQ ID NO: 89502 - protein, 9 aa, Homo Sapiens
HACGVIATI

SEQ ID NO: 89503 - protein, 9 aa, Homo Sapiens
HACLAVAVL

SEQ ID NO: 89504 - protein, 9 aa, Homo Sapiens
HACSSIIKM

SEQ ID NO: 89505 - protein, 9 aa, Homo Sapiens
HADDSFLVL

SEQ ID NO: 89506 - protein, 9 aa, Homo Sapiens
HADGTIVRY

SEQ ID NO: 89507 - protein, 9 aa, Homo Sapiens
HADPRIQGY

SEQ ID NO: 89508 - protein, 9 aa, Homo Sapiens
HADSNIVIM

SEQ ID NO: 89509 - protein, 9 aa, Homo Sapiens
HAFVDLHEF

SEQ ID NO: 89510 - protein, 9 aa, Homo Sapiens
HAFVELHEF

SEQ ID NO: 89511 - protein, 9 aa, Homo Sapiens
HAFVTEVAY

SEQ ID NO: 89512 - protein, 9 aa, Homo Sapiens
HAGEAIPAL

SEQ ID NO: 89513 - protein, 9 aa, Homo Sapiens
HAHVDKVTY

SEQ ID NO: 89514 - protein, 9 aa, Homo Sapiens
HAIDIICGF

SEQ ID NO: 89515 - protein, 9 aa, Homo Sapiens
HAIKVGVKY

SEQ ID NO: 89516 - protein, 9 aa, Homo Sapiens
HAIPPTAIM

SEQ ID NO: 89517 - protein, 9 aa, Homo Sapiens
HAIPPTLAM

SEQ ID NO: 89518 - protein, 9 aa, Homo Sapiens
HAIQDLLVF

SEQ ID NO: 89519 - protein, 9 aa, Homo Sapiens
HAIRLLLEY

SEQ ID NO: 89520 - protein, 9 aa, Homo Sapiens
HAISCVEMY

SEQ ID NO: 89521 - protein, 9 aa, Homo Sapiens
HALERLFTM

SEQ ID NO: 89522 - protein, 9 aa, Homo Sapiens
HALSLKIVL

SEQ ID NO: 89523 - protein, 9 aa, Homo Sapiens
HANDQTVIF

SEQ ID NO: 89524 - protein, 9 aa, Homo Sapiens
HANVVVYSY

SEQ ID NO: 89525 - protein, 9 aa, Homo Sapiens
HAQGFALTY

SEQ ID NO: 89526 - protein, 9 aa, Homo Sapiens
HASVYQITY

SEQ ID NO: 89527 - protein, 9 aa, Homo Sapiens
HATFNDPVM

SEQ ID NO: 89528 - protein, 9 aa, Homo Sapiens
HATTALLHY

SEQ ID NO: 89529 - protein, 9 aa, Homo Sapiens
HATTIQPEF

SEQ ID NO: 89530 - protein, 9 aa, Homo Sapiens
HAVAVTESY

SEQ ID NO: 89531 - protein, 9 aa, Homo Sapiens
HAVEISAVH

SEQ ID NO: 89532 - protein, 9 aa, Homo Sapiens
HAVEWPVVM

SEQ ID NO: 89533 - protein, 9 aa, Homo Sapiens
HAVGNVELY

SEQ ID NO: 89534 - protein, 9 aa, Homo Sapiens
HAVGPSTAM

SEQ ID NO: 89535 - protein, 9 aa, Homo Sapiens
HAVHVALVL

SEQ ID NO: 89536 - protein, 9 aa, Homo Sapiens
HAVIDINAF

SEQ ID NO: 89537 - protein, 9 aa, Homo Sapiens
HAVPIYEGF

SEQ ID NO: 89538 - protein, 9 aa, Homo Sapiens
HAVQTVETM

SEQ ID NO: 89539 - protein, 9 aa, Homo Sapiens
HAVSPIAKY

SEQ ID NO: 89540 - protein, 9 aa, Homo Sapiens
HAVVNLINY

SEQ ID NO: 89541 - protein, 9 aa, Homo Sapiens
HAVVTVPAY

SEQ ID NO: 89542 - protein, 9 aa, Homo Sapiens
HGFGNVHAY

SEQ ID NO: 89543 - protein, 9 aa, Homo Sapiens
HGIDPTGTY

SEQ ID NO: 89544 - protein, 9 aa, Homo Sapiens
HIMEIFSTY

SEQ ID NO: 89545 - protein, 9 aa, Homo Sapiens
HPAAKMIVM

SEQ ID NO: 89546 - protein, 9 aa, Homo Sapiens
HPAGCMSQF

SEQ ID NO: 89547 - protein, 9 aa, Homo Sapiens
HPAIALREY

SEQ ID NO: 89548 - protein, 9 aa, Homo Sapiens
HPAPPPSNY

SEQ ID NO: 89549 - protein, 9 aa, Homo Sapiens
HPATVFILF

SEQ ID NO: 89550 - protein, 9 aa, Homo Sapiens
HPCLYILTF

SEQ ID NO: 89551 - protein, 9 aa, Homo Sapiens
HPDEPLYSF

SEQ ID NO: 89552 - protein, 9 aa, Homo Sapiens
HPDKKIVAY

SEQ ID NO: 89553 - protein, 9 aa, Homo Sapiens
HPDLPLAVY

SEQ ID NO: 89554 - protein, 9 aa, Homo Sapiens
HPDQAQAIL

SEQ ID NO: 89555 - protein, 9 aa, Homo Sapiens
HPDRSQPAF

SEQ ID NO: 89556 - protein, 9 aa, Homo Sapiens
HPDSRAIMY

SEQ ID NO: 89557 - protein, 9 aa, Homo Sapiens
HPDVLPFAL

SEQ ID NO: 89558 - protein, 9 aa, Homo Sapiens
HPEIDNPEY

SEQ ID NO: 89559 - protein, 9 aa, Homo Sapiens
HPEKLATVL

SEQ ID NO: 89560 - protein, 9 aa, Homo Sapiens
HPELQALIY

SEQ ID NO: 89561 - protein, 9 aa, Homo Sapiens
HPEPTDHVL

SEQ ID NO: 89562 - protein, 9 aa, Homo Sapiens
HPESVSQSL

SEQ ID NO: 89563 - protein, 9 aa, Homo Sapiens
HPFAPPICF

SEQ ID NO: 89564 - protein, 9 aa, Homo Sapiens
HPFENMVAF

SEQ ID NO: 89565 - protein, 9 aa, Homo Sapiens
HPFEVPREY

SEQ ID NO: 89566 - protein, 9 aa, Homo Sapiens
HPFFVGVQY

SEQ ID NO: 89567 - protein, 9 aa, Homo Sapiens
HPFHILIAL

SEQ ID NO: 89568 - protein, 9 aa, Homo Sapiens
HPFIDDYQY

SEQ ID NO: 89569 - protein, 9 aa, Homo Sapiens
HPFKFSDHY

SEQ ID NO: 89570 - protein, 9 aa, Homo Sapiens
HPFKIFTKM

SEQ ID NO: 89571 - protein, 9 aa, Homo Sapiens
HPFPCPTSY

SEQ ID NO: 89572 - protein, 9 aa, Homo Sapiens
HPFQERHVY

SEQ ID NO: 89573 - protein, 9 aa, Homo Sapiens
HPGQISAGY

SEQ ID NO: 89574 - protein, 9 aa, Homo Sapiens
HPGSFDVVH

SEQ ID NO: 89575 - protein, 9 aa, Homo Sapiens
HPGSSALHY

SEQ ID NO: 89576 - protein, 9 aa, Homo Sapiens
HPHDLVILM

SEQ ID NO: 89577 - protein, 9 aa, Homo Sapiens
HPHKIIVMY

SEQ ID NO: 89578 - protein, 9 aa, Homo Sapiens
HPHLVAEAF

SEQ ID NO: 89579 - protein, 9 aa, Homo Sapiens
HPHLVAEAY

SEQ ID NO: 89580 - protein, 9 aa, Homo Sapiens
HPHPEDIKF

SEQ ID NO: 89581 - protein, 9 aa, Homo Sapiens
HPHPVVPKM

SEQ ID NO: 89582 - protein, 9 aa, Homo Sapiens
HPIDRSVDF

SEQ ID NO: 89583 - protein, 9 aa, Homo Sapiens
HPIEVSVGH

SEQ ID NO: 89584 - protein, 9 aa, Homo Sapiens
HPIHADNCL

SEQ ID NO: 89585 - protein, 9 aa, Homo Sapiens
HPIKQVDVL

SEQ ID NO: 89586 - protein, 9 aa, Homo Sapiens
HPILNDPIY

SEQ ID NO: 89587 - protein, 9 aa, Homo Sapiens
HPIPGEYKF

SEQ ID NO: 89588 - protein, 9 aa, Homo Sapiens
HPIQTQAQY

SEQ ID NO: 89589 - protein, 9 aa, Homo Sapiens
HPIRIADGY

SEQ ID NO: 89590 - protein, 9 aa, Homo Sapiens
HPIRLFCRY

SEQ ID NO: 89591 - protein, 9 aa, Homo Sapiens
HPIRVVNAL

SEQ ID NO: 89592 - protein, 9 aa, Homo Sapiens
HPLDLQSAL

SEQ ID NO: 89593 - protein, 9 aa, Homo Sapiens
HPLDLRVQF

SEQ ID NO: 89594 - protein, 9 aa, Homo Sapiens
HPLDYELTY

SEQ ID NO: 89595 - protein, 9 aa, Homo Sapiens
HPLEGTHEL

SEQ ID NO: 89596 - protein, 9 aa, Homo Sapiens
HPLGDIVAF

SEQ ID NO: 89597 - protein, 9 aa, Homo Sapiens
HPLGVLSAF

SEQ ID NO: 89598 - protein, 9 aa, Homo Sapiens
HPLINPVAF

SEQ ID NO: 89599 - protein, 9 aa, Homo Sapiens
HPLLKTLEY

SEQ ID NO: 89600 - protein, 9 aa, Homo Sapiens
HPLSNPAEL

SEQ ID NO: 89601 - protein, 9 aa, Homo Sapiens
HPLTQSAVM

SEQ ID NO: 89602 - protein, 9 aa, Homo Sapiens
HPMAYQLQL

SEQ ID NO: 89603 - protein, 9 aa, Homo Sapiens
HPMDHPSAF

SEQ ID NO: 89604 - protein, 9 aa, Homo Sapiens
HPMGGLNAM

SEQ ID NO: 89605 - protein, 9 aa, Homo Sapiens
HPMNSISSL

SEQ ID NO: 89606 - protein, 9 aa, Homo Sapiens
HPNDDDVHF

SEQ ID NO: 89607 - protein, 9 aa, Homo Sapiens
HPNEGALVL

SEQ ID NO: 89608 - protein, 9 aa, Homo Sapiens
HPNGLQVMY

SEQ ID NO: 89609 - protein, 9 aa, Homo Sapiens
HPNPIPSGL

SEQ ID NO: 89610 - protein, 9 aa, Homo Sapiens
HPNTIQEYM

SEQ ID NO: 89611 - protein, 9 aa, Homo Sapiens
HPPHYFFTY

SEQ ID NO: 89612 - protein, 9 aa, Homo Sapiens
HPQDSAFSY

SEQ ID NO: 89613 - protein, 9 aa, Homo Sapiens
HPQEVYNEY

SEQ ID NO: 89614 - protein, 9 aa, Homo Sapiens
HPQFVTDVM

SEQ ID NO: 89615 - protein, 9 aa, Homo Sapiens
HPQIIIRAF

SEQ ID NO: 89616 - protein, 9 aa, Homo Sapiens
HPQPGAVEL

SEQ ID NO: 89617 - protein, 9 aa, Homo Sapiens
HPQQKVAVY

SEQ ID NO: 89618 - protein, 9 aa, Homo Sapiens
HPQYEVVEI

SEQ ID NO: 89619 - protein, 9 aa, Homo Sapiens
HPRIITEGF

SEQ ID NO: 89620 - protein, 9 aa, Homo Sapiens
HPSALSSVY

SEQ ID NO: 89621 - protein, 9 aa, Homo Sapiens
HPSDIEVDL

SEQ ID NO: 89622 - protein, 9 aa, Homo Sapiens
HPSESLEKM

SEQ ID NO: 89623 - protein, 9 aa, Homo Sapiens
HPSGATPTL

SEQ ID NO: 89624 - protein, 9 aa, Homo Sapiens
HPSHVQPAY

SEQ ID NO: 89625 - protein, 9 aa, Homo Sapiens
HPSLQPEEY

SEQ ID NO: 89626 - protein, 9 aa, Homo Sapiens
HPSNVLHFF

SEQ ID NO: 89627 - protein, 9 aa, Homo Sapiens
HPSQHVMQY

SEQ ID NO: 89628 - protein, 9 aa, Homo Sapiens
HPSQTVELF

SEQ ID NO: 89629 - protein, 9 aa, Homo Sapiens
HPTADVQTF

SEQ ID NO: 89630 - protein, 9 aa, Homo Sapiens
HPTAFVVSY

SEQ ID NO: 89631 - protein, 9 aa, Homo Sapiens
HPTAHAPMM

SEQ ID NO: 89632 - protein, 9 aa, Homo Sapiens
HPTDPLTSF

SEQ ID NO: 89633 - protein, 9 aa, Homo Sapiens
HPTERCFVF

SEQ ID NO: 89634 - protein, 9 aa, Homo Sapiens
HPTIISESF

SEQ ID NO: 89635 - protein, 9 aa, Homo Sapiens
HPTLIQRTY

SEQ ID NO: 89636 - protein, 9 aa, Homo Sapiens
HPTPSPMAY

SEQ ID NO: 89637 - protein, 9 aa, Homo Sapiens
HPTSHVSLL

SEQ ID NO: 89638 - protein, 9 aa, Homo Sapiens
HPTSVISGY

SEQ ID NO: 89639 - protein, 9 aa, Homo Sapiens
HPTTISPRY

SEQ ID NO: 89640 - protein, 9 aa, Homo Sapiens
HPTVVISAY

SEQ ID NO: 89641 - protein, 9 aa, Homo Sapiens
HPVDFLDAF

SEQ ID NO: 89642 - protein, 9 aa, Homo Sapiens
HPVNLTWPF

SEQ ID NO: 89643 - protein, 9 aa, Homo Sapiens
HPVTGQFLY

SEQ ID NO: 89644 - protein, 9 aa, Homo Sapiens
HPVVGDLTY

SEQ ID NO: 89645 - protein, 9 aa, Homo Sapiens
HPVVSSVPL

SEQ ID NO: 89646 - protein, 9 aa, Homo Sapiens
HPWELFVKY

SEQ ID NO: 89647 - protein, 9 aa, Homo Sapiens
HPWGSSSSF

SEQ ID NO: 89648 - protein, 9 aa, Homo Sapiens
HPYIYRVTF

SEQ ID NO: 89649 - protein, 9 aa, Homo Sapiens
HPYPHNHYM

SEQ ID NO: 89650 - protein, 9 aa, Homo Sapiens
HPYQFLLKY

SEQ ID NO: 89651 - protein, 9 aa, Homo Sapiens
HPYQPDPKM

SEQ ID NO: 89652 - protein, 9 aa, Homo Sapiens
HSGPVIPVY

SEQ ID NO: 89653 - protein, 9 aa, Homo Sapiens
HSSSIVTAY

SEQ ID NO: 89654 - protein, 9 aa, Homo Sapiens
HVAQPDSVY

SEQ ID NO: 89655 - protein, 9 aa, Homo Sapiens
HVFPTFVAY

SEQ ID NO: 89656 - protein, 9 aa, Homo Sapiens
HVHHLINEY

SEQ ID NO: 89657 - protein, 9 aa, Homo Sapiens
HVICLAEEF

SEQ ID NO: 89658 - protein, 9 aa, Homo Sapiens
HVIDVKFLY

SEQ ID NO: 89659 - protein, 9 aa, Homo Sapiens
HVSLVQLTL

SEQ ID NO: 89660 - protein, 9 aa, Homo Sapiens
HVSTVNPNY

SEQ ID NO: 89661 - protein, 9 aa, Homo Sapiens
HVYEIPVEY

SEQ ID NO: 89662 - protein, 9 aa, Homo Sapiens
IAFFDVRTF

SEQ ID NO: 89663 - protein, 9 aa, Homo Sapiens
IAIDVIDAY

SEQ ID NO: 89664 - protein, 9 aa, Homo Sapiens
IAIPVTVAF

SEQ ID NO: 89665 - protein, 9 aa, Homo Sapiens
IALVHTDSY

SEQ ID NO: 89666 - protein, 9 aa, Homo Sapiens
IAMDLILKM

SEQ ID NO: 89667 - protein, 9 aa, Homo Sapiens
IANQVQLFY

SEQ ID NO: 89668 - protein, 9 aa, Homo Sapiens
IATAVITLF

SEQ ID NO: 89669 - protein, 9 aa, Homo Sapiens
ILGPPGSVY

SEQ ID NO: 89670 - protein, 9 aa, Homo Sapiens
INELMIYIF

SEQ ID NO: 89671 - protein, 9 aa, Homo Sapiens
IPAAPVPSL

SEQ ID NO: 89672 - protein, 9 aa, Homo Sapiens
IPAATTIAY

SEQ ID NO: 89673 - protein, 9 aa, Homo Sapiens
IPAAVKLTY

SEQ ID NO: 89674 - protein, 9 aa, Homo Sapiens
IPADIVFVL

SEQ ID NO: 89675 - protein, 9 aa, Homo Sapiens
IPADTFAAL

SEQ ID NO: 89676 - protein, 9 aa, Homo Sapiens
IPAEDMNAF

SEQ ID NO: 89677 - protein, 9 aa, Homo Sapiens
IPAEEIPAY

SEQ ID NO: 89678 - protein, 9 aa, Homo Sapiens
IPAESYTFF

SEQ ID NO: 89679 - protein, 9 aa, Homo Sapiens
IPAFTCEEY

SEQ ID NO: 89680 - protein, 9 aa, Homo Sapiens
IPCKSSPEL

SEQ ID NO: 89681 - protein, 9 aa, Homo Sapiens
IPCPTVVLL

SEQ ID NO: 89682 - protein, 9 aa, Homo Sapiens
IPDDLKQLY

SEQ ID NO: 89683 - protein, 9 aa, Homo Sapiens
IPDEQIVVM

SEQ ID NO: 89684 - protein, 9 aa, Homo Sapiens
IPDQVIRVF

SEQ ID NO: 89685 - protein, 9 aa, Homo Sapiens
IPEESQLVF

SEQ ID NO: 89686 - protein, 9 aa, Homo Sapiens
IPFEFPLHL

SEQ ID NO: 89687 - protein, 9 aa, Homo Sapiens
IPFGNNPIF

SEQ ID NO: 89688 - protein, 9 aa, Homo Sapiens
IPFNQALVF

SEQ ID NO: 89689 - protein, 9 aa, Homo Sapiens
IPFRPSIQF

SEQ ID NO: 89690 - protein, 9 aa, Homo Sapiens
IPFSGALEL

SEQ ID NO: 89691 - protein, 9 aa, Homo Sapiens
IPHMDIEAL

SEQ ID NO: 89692 - protein, 9 aa, Homo Sapiens
IPHTDPVDY

SEQ ID NO: 89693 - protein, 9 aa, Homo Sapiens
IPIANTEKY

SEQ ID NO: 89694 - protein, 9 aa, Homo Sapiens
IPIKAICDY

SEQ ID NO: 89695 - protein, 9 aa, Homo Sapiens
IPISAQLKY

SEQ ID NO: 89696 - protein, 9 aa, Homo Sapiens
IPISSELCY

SEQ ID NO: 89697 - protein, 9 aa, Homo Sapiens
IPLGEIISF

SEQ ID NO: 89698 - protein, 9 aa, Homo Sapiens
IPLPLIKSY

SEQ ID NO: 89699 - protein, 9 aa, Homo Sapiens
IPLRSSWVM

SEQ ID NO: 89700 - protein, 9 aa, Homo Sapiens
IPLTTFTPR

SEQ ID NO: 89701 - protein, 9 aa, Homo Sapiens
IPMEFVNKM

SEQ ID NO: 89702 - protein, 9 aa, Homo Sapiens
IPMQSEPQY

SEQ ID NO: 89703 - protein, 9 aa, Homo Sapiens
IPMSDPQVL

SEQ ID NO: 89704 - protein, 9 aa, Homo Sapiens
IPMTPTSSF

SEQ ID NO: 89705 - protein, 9 aa, Homo Sapiens
IPNEIIHAL

SEQ ID NO: 89706 - protein, 9 aa, Homo Sapiens
IPNENEAQF

SEQ ID NO: 89707 - protein, 9 aa, Homo Sapiens
IPNENELQF

SEQ ID NO: 89708 - protein, 9 aa, Homo Sapiens
IPNGVQIFF

SEQ ID NO: 89709 - protein, 9 aa, Homo Sapiens
IPNSIMTIL

SEQ ID NO: 89710 - protein, 9 aa, Homo Sapiens
IPPDVPILL

SEQ ID NO: 89711 - protein, 9 aa, Homo Sapiens
IPSPLQPEM

SEQ ID NO: 89712 - protein, 9 aa, Homo Sapiens
IPSSVPATF

SEQ ID NO: 89713 - protein, 9 aa, Homo Sapiens
IPTEQVNEL

SEQ ID NO: 89714 - protein, 9 aa, Homo Sapiens
IPTHHPRVY

SEQ ID NO: 89715 - protein, 9 aa, Homo Sapiens
IPTHTQPSY

SEQ ID NO: 89716 - protein, 9 aa, Homo Sapiens
IPTKQTQTF

SEQ ID NO: 89717 - protein, 9 aa, Homo Sapiens
IPTPPLPSY

SEQ ID NO: 89718 - protein, 9 aa, Homo Sapiens
IPTRVITNF

SEQ ID NO: 89719 - protein, 9 aa, Homo Sapiens
IPVAIRTQI

SEQ ID NO: 89720 - protein, 9 aa, Homo Sapiens
IPVDTVLTM

SEQ ID NO: 89721 - protein, 9 aa, Homo Sapiens
IPVEEPLPF

SEQ ID NO: 89722 - protein, 9 aa, Homo Sapiens
IPVIVTEQY

SEQ ID NO: 89723 - protein, 9 aa, Homo Sapiens
IPVPINAEL

SEQ ID NO: 89724 - protein, 9 aa, Homo Sapiens
IPVPYVEKY

SEQ ID NO: 89725 - protein, 9 aa, Homo Sapiens
IPVTIITGY

SEQ ID NO: 89726 - protein, 9 aa, Homo Sapiens
IPVTIMDVF

SEQ ID NO: 89727 - protein, 9 aa, Homo Sapiens
IPWDDLIAL

SEQ ID NO: 89728 - protein, 9 aa, Homo Sapiens
IPWKHIDYF

SEQ ID NO: 89729 - protein, 9 aa, Homo Sapiens
IPYEGFASL

SEQ ID NO: 89730 - protein, 9 aa, Homo Sapiens
IPYPLPPNY

SEQ ID NO: 89731 - protein, 9 aa, Homo Sapiens
IPYQDRESY

SEQ ID NO: 89732 - protein, 9 aa, Homo Sapiens
ISQPRILLY

SEQ ID NO: 89733 - protein, 9 aa, Homo Sapiens
ISSDTFITY

SEQ ID NO: 89734 - protein, 9 aa, Homo Sapiens
IVSQIAVAY

SEQ ID NO: 89735 - protein, 9 aa, Homo Sapiens
KPAPLTPAY

SEQ ID NO: 89736 - protein, 9 aa, Homo Sapiens
KPIESFNEY

SEQ ID NO: 89737 - protein, 9 aa, Homo Sapiens
LAAGVVSAM

SEQ ID NO: 89738 - protein, 9 aa, Homo Sapiens
LADLSCLVY

SEQ ID NO: 89739 - protein, 9 aa, Homo Sapiens
LAHQHVVGF

SEQ ID NO: 89740 - protein, 9 aa, Homo Sapiens
LALEPGVAY

SEQ ID NO: 89741 - protein, 9 aa, Homo Sapiens
LAMVEAISY

SEQ ID NO: 89742 - protein, 9 aa, Homo Sapiens
LAQQYYLVY

SEQ ID NO: 89743 - protein, 9 aa, Homo Sapiens
LAWLDEHTL

SEQ ID NO: 89744 - protein, 9 aa, Homo Sapiens
LDPVLQNPL

SEQ ID NO: 89745 - protein, 9 aa, Homo Sapiens
LIFSVPIVY

SEQ ID NO: 89746 - protein, 9 aa, Homo Sapiens
LPADHVSGY

SEQ ID NO: 89747 - protein, 9 aa, Homo Sapiens
LPADIQAQF

SEQ ID NO: 89748 - protein, 9 aa, Homo Sapiens
LPADVQNYY

SEQ ID NO: 89749 - protein, 9 aa, Homo Sapiens
LPADWAPLF

SEQ ID NO: 89750 - protein, 9 aa, Homo Sapiens
LPAEFFEVL

SEQ ID NO: 89751 - protein, 9 aa, Homo Sapiens
LPAEHQFSF

SEQ ID NO: 89752 - protein, 9 aa, Homo Sapiens
LPAGIVAVL

SEQ ID NO: 89753 - protein, 9 aa, Homo Sapiens
LPAKILVEF

SEQ ID NO: 89754 - protein, 9 aa, Homo Sapiens
LPALFTDLY

SEQ ID NO: 89755 - protein, 9 aa, Homo Sapiens
LPALPTQAL

SEQ ID NO: 89756 - protein, 9 aa, Homo Sapiens
LPAPPTQNM

SEQ ID NO: 89757 - protein, 9 aa, Homo Sapiens
LPAPSTKEY

SEQ ID NO: 89758 - protein, 9 aa, Homo Sapiens
LPAQGLIEF

SEQ ID NO: 89759 - protein, 9 aa, Homo Sapiens
LPAQLLELY

SEQ ID NO: 89760 - protein, 9 aa, Homo Sapiens
LPAQQVHNY

SEQ ID NO: 89761 - protein, 9 aa, Homo Sapiens
LPATATMSL

SEQ ID NO: 89762 - protein, 9 aa, Homo Sapiens
LPAYPTENF

SEQ ID NO: 89763 - protein, 9 aa, Homo Sapiens
LPCFEPYEF

SEQ ID NO: 89764 - protein, 9 aa, Homo Sapiens
LPCGASVIL

SEQ ID NO: 89765 - protein, 9 aa, Homo Sapiens
LPCKAEEIY

SEQ ID NO: 89766 - protein, 9 aa, Homo Sapiens
LPCKDAPEL

SEQ ID NO: 89767 - protein, 9 aa, Homo Sapiens
LPCPLLPSY

SEQ ID NO: 89768 - protein, 9 aa, Homo Sapiens
LPDEIYHVY

SEQ ID NO: 89769 - protein, 9 aa, Homo Sapiens
LPDKKTVHY

SEQ ID NO: 89770 - protein, 9 aa, Homo Sapiens
LPDNVHYVF

SEQ ID NO: 89771 - protein, 9 aa, Homo Sapiens
LPDPLQEPY

SEQ ID NO: 89772 - protein, 9 aa, Homo Sapiens
LPDPNLITF

SEQ ID NO: 89773 - protein, 9 aa, Homo Sapiens
LPDPNVQKY

SEQ ID NO: 89774 - protein, 9 aa, Homo Sapiens
LPDSGVVEY

SEQ ID NO: 89775 - protein, 9 aa, Homo Sapiens
LPDTLKVTY

SEQ ID NO: 89776 - protein, 9 aa, Homo Sapiens
LPDTRSEAY

SEQ ID NO: 89777 - protein, 9 aa, Homo Sapiens
LPEDRALYY

SEQ ID NO: 89778 - protein, 9 aa, Homo Sapiens
LPEDVGHCF

SEQ ID NO: 89779 - protein, 9 aa, Homo Sapiens
LPEEHARFY

SEQ ID NO: 89780 - protein, 9 aa, Homo Sapiens
LPESAPLIY

SEQ ID NO: 89781 - protein, 9 aa, Homo Sapiens
LPESTHVEF

SEQ ID NO: 89782 - protein, 9 aa, Homo Sapiens
LPFAEAEAF

SEQ ID NO: 89783 - protein, 9 aa, Homo Sapiens
LPFATPEEF

SEQ ID NO: 89784 - protein, 9 aa, Homo Sapiens
LPFDCTQAL

SEQ ID NO: 89785 - protein, 9 aa, Homo Sapiens
LPFDKETGF

SEQ ID NO: 89786 - protein, 9 aa, Homo Sapiens
LPFDLRASF

SEQ ID NO: 89787 - protein, 9 aa, Homo Sapiens
LPFDLRIPF

SEQ ID NO: 89788 - protein, 9 aa, Homo Sapiens
LPFEGKCYY

SEQ ID NO: 89789 - protein, 9 aa, Homo Sapiens
LPFFNDRPW

SEQ ID NO: 89790 - protein, 9 aa, Homo Sapiens
LPFFPIATY

SEQ ID NO: 89791 - protein, 9 aa, Homo Sapiens
LPFHFPGSF

SEQ ID NO: 89792 - protein, 9 aa, Homo Sapiens
LPFPIIQQY

SEQ ID NO: 89793 - protein, 9 aa, Homo Sapiens
LPFPKDASL

SEQ ID NO: 89794 - protein, 9 aa, Homo Sapiens
LPFPKIDPY

SEQ ID NO: 89795 - protein, 9 aa, Homo Sapiens
LPGSIQHVY

SEQ ID NO: 89796 - protein, 9 aa, Homo Sapiens
LPHAPGVQM

SEQ ID NO: 89797 - protein, 9 aa, Homo Sapiens
LPHDPDLAY

SEQ ID NO: 89798 - protein, 9 aa, Homo Sapiens
LPHELFQEF

SEQ ID NO: 89799 - protein, 9 aa, Homo Sapiens
LPHFDESTF

SEQ ID NO: 89800 - protein, 9 aa, Homo Sapiens
LPHFIKDDY

SEQ ID NO: 89801 - protein, 9 aa, Homo Sapiens
LPHGLIESF

SEQ ID NO: 89802 - protein, 9 aa, Homo Sapiens
LPHQPLATY

SEQ ID NO: 89803 - protein, 9 aa, Homo Sapiens
LPHSATVTL

SEQ ID NO: 89804 - protein, 9 aa, Homo Sapiens
LPHYEPIPF

SEQ ID NO: 89805 - protein, 9 aa, Homo Sapiens
LPIATVEEL

SEQ ID NO: 89806 - protein, 9 aa, Homo Sapiens
LPIDCSPAL

SEQ ID NO: 89807 - protein, 9 aa, Homo Sapiens
LPINHQIIY

SEQ ID NO: 89808 - protein, 9 aa, Homo Sapiens
LPIPDQQLY

SEQ ID NO: 89809 - protein, 9 aa, Homo Sapiens
LPIPSQPQF

SEQ ID NO: 89810 - protein, 9 aa, Homo Sapiens
LPIRFNLTY

SEQ ID NO: 89811 - protein, 9 aa, Homo Sapiens
LPKNDLITY

SEQ ID NO: 89812 - protein, 9 aa, Homo Sapiens
LPKTCDISF

SEQ ID NO: 89813 - protein, 9 aa, Homo Sapiens
LPLAHVLEL

SEQ ID NO: 89814 - protein, 9 aa, Homo Sapiens
LPLDIQIFY

SEQ ID NO: 89815 - protein, 9 aa, Homo Sapiens
LPLDTVTFY

SEQ ID NO: 89816 - protein, 9 aa, Homo Sapiens
LPLEEAYRF

SEQ ID NO: 89817 - protein, 9 aa, Homo Sapiens
LPLEEHYRF

SEQ ID NO: 89818 - protein, 9 aa, Homo Sapiens
LPLHVLPLY

SEQ ID NO: 89819 - protein, 9 aa, Homo Sapiens
LPLLDPWYF

SEQ ID NO: 89820 - protein, 9 aa, Homo Sapiens
LPLLKAQEY

SEQ ID NO: 89821 - protein, 9 aa, Homo Sapiens
LPLLPNVSY

SEQ ID NO: 89822 - protein, 9 aa, Homo Sapiens
LPLLSPVTF

SEQ ID NO: 89823 - protein, 9 aa, Homo Sapiens
LPLNSVYVY

SEQ ID NO: 89824 - protein, 9 aa, Homo Sapiens
LPLPDPLKY

SEQ ID NO: 89825 - protein, 9 aa, Homo Sapiens
LPLPEVQCF

SEQ ID NO: 89826 - protein, 9 aa, Homo Sapiens
LPLPLPMAL

SEQ ID NO: 89827 - protein, 9 aa, Homo Sapiens
LPLQDELAF

SEQ ID NO: 89828 - protein, 9 aa, Homo Sapiens
LPLQREPLY

SEQ ID NO: 89829 - protein, 9 aa, Homo Sapiens
LPLQTSHAL

SEQ ID NO: 89830 - protein, 9 aa, Homo Sapiens
LPLRFDLQY

SEQ ID NO: 89831 - protein, 9 aa, Homo Sapiens
LPLSIQEAY

SEQ ID NO: 89832 - protein, 9 aa, Homo Sapiens
LPLSLQTVF

SEQ ID NO: 89833 - protein, 9 aa, Homo Sapiens
LPLTARWEY

SEQ ID NO: 89834 - protein, 9 aa, Homo Sapiens
LPLTHFELY

SEQ ID NO: 89835 - protein, 9 aa, Homo Sapiens
LPMGVVVDY

SEQ ID NO: 89836 - protein, 9 aa, Homo Sapiens
LPMRMLEVF

SEQ ID NO: 89837 - protein, 9 aa, Homo Sapiens
LPNDGDEKY

SEQ ID NO: 89838 - protein, 9 aa, Homo Sapiens
LPNDKTLLY

SEQ ID NO: 89839 - protein, 9 aa, Homo Sapiens
LPNDVISSL

SEQ ID NO: 89840 - protein, 9 aa, Homo Sapiens
LPNGLDVTF

SEQ ID NO: 89841 - protein, 9 aa, Homo Sapiens
LPNGQMFVF

SEQ ID NO: 89842 - protein, 9 aa, Homo Sapiens
LPNGYVYGY

SEQ ID NO: 89843 - protein, 9 aa, Homo Sapiens
LPNNAKLEM

SEQ ID NO: 89844 - protein, 9 aa, Homo Sapiens
LPNNIVDVW

SEQ ID NO: 89845 - protein, 9 aa, Homo Sapiens
LPNSIASRF

SEQ ID NO: 89846 - protein, 9 aa, Homo Sapiens
LPPEELVPY

SEQ ID NO: 89847 - protein, 9 aa, Homo Sapiens
LPPGVHISY

SEQ ID NO: 89848 - protein, 9 aa, Homo Sapiens
LPPKIVIGY

SEQ ID NO: 89849 - protein, 9 aa, Homo Sapiens
LPPNTIMEY

SEQ ID NO: 89850 - protein, 9 aa, Homo Sapiens
LPPPSDPQY

SEQ ID NO: 89851 - protein, 9 aa, Homo Sapiens
LPQDVILKF

SEQ ID NO: 89852 - protein, 9 aa, Homo Sapiens
LPQEAFEKY

SEQ ID NO: 89853 - protein, 9 aa, Homo Sapiens
LPQEDLEAL

SEQ ID NO: 89854 - protein, 9 aa, Homo Sapiens
LPQHPDVEM

SEQ ID NO: 89855 - protein, 9 aa, Homo Sapiens
LPQHQVPAY

SEQ ID NO: 89856 - protein, 9 aa, Homo Sapiens
LPQHTIETY

SEQ ID NO: 89857 - protein, 9 aa, Homo Sapiens
LPQKGDVEM

SEQ ID NO: 89858 - protein, 9 aa, Homo Sapiens
LPQNQPFVF

SEQ ID NO: 89859 - protein, 9 aa, Homo Sapiens
LPQPDVFPL

SEQ ID NO: 89860 - protein, 9 aa, Homo Sapiens
LPQSTVPEM

SEQ ID NO: 89861 - protein, 9 aa, Homo Sapiens
LPQVQNTAM

SEQ ID NO: 89862 - protein, 9 aa, Homo Sapiens
LPREGEQNF

SEQ ID NO: 89863 - protein, 9 aa, Homo Sapiens
LPRISPEEY

SEQ ID NO: 89864 - protein, 9 aa, Homo Sapiens
LPSDHSVKY

SEQ ID NO: 89865 - protein, 9 aa, Homo Sapiens
LPSDIAAEA

SEQ ID NO: 89866 - protein, 9 aa, Homo Sapiens
LPSDKALVL

SEQ ID NO: 89867 - protein, 9 aa, Homo Sapiens
LPSDVPLHF

SEQ ID NO: 89868 - protein, 9 aa, Homo Sapiens
LPSDVSILY

SEQ ID NO: 89869 - protein, 9 aa, Homo Sapiens
LPSDVVTGY

SEQ ID NO: 89870 - protein, 9 aa, Homo Sapiens
LPSEHQTIL

SEQ ID NO: 89871 - protein, 9 aa, Homo Sapiens
LPSEIEVKY

SEQ ID NO: 89872 - protein, 9 aa, Homo Sapiens
LPSELERSY

SEQ ID NO: 89873 - protein, 9 aa, Homo Sapiens
LPSHTKIKY

SEQ ID NO: 89874 - protein, 9 aa, Homo Sapiens
LPSHVVTML

SEQ ID NO: 89875 - protein, 9 aa, Homo Sapiens
LPSNDPVVM

SEQ ID NO: 89876 - protein, 9 aa, Homo Sapiens
LPSNDSSKF

SEQ ID NO: 89877 - protein, 9 aa, Homo Sapiens
LPSPHPVRY

SEQ ID NO: 89878 - protein, 9 aa, Homo Sapiens
LPSRVIEEL

SEQ ID NO: 89879 - protein, 9 aa, Homo Sapiens
LPSSEVVKF

SEQ ID NO: 89880 - protein, 9 aa, Homo Sapiens
LPSSVISAI

SEQ ID NO: 89881 - protein, 9 aa, Homo Sapiens
LPSTTIVSM

SEQ ID NO: 89882 - protein, 9 aa, Homo Sapiens
LPTDAVDCM

SEQ ID NO: 89883 - protein, 9 aa, Homo Sapiens
LPTDSHASL

SEQ ID NO: 89884 - protein, 9 aa, Homo Sapiens
LPTDTLQEL

SEQ ID NO: 89885 - protein, 9 aa, Homo Sapiens
LPTEEEWEF

SEQ ID NO: 89886 - protein, 9 aa, Homo Sapiens
LPTENVDKM

SEQ ID NO: 89887 - protein, 9 aa, Homo Sapiens
LPTFQSPEF

SEQ ID NO: 89888 - protein, 9 aa, Homo Sapiens
LPTGIPIVY

SEQ ID NO: 89889 - protein, 9 aa, Homo Sapiens
LPTIVIVAH

SEQ ID NO: 89890 - protein, 9 aa, Homo Sapiens
LPTKQNEEF

SEQ ID NO: 89891 - protein, 9 aa, Homo Sapiens
LPTPETVPF

SEQ ID NO: 89892 - protein, 9 aa, Homo Sapiens
LPTSVVTIT

SEQ ID NO: 89893 - protein, 9 aa, Homo Sapiens
LPVAKDVSY

SEQ ID NO: 89894 - protein, 9 aa, Homo Sapiens
LPVATDFEF

SEQ ID NO: 89895 - protein, 9 aa, Homo Sapiens
LPVDFHIKM

SEQ ID NO: 89896 - protein, 9 aa, Homo Sapiens
LPVDFVECL

SEQ ID NO: 89897 - protein, 9 aa, Homo Sapiens
LPVDLAEEL

SEQ ID NO: 89898 - protein, 9 aa, Homo Sapiens
LPVEEFNEL

SEQ ID NO: 89899 - protein, 9 aa, Homo Sapiens
LPVEELRVY

SEQ ID NO: 89900 - protein, 9 aa, Homo Sapiens
LPVEHVNQL

SEQ ID NO: 89901 - protein, 9 aa, Homo Sapiens
LPVHVFEAL

SEQ ID NO: 89902 - protein, 9 aa, Homo Sapiens
LPVIIFTTF

SEQ ID NO: 89903 - protein, 9 aa, Homo Sapiens
LPVKGFRSY

SEQ ID NO: 89904 - protein, 9 aa, Homo Sapiens
LPVLERLIY

SEQ ID NO: 89905 - protein, 9 aa, Homo Sapiens
LPVPDPILL

SEQ ID NO: 89906 - protein, 9 aa, Homo Sapiens
LPVPSGVAF

SEQ ID NO: 89907 - protein, 9 aa, Homo Sapiens
LPVPVIPSF

SEQ ID NO: 89908 - protein, 9 aa, Homo Sapiens
LPVPVLETY

SEQ ID NO: 89909 - protein, 9 aa, Homo Sapiens
LPVRLATAM

SEQ ID NO: 89910 - protein, 9 aa, Homo Sapiens
LPVVDFNEM

SEQ ID NO: 89911 - protein, 9 aa, Homo Sapiens
LPVVPKATY

SEQ ID NO: 89912 - protein, 9 aa, Homo Sapiens
LPWASTHSL

SEQ ID NO: 89913 - protein, 9 aa, Homo Sapiens
LPWVGKELY

SEQ ID NO: 89914 - protein, 9 aa, Homo Sapiens
LPYAGDVSM

SEQ ID NO: 89915 - protein, 9 aa, Homo Sapiens
LPYDLRASF

SEQ ID NO: 89916 - protein, 9 aa, Homo Sapiens
LPYNDYFEY

SEQ ID NO: 89917 - protein, 9 aa, Homo Sapiens
LPYNHQHEY

SEQ ID NO: 89918 - protein, 9 aa, Homo Sapiens
LPYNMPLAY

SEQ ID NO: 89919 - protein, 9 aa, Homo Sapiens
LPYPDLETY

SEQ ID NO: 89920 - protein, 9 aa, Homo Sapiens
LPYPDLQEF

SEQ ID NO: 89921 - protein, 9 aa, Homo Sapiens
LPYQGHNSF

SEQ ID NO: 89922 - protein, 9 aa, Homo Sapiens
LPYSEYFEY

SEQ ID NO: 89923 - protein, 9 aa, Homo Sapiens
LPYTVVIHY

SEQ ID NO: 89924 - protein, 9 aa, Homo Sapiens
LSDTEVLEY

SEQ ID NO: 89925 - protein, 9 aa, Homo Sapiens
MAADDVEEY

SEQ ID NO: 89926 - protein, 9 aa, Homo Sapiens
MAAKILEEF

SEQ ID NO: 89927 - protein, 9 aa, Homo Sapiens
MAAMPQTVY

SEQ ID NO: 89928 - protein, 9 aa, Homo Sapiens
MAGDIYSVF

SEQ ID NO: 89929 - protein, 9 aa, Homo Sapiens
MAHSFGESY

SEQ ID NO: 89930 - protein, 9 aa, Homo Sapiens
MAIEAQQKF

SEQ ID NO: 89931 - protein, 9 aa, Homo Sapiens
MAIKLRNEY

SEQ ID NO: 89932 - protein, 9 aa, Homo Sapiens
MAISDELHY

SEQ ID NO: 89933 - protein, 9 aa, Homo Sapiens
MALAVRVVY

SEQ ID NO: 89934 - protein, 9 aa, Homo Sapiens
MALLVPLVY

SEQ ID NO: 89935 - protein, 9 aa, Homo Sapiens
MALSIAERY

SEQ ID NO: 89936 - protein, 9 aa, Homo Sapiens
MANIPLPEY

SEQ ID NO: 89937 - protein, 9 aa, Homo Sapiens
MAQNAIKAM

SEQ ID NO: 89938 - protein, 9 aa, Homo Sapiens
MAQTAIKAM

SEQ ID NO: 89939 - protein, 9 aa, Homo Sapiens
MAVEGDHSM

SEQ ID NO: 89940 - protein, 9 aa, Homo Sapiens
MAVIDGNVM

SEQ ID NO: 89941 - protein, 9 aa, Homo Sapiens
MAWLVDHVY

SEQ ID NO: 89942 - protein, 9 aa, Homo Sapiens
MAYETLEQY

SEQ ID NO: 89943 - protein, 9 aa, Homo Sapiens
MAYGGKLKY

SEQ ID NO: 89944 - protein, 9 aa, Homo Sapiens
MAYGHIDSY

SEQ ID NO: 89945 - protein, 9 aa, Homo Sapiens
MGDPGARVY

SEQ ID NO: 89946 - protein, 9 aa, Homo Sapiens
MIFQDPTAM

SEQ ID NO: 89947 - protein, 9 aa, Homo Sapiens
MIHDLCLVF

SEQ ID NO: 89948 - protein, 9 aa, Homo Sapiens
MINELAVAM

SEQ ID NO: 89949 - protein, 9 aa, Homo Sapiens
MPAAGGVLY

SEQ ID NO: 89950 - protein, 9 aa, Homo Sapiens
MPAATDNRY

SEQ ID NO: 89951 - protein, 9 aa, Homo Sapiens
MPADIATLL

SEQ ID NO: 89952 - protein, 9 aa, Homo Sapiens
MPADTNKAF

SEQ ID NO: 89953 - protein, 9 aa, Homo Sapiens
MPAGEIEQF

SEQ ID NO: 89954 - protein, 9 aa, Homo Sapiens
MPAPCAQVM

SEQ ID NO: 89955 - protein, 9 aa, Homo Sapiens
MPAPEIVSY

SEQ ID NO: 89956 - protein, 9 aa, Homo Sapiens
MPATVFMLF

SEQ ID NO: 89957 - protein, 9 aa, Homo Sapiens
MPAVKAIIY

SEQ ID NO: 89958 - protein, 9 aa, Homo Sapiens
MPCVFVTEV

SEQ ID NO: 89959 - protein, 9 aa, Homo Sapiens
MPDDLLTTL

SEQ ID NO: 89960 - protein, 9 aa, Homo Sapiens
MPDHTDVSL

SEQ ID NO: 89961 - protein, 9 aa, Homo Sapiens
MPDPTPFLL

SEQ ID NO: 89962 - protein, 9 aa, Homo Sapiens
MPDSAAALL

SEQ ID NO: 89963 - protein, 9 aa, Homo Sapiens
MPDSGRPAF

SEQ ID NO: 89964 - protein, 9 aa, Homo Sapiens
MPEDLVEAL

SEQ ID NO: 89965 - protein, 9 aa, Homo Sapiens
MPEDVKNFY

SEQ ID NO: 89966 - protein, 9 aa, Homo Sapiens
MPEEIARYY

SEQ ID NO: 89967 - protein, 9 aa, Homo Sapiens
MPEFVNAAF

SEQ ID NO: 89968 - protein, 9 aa, Homo Sapiens
MPEKEPSVL

SEQ ID NO: 89969 - protein, 9 aa, Homo Sapiens
MPEPASRCL

SEQ ID NO: 89970 - protein, 9 aa, Homo Sapiens
MPEPDAQRF

SEQ ID NO: 89971 - protein, 9 aa, Homo Sapiens
MPETTETVL

SEQ ID NO: 89972 - protein, 9 aa, Homo Sapiens
MPFGNVISA

SEQ ID NO: 89973 - protein, 9 aa, Homo Sapiens
MPFGNVVSA

SEQ ID NO: 89974 - protein, 9 aa, Homo Sapiens
MPFITCDEF

SEQ ID NO: 89975 - protein, 9 aa, Homo Sapiens
MPFNKEPKW

SEQ ID NO: 89976 - protein, 9 aa, Homo Sapiens
MPFPAHLTY

SEQ ID NO: 89977 - protein, 9 aa, Homo Sapiens
MPFQQWEAL

SEQ ID NO: 89978 - protein, 9 aa, Homo Sapiens
MPFTTVSEL

SEQ ID NO: 89979 - protein, 9 aa, Homo Sapiens
MPFYPRVVY

SEQ ID NO: 89980 - protein, 9 aa, Homo Sapiens
MPHDAIILL

SEQ ID NO: 89981 - protein, 9 aa, Homo Sapiens
MPHDLITQL

SEQ ID NO: 89982 - protein, 9 aa, Homo Sapiens
MPHEDCITA

SEQ ID NO: 89983 - protein, 9 aa, Homo Sapiens
MPHEKHYTL

SEQ ID NO: 89984 - protein, 9 aa, Homo Sapiens
MPHHTPHQL

SEQ ID NO: 89985 - protein, 9 aa, Homo Sapiens
MPHNQFIKM

SEQ ID NO: 89986 - protein, 9 aa, Homo Sapiens
MPHNYSRCY

SEQ ID NO: 89987 - protein, 9 aa, Homo Sapiens
MPHQLQDTF

SEQ ID NO: 89988 - protein, 9 aa, Homo Sapiens
MPIGPDVSL

SEQ ID NO: 89989 - protein, 9 aa, Homo Sapiens
MPIQGQPCF

SEQ ID NO: 89990 - protein, 9 aa, Homo Sapiens
MPISSHVDL

SEQ ID NO: 89991 - protein, 9 aa, Homo Sapiens
MPLEDLLAF

SEQ ID NO: 89992 - protein, 9 aa, Homo Sapiens
MPLEDMNEF

SEQ ID NO: 89993 - protein, 9 aa, Homo Sapiens
MPLEEGDTF

SEQ ID NO: 89994 - protein, 9 aa, Homo Sapiens
MPLGARILF

SEQ ID NO: 89995 - protein, 9 aa, Homo Sapiens
MPLHVAPLL

SEQ ID NO: 89996 - protein, 9 aa, Homo Sapiens
MPLQDSISL

SEQ ID NO: 89997 - protein, 9 aa, Homo Sapiens
MPLQLLLLL

SEQ ID NO: 89998 - protein, 9 aa, Homo Sapiens
MPMGPDQKY

SEQ ID NO: 89999 - protein, 9 aa, Homo Sapiens
MPNENIPEL

SEQ ID NO: 90000 - protein, 9 aa, Homo Sapiens
MPNGTVQRF

SEQ ID NO: 90001 - protein, 9 aa, Homo Sapiens
MPNQHACKL

SEQ ID NO: 90002 - protein, 9 aa, Homo Sapiens
MPNQIVQIL

SEQ ID NO: 90003 - protein, 9 aa, Homo Sapiens
MPNSPAPHF

SEQ ID NO: 90004 - protein, 9 aa, Homo Sapiens
MPNVKVAVF

SEQ ID NO: 90005 - protein, 9 aa, Homo Sapiens
MPPALCIDY

SEQ ID NO: 90006 - protein, 9 aa, Homo Sapiens
MPQDLSEAL

SEQ ID NO: 90007 - protein, 9 aa, Homo Sapiens
MPQEKSPGY

SEQ ID NO: 90008 - protein, 9 aa, Homo Sapiens
MPQFSTIEY

SEQ ID NO: 90009 - protein, 9 aa, Homo Sapiens
MPQGAPRLY

SEQ ID NO: 90010 - protein, 9 aa, Homo Sapiens
MPQGGGQHY

SEQ ID NO: 90011 - protein, 9 aa, Homo Sapiens
MPQHIMAIL

SEQ ID NO: 90012 - protein, 9 aa, Homo Sapiens
MPQVAPDLY

SEQ ID NO: 90013 - protein, 9 aa, Homo Sapiens
MPRLEVQSF

SEQ ID NO: 90014 - protein, 9 aa, Homo Sapiens
MPRVQTQQY

SEQ ID NO: 90015 - protein, 9 aa, Homo Sapiens
MPSDVLEVT

SEQ ID NO: 90016 - protein, 9 aa, Homo Sapiens
MPSEDVVSL

SEQ ID NO: 90017 - protein, 9 aa, Homo Sapiens
MPSEKVSSY

SEQ ID NO: 90018 - protein, 9 aa, Homo Sapiens
MPSKTELIV

SEQ ID NO: 90019 - protein, 9 aa, Homo Sapiens
MPSPATLSH

SEQ ID NO: 90020 - protein, 9 aa, Homo Sapiens
MPSPVSPKL

SEQ ID NO: 90021 - protein, 9 aa, Homo Sapiens
MPSQSVETY

SEQ ID NO: 90022 - protein, 9 aa, Homo Sapiens
MPSSAVRVL

SEQ ID NO: 90023 - protein, 9 aa, Homo Sapiens
MPSVKVSVF

SEQ ID NO: 90024 - protein, 9 aa, Homo Sapiens
MPTAYNTDY

SEQ ID NO: 90025 - protein, 9 aa, Homo Sapiens
MPTDVLEVT

SEQ ID NO: 90026 - protein, 9 aa, Homo Sapiens
MPTEQAEGF

SEQ ID NO: 90027 - protein, 9 aa, Homo Sapiens
MPTQEVQEL

SEQ ID NO: 90028 - protein, 9 aa, Homo Sapiens
MPTRPVPSY

SEQ ID NO: 90029 - protein, 9 aa, Homo Sapiens
MPTSTILRL

SEQ ID NO: 90030 - protein, 9 aa, Homo Sapiens
MPTSVAYIH

SEQ ID NO: 90031 - protein, 9 aa, Homo Sapiens
MPTTGINEY

SEQ ID NO: 90032 - protein, 9 aa, Homo Sapiens
MPTVSVLEY

SEQ ID NO: 90033 - protein, 9 aa, Homo Sapiens
MPVDSFNSM

SEQ ID NO: 90034 - protein, 9 aa, Homo Sapiens
MPVFPDFKM

SEQ ID NO: 90035 - protein, 9 aa, Homo Sapiens
MPVGMTHGL

SEQ ID NO: 90036 - protein, 9 aa, Homo Sapiens
MPVGPAPGM

SEQ ID NO: 90037 - protein, 9 aa, Homo Sapiens
MPVHAAVQM

SEQ ID NO: 90038 - protein, 9 aa, Homo Sapiens
MPVLEQSVL

SEQ ID NO: 90039 - protein, 9 aa, Homo Sapiens
MPVPTTPEF

SEQ ID NO: 90040 - protein, 9 aa, Homo Sapiens
MPVPVILNF

SEQ ID NO: 90041 - protein, 9 aa, Homo Sapiens
MPVRAADKL

SEQ ID NO: 90042 - protein, 9 aa, Homo Sapiens
MPVSSQHRY

SEQ ID NO: 90043 - protein, 9 aa, Homo Sapiens
MPVVAGAVF

SEQ ID NO: 90044 - protein, 9 aa, Homo Sapiens
MPYACKLLF

SEQ ID NO: 90045 - protein, 9 aa, Homo Sapiens
MPYLEHESF

SEQ ID NO: 90046 - protein, 9 aa, Homo Sapiens
MPYNHQHKY

SEQ ID NO: 90047 - protein, 9 aa, Homo Sapiens
MPYNYPVLL

SEQ ID NO: 90048 - protein, 9 aa, Homo Sapiens
MPYSHPSSY

SEQ ID NO: 90049 - protein, 9 aa, Homo Sapiens
MVADRVEVY

SEQ ID NO: 90050 - protein, 9 aa, Homo Sapiens
MVHSEVAAY

SEQ ID NO: 90051 - protein, 9 aa, Homo Sapiens
MVLENVKEM

SEQ ID NO: 90052 - protein, 9 aa, Homo Sapiens
MVNHFIAEF

SEQ ID NO: 90053 - protein, 9 aa, Homo Sapiens
MVVEERCVY

SEQ ID NO: 90054 - protein, 9 aa, Homo Sapiens
NAAFPFLAY

SEQ ID NO: 90055 - protein, 9 aa, Homo Sapiens
NAAPCAVSY

SEQ ID NO: 90056 - protein, 9 aa, Homo Sapiens
NAAPPPVTY

SEQ ID NO: 90057 - protein, 9 aa, Homo Sapiens
NAAQIFAIY

SEQ ID NO: 90058 - protein, 9 aa, Homo Sapiens
NAAQTSVAY

SEQ ID NO: 90059 - protein, 9 aa, Homo Sapiens
NADPQAVTM

SEQ ID NO: 90060 - protein, 9 aa, Homo Sapiens
NADTLALVF

SEQ ID NO: 90061 - protein, 9 aa, Homo Sapiens
NAFDVFAAY

SEQ ID NO: 90062 - protein, 9 aa, Homo Sapiens
NAFEELVAF

SEQ ID NO: 90063 - protein, 9 aa, Homo Sapiens
NAFEVAEKY

SEQ ID NO: 90064 - protein, 9 aa, Homo Sapiens
NAFHVYQVY

SEQ ID NO: 90065 - protein, 9 aa, Homo Sapiens
NAFKEITTM

SEQ ID NO: 90066 - protein, 9 aa, Homo Sapiens
NAFLDDPEF

SEQ ID NO: 90067 - protein, 9 aa, Homo Sapiens
NAHNLALVF

SEQ ID NO: 90068 - protein, 9 aa, Homo Sapiens
NAIEDTIFY

SEQ ID NO: 90069 - protein, 9 aa, Homo Sapiens
NAISVTTSY

SEQ ID NO: 90070 - protein, 9 aa, Homo Sapiens
NAITLPEEF

SEQ ID NO: 90071 - protein, 9 aa, Homo Sapiens
NALNHTEQY

SEQ ID NO: 90072 - protein, 9 aa, Homo Sapiens
NAMDVTTGY

SEQ ID NO: 90073 - protein, 9 aa, Homo Sapiens
NAMDVVVQF

SEQ ID NO: 90074 - protein, 9 aa, Homo Sapiens
NAMNMQETY

SEQ ID NO: 90075 - protein, 9 aa, Homo Sapiens
NATGPDLEF

SEQ ID NO: 90076 - protein, 9 aa, Homo Sapiens
NAVNLAIKY

SEQ ID NO: 90077 - protein, 9 aa, Homo Sapiens
NAVNLSCKY

SEQ ID NO: 90078 - protein, 9 aa, Homo Sapiens
NAVVTVPAY

SEQ ID NO: 90079 - protein, 9 aa, Homo Sapiens
NAWADIERF

SEQ ID NO: 90080 - protein, 9 aa, Homo Sapiens
NAWAEQTGM

SEQ ID NO: 90081 - protein, 9 aa, Homo Sapiens
NAWNNLEKY

SEQ ID NO: 90082 - protein, 9 aa, Homo Sapiens
NIPEIVAVY

SEQ ID NO: 90083 - protein, 9 aa, Homo Sapiens
NPADITVLF

SEQ ID NO: 90084 - protein, 9 aa, Homo Sapiens
NPAIVALVY

SEQ ID NO: 90085 - protein, 9 aa, Homo Sapiens
NPAPNPAVY

SEQ ID NO: 90086 - protein, 9 aa, Homo Sapiens
NPCEYDLKF

SEQ ID NO: 90087 - protein, 9 aa, Homo Sapiens
NPDDVFREF

SEQ ID NO: 90088 - protein, 9 aa, Homo Sapiens
NPDTHSWEM

SEQ ID NO: 90089 - protein, 9 aa, Homo Sapiens
NPEPNTVSY

SEQ ID NO: 90090 - protein, 9 aa, Homo Sapiens
NPFEKGDLY

SEQ ID NO: 90091 - protein, 9 aa, Homo Sapiens
NPFPHSHTF

SEQ ID NO: 90092 - protein, 9 aa, Homo Sapiens
NPFQEAIVF

SEQ ID NO: 90093 - protein, 9 aa, Homo Sapiens
NPHEVQPAY

SEQ ID NO: 90094 - protein, 9 aa, Homo Sapiens
NPHQQYSVY

SEQ ID NO: 90095 - protein, 9 aa, Homo Sapiens
NPIDQCNTL

SEQ ID NO: 90096 - protein, 9 aa, Homo Sapiens
NPISGLLEY

SEQ ID NO: 90097 - protein, 9 aa, Homo Sapiens
NPISTVTEL

SEQ ID NO: 90098 - protein, 9 aa, Homo Sapiens
NPITVQTVY

SEQ ID NO: 90099 - protein, 9 aa, Homo Sapiens
NPIWHREKY

SEQ ID NO: 90100 - protein, 9 aa, Homo Sapiens
NPLAATHEF

SEQ ID NO: 90101 - protein, 9 aa, Homo Sapiens
NPLQKDPQY

SEQ ID NO: 90102 - protein, 9 aa, Homo Sapiens
NPNSPSITY

SEQ ID NO: 90103 - protein, 9 aa, Homo Sapiens
NPSPYHLYY

SEQ ID NO: 90104 - protein, 9 aa, Homo Sapiens
NPTDAFTVF

SEQ ID NO: 90105 - protein, 9 aa, Homo Sapiens
NPTDISYVY

SEQ ID NO: 90106 - protein, 9 aa, Homo Sapiens
NPTDPLLAY

SEQ ID NO: 90107 - protein, 9 aa, Homo Sapiens
NPTIVALVY

SEQ ID NO: 90108 - protein, 9 aa, Homo Sapiens
NPVDIVSTL

SEQ ID NO: 90109 - protein, 9 aa, Homo Sapiens
NPVDWKEKY

SEQ ID NO: 90110 - protein, 9 aa, Homo Sapiens
NPVELKALY

SEQ ID NO: 90111 - protein, 9 aa, Homo Sapiens
NPVEYSIVM

SEQ ID NO: 90112 - protein, 9 aa, Homo Sapiens
NPVGGLLEY

SEQ ID NO: 90113 - protein, 9 aa, Homo Sapiens
NPVQALSEF

SEQ ID NO: 90114 - protein, 9 aa, Homo Sapiens
NPWDDKLIF

SEQ ID NO: 90115 - protein, 9 aa, Homo Sapiens
NPWDNKAVY

SEQ ID NO: 90116 - protein, 9 aa, Homo Sapiens
NPYHVVILF

SEQ ID NO: 90117 - protein, 9 aa, Homo Sapiens
NPYRDLQIY

SEQ ID NO: 90118 - protein, 9 aa, Homo Sapiens
NTCNIILIY

SEQ ID NO: 90119 - protein, 9 aa, Homo Sapiens
NVADLHEKY

SEQ ID NO: 90120 - protein, 9 aa, Homo Sapiens
NVADVVIKF

SEQ ID NO: 90121 - protein, 9 aa, Homo Sapiens
NVFGVCHIF

SEQ ID NO: 90122 - protein, 9 aa, Homo Sapiens
NVHAVVFVY

SEQ ID NO: 90123 - protein, 9 aa, Homo Sapiens
NVHDIMVSF

SEQ ID NO: 90124 - protein, 9 aa, Homo Sapiens
NVIHNLATY

SEQ ID NO: 90125 - protein, 9 aa, Homo Sapiens
NVIRDAVTY

SEQ ID NO: 90126 - protein, 9 aa, Homo Sapiens
NVRCESEVF

SEQ ID NO: 90127 - protein, 9 aa, Homo Sapiens
NVYCGVHRY

SEQ ID NO: 90128 - protein, 9 aa, Homo Sapiens
NVYDFKTTY

SEQ ID NO: 90129 - protein, 9 aa, Homo Sapiens
PALHEGPPL

SEQ ID NO: 90130 - protein, 9 aa, Homo Sapiens
PEIAFLTAF

SEQ ID NO: 90131 - protein, 9 aa, Homo Sapiens
PHNQFIKMM

SEQ ID NO: 90132 - protein, 9 aa, Homo Sapiens
PKVDFPTAI

SEQ ID NO: 90133 - protein, 9 aa, Homo Sapiens
PVATVLTDM

SEQ ID NO: 90134 - protein, 9 aa, Homo Sapiens
QAADTVVIF

SEQ ID NO: 90135 - protein, 9 aa, Homo Sapiens
QAAMPQVSY

SEQ ID NO: 90136 - protein, 9 aa, Homo Sapiens
QAAQCYIKY

SEQ ID NO: 90137 - protein, 9 aa, Homo Sapiens
QADPTKLEL

SEQ ID NO: 90138 - protein, 9 aa, Homo Sapiens
QAFEQALEF

SEQ ID NO: 90139 - protein, 9 aa, Homo Sapiens
QAFESSQKY

SEQ ID NO: 90140 - protein, 9 aa, Homo Sapiens
QAFFLHTTY

SEQ ID NO: 90141 - protein, 9 aa, Homo Sapiens
QAFLEAVQF

SEQ ID NO: 90142 - protein, 9 aa, Homo Sapiens
QAFPGGHSM

SEQ ID NO: 90143 - protein, 9 aa, Homo Sapiens
QAFVDCHEF

SEQ ID NO: 90144 - protein, 9 aa, Homo Sapiens
QAIEDMVGY

SEQ ID NO: 90145 - protein, 9 aa, Homo Sapiens
QAIENAHVL

SEQ ID NO: 90146 - protein, 9 aa, Homo Sapiens
QAINNAISY

SEQ ID NO: 90147 - protein, 9 aa, Homo Sapiens
QAINNAITY

SEQ ID NO: 90148 - protein, 9 aa, Homo Sapiens
QAIQWILHY

SEQ ID NO: 90149 - protein, 9 aa, Homo Sapiens
QAITLVTQY

SEQ ID NO: 90150 - protein, 9 aa, Homo Sapiens
QALALIELY

SEQ ID NO: 90151 - protein, 9 aa, Homo Sapiens
QALLDLHAL

SEQ ID NO: 90152 - protein, 9 aa, Homo Sapiens
QANVICIVY

SEQ ID NO: 90153 - protein, 9 aa, Homo Sapiens
QARIEIESF

SEQ ID NO: 90154 - protein, 9 aa, Homo Sapiens
QASDVSVKY

SEQ ID NO: 90155 - protein, 9 aa, Homo Sapiens
QASSKILKY

SEQ ID NO: 90156 - protein, 9 aa, Homo Sapiens
QATQVLQEM

SEQ ID NO: 90157 - protein, 9 aa, Homo Sapiens
QATRTVPVF

SEQ ID NO: 90158 - protein, 9 aa, Homo Sapiens
QAVADAVTY

SEQ ID NO: 90159 - protein, 9 aa, Homo Sapiens
QAVADMAAY

SEQ ID NO: 90160 - protein, 9 aa, Homo Sapiens
QAVAIFTVY

SEQ ID NO: 90161 - protein, 9 aa, Homo Sapiens
QAVDAVEEF

SEQ ID NO: 90162 - protein, 9 aa, Homo Sapiens
QAVQQQEVY

SEQ ID NO: 90163 - protein, 9 aa, Homo Sapiens
QAYDDKIYY

SEQ ID NO: 90164 - protein, 9 aa, Homo Sapiens
QPAEMAAEL

SEQ ID NO: 90165 - protein, 9 aa, Homo Sapiens
QPAPISPHL

SEQ ID NO: 90166 - protein, 9 aa, Homo Sapiens
QPAPPHISH

SEQ ID NO: 90167 - protein, 9 aa, Homo Sapiens
QPFQVAEVF

SEQ ID NO: 90168 - protein, 9 aa, Homo Sapiens
QPFYHDDSY

SEQ ID NO: 90169 - protein, 9 aa, Homo Sapiens
QPGSFEYEY

SEQ ID NO: 90170 - protein, 9 aa, Homo Sapiens
QPILYSYSF

SEQ ID NO: 90171 - protein, 9 aa, Homo Sapiens
QPINLIFRY

SEQ ID NO: 90172 - protein, 9 aa, Homo Sapiens
QPIVWITPY

SEQ ID NO: 90173 - protein, 9 aa, Homo Sapiens
QPLALNVAY

SEQ ID NO: 90174 - protein, 9 aa, Homo Sapiens
QPLEDLASF

SEQ ID NO: 90175 - protein, 9 aa, Homo Sapiens
QPLEEIITY

SEQ ID NO: 90176 - protein, 9 aa, Homo Sapiens
QPLHVTKGY

SEQ ID NO: 90177 - protein, 9 aa, Homo Sapiens
QPLKLDTSF

SEQ ID NO: 90178 - protein, 9 aa, Homo Sapiens
QPMDIHVEL

SEQ ID NO: 90179 - protein, 9 aa, Homo Sapiens
QPMEVQEGY

SEQ ID NO: 90180 - protein, 9 aa, Homo Sapiens
QPMQTNVVY

SEQ ID NO: 90181 - protein, 9 aa, Homo Sapiens
QPNPLPLRL

SEQ ID NO: 90182 - protein, 9 aa, Homo Sapiens
QPQANSHVY

SEQ ID NO: 90183 - protein, 9 aa, Homo Sapiens
QPSPQQDVY

SEQ ID NO: 90184 - protein, 9 aa, Homo Sapiens
QPTEVVNIL

SEQ ID NO: 90185 - protein, 9 aa, Homo Sapiens
QPVDWFVVY

SEQ ID NO: 90186 - protein, 9 aa, Homo Sapiens
QPVEPLPGF

SEQ ID NO: 90187 - protein, 9 aa, Homo Sapiens
QPVKVRVSY

SEQ ID NO: 90188 - protein, 9 aa, Homo Sapiens
QPYSKDSPF

SEQ ID NO: 90189 - protein, 9 aa, Homo Sapiens
QQVPVNQVF

SEQ ID NO: 90190 - protein, 9 aa, Homo Sapiens
QVFEGHTHY

SEQ ID NO: 90191 - protein, 9 aa, Homo Sapiens
RPADCIANY

SEQ ID NO: 90192 - protein, 9 aa, Homo Sapiens
RPAPVEVSY

SEQ ID NO: 90193 - protein, 9 aa, Homo Sapiens
RPAPVEVTY

SEQ ID NO: 90194 - protein, 9 aa, Homo Sapiens
RPAQVSQPF

SEQ ID NO: 90195 - protein, 9 aa, Homo Sapiens
RPFAGFEDF

SEQ ID NO: 90196 - protein, 9 aa, Homo Sapiens
RPFDLVIPF

SEQ ID NO: 90197 - protein, 9 aa, Homo Sapiens
RPFEDQTSL

SEQ ID NO: 90198 - protein, 9 aa, Homo Sapiens
RPFEQPQEY

SEQ ID NO: 90199 - protein, 9 aa, Homo Sapiens
RPFERTITM

SEQ ID NO: 90200 - protein, 9 aa, Homo Sapiens
RPIFIITEY

SEQ ID NO: 90201 - protein, 9 aa, Homo Sapiens
RPIRLQVQY

SEQ ID NO: 90202 - protein, 9 aa, Homo Sapiens
RPLEQVTCY

SEQ ID NO: 90203 - protein, 9 aa, Homo Sapiens
RPLPPMKSY

SEQ ID NO: 90204 - protein, 9 aa, Homo Sapiens
RPNDIYVNM

SEQ ID NO: 90205 - protein, 9 aa, Homo Sapiens
RPTDVAISF

SEQ ID NO: 90206 - protein, 9 aa, Homo Sapiens
RPVNVVNVY

SEQ ID NO: 90207 - protein, 9 aa, Homo Sapiens
RPVPLEQTY

SEQ ID NO: 90208 - protein, 9 aa, Homo Sapiens
SAANIQPIF

SEQ ID NO: 90209 - protein, 9 aa, Homo Sapiens
SAAQPGVAF

SEQ ID NO: 90210 - protein, 9 aa, Homo Sapiens
SADKTVRVY

SEQ ID NO: 90211 - protein, 9 aa, Homo Sapiens
SADQVALVY

SEQ ID NO: 90212 - protein, 9 aa, Homo Sapiens
SAFDEAMSY

SEQ ID NO: 90213 - protein, 9 aa, Homo Sapiens
SAIPHPLIM

SEQ ID NO: 90214 - protein, 9 aa, Homo Sapiens
SALEHSIQY

SEQ ID NO: 90215 - protein, 9 aa, Homo Sapiens
SALHIIVQY

SEQ ID NO: 90216 - protein, 9 aa, Homo Sapiens
SALPAVTEM

SEQ ID NO: 90217 - protein, 9 aa, Homo Sapiens
SALPLAIKY

SEQ ID NO: 90218 - protein, 9 aa, Homo Sapiens
SALPLYNLY

SEQ ID NO: 90219 - protein, 9 aa, Homo Sapiens
SALPTVVAY

SEQ ID NO: 90220 - protein, 9 aa, Homo Sapiens
SAMEVVPAL

SEQ ID NO: 90221 - protein, 9 aa, Homo Sapiens
SASALAVAL

SEQ ID NO: 90222 - protein, 9 aa, Homo Sapiens
SASRLVLNY

SEQ ID NO: 90223 - protein, 9 aa, Homo Sapiens
SASTTTLRY

SEQ ID NO: 90224 - protein, 9 aa, Homo Sapiens
SASVVFTTY

SEQ ID NO: 90225 - protein, 9 aa, Homo Sapiens
SATAVAQLY

SEQ ID NO: 90226 - protein, 9 aa, Homo Sapiens
SATELFEAY

SEQ ID NO: 90227 - protein, 9 aa, Homo Sapiens
SATYIAEEY

SEQ ID NO: 90228 - protein, 9 aa, Homo Sapiens
SAVAATYKY

SEQ ID NO: 90229 - protein, 9 aa, Homo Sapiens
SAVDVHINM

SEQ ID NO: 90230 - protein, 9 aa, Homo Sapiens
SAVELVQEF

SEQ ID NO: 90231 - protein, 9 aa, Homo Sapiens
SAYEALEKY

SEQ ID NO: 90232 - protein, 9 aa, Homo Sapiens
SPAEVAEQY

SEQ ID NO: 90233 - protein, 9 aa, Homo Sapiens
SPAPVPVTY

SEQ ID NO: 90234 - protein, 9 aa, Homo Sapiens
SPAVAAPAY

SEQ ID NO: 90235 - protein, 9 aa, Homo Sapiens
SPCQISQIY

SEQ ID NO: 90236 - protein, 9 aa, Homo Sapiens
SPDATIRIW

SEQ ID NO: 90237 - protein, 9 aa, Homo Sapiens
SPDPSIYAY

SEQ ID NO: 90238 - protein, 9 aa, Homo Sapiens
SPDSGVYEM

SEQ ID NO: 90239 - protein, 9 aa, Homo Sapiens
SPEDIKKAY

SEQ ID NO: 90240 - protein, 9 aa, Homo Sapiens
SPEELYRVF

SEQ ID NO: 90241 - protein, 9 aa, Homo Sapiens
SPFHDIPIY

SEQ ID NO: 90242 - protein, 9 aa, Homo Sapiens
SPFLTITSM

SEQ ID NO: 90243 - protein, 9 aa, Homo Sapiens
SPFNDRFPL

SEQ ID NO: 90244 - protein, 9 aa, Homo Sapiens
SPFQPHVPY

SEQ ID NO: 90245 - protein, 9 aa, Homo Sapiens
SPFSFHHVL

SEQ ID NO: 90246 - protein, 9 aa, Homo Sapiens
SPHGGALVM

SEQ ID NO: 90247 - protein, 9 aa, Homo Sapiens
SPIDVVEKY

SEQ ID NO: 90248 - protein, 9 aa, Homo Sapiens
SPIHTSVQF

SEQ ID NO: 90249 - protein, 9 aa, Homo Sapiens
SPIKDQPVM

SEQ ID NO: 90250 - protein, 9 aa, Homo Sapiens
SPIVKSAKF

SEQ ID NO: 90251 - protein, 9 aa, Homo Sapiens
SPLAFEHVM

SEQ ID NO: 90252 - protein, 9 aa, Homo Sapiens
SPLERYYDY

SEQ ID NO: 90253 - protein, 9 aa, Homo Sapiens
SPLPAQLVY

SEQ ID NO: 90254 - protein, 9 aa, Homo Sapiens
SPMDIFDMF

SEQ ID NO: 90255 - protein, 9 aa, Homo Sapiens
SPNAKEFVY

SEQ ID NO: 90256 - protein, 9 aa, Homo Sapiens
SPQDLRLFY

SEQ ID NO: 90257 - protein, 9 aa, Homo Sapiens
SPSDVFIGY

SEQ ID NO: 90258 - protein, 9 aa, Homo Sapiens
SPSHIIHNY

SEQ ID NO: 90259 - protein, 9 aa, Homo Sapiens
SPSKPTLAY

SEQ ID NO: 90260 - protein, 9 aa, Homo Sapiens
SPTCLTLIY

SEQ ID NO: 90261 - protein, 9 aa, Homo Sapiens
SPVALNVQY

SEQ ID NO: 90262 - protein, 9 aa, Homo Sapiens
SPVDSVLFY

SEQ ID NO: 90263 - protein, 9 aa, Homo Sapiens
SPVDVLQIF

SEQ ID NO: 90264 - protein, 9 aa, Homo Sapiens
SPVENKEVY

SEQ ID NO: 90265 - protein, 9 aa, Homo Sapiens
SPVFMQPVY

SEQ ID NO: 90266 - protein, 9 aa, Homo Sapiens
SPVSFIATY

SEQ ID NO: 90267 - protein, 9 aa, Homo Sapiens
SPWADNTAL

SEQ ID NO: 90268 - protein, 9 aa, Homo Sapiens
SQFGTVTRF

SEQ ID NO: 90269 - protein, 9 aa, Homo Sapiens
SSLLEKGLD

SEQ ID NO: 90270 - protein, 9 aa, Homo Sapiens
TAAAALPAF

SEQ ID NO: 90271 - protein, 9 aa, Homo Sapiens
TAAAPMIGY

SEQ ID NO: 90272 - protein, 9 aa, Homo Sapiens
TAAAVGAVF

SEQ ID NO: 90273 - protein, 9 aa, Homo Sapiens
TAADIFKQY

SEQ ID NO: 90274 - protein, 9 aa, Homo Sapiens
TAADLVPIF

SEQ ID NO: 90275 - protein, 9 aa, Homo Sapiens
TAADTVIFY

SEQ ID NO: 90276 - protein, 9 aa, Homo Sapiens
TAADTVIIY

SEQ ID NO: 90277 - protein, 9 aa, Homo Sapiens
TAAETHYTY

SEQ ID NO: 90278 - protein, 9 aa, Homo Sapiens
TAAKAILLY

SEQ ID NO: 90279 - protein, 9 aa, Homo Sapiens
TAAPLLLAM

SEQ ID NO: 90280 - protein, 9 aa, Homo Sapiens
TAAPPAQPL

SEQ ID NO: 90281 - protein, 9 aa, Homo Sapiens
TAAPVPTTL

SEQ ID NO: 90282 - protein, 9 aa, Homo Sapiens
TAAPVVPEL

SEQ ID NO: 90283 - protein, 9 aa, Homo Sapiens
TAASPTIAL

SEQ ID NO: 90284 - protein, 9 aa, Homo Sapiens
TACDIQTHM

SEQ ID NO: 90285 - protein, 9 aa, Homo Sapiens
TACELMNIY

SEQ ID NO: 90286 - protein, 9 aa, Homo Sapiens
TADHNLLLY

SEQ ID NO: 90287 - protein, 9 aa, Homo Sapiens
TAEGQTIVY

SEQ ID NO: 90288 - protein, 9 aa, Homo Sapiens
TAFGGFLKY

SEQ ID NO: 90289 - protein, 9 aa, Homo Sapiens
TAFHVTCAF

SEQ ID NO: 90290 - protein, 9 aa, Homo Sapiens
TAGDFQEIY

SEQ ID NO: 90291 - protein, 9 aa, Homo Sapiens
TAIDDMEAY

SEQ ID NO: 90292 - protein, 9 aa, Homo Sapiens
TAIMEKHSM

SEQ ID NO: 90293 - protein, 9 aa, Homo Sapiens
TAIRALETY

SEQ ID NO: 90294 - protein, 9 aa, Homo Sapiens
TAIREAQTF

SEQ ID NO: 90295 - protein, 9 aa, Homo Sapiens
TAISLFYEL

SEQ ID NO: 90296 - protein, 9 aa, Homo Sapiens
TALAAFLSY

SEQ ID NO: 90297 - protein, 9 aa, Homo Sapiens
TALASVVAM

SEQ ID NO: 90298 - protein, 9 aa, Homo Sapiens
TALDKIEEM

SEQ ID NO: 90299 - protein, 9 aa, Homo Sapiens
TALHLATEM

SEQ ID NO: 90300 - protein, 9 aa, Homo Sapiens
TALNPHIGY

SEQ ID NO: 90301 - protein, 9 aa, Homo Sapiens
TALPTRIAY

SEQ ID NO: 90302 - protein, 9 aa, Homo Sapiens
TALQAIVEY

SEQ ID NO: 90303 - protein, 9 aa, Homo Sapiens
TALRLALQY

SEQ ID NO: 90304 - protein, 9 aa, Homo Sapiens
TALSWKEAY

SEQ ID NO: 90305 - protein, 9 aa, Homo Sapiens
TAMPYLTSY

SEQ ID NO: 90306 - protein, 9 aa, Homo Sapiens
TANALALAM

SEQ ID NO: 90307 - protein, 9 aa, Homo Sapiens
TAPAAPTMA

SEQ ID NO: 90308 - protein, 9 aa, Homo Sapiens
TARMEDFTF

SEQ ID NO: 90309 - protein, 9 aa, Homo Sapiens
TASAVVQHM

SEQ ID NO: 90310 - protein, 9 aa, Homo Sapiens
TASELKILY

SEQ ID NO: 90311 - protein, 9 aa, Homo Sapiens
TASEMILVL

SEQ ID NO: 90312 - protein, 9 aa, Homo Sapiens
TASHYYIKY

SEQ ID NO: 90313 - protein, 9 aa, Homo Sapiens
TASPVAVSL

SEQ ID NO: 90314 - protein, 9 aa, Homo Sapiens
TATALAIIY

SEQ ID NO: 90315 - protein, 9 aa, Homo Sapiens
TATATNHVL

SEQ ID NO: 90316 - protein, 9 aa, Homo Sapiens
TAVGSILLY

SEQ ID NO: 90317 - protein, 9 aa, Homo Sapiens
TAVIDHHNY

SEQ ID NO: 90318 - protein, 9 aa, Homo Sapiens
TAVKIAPRY

SEQ ID NO: 90319 - protein, 9 aa, Homo Sapiens
TAVRVHVSY

SEQ ID NO: 90320 - protein, 9 aa, Homo Sapiens
TAYPGQTQY

SEQ ID NO: 90321 - protein, 9 aa, Homo Sapiens
TAYVGSAVM

SEQ ID NO: 90322 - protein, 9 aa, Homo Sapiens
TGYGGYEEY

SEQ ID NO: 90323 - protein, 9 aa, Homo Sapiens
TNFEDRNAF

SEQ ID NO: 90324 - protein, 9 aa, Homo Sapiens
TPADVFIVF

SEQ ID NO: 90325 - protein, 9 aa, Homo Sapiens
TPAEIREEF

SEQ ID NO: 90326 - protein, 9 aa, Homo Sapiens
TPAEVSHRF

SEQ ID NO: 90327 - protein, 9 aa, Homo Sapiens
TPAGVVNKY

SEQ ID NO: 90328 - protein, 9 aa, Homo Sapiens
TPAPGFSSM

SEQ ID NO: 90329 - protein, 9 aa, Homo Sapiens
TPAPPTHAL

SEQ ID NO: 90330 - protein, 9 aa, Homo Sapiens
TPDEIDHVF

SEQ ID NO: 90331 - protein, 9 aa, Homo Sapiens
TPDPSRSVF

SEQ ID NO: 90332 - protein, 9 aa, Homo Sapiens
TPEEFFRIF

SEQ ID NO: 90333 - protein, 9 aa, Homo Sapiens
TPEEKIREY

SEQ ID NO: 90334 - protein, 9 aa, Homo Sapiens
TPFSVGLVY

SEQ ID NO: 90335 - protein, 9 aa, Homo Sapiens
TPFVDPRVY

SEQ ID NO: 90336 - protein, 9 aa, Homo Sapiens
TPFVEGLSY

SEQ ID NO: 90337 - protein, 9 aa, Homo Sapiens
TPGGTRIIY

SEQ ID NO: 90338 - protein, 9 aa, Homo Sapiens
TPHGLFILF

SEQ ID NO: 90339 - protein, 9 aa, Homo Sapiens
TPHSEIIFY

SEQ ID NO: 90340 - protein, 9 aa, Homo Sapiens
TPIDSNIAF

SEQ ID NO: 90341 - protein, 9 aa, Homo Sapiens
TPIKDGILY

SEQ ID NO: 90342 - protein, 9 aa, Homo Sapiens
TPIPGTIEM

SEQ ID NO: 90343 - protein, 9 aa, Homo Sapiens
TPIQSKEAY

SEQ ID NO: 90344 - protein, 9 aa, Homo Sapiens
TPIQVLHEY

SEQ ID NO: 90345 - protein, 9 aa, Homo Sapiens
TPIREQHVL

SEQ ID NO: 90346 - protein, 9 aa, Homo Sapiens
TPISEHAVF

SEQ ID NO: 90347 - protein, 9 aa, Homo Sapiens
TPISITSSY

SEQ ID NO: 90348 - protein, 9 aa, Homo Sapiens
TPLATQLTY

SEQ ID NO: 90349 - protein, 9 aa, Homo Sapiens
TPLEEAIKF

SEQ ID NO: 90350 - protein, 9 aa, Homo Sapiens
TPLHLVALY

SEQ ID NO: 90351 - protein, 9 aa, Homo Sapiens
TPLHMAIAY

SEQ ID NO: 90352 - protein, 9 aa, Homo Sapiens
TPLPEDNSM

SEQ ID NO: 90353 - protein, 9 aa, Homo Sapiens
TPLSSTVTL

SEQ ID NO: 90354 - protein, 9 aa, Homo Sapiens
TPLVDPSVY

SEQ ID NO: 90355 - protein, 9 aa, Homo Sapiens
TPMFVVKAY

SEQ ID NO: 90356 - protein, 9 aa, Homo Sapiens
TPMLNSLIY

SEQ ID NO: 90357 - protein, 9 aa, Homo Sapiens
TPNDFCSFY

SEQ ID NO: 90358 - protein, 9 aa, Homo Sapiens
TPRIELEEM

SEQ ID NO: 90359 - protein, 9 aa, Homo Sapiens
TPSEPHPVL

SEQ ID NO: 90360 - protein, 9 aa, Homo Sapiens
TPSPDIIVL

SEQ ID NO: 90361 - protein, 9 aa, Homo Sapiens
TPSPEIVKY

SEQ ID NO: 90362 - protein, 9 aa, Homo Sapiens
TPSPPEVVY

SEQ ID NO: 90363 - protein, 9 aa, Homo Sapiens
TPSQPLPTY

SEQ ID NO: 90364 - protein, 9 aa, Homo Sapiens
TPSSDVLVF

SEQ ID NO: 90365 - protein, 9 aa, Homo Sapiens
TPTEISLVL

SEQ ID NO: 90366 - protein, 9 aa, Homo Sapiens
TPTGIKVVM

SEQ ID NO: 90367 - protein, 9 aa, Homo Sapiens
TPTPFFHTF

SEQ ID NO: 90368 - protein, 9 aa, Homo Sapiens
TPVFNPTVF

SEQ ID NO: 90369 - protein, 9 aa, Homo Sapiens
TPVFSKARY

SEQ ID NO: 90370 - protein, 9 aa, Homo Sapiens
TPWPHIVEF

SEQ ID NO: 90371 - protein, 9 aa, Homo Sapiens
TPYDRFCPF

SEQ ID NO: 90372 - protein, 9 aa, Homo Sapiens
TPYKGGNLY

SEQ ID NO: 90373 - protein, 9 aa, Homo Sapiens
TPYSDGVLY

SEQ ID NO: 90374 - protein, 9 aa, Homo Sapiens
TRPLYRHLF

SEQ ID NO: 90375 - protein, 9 aa, Homo Sapiens
TSSDILLCY

SEQ ID NO: 90376 - protein, 9 aa, Homo Sapiens
TVCDFRLSY

SEQ ID NO: 90377 - protein, 9 aa, Homo Sapiens
TVFDLVEEY

SEQ ID NO: 90378 - protein, 9 aa, Homo Sapiens
TVFREVVSF

SEQ ID NO: 90379 - protein, 9 aa, Homo Sapiens
TVLELVTQY

SEQ ID NO: 90380 - protein, 9 aa, Homo Sapiens
TVMNIAEHY

SEQ ID NO: 90381 - protein, 9 aa, Homo Sapiens
TVSDAILRY

SEQ ID NO: 90382 - protein, 9 aa, Homo Sapiens
TVTEVLLKY

SEQ ID NO: 90383 - protein, 9 aa, Homo Sapiens
TVVRNLEAY

SEQ ID NO: 90384 - protein, 9 aa, Homo Sapiens
VAAPLFELY

SEQ ID NO: 90385 - protein, 9 aa, Homo Sapiens
VADPYVVIM

SEQ ID NO: 90386 - protein, 9 aa, Homo Sapiens
VAQSTRIIY

SEQ ID NO: 90387 - protein, 9 aa, Homo Sapiens
VPADAVVQY

SEQ ID NO: 90388 - protein, 9 aa, Homo Sapiens
VPAEHQVAM

SEQ ID NO: 90389 - protein, 9 aa, Homo Sapiens
VPASLPVEF

SEQ ID NO: 90390 - protein, 9 aa, Homo Sapiens
VPASNAIAY

SEQ ID NO: 90391 - protein, 9 aa, Homo Sapiens
VPDPNVIKL

SEQ ID NO: 90392 - protein, 9 aa, Homo Sapiens
VPFALFESF

SEQ ID NO: 90393 - protein, 9 aa, Homo Sapiens
VPFDQFIQL

SEQ ID NO: 90394 - protein, 9 aa, Homo Sapiens
VPFETSCRY

SEQ ID NO: 90395 - protein, 9 aa, Homo Sapiens
VPFHSDLGY

SEQ ID NO: 90396 - protein, 9 aa, Homo Sapiens
VPFNIPLEF

SEQ ID NO: 90397 - protein, 9 aa, Homo Sapiens
VPFPLTLRF

SEQ ID NO: 90398 - protein, 9 aa, Homo Sapiens
VPFSIFDEF

SEQ ID NO: 90399 - protein, 9 aa, Homo Sapiens
VPFTEEQLF

SEQ ID NO: 90400 - protein, 9 aa, Homo Sapiens
VPHSIINGY

SEQ ID NO: 90401 - protein, 9 aa, Homo Sapiens
VPHTNPPEY

SEQ ID NO: 90402 - protein, 9 aa, Homo Sapiens
VPILNPVVY

SEQ ID NO: 90403 - protein, 9 aa, Homo Sapiens
VPIPTVNQY

SEQ ID NO: 90404 - protein, 9 aa, Homo Sapiens
VPLDLCEVY

SEQ ID NO: 90405 - protein, 9 aa, Homo Sapiens
VPLGMTVTF

SEQ ID NO: 90406 - protein, 9 aa, Homo Sapiens
VPNDIQSEL

SEQ ID NO: 90407 - protein, 9 aa, Homo Sapiens
VPNKVIQCF

SEQ ID NO: 90408 - protein, 9 aa, Homo Sapiens
VPQSGVPAL

SEQ ID NO: 90409 - protein, 9 aa, Homo Sapiens
VPRIQLEEY

SEQ ID NO: 90410 - protein, 9 aa, Homo Sapiens
VPSGLIVDY

SEQ ID NO: 90411 - protein, 9 aa, Homo Sapiens
VPSPAQIMY

SEQ ID NO: 90412 - protein, 9 aa, Homo Sapiens
VPTDEITVY

SEQ ID NO: 90413 - protein, 9 aa, Homo Sapiens
VPTELALLY

SEQ ID NO: 90414 - protein, 9 aa, Homo Sapiens
VPTPIHPIF

SEQ ID NO: 90415 - protein, 9 aa, Homo Sapiens
VPTPIQPTF

SEQ ID NO: 90416 - protein, 9 aa, Homo Sapiens
VPTTGIIEY

SEQ ID NO: 90417 - protein, 9 aa, Homo Sapiens
VPVDDLEVY

SEQ ID NO: 90418 - protein, 9 aa, Homo Sapiens
VPVDLQHQF

SEQ ID NO: 90419 - protein, 9 aa, Homo Sapiens
VPVDSAPVM

SEQ ID NO: 90420 - protein, 9 aa, Homo Sapiens
VPVDVVVNM

SEQ ID NO: 90421 - protein, 9 aa, Homo Sapiens
VPVEEPIAF

SEQ ID NO: 90422 - protein, 9 aa, Homo Sapiens
VPVEEQEEF

SEQ ID NO: 90423 - protein, 9 aa, Homo Sapiens
VPVGEKTTY

SEQ ID NO: 90424 - protein, 9 aa, Homo Sapiens
VPVMLTEQY

SEQ ID NO: 90425 - protein, 9 aa, Homo Sapiens
VPVNHTQVM

SEQ ID NO: 90426 - protein, 9 aa, Homo Sapiens
VPVPPLPEY

SEQ ID NO: 90427 - protein, 9 aa, Homo Sapiens
VPVPPNVAF

SEQ ID NO: 90428 - protein, 9 aa, Homo Sapiens
VPVRDIPAF

SEQ ID NO: 90429 - protein, 9 aa, Homo Sapiens
VPVSVVECF

SEQ ID NO: 90430 - protein, 9 aa, Homo Sapiens
VPVWIIHYY

SEQ ID NO: 90431 - protein, 9 aa, Homo Sapiens
VPWLSSVRY

SEQ ID NO: 90432 - protein, 9 aa, Homo Sapiens
VPWTELLSL

SEQ ID NO: 90433 - protein, 9 aa, Homo Sapiens
VPYKDEELY

SEQ ID NO: 90434 - protein, 9 aa, Homo Sapiens
VPYWPEVGM

SEQ ID NO: 90435 - protein, 9 aa, Homo Sapiens
VVAPITTGY

SEQ ID NO: 90436 - protein, 9 aa, Homo Sapiens
VVPTAILAF

SEQ ID NO: 90437 - protein, 9 aa, Homo Sapiens
WARLDETPF

SEQ ID NO: 90438 - protein, 9 aa, Homo Sapiens
WPHEDAAQF

SEQ ID NO: 90439 - protein, 9 aa, Homo Sapiens
WPIDDHFTY

SEQ ID NO: 90440 - protein, 9 aa, Homo Sapiens
YAALHGEFY

SEQ ID NO: 90441 - protein, 9 aa, Homo Sapiens
YAFDFARQS

SEQ ID NO: 90442 - protein, 9 aa, Homo Sapiens
YAFKFFDTY

SEQ ID NO: 90443 - protein, 9 aa, Homo Sapiens
YAFPKEFPY

SEQ ID NO: 90444 - protein, 9 aa, Homo Sapiens
YAHQYYMQY

SEQ ID NO: 90445 - protein, 9 aa, Homo Sapiens
YAIDNPLHY

SEQ ID NO: 90446 - protein, 9 aa, Homo Sapiens
YAIEVDPVL

SEQ ID NO: 90447 - protein, 9 aa, Homo Sapiens
YANEVGEAF

SEQ ID NO: 90448 - protein, 9 aa, Homo Sapiens
YARDETEFY

SEQ ID NO: 90449 - protein, 9 aa, Homo Sapiens
YARNDTVRF

SEQ ID NO: 90450 - protein, 9 aa, Homo Sapiens
YATFIVTNY

SEQ ID NO: 90451 - protein, 9 aa, Homo Sapiens
YAYETKDAL

SEQ ID NO: 90452 - protein, 9 aa, Homo Sapiens
YGFQEKEAF

SEQ ID NO: 90453 - protein, 9 aa, Homo Sapiens
YIFKERESF

SEQ ID NO: 90454 - protein, 9 aa, Homo Sapiens
YMFVDENTF

SEQ ID NO: 90455 - protein, 9 aa, Homo Sapiens
YPAAPLPGF

SEQ ID NO: 90456 - protein, 9 aa, Homo Sapiens
YPAAVPQAL

SEQ ID NO: 90457 - protein, 9 aa, Homo Sapiens
YPAEITLTW

SEQ ID NO: 90458 - protein, 9 aa, Homo Sapiens
YPAENLIEY

SEQ ID NO: 90459 - protein, 9 aa, Homo Sapiens
YPAHMYQVY

SEQ ID NO: 90460 - protein, 9 aa, Homo Sapiens
YPALVVEKM

SEQ ID NO: 90461 - protein, 9 aa, Homo Sapiens
YPAPGLKTF

SEQ ID NO: 90462 - protein, 9 aa, Homo Sapiens
YPAPYLDEY

SEQ ID NO: 90463 - protein, 9 aa, Homo Sapiens
YPAQGVQQF

SEQ ID NO: 90464 - protein, 9 aa, Homo Sapiens
YPAQITPKM

SEQ ID NO: 90465 - protein, 9 aa, Homo Sapiens
YPASTVQIL

SEQ ID NO: 90466 - protein, 9 aa, Homo Sapiens
YPDEKSVCL

SEQ ID NO: 90467 - protein, 9 aa, Homo Sapiens
YPDEYHGEY

SEQ ID NO: 90468 - protein, 9 aa, Homo Sapiens
YPDPRGAPW

SEQ ID NO: 90469 - protein, 9 aa, Homo Sapiens
YPDPTFPAM

SEQ ID NO: 90470 - protein, 9 aa, Homo Sapiens
YPDPVIQEL

SEQ ID NO: 90471 - protein, 9 aa, Homo Sapiens
YPDQYVREY

SEQ ID NO: 90472 - protein, 9 aa, Homo Sapiens
YPDTDVILM

SEQ ID NO: 90473 - protein, 9 aa, Homo Sapiens
YPENIVPSF

SEQ ID NO: 90474 - protein, 9 aa, Homo Sapiens
YPFDDSPEH

SEQ ID NO: 90475 - protein, 9 aa, Homo Sapiens
YPFDSPQVM

SEQ ID NO: 90476 - protein, 9 aa, Homo Sapiens
YPFENKREF

SEQ ID NO: 90477 - protein, 9 aa, Homo Sapiens
YPFKDVNNW

SEQ ID NO: 90478 - protein, 9 aa, Homo Sapiens
YPFSSEQKW

SEQ ID NO: 90479 - protein, 9 aa, Homo Sapiens
YPFYKTDPF

SEQ ID NO: 90480 - protein, 9 aa, Homo Sapiens
YPGQPHPAL

SEQ ID NO: 90481 - protein, 9 aa, Homo Sapiens
YPHDGKIFF

SEQ ID NO: 90482 - protein, 9 aa, Homo Sapiens
YPHEPTAVF

SEQ ID NO: 90483 - protein, 9 aa, Homo Sapiens
YPHQVPLVL

SEQ ID NO: 90484 - protein, 9 aa, Homo Sapiens
YPIAVDCSW

SEQ ID NO: 90485 - protein, 9 aa, Homo Sapiens
YPKANIVAY

SEQ ID NO: 90486 - protein, 9 aa, Homo Sapiens
YPLDLLLKL

SEQ ID NO: 90487 - protein, 9 aa, Homo Sapiens
YPLDVQKEF

SEQ ID NO: 90488 - protein, 9 aa, Homo Sapiens
YPLEDHTEF

SEQ ID NO: 90489 - protein, 9 aa, Homo Sapiens
YPLEDLPSL

SEQ ID NO: 90490 - protein, 9 aa, Homo Sapiens
YPLLQDPAY

SEQ ID NO: 90491 - protein, 9 aa, Homo Sapiens
YPLQEVERF

SEQ ID NO: 90492 - protein, 9 aa, Homo Sapiens
YPLTCKVVY

SEQ ID NO: 90493 - protein, 9 aa, Homo Sapiens
YPLWGGIMY

SEQ ID NO: 90494 - protein, 9 aa, Homo Sapiens
YPNEEKDAW

SEQ ID NO: 90495 - protein, 9 aa, Homo Sapiens
YPNGLQVNF

SEQ ID NO: 90496 - protein, 9 aa, Homo Sapiens
YPNGVVVHY

SEQ ID NO: 90497 - protein, 9 aa, Homo Sapiens
YPNPKPEVL

SEQ ID NO: 90498 - protein, 9 aa, Homo Sapiens
YPNSHTHYF

SEQ ID NO: 90499 - protein, 9 aa, Homo Sapiens
YPNVNIHNF

SEQ ID NO: 90500 - protein, 9 aa, Homo Sapiens
YPQDNMHQM

SEQ ID NO: 90501 - protein, 9 aa, Homo Sapiens
YPQEDYESF

SEQ ID NO: 90502 - protein, 9 aa, Homo Sapiens
YPQEVIPTF

SEQ ID NO: 90503 - protein, 9 aa, Homo Sapiens
YPQNPDHVL

SEQ ID NO: 90504 - protein, 9 aa, Homo Sapiens
YPQPPSQSY

SEQ ID NO: 90505 - protein, 9 aa, Homo Sapiens
YPRFLESEF

SEQ ID NO: 90506 - protein, 9 aa, Homo Sapiens
YPRPRDTSF

SEQ ID NO: 90507 - protein, 9 aa, Homo Sapiens
YPRSDVDLY

SEQ ID NO: 90508 - protein, 9 aa, Homo Sapiens
YPSEFATYL

SEQ ID NO: 90509 - protein, 9 aa, Homo Sapiens
YPSETTVKY

SEQ ID NO: 90510 - protein, 9 aa, Homo Sapiens
YPSIHITAY

SEQ ID NO: 90511 - protein, 9 aa, Homo Sapiens
YPSNIFISF

SEQ ID NO: 90512 - protein, 9 aa, Homo Sapiens
YPSSDNSLY

SEQ ID NO: 90513 - protein, 9 aa, Homo Sapiens
YPTEDYKVY

SEQ ID NO: 90514 - protein, 9 aa, Homo Sapiens
YPTQPGQGY

SEQ ID NO: 90515 - protein, 9 aa, Homo Sapiens
YPTVASVPH

SEQ ID NO: 90516 - protein, 9 aa, Homo Sapiens
YPVDLGDKF

SEQ ID NO: 90517 - protein, 9 aa, Homo Sapiens
YPVEHPDKF

SEQ ID NO: 90518 - protein, 9 aa, Homo Sapiens
YPVEIHEYL

SEQ ID NO: 90519 - protein, 9 aa, Homo Sapiens
YPVLVRAAF

SEQ ID NO: 90520 - protein, 9 aa, Homo Sapiens
YPVPDVSTY

SEQ ID NO: 90521 - protein, 9 aa, Homo Sapiens
YPVSSPKSM

SEQ ID NO: 90522 - protein, 9 aa, Homo Sapiens
YPWSQRVSF

SEQ ID NO: 90523 - protein, 9 aa, Homo Sapiens
YPWWEQQGF

SEQ ID NO: 90524 - protein, 9 aa, Homo Sapiens
YPYEAPPSY

SEQ ID NO: 90525 - protein, 9 aa, Homo Sapiens
YPYNPPICF

SEQ ID NO: 90526 - protein, 9 aa, Homo Sapiens
YPYPYPHTL

SEQ ID NO: 90527 - protein, 9 aa, Homo Sapiens
YPYTETQMY

SEQ ID NO: 90528 - protein, 9 aa, Homo Sapiens
YVVDLDDEY

SEQ ID NO: 90529 - protein, 10 aa, Homo Sapiens
AGHINPLIIY

SEQ ID NO: 90530 - protein, 10 aa, Homo Sapiens
APIDEAFESY

SEQ ID NO: 90531 - protein, 10 aa, Homo Sapiens
AQAGWLQHDY

SEQ ID NO: 90532 - protein, 10 aa, Homo Sapiens
CPASLRDVAY

SEQ ID NO: 90533 - protein, 10 aa, Homo Sapiens
DAFLEQAVSY

SEQ ID NO: 90534 - protein, 10 aa, Homo Sapiens
DAWEGKGVSY

SEQ ID NO: 90535 - protein, 10 aa, Homo Sapiens
DAWLEMNPGY

SEQ ID NO: 90536 - protein, 10 aa, Homo Sapiens
DPIGGHIHSY

SEQ ID NO: 90537 - protein, 10 aa, Homo Sapiens
EAARLEYDAY

SEQ ID NO: 90538 - protein, 10 aa, Homo Sapiens
EAIKILKGEY

SEQ ID NO: 90539 - protein, 10 aa, Homo Sapiens
EAMRIGAEVY

SEQ ID NO: 90540 - protein, 10 aa, Homo Sapiens
EAVWLTDNTY

SEQ ID NO: 90541 - protein, 10 aa, Homo Sapiens
EAWADDVERF

SEQ ID NO: 90542 - protein, 10 aa, Homo Sapiens
EAWASKDATY

SEQ ID NO: 90543 - protein, 10 aa, Homo Sapiens
EAWHELAELY

SEQ ID NO: 90544 - protein, 10 aa, Homo Sapiens
EAWLEMNPGY

SEQ ID NO: 90545 - protein, 10 aa, Homo Sapiens
EPAHRTAPAG

SEQ ID NO: 90546 - protein, 10 aa, Homo Sapiens
EPVDHGKIEY

SEQ ID NO: 90547 - protein, 10 aa, Homo Sapiens
EPWPENATLY

SEQ ID NO: 90548 - protein, 10 aa, Homo Sapiens
FAAQTVGNTY

SEQ ID NO: 90549 - protein, 10 aa, Homo Sapiens
FADPHSKRVF

SEQ ID NO: 90550 - protein, 10 aa, Homo Sapiens
FANPEDCVAF

SEQ ID NO: 90551 - protein, 10 aa, Homo Sapiens
FAVDLEHHSY

SEQ ID NO: 90552 - protein, 10 aa, Homo Sapiens
FAYSDSRVGF

SEQ ID NO: 90553 - protein, 10 aa, Homo Sapiens
FPAGILQAPF

SEQ ID NO: 90554 - protein, 10 aa, Homo Sapiens
FPAGIYDTKY

SEQ ID NO: 90555 - protein, 10 aa, Homo Sapiens
FPAPAKAVVY

SEQ ID NO: 90556 - protein, 10 aa, Homo Sapiens
FPASFPNRQY

SEQ ID NO: 90557 - protein, 10 aa, Homo Sapiens
FPASVHTTRY

SEQ ID NO: 90558 - protein, 10 aa, Homo Sapiens
FPDEPYKDGY

SEQ ID NO: 90559 - protein, 10 aa, Homo Sapiens
FPDPEKPCKM

SEQ ID NO: 90560 - protein, 10 aa, Homo Sapiens
FPDPNVKYVF

SEQ ID NO: 90561 - protein, 10 aa, Homo Sapiens
FPDTGSDHSY

SEQ ID NO: 90562 - protein, 10 aa, Homo Sapiens
FPEAYKPTVY

SEQ ID NO: 90563 - protein, 10 aa, Homo Sapiens
FPEEVIATIF

SEQ ID NO: 90564 - protein, 10 aa, Homo Sapiens
FPEGLVIQAY

SEQ ID NO: 90565 - protein, 10 aa, Homo Sapiens
FPEPSRPPLF

SEQ ID NO: 90566 - protein, 10 aa, Homo Sapiens
FPESLVIQAY

SEQ ID NO: 90567 - protein, 10 aa, Homo Sapiens
FPESSAIEAL

SEQ ID NO: 90568 - protein, 10 aa, Homo Sapiens
FPETTSPHEY

SEQ ID NO: 90569 - protein, 10 aa, Homo Sapiens
FPFEKGSVQY

SEQ ID NO: 90570 - protein, 10 aa, Homo Sapiens
FPFHEVIQEF

SEQ ID NO: 90571 - protein, 10 aa, Homo Sapiens
FPFPKPDLIF

SEQ ID NO: 90572 - protein, 10 aa, Homo Sapiens
FPFSQDINSH

SEQ ID NO: 90573 - protein, 10 aa, Homo Sapiens
FPHNFQETTY

SEQ ID NO: 90574 - protein, 10 aa, Homo Sapiens
FPHPVNQVTF

SEQ ID NO: 90575 - protein, 10 aa, Homo Sapiens
FPMTHGNTGF

SEQ ID NO: 90576 - protein, 10 aa, Homo Sapiens
FPNTETNGEF

SEQ ID NO: 90577 - protein, 10 aa, Homo Sapiens
FPRAQDKVHY

SEQ ID NO: 90578 - protein, 10 aa, Homo Sapiens
FPSEYVPTVF

SEQ ID NO: 90579 - protein, 10 aa, Homo Sapiens
FPSPILKVQY

SEQ ID NO: 90580 - protein, 10 aa, Homo Sapiens
FPSSVAALRF

SEQ ID NO: 90581 - protein, 10 aa, Homo Sapiens
FPSTICTESF

SEQ ID NO: 90582 - protein, 10 aa, Homo Sapiens
FPTDPKVVVY

SEQ ID NO: 90583 - protein, 10 aa, Homo Sapiens
FPVAGQKLIY

SEQ ID NO: 90584 - protein, 10 aa, Homo Sapiens
FPVEEKAVEY

SEQ ID NO: 90585 - protein, 10 aa, Homo Sapiens
FPVEIKSFYM

SEQ ID NO: 90586 - protein, 10 aa, Homo Sapiens
FPVKGLKTGY

SEQ ID NO: 90587 - protein, 10 aa, Homo Sapiens
FPVPGSGLVL

SEQ ID NO: 90588 - protein, 10 aa, Homo Sapiens
FPWGDGNHTL

SEQ ID NO: 90589 - protein, 10 aa, Homo Sapiens
FPYADGPHQF

SEQ ID NO: 90590 - protein, 10 aa, Homo Sapiens
FPYDYSASEY

SEQ ID NO: 90591 - protein, 10 aa, Homo Sapiens
FPYEESKEKF

SEQ ID NO: 90592 - protein, 10 aa, Homo Sapiens
FPYIEAEVKY

SEQ ID NO: 90593 - protein, 10 aa, Homo Sapiens
FPYQDKLVGY

SEQ ID NO: 90594 - protein, 10 aa, Homo Sapiens
FPYSENKEKY

SEQ ID NO: 90595 - protein, 10 aa, Homo Sapiens
HAAESISSPY

SEQ ID NO: 90596 - protein, 10 aa, Homo Sapiens
HAARIINDLL

SEQ ID NO: 90597 - protein, 10 aa, Homo Sapiens
HACDVVAVTL

SEQ ID NO: 90598 - protein, 10 aa, Homo Sapiens
HAEASAIVEY

SEQ ID NO: 90599 - protein, 10 aa, Homo Sapiens
HAFGGNKASY

SEQ ID NO: 90600 - protein, 10 aa, Homo Sapiens
HAIQDLLVFY

SEQ ID NO: 90601 - protein, 10 aa, Homo Sapiens
HAYIFRPEVY

SEQ ID NO: 90602 - protein, 10 aa, Homo Sapiens
HPCGADVPSY

SEQ ID NO: 90603 - protein, 10 aa, Homo Sapiens
HPDAPMSQVY

SEQ ID NO: 90604 - protein, 10 aa, Homo Sapiens
HPDEKSIITY

SEQ ID NO: 90605 - protein, 10 aa, Homo Sapiens
HPDPFANKSL

SEQ ID NO: 90606 - protein, 10 aa, Homo Sapiens
HPEASIQAVF

SEQ ID NO: 90607 - protein, 10 aa, Homo Sapiens
HPFHATPNTY

SEQ ID NO: 90608 - protein, 10 aa, Homo Sapiens
HPFHATPNVY

SEQ ID NO: 90609 - protein, 10 aa, Homo Sapiens
HPFLSGAETF

SEQ ID NO: 90610 - protein, 10 aa, Homo Sapiens
HPFLYDRETY

SEQ ID NO: 90611 - protein, 10 aa, Homo Sapiens
HPFTNKPTTF

SEQ ID NO: 90612 - protein, 10 aa, Homo Sapiens
HPHPFLNSVY

SEQ ID NO: 90613 - protein, 10 aa, Homo Sapiens
HPHQNLIATY

SEQ ID NO: 90614 - protein, 10 aa, Homo Sapiens
HPIDDLQSAY

SEQ ID NO: 90615 - protein, 10 aa, Homo Sapiens
HPIDGFLQSL

SEQ ID NO: 90616 - protein, 10 aa, Homo Sapiens
HPIEGSTTVF

SEQ ID NO: 90617 - protein, 10 aa, Homo Sapiens
HPIETLVDIF

SEQ ID NO: 90618 - protein, 10 aa, Homo Sapiens
HPIHADNCLL

SEQ ID NO: 90619 - protein, 10 aa, Homo Sapiens
HPIHQGITEL

SEQ ID NO: 90620 - protein, 10 aa, Homo Sapiens
HPIIPEQSTF

SEQ ID NO: 90621 - protein, 10 aa, Homo Sapiens
HPISDHEATL

SEQ ID NO: 90622 - protein, 10 aa, Homo Sapiens
HPISSGLEAM

SEQ ID NO: 90623 - protein, 10 aa, Homo Sapiens
HPLSLTSDQY

SEQ ID NO: 90624 - protein, 10 aa, Homo Sapiens
HPLSVLGINY

SEQ ID NO: 90625 - protein, 10 aa, Homo Sapiens
HPLYPFNDPY

SEQ ID NO: 90626 - protein, 10 aa, Homo Sapiens
HPNLVVGGTY

SEQ ID NO: 90627 - protein, 10 aa, Homo Sapiens
HPNNVVSIKY

SEQ ID NO: 90628 - protein, 10 aa, Homo Sapiens
HPNNVVSVKY

SEQ ID NO: 90629 - protein, 10 aa, Homo Sapiens
HPNSCNTFVY

SEQ ID NO: 90630 - protein, 10 aa, Homo Sapiens
HPNYLGDLIM

SEQ ID NO: 90631 - protein, 10 aa, Homo Sapiens
HPTLGPKITY

SEQ ID NO: 90632 - protein, 10 aa, Homo Sapiens
HPVAKILHAY

SEQ ID NO: 90633 - protein, 10 aa, Homo Sapiens
HPVEELLDSY

SEQ ID NO: 90634 - protein, 10 aa, Homo Sapiens
HPVRDPVHMY

SEQ ID NO: 90635 - protein, 10 aa, Homo Sapiens
HPVSLEQYLM

SEQ ID NO: 90636 - protein, 10 aa, Homo Sapiens
HPVYILKGGY

SEQ ID NO: 90637 - protein, 10 aa, Homo Sapiens
HPWEVMPDLY

SEQ ID NO: 90638 - protein, 10 aa, Homo Sapiens
HPWFGMEQEY

SEQ ID NO: 90639 - protein, 10 aa, Homo Sapiens
HPYSQALIQY

SEQ ID NO: 90640 - protein, 10 aa, Homo Sapiens
IPAPGSGVSF

SEQ ID NO: 90641 - protein, 10 aa, Homo Sapiens
IPFDGDLLSM

SEQ ID NO: 90642 - protein, 10 aa, Homo Sapiens
IPFDPKFITY

SEQ ID NO: 90643 - protein, 10 aa, Homo Sapiens
IPFLGHAIAF

SEQ ID NO: 90644 - protein, 10 aa, Homo Sapiens
IPFSGKGYVL

SEQ ID NO: 90645 - protein, 10 aa, Homo Sapiens
IPIAGRDITY

SEQ ID NO: 90646 - protein, 10 aa, Homo Sapiens
IPLDGETWSY

SEQ ID NO: 90647 - protein, 10 aa, Homo Sapiens
IPLHQINQVY

SEQ ID NO: 90648 - protein, 10 aa, Homo Sapiens
IPMELINEVM

SEQ ID NO: 90649 - protein, 10 aa, Homo Sapiens
IPMELVNEVM

SEQ ID NO: 90650 - protein, 10 aa, Homo Sapiens
IPSSVIHPAM

SEQ ID NO: 90651 - protein, 10 aa, Homo Sapiens
IPVEQKEGAF

SEQ ID NO: 90652 - protein, 10 aa, Homo Sapiens
LAWLDEHVAF

SEQ ID NO: 90653 - protein, 10 aa, Homo Sapiens
LPAAAAAGAA

SEQ ID NO: 90654 - protein, 10 aa, Homo Sapiens
LPAAAQDVYY

SEQ ID NO: 90655 - protein, 10 aa, Homo Sapiens
LPADITEDEF

SEQ ID NO: 90656 - protein, 10 aa, Homo Sapiens
LPDLSGPHSY

SEQ ID NO: 90657 - protein, 10 aa, Homo Sapiens
LPEARGRAGL

SEQ ID NO: 90658 - protein, 10 aa, Homo Sapiens
LPFEGKCYYF

SEQ ID NO: 90659 - protein, 10 aa, Homo Sapiens
LPFPGRSASY

SEQ ID NO: 90660 - protein, 10 aa, Homo Sapiens
LPFPNPERNF

SEQ ID NO: 90661 - protein, 10 aa, Homo Sapiens
LPFSSMPTAY

SEQ ID NO: 90662 - protein, 10 aa, Homo Sapiens
LPHPYAIAVF

SEQ ID NO: 90663 - protein, 10 aa, Homo Sapiens
LPIAPDLEHF

SEQ ID NO: 90664 - protein, 10 aa, Homo Sapiens
LPIDGANDLF

SEQ ID NO: 90665 - protein, 10 aa, Homo Sapiens
LPIDPNEPTY

SEQ ID NO: 90666 - protein, 10 aa, Homo Sapiens
LPIENDVYKY

SEQ ID NO: 90667 - protein, 10 aa, Homo Sapiens
LPIESNPHSF

SEQ ID NO: 90668 - protein, 10 aa, Homo Sapiens
LPIGDVATQY

SEQ ID NO: 90669 - protein, 10 aa, Homo Sapiens
LPIPGPVEEM

SEQ ID NO: 90670 - protein, 10 aa, Homo Sapiens
LPIPSKLLEF

SEQ ID NO: 90671 - protein, 10 aa, Homo Sapiens
LPLERDAESF

SEQ ID NO: 90672 - protein, 10 aa, Homo Sapiens
LPLPAPHAQY

SEQ ID NO: 90673 - protein, 10 aa, Homo Sapiens
LPLPSCLPAL

SEQ ID NO: 90674 - protein, 10 aa, Homo Sapiens
LPLPSPALEY

SEQ ID NO: 90675 - protein, 10 aa, Homo Sapiens
LPLSIKDDEY

SEQ ID NO: 90676 - protein, 10 aa, Homo Sapiens
LPMKETGLMY

SEQ ID NO: 90677 - protein, 10 aa, Homo Sapiens
LPQPPEGQTY

SEQ ID NO: 90678 - protein, 10 aa, Homo Sapiens
LPSEAGFAEY

SEQ ID NO: 90679 - protein, 10 aa, Homo Sapiens
LPSPVTAQKY

SEQ ID NO: 90680 - protein, 10 aa, Homo Sapiens
LPTAAHFIEY

SEQ ID NO: 90681 - protein, 10 aa, Homo Sapiens
LPTEPPYTAY

SEQ ID NO: 90682 - protein, 10 aa, Homo Sapiens
LPVEQGNFPY

SEQ ID NO: 90683 - protein, 10 aa, Homo Sapiens
LPVGNETGLL

SEQ ID NO: 90684 - protein, 10 aa, Homo Sapiens
LPWEDPSFQY

SEQ ID NO: 90685 - protein, 10 aa, Homo Sapiens
LPYNHQHEYF

SEQ ID NO: 90686 - protein, 10 aa, Homo Sapiens
MALQEACEAY

SEQ ID NO: 90687 - protein, 10 aa, Homo Sapiens
MALQEASEAY

SEQ ID NO: 90688 - protein, 10 aa, Homo Sapiens
MAYEGQYDAY

SEQ ID NO: 90689 - protein, 10 aa, Homo Sapiens
MPADSGYPAY

SEQ ID NO: 90690 - protein, 10 aa, Homo Sapiens
MPALFSDHTF

SEQ ID NO: 90691 - protein, 10 aa, Homo Sapiens
MPAPHTSITM

SEQ ID NO: 90692 - protein, 10 aa, Homo Sapiens
MPCPVPPARM

SEQ ID NO: 90693 - protein, 10 aa, Homo Sapiens
MPEEKLVEAL

SEQ ID NO: 90694 - protein, 10 aa, Homo Sapiens
MPEPDAQRFF

SEQ ID NO: 90695 - protein, 10 aa, Homo Sapiens
MPESGPSYEF

SEQ ID NO: 90696 - protein, 10 aa, Homo Sapiens
MPFAPAIQTF

SEQ ID NO: 90697 - protein, 10 aa, Homo Sapiens
MPFEIRLPEF

SEQ ID NO: 90698 - protein, 10 aa, Homo Sapiens
MPFKDRATSM

SEQ ID NO: 90699 - protein, 10 aa, Homo Sapiens
MPFQRAGVNF

SEQ ID NO: 90700 - protein, 10 aa, Homo Sapiens
MPHANMNVHY

SEQ ID NO: 90701 - protein, 10 aa, Homo Sapiens
MPHAPIGLYF

SEQ ID NO: 90702 - protein, 10 aa, Homo Sapiens
MPHEDCITAL

SEQ ID NO: 90703 - protein, 10 aa, Homo Sapiens
MPIPGGNQRF

SEQ ID NO: 90704 - protein, 10 aa, Homo Sapiens
MPLEEGDTFF

SEQ ID NO: 90705 - protein, 10 aa, Homo Sapiens
MPLGSAVDIL

SEQ ID NO: 90706 - protein, 10 aa, Homo Sapiens
MPLSNGLQLY

SEQ ID NO: 90707 - protein, 10 aa, Homo Sapiens
MPNSASRDEF

SEQ ID NO: 90708 - protein, 10 aa, Homo Sapiens
MPPQNVGEVY

SEQ ID NO: 90709 - protein, 10 aa, Homo Sapiens
MPSQSVEQTY

SEQ ID NO: 90710 - protein, 10 aa, Homo Sapiens
MPSSDTTVTF

SEQ ID NO: 90711 - protein, 10 aa, Homo Sapiens
MPTGEAMVAF

SEQ ID NO: 90712 - protein, 10 aa, Homo Sapiens
MPVDDVIGTL

SEQ ID NO: 90713 - protein, 10 aa, Homo Sapiens
MPVDPNEPTY

SEQ ID NO: 90714 - protein, 10 aa, Homo Sapiens
MPVPSMVPSY

SEQ ID NO: 90715 - protein, 10 aa, Homo Sapiens
MPVTYKDPAY

SEQ ID NO: 90716 - protein, 10 aa, Homo Sapiens
MPYDTPVPGY

SEQ ID NO: 90717 - protein, 10 aa, Homo Sapiens
MVNPFAYEEY

SEQ ID NO: 90718 - protein, 10 aa, Homo Sapiens
MVYAATPIDF

SEQ ID NO: 90719 - protein, 10 aa, Homo Sapiens
NAARSQLETY

SEQ ID NO: 90720 - protein, 10 aa, Homo Sapiens
NAFYEHAQTY

SEQ ID NO: 90721 - protein, 10 aa, Homo Sapiens
NALNEQRVEF

SEQ ID NO: 90722 - protein, 10 aa, Homo Sapiens
NAVDALIDSM

SEQ ID NO: 90723 - protein, 10 aa, Homo Sapiens
NPFHWGEVEY

SEQ ID NO: 90724 - protein, 10 aa, Homo Sapiens
NPMMEDGISY

SEQ ID NO: 90725 - protein, 10 aa, Homo Sapiens
NVVKLLGEQY

SEQ ID NO: 90726 - protein, 10 aa, Homo Sapiens
QAFQERLNSY

SEQ ID NO: 90727 - protein, 10 aa, Homo Sapiens
QALRLEREEY

SEQ ID NO: 90728 - protein, 10 aa, Homo Sapiens
QARPELLEVF

SEQ ID NO: 90729 - protein, 10 aa, Homo Sapiens
QAYPEYLITY

SEQ ID NO: 90730 - protein, 10 aa, Homo Sapiens
QPAIIDGELY

SEQ ID NO: 90731 - protein, 10 aa, Homo Sapiens
QPAQDIFSVY

SEQ ID NO: 90732 - protein, 10 aa, Homo Sapiens
QPDPDAIKMF

SEQ ID NO: 90733 - protein, 10 aa, Homo Sapiens
QPWEEIKTSY

SEQ ID NO: 90734 - protein, 10 aa, Homo Sapiens
SALDRCYSVY

SEQ ID NO: 90735 - protein, 10 aa, Homo Sapiens
SASEVTSTVY

SEQ ID NO: 90736 - protein, 10 aa, Homo Sapiens
SMPADVSEAL

SEQ ID NO: 90737 - protein, 10 aa, Homo Sapiens
SPASDTYIVF

SEQ ID NO: 90738 - protein, 10 aa, Homo Sapiens
SPFPGPDPGF

SEQ ID NO: 90739 - protein, 10 aa, Homo Sapiens
SPFYPGKTTY

SEQ ID NO: 90740 - protein, 10 aa, Homo Sapiens
SPIEFLENAY

SEQ ID NO: 90741 - protein, 10 aa, Homo Sapiens
SPIPFPPLSY

SEQ ID NO: 90742 - protein, 10 aa, Homo Sapiens
SPPIIVGEEY

SEQ ID NO: 90743 - protein, 10 aa, Homo Sapiens
SPQPDGKVVY

SEQ ID NO: 90744 - protein, 10 aa, Homo Sapiens
SPVSKGILQY

SEQ ID NO: 90745 - protein, 10 aa, Homo Sapiens
SQRPPTRETF

SEQ ID NO: 90746 - protein, 10 aa, Homo Sapiens
SVAEITNACF

SEQ ID NO: 90747 - protein, 10 aa, Homo Sapiens
TAALIKGELY

SEQ ID NO: 90748 - protein, 10 aa, Homo Sapiens
TAHDDRGIRF

SEQ ID NO: 90749 - protein, 10 aa, Homo Sapiens
TAIGAHPVSM

SEQ ID NO: 90750 - protein, 10 aa, Homo Sapiens
TANPQTPVEY

SEQ ID NO: 90751 - protein, 10 aa, Homo Sapiens
TAVHLVDSHY

SEQ ID NO: 90752 - protein, 10 aa, Homo Sapiens
TAWDEADVRF

SEQ ID NO: 90753 - protein, 10 aa, Homo Sapiens
TAWLEIMTKY

SEQ ID NO: 90754 - protein, 10 aa, Homo Sapiens
TPCPGPFLRY

SEQ ID NO: 90755 - protein, 10 aa, Homo Sapiens
TPLSLFGDTY

SEQ ID NO: 90756 - protein, 10 aa, Homo Sapiens
TPNPGYQPSM

SEQ ID NO: 90757 - protein, 10 aa, Homo Sapiens
VPFSSCLEAY

SEQ ID NO: 90758 - protein, 10 aa, Homo Sapiens
VPLEEAAQEY

SEQ ID NO: 90759 - protein, 10 aa, Homo Sapiens
VPLREINQKY

SEQ ID NO: 90760 - protein, 10 aa, Homo Sapiens
VPYPDDLVGF

SEQ ID NO: 90761 - protein, 10 aa, Homo Sapiens
YAAPAPEQAY

SEQ ID NO: 90762 - protein, 10 aa, Homo Sapiens
YAAPHPLQSY

SEQ ID NO: 90763 - protein, 10 aa, Homo Sapiens
YAFQDDRYLY

SEQ ID NO: 90764 - protein, 10 aa, Homo Sapiens
YALEEGIVRY

SEQ ID NO: 90765 - protein, 10 aa, Homo Sapiens
YAQDEHLITF

SEQ ID NO: 90766 - protein, 10 aa, Homo Sapiens
YAWRPVFDEY

SEQ ID NO: 90767 - protein, 10 aa, Homo Sapiens
YDAEISQIHQ

SEQ ID NO: 90768 - protein, 10 aa, Homo Sapiens
YPAHIEDIDY

SEQ ID NO: 90769 - protein, 10 aa, Homo Sapiens
YPATGADVAF

SEQ ID NO: 90770 - protein, 10 aa, Homo Sapiens
YPDPSKQKPM

SEQ ID NO: 90771 - protein, 10 aa, Homo Sapiens
YPEPQNKEAF

SEQ ID NO: 90772 - protein, 10 aa, Homo Sapiens
YPFDSPQVMF

SEQ ID NO: 90773 - protein, 10 aa, Homo Sapiens
YPFHKQPPTY

SEQ ID NO: 90774 - protein, 10 aa, Homo Sapiens
YPFIISSESY

SEQ ID NO: 90775 - protein, 10 aa, Homo Sapiens
YPFKPPKIAF

SEQ ID NO: 90776 - protein, 10 aa, Homo Sapiens
YPFKPPKITF

SEQ ID NO: 90777 - protein, 10 aa, Homo Sapiens
YPFKPPKVAF

SEQ ID NO: 90778 - protein, 10 aa, Homo Sapiens
YPFKPPKVTF

SEQ ID NO: 90779 - protein, 10 aa, Homo Sapiens
YPFKSPSIGF

SEQ ID NO: 90780 - protein, 10 aa, Homo Sapiens
YPFLLVGDLM

SEQ ID NO: 90781 - protein, 10 aa, Homo Sapiens
YPFPTFQPAF

SEQ ID NO: 90782 - protein, 10 aa, Homo Sapiens
YPIALTRAEM

SEQ ID NO: 90783 - protein, 10 aa, Homo Sapiens
YPIDDVYTGM

SEQ ID NO: 90784 - protein, 10 aa, Homo Sapiens
YPIDPVTQEF

SEQ ID NO: 90785 - protein, 10 aa, Homo Sapiens
YPLEVTKLIY

SEQ ID NO: 90786 - protein, 10 aa, Homo Sapiens
YPLPAVKVSM

SEQ ID NO: 90787 - protein, 10 aa, Homo Sapiens
YPLTSPPTSY

SEQ ID NO: 90788 - protein, 10 aa, Homo Sapiens
YPMYSRDYVY

SEQ ID NO: 90789 - protein, 10 aa, Homo Sapiens
YPRFLESEFY

SEQ ID NO: 90790 - protein, 10 aa, Homo Sapiens
YPTSIASLAF

SEQ ID NO: 90791 - protein, 10 aa, Homo Sapiens
YPVEDFEASF

SEQ ID NO: 90792 - protein, 10 aa, Homo Sapiens
YPYGEKQDEF

SEQ ID NO: 90793 - protein, 10 aa, Homo Sapiens
YPYNAPTVKF

SEQ ID NO: 90794 - protein, 10 aa, Homo Sapiens
YPYPGELTMM

SEQ ID NO: 90795 - protein, 10 aa, Homo Sapiens
YPYPPPPPEF

SEQ ID NO: 90796 - protein, 10 aa, Homo Sapiens
YPYPPVPETF

SEQ ID NO: 90797 - protein, 10 aa, Homo Sapiens
YPYPYPHTLY

SEQ ID NO: 90798 - protein, 10 aa, Homo Sapiens
YVFDGTNPPY

SEQ ID NO: 90799 - protein, 10 aa, Homo Sapiens
YVHDDGRVSY

SEQ ID NO: 90800 - protein, 11 aa, Homo Sapiens
APWIESQDWAY

SEQ ID NO: 90801 - protein, 11 aa, Homo Sapiens
CPRVINLHEVY

SEQ ID NO: 90802 - protein, 11 aa, Homo Sapiens
DAIRSLASVSY

SEQ ID NO: 90803 - protein, 11 aa, Homo Sapiens
DPFSFDGPEIM

SEQ ID NO: 90804 - protein, 11 aa, Homo Sapiens
DVREEGKENAF

SEQ ID NO: 90805 - protein, 11 aa, Homo Sapiens
EAFDELLASKY

SEQ ID NO: 90806 - protein, 11 aa, Homo Sapiens
EAVFLRGVDIY

SEQ ID NO: 90807 - protein, 11 aa, Homo Sapiens
EAWNEEGKAVW

SEQ ID NO: 90808 - protein, 11 aa, Homo Sapiens
ELPQDVPEEPN

SEQ ID NO: 90809 - protein, 11 aa, Homo Sapiens
EPIYPEVVHMF

SEQ ID NO: 90810 - protein, 11 aa, Homo Sapiens
EPMSIDCGHSF

SEQ ID NO: 90811 - protein, 11 aa, Homo Sapiens
EPVPASIPNYY

SEQ ID NO: 90812 - protein, 11 aa, Homo Sapiens
ETQITQIEHEV

SEQ ID NO: 90813 - protein, 11 aa, Homo Sapiens
FAKSVSFSDVF

SEQ ID NO: 90814 - protein, 11 aa, Homo Sapiens
FALPSELERSY

SEQ ID NO: 90815 - protein, 11 aa, Homo Sapiens
FASKEIAENAL

SEQ ID NO: 90816 - protein, 11 aa, Homo Sapiens
FPAGSVHVNVY

SEQ ID NO: 90817 - protein, 11 aa, Homo Sapiens
FPASPPKGYFL

SEQ ID NO: 90818 - protein, 11 aa, Homo Sapiens
FPAVEPAVVKF

SEQ ID NO: 90819 - protein, 11 aa, Homo Sapiens
FPEPNPRVIEL

SEQ ID NO: 90820 - protein, 11 aa, Homo Sapiens
FPFGYVSNIHY

SEQ ID NO: 90821 - protein, 11 aa, Homo Sapiens
FPFLPGGPPEY

SEQ ID NO: 90822 - protein, 11 aa, Homo Sapiens
FPFLSGDNQHY

SEQ ID NO: 90823 - protein, 11 aa, Homo Sapiens
FPFNPLDFESF

SEQ ID NO: 90824 - protein, 11 aa, Homo Sapiens
FPFSAVVPAAL

SEQ ID NO: 90825 - protein, 11 aa, Homo Sapiens
FPHHLQEYIEY

SEQ ID NO: 90826 - protein, 11 aa, Homo Sapiens
FPHLPGKTFVY

SEQ ID NO: 90827 - protein, 11 aa, Homo Sapiens
FPIIIHDEPTY

SEQ ID NO: 90828 - protein, 11 aa, Homo Sapiens
FPLDVGSIVGY

SEQ ID NO: 90829 - protein, 11 aa, Homo Sapiens
FPLEAVREDAF

SEQ ID NO: 90830 - protein, 11 aa, Homo Sapiens
FPLIEVNKVYY

SEQ ID NO: 90831 - protein, 11 aa, Homo Sapiens
FPLLPQDVHLL

SEQ ID NO: 90832 - protein, 11 aa, Homo Sapiens
FPLQPGKVATF

SEQ ID NO: 90833 - protein, 11 aa, Homo Sapiens
FPNIVIKGSEL

SEQ ID NO: 90834 - protein, 11 aa, Homo Sapiens
FPQEEAIIDKY

SEQ ID NO: 90835 - protein, 11 aa, Homo Sapiens
FPVDPQRMSIF

SEQ ID NO: 90836 - protein, 11 aa, Homo Sapiens
FPVPESILTSM

SEQ ID NO: 90837 - protein, 11 aa, Homo Sapiens
FPVYVLPKVEY

SEQ ID NO: 90838 - protein, 11 aa, Homo Sapiens
FPWEVPKKLKY

SEQ ID NO: 90839 - protein, 11 aa, Homo Sapiens
FPWGDGNHTLF

SEQ ID NO: 90840 - protein, 11 aa, Homo Sapiens
FPYIEENVKEY

SEQ ID NO: 90841 - protein, 11 aa, Homo Sapiens
HAAEDSSLLIY

SEQ ID NO: 90842 - protein, 11 aa, Homo Sapiens
HAAVAIACVVM

SEQ ID NO: 90843 - protein, 11 aa, Homo Sapiens
HACGVIATIAF

SEQ ID NO: 90844 - protein, 11 aa, Homo Sapiens
HAGPPYEDIAF

SEQ ID NO: 90845 - protein, 11 aa, Homo Sapiens
HATVATENEVF

SEQ ID NO: 90846 - protein, 11 aa, Homo Sapiens
HAVDVDSGNSY

SEQ ID NO: 90847 - protein, 11 aa, Homo Sapiens
HAVDVDSGSVY

SEQ ID NO: 90848 - protein, 11 aa, Homo Sapiens
HAWLQAGKIYY

SEQ ID NO: 90849 - protein, 11 aa, Homo Sapiens
HPAPLCTIRTL

SEQ ID NO: 90850 - protein, 11 aa, Homo Sapiens
HPASVLSQPQY

SEQ ID NO: 90851 - protein, 11 aa, Homo Sapiens
HPDPDAELQRM

SEQ ID NO: 90852 - protein, 11 aa, Homo Sapiens
HPDTGISSKAM

SEQ ID NO: 90853 - protein, 11 aa, Homo Sapiens
HPFPSPATDLY

SEQ ID NO: 90854 - protein, 11 aa, Homo Sapiens
HPKDIRESDYF

SEQ ID NO: 90855 - protein, 11 aa, Homo Sapiens
HPLEDRNTIEM

SEQ ID NO: 90856 - protein, 11 aa, Homo Sapiens
HPLPETAVRGY

SEQ ID NO: 90857 - protein, 11 aa, Homo Sapiens
HPLSECEFQEY

SEQ ID NO: 90858 - protein, 11 aa, Homo Sapiens
HPNIITLKDVY

SEQ ID NO: 90859 - protein, 11 aa, Homo Sapiens
HPQGSTAGVVY

SEQ ID NO: 90860 - protein, 11 aa, Homo Sapiens
HPTDITSLDQY

SEQ ID NO: 90861 - protein, 11 aa, Homo Sapiens
HVRPVTQGDVY

SEQ ID NO: 90862 - protein, 11 aa, Homo Sapiens
IARREEEFDLF

SEQ ID NO: 90863 - protein, 11 aa, Homo Sapiens
IPEGEILVITY

SEQ ID NO: 90864 - protein, 11 aa, Homo Sapiens
IPFSSDVTHEM

SEQ ID NO: 90865 - protein, 11 aa, Homo Sapiens
IPIALSGRDIL

SEQ ID NO: 90866 - protein, 11 aa, Homo Sapiens
IPIGGGTSVSY

SEQ ID NO: 90867 - protein, 11 aa, Homo Sapiens
IPSEDIARNLM

SEQ ID NO: 90868 - protein, 11 aa, Homo Sapiens
IPWKHAGKQDY

SEQ ID NO: 90869 - protein, 11 aa, Homo Sapiens
IPYHSEVPVSL

SEQ ID NO: 90870 - protein, 11 aa, Homo Sapiens
IPYSEPMPLSF

SEQ ID NO: 90871 - protein, 11 aa, Homo Sapiens
KPYNPIIGETF

SEQ ID NO: 90872 - protein, 11 aa, Homo Sapiens
LAAAAAASYQV

SEQ ID NO: 90873 - protein, 11 aa, Homo Sapiens
LAAVAGARDTY

SEQ ID NO: 90874 - protein, 11 aa, Homo Sapiens
LPAAGVGDMVM

SEQ ID NO: 90875 - protein, 11 aa, Homo Sapiens
LPADIRIPDGY

SEQ ID NO: 90876 - protein, 11 aa, Homo Sapiens
LPAETGQNHPF

SEQ ID NO: 90877 - protein, 11 aa, Homo Sapiens
LPAKDIQTNVY

SEQ ID NO: 90878 - protein, 11 aa, Homo Sapiens
LPAPPHIDVMY

SEQ ID NO: 90879 - protein, 11 aa, Homo Sapiens
LPEAQLSTVEY

SEQ ID NO: 90880 - protein, 11 aa, Homo Sapiens
LPFCQPSKITY

SEQ ID NO: 90881 - protein, 11 aa, Homo Sapiens
LPFLPSTEDVY

SEQ ID NO: 90882 - protein, 11 aa, Homo Sapiens
LPFPDETHERY

SEQ ID NO: 90883 - protein, 11 aa, Homo Sapiens
LPIGDVATQYF

SEQ ID NO: 90884 - protein, 11 aa, Homo Sapiens
LPINDPLQTVY

SEQ ID NO: 90885 - protein, 11 aa, Homo Sapiens
LPLDDGAAHVM

SEQ ID NO: 90886 - protein, 11 aa, Homo Sapiens
LPLFPEPLHVF

SEQ ID NO: 90887 - protein, 11 aa, Homo Sapiens
LPLGSCASKML

SEQ ID NO: 90888 - protein, 11 aa, Homo Sapiens
LPLNTNIRLAY

SEQ ID NO: 90889 - protein, 11 aa, Homo Sapiens
LPRTTTESEVM

SEQ ID NO: 90890 - protein, 11 aa, Homo Sapiens
LPVFLDSHFVY

SEQ ID NO: 90891 - protein, 11 aa, Homo Sapiens
LPYKATENDIY

SEQ ID NO: 90892 - protein, 11 aa, Homo Sapiens
LPYKITAEEMY

SEQ ID NO: 90893 - protein, 11 aa, Homo Sapiens
LPYPDPAIAQF

SEQ ID NO: 90894 - protein, 11 aa, Homo Sapiens
LPYPSEASTTF

SEQ ID NO: 90895 - protein, 11 aa, Homo Sapiens
LPYRATENDIY

SEQ ID NO: 90896 - protein, 11 aa, Homo Sapiens
MAFLDSQTATF

SEQ ID NO: 90897 - protein, 11 aa, Homo Sapiens
MPAAQEGAVAF

SEQ ID NO: 90898 - protein, 11 aa, Homo Sapiens
MPALAPPEVVM

SEQ ID NO: 90899 - protein, 11 aa, Homo Sapiens
MPAPEEIVEEL

SEQ ID NO: 90900 - protein, 11 aa, Homo Sapiens
MPAVKAIIYQY

SEQ ID NO: 90901 - protein, 11 aa, Homo Sapiens
MPEEESAKVCL

SEQ ID NO: 90902 - protein, 11 aa, Homo Sapiens
MPEGEKLVNYY

SEQ ID NO: 90903 - protein, 11 aa, Homo Sapiens
MPFDFRRFDIY

SEQ ID NO: 90904 - protein, 11 aa, Homo Sapiens
MPHPETGKDLY

SEQ ID NO: 90905 - protein, 11 aa, Homo Sapiens
MPIQEERFVTY

SEQ ID NO: 90906 - protein, 11 aa, Homo Sapiens
MPIREGDTVTL

SEQ ID NO: 90907 - protein, 11 aa, Homo Sapiens
MPKSDVNKEYY

SEQ ID NO: 90908 - protein, 11 aa, Homo Sapiens
MPRAPGGFECF

SEQ ID NO: 90909 - protein, 11 aa, Homo Sapiens
MPTGAGKSLCY

SEQ ID NO: 90910 - protein, 11 aa, Homo Sapiens
MPVAAREASIY

SEQ ID NO: 90911 - protein, 11 aa, Homo Sapiens
MPVGPDAILRY

SEQ ID NO: 90912 - protein, 11 aa, Homo Sapiens
MPVRGPDVEAY

SEQ ID NO: 90913 - protein, 11 aa, Homo Sapiens
NAFAEPGRVPF

SEQ ID NO: 90914 - protein, 11 aa, Homo Sapiens
NAFEHGGEFTY

SEQ ID NO: 90915 - protein, 11 aa, Homo Sapiens
NAFYEHAQTYY

SEQ ID NO: 90916 - protein, 11 aa, Homo Sapiens
NAIKLEEKGVY

SEQ ID NO: 90917 - protein, 11 aa, Homo Sapiens
NALPDTLKVTY

SEQ ID NO: 90918 - protein, 11 aa, Homo Sapiens
NAVDLGQMSSF

SEQ ID NO: 90919 - protein, 11 aa, Homo Sapiens
NAWMETEAVNY

SEQ ID NO: 90920 - protein, 11 aa, Homo Sapiens
NPADSISHVAY

SEQ ID NO: 90921 - protein, 11 aa, Homo Sapiens
NPENLATLERY

SEQ ID NO: 90922 - protein, 11 aa, Homo Sapiens
NPFCEPVFVRY

SEQ ID NO: 90923 - protein, 11 aa, Homo Sapiens
NPLKGDLANTF

SEQ ID NO: 90924 - protein, 11 aa, Homo Sapiens
PVSVYEDPPDA

SEQ ID NO: 90925 - protein, 11 aa, Homo Sapiens
QAADIDTRSEF

SEQ ID NO: 90926 - protein, 11 aa, Homo Sapiens
QALDDRLYCVY

SEQ ID NO: 90927 - protein, 11 aa, Homo Sapiens
QAWQEASDNCF

SEQ ID NO: 90928 - protein, 11 aa, Homo Sapiens
QPAENISKDLY

SEQ ID NO: 90929 - protein, 11 aa, Homo Sapiens
QPFLEVTKEAF

SEQ ID NO: 90930 - protein, 11 aa, Homo Sapiens
QPFPTCQALVY

SEQ ID NO: 90931 - protein, 11 aa, Homo Sapiens
RAFDQGADAIY

SEQ ID NO: 90932 - protein, 11 aa, Homo Sapiens
RPFASGANFEY

SEQ ID NO: 90933 - protein, 11 aa, Homo Sapiens
RPFEENGACKY

SEQ ID NO: 90934 - protein, 11 aa, Homo Sapiens
RPFEESGTCKY

SEQ ID NO: 90935 - protein, 11 aa, Homo Sapiens
RPVETHQVHEY

SEQ ID NO: 90936 - protein, 11 aa, Homo Sapiens
RPVETYQVHEY

SEQ ID NO: 90937 - protein, 11 aa, Homo Sapiens
SAAAAAAAAAY

SEQ ID NO: 90938 - protein, 11 aa, Homo Sapiens
SPAPSPVPEPD

SEQ ID NO: 90939 - protein, 11 aa, Homo Sapiens
SPDPLPDNKVL

SEQ ID NO: 90940 - protein, 11 aa, Homo Sapiens
SPEGRLYQVEY

SEQ ID NO: 90941 - protein, 11 aa, Homo Sapiens
SPFFERSGLAY

SEQ ID NO: 90942 - protein, 11 aa, Homo Sapiens
SPLGMPDPHLY

SEQ ID NO: 90943 - protein, 11 aa, Homo Sapiens
SPVNSSKQPSY

SEQ ID NO: 90944 - protein, 11 aa, Homo Sapiens
SPWPQDSRGLY

SEQ ID NO: 90945 - protein, 11 aa, Homo Sapiens
TAAPSLKNAAF

SEQ ID NO: 90946 - protein, 11 aa, Homo Sapiens
TADGSGCRVSY

SEQ ID NO: 90947 - protein, 11 aa, Homo Sapiens
TAEGQATLERL

SEQ ID NO: 90948 - protein, 11 aa, Homo Sapiens
TAIPVHDGYVL

SEQ ID NO: 90949 - protein, 11 aa, Homo Sapiens
TPALVNAAVTY

SEQ ID NO: 90950 - protein, 11 aa, Homo Sapiens
TPIQDNVDQTY

SEQ ID NO: 90951 - protein, 11 aa, Homo Sapiens
TPLKEGNTNCY

SEQ ID NO: 90952 - protein, 11 aa, Homo Sapiens
TPLSSTVTLSM

SEQ ID NO: 90953 - protein, 11 aa, Homo Sapiens
TPWNQGATPAY

SEQ ID NO: 90954 - protein, 11 aa, Homo Sapiens
VGGEFDLEMNF

SEQ ID NO: 90955 - protein, 11 aa, Homo Sapiens
VPDSSGPERIL

SEQ ID NO: 90956 - protein, 11 aa, Homo Sapiens
VPEAASTLVSM

SEQ ID NO: 90957 - protein, 11 aa, Homo Sapiens
VPEEGGATHVY

SEQ ID NO: 90958 - protein, 11 aa, Homo Sapiens
VPESSLAGHSF

SEQ ID NO: 90959 - protein, 11 aa, Homo Sapiens
VPIHDIAAVSY

SEQ ID NO: 90960 - protein, 11 aa, Homo Sapiens
VPMPYTLKVHY

SEQ ID NO: 90961 - protein, 11 aa, Homo Sapiens
WPSGTECIAKY

SEQ ID NO: 90962 - protein, 11 aa, Homo Sapiens
YAWESSAGGSF

SEQ ID NO: 90963 - protein, 11 aa, Homo Sapiens
YPANQGQEVEY

SEQ ID NO: 90964 - protein, 11 aa, Homo Sapiens
YPASIVDEPTF

SEQ ID NO: 90965 - protein, 11 aa, Homo Sapiens
YPDPVSIIQKY

SEQ ID NO: 90966 - protein, 11 aa, Homo Sapiens
YPETLGRLLIL

SEQ ID NO: 90967 - protein, 11 aa, Homo Sapiens
YPFESAEAQLL

SEQ ID NO: 90968 - protein, 11 aa, Homo Sapiens
YPFTGDHKQKF

SEQ ID NO: 90969 - protein, 11 aa, Homo Sapiens
YPGPASLTQIY

SEQ ID NO: 90970 - protein, 11 aa, Homo Sapiens
YPLDLEGGSEY

SEQ ID NO: 90971 - protein, 11 aa, Homo Sapiens
YPLDPTTEHIY

SEQ ID NO: 90972 - protein, 11 aa, Homo Sapiens
YPLEDATHIAL

SEQ ID NO: 90973 - protein, 11 aa, Homo Sapiens
YPLQDPKNLIL

SEQ ID NO: 90974 - protein, 11 aa, Homo Sapiens
YPLQISPVSSY

SEQ ID NO: 90975 - protein, 11 aa, Homo Sapiens
YPSETTVKYVF

SEQ ID NO: 90976 - protein, 11 aa, Homo Sapiens
YPVFPWIIHDY

SEQ ID NO: 90977 - protein, 11 aa, Homo Sapiens
YPVTPELLERY

SEQ ID NO: 90978 - protein, 8 aa, Homo Sapiens
ADALTYGF

SEQ ID NO: 90979 - protein, 8 aa, Homo Sapiens
ADELVAEF

SEQ ID NO: 90980 - protein, 8 aa, Homo Sapiens
ADELVSEF

SEQ ID NO: 90981 - protein, 8 aa, Homo Sapiens
ADFCHTHM

SEQ ID NO: 90982 - protein, 8 aa, Homo Sapiens
ADFEAHNI

SEQ ID NO: 90983 - protein, 8 aa, Homo Sapiens
ADFETVRM

SEQ ID NO: 90984 - protein, 8 aa, Homo Sapiens
ADFKAQNV

SEQ ID NO: 90985 - protein, 8 aa, Homo Sapiens
ADFLVYEF

SEQ ID NO: 90986 - protein, 8 aa, Homo Sapiens
ADFMTTNV

SEQ ID NO: 90987 - protein, 8 aa, Homo Sapiens
ADFYVRVF

SEQ ID NO: 90988 - protein, 8 aa, Homo Sapiens
ADGVHNTL

SEQ ID NO: 90989 - protein, 8 aa, Homo Sapiens
ADHIGQGF

SEQ ID NO: 90990 - protein, 8 aa, Homo Sapiens
ADHLAHEV

SEQ ID NO: 90991 - protein, 8 aa, Homo Sapiens
ADHTAPLL

SEQ ID NO: 90992 - protein, 8 aa, Homo Sapiens
ADHVSSSL

SEQ ID NO: 90993 - protein, 8 aa, Homo Sapiens
ADHYSQQM

SEQ ID NO: 90994 - protein, 8 aa, Homo Sapiens
ADIVATGF

SEQ ID NO: 90995 - protein, 8 aa, Homo Sapiens
ADKGHYKF

SEQ ID NO: 90996 - protein, 8 aa, Homo Sapiens
ADKIHSSF

SEQ ID NO: 90997 - protein, 8 aa, Homo Sapiens
ADKLIYVF

SEQ ID NO: 90998 - protein, 8 aa, Homo Sapiens
ADLIHHDL

SEQ ID NO: 90999 - protein, 8 aa, Homo Sapiens
ADLKKYHF

SEQ ID NO: 91000 - protein, 8 aa, Homo Sapiens
ADLLKRAF

SEQ ID NO: 91001 - protein, 8 aa, Homo Sapiens
ADLPARGF

SEQ ID NO: 91002 - protein, 8 aa, Homo Sapiens
ADLRAVNI

SEQ ID NO: 91003 - protein, 8 aa, Homo Sapiens
ADLVHFLF

SEQ ID NO: 91004 - protein, 8 aa, Homo Sapiens
ADMKIRLF

SEQ ID NO: 91005 - protein, 8 aa, Homo Sapiens
ADMSHVAL

SEQ ID NO: 91006 - protein, 8 aa, Homo Sapiens
ADMVKQFF

SEQ ID NO: 91007 - protein, 8 aa, Homo Sapiens
ADNISHGL

SEQ ID NO: 91008 - protein, 8 aa, Homo Sapiens
ADNPHVAL

SEQ ID NO: 91009 - protein, 8 aa, Homo Sapiens
ADNQVMHF

SEQ ID NO: 91010 - protein, 8 aa, Homo Sapiens
ADNRHYTF

SEQ ID NO: 91011 - protein, 8 aa, Homo Sapiens
ADQIVTKL

SEQ ID NO: 91012 - protein, 8 aa, Homo Sapiens
ADQLHAAV

SEQ ID NO: 91013 - protein, 8 aa, Homo Sapiens
ADQVIASF

SEQ ID NO: 91014 - protein, 8 aa, Homo Sapiens
ADSATRLL

SEQ ID NO: 91015 - protein, 8 aa, Homo Sapiens
ADSAVSSF

SEQ ID NO: 91016 - protein, 8 aa, Homo Sapiens
ADSGHYCV

SEQ ID NO: 91017 - protein, 8 aa, Homo Sapiens
ADSIHSTL

SEQ ID NO: 91018 - protein, 8 aa, Homo Sapiens
ADSITNTM

SEQ ID NO: 91019 - protein, 8 aa, Homo Sapiens
ADSKSVHF

SEQ ID NO: 91020 - protein, 8 aa, Homo Sapiens
ADSKTVKL

SEQ ID NO: 91021 - protein, 8 aa, Homo Sapiens
ADSKVLLF

SEQ ID NO: 91022 - protein, 8 aa, Homo Sapiens
ADSLINSF

SEQ ID NO: 91023 - protein, 8 aa, Homo Sapiens
ADSLTYDI

SEQ ID NO: 91024 - protein, 8 aa, Homo Sapiens
ADSLVTGI

SEQ ID NO: 91025 - protein, 8 aa, Homo Sapiens
ADSNAREF

SEQ ID NO: 91026 - protein, 8 aa, Homo Sapiens
ADSPSEGF

SEQ ID NO: 91027 - protein, 8 aa, Homo Sapiens
ADSPSQNL

SEQ ID NO: 91028 - protein, 8 aa, Homo Sapiens
ADSRIVKM

SEQ ID NO: 91029 - protein, 8 aa, Homo Sapiens
ADSTPAHF

SEQ ID NO: 91030 - protein, 8 aa, Homo Sapiens
ADSVANKL

SEQ ID NO: 91031 - protein, 8 aa, Homo Sapiens
ADSVGHHL

SEQ ID NO: 91032 - protein, 8 aa, Homo Sapiens
ADSVVVLL

SEQ ID NO: 91033 - protein, 8 aa, Homo Sapiens
ADTLAFEM

SEQ ID NO: 91034 - protein, 8 aa, Homo Sapiens
ADTLVTKF

SEQ ID NO: 91035 - protein, 8 aa, Homo Sapiens
ADTTHTSL

SEQ ID NO: 91036 - protein, 8 aa, Homo Sapiens
ADTVSSKL

SEQ ID NO: 91037 - protein, 8 aa, Homo Sapiens
ADVIVHRL

SEQ ID NO: 91038 - protein, 8 aa, Homo Sapiens
ADVVISAF

SEQ ID NO: 91039 - protein, 8 aa, Homo Sapiens
ADWFKASF

SEQ ID NO: 91040 - protein, 8 aa, Homo Sapiens
ADYASKNL

SEQ ID NO: 91041 - protein, 8 aa, Homo Sapiens
ADYEATTF

SEQ ID NO: 91042 - protein, 8 aa, Homo Sapiens
ADYIAPLF

SEQ ID NO: 91043 - protein, 8 aa, Homo Sapiens
ADYLAHES

SEQ ID NO: 91044 - protein, 8 aa, Homo Sapiens
ADYLSSHL

SEQ ID NO: 91045 - protein, 8 aa, Homo Sapiens
AEAFVRAF

SEQ ID NO: 91046 - protein, 8 aa, Homo Sapiens
AEALVNGF

SEQ ID NO: 91047 - protein, 8 aa, Homo Sapiens
AEALVQSF

SEQ ID NO: 91048 - protein, 8 aa, Homo Sapiens
AEAVKTVF

SEQ ID NO: 91049 - protein, 8 aa, Homo Sapiens
AEFVWHKL

SEQ ID NO: 91050 - protein, 8 aa, Homo Sapiens
AEIRVHTV

SEQ ID NO: 91051 - protein, 8 aa, Homo Sapiens
AEKKVVKI

SEQ ID NO: 91052 - protein, 8 aa, Homo Sapiens
AEKRWDRV

SEQ ID NO: 91053 - protein, 8 aa, Homo Sapiens
AEMVHTGL

SEQ ID NO: 91054 - protein, 8 aa, Homo Sapiens
AEMVRHAL

SEQ ID NO: 91055 - protein, 8 aa, Homo Sapiens
AEMYVAKF

SEQ ID NO: 91056 - protein, 8 aa, Homo Sapiens
AENISHGL

SEQ ID NO: 91057 - protein, 8 aa, Homo Sapiens
AEPIKQAF

SEQ ID NO: 91058 - protein, 8 aa, Homo Sapiens
AEQVIAGF

SEQ ID NO: 91059 - protein, 8 aa, Homo Sapiens
AEQYVSAF

SEQ ID NO: 91060 - protein, 8 aa, Homo Sapiens
AESIHTGL

SEQ ID NO: 91061 - protein, 8 aa, Homo Sapiens
AESKIKSF

SEQ ID NO: 91062 - protein, 8 aa, Homo Sapiens
AESKVFYL

SEQ ID NO: 91063 - protein, 8 aa, Homo Sapiens
AESKVVLV

SEQ ID NO: 91064 - protein, 8 aa, Homo Sapiens
AESLKTKF

SEQ ID NO: 91065 - protein, 8 aa, Homo Sapiens
AESLRYKL

SEQ ID NO: 91066 - protein, 8 aa, Homo Sapiens
AESLVRNL

SEQ ID NO: 91067 - protein, 8 aa, Homo Sapiens
AESYHQHF

SEQ ID NO: 91068 - protein, 8 aa, Homo Sapiens
AETAVQLF

SEQ ID NO: 91069 - protein, 8 aa, Homo Sapiens
AETLHFLL

SEQ ID NO: 91070 - protein, 8 aa, Homo Sapiens
AEVEVKKF

SEQ ID NO: 91071 - protein, 8 aa, Homo Sapiens
AEVIKNRF

SEQ ID NO: 91072 - protein, 8 aa, Homo Sapiens
AEYGAEAL

SEQ ID NO: 91073 - protein, 8 aa, Homo Sapiens
AEYIQKNV

SEQ ID NO: 91074 - protein, 8 aa, Homo Sapiens
AEYLHWLL

SEQ ID NO: 91075 - protein, 8 aa, Homo Sapiens
AEYLREKL

SEQ ID NO: 91076 - protein, 8 aa, Homo Sapiens
AEYPAVKF

SEQ ID NO: 91077 - protein, 8 aa, Homo Sapiens
ALAVRGSD

SEQ ID NO: 91078 - protein, 8 aa, Homo Sapiens
CSSVHPSV

SEQ ID NO: 91079 - protein, 8 aa, Homo Sapiens
DHLDLKAP

SEQ ID NO: 91080 - protein, 8 aa, Homo Sapiens
DLARAQAV

SEQ ID NO: 91081 - protein, 8 aa, Homo Sapiens
DLRKVEAL

SEQ ID NO: 91082 - protein, 8 aa, Homo Sapiens
DNIRVCKI

SEQ ID NO: 91083 - protein, 8 aa, Homo Sapiens
DRIPSKHF

SEQ ID NO: 91084 - protein, 8 aa, Homo Sapiens
EKSTDFVF

SEQ ID NO: 91085 - protein, 8 aa, Homo Sapiens
ELSGKNTI

SEQ ID NO: 91086 - protein, 8 aa, Homo Sapiens
ENQKLNSF

SEQ ID NO: 91087 - protein, 8 aa, Homo Sapiens
ERDLLKKF

SEQ ID NO: 91088 - protein, 8 aa, Homo Sapiens
FDDIVHSF

SEQ ID NO: 91089 - protein, 8 aa, Homo Sapiens
FDHAVSKF

SEQ ID NO: 91090 - protein, 8 aa, Homo Sapiens
FDSLSQML

SEQ ID NO: 91091 - protein, 8 aa, Homo Sapiens
FEHIVTQF

SEQ ID NO: 91092 - protein, 8 aa, Homo Sapiens
FESIIHEF

SEQ ID NO: 91093 - protein, 8 aa, Homo Sapiens
FESLASQF

SEQ ID NO: 91094 - protein, 8 aa, Homo Sapiens
FESLSEAF

SEQ ID NO: 91095 - protein, 8 aa, Homo Sapiens
FESVIHEF

SEQ ID NO: 91096 - protein, 8 aa, Homo Sapiens
FESVVEYF

SEQ ID NO: 91097 - protein, 8 aa, Homo Sapiens
GDHIHTNF

SEQ ID NO: 91098 - protein, 8 aa, Homo Sapiens
GDHLSPGV

SEQ ID NO: 91099 - protein, 8 aa, Homo Sapiens
GDILVQQF

SEQ ID NO: 91100 - protein, 8 aa, Homo Sapiens
GDNRVHEF

SEQ ID NO: 91101 - protein, 8 aa, Homo Sapiens
GDTLVTGF

SEQ ID NO: 91102 - protein, 8 aa, Homo Sapiens
GDTQVVVF

SEQ ID NO: 91103 - protein, 8 aa, Homo Sapiens
GDVLVNQF

SEQ ID NO: 91104 - protein, 8 aa, Homo Sapiens
GDYLKELF

SEQ ID NO: 91105 - protein, 8 aa, Homo Sapiens
GESITHAL

SEQ ID NO: 91106 - protein, 8 aa, Homo Sapiens
GEYVVAKL

SEQ ID NO: 91107 - protein, 8 aa, Homo Sapiens
HDCVVKLL

SEQ ID NO: 91108 - protein, 8 aa, Homo Sapiens
HDDIVTEF

SEQ ID NO: 91109 - protein, 8 aa, Homo Sapiens
HDFHHMNF

SEQ ID NO: 91110 - protein, 8 aa, Homo Sapiens
HDFLKYDF

SEQ ID NO: 91111 - protein, 8 aa, Homo Sapiens
HDFQAPYL

SEQ ID NO: 91112 - protein, 8 aa, Homo Sapiens
HDFSVQNF

SEQ ID NO: 91113 - protein, 8 aa, Homo Sapiens
HDFTSQIF

SEQ ID NO: 91114 - protein, 8 aa, Homo Sapiens
HDGITVAV

SEQ ID NO: 91115 - protein, 8 aa, Homo Sapiens
HDGLTVHL

SEQ ID NO: 91116 - protein, 8 aa, Homo Sapiens
HDILIRKF

SEQ ID NO: 91117 - protein, 8 aa, Homo Sapiens
HDKLSHYL

SEQ ID NO: 91118 - protein, 8 aa, Homo Sapiens
HDLLKYEF

SEQ ID NO: 91119 - protein, 8 aa, Homo Sapiens
HDLLVHKA

SEQ ID NO: 91120 - protein, 8 aa, Homo Sapiens
HDMEVYSF

SEQ ID NO: 91121 - protein, 8 aa, Homo Sapiens
HDNIVKVF

SEQ ID NO: 91122 - protein, 8 aa, Homo Sapiens
HDNPVFEM

SEQ ID NO: 91123 - protein, 8 aa, Homo Sapiens
HDQAVQAL

SEQ ID NO: 91124 - protein, 8 aa, Homo Sapiens
HDQQVARM

SEQ ID NO: 91125 - protein, 8 aa, Homo Sapiens
HDSAVTSV

SEQ ID NO: 91126 - protein, 8 aa, Homo Sapiens
HDSPVKAV

SEQ ID NO: 91127 - protein, 8 aa, Homo Sapiens
HDSPVRAM

SEQ ID NO: 91128 - protein, 8 aa, Homo Sapiens
HDSRAVKF

SEQ ID NO: 91129 - protein, 8 aa, Homo Sapiens
HDSRVAGF

SEQ ID NO: 91130 - protein, 8 aa, Homo Sapiens
HDSSTVEV

SEQ ID NO: 91131 - protein, 8 aa, Homo Sapiens
HDSVVSMF

SEQ ID NO: 91132 - protein, 8 aa, Homo Sapiens
HDSYGNQF

SEQ ID NO: 91133 - protein, 8 aa, Homo Sapiens
HDVLKLEF

SEQ ID NO: 91134 - protein, 8 aa, Homo Sapiens
HDVPHQPF

SEQ ID NO: 91135 - protein, 8 aa, Homo Sapiens
HDYAKAAF

SEQ ID NO: 91136 - protein, 8 aa, Homo Sapiens
HDYEVAQM

SEQ ID NO: 91137 - protein, 8 aa, Homo Sapiens
HDYGHLSV

SEQ ID NO: 91138 - protein, 8 aa, Homo Sapiens
HDYTSVCL

SEQ ID NO: 91139 - protein, 8 aa, Homo Sapiens
HDYYTTEF

SEQ ID NO: 91140 - protein, 8 aa, Homo Sapiens
HECMVNKF

SEQ ID NO: 91141 - protein, 8 aa, Homo Sapiens
HEGHVYGF

SEQ ID NO: 91142 - protein, 8 aa, Homo Sapiens
HEGLHNGF

SEQ ID NO: 91143 - protein, 8 aa, Homo Sapiens
HEHFVTSL

SEQ ID NO: 91144 - protein, 8 aa, Homo Sapiens
HEHQANLL

SEQ ID NO: 91145 - protein, 8 aa, Homo Sapiens
HEHQVMLM

SEQ ID NO: 91146 - protein, 8 aa, Homo Sapiens
HEHYWETI

SEQ ID NO: 91147 - protein, 8 aa, Homo Sapiens
HEQVVERL

SEQ ID NO: 91148 - protein, 8 aa, Homo Sapiens
HESAVTGL

SEQ ID NO: 91149 - protein, 8 aa, Homo Sapiens
HESLSHEL

SEQ ID NO: 91150 - protein, 8 aa, Homo Sapiens
IDFLTKQM

SEQ ID NO: 91151 - protein, 8 aa, Homo Sapiens
IDHSVTGF

SEQ ID NO: 91152 - protein, 8 aa, Homo Sapiens
IDKVVQEF

SEQ ID NO: 91153 - protein, 8 aa, Homo Sapiens
IDSIHHLL

SEQ ID NO: 91154 - protein, 8 aa, Homo Sapiens
IDSIIQRL

SEQ ID NO: 91155 - protein, 8 aa, Homo Sapiens
IDSKVKGM

SEQ ID NO: 91156 - protein, 8 aa, Homo Sapiens
IDSLKESF

SEQ ID NO: 91157 - protein, 8 aa, Homo Sapiens
IDYIVHPL

SEQ ID NO: 91158 - protein, 8 aa, Homo Sapiens
IEDVIHKF

SEQ ID NO: 91159 - protein, 8 aa, Homo Sapiens
IEHITHSL

SEQ ID NO: 91160 - protein, 8 aa, Homo Sapiens
IESIVHAF

SEQ ID NO: 91161 - protein, 8 aa, Homo Sapiens
IESKIYKM

SEQ ID NO: 91162 - protein, 8 aa, Homo Sapiens
IESLAHAL

SEQ ID NO: 91163 - protein, 8 aa, Homo Sapiens
IESLVKKL

SEQ ID NO: 91164 - protein, 8 aa, Homo Sapiens
IETIVAAM

SEQ ID NO: 91165 - protein, 8 aa, Homo Sapiens
IQERLQKI

SEQ ID NO: 91166 - protein, 8 aa, Homo Sapiens
ISRDIQSI

SEQ ID NO: 91167 - protein, 8 aa, Homo Sapiens
KDAEKVHF

SEQ ID NO: 91168 - protein, 8 aa, Homo Sapiens
KDAIVACF

SEQ ID NO: 91169 - protein, 8 aa, Homo Sapiens
KDCIHEHL

SEQ ID NO: 91170 - protein, 8 aa, Homo Sapiens
KDFPAHRI

SEQ ID NO: 91171 - protein, 8 aa, Homo Sapiens
KDFPSNSF

SEQ ID NO: 91172 - protein, 8 aa, Homo Sapiens
KDFSHPQM

SEQ ID NO: 91173 - protein, 8 aa, Homo Sapiens
KDHASIQM

SEQ ID NO: 91174 - protein, 8 aa, Homo Sapiens
KDHGVNSF

SEQ ID NO: 91175 - protein, 8 aa, Homo Sapiens
KDHPTVEM

SEQ ID NO: 91176 - protein, 8 aa, Homo Sapiens
KDHRISTF

SEQ ID NO: 91177 - protein, 8 aa, Homo Sapiens
KDHSVNSF

SEQ ID NO: 91178 - protein, 8 aa, Homo Sapiens
KDHYSNGF

SEQ ID NO: 91179 - protein, 8 aa, Homo Sapiens
KDIAINLF

SEQ ID NO: 91180 - protein, 8 aa, Homo Sapiens
KDIPKRPF

SEQ ID NO: 91181 - protein, 8 aa, Homo Sapiens
KDLISKLL

SEQ ID NO: 91182 - protein, 8 aa, Homo Sapiens
KDLIVCLF

SEQ ID NO: 91183 - protein, 8 aa, Homo Sapiens
KDLKVNRF

SEQ ID NO: 91184 - protein, 8 aa, Homo Sapiens
KDLLHRAL

SEQ ID NO: 91185 - protein, 8 aa, Homo Sapiens
KDMESHVF

SEQ ID NO: 91186 - protein, 8 aa, Homo Sapiens
KDMPHNAL

SEQ ID NO: 91187 - protein, 8 aa, Homo Sapiens
KDMVHKEL

SEQ ID NO: 91188 - protein, 8 aa, Homo Sapiens
KDNPKFSF

SEQ ID NO: 91189 - protein, 8 aa, Homo Sapiens
KDNRVVLF

SEQ ID NO: 91190 - protein, 8 aa, Homo Sapiens
KDSITHDF

SEQ ID NO: 91191 - protein, 8 aa, Homo Sapiens
KDSIVQGF

SEQ ID NO: 91192 - protein, 8 aa, Homo Sapiens
KDSKVFPL

SEQ ID NO: 91193 - protein, 8 aa, Homo Sapiens
KDSKVVEI

SEQ ID NO: 91194 - protein, 8 aa, Homo Sapiens
KDSLHEKF

SEQ ID NO: 91195 - protein, 8 aa, Homo Sapiens
KDSLIVQV

SEQ ID NO: 91196 - protein, 8 aa, Homo Sapiens
KDSLVSSL

SEQ ID NO: 91197 - protein, 8 aa, Homo Sapiens
KDSMIRKF

SEQ ID NO: 91198 - protein, 8 aa, Homo Sapiens
KDSPVSAF

SEQ ID NO: 91199 - protein, 8 aa, Homo Sapiens
KDSQVVQV

SEQ ID NO: 91200 - protein, 8 aa, Homo Sapiens
KDSTKTAF

SEQ ID NO: 91201 - protein, 8 aa, Homo Sapiens
KDSTVQVF

SEQ ID NO: 91202 - protein, 8 aa, Homo Sapiens
KDSVSTFS

SEQ ID NO: 91203 - protein, 8 aa, Homo Sapiens
KDSVVAGF

SEQ ID NO: 91204 - protein, 8 aa, Homo Sapiens
KDSYVVAF

SEQ ID NO: 91205 - protein, 8 aa, Homo Sapiens
KDTYSWLL

SEQ ID NO: 91206 - protein, 8 aa, Homo Sapiens
KDVATVAF

SEQ ID NO: 91207 - protein, 8 aa, Homo Sapiens
KDVKVFNV

SEQ ID NO: 91208 - protein, 8 aa, Homo Sapiens
KDVLAHQV

SEQ ID NO: 91209 - protein, 8 aa, Homo Sapiens
KDVLISEF

SEQ ID NO: 91210 - protein, 8 aa, Homo Sapiens
KDVLKFGF

SEQ ID NO: 91211 - protein, 8 aa, Homo Sapiens
KDVLSVAF

SEQ ID NO: 91212 - protein, 8 aa, Homo Sapiens
KDVVIHRF

SEQ ID NO: 91213 - protein, 8 aa, Homo Sapiens
KDVYKEHF

SEQ ID NO: 91214 - protein, 8 aa, Homo Sapiens
KDWWTYEF

SEQ ID NO: 91215 - protein, 8 aa, Homo Sapiens
KDYEVELL

SEQ ID NO: 91216 - protein, 8 aa, Homo Sapiens
KDYIHINI

SEQ ID NO: 91217 - protein, 8 aa, Homo Sapiens
KDYLKHKF

SEQ ID NO: 91218 - protein, 8 aa, Homo Sapiens
KDYPHSAF

SEQ ID NO: 91219 - protein, 8 aa, Homo Sapiens
KEALKTGF

SEQ ID NO: 91220 - protein, 8 aa, Homo Sapiens
KEALTHSF

SEQ ID NO: 91221 - protein, 8 aa, Homo Sapiens
KEALVWKV

SEQ ID NO: 91222 - protein, 8 aa, Homo Sapiens
KEASKVPF

SEQ ID NO: 91223 - protein, 8 aa, Homo Sapiens
KEAVVHGL

SEQ ID NO: 91224 - protein, 8 aa, Homo Sapiens
KECAVNTF

SEQ ID NO: 91225 - protein, 8 aa, Homo Sapiens
KEDIIQGF

SEQ ID NO: 91226 - protein, 8 aa, Homo Sapiens
KEEIVHQL

SEQ ID NO: 91227 - protein, 8 aa, Homo Sapiens
KEEIVQFF

SEQ ID NO: 91228 - protein, 8 aa, Homo Sapiens
KEELVVQF

SEQ ID NO: 91229 - protein, 8 aa, Homo Sapiens
KEHLVFTV

SEQ ID NO: 91230 - protein, 8 aa, Homo Sapiens
KEHLWQKV

SEQ ID NO: 91231 - protein, 8 aa, Homo Sapiens
KEILIPVF

SEQ ID NO: 91232 - protein, 8 aa, Homo Sapiens
KEKIVRSF

SEQ ID NO: 91233 - protein, 8 aa, Homo Sapiens
KEKVWYHV

SEQ ID NO: 91234 - protein, 8 aa, Homo Sapiens
KELAVRTF

SEQ ID NO: 91235 - protein, 8 aa, Homo Sapiens
KELEATVR

SEQ ID NO: 91236 - protein, 8 aa, Homo Sapiens
KELEVPHF

SEQ ID NO: 91237 - protein, 8 aa, Homo Sapiens
KELEVRKL

SEQ ID NO: 91238 - protein, 8 aa, Homo Sapiens
KELLKHKF

SEQ ID NO: 91239 - protein, 8 aa, Homo Sapiens
KELLTHHL

SEQ ID NO: 91240 - protein, 8 aa, Homo Sapiens
KELLTHHV

SEQ ID NO: 91241 - protein, 8 aa, Homo Sapiens
KELLTREL

SEQ ID NO: 91242 - protein, 8 aa, Homo Sapiens
KENIVNSF

SEQ ID NO: 91243 - protein, 8 aa, Homo Sapiens
KENLTNEL

SEQ ID NO: 91244 - protein, 8 aa, Homo Sapiens
KENLVQAF

SEQ ID NO: 91245 - protein, 8 aa, Homo Sapiens
KEQIIHHV

SEQ ID NO: 91246 - protein, 8 aa, Homo Sapiens
KEQLVQAV

SEQ ID NO: 91247 - protein, 8 aa, Homo Sapiens
KESESFVF

SEQ ID NO: 91248 - protein, 8 aa, Homo Sapiens
KESEVKAL

SEQ ID NO: 91249 - protein, 8 aa, Homo Sapiens
KESEVYKM

SEQ ID NO: 91250 - protein, 8 aa, Homo Sapiens
KESKIFRI

SEQ ID NO: 91251 - protein, 8 aa, Homo Sapiens
KESLTTDL

SEQ ID NO: 91252 - protein, 8 aa, Homo Sapiens
KESSVAKL

SEQ ID NO: 91253 - protein, 8 aa, Homo Sapiens
KESVAFNF

SEQ ID NO: 91254 - protein, 8 aa, Homo Sapiens
KESVANHL

SEQ ID NO: 91255 - protein, 8 aa, Homo Sapiens
KESVITHF

SEQ ID NO: 91256 - protein, 8 aa, Homo Sapiens
KEVVVHLL

SEQ ID NO: 91257 - protein, 8 aa, Homo Sapiens
KEYLIELF

SEQ ID NO: 91258 - protein, 8 aa, Homo Sapiens
KQDFVQHF

SEQ ID NO: 91259 - protein, 8 aa, Homo Sapiens
KSDMVHRF

SEQ ID NO: 91260 - protein, 8 aa, Homo Sapiens
LDALVFHF

SEQ ID NO: 91261 - protein, 8 aa, Homo Sapiens
LDHESYEF

SEQ ID NO: 91262 - protein, 8 aa, Homo Sapiens
LDHLAEKF

SEQ ID NO: 91263 - protein, 8 aa, Homo Sapiens
LDKKVEKV

SEQ ID NO: 91264 - protein, 8 aa, Homo Sapiens
LDNAAFPF

SEQ ID NO: 91265 - protein, 8 aa, Homo Sapiens
LDNPHHGF

SEQ ID NO: 91266 - protein, 8 aa, Homo Sapiens
LDRHYLNL

SEQ ID NO: 91267 - protein, 8 aa, Homo Sapiens
LDRVLLHK

SEQ ID NO: 91268 - protein, 8 aa, Homo Sapiens
LDSEVVTF

SEQ ID NO: 91269 - protein, 8 aa, Homo Sapiens
LDSIIWAF

SEQ ID NO: 91270 - protein, 8 aa, Homo Sapiens
LDSKANNL

SEQ ID NO: 91271 - protein, 8 aa, Homo Sapiens
LDSQSHHL

SEQ ID NO: 91272 - protein, 8 aa, Homo Sapiens
LDSSHSEL

SEQ ID NO: 91273 - protein, 8 aa, Homo Sapiens
LDSVHQLL

SEQ ID NO: 91274 - protein, 8 aa, Homo Sapiens
LDTNGKNL

SEQ ID NO: 91275 - protein, 8 aa, Homo Sapiens
LENVVHHF

SEQ ID NO: 91276 - protein, 8 aa, Homo Sapiens
LESLVQKV

SEQ ID NO: 91277 - protein, 8 aa, Homo Sapiens
LLEGATGF

SEQ ID NO: 91278 - protein, 8 aa, Homo Sapiens
LQQAKDEI

SEQ ID NO: 91279 - protein, 8 aa, Homo Sapiens
MDHPHHTL

SEQ ID NO: 91280 - protein, 8 aa, Homo Sapiens
MDILKQAF

SEQ ID NO: 91281 - protein, 8 aa, Homo Sapiens
MDSKIVQV

SEQ ID NO: 91282 - protein, 8 aa, Homo Sapiens
MDSSHVSL

SEQ ID NO: 91283 - protein, 8 aa, Homo Sapiens
MDTVHHML

SEQ ID NO: 91284 - protein, 8 aa, Homo Sapiens
MDWEKVAF

SEQ ID NO: 91285 - protein, 8 aa, Homo Sapiens
MEKIWHHT

SEQ ID NO: 91286 - protein, 8 aa, Homo Sapiens
MENRVQSF

SEQ ID NO: 91287 - protein, 8 aa, Homo Sapiens
MESLIHHF

SEQ ID NO: 91288 - protein, 8 aa, Homo Sapiens
NDFLAHHV

SEQ ID NO: 91289 - protein, 8 aa, Homo Sapiens
NDSAHYAL

SEQ ID NO: 91290 - protein, 8 aa, Homo Sapiens
QDFQIQAF

SEQ ID NO: 91291 - protein, 8 aa, Homo Sapiens
QDHITFAM

SEQ ID NO: 91292 - protein, 8 aa, Homo Sapiens
QDIGAKSL

SEQ ID NO: 91293 - protein, 8 aa, Homo Sapiens
QDSITRLM

SEQ ID NO: 91294 - protein, 8 aa, Homo Sapiens
QDSLINQM

SEQ ID NO: 91295 - protein, 8 aa, Homo Sapiens
QDSQVNAL

SEQ ID NO: 91296 - protein, 8 aa, Homo Sapiens
RDALKTEF

SEQ ID NO: 91297 - protein, 8 aa, Homo Sapiens
RDALVKEF

SEQ ID NO: 91298 - protein, 8 aa, Homo Sapiens
RDAYVQAL

SEQ ID NO: 91299 - protein, 8 aa, Homo Sapiens
RDCEASLF

SEQ ID NO: 91300 - protein, 8 aa, Homo Sapiens
RDCNKIAF

SEQ ID NO: 91301 - protein, 8 aa, Homo Sapiens
RDDTHYLL

SEQ ID NO: 91302 - protein, 8 aa, Homo Sapiens
RDEESHEF

SEQ ID NO: 91303 - protein, 8 aa, Homo Sapiens
RDEEVKSF

SEQ ID NO: 91304 - protein, 8 aa, Homo Sapiens
RDEVVQVF

SEQ ID NO: 91305 - protein, 8 aa, Homo Sapiens
RDFAARLV

SEQ ID NO: 91306 - protein, 8 aa, Homo Sapiens
RDFIHVSF

SEQ ID NO: 91307 - protein, 8 aa, Homo Sapiens
RDFIKLEF

SEQ ID NO: 91308 - protein, 8 aa, Homo Sapiens
RDFKAYSL

SEQ ID NO: 91309 - protein, 8 aa, Homo Sapiens
RDFKVQFV

SEQ ID NO: 91310 - protein, 8 aa, Homo Sapiens
RDFLITQM

SEQ ID NO: 91311 - protein, 8 aa, Homo Sapiens
RDFLKVKF

SEQ ID NO: 91312 - protein, 8 aa, Homo Sapiens
RDFLVEIL

SEQ ID NO: 91313 - protein, 8 aa, Homo Sapiens
RDFLVQRI

SEQ ID NO: 91314 - protein, 8 aa, Homo Sapiens
RDFNHINV

SEQ ID NO: 91315 - protein, 8 aa, Homo Sapiens
RDFRSSDF

SEQ ID NO: 91316 - protein, 8 aa, Homo Sapiens
RDFTVSAL

SEQ ID NO: 91317 - protein, 8 aa, Homo Sapiens
RDFTVSAM

SEQ ID NO: 91318 - protein, 8 aa, Homo Sapiens
RDFVARNV

SEQ ID NO: 91319 - protein, 8 aa, Homo Sapiens
RDGLLFRH

SEQ ID NO: 91320 - protein, 8 aa, Homo Sapiens
RDGVVRPL

SEQ ID NO: 91321 - protein, 8 aa, Homo Sapiens
RDHEAVPL

SEQ ID NO: 91322 - protein, 8 aa, Homo Sapiens
RDHIHVHF

SEQ ID NO: 91323 - protein, 8 aa, Homo Sapiens
RDHIKDSF

SEQ ID NO: 91324 - protein, 8 aa, Homo Sapiens
RDHLFHQV

SEQ ID NO: 91325 - protein, 8 aa, Homo Sapiens
RDHLRVNL

SEQ ID NO: 91326 - protein, 8 aa, Homo Sapiens
RDHMAQHF

SEQ ID NO: 91327 - protein, 8 aa, Homo Sapiens
RDHTNAQF

SEQ ID NO: 91328 - protein, 8 aa, Homo Sapiens
RDHVNVSM

SEQ ID NO: 91329 - protein, 8 aa, Homo Sapiens
RDIEVQKM

SEQ ID NO: 91330 - protein, 8 aa, Homo Sapiens
RDIKAANV

SEQ ID NO: 91331 - protein, 8 aa, Homo Sapiens
RDILKEMF

SEQ ID NO: 91332 - protein, 8 aa, Homo Sapiens
RDILVKGV

SEQ ID NO: 91333 - protein, 8 aa, Homo Sapiens
RDKISESL

SEQ ID NO: 91334 - protein, 8 aa, Homo Sapiens
RDKLAAHL

SEQ ID NO: 91335 - protein, 8 aa, Homo Sapiens
RDKPHVNV

SEQ ID NO: 91336 - protein, 8 aa, Homo Sapiens
RDKVVSIF

SEQ ID NO: 91337 - protein, 8 aa, Homo Sapiens
RDLEAEHV

SEQ ID NO: 91338 - protein, 8 aa, Homo Sapiens
RDLEKPFL

SEQ ID NO: 91339 - protein, 8 aa, Homo Sapiens
RDLHTTAF

SEQ ID NO: 91340 - protein, 8 aa, Homo Sapiens
RDLIHTGV

SEQ ID NO: 91341 - protein, 8 aa, Homo Sapiens
RDLISRLL

SEQ ID NO: 91342 - protein, 8 aa, Homo Sapiens
RDLITEAM

SEQ ID NO: 91343 - protein, 8 aa, Homo Sapiens
RDLITNKM

SEQ ID NO: 91344 - protein, 8 aa, Homo Sapiens
RDLKAENL

SEQ ID NO: 91345 - protein, 8 aa, Homo Sapiens
RDLKSSQL

SEQ ID NO: 91346 - protein, 8 aa, Homo Sapiens
RDLKTSNL

SEQ ID NO: 91347 - protein, 8 aa, Homo Sapiens
RDLLAVVF

SEQ ID NO: 91348 - protein, 8 aa, Homo Sapiens
RDLLHNSL

SEQ ID NO: 91349 - protein, 8 aa, Homo Sapiens
RDLLHPSL

SEQ ID NO: 91350 - protein, 8 aa, Homo Sapiens
RDLLTRRL

SEQ ID NO: 91351 - protein, 8 aa, Homo Sapiens
RDLMVHNI

SEQ ID NO: 91352 - protein, 8 aa, Homo Sapiens
RDLPAQLL

SEQ ID NO: 91353 - protein, 8 aa, Homo Sapiens
RDMAAAGL

SEQ ID NO: 91354 - protein, 8 aa, Homo Sapiens
RDMEANLL

SEQ ID NO: 91355 - protein, 8 aa, Homo Sapiens
RDMETIGF

SEQ ID NO: 91356 - protein, 8 aa, Homo Sapiens
RDMVHHLL

SEQ ID NO: 91357 - protein, 8 aa, Homo Sapiens
RDMVSKKL

SEQ ID NO: 91358 - protein, 8 aa, Homo Sapiens
RDMVVNLF

SEQ ID NO: 91359 - protein, 8 aa, Homo Sapiens
RDMYSHYV

SEQ ID NO: 91360 - protein, 8 aa, Homo Sapiens
RDNIFRNV

SEQ ID NO: 91361 - protein, 8 aa, Homo Sapiens
RDNLTRRF

SEQ ID NO: 91362 - protein, 8 aa, Homo Sapiens
RDNQWLGV

SEQ ID NO: 91363 - protein, 8 aa, Homo Sapiens
RDNTVHSF

SEQ ID NO: 91364 - protein, 8 aa, Homo Sapiens
RDNYVPEV

SEQ ID NO: 91365 - protein, 8 aa, Homo Sapiens
RDPRERTL

SEQ ID NO: 91366 - protein, 8 aa, Homo Sapiens
RDQEKPYF

SEQ ID NO: 91367 - protein, 8 aa, Homo Sapiens
RDQLVESL

SEQ ID NO: 91368 - protein, 8 aa, Homo Sapiens
RDQYSHLL

SEQ ID NO: 91369 - protein, 8 aa, Homo Sapiens
RDRIHVTV

SEQ ID NO: 91370 - protein, 8 aa, Homo Sapiens
RDRIKRAF

SEQ ID NO: 91371 - protein, 8 aa, Homo Sapiens
RDSEITHL

SEQ ID NO: 91372 - protein, 8 aa, Homo Sapiens
RDSIINDF

SEQ ID NO: 91373 - protein, 8 aa, Homo Sapiens
RDSISETV

SEQ ID NO: 91374 - protein, 8 aa, Homo Sapiens
RDSIVAEL

SEQ ID NO: 91375 - protein, 8 aa, Homo Sapiens
RDSIVETL

SEQ ID NO: 91376 - protein, 8 aa, Homo Sapiens
RDSLAEKL

SEQ ID NO: 91377 - protein, 8 aa, Homo Sapiens
RDSLAKTI

SEQ ID NO: 91378 - protein, 8 aa, Homo Sapiens
RDSLSHLV

SEQ ID NO: 91379 - protein, 8 aa, Homo Sapiens
RDSLVALL

SEQ ID NO: 91380 - protein, 8 aa, Homo Sapiens
RDSLVERL

SEQ ID NO: 91381 - protein, 8 aa, Homo Sapiens
RDSMAKSL

SEQ ID NO: 91382 - protein, 8 aa, Homo Sapiens
RDSPAVSL

SEQ ID NO: 91383 - protein, 8 aa, Homo Sapiens
RDSRSTVF

SEQ ID NO: 91384 - protein, 8 aa, Homo Sapiens
RDSRTYSV

SEQ ID NO: 91385 - protein, 8 aa, Homo Sapiens
RDSVSGEL

SEQ ID NO: 91386 - protein, 8 aa, Homo Sapiens
RDSYAKLL

SEQ ID NO: 91387 - protein, 8 aa, Homo Sapiens
RDSYVREL

SEQ ID NO: 91388 - protein, 8 aa, Homo Sapiens
RDTKVVSM

SEQ ID NO: 91389 - protein, 8 aa, Homo Sapiens
RDTLVSYM

SEQ ID NO: 91390 - protein, 8 aa, Homo Sapiens
RDTMVTKL

SEQ ID NO: 91391 - protein, 8 aa, Homo Sapiens
RDTPHSDF

SEQ ID NO: 91392 - protein, 8 aa, Homo Sapiens
RDTVVEGL

SEQ ID NO: 91393 - protein, 8 aa, Homo Sapiens
RDTYVSSF

SEQ ID NO: 91394 - protein, 8 aa, Homo Sapiens
RDVITHVV

SEQ ID NO: 91395 - protein, 8 aa, Homo Sapiens
RDVKKTGF

SEQ ID NO: 91396 - protein, 8 aa, Homo Sapiens
RDVKVSLF

SEQ ID NO: 91397 - protein, 8 aa, Homo Sapiens
RDVLKQHF

SEQ ID NO: 91398 - protein, 8 aa, Homo Sapiens
RDVLSAAF

SEQ ID NO: 91399 - protein, 8 aa, Homo Sapiens
RDVMVENF

SEQ ID NO: 91400 - protein, 8 aa, Homo Sapiens
RDVRVANV

SEQ ID NO: 91401 - protein, 8 aa, Homo Sapiens
RDVTVVQF

SEQ ID NO: 91402 - protein, 8 aa, Homo Sapiens
RDVVHSTL

SEQ ID NO: 91403 - protein, 8 aa, Homo Sapiens
RDWFSSQL

SEQ ID NO: 91404 - protein, 8 aa, Homo Sapiens
RDWVLNEF

SEQ ID NO: 91405 - protein, 8 aa, Homo Sapiens
RDWYKRNF

SEQ ID NO: 91406 - protein, 8 aa, Homo Sapiens
RDWYVYAF

SEQ ID NO: 91407 - protein, 8 aa, Homo Sapiens
RDYCAHHL

SEQ ID NO: 91408 - protein, 8 aa, Homo Sapiens
RDYETATL

SEQ ID NO: 91409 - protein, 8 aa, Homo Sapiens
RDYLATHV

SEQ ID NO: 91410 - protein, 8 aa, Homo Sapiens
RDYLHYHI

SEQ ID NO: 91411 - protein, 8 aa, Homo Sapiens
RDYLVQKL

SEQ ID NO: 91412 - protein, 8 aa, Homo Sapiens
RDYQVRGL

SEQ ID NO: 91413 - protein, 8 aa, Homo Sapiens
RDYVAPTA

SEQ ID NO: 91414 - protein, 8 aa, Homo Sapiens
RDYVKARL

SEQ ID NO: 91415 - protein, 8 aa, Homo Sapiens
RDYVRYRL

SEQ ID NO: 91416 - protein, 8 aa, Homo Sapiens
REALKHPF

SEQ ID NO: 91417 - protein, 8 aa, Homo Sapiens
REALTTGF

SEQ ID NO: 91418 - protein, 8 aa, Homo Sapiens
REALVKKF

SEQ ID NO: 91419 - protein, 8 aa, Homo Sapiens
REDAVHAM

SEQ ID NO: 91420 - protein, 8 aa, Homo Sapiens
REDIVNQM

SEQ ID NO: 91421 - protein, 8 aa, Homo Sapiens
REDLKFYF

SEQ ID NO: 91422 - protein, 8 aa, Homo Sapiens
REDLVNKM

SEQ ID NO: 91423 - protein, 8 aa, Homo Sapiens
REDTHHLV

SEQ ID NO: 91424 - protein, 8 aa, Homo Sapiens
REEYITAF

SEQ ID NO: 91425 - protein, 8 aa, Homo Sapiens
REFLKKEF

SEQ ID NO: 91426 - protein, 8 aa, Homo Sapiens
REFLVRSL

SEQ ID NO: 91427 - protein, 8 aa, Homo Sapiens
REFLWQHV

SEQ ID NO: 91428 - protein, 8 aa, Homo Sapiens
REFLWSKL

SEQ ID NO: 91429 - protein, 8 aa, Homo Sapiens
REHLTASM

SEQ ID NO: 91430 - protein, 8 aa, Homo Sapiens
REHPVPLL

SEQ ID NO: 91431 - protein, 8 aa, Homo Sapiens
REHVSRAL

SEQ ID NO: 91432 - protein, 8 aa, Homo Sapiens
REIIINAV

SEQ ID NO: 91433 - protein, 8 aa, Homo Sapiens
REILINNF

SEQ ID NO: 91434 - protein, 8 aa, Homo Sapiens
REKEWQRL

SEQ ID NO: 91435 - protein, 8 aa, Homo Sapiens
REKIVWEF

SEQ ID NO: 91436 - protein, 8 aa, Homo Sapiens
RELISRKL

SEQ ID NO: 91437 - protein, 8 aa, Homo Sapiens
RELLSHHF

SEQ ID NO: 91438 - protein, 8 aa, Homo Sapiens
RELLVERL

SEQ ID NO: 91439 - protein, 8 aa, Homo Sapiens
RELQHAAL

SEQ ID NO: 91440 - protein, 8 aa, Homo Sapiens
RELVAHHL

SEQ ID NO: 91441 - protein, 8 aa, Homo Sapiens
RELVKKGF

SEQ ID NO: 91442 - protein, 8 aa, Homo Sapiens
REMIVHSV

SEQ ID NO: 91443 - protein, 8 aa, Homo Sapiens
REMVVQLL

SEQ ID NO: 91444 - protein, 8 aa, Homo Sapiens
RENKAYSF

SEQ ID NO: 91445 - protein, 8 aa, Homo Sapiens
RENLISAL

SEQ ID NO: 91446 - protein, 8 aa, Homo Sapiens
RENLKQHF

SEQ ID NO: 91447 - protein, 8 aa, Homo Sapiens
RENLSAAF

SEQ ID NO: 91448 - protein, 8 aa, Homo Sapiens
RENYIHRI

SEQ ID NO: 91449 - protein, 8 aa, Homo Sapiens
REPVAVSV

SEQ ID NO: 91450 - protein, 8 aa, Homo Sapiens
REQEITAV

SEQ ID NO: 91451 - protein, 8 aa, Homo Sapiens
REQEVNIL

SEQ ID NO: 91452 - protein, 8 aa, Homo Sapiens
REQLVIEV

SEQ ID NO: 91453 - protein, 8 aa, Homo Sapiens
REQRVTGI

SEQ ID NO: 91454 - protein, 8 aa, Homo Sapiens
RESGVRNL

SEQ ID NO: 91455 - protein, 8 aa, Homo Sapiens
RESIVKDF

SEQ ID NO: 91456 - protein, 8 aa, Homo Sapiens
RESRHIAL

SEQ ID NO: 91457 - protein, 8 aa, Homo Sapiens
RESRVPAV

SEQ ID NO: 91458 - protein, 8 aa, Homo Sapiens
RESYICKV

SEQ ID NO: 91459 - protein, 8 aa, Homo Sapiens
RETKKISF

SEQ ID NO: 91460 - protein, 8 aa, Homo Sapiens
REWLTELF

SEQ ID NO: 91461 - protein, 8 aa, Homo Sapiens
REYCIQAF

SEQ ID NO: 91462 - protein, 8 aa, Homo Sapiens
REYHVQFF

SEQ ID NO: 91463 - protein, 8 aa, Homo Sapiens
REYQHIGL

SEQ ID NO: 91464 - protein, 8 aa, Homo Sapiens
REYVRPGL

SEQ ID NO: 91465 - protein, 8 aa, Homo Sapiens
REYYVNQF

SEQ ID NO: 91466 - protein, 8 aa, Homo Sapiens
RGCVVTSV

SEQ ID NO: 91467 - protein, 8 aa, Homo Sapiens
SDALAHHL

SEQ ID NO: 91468 - protein, 8 aa, Homo Sapiens
SDALAVTF

SEQ ID NO: 91469 - protein, 8 aa, Homo Sapiens
SDALKVTF

SEQ ID NO: 91470 - protein, 8 aa, Homo Sapiens
SDAPHPPL

SEQ ID NO: 91471 - protein, 8 aa, Homo Sapiens
SDCSHFDL

SEQ ID NO: 91472 - protein, 8 aa, Homo Sapiens
SDELTHNF

SEQ ID NO: 91473 - protein, 8 aa, Homo Sapiens
SDFEARQL

SEQ ID NO: 91474 - protein, 8 aa, Homo Sapiens
SDFKAHAV

SEQ ID NO: 91475 - protein, 8 aa, Homo Sapiens
SDFLVQQL

SEQ ID NO: 91476 - protein, 8 aa, Homo Sapiens
SDFVVHEI

SEQ ID NO: 91477 - protein, 8 aa, Homo Sapiens
SDFVVVQF

SEQ ID NO: 91478 - protein, 8 aa, Homo Sapiens
SDGIKHGF

SEQ ID NO: 91479 - protein, 8 aa, Homo Sapiens
SDGLVNVF

SEQ ID NO: 91480 - protein, 8 aa, Homo Sapiens
SDHSSHPF

SEQ ID NO: 91481 - protein, 8 aa, Homo Sapiens
SDITVHNF

SEQ ID NO: 91482 - protein, 8 aa, Homo Sapiens
SDIVKKEF

SEQ ID NO: 91483 - protein, 8 aa, Homo Sapiens
SDKETYEL

SEQ ID NO: 91484 - protein, 8 aa, Homo Sapiens
SDLHAHKL

SEQ ID NO: 91485 - protein, 8 aa, Homo Sapiens
SDMMSHLV

SEQ ID NO: 91486 - protein, 8 aa, Homo Sapiens
SDMRTERF

SEQ ID NO: 91487 - protein, 8 aa, Homo Sapiens
SDNFSHNL

SEQ ID NO: 91488 - protein, 8 aa, Homo Sapiens
SDNIIFQF

SEQ ID NO: 91489 - protein, 8 aa, Homo Sapiens
SDNRVTSF

SEQ ID NO: 91490 - protein, 8 aa, Homo Sapiens
SDQRVQNF

SEQ ID NO: 91491 - protein, 8 aa, Homo Sapiens
SDRLIIGF

SEQ ID NO: 91492 - protein, 8 aa, Homo Sapiens
SDSIHYQM

SEQ ID NO: 91493 - protein, 8 aa, Homo Sapiens
SDSLITKK

SEQ ID NO: 91494 - protein, 8 aa, Homo Sapiens
SDSLTQAL

SEQ ID NO: 91495 - protein, 8 aa, Homo Sapiens
SDSLTYKL

SEQ ID NO: 91496 - protein, 8 aa, Homo Sapiens
SDSLVKYF

SEQ ID NO: 91497 - protein, 8 aa, Homo Sapiens
SDSLVPAL

SEQ ID NO: 91498 - protein, 8 aa, Homo Sapiens
SDSPTNHF

SEQ ID NO: 91499 - protein, 8 aa, Homo Sapiens
SDSQVRAF

SEQ ID NO: 91500 - protein, 8 aa, Homo Sapiens
SDSQVRKL

SEQ ID NO: 91501 - protein, 8 aa, Homo Sapiens
SDSRTPAF

SEQ ID NO: 91502 - protein, 8 aa, Homo Sapiens
SDSRVQYF

SEQ ID NO: 91503 - protein, 8 aa, Homo Sapiens
SDSRVTCL

SEQ ID NO: 91504 - protein, 8 aa, Homo Sapiens
SDSSHAQF

SEQ ID NO: 91505 - protein, 8 aa, Homo Sapiens
SDSTHVTF

SEQ ID NO: 91506 - protein, 8 aa, Homo Sapiens
SDSVKSTF

SEQ ID NO: 91507 - protein, 8 aa, Homo Sapiens
SDSYAITF

SEQ ID NO: 91508 - protein, 8 aa, Homo Sapiens
SDTGNFGF

SEQ ID NO: 91509 - protein, 8 aa, Homo Sapiens
SDTLKTYF

SEQ ID NO: 91510 - protein, 8 aa, Homo Sapiens
SDTLVRYF

SEQ ID NO: 91511 - protein, 8 aa, Homo Sapiens
SDVIKEEF

SEQ ID NO: 91512 - protein, 8 aa, Homo Sapiens
SEHVWVEV

SEQ ID NO: 91513 - protein, 8 aa, Homo Sapiens
SELLIHVF

SEQ ID NO: 91514 - protein, 8 aa, Homo Sapiens
SENVVCHF

SEQ ID NO: 91515 - protein, 8 aa, Homo Sapiens
SENVVNRM

SEQ ID NO: 91516 - protein, 8 aa, Homo Sapiens
SENVVVEF

SEQ ID NO: 91517 - protein, 8 aa, Homo Sapiens
SEPTTVAF

SEQ ID NO: 91518 - protein, 8 aa, Homo Sapiens
SESIHQSL

SEQ ID NO: 91519 - protein, 8 aa, Homo Sapiens
SESIVNDF

SEQ ID NO: 91520 - protein, 8 aa, Homo Sapiens
SESIVQGF

SEQ ID NO: 91521 - protein, 8 aa, Homo Sapiens
SESMKPKF

SEQ ID NO: 91522 - protein, 8 aa, Homo Sapiens
SESQTHSF

SEQ ID NO: 91523 - protein, 8 aa, Homo Sapiens
SESQVKSL

SEQ ID NO: 91524 - protein, 8 aa, Homo Sapiens
SESYTQSF

SEQ ID NO: 91525 - protein, 8 aa, Homo Sapiens
TDALIKKF

SEQ ID NO: 91526 - protein, 8 aa, Homo Sapiens
TDFIAHLL

SEQ ID NO: 91527 - protein, 8 aa, Homo Sapiens
TDFISHLF

SEQ ID NO: 91528 - protein, 8 aa, Homo Sapiens
TDGKVFQF

SEQ ID NO: 91529 - protein, 8 aa, Homo Sapiens
TDHATTAL

SEQ ID NO: 91530 - protein, 8 aa, Homo Sapiens
TDLLKTGF

SEQ ID NO: 91531 - protein, 8 aa, Homo Sapiens
TDLRHTGF

SEQ ID NO: 91532 - protein, 8 aa, Homo Sapiens
TDSCVQRL

SEQ ID NO: 91533 - protein, 8 aa, Homo Sapiens
TDSFVNKL

SEQ ID NO: 91534 - protein, 8 aa, Homo Sapiens
TDSHVACF

SEQ ID NO: 91535 - protein, 8 aa, Homo Sapiens
TDSIVCEM

SEQ ID NO: 91536 - protein, 8 aa, Homo Sapiens
TDSPIWNF

SEQ ID NO: 91537 - protein, 8 aa, Homo Sapiens
TDSRKNPF

SEQ ID NO: 91538 - protein, 8 aa, Homo Sapiens
TDTAHVSL

SEQ ID NO: 91539 - protein, 8 aa, Homo Sapiens
TDVLVVGV

SEQ ID NO: 91540 - protein, 8 aa, Homo Sapiens
TDYETHEF

SEQ ID NO: 91541 - protein, 8 aa, Homo Sapiens
TESEVTAF

SEQ ID NO: 91542 - protein, 8 aa, Homo Sapiens
TESKVTEF

SEQ ID NO: 91543 - protein, 8 aa, Homo Sapiens
TESLVRGF

SEQ ID NO: 91544 - protein, 8 aa, Homo Sapiens
TESSVYNF

SEQ ID NO: 91545 - protein, 8 aa, Homo Sapiens
TNGEPPVF

SEQ ID NO: 91546 - protein, 8 aa, Homo Sapiens
TSPSHVNL

SEQ ID NO: 91547 - protein, 8 aa, Homo Sapiens
TVGNNKTL

SEQ ID NO: 91548 - protein, 8 aa, Homo Sapiens
VDHLHEHF

SEQ ID NO: 91549 - protein, 8 aa, Homo Sapiens
VDKAVQAF

SEQ ID NO: 91550 - protein, 8 aa, Homo Sapiens
VDKKIEEF

SEQ ID NO: 91551 - protein, 8 aa, Homo Sapiens
VDKTVQAF

SEQ ID NO: 91552 - protein, 8 aa, Homo Sapiens
VDMGHSAF

SEQ ID NO: 91553 - protein, 8 aa, Homo Sapiens
VDRVSYLL

SEQ ID NO: 91554 - protein, 8 aa, Homo Sapiens
VDSIVWTF

SEQ ID NO: 91555 - protein, 8 aa, Homo Sapiens
VDSKVKAF

SEQ ID NO: 91556 - protein, 8 aa, Homo Sapiens
VDSLHQLF

SEQ ID NO: 91557 - protein, 8 aa, Homo Sapiens
VDSLINKF

SEQ ID NO: 91558 - protein, 8 aa, Homo Sapiens
VDSLITRL

SEQ ID NO: 91559 - protein, 8 aa, Homo Sapiens
VDSMVQHF

SEQ ID NO: 91560 - protein, 8 aa, Homo Sapiens
VDSPAASF

SEQ ID NO: 91561 - protein, 8 aa, Homo Sapiens
VDSPSHGL

SEQ ID NO: 91562 - protein, 8 aa, Homo Sapiens
VDTLVTKF

SEQ ID NO: 91563 - protein, 8 aa, Homo Sapiens
VDTYKYLF

SEQ ID NO: 91564 - protein, 8 aa, Homo Sapiens
VDWLHELL

SEQ ID NO: 91565 - protein, 8 aa, Homo Sapiens
VDWLTEKM

SEQ ID NO: 91566 - protein, 8 aa, Homo Sapiens
VDYWVKAF

SEQ ID NO: 91567 - protein, 8 aa, Homo Sapiens
VEAVVRSF

SEQ ID NO: 91568 - protein, 8 aa, Homo Sapiens
VENKKVKF

SEQ ID NO: 91569 - protein, 8 aa, Homo Sapiens
VENKWHRV

SEQ ID NO: 91570 - protein, 8 aa, Homo Sapiens
VESKSQAF

SEQ ID NO: 91571 - protein, 8 aa, Homo Sapiens
VESKVYAV

SEQ ID NO: 91572 - protein, 8 aa, Homo Sapiens
VESMKYPF

SEQ ID NO: 91573 - protein, 8 aa, Homo Sapiens
YDFIHTSF

SEQ ID NO: 91574 - protein, 8 aa, Homo Sapiens
YDKAVASF

SEQ ID NO: 91575 - protein, 8 aa, Homo Sapiens
YDKDHYKL

SEQ ID NO: 91576 - protein, 8 aa, Homo Sapiens
YDLIVHQL

SEQ ID NO: 91577 - protein, 8 aa, Homo Sapiens
YDNPHEAL

SEQ ID NO: 91578 - protein, 8 aa, Homo Sapiens
YDSESKEF

SEQ ID NO: 91579 - protein, 8 aa, Homo Sapiens
YDSIIYRM

SEQ ID NO: 91580 - protein, 8 aa, Homo Sapiens
YDSTHGKF

SEQ ID NO: 91581 - protein, 8 aa, Homo Sapiens
YDSVKVYF

SEQ ID NO: 91582 - protein, 8 aa, Homo Sapiens
YDTVVHPF

SEQ ID NO: 91583 - protein, 8 aa, Homo Sapiens
YEMILHEF

SEQ ID NO: 91584 - protein, 8 aa, Homo Sapiens
YENLTNKL

SEQ ID NO: 91585 - protein, 8 aa, Homo Sapiens
YENLVVAL

SEQ ID NO: 91586 - protein, 8 aa, Homo Sapiens
YESKVFYL

SEQ ID NO: 91587 - protein, 8 aa, Homo Sapiens
YESLVHAV

SEQ ID NO: 91588 - protein, 8 aa, Homo Sapiens
YETLTRPF

SEQ ID NO: 91589 - protein, 9 aa, Homo Sapiens
ADALRPSVV

SEQ ID NO: 91590 - protein, 9 aa, Homo Sapiens
ADAMKVIGF

SEQ ID NO: 91591 - protein, 9 aa, Homo Sapiens
ADAVTHARF

SEQ ID NO: 91592 - protein, 9 aa, Homo Sapiens
ADFARVAHL

SEQ ID NO: 91593 - protein, 9 aa, Homo Sapiens
ADFERFSKV

SEQ ID NO: 91594 - protein, 9 aa, Homo Sapiens
ADFHRVEGL

SEQ ID NO: 91595 - protein, 9 aa, Homo Sapiens
ADGVHLLGF

SEQ ID NO: 91596 - protein, 9 aa, Homo Sapiens
ADHARTITV

SEQ ID NO: 91597 - protein, 9 aa, Homo Sapiens
ADHIHSVEM

SEQ ID NO: 91598 - protein, 9 aa, Homo Sapiens
ADHIRSIHV

SEQ ID NO: 91599 - protein, 9 aa, Homo Sapiens
ADKVRTMLV

SEQ ID NO: 91600 - protein, 9 aa, Homo Sapiens
ADLAHVLSL

SEQ ID NO: 91601 - protein, 9 aa, Homo Sapiens
ADLARFYTV

SEQ ID NO: 91602 - protein, 9 aa, Homo Sapiens
ADLARHAQV

SEQ ID NO: 91603 - protein, 9 aa, Homo Sapiens
ADLARRLGL

SEQ ID NO: 91604 - protein, 9 aa, Homo Sapiens
ADLERAQAM

SEQ ID NO: 91605 - protein, 9 aa, Homo Sapiens
ADLERFFNF

SEQ ID NO: 91606 - protein, 9 aa, Homo Sapiens
ADLERVLGL

SEQ ID NO: 91607 - protein, 9 aa, Homo Sapiens
ADLIRCKLL

SEQ ID NO: 91608 - protein, 9 aa, Homo Sapiens
ADLIRHVYF

SEQ ID NO: 91609 - protein, 9 aa, Homo Sapiens
ADLIRMAFM

SEQ ID NO: 91610 - protein, 9 aa, Homo Sapiens
ADLKKQELF

SEQ ID NO: 91611 - protein, 9 aa, Homo Sapiens
ADLKRHVEF

SEQ ID NO: 91612 - protein, 9 aa, Homo Sapiens
ADLLRARNM

SEQ ID NO: 91613 - protein, 9 aa, Homo Sapiens
ADLPRNIML

SEQ ID NO: 91614 - protein, 9 aa, Homo Sapiens
ADLRHKEAL

SEQ ID NO: 91615 - protein, 9 aa, Homo Sapiens
ADLRRAIQL

SEQ ID NO: 91616 - protein, 9 aa, Homo Sapiens
ADLSRAVSL

SEQ ID NO: 91617 - protein, 9 aa, Homo Sapiens
ADLTRVETF

SEQ ID NO: 91618 - protein, 9 aa, Homo Sapiens
ADLVNAHVV

SEQ ID NO: 91619 - protein, 9 aa, Homo Sapiens
ADLYRVLGV

SEQ ID NO: 91620 - protein, 9 aa, Homo Sapiens
ADMAHISGL

SEQ ID NO: 91621 - protein, 9 aa, Homo Sapiens
ADMAKRERF

SEQ ID NO: 91622 - protein, 9 aa, Homo Sapiens
ADMPRVFVF

SEQ ID NO: 91623 - protein, 9 aa, Homo Sapiens
ADNARVNFF

SEQ ID NO: 91624 - protein, 9 aa, Homo Sapiens
ADNIKAQLF

SEQ ID NO: 91625 - protein, 9 aa, Homo Sapiens
ADNLRLIQV

SEQ ID NO: 91626 - protein, 9 aa, Homo Sapiens
ADQKRFSAL

SEQ ID NO: 91627 - protein, 9 aa, Homo Sapiens
ADQLKEYLF

SEQ ID NO: 91628 - protein, 9 aa, Homo Sapiens
ADQLRFSYL

SEQ ID NO: 91629 - protein, 9 aa, Homo Sapiens
ADQMRMLNF

SEQ ID NO: 91630 - protein, 9 aa, Homo Sapiens
ADRARYSAF

SEQ ID NO: 91631 - protein, 9 aa, Homo Sapiens
ADSFHLQQF

SEQ ID NO: 91632 - protein, 9 aa, Homo Sapiens
ADSFKADYF

SEQ ID NO: 91633 - protein, 9 aa, Homo Sapiens
ADSIRQQEL

SEQ ID NO: 91634 - protein, 9 aa, Homo Sapiens
ADSKRAFEL

SEQ ID NO: 91635 - protein, 9 aa, Homo Sapiens
ADSLHRGLI

SEQ ID NO: 91636 - protein, 9 aa, Homo Sapiens
ADSLHRLGL

SEQ ID NO: 91637 - protein, 9 aa, Homo Sapiens
ADSLRHFKV

SEQ ID NO: 91638 - protein, 9 aa, Homo Sapiens
ADSLRLQQL

SEQ ID NO: 91639 - protein, 9 aa, Homo Sapiens
ADSPRTALL

SEQ ID NO: 91640 - protein, 9 aa, Homo Sapiens
ADSPRTSVF

SEQ ID NO: 91641 - protein, 9 aa, Homo Sapiens
ADSQRFRQF

SEQ ID NO: 91642 - protein, 9 aa, Homo Sapiens
ADTGRIHRF

SEQ ID NO: 91643 - protein, 9 aa, Homo Sapiens
ADVKHVFRL

SEQ ID NO: 91644 - protein, 9 aa, Homo Sapiens
ADVLKVEVF

SEQ ID NO: 91645 - protein, 9 aa, Homo Sapiens
ADWIRISEM

SEQ ID NO: 91646 - protein, 9 aa, Homo Sapiens
ADYIMANSF

SEQ ID NO: 91647 - protein, 9 aa, Homo Sapiens
ADYKRSSSL

SEQ ID NO: 91648 - protein, 9 aa, Homo Sapiens
ADYLVPILA

SEQ ID NO: 91649 - protein, 9 aa, Homo Sapiens
ADYQRICKM

SEQ ID NO: 91650 - protein, 9 aa, Homo Sapiens
ADYVHSLGL

SEQ ID NO: 91651 - protein, 9 aa, Homo Sapiens
AEAHARIHL

SEQ ID NO: 91652 - protein, 9 aa, Homo Sapiens
AEAIRKIGF

SEQ ID NO: 91653 - protein, 9 aa, Homo Sapiens
AEALRTSGL

SEQ ID NO: 91654 - protein, 9 aa, Homo Sapiens
AEAPHLVQV

SEQ ID NO: 91655 - protein, 9 aa, Homo Sapiens
AEAQRFARM

SEQ ID NO: 91656 - protein, 9 aa, Homo Sapiens
AEERRKYTL

SEQ ID NO: 91657 - protein, 9 aa, Homo Sapiens
AEGLRNENL

SEQ ID NO: 91658 - protein, 9 aa, Homo Sapiens
AEGPPRLAI

SEQ ID NO: 91659 - protein, 9 aa, Homo Sapiens
AEIRHEVSV

SEQ ID NO: 91660 - protein, 9 aa, Homo Sapiens
AEKAYHEQL

SEQ ID NO: 91661 - protein, 9 aa, Homo Sapiens
AELERAAAL

SEQ ID NO: 91662 - protein, 9 aa, Homo Sapiens
AELERAQKI

SEQ ID NO: 91663 - protein, 9 aa, Homo Sapiens
AELERNVAL

SEQ ID NO: 91664 - protein, 9 aa, Homo Sapiens
AELERQAVL

SEQ ID NO: 91665 - protein, 9 aa, Homo Sapiens
AELIRAFGL

SEQ ID NO: 91666 - protein, 9 aa, Homo Sapiens
AELLRGLSL

SEQ ID NO: 91667 - protein, 9 aa, Homo Sapiens
AELLRHDFV

SEQ ID NO: 91668 - protein, 9 aa, Homo Sapiens
AELLRHKFF

SEQ ID NO: 91669 - protein, 9 aa, Homo Sapiens
AELMRSMGL

SEQ ID NO: 91670 - protein, 9 aa, Homo Sapiens
AELQHCWAL

SEQ ID NO: 91671 - protein, 9 aa, Homo Sapiens
AELQRAESL

SEQ ID NO: 91672 - protein, 9 aa, Homo Sapiens
AELQRKESL

SEQ ID NO: 91673 - protein, 9 aa, Homo Sapiens
AELQRVQKV

SEQ ID NO: 91674 - protein, 9 aa, Homo Sapiens
AELRRHLQF

SEQ ID NO: 91675 - protein, 9 aa, Homo Sapiens
AELRRMQEM

SEQ ID NO: 91676 - protein, 9 aa, Homo Sapiens
AELVRHQRI

SEQ ID NO: 91677 - protein, 9 aa, Homo Sapiens
AEMIRQIEF

SEQ ID NO: 91678 - protein, 9 aa, Homo Sapiens
AEMLHNVTL

SEQ ID NO: 91679 - protein, 9 aa, Homo Sapiens
AEMLRSISF

SEQ ID NO: 91680 - protein, 9 aa, Homo Sapiens
AENPGKYNI

SEQ ID NO: 91681 - protein, 9 aa, Homo Sapiens
AEPAHFYLF

SEQ ID NO: 91682 - protein, 9 aa, Homo Sapiens
AEPGPRPAL

SEQ ID NO: 91683 - protein, 9 aa, Homo Sapiens
AEPKAKDPF

SEQ ID NO: 91684 - protein, 9 aa, Homo Sapiens
AEPVPTSHF

SEQ ID NO: 91685 - protein, 9 aa, Homo Sapiens
AEQIRLAQM

SEQ ID NO: 91686 - protein, 9 aa, Homo Sapiens
AEQKRLKTV

SEQ ID NO: 91687 - protein, 9 aa, Homo Sapiens
AEQKVEYTL

SEQ ID NO: 91688 - protein, 9 aa, Homo Sapiens
AEQLRAELL

SEQ ID NO: 91689 - protein, 9 aa, Homo Sapiens
AEQMHKTGF

SEQ ID NO: 91690 - protein, 9 aa, Homo Sapiens
AEQMRKIAL

SEQ ID NO: 91691 - protein, 9 aa, Homo Sapiens
AEQMRLAQV

SEQ ID NO: 91692 - protein, 9 aa, Homo Sapiens
AEQQITEVF

SEQ ID NO: 91693 - protein, 9 aa, Homo Sapiens
AEQVRKSTL

SEQ ID NO: 91694 - protein, 9 aa, Homo Sapiens
AEQWRSAQL

SEQ ID NO: 91695 - protein, 9 aa, Homo Sapiens
AEQYRSYRL

SEQ ID NO: 91696 - protein, 9 aa, Homo Sapiens
AESIRTGKL

SEQ ID NO: 91697 - protein, 9 aa, Homo Sapiens
AESLRYKLL

SEQ ID NO: 91698 - protein, 9 aa, Homo Sapiens
AESPAGHSF

SEQ ID NO: 91699 - protein, 9 aa, Homo Sapiens
AESPERVLL

SEQ ID NO: 91700 - protein, 9 aa, Homo Sapiens
AESVVPARM

SEQ ID NO: 91701 - protein, 9 aa, Homo Sapiens
AEVERVKNM

SEQ ID NO: 91702 - protein, 9 aa, Homo Sapiens
AEVLRTMEL

SEQ ID NO: 91703 - protein, 9 aa, Homo Sapiens
AEVPHSTGV

SEQ ID NO: 91704 - protein, 9 aa, Homo Sapiens
AEWQRAMTM

SEQ ID NO: 91705 - protein, 9 aa, Homo Sapiens
AEYIRTEML

SEQ ID NO: 91706 - protein, 9 aa, Homo Sapiens
AEYKRYLEM

SEQ ID NO: 91707 - protein, 9 aa, Homo Sapiens
AGPSHVAAM

SEQ ID NO: 91708 - protein, 9 aa, Homo Sapiens
AKMANYAKF

SEQ ID NO: 91709 - protein, 9 aa, Homo Sapiens
AQDEHLITF

SEQ ID NO: 91710 - protein, 9 aa, Homo Sapiens
AQPDHSYNL

SEQ ID NO: 91711 - protein, 9 aa, Homo Sapiens
ASPTPHAAF

SEQ ID NO: 91712 - protein, 9 aa, Homo Sapiens
ATNQMGSSF

SEQ ID NO: 91713 - protein, 9 aa, Homo Sapiens
CDVVKDYAF

SEQ ID NO: 91714 - protein, 9 aa, Homo Sapiens
CEVTRVKAV

SEQ ID NO: 91715 - protein, 9 aa, Homo Sapiens
DKVSVTFQF

SEQ ID NO: 91716 - protein, 9 aa, Homo Sapiens
EAQSRALQL

SEQ ID NO: 91717 - protein, 9 aa, Homo Sapiens
EDLIHEIAF

SEQ ID NO: 91718 - protein, 9 aa, Homo Sapiens
EDLQRALAL

SEQ ID NO: 91719 - protein, 9 aa, Homo Sapiens
EDQLRGAGF

SEQ ID NO: 91720 - protein, 9 aa, Homo Sapiens
EELERHAQF

SEQ ID NO: 91721 - protein, 9 aa, Homo Sapiens
EELKRVASF

SEQ ID NO: 91722 - protein, 9 aa, Homo Sapiens
EELPHIHAF

SEQ ID NO: 91723 - protein, 9 aa, Homo Sapiens
EVREHVKLL

SEQ ID NO: 91724 - protein, 9 aa, Homo Sapiens
FDHPHIVKL

SEQ ID NO: 91725 - protein, 9 aa, Homo Sapiens
FDRERIELF

SEQ ID NO: 91726 - protein, 9 aa, Homo Sapiens
FEDETVRKF

SEQ ID NO: 91727 - protein, 9 aa, Homo Sapiens
FEQIKKERF

SEQ ID NO: 91728 - protein, 9 aa, Homo Sapiens
FLQQPRPLM

SEQ ID NO: 91729 - protein, 9 aa, Homo Sapiens
FSDEIRHNL

SEQ ID NO: 91730 - protein, 9 aa, Homo Sapiens
GDEERVIGF

SEQ ID NO: 91731 - protein, 9 aa, Homo Sapiens
GDHLRKAKL

SEQ ID NO: 91732 - protein, 9 aa, Homo Sapiens
GDHVKKVSF

SEQ ID NO: 91733 - protein, 9 aa, Homo Sapiens
GDLAHANGL

SEQ ID NO: 91734 - protein, 9 aa, Homo Sapiens
GDLGRVKHL

SEQ ID NO: 91735 - protein, 9 aa, Homo Sapiens
GDLIRYIVL

SEQ ID NO: 91736 - protein, 9 aa, Homo Sapiens
GDLKHITKL

SEQ ID NO: 91737 - protein, 9 aa, Homo Sapiens
GDLQRELNL

SEQ ID NO: 91738 - protein, 9 aa, Homo Sapiens
GDLSHIHRL

SEQ ID NO: 91739 - protein, 9 aa, Homo Sapiens
GDLSRHLGL

SEQ ID NO: 91740 - protein, 9 aa, Homo Sapiens
GDLVKKESF

SEQ ID NO: 91741 - protein, 9 aa, Homo Sapiens
GDMRRLIGF

SEQ ID NO: 91742 - protein, 9 aa, Homo Sapiens
GDSVKASKF

SEQ ID NO: 91743 - protein, 9 aa, Homo Sapiens
GDTLRVFKM

SEQ ID NO: 91744 - protein, 9 aa, Homo Sapiens
GDYIRTGFI

SEQ ID NO: 91745 - protein, 9 aa, Homo Sapiens
GDYLRVWRV

SEQ ID NO: 91746 - protein, 9 aa, Homo Sapiens
GDYSRPLHI

SEQ ID NO: 91747 - protein, 9 aa, Homo Sapiens
GEAARAAGF

SEQ ID NO: 91748 - protein, 9 aa, Homo Sapiens
GEDPYPHKF

SEQ ID NO: 91749 - protein, 9 aa, Homo Sapiens
GELKRRLGL

SEQ ID NO: 91750 - protein, 9 aa, Homo Sapiens
GELQRKIGL

SEQ ID NO: 91751 - protein, 9 aa, Homo Sapiens
GEMPRHMQL

SEQ ID NO: 91752 - protein, 9 aa, Homo Sapiens
GEQEDRPGL

SEQ ID NO: 91753 - protein, 9 aa, Homo Sapiens
GGGWDHISV

SEQ ID NO: 91754 - protein, 9 aa, Homo Sapiens
GREAVLAAL

SEQ ID NO: 91755 - protein, 9 aa, Homo Sapiens
GSDMRTERF

SEQ ID NO: 91756 - protein, 9 aa, Homo Sapiens
GYERPFAQI

SEQ ID NO: 91757 - protein, 9 aa, Homo Sapiens
HDAARTGFL

SEQ ID NO: 91758 - protein, 9 aa, Homo Sapiens
HDFFRNDFL

SEQ ID NO: 91759 - protein, 9 aa, Homo Sapiens
HDFGHLSVF

SEQ ID NO: 91760 - protein, 9 aa, Homo Sapiens
HDFLKYDFF

SEQ ID NO: 91761 - protein, 9 aa, Homo Sapiens
HDFLVKVKV

SEQ ID NO: 91762 - protein, 9 aa, Homo Sapiens
HDFPQFYPL

SEQ ID NO: 91763 - protein, 9 aa, Homo Sapiens
HDFPRALIF

SEQ ID NO: 91764 - protein, 9 aa, Homo Sapiens
HDFVVVETV

SEQ ID NO: 91765 - protein, 9 aa, Homo Sapiens
HDGLTVHLV

SEQ ID NO: 91766 - protein, 9 aa, Homo Sapiens
HDHPHALEF

SEQ ID NO: 91767 - protein, 9 aa, Homo Sapiens
HDHQIRVGV

SEQ ID NO: 91768 - protein, 9 aa, Homo Sapiens
HDIETTHGV

SEQ ID NO: 91769 - protein, 9 aa, Homo Sapiens
HDILHLVEL

SEQ ID NO: 91770 - protein, 9 aa, Homo Sapiens
HDLERARLL

SEQ ID NO: 91771 - protein, 9 aa, Homo Sapiens
HDLERKYAV

SEQ ID NO: 91772 - protein, 9 aa, Homo Sapiens
HDLERRYEL

SEQ ID NO: 91773 - protein, 9 aa, Homo Sapiens
HDLKHAHEL

SEQ ID NO: 91774 - protein, 9 aa, Homo Sapiens
HDLKRKMIL

SEQ ID NO: 91775 - protein, 9 aa, Homo Sapiens
HDLLKLKKF

SEQ ID NO: 91776 - protein, 9 aa, Homo Sapiens
HDLLMSQVM

SEQ ID NO: 91777 - protein, 9 aa, Homo Sapiens
HDLMHFNTL

SEQ ID NO: 91778 - protein, 9 aa, Homo Sapiens
HDLPHYVAL

SEQ ID NO: 91779 - protein, 9 aa, Homo Sapiens
HDLTKWDLF

SEQ ID NO: 91780 - protein, 9 aa, Homo Sapiens
HDLWHIIKF

SEQ ID NO: 91781 - protein, 9 aa, Homo Sapiens
HDMVSPAVF

SEQ ID NO: 91782 - protein, 9 aa, Homo Sapiens
HDPGRGAPL

SEQ ID NO: 91783 - protein, 9 aa, Homo Sapiens
HDQLRHGGL

SEQ ID NO: 91784 - protein, 9 aa, Homo Sapiens
HDRIRPHNL

SEQ ID NO: 91785 - protein, 9 aa, Homo Sapiens
HDVLSFLTF

SEQ ID NO: 91786 - protein, 9 aa, Homo Sapiens
HDYAKAAFC

SEQ ID NO: 91787 - protein, 9 aa, Homo Sapiens
HDYMKQMTF

SEQ ID NO: 91788 - protein, 9 aa, Homo Sapiens
HEAERNIAL

SEQ ID NO: 91789 - protein, 9 aa, Homo Sapiens
HEDLRKAGL

SEQ ID NO: 91790 - protein, 9 aa, Homo Sapiens
HEFLRLSQV

SEQ ID NO: 91791 - protein, 9 aa, Homo Sapiens
HEGPALYYM

SEQ ID NO: 91792 - protein, 9 aa, Homo Sapiens
HEHIHSCQF

SEQ ID NO: 91793 - protein, 9 aa, Homo Sapiens
HEIGHSLGL

SEQ ID NO: 91794 - protein, 9 aa, Homo Sapiens
HELIHGSSF

SEQ ID NO: 91795 - protein, 9 aa, Homo Sapiens
HELLKENGF

SEQ ID NO: 91796 - protein, 9 aa, Homo Sapiens
HELQRFYSL

SEQ ID NO: 91797 - protein, 9 aa, Homo Sapiens
HEMEKAFAF

SEQ ID NO: 91798 - protein, 9 aa, Homo Sapiens
HEMPKTFTF

SEQ ID NO: 91799 - protein, 9 aa, Homo Sapiens
HENDAIHKI

SEQ ID NO: 91800 - protein, 9 aa, Homo Sapiens
HEPEPHILL

SEQ ID NO: 91801 - protein, 9 aa, Homo Sapiens
HEQLRAVIV

SEQ ID NO: 91802 - protein, 9 aa, Homo Sapiens
HEQSRIITV

SEQ ID NO: 91803 - protein, 9 aa, Homo Sapiens
HESPAVKLM

SEQ ID NO: 91804 - protein, 9 aa, Homo Sapiens
HGLIRKYGL

SEQ ID NO: 91805 - protein, 9 aa, Homo Sapiens
HSPLHSTGV

SEQ ID NO: 91806 - protein, 9 aa, Homo Sapiens
HSQAHCIGF

SEQ ID NO: 91807 - protein, 9 aa, Homo Sapiens
IDAIHQLGF

SEQ ID NO: 91808 - protein, 9 aa, Homo Sapiens
IDHPHTHVV

SEQ ID NO: 91809 - protein, 9 aa, Homo Sapiens
IDHVKGDSF

SEQ ID NO: 91810 - protein, 9 aa, Homo Sapiens
IDLERLQCL

SEQ ID NO: 91811 - protein, 9 aa, Homo Sapiens
IDLKRGFGF

SEQ ID NO: 91812 - protein, 9 aa, Homo Sapiens
IDLKRRYNF

SEQ ID NO: 91813 - protein, 9 aa, Homo Sapiens
IDLLRVIHV

SEQ ID NO: 91814 - protein, 9 aa, Homo Sapiens
IDLPRYAVL

SEQ ID NO: 91815 - protein, 9 aa, Homo Sapiens
IDMKRALMM

SEQ ID NO: 91816 - protein, 9 aa, Homo Sapiens
IDMSRVAVM

SEQ ID NO: 91817 - protein, 9 aa, Homo Sapiens
IDNGRAAEF

SEQ ID NO: 91818 - protein, 9 aa, Homo Sapiens
IDNNPKVKF

SEQ ID NO: 91819 - protein, 9 aa, Homo Sapiens
IDSIHQLGF

SEQ ID NO: 91820 - protein, 9 aa, Homo Sapiens
IDSIHQVGV

SEQ ID NO: 91821 - protein, 9 aa, Homo Sapiens
IDSLHSYCF

SEQ ID NO: 91822 - protein, 9 aa, Homo Sapiens
IDSLRALGV

SEQ ID NO: 91823 - protein, 9 aa, Homo Sapiens
IEDNPHPRL

SEQ ID NO: 91824 - protein, 9 aa, Homo Sapiens
IEHPHTDVV

SEQ ID NO: 91825 - protein, 9 aa, Homo Sapiens
IEISRNEAL

SEQ ID NO: 91826 - protein, 9 aa, Homo Sapiens
IEMPCHHLF

SEQ ID NO: 91827 - protein, 9 aa, Homo Sapiens
IENGHIFTV

SEQ ID NO: 91828 - protein, 9 aa, Homo Sapiens
IEPPERMEF

SEQ ID NO: 91829 - protein, 9 aa, Homo Sapiens
IERPTYTNL

SEQ ID NO: 91830 - protein, 9 aa, Homo Sapiens
ISPDAKVCF

SEQ ID NO: 91831 - protein, 9 aa, Homo Sapiens
ISPIKTETF

SEQ ID NO: 91832 - protein, 9 aa, Homo Sapiens
KAPPPKAAF

SEQ ID NO: 91833 - protein, 9 aa, Homo Sapiens
KDALRALNF

SEQ ID NO: 91834 - protein, 9 aa, Homo Sapiens
KDAVRKAMF

SEQ ID NO: 91835 - protein, 9 aa, Homo Sapiens
KDFEKAYKT

SEQ ID NO: 91836 - protein, 9 aa, Homo Sapiens
KDFERAKAV

SEQ ID NO: 91837 - protein, 9 aa, Homo Sapiens
KDFFRVLNL

SEQ ID NO: 91838 - protein, 9 aa, Homo Sapiens
KDFIKFIEF

SEQ ID NO: 91839 - protein, 9 aa, Homo Sapiens
KDFLKIFTF

SEQ ID NO: 91840 - protein, 9 aa, Homo Sapiens
KDFLRIAGL

SEQ ID NO: 91841 - protein, 9 aa, Homo Sapiens
KDFNRAFGF

SEQ ID NO: 91842 - protein, 9 aa, Homo Sapiens
KDFQKVAHF

SEQ ID NO: 91843 - protein, 9 aa, Homo Sapiens
KDHMVTSSF

SEQ ID NO: 91844 - protein, 9 aa, Homo Sapiens
KDHVLVKAF

SEQ ID NO: 91845 - protein, 9 aa, Homo Sapiens
KDIEHALSV

SEQ ID NO: 91846 - protein, 9 aa, Homo Sapiens
KDKLRINRF

SEQ ID NO: 91847 - protein, 9 aa, Homo Sapiens
KDLAKFSTF

SEQ ID NO: 91848 - protein, 9 aa, Homo Sapiens
KDLIHDVSF

SEQ ID NO: 91849 - protein, 9 aa, Homo Sapiens
KDLIRHFNI

SEQ ID NO: 91850 - protein, 9 aa, Homo Sapiens
KDLLRFAQV

SEQ ID NO: 91851 - protein, 9 aa, Homo Sapiens
KDLLRLSHL

SEQ ID NO: 91852 - protein, 9 aa, Homo Sapiens
KDLPHWNKL

SEQ ID NO: 91853 - protein, 9 aa, Homo Sapiens
KDLPRAVEI

SEQ ID NO: 91854 - protein, 9 aa, Homo Sapiens
KDLPRDIQF

SEQ ID NO: 91855 - protein, 9 aa, Homo Sapiens
KDLVHEFVV

SEQ ID NO: 91856 - protein, 9 aa, Homo Sapiens
KDLVHLLTL

SEQ ID NO: 91857 - protein, 9 aa, Homo Sapiens
KDMERLTSL

SEQ ID NO: 91858 - protein, 9 aa, Homo Sapiens
KDNERVVGF

SEQ ID NO: 91859 - protein, 9 aa, Homo Sapiens
KDQERVAEV

SEQ ID NO: 91860 - protein, 9 aa, Homo Sapiens
KDQLRTQVV

SEQ ID NO: 91861 - protein, 9 aa, Homo Sapiens
KDRLRINRF

SEQ ID NO: 91862 - protein, 9 aa, Homo Sapiens
KDRPWIWNI

SEQ ID NO: 91863 - protein, 9 aa, Homo Sapiens
KDSSVAARF

SEQ ID NO: 91864 - protein, 9 aa, Homo Sapiens
KDSVKGDVF

SEQ ID NO: 91865 - protein, 9 aa, Homo Sapiens
KDSVKVMTV

SEQ ID NO: 91866 - protein, 9 aa, Homo Sapiens
KDSVTCAGF

SEQ ID NO: 91867 - protein, 9 aa, Homo Sapiens
KDVAKHLGF

SEQ ID NO: 91868 - protein, 9 aa, Homo Sapiens
KDVDRIIGL

SEQ ID NO: 91869 - protein, 9 aa, Homo Sapiens
KDWERHHRL

SEQ ID NO: 91870 - protein, 9 aa, Homo Sapiens
KDYERVLEL

SEQ ID NO: 91871 - protein, 9 aa, Homo Sapiens
KDYPHRCEF

SEQ ID NO: 91872 - protein, 9 aa, Homo Sapiens
KEACRAYGL

SEQ ID NO: 91873 - protein, 9 aa, Homo Sapiens
KEAETRAEF

SEQ ID NO: 91874 - protein, 9 aa, Homo Sapiens
KEAIREASF

SEQ ID NO: 91875 - protein, 9 aa, Homo Sapiens
KEAIREHQM

SEQ ID NO: 91876 - protein, 9 aa, Homo Sapiens
KEALPKAAF

SEQ ID NO: 91877 - protein, 9 aa, Homo Sapiens
KEAQRIMTL

SEQ ID NO: 91878 - protein, 9 aa, Homo Sapiens
KECMRALGF

SEQ ID NO: 91879 - protein, 9 aa, Homo Sapiens
KEDGTFYEF

SEQ ID NO: 91880 - protein, 9 aa, Homo Sapiens
KEDNTIYRL

SEQ ID NO: 91881 - protein, 9 aa, Homo Sapiens
KEDPTSFRL

SEQ ID NO: 91882 - protein, 9 aa, Homo Sapiens
KEDTPHTAL

SEQ ID NO: 91883 - protein, 9 aa, Homo Sapiens
KEEIPTHSF

SEQ ID NO: 91884 - protein, 9 aa, Homo Sapiens
KEEPRKVCF

SEQ ID NO: 91885 - protein, 9 aa, Homo Sapiens
KEGEFVAQF

SEQ ID NO: 91886 - protein, 9 aa, Homo Sapiens
KEHRPVEKF

SEQ ID NO: 91887 - protein, 9 aa, Homo Sapiens
KEHVLHCQF

SEQ ID NO: 91888 - protein, 9 aa, Homo Sapiens
KEHYKIEAF

SEQ ID NO: 91889 - protein, 9 aa, Homo Sapiens
KEIPHLVAV

SEQ ID NO: 91890 - protein, 9 aa, Homo Sapiens
KEKVHEYNV

SEQ ID NO: 91891 - protein, 9 aa, Homo Sapiens
KELARIEEF

SEQ ID NO: 91892 - protein, 9 aa, Homo Sapiens
KELARQISF

SEQ ID NO: 91893 - protein, 9 aa, Homo Sapiens
KELERLTSL

SEQ ID NO: 91894 - protein, 9 aa, Homo Sapiens
KELERSYHL

SEQ ID NO: 91895 - protein, 9 aa, Homo Sapiens
KELERVTSL

SEQ ID NO: 91896 - protein, 9 aa, Homo Sapiens
KELGRMCQL

SEQ ID NO: 91897 - protein, 9 aa, Homo Sapiens
KELHRFEKL

SEQ ID NO: 91898 - protein, 9 aa, Homo Sapiens
KELIREVEM

SEQ ID NO: 91899 - protein, 9 aa, Homo Sapiens
KELLHNIQL

SEQ ID NO: 91900 - protein, 9 aa, Homo Sapiens
KELLRVAQI

SEQ ID NO: 91901 - protein, 9 aa, Homo Sapiens
KELNILHEM

SEQ ID NO: 91902 - protein, 9 aa, Homo Sapiens
KELNRWCSL

SEQ ID NO: 91903 - protein, 9 aa, Homo Sapiens
KELQHYVTM

SEQ ID NO: 91904 - protein, 9 aa, Homo Sapiens
KELQKSCTF

SEQ ID NO: 91905 - protein, 9 aa, Homo Sapiens
KELQRFKAV

SEQ ID NO: 91906 - protein, 9 aa, Homo Sapiens
KELQRSVEF

SEQ ID NO: 91907 - protein, 9 aa, Homo Sapiens
KELVRQLQL

SEQ ID NO: 91908 - protein, 9 aa, Homo Sapiens
KEMLKLLDF

SEQ ID NO: 91909 - protein, 9 aa, Homo Sapiens
KEMLPHVGV

SEQ ID NO: 91910 - protein, 9 aa, Homo Sapiens
KEMPAVLVF

SEQ ID NO: 91911 - protein, 9 aa, Homo Sapiens
KENPLQFKF

SEQ ID NO: 91912 - protein, 9 aa, Homo Sapiens
KENSYVKKF

SEQ ID NO: 91913 - protein, 9 aa, Homo Sapiens
KEPEERPTF

SEQ ID NO: 91914 - protein, 9 aa, Homo Sapiens
KEPPEVQSF

SEQ ID NO: 91915 - protein, 9 aa, Homo Sapiens
KEPPGSEEF

SEQ ID NO: 91916 - protein, 9 aa, Homo Sapiens
KEPPPEFEF

SEQ ID NO: 91917 - protein, 9 aa, Homo Sapiens
KEPPQGAHF

SEQ ID NO: 91918 - protein, 9 aa, Homo Sapiens
KEQARYNQL

SEQ ID NO: 91919 - protein, 9 aa, Homo Sapiens
KEQERIFQL

SEQ ID NO: 91920 - protein, 9 aa, Homo Sapiens
KEQERLAQL

SEQ ID NO: 91921 - protein, 9 aa, Homo Sapiens
KEQERTLAL

SEQ ID NO: 91922 - protein, 9 aa, Homo Sapiens
KEQMRIQSL

SEQ ID NO: 91923 - protein, 9 aa, Homo Sapiens
KESDGFHRF

SEQ ID NO: 91924 - protein, 9 aa, Homo Sapiens
KESERLQAM

SEQ ID NO: 91925 - protein, 9 aa, Homo Sapiens
KESETFVQF

SEQ ID NO: 91926 - protein, 9 aa, Homo Sapiens
KESEVFYEL

SEQ ID NO: 91927 - protein, 9 aa, Homo Sapiens
KESEVKREF

SEQ ID NO: 91928 - protein, 9 aa, Homo Sapiens
KESEVVMKF

SEQ ID NO: 91929 - protein, 9 aa, Homo Sapiens
KESEVYKML

SEQ ID NO: 91930 - protein, 9 aa, Homo Sapiens
KESKINQVF

SEQ ID NO: 91931 - protein, 9 aa, Homo Sapiens
KESPLLFKF

SEQ ID NO: 91932 - protein, 9 aa, Homo Sapiens
KESPPHEDL

SEQ ID NO: 91933 - protein, 9 aa, Homo Sapiens
KESQRLVGF

SEQ ID NO: 91934 - protein, 9 aa, Homo Sapiens
KESTTKYYF

SEQ ID NO: 91935 - protein, 9 aa, Homo Sapiens
KEVERILGL

SEQ ID NO: 91936 - protein, 9 aa, Homo Sapiens
KEVPRSYEL

SEQ ID NO: 91937 - protein, 9 aa, Homo Sapiens
KEYVRCETV

SEQ ID NO: 91938 - protein, 9 aa, Homo Sapiens
KQDKGGFGF

SEQ ID NO: 91939 - protein, 9 aa, Homo Sapiens
KSDERLTAF

SEQ ID NO: 91940 - protein, 9 aa, Homo Sapiens
KSDPSIVRL

SEQ ID NO: 91941 - protein, 9 aa, Homo Sapiens
KSPAPSSDF

SEQ ID NO: 91942 - protein, 9 aa, Homo Sapiens
KSPDASSAF

SEQ ID NO: 91943 - protein, 9 aa, Homo Sapiens
LDFERTLGL

SEQ ID NO: 91944 - protein, 9 aa, Homo Sapiens
LDHPHIIKL

SEQ ID NO: 91945 - protein, 9 aa, Homo Sapiens
LDHPHIVKL

SEQ ID NO: 91946 - protein, 9 aa, Homo Sapiens
LDHVRTSFL

SEQ ID NO: 91947 - protein, 9 aa, Homo Sapiens
LDLQRNYIF

SEQ ID NO: 91948 - protein, 9 aa, Homo Sapiens
LDLQRTLSL

SEQ ID NO: 91949 - protein, 9 aa, Homo Sapiens
LDMLKVAVF

SEQ ID NO: 91950 - protein, 9 aa, Homo Sapiens
LDVPHSYSV

SEQ ID NO: 91951 - protein, 9 aa, Homo Sapiens
LEAHRIVKM

SEQ ID NO: 91952 - protein, 9 aa, Homo Sapiens
LELPRGWEM

SEQ ID NO: 91953 - protein, 9 aa, Homo Sapiens
LENPRFYGF

SEQ ID NO: 91954 - protein, 9 aa, Homo Sapiens
LENQVRHQL

SEQ ID NO: 91955 - protein, 9 aa, Homo Sapiens
LEQLRPVTV

SEQ ID NO: 91956 - protein, 9 aa, Homo Sapiens
LESGHYTSF

SEQ ID NO: 91957 - protein, 9 aa, Homo Sapiens
LHREDLTSI

SEQ ID NO: 91958 - protein, 9 aa, Homo Sapiens
LQERRHLDL

SEQ ID NO: 91959 - protein, 9 aa, Homo Sapiens
LQQTPHAHL

SEQ ID NO: 91960 - protein, 9 aa, Homo Sapiens
LTVGNNKTL

SEQ ID NO: 91961 - protein, 9 aa, Homo Sapiens
MDHPHHTLF

SEQ ID NO: 91962 - protein, 9 aa, Homo Sapiens
MDLEHKVLL

SEQ ID NO: 91963 - protein, 9 aa, Homo Sapiens
MDLKRGMLL

SEQ ID NO: 91964 - protein, 9 aa, Homo Sapiens
MDLLRESQL

SEQ ID NO: 91965 - protein, 9 aa, Homo Sapiens
MDLVKNHLM

SEQ ID NO: 91966 - protein, 9 aa, Homo Sapiens
MDSIHDVTF

SEQ ID NO: 91967 - protein, 9 aa, Homo Sapiens
MDSVRQAKL

SEQ ID NO: 91968 - protein, 9 aa, Homo Sapiens
MDSVRSGPF

SEQ ID NO: 91969 - protein, 9 aa, Homo Sapiens
MEIERILGV

SEQ ID NO: 91970 - protein, 9 aa, Homo Sapiens
MELERVKAL

SEQ ID NO: 91971 - protein, 9 aa, Homo Sapiens
MEMAHLYSL

SEQ ID NO: 91972 - protein, 9 aa, Homo Sapiens
MGPPPTPHF

SEQ ID NO: 91973 - protein, 9 aa, Homo Sapiens
MGPPPTSHF

SEQ ID NO: 91974 - protein, 9 aa, Homo Sapiens
MQSGPKPLF

SEQ ID NO: 91975 - protein, 9 aa, Homo Sapiens
NDSVKTVGF

SEQ ID NO: 91976 - protein, 9 aa, Homo Sapiens
NELIRFEEF

SEQ ID NO: 91977 - protein, 9 aa, Homo Sapiens
NELKRLCGL

SEQ ID NO: 91978 - protein, 9 aa, Homo Sapiens
PDLPHLLAF

SEQ ID NO: 91979 - protein, 9 aa, Homo Sapiens
PDLPRNAQV

SEQ ID NO: 91980 - protein, 9 aa, Homo Sapiens
QDFLRASQM

SEQ ID NO: 91981 - protein, 9 aa, Homo Sapiens
QDHPSSMGV

SEQ ID NO: 91982 - protein, 9 aa, Homo Sapiens
QDLCRLAKL

SEQ ID NO: 91983 - protein, 9 aa, Homo Sapiens
QDLEHHLGL

SEQ ID NO: 91984 - protein, 9 aa, Homo Sapiens
QDLERASQL

SEQ ID NO: 91985 - protein, 9 aa, Homo Sapiens
QDLERVRNL

SEQ ID NO: 91986 - protein, 9 aa, Homo Sapiens
QDLIHRSKM

SEQ ID NO: 91987 - protein, 9 aa, Homo Sapiens
QDLIRELEL

SEQ ID NO: 91988 - protein, 9 aa, Homo Sapiens
QDLLRCRVL

SEQ ID NO: 91989 - protein, 9 aa, Homo Sapiens
QDLLRIGLF

SEQ ID NO: 91990 - protein, 9 aa, Homo Sapiens
QDLQHGNSM

SEQ ID NO: 91991 - protein, 9 aa, Homo Sapiens
QDLRRTNSL

SEQ ID NO: 91992 - protein, 9 aa, Homo Sapiens
QDNCRAANF

SEQ ID NO: 91993 - protein, 9 aa, Homo Sapiens
QDNLRQLSV

SEQ ID NO: 91994 - protein, 9 aa, Homo Sapiens
QDSVRLLAV

SEQ ID NO: 91995 - protein, 9 aa, Homo Sapiens
QDTLRTMYF

SEQ ID NO: 91996 - protein, 9 aa, Homo Sapiens
QDVARVLGF

SEQ ID NO: 91997 - protein, 9 aa, Homo Sapiens
QDVERWLGF

SEQ ID NO: 91998 - protein, 9 aa, Homo Sapiens
QDVKKIEKF

SEQ ID NO: 91999 - protein, 9 aa, Homo Sapiens
QDYARIFQF

SEQ ID NO: 92000 - protein, 9 aa, Homo Sapiens
QEDMPHNQF

SEQ ID NO: 92001 - protein, 9 aa, Homo Sapiens
QEDVRLIGL

SEQ ID NO: 92002 - protein, 9 aa, Homo Sapiens
QEHARHISF

SEQ ID NO: 92003 - protein, 9 aa, Homo Sapiens
QEMPWNVRM

SEQ ID NO: 92004 - protein, 9 aa, Homo Sapiens
QEPPPVKQV

SEQ ID NO: 92005 - protein, 9 aa, Homo Sapiens
QEPPTKPRF

SEQ ID NO: 92006 - protein, 9 aa, Homo Sapiens
QEQLRLQGL

SEQ ID NO: 92007 - protein, 9 aa, Homo Sapiens
QEYTRVCSL

SEQ ID NO: 92008 - protein, 9 aa, Homo Sapiens
QITAGRHGD

SEQ ID NO: 92009 - protein, 9 aa, Homo Sapiens
QSQKHLIGL

SEQ ID NO: 92010 - protein, 9 aa, Homo Sapiens
RAPEKIVTF

SEQ ID NO: 92011 - protein, 9 aa, Homo Sapiens
RDAERVKEM

SEQ ID NO: 92012 - protein, 9 aa, Homo Sapiens
RDAFRTLGL

SEQ ID NO: 92013 - protein, 9 aa, Homo Sapiens
RDALVHARL

SEQ ID NO: 92014 - protein, 9 aa, Homo Sapiens
RDCEVRATF

SEQ ID NO: 92015 - protein, 9 aa, Homo Sapiens
RDCLVLQSF

SEQ ID NO: 92016 - protein, 9 aa, Homo Sapiens
RDCQRLVAL

SEQ ID NO: 92017 - protein, 9 aa, Homo Sapiens
RDCVHIMKL

SEQ ID NO: 92018 - protein, 9 aa, Homo Sapiens
RDEIRPLSF

SEQ ID NO: 92019 - protein, 9 aa, Homo Sapiens
RDFEKNYNM

SEQ ID NO: 92020 - protein, 9 aa, Homo Sapiens
RDFERISTV

SEQ ID NO: 92021 - protein, 9 aa, Homo Sapiens
RDFFRAQTL

SEQ ID NO: 92022 - protein, 9 aa, Homo Sapiens
RDFLRYWRI

SEQ ID NO: 92023 - protein, 9 aa, Homo Sapiens
RDFPSFAQL

SEQ ID NO: 92024 - protein, 9 aa, Homo Sapiens
RDFQHVEKL

SEQ ID NO: 92025 - protein, 9 aa, Homo Sapiens
RDHAVVVGV

SEQ ID NO: 92026 - protein, 9 aa, Homo Sapiens
RDHDRFWVL

SEQ ID NO: 92027 - protein, 9 aa, Homo Sapiens
RDHILISHF

SEQ ID NO: 92028 - protein, 9 aa, Homo Sapiens
RDHLIAKNV

SEQ ID NO: 92029 - protein, 9 aa, Homo Sapiens
RDHLQPAVF

SEQ ID NO: 92030 - protein, 9 aa, Homo Sapiens
RDHLRQTLL

SEQ ID NO: 92031 - protein, 9 aa, Homo Sapiens
RDILAVLTM

SEQ ID NO: 92032 - protein, 9 aa, Homo Sapiens
RDILRASTL

SEQ ID NO: 92033 - protein, 9 aa, Homo Sapiens
RDILSHGRF

SEQ ID NO: 92034 - protein, 9 aa, Homo Sapiens
RDIYRSQSF

SEQ ID NO: 92035 - protein, 9 aa, Homo Sapiens
RDKLLKDAV

SEQ ID NO: 92036 - protein, 9 aa, Homo Sapiens
RDKSRNIQF

SEQ ID NO: 92037 - protein, 9 aa, Homo Sapiens
RDKVKLMKF

SEQ ID NO: 92038 - protein, 9 aa, Homo Sapiens
RDKVREMFM

SEQ ID NO: 92039 - protein, 9 aa, Homo Sapiens
RDLCRVLQL

SEQ ID NO: 92040 - protein, 9 aa, Homo Sapiens
RDLEELVKL

SEQ ID NO: 92041 - protein, 9 aa, Homo Sapiens
RDLEHLMLL

SEQ ID NO: 92042 - protein, 9 aa, Homo Sapiens
RDLERAEVA

SEQ ID NO: 92043 - protein, 9 aa, Homo Sapiens
RDLERALYL

SEQ ID NO: 92044 - protein, 9 aa, Homo Sapiens
RDLERGVEI

SEQ ID NO: 92045 - protein, 9 aa, Homo Sapiens
RDLERMENI

SEQ ID NO: 92046 - protein, 9 aa, Homo Sapiens
RDLERSRTV

SEQ ID NO: 92047 - protein, 9 aa, Homo Sapiens
RDLGHVETI

SEQ ID NO: 92048 - protein, 9 aa, Homo Sapiens
RDLIREVEM

SEQ ID NO: 92049 - protein, 9 aa, Homo Sapiens
RDLIRQGIL

SEQ ID NO: 92050 - protein, 9 aa, Homo Sapiens
RDLLHNSLL

SEQ ID NO: 92051 - protein, 9 aa, Homo Sapiens
RDLLIKVKF

SEQ ID NO: 92052 - protein, 9 aa, Homo Sapiens
RDLLRFLLI

SEQ ID NO: 92053 - protein, 9 aa, Homo Sapiens
RDLMHVHSF

SEQ ID NO: 92054 - protein, 9 aa, Homo Sapiens
RDLPRLLAV

SEQ ID NO: 92055 - protein, 9 aa, Homo Sapiens
RDLQEFVPF

SEQ ID NO: 92056 - protein, 9 aa, Homo Sapiens
RDLQHRHIV

SEQ ID NO: 92057 - protein, 9 aa, Homo Sapiens
RDLQRLGEL

SEQ ID NO: 92058 - protein, 9 aa, Homo Sapiens
RDLSHKEKL

SEQ ID NO: 92059 - protein, 9 aa, Homo Sapiens
RDLTRHISL

SEQ ID NO: 92060 - protein, 9 aa, Homo Sapiens
RDLVHKVQM

SEQ ID NO: 92061 - protein, 9 aa, Homo Sapiens
RDLVHRQTA

SEQ ID NO: 92062 - protein, 9 aa, Homo Sapiens
RDLVRQGRL

SEQ ID NO: 92063 - protein, 9 aa, Homo Sapiens
RDLVSKEGF

SEQ ID NO: 92064 - protein, 9 aa, Homo Sapiens
RDMEQRHVL

SEQ ID NO: 92065 - protein, 9 aa, Homo Sapiens
RDMGRPMEL

SEQ ID NO: 92066 - protein, 9 aa, Homo Sapiens
RDNLKISDF

SEQ ID NO: 92067 - protein, 9 aa, Homo Sapiens
RDNPRFNLM

SEQ ID NO: 92068 - protein, 9 aa, Homo Sapiens
RDNPRNTRF

SEQ ID NO: 92069 - protein, 9 aa, Homo Sapiens
RDQLRPTQL

SEQ ID NO: 92070 - protein, 9 aa, Homo Sapiens
RDQPQFQNM

SEQ ID NO: 92071 - protein, 9 aa, Homo Sapiens
RDRPHEVLL

SEQ ID NO: 92072 - protein, 9 aa, Homo Sapiens
RDSDGHVSF

SEQ ID NO: 92073 - protein, 9 aa, Homo Sapiens
RDSERLLEV

SEQ ID NO: 92074 - protein, 9 aa, Homo Sapiens
RDSLREQTL

SEQ ID NO: 92075 - protein, 9 aa, Homo Sapiens
RDSMCRQTF

SEQ ID NO: 92076 - protein, 9 aa, Homo Sapiens
RDSPKCYKL

SEQ ID NO: 92077 - protein, 9 aa, Homo Sapiens
RDSQRVLYI

SEQ ID NO: 92078 - protein, 9 aa, Homo Sapiens
RDSSPKVRF

SEQ ID NO: 92079 - protein, 9 aa, Homo Sapiens
RDSVVEILF

SEQ ID NO: 92080 - protein, 9 aa, Homo Sapiens
RDTMRAMGL

SEQ ID NO: 92081 - protein, 9 aa, Homo Sapiens
RDTQKYKPF

SEQ ID NO: 92082 - protein, 9 aa, Homo Sapiens
RDVIRHITV

SEQ ID NO: 92083 - protein, 9 aa, Homo Sapiens
RDVQHIIVF

SEQ ID NO: 92084 - protein, 9 aa, Homo Sapiens
RDVQKVVGF

SEQ ID NO: 92085 - protein, 9 aa, Homo Sapiens
RDYAQQIGV

SEQ ID NO: 92086 - protein, 9 aa, Homo Sapiens
RDYCAHHLI

SEQ ID NO: 92087 - protein, 9 aa, Homo Sapiens
RDYEHQFHL

SEQ ID NO: 92088 - protein, 9 aa, Homo Sapiens
RDYEKAIKF

SEQ ID NO: 92089 - protein, 9 aa, Homo Sapiens
RDYTRFQKL

SEQ ID NO: 92090 - protein, 9 aa, Homo Sapiens
REAEPIPKM

SEQ ID NO: 92091 - protein, 9 aa, Homo Sapiens
REAEREALL

SEQ ID NO: 92092 - protein, 9 aa, Homo Sapiens
REAIRVLGL

SEQ ID NO: 92093 - protein, 9 aa, Homo Sapiens
REALKKYLF

SEQ ID NO: 92094 - protein, 9 aa, Homo Sapiens
REAPERPSL

SEQ ID NO: 92095 - protein, 9 aa, Homo Sapiens
REATGKITF

SEQ ID NO: 92096 - protein, 9 aa, Homo Sapiens
RECGKSFSF

SEQ ID NO: 92097 - protein, 9 aa, Homo Sapiens
RECPRSFLL

SEQ ID NO: 92098 - protein, 9 aa, Homo Sapiens
REDRRPITV

SEQ ID NO: 92099 - protein, 9 aa, Homo Sapiens
REDTRVATF

SEQ ID NO: 92100 - protein, 9 aa, Homo Sapiens
REDVGKVKF

SEQ ID NO: 92101 - protein, 9 aa, Homo Sapiens
REEAHRVSV

SEQ ID NO: 92102 - protein, 9 aa, Homo Sapiens
REEKRVLGL

SEQ ID NO: 92103 - protein, 9 aa, Homo Sapiens
REFERFQEM

SEQ ID NO: 92104 - protein, 9 aa, Homo Sapiens
REFPKFFTF

SEQ ID NO: 92105 - protein, 9 aa, Homo Sapiens
REGARVLAL

SEQ ID NO: 92106 - protein, 9 aa, Homo Sapiens
REHLLTNHL

SEQ ID NO: 92107 - protein, 9 aa, Homo Sapiens
REHYHATAL

SEQ ID NO: 92108 - protein, 9 aa, Homo Sapiens
RELARQKNM

SEQ ID NO: 92109 - protein, 9 aa, Homo Sapiens
RELARVSVL

SEQ ID NO: 92110 - protein, 9 aa, Homo Sapiens
RELDRNELF

SEQ ID NO: 92111 - protein, 9 aa, Homo Sapiens
RELEKLFQL

SEQ ID NO: 92112 - protein, 9 aa, Homo Sapiens
RELEKLMVF

SEQ ID NO: 92113 - protein, 9 aa, Homo Sapiens
RELEVQHPA

SEQ ID NO: 92114 - protein, 9 aa, Homo Sapiens
RELIRSQAV

SEQ ID NO: 92115 - protein, 9 aa, Homo Sapiens
RELLHCARL

SEQ ID NO: 92116 - protein, 9 aa, Homo Sapiens
RELLKYKAF

SEQ ID NO: 92117 - protein, 9 aa, Homo Sapiens
RELPAWVSF

SEQ ID NO: 92118 - protein, 9 aa, Homo Sapiens
RELQKLSKF

SEQ ID NO: 92119 - protein, 9 aa, Homo Sapiens
RELQRLSYL

SEQ ID NO: 92120 - protein, 9 aa, Homo Sapiens
RELTHLSEM

SEQ ID NO: 92121 - protein, 9 aa, Homo Sapiens
RELYHVISF

SEQ ID NO: 92122 - protein, 9 aa, Homo Sapiens
REMDVIRNF

SEQ ID NO: 92123 - protein, 9 aa, Homo Sapiens
REMEHLRQF

SEQ ID NO: 92124 - protein, 9 aa, Homo Sapiens
REMERREAL

SEQ ID NO: 92125 - protein, 9 aa, Homo Sapiens
REMGVIAAM

SEQ ID NO: 92126 - protein, 9 aa, Homo Sapiens
REMHRAATF

SEQ ID NO: 92127 - protein, 9 aa, Homo Sapiens
REMLHNHSF

SEQ ID NO: 92128 - protein, 9 aa, Homo Sapiens
REMLIRVNM

SEQ ID NO: 92129 - protein, 9 aa, Homo Sapiens
REMLKQYYI

SEQ ID NO: 92130 - protein, 9 aa, Homo Sapiens
RENDIKSYF

SEQ ID NO: 92131 - protein, 9 aa, Homo Sapiens
RENIATHHL

SEQ ID NO: 92132 - protein, 9 aa, Homo Sapiens
RENIRSLTM

SEQ ID NO: 92133 - protein, 9 aa, Homo Sapiens
RENIRTEVM

SEQ ID NO: 92134 - protein, 9 aa, Homo Sapiens
RENNAVYAF

SEQ ID NO: 92135 - protein, 9 aa, Homo Sapiens
RENNYTYEF

SEQ ID NO: 92136 - protein, 9 aa, Homo Sapiens
RENPRRFVI

SEQ ID NO: 92137 - protein, 9 aa, Homo Sapiens
RENPVLRAF

SEQ ID NO: 92138 - protein, 9 aa, Homo Sapiens
RENSHLVTF

SEQ ID NO: 92139 - protein, 9 aa, Homo Sapiens
RENVAHNAL

SEQ ID NO: 92140 - protein, 9 aa, Homo Sapiens
REPAPAEAL

SEQ ID NO: 92141 - protein, 9 aa, Homo Sapiens
REPAPCAAL

SEQ ID NO: 92142 - protein, 9 aa, Homo Sapiens
REPLPHLHF

SEQ ID NO: 92143 - protein, 9 aa, Homo Sapiens
REPNVLICF

SEQ ID NO: 92144 - protein, 9 aa, Homo Sapiens
REPPNDPCL

SEQ ID NO: 92145 - protein, 9 aa, Homo Sapiens
REPPPGEAI

SEQ ID NO: 92146 - protein, 9 aa, Homo Sapiens
REPPPIWRV

SEQ ID NO: 92147 - protein, 9 aa, Homo Sapiens
REPPPSPMV

SEQ ID NO: 92148 - protein, 9 aa, Homo Sapiens
REPQAKPQL

SEQ ID NO: 92149 - protein, 9 aa, Homo Sapiens
REPTAVNSF

SEQ ID NO: 92150 - protein, 9 aa, Homo Sapiens
REPTKRLGV

SEQ ID NO: 92151 - protein, 9 aa, Homo Sapiens
REQDRDVQL

SEQ ID NO: 92152 - protein, 9 aa, Homo Sapiens
REQEHTFVF

SEQ ID NO: 92153 - protein, 9 aa, Homo Sapiens
REQEIPFVF

SEQ ID NO: 92154 - protein, 9 aa, Homo Sapiens
REQERAYIV

SEQ ID NO: 92155 - protein, 9 aa, Homo Sapiens
REQERDIAL

SEQ ID NO: 92156 - protein, 9 aa, Homo Sapiens
REQLRADLL

SEQ ID NO: 92157 - protein, 9 aa, Homo Sapiens
REQPKLAGF

SEQ ID NO: 92158 - protein, 9 aa, Homo Sapiens
REQVRFNGF

SEQ ID NO: 92159 - protein, 9 aa, Homo Sapiens
RERIIPRSV

SEQ ID NO: 92160 - protein, 9 aa, Homo Sapiens
RESELIYVF

SEQ ID NO: 92161 - protein, 9 aa, Homo Sapiens
RESERQLRL

SEQ ID NO: 92162 - protein, 9 aa, Homo Sapiens
RESHTHVSV

SEQ ID NO: 92163 - protein, 9 aa, Homo Sapiens
RESIHILSV

SEQ ID NO: 92164 - protein, 9 aa, Homo Sapiens
RESLGHTRL

SEQ ID NO: 92165 - protein, 9 aa, Homo Sapiens
RESLPPEQF

SEQ ID NO: 92166 - protein, 9 aa, Homo Sapiens
RESPCHVKL

SEQ ID NO: 92167 - protein, 9 aa, Homo Sapiens
RESPPIRAF

SEQ ID NO: 92168 - protein, 9 aa, Homo Sapiens
RESPRPLQL

SEQ ID NO: 92169 - protein, 9 aa, Homo Sapiens
RESPSVKRM

SEQ ID NO: 92170 - protein, 9 aa, Homo Sapiens
RESPTMTEF

SEQ ID NO: 92171 - protein, 9 aa, Homo Sapiens
RESPVQHLV

SEQ ID NO: 92172 - protein, 9 aa, Homo Sapiens
RESQRLVGF

SEQ ID NO: 92173 - protein, 9 aa, Homo Sapiens
RESSGKYTF

SEQ ID NO: 92174 - protein, 9 aa, Homo Sapiens
RETERIYSL

SEQ ID NO: 92175 - protein, 9 aa, Homo Sapiens
REVLHKFTV

SEQ ID NO: 92176 - protein, 9 aa, Homo Sapiens
REVQREYNL

SEQ ID NO: 92177 - protein, 9 aa, Homo Sapiens
REYLRVNVV

SEQ ID NO: 92178 - protein, 9 aa, Homo Sapiens
RNVSTGDVN

SEQ ID NO: 92179 - protein, 9 aa, Homo Sapiens
RPSEPKPFS

SEQ ID NO: 92180 - protein, 9 aa, Homo Sapiens
RQAPPHIEL

SEQ ID NO: 92181 - protein, 9 aa, Homo Sapiens
RQDARSVHL

SEQ ID NO: 92182 - protein, 9 aa, Homo Sapiens
RQDQRVEQL

SEQ ID NO: 92183 - protein, 9 aa, Homo Sapiens
RQPKHLLAF

SEQ ID NO: 92184 - protein, 9 aa, Homo Sapiens
RQPPPRPFL

SEQ ID NO: 92185 - protein, 9 aa, Homo Sapiens
RSDEAVKPF

SEQ ID NO: 92186 - protein, 9 aa, Homo Sapiens
RSDELTRHF

SEQ ID NO: 92187 - protein, 9 aa, Homo Sapiens
RSDPGHYSF

SEQ ID NO: 92188 - protein, 9 aa, Homo Sapiens
RSNPKIWNV

SEQ ID NO: 92189 - protein, 9 aa, Homo Sapiens
RSPPPGMGL

SEQ ID NO: 92190 - protein, 9 aa, Homo Sapiens
RVHEAVKAI

SEQ ID NO: 92191 - protein, 9 aa, Homo Sapiens
SDAERALAV

SEQ ID NO: 92192 - protein, 9 aa, Homo Sapiens
SDAPAHHLF

SEQ ID NO: 92193 - protein, 9 aa, Homo Sapiens
SDDPRYNQM

SEQ ID NO: 92194 - protein, 9 aa, Homo Sapiens
SDFEHTIHV

SEQ ID NO: 92195 - protein, 9 aa, Homo Sapiens
SDFIRILVI

SEQ ID NO: 92196 - protein, 9 aa, Homo Sapiens
SDFIRVQLI

SEQ ID NO: 92197 - protein, 9 aa, Homo Sapiens
SDFNRQDRF

SEQ ID NO: 92198 - protein, 9 aa, Homo Sapiens
SDGLRLIAL

SEQ ID NO: 92199 - protein, 9 aa, Homo Sapiens
SDGTRPVGM

SEQ ID NO: 92200 - protein, 9 aa, Homo Sapiens
SDHIHIIAL

SEQ ID NO: 92201 - protein, 9 aa, Homo Sapiens
SDIVRVCFF

SEQ ID NO: 92202 - protein, 9 aa, Homo Sapiens
SDKAHILSM

SEQ ID NO: 92203 - protein, 9 aa, Homo Sapiens
SDKVRVITL

SEQ ID NO: 92204 - protein, 9 aa, Homo Sapiens
SDLARLILL

SEQ ID NO: 92205 - protein, 9 aa, Homo Sapiens
SDLERVTSL

SEQ ID NO: 92206 - protein, 9 aa, Homo Sapiens
SDLFHLIGV

SEQ ID NO: 92207 - protein, 9 aa, Homo Sapiens
SDLGKVFSF

SEQ ID NO: 92208 - protein, 9 aa, Homo Sapiens
SDLIHGEVL

SEQ ID NO: 92209 - protein, 9 aa, Homo Sapiens
SDLIRHEGI

SEQ ID NO: 92210 - protein, 9 aa, Homo Sapiens
SDLIRHEKT

SEQ ID NO: 92211 - protein, 9 aa, Homo Sapiens
SDLIRHHRI

SEQ ID NO: 92212 - protein, 9 aa, Homo Sapiens
SDLIRHQGI

SEQ ID NO: 92213 - protein, 9 aa, Homo Sapiens
SDLIRMAFM

SEQ ID NO: 92214 - protein, 9 aa, Homo Sapiens
SDLKRGLKI

SEQ ID NO: 92215 - protein, 9 aa, Homo Sapiens
SDLKRHMRV

SEQ ID NO: 92216 - protein, 9 aa, Homo Sapiens
SDLKRINGF

SEQ ID NO: 92217 - protein, 9 aa, Homo Sapiens
SDLLRLTKI

SEQ ID NO: 92218 - protein, 9 aa, Homo Sapiens
SDLMRMEKI

SEQ ID NO: 92219 - protein, 9 aa, Homo Sapiens
SDLNHSFSL

SEQ ID NO: 92220 - protein, 9 aa, Homo Sapiens
SDLPRTDGL

SEQ ID NO: 92221 - protein, 9 aa, Homo Sapiens
SDLPRTFEF

SEQ ID NO: 92222 - protein, 9 aa, Homo Sapiens
SDLQRTQLL

SEQ ID NO: 92223 - protein, 9 aa, Homo Sapiens
SDLQRVYSI

SEQ ID NO: 92224 - protein, 9 aa, Homo Sapiens
SDLRHLRAV

SEQ ID NO: 92225 - protein, 9 aa, Homo Sapiens
SDLRHRHGF

SEQ ID NO: 92226 - protein, 9 aa, Homo Sapiens
SDLSHFHVV

SEQ ID NO: 92227 - protein, 9 aa, Homo Sapiens
SDLSRASSV

SEQ ID NO: 92228 - protein, 9 aa, Homo Sapiens
SDLTHLAAL

SEQ ID NO: 92229 - protein, 9 aa, Homo Sapiens
SDLTRHHRI

SEQ ID NO: 92230 - protein, 9 aa, Homo Sapiens
SDLTRHQRI

SEQ ID NO: 92231 - protein, 9 aa, Homo Sapiens
SDLVIRAKF

SEQ ID NO: 92232 - protein, 9 aa, Homo Sapiens
SDLVRCLSV

SEQ ID NO: 92233 - protein, 9 aa, Homo Sapiens
SDLVRCREV

SEQ ID NO: 92234 - protein, 9 aa, Homo Sapiens
SDLVRHQGV

SEQ ID NO: 92235 - protein, 9 aa, Homo Sapiens
SDLYRHQRL

SEQ ID NO: 92236 - protein, 9 aa, Homo Sapiens
SDLYRVHFL

SEQ ID NO: 92237 - protein, 9 aa, Homo Sapiens
SDMPRAHSF

SEQ ID NO: 92238 - protein, 9 aa, Homo Sapiens
SDMVHRFLL

SEQ ID NO: 92239 - protein, 9 aa, Homo Sapiens
SDMVRFHLF

SEQ ID NO: 92240 - protein, 9 aa, Homo Sapiens
SDNIRIETV

SEQ ID NO: 92241 - protein, 9 aa, Homo Sapiens
SDNPRFSDL

SEQ ID NO: 92242 - protein, 9 aa, Homo Sapiens
SDQIRSAVL

SEQ ID NO: 92243 - protein, 9 aa, Homo Sapiens
SDQLKKHGF

SEQ ID NO: 92244 - protein, 9 aa, Homo Sapiens
SDQQRSYEI

SEQ ID NO: 92245 - protein, 9 aa, Homo Sapiens
SDQVKFNVF

SEQ ID NO: 92246 - protein, 9 aa, Homo Sapiens
SDSARVAAM

SEQ ID NO: 92247 - protein, 9 aa, Homo Sapiens
SDSCREVTV

SEQ ID NO: 92248 - protein, 9 aa, Homo Sapiens
SDSIHTVAM

SEQ ID NO: 92249 - protein, 9 aa, Homo Sapiens
SDSMRTASL

SEQ ID NO: 92250 - protein, 9 aa, Homo Sapiens
SDSPHAVTV

SEQ ID NO: 92251 - protein, 9 aa, Homo Sapiens
SDSTHLVTL

SEQ ID NO: 92252 - protein, 9 aa, Homo Sapiens
SDVAHVESL

SEQ ID NO: 92253 - protein, 9 aa, Homo Sapiens
SDYELKYCF

SEQ ID NO: 92254 - protein, 9 aa, Homo Sapiens
SDYGRPLSF

SEQ ID NO: 92255 - protein, 9 aa, Homo Sapiens
SDYIRCIAV

SEQ ID NO: 92256 - protein, 9 aa, Homo Sapiens
SDYIRLLAI

SEQ ID NO: 92257 - protein, 9 aa, Homo Sapiens
SEAARVLQF

SEQ ID NO: 92258 - protein, 9 aa, Homo Sapiens
SEACRELGF

SEQ ID NO: 92259 - protein, 9 aa, Homo Sapiens
SEAERVSEL

SEQ ID NO: 92260 - protein, 9 aa, Homo Sapiens
SEALHVLAF

SEQ ID NO: 92261 - protein, 9 aa, Homo Sapiens
SEAPARQGF

SEQ ID NO: 92262 - protein, 9 aa, Homo Sapiens
SEAQRITGL

SEQ ID NO: 92263 - protein, 9 aa, Homo Sapiens
SECHPHYSF

SEQ ID NO: 92264 - protein, 9 aa, Homo Sapiens
SEDPSHPSM

SEQ ID NO: 92265 - protein, 9 aa, Homo Sapiens
SEEERQVGL

SEQ ID NO: 92266 - protein, 9 aa, Homo Sapiens
SEFQRLLGF

SEQ ID NO: 92267 - protein, 9 aa, Homo Sapiens
SEGDAHAGF

SEQ ID NO: 92268 - protein, 9 aa, Homo Sapiens
SEGPPLTSF

SEQ ID NO: 92269 - protein, 9 aa, Homo Sapiens
SEGTPVNKL

SEQ ID NO: 92270 - protein, 9 aa, Homo Sapiens
SEHERQYLL

SEQ ID NO: 92271 - protein, 9 aa, Homo Sapiens
SEKKRWLGL

SEQ ID NO: 92272 - protein, 9 aa, Homo Sapiens
SELIRHQKI

SEQ ID NO: 92273 - protein, 9 aa, Homo Sapiens
SELIRHQTI

SEQ ID NO: 92274 - protein, 9 aa, Homo Sapiens
SELIRNVTL

SEQ ID NO: 92275 - protein, 9 aa, Homo Sapiens
SELKHWATF

SEQ ID NO: 92276 - protein, 9 aa, Homo Sapiens
SELKRLFNL

SEQ ID NO: 92277 - protein, 9 aa, Homo Sapiens
SELLKNMGF

SEQ ID NO: 92278 - protein, 9 aa, Homo Sapiens
SELPHCLEV

SEQ ID NO: 92279 - protein, 9 aa, Homo Sapiens
SELVRHSSF

SEQ ID NO: 92280 - protein, 9 aa, Homo Sapiens
SEMQRHYVM

SEQ ID NO: 92281 - protein, 9 aa, Homo Sapiens
SENMKASSF

SEQ ID NO: 92282 - protein, 9 aa, Homo Sapiens
SEPLHNVQV

SEQ ID NO: 92283 - protein, 9 aa, Homo Sapiens
SEQKRVQFL

SEQ ID NO: 92284 - protein, 9 aa, Homo Sapiens
SEQLRCLEL

SEQ ID NO: 92285 - protein, 9 aa, Homo Sapiens
SEQLRVFVL

SEQ ID NO: 92286 - protein, 9 aa, Homo Sapiens
SEQVRKHYL

SEQ ID NO: 92287 - protein, 9 aa, Homo Sapiens
SESFPHPGF

SEQ ID NO: 92288 - protein, 9 aa, Homo Sapiens
SESLPKEAF

SEQ ID NO: 92289 - protein, 9 aa, Homo Sapiens
SESLRLHSL

SEQ ID NO: 92290 - protein, 9 aa, Homo Sapiens
SEYARPHVM

SEQ ID NO: 92291 - protein, 9 aa, Homo Sapiens
SEYQRFAVM

SEQ ID NO: 92292 - protein, 9 aa, Homo Sapiens
SGPLHSVSL

SEQ ID NO: 92293 - protein, 9 aa, Homo Sapiens
SSPAPRTAL

SEQ ID NO: 92294 - protein, 9 aa, Homo Sapiens
SSPARPCSF

SEQ ID NO: 92295 - protein, 9 aa, Homo Sapiens
SSPPPHPQL

SEQ ID NO: 92296 - protein, 9 aa, Homo Sapiens
TDAKRLHGL

SEQ ID NO: 92297 - protein, 9 aa, Homo Sapiens
TDAPHFYGL

SEQ ID NO: 92298 - protein, 9 aa, Homo Sapiens
TDFIKIEEF

SEQ ID NO: 92299 - protein, 9 aa, Homo Sapiens
TDFISHLFM

SEQ ID NO: 92300 - protein, 9 aa, Homo Sapiens
TDGPPPVQF

SEQ ID NO: 92301 - protein, 9 aa, Homo Sapiens
TDIARTEYL

SEQ ID NO: 92302 - protein, 9 aa, Homo Sapiens
TDLAKRTVF

SEQ ID NO: 92303 - protein, 9 aa, Homo Sapiens
TDLEQVHQF

SEQ ID NO: 92304 - protein, 9 aa, Homo Sapiens
TDLERKGLL

SEQ ID NO: 92305 - protein, 9 aa, Homo Sapiens
TDLIRHQTV

SEQ ID NO: 92306 - protein, 9 aa, Homo Sapiens
TDLNRKDKF

SEQ ID NO: 92307 - protein, 9 aa, Homo Sapiens
TDLSRNAQL

SEQ ID NO: 92308 - protein, 9 aa, Homo Sapiens
TDLTRKEGL

SEQ ID NO: 92309 - protein, 9 aa, Homo Sapiens
TDMNRLHRF

SEQ ID NO: 92310 - protein, 9 aa, Homo Sapiens
TDMVRSSTI

SEQ ID NO: 92311 - protein, 9 aa, Homo Sapiens
TDNPRLLSM

SEQ ID NO: 92312 - protein, 9 aa, Homo Sapiens
TDNQRILEF

SEQ ID NO: 92313 - protein, 9 aa, Homo Sapiens
TDNQRQQQL

SEQ ID NO: 92314 - protein, 9 aa, Homo Sapiens
TDSPREVFF

SEQ ID NO: 92315 - protein, 9 aa, Homo Sapiens
TDSVHNINF

SEQ ID NO: 92316 - protein, 9 aa, Homo Sapiens
TEAMRVIGF

SEQ ID NO: 92317 - protein, 9 aa, Homo Sapiens
TEDTRQLGL

SEQ ID NO: 92318 - protein, 9 aa, Homo Sapiens
TEGAAKIAF

SEQ ID NO: 92319 - protein, 9 aa, Homo Sapiens
TEHAHQVVV

SEQ ID NO: 92320 - protein, 9 aa, Homo Sapiens
TEHKRFLAF

SEQ ID NO: 92321 - protein, 9 aa, Homo Sapiens
TEKIHQTGL

SEQ ID NO: 92322 - protein, 9 aa, Homo Sapiens
TELERKLTF

SEQ ID NO: 92323 - protein, 9 aa, Homo Sapiens
TELGRAAKL

SEQ ID NO: 92324 - protein, 9 aa, Homo Sapiens
TELIHIALL

SEQ ID NO: 92325 - protein, 9 aa, Homo Sapiens
TELLRYYML

SEQ ID NO: 92326 - protein, 9 aa, Homo Sapiens
TELTRNKKF

SEQ ID NO: 92327 - protein, 9 aa, Homo Sapiens
TEMERTLAL

SEQ ID NO: 92328 - protein, 9 aa, Homo Sapiens
TEMLRAALL

SEQ ID NO: 92329 - protein, 9 aa, Homo Sapiens
TEMQRHYVM

SEQ ID NO: 92330 - protein, 9 aa, Homo Sapiens
TEPPAHFQV

SEQ ID NO: 92331 - protein, 9 aa, Homo Sapiens
TEPPPKAAL

SEQ ID NO: 92332 - protein, 9 aa, Homo Sapiens
TEQERGVGI

SEQ ID NO: 92333 - protein, 9 aa, Homo Sapiens
TEQKRLGLL

SEQ ID NO: 92334 - protein, 9 aa, Homo Sapiens
TETARIAQL

SEQ ID NO: 92335 - protein, 9 aa, Homo Sapiens
TEWIRAIQM

SEQ ID NO: 92336 - protein, 9 aa, Homo Sapiens
TSPDPHKGL

SEQ ID NO: 92337 - protein, 9 aa, Homo Sapiens
VDFVRPDFL

SEQ ID NO: 92338 - protein, 9 aa, Homo Sapiens
VDHEKIYRM

SEQ ID NO: 92339 - protein, 9 aa, Homo Sapiens
VDHEKPLSF

SEQ ID NO: 92340 - protein, 9 aa, Homo Sapiens
VDHERLKNL

SEQ ID NO: 92341 - protein, 9 aa, Homo Sapiens
VDLERKETA

SEQ ID NO: 92342 - protein, 9 aa, Homo Sapiens
VDLERTIAL

SEQ ID NO: 92343 - protein, 9 aa, Homo Sapiens
VDLIHDIQI

SEQ ID NO: 92344 - protein, 9 aa, Homo Sapiens
VDLIRGSTF

SEQ ID NO: 92345 - protein, 9 aa, Homo Sapiens
VDLPHCHLI

SEQ ID NO: 92346 - protein, 9 aa, Homo Sapiens
VDLTRSFSF

SEQ ID NO: 92347 - protein, 9 aa, Homo Sapiens
VDMVRVMEV

SEQ ID NO: 92348 - protein, 9 aa, Homo Sapiens
VDNIRVCKI

SEQ ID NO: 92349 - protein, 9 aa, Homo Sapiens
VDNLHVLDF

SEQ ID NO: 92350 - protein, 9 aa, Homo Sapiens
VDNQRGSGL

SEQ ID NO: 92351 - protein, 9 aa, Homo Sapiens
VDSARNLQL

SEQ ID NO: 92352 - protein, 9 aa, Homo Sapiens
VDSLKLAVF

SEQ ID NO: 92353 - protein, 9 aa, Homo Sapiens
VDSLLHGTF

SEQ ID NO: 92354 - protein, 9 aa, Homo Sapiens
VDVVRNLVF

SEQ ID NO: 92355 - protein, 9 aa, Homo Sapiens
VDWLRYASL

SEQ ID NO: 92356 - protein, 9 aa, Homo Sapiens
VEDGIGHEF

SEQ ID NO: 92357 - protein, 9 aa, Homo Sapiens
VEGHPVWAL

SEQ ID NO: 92358 - protein, 9 aa, Homo Sapiens
VEILPCSRI

SEQ ID NO: 92359 - protein, 9 aa, Homo Sapiens
VELERFVNL

SEQ ID NO: 92360 - protein, 9 aa, Homo Sapiens
VELFRTAYF

SEQ ID NO: 92361 - protein, 9 aa, Homo Sapiens
VELIHFERV

SEQ ID NO: 92362 - protein, 9 aa, Homo Sapiens
VELPHINLL

SEQ ID NO: 92363 - protein, 9 aa, Homo Sapiens
VENTRWDYL

SEQ ID NO: 92364 - protein, 9 aa, Homo Sapiens
VEQLRPERL

SEQ ID NO: 92365 - protein, 9 aa, Homo Sapiens
VEVGRVAYV

SEQ ID NO: 92366 - protein, 9 aa, Homo Sapiens
VSHPRYLEL

SEQ ID NO: 92367 - protein, 9 aa, Homo Sapiens
WESERVLSF

SEQ ID NO: 92368 - protein, 9 aa, Homo Sapiens
YDFLKQNKF

SEQ ID NO: 92369 - protein, 9 aa, Homo Sapiens
YDHKRISKL

SEQ ID NO: 92370 - protein, 9 aa, Homo Sapiens
YDLERIKLL

SEQ ID NO: 92371 - protein, 9 aa, Homo Sapiens
YDLGRSYAM

SEQ ID NO: 92372 - protein, 9 aa, Homo Sapiens
YDLLRHERL

SEQ ID NO: 92373 - protein, 9 aa, Homo Sapiens
YDLLRNTNF

SEQ ID NO: 92374 - protein, 9 aa, Homo Sapiens
YDYLRPIAL

SEQ ID NO: 92375 - protein, 9 aa, Homo Sapiens
YEEARSAYL

SEQ ID NO: 92376 - protein, 9 aa, Homo Sapiens
YELARVKEI

SEQ ID NO: 92377 - protein, 9 aa, Homo Sapiens
YELERVAGF

SEQ ID NO: 92378 - protein, 9 aa, Homo Sapiens
YEPPLTNVF

SEQ ID NO: 92379 - protein, 9 aa, Homo Sapiens
YEPPRYMSV

SEQ ID NO: 92380 - protein, 9 aa, Homo Sapiens
YEPPVQESV

SEQ ID NO: 92381 - protein, 9 aa, Homo Sapiens
YEVERCQQL

SEQ ID NO: 92382 - protein, 9 aa, Homo Sapiens
YEVERTERI

SEQ ID NO: 92383 - protein, 9 aa, Homo Sapiens
YSDDIPHAL

SEQ ID NO: 92384 - protein, 9 aa, Homo Sapiens
YSDLRKESM

SEQ ID NO: 92385 - protein, 9 aa, Homo Sapiens
YSSLRVVGV

SEQ ID NO: 92386 - protein, 10 aa, Homo Sapiens
AAGPPISEGK

SEQ ID NO: 92387 - protein, 10 aa, Homo Sapiens
ADNPGPMVVF

SEQ ID NO: 92388 - protein, 10 aa, Homo Sapiens
AEEVARLWGI

SEQ ID NO: 92389 - protein, 10 aa, Homo Sapiens
AELKGRSEAL

SEQ ID NO: 92390 - protein, 10 aa, Homo Sapiens
AEMDARTILL

SEQ ID NO: 92391 - protein, 10 aa, Homo Sapiens
AENPGKYNIL

SEQ ID NO: 92392 - protein, 10 aa, Homo Sapiens
AEQERQHNYL

SEQ ID NO: 92393 - protein, 10 aa, Homo Sapiens
AEQLPRLQAF

SEQ ID NO: 92394 - protein, 10 aa, Homo Sapiens
ETQITQIEHE

SEQ ID NO: 92395 - protein, 10 aa, Homo Sapiens
HEPEPHILLF

SEQ ID NO: 92396 - protein, 10 aa, Homo Sapiens
HEPPSRPCGL

SEQ ID NO: 92397 - protein, 10 aa, Homo Sapiens
IHIVFTAHVF

SEQ ID NO: 92398 - protein, 10 aa, Homo Sapiens
KEDKPRKSLF

SEQ ID NO: 92399 - protein, 10 aa, Homo Sapiens
KEGIGRVIGM

SEQ ID NO: 92400 - protein, 10 aa, Homo Sapiens
KEHDPRVITV

SEQ ID NO: 92401 - protein, 10 aa, Homo Sapiens
KQQNPRLVYV

SEQ ID NO: 92402 - protein, 10 aa, Homo Sapiens
MDSVRSGPFG

SEQ ID NO: 92403 - protein, 10 aa, Homo Sapiens
QSELVRHSSF

SEQ ID NO: 92404 - protein, 10 aa, Homo Sapiens
RDFEREYGKL

SEQ ID NO: 92405 - protein, 10 aa, Homo Sapiens
RDLERALYLL

SEQ ID NO: 92406 - protein, 10 aa, Homo Sapiens
RDLERGCHLL

SEQ ID NO: 92407 - protein, 10 aa, Homo Sapiens
RDMIREVCGF

SEQ ID NO: 92408 - protein, 10 aa, Homo Sapiens
RDVQATRVGL

SEQ ID NO: 92409 - protein, 10 aa, Homo Sapiens
REEAARTQQL

SEQ ID NO: 92410 - protein, 10 aa, Homo Sapiens
REQAEEERYF

SEQ ID NO: 92411 - protein, 10 aa, Homo Sapiens
REQEIRMGQM

SEQ ID NO: 92412 - protein, 10 aa, Homo Sapiens
REYELRKNNF

SEQ ID NO: 92413 - protein, 10 aa, Homo Sapiens
RQGVDADING

SEQ ID NO: 92414 - protein, 10 aa, Homo Sapiens
SDILYVISKT

SEQ ID NO: 92415 - protein, 10 aa, Homo Sapiens
SDLLHGAPGF

SEQ ID NO: 92416 - protein, 10 aa, Homo Sapiens
SEAGSQPHGI

SEQ ID NO: 92417 - protein, 10 aa, Homo Sapiens
SEDGFIKELF

SEQ ID NO: 92418 - protein, 10 aa, Homo Sapiens
SEDGITKIMF

SEQ ID NO: 92419 - protein, 10 aa, Homo Sapiens
SEGFPRRAVM

SEQ ID NO: 92420 - protein, 10 aa, Homo Sapiens
SEKGSLKIEF

SEQ ID NO: 92421 - protein, 10 aa, Homo Sapiens
SMDNNRSLDL

SEQ ID NO: 92422 - protein, 10 aa, Homo Sapiens
SSDLKRINGF

SEQ ID NO: 92423 - protein, 10 aa, Homo Sapiens
SYGGGSGGGF

SEQ ID NO: 92424 - protein, 10 aa, Homo Sapiens
TDAEKGKGLI

SEQ ID NO: 92425 - protein, 10 aa, Homo Sapiens
TDGPNERIGM

SEQ ID NO: 92426 - protein, 10 aa, Homo Sapiens
TEKDSYVVAF

SEQ ID NO: 92427 - protein, 10 aa, Homo Sapiens
VDLWSIGVTL

SEQ ID NO: 92428 - protein, 10 aa, Homo Sapiens
VDREVVSLFL

SEQ ID NO: 92429 - protein, 10 aa, Homo Sapiens
VESPAKIHVF

SEQ ID NO: 92430 - protein, 10 aa, Homo Sapiens
VVHGSPREGF

SEQ ID NO: 92431 - protein, 10 aa, Homo Sapiens
YSPPERTESF

SEQ ID NO: 92432 - protein, 11 aa, Homo Sapiens
ADKGTCKYVSL

SEQ ID NO: 92433 - protein, 11 aa, Homo Sapiens
AEQCRKISASL

SEQ ID NO: 92434 - protein, 11 aa, Homo Sapiens
AEQLREKAGQL

SEQ ID NO: 92435 - protein, 11 aa, Homo Sapiens
DSLDHVTSDAV

SEQ ID NO: 92436 - protein, 11 aa, Homo Sapiens
GAGSDTLVRYF

SEQ ID NO: 92437 - protein, 11 aa, Homo Sapiens
GLGSGGSIRSS

SEQ ID NO: 92438 - protein, 11 aa, Homo Sapiens
IAKNRKDIENQ

SEQ ID NO: 92439 - protein, 11 aa, Homo Sapiens
KDMVHKELHRF

SEQ ID NO: 92440 - protein, 11 aa, Homo Sapiens
KEQNRAKPVHL

SEQ ID NO: 92441 - protein, 11 aa, Homo Sapiens
KQDAFANFANF

SEQ ID NO: 92442 - protein, 11 aa, Homo Sapiens
LALIYNEALKG

SEQ ID NO: 92443 - protein, 11 aa, Homo Sapiens
PAVPQLLHMPD

SEQ ID NO: 92444 - protein, 11 aa, Homo Sapiens
RDLKRTVDARL

SEQ ID NO: 92445 - protein, 11 aa, Homo Sapiens
REHERLLKHKL

SEQ ID NO: 92446 - protein, 11 aa, Homo Sapiens
RQGVDADINGL

SEQ ID NO: 92447 - protein, 11 aa, Homo Sapiens
RSSDLKRINGF

SEQ ID NO: 92448 - protein, 11 aa, Homo Sapiens
SDYRRLSESQL

SEQ ID NO: 92449 - protein, 11 aa, Homo Sapiens
TEKGNERNVKF

SEQ ID NO: 92450 - protein, 11 aa, Homo Sapiens
VGGSDHSSHPF

SEQ ID NO: 92451 - protein, 11 aa, Homo Sapiens
VTIKKDVDGAY

SEQ ID NO: 92452 - protein, 11 aa, Homo Sapiens
YQAELSQMQTQ

SEQ ID NO: 92453 - protein, 8 aa, Homo Sapiens
AHGPEWNL

SEQ ID NO: 92454 - protein, 8 aa, Homo Sapiens
DHCVAHKL

SEQ ID NO: 92455 - protein, 8 aa, Homo Sapiens
EHGPNPIL

SEQ ID NO: 92456 - protein, 8 aa, Homo Sapiens
FHAIDHRL

SEQ ID NO: 92457 - protein, 8 aa, Homo Sapiens
FHDIERKF

SEQ ID NO: 92458 - protein, 8 aa, Homo Sapiens
FHSEEQQL

SEQ ID NO: 92459 - protein, 8 aa, Homo Sapiens
HCALILNL

SEQ ID NO: 92460 - protein, 8 aa, Homo Sapiens
HDGLTVHL

SEQ ID NO: 92461 - protein, 8 aa, Homo Sapiens
HDGQRIYI

SEQ ID NO: 92462 - protein, 8 aa, Homo Sapiens
HDRNVVTI

SEQ ID NO: 92463 - protein, 8 aa, Homo Sapiens
HDSIDYRF

SEQ ID NO: 92464 - protein, 8 aa, Homo Sapiens
HDTTEYKL

SEQ ID NO: 92465 - protein, 8 aa, Homo Sapiens
HDTVFQYL

SEQ ID NO: 92466 - protein, 8 aa, Homo Sapiens
HFEELETI

SEQ ID NO: 92467 - protein, 8 aa, Homo Sapiens
HFLELVTL

SEQ ID NO: 92468 - protein, 8 aa, Homo Sapiens
HHFQEFSF

SEQ ID NO: 92469 - protein, 8 aa, Homo Sapiens
HIGDAVVI

SEQ ID NO: 92470 - protein, 8 aa, Homo Sapiens
HIITGNKI

SEQ ID NO: 92471 - protein, 8 aa, Homo Sapiens
HTVAGNDI

SEQ ID NO: 92472 - protein, 8 aa, Homo Sapiens
IDHDQVLV

SEQ ID NO: 92473 - protein, 8 aa, Homo Sapiens
IHNADVTL

SEQ ID NO: 92474 - protein, 8 aa, Homo Sapiens
IHSLEVLI

SEQ ID NO: 92475 - protein, 8 aa, Homo Sapiens
LEQQNQVL

SEQ ID NO: 92476 - protein, 8 aa, Homo Sapiens
LPWWLILI

SEQ ID NO: 92477 - protein, 8 aa, Homo Sapiens
LWMESHLI

SEQ ID NO: 92478 - protein, 8 aa, Homo Sapiens
NHDKEIFF

SEQ ID NO: 92479 - protein, 8 aa, Homo Sapiens
NHHTDTFL

SEQ ID NO: 92480 - protein, 8 aa, Homo Sapiens
NHSSDFLL

SEQ ID NO: 92481 - protein, 8 aa, Homo Sapiens
QHAEEFLI

SEQ ID NO: 92482 - protein, 8 aa, Homo Sapiens
RLQEGDKI

SEQ ID NO: 92483 - protein, 8 aa, Homo Sapiens
TVGNNKTL

SEQ ID NO: 92484 - protein, 8 aa, Homo Sapiens
VHGPDWHL

SEQ ID NO: 92485 - protein, 8 aa, Homo Sapiens
VHGPDWNL

SEQ ID NO: 92486 - protein, 8 aa, Homo Sapiens
WHSEDVSL

SEQ ID NO: 92487 - protein, 8 aa, Homo Sapiens
YEDIAQKS

SEQ ID NO: 92488 - protein, 8 aa, Homo Sapiens
YHDLEQSI

SEQ ID NO: 92489 - protein, 8 aa, Homo Sapiens
YHDNAQLI

SEQ ID NO: 92490 - protein, 8 aa, Homo Sapiens
YHLENAGC

SEQ ID NO: 92491 - protein, 8 aa, Homo Sapiens
YHQKSVLI

SEQ ID NO: 92492 - protein, 9 aa, Homo Sapiens
AHAEEKLQL

SEQ ID NO: 92493 - protein, 9 aa, Homo Sapiens
AHAKEDPLL

SEQ ID NO: 92494 - protein, 9 aa, Homo Sapiens
AHAQPQTTM

SEQ ID NO: 92495 - protein, 9 aa, Homo Sapiens
AHARVQTCI

SEQ ID NO: 92496 - protein, 9 aa, Homo Sapiens
AHCGAGDEL

SEQ ID NO: 92497 - protein, 9 aa, Homo Sapiens
AHCPELVTL

SEQ ID NO: 92498 - protein, 9 aa, Homo Sapiens
AHCPHTPEF

SEQ ID NO: 92499 - protein, 9 aa, Homo Sapiens
AHCPKAEVL

SEQ ID NO: 92500 - protein, 9 aa, Homo Sapiens
AHCQLVHHF

SEQ ID NO: 92501 - protein, 9 aa, Homo Sapiens
AHCWVVVRL

SEQ ID NO: 92502 - protein, 9 aa, Homo Sapiens
AHDAGITIF

SEQ ID NO: 92503 - protein, 9 aa, Homo Sapiens
AHDDAIWSV

SEQ ID NO: 92504 - protein, 9 aa, Homo Sapiens
AHDDGRWSL

SEQ ID NO: 92505 - protein, 9 aa, Homo Sapiens
AHDDSVMYL

SEQ ID NO: 92506 - protein, 9 aa, Homo Sapiens
AHDEYLQLL

SEQ ID NO: 92507 - protein, 9 aa, Homo Sapiens
AHDFHRIYI

SEQ ID NO: 92508 - protein, 9 aa, Homo Sapiens
AHDFLAFIL

SEQ ID NO: 92509 - protein, 9 aa, Homo Sapiens
AHDGAGLKL

SEQ ID NO: 92510 - protein, 9 aa, Homo Sapiens
AHDGDVNVI

SEQ ID NO: 92511 - protein, 9 aa, Homo Sapiens
AHDGIILKV

SEQ ID NO: 92512 - protein, 9 aa, Homo Sapiens
AHDGQRIYI

SEQ ID NO: 92513 - protein, 9 aa, Homo Sapiens
AHDGSATYL

SEQ ID NO: 92514 - protein, 9 aa, Homo Sapiens
AHDKEVYDI

SEQ ID NO: 92515 - protein, 9 aa, Homo Sapiens
AHDKPRYTL

SEQ ID NO: 92516 - protein, 9 aa, Homo Sapiens
AHDNPVCTL

SEQ ID NO: 92517 - protein, 9 aa, Homo Sapiens
AHDPISPVL

SEQ ID NO: 92518 - protein, 9 aa, Homo Sapiens
AHDQAVRTL

SEQ ID NO: 92519 - protein, 9 aa, Homo Sapiens
AHDQFKSTL

SEQ ID NO: 92520 - protein, 9 aa, Homo Sapiens
AHDQLLWAI

SEQ ID NO: 92521 - protein, 9 aa, Homo Sapiens
AHDSSEYAI

SEQ ID NO: 92522 - protein, 9 aa, Homo Sapiens
AHDTKSVKL

SEQ ID NO: 92523 - protein, 9 aa, Homo Sapiens
AHDTTLVAL

SEQ ID NO: 92524 - protein, 9 aa, Homo Sapiens
AHDVDPIEL

SEQ ID NO: 92525 - protein, 9 aa, Homo Sapiens
AHEDAVYGL

SEQ ID NO: 92526 - protein, 9 aa, Homo Sapiens
AHEDKVWGL

SEQ ID NO: 92527 - protein, 9 aa, Homo Sapiens
AHEEIGNIL

SEQ ID NO: 92528 - protein, 9 aa, Homo Sapiens
AHEEINITF

SEQ ID NO: 92529 - protein, 9 aa, Homo Sapiens
AHEFGAITF

SEQ ID NO: 92530 - protein, 9 aa, Homo Sapiens
AHEGLGFSI

SEQ ID NO: 92531 - protein, 9 aa, Homo Sapiens
AHFADPDTL

SEQ ID NO: 92532 - protein, 9 aa, Homo Sapiens
AHFAKSISL

SEQ ID NO: 92533 - protein, 9 aa, Homo Sapiens
AHFGFDEQL

SEQ ID NO: 92534 - protein, 9 aa, Homo Sapiens
AHFKEMESI

SEQ ID NO: 92535 - protein, 9 aa, Homo Sapiens
AHFPINVVI

SEQ ID NO: 92536 - protein, 9 aa, Homo Sapiens
AHFQKSYTL

SEQ ID NO: 92537 - protein, 9 aa, Homo Sapiens
AHFSYPFTF

SEQ ID NO: 92538 - protein, 9 aa, Homo Sapiens
AHHEVCPKF

SEQ ID NO: 92539 - protein, 9 aa, Homo Sapiens
AHHLELWRL

SEQ ID NO: 92540 - protein, 9 aa, Homo Sapiens
AHHNYLTRL

SEQ ID NO: 92541 - protein, 9 aa, Homo Sapiens
AHHPHQNLI

SEQ ID NO: 92542 - protein, 9 aa, Homo Sapiens
AHHTDCTFI

SEQ ID NO: 92543 - protein, 9 aa, Homo Sapiens
AHHTDHHMF

SEQ ID NO: 92544 - protein, 9 aa, Homo Sapiens
AHIGSFVSF

SEQ ID NO: 92545 - protein, 9 aa, Homo Sapiens
AHIIALESI

SEQ ID NO: 92546 - protein, 9 aa, Homo Sapiens
AHIKDAVAL

SEQ ID NO: 92547 - protein, 9 aa, Homo Sapiens
AHIKGVETI

SEQ ID NO: 92548 - protein, 9 aa, Homo Sapiens
AHISEQAVW

SEQ ID NO: 92549 - protein, 9 aa, Homo Sapiens
AHLALIDYL

SEQ ID NO: 92550 - protein, 9 aa, Homo Sapiens
AHLDATTVL

SEQ ID NO: 92551 - protein, 9 aa, Homo Sapiens
AHMDGTYKF

SEQ ID NO: 92552 - protein, 9 aa, Homo Sapiens
AHMDIFQNL

SEQ ID NO: 92553 - protein, 9 aa, Homo Sapiens
AHMWFDNQI

SEQ ID NO: 92554 - protein, 9 aa, Homo Sapiens
AHNDVMEVL

SEQ ID NO: 92555 - protein, 9 aa, Homo Sapiens
AHNKEIYTI

SEQ ID NO: 92556 - protein, 9 aa, Homo Sapiens
AHNLCYTTL

SEQ ID NO: 92557 - protein, 9 aa, Homo Sapiens
AHNPQQIYF

SEQ ID NO: 92558 - protein, 9 aa, Homo Sapiens
AHQAEIAQL

SEQ ID NO: 92559 - protein, 9 aa, Homo Sapiens
AHQFPEVRF

SEQ ID NO: 92560 - protein, 9 aa, Homo Sapiens
AHQIFEEFI

SEQ ID NO: 92561 - protein, 9 aa, Homo Sapiens
AHQQQQQLL

SEQ ID NO: 92562 - protein, 9 aa, Homo Sapiens
AHQVEQVLL

SEQ ID NO: 92563 - protein, 9 aa, Homo Sapiens
AHSDTLFTI

SEQ ID NO: 92564 - protein, 9 aa, Homo Sapiens
AHSDYIRCI

SEQ ID NO: 92565 - protein, 9 aa, Homo Sapiens
AHSEDLQSL

SEQ ID NO: 92566 - protein, 9 aa, Homo Sapiens
AHSELLCYF

SEQ ID NO: 92567 - protein, 9 aa, Homo Sapiens
AHSEQTLSL

SEQ ID NO: 92568 - protein, 9 aa, Homo Sapiens
AHSESINVI

SEQ ID NO: 92569 - protein, 9 aa, Homo Sapiens
AHSFVDLLL

SEQ ID NO: 92570 - protein, 9 aa, Homo Sapiens
AHSILIANI

SEQ ID NO: 92571 - protein, 9 aa, Homo Sapiens
AHSILQFQF

SEQ ID NO: 92572 - protein, 9 aa, Homo Sapiens
AHSKGVTCL

SEQ ID NO: 92573 - protein, 9 aa, Homo Sapiens
AHSNEILIF

SEQ ID NO: 92574 - protein, 9 aa, Homo Sapiens
AHSNLASVL

SEQ ID NO: 92575 - protein, 9 aa, Homo Sapiens
AHSPAGNQV

SEQ ID NO: 92576 - protein, 9 aa, Homo Sapiens
AHSPELLQF

SEQ ID NO: 92577 - protein, 9 aa, Homo Sapiens
AHSPLAAQL

SEQ ID NO: 92578 - protein, 9 aa, Homo Sapiens
AHSPSLQSL

SEQ ID NO: 92579 - protein, 9 aa, Homo Sapiens
AHSSLQIVL

SEQ ID NO: 92580 - protein, 9 aa, Homo Sapiens
AHSTIMPRL

SEQ ID NO: 92581 - protein, 9 aa, Homo Sapiens
AHSVPSPAF

SEQ ID NO: 92582 - protein, 9 aa, Homo Sapiens
AHSVVLGYL

SEQ ID NO: 92583 - protein, 9 aa, Homo Sapiens
AHTAEVNCL

SEQ ID NO: 92584 - protein, 9 aa, Homo Sapiens
AHTGVIFFL

SEQ ID NO: 92585 - protein, 9 aa, Homo Sapiens
AHTIPLVPL

SEQ ID NO: 92586 - protein, 9 aa, Homo Sapiens
AHTTVSTNI

SEQ ID NO: 92587 - protein, 9 aa, Homo Sapiens
AHVDEQVFL

SEQ ID NO: 92588 - protein, 9 aa, Homo Sapiens
AHVDFEAML

SEQ ID NO: 92589 - protein, 9 aa, Homo Sapiens
AHVDLIEKL

SEQ ID NO: 92590 - protein, 9 aa, Homo Sapiens
AHVFPSNTI

SEQ ID NO: 92591 - protein, 9 aa, Homo Sapiens
AHVGSGDLF

SEQ ID NO: 92592 - protein, 9 aa, Homo Sapiens
AHVVVGDVL

SEQ ID NO: 92593 - protein, 9 aa, Homo Sapiens
AHWQFETAL

SEQ ID NO: 92594 - protein, 9 aa, Homo Sapiens
AQGGVLPNI

SEQ ID NO: 92595 - protein, 9 aa, Homo Sapiens
AQHVEVESI

SEQ ID NO: 92596 - protein, 9 aa, Homo Sapiens
ARALAQEIL

SEQ ID NO: 92597 - protein, 9 aa, Homo Sapiens
ARDDTHYLL

SEQ ID NO: 92598 - protein, 9 aa, Homo Sapiens
ARDEIIWLL

SEQ ID NO: 92599 - protein, 9 aa, Homo Sapiens
ARDETEFYL

SEQ ID NO: 92600 - protein, 9 aa, Homo Sapiens
ARLFIFETF

SEQ ID NO: 92601 - protein, 9 aa, Homo Sapiens
ARVEGREII

SEQ ID NO: 92602 - protein, 9 aa, Homo Sapiens
CHAPDEQGL

SEQ ID NO: 92603 - protein, 9 aa, Homo Sapiens
CHAVILLQL

SEQ ID NO: 92604 - protein, 9 aa, Homo Sapiens
CHDATPFIF

SEQ ID NO: 92605 - protein, 9 aa, Homo Sapiens
CHDESSVSL

SEQ ID NO: 92606 - protein, 9 aa, Homo Sapiens
CHDPINIQF

SEQ ID NO: 92607 - protein, 9 aa, Homo Sapiens
CHDRNVVTI

SEQ ID NO: 92608 - protein, 9 aa, Homo Sapiens
CHDSGATVL

SEQ ID NO: 92609 - protein, 9 aa, Homo Sapiens
CHDVYRATF

SEQ ID NO: 92610 - protein, 9 aa, Homo Sapiens
CHFMDPQTI

SEQ ID NO: 92611 - protein, 9 aa, Homo Sapiens
CHIIQILEI

SEQ ID NO: 92612 - protein, 9 aa, Homo Sapiens
CHMLVEPNL

SEQ ID NO: 92613 - protein, 9 aa, Homo Sapiens
CHNAQTFNL

SEQ ID NO: 92614 - protein, 9 aa, Homo Sapiens
CHNQFSLFL

SEQ ID NO: 92615 - protein, 9 aa, Homo Sapiens
CHNSAITHL

SEQ ID NO: 92616 - protein, 9 aa, Homo Sapiens
CHSPVVSQL

SEQ ID NO: 92617 - protein, 9 aa, Homo Sapiens
CHSVLPLLL

SEQ ID NO: 92618 - protein, 9 aa, Homo Sapiens
CHTAFFVSI

SEQ ID NO: 92619 - protein, 9 aa, Homo Sapiens
DHAAPEITL

SEQ ID NO: 92620 - protein, 9 aa, Homo Sapiens
DHADSNIVI

SEQ ID NO: 92621 - protein, 9 aa, Homo Sapiens
DHARLQLQL

SEQ ID NO: 92622 - protein, 9 aa, Homo Sapiens
DHCDFPELL

SEQ ID NO: 92623 - protein, 9 aa, Homo Sapiens
DHCGALPYF

SEQ ID NO: 92624 - protein, 9 aa, Homo Sapiens
DHCKQVVEI

SEQ ID NO: 92625 - protein, 9 aa, Homo Sapiens
DHCPITLYL

SEQ ID NO: 92626 - protein, 9 aa, Homo Sapiens
DHCPTKISL

SEQ ID NO: 92627 - protein, 9 aa, Homo Sapiens
DHDCVLVLL

SEQ ID NO: 92628 - protein, 9 aa, Homo Sapiens
DHDGNIVEL

SEQ ID NO: 92629 - protein, 9 aa, Homo Sapiens
DHDGVVMCF

SEQ ID NO: 92630 - protein, 9 aa, Homo Sapiens
DHDIGTTNL

SEQ ID NO: 92631 - protein, 9 aa, Homo Sapiens
DHDKALQLL

SEQ ID NO: 92632 - protein, 9 aa, Homo Sapiens
DHDRIRQFI

SEQ ID NO: 92633 - protein, 9 aa, Homo Sapiens
DHDTVFQYL

SEQ ID NO: 92634 - protein, 9 aa, Homo Sapiens
DHEASYHSL

SEQ ID NO: 92635 - protein, 9 aa, Homo Sapiens
DHEGLGISI

SEQ ID NO: 92636 - protein, 9 aa, Homo Sapiens
DHESSTWII

SEQ ID NO: 92637 - protein, 9 aa, Homo Sapiens
DHFEEAMRF

SEQ ID NO: 92638 - protein, 9 aa, Homo Sapiens
DHFPEILFI

SEQ ID NO: 92639 - protein, 9 aa, Homo Sapiens
DHFPVEFKL

SEQ ID NO: 92640 - protein, 9 aa, Homo Sapiens
DHFVEGQTV

SEQ ID NO: 92641 - protein, 9 aa, Homo Sapiens
DHHFDMINI

SEQ ID NO: 92642 - protein, 9 aa, Homo Sapiens
DHHMEFCRV

SEQ ID NO: 92643 - protein, 9 aa, Homo Sapiens
DHHQEVIGF

SEQ ID NO: 92644 - protein, 9 aa, Homo Sapiens
DHIIDICFL

SEQ ID NO: 92645 - protein, 9 aa, Homo Sapiens
DHIKFDLEI

SEQ ID NO: 92646 - protein, 9 aa, Homo Sapiens
DHINDIIKI

SEQ ID NO: 92647 - protein, 9 aa, Homo Sapiens
DHIRFISEL

SEQ ID NO: 92648 - protein, 9 aa, Homo Sapiens
DHLLDPSSF

SEQ ID NO: 92649 - protein, 9 aa, Homo Sapiens
DHLPETTTI

SEQ ID NO: 92650 - protein, 9 aa, Homo Sapiens
DHLSYFTFI

SEQ ID NO: 92651 - protein, 9 aa, Homo Sapiens
DHMSLIVTI

SEQ ID NO: 92652 - protein, 9 aa, Homo Sapiens
DHNCEIGLI

SEQ ID NO: 92653 - protein, 9 aa, Homo Sapiens
DHQQNSPTL

SEQ ID NO: 92654 - protein, 9 aa, Homo Sapiens
DHQREITSL

SEQ ID NO: 92655 - protein, 9 aa, Homo Sapiens
DHSAFIILL

SEQ ID NO: 92656 - protein, 9 aa, Homo Sapiens
DHSATIVSI

SEQ ID NO: 92657 - protein, 9 aa, Homo Sapiens
DHSPCDPTI

SEQ ID NO: 92658 - protein, 9 aa, Homo Sapiens
DHSPDLYSL

SEQ ID NO: 92659 - protein, 9 aa, Homo Sapiens
DHSPVFATF

SEQ ID NO: 92660 - protein, 9 aa, Homo Sapiens
DHSPVFGTF

SEQ ID NO: 92661 - protein, 9 aa, Homo Sapiens
DHSTLVTLF

SEQ ID NO: 92662 - protein, 9 aa, Homo Sapiens
DHSYVELFL

SEQ ID NO: 92663 - protein, 9 aa, Homo Sapiens
DHVGTEPSI

SEQ ID NO: 92664 - protein, 9 aa, Homo Sapiens
DHYEDVRKI

SEQ ID NO: 92665 - protein, 9 aa, Homo Sapiens
DQDPSVLYF

SEQ ID NO: 92666 - protein, 9 aa, Homo Sapiens
EHAANDVSF

SEQ ID NO: 92667 - protein, 9 aa, Homo Sapiens
EHADDDPSL

SEQ ID NO: 92668 - protein, 9 aa, Homo Sapiens
EHAGGEVEL

SEQ ID NO: 92669 - protein, 9 aa, Homo Sapiens
EHAGVISVL

SEQ ID NO: 92670 - protein, 9 aa, Homo Sapiens
EHAKEIPRF

SEQ ID NO: 92671 - protein, 9 aa, Homo Sapiens
EHALLAYTL

SEQ ID NO: 92672 - protein, 9 aa, Homo Sapiens
EHALTSGTI

SEQ ID NO: 92673 - protein, 9 aa, Homo Sapiens
EHANDYAEI

SEQ ID NO: 92674 - protein, 9 aa, Homo Sapiens
EHAPGNQGF

SEQ ID NO: 92675 - protein, 9 aa, Homo Sapiens
EHAPGVPRI

SEQ ID NO: 92676 - protein, 9 aa, Homo Sapiens
EHAPSIIFM

SEQ ID NO: 92677 - protein, 9 aa, Homo Sapiens
EHAPSIVFI

SEQ ID NO: 92678 - protein, 9 aa, Homo Sapiens
EHARPQTTL

SEQ ID NO: 92679 - protein, 9 aa, Homo Sapiens
EHASSLLEL

SEQ ID NO: 92680 - protein, 9 aa, Homo Sapiens
EHAVGYALL

SEQ ID NO: 92681 - protein, 9 aa, Homo Sapiens
EHCDIFMNL

SEQ ID NO: 92682 - protein, 9 aa, Homo Sapiens
EHCNKYSKI

SEQ ID NO: 92683 - protein, 9 aa, Homo Sapiens
EHCPSQVTV

SEQ ID NO: 92684 - protein, 9 aa, Homo Sapiens
EHCYDIYRL

SEQ ID NO: 92685 - protein, 9 aa, Homo Sapiens
EHDAAAESL

SEQ ID NO: 92686 - protein, 9 aa, Homo Sapiens
EHDAFIFAL

SEQ ID NO: 92687 - protein, 9 aa, Homo Sapiens
EHDDFFISL

SEQ ID NO: 92688 - protein, 9 aa, Homo Sapiens
EHDDIVSTV

SEQ ID NO: 92689 - protein, 9 aa, Homo Sapiens
EHDFSKISI

SEQ ID NO: 92690 - protein, 9 aa, Homo Sapiens
EHDISLDRI

SEQ ID NO: 92691 - protein, 9 aa, Homo Sapiens
EHDPQYAVI

SEQ ID NO: 92692 - protein, 9 aa, Homo Sapiens
EHDPRVITV

SEQ ID NO: 92693 - protein, 9 aa, Homo Sapiens
EHDPSSIYL

SEQ ID NO: 92694 - protein, 9 aa, Homo Sapiens
EHDPVGQMV

SEQ ID NO: 92695 - protein, 9 aa, Homo Sapiens
EHDRIARQW

SEQ ID NO: 92696 - protein, 9 aa, Homo Sapiens
EHDRMARQW

SEQ ID NO: 92697 - protein, 9 aa, Homo Sapiens
EHDSQIVQI

SEQ ID NO: 92698 - protein, 9 aa, Homo Sapiens
EHDTTEYKL

SEQ ID NO: 92699 - protein, 9 aa, Homo Sapiens
EHDVKTLQL

SEQ ID NO: 92700 - protein, 9 aa, Homo Sapiens
EHDVPHQPF

SEQ ID NO: 92701 - protein, 9 aa, Homo Sapiens
EHDYGLFHL

SEQ ID NO: 92702 - protein, 9 aa, Homo Sapiens
EHDYTSVCL

SEQ ID NO: 92703 - protein, 9 aa, Homo Sapiens
EHEDTFVYL

SEQ ID NO: 92704 - protein, 9 aa, Homo Sapiens
EHENFLETI

SEQ ID NO: 92705 - protein, 9 aa, Homo Sapiens
EHEQFQHAI

SEQ ID NO: 92706 - protein, 9 aa, Homo Sapiens
EHFKTILLL

SEQ ID NO: 92707 - protein, 9 aa, Homo Sapiens
EHFKYPVMI

SEQ ID NO: 92708 - protein, 9 aa, Homo Sapiens
EHFNGVAEL

SEQ ID NO: 92709 - protein, 9 aa, Homo Sapiens
EHFPNHQQL

SEQ ID NO: 92710 - protein, 9 aa, Homo Sapiens
EHFPRVLEF

SEQ ID NO: 92711 - protein, 9 aa, Homo Sapiens
EHFSHSSKW

SEQ ID NO: 92712 - protein, 9 aa, Homo Sapiens
EHFSSEVTI

SEQ ID NO: 92713 - protein, 9 aa, Homo Sapiens
EHGDQDYIW

SEQ ID NO: 92714 - protein, 9 aa, Homo Sapiens
EHHAEAAQF

SEQ ID NO: 92715 - protein, 9 aa, Homo Sapiens
EHHEDFEFI

SEQ ID NO: 92716 - protein, 9 aa, Homo Sapiens
EHHEEDFFL

SEQ ID NO: 92717 - protein, 9 aa, Homo Sapiens
EHHSKELRL

SEQ ID NO: 92718 - protein, 9 aa, Homo Sapiens
EHIAASVSI

SEQ ID NO: 92719 - protein, 9 aa, Homo Sapiens
EHIDDKIAL

SEQ ID NO: 92720 - protein, 9 aa, Homo Sapiens
EHIEEVSLF

SEQ ID NO: 92721 - protein, 9 aa, Homo Sapiens
EHIGPDEVI

SEQ ID NO: 92722 - protein, 9 aa, Homo Sapiens
EHIHFIGKI

SEQ ID NO: 92723 - protein, 9 aa, Homo Sapiens
EHIHSNEVI

SEQ ID NO: 92724 - protein, 9 aa, Homo Sapiens
EHILSFETI

SEQ ID NO: 92725 - protein, 9 aa, Homo Sapiens
EHIMDLTRL

SEQ ID NO: 92726 - protein, 9 aa, Homo Sapiens
EHIQEIRTL

SEQ ID NO: 92727 - protein, 9 aa, Homo Sapiens
EHIQNIMTL

SEQ ID NO: 92728 - protein, 9 aa, Homo Sapiens
EHITSEYTL

SEQ ID NO: 92729 - protein, 9 aa, Homo Sapiens
EHIVADDRF

SEQ ID NO: 92730 - protein, 9 aa, Homo Sapiens
EHLFSVEQI

SEQ ID NO: 92731 - protein, 9 aa, Homo Sapiens
EHLNYVTEI

SEQ ID NO: 92732 - protein, 9 aa, Homo Sapiens
EHMAEPVTF

SEQ ID NO: 92733 - protein, 9 aa, Homo Sapiens
EHMMESVLI

SEQ ID NO: 92734 - protein, 9 aa, Homo Sapiens
EHNLFKQRL

SEQ ID NO: 92735 - protein, 9 aa, Homo Sapiens
EHQAIVQHL

SEQ ID NO: 92736 - protein, 9 aa, Homo Sapiens
EHQEYITFL

SEQ ID NO: 92737 - protein, 9 aa, Homo Sapiens
EHQKPPVSI

SEQ ID NO: 92738 - protein, 9 aa, Homo Sapiens
EHQQEISKI

SEQ ID NO: 92739 - protein, 9 aa, Homo Sapiens
EHQQFITFL

SEQ ID NO: 92740 - protein, 9 aa, Homo Sapiens
EHQVELELL

SEQ ID NO: 92741 - protein, 9 aa, Homo Sapiens
EHQVPVEKL

SEQ ID NO: 92742 - protein, 9 aa, Homo Sapiens
EHSAAFFLL

SEQ ID NO: 92743 - protein, 9 aa, Homo Sapiens
EHSAVNMNL

SEQ ID NO: 92744 - protein, 9 aa, Homo Sapiens
EHSAVPDSL

SEQ ID NO: 92745 - protein, 9 aa, Homo Sapiens
EHSCDEQYL

SEQ ID NO: 92746 - protein, 9 aa, Homo Sapiens
EHSDVLPVL

SEQ ID NO: 92747 - protein, 9 aa, Homo Sapiens
EHSGPPIVI

SEQ ID NO: 92748 - protein, 9 aa, Homo Sapiens
EHSIATLLL

SEQ ID NO: 92749 - protein, 9 aa, Homo Sapiens
EHSKLIAKV

SEQ ID NO: 92750 - protein, 9 aa, Homo Sapiens
EHSKVRLVI

SEQ ID NO: 92751 - protein, 9 aa, Homo Sapiens
EHSLLPLML

SEQ ID NO: 92752 - protein, 9 aa, Homo Sapiens
EHSLPTLGL

SEQ ID NO: 92753 - protein, 9 aa, Homo Sapiens
EHSLVIDTL

SEQ ID NO: 92754 - protein, 9 aa, Homo Sapiens
EHSPVPAGF

SEQ ID NO: 92755 - protein, 9 aa, Homo Sapiens
EHSSLKTHL

SEQ ID NO: 92756 - protein, 9 aa, Homo Sapiens
EHSTGITHL

SEQ ID NO: 92757 - protein, 9 aa, Homo Sapiens
EHSTVITFL

SEQ ID NO: 92758 - protein, 9 aa, Homo Sapiens
EHSVCANEM

SEQ ID NO: 92759 - protein, 9 aa, Homo Sapiens
EHTDIQEYI

SEQ ID NO: 92760 - protein, 9 aa, Homo Sapiens
EHTDQVLHL

SEQ ID NO: 92761 - protein, 9 aa, Homo Sapiens
EHTEVLQLL

SEQ ID NO: 92762 - protein, 9 aa, Homo Sapiens
EHVDVIAKF

SEQ ID NO: 92763 - protein, 9 aa, Homo Sapiens
EHVEAFITI

SEQ ID NO: 92764 - protein, 9 aa, Homo Sapiens
EHVKEVQQL

SEQ ID NO: 92765 - protein, 9 aa, Homo Sapiens
EHVLETINF

SEQ ID NO: 92766 - protein, 9 aa, Homo Sapiens
EHVLHFITI

SEQ ID NO: 92767 - protein, 9 aa, Homo Sapiens
EHVLLVSIL

SEQ ID NO: 92768 - protein, 9 aa, Homo Sapiens
EHVLTGDSI

SEQ ID NO: 92769 - protein, 9 aa, Homo Sapiens
EHVNLFPLF

SEQ ID NO: 92770 - protein, 9 aa, Homo Sapiens
EHVPLLLYI

SEQ ID NO: 92771 - protein, 9 aa, Homo Sapiens
EHVPSSSSI

SEQ ID NO: 92772 - protein, 9 aa, Homo Sapiens
EHVQFNEFL

SEQ ID NO: 92773 - protein, 9 aa, Homo Sapiens
EHVQLFDLM

SEQ ID NO: 92774 - protein, 9 aa, Homo Sapiens
EHVVQGDAL

SEQ ID NO: 92775 - protein, 9 aa, Homo Sapiens
EHYHIVQKF

SEQ ID NO: 92776 - protein, 9 aa, Homo Sapiens
ELDPVEYTL

SEQ ID NO: 92777 - protein, 9 aa, Homo Sapiens
ELDSNEHLL

SEQ ID NO: 92778 - protein, 9 aa, Homo Sapiens
EQIRDVPVL

SEQ ID NO: 92779 - protein, 9 aa, Homo Sapiens
EQRLIYEEL

SEQ ID NO: 92780 - protein, 9 aa, Homo Sapiens
ERAAANEQL

SEQ ID NO: 92781 - protein, 9 aa, Homo Sapiens
ERAALQEEL

SEQ ID NO: 92782 - protein, 9 aa, Homo Sapiens
ERDPATYNI

SEQ ID NO: 92783 - protein, 9 aa, Homo Sapiens
ERDPQSPEF

SEQ ID NO: 92784 - protein, 9 aa, Homo Sapiens
ERDRLILFL

SEQ ID NO: 92785 - protein, 9 aa, Homo Sapiens
ERIRDVVYF

SEQ ID NO: 92786 - protein, 9 aa, Homo Sapiens
ERLQIDEQL

SEQ ID NO: 92787 - protein, 9 aa, Homo Sapiens
ERMNGQEVF

SEQ ID NO: 92788 - protein, 9 aa, Homo Sapiens
FEDLEVSTF

SEQ ID NO: 92789 - protein, 9 aa, Homo Sapiens
FHADAILSF

SEQ ID NO: 92790 - protein, 9 aa, Homo Sapiens
FHAEPVDVW

SEQ ID NO: 92791 - protein, 9 aa, Homo Sapiens
FHAFLKTEF

SEQ ID NO: 92792 - protein, 9 aa, Homo Sapiens
FHCESSAHW

SEQ ID NO: 92793 - protein, 9 aa, Homo Sapiens
FHCTLIGYF

SEQ ID NO: 92794 - protein, 9 aa, Homo Sapiens
FHDATRVYL

SEQ ID NO: 92795 - protein, 9 aa, Homo Sapiens
FHDDWISSI

SEQ ID NO: 92796 - protein, 9 aa, Homo Sapiens
FHDGDSVVF

SEQ ID NO: 92797 - protein, 9 aa, Homo Sapiens
FHDGFLLEV

SEQ ID NO: 92798 - protein, 9 aa, Homo Sapiens
FHDGSVHIV

SEQ ID NO: 92799 - protein, 9 aa, Homo Sapiens
FHDKYGNAV

SEQ ID NO: 92800 - protein, 9 aa, Homo Sapiens
FHDMGGVQL

SEQ ID NO: 92801 - protein, 9 aa, Homo Sapiens
FHDMNPQSI

SEQ ID NO: 92802 - protein, 9 aa, Homo Sapiens
FHDNSGDVF

SEQ ID NO: 92803 - protein, 9 aa, Homo Sapiens
FHDPDSAVV

SEQ ID NO: 92804 - protein, 9 aa, Homo Sapiens
FHDPWKLLI

SEQ ID NO: 92805 - protein, 9 aa, Homo Sapiens
FHDSAVTSV

SEQ ID NO: 92806 - protein, 9 aa, Homo Sapiens
FHDSSPTQI

SEQ ID NO: 92807 - protein, 9 aa, Homo Sapiens
FHEEDESSF

SEQ ID NO: 92808 - protein, 9 aa, Homo Sapiens
FHEEILPMF

SEQ ID NO: 92809 - protein, 9 aa, Homo Sapiens
FHEFQESTI

SEQ ID NO: 92810 - protein, 9 aa, Homo Sapiens
FHEGDVITL

SEQ ID NO: 92811 - protein, 9 aa, Homo Sapiens
FHESGFTTV

SEQ ID NO: 92812 - protein, 9 aa, Homo Sapiens
FHEYQESTI

SEQ ID NO: 92813 - protein, 9 aa, Homo Sapiens
FHFAGDGKL

SEQ ID NO: 92814 - protein, 9 aa, Homo Sapiens
FHFEPNEYF

SEQ ID NO: 92815 - protein, 9 aa, Homo Sapiens
FHGDPHATF

SEQ ID NO: 92816 - protein, 9 aa, Homo Sapiens
FHGPPEPVL

SEQ ID NO: 92817 - protein, 9 aa, Homo Sapiens
FHHESKENF

SEQ ID NO: 92818 - protein, 9 aa, Homo Sapiens
FHHEYPWIL

SEQ ID NO: 92819 - protein, 9 aa, Homo Sapiens
FHHPNILEL

SEQ ID NO: 92820 - protein, 9 aa, Homo Sapiens
FHHQDGYRY

SEQ ID NO: 92821 - protein, 9 aa, Homo Sapiens
FHIDFGHFL

SEQ ID NO: 92822 - protein, 9 aa, Homo Sapiens
FHIDFGHIL

SEQ ID NO: 92823 - protein, 9 aa, Homo Sapiens
FHIGDRVLI

SEQ ID NO: 92824 - protein, 9 aa, Homo Sapiens
FHKDPDVNM

SEQ ID NO: 92825 - protein, 9 aa, Homo Sapiens
FHLDVEDYL

SEQ ID NO: 92826 - protein, 9 aa, Homo Sapiens
FHLIDFNLL

SEQ ID NO: 92827 - protein, 9 aa, Homo Sapiens
FHLPDDPSI

SEQ ID NO: 92828 - protein, 9 aa, Homo Sapiens
FHMDPSGTF

SEQ ID NO: 92829 - protein, 9 aa, Homo Sapiens
FHMGGNMEL

SEQ ID NO: 92830 - protein, 9 aa, Homo Sapiens
FHNFIKVTL

SEQ ID NO: 92831 - protein, 9 aa, Homo Sapiens
FHNLPSLTL

SEQ ID NO: 92832 - protein, 9 aa, Homo Sapiens
FHNNIIVLI

SEQ ID NO: 92833 - protein, 9 aa, Homo Sapiens
FHNTEVEAM

SEQ ID NO: 92834 - protein, 9 aa, Homo Sapiens
FHQDDHNNL

SEQ ID NO: 92835 - protein, 9 aa, Homo Sapiens
FHQDLPLSI

SEQ ID NO: 92836 - protein, 9 aa, Homo Sapiens
FHQDPPLMF

SEQ ID NO: 92837 - protein, 9 aa, Homo Sapiens
FHQELPLYI

SEQ ID NO: 92838 - protein, 9 aa, Homo Sapiens
FHQPDSVIL

SEQ ID NO: 92839 - protein, 9 aa, Homo Sapiens
FHQVQVVHL

SEQ ID NO: 92840 - protein, 9 aa, Homo Sapiens
FHSDPLSAI

SEQ ID NO: 92841 - protein, 9 aa, Homo Sapiens
FHSEEQQLL

SEQ ID NO: 92842 - protein, 9 aa, Homo Sapiens
FHSGGKFIL

SEQ ID NO: 92843 - protein, 9 aa, Homo Sapiens
FHSHDGPSL

SEQ ID NO: 92844 - protein, 9 aa, Homo Sapiens
FHSNDVATL

SEQ ID NO: 92845 - protein, 9 aa, Homo Sapiens
FHSVEVHKW

SEQ ID NO: 92846 - protein, 9 aa, Homo Sapiens
FHTEFQNLL

SEQ ID NO: 92847 - protein, 9 aa, Homo Sapiens
FHTVIGDTV

SEQ ID NO: 92848 - protein, 9 aa, Homo Sapiens
FHVDVPVQF

SEQ ID NO: 92849 - protein, 9 aa, Homo Sapiens
FHVSPDPSV

SEQ ID NO: 92850 - protein, 9 aa, Homo Sapiens
FHWSGNEQM

SEQ ID NO: 92851 - protein, 9 aa, Homo Sapiens
FHYPGVQNL

SEQ ID NO: 92852 - protein, 9 aa, Homo Sapiens
FKIDAGDRF

SEQ ID NO: 92853 - protein, 9 aa, Homo Sapiens
FKIDKEYLL

SEQ ID NO: 92854 - protein, 9 aa, Homo Sapiens
FPNVEIVTI

SEQ ID NO: 92855 - protein, 9 aa, Homo Sapiens
FQCQTKLEL

SEQ ID NO: 92856 - protein, 9 aa, Homo Sapiens
FQDALEPLL

SEQ ID NO: 92857 - protein, 9 aa, Homo Sapiens
FQDEINWRL

SEQ ID NO: 92858 - protein, 9 aa, Homo Sapiens
FQDGTKATF

SEQ ID NO: 92859 - protein, 9 aa, Homo Sapiens
FQHEDLNFL

SEQ ID NO: 92860 - protein, 9 aa, Homo Sapiens
FQSPPTPFL

SEQ ID NO: 92861 - protein, 9 aa, Homo Sapiens
FRFAGSENL

SEQ ID NO: 92862 - protein, 9 aa, Homo Sapiens
FRGPVVPAF

SEQ ID NO: 92863 - protein, 9 aa, Homo Sapiens
FRTEGAEKL

SEQ ID NO: 92864 - protein, 9 aa, Homo Sapiens
GHAASSPEI

SEQ ID NO: 92865 - protein, 9 aa, Homo Sapiens
GHADVAQLL

SEQ ID NO: 92866 - protein, 9 aa, Homo Sapiens
GHAMPIRSL

SEQ ID NO: 92867 - protein, 9 aa, Homo Sapiens
GHASPCPPL

SEQ ID NO: 92868 - protein, 9 aa, Homo Sapiens
GHCDVLLSL

SEQ ID NO: 92869 - protein, 9 aa, Homo Sapiens
GHDASQITL

SEQ ID NO: 92870 - protein, 9 aa, Homo Sapiens
GHDASVLKV

SEQ ID NO: 92871 - protein, 9 aa, Homo Sapiens
GHDCFPVLF

SEQ ID NO: 92872 - protein, 9 aa, Homo Sapiens
GHDGIVLAL

SEQ ID NO: 92873 - protein, 9 aa, Homo Sapiens
GHDNTDVSI

SEQ ID NO: 92874 - protein, 9 aa, Homo Sapiens
GHDQVVVLL

SEQ ID NO: 92875 - protein, 9 aa, Homo Sapiens
GHDTNHVLL

SEQ ID NO: 92876 - protein, 9 aa, Homo Sapiens
GHFDGVQDL

SEQ ID NO: 92877 - protein, 9 aa, Homo Sapiens
GHFEKPLFL

SEQ ID NO: 92878 - protein, 9 aa, Homo Sapiens
GHLDMVEFL

SEQ ID NO: 92879 - protein, 9 aa, Homo Sapiens
GHMPTVELL

SEQ ID NO: 92880 - protein, 9 aa, Homo Sapiens
GHNVFKERI

SEQ ID NO: 92881 - protein, 9 aa, Homo Sapiens
GHSAPLTNI

SEQ ID NO: 92882 - protein, 9 aa, Homo Sapiens
GHSDIHSLL

SEQ ID NO: 92883 - protein, 9 aa, Homo Sapiens
GHSDPEESF

SEQ ID NO: 92884 - protein, 9 aa, Homo Sapiens
GHSEVVAIL

SEQ ID NO: 92885 - protein, 9 aa, Homo Sapiens
GHSGPITSI

SEQ ID NO: 92886 - protein, 9 aa, Homo Sapiens
GHSPPTSSL

SEQ ID NO: 92887 - protein, 9 aa, Homo Sapiens
GHSPVLRNI

SEQ ID NO: 92888 - protein, 9 aa, Homo Sapiens
GHSSFITHL

SEQ ID NO: 92889 - protein, 9 aa, Homo Sapiens
GHSSYITHL

SEQ ID NO: 92890 - protein, 9 aa, Homo Sapiens
GHTAVVSFL

SEQ ID NO: 92891 - protein, 9 aa, Homo Sapiens
GHVVDGHKL

SEQ ID NO: 92892 - protein, 9 aa, Homo Sapiens
GHYEVAELL

SEQ ID NO: 92893 - protein, 9 aa, Homo Sapiens
GHYEVTELL

SEQ ID NO: 92894 - protein, 9 aa, Homo Sapiens
GHYLGEFSI

SEQ ID NO: 92895 - protein, 9 aa, Homo Sapiens
GRYAGEESL

SEQ ID NO: 92896 - protein, 9 aa, Homo Sapiens
HDPTSANLL

SEQ ID NO: 92897 - protein, 9 aa, Homo Sapiens
HEAMEQQTI

SEQ ID NO: 92898 - protein, 9 aa, Homo Sapiens
HEVMEQQTI

SEQ ID NO: 92899 - protein, 9 aa, Homo Sapiens
HHAEPPPAL

SEQ ID NO: 92900 - protein, 9 aa, Homo Sapiens
HHAEYLTEL

SEQ ID NO: 92901 - protein, 9 aa, Homo Sapiens
HHAFQPSKL

SEQ ID NO: 92902 - protein, 9 aa, Homo Sapiens
HHALELEYL

SEQ ID NO: 92903 - protein, 9 aa, Homo Sapiens
HHANPILLL

SEQ ID NO: 92904 - protein, 9 aa, Homo Sapiens
HHAPLPSHL

SEQ ID NO: 92905 - protein, 9 aa, Homo Sapiens
HHAPLVNSL

SEQ ID NO: 92906 - protein, 9 aa, Homo Sapiens
HHAQDYGGL

SEQ ID NO: 92907 - protein, 9 aa, Homo Sapiens
HHCDDHLSL

SEQ ID NO: 92908 - protein, 9 aa, Homo Sapiens
HHCEAVLHL

SEQ ID NO: 92909 - protein, 9 aa, Homo Sapiens
HHCKLTQVL

SEQ ID NO: 92910 - protein, 9 aa, Homo Sapiens
HHCPAFGLL

SEQ ID NO: 92911 - protein, 9 aa, Homo Sapiens
HHCPGNHSW

SEQ ID NO: 92912 - protein, 9 aa, Homo Sapiens
HHCPKTPFL

SEQ ID NO: 92913 - protein, 9 aa, Homo Sapiens
HHDFHHMNF

SEQ ID NO: 92914 - protein, 9 aa, Homo Sapiens
HHDHLQPLL

SEQ ID NO: 92915 - protein, 9 aa, Homo Sapiens
HHDIKPSNI

SEQ ID NO: 92916 - protein, 9 aa, Homo Sapiens
HHDQLHTYL

SEQ ID NO: 92917 - protein, 9 aa, Homo Sapiens
HHEAGVTAL

SEQ ID NO: 92918 - protein, 9 aa, Homo Sapiens
HHEAMKTQI

SEQ ID NO: 92919 - protein, 9 aa, Homo Sapiens
HHEASGVTV

SEQ ID NO: 92920 - protein, 9 aa, Homo Sapiens
HHELHAAHL

SEQ ID NO: 92921 - protein, 9 aa, Homo Sapiens
HHELVALLL

SEQ ID NO: 92922 - protein, 9 aa, Homo Sapiens
HHENLVSFL

SEQ ID NO: 92923 - protein, 9 aa, Homo Sapiens
HHEPESPQL

SEQ ID NO: 92924 - protein, 9 aa, Homo Sapiens
HHFCDFINL

SEQ ID NO: 92925 - protein, 9 aa, Homo Sapiens
HHFEGAQIL

SEQ ID NO: 92926 - protein, 9 aa, Homo Sapiens
HHFEKAVTL

SEQ ID NO: 92927 - protein, 9 aa, Homo Sapiens
HHFEQMLKL

SEQ ID NO: 92928 - protein, 9 aa, Homo Sapiens
HHFLELVTL

SEQ ID NO: 92929 - protein, 9 aa, Homo Sapiens
HHFLIGNNF

SEQ ID NO: 92930 - protein, 9 aa, Homo Sapiens
HHFPGPLLV

SEQ ID NO: 92931 - protein, 9 aa, Homo Sapiens
HHFVPLVTL

SEQ ID NO: 92932 - protein, 9 aa, Homo Sapiens
HHGPMAVAF

SEQ ID NO: 92933 - protein, 9 aa, Homo Sapiens
HHGPPGPTF

SEQ ID NO: 92934 - protein, 9 aa, Homo Sapiens
HHGQAQPGL

SEQ ID NO: 92935 - protein, 9 aa, Homo Sapiens
HHGTFMEEF

SEQ ID NO: 92936 - protein, 9 aa, Homo Sapiens
HHGTPHTTI

SEQ ID NO: 92937 - protein, 9 aa, Homo Sapiens
HHGTSILTL

SEQ ID NO: 92938 - protein, 9 aa, Homo Sapiens
HHHAGYEQF

SEQ ID NO: 92939 - protein, 9 aa, Homo Sapiens
HHHHHPPMI

SEQ ID NO: 92940 - protein, 9 aa, Homo Sapiens
HHHLQNNEL

SEQ ID NO: 92941 - protein, 9 aa, Homo Sapiens
HHHQEVILV

SEQ ID NO: 92942 - protein, 9 aa, Homo Sapiens
HHHSVPVFI

SEQ ID NO: 92943 - protein, 9 aa, Homo Sapiens
HHHTDGAYF

SEQ ID NO: 92944 - protein, 9 aa, Homo Sapiens
HHIANANLM

SEQ ID NO: 92945 - protein, 9 aa, Homo Sapiens
HHIASVEKL

SEQ ID NO: 92946 - protein, 9 aa, Homo Sapiens
HHIATVEKL

SEQ ID NO: 92947 - protein, 9 aa, Homo Sapiens
HHIDSANAL

SEQ ID NO: 92948 - protein, 9 aa, Homo Sapiens
HHIEAQQRL

SEQ ID NO: 92949 - protein, 9 aa, Homo Sapiens
HHIEPFCKL

SEQ ID NO: 92950 - protein, 9 aa, Homo Sapiens
HHIIENNHI

SEQ ID NO: 92951 - protein, 9 aa, Homo Sapiens
HHIIEQLRF

SEQ ID NO: 92952 - protein, 9 aa, Homo Sapiens
HHILADVSL

SEQ ID NO: 92953 - protein, 9 aa, Homo Sapiens
HHILKSDDL

SEQ ID NO: 92954 - protein, 9 aa, Homo Sapiens
HHISTEQEI

SEQ ID NO: 92955 - protein, 9 aa, Homo Sapiens
HHITGSQNI

SEQ ID NO: 92956 - protein, 9 aa, Homo Sapiens
HHIVENTYF

SEQ ID NO: 92957 - protein, 9 aa, Homo Sapiens
HHLADLSHL

SEQ ID NO: 92958 - protein, 9 aa, Homo Sapiens
HHLDPDTEL

SEQ ID NO: 92959 - protein, 9 aa, Homo Sapiens
HHLEQMYKL

SEQ ID NO: 92960 - protein, 9 aa, Homo Sapiens
HHLVIPSVL

SEQ ID NO: 92961 - protein, 9 aa, Homo Sapiens
HHMEVLREL

SEQ ID NO: 92962 - protein, 9 aa, Homo Sapiens
HHMGGMAGL

SEQ ID NO: 92963 - protein, 9 aa, Homo Sapiens
HHMGISHVL

SEQ ID NO: 92964 - protein, 9 aa, Homo Sapiens
HHMNSIRKI

SEQ ID NO: 92965 - protein, 9 aa, Homo Sapiens
HHNEAVLHL

SEQ ID NO: 92966 - protein, 9 aa, Homo Sapiens
HHNGIAELL

SEQ ID NO: 92967 - protein, 9 aa, Homo Sapiens
HHQAAIEKL

SEQ ID NO: 92968 - protein, 9 aa, Homo Sapiens
HHQALEVLL

SEQ ID NO: 92969 - protein, 9 aa, Homo Sapiens
HHQPMVQGI

SEQ ID NO: 92970 - protein, 9 aa, Homo Sapiens
HHQQPHQYL

SEQ ID NO: 92971 - protein, 9 aa, Homo Sapiens
HHSALLILL

SEQ ID NO: 92972 - protein, 9 aa, Homo Sapiens
HHSDGSVSL

SEQ ID NO: 92973 - protein, 9 aa, Homo Sapiens
HHSFDLVIF

SEQ ID NO: 92974 - protein, 9 aa, Homo Sapiens
HHSGAKVVL

SEQ ID NO: 92975 - protein, 9 aa, Homo Sapiens
HHSGILPIL

SEQ ID NO: 92976 - protein, 9 aa, Homo Sapiens
HHSGTITCL

SEQ ID NO: 92977 - protein, 9 aa, Homo Sapiens
HHSISSQTF

SEQ ID NO: 92978 - protein, 9 aa, Homo Sapiens
HHSLALTSF

SEQ ID NO: 92979 - protein, 9 aa, Homo Sapiens
HHSLVLSHL

SEQ ID NO: 92980 - protein, 9 aa, Homo Sapiens
HHSNILLTF

SEQ ID NO: 92981 - protein, 9 aa, Homo Sapiens
HHSNIPMSL

SEQ ID NO: 92982 - protein, 9 aa, Homo Sapiens
HHSNLIAGM

SEQ ID NO: 92983 - protein, 9 aa, Homo Sapiens
HHSQSFQLL

SEQ ID NO: 92984 - protein, 9 aa, Homo Sapiens
HHSRALQSI

SEQ ID NO: 92985 - protein, 9 aa, Homo Sapiens
HHSSEDYNL

SEQ ID NO: 92986 - protein, 9 aa, Homo Sapiens
HHSTQMQEL

SEQ ID NO: 92987 - protein, 9 aa, Homo Sapiens
HHSTSLPNL

SEQ ID NO: 92988 - protein, 9 aa, Homo Sapiens
HHSVGTELL

SEQ ID NO: 92989 - protein, 9 aa, Homo Sapiens
HHSYEDTGL

SEQ ID NO: 92990 - protein, 9 aa, Homo Sapiens
HHTLYINLI

SEQ ID NO: 92991 - protein, 9 aa, Homo Sapiens
HHTSSVYSI

SEQ ID NO: 92992 - protein, 9 aa, Homo Sapiens
HHTTQQTFL

SEQ ID NO: 92993 - protein, 9 aa, Homo Sapiens
HHVIPMPLL

SEQ ID NO: 92994 - protein, 9 aa, Homo Sapiens
HHVKDISCL

SEQ ID NO: 92995 - protein, 9 aa, Homo Sapiens
HHVLQNDVL

SEQ ID NO: 92996 - protein, 9 aa, Homo Sapiens
HHVNMTPEF

SEQ ID NO: 92997 - protein, 9 aa, Homo Sapiens
HHVNVNPNF

SEQ ID NO: 92998 - protein, 9 aa, Homo Sapiens
HHYEGAVVI

SEQ ID NO: 92999 - protein, 9 aa, Homo Sapiens
HHYELPAIL

SEQ ID NO: 93000 - protein, 9 aa, Homo Sapiens
HHYQAGESL

SEQ ID NO: 93001 - protein, 9 aa, Homo Sapiens
HHYTGLLKL

SEQ ID NO: 93002 - protein, 9 aa, Homo Sapiens
HLAWFGDSL

SEQ ID NO: 93003 - protein, 9 aa, Homo Sapiens
HPLEDRNTI

SEQ ID NO: 93004 - protein, 9 aa, Homo Sapiens
HPNQEPAVI

SEQ ID NO: 93005 - protein, 9 aa, Homo Sapiens
HQAEYELNI

SEQ ID NO: 93006 - protein, 9 aa, Homo Sapiens
HQALELDFL

SEQ ID NO: 93007 - protein, 9 aa, Homo Sapiens
HQAPTERQL

SEQ ID NO: 93008 - protein, 9 aa, Homo Sapiens
HQAQIDHYL

SEQ ID NO: 93009 - protein, 9 aa, Homo Sapiens
HQCSRIDLL

SEQ ID NO: 93010 - protein, 9 aa, Homo Sapiens
HQDDFNQLL

SEQ ID NO: 93011 - protein, 9 aa, Homo Sapiens
HQDNNFLYL

SEQ ID NO: 93012 - protein, 9 aa, Homo Sapiens
HQDPNSYSW

SEQ ID NO: 93013 - protein, 9 aa, Homo Sapiens
HQDQLQVLL

SEQ ID NO: 93014 - protein, 9 aa, Homo Sapiens
HQDSRAHLL

SEQ ID NO: 93015 - protein, 9 aa, Homo Sapiens
HQEQGHQLL

SEQ ID NO: 93016 - protein, 9 aa, Homo Sapiens
HQFGMDLLL

SEQ ID NO: 93017 - protein, 9 aa, Homo Sapiens
HQGPDDIYL

SEQ ID NO: 93018 - protein, 9 aa, Homo Sapiens
HQHEEIQNV

SEQ ID NO: 93019 - protein, 9 aa, Homo Sapiens
HQHEYFFLI

SEQ ID NO: 93020 - protein, 9 aa, Homo Sapiens
HQLLEKVRI

SEQ ID NO: 93021 - protein, 9 aa, Homo Sapiens
HQNVESHLL

SEQ ID NO: 93022 - protein, 9 aa, Homo Sapiens
HQRLEPATL

SEQ ID NO: 93023 - protein, 9 aa, Homo Sapiens
HQSKEENLI

SEQ ID NO: 93024 - protein, 9 aa, Homo Sapiens
HQSPATPAF

SEQ ID NO: 93025 - protein, 9 aa, Homo Sapiens
HQSVDIATL

SEQ ID NO: 93026 - protein, 9 aa, Homo Sapiens
HQTELGNQL

SEQ ID NO: 93027 - protein, 9 aa, Homo Sapiens
HQTGGEVTI

SEQ ID NO: 93028 - protein, 9 aa, Homo Sapiens
HRAQLQIRI

SEQ ID NO: 93029 - protein, 9 aa, Homo Sapiens
HRAQYEPLF

SEQ ID NO: 93030 - protein, 9 aa, Homo Sapiens
HRDNLEFFL

SEQ ID NO: 93031 - protein, 9 aa, Homo Sapiens
HRDSHITNL

SEQ ID NO: 93032 - protein, 9 aa, Homo Sapiens
HRFYMFHSF

SEQ ID NO: 93033 - protein, 9 aa, Homo Sapiens
HRLPLQELW

SEQ ID NO: 93034 - protein, 9 aa, Homo Sapiens
HSLSSSESL

SEQ ID NO: 93035 - protein, 9 aa, Homo Sapiens
IHCNTPSLL

SEQ ID NO: 93036 - protein, 9 aa, Homo Sapiens
IHDELQQSF

SEQ ID NO: 93037 - protein, 9 aa, Homo Sapiens
IHDFQPHVI

SEQ ID NO: 93038 - protein, 9 aa, Homo Sapiens
IHDGFGFML

SEQ ID NO: 93039 - protein, 9 aa, Homo Sapiens
IHDGLTVHL

SEQ ID NO: 93040 - protein, 9 aa, Homo Sapiens
IHDGMNLEL

SEQ ID NO: 93041 - protein, 9 aa, Homo Sapiens
IHDGTVHTI

SEQ ID NO: 93042 - protein, 9 aa, Homo Sapiens
IHDHNIPTL

SEQ ID NO: 93043 - protein, 9 aa, Homo Sapiens
IHDHSKAEF

SEQ ID NO: 93044 - protein, 9 aa, Homo Sapiens
IHDILDLTF

SEQ ID NO: 93045 - protein, 9 aa, Homo Sapiens
IHDKTEINL

SEQ ID NO: 93046 - protein, 9 aa, Homo Sapiens
IHDLDNISF

SEQ ID NO: 93047 - protein, 9 aa, Homo Sapiens
IHDLDSNSF

SEQ ID NO: 93048 - protein, 9 aa, Homo Sapiens
IHDLFPSLI

SEQ ID NO: 93049 - protein, 9 aa, Homo Sapiens
IHDMFPLHL

SEQ ID NO: 93050 - protein, 9 aa, Homo Sapiens
IHDNGEFYL

SEQ ID NO: 93051 - protein, 9 aa, Homo Sapiens
IHDSQAPSL

SEQ ID NO: 93052 - protein, 9 aa, Homo Sapiens
IHEDQTVYI

SEQ ID NO: 93053 - protein, 9 aa, Homo Sapiens
IHEDSMNLL

SEQ ID NO: 93054 - protein, 9 aa, Homo Sapiens
IHEDTRHLL

SEQ ID NO: 93055 - protein, 9 aa, Homo Sapiens
IHEPEPHIL

SEQ ID NO: 93056 - protein, 9 aa, Homo Sapiens
IHESVSAQI

SEQ ID NO: 93057 - protein, 9 aa, Homo Sapiens
IHETTFNSI

SEQ ID NO: 93058 - protein, 9 aa, Homo Sapiens
IHEVTKVLL

SEQ ID NO: 93059 - protein, 9 aa, Homo Sapiens
IHFFGEEYL

SEQ ID NO: 93060 - protein, 9 aa, Homo Sapiens
IHGPKGNEI

SEQ ID NO: 93061 - protein, 9 aa, Homo Sapiens
IHGPTDYQV

SEQ ID NO: 93062 - protein, 9 aa, Homo Sapiens
IHHDVNELL

SEQ ID NO: 93063 - protein, 9 aa, Homo Sapiens
IHHEGGENI

SEQ ID NO: 93064 - protein, 9 aa, Homo Sapiens
IHHGGLLPI

SEQ ID NO: 93065 - protein, 9 aa, Homo Sapiens
IHHPTPIQI

SEQ ID NO: 93066 - protein, 9 aa, Homo Sapiens
IHIDIMDYI

SEQ ID NO: 93067 - protein, 9 aa, Homo Sapiens
IHILDVLVL

SEQ ID NO: 93068 - protein, 9 aa, Homo Sapiens
IHIPINNII

SEQ ID NO: 93069 - protein, 9 aa, Homo Sapiens
IHITPEPEF

SEQ ID NO: 93070 - protein, 9 aa, Homo Sapiens
IHLGHILFL

SEQ ID NO: 93071 - protein, 9 aa, Homo Sapiens
IHLHTEALL

SEQ ID NO: 93072 - protein, 9 aa, Homo Sapiens
IHLIDPNTL

SEQ ID NO: 93073 - protein, 9 aa, Homo Sapiens
IHNDNEELI

SEQ ID NO: 93074 - protein, 9 aa, Homo Sapiens
IHNDVKVLL

SEQ ID NO: 93075 - protein, 9 aa, Homo Sapiens
IHNEDNSQF

SEQ ID NO: 93076 - protein, 9 aa, Homo Sapiens
IHNEPFLTL

SEQ ID NO: 93077 - protein, 9 aa, Homo Sapiens
IHNIEPVTF

SEQ ID NO: 93078 - protein, 9 aa, Homo Sapiens
IHNNFGVLF

SEQ ID NO: 93079 - protein, 9 aa, Homo Sapiens
IHNSDQILL

SEQ ID NO: 93080 - protein, 9 aa, Homo Sapiens
IHQDGIHIL

SEQ ID NO: 93081 - protein, 9 aa, Homo Sapiens
IHSDFQTLI

SEQ ID NO: 93082 - protein, 9 aa, Homo Sapiens
IHSENFQTL

SEQ ID NO: 93083 - protein, 9 aa, Homo Sapiens
IHSESSDTF

SEQ ID NO: 93084 - protein, 9 aa, Homo Sapiens
IHSFELDLL

SEQ ID NO: 93085 - protein, 9 aa, Homo Sapiens
IHSFIGDGL

SEQ ID NO: 93086 - protein, 9 aa, Homo Sapiens
IHSGELTKI

SEQ ID NO: 93087 - protein, 9 aa, Homo Sapiens
IHSPVVNEL

SEQ ID NO: 93088 - protein, 9 aa, Homo Sapiens
IHSQPQPAL

SEQ ID NO: 93089 - protein, 9 aa, Homo Sapiens
IHSQVSQQL

SEQ ID NO: 93090 - protein, 9 aa, Homo Sapiens
IHSQVTVQI

SEQ ID NO: 93091 - protein, 9 aa, Homo Sapiens
IHSSIVSTL

SEQ ID NO: 93092 - protein, 9 aa, Homo Sapiens
IHSSVQCKL

SEQ ID NO: 93093 - protein, 9 aa, Homo Sapiens
IHTEVINNL

SEQ ID NO: 93094 - protein, 9 aa, Homo Sapiens
IHTPENPVI

SEQ ID NO: 93095 - protein, 9 aa, Homo Sapiens
IHVDFPVIL

SEQ ID NO: 93096 - protein, 9 aa, Homo Sapiens
IHVIGGNDV

SEQ ID NO: 93097 - protein, 9 aa, Homo Sapiens
ILANIGDHF

SEQ ID NO: 93098 - protein, 9 aa, Homo Sapiens
ILANVGDQF

SEQ ID NO: 93099 - protein, 9 aa, Homo Sapiens
ILATDDPNF

SEQ ID NO: 93100 - protein, 9 aa, Homo Sapiens
ILDPHVVLL

SEQ ID NO: 93101 - protein, 9 aa, Homo Sapiens
IPCEEGDKL

SEQ ID NO: 93102 - protein, 9 aa, Homo Sapiens
IPHMDIEAL

SEQ ID NO: 93103 - protein, 9 aa, Homo Sapiens
IQCEIFQVL

SEQ ID NO: 93104 - protein, 9 aa, Homo Sapiens
IQDEEFYTL

SEQ ID NO: 93105 - protein, 9 aa, Homo Sapiens
IRAAPPPLF

SEQ ID NO: 93106 - protein, 9 aa, Homo Sapiens
IRTPTGDEF

SEQ ID NO: 93107 - protein, 9 aa, Homo Sapiens
ITQIEHEVS

SEQ ID NO: 93108 - protein, 9 aa, Homo Sapiens
KDVDGAYMT

SEQ ID NO: 93109 - protein, 9 aa, Homo Sapiens
KHAVSDPSI

SEQ ID NO: 93110 - protein, 9 aa, Homo Sapiens
KHDEYLILL

SEQ ID NO: 93111 - protein, 9 aa, Homo Sapiens
KHDTKLLIL

SEQ ID NO: 93112 - protein, 9 aa, Homo Sapiens
KHFEGTEFL

SEQ ID NO: 93113 - protein, 9 aa, Homo Sapiens
KHGDVITII

SEQ ID NO: 93114 - protein, 9 aa, Homo Sapiens
KHVEFDFLI

SEQ ID NO: 93115 - protein, 9 aa, Homo Sapiens
KLAPKDVKI

SEQ ID NO: 93116 - protein, 9 aa, Homo Sapiens
LHADPEPSV

SEQ ID NO: 93117 - protein, 9 aa, Homo Sapiens
LHAFPELYF

SEQ ID NO: 93118 - protein, 9 aa, Homo Sapiens
LHALPELYF

SEQ ID NO: 93119 - protein, 9 aa, Homo Sapiens
LHAQGDPAL

SEQ ID NO: 93120 - protein, 9 aa, Homo Sapiens
LHAQPIISI

SEQ ID NO: 93121 - protein, 9 aa, Homo Sapiens
LHATVMNTL

SEQ ID NO: 93122 - protein, 9 aa, Homo Sapiens
LHDDRGPVL

SEQ ID NO: 93123 - protein, 9 aa, Homo Sapiens
LHDERFEKF

SEQ ID NO: 93124 - protein, 9 aa, Homo Sapiens
LHDETLTYL

SEQ ID NO: 93125 - protein, 9 aa, Homo Sapiens
LHDHGVSSL

SEQ ID NO: 93126 - protein, 9 aa, Homo Sapiens
LHDKFVTKM

SEQ ID NO: 93127 - protein, 9 aa, Homo Sapiens
LHDQFQHQL

SEQ ID NO: 93128 - protein, 9 aa, Homo Sapiens
LHDSSDYLL

SEQ ID NO: 93129 - protein, 9 aa, Homo Sapiens
LHDTRTHFL

SEQ ID NO: 93130 - protein, 9 aa, Homo Sapiens
LHDTVTTLI

SEQ ID NO: 93131 - protein, 9 aa, Homo Sapiens
LHDVDLNTF

SEQ ID NO: 93132 - protein, 9 aa, Homo Sapiens
LHDVEHVLI

SEQ ID NO: 93133 - protein, 9 aa, Homo Sapiens
LHDVSDFLL

SEQ ID NO: 93134 - protein, 9 aa, Homo Sapiens
LHEAGGQIL

SEQ ID NO: 93135 - protein, 9 aa, Homo Sapiens
LHEDFVVEL

SEQ ID NO: 93136 - protein, 9 aa, Homo Sapiens
LHEDGGKLF

SEQ ID NO: 93137 - protein, 9 aa, Homo Sapiens
LHEEATMTI

SEQ ID NO: 93138 - protein, 9 aa, Homo Sapiens
LHENGCITL

SEQ ID NO: 93139 - protein, 9 aa, Homo Sapiens
LHFADDISI

SEQ ID NO: 93140 - protein, 9 aa, Homo Sapiens
LHHRELENL

SEQ ID NO: 93141 - protein, 9 aa, Homo Sapiens
LHIATEDNI

SEQ ID NO: 93142 - protein, 9 aa, Homo Sapiens
LHIGDIVSL

SEQ ID NO: 93143 - protein, 9 aa, Homo Sapiens
LHNAETSSW

SEQ ID NO: 93144 - protein, 9 aa, Homo Sapiens
LHNNLLTYL

SEQ ID NO: 93145 - protein, 9 aa, Homo Sapiens
LHSEDFLEL

SEQ ID NO: 93146 - protein, 9 aa, Homo Sapiens
LHSEEFLSF

SEQ ID NO: 93147 - protein, 9 aa, Homo Sapiens
LHSRVKLIL

SEQ ID NO: 93148 - protein, 9 aa, Homo Sapiens
LHTEECNVL

SEQ ID NO: 93149 - protein, 9 aa, Homo Sapiens
LHTSIGNSV

SEQ ID NO: 93150 - protein, 9 aa, Homo Sapiens
LHYFPEYQW

SEQ ID NO: 93151 - protein, 9 aa, Homo Sapiens
LLTTMGDRF

SEQ ID NO: 93152 - protein, 9 aa, Homo Sapiens
LPDGQVITI

SEQ ID NO: 93153 - protein, 9 aa, Homo Sapiens
LPIDDVLRI

SEQ ID NO: 93154 - protein, 9 aa, Homo Sapiens
LQDPGNHLI

SEQ ID NO: 93155 - protein, 9 aa, Homo Sapiens
LQHPDPIVI

SEQ ID NO: 93156 - protein, 9 aa, Homo Sapiens
LRAAGNESF

SEQ ID NO: 93157 - protein, 9 aa, Homo Sapiens
LTVGNNKTL

SEQ ID NO: 93158 - protein, 9 aa, Homo Sapiens
MHAGSSDLL

SEQ ID NO: 93159 - protein, 9 aa, Homo Sapiens
MHAPGMKKI

SEQ ID NO: 93160 - protein, 9 aa, Homo Sapiens
MHAQDPQML

SEQ ID NO: 93161 - protein, 9 aa, Homo Sapiens
MHDCVVKLL

SEQ ID NO: 93162 - protein, 9 aa, Homo Sapiens
MHDEKVDLW

SEQ ID NO: 93163 - protein, 9 aa, Homo Sapiens
MHDFNLISI

SEQ ID NO: 93164 - protein, 9 aa, Homo Sapiens
MHDHFNAEI

SEQ ID NO: 93165 - protein, 9 aa, Homo Sapiens
MHDKVFAYI

SEQ ID NO: 93166 - protein, 9 aa, Homo Sapiens
MHDYDGNNL

SEQ ID NO: 93167 - protein, 9 aa, Homo Sapiens
MHEENVYTV

SEQ ID NO: 93168 - protein, 9 aa, Homo Sapiens
MHEVGVVAF

SEQ ID NO: 93169 - protein, 9 aa, Homo Sapiens
MHFHETETF

SEQ ID NO: 93170 - protein, 9 aa, Homo Sapiens
MHGLEPQTI

SEQ ID NO: 93171 - protein, 9 aa, Homo Sapiens
MHGQPSPSL

SEQ ID NO: 93172 - protein, 9 aa, Homo Sapiens
MHHFIPDLL

SEQ ID NO: 93173 - protein, 9 aa, Homo Sapiens
MHHSLPETL

SEQ ID NO: 93174 - protein, 9 aa, Homo Sapiens
MHIDSHEAL

SEQ ID NO: 93175 - protein, 9 aa, Homo Sapiens
MHILDGCSI

SEQ ID NO: 93176 - protein, 9 aa, Homo Sapiens
MHLLGPWLL

SEQ ID NO: 93177 - protein, 9 aa, Homo Sapiens
MHLRQYELL

SEQ ID NO: 93178 - protein, 9 aa, Homo Sapiens
MHNEKVDLW

SEQ ID NO: 93179 - protein, 9 aa, Homo Sapiens
MHSAGTPGL

SEQ ID NO: 93180 - protein, 9 aa, Homo Sapiens
MHSDHTVGL

SEQ ID NO: 93181 - protein, 9 aa, Homo Sapiens
MHSDMIYNV

SEQ ID NO: 93182 - protein, 9 aa, Homo Sapiens
MHSGPVVAM

SEQ ID NO: 93183 - protein, 9 aa, Homo Sapiens
MHYKEAIRI

SEQ ID NO: 93184 - protein, 9 aa, Homo Sapiens
MHYPTALLF

SEQ ID NO: 93185 - protein, 9 aa, Homo Sapiens
MKDDFFIKI

SEQ ID NO: 93186 - protein, 9 aa, Homo Sapiens
MKIEEKITL

SEQ ID NO: 93187 - protein, 9 aa, Homo Sapiens
MLDNSFERL

SEQ ID NO: 93188 - protein, 9 aa, Homo Sapiens
MLDPLEVHL

SEQ ID NO: 93189 - protein, 9 aa, Homo Sapiens
MLVGIGDKI

SEQ ID NO: 93190 - protein, 9 aa, Homo Sapiens
MQALEKAYI

SEQ ID NO: 93191 - protein, 9 aa, Homo Sapiens
MQDESQYFF

SEQ ID NO: 93192 - protein, 9 aa, Homo Sapiens
MQDGSVQVI

SEQ ID NO: 93193 - protein, 9 aa, Homo Sapiens
MQDKSSYLL

SEQ ID NO: 93194 - protein, 9 aa, Homo Sapiens
MQDSRLYLI

SEQ ID NO: 93195 - protein, 9 aa, Homo Sapiens
MQEPSAHTF

SEQ ID NO: 93196 - protein, 9 aa, Homo Sapiens
MRDPTFVRL

SEQ ID NO: 93197 - protein, 9 aa, Homo Sapiens
MRLSLPLLL

SEQ ID NO: 93198 - protein, 9 aa, Homo Sapiens
MRMVLNESL

SEQ ID NO: 93199 - protein, 9 aa, Homo Sapiens
NHAAQLHTL

SEQ ID NO: 93200 - protein, 9 aa, Homo Sapiens
NHADIGFCL

SEQ ID NO: 93201 - protein, 9 aa, Homo Sapiens
NHAEAYNNL

SEQ ID NO: 93202 - protein, 9 aa, Homo Sapiens
NHAFHFHCI

SEQ ID NO: 93203 - protein, 9 aa, Homo Sapiens
NHALELLVI

SEQ ID NO: 93204 - protein, 9 aa, Homo Sapiens
NHALPLPGF

SEQ ID NO: 93205 - protein, 9 aa, Homo Sapiens
NHALPVYVF

SEQ ID NO: 93206 - protein, 9 aa, Homo Sapiens
NHASAKLDF

SEQ ID NO: 93207 - protein, 9 aa, Homo Sapiens
NHASMIQGI

SEQ ID NO: 93208 - protein, 9 aa, Homo Sapiens
NHCELLSRL

SEQ ID NO: 93209 - protein, 9 aa, Homo Sapiens
NHCMEVIRL

SEQ ID NO: 93210 - protein, 9 aa, Homo Sapiens
NHCSVSSEL

SEQ ID NO: 93211 - protein, 9 aa, Homo Sapiens
NHDDYTNQI

SEQ ID NO: 93212 - protein, 9 aa, Homo Sapiens
NHDEAIALL

SEQ ID NO: 93213 - protein, 9 aa, Homo Sapiens
NHDFQALAL

SEQ ID NO: 93214 - protein, 9 aa, Homo Sapiens
NHDFSPLEI

SEQ ID NO: 93215 - protein, 9 aa, Homo Sapiens
NHDFTPLEI

SEQ ID NO: 93216 - protein, 9 aa, Homo Sapiens
NHDIISMKL

SEQ ID NO: 93217 - protein, 9 aa, Homo Sapiens
NHDKLIPLL

SEQ ID NO: 93218 - protein, 9 aa, Homo Sapiens
NHDKVLQRL

SEQ ID NO: 93219 - protein, 9 aa, Homo Sapiens
NHDMTLTEF

SEQ ID NO: 93220 - protein, 9 aa, Homo Sapiens
NHDPNVEEF

SEQ ID NO: 93221 - protein, 9 aa, Homo Sapiens
NHDPQFEPI

SEQ ID NO: 93222 - protein, 9 aa, Homo Sapiens
NHDQHLLLL

SEQ ID NO: 93223 - protein, 9 aa, Homo Sapiens
NHDQKLLLI

SEQ ID NO: 93224 - protein, 9 aa, Homo Sapiens
NHDRPDVCI

SEQ ID NO: 93225 - protein, 9 aa, Homo Sapiens
NHDTGECRL

SEQ ID NO: 93226 - protein, 9 aa, Homo Sapiens
NHDTGEYVL

SEQ ID NO: 93227 - protein, 9 aa, Homo Sapiens
NHDVAQSEI

SEQ ID NO: 93228 - protein, 9 aa, Homo Sapiens
NHDVQVILF

SEQ ID NO: 93229 - protein, 9 aa, Homo Sapiens
NHEDKEWKF

SEQ ID NO: 93230 - protein, 9 aa, Homo Sapiens
NHEDPTPEI

SEQ ID NO: 93231 - protein, 9 aa, Homo Sapiens
NHENQKVQL

SEQ ID NO: 93232 - protein, 9 aa, Homo Sapiens
NHFDRSVVL

SEQ ID NO: 93233 - protein, 9 aa, Homo Sapiens
NHFIDLSQI

SEQ ID NO: 93234 - protein, 9 aa, Homo Sapiens
NHFMDNTTL

SEQ ID NO: 93235 - protein, 9 aa, Homo Sapiens
NHFPGSFQI

SEQ ID NO: 93236 - protein, 9 aa, Homo Sapiens
NHFQEDEQF

SEQ ID NO: 93237 - protein, 9 aa, Homo Sapiens
NHFSPCHFL

SEQ ID NO: 93238 - protein, 9 aa, Homo Sapiens
NHGAKEPTI

SEQ ID NO: 93239 - protein, 9 aa, Homo Sapiens
NHGVLKITI

SEQ ID NO: 93240 - protein, 9 aa, Homo Sapiens
NHHLQETSF

SEQ ID NO: 93241 - protein, 9 aa, Homo Sapiens
NHIGHTGYL

SEQ ID NO: 93242 - protein, 9 aa, Homo Sapiens
NHILPGQSI

SEQ ID NO: 93243 - protein, 9 aa, Homo Sapiens
NHINVMVKF

SEQ ID NO: 93244 - protein, 9 aa, Homo Sapiens
NHIQDLISL

SEQ ID NO: 93245 - protein, 9 aa, Homo Sapiens
NHISELVQL

SEQ ID NO: 93246 - protein, 9 aa, Homo Sapiens
NHLAAIEIF

SEQ ID NO: 93247 - protein, 9 aa, Homo Sapiens
NHLALIFKI

SEQ ID NO: 93248 - protein, 9 aa, Homo Sapiens
NHLDSHILL

SEQ ID NO: 93249 - protein, 9 aa, Homo Sapiens
NHLEDKINI

SEQ ID NO: 93250 - protein, 9 aa, Homo Sapiens
NHLEKFFTL

SEQ ID NO: 93251 - protein, 9 aa, Homo Sapiens
NHLSFAELL

SEQ ID NO: 93252 - protein, 9 aa, Homo Sapiens
NHMAVAFVL

SEQ ID NO: 93253 - protein, 9 aa, Homo Sapiens
NHMVQQDYF

SEQ ID NO: 93254 - protein, 9 aa, Homo Sapiens
NHNEIGELI

SEQ ID NO: 93255 - protein, 9 aa, Homo Sapiens
NHNFEIDFL

SEQ ID NO: 93256 - protein, 9 aa, Homo Sapiens
NHNFSQQCL

SEQ ID NO: 93257 - protein, 9 aa, Homo Sapiens
NHNSGIDLL

SEQ ID NO: 93258 - protein, 9 aa, Homo Sapiens
NHQEVVELL

SEQ ID NO: 93259 - protein, 9 aa, Homo Sapiens
NHQGGSVQL

SEQ ID NO: 93260 - protein, 9 aa, Homo Sapiens
NHQKDIQVL

SEQ ID NO: 93261 - protein, 9 aa, Homo Sapiens
NHSADFETV

SEQ ID NO: 93262 - protein, 9 aa, Homo Sapiens
NHSELAILL

SEQ ID NO: 93263 - protein, 9 aa, Homo Sapiens
NHSFALTLF

SEQ ID NO: 93264 - protein, 9 aa, Homo Sapiens
NHSGISVNI

SEQ ID NO: 93265 - protein, 9 aa, Homo Sapiens
NHSHDQLVL

SEQ ID NO: 93266 - protein, 9 aa, Homo Sapiens
NHSIIEEEF

SEQ ID NO: 93267 - protein, 9 aa, Homo Sapiens
NHSNQFTQL

SEQ ID NO: 93268 - protein, 9 aa, Homo Sapiens
NHSYSDPLL

SEQ ID NO: 93269 - protein, 9 aa, Homo Sapiens
NHTEDYVLL

SEQ ID NO: 93270 - protein, 9 aa, Homo Sapiens
NHTIYINNL

SEQ ID NO: 93271 - protein, 9 aa, Homo Sapiens
NHTSIAELI

SEQ ID NO: 93272 - protein, 9 aa, Homo Sapiens
NHTSISSLF

SEQ ID NO: 93273 - protein, 9 aa, Homo Sapiens
NHVASDISL

SEQ ID NO: 93274 - protein, 9 aa, Homo Sapiens
NHVDPEEEI

SEQ ID NO: 93275 - protein, 9 aa, Homo Sapiens
NHVEVAELL

SEQ ID NO: 93276 - protein, 9 aa, Homo Sapiens
NHVILTDTF

SEQ ID NO: 93277 - protein, 9 aa, Homo Sapiens
NHVPSGPSI

SEQ ID NO: 93278 - protein, 9 aa, Homo Sapiens
NHVPVITTL

SEQ ID NO: 93279 - protein, 9 aa, Homo Sapiens
NHYQKQLEI

SEQ ID NO: 93280 - protein, 9 aa, Homo Sapiens
NKTAIGDYL

SEQ ID NO: 93281 - protein, 9 aa, Homo Sapiens
NKTVIGDYL

SEQ ID NO: 93282 - protein, 9 aa, Homo Sapiens
NLVQVGDSL

SEQ ID NO: 93283 - protein, 9 aa, Homo Sapiens
NQDDLTHKL

SEQ ID NO: 93284 - protein, 9 aa, Homo Sapiens
NQDLTFQHI

SEQ ID NO: 93285 - protein, 9 aa, Homo Sapiens
NQDNLQLFL

SEQ ID NO: 93286 - protein, 9 aa, Homo Sapiens
NQSELAVLL

SEQ ID NO: 93287 - protein, 9 aa, Homo Sapiens
NRAAAFEQL

SEQ ID NO: 93288 - protein, 9 aa, Homo Sapiens
NRAHVQELL

SEQ ID NO: 93289 - protein, 9 aa, Homo Sapiens
NRCVKGDSL

SEQ ID NO: 93290 - protein, 9 aa, Homo Sapiens
NRDDSNLYI

SEQ ID NO: 93291 - protein, 9 aa, Homo Sapiens
NRDFILYRF

SEQ ID NO: 93292 - protein, 9 aa, Homo Sapiens
NRHYYSITI

SEQ ID NO: 93293 - protein, 9 aa, Homo Sapiens
NRIAIYELL

SEQ ID NO: 93294 - protein, 9 aa, Homo Sapiens
NRLGGEEKF

SEQ ID NO: 93295 - protein, 9 aa, Homo Sapiens
NRTDVVLIL

SEQ ID NO: 93296 - protein, 9 aa, Homo Sapiens
PANRDLHIP

SEQ ID NO: 93297 - protein, 9 aa, Homo Sapiens
QEYPDLIHI

SEQ ID NO: 93298 - protein, 9 aa, Homo Sapiens
QHAASLLKL

SEQ ID NO: 93299 - protein, 9 aa, Homo Sapiens
QHAAVSEKL

SEQ ID NO: 93300 - protein, 9 aa, Homo Sapiens
QHADPPVQI

SEQ ID NO: 93301 - protein, 9 aa, Homo Sapiens
QHADVGKEL

SEQ ID NO: 93302 - protein, 9 aa, Homo Sapiens
QHAIVFQHI

SEQ ID NO: 93303 - protein, 9 aa, Homo Sapiens
QHAKYTCSF

SEQ ID NO: 93304 - protein, 9 aa, Homo Sapiens
QHALERETM

SEQ ID NO: 93305 - protein, 9 aa, Homo Sapiens
QHALLQEEL

SEQ ID NO: 93306 - protein, 9 aa, Homo Sapiens
QHAPANDYL

SEQ ID NO: 93307 - protein, 9 aa, Homo Sapiens
QHAVEAISL

SEQ ID NO: 93308 - protein, 9 aa, Homo Sapiens
QHAWAQLTF

SEQ ID NO: 93309 - protein, 9 aa, Homo Sapiens
QHCEQWIEF

SEQ ID NO: 93310 - protein, 9 aa, Homo Sapiens
QHCLALLNL

SEQ ID NO: 93311 - protein, 9 aa, Homo Sapiens
QHDAACRVI

SEQ ID NO: 93312 - protein, 9 aa, Homo Sapiens
QHDAAQLYL

SEQ ID NO: 93313 - protein, 9 aa, Homo Sapiens
QHDAPVKTI

SEQ ID NO: 93314 - protein, 9 aa, Homo Sapiens
QHDEVETYF

SEQ ID NO: 93315 - protein, 9 aa, Homo Sapiens
QHDFQAPYL

SEQ ID NO: 93316 - protein, 9 aa, Homo Sapiens
QHDFQKVKL

SEQ ID NO: 93317 - protein, 9 aa, Homo Sapiens
QHDFTSQIF

SEQ ID NO: 93318 - protein, 9 aa, Homo Sapiens
QHDGPTKNL

SEQ ID NO: 93319 - protein, 9 aa, Homo Sapiens
QHDIHNAKL

SEQ ID NO: 93320 - protein, 9 aa, Homo Sapiens
QHDLALLRL

SEQ ID NO: 93321 - protein, 9 aa, Homo Sapiens
QHDLFDSGF

SEQ ID NO: 93322 - protein, 9 aa, Homo Sapiens
QHDLFFDTL

SEQ ID NO: 93323 - protein, 9 aa, Homo Sapiens
QHDNIIAYY

SEQ ID NO: 93324 - protein, 9 aa, Homo Sapiens
QHDPGKMFI

SEQ ID NO: 93325 - protein, 9 aa, Homo Sapiens
QHDPLTTDL

SEQ ID NO: 93326 - protein, 9 aa, Homo Sapiens
QHDPYITSI

SEQ ID NO: 93327 - protein, 9 aa, Homo Sapiens
QHDTIGYLL

SEQ ID NO: 93328 - protein, 9 aa, Homo Sapiens
QHDVLFSYL

SEQ ID NO: 93329 - protein, 9 aa, Homo Sapiens
QHDVLKLEF

SEQ ID NO: 93330 - protein, 9 aa, Homo Sapiens
QHDVQTLLL

SEQ ID NO: 93331 - protein, 9 aa, Homo Sapiens
QHDVSQTLL

SEQ ID NO: 93332 - protein, 9 aa, Homo Sapiens
QHEAAVPQL

SEQ ID NO: 93333 - protein, 9 aa, Homo Sapiens
QHEAFIRSI

SEQ ID NO: 93334 - protein, 9 aa, Homo Sapiens
QHEEFVTSL

SEQ ID NO: 93335 - protein, 9 aa, Homo Sapiens
QHEEPESFF

SEQ ID NO: 93336 - protein, 9 aa, Homo Sapiens
QHEFPGPAF

SEQ ID NO: 93337 - protein, 9 aa, Homo Sapiens
QHEGGVQEL

SEQ ID NO: 93338 - protein, 9 aa, Homo Sapiens
QHEKAALYF

SEQ ID NO: 93339 - protein, 9 aa, Homo Sapiens
QHEKLIVRI

SEQ ID NO: 93340 - protein, 9 aa, Homo Sapiens
QHELGNVFL

SEQ ID NO: 93341 - protein, 9 aa, Homo Sapiens
QHENSSLLL

SEQ ID NO: 93342 - protein, 9 aa, Homo Sapiens
QHEQPGQGI

SEQ ID NO: 93343 - protein, 9 aa, Homo Sapiens
QHETSSPAL

SEQ ID NO: 93344 - protein, 9 aa, Homo Sapiens
QHFDAAYIF

SEQ ID NO: 93345 - protein, 9 aa, Homo Sapiens
QHFDSVMQL

SEQ ID NO: 93346 - protein, 9 aa, Homo Sapiens
QHFEGLNML

SEQ ID NO: 93347 - protein, 9 aa, Homo Sapiens
QHFGMVELL

SEQ ID NO: 93348 - protein, 9 aa, Homo Sapiens
QHFNGLLEI

SEQ ID NO: 93349 - protein, 9 aa, Homo Sapiens
QHFPATPLL

SEQ ID NO: 93350 - protein, 9 aa, Homo Sapiens
QHFVEKVVF

SEQ ID NO: 93351 - protein, 9 aa, Homo Sapiens
QHFYICENF

SEQ ID NO: 93352 - protein, 9 aa, Homo Sapiens
QHGDTFTVL

SEQ ID NO: 93353 - protein, 9 aa, Homo Sapiens
QHGDVVSAI

SEQ ID NO: 93354 - protein, 9 aa, Homo Sapiens
QHGPLLLTL

SEQ ID NO: 93355 - protein, 9 aa, Homo Sapiens
QHHAKPNIF

SEQ ID NO: 93356 - protein, 9 aa, Homo Sapiens
QHHHLPQHL

SEQ ID NO: 93357 - protein, 9 aa, Homo Sapiens
QHIAQDSSL

SEQ ID NO: 93358 - protein, 9 aa, Homo Sapiens
QHIDAVARF

SEQ ID NO: 93359 - protein, 9 aa, Homo Sapiens
QHIDFVTAI

SEQ ID NO: 93360 - protein, 9 aa, Homo Sapiens
QHIDNITQI

SEQ ID NO: 93361 - protein, 9 aa, Homo Sapiens
QHIGKPSTI

SEQ ID NO: 93362 - protein, 9 aa, Homo Sapiens
QHIKSDVHL

SEQ ID NO: 93363 - protein, 9 aa, Homo Sapiens
QHILNPAFL

SEQ ID NO: 93364 - protein, 9 aa, Homo Sapiens
QHILSVQQF

SEQ ID NO: 93365 - protein, 9 aa, Homo Sapiens
QHIPTPLFV

SEQ ID NO: 93366 - protein, 9 aa, Homo Sapiens
QHISDSPII

SEQ ID NO: 93367 - protein, 9 aa, Homo Sapiens
QHLIDTNKI

SEQ ID NO: 93368 - protein, 9 aa, Homo Sapiens
QHLIIFDYI

SEQ ID NO: 93369 - protein, 9 aa, Homo Sapiens
QHLPYIQIL

SEQ ID NO: 93370 - protein, 9 aa, Homo Sapiens
QHLQQSNEI

SEQ ID NO: 93371 - protein, 9 aa, Homo Sapiens
QHLSDYSQL

SEQ ID NO: 93372 - protein, 9 aa, Homo Sapiens
QHLVQQLVL

SEQ ID NO: 93373 - protein, 9 aa, Homo Sapiens
QHNIPFPCL

SEQ ID NO: 93374 - protein, 9 aa, Homo Sapiens
QHNPVPDFI

SEQ ID NO: 93375 - protein, 9 aa, Homo Sapiens
QHNQSVNYF

SEQ ID NO: 93376 - protein, 9 aa, Homo Sapiens
QHNYPGIKL

SEQ ID NO: 93377 - protein, 9 aa, Homo Sapiens
QHQAWLQSI

SEQ ID NO: 93378 - protein, 9 aa, Homo Sapiens
QHQDRVQNL

SEQ ID NO: 93379 - protein, 9 aa, Homo Sapiens
QHQEFSFLL

SEQ ID NO: 93380 - protein, 9 aa, Homo Sapiens
QHQESIIQL

SEQ ID NO: 93381 - protein, 9 aa, Homo Sapiens
QHQETINTL

SEQ ID NO: 93382 - protein, 9 aa, Homo Sapiens
QHQETPVYL

SEQ ID NO: 93383 - protein, 9 aa, Homo Sapiens
QHQFRDQRW

SEQ ID NO: 93384 - protein, 9 aa, Homo Sapiens
QHQGAVELL

SEQ ID NO: 93385 - protein, 9 aa, Homo Sapiens
QHQLDTILF

SEQ ID NO: 93386 - protein, 9 aa, Homo Sapiens
QHQLQQQQL

SEQ ID NO: 93387 - protein, 9 aa, Homo Sapiens
QHQMDVAFL

SEQ ID NO: 93388 - protein, 9 aa, Homo Sapiens
QHQSGIVQL

SEQ ID NO: 93389 - protein, 9 aa, Homo Sapiens
QHQSVPQCL

SEQ ID NO: 93390 - protein, 9 aa, Homo Sapiens
QHSAAGATI

SEQ ID NO: 93391 - protein, 9 aa, Homo Sapiens
QHSDKIIRL

SEQ ID NO: 93392 - protein, 9 aa, Homo Sapiens
QHSEEERTL

SEQ ID NO: 93393 - protein, 9 aa, Homo Sapiens
QHSGSYEVI

SEQ ID NO: 93394 - protein, 9 aa, Homo Sapiens
QHSILACKI

SEQ ID NO: 93395 - protein, 9 aa, Homo Sapiens
QHSIPVFIF

SEQ ID NO: 93396 - protein, 9 aa, Homo Sapiens
QHSLGGHRL

SEQ ID NO: 93397 - protein, 9 aa, Homo Sapiens
QHSLPLLLI

SEQ ID NO: 93398 - protein, 9 aa, Homo Sapiens
QHSLTQQRL

SEQ ID NO: 93399 - protein, 9 aa, Homo Sapiens
QHSPDLMSF

SEQ ID NO: 93400 - protein, 9 aa, Homo Sapiens
QHSQLGQDL

SEQ ID NO: 93401 - protein, 9 aa, Homo Sapiens
QHSSFFIFL

SEQ ID NO: 93402 - protein, 9 aa, Homo Sapiens
QHSSLSTRF

SEQ ID NO: 93403 - protein, 9 aa, Homo Sapiens
QHSTAQLNL

SEQ ID NO: 93404 - protein, 9 aa, Homo Sapiens
QHSVQVDQL

SEQ ID NO: 93405 - protein, 9 aa, Homo Sapiens
QHTDTVVNF

SEQ ID NO: 93406 - protein, 9 aa, Homo Sapiens
QHTPTSITL

SEQ ID NO: 93407 - protein, 9 aa, Homo Sapiens
QHTSLPLTF

SEQ ID NO: 93408 - protein, 9 aa, Homo Sapiens
QHVTEAFQF

SEQ ID NO: 93409 - protein, 9 aa, Homo Sapiens
QHVTISQLF

SEQ ID NO: 93410 - protein, 9 aa, Homo Sapiens
QQDAQEFFL

SEQ ID NO: 93411 - protein, 9 aa, Homo Sapiens
QQDQVDRNI

SEQ ID NO: 93412 - protein, 9 aa, Homo Sapiens
QQSNVILLL

SEQ ID NO: 93413 - protein, 9 aa, Homo Sapiens
QQSVIGDYL

SEQ ID NO: 93414 - protein, 9 aa, Homo Sapiens
QRAHVQEFF

SEQ ID NO: 93415 - protein, 9 aa, Homo Sapiens
QRDGYQQNF

SEQ ID NO: 93416 - protein, 9 aa, Homo Sapiens
QRDNTVHSF

SEQ ID NO: 93417 - protein, 9 aa, Homo Sapiens
QRIIQQETL

SEQ ID NO: 93418 - protein, 9 aa, Homo Sapiens
QRISSFETF

SEQ ID NO: 93419 - protein, 9 aa, Homo Sapiens
QRLAGNEQV

SEQ ID NO: 93420 - protein, 9 aa, Homo Sapiens
QRLDLQIKL

SEQ ID NO: 93421 - protein, 9 aa, Homo Sapiens
QRTPGEEKI

SEQ ID NO: 93422 - protein, 9 aa, Homo Sapiens
QRVPINESF

SEQ ID NO: 93423 - protein, 9 aa, Homo Sapiens
QRYADFTLL

SEQ ID NO: 93424 - protein, 9 aa, Homo Sapiens
RHADLEIRL

SEQ ID NO: 93425 - protein, 9 aa, Homo Sapiens
RHAEPGFSL

SEQ ID NO: 93426 - protein, 9 aa, Homo Sapiens
RHAVVMELI

SEQ ID NO: 93427 - protein, 9 aa, Homo Sapiens
RHCDLQVRI

SEQ ID NO: 93428 - protein, 9 aa, Homo Sapiens
RHDDRPQVL

SEQ ID NO: 93429 - protein, 9 aa, Homo Sapiens
RHDDYLVML

SEQ ID NO: 93430 - protein, 9 aa, Homo Sapiens
RHDIAFVEF

SEQ ID NO: 93431 - protein, 9 aa, Homo Sapiens
RHDKFLDTL

SEQ ID NO: 93432 - protein, 9 aa, Homo Sapiens
RHDLEDNLL

SEQ ID NO: 93433 - protein, 9 aa, Homo Sapiens
RHDNKVTWL

SEQ ID NO: 93434 - protein, 9 aa, Homo Sapiens
RHDPQTTNL

SEQ ID NO: 93435 - protein, 9 aa, Homo Sapiens
RHDPYINRI

SEQ ID NO: 93436 - protein, 9 aa, Homo Sapiens
RHDSAQLVL

SEQ ID NO: 93437 - protein, 9 aa, Homo Sapiens
RHDSYGNQF

SEQ ID NO: 93438 - protein, 9 aa, Homo Sapiens
RHDVIVTII

SEQ ID NO: 93439 - protein, 9 aa, Homo Sapiens
RHFEELETI

SEQ ID NO: 93440 - protein, 9 aa, Homo Sapiens
RHLDFFEML

SEQ ID NO: 93441 - protein, 9 aa, Homo Sapiens
RHLDSYEFL

SEQ ID NO: 93442 - protein, 9 aa, Homo Sapiens
RHMEQHVSF

SEQ ID NO: 93443 - protein, 9 aa, Homo Sapiens
RHMHVQLQL

SEQ ID NO: 93444 - protein, 9 aa, Homo Sapiens
RHMQIVHKI

SEQ ID NO: 93445 - protein, 9 aa, Homo Sapiens
RHSDYPLSL

SEQ ID NO: 93446 - protein, 9 aa, Homo Sapiens
RHSGLIIHL

SEQ ID NO: 93447 - protein, 9 aa, Homo Sapiens
RHSNLVQLL

SEQ ID NO: 93448 - protein, 9 aa, Homo Sapiens
RHVDAHATL

SEQ ID NO: 93449 - protein, 9 aa, Homo Sapiens
RHVDFPLML

SEQ ID NO: 93450 - protein, 9 aa, Homo Sapiens
RLVDTGDKF

SEQ ID NO: 93451 - protein, 9 aa, Homo Sapiens
RMDELFVLI

SEQ ID NO: 93452 - protein, 9 aa, Homo Sapiens
RPAQVGDSF

SEQ ID NO: 93453 - protein, 9 aa, Homo Sapiens
RQIEREHLI

SEQ ID NO: 93454 - protein, 9 aa, Homo Sapiens
SGHVELYTI

SEQ ID NO: 93455 - protein, 9 aa, Homo Sapiens
SHADVVNLL

SEQ ID NO: 93456 - protein, 9 aa, Homo Sapiens
SHAEIKAII

SEQ ID NO: 93457 - protein, 9 aa, Homo Sapiens
SHAENILQI

SEQ ID NO: 93458 - protein, 9 aa, Homo Sapiens
SHAIEALIL

SEQ ID NO: 93459 - protein, 9 aa, Homo Sapiens
SHAIFTITI

SEQ ID NO: 93460 - protein, 9 aa, Homo Sapiens
SHANSAVVL

SEQ ID NO: 93461 - protein, 9 aa, Homo Sapiens
SHAPQDVSL

SEQ ID NO: 93462 - protein, 9 aa, Homo Sapiens
SHAPSFNFL

SEQ ID NO: 93463 - protein, 9 aa, Homo Sapiens
SHAPYLLVF

SEQ ID NO: 93464 - protein, 9 aa, Homo Sapiens
SHASGTYLI

SEQ ID NO: 93465 - protein, 9 aa, Homo Sapiens
SHASKDVAI

SEQ ID NO: 93466 - protein, 9 aa, Homo Sapiens
SHAVFQIYL

SEQ ID NO: 93467 - protein, 9 aa, Homo Sapiens
SHAVGPQEI

SEQ ID NO: 93468 - protein, 9 aa, Homo Sapiens
SHAVQHPVL

SEQ ID NO: 93469 - protein, 9 aa, Homo Sapiens
SHCDETYTL

SEQ ID NO: 93470 - protein, 9 aa, Homo Sapiens
SHCDLSLKI

SEQ ID NO: 93471 - protein, 9 aa, Homo Sapiens
SHCEIAVFI

SEQ ID NO: 93472 - protein, 9 aa, Homo Sapiens
SHCQLVTLI

SEQ ID NO: 93473 - protein, 9 aa, Homo Sapiens
SHDAPENTL

SEQ ID NO: 93474 - protein, 9 aa, Homo Sapiens
SHDDGNIDL

SEQ ID NO: 93475 - protein, 9 aa, Homo Sapiens
SHDDIVTEF

SEQ ID NO: 93476 - protein, 9 aa, Homo Sapiens
SHDDIVTRM

SEQ ID NO: 93477 - protein, 9 aa, Homo Sapiens
SHDEINNYL

SEQ ID NO: 93478 - protein, 9 aa, Homo Sapiens
SHDERFIRL

SEQ ID NO: 93479 - protein, 9 aa, Homo Sapiens
SHDEVFVVL

SEQ ID NO: 93480 - protein, 9 aa, Homo Sapiens
SHDFLEIRF

SEQ ID NO: 93481 - protein, 9 aa, Homo Sapiens
SHDFLETRF

SEQ ID NO: 93482 - protein, 9 aa, Homo Sapiens
SHDFYSHEL

SEQ ID NO: 93483 - protein, 9 aa, Homo Sapiens
SHDGHINYW

SEQ ID NO: 93484 - protein, 9 aa, Homo Sapiens
SHDHGYTTL

SEQ ID NO: 93485 - protein, 9 aa, Homo Sapiens
SHDHLTLFL

SEQ ID NO: 93486 - protein, 9 aa, Homo Sapiens
SHDLMLLRL

SEQ ID NO: 93487 - protein, 9 aa, Homo Sapiens
SHDNFIYLY

SEQ ID NO: 93488 - protein, 9 aa, Homo Sapiens
SHDNIICGI

SEQ ID NO: 93489 - protein, 9 aa, Homo Sapiens
SHDNLVYVY

SEQ ID NO: 93490 - protein, 9 aa, Homo Sapiens
SHDNVIYIY

SEQ ID NO: 93491 - protein, 9 aa, Homo Sapiens
SHDQHAYAL

SEQ ID NO: 93492 - protein, 9 aa, Homo Sapiens
SHDSIKMEI

SEQ ID NO: 93493 - protein, 9 aa, Homo Sapiens
SHDTMTYCL

SEQ ID NO: 93494 - protein, 9 aa, Homo Sapiens
SHDYSLYSL

SEQ ID NO: 93495 - protein, 9 aa, Homo Sapiens
SHEAPIPTF

SEQ ID NO: 93496 - protein, 9 aa, Homo Sapiens
SHEDYRVFI

SEQ ID NO: 93497 - protein, 9 aa, Homo Sapiens
SHEEVVQTL

SEQ ID NO: 93498 - protein, 9 aa, Homo Sapiens
SHEGETAYI

SEQ ID NO: 93499 - protein, 9 aa, Homo Sapiens
SHEGETSYI

SEQ ID NO: 93500 - protein, 9 aa, Homo Sapiens
SHEGHVYGF

SEQ ID NO: 93501 - protein, 9 aa, Homo Sapiens
SHEGKPLKL

SEQ ID NO: 93502 - protein, 9 aa, Homo Sapiens
SHELENHQI

SEQ ID NO: 93503 - protein, 9 aa, Homo Sapiens
SHEPKSPSL

SEQ ID NO: 93504 - protein, 9 aa, Homo Sapiens
SHEQIILLL

SEQ ID NO: 93505 - protein, 9 aa, Homo Sapiens
SHETSLYYL

SEQ ID NO: 93506 - protein, 9 aa, Homo Sapiens
SHETVTIEL

SEQ ID NO: 93507 - protein, 9 aa, Homo Sapiens
SHEVTVVLF

SEQ ID NO: 93508 - protein, 9 aa, Homo Sapiens
SHFQVAHTI

SEQ ID NO: 93509 - protein, 9 aa, Homo Sapiens
SHFTEPENI

SEQ ID NO: 93510 - protein, 9 aa, Homo Sapiens
SHFVEPVYL

SEQ ID NO: 93511 - protein, 9 aa, Homo Sapiens
SHFVSDVVI

SEQ ID NO: 93512 - protein, 9 aa, Homo Sapiens
SHGELQYYL

SEQ ID NO: 93513 - protein, 9 aa, Homo Sapiens
SHGPPTHRL

SEQ ID NO: 93514 - protein, 9 aa, Homo Sapiens
SHGVPLPNW

SEQ ID NO: 93515 - protein, 9 aa, Homo Sapiens
SHHLVISHL

SEQ ID NO: 93516 - protein, 9 aa, Homo Sapiens
SHHPGQYNL

SEQ ID NO: 93517 - protein, 9 aa, Homo Sapiens
SHHQIFVFI

SEQ ID NO: 93518 - protein, 9 aa, Homo Sapiens
SHHSMVSML

SEQ ID NO: 93519 - protein, 9 aa, Homo Sapiens
SHIDQREKI

SEQ ID NO: 93520 - protein, 9 aa, Homo Sapiens
SHIGDAVVI

SEQ ID NO: 93521 - protein, 9 aa, Homo Sapiens
SHIIGDEEI

SEQ ID NO: 93522 - protein, 9 aa, Homo Sapiens
SHIITGNKI

SEQ ID NO: 93523 - protein, 9 aa, Homo Sapiens
SHILEAINI

SEQ ID NO: 93524 - protein, 9 aa, Homo Sapiens
SHINSNYKL

SEQ ID NO: 93525 - protein, 9 aa, Homo Sapiens
SHINTVFVL

SEQ ID NO: 93526 - protein, 9 aa, Homo Sapiens
SHIPEASFL

SEQ ID NO: 93527 - protein, 9 aa, Homo Sapiens
SHIPLIIQF

SEQ ID NO: 93528 - protein, 9 aa, Homo Sapiens
SHIQDDMHL

SEQ ID NO: 93529 - protein, 9 aa, Homo Sapiens
SHIQGAVHI

SEQ ID NO: 93530 - protein, 9 aa, Homo Sapiens
SHIRGDINI

SEQ ID NO: 93531 - protein, 9 aa, Homo Sapiens
SHISSSESI

SEQ ID NO: 93532 - protein, 9 aa, Homo Sapiens
SHITPTQGF

SEQ ID NO: 93533 - protein, 9 aa, Homo Sapiens
SHKGEEPTI

SEQ ID NO: 93534 - protein, 9 aa, Homo Sapiens
SHLDYDITL

SEQ ID NO: 93535 - protein, 9 aa, Homo Sapiens
SHLEKAWLI

SEQ ID NO: 93536 - protein, 9 aa, Homo Sapiens
SHLGEPHKF

SEQ ID NO: 93537 - protein, 9 aa, Homo Sapiens
SHLGQEVTL

SEQ ID NO: 93538 - protein, 9 aa, Homo Sapiens
SHLNLLLGF

SEQ ID NO: 93539 - protein, 9 aa, Homo Sapiens
SHLPFDCVL

SEQ ID NO: 93540 - protein, 9 aa, Homo Sapiens
SHLPLVEEL

SEQ ID NO: 93541 - protein, 9 aa, Homo Sapiens
SHLSDQLTL

SEQ ID NO: 93542 - protein, 9 aa, Homo Sapiens
SHLVEHVRI

SEQ ID NO: 93543 - protein, 9 aa, Homo Sapiens
SHMEPQVCL

SEQ ID NO: 93544 - protein, 9 aa, Homo Sapiens
SHMETTMKL

SEQ ID NO: 93545 - protein, 9 aa, Homo Sapiens
SHNRFEHSL

SEQ ID NO: 93546 - protein, 9 aa, Homo Sapiens
SHNSSFELI

SEQ ID NO: 93547 - protein, 9 aa, Homo Sapiens
SHQDILSTI

SEQ ID NO: 93548 - protein, 9 aa, Homo Sapiens
SHQEAISKI

SEQ ID NO: 93549 - protein, 9 aa, Homo Sapiens
SHQEILILL

SEQ ID NO: 93550 - protein, 9 aa, Homo Sapiens
SHQGDYAVL

SEQ ID NO: 93551 - protein, 9 aa, Homo Sapiens
SHQLDFNVL

SEQ ID NO: 93552 - protein, 9 aa, Homo Sapiens
SHQNFALFF

SEQ ID NO: 93553 - protein, 9 aa, Homo Sapiens
SHQQYFYKI

SEQ ID NO: 93554 - protein, 9 aa, Homo Sapiens
SHSDTIQAI

SEQ ID NO: 93555 - protein, 9 aa, Homo Sapiens
SHSEAVAML

SEQ ID NO: 93556 - protein, 9 aa, Homo Sapiens
SHSELIHNL

SEQ ID NO: 93557 - protein, 9 aa, Homo Sapiens
SHSELKCDI

SEQ ID NO: 93558 - protein, 9 aa, Homo Sapiens
SHSFVVNIL

SEQ ID NO: 93559 - protein, 9 aa, Homo Sapiens
SHSGITNKL

SEQ ID NO: 93560 - protein, 9 aa, Homo Sapiens
SHSGLSIFI

SEQ ID NO: 93561 - protein, 9 aa, Homo Sapiens
SHSHVGYTL

SEQ ID NO: 93562 - protein, 9 aa, Homo Sapiens
SHSQLMQLI

SEQ ID NO: 93563 - protein, 9 aa, Homo Sapiens
SHSSDFIEL

SEQ ID NO: 93564 - protein, 9 aa, Homo Sapiens
SHSSDLQGL

SEQ ID NO: 93565 - protein, 9 aa, Homo Sapiens
SHSSFQASL

SEQ ID NO: 93566 - protein, 9 aa, Homo Sapiens
SHSSIIHRL

SEQ ID NO: 93567 - protein, 9 aa, Homo Sapiens
SHSSSFLSL

SEQ ID NO: 93568 - protein, 9 aa, Homo Sapiens
SHSSSVQTL

SEQ ID NO: 93569 - protein, 9 aa, Homo Sapiens
SHSSVILKM

SEQ ID NO: 93570 - protein, 9 aa, Homo Sapiens
SHSTPSSSI

SEQ ID NO: 93571 - protein, 9 aa, Homo Sapiens
SHSVFQLQI

SEQ ID NO: 93572 - protein, 9 aa, Homo Sapiens
SHSVFSVTI

SEQ ID NO: 93573 - protein, 9 aa, Homo Sapiens
SHSVLNLLF

SEQ ID NO: 93574 - protein, 9 aa, Homo Sapiens
SHSVPDTAF

SEQ ID NO: 93575 - protein, 9 aa, Homo Sapiens
SHTAPQVLF

SEQ ID NO: 93576 - protein, 9 aa, Homo Sapiens
SHTDVVPVF

SEQ ID NO: 93577 - protein, 9 aa, Homo Sapiens
SHTHVSVVI

SEQ ID NO: 93578 - protein, 9 aa, Homo Sapiens
SHTPGEHQI

SEQ ID NO: 93579 - protein, 9 aa, Homo Sapiens
SHTPWIVII

SEQ ID NO: 93580 - protein, 9 aa, Homo Sapiens
SHTSVGNIL

SEQ ID NO: 93581 - protein, 9 aa, Homo Sapiens
SHTSVPLLL

SEQ ID NO: 93582 - protein, 9 aa, Homo Sapiens
SHVEEGNVV

SEQ ID NO: 93583 - protein, 9 aa, Homo Sapiens
SHVHFDEKL

SEQ ID NO: 93584 - protein, 9 aa, Homo Sapiens
SHVQIPVML

SEQ ID NO: 93585 - protein, 9 aa, Homo Sapiens
SHVSGTTTL

SEQ ID NO: 93586 - protein, 9 aa, Homo Sapiens
SHWPFFEAF

SEQ ID NO: 93587 - protein, 9 aa, Homo Sapiens
SHYEKEYIL

SEQ ID NO: 93588 - protein, 9 aa, Homo Sapiens
SHYLFSEEI

SEQ ID NO: 93589 - protein, 9 aa, Homo Sapiens
SHYPFFSTF

SEQ ID NO: 93590 - protein, 9 aa, Homo Sapiens
SHYTTPMVL

SEQ ID NO: 93591 - protein, 9 aa, Homo Sapiens
SLIDADPYL

SEQ ID NO: 93592 - protein, 9 aa, Homo Sapiens
SQCPHIVRI

SEQ ID NO: 93593 - protein, 9 aa, Homo Sapiens
SQDPGTHVV

SEQ ID NO: 93594 - protein, 9 aa, Homo Sapiens
SQDPPEKSI

SEQ ID NO: 93595 - protein, 9 aa, Homo Sapiens
SQDTGKYCF

SEQ ID NO: 93596 - protein, 9 aa, Homo Sapiens
SQIADVARF

SEQ ID NO: 93597 - protein, 9 aa, Homo Sapiens
SQYPFPVTL

SEQ ID NO: 93598 - protein, 9 aa, Homo Sapiens
SRDPGHFLI

SEQ ID NO: 93599 - protein, 9 aa, Homo Sapiens
SRDPVQLNL

SEQ ID NO: 93600 - protein, 9 aa, Homo Sapiens
SRDRLIHVL

SEQ ID NO: 93601 - protein, 9 aa, Homo Sapiens
SREPSQVIF

SEQ ID NO: 93602 - protein, 9 aa, Homo Sapiens
SRFEKEFSF

SEQ ID NO: 93603 - protein, 9 aa, Homo Sapiens
SRFLANEVL

SEQ ID NO: 93604 - protein, 9 aa, Homo Sapiens
SYLDKVQAL

SEQ ID NO: 93605 - protein, 9 aa, Homo Sapiens
TEDGNILQL

SEQ ID NO: 93606 - protein, 9 aa, Homo Sapiens
TEIEDSHTL

SEQ ID NO: 93607 - protein, 9 aa, Homo Sapiens
THAAPCMLF

SEQ ID NO: 93608 - protein, 9 aa, Homo Sapiens
THAAQQILL

SEQ ID NO: 93609 - protein, 9 aa, Homo Sapiens
THAAQQLKL

SEQ ID NO: 93610 - protein, 9 aa, Homo Sapiens
THADYVLEM

SEQ ID NO: 93611 - protein, 9 aa, Homo Sapiens
THAEHIETI

SEQ ID NO: 93612 - protein, 9 aa, Homo Sapiens
THAEVHQSL

SEQ ID NO: 93613 - protein, 9 aa, Homo Sapiens
THAGVRLYF

SEQ ID NO: 93614 - protein, 9 aa, Homo Sapiens
THALEYVLF

SEQ ID NO: 93615 - protein, 9 aa, Homo Sapiens
THALLGDSL

SEQ ID NO: 93616 - protein, 9 aa, Homo Sapiens
THALLSVLL

SEQ ID NO: 93617 - protein, 9 aa, Homo Sapiens
THALPIPVI

SEQ ID NO: 93618 - protein, 9 aa, Homo Sapiens
THANYKVTL

SEQ ID NO: 93619 - protein, 9 aa, Homo Sapiens
THASQIELL

SEQ ID NO: 93620 - protein, 9 aa, Homo Sapiens
THAVVFAKL

SEQ ID NO: 93621 - protein, 9 aa, Homo Sapiens
THAVVIKKL

SEQ ID NO: 93622 - protein, 9 aa, Homo Sapiens
THCEIHPSM

SEQ ID NO: 93623 - protein, 9 aa, Homo Sapiens
THCLWTDQL

SEQ ID NO: 93624 - protein, 9 aa, Homo Sapiens
THCPDTPLL

SEQ ID NO: 93625 - protein, 9 aa, Homo Sapiens
THDAPATTF

SEQ ID NO: 93626 - protein, 9 aa, Homo Sapiens
THDAPIRCV

SEQ ID NO: 93627 - protein, 9 aa, Homo Sapiens
THDDVQQSF

SEQ ID NO: 93628 - protein, 9 aa, Homo Sapiens
THDEDFVEL

SEQ ID NO: 93629 - protein, 9 aa, Homo Sapiens
THDEGFYWW

SEQ ID NO: 93630 - protein, 9 aa, Homo Sapiens
THDELIQLV

SEQ ID NO: 93631 - protein, 9 aa, Homo Sapiens
THDFSDSSL

SEQ ID NO: 93632 - protein, 9 aa, Homo Sapiens
THDGGFLSL

SEQ ID NO: 93633 - protein, 9 aa, Homo Sapiens
THDGSILIV

SEQ ID NO: 93634 - protein, 9 aa, Homo Sapiens
THDGSVYFW

SEQ ID NO: 93635 - protein, 9 aa, Homo Sapiens
THDIHALIL

SEQ ID NO: 93636 - protein, 9 aa, Homo Sapiens
THDIPIKVI

SEQ ID NO: 93637 - protein, 9 aa, Homo Sapiens
THDITTISI

SEQ ID NO: 93638 - protein, 9 aa, Homo Sapiens
THDLEGPPL

SEQ ID NO: 93639 - protein, 9 aa, Homo Sapiens
THDLKTLSL

SEQ ID NO: 93640 - protein, 9 aa, Homo Sapiens
THDLLDICL

SEQ ID NO: 93641 - protein, 9 aa, Homo Sapiens
THDLVGPEL

SEQ ID NO: 93642 - protein, 9 aa, Homo Sapiens
THDPLHQEV

SEQ ID NO: 93643 - protein, 9 aa, Homo Sapiens
THDPNKEAL

SEQ ID NO: 93644 - protein, 9 aa, Homo Sapiens
THDPNKETF

SEQ ID NO: 93645 - protein, 9 aa, Homo Sapiens
THDPNKMAF

SEQ ID NO: 93646 - protein, 9 aa, Homo Sapiens
THDQAVQAL

SEQ ID NO: 93647 - protein, 9 aa, Homo Sapiens
THDQMIDLL

SEQ ID NO: 93648 - protein, 9 aa, Homo Sapiens
THDSGLITI

SEQ ID NO: 93649 - protein, 9 aa, Homo Sapiens
THDSNTDMF

SEQ ID NO: 93650 - protein, 9 aa, Homo Sapiens
THDSRAVKF

SEQ ID NO: 93651 - protein, 9 aa, Homo Sapiens
THDTFQNEL

SEQ ID NO: 93652 - protein, 9 aa, Homo Sapiens
THDTKIELL

SEQ ID NO: 93653 - protein, 9 aa, Homo Sapiens
THEAYVTVL

SEQ ID NO: 93654 - protein, 9 aa, Homo Sapiens
THEDDKYRL

SEQ ID NO: 93655 - protein, 9 aa, Homo Sapiens
THEDGVLEL

SEQ ID NO: 93656 - protein, 9 aa, Homo Sapiens
THEDIEAQI

SEQ ID NO: 93657 - protein, 9 aa, Homo Sapiens
THEDSKILL

SEQ ID NO: 93658 - protein, 9 aa, Homo Sapiens
THEEMPQSI

SEQ ID NO: 93659 - protein, 9 aa, Homo Sapiens
THEGFNVTL

SEQ ID NO: 93660 - protein, 9 aa, Homo Sapiens
THEGNKTFI

SEQ ID NO: 93661 - protein, 9 aa, Homo Sapiens
THEITVLII

SEQ ID NO: 93662 - protein, 9 aa, Homo Sapiens
THENENYLL

SEQ ID NO: 93663 - protein, 9 aa, Homo Sapiens
THEPNFTII

SEQ ID NO: 93664 - protein, 9 aa, Homo Sapiens
THEQAILRL

SEQ ID NO: 93665 - protein, 9 aa, Homo Sapiens
THEYHAETI

SEQ ID NO: 93666 - protein, 9 aa, Homo Sapiens
THFDTQNNI

SEQ ID NO: 93667 - protein, 9 aa, Homo Sapiens
THFLQPIYL

SEQ ID NO: 93668 - protein, 9 aa, Homo Sapiens
THFPDETEI

SEQ ID NO: 93669 - protein, 9 aa, Homo Sapiens
THFQLAYRL

SEQ ID NO: 93670 - protein, 9 aa, Homo Sapiens
THFSFPLRL

SEQ ID NO: 93671 - protein, 9 aa, Homo Sapiens
THGEAVQLL

SEQ ID NO: 93672 - protein, 9 aa, Homo Sapiens
THGLVINII

SEQ ID NO: 93673 - protein, 9 aa, Homo Sapiens
THGPENPKL

SEQ ID NO: 93674 - protein, 9 aa, Homo Sapiens
THGQFYDLL

SEQ ID NO: 93675 - protein, 9 aa, Homo Sapiens
THGVVHVTI

SEQ ID NO: 93676 - protein, 9 aa, Homo Sapiens
THHLFVIFF

SEQ ID NO: 93677 - protein, 9 aa, Homo Sapiens
THHNDTELI

SEQ ID NO: 93678 - protein, 9 aa, Homo Sapiens
THIAEATGW

SEQ ID NO: 93679 - protein, 9 aa, Homo Sapiens
THIDINSKI

SEQ ID NO: 93680 - protein, 9 aa, Homo Sapiens
THIEAQNKI

SEQ ID NO: 93681 - protein, 9 aa, Homo Sapiens
THILTPQKL

SEQ ID NO: 93682 - protein, 9 aa, Homo Sapiens
THINGESVL

SEQ ID NO: 93683 - protein, 9 aa, Homo Sapiens
THIRDFLQV

SEQ ID NO: 93684 - protein, 9 aa, Homo Sapiens
THISPNAIF

SEQ ID NO: 93685 - protein, 9 aa, Homo Sapiens
THIVSTSNF

SEQ ID NO: 93686 - protein, 9 aa, Homo Sapiens
THIYDARRL

SEQ ID NO: 93687 - protein, 9 aa, Homo Sapiens
THLAEFHQI

SEQ ID NO: 93688 - protein, 9 aa, Homo Sapiens
THLDSVTKI

SEQ ID NO: 93689 - protein, 9 aa, Homo Sapiens
THLEAQNRI

SEQ ID NO: 93690 - protein, 9 aa, Homo Sapiens
THLEHQQRI

SEQ ID NO: 93691 - protein, 9 aa, Homo Sapiens
THLEPAPYI

SEQ ID NO: 93692 - protein, 9 aa, Homo Sapiens
THLESLVEL

SEQ ID NO: 93693 - protein, 9 aa, Homo Sapiens
THLEYFSLW

SEQ ID NO: 93694 - protein, 9 aa, Homo Sapiens
THLPQTLTI

SEQ ID NO: 93695 - protein, 9 aa, Homo Sapiens
THLSAGELL

SEQ ID NO: 93696 - protein, 9 aa, Homo Sapiens
THLTIGNRL

SEQ ID NO: 93697 - protein, 9 aa, Homo Sapiens
THLWLNEGF

SEQ ID NO: 93698 - protein, 9 aa, Homo Sapiens
THMAPEVVL

SEQ ID NO: 93699 - protein, 9 aa, Homo Sapiens
THMELYSQL

SEQ ID NO: 93700 - protein, 9 aa, Homo Sapiens
THMEPEHRL

SEQ ID NO: 93701 - protein, 9 aa, Homo Sapiens
THMNSSEKL

SEQ ID NO: 93702 - protein, 9 aa, Homo Sapiens
THMTAIVGM

SEQ ID NO: 93703 - protein, 9 aa, Homo Sapiens
THNEPGVRL

SEQ ID NO: 93704 - protein, 9 aa, Homo Sapiens
THNLMELLI

SEQ ID NO: 93705 - protein, 9 aa, Homo Sapiens
THNLSFDEI

SEQ ID NO: 93706 - protein, 9 aa, Homo Sapiens
THNPTNATL

SEQ ID NO: 93707 - protein, 9 aa, Homo Sapiens
THQAAHIQL

SEQ ID NO: 93708 - protein, 9 aa, Homo Sapiens
THQENGIEI

SEQ ID NO: 93709 - protein, 9 aa, Homo Sapiens
THQHQVELI

SEQ ID NO: 93710 - protein, 9 aa, Homo Sapiens
THQKGKVVF

SEQ ID NO: 93711 - protein, 9 aa, Homo Sapiens
THQPVYHKI

SEQ ID NO: 93712 - protein, 9 aa, Homo Sapiens
THQQETQSI

SEQ ID NO: 93713 - protein, 9 aa, Homo Sapiens
THQQGQPAL

SEQ ID NO: 93714 - protein, 9 aa, Homo Sapiens
THQQVVSRI

SEQ ID NO: 93715 - protein, 9 aa, Homo Sapiens
THSDDVTQV

SEQ ID NO: 93716 - protein, 9 aa, Homo Sapiens
THSDIQVKL

SEQ ID NO: 93717 - protein, 9 aa, Homo Sapiens
THSDSALKI

SEQ ID NO: 93718 - protein, 9 aa, Homo Sapiens
THSEPLSTI

SEQ ID NO: 93719 - protein, 9 aa, Homo Sapiens
THSLETQEL

SEQ ID NO: 93720 - protein, 9 aa, Homo Sapiens
THSLPISQW

SEQ ID NO: 93721 - protein, 9 aa, Homo Sapiens
THSLPLLLF

SEQ ID NO: 93722 - protein, 9 aa, Homo Sapiens
THSLPVVVI

SEQ ID NO: 93723 - protein, 9 aa, Homo Sapiens
THSLTTPVV

SEQ ID NO: 93724 - protein, 9 aa, Homo Sapiens
THSMDLVAL

SEQ ID NO: 93725 - protein, 9 aa, Homo Sapiens
THSNLHTSI

SEQ ID NO: 93726 - protein, 9 aa, Homo Sapiens
THSNMANAL

SEQ ID NO: 93727 - protein, 9 aa, Homo Sapiens
THSPFCWHL

SEQ ID NO: 93728 - protein, 9 aa, Homo Sapiens
THSPKEVMF

SEQ ID NO: 93729 - protein, 9 aa, Homo Sapiens
THSPSNAQF

SEQ ID NO: 93730 - protein, 9 aa, Homo Sapiens
THSPSSSSI

SEQ ID NO: 93731 - protein, 9 aa, Homo Sapiens
THSPYVAQI

SEQ ID NO: 93732 - protein, 9 aa, Homo Sapiens
THSQELCKL

SEQ ID NO: 93733 - protein, 9 aa, Homo Sapiens
THSSPSFNL

SEQ ID NO: 93734 - protein, 9 aa, Homo Sapiens
THSTTSQAI

SEQ ID NO: 93735 - protein, 9 aa, Homo Sapiens
THTDAVNLL

SEQ ID NO: 93736 - protein, 9 aa, Homo Sapiens
THTLDISQL

SEQ ID NO: 93737 - protein, 9 aa, Homo Sapiens
THTNEFITW

SEQ ID NO: 93738 - protein, 9 aa, Homo Sapiens
THTQPGVQL

SEQ ID NO: 93739 - protein, 9 aa, Homo Sapiens
THTTVIHQL

SEQ ID NO: 93740 - protein, 9 aa, Homo Sapiens
THVDPILLI

SEQ ID NO: 93741 - protein, 9 aa, Homo Sapiens
THVDSMDLI

SEQ ID NO: 93742 - protein, 9 aa, Homo Sapiens
THVETLLTF

SEQ ID NO: 93743 - protein, 9 aa, Homo Sapiens
THVFVIAEL

SEQ ID NO: 93744 - protein, 9 aa, Homo Sapiens
THVGADTTL

SEQ ID NO: 93745 - protein, 9 aa, Homo Sapiens
THVGKVNIF

SEQ ID NO: 93746 - protein, 9 aa, Homo Sapiens
THVGPTPAI

SEQ ID NO: 93747 - protein, 9 aa, Homo Sapiens
THVIENIYL

SEQ ID NO: 93748 - protein, 9 aa, Homo Sapiens
THVKELWTW

SEQ ID NO: 93749 - protein, 9 aa, Homo Sapiens
THVNDGTEF

SEQ ID NO: 93750 - protein, 9 aa, Homo Sapiens
THVPSTEEI

SEQ ID NO: 93751 - protein, 9 aa, Homo Sapiens
THVRDWVMW

SEQ ID NO: 93752 - protein, 9 aa, Homo Sapiens
THVSNGCQL

SEQ ID NO: 93753 - protein, 9 aa, Homo Sapiens
THVTEIISF

SEQ ID NO: 93754 - protein, 9 aa, Homo Sapiens
THYGKVYLL

SEQ ID NO: 93755 - protein, 9 aa, Homo Sapiens
TKIEIGDTI

SEQ ID NO: 93756 - protein, 9 aa, Homo Sapiens
TLCDLYETL

SEQ ID NO: 93757 - protein, 9 aa, Homo Sapiens
TLDPAEYNI

SEQ ID NO: 93758 - protein, 9 aa, Homo Sapiens
TLTELGDEL

SEQ ID NO: 93759 - protein, 9 aa, Homo Sapiens
TQALEKYNI

SEQ ID NO: 93760 - protein, 9 aa, Homo Sapiens
TQAMEKYNI

SEQ ID NO: 93761 - protein, 9 aa, Homo Sapiens
TQCADAHLF

SEQ ID NO: 93762 - protein, 9 aa, Homo Sapiens
TQDAVPLTL

SEQ ID NO: 93763 - protein, 9 aa, Homo Sapiens
TQDDFHLKI

SEQ ID NO: 93764 - protein, 9 aa, Homo Sapiens
TQDECILHF

SEQ ID NO: 93765 - protein, 9 aa, Homo Sapiens
TQDGIKLMF

SEQ ID NO: 93766 - protein, 9 aa, Homo Sapiens
TQDGLLFTF

SEQ ID NO: 93767 - protein, 9 aa, Homo Sapiens
TQDGNIYQL

SEQ ID NO: 93768 - protein, 9 aa, Homo Sapiens
TQDNGILTF

SEQ ID NO: 93769 - protein, 9 aa, Homo Sapiens
TQDPTVTRL

SEQ ID NO: 93770 - protein, 9 aa, Homo Sapiens
TQESTFQEL

SEQ ID NO: 93771 - protein, 9 aa, Homo Sapiens
TQGPIEVYL

SEQ ID NO: 93772 - protein, 9 aa, Homo Sapiens
TQGPSERTL

SEQ ID NO: 93773 - protein, 9 aa, Homo Sapiens
TQMDVKLVF

SEQ ID NO: 93774 - protein, 9 aa, Homo Sapiens
TQMPDPKTF

SEQ ID NO: 93775 - protein, 9 aa, Homo Sapiens
TQNLDVHFW

SEQ ID NO: 93776 - protein, 9 aa, Homo Sapiens
TQSEVDPHL

SEQ ID NO: 93777 - protein, 9 aa, Homo Sapiens
TQTAVITRI

SEQ ID NO: 93778 - protein, 9 aa, Homo Sapiens
TQTTHELTI

SEQ ID NO: 93779 - protein, 9 aa, Homo Sapiens
TQVGPGPQI

SEQ ID NO: 93780 - protein, 9 aa, Homo Sapiens
TQVLIGNNI

SEQ ID NO: 93781 - protein, 9 aa, Homo Sapiens
TRCIAILYI

SEQ ID NO: 93782 - protein, 9 aa, Homo Sapiens
TRCQFQTKF

SEQ ID NO: 93783 - protein, 9 aa, Homo Sapiens
TRDALHLGF

SEQ ID NO: 93784 - protein, 9 aa, Homo Sapiens
TRDELEWKL

SEQ ID NO: 93785 - protein, 9 aa, Homo Sapiens
TRDELPYTF

SEQ ID NO: 93786 - protein, 9 aa, Homo Sapiens
TRDPLVIEL

SEQ ID NO: 93787 - protein, 9 aa, Homo Sapiens
TRDSNIIRL

SEQ ID NO: 93788 - protein, 9 aa, Homo Sapiens
TRDSVKTVL

SEQ ID NO: 93789 - protein, 9 aa, Homo Sapiens
TREEGAQTL

SEQ ID NO: 93790 - protein, 9 aa, Homo Sapiens
TREEGKALL

SEQ ID NO: 93791 - protein, 9 aa, Homo Sapiens
TRLAIQEAL

SEQ ID NO: 93792 - protein, 9 aa, Homo Sapiens
TRLDQDESF

SEQ ID NO: 93793 - protein, 9 aa, Homo Sapiens
TRLEFQQQL

SEQ ID NO: 93794 - protein, 9 aa, Homo Sapiens
TRLLMKERF

SEQ ID NO: 93795 - protein, 9 aa, Homo Sapiens
TRSAIILHL

SEQ ID NO: 93796 - protein, 9 aa, Homo Sapiens
VHAFLIHTL

SEQ ID NO: 93797 - protein, 9 aa, Homo Sapiens
VHAFPELFL

SEQ ID NO: 93798 - protein, 9 aa, Homo Sapiens
VHAVIGDEL

SEQ ID NO: 93799 - protein, 9 aa, Homo Sapiens
VHAYIISYL

SEQ ID NO: 93800 - protein, 9 aa, Homo Sapiens
VHDALVQII

SEQ ID NO: 93801 - protein, 9 aa, Homo Sapiens
VHDDVDIIL

SEQ ID NO: 93802 - protein, 9 aa, Homo Sapiens
VHDEGVWAL

SEQ ID NO: 93803 - protein, 9 aa, Homo Sapiens
VHDETCQVI

SEQ ID NO: 93804 - protein, 9 aa, Homo Sapiens
VHDGCVNTI

SEQ ID NO: 93805 - protein, 9 aa, Homo Sapiens
VHDKTPTHF

SEQ ID NO: 93806 - protein, 9 aa, Homo Sapiens
VHDLPAAVL

SEQ ID NO: 93807 - protein, 9 aa, Homo Sapiens
VHDNKVLRI

SEQ ID NO: 93808 - protein, 9 aa, Homo Sapiens
VHDNLAMKI

SEQ ID NO: 93809 - protein, 9 aa, Homo Sapiens
VHDSFQQLI

SEQ ID NO: 93810 - protein, 9 aa, Homo Sapiens
VHDSIDYRF

SEQ ID NO: 93811 - protein, 9 aa, Homo Sapiens
VHFIKPLLL

SEQ ID NO: 93812 - protein, 9 aa, Homo Sapiens
VHFLQLELI

SEQ ID NO: 93813 - protein, 9 aa, Homo Sapiens
VHHLDNNEF

SEQ ID NO: 93814 - protein, 9 aa, Homo Sapiens
VHIADVSYF

SEQ ID NO: 93815 - protein, 9 aa, Homo Sapiens
VHIADVTHF

SEQ ID NO: 93816 - protein, 9 aa, Homo Sapiens
VHIDLPLFF

SEQ ID NO: 93817 - protein, 9 aa, Homo Sapiens
VHIEVGNRV

SEQ ID NO: 93818 - protein, 9 aa, Homo Sapiens
VHIIEKDKI

SEQ ID NO: 93819 - protein, 9 aa, Homo Sapiens
VHILDTESF

SEQ ID NO: 93820 - protein, 9 aa, Homo Sapiens
VHILDTETF

SEQ ID NO: 93821 - protein, 9 aa, Homo Sapiens
VHINAGPEI

SEQ ID NO: 93822 - protein, 9 aa, Homo Sapiens
VHIPEVYLI

SEQ ID NO: 93823 - protein, 9 aa, Homo Sapiens
VHMDVVELL

SEQ ID NO: 93824 - protein, 9 aa, Homo Sapiens
VHNEGMQVL

SEQ ID NO: 93825 - protein, 9 aa, Homo Sapiens
VHNLLLTYL

SEQ ID NO: 93826 - protein, 9 aa, Homo Sapiens
VHTIVNETL

SEQ ID NO: 93827 - protein, 9 aa, Homo Sapiens
VHTQLEPLL

SEQ ID NO: 93828 - protein, 9 aa, Homo Sapiens
VHVDQELLI

SEQ ID NO: 93829 - protein, 9 aa, Homo Sapiens
VHVPEGQTI

SEQ ID NO: 93830 - protein, 9 aa, Homo Sapiens
VHYGGVQNL

SEQ ID NO: 93831 - protein, 9 aa, Homo Sapiens
WHAGKVWLI

SEQ ID NO: 93832 - protein, 9 aa, Homo Sapiens
WHDGKQVHL

SEQ ID NO: 93833 - protein, 9 aa, Homo Sapiens
WHDMEVYSF

SEQ ID NO: 93834 - protein, 9 aa, Homo Sapiens
WHEDITQDL

SEQ ID NO: 93835 - protein, 9 aa, Homo Sapiens
WQEGSVTRL

SEQ ID NO: 93836 - protein, 9 aa, Homo Sapiens
YHADIYDKV

SEQ ID NO: 93837 - protein, 9 aa, Homo Sapiens
YHAGFNHGF

SEQ ID NO: 93838 - protein, 9 aa, Homo Sapiens
YHAKDPNNL

SEQ ID NO: 93839 - protein, 9 aa, Homo Sapiens
YHALCNEEF

SEQ ID NO: 93840 - protein, 9 aa, Homo Sapiens
YHALDSDHL

SEQ ID NO: 93841 - protein, 9 aa, Homo Sapiens
YHALPATVW

SEQ ID NO: 93842 - protein, 9 aa, Homo Sapiens
YHARVYEFL

SEQ ID NO: 93843 - protein, 9 aa, Homo Sapiens
YHATTETVI

SEQ ID NO: 93844 - protein, 9 aa, Homo Sapiens
YHCALILNL

SEQ ID NO: 93845 - protein, 9 aa, Homo Sapiens
YHDDKQPAF

SEQ ID NO: 93846 - protein, 9 aa, Homo Sapiens
YHDEGWVAI

SEQ ID NO: 93847 - protein, 9 aa, Homo Sapiens
YHDFSVQNF

SEQ ID NO: 93848 - protein, 9 aa, Homo Sapiens
YHDIAQQAF

SEQ ID NO: 93849 - protein, 9 aa, Homo Sapiens
YHDINVYSL

SEQ ID NO: 93850 - protein, 9 aa, Homo Sapiens
YHDIVVTFL

SEQ ID NO: 93851 - protein, 9 aa, Homo Sapiens
YHDKNIVLL

SEQ ID NO: 93852 - protein, 9 aa, Homo Sapiens
YHDLECQLI

SEQ ID NO: 93853 - protein, 9 aa, Homo Sapiens
YHDMGNINL

SEQ ID NO: 93854 - protein, 9 aa, Homo Sapiens
YHDPEMDFF

SEQ ID NO: 93855 - protein, 9 aa, Homo Sapiens
YHDRTNLKV

SEQ ID NO: 93856 - protein, 9 aa, Homo Sapiens
YHDVMLENL

SEQ ID NO: 93857 - protein, 9 aa, Homo Sapiens
YHDYGHLEL

SEQ ID NO: 93858 - protein, 9 aa, Homo Sapiens
YHEDIHTYL

SEQ ID NO: 93859 - protein, 9 aa, Homo Sapiens
YHEEKERLM

SEQ ID NO: 93860 - protein, 9 aa, Homo Sapiens
YHEGLSDHI

SEQ ID NO: 93861 - protein, 9 aa, Homo Sapiens
YHEHQANLL

SEQ ID NO: 93862 - protein, 9 aa, Homo Sapiens
YHEKGRAFL

SEQ ID NO: 93863 - protein, 9 aa, Homo Sapiens
YHESGHAII

SEQ ID NO: 93864 - protein, 9 aa, Homo Sapiens
YHFEEVQKL

SEQ ID NO: 93865 - protein, 9 aa, Homo Sapiens
YHFMPEHRL

SEQ ID NO: 93866 - protein, 9 aa, Homo Sapiens
YHFPDQQEL

SEQ ID NO: 93867 - protein, 9 aa, Homo Sapiens
YHFPELVKI

SEQ ID NO: 93868 - protein, 9 aa, Homo Sapiens
YHGAEIVSL

SEQ ID NO: 93869 - protein, 9 aa, Homo Sapiens
YHGATPLHL

SEQ ID NO: 93870 - protein, 9 aa, Homo Sapiens
YHGDAGDSL

SEQ ID NO: 93871 - protein, 9 aa, Homo Sapiens
YHGDLNETF

SEQ ID NO: 93872 - protein, 9 aa, Homo Sapiens
YHGDSDLQL

SEQ ID NO: 93873 - protein, 9 aa, Homo Sapiens
YHGGDDALL

SEQ ID NO: 93874 - protein, 9 aa, Homo Sapiens
YHGLTVPLI

SEQ ID NO: 93875 - protein, 9 aa, Homo Sapiens
YHGNTNPEL

SEQ ID NO: 93876 - protein, 9 aa, Homo Sapiens
YHHCVINKL

SEQ ID NO: 93877 - protein, 9 aa, Homo Sapiens
YHIAVDEKL

SEQ ID NO: 93878 - protein, 9 aa, Homo Sapiens
YHIDLDPHF

SEQ ID NO: 93879 - protein, 9 aa, Homo Sapiens
YHILNDPEL

SEQ ID NO: 93880 - protein, 9 aa, Homo Sapiens
YHIQQNEAL

SEQ ID NO: 93881 - protein, 9 aa, Homo Sapiens
YHISLEHEI

SEQ ID NO: 93882 - protein, 9 aa, Homo Sapiens
YHISLVDLL

SEQ ID NO: 93883 - protein, 9 aa, Homo Sapiens
YHISMDDRF

SEQ ID NO: 93884 - protein, 9 aa, Homo Sapiens
YHITDIPII

SEQ ID NO: 93885 - protein, 9 aa, Homo Sapiens
YHITDQVHL

SEQ ID NO: 93886 - protein, 9 aa, Homo Sapiens
YHITDVPCI

SEQ ID NO: 93887 - protein, 9 aa, Homo Sapiens
YHITGAISF

SEQ ID NO: 93888 - protein, 9 aa, Homo Sapiens
YHLLAEEKL

SEQ ID NO: 93889 - protein, 9 aa, Homo Sapiens
YHLQDATSW

SEQ ID NO: 93890 - protein, 9 aa, Homo Sapiens
YHLQLFEEL

SEQ ID NO: 93891 - protein, 9 aa, Homo Sapiens
YHLQSAELL

SEQ ID NO: 93892 - protein, 9 aa, Homo Sapiens
YHNLHPDYI

SEQ ID NO: 93893 - protein, 9 aa, Homo Sapiens
YHNQSQGLL

SEQ ID NO: 93894 - protein, 9 aa, Homo Sapiens
YHQDKEAAI

SEQ ID NO: 93895 - protein, 9 aa, Homo Sapiens
YHQEASKRI

SEQ ID NO: 93896 - protein, 9 aa, Homo Sapiens
YHQEEIDVW

SEQ ID NO: 93897 - protein, 9 aa, Homo Sapiens
YHQHFDPVI

SEQ ID NO: 93898 - protein, 9 aa, Homo Sapiens
YHQHLQEQL

SEQ ID NO: 93899 - protein, 9 aa, Homo Sapiens
YHQNVESHL

SEQ ID NO: 93900 - protein, 9 aa, Homo Sapiens
YHQPDLPEI

SEQ ID NO: 93901 - protein, 9 aa, Homo Sapiens
YHSDDYIKF

SEQ ID NO: 93902 - protein, 9 aa, Homo Sapiens
YHSDEYIKF

SEQ ID NO: 93903 - protein, 9 aa, Homo Sapiens
YHSEGHRGL

SEQ ID NO: 93904 - protein, 9 aa, Homo Sapiens
YHSEVPVSL

SEQ ID NO: 93905 - protein, 9 aa, Homo Sapiens
YHSEYFLAL

SEQ ID NO: 93906 - protein, 9 aa, Homo Sapiens
YHSFSEQSF

SEQ ID NO: 93907 - protein, 9 aa, Homo Sapiens
YHSFVSSVF

SEQ ID NO: 93908 - protein, 9 aa, Homo Sapiens
YHSGYVHKF

SEQ ID NO: 93909 - protein, 9 aa, Homo Sapiens
YHSIEEDKW

SEQ ID NO: 93910 - protein, 9 aa, Homo Sapiens
YHSNQVVRM

SEQ ID NO: 93911 - protein, 9 aa, Homo Sapiens
YHSNSGAQL

SEQ ID NO: 93912 - protein, 9 aa, Homo Sapiens
YHSPADRVM

SEQ ID NO: 93913 - protein, 9 aa, Homo Sapiens
YHSQDRYEF

SEQ ID NO: 93914 - protein, 9 aa, Homo Sapiens
YHSTPDRLF

SEQ ID NO: 93915 - protein, 9 aa, Homo Sapiens
YHSVGDSVL

SEQ ID NO: 93916 - protein, 9 aa, Homo Sapiens
YHTDCNVLL

SEQ ID NO: 93917 - protein, 9 aa, Homo Sapiens
YHTDTTVKF

SEQ ID NO: 93918 - protein, 9 aa, Homo Sapiens
YHTNAEVKL

SEQ ID NO: 93919 - protein, 9 aa, Homo Sapiens
YHTPNVVFI

SEQ ID NO: 93920 - protein, 9 aa, Homo Sapiens
YHTQTTPLI

SEQ ID NO: 93921 - protein, 9 aa, Homo Sapiens
YHTVAGNDI

SEQ ID NO: 93922 - protein, 9 aa, Homo Sapiens
YHVDSLLQL

SEQ ID NO: 93923 - protein, 9 aa, Homo Sapiens
YHVLQEELI

SEQ ID NO: 93924 - protein, 9 aa, Homo Sapiens
YHWADGTNI

SEQ ID NO: 93925 - protein, 9 aa, Homo Sapiens
YHWLEKEVI

SEQ ID NO: 93926 - protein, 9 aa, Homo Sapiens
YHYDPEQVI

SEQ ID NO: 93927 - protein, 9 aa, Homo Sapiens
YHYGFCDVI

SEQ ID NO: 93928 - protein, 9 aa, Homo Sapiens
YKADEDPAL

SEQ ID NO: 93929 - protein, 9 aa, Homo Sapiens
YKDKYSHLI

SEQ ID NO: 93930 - protein, 9 aa, Homo Sapiens
YNDEDIYLF

SEQ ID NO: 93931 - protein, 9 aa, Homo Sapiens
YNQKLQQQL

SEQ ID NO: 93932 - protein, 9 aa, Homo Sapiens
YPVDLGDKF

SEQ ID NO: 93933 - protein, 9 aa, Homo Sapiens
YPVEIHEYL

SEQ ID NO: 93934 - protein, 9 aa, Homo Sapiens
YQFGEIRTI

SEQ ID NO: 93935 - protein, 9 aa, Homo Sapiens
YQHKEEYQL

SEQ ID NO: 93936 - protein, 9 aa, Homo Sapiens
YQNPDYNFF

SEQ ID NO: 93937 - protein, 9 aa, Homo Sapiens
YQNQEIHNL

SEQ ID NO: 93938 - protein, 9 aa, Homo Sapiens
YQSPTGDRI

SEQ ID NO: 93939 - protein, 9 aa, Homo Sapiens
YRDTFSYNF

SEQ ID NO: 93940 - protein, 9 aa, Homo Sapiens
YRWQDEHKF

SEQ ID NO: 93941 - protein, 9 aa, Homo Sapiens
YVPPLAPHP

SEQ ID NO: 93942 - protein, 10 aa, Homo Sapiens
AHAASDTVGW

SEQ ID NO: 93943 - protein, 10 aa, Homo Sapiens
AHADHIGQGF

SEQ ID NO: 93944 - protein, 10 aa, Homo Sapiens
AHAQNQNYTL

SEQ ID NO: 93945 - protein, 10 aa, Homo Sapiens
AHASTTRLYL

SEQ ID NO: 93946 - protein, 10 aa, Homo Sapiens
AHDPQTTQEL

SEQ ID NO: 93947 - protein, 10 aa, Homo Sapiens
AHDRDNQTTL

SEQ ID NO: 93948 - protein, 10 aa, Homo Sapiens
AHFGIHEEML

SEQ ID NO: 93949 - protein, 10 aa, Homo Sapiens
AHIDGDHLTL

SEQ ID NO: 93950 - protein, 10 aa, Homo Sapiens
AHIDPDASYM

SEQ ID NO: 93951 - protein, 10 aa, Homo Sapiens
AHIDSGKTTL

SEQ ID NO: 93952 - protein, 10 aa, Homo Sapiens
AHIFCTTDQL

SEQ ID NO: 93953 - protein, 10 aa, Homo Sapiens
AHIGVIPHFF

SEQ ID NO: 93954 - protein, 10 aa, Homo Sapiens
AHIKEEHCIF

SEQ ID NO: 93955 - protein, 10 aa, Homo Sapiens
AHIQQLYDLL

SEQ ID NO: 93956 - protein, 10 aa, Homo Sapiens
AHLSIINEYL

SEQ ID NO: 93957 - protein, 10 aa, Homo Sapiens
AHMEFCYQEL

SEQ ID NO: 93958 - protein, 10 aa, Homo Sapiens
AHNSNWYITF

SEQ ID NO: 93959 - protein, 10 aa, Homo Sapiens
AHNTNDFVTL

SEQ ID NO: 93960 - protein, 10 aa, Homo Sapiens
AHQDDFNQLL

SEQ ID NO: 93961 - protein, 10 aa, Homo Sapiens
AHQNVVAETL

SEQ ID NO: 93962 - protein, 10 aa, Homo Sapiens
AHSVSGQQTL

SEQ ID NO: 93963 - protein, 10 aa, Homo Sapiens
AHVDLTGDGL

SEQ ID NO: 93964 - protein, 10 aa, Homo Sapiens
AHVICLAEEF

SEQ ID NO: 93965 - protein, 10 aa, Homo Sapiens
AHYDPATEEF

SEQ ID NO: 93966 - protein, 10 aa, Homo Sapiens
AKMLSIFTEF

SEQ ID NO: 93967 - protein, 10 aa, Homo Sapiens
AQAKAESITL

SEQ ID NO: 93968 - protein, 10 aa, Homo Sapiens
AQQSRCTLTI

SEQ ID NO: 93969 - protein, 10 aa, Homo Sapiens
CGHTACVKLL

SEQ ID NO: 93970 - protein, 10 aa, Homo Sapiens
CHDRNVVTIF

SEQ ID NO: 93971 - protein, 10 aa, Homo Sapiens
CHEGKVFISL

SEQ ID NO: 93972 - protein, 10 aa, Homo Sapiens
CHLFLPDEQF

SEQ ID NO: 93973 - protein, 10 aa, Homo Sapiens
CHNSKDTVTI

SEQ ID NO: 93974 - protein, 10 aa, Homo Sapiens
CHSDEYFRQL

SEQ ID NO: 93975 - protein, 10 aa, Homo Sapiens
CHSKLANILF

SEQ ID NO: 93976 - protein, 10 aa, Homo Sapiens
CHVYVRNDSL

SEQ ID NO: 93977 - protein, 10 aa, Homo Sapiens
DHAPAIGRYI

SEQ ID NO: 93978 - protein, 10 aa, Homo Sapiens
DHDPVDKIVL

SEQ ID NO: 93979 - protein, 10 aa, Homo Sapiens
DHDSVDKIVI

SEQ ID NO: 93980 - protein, 10 aa, Homo Sapiens
DHESVCKYYL

SEQ ID NO: 93981 - protein, 10 aa, Homo Sapiens
DHIKDSFHSL

SEQ ID NO: 93982 - protein, 10 aa, Homo Sapiens
DHINGATNYF

SEQ ID NO: 93983 - protein, 10 aa, Homo Sapiens
DHSFLTNDEL

SEQ ID NO: 93984 - protein, 10 aa, Homo Sapiens
DHSLPESDKI

SEQ ID NO: 93985 - protein, 10 aa, Homo Sapiens
DHSSTVLQRL

SEQ ID NO: 93986 - protein, 10 aa, Homo Sapiens
DHVEVNGEVF

SEQ ID NO: 93987 - protein, 10 aa, Homo Sapiens
DHYYGTGETF

SEQ ID NO: 93988 - protein, 10 aa, Homo Sapiens
EHAAPYFQQL

SEQ ID NO: 93989 - protein, 10 aa, Homo Sapiens
EHAGPQLTCI

SEQ ID NO: 93990 - protein, 10 aa, Homo Sapiens
EHAIEDKETI

SEQ ID NO: 93991 - protein, 10 aa, Homo Sapiens
EHANLTEVTF

SEQ ID NO: 93992 - protein, 10 aa, Homo Sapiens
EHAPISYEDF

SEQ ID NO: 93993 - protein, 10 aa, Homo Sapiens
EHAQKELQKL

SEQ ID NO: 93994 - protein, 10 aa, Homo Sapiens
EHCSINLMYL

SEQ ID NO: 93995 - protein, 10 aa, Homo Sapiens
EHDDTLPSQL

SEQ ID NO: 93996 - protein, 10 aa, Homo Sapiens
EHDEPILKHL

SEQ ID NO: 93997 - protein, 10 aa, Homo Sapiens
EHDPHVLLAV

SEQ ID NO: 93998 - protein, 10 aa, Homo Sapiens
EHDPQYAVIL

SEQ ID NO: 93999 - protein, 10 aa, Homo Sapiens
EHDPVKPRQL

SEQ ID NO: 94000 - protein, 10 aa, Homo Sapiens
EHDWPVHNNF

SEQ ID NO: 94001 - protein, 10 aa, Homo Sapiens
EHEDLLNITL

SEQ ID NO: 94002 - protein, 10 aa, Homo Sapiens
EHEGPALYYM

SEQ ID NO: 94003 - protein, 10 aa, Homo Sapiens
EHFDDTVVCL

SEQ ID NO: 94004 - protein, 10 aa, Homo Sapiens
EHFNGVAELL

SEQ ID NO: 94005 - protein, 10 aa, Homo Sapiens
EHIEALLDKF

SEQ ID NO: 94006 - protein, 10 aa, Homo Sapiens
EHIGIGLLSL

SEQ ID NO: 94007 - protein, 10 aa, Homo Sapiens
EHINEINAEL

SEQ ID NO: 94008 - protein, 10 aa, Homo Sapiens
EHIRVGWEQL

SEQ ID NO: 94009 - protein, 10 aa, Homo Sapiens
EHLDTQKELL

SEQ ID NO: 94010 - protein, 10 aa, Homo Sapiens
EHLRDTKSTF

SEQ ID NO: 94011 - protein, 10 aa, Homo Sapiens
EHMPVGPDAI

SEQ ID NO: 94012 - protein, 10 aa, Homo Sapiens
EHQPTTWVSF

SEQ ID NO: 94013 - protein, 10 aa, Homo Sapiens
EHQRKEKELL

SEQ ID NO: 94014 - protein, 10 aa, Homo Sapiens
EHSESTLNVM

SEQ ID NO: 94015 - protein, 10 aa, Homo Sapiens
EHSPFHEHVL

SEQ ID NO: 94016 - protein, 10 aa, Homo Sapiens
EHSPHNGSLF

SEQ ID NO: 94017 - protein, 10 aa, Homo Sapiens
EHSPLSEDRF

SEQ ID NO: 94018 - protein, 10 aa, Homo Sapiens
EHSQPLEELL

SEQ ID NO: 94019 - protein, 10 aa, Homo Sapiens
EHSSDSEYTL

SEQ ID NO: 94020 - protein, 10 aa, Homo Sapiens
EHSSRVVQEL

SEQ ID NO: 94021 - protein, 10 aa, Homo Sapiens
EHTDPHVQQI

SEQ ID NO: 94022 - protein, 10 aa, Homo Sapiens
EHVADVDTLL

SEQ ID NO: 94023 - protein, 10 aa, Homo Sapiens
EHVEAIKIGL

SEQ ID NO: 94024 - protein, 10 aa, Homo Sapiens
EHVQADHELF

SEQ ID NO: 94025 - protein, 10 aa, Homo Sapiens
EHVREMQEKL

SEQ ID NO: 94026 - protein, 10 aa, Homo Sapiens
EHVRGMQEKL

SEQ ID NO: 94027 - protein, 10 aa, Homo Sapiens
EHVSGPFVQF

SEQ ID NO: 94028 - protein, 10 aa, Homo Sapiens
EQNNDSQLKI

SEQ ID NO: 94029 - protein, 10 aa, Homo Sapiens
ERFFSDKETF

SEQ ID NO: 94030 - protein, 10 aa, Homo Sapiens
FFNFKVAQTL

SEQ ID NO: 94031 - protein, 10 aa, Homo Sapiens
FHAQLQLEQL

SEQ ID NO: 94032 - protein, 10 aa, Homo Sapiens
FHARPGLSTL

SEQ ID NO: 94033 - protein, 10 aa, Homo Sapiens
FHCDLNSDQF

SEQ ID NO: 94034 - protein, 10 aa, Homo Sapiens
FHDDSMKSFF

SEQ ID NO: 94035 - protein, 10 aa, Homo Sapiens
FHDESTQVQL

SEQ ID NO: 94036 - protein, 10 aa, Homo Sapiens
FHDKYGNAVL

SEQ ID NO: 94037 - protein, 10 aa, Homo Sapiens
FHDMGGVQLI

SEQ ID NO: 94038 - protein, 10 aa, Homo Sapiens
FHDPELSNHL

SEQ ID NO: 94039 - protein, 10 aa, Homo Sapiens
FHDSSDHHTF

SEQ ID NO: 94040 - protein, 10 aa, Homo Sapiens
FHDTSSPLLI

SEQ ID NO: 94041 - protein, 10 aa, Homo Sapiens
FHEEAGIFKL

SEQ ID NO: 94042 - protein, 10 aa, Homo Sapiens
FHEGTDVIML

SEQ ID NO: 94043 - protein, 10 aa, Homo Sapiens
FHEPSAFNDF

SEQ ID NO: 94044 - protein, 10 aa, Homo Sapiens
FHETSNINDF

SEQ ID NO: 94045 - protein, 10 aa, Homo Sapiens
FHEVGIGSVL

SEQ ID NO: 94046 - protein, 10 aa, Homo Sapiens
FHFNDSTVTL

SEQ ID NO: 94047 - protein, 10 aa, Homo Sapiens
FHFTSSTEVF

SEQ ID NO: 94048 - protein, 10 aa, Homo Sapiens
FHGNIIKVSF

SEQ ID NO: 94049 - protein, 10 aa, Homo Sapiens
FHGNSEVNAI

SEQ ID NO: 94050 - protein, 10 aa, Homo Sapiens
FHGPPEPVLL

SEQ ID NO: 94051 - protein, 10 aa, Homo Sapiens
FHGVSNLQEF

SEQ ID NO: 94052 - protein, 10 aa, Homo Sapiens
FHHEASGVTV

SEQ ID NO: 94053 - protein, 10 aa, Homo Sapiens
FHIAGDNNPL

SEQ ID NO: 94054 - protein, 10 aa, Homo Sapiens
FHKDPDVNML

SEQ ID NO: 94055 - protein, 10 aa, Homo Sapiens
FHLGKIEELL

SEQ ID NO: 94056 - protein, 10 aa, Homo Sapiens
FHMDPSGTFV

SEQ ID NO: 94057 - protein, 10 aa, Homo Sapiens
FHNQVEIEFL

SEQ ID NO: 94058 - protein, 10 aa, Homo Sapiens
FHQDSRAHLL

SEQ ID NO: 94059 - protein, 10 aa, Homo Sapiens
FHQEQGHQLL

SEQ ID NO: 94060 - protein, 10 aa, Homo Sapiens
FHSEDYIDFL

SEQ ID NO: 94061 - protein, 10 aa, Homo Sapiens
FHSEEQQLLL

SEQ ID NO: 94062 - protein, 10 aa, Homo Sapiens
FHSEIEDFLL

SEQ ID NO: 94063 - protein, 10 aa, Homo Sapiens
FHSGDDSQVL

SEQ ID NO: 94064 - protein, 10 aa, Homo Sapiens
FHSNDVATLL

SEQ ID NO: 94065 - protein, 10 aa, Homo Sapiens
FHSVAEEELL

SEQ ID NO: 94066 - protein, 10 aa, Homo Sapiens
FHTEALTALL

SEQ ID NO: 94067 - protein, 10 aa, Homo Sapiens
FHVEPGLQRL

SEQ ID NO: 94068 - protein, 10 aa, Homo Sapiens
FHVGAFGELW

SEQ ID NO: 94069 - protein, 10 aa, Homo Sapiens
FHVGAHVNTF

SEQ ID NO: 94070 - protein, 10 aa, Homo Sapiens
FHVIDDFVQF

SEQ ID NO: 94071 - protein, 10 aa, Homo Sapiens
FHYNGTDVSF

SEQ ID NO: 94072 - protein, 10 aa, Homo Sapiens
GAHHGPGVLG

SEQ ID NO: 94073 - protein, 10 aa, Homo Sapiens
GHDEYSTQSL

SEQ ID NO: 94074 - protein, 10 aa, Homo Sapiens
GHDKVLSILL

SEQ ID NO: 94075 - protein, 10 aa, Homo Sapiens
GHDPHLLYTL

SEQ ID NO: 94076 - protein, 10 aa, Homo Sapiens
GHDPKEPEQL

SEQ ID NO: 94077 - protein, 10 aa, Homo Sapiens
GHDPNLSLLL

SEQ ID NO: 94078 - protein, 10 aa, Homo Sapiens
GHDPRAQGTL

SEQ ID NO: 94079 - protein, 10 aa, Homo Sapiens
GHEELVSVLI

SEQ ID NO: 94080 - protein, 10 aa, Homo Sapiens
GHGPAETQTL

SEQ ID NO: 94081 - protein, 10 aa, Homo Sapiens
GHIFTVNDQF

SEQ ID NO: 94082 - protein, 10 aa, Homo Sapiens
GHIQESRVTI

SEQ ID NO: 94083 - protein, 10 aa, Homo Sapiens
GHMDSRLDEL

SEQ ID NO: 94084 - protein, 10 aa, Homo Sapiens
GHTHFGNDNF

SEQ ID NO: 94085 - protein, 10 aa, Homo Sapiens
GHVEDDYILF

SEQ ID NO: 94086 - protein, 10 aa, Homo Sapiens
GHYEVTELLL

SEQ ID NO: 94087 - protein, 10 aa, Homo Sapiens
HDADRIHNEL

SEQ ID NO: 94088 - protein, 10 aa, Homo Sapiens
HDGLTVHLVI

SEQ ID NO: 94089 - protein, 10 aa, Homo Sapiens
HEDVSLQYFI

SEQ ID NO: 94090 - protein, 10 aa, Homo Sapiens
HEDVVNSVVF

SEQ ID NO: 94091 - protein, 10 aa, Homo Sapiens
HENVVNLIEI

SEQ ID NO: 94092 - protein, 10 aa, Homo Sapiens
HHAAAPAVSL

SEQ ID NO: 94093 - protein, 10 aa, Homo Sapiens
HHADDSFLVL

SEQ ID NO: 94094 - protein, 10 aa, Homo Sapiens
HHAEPLAAVL

SEQ ID NO: 94095 - protein, 10 aa, Homo Sapiens
HHAEYLTELL

SEQ ID NO: 94096 - protein, 10 aa, Homo Sapiens
HHAQAHKALF

SEQ ID NO: 94097 - protein, 10 aa, Homo Sapiens
HHAQDYGGLL

SEQ ID NO: 94098 - protein, 10 aa, Homo Sapiens
HHATHLSNTL

SEQ ID NO: 94099 - protein, 10 aa, Homo Sapiens
HHCEHLLERL

SEQ ID NO: 94100 - protein, 10 aa, Homo Sapiens
HHCNSFLEEL

SEQ ID NO: 94101 - protein, 10 aa, Homo Sapiens
HHCPDVPILL

SEQ ID NO: 94102 - protein, 10 aa, Homo Sapiens
HHCPHTPILL

SEQ ID NO: 94103 - protein, 10 aa, Homo Sapiens
HHDFHHMNFI

SEQ ID NO: 94104 - protein, 10 aa, Homo Sapiens
HHDHHDEFCL

SEQ ID NO: 94105 - protein, 10 aa, Homo Sapiens
HHDMVMDLAF

SEQ ID NO: 94106 - protein, 10 aa, Homo Sapiens
HHDNTYTVKY

SEQ ID NO: 94107 - protein, 10 aa, Homo Sapiens
HHDSHSSVIL

SEQ ID NO: 94108 - protein, 10 aa, Homo Sapiens
HHDSPALEVF

SEQ ID NO: 94109 - protein, 10 aa, Homo Sapiens
HHDYIDSPSL

SEQ ID NO: 94110 - protein, 10 aa, Homo Sapiens
HHDYSTYTFL

SEQ ID NO: 94111 - protein, 10 aa, Homo Sapiens
HHEAITCLEW

SEQ ID NO: 94112 - protein, 10 aa, Homo Sapiens
HHEEDFFLYI

SEQ ID NO: 94113 - protein, 10 aa, Homo Sapiens
HHEGYVHADL

SEQ ID NO: 94114 - protein, 10 aa, Homo Sapiens
HHELHAAHLL

SEQ ID NO: 94115 - protein, 10 aa, Homo Sapiens
HHELVYEAII

SEQ ID NO: 94116 - protein, 10 aa, Homo Sapiens
HHEPGVADRL

SEQ ID NO: 94117 - protein, 10 aa, Homo Sapiens
HHFLIGNNFL

SEQ ID NO: 94118 - protein, 10 aa, Homo Sapiens
HHGEEEVETF

SEQ ID NO: 94119 - protein, 10 aa, Homo Sapiens
HHGTAQLQAL

SEQ ID NO: 94120 - protein, 10 aa, Homo Sapiens
HHGTSILTLF

SEQ ID NO: 94121 - protein, 10 aa, Homo Sapiens
HHHIASVEKL

SEQ ID NO: 94122 - protein, 10 aa, Homo Sapiens
HHHYEGAVVI

SEQ ID NO: 94123 - protein, 10 aa, Homo Sapiens
HHIDPALPYI

SEQ ID NO: 94124 - protein, 10 aa, Homo Sapiens
HHIDSANALY

SEQ ID NO: 94125 - protein, 10 aa, Homo Sapiens
HHIEAQQRLL

SEQ ID NO: 94126 - protein, 10 aa, Homo Sapiens
HHIEQLNDKL

SEQ ID NO: 94127 - protein, 10 aa, Homo Sapiens
HHINDTDTIL

SEQ ID NO: 94128 - protein, 10 aa, Homo Sapiens
HHIPDVITYL

SEQ ID NO: 94129 - protein, 10 aa, Homo Sapiens
HHIQEIMVQL

SEQ ID NO: 94130 - protein, 10 aa, Homo Sapiens
HHISSKYDEL

SEQ ID NO: 94131 - protein, 10 aa, Homo Sapiens
HHIYDKTSVL

SEQ ID NO: 94132 - protein, 10 aa, Homo Sapiens
HHLDPDTELM

SEQ ID NO: 94133 - protein, 10 aa, Homo Sapiens
HHLEEPVIFI

SEQ ID NO: 94134 - protein, 10 aa, Homo Sapiens
HHLGSVILIF

SEQ ID NO: 94135 - protein, 10 aa, Homo Sapiens
HHLLLEVEVI

SEQ ID NO: 94136 - protein, 10 aa, Homo Sapiens
HHNQSTAINL

SEQ ID NO: 94137 - protein, 10 aa, Homo Sapiens
HHQDHKTELL

SEQ ID NO: 94138 - protein, 10 aa, Homo Sapiens
HHSAFSQMVI

SEQ ID NO: 94139 - protein, 10 aa, Homo Sapiens
HHSEEGRDTL

SEQ ID NO: 94140 - protein, 10 aa, Homo Sapiens
HHSKWLDETL

SEQ ID NO: 94141 - protein, 10 aa, Homo Sapiens
HHSTQMQELF

SEQ ID NO: 94142 - protein, 10 aa, Homo Sapiens
HHSYEDTGLL

SEQ ID NO: 94143 - protein, 10 aa, Homo Sapiens
HHTKPDKYQL

SEQ ID NO: 94144 - protein, 10 aa, Homo Sapiens
HHVAPELDEL

SEQ ID NO: 94145 - protein, 10 aa, Homo Sapiens
HHVENKGATL

SEQ ID NO: 94146 - protein, 10 aa, Homo Sapiens
HHVSPHETYF

SEQ ID NO: 94147 - protein, 10 aa, Homo Sapiens
HHVYLEGTLL

SEQ ID NO: 94148 - protein, 10 aa, Homo Sapiens
HHVYSGKDLI

SEQ ID NO: 94149 - protein, 10 aa, Homo Sapiens
HHYEGAVVIL

SEQ ID NO: 94150 - protein, 10 aa, Homo Sapiens
HHYFSKADHF

SEQ ID NO: 94151 - protein, 10 aa, Homo Sapiens
HHYNSHYEKF

SEQ ID NO: 94152 - protein, 10 aa, Homo Sapiens
HHYPGPGNHF

SEQ ID NO: 94153 - protein, 10 aa, Homo Sapiens
HHYSGNNIEL

SEQ ID NO: 94154 - protein, 10 aa, Homo Sapiens
HHYTEAERSL

SEQ ID NO: 94155 - protein, 10 aa, Homo Sapiens
HPISDHEATL

SEQ ID NO: 94156 - protein, 10 aa, Homo Sapiens
HQDPGQPLYI

SEQ ID NO: 94157 - protein, 10 aa, Homo Sapiens
HQNDDAEVSL

SEQ ID NO: 94158 - protein, 10 aa, Homo Sapiens
HSLTMDLWIP

SEQ ID NO: 94159 - protein, 10 aa, Homo Sapiens
IHAFVQDTTL

SEQ ID NO: 94160 - protein, 10 aa, Homo Sapiens
IHAGIIADEL

SEQ ID NO: 94161 - protein, 10 aa, Homo Sapiens
IHDFMSEYLI

SEQ ID NO: 94162 - protein, 10 aa, Homo Sapiens
IHDGAAGVHF

SEQ ID NO: 94163 - protein, 10 aa, Homo Sapiens
IHDGTVTHTF

SEQ ID NO: 94164 - protein, 10 aa, Homo Sapiens
IHDPGRGAPL

SEQ ID NO: 94165 - protein, 10 aa, Homo Sapiens
IHEAMEQQTI

SEQ ID NO: 94166 - protein, 10 aa, Homo Sapiens
IHEDLLGLTF

SEQ ID NO: 94167 - protein, 10 aa, Homo Sapiens
IHEGAVTHTF

SEQ ID NO: 94168 - protein, 10 aa, Homo Sapiens
IHEGENSYKF

SEQ ID NO: 94169 - protein, 10 aa, Homo Sapiens
IHEPEPHILL

SEQ ID NO: 94170 - protein, 10 aa, Homo Sapiens
IHGDTVQNQL

SEQ ID NO: 94171 - protein, 10 aa, Homo Sapiens
IHHSGAKVVL

SEQ ID NO: 94172 - protein, 10 aa, Homo Sapiens
IHILEVTNNL

SEQ ID NO: 94173 - protein, 10 aa, Homo Sapiens
IHMETDPQTI

SEQ ID NO: 94174 - protein, 10 aa, Homo Sapiens
IHSPASETLL

SEQ ID NO: 94175 - protein, 10 aa, Homo Sapiens
IHSSIVSTLL

SEQ ID NO: 94176 - protein, 10 aa, Homo Sapiens
IHVGQAGVQI

SEQ ID NO: 94177 - protein, 10 aa, Homo Sapiens
IHYLDTTTLI

SEQ ID NO: 94178 - protein, 10 aa, Homo Sapiens
ILDNDGDRLF

SEQ ID NO: 94179 - protein, 10 aa, Homo Sapiens
IQAGQCGNQI

SEQ ID NO: 94180 - protein, 10 aa, Homo Sapiens
IQDGKGDVTI

SEQ ID NO: 94181 - protein, 10 aa, Homo Sapiens
IWQTHNALFI

SEQ ID NO: 94182 - protein, 10 aa, Homo Sapiens
KHDPTSANLL

SEQ ID NO: 94183 - protein, 10 aa, Homo Sapiens
KLIDDQDISI

SEQ ID NO: 94184 - protein, 10 aa, Homo Sapiens
KQILEGVYYL

SEQ ID NO: 94185 - protein, 10 aa, Homo Sapiens
LHCDIIGDAF

SEQ ID NO: 94186 - protein, 10 aa, Homo Sapiens
LHDATRDLVL

SEQ ID NO: 94187 - protein, 10 aa, Homo Sapiens
LHDTVTTLIL

SEQ ID NO: 94188 - protein, 10 aa, Homo Sapiens
LHEGTGPRVI

SEQ ID NO: 94189 - protein, 10 aa, Homo Sapiens
LHIDPNFASL

SEQ ID NO: 94190 - protein, 10 aa, Homo Sapiens
LHIEAYNETF

SEQ ID NO: 94191 - protein, 10 aa, Homo Sapiens
LHIESQVELL

SEQ ID NO: 94192 - protein, 10 aa, Homo Sapiens
LHIPYAGETL

SEQ ID NO: 94193 - protein, 10 aa, Homo Sapiens
LHSMEVVNRL

SEQ ID NO: 94194 - protein, 10 aa, Homo Sapiens
LHSNPEPKTF

SEQ ID NO: 94195 - protein, 10 aa, Homo Sapiens
LHTSIGNSVW

SEQ ID NO: 94196 - protein, 10 aa, Homo Sapiens
LHVSGESSVF

SEQ ID NO: 94197 - protein, 10 aa, Homo Sapiens
LPEPNILQLL

SEQ ID NO: 94198 - protein, 10 aa, Homo Sapiens
LPVNDEHVTV

SEQ ID NO: 94199 - protein, 10 aa, Homo Sapiens
MHCGTTSDQF

SEQ ID NO: 94200 - protein, 10 aa, Homo Sapiens
MHDKQGEVRL

SEQ ID NO: 94201 - protein, 10 aa, Homo Sapiens
MHDYDGNNLL

SEQ ID NO: 94202 - protein, 10 aa, Homo Sapiens
MHIDNNILLI

SEQ ID NO: 94203 - protein, 10 aa, Homo Sapiens
MHINVAVETL

SEQ ID NO: 94204 - protein, 10 aa, Homo Sapiens
MHISESQQEF

SEQ ID NO: 94205 - protein, 10 aa, Homo Sapiens
MHLLEEPIYL

SEQ ID NO: 94206 - protein, 10 aa, Homo Sapiens
MHMPAEQAFW

SEQ ID NO: 94207 - protein, 10 aa, Homo Sapiens
MHSDAAAVNF

SEQ ID NO: 94208 - protein, 10 aa, Homo Sapiens
MHSGVDTSVL

SEQ ID NO: 94209 - protein, 10 aa, Homo Sapiens
MHYNQTVDIW

SEQ ID NO: 94210 - protein, 10 aa, Homo Sapiens
MQCDAKFDFL

SEQ ID NO: 94211 - protein, 10 aa, Homo Sapiens
MRDPDDQYKL

SEQ ID NO: 94212 - protein, 10 aa, Homo Sapiens
NHADILLINL

SEQ ID NO: 94213 - protein, 10 aa, Homo Sapiens
NHAPGATDAF

SEQ ID NO: 94214 - protein, 10 aa, Homo Sapiens
NHAPGATEAF

SEQ ID NO: 94215 - protein, 10 aa, Homo Sapiens
NHASSEQLYF

SEQ ID NO: 94216 - protein, 10 aa, Homo Sapiens
NHASYYKDAL

SEQ ID NO: 94217 - protein, 10 aa, Homo Sapiens
NHCYIAILNI

SEQ ID NO: 94218 - protein, 10 aa, Homo Sapiens
NHDASSIPRL

SEQ ID NO: 94219 - protein, 10 aa, Homo Sapiens
NHDFSAGLII

SEQ ID NO: 94220 - protein, 10 aa, Homo Sapiens
NHDGDFGITL

SEQ ID NO: 94221 - protein, 10 aa, Homo Sapiens
NHDKLIPLLL

SEQ ID NO: 94222 - protein, 10 aa, Homo Sapiens
NHDLGENHHL

SEQ ID NO: 94223 - protein, 10 aa, Homo Sapiens
NHDPNTHHCL

SEQ ID NO: 94224 - protein, 10 aa, Homo Sapiens
NHDPVVGDRL

SEQ ID NO: 94225 - protein, 10 aa, Homo Sapiens
NHDRPDVCIL

SEQ ID NO: 94226 - protein, 10 aa, Homo Sapiens
NHDSTHVIRF

SEQ ID NO: 94227 - protein, 10 aa, Homo Sapiens
NHDTSFAKTF

SEQ ID NO: 94228 - protein, 10 aa, Homo Sapiens
NHDYMKQMTF

SEQ ID NO: 94229 - protein, 10 aa, Homo Sapiens
NHECASINRI

SEQ ID NO: 94230 - protein, 10 aa, Homo Sapiens
NHEDKIRVVL

SEQ ID NO: 94231 - protein, 10 aa, Homo Sapiens
NHEFLVKPSF

SEQ ID NO: 94232 - protein, 10 aa, Homo Sapiens
NHENEDIYKL

SEQ ID NO: 94233 - protein, 10 aa, Homo Sapiens
NHETECITFL

SEQ ID NO: 94234 - protein, 10 aa, Homo Sapiens
NHFPGEAETL

SEQ ID NO: 94235 - protein, 10 aa, Homo Sapiens
NHHLDSQSRW

SEQ ID NO: 94236 - protein, 10 aa, Homo Sapiens
NHIEPLKIQL

SEQ ID NO: 94237 - protein, 10 aa, Homo Sapiens
NHIGVTEVLL

SEQ ID NO: 94238 - protein, 10 aa, Homo Sapiens
NHINVELSLL

SEQ ID NO: 94239 - protein, 10 aa, Homo Sapiens
NHIRNGIDIL

SEQ ID NO: 94240 - protein, 10 aa, Homo Sapiens
NHITHTGVYL

SEQ ID NO: 94241 - protein, 10 aa, Homo Sapiens
NHQEVVELLI

SEQ ID NO: 94242 - protein, 10 aa, Homo Sapiens
NHQGATPLVL

SEQ ID NO: 94243 - protein, 10 aa, Homo Sapiens
NHSDPESMSL

SEQ ID NO: 94244 - protein, 10 aa, Homo Sapiens
NHSNADFHRI

SEQ ID NO: 94245 - protein, 10 aa, Homo Sapiens
NHVAAHGQSL

SEQ ID NO: 94246 - protein, 10 aa, Homo Sapiens
NHVSQASVTI

SEQ ID NO: 94247 - protein, 10 aa, Homo Sapiens
NHVTPPNVSL

SEQ ID NO: 94248 - protein, 10 aa, Homo Sapiens
NHYKSNVEIF

SEQ ID NO: 94249 - protein, 10 aa, Homo Sapiens
NRLEVVKEFL

SEQ ID NO: 94250 - protein, 10 aa, Homo Sapiens
QAHNKEIYTI

SEQ ID NO: 94251 - protein, 10 aa, Homo Sapiens
QHADPPVQIL

SEQ ID NO: 94252 - protein, 10 aa, Homo Sapiens
QHADVARAML

SEQ ID NO: 94253 - protein, 10 aa, Homo Sapiens
QHAEADREQL

SEQ ID NO: 94254 - protein, 10 aa, Homo Sapiens
QHAIEESVVL

SEQ ID NO: 94255 - protein, 10 aa, Homo Sapiens
QHCDLELSIL

SEQ ID NO: 94256 - protein, 10 aa, Homo Sapiens
QHDAASLLKL

SEQ ID NO: 94257 - protein, 10 aa, Homo Sapiens
QHDEPCYWRL

SEQ ID NO: 94258 - protein, 10 aa, Homo Sapiens
QHDFGHLSVF

SEQ ID NO: 94259 - protein, 10 aa, Homo Sapiens
QHDFQAPYLL

SEQ ID NO: 94260 - protein, 10 aa, Homo Sapiens
QHDGPTKNLF

SEQ ID NO: 94261 - protein, 10 aa, Homo Sapiens
QHDGSITASL

SEQ ID NO: 94262 - protein, 10 aa, Homo Sapiens
QHDITGRALL

SEQ ID NO: 94263 - protein, 10 aa, Homo Sapiens
QHDLSQSAFL

SEQ ID NO: 94264 - protein, 10 aa, Homo Sapiens
QHDPGQLLGW

SEQ ID NO: 94265 - protein, 10 aa, Homo Sapiens
QHDPKAETRL

SEQ ID NO: 94266 - protein, 10 aa, Homo Sapiens
QHDSQELLSF

SEQ ID NO: 94267 - protein, 10 aa, Homo Sapiens
QHDVFGDISF

SEQ ID NO: 94268 - protein, 10 aa, Homo Sapiens
QHECIPQAIL

SEQ ID NO: 94269 - protein, 10 aa, Homo Sapiens
QHEDLAKKSI

SEQ ID NO: 94270 - protein, 10 aa, Homo Sapiens
QHEERRCQYL

SEQ ID NO: 94271 - protein, 10 aa, Homo Sapiens
QHEIFVDYEL

SEQ ID NO: 94272 - protein, 10 aa, Homo Sapiens
QHELVTTQRL

SEQ ID NO: 94273 - protein, 10 aa, Homo Sapiens
QHENEDIYKL

SEQ ID NO: 94274 - protein, 10 aa, Homo Sapiens
QHETSSPALL

SEQ ID NO: 94275 - protein, 10 aa, Homo Sapiens
QHFDLASTTI

SEQ ID NO: 94276 - protein, 10 aa, Homo Sapiens
QHFLEPEVNL

SEQ ID NO: 94277 - protein, 10 aa, Homo Sapiens
QHIAGFLDGF

SEQ ID NO: 94278 - protein, 10 aa, Homo Sapiens
QHIEVLKESL

SEQ ID NO: 94279 - protein, 10 aa, Homo Sapiens
QHIGTGNLYI

SEQ ID NO: 94280 - protein, 10 aa, Homo Sapiens
QHIQDGALRL

SEQ ID NO: 94281 - protein, 10 aa, Homo Sapiens
QHIQVFIDRF

SEQ ID NO: 94282 - protein, 10 aa, Homo Sapiens
QHIYKEIVNF

SEQ ID NO: 94283 - protein, 10 aa, Homo Sapiens
QHLETQNVTF

SEQ ID NO: 94284 - protein, 10 aa, Homo Sapiens
QHLNPDPQLI

SEQ ID NO: 94285 - protein, 10 aa, Homo Sapiens
QHLQATGVSL

SEQ ID NO: 94286 - protein, 10 aa, Homo Sapiens
QHLREDNLRL

SEQ ID NO: 94287 - protein, 10 aa, Homo Sapiens
QHNDALTVTL

SEQ ID NO: 94288 - protein, 10 aa, Homo Sapiens
QHNIPFPCLL

SEQ ID NO: 94289 - protein, 10 aa, Homo Sapiens
QHQAAQALHL

SEQ ID NO: 94290 - protein, 10 aa, Homo Sapiens
QHQDSQVNAL

SEQ ID NO: 94291 - protein, 10 aa, Homo Sapiens
QHQEVKPYTL

SEQ ID NO: 94292 - protein, 10 aa, Homo Sapiens
QHQGPDDIYL

SEQ ID NO: 94293 - protein, 10 aa, Homo Sapiens
QHQLDTILFF

SEQ ID NO: 94294 - protein, 10 aa, Homo Sapiens
QHQSGIVQLL

SEQ ID NO: 94295 - protein, 10 aa, Homo Sapiens
QHSASSANVF

SEQ ID NO: 94296 - protein, 10 aa, Homo Sapiens
QHSEFEEVTI

SEQ ID NO: 94297 - protein, 10 aa, Homo Sapiens
QHSLAITNNF

SEQ ID NO: 94298 - protein, 10 aa, Homo Sapiens
QHSNVVINLI

SEQ ID NO: 94299 - protein, 10 aa, Homo Sapiens
QHSQEFINRL

SEQ ID NO: 94300 - protein, 10 aa, Homo Sapiens
QHTDTVVNFL

SEQ ID NO: 94301 - protein, 10 aa, Homo Sapiens
QHVDESGLSL

SEQ ID NO: 94302 - protein, 10 aa, Homo Sapiens
QQIEAQQQLL

SEQ ID NO: 94303 - protein, 10 aa, Homo Sapiens
QQLEDEFYTF

SEQ ID NO: 94304 - protein, 10 aa, Homo Sapiens
QQMEAEHNTL

SEQ ID NO: 94305 - protein, 10 aa, Homo Sapiens
RHDPNMKYEL

SEQ ID NO: 94306 - protein, 10 aa, Homo Sapiens
RHDPQTTNLL

SEQ ID NO: 94307 - protein, 10 aa, Homo Sapiens
RHESGASIKI

SEQ ID NO: 94308 - protein, 10 aa, Homo Sapiens
RHIEAHRILL

SEQ ID NO: 94309 - protein, 10 aa, Homo Sapiens
RHIIEDPCTL

SEQ ID NO: 94310 - protein, 10 aa, Homo Sapiens
RHLDMEHERL

SEQ ID NO: 94311 - protein, 10 aa, Homo Sapiens
RHMQAKGILL

SEQ ID NO: 94312 - protein, 10 aa, Homo Sapiens
RQGVDADING

SEQ ID NO: 94313 - protein, 10 aa, Homo Sapiens
SFPAALIILL

SEQ ID NO: 94314 - protein, 10 aa, Homo Sapiens
SHAENILQIF

SEQ ID NO: 94315 - protein, 10 aa, Homo Sapiens
SHCNIIHTEI

SEQ ID NO: 94316 - protein, 10 aa, Homo Sapiens
SHCQEAGATL

SEQ ID NO: 94317 - protein, 10 aa, Homo Sapiens
SHCVPDVSTI

SEQ ID NO: 94318 - protein, 10 aa, Homo Sapiens
SHDISRNVTL

SEQ ID NO: 94319 - protein, 10 aa, Homo Sapiens
SHDNGSQFFF

SEQ ID NO: 94320 - protein, 10 aa, Homo Sapiens
SHDVSGALLL

SEQ ID NO: 94321 - protein, 10 aa, Homo Sapiens
SHDVSLANRM

SEQ ID NO: 94322 - protein, 10 aa, Homo Sapiens
SHEAATKAVL

SEQ ID NO: 94323 - protein, 10 aa, Homo Sapiens
SHEAGDPQLF

SEQ ID NO: 94324 - protein, 10 aa, Homo Sapiens
SHEEPAFQNF

SEQ ID NO: 94325 - protein, 10 aa, Homo Sapiens
SHEGEILQAF

SEQ ID NO: 94326 - protein, 10 aa, Homo Sapiens
SHEGLVLTKL

SEQ ID NO: 94327 - protein, 10 aa, Homo Sapiens
SHEGSSFQMF

SEQ ID NO: 94328 - protein, 10 aa, Homo Sapiens
SHENPVDILI

SEQ ID NO: 94329 - protein, 10 aa, Homo Sapiens
SHFEGLITTI

SEQ ID NO: 94330 - protein, 10 aa, Homo Sapiens
SHFFSENEDF

SEQ ID NO: 94331 - protein, 10 aa, Homo Sapiens
SHGEVHLDCL

SEQ ID NO: 94332 - protein, 10 aa, Homo Sapiens
SHHEAEFQHL

SEQ ID NO: 94333 - protein, 10 aa, Homo Sapiens
SHIEDQAEQF

SEQ ID NO: 94334 - protein, 10 aa, Homo Sapiens
SHIKDFAAKL

SEQ ID NO: 94335 - protein, 10 aa, Homo Sapiens
SHILISGDGL

SEQ ID NO: 94336 - protein, 10 aa, Homo Sapiens
SHIVRGEHTF

SEQ ID NO: 94337 - protein, 10 aa, Homo Sapiens
SHLNALEERF

SEQ ID NO: 94338 - protein, 10 aa, Homo Sapiens
SHLPPFFDCL

SEQ ID NO: 94339 - protein, 10 aa, Homo Sapiens
SHMPAETEEL

SEQ ID NO: 94340 - protein, 10 aa, Homo Sapiens
SHQDITEDSF

SEQ ID NO: 94341 - protein, 10 aa, Homo Sapiens
SHQEARNMLL

SEQ ID NO: 94342 - protein, 10 aa, Homo Sapiens
SHSDDGCLKL

SEQ ID NO: 94343 - protein, 10 aa, Homo Sapiens
SHSDGSFNLL

SEQ ID NO: 94344 - protein, 10 aa, Homo Sapiens
SHSDSSVITI

SEQ ID NO: 94345 - protein, 10 aa, Homo Sapiens
SHSGPEISRI

SEQ ID NO: 94346 - protein, 10 aa, Homo Sapiens
SHSGSDSPTL

SEQ ID NO: 94347 - protein, 10 aa, Homo Sapiens
SHSNPEGSSW

SEQ ID NO: 94348 - protein, 10 aa, Homo Sapiens
SHSPFGLDSF

SEQ ID NO: 94349 - protein, 10 aa, Homo Sapiens
SHSSYVLQQL

SEQ ID NO: 94350 - protein, 10 aa, Homo Sapiens
SHVKEPRYLL

SEQ ID NO: 94351 - protein, 10 aa, Homo Sapiens
SHVNYFLDQF

SEQ ID NO: 94352 - protein, 10 aa, Homo Sapiens
SHVPYTSVFL

SEQ ID NO: 94353 - protein, 10 aa, Homo Sapiens
SHVRPDRQTL

SEQ ID NO: 94354 - protein, 10 aa, Homo Sapiens
SHVSLVQLTL

SEQ ID NO: 94355 - protein, 10 aa, Homo Sapiens
SKDPGENYNL

SEQ ID NO: 94356 - protein, 10 aa, Homo Sapiens
SLLDDTTVTL

SEQ ID NO: 94357 - protein, 10 aa, Homo Sapiens
SMDNNRSLDL

SEQ ID NO: 94358 - protein, 10 aa, Homo Sapiens
SQLDDQYSRF

SEQ ID NO: 94359 - protein, 10 aa, Homo Sapiens
SRCPHLLDFF

SEQ ID NO: 94360 - protein, 10 aa, Homo Sapiens
SRMLEDRDLF

SEQ ID NO: 94361 - protein, 10 aa, Homo Sapiens
THAKSILNSM

SEQ ID NO: 94362 - protein, 10 aa, Homo Sapiens
THANNTVSNF

SEQ ID NO: 94363 - protein, 10 aa, Homo Sapiens
THAPLPEVQL

SEQ ID NO: 94364 - protein, 10 aa, Homo Sapiens
THAQVEDGRL

SEQ ID NO: 94365 - protein, 10 aa, Homo Sapiens
THAVPIYEGF

SEQ ID NO: 94366 - protein, 10 aa, Homo Sapiens
THCEIHPSMI

SEQ ID NO: 94367 - protein, 10 aa, Homo Sapiens
THCLPEPHLL

SEQ ID NO: 94368 - protein, 10 aa, Homo Sapiens
THCLWTDQLL

SEQ ID NO: 94369 - protein, 10 aa, Homo Sapiens
THCPPSSIEL

SEQ ID NO: 94370 - protein, 10 aa, Homo Sapiens
THCTYDRVVL

SEQ ID NO: 94371 - protein, 10 aa, Homo Sapiens
THDDFVMIDF

SEQ ID NO: 94372 - protein, 10 aa, Homo Sapiens
THDDSHLVSL

SEQ ID NO: 94373 - protein, 10 aa, Homo Sapiens
THDEDFVELL

SEQ ID NO: 94374 - protein, 10 aa, Homo Sapiens
THDELIQLVL

SEQ ID NO: 94375 - protein, 10 aa, Homo Sapiens
THDQSISQKL

SEQ ID NO: 94376 - protein, 10 aa, Homo Sapiens
THDQVLKTRL

SEQ ID NO: 94377 - protein, 10 aa, Homo Sapiens
THDSVTVLLF

SEQ ID NO: 94378 - protein, 10 aa, Homo Sapiens
THDVPYHDYF

SEQ ID NO: 94379 - protein, 10 aa, Homo Sapiens
THEDAVAAML

SEQ ID NO: 94380 - protein, 10 aa, Homo Sapiens
THEDPVIAVF

SEQ ID NO: 94381 - protein, 10 aa, Homo Sapiens
THEGTSVTNL

SEQ ID NO: 94382 - protein, 10 aa, Homo Sapiens
THENLTYLQL

SEQ ID NO: 94383 - protein, 10 aa, Homo Sapiens
THEQGSVMMF

SEQ ID NO: 94384 - protein, 10 aa, Homo Sapiens
THFDTIFEVF

SEQ ID NO: 94385 - protein, 10 aa, Homo Sapiens
THFENENQKL

SEQ ID NO: 94386 - protein, 10 aa, Homo Sapiens
THFKELPTLL

SEQ ID NO: 94387 - protein, 10 aa, Homo Sapiens
THFQQGHEEL

SEQ ID NO: 94388 - protein, 10 aa, Homo Sapiens
THFTGNEVGF

SEQ ID NO: 94389 - protein, 10 aa, Homo Sapiens
THHKDHFTKL

SEQ ID NO: 94390 - protein, 10 aa, Homo Sapiens
THICPVYEGF

SEQ ID NO: 94391 - protein, 10 aa, Homo Sapiens
THIPNIFQKI

SEQ ID NO: 94392 - protein, 10 aa, Homo Sapiens
THISALLQYI

SEQ ID NO: 94393 - protein, 10 aa, Homo Sapiens
THISPYKDLL

SEQ ID NO: 94394 - protein, 10 aa, Homo Sapiens
THISSQNSEL

SEQ ID NO: 94395 - protein, 10 aa, Homo Sapiens
THISSSGQNL

SEQ ID NO: 94396 - protein, 10 aa, Homo Sapiens
THITAQTAVL

SEQ ID NO: 94397 - protein, 10 aa, Homo Sapiens
THLINFSETL

SEQ ID NO: 94398 - protein, 10 aa, Homo Sapiens
THLKAVKMTL

SEQ ID NO: 94399 - protein, 10 aa, Homo Sapiens
THLSGLLDIF

SEQ ID NO: 94400 - protein, 10 aa, Homo Sapiens
THLTSMFEYL

SEQ ID NO: 94401 - protein, 10 aa, Homo Sapiens
THMSPSWTLL

SEQ ID NO: 94402 - protein, 10 aa, Homo Sapiens
THQEAVSALL

SEQ ID NO: 94403 - protein, 10 aa, Homo Sapiens
THQSEVAQSF

SEQ ID NO: 94404 - protein, 10 aa, Homo Sapiens
THSAVDNILL

SEQ ID NO: 94405 - protein, 10 aa, Homo Sapiens
THSIPENTNF

SEQ ID NO: 94406 - protein, 10 aa, Homo Sapiens
THSSVVLQGF

SEQ ID NO: 94407 - protein, 10 aa, Homo Sapiens
THTETGKVLF

SEQ ID NO: 94408 - protein, 10 aa, Homo Sapiens
THTSPEDVSF

SEQ ID NO: 94409 - protein, 10 aa, Homo Sapiens
THVEDLNAKW

SEQ ID NO: 94410 - protein, 10 aa, Homo Sapiens
THVKEQLETL

SEQ ID NO: 94411 - protein, 10 aa, Homo Sapiens
THVQSQLEKL

SEQ ID NO: 94412 - protein, 10 aa, Homo Sapiens
THVSNGCQLL

SEQ ID NO: 94413 - protein, 10 aa, Homo Sapiens
THYDHVLIEL

SEQ ID NO: 94414 - protein, 10 aa, Homo Sapiens
TLIQSFTDRL

SEQ ID NO: 94415 - protein, 10 aa, Homo Sapiens
TQDFPESNRL

SEQ ID NO: 94416 - protein, 10 aa, Homo Sapiens
TQDHNTPALL

SEQ ID NO: 94417 - protein, 10 aa, Homo Sapiens
TQDPHVNAFF

SEQ ID NO: 94418 - protein, 10 aa, Homo Sapiens
TQENVVKTLL

SEQ ID NO: 94419 - protein, 10 aa, Homo Sapiens
TQGPAESSSL

SEQ ID NO: 94420 - protein, 10 aa, Homo Sapiens
TQIGGERYNF

SEQ ID NO: 94421 - protein, 10 aa, Homo Sapiens
TQMESEKENL

SEQ ID NO: 94422 - protein, 10 aa, Homo Sapiens
TQVDPEIELF

SEQ ID NO: 94423 - protein, 10 aa, Homo Sapiens
TRLSITNETF

SEQ ID NO: 94424 - protein, 10 aa, Homo Sapiens
VHAPPMQLGF

SEQ ID NO: 94425 - protein, 10 aa, Homo Sapiens
VHCGIIEPLM

SEQ ID NO: 94426 - protein, 10 aa, Homo Sapiens
VHDANTLYIF

SEQ ID NO: 94427 - protein, 10 aa, Homo Sapiens
VHDNQILIVI

SEQ ID NO: 94428 - protein, 10 aa, Homo Sapiens
VHEDRSIQQI

SEQ ID NO: 94429 - protein, 10 aa, Homo Sapiens
VHIPNDDAQF

SEQ ID NO: 94430 - protein, 10 aa, Homo Sapiens
VHSFEEGSEL

SEQ ID NO: 94431 - protein, 10 aa, Homo Sapiens
VHSTPGANVL

SEQ ID NO: 94432 - protein, 10 aa, Homo Sapiens
VHVNVSGNEL

SEQ ID NO: 94433 - protein, 10 aa, Homo Sapiens
VTIKKDVDGA

SEQ ID NO: 94434 - protein, 10 aa, Homo Sapiens
VVPPFLQPEV

SEQ ID NO: 94435 - protein, 10 aa, Homo Sapiens
WHDEQGHNGL

SEQ ID NO: 94436 - protein, 10 aa, Homo Sapiens
WHEEMKNQII

SEQ ID NO: 94437 - protein, 10 aa, Homo Sapiens
WHIYSEEEYL

SEQ ID NO: 94438 - protein, 10 aa, Homo Sapiens
WHQTGGEVTI

SEQ ID NO: 94439 - protein, 10 aa, Homo Sapiens
WHTTAQNVLL

SEQ ID NO: 94440 - protein, 10 aa, Homo Sapiens
YHAEEVEERF

SEQ ID NO: 94441 - protein, 10 aa, Homo Sapiens
YHAKDPNNLF

SEQ ID NO: 94442 - protein, 10 aa, Homo Sapiens
YHAKLENARL

SEQ ID NO: 94443 - protein, 10 aa, Homo Sapiens
YHAPPRLHHL

SEQ ID NO: 94444 - protein, 10 aa, Homo Sapiens
YHAQPLEDNL

SEQ ID NO: 94445 - protein, 10 aa, Homo Sapiens
YHDEADQSAL

SEQ ID NO: 94446 - protein, 10 aa, Homo Sapiens
YHDFSVQNFI

SEQ ID NO: 94447 - protein, 10 aa, Homo Sapiens
YHDGNRNPKF

SEQ ID NO: 94448 - protein, 10 aa, Homo Sapiens
YHDNHIVIRW

SEQ ID NO: 94449 - protein, 10 aa, Homo Sapiens
YHDPMLKLSI

SEQ ID NO: 94450 - protein, 10 aa, Homo Sapiens
YHDSRIHVCL

SEQ ID NO: 94451 - protein, 10 aa, Homo Sapiens
YHDYGHLELI

SEQ ID NO: 94452 - protein, 10 aa, Homo Sapiens
YHEADKTYML

SEQ ID NO: 94453 - protein, 10 aa, Homo Sapiens
YHEGSAPALI

SEQ ID NO: 94454 - protein, 10 aa, Homo Sapiens
YHEGYACTSI

SEQ ID NO: 94455 - protein, 10 aa, Homo Sapiens
YHEKDIKVFF

SEQ ID NO: 94456 - protein, 10 aa, Homo Sapiens
YHEQLSVAEI

SEQ ID NO: 94457 - protein, 10 aa, Homo Sapiens
YHEQLTVAEI

SEQ ID NO: 94458 - protein, 10 aa, Homo Sapiens
YHEVPYTTSF

SEQ ID NO: 94459 - protein, 10 aa, Homo Sapiens
YHEVVDEIYF

SEQ ID NO: 94460 - protein, 10 aa, Homo Sapiens
YHFYQGLVYL

SEQ ID NO: 94461 - protein, 10 aa, Homo Sapiens
YHHEAGVTAL

SEQ ID NO: 94462 - protein, 10 aa, Homo Sapiens
YHHHGVGQGF

SEQ ID NO: 94463 - protein, 10 aa, Homo Sapiens
YHIDVGTQTF

SEQ ID NO: 94464 - protein, 10 aa, Homo Sapiens
YHISLEHEIL

SEQ ID NO: 94465 - protein, 10 aa, Homo Sapiens
YHITDVPCIF

SEQ ID NO: 94466 - protein, 10 aa, Homo Sapiens
YHNEVEIEKL

SEQ ID NO: 94467 - protein, 10 aa, Homo Sapiens
YHNNEEKNRL

SEQ ID NO: 94468 - protein, 10 aa, Homo Sapiens
YHQGSGTFLF

SEQ ID NO: 94469 - protein, 10 aa, Homo Sapiens
YHQNVESHLL

SEQ ID NO: 94470 - protein, 10 aa, Homo Sapiens
YHQPAPIAQL

SEQ ID NO: 94471 - protein, 10 aa, Homo Sapiens
YHQSASEHGL

SEQ ID NO: 94472 - protein, 10 aa, Homo Sapiens
YHSDEYIKFL

SEQ ID NO: 94473 - protein, 10 aa, Homo Sapiens
YHSEESQIYL

SEQ ID NO: 94474 - protein, 10 aa, Homo Sapiens
YHSPEEEISL

SEQ ID NO: 94475 - protein, 10 aa, Homo Sapiens
YHVAEKETLL

SEQ ID NO: 94476 - protein, 10 aa, Homo Sapiens
YHVEPHPEHL

SEQ ID NO: 94477 - protein, 10 aa, Homo Sapiens
YHYPSCDLYF

SEQ ID NO: 94478 - protein, 10 aa, Homo Sapiens
YQAPDIDVQL

SEQ ID NO: 94479 - protein, 10 aa, Homo Sapiens
YQNEDEKVTL

SEQ ID NO: 94480 - protein, 10 aa, Homo Sapiens
YRDPYTEQTI

SEQ ID NO: 94481 - protein, 11 aa, Homo Sapiens
AHAAAGPGEVL

SEQ ID NO: 94482 - protein, 11 aa, Homo Sapiens
AHAPPGHHSVI

SEQ ID NO: 94483 - protein, 11 aa, Homo Sapiens
AHAQSIGMNRL

SEQ ID NO: 94484 - protein, 11 aa, Homo Sapiens
AHCDLGAHHSL

SEQ ID NO: 94485 - protein, 11 aa, Homo Sapiens
AHCPAAAVPAL

SEQ ID NO: 94486 - protein, 11 aa, Homo Sapiens
AHDDSVMYLQF

SEQ ID NO: 94487 - protein, 11 aa, Homo Sapiens
AHDESPGNNVV

SEQ ID NO: 94488 - protein, 11 aa, Homo Sapiens
AHDEYLQLLNL

SEQ ID NO: 94489 - protein, 11 aa, Homo Sapiens
AHDGSATYLRF

SEQ ID NO: 94490 - protein, 11 aa, Homo Sapiens
AHDPQTLEQNI

SEQ ID NO: 94491 - protein, 11 aa, Homo Sapiens
AHDPQTTQELL

SEQ ID NO: 94492 - protein, 11 aa, Homo Sapiens
AHDTDPKALRL

SEQ ID NO: 94493 - protein, 11 aa, Homo Sapiens
AHEDCVNNIRF

SEQ ID NO: 94494 - protein, 11 aa, Homo Sapiens
AHEENSQIYKF

SEQ ID NO: 94495 - protein, 11 aa, Homo Sapiens
AHEGTLAAITF

SEQ ID NO: 94496 - protein, 11 aa, Homo Sapiens
AHELVTSKIAL

SEQ ID NO: 94497 - protein, 11 aa, Homo Sapiens
AHESAVTGLSL

SEQ ID NO: 94498 - protein, 11 aa, Homo Sapiens
AHFPGLASELL

SEQ ID NO: 94499 - protein, 11 aa, Homo Sapiens
AHFSENPILYL

SEQ ID NO: 94500 - protein, 11 aa, Homo Sapiens
AHIDGDHLTLL

SEQ ID NO: 94501 - protein, 11 aa, Homo Sapiens
AHLNPSDTEEW

SEQ ID NO: 94502 - protein, 11 aa, Homo Sapiens
AHLPADLEVTL

SEQ ID NO: 94503 - protein, 11 aa, Homo Sapiens
AHLPASGLDIF

SEQ ID NO: 94504 - protein, 11 aa, Homo Sapiens
AHQASHQPLYL

SEQ ID NO: 94505 - protein, 11 aa, Homo Sapiens
AHQRPDKQNLF

SEQ ID NO: 94506 - protein, 11 aa, Homo Sapiens
AHQSNRVCNAL

SEQ ID NO: 94507 - protein, 11 aa, Homo Sapiens
AHSSDVLENVF

SEQ ID NO: 94508 - protein, 11 aa, Homo Sapiens
AHSTAIAGLTF

SEQ ID NO: 94509 - protein, 11 aa, Homo Sapiens
AHVPNFIFDEF

SEQ ID NO: 94510 - protein, 11 aa, Homo Sapiens
AHYADVLGLLL

SEQ ID NO: 94511 - protein, 11 aa, Homo Sapiens
AHYDPATEEFI

SEQ ID NO: 94512 - protein, 11 aa, Homo Sapiens
CHAPTSSAYEF

SEQ ID NO: 94513 - protein, 11 aa, Homo Sapiens
CHDIYNSLLQL

SEQ ID NO: 94514 - protein, 11 aa, Homo Sapiens
CHIAISNSENL

SEQ ID NO: 94515 - protein, 11 aa, Homo Sapiens
DHDRYSGNVTI

SEQ ID NO: 94516 - protein, 11 aa, Homo Sapiens
DHSPCDPTITL

SEQ ID NO: 94517 - protein, 11 aa, Homo Sapiens
DHYKPGSSETL

SEQ ID NO: 94518 - protein, 11 aa, Homo Sapiens
EHAKINETDTF

SEQ ID NO: 94519 - protein, 11 aa, Homo Sapiens
EHCWVGELNGL

SEQ ID NO: 94520 - protein, 11 aa, Homo Sapiens
EHDPITKNKQV

SEQ ID NO: 94521 - protein, 11 aa, Homo Sapiens
EHDPSSIYLRI

SEQ ID NO: 94522 - protein, 11 aa, Homo Sapiens
EHEDIKKGILL

SEQ ID NO: 94523 - protein, 11 aa, Homo Sapiens
EHEDTDKYRQL

SEQ ID NO: 94524 - protein, 11 aa, Homo Sapiens
EHFSSCLHQVL

SEQ ID NO: 94525 - protein, 11 aa, Homo Sapiens
EHHSTQMQELF

SEQ ID NO: 94526 - protein, 11 aa, Homo Sapiens
EHILPINSEVL

SEQ ID NO: 94527 - protein, 11 aa, Homo Sapiens
EHINEGETAML

SEQ ID NO: 94528 - protein, 11 aa, Homo Sapiens
EHLLEKDIITL

SEQ ID NO: 94529 - protein, 11 aa, Homo Sapiens
EHLPARDSPSL

SEQ ID NO: 94530 - protein, 11 aa, Homo Sapiens
EHLRKLEAERL

SEQ ID NO: 94531 - protein, 11 aa, Homo Sapiens
EHMPVGPDAIL

SEQ ID NO: 94532 - protein, 11 aa, Homo Sapiens
EHQGSHLTQKL

SEQ ID NO: 94533 - protein, 11 aa, Homo Sapiens
EHQPDNIKALF

SEQ ID NO: 94534 - protein, 11 aa, Homo Sapiens
EHQPPYIIAVL

SEQ ID NO: 94535 - protein, 11 aa, Homo Sapiens
EHQSNGGALVL

SEQ ID NO: 94536 - protein, 11 aa, Homo Sapiens
EHSMDTLLATL

SEQ ID NO: 94537 - protein, 11 aa, Homo Sapiens
EHSPSDLEAHF

SEQ ID NO: 94538 - protein, 11 aa, Homo Sapiens
EHSPVPAGFGF

SEQ ID NO: 94539 - protein, 11 aa, Homo Sapiens
EHVKAANRLTL

SEQ ID NO: 94540 - protein, 11 aa, Homo Sapiens
EHYADQLKEYL

SEQ ID NO: 94541 - protein, 11 aa, Homo Sapiens
FHCEPANILYI

SEQ ID NO: 94542 - protein, 11 aa, Homo Sapiens
FHDCEDAAREL

SEQ ID NO: 94543 - protein, 11 aa, Homo Sapiens
FHDDQGGVTRW

SEQ ID NO: 94544 - protein, 11 aa, Homo Sapiens
FHDKYGNAVLA

SEQ ID NO: 94545 - protein, 11 aa, Homo Sapiens
FHDLPCGASVI

SEQ ID NO: 94546 - protein, 11 aa, Homo Sapiens
FHDPESAQQHF

SEQ ID NO: 94547 - protein, 11 aa, Homo Sapiens
FHDPNAIYSEL

SEQ ID NO: 94548 - protein, 11 aa, Homo Sapiens
FHEEVEQGVKF

SEQ ID NO: 94549 - protein, 11 aa, Homo Sapiens
FHEEYSRLYQL

SEQ ID NO: 94550 - protein, 11 aa, Homo Sapiens
FHEHPDLIVGF

SEQ ID NO: 94551 - protein, 11 aa, Homo Sapiens
FHELTALANQI

SEQ ID NO: 94552 - protein, 11 aa, Homo Sapiens
FHFSQAEKVYI

SEQ ID NO: 94553 - protein, 11 aa, Homo Sapiens
FHFTNRDCDSL

SEQ ID NO: 94554 - protein, 11 aa, Homo Sapiens
FHGDSEIDQLF

SEQ ID NO: 94555 - protein, 11 aa, Homo Sapiens
FHILSGQGDVL

SEQ ID NO: 94556 - protein, 11 aa, Homo Sapiens
FHLDPSLTHTI

SEQ ID NO: 94557 - protein, 11 aa, Homo Sapiens
FHLTPLSYETL

SEQ ID NO: 94558 - protein, 11 aa, Homo Sapiens
FHNDIDSNSTI

SEQ ID NO: 94559 - protein, 11 aa, Homo Sapiens
FHQPASAEQLL

SEQ ID NO: 94560 - protein, 11 aa, Homo Sapiens
FHSGGYGQDAL

SEQ ID NO: 94561 - protein, 11 aa, Homo Sapiens
FHVNSEVNSVL

SEQ ID NO: 94562 - protein, 11 aa, Homo Sapiens
FHVSPDPSVTL

SEQ ID NO: 94563 - protein, 11 aa, Homo Sapiens
FQENSTIGQKI

SEQ ID NO: 94564 - protein, 11 aa, Homo Sapiens
GEQHLPQPLLL

SEQ ID NO: 94565 - protein, 11 aa, Homo Sapiens
GHDGTTESNCF

SEQ ID NO: 94566 - protein, 11 aa, Homo Sapiens
GHDPSSGVQEF

SEQ ID NO: 94567 - protein, 11 aa, Homo Sapiens
GHEEALSKFTL

SEQ ID NO: 94568 - protein, 11 aa, Homo Sapiens
GHQLPVKEATL

SEQ ID NO: 94569 - protein, 11 aa, Homo Sapiens
GHSDYINGNFI

SEQ ID NO: 94570 - protein, 11 aa, Homo Sapiens
GHVVPTILEKF

SEQ ID NO: 94571 - protein, 11 aa, Homo Sapiens
GKHWFNLNSLL

SEQ ID NO: 94572 - protein, 11 aa, Homo Sapiens
HADDSAAMAIA

SEQ ID NO: 94573 - protein, 11 aa, Homo Sapiens
HHAESKNGWTL

SEQ ID NO: 94574 - protein, 11 aa, Homo Sapiens
HHAQDLGVVNL

SEQ ID NO: 94575 - protein, 11 aa, Homo Sapiens
HHAQDYGGLLL

SEQ ID NO: 94576 - protein, 11 aa, Homo Sapiens
HHCPDVPILLV

SEQ ID NO: 94577 - protein, 11 aa, Homo Sapiens
HHCPSTPIILV

SEQ ID NO: 94578 - protein, 11 aa, Homo Sapiens
HHDASTFTINI

SEQ ID NO: 94579 - protein, 11 aa, Homo Sapiens
HHDDYTQNHSF

SEQ ID NO: 94580 - protein, 11 aa, Homo Sapiens
HHDESVLTNVF

SEQ ID NO: 94581 - protein, 11 aa, Homo Sapiens
HHDIHPINQYL

SEQ ID NO: 94582 - protein, 11 aa, Homo Sapiens
HHEDGSQHIGL

SEQ ID NO: 94583 - protein, 11 aa, Homo Sapiens
HHEDRQMNTNW

SEQ ID NO: 94584 - protein, 11 aa, Homo Sapiens
HHEDYQFCYSF

SEQ ID NO: 94585 - protein, 11 aa, Homo Sapiens
HHEESVREASL

SEQ ID NO: 94586 - protein, 11 aa, Homo Sapiens
HHEETLQHEKI

SEQ ID NO: 94587 - protein, 11 aa, Homo Sapiens
HHENTHTGVKF

SEQ ID NO: 94588 - protein, 11 aa, Homo Sapiens
HHGDFSAEEVF

SEQ ID NO: 94589 - protein, 11 aa, Homo Sapiens
HHHGTSILTLF

SEQ ID NO: 94590 - protein, 11 aa, Homo Sapiens
HHHLGSVILIF

SEQ ID NO: 94591 - protein, 11 aa, Homo Sapiens
HHHYEGAVVIL

SEQ ID NO: 94592 - protein, 11 aa, Homo Sapiens
HHIPEQTTQLL

SEQ ID NO: 94593 - protein, 11 aa, Homo Sapiens
HHIYDKTSVLF

SEQ ID NO: 94594 - protein, 11 aa, Homo Sapiens
HHMAGLSSSKL

SEQ ID NO: 94595 - protein, 11 aa, Homo Sapiens
HHQASETHNVI

SEQ ID NO: 94596 - protein, 11 aa, Homo Sapiens
HHQYNPKFQTL

SEQ ID NO: 94597 - protein, 11 aa, Homo Sapiens
HHQYPSRSSGL

SEQ ID NO: 94598 - protein, 11 aa, Homo Sapiens
HHTEEALRELF

SEQ ID NO: 94599 - protein, 11 aa, Homo Sapiens
HHVAESSLSRL

SEQ ID NO: 94600 - protein, 11 aa, Homo Sapiens
HHVAFLEADVL

SEQ ID NO: 94601 - protein, 11 aa, Homo Sapiens
HHVIARHEYTF

SEQ ID NO: 94602 - protein, 11 aa, Homo Sapiens
HHYPGPGNHFW

SEQ ID NO: 94603 - protein, 11 aa, Homo Sapiens
HHYPNQSNTTL

SEQ ID NO: 94604 - protein, 11 aa, Homo Sapiens
HHYQAGESLRF

SEQ ID NO: 94605 - protein, 11 aa, Homo Sapiens
HHYTEAERSLL

SEQ ID NO: 94606 - protein, 11 aa, Homo Sapiens
HQDESSSFHHL

SEQ ID NO: 94607 - protein, 11 aa, Homo Sapiens
HQDLKSGEVTL

SEQ ID NO: 94608 - protein, 11 aa, Homo Sapiens
HQDTSSVGNFI

SEQ ID NO: 94609 - protein, 11 aa, Homo Sapiens
HQIEAVDGEEL

SEQ ID NO: 94610 - protein, 11 aa, Homo Sapiens
HQTELGNQLEY

SEQ ID NO: 94611 - protein, 11 aa, Homo Sapiens
IHCNTPSLLQL

SEQ ID NO: 94612 - protein, 11 aa, Homo Sapiens
IHDDQDYLHSL

SEQ ID NO: 94613 - protein, 11 aa, Homo Sapiens
IHDGAAGVHFI

SEQ ID NO: 94614 - protein, 11 aa, Homo Sapiens
IHDNSVLRNFL

SEQ ID NO: 94615 - protein, 11 aa, Homo Sapiens
IHEDSTNRRRL

SEQ ID NO: 94616 - protein, 11 aa, Homo Sapiens
IHEEFSEHALL

SEQ ID NO: 94617 - protein, 11 aa, Homo Sapiens
IHEIYTVGKRF

SEQ ID NO: 94618 - protein, 11 aa, Homo Sapiens
IHEPEPHILLF

SEQ ID NO: 94619 - protein, 11 aa, Homo Sapiens
IHLISSEANEI

SEQ ID NO: 94620 - protein, 11 aa, Homo Sapiens
IHSDPHPGNVL

SEQ ID NO: 94621 - protein, 11 aa, Homo Sapiens
IHYDDKAIERL

SEQ ID NO: 94622 - protein, 11 aa, Homo Sapiens
ILILDNDGDRL

SEQ ID NO: 94623 - protein, 11 aa, Homo Sapiens
ILINDAGEVRL

SEQ ID NO: 94624 - protein, 11 aa, Homo Sapiens
ILLDDTGLAYI

SEQ ID NO: 94625 - protein, 11 aa, Homo Sapiens
KHEDVAQMLYL

SEQ ID NO: 94626 - protein, 11 aa, Homo Sapiens
KHENVVNLIEI

SEQ ID NO: 94627 - protein, 11 aa, Homo Sapiens
KQDDSQSSNQF

SEQ ID NO: 94628 - protein, 11 aa, Homo Sapiens
LHADVVPNATI

SEQ ID NO: 94629 - protein, 11 aa, Homo Sapiens
LHDIETENQKL

SEQ ID NO: 94630 - protein, 11 aa, Homo Sapiens
LHDIIHTKETL

SEQ ID NO: 94631 - protein, 11 aa, Homo Sapiens
LHDKNGKSYRF

SEQ ID NO: 94632 - protein, 11 aa, Homo Sapiens
LHEIESAGQTW

SEQ ID NO: 94633 - protein, 11 aa, Homo Sapiens
LHHIPDVITYL

SEQ ID NO: 94634 - protein, 11 aa, Homo Sapiens
LHQDPGQPLYI

SEQ ID NO: 94635 - protein, 11 aa, Homo Sapiens
LHVNPYIGLFF

SEQ ID NO: 94636 - protein, 11 aa, Homo Sapiens
LLLDDSLVSIF

SEQ ID NO: 94637 - protein, 11 aa, Homo Sapiens
LPDGTSLTQTF

SEQ ID NO: 94638 - protein, 11 aa, Homo Sapiens
LPEKLTIYTTL

SEQ ID NO: 94639 - protein, 11 aa, Homo Sapiens
LPIDVTEGEVI

SEQ ID NO: 94640 - protein, 11 aa, Homo Sapiens
LQADDGKIVIF

SEQ ID NO: 94641 - protein, 11 aa, Homo Sapiens
MHANAQRTDAL

SEQ ID NO: 94642 - protein, 11 aa, Homo Sapiens
MHAQSAELQRL

SEQ ID NO: 94643 - protein, 11 aa, Homo Sapiens
MHCDADGLHSL

SEQ ID NO: 94644 - protein, 11 aa, Homo Sapiens
MHCGTTSDQFL

SEQ ID NO: 94645 - protein, 11 aa, Homo Sapiens
MHDEKVDLWSL

SEQ ID NO: 94646 - protein, 11 aa, Homo Sapiens
MHDFQDGVLYL

SEQ ID NO: 94647 - protein, 11 aa, Homo Sapiens
MHDLNTDQENL

SEQ ID NO: 94648 - protein, 11 aa, Homo Sapiens
MHENGSTKNLL

SEQ ID NO: 94649 - protein, 11 aa, Homo Sapiens
MHFDPGFEEQL

SEQ ID NO: 94650 - protein, 11 aa, Homo Sapiens
MHGDSEYNIMF

SEQ ID NO: 94651 - protein, 11 aa, Homo Sapiens
MHIKSIILEGF

SEQ ID NO: 94652 - protein, 11 aa, Homo Sapiens
MHIQDPASQRL

SEQ ID NO: 94653 - protein, 11 aa, Homo Sapiens
MHISESQQEFF

SEQ ID NO: 94654 - protein, 11 aa, Homo Sapiens
MRDSTGAGNSL

SEQ ID NO: 94655 - protein, 11 aa, Homo Sapiens
NHDDLMSVVVF

SEQ ID NO: 94656 - protein, 11 aa, Homo Sapiens
NHDQHGRNSLL

SEQ ID NO: 94657 - protein, 11 aa, Homo Sapiens
NHDTSFAKTFV

SEQ ID NO: 94658 - protein, 11 aa, Homo Sapiens
NHEASELANYF

SEQ ID NO: 94659 - protein, 11 aa, Homo Sapiens
NHEEATLGAFL

SEQ ID NO: 94660 - protein, 11 aa, Homo Sapiens
NHINITQSDKF

SEQ ID NO: 94661 - protein, 11 aa, Homo Sapiens
NHLDKQQVQLL

SEQ ID NO: 94662 - protein, 11 aa, Homo Sapiens
NHLESDGQITI

SEQ ID NO: 94663 - protein, 11 aa, Homo Sapiens
NHMEALGHDHL

SEQ ID NO: 94664 - protein, 11 aa, Homo Sapiens
NHMGIHIGEKL

SEQ ID NO: 94665 - protein, 11 aa, Homo Sapiens
NHQATGDVCTL

SEQ ID NO: 94666 - protein, 11 aa, Homo Sapiens
NHQKQLESNKI

SEQ ID NO: 94667 - protein, 11 aa, Homo Sapiens
NHQLPSEHQTI

SEQ ID NO: 94668 - protein, 11 aa, Homo Sapiens
NHSIESKGNEI

SEQ ID NO: 94669 - protein, 11 aa, Homo Sapiens
NHSSLIYSNLL

SEQ ID NO: 94670 - protein, 11 aa, Homo Sapiens
NHVGELCGETL

SEQ ID NO: 94671 - protein, 11 aa, Homo Sapiens
NHVGLGPIESI

SEQ ID NO: 94672 - protein, 11 aa, Homo Sapiens
NHYEFSDCEKF

SEQ ID NO: 94673 - protein, 11 aa, Homo Sapiens
NISHNTQDILI

SEQ ID NO: 94674 - protein, 11 aa, Homo Sapiens
NKTAIGDYLGE

SEQ ID NO: 94675 - protein, 11 aa, Homo Sapiens
NQIPIISAEHL

SEQ ID NO: 94676 - protein, 11 aa, Homo Sapiens
NREGSPDTNRI

SEQ ID NO: 94677 - protein, 11 aa, Homo Sapiens
NRIEENTGHTF

SEQ ID NO: 94678 - protein, 11 aa, Homo Sapiens
NRIGGVQQDTI

SEQ ID NO: 94679 - protein, 11 aa, Homo Sapiens
NRLFTSAEETF

SEQ ID NO: 94680 - protein, 11 aa, Homo Sapiens
PENVEIFAHLL

SEQ ID NO: 94681 - protein, 11 aa, Homo Sapiens
QHAIEESVVLI

SEQ ID NO: 94682 - protein, 11 aa, Homo Sapiens
QHCLDTAFNFF

SEQ ID NO: 94683 - protein, 11 aa, Homo Sapiens
QHDFTSQIFSL

SEQ ID NO: 94684 - protein, 11 aa, Homo Sapiens
QHDPETSVLVL

SEQ ID NO: 94685 - protein, 11 aa, Homo Sapiens
QHDPSSNNAML

SEQ ID NO: 94686 - protein, 11 aa, Homo Sapiens
QHDSGAAVIQL

SEQ ID NO: 94687 - protein, 11 aa, Homo Sapiens
QHDTSLPHCRF

SEQ ID NO: 94688 - protein, 11 aa, Homo Sapiens
QHDVFGDISFL

SEQ ID NO: 94689 - protein, 11 aa, Homo Sapiens
QHECRSILERL

SEQ ID NO: 94690 - protein, 11 aa, Homo Sapiens
QHEDLINLQSF

SEQ ID NO: 94691 - protein, 11 aa, Homo Sapiens
QHEEPESFFTW

SEQ ID NO: 94692 - protein, 11 aa, Homo Sapiens
QHEGLPEPVTL

SEQ ID NO: 94693 - protein, 11 aa, Homo Sapiens
QHEGLPKPLTL

SEQ ID NO: 94694 - protein, 11 aa, Homo Sapiens
QHELGNVFLKF

SEQ ID NO: 94695 - protein, 11 aa, Homo Sapiens
QHETALQGNVF

SEQ ID NO: 94696 - protein, 11 aa, Homo Sapiens
QHEVEEATNIL

SEQ ID NO: 94697 - protein, 11 aa, Homo Sapiens
QHIEESFAEHL

SEQ ID NO: 94698 - protein, 11 aa, Homo Sapiens
QHIEESFSEHL

SEQ ID NO: 94699 - protein, 11 aa, Homo Sapiens
QHIIPLENVTI

SEQ ID NO: 94700 - protein, 11 aa, Homo Sapiens
QHINPLLPACL

SEQ ID NO: 94701 - protein, 11 aa, Homo Sapiens
QHIQTSDPENF

SEQ ID NO: 94702 - protein, 11 aa, Homo Sapiens
QHIVPCTISQL

SEQ ID NO: 94703 - protein, 11 aa, Homo Sapiens
QHIWESDSNEF

SEQ ID NO: 94704 - protein, 11 aa, Homo Sapiens
QHLDPQGAQEL

SEQ ID NO: 94705 - protein, 11 aa, Homo Sapiens
QHLINQNSDYL

SEQ ID NO: 94706 - protein, 11 aa, Homo Sapiens
QHLLSIDEPLF

SEQ ID NO: 94707 - protein, 11 aa, Homo Sapiens
QHLNLNNAEQL

SEQ ID NO: 94708 - protein, 11 aa, Homo Sapiens
QHMDVEESQCL

SEQ ID NO: 94709 - protein, 11 aa, Homo Sapiens
QHQENEGTNQL

SEQ ID NO: 94710 - protein, 11 aa, Homo Sapiens
QHQGAVELLVF

SEQ ID NO: 94711 - protein, 11 aa, Homo Sapiens
QHQLIDQQARL

SEQ ID NO: 94712 - protein, 11 aa, Homo Sapiens
QHQSGIVQLLW

SEQ ID NO: 94713 - protein, 11 aa, Homo Sapiens
QHSGQEVPQVL

SEQ ID NO: 94714 - protein, 11 aa, Homo Sapiens
QHSSQDVHVVL

SEQ ID NO: 94715 - protein, 11 aa, Homo Sapiens
QHVDERKLIQF

SEQ ID NO: 94716 - protein, 11 aa, Homo Sapiens
QHYEDASCGLL

SEQ ID NO: 94717 - protein, 11 aa, Homo Sapiens
QRDEQLLTNVL

SEQ ID NO: 94718 - protein, 11 aa, Homo Sapiens
QRFQSISTEFL

SEQ ID NO: 94719 - protein, 11 aa, Homo Sapiens
QRIGLSSQELF

SEQ ID NO: 94720 - protein, 11 aa, Homo Sapiens
QRLKAIVAEKF

SEQ ID NO: 94721 - protein, 11 aa, Homo Sapiens
QVAEEHYSLFL

SEQ ID NO: 94722 - protein, 11 aa, Homo Sapiens
RHDADGQATLL

SEQ ID NO: 94723 - protein, 11 aa, Homo Sapiens
RHDDSWPFLKL

SEQ ID NO: 94724 - protein, 11 aa, Homo Sapiens
RHEDVVNSVVF

SEQ ID NO: 94725 - protein, 11 aa, Homo Sapiens
RHFGSVVAQTI

SEQ ID NO: 94726 - protein, 11 aa, Homo Sapiens
RHISPTAPDTL

SEQ ID NO: 94727 - protein, 11 aa, Homo Sapiens
RHLPVNSKEFL

SEQ ID NO: 94728 - protein, 11 aa, Homo Sapiens
RQGVDADINGL

SEQ ID NO: 94729 - protein, 11 aa, Homo Sapiens
SHAMASAEQQL

SEQ ID NO: 94730 - protein, 11 aa, Homo Sapiens
SHATQAIFEIL

SEQ ID NO: 94731 - protein, 11 aa, Homo Sapiens
SHDASVKEWTI

SEQ ID NO: 94732 - protein, 11 aa, Homo Sapiens
SHDDTILIWDF

SEQ ID NO: 94733 - protein, 11 aa, Homo Sapiens
SHDIVDGNHRL

SEQ ID NO: 94734 - protein, 11 aa, Homo Sapiens
SHDPSYFACLI

SEQ ID NO: 94735 - protein, 11 aa, Homo Sapiens
SHDSGSDHLAF

SEQ ID NO: 94736 - protein, 11 aa, Homo Sapiens
SHDSTSQLYTV

SEQ ID NO: 94737 - protein, 11 aa, Homo Sapiens
SHDYPGEGIYL

SEQ ID NO: 94738 - protein, 11 aa, Homo Sapiens
SHEANSNAVRF

SEQ ID NO: 94739 - protein, 11 aa, Homo Sapiens
SHEDVILGELL

SEQ ID NO: 94740 - protein, 11 aa, Homo Sapiens
SHEEALSFVSL

SEQ ID NO: 94741 - protein, 11 aa, Homo Sapiens
SHEESELANKL

SEQ ID NO: 94742 - protein, 11 aa, Homo Sapiens
SHEESQTATLL

SEQ ID NO: 94743 - protein, 11 aa, Homo Sapiens
SHEGETAYIRV

SEQ ID NO: 94744 - protein, 11 aa, Homo Sapiens
SHEGETSYIRV

SEQ ID NO: 94745 - protein, 11 aa, Homo Sapiens
SHESDTMSNRI

SEQ ID NO: 94746 - protein, 11 aa, Homo Sapiens
SHETRLPSNTL

SEQ ID NO: 94747 - protein, 11 aa, Homo Sapiens
SHFDDFVTNLI

SEQ ID NO: 94748 - protein, 11 aa, Homo Sapiens
SHFISGGKDCL

SEQ ID NO: 94749 - protein, 11 aa, Homo Sapiens
SHFKESGHNKL

SEQ ID NO: 94750 - protein, 11 aa, Homo Sapiens
SHFNLKEKEYF

SEQ ID NO: 94751 - protein, 11 aa, Homo Sapiens
SHIATEMNQVF

SEQ ID NO: 94752 - protein, 11 aa, Homo Sapiens
SHIDLIDLDTI

SEQ ID NO: 94753 - protein, 11 aa, Homo Sapiens
SHIEDQAEQFF

SEQ ID NO: 94754 - protein, 11 aa, Homo Sapiens
SHILEQHPHTL

SEQ ID NO: 94755 - protein, 11 aa, Homo Sapiens
SHITPSTQQHL

SEQ ID NO: 94756 - protein, 11 aa, Homo Sapiens
SHLSPMEMERF

SEQ ID NO: 94757 - protein, 11 aa, Homo Sapiens
SHLTAEGQATL

SEQ ID NO: 94758 - protein, 11 aa, Homo Sapiens
SHLTDQSSNLL

SEQ ID NO: 94759 - protein, 11 aa, Homo Sapiens
SHMGSIREETL

SEQ ID NO: 94760 - protein, 11 aa, Homo Sapiens
SHSLVELLNQI

SEQ ID NO: 94761 - protein, 11 aa, Homo Sapiens
SHSPVALLNTL

SEQ ID NO: 94762 - protein, 11 aa, Homo Sapiens
SHYEEGPGKNL

SEQ ID NO: 94763 - protein, 11 aa, Homo Sapiens
SHYEFSDCEKF

SEQ ID NO: 94764 - protein, 11 aa, Homo Sapiens
SHYNSVANETF

SEQ ID NO: 94765 - protein, 11 aa, Homo Sapiens
SRADVGDALET

SEQ ID NO: 94766 - protein, 11 aa, Homo Sapiens
SVHVCALEAQA

SEQ ID NO: 94767 - protein, 11 aa, Homo Sapiens
THAAEDIVYTL

SEQ ID NO: 94768 - protein, 11 aa, Homo Sapiens
THADTPVDHCL

SEQ ID NO: 94769 - protein, 11 aa, Homo Sapiens
THAEPQEADYL

SEQ ID NO: 94770 - protein, 11 aa, Homo Sapiens
THANDASALRI

SEQ ID NO: 94771 - protein, 11 aa, Homo Sapiens
THAPLPEVQLL

SEQ ID NO: 94772 - protein, 11 aa, Homo Sapiens
THAPPGEFNEV

SEQ ID NO: 94773 - protein, 11 aa, Homo Sapiens
THAPTHSDYTM

SEQ ID NO: 94774 - protein, 11 aa, Homo Sapiens
THAVVTVPAYF

SEQ ID NO: 94775 - protein, 11 aa, Homo Sapiens
THCIVGATIGF

SEQ ID NO: 94776 - protein, 11 aa, Homo Sapiens
THCIVGSTIGF

SEQ ID NO: 94777 - protein, 11 aa, Homo Sapiens
THCTPLPAQNF

SEQ ID NO: 94778 - protein, 11 aa, Homo Sapiens
THCYDPGSNTW

SEQ ID NO: 94779 - protein, 11 aa, Homo Sapiens
THDATALASVV

SEQ ID NO: 94780 - protein, 11 aa, Homo Sapiens
THDPLHQEVSF

SEQ ID NO: 94781 - protein, 11 aa, Homo Sapiens
THDSEASRQKF

SEQ ID NO: 94782 - protein, 11 aa, Homo Sapiens
THDSNTDMFQI

SEQ ID NO: 94783 - protein, 11 aa, Homo Sapiens
THDVFMNDSLF

SEQ ID NO: 94784 - protein, 11 aa, Homo Sapiens
THEALTLKYKL

SEQ ID NO: 94785 - protein, 11 aa, Homo Sapiens
THEAVYPLYTI

SEQ ID NO: 94786 - protein, 11 aa, Homo Sapiens
THEGTSVTNLL

SEQ ID NO: 94787 - protein, 11 aa, Homo Sapiens
THEKLDFRLHF

SEQ ID NO: 94788 - protein, 11 aa, Homo Sapiens
THELTIPNNLI

SEQ ID NO: 94789 - protein, 11 aa, Homo Sapiens
THEPISVEVQL

SEQ ID NO: 94790 - protein, 11 aa, Homo Sapiens
THEYNEVANLF

SEQ ID NO: 94791 - protein, 11 aa, Homo Sapiens
THFSAGVLQLL

SEQ ID NO: 94792 - protein, 11 aa, Homo Sapiens
THHCPKTPFLL

SEQ ID NO: 94793 - protein, 11 aa, Homo Sapiens
THIILDNADVL

SEQ ID NO: 94794 - protein, 11 aa, Homo Sapiens
THISNDYGNNF

SEQ ID NO: 94795 - protein, 11 aa, Homo Sapiens
THITAQTAVLI

SEQ ID NO: 94796 - protein, 11 aa, Homo Sapiens
THLDYVDTERI

SEQ ID NO: 94797 - protein, 11 aa, Homo Sapiens
THLHRVVSELL

SEQ ID NO: 94798 - protein, 11 aa, Homo Sapiens
THMNSSEKLQF

SEQ ID NO: 94799 - protein, 11 aa, Homo Sapiens
THMTAIVGMAL

SEQ ID NO: 94800 - protein, 11 aa, Homo Sapiens
THNGESVSYLF

SEQ ID NO: 94801 - protein, 11 aa, Homo Sapiens
THQDVHLGETL

SEQ ID NO: 94802 - protein, 11 aa, Homo Sapiens
THQGAGLNMTV

SEQ ID NO: 94803 - protein, 11 aa, Homo Sapiens
THQKVTKGVSL

SEQ ID NO: 94804 - protein, 11 aa, Homo Sapiens
THSDDVTQVRF

SEQ ID NO: 94805 - protein, 11 aa, Homo Sapiens
THSPYVAQILL

SEQ ID NO: 94806 - protein, 11 aa, Homo Sapiens
THTKVLANNSL

SEQ ID NO: 94807 - protein, 11 aa, Homo Sapiens
THVDILNDFTL

SEQ ID NO: 94808 - protein, 11 aa, Homo Sapiens
THVDSHGHNVF

SEQ ID NO: 94809 - protein, 11 aa, Homo Sapiens
THVENQSANCL

SEQ ID NO: 94810 - protein, 11 aa, Homo Sapiens
THVGPTPAITI

SEQ ID NO: 94811 - protein, 11 aa, Homo Sapiens
THVLEGAGNKL

SEQ ID NO: 94812 - protein, 11 aa, Homo Sapiens
THVVVYDGEHL

SEQ ID NO: 94813 - protein, 11 aa, Homo Sapiens
TPDGTEKGDFL

SEQ ID NO: 94814 - protein, 11 aa, Homo Sapiens
TQAESAQSNRL

SEQ ID NO: 94815 - protein, 11 aa, Homo Sapiens
TQANPGKGEGL

SEQ ID NO: 94816 - protein, 11 aa, Homo Sapiens
TQDQNSSSWLI

SEQ ID NO: 94817 - protein, 11 aa, Homo Sapiens
TQEKVTLVQTL

SEQ ID NO: 94818 - protein, 11 aa, Homo Sapiens
TQIGGERYNFF

SEQ ID NO: 94819 - protein, 11 aa, Homo Sapiens
TRDETDTWAYI

SEQ ID NO: 94820 - protein, 11 aa, Homo Sapiens
TRDTNFGTNCI

SEQ ID NO: 94821 - protein, 11 aa, Homo Sapiens
TRLKEEGNEQF

SEQ ID NO: 94822 - protein, 11 aa, Homo Sapiens
VAPGKDLTKTL

SEQ ID NO: 94823 - protein, 11 aa, Homo Sapiens
VHCDPHPGNVL

SEQ ID NO: 94824 - protein, 11 aa, Homo Sapiens
VHDPDKKKMKL

SEQ ID NO: 94825 - protein, 11 aa, Homo Sapiens
VHDPNHSKMRL

SEQ ID NO: 94826 - protein, 11 aa, Homo Sapiens
VHDPVTGKTKL

SEQ ID NO: 94827 - protein, 11 aa, Homo Sapiens
VHDVTLHADAI

SEQ ID NO: 94828 - protein, 11 aa, Homo Sapiens
VHEDIVAVELL

SEQ ID NO: 94829 - protein, 11 aa, Homo Sapiens
VHFHPSNPEHL

SEQ ID NO: 94830 - protein, 11 aa, Homo Sapiens
VHHNPPTIELL

SEQ ID NO: 94831 - protein, 11 aa, Homo Sapiens
VHISDPYNVNL

SEQ ID NO: 94832 - protein, 11 aa, Homo Sapiens
VHLAPFTDEQL

SEQ ID NO: 94833 - protein, 11 aa, Homo Sapiens
VHQGGVELQQL

SEQ ID NO: 94834 - protein, 11 aa, Homo Sapiens
VHSSDLQGNYI

SEQ ID NO: 94835 - protein, 11 aa, Homo Sapiens
VTIKKDVDGAY

SEQ ID NO: 94836 - protein, 11 aa, Homo Sapiens
YEDIAQKSKAE

SEQ ID NO: 94837 - protein, 11 aa, Homo Sapiens
YHAGGSTQNSI

SEQ ID NO: 94838 - protein, 11 aa, Homo Sapiens
YHALPATVWSL

SEQ ID NO: 94839 - protein, 11 aa, Homo Sapiens
YHAPPLSAITF

SEQ ID NO: 94840 - protein, 11 aa, Homo Sapiens
YHARPDSDQRF

SEQ ID NO: 94841 - protein, 11 aa, Homo Sapiens
YHDDSYTATGY

SEQ ID NO: 94842 - protein, 11 aa, Homo Sapiens
YHDIAQQAFKF

SEQ ID NO: 94843 - protein, 11 aa, Homo Sapiens
YHDPTVKHSTF

SEQ ID NO: 94844 - protein, 11 aa, Homo Sapiens
YHDQQDVTSNF

SEQ ID NO: 94845 - protein, 11 aa, Homo Sapiens
YHEATDSLYVF

SEQ ID NO: 94846 - protein, 11 aa, Homo Sapiens
YHEHGSLFDYL

SEQ ID NO: 94847 - protein, 11 aa, Homo Sapiens
YHISLEHEILL

SEQ ID NO: 94848 - protein, 11 aa, Homo Sapiens
YHLENAGCNKI

SEQ ID NO: 94849 - protein, 11 aa, Homo Sapiens
YHLEYSEGESL

SEQ ID NO: 94850 - protein, 11 aa, Homo Sapiens
YHQIGSGKCEI

SEQ ID NO: 94851 - protein, 11 aa, Homo Sapiens
YHSDVAYHNSL

SEQ ID NO: 94852 - protein, 11 aa, Homo Sapiens
YHSEEKASNVL

SEQ ID NO: 94853 - protein, 11 aa, Homo Sapiens
YHSPADNKRYI

SEQ ID NO: 94854 - protein, 11 aa, Homo Sapiens
YHTVAGNDIKI

SEQ ID NO: 94855 - protein, 11 aa, Homo Sapiens
YHVESTVNSEL

SEQ ID NO: 94856 - protein, 11 aa, Homo Sapiens
YQAELSQMQTQ

SEQ ID NO: 94857 - protein, 11 aa, Homo Sapiens
YQLDLPKANLL

SEQ ID NO: 94858 - protein, 11 aa, Homo Sapiens
YRLPAEDEVLL

SEQ ID NO: 94859 - protein, 8 aa, Homo Sapiens
AHGPEWNL

SEQ ID NO: 94860 - protein, 8 aa, Homo Sapiens
DHNQEILL

SEQ ID NO: 94861 - protein, 8 aa, Homo Sapiens
DHQIEVLL

SEQ ID NO: 94862 - protein, 8 aa, Homo Sapiens
DTNADKQL

SEQ ID NO: 94863 - protein, 8 aa, Homo Sapiens
EHSMDTLL

SEQ ID NO: 94864 - protein, 8 aa, Homo Sapiens
EHVFDHPW

SEQ ID NO: 94865 - protein, 8 aa, Homo Sapiens
FHAIDHRL

SEQ ID NO: 94866 - protein, 8 aa, Homo Sapiens
FHDIERKF

SEQ ID NO: 94867 - protein, 8 aa, Homo Sapiens
FHSEEQQL

SEQ ID NO: 94868 - protein, 8 aa, Homo Sapiens
GPTSGHWD

SEQ ID NO: 94869 - protein, 8 aa, Homo Sapiens
HCALILNL

SEQ ID NO: 94870 - protein, 8 aa, Homo Sapiens
HDETLTYL

SEQ ID NO: 94871 - protein, 8 aa, Homo Sapiens
HDGIILKV

SEQ ID NO: 94872 - protein, 8 aa, Homo Sapiens
HDGIVIKI

SEQ ID NO: 94873 - protein, 8 aa, Homo Sapiens
HDGLTVHL

SEQ ID NO: 94874 - protein, 8 aa, Homo Sapiens
HDPYITSI

SEQ ID NO: 94875 - protein, 8 aa, Homo Sapiens
HDSIDYRF

SEQ ID NO: 94876 - protein, 8 aa, Homo Sapiens
HDTTEYKL

SEQ ID NO: 94877 - protein, 8 aa, Homo Sapiens
HDTVFQYL

SEQ ID NO: 94878 - protein, 8 aa, Homo Sapiens
HHCRDVPL

SEQ ID NO: 94879 - protein, 8 aa, Homo Sapiens
HHFQEFSF

SEQ ID NO: 94880 - protein, 8 aa, Homo Sapiens
HHSVEIKI

SEQ ID NO: 94881 - protein, 8 aa, Homo Sapiens
HIITGNKI

SEQ ID NO: 94882 - protein, 8 aa, Homo Sapiens
HTSVGNIL

SEQ ID NO: 94883 - protein, 8 aa, Homo Sapiens
HTVAGNDI

SEQ ID NO: 94884 - protein, 8 aa, Homo Sapiens
IDHDQVLV

SEQ ID NO: 94885 - protein, 8 aa, Homo Sapiens
IHGPDAKL

SEQ ID NO: 94886 - protein, 8 aa, Homo Sapiens
IHSLEVLI

SEQ ID NO: 94887 - protein, 8 aa, Homo Sapiens
IHTVEHMI

SEQ ID NO: 94888 - protein, 8 aa, Homo Sapiens
LHHKDIAL

SEQ ID NO: 94889 - protein, 8 aa, Homo Sapiens
LHNADQPL

SEQ ID NO: 94890 - protein, 8 aa, Homo Sapiens
LHNLDRKW

SEQ ID NO: 94891 - protein, 8 aa, Homo Sapiens
MQGPDWNL

SEQ ID NO: 94892 - protein, 8 aa, Homo Sapiens
NHAPSVQI

SEQ ID NO: 94893 - protein, 8 aa, Homo Sapiens
NHDHEVLL

SEQ ID NO: 94894 - protein, 8 aa, Homo Sapiens
NHDKEIFF

SEQ ID NO: 94895 - protein, 8 aa, Homo Sapiens
NHSSDFLL

SEQ ID NO: 94896 - protein, 8 aa, Homo Sapiens
PINGNGKQ

SEQ ID NO: 94897 - protein, 8 aa, Homo Sapiens
QHAEEFLI

SEQ ID NO: 94898 - protein, 8 aa, Homo Sapiens
QHAYEHSL

SEQ ID NO: 94899 - protein, 8 aa, Homo Sapiens
QHVIETLI

SEQ ID NO: 94900 - protein, 8 aa, Homo Sapiens
RLQEGDKI

SEQ ID NO: 94901 - protein, 8 aa, Homo Sapiens
THSLDIKW

SEQ ID NO: 94902 - protein, 8 aa, Homo Sapiens
VHDFDVKI

SEQ ID NO: 94903 - protein, 8 aa, Homo Sapiens
VHGPDWHL

SEQ ID NO: 94904 - protein, 8 aa, Homo Sapiens
VSLTACKV

SEQ ID NO: 94905 - protein, 8 aa, Homo Sapiens
WHSEDVSL

SEQ ID NO: 94906 - protein, 8 aa, Homo Sapiens
YHDLEQSI

SEQ ID NO: 94907 - protein, 8 aa, Homo Sapiens
YHLENAGC

SEQ ID NO: 94908 - protein, 8 aa, Homo Sapiens
YHMEDSEI

SEQ ID NO: 94909 - protein, 9 aa, Homo Sapiens
AHAEEKLQL

SEQ ID NO: 94910 - protein, 9 aa, Homo Sapiens
AHAKTKVLL

SEQ ID NO: 94911 - protein, 9 aa, Homo Sapiens
AHARVQTCI

SEQ ID NO: 94912 - protein, 9 aa, Homo Sapiens
AHASGLQQV

SEQ ID NO: 94913 - protein, 9 aa, Homo Sapiens
AHAVTEQAI

SEQ ID NO: 94914 - protein, 9 aa, Homo Sapiens
AHCGAGDEL

SEQ ID NO: 94915 - protein, 9 aa, Homo Sapiens
AHCPELVTL

SEQ ID NO: 94916 - protein, 9 aa, Homo Sapiens
AHCQLVHHF

SEQ ID NO: 94917 - protein, 9 aa, Homo Sapiens
AHCWVVVRL

SEQ ID NO: 94918 - protein, 9 aa, Homo Sapiens
AHDAFRSSL

SEQ ID NO: 94919 - protein, 9 aa, Homo Sapiens
AHDAGITIF

SEQ ID NO: 94920 - protein, 9 aa, Homo Sapiens
AHDDAIWSV

SEQ ID NO: 94921 - protein, 9 aa, Homo Sapiens
AHDDGRWSL

SEQ ID NO: 94922 - protein, 9 aa, Homo Sapiens
AHDDSVMYL

SEQ ID NO: 94923 - protein, 9 aa, Homo Sapiens
AHDELDFKL

SEQ ID NO: 94924 - protein, 9 aa, Homo Sapiens
AHDEYLQLL

SEQ ID NO: 94925 - protein, 9 aa, Homo Sapiens
AHDFHRIYI

SEQ ID NO: 94926 - protein, 9 aa, Homo Sapiens
AHDFLAFIL

SEQ ID NO: 94927 - protein, 9 aa, Homo Sapiens
AHDGAGLKL

SEQ ID NO: 94928 - protein, 9 aa, Homo Sapiens
AHDGALWSM

SEQ ID NO: 94929 - protein, 9 aa, Homo Sapiens
AHDGDVNVI

SEQ ID NO: 94930 - protein, 9 aa, Homo Sapiens
AHDGGIYAI

SEQ ID NO: 94931 - protein, 9 aa, Homo Sapiens
AHDGGVFGL

SEQ ID NO: 94932 - protein, 9 aa, Homo Sapiens
AHDGIILKV

SEQ ID NO: 94933 - protein, 9 aa, Homo Sapiens
AHDGIVIKI

SEQ ID NO: 94934 - protein, 9 aa, Homo Sapiens
AHDGQRIYI

SEQ ID NO: 94935 - protein, 9 aa, Homo Sapiens
AHDGSATYL

SEQ ID NO: 94936 - protein, 9 aa, Homo Sapiens
AHDGSVFTL

SEQ ID NO: 94937 - protein, 9 aa, Homo Sapiens
AHDKEVYDI

SEQ ID NO: 94938 - protein, 9 aa, Homo Sapiens
AHDPAGPSL

SEQ ID NO: 94939 - protein, 9 aa, Homo Sapiens
AHDPISPVL

SEQ ID NO: 94940 - protein, 9 aa, Homo Sapiens
AHDQFKSTL

SEQ ID NO: 94941 - protein, 9 aa, Homo Sapiens
AHDQLLWAI

SEQ ID NO: 94942 - protein, 9 aa, Homo Sapiens
AHDSSEYAI

SEQ ID NO: 94943 - protein, 9 aa, Homo Sapiens
AHDTKSVKL

SEQ ID NO: 94944 - protein, 9 aa, Homo Sapiens
AHDTSNATL

SEQ ID NO: 94945 - protein, 9 aa, Homo Sapiens
AHDTTLVAL

SEQ ID NO: 94946 - protein, 9 aa, Homo Sapiens
AHDVDPIEL

SEQ ID NO: 94947 - protein, 9 aa, Homo Sapiens
AHEDAVYGL

SEQ ID NO: 94948 - protein, 9 aa, Homo Sapiens
AHEDKVWGL

SEQ ID NO: 94949 - protein, 9 aa, Homo Sapiens
AHEEIGNIL

SEQ ID NO: 94950 - protein, 9 aa, Homo Sapiens
AHEGFVRGI

SEQ ID NO: 94951 - protein, 9 aa, Homo Sapiens
AHEGMIWSL

SEQ ID NO: 94952 - protein, 9 aa, Homo Sapiens
AHEGQQYNI

SEQ ID NO: 94953 - protein, 9 aa, Homo Sapiens
AHERQAWVI

SEQ ID NO: 94954 - protein, 9 aa, Homo Sapiens
AHETNILEI

SEQ ID NO: 94955 - protein, 9 aa, Homo Sapiens
AHFGFDEQL

SEQ ID NO: 94956 - protein, 9 aa, Homo Sapiens
AHFPINVVI

SEQ ID NO: 94957 - protein, 9 aa, Homo Sapiens
AHFQKSYTL

SEQ ID NO: 94958 - protein, 9 aa, Homo Sapiens
AHFSPQLCI

SEQ ID NO: 94959 - protein, 9 aa, Homo Sapiens
AHHLELWRL

SEQ ID NO: 94960 - protein, 9 aa, Homo Sapiens
AHHNYLTRL

SEQ ID NO: 94961 - protein, 9 aa, Homo Sapiens
AHHPHQNLI

SEQ ID NO: 94962 - protein, 9 aa, Homo Sapiens
AHHTDCTFI

SEQ ID NO: 94963 - protein, 9 aa, Homo Sapiens
AHHTDHHMF

SEQ ID NO: 94964 - protein, 9 aa, Homo Sapiens
AHIFSYERL

SEQ ID NO: 94965 - protein, 9 aa, Homo Sapiens
AHIIALESI

SEQ ID NO: 94966 - protein, 9 aa, Homo Sapiens
AHIKDAVAL

SEQ ID NO: 94967 - protein, 9 aa, Homo Sapiens
AHIKGVETI

SEQ ID NO: 94968 - protein, 9 aa, Homo Sapiens
AHINIRDSI

SEQ ID NO: 94969 - protein, 9 aa, Homo Sapiens
AHISEQAVW

SEQ ID NO: 94970 - protein, 9 aa, Homo Sapiens
AHLALIDYL

SEQ ID NO: 94971 - protein, 9 aa, Homo Sapiens
AHLDGHQKI

SEQ ID NO: 94972 - protein, 9 aa, Homo Sapiens
AHMDGTYKF

SEQ ID NO: 94973 - protein, 9 aa, Homo Sapiens
AHMDIFQNL

SEQ ID NO: 94974 - protein, 9 aa, Homo Sapiens
AHMWFDNQI

SEQ ID NO: 94975 - protein, 9 aa, Homo Sapiens
AHNDVMEVL

SEQ ID NO: 94976 - protein, 9 aa, Homo Sapiens
AHNKEIYTI

SEQ ID NO: 94977 - protein, 9 aa, Homo Sapiens
AHNPQQIYF

SEQ ID NO: 94978 - protein, 9 aa, Homo Sapiens
AHQAEIAQL

SEQ ID NO: 94979 - protein, 9 aa, Homo Sapiens
AHQFPEVRF

SEQ ID NO: 94980 - protein, 9 aa, Homo Sapiens
AHQKFALRL

SEQ ID NO: 94981 - protein, 9 aa, Homo Sapiens
AHQQQQQLL

SEQ ID NO: 94982 - protein, 9 aa, Homo Sapiens
AHQVEQVLL

SEQ ID NO: 94983 - protein, 9 aa, Homo Sapiens
AHSAEEIGI

SEQ ID NO: 94984 - protein, 9 aa, Homo Sapiens
AHSDLILHV

SEQ ID NO: 94985 - protein, 9 aa, Homo Sapiens
AHSDTLFTI

SEQ ID NO: 94986 - protein, 9 aa, Homo Sapiens
AHSEDLQSL

SEQ ID NO: 94987 - protein, 9 aa, Homo Sapiens
AHSELLCYF

SEQ ID NO: 94988 - protein, 9 aa, Homo Sapiens
AHSEQTLSL

SEQ ID NO: 94989 - protein, 9 aa, Homo Sapiens
AHSFVDLLL

SEQ ID NO: 94990 - protein, 9 aa, Homo Sapiens
AHSILIANI

SEQ ID NO: 94991 - protein, 9 aa, Homo Sapiens
AHSILQFQF

SEQ ID NO: 94992 - protein, 9 aa, Homo Sapiens
AHSIQIMKV

SEQ ID NO: 94993 - protein, 9 aa, Homo Sapiens
AHSKGVTCL

SEQ ID NO: 94994 - protein, 9 aa, Homo Sapiens
AHSNEILIF

SEQ ID NO: 94995 - protein, 9 aa, Homo Sapiens
AHSNLASVL

SEQ ID NO: 94996 - protein, 9 aa, Homo Sapiens
AHSPAGNQV

SEQ ID NO: 94997 - protein, 9 aa, Homo Sapiens
AHSPASLSF

SEQ ID NO: 94998 - protein, 9 aa, Homo Sapiens
AHSPELLQF

SEQ ID NO: 94999 - protein, 9 aa, Homo Sapiens
AHSPLAAQL

SEQ ID NO: 95000 - protein, 9 aa, Homo Sapiens
AHSPSLQSL

SEQ ID NO: 95001 - protein, 9 aa, Homo Sapiens
AHSSFQMAL

SEQ ID NO: 95002 - protein, 9 aa, Homo Sapiens
AHSSLPAEL

SEQ ID NO: 95003 - protein, 9 aa, Homo Sapiens
AHSSLQIVL

SEQ ID NO: 95004 - protein, 9 aa, Homo Sapiens
AHSTIMPRL

SEQ ID NO: 95005 - protein, 9 aa, Homo Sapiens
AHSVPSPAF

SEQ ID NO: 95006 - protein, 9 aa, Homo Sapiens
AHTAEVNCL

SEQ ID NO: 95007 - protein, 9 aa, Homo Sapiens
AHTGVIFFL

SEQ ID NO: 95008 - protein, 9 aa, Homo Sapiens
AHTIQICKL

SEQ ID NO: 95009 - protein, 9 aa, Homo Sapiens
AHVDEQVFL

SEQ ID NO: 95010 - protein, 9 aa, Homo Sapiens
AHVDFEAML

SEQ ID NO: 95011 - protein, 9 aa, Homo Sapiens
AHVDLIEKL

SEQ ID NO: 95012 - protein, 9 aa, Homo Sapiens
AHVGSGDLF

SEQ ID NO: 95013 - protein, 9 aa, Homo Sapiens
AHVRTLEML

SEQ ID NO: 95014 - protein, 9 aa, Homo Sapiens
AHVVVGDVL

SEQ ID NO: 95015 - protein, 9 aa, Homo Sapiens
AHWQFETAL

SEQ ID NO: 95016 - protein, 9 aa, Homo Sapiens
ARAALQELL

SEQ ID NO: 95017 - protein, 9 aa, Homo Sapiens
ARCDFALFL

SEQ ID NO: 95018 - protein, 9 aa, Homo Sapiens
ARDEIIWLL

SEQ ID NO: 95019 - protein, 9 aa, Homo Sapiens
ARDSTVLRL

SEQ ID NO: 95020 - protein, 9 aa, Homo Sapiens
ARLDHKFDL

SEQ ID NO: 95021 - protein, 9 aa, Homo Sapiens
ASVRVVNQL

SEQ ID NO: 95022 - protein, 9 aa, Homo Sapiens
CHDPINIQF

SEQ ID NO: 95023 - protein, 9 aa, Homo Sapiens
CHDRNVVTI

SEQ ID NO: 95024 - protein, 9 aa, Homo Sapiens
CHFHIAASI

SEQ ID NO: 95025 - protein, 9 aa, Homo Sapiens
CHFMDPQTI

SEQ ID NO: 95026 - protein, 9 aa, Homo Sapiens
CHIGDNVVL

SEQ ID NO: 95027 - protein, 9 aa, Homo Sapiens
CHNAQTFNL

SEQ ID NO: 95028 - protein, 9 aa, Homo Sapiens
CHNQFSLFL

SEQ ID NO: 95029 - protein, 9 aa, Homo Sapiens
CHSPVVSQL

SEQ ID NO: 95030 - protein, 9 aa, Homo Sapiens
CHSVLPLLL

SEQ ID NO: 95031 - protein, 9 aa, Homo Sapiens
CRSIIQVYL

SEQ ID NO: 95032 - protein, 9 aa, Homo Sapiens
DHARLQLQL

SEQ ID NO: 95033 - protein, 9 aa, Homo Sapiens
DHASIQMNV

SEQ ID NO: 95034 - protein, 9 aa, Homo Sapiens
DHCDFPELL

SEQ ID NO: 95035 - protein, 9 aa, Homo Sapiens
DHCKQVVEI

SEQ ID NO: 95036 - protein, 9 aa, Homo Sapiens
DHCPITLYL

SEQ ID NO: 95037 - protein, 9 aa, Homo Sapiens
DHCPTKISL

SEQ ID NO: 95038 - protein, 9 aa, Homo Sapiens
DHCPVGAVL

SEQ ID NO: 95039 - protein, 9 aa, Homo Sapiens
DHDGGFWLV

SEQ ID NO: 95040 - protein, 9 aa, Homo Sapiens
DHDGNIVEL

SEQ ID NO: 95041 - protein, 9 aa, Homo Sapiens
DHDGVVMCF

SEQ ID NO: 95042 - protein, 9 aa, Homo Sapiens
DHDIGTTNL

SEQ ID NO: 95043 - protein, 9 aa, Homo Sapiens
DHDKALQLL

SEQ ID NO: 95044 - protein, 9 aa, Homo Sapiens
DHDNIVKVF

SEQ ID NO: 95045 - protein, 9 aa, Homo Sapiens
DHDRIRQFI

SEQ ID NO: 95046 - protein, 9 aa, Homo Sapiens
DHDTVFQYL

SEQ ID NO: 95047 - protein, 9 aa, Homo Sapiens
DHEASYHSL

SEQ ID NO: 95048 - protein, 9 aa, Homo Sapiens
DHEGLGISI

SEQ ID NO: 95049 - protein, 9 aa, Homo Sapiens
DHERLFELI

SEQ ID NO: 95050 - protein, 9 aa, Homo Sapiens
DHERLQYYF

SEQ ID NO: 95051 - protein, 9 aa, Homo Sapiens
DHESSTWII

SEQ ID NO: 95052 - protein, 9 aa, Homo Sapiens
DHFGGKLHL

SEQ ID NO: 95053 - protein, 9 aa, Homo Sapiens
DHFPEILFI

SEQ ID NO: 95054 - protein, 9 aa, Homo Sapiens
DHFPVEFKL

SEQ ID NO: 95055 - protein, 9 aa, Homo Sapiens
DHFSKSLFL

SEQ ID NO: 95056 - protein, 9 aa, Homo Sapiens
DHHGEKLLL

SEQ ID NO: 95057 - protein, 9 aa, Homo Sapiens
DHHLEVVAF

SEQ ID NO: 95058 - protein, 9 aa, Homo Sapiens
DHHQEVIGF

SEQ ID NO: 95059 - protein, 9 aa, Homo Sapiens
DHIIDICFL

SEQ ID NO: 95060 - protein, 9 aa, Homo Sapiens
DHINDIIKI

SEQ ID NO: 95061 - protein, 9 aa, Homo Sapiens
DHIRFISEL

SEQ ID NO: 95062 - protein, 9 aa, Homo Sapiens
DHLGDSPKI

SEQ ID NO: 95063 - protein, 9 aa, Homo Sapiens
DHMRFISEL

SEQ ID NO: 95064 - protein, 9 aa, Homo Sapiens
DHNEGFSLI

SEQ ID NO: 95065 - protein, 9 aa, Homo Sapiens
DHQREITSL

SEQ ID NO: 95066 - protein, 9 aa, Homo Sapiens
DHSAFIILL

SEQ ID NO: 95067 - protein, 9 aa, Homo Sapiens
DHSATIVSI

SEQ ID NO: 95068 - protein, 9 aa, Homo Sapiens
DHSNIGNKM

SEQ ID NO: 95069 - protein, 9 aa, Homo Sapiens
DHSPCDPTI

SEQ ID NO: 95070 - protein, 9 aa, Homo Sapiens
DHSPDLYSL

SEQ ID NO: 95071 - protein, 9 aa, Homo Sapiens
DHSPTPSVF

SEQ ID NO: 95072 - protein, 9 aa, Homo Sapiens
DHSPVFATF

SEQ ID NO: 95073 - protein, 9 aa, Homo Sapiens
DHSRDVAAI

SEQ ID NO: 95074 - protein, 9 aa, Homo Sapiens
DHSSALQNI

SEQ ID NO: 95075 - protein, 9 aa, Homo Sapiens
DHSTLVTLF

SEQ ID NO: 95076 - protein, 9 aa, Homo Sapiens
DHSYVELFL

SEQ ID NO: 95077 - protein, 9 aa, Homo Sapiens
DKVQAGDVI

SEQ ID NO: 95078 - protein, 9 aa, Homo Sapiens
DLITKGDLI

SEQ ID NO: 95079 - protein, 9 aa, Homo Sapiens
DQCKTVLKL

SEQ ID NO: 95080 - protein, 9 aa, Homo Sapiens
DQHELGPDA

SEQ ID NO: 95081 - protein, 9 aa, Homo Sapiens
DRCLLVLHL

SEQ ID NO: 95082 - protein, 9 aa, Homo Sapiens
DRDGTIIHL

SEQ ID NO: 95083 - protein, 9 aa, Homo Sapiens
DRDPTAYAL

SEQ ID NO: 95084 - protein, 9 aa, Homo Sapiens
DRFENNELF

SEQ ID NO: 95085 - protein, 9 aa, Homo Sapiens
DRTNVGDQI

SEQ ID NO: 95086 - protein, 9 aa, Homo Sapiens
EHAANDVSF

SEQ ID NO: 95087 - protein, 9 aa, Homo Sapiens
EHADDDPSL

SEQ ID NO: 95088 - protein, 9 aa, Homo Sapiens
EHADTVQLV

SEQ ID NO: 95089 - protein, 9 aa, Homo Sapiens
EHAGGEVEL

SEQ ID NO: 95090 - protein, 9 aa, Homo Sapiens
EHAGVISVL

SEQ ID NO: 95091 - protein, 9 aa, Homo Sapiens
EHAHLIVVL

SEQ ID NO: 95092 - protein, 9 aa, Homo Sapiens
EHAKAVVSL

SEQ ID NO: 95093 - protein, 9 aa, Homo Sapiens
EHAKEIPRF

SEQ ID NO: 95094 - protein, 9 aa, Homo Sapiens
EHANDYAEI

SEQ ID NO: 95095 - protein, 9 aa, Homo Sapiens
EHANNYPEI

SEQ ID NO: 95096 - protein, 9 aa, Homo Sapiens
EHANQQTGF

SEQ ID NO: 95097 - protein, 9 aa, Homo Sapiens
EHAPAPQEV

SEQ ID NO: 95098 - protein, 9 aa, Homo Sapiens
EHAPGNQGF

SEQ ID NO: 95099 - protein, 9 aa, Homo Sapiens
EHAPIRSSL

SEQ ID NO: 95100 - protein, 9 aa, Homo Sapiens
EHAPSIIFM

SEQ ID NO: 95101 - protein, 9 aa, Homo Sapiens
EHAPSIVFI

SEQ ID NO: 95102 - protein, 9 aa, Homo Sapiens
EHAQAVDYI

SEQ ID NO: 95103 - protein, 9 aa, Homo Sapiens
EHARPQTTL

SEQ ID NO: 95104 - protein, 9 aa, Homo Sapiens
EHASSLLEL

SEQ ID NO: 95105 - protein, 9 aa, Homo Sapiens
EHAVGYALL

SEQ ID NO: 95106 - protein, 9 aa, Homo Sapiens
EHCDIFMNL

SEQ ID NO: 95107 - protein, 9 aa, Homo Sapiens
EHCPELQYV

SEQ ID NO: 95108 - protein, 9 aa, Homo Sapiens
EHCYDIYRL

SEQ ID NO: 95109 - protein, 9 aa, Homo Sapiens
EHDAAAESL

SEQ ID NO: 95110 - protein, 9 aa, Homo Sapiens
EHDAFIFAL

SEQ ID NO: 95111 - protein, 9 aa, Homo Sapiens
EHDARIQAL

SEQ ID NO: 95112 - protein, 9 aa, Homo Sapiens
EHDAWFIFF

SEQ ID NO: 95113 - protein, 9 aa, Homo Sapiens
EHDDFFISL

SEQ ID NO: 95114 - protein, 9 aa, Homo Sapiens
EHDDGGYRI

SEQ ID NO: 95115 - protein, 9 aa, Homo Sapiens
EHDDIVSTV

SEQ ID NO: 95116 - protein, 9 aa, Homo Sapiens
EHDFSKISI

SEQ ID NO: 95117 - protein, 9 aa, Homo Sapiens
EHDIRHYDL

SEQ ID NO: 95118 - protein, 9 aa, Homo Sapiens
EHDISLDRI

SEQ ID NO: 95119 - protein, 9 aa, Homo Sapiens
EHDPHVLLA

SEQ ID NO: 95120 - protein, 9 aa, Homo Sapiens
EHDPQYAVI

SEQ ID NO: 95121 - protein, 9 aa, Homo Sapiens
EHDPRVITV

SEQ ID NO: 95122 - protein, 9 aa, Homo Sapiens
EHDPSSIYL

SEQ ID NO: 95123 - protein, 9 aa, Homo Sapiens
EHDPVGQMV

SEQ ID NO: 95124 - protein, 9 aa, Homo Sapiens
EHDPVSQRL

SEQ ID NO: 95125 - protein, 9 aa, Homo Sapiens
EHDPVTEFI

SEQ ID NO: 95126 - protein, 9 aa, Homo Sapiens
EHDQALAVL

SEQ ID NO: 95127 - protein, 9 aa, Homo Sapiens
EHDRIARQW

SEQ ID NO: 95128 - protein, 9 aa, Homo Sapiens
EHDRMARQW

SEQ ID NO: 95129 - protein, 9 aa, Homo Sapiens
EHDSQIVQI

SEQ ID NO: 95130 - protein, 9 aa, Homo Sapiens
EHDTTEYKL

SEQ ID NO: 95131 - protein, 9 aa, Homo Sapiens
EHDVKTLQL

SEQ ID NO: 95132 - protein, 9 aa, Homo Sapiens
EHDVPHQPF

SEQ ID NO: 95133 - protein, 9 aa, Homo Sapiens
EHDVSVDTI

SEQ ID NO: 95134 - protein, 9 aa, Homo Sapiens
EHDYGLFHL

SEQ ID NO: 95135 - protein, 9 aa, Homo Sapiens
EHDYTSVCL

SEQ ID NO: 95136 - protein, 9 aa, Homo Sapiens
EHEDTFVYL

SEQ ID NO: 95137 - protein, 9 aa, Homo Sapiens
EHEKEQYCI

SEQ ID NO: 95138 - protein, 9 aa, Homo Sapiens
EHEKLQQLL

SEQ ID NO: 95139 - protein, 9 aa, Homo Sapiens
EHEQFQHAI

SEQ ID NO: 95140 - protein, 9 aa, Homo Sapiens
EHFEKAIEL

SEQ ID NO: 95141 - protein, 9 aa, Homo Sapiens
EHFEKLIFL

SEQ ID NO: 95142 - protein, 9 aa, Homo Sapiens
EHFFHSLML

SEQ ID NO: 95143 - protein, 9 aa, Homo Sapiens
EHFKTILLL

SEQ ID NO: 95144 - protein, 9 aa, Homo Sapiens
EHFKYPVMI

SEQ ID NO: 95145 - protein, 9 aa, Homo Sapiens
EHFNGVAEL

SEQ ID NO: 95146 - protein, 9 aa, Homo Sapiens
EHFPNHQQL

SEQ ID NO: 95147 - protein, 9 aa, Homo Sapiens
EHFPRVLEF

SEQ ID NO: 95148 - protein, 9 aa, Homo Sapiens
EHFREKHFL

SEQ ID NO: 95149 - protein, 9 aa, Homo Sapiens
EHFSHSSKW

SEQ ID NO: 95150 - protein, 9 aa, Homo Sapiens
EHFSSEVTI

SEQ ID NO: 95151 - protein, 9 aa, Homo Sapiens
EHGDQDYIW

SEQ ID NO: 95152 - protein, 9 aa, Homo Sapiens
EHGLNFQRL

SEQ ID NO: 95153 - protein, 9 aa, Homo Sapiens
EHGNTPLHL

SEQ ID NO: 95154 - protein, 9 aa, Homo Sapiens
EHHAEAAQF

SEQ ID NO: 95155 - protein, 9 aa, Homo Sapiens
EHHEEDFFL

SEQ ID NO: 95156 - protein, 9 aa, Homo Sapiens
EHHNGIAEL

SEQ ID NO: 95157 - protein, 9 aa, Homo Sapiens
EHHSKELRL

SEQ ID NO: 95158 - protein, 9 aa, Homo Sapiens
EHIAQGLRL

SEQ ID NO: 95159 - protein, 9 aa, Homo Sapiens
EHIDDKIAL

SEQ ID NO: 95160 - protein, 9 aa, Homo Sapiens
EHIETAYRI

SEQ ID NO: 95161 - protein, 9 aa, Homo Sapiens
EHIHFIGKI

SEQ ID NO: 95162 - protein, 9 aa, Homo Sapiens
EHIHSNEVI

SEQ ID NO: 95163 - protein, 9 aa, Homo Sapiens
EHIKLQQEL

SEQ ID NO: 95164 - protein, 9 aa, Homo Sapiens
EHIMDLTRL

SEQ ID NO: 95165 - protein, 9 aa, Homo Sapiens
EHITSEYTL

SEQ ID NO: 95166 - protein, 9 aa, Homo Sapiens
EHIVADDRF

SEQ ID NO: 95167 - protein, 9 aa, Homo Sapiens
EHLDLPCAL

SEQ ID NO: 95168 - protein, 9 aa, Homo Sapiens
EHLFSVEQI

SEQ ID NO: 95169 - protein, 9 aa, Homo Sapiens
EHLNYVTEI

SEQ ID NO: 95170 - protein, 9 aa, Homo Sapiens
EHLPVSAEI

SEQ ID NO: 95171 - protein, 9 aa, Homo Sapiens
EHMEMQQNI

SEQ ID NO: 95172 - protein, 9 aa, Homo Sapiens
EHMKEIVVL

SEQ ID NO: 95173 - protein, 9 aa, Homo Sapiens
EHMMESVLI

SEQ ID NO: 95174 - protein, 9 aa, Homo Sapiens
EHMPSGESL

SEQ ID NO: 95175 - protein, 9 aa, Homo Sapiens
EHNDWIIHL

SEQ ID NO: 95176 - protein, 9 aa, Homo Sapiens
EHQAISFML

SEQ ID NO: 95177 - protein, 9 aa, Homo Sapiens
EHQAIVQHL

SEQ ID NO: 95178 - protein, 9 aa, Homo Sapiens
EHQAVLQSL

SEQ ID NO: 95179 - protein, 9 aa, Homo Sapiens
EHQDIVCLL

SEQ ID NO: 95180 - protein, 9 aa, Homo Sapiens
EHQEYITFL

SEQ ID NO: 95181 - protein, 9 aa, Homo Sapiens
EHQGIFTFL

SEQ ID NO: 95182 - protein, 9 aa, Homo Sapiens
EHQKPPVSI

SEQ ID NO: 95183 - protein, 9 aa, Homo Sapiens
EHQQFITFL

SEQ ID NO: 95184 - protein, 9 aa, Homo Sapiens
EHQQLQAKI

SEQ ID NO: 95185 - protein, 9 aa, Homo Sapiens
EHQVPVEKL

SEQ ID NO: 95186 - protein, 9 aa, Homo Sapiens
EHSAVNMNL

SEQ ID NO: 95187 - protein, 9 aa, Homo Sapiens
EHSCDEQYL

SEQ ID NO: 95188 - protein, 9 aa, Homo Sapiens
EHSDLIMTL

SEQ ID NO: 95189 - protein, 9 aa, Homo Sapiens
EHSDVLPVL

SEQ ID NO: 95190 - protein, 9 aa, Homo Sapiens
EHSELQDRL

SEQ ID NO: 95191 - protein, 9 aa, Homo Sapiens
EHSETIIEL

SEQ ID NO: 95192 - protein, 9 aa, Homo Sapiens
EHSFPFQFL

SEQ ID NO: 95193 - protein, 9 aa, Homo Sapiens
EHSGEFEKI

SEQ ID NO: 95194 - protein, 9 aa, Homo Sapiens
EHSGPPIVI

SEQ ID NO: 95195 - protein, 9 aa, Homo Sapiens
EHSIATLLL

SEQ ID NO: 95196 - protein, 9 aa, Homo Sapiens
EHSKLIAKV

SEQ ID NO: 95197 - protein, 9 aa, Homo Sapiens
EHSKSFDKW

SEQ ID NO: 95198 - protein, 9 aa, Homo Sapiens
EHSKVRLVI

SEQ ID NO: 95199 - protein, 9 aa, Homo Sapiens
EHSLLPLML

SEQ ID NO: 95200 - protein, 9 aa, Homo Sapiens
EHSLPTLGL

SEQ ID NO: 95201 - protein, 9 aa, Homo Sapiens
EHSLVIDTL

SEQ ID NO: 95202 - protein, 9 aa, Homo Sapiens
EHSNMAIDL

SEQ ID NO: 95203 - protein, 9 aa, Homo Sapiens
EHSPVPAGF

SEQ ID NO: 95204 - protein, 9 aa, Homo Sapiens
EHSPYYEAM

SEQ ID NO: 95205 - protein, 9 aa, Homo Sapiens
EHSSLKTHL

SEQ ID NO: 95206 - protein, 9 aa, Homo Sapiens
EHSTGITHL

SEQ ID NO: 95207 - protein, 9 aa, Homo Sapiens
EHSTVITFL

SEQ ID NO: 95208 - protein, 9 aa, Homo Sapiens
EHTDQVLHL

SEQ ID NO: 95209 - protein, 9 aa, Homo Sapiens
EHTEVLQLL

SEQ ID NO: 95210 - protein, 9 aa, Homo Sapiens
EHVDVIAKF

SEQ ID NO: 95211 - protein, 9 aa, Homo Sapiens
EHVLTGDSI

SEQ ID NO: 95212 - protein, 9 aa, Homo Sapiens
EHVPLLLYI

SEQ ID NO: 95213 - protein, 9 aa, Homo Sapiens
EHVPSSSSI

SEQ ID NO: 95214 - protein, 9 aa, Homo Sapiens
EHVQYMAEL

SEQ ID NO: 95215 - protein, 9 aa, Homo Sapiens
EHVYPDHRL

SEQ ID NO: 95216 - protein, 9 aa, Homo Sapiens
EHYHIVQKF

SEQ ID NO: 95217 - protein, 9 aa, Homo Sapiens
EHYHLTEAL

SEQ ID NO: 95218 - protein, 9 aa, Homo Sapiens
EHYNIPAFF

SEQ ID NO: 95219 - protein, 9 aa, Homo Sapiens
EHYNSVTRL

SEQ ID NO: 95220 - protein, 9 aa, Homo Sapiens
EHYPMTEQF

SEQ ID NO: 95221 - protein, 9 aa, Homo Sapiens
EHYRHALRL

SEQ ID NO: 95222 - protein, 9 aa, Homo Sapiens
ELDPVEYTL

SEQ ID NO: 95223 - protein, 9 aa, Homo Sapiens
EQDPTNLYI

SEQ ID NO: 95224 - protein, 9 aa, Homo Sapiens
ERAALQEEL

SEQ ID NO: 95225 - protein, 9 aa, Homo Sapiens
ERDDQQVFI

SEQ ID NO: 95226 - protein, 9 aa, Homo Sapiens
ERDPATYNI

SEQ ID NO: 95227 - protein, 9 aa, Homo Sapiens
ERDPQSPEF

SEQ ID NO: 95228 - protein, 9 aa, Homo Sapiens
ERDPVLWSL

SEQ ID NO: 95229 - protein, 9 aa, Homo Sapiens
ERDPVPLSI

SEQ ID NO: 95230 - protein, 9 aa, Homo Sapiens
ERDRLILFL

SEQ ID NO: 95231 - protein, 9 aa, Homo Sapiens
ERFRCPEAI

SEQ ID NO: 95232 - protein, 9 aa, Homo Sapiens
ERIRDVVYF

SEQ ID NO: 95233 - protein, 9 aa, Homo Sapiens
ERLQIDEQL

SEQ ID NO: 95234 - protein, 9 aa, Homo Sapiens
ERLVIQSYF

SEQ ID NO: 95235 - protein, 9 aa, Homo Sapiens
FEDDTRFYL

SEQ ID NO: 95236 - protein, 9 aa, Homo Sapiens
FEDSNVYML

SEQ ID NO: 95237 - protein, 9 aa, Homo Sapiens
FHAEPVDVW

SEQ ID NO: 95238 - protein, 9 aa, Homo Sapiens
FHAEQEKFL

SEQ ID NO: 95239 - protein, 9 aa, Homo Sapiens
FHAFLKTEF

SEQ ID NO: 95240 - protein, 9 aa, Homo Sapiens
FHAKEVQLF

SEQ ID NO: 95241 - protein, 9 aa, Homo Sapiens
FHATDLQML

SEQ ID NO: 95242 - protein, 9 aa, Homo Sapiens
FHCESSAHW

SEQ ID NO: 95243 - protein, 9 aa, Homo Sapiens
FHCLRILDL

SEQ ID NO: 95244 - protein, 9 aa, Homo Sapiens
FHCTLIGYF

SEQ ID NO: 95245 - protein, 9 aa, Homo Sapiens
FHDATRVYL

SEQ ID NO: 95246 - protein, 9 aa, Homo Sapiens
FHDDSMKSF

SEQ ID NO: 95247 - protein, 9 aa, Homo Sapiens
FHDDTHSRI

SEQ ID NO: 95248 - protein, 9 aa, Homo Sapiens
FHDDWISSI

SEQ ID NO: 95249 - protein, 9 aa, Homo Sapiens
FHDGDSVVF

SEQ ID NO: 95250 - protein, 9 aa, Homo Sapiens
FHDGFLLEV

SEQ ID NO: 95251 - protein, 9 aa, Homo Sapiens
FHDGSVHIV

SEQ ID NO: 95252 - protein, 9 aa, Homo Sapiens
FHDGYGEDL

SEQ ID NO: 95253 - protein, 9 aa, Homo Sapiens
FHDITRLHL

SEQ ID NO: 95254 - protein, 9 aa, Homo Sapiens
FHDKTPYTI

SEQ ID NO: 95255 - protein, 9 aa, Homo Sapiens
FHDKYGNAV

SEQ ID NO: 95256 - protein, 9 aa, Homo Sapiens
FHDLEGNAV

SEQ ID NO: 95257 - protein, 9 aa, Homo Sapiens
FHDMGGVQL

SEQ ID NO: 95258 - protein, 9 aa, Homo Sapiens
FHDMMPKYL

SEQ ID NO: 95259 - protein, 9 aa, Homo Sapiens
FHDMNPQSI

SEQ ID NO: 95260 - protein, 9 aa, Homo Sapiens
FHDNSGDVF

SEQ ID NO: 95261 - protein, 9 aa, Homo Sapiens
FHDPDSAVV

SEQ ID NO: 95262 - protein, 9 aa, Homo Sapiens
FHDPWKLLI

SEQ ID NO: 95263 - protein, 9 aa, Homo Sapiens
FHDSAVTSV

SEQ ID NO: 95264 - protein, 9 aa, Homo Sapiens
FHDSSPTQI

SEQ ID NO: 95265 - protein, 9 aa, Homo Sapiens
FHDVAGDIF

SEQ ID NO: 95266 - protein, 9 aa, Homo Sapiens
FHDVNCEVV

SEQ ID NO: 95267 - protein, 9 aa, Homo Sapiens
FHEEDESSF

SEQ ID NO: 95268 - protein, 9 aa, Homo Sapiens
FHEEEREGL

SEQ ID NO: 95269 - protein, 9 aa, Homo Sapiens
FHEEFIHYL

SEQ ID NO: 95270 - protein, 9 aa, Homo Sapiens
FHEEILPMF

SEQ ID NO: 95271 - protein, 9 aa, Homo Sapiens
FHEFHSPAL

SEQ ID NO: 95272 - protein, 9 aa, Homo Sapiens
FHEGDVITL

SEQ ID NO: 95273 - protein, 9 aa, Homo Sapiens
FHESGFTTV

SEQ ID NO: 95274 - protein, 9 aa, Homo Sapiens
FHESGLLRF

SEQ ID NO: 95275 - protein, 9 aa, Homo Sapiens
FHEYQESTI

SEQ ID NO: 95276 - protein, 9 aa, Homo Sapiens
FHFAGDGKL

SEQ ID NO: 95277 - protein, 9 aa, Homo Sapiens
FHFEPNEYF

SEQ ID NO: 95278 - protein, 9 aa, Homo Sapiens
FHFHCISRW

SEQ ID NO: 95279 - protein, 9 aa, Homo Sapiens
FHFRTDERI

SEQ ID NO: 95280 - protein, 9 aa, Homo Sapiens
FHGDPHATF

SEQ ID NO: 95281 - protein, 9 aa, Homo Sapiens
FHGPPEPVL

SEQ ID NO: 95282 - protein, 9 aa, Homo Sapiens
FHGVKDIKW

SEQ ID NO: 95283 - protein, 9 aa, Homo Sapiens
FHHESKENF

SEQ ID NO: 95284 - protein, 9 aa, Homo Sapiens
FHHEYPWIL

SEQ ID NO: 95285 - protein, 9 aa, Homo Sapiens
FHHPNILEL

SEQ ID NO: 95286 - protein, 9 aa, Homo Sapiens
FHHPSAVRL

SEQ ID NO: 95287 - protein, 9 aa, Homo Sapiens
FHHQDGYRY

SEQ ID NO: 95288 - protein, 9 aa, Homo Sapiens
FHHVGQAGL

SEQ ID NO: 95289 - protein, 9 aa, Homo Sapiens
FHIDFGHFL

SEQ ID NO: 95290 - protein, 9 aa, Homo Sapiens
FHIDFGHIL

SEQ ID NO: 95291 - protein, 9 aa, Homo Sapiens
FHIGDRVLI

SEQ ID NO: 95292 - protein, 9 aa, Homo Sapiens
FHITVGKAI

SEQ ID NO: 95293 - protein, 9 aa, Homo Sapiens
FHLAFEEEF

SEQ ID NO: 95294 - protein, 9 aa, Homo Sapiens
FHLDVEDYL

SEQ ID NO: 95295 - protein, 9 aa, Homo Sapiens
FHLIDFNLL

SEQ ID NO: 95296 - protein, 9 aa, Homo Sapiens
FHLPDDPSI

SEQ ID NO: 95297 - protein, 9 aa, Homo Sapiens
FHMDKVHYI

SEQ ID NO: 95298 - protein, 9 aa, Homo Sapiens
FHMDPSGTF

SEQ ID NO: 95299 - protein, 9 aa, Homo Sapiens
FHMHCILKW

SEQ ID NO: 95300 - protein, 9 aa, Homo Sapiens
FHNFIKVTL

SEQ ID NO: 95301 - protein, 9 aa, Homo Sapiens
FHNNIIVLI

SEQ ID NO: 95302 - protein, 9 aa, Homo Sapiens
FHNTEVEAM

SEQ ID NO: 95303 - protein, 9 aa, Homo Sapiens
FHQDLPLSI

SEQ ID NO: 95304 - protein, 9 aa, Homo Sapiens
FHQDPPLMF

SEQ ID NO: 95305 - protein, 9 aa, Homo Sapiens
FHQEEKESL

SEQ ID NO: 95306 - protein, 9 aa, Homo Sapiens
FHQEHEVRM

SEQ ID NO: 95307 - protein, 9 aa, Homo Sapiens
FHQELPLYI

SEQ ID NO: 95308 - protein, 9 aa, Homo Sapiens
FHQEQGHQL

SEQ ID NO: 95309 - protein, 9 aa, Homo Sapiens
FHQPDSVIL

SEQ ID NO: 95310 - protein, 9 aa, Homo Sapiens
FHQRGIALW

SEQ ID NO: 95311 - protein, 9 aa, Homo Sapiens
FHSDPLSAI

SEQ ID NO: 95312 - protein, 9 aa, Homo Sapiens
FHSDYRPLI

SEQ ID NO: 95313 - protein, 9 aa, Homo Sapiens
FHSEEQQLL

SEQ ID NO: 95314 - protein, 9 aa, Homo Sapiens
FHSEIEDFL

SEQ ID NO: 95315 - protein, 9 aa, Homo Sapiens
FHSFEELLL

SEQ ID NO: 95316 - protein, 9 aa, Homo Sapiens
FHSHDGPSL

SEQ ID NO: 95317 - protein, 9 aa, Homo Sapiens
FHSNDVATL

SEQ ID NO: 95318 - protein, 9 aa, Homo Sapiens
FHSPPQEAL

SEQ ID NO: 95319 - protein, 9 aa, Homo Sapiens
FHSVEVHKW

SEQ ID NO: 95320 - protein, 9 aa, Homo Sapiens
FHTEFQNLL

SEQ ID NO: 95321 - protein, 9 aa, Homo Sapiens
FHTGDVLKI

SEQ ID NO: 95322 - protein, 9 aa, Homo Sapiens
FHTVIGDTV

SEQ ID NO: 95323 - protein, 9 aa, Homo Sapiens
FHVDKVHNI

SEQ ID NO: 95324 - protein, 9 aa, Homo Sapiens
FHVDVPVQF

SEQ ID NO: 95325 - protein, 9 aa, Homo Sapiens
FHVFVRDVL

SEQ ID NO: 95326 - protein, 9 aa, Homo Sapiens
FHVPSLEEL

SEQ ID NO: 95327 - protein, 9 aa, Homo Sapiens
FHVSPDPSV

SEQ ID NO: 95328 - protein, 9 aa, Homo Sapiens
FHVVGTNIV

SEQ ID NO: 95329 - protein, 9 aa, Homo Sapiens
FHWSGNEQM

SEQ ID NO: 95330 - protein, 9 aa, Homo Sapiens
FHYDYIDLL

SEQ ID NO: 95331 - protein, 9 aa, Homo Sapiens
FHYHHVTKL

SEQ ID NO: 95332 - protein, 9 aa, Homo Sapiens
FHYPGVQNL

SEQ ID NO: 95333 - protein, 9 aa, Homo Sapiens
FKIDAGDRF

SEQ ID NO: 95334 - protein, 9 aa, Homo Sapiens
FKIDKEYLL

SEQ ID NO: 95335 - protein, 9 aa, Homo Sapiens
FLLPMFERL

SEQ ID NO: 95336 - protein, 9 aa, Homo Sapiens
FLSTVGDLL

SEQ ID NO: 95337 - protein, 9 aa, Homo Sapiens
FQDALEPLL

SEQ ID NO: 95338 - protein, 9 aa, Homo Sapiens
FQDEINWRL

SEQ ID NO: 95339 - protein, 9 aa, Homo Sapiens
FQDGTKATF

SEQ ID NO: 95340 - protein, 9 aa, Homo Sapiens
FQDHTKLIL

SEQ ID NO: 95341 - protein, 9 aa, Homo Sapiens
FQDPSVTQL

SEQ ID NO: 95342 - protein, 9 aa, Homo Sapiens
FQHEDLNFL

SEQ ID NO: 95343 - protein, 9 aa, Homo Sapiens
FRDVGSEEI

SEQ ID NO: 95344 - protein, 9 aa, Homo Sapiens
FRDYLHYHI

SEQ ID NO: 95345 - protein, 9 aa, Homo Sapiens
FRFAGSENL

SEQ ID NO: 95346 - protein, 9 aa, Homo Sapiens
FRMIERHYF

SEQ ID NO: 95347 - protein, 9 aa, Homo Sapiens
FRTEGAEKL

SEQ ID NO: 95348 - protein, 9 aa, Homo Sapiens
GHADVAQLL

SEQ ID NO: 95349 - protein, 9 aa, Homo Sapiens
GHAGSVDSI

SEQ ID NO: 95350 - protein, 9 aa, Homo Sapiens
GHASPCPPL

SEQ ID NO: 95351 - protein, 9 aa, Homo Sapiens
GHCDVLLSL

SEQ ID NO: 95352 - protein, 9 aa, Homo Sapiens
GHDASQITL

SEQ ID NO: 95353 - protein, 9 aa, Homo Sapiens
GHDASVLKV

SEQ ID NO: 95354 - protein, 9 aa, Homo Sapiens
GHDCFPVLF

SEQ ID NO: 95355 - protein, 9 aa, Homo Sapiens
GHDDAVSKI

SEQ ID NO: 95356 - protein, 9 aa, Homo Sapiens
GHDGIVLAL

SEQ ID NO: 95357 - protein, 9 aa, Homo Sapiens
GHDNRVSCL

SEQ ID NO: 95358 - protein, 9 aa, Homo Sapiens
GHDNTDVSI

SEQ ID NO: 95359 - protein, 9 aa, Homo Sapiens
GHDPNLSLL

SEQ ID NO: 95360 - protein, 9 aa, Homo Sapiens
GHDQVVVLL

SEQ ID NO: 95361 - protein, 9 aa, Homo Sapiens
GHDTNHVLL

SEQ ID NO: 95362 - protein, 9 aa, Homo Sapiens
GHDVIKTLI

SEQ ID NO: 95363 - protein, 9 aa, Homo Sapiens
GHFDGVQDL

SEQ ID NO: 95364 - protein, 9 aa, Homo Sapiens
GHFEKPLFL

SEQ ID NO: 95365 - protein, 9 aa, Homo Sapiens
GHIESPVFI

SEQ ID NO: 95366 - protein, 9 aa, Homo Sapiens
GHLDMVEFL

SEQ ID NO: 95367 - protein, 9 aa, Homo Sapiens
GHNGWVTQI

SEQ ID NO: 95368 - protein, 9 aa, Homo Sapiens
GHSDVVMGL

SEQ ID NO: 95369 - protein, 9 aa, Homo Sapiens
GHSEVSTAI

SEQ ID NO: 95370 - protein, 9 aa, Homo Sapiens
GHSGPITSI

SEQ ID NO: 95371 - protein, 9 aa, Homo Sapiens
GHSHVKLQL

SEQ ID NO: 95372 - protein, 9 aa, Homo Sapiens
GHSPVLRNI

SEQ ID NO: 95373 - protein, 9 aa, Homo Sapiens
GHSQGFNKL

SEQ ID NO: 95374 - protein, 9 aa, Homo Sapiens
GHSSFITHL

SEQ ID NO: 95375 - protein, 9 aa, Homo Sapiens
GHSSVFQAL

SEQ ID NO: 95376 - protein, 9 aa, Homo Sapiens
GHSSYITHL

SEQ ID NO: 95377 - protein, 9 aa, Homo Sapiens
GHVNLKDRL

SEQ ID NO: 95378 - protein, 9 aa, Homo Sapiens
GHVVDIVAL

SEQ ID NO: 95379 - protein, 9 aa, Homo Sapiens
GHYEVAELL

SEQ ID NO: 95380 - protein, 9 aa, Homo Sapiens
GHYEVTELL

SEQ ID NO: 95381 - protein, 9 aa, Homo Sapiens
GHYLGEFSI

SEQ ID NO: 95382 - protein, 9 aa, Homo Sapiens
GHYTEGAEL

SEQ ID NO: 95383 - protein, 9 aa, Homo Sapiens
GKDPNTYFI

SEQ ID NO: 95384 - protein, 9 aa, Homo Sapiens
GRYAGEESL

SEQ ID NO: 95385 - protein, 9 aa, Homo Sapiens
HDPTSANLL

SEQ ID NO: 95386 - protein, 9 aa, Homo Sapiens
HEGDIILKI

SEQ ID NO: 95387 - protein, 9 aa, Homo Sapiens
HHAEPPPAL

SEQ ID NO: 95388 - protein, 9 aa, Homo Sapiens
HHAESEAHL

SEQ ID NO: 95389 - protein, 9 aa, Homo Sapiens
HHAEYLTEL

SEQ ID NO: 95390 - protein, 9 aa, Homo Sapiens
HHAFQPSKL

SEQ ID NO: 95391 - protein, 9 aa, Homo Sapiens
HHALELEYL

SEQ ID NO: 95392 - protein, 9 aa, Homo Sapiens
HHANELIRF

SEQ ID NO: 95393 - protein, 9 aa, Homo Sapiens
HHANFPQYV

SEQ ID NO: 95394 - protein, 9 aa, Homo Sapiens
HHANPAIGF

SEQ ID NO: 95395 - protein, 9 aa, Homo Sapiens
HHANPILLL

SEQ ID NO: 95396 - protein, 9 aa, Homo Sapiens
HHAPLPSHL

SEQ ID NO: 95397 - protein, 9 aa, Homo Sapiens
HHAPLVNSL

SEQ ID NO: 95398 - protein, 9 aa, Homo Sapiens
HHAQDKSLL

SEQ ID NO: 95399 - protein, 9 aa, Homo Sapiens
HHAQDYGGL

SEQ ID NO: 95400 - protein, 9 aa, Homo Sapiens
HHAQLIFVF

SEQ ID NO: 95401 - protein, 9 aa, Homo Sapiens
HHARLIFVF

SEQ ID NO: 95402 - protein, 9 aa, Homo Sapiens
HHARSICHL

SEQ ID NO: 95403 - protein, 9 aa, Homo Sapiens
HHAVSPYSI

SEQ ID NO: 95404 - protein, 9 aa, Homo Sapiens
HHAVSTLGI

SEQ ID NO: 95405 - protein, 9 aa, Homo Sapiens
HHCDDHLSL

SEQ ID NO: 95406 - protein, 9 aa, Homo Sapiens
HHCEAVLHL

SEQ ID NO: 95407 - protein, 9 aa, Homo Sapiens
HHCEVDVSF

SEQ ID NO: 95408 - protein, 9 aa, Homo Sapiens
HHCKLTQVL

SEQ ID NO: 95409 - protein, 9 aa, Homo Sapiens
HHCPAFGLL

SEQ ID NO: 95410 - protein, 9 aa, Homo Sapiens
HHCPDVPIL

SEQ ID NO: 95411 - protein, 9 aa, Homo Sapiens
HHCPGNHSW

SEQ ID NO: 95412 - protein, 9 aa, Homo Sapiens
HHCPKTPFL

SEQ ID NO: 95413 - protein, 9 aa, Homo Sapiens
HHDASTFTI

SEQ ID NO: 95414 - protein, 9 aa, Homo Sapiens
HHDDYYSRL

SEQ ID NO: 95415 - protein, 9 aa, Homo Sapiens
HHDFHHMNF

SEQ ID NO: 95416 - protein, 9 aa, Homo Sapiens
HHDHLQPLL

SEQ ID NO: 95417 - protein, 9 aa, Homo Sapiens
HHDIKPSNI

SEQ ID NO: 95418 - protein, 9 aa, Homo Sapiens
HHDIVRFLV

SEQ ID NO: 95419 - protein, 9 aa, Homo Sapiens
HHDQLHTYL

SEQ ID NO: 95420 - protein, 9 aa, Homo Sapiens
HHDQPVKPL

SEQ ID NO: 95421 - protein, 9 aa, Homo Sapiens
HHDSRTYLV

SEQ ID NO: 95422 - protein, 9 aa, Homo Sapiens
HHDSSTFTL

SEQ ID NO: 95423 - protein, 9 aa, Homo Sapiens
HHDYHQYFS

SEQ ID NO: 95424 - protein, 9 aa, Homo Sapiens
HHDYSTYTF

SEQ ID NO: 95425 - protein, 9 aa, Homo Sapiens
HHEAGVTAL

SEQ ID NO: 95426 - protein, 9 aa, Homo Sapiens
HHEAMKTQI

SEQ ID NO: 95427 - protein, 9 aa, Homo Sapiens
HHEASGVTV

SEQ ID NO: 95428 - protein, 9 aa, Homo Sapiens
HHELHAAHL

SEQ ID NO: 95429 - protein, 9 aa, Homo Sapiens
HHENKYLLL

SEQ ID NO: 95430 - protein, 9 aa, Homo Sapiens
HHENLVSFL

SEQ ID NO: 95431 - protein, 9 aa, Homo Sapiens
HHEPESPQL

SEQ ID NO: 95432 - protein, 9 aa, Homo Sapiens
HHERTFIGI

SEQ ID NO: 95433 - protein, 9 aa, Homo Sapiens
HHFAGFSQI

SEQ ID NO: 95434 - protein, 9 aa, Homo Sapiens
HHFEGAQIL

SEQ ID NO: 95435 - protein, 9 aa, Homo Sapiens
HHFEQMLKL

SEQ ID NO: 95436 - protein, 9 aa, Homo Sapiens
HHFKYPCVL

SEQ ID NO: 95437 - protein, 9 aa, Homo Sapiens
HHFLELVTL

SEQ ID NO: 95438 - protein, 9 aa, Homo Sapiens
HHFLIGNNF

SEQ ID NO: 95439 - protein, 9 aa, Homo Sapiens
HHFPGPLLV

SEQ ID NO: 95440 - protein, 9 aa, Homo Sapiens
HHGGLLPIL

SEQ ID NO: 95441 - protein, 9 aa, Homo Sapiens
HHGPAEGLL

SEQ ID NO: 95442 - protein, 9 aa, Homo Sapiens
HHGPMAVAF

SEQ ID NO: 95443 - protein, 9 aa, Homo Sapiens
HHGPPGPTF

SEQ ID NO: 95444 - protein, 9 aa, Homo Sapiens
HHGPQTLYL

SEQ ID NO: 95445 - protein, 9 aa, Homo Sapiens
HHGQAQPGL

SEQ ID NO: 95446 - protein, 9 aa, Homo Sapiens
HHGRFIMSL

SEQ ID NO: 95447 - protein, 9 aa, Homo Sapiens
HHGTFMEEF

SEQ ID NO: 95448 - protein, 9 aa, Homo Sapiens
HHGTSILTL

SEQ ID NO: 95449 - protein, 9 aa, Homo Sapiens
HHGVNQLKF

SEQ ID NO: 95450 - protein, 9 aa, Homo Sapiens
HHHAGYEQF

SEQ ID NO: 95451 - protein, 9 aa, Homo Sapiens
HHHDYHHIL

SEQ ID NO: 95452 - protein, 9 aa, Homo Sapiens
HHHHHPPMI

SEQ ID NO: 95453 - protein, 9 aa, Homo Sapiens
HHHPPMIAL

SEQ ID NO: 95454 - protein, 9 aa, Homo Sapiens
HHHQEVILV

SEQ ID NO: 95455 - protein, 9 aa, Homo Sapiens
HHHSFYDFI

SEQ ID NO: 95456 - protein, 9 aa, Homo Sapiens
HHHSVPVFI

SEQ ID NO: 95457 - protein, 9 aa, Homo Sapiens
HHHTDGAYF

SEQ ID NO: 95458 - protein, 9 aa, Homo Sapiens
HHIASVEKL

SEQ ID NO: 95459 - protein, 9 aa, Homo Sapiens
HHIATVEKL

SEQ ID NO: 95460 - protein, 9 aa, Homo Sapiens
HHIDSANAL

SEQ ID NO: 95461 - protein, 9 aa, Homo Sapiens
HHIEAQQRL

SEQ ID NO: 95462 - protein, 9 aa, Homo Sapiens
HHIENLDLF

SEQ ID NO: 95463 - protein, 9 aa, Homo Sapiens
HHIEPFCKL

SEQ ID NO: 95464 - protein, 9 aa, Homo Sapiens
HHIIEQLRF

SEQ ID NO: 95465 - protein, 9 aa, Homo Sapiens
HHIKYQHLL

SEQ ID NO: 95466 - protein, 9 aa, Homo Sapiens
HHILKSDDL

SEQ ID NO: 95467 - protein, 9 aa, Homo Sapiens
HHISTEQEI

SEQ ID NO: 95468 - protein, 9 aa, Homo Sapiens
HHITGSQNI

SEQ ID NO: 95469 - protein, 9 aa, Homo Sapiens
HHLADLSHL

SEQ ID NO: 95470 - protein, 9 aa, Homo Sapiens
HHLAGPVYI

SEQ ID NO: 95471 - protein, 9 aa, Homo Sapiens
HHLDALDQL

SEQ ID NO: 95472 - protein, 9 aa, Homo Sapiens
HHLDPDTEL

SEQ ID NO: 95473 - protein, 9 aa, Homo Sapiens
HHLEQMYKL

SEQ ID NO: 95474 - protein, 9 aa, Homo Sapiens
HHLKEHLRI

SEQ ID NO: 95475 - protein, 9 aa, Homo Sapiens
HHLSDICHL

SEQ ID NO: 95476 - protein, 9 aa, Homo Sapiens
HHLTAYEKL

SEQ ID NO: 95477 - protein, 9 aa, Homo Sapiens
HHLVIPSVL

SEQ ID NO: 95478 - protein, 9 aa, Homo Sapiens
HHMGGMAGL

SEQ ID NO: 95479 - protein, 9 aa, Homo Sapiens
HHMGISHVL

SEQ ID NO: 95480 - protein, 9 aa, Homo Sapiens
HHMPICVSF

SEQ ID NO: 95481 - protein, 9 aa, Homo Sapiens
HHNEAVLHL

SEQ ID NO: 95482 - protein, 9 aa, Homo Sapiens
HHNGIAELL

SEQ ID NO: 95483 - protein, 9 aa, Homo Sapiens
HHNKLRLCF

SEQ ID NO: 95484 - protein, 9 aa, Homo Sapiens
HHNRAITHL

SEQ ID NO: 95485 - protein, 9 aa, Homo Sapiens
HHQAAIEKL

SEQ ID NO: 95486 - protein, 9 aa, Homo Sapiens
HHQALEVLL

SEQ ID NO: 95487 - protein, 9 aa, Homo Sapiens
HHQDAYIRI

SEQ ID NO: 95488 - protein, 9 aa, Homo Sapiens
HHQPELQQL

SEQ ID NO: 95489 - protein, 9 aa, Homo Sapiens
HHQPMVQGI

SEQ ID NO: 95490 - protein, 9 aa, Homo Sapiens
HHQQPHQYL

SEQ ID NO: 95491 - protein, 9 aa, Homo Sapiens
HHSALLILL

SEQ ID NO: 95492 - protein, 9 aa, Homo Sapiens
HHSDCLSTW

SEQ ID NO: 95493 - protein, 9 aa, Homo Sapiens
HHSDGSVSL

SEQ ID NO: 95494 - protein, 9 aa, Homo Sapiens
HHSGAKVVL

SEQ ID NO: 95495 - protein, 9 aa, Homo Sapiens
HHSGILPIL

SEQ ID NO: 95496 - protein, 9 aa, Homo Sapiens
HHSGTITCL

SEQ ID NO: 95497 - protein, 9 aa, Homo Sapiens
HHSISSQTF

SEQ ID NO: 95498 - protein, 9 aa, Homo Sapiens
HHSLALTSF

SEQ ID NO: 95499 - protein, 9 aa, Homo Sapiens
HHSNILLTF

SEQ ID NO: 95500 - protein, 9 aa, Homo Sapiens
HHSNIPMSL

SEQ ID NO: 95501 - protein, 9 aa, Homo Sapiens
HHSNLIAGM

SEQ ID NO: 95502 - protein, 9 aa, Homo Sapiens
HHSQSFQLL

SEQ ID NO: 95503 - protein, 9 aa, Homo Sapiens
HHSRALQSI

SEQ ID NO: 95504 - protein, 9 aa, Homo Sapiens
HHSSEDYNL

SEQ ID NO: 95505 - protein, 9 aa, Homo Sapiens
HHSSVQDAV

SEQ ID NO: 95506 - protein, 9 aa, Homo Sapiens
HHSTQMQEL

SEQ ID NO: 95507 - protein, 9 aa, Homo Sapiens
HHSVGTELL

SEQ ID NO: 95508 - protein, 9 aa, Homo Sapiens
HHSYEDTGL

SEQ ID NO: 95509 - protein, 9 aa, Homo Sapiens
HHTLYINLI

SEQ ID NO: 95510 - protein, 9 aa, Homo Sapiens
HHTMVVQAI

SEQ ID NO: 95511 - protein, 9 aa, Homo Sapiens
HHTQVDPAM

SEQ ID NO: 95512 - protein, 9 aa, Homo Sapiens
HHTRLILYF

SEQ ID NO: 95513 - protein, 9 aa, Homo Sapiens
HHTSSVYSI

SEQ ID NO: 95514 - protein, 9 aa, Homo Sapiens
HHTTDSASW

SEQ ID NO: 95515 - protein, 9 aa, Homo Sapiens
HHTTQQTFL

SEQ ID NO: 95516 - protein, 9 aa, Homo Sapiens
HHVATIILI

SEQ ID NO: 95517 - protein, 9 aa, Homo Sapiens
HHVDTEANI

SEQ ID NO: 95518 - protein, 9 aa, Homo Sapiens
HHVEPLERL

SEQ ID NO: 95519 - protein, 9 aa, Homo Sapiens
HHVKDISCL

SEQ ID NO: 95520 - protein, 9 aa, Homo Sapiens
HHVKFHYAF

SEQ ID NO: 95521 - protein, 9 aa, Homo Sapiens
HHVLQNDVL

SEQ ID NO: 95522 - protein, 9 aa, Homo Sapiens
HHVNMTPEF

SEQ ID NO: 95523 - protein, 9 aa, Homo Sapiens
HHVNVNPNF

SEQ ID NO: 95524 - protein, 9 aa, Homo Sapiens
HHVPLYLEW

SEQ ID NO: 95525 - protein, 9 aa, Homo Sapiens
HHVQLESLL

SEQ ID NO: 95526 - protein, 9 aa, Homo Sapiens
HHVSAVLNF

SEQ ID NO: 95527 - protein, 9 aa, Homo Sapiens
HHVSSLAWL

SEQ ID NO: 95528 - protein, 9 aa, Homo Sapiens
HHVVFGQVI

SEQ ID NO: 95529 - protein, 9 aa, Homo Sapiens
HHYEGAVVI

SEQ ID NO: 95530 - protein, 9 aa, Homo Sapiens
HHYELPAIL

SEQ ID NO: 95531 - protein, 9 aa, Homo Sapiens
HHYTGLLKL

SEQ ID NO: 95532 - protein, 9 aa, Homo Sapiens
HLATKLNIL

SEQ ID NO: 95533 - protein, 9 aa, Homo Sapiens
HLAWFGDSL

SEQ ID NO: 95534 - protein, 9 aa, Homo Sapiens
HLGEDLKSI

SEQ ID NO: 95535 - protein, 9 aa, Homo Sapiens
HLGLKLLLL

SEQ ID NO: 95536 - protein, 9 aa, Homo Sapiens
HLSDVVLRF

SEQ ID NO: 95537 - protein, 9 aa, Homo Sapiens
HPDSHQLFI

SEQ ID NO: 95538 - protein, 9 aa, Homo Sapiens
HQAPTERQL

SEQ ID NO: 95539 - protein, 9 aa, Homo Sapiens
HQDDFNQLL

SEQ ID NO: 95540 - protein, 9 aa, Homo Sapiens
HQDNILSLI

SEQ ID NO: 95541 - protein, 9 aa, Homo Sapiens
HQDNNFLYL

SEQ ID NO: 95542 - protein, 9 aa, Homo Sapiens
HQDPNSYSW

SEQ ID NO: 95543 - protein, 9 aa, Homo Sapiens
HQDQLQVLL

SEQ ID NO: 95544 - protein, 9 aa, Homo Sapiens
HQDQMVQKI

SEQ ID NO: 95545 - protein, 9 aa, Homo Sapiens
HQEQGHQLL

SEQ ID NO: 95546 - protein, 9 aa, Homo Sapiens
HQHEYFFLI

SEQ ID NO: 95547 - protein, 9 aa, Homo Sapiens
HQSKEENLI

SEQ ID NO: 95548 - protein, 9 aa, Homo Sapiens
HQTELGNQL

SEQ ID NO: 95549 - protein, 9 aa, Homo Sapiens
HRAQLQIRI

SEQ ID NO: 95550 - protein, 9 aa, Homo Sapiens
HRAQYEPLF

SEQ ID NO: 95551 - protein, 9 aa, Homo Sapiens
HRAVFQESI

SEQ ID NO: 95552 - protein, 9 aa, Homo Sapiens
HRDIVELLF

SEQ ID NO: 95553 - protein, 9 aa, Homo Sapiens
HRDSHITNL

SEQ ID NO: 95554 - protein, 9 aa, Homo Sapiens
HRDYVPCKI

SEQ ID NO: 95555 - protein, 9 aa, Homo Sapiens
HRFYMFHSF

SEQ ID NO: 95556 - protein, 9 aa, Homo Sapiens
HRHALRLLI

SEQ ID NO: 95557 - protein, 9 aa, Homo Sapiens
HRIQDLEQL

SEQ ID NO: 95558 - protein, 9 aa, Homo Sapiens
HRLFEDQRF

SEQ ID NO: 95559 - protein, 9 aa, Homo Sapiens
HRLPLQELW

SEQ ID NO: 95560 - protein, 9 aa, Homo Sapiens
HRMKGTEGL

SEQ ID NO: 95561 - protein, 9 aa, Homo Sapiens
HRYECEESF

SEQ ID NO: 95562 - protein, 9 aa, Homo Sapiens
HSLDHLKYL

SEQ ID NO: 95563 - protein, 9 aa, Homo Sapiens
HSLSSSESL

SEQ ID NO: 95564 - protein, 9 aa, Homo Sapiens
IAPETRRSI

SEQ ID NO: 95565 - protein, 9 aa, Homo Sapiens
IHAAYVHVI

SEQ ID NO: 95566 - protein, 9 aa, Homo Sapiens
IHADPKLLL

SEQ ID NO: 95567 - protein, 9 aa, Homo Sapiens
IHAGDILKF

SEQ ID NO: 95568 - protein, 9 aa, Homo Sapiens
IHCNTPSLL

SEQ ID NO: 95569 - protein, 9 aa, Homo Sapiens
IHDDPIRLF

SEQ ID NO: 95570 - protein, 9 aa, Homo Sapiens
IHDEEVLRL

SEQ ID NO: 95571 - protein, 9 aa, Homo Sapiens
IHDELQQSF

SEQ ID NO: 95572 - protein, 9 aa, Homo Sapiens
IHDFQPHVI

SEQ ID NO: 95573 - protein, 9 aa, Homo Sapiens
IHDGFGFML

SEQ ID NO: 95574 - protein, 9 aa, Homo Sapiens
IHDGLTVHL

SEQ ID NO: 95575 - protein, 9 aa, Homo Sapiens
IHDGMNLEL

SEQ ID NO: 95576 - protein, 9 aa, Homo Sapiens
IHDGTVHTI

SEQ ID NO: 95577 - protein, 9 aa, Homo Sapiens
IHDHNIPTL

SEQ ID NO: 95578 - protein, 9 aa, Homo Sapiens
IHDHSKAEF

SEQ ID NO: 95579 - protein, 9 aa, Homo Sapiens
IHDIKLLFL

SEQ ID NO: 95580 - protein, 9 aa, Homo Sapiens
IHDILDLTF

SEQ ID NO: 95581 - protein, 9 aa, Homo Sapiens
IHDKTEINL

SEQ ID NO: 95582 - protein, 9 aa, Homo Sapiens
IHDLDNISF

SEQ ID NO: 95583 - protein, 9 aa, Homo Sapiens
IHDLDSNSF

SEQ ID NO: 95584 - protein, 9 aa, Homo Sapiens
IHDLFPSLI

SEQ ID NO: 95585 - protein, 9 aa, Homo Sapiens
IHDMFPLHL

SEQ ID NO: 95586 - protein, 9 aa, Homo Sapiens
IHDNGEFYL

SEQ ID NO: 95587 - protein, 9 aa, Homo Sapiens
IHDSSSLLM

SEQ ID NO: 95588 - protein, 9 aa, Homo Sapiens
IHDYVVAML

SEQ ID NO: 95589 - protein, 9 aa, Homo Sapiens
IHEDQTVYI

SEQ ID NO: 95590 - protein, 9 aa, Homo Sapiens
IHEDSMNLL

SEQ ID NO: 95591 - protein, 9 aa, Homo Sapiens
IHEDTRHLL

SEQ ID NO: 95592 - protein, 9 aa, Homo Sapiens
IHEPEPHIL

SEQ ID NO: 95593 - protein, 9 aa, Homo Sapiens
IHEPSAALL

SEQ ID NO: 95594 - protein, 9 aa, Homo Sapiens
IHEQVNHRW

SEQ ID NO: 95595 - protein, 9 aa, Homo Sapiens
IHESVSAQI

SEQ ID NO: 95596 - protein, 9 aa, Homo Sapiens
IHETTFNSI

SEQ ID NO: 95597 - protein, 9 aa, Homo Sapiens
IHFFGEEYL

SEQ ID NO: 95598 - protein, 9 aa, Homo Sapiens
IHGDGVQKI

SEQ ID NO: 95599 - protein, 9 aa, Homo Sapiens
IHGPKGNEI

SEQ ID NO: 95600 - protein, 9 aa, Homo Sapiens
IHHDAVIFL

SEQ ID NO: 95601 - protein, 9 aa, Homo Sapiens
IHHEGGENI

SEQ ID NO: 95602 - protein, 9 aa, Homo Sapiens
IHHNWPSLL

SEQ ID NO: 95603 - protein, 9 aa, Homo Sapiens
IHHPTPIQI

SEQ ID NO: 95604 - protein, 9 aa, Homo Sapiens
IHIDCEKRI

SEQ ID NO: 95605 - protein, 9 aa, Homo Sapiens
IHIDIMDYI

SEQ ID NO: 95606 - protein, 9 aa, Homo Sapiens
IHIEQLDKI

SEQ ID NO: 95607 - protein, 9 aa, Homo Sapiens
IHILDVLVL

SEQ ID NO: 95608 - protein, 9 aa, Homo Sapiens
IHISSGNTM

SEQ ID NO: 95609 - protein, 9 aa, Homo Sapiens
IHLGHILFL

SEQ ID NO: 95610 - protein, 9 aa, Homo Sapiens
IHLHTEALL

SEQ ID NO: 95611 - protein, 9 aa, Homo Sapiens
IHLIDPNTL

SEQ ID NO: 95612 - protein, 9 aa, Homo Sapiens
IHNDNEELI

SEQ ID NO: 95613 - protein, 9 aa, Homo Sapiens
IHNDVKVLL

SEQ ID NO: 95614 - protein, 9 aa, Homo Sapiens
IHNEDFPAL

SEQ ID NO: 95615 - protein, 9 aa, Homo Sapiens
IHNEDNSQF

SEQ ID NO: 95616 - protein, 9 aa, Homo Sapiens
IHNSDQILL

SEQ ID NO: 95617 - protein, 9 aa, Homo Sapiens
IHQDGIHIL

SEQ ID NO: 95618 - protein, 9 aa, Homo Sapiens
IHQRETQLI

SEQ ID NO: 95619 - protein, 9 aa, Homo Sapiens
IHSDFQTLI

SEQ ID NO: 95620 - protein, 9 aa, Homo Sapiens
IHSENFQTL

SEQ ID NO: 95621 - protein, 9 aa, Homo Sapiens
IHSESSDTF

SEQ ID NO: 95622 - protein, 9 aa, Homo Sapiens
IHSFELDLL

SEQ ID NO: 95623 - protein, 9 aa, Homo Sapiens
IHSFIGDGL

SEQ ID NO: 95624 - protein, 9 aa, Homo Sapiens
IHSGDEAYI

SEQ ID NO: 95625 - protein, 9 aa, Homo Sapiens
IHSGELTKI

SEQ ID NO: 95626 - protein, 9 aa, Homo Sapiens
IHSMFPLHL

SEQ ID NO: 95627 - protein, 9 aa, Homo Sapiens
IHSPVVNEL

SEQ ID NO: 95628 - protein, 9 aa, Homo Sapiens
IHSQPQPAL

SEQ ID NO: 95629 - protein, 9 aa, Homo Sapiens
IHSQVSQQL

SEQ ID NO: 95630 - protein, 9 aa, Homo Sapiens
IHSSIVSTL

SEQ ID NO: 95631 - protein, 9 aa, Homo Sapiens
IHSSVQCKL

SEQ ID NO: 95632 - protein, 9 aa, Homo Sapiens
IHSTGQQFI

SEQ ID NO: 95633 - protein, 9 aa, Homo Sapiens
IHTDGNEQI

SEQ ID NO: 95634 - protein, 9 aa, Homo Sapiens
IHTETGNIW

SEQ ID NO: 95635 - protein, 9 aa, Homo Sapiens
IHTSVSQDF

SEQ ID NO: 95636 - protein, 9 aa, Homo Sapiens
IHVDDRQDF

SEQ ID NO: 95637 - protein, 9 aa, Homo Sapiens
IHVDFPVIL

SEQ ID NO: 95638 - protein, 9 aa, Homo Sapiens
IHVIGGNDV

SEQ ID NO: 95639 - protein, 9 aa, Homo Sapiens
IKDVIGDEI

SEQ ID NO: 95640 - protein, 9 aa, Homo Sapiens
ILANIGDHF

SEQ ID NO: 95641 - protein, 9 aa, Homo Sapiens
ILANVGDQF

SEQ ID NO: 95642 - protein, 9 aa, Homo Sapiens
ILDGNQLHI

SEQ ID NO: 95643 - protein, 9 aa, Homo Sapiens
ILDPSNTEI

SEQ ID NO: 95644 - protein, 9 aa, Homo Sapiens
IPDDAKDLI

SEQ ID NO: 95645 - protein, 9 aa, Homo Sapiens
IQCEIFQVL

SEQ ID NO: 95646 - protein, 9 aa, Homo Sapiens
KHAVSDPSI

SEQ ID NO: 95647 - protein, 9 aa, Homo Sapiens
KHCHTKLSL

SEQ ID NO: 95648 - protein, 9 aa, Homo Sapiens
KHDDVMAKF

SEQ ID NO: 95649 - protein, 9 aa, Homo Sapiens
KHDEYLILL

SEQ ID NO: 95650 - protein, 9 aa, Homo Sapiens
KHDPTSANL

SEQ ID NO: 95651 - protein, 9 aa, Homo Sapiens
KHDTKLLIL

SEQ ID NO: 95652 - protein, 9 aa, Homo Sapiens
KHDVGAYML

SEQ ID NO: 95653 - protein, 9 aa, Homo Sapiens
KHFDLFLRF

SEQ ID NO: 95654 - protein, 9 aa, Homo Sapiens
KHFEGTEFL

SEQ ID NO: 95655 - protein, 9 aa, Homo Sapiens
KHHPDLHLW

SEQ ID NO: 95656 - protein, 9 aa, Homo Sapiens
KHQEHILRF

SEQ ID NO: 95657 - protein, 9 aa, Homo Sapiens
KHSEVVTQI

SEQ ID NO: 95658 - protein, 9 aa, Homo Sapiens
KHVEFDFLI

SEQ ID NO: 95659 - protein, 9 aa, Homo Sapiens
KLAPKDVKI

SEQ ID NO: 95660 - protein, 9 aa, Homo Sapiens
KPDEFESGI

SEQ ID NO: 95661 - protein, 9 aa, Homo Sapiens
KPHEDIIGI

SEQ ID NO: 95662 - protein, 9 aa, Homo Sapiens
KQDETQTKI

SEQ ID NO: 95663 - protein, 9 aa, Homo Sapiens
KQVHPDTGI

SEQ ID NO: 95664 - protein, 9 aa, Homo Sapiens
LDTNADKQL

SEQ ID NO: 95665 - protein, 9 aa, Homo Sapiens
LHAAESDEF

SEQ ID NO: 95666 - protein, 9 aa, Homo Sapiens
LHADPEPSV

SEQ ID NO: 95667 - protein, 9 aa, Homo Sapiens
LHAFPELYF

SEQ ID NO: 95668 - protein, 9 aa, Homo Sapiens
LHALPELYF

SEQ ID NO: 95669 - protein, 9 aa, Homo Sapiens
LHAQGDPAL

SEQ ID NO: 95670 - protein, 9 aa, Homo Sapiens
LHAQPIISI

SEQ ID NO: 95671 - protein, 9 aa, Homo Sapiens
LHATGDYLL

SEQ ID NO: 95672 - protein, 9 aa, Homo Sapiens
LHCDHQAFL

SEQ ID NO: 95673 - protein, 9 aa, Homo Sapiens
LHCGDESML

SEQ ID NO: 95674 - protein, 9 aa, Homo Sapiens
LHDAEIVRL

SEQ ID NO: 95675 - protein, 9 aa, Homo Sapiens
LHDEMLHWF

SEQ ID NO: 95676 - protein, 9 aa, Homo Sapiens
LHDETLTYL

SEQ ID NO: 95677 - protein, 9 aa, Homo Sapiens
LHDFHSHEI

SEQ ID NO: 95678 - protein, 9 aa, Homo Sapiens
LHDGHFYAL

SEQ ID NO: 95679 - protein, 9 aa, Homo Sapiens
LHDHGVSSL

SEQ ID NO: 95680 - protein, 9 aa, Homo Sapiens
LHDPHPTCW

SEQ ID NO: 95681 - protein, 9 aa, Homo Sapiens
LHDQFQHQL

SEQ ID NO: 95682 - protein, 9 aa, Homo Sapiens
LHDSSDYLL

SEQ ID NO: 95683 - protein, 9 aa, Homo Sapiens
LHDTRTHFL

SEQ ID NO: 95684 - protein, 9 aa, Homo Sapiens
LHDVEHVLI

SEQ ID NO: 95685 - protein, 9 aa, Homo Sapiens
LHEAGGEDF

SEQ ID NO: 95686 - protein, 9 aa, Homo Sapiens
LHEDGGKLF

SEQ ID NO: 95687 - protein, 9 aa, Homo Sapiens
LHENGCITL

SEQ ID NO: 95688 - protein, 9 aa, Homo Sapiens
LHHPNIIRL

SEQ ID NO: 95689 - protein, 9 aa, Homo Sapiens
LHHPNNQTL

SEQ ID NO: 95690 - protein, 9 aa, Homo Sapiens
LHIATEDNI

SEQ ID NO: 95691 - protein, 9 aa, Homo Sapiens
LHIGDIVSL

SEQ ID NO: 95692 - protein, 9 aa, Homo Sapiens
LHLDATKLL

SEQ ID NO: 95693 - protein, 9 aa, Homo Sapiens
LHNGEPLYI

SEQ ID NO: 95694 - protein, 9 aa, Homo Sapiens
LHNNLLTYL

SEQ ID NO: 95695 - protein, 9 aa, Homo Sapiens
LHNRENQSI

SEQ ID NO: 95696 - protein, 9 aa, Homo Sapiens
LHSEDFLEL

SEQ ID NO: 95697 - protein, 9 aa, Homo Sapiens
LHSEEFLSF

SEQ ID NO: 95698 - protein, 9 aa, Homo Sapiens
LHSKVILAI

SEQ ID NO: 95699 - protein, 9 aa, Homo Sapiens
LHSRVKLIL

SEQ ID NO: 95700 - protein, 9 aa, Homo Sapiens
LHTEECNVL

SEQ ID NO: 95701 - protein, 9 aa, Homo Sapiens
LHTSIGNSV

SEQ ID NO: 95702 - protein, 9 aa, Homo Sapiens
LHTTVGSLL

SEQ ID NO: 95703 - protein, 9 aa, Homo Sapiens
LHVDNHIGI

SEQ ID NO: 95704 - protein, 9 aa, Homo Sapiens
LHYFPEYQW

SEQ ID NO: 95705 - protein, 9 aa, Homo Sapiens
LHYGSVLLI

SEQ ID NO: 95706 - protein, 9 aa, Homo Sapiens
LLKVAHLLL

SEQ ID NO: 95707 - protein, 9 aa, Homo Sapiens
LLTTMGDRF

SEQ ID NO: 95708 - protein, 9 aa, Homo Sapiens
LPAESNEKI

SEQ ID NO: 95709 - protein, 9 aa, Homo Sapiens
LPATIGDLI

SEQ ID NO: 95710 - protein, 9 aa, Homo Sapiens
LPIDDVLRI

SEQ ID NO: 95711 - protein, 9 aa, Homo Sapiens
LPINGNGKQ

SEQ ID NO: 95712 - protein, 9 aa, Homo Sapiens
LPSRLGLLL

SEQ ID NO: 95713 - protein, 9 aa, Homo Sapiens
LQDPGNHLI

SEQ ID NO: 95714 - protein, 9 aa, Homo Sapiens
LQDTSLQQL

SEQ ID NO: 95715 - protein, 9 aa, Homo Sapiens
LQNNTILRL

SEQ ID NO: 95716 - protein, 9 aa, Homo Sapiens
MENLDPLGI

SEQ ID NO: 95717 - protein, 9 aa, Homo Sapiens
MHAGSSDLL

SEQ ID NO: 95718 - protein, 9 aa, Homo Sapiens
MHAQDPQML

SEQ ID NO: 95719 - protein, 9 aa, Homo Sapiens
MHCDDETSL

SEQ ID NO: 95720 - protein, 9 aa, Homo Sapiens
MHCEKVFRI

SEQ ID NO: 95721 - protein, 9 aa, Homo Sapiens
MHDCVVKLL

SEQ ID NO: 95722 - protein, 9 aa, Homo Sapiens
MHDEKVDLW

SEQ ID NO: 95723 - protein, 9 aa, Homo Sapiens
MHDFNLISI

SEQ ID NO: 95724 - protein, 9 aa, Homo Sapiens
MHDHFNAEI

SEQ ID NO: 95725 - protein, 9 aa, Homo Sapiens
MHDKVFAYI

SEQ ID NO: 95726 - protein, 9 aa, Homo Sapiens
MHDTIGCYL

SEQ ID NO: 95727 - protein, 9 aa, Homo Sapiens
MHDVYGMLL

SEQ ID NO: 95728 - protein, 9 aa, Homo Sapiens
MHDYDGNNL

SEQ ID NO: 95729 - protein, 9 aa, Homo Sapiens
MHDYNQAEM

SEQ ID NO: 95730 - protein, 9 aa, Homo Sapiens
MHEENVYTV

SEQ ID NO: 95731 - protein, 9 aa, Homo Sapiens
MHEVGVVAF

SEQ ID NO: 95732 - protein, 9 aa, Homo Sapiens
MHFEKHWRL

SEQ ID NO: 95733 - protein, 9 aa, Homo Sapiens
MHFHETETF

SEQ ID NO: 95734 - protein, 9 aa, Homo Sapiens
MHGLEPQTI

SEQ ID NO: 95735 - protein, 9 aa, Homo Sapiens
MHGQPSPSL

SEQ ID NO: 95736 - protein, 9 aa, Homo Sapiens
MHHFIPDLL

SEQ ID NO: 95737 - protein, 9 aa, Homo Sapiens
MHHNIPHRF

SEQ ID NO: 95738 - protein, 9 aa, Homo Sapiens
MHHPDGCAL

SEQ ID NO: 95739 - protein, 9 aa, Homo Sapiens
MHHQPDPAL

SEQ ID NO: 95740 - protein, 9 aa, Homo Sapiens
MHHWLLFEM

SEQ ID NO: 95741 - protein, 9 aa, Homo Sapiens
MHIDSHEAL

SEQ ID NO: 95742 - protein, 9 aa, Homo Sapiens
MHILDGCSI

SEQ ID NO: 95743 - protein, 9 aa, Homo Sapiens
MHIRYQSKL

SEQ ID NO: 95744 - protein, 9 aa, Homo Sapiens
MHIYETDGF

SEQ ID NO: 95745 - protein, 9 aa, Homo Sapiens
MHLRQYELL

SEQ ID NO: 95746 - protein, 9 aa, Homo Sapiens
MHMVDTVTW

SEQ ID NO: 95747 - protein, 9 aa, Homo Sapiens
MHNDTWVLL

SEQ ID NO: 95748 - protein, 9 aa, Homo Sapiens
MHNEEPFAL

SEQ ID NO: 95749 - protein, 9 aa, Homo Sapiens
MHNEKVDLW

SEQ ID NO: 95750 - protein, 9 aa, Homo Sapiens
MHQNIYDYI

SEQ ID NO: 95751 - protein, 9 aa, Homo Sapiens
MHSDHTVGL

SEQ ID NO: 95752 - protein, 9 aa, Homo Sapiens
MHSEELLAF

SEQ ID NO: 95753 - protein, 9 aa, Homo Sapiens
MHSEKLLSF

SEQ ID NO: 95754 - protein, 9 aa, Homo Sapiens
MHSGLTQNL

SEQ ID NO: 95755 - protein, 9 aa, Homo Sapiens
MHSGPVVAM

SEQ ID NO: 95756 - protein, 9 aa, Homo Sapiens
MHSPLIHHI

SEQ ID NO: 95757 - protein, 9 aa, Homo Sapiens
MHSQFHAPL

SEQ ID NO: 95758 - protein, 9 aa, Homo Sapiens
MHVDECVEF

SEQ ID NO: 95759 - protein, 9 aa, Homo Sapiens
MHVRDNVKI

SEQ ID NO: 95760 - protein, 9 aa, Homo Sapiens
MHVSLAEAL

SEQ ID NO: 95761 - protein, 9 aa, Homo Sapiens
MHYKEAIRI

SEQ ID NO: 95762 - protein, 9 aa, Homo Sapiens
MHYPNGHAI

SEQ ID NO: 95763 - protein, 9 aa, Homo Sapiens
MHYPTALLF

SEQ ID NO: 95764 - protein, 9 aa, Homo Sapiens
MIDDTYQCL

SEQ ID NO: 95765 - protein, 9 aa, Homo Sapiens
MIDNVILLI

SEQ ID NO: 95766 - protein, 9 aa, Homo Sapiens
MKDLGAEHL

SEQ ID NO: 95767 - protein, 9 aa, Homo Sapiens
MKMEIGDTL

SEQ ID NO: 95768 - protein, 9 aa, Homo Sapiens
MLDNSFERL

SEQ ID NO: 95769 - protein, 9 aa, Homo Sapiens
MLVGIGDKI

SEQ ID NO: 95770 - protein, 9 aa, Homo Sapiens
MQDGSVQVI

SEQ ID NO: 95771 - protein, 9 aa, Homo Sapiens
MQDKTEWKL

SEQ ID NO: 95772 - protein, 9 aa, Homo Sapiens
MQDPNPYSF

SEQ ID NO: 95773 - protein, 9 aa, Homo Sapiens
MQDSRLYLI

SEQ ID NO: 95774 - protein, 9 aa, Homo Sapiens
MQEAAQHLL

SEQ ID NO: 95775 - protein, 9 aa, Homo Sapiens
MQESGEQTI

SEQ ID NO: 95776 - protein, 9 aa, Homo Sapiens
MQVKVGNEV

SEQ ID NO: 95777 - protein, 9 aa, Homo Sapiens
MRDAIILIF

SEQ ID NO: 95778 - protein, 9 aa, Homo Sapiens
MRDAKIYQI

SEQ ID NO: 95779 - protein, 9 aa, Homo Sapiens
MRDCLILVL

SEQ ID NO: 95780 - protein, 9 aa, Homo Sapiens
MRDGGKYSL

SEQ ID NO: 95781 - protein, 9 aa, Homo Sapiens
MRDPIRILV

SEQ ID NO: 95782 - protein, 9 aa, Homo Sapiens
MRDPTFVRL

SEQ ID NO: 95783 - protein, 9 aa, Homo Sapiens
MRDPVSSQY

SEQ ID NO: 95784 - protein, 9 aa, Homo Sapiens
MREERQDRL

SEQ ID NO: 95785 - protein, 9 aa, Homo Sapiens
MRLSLPLLL

SEQ ID NO: 95786 - protein, 9 aa, Homo Sapiens
MRMVLNESL

SEQ ID NO: 95787 - protein, 9 aa, Homo Sapiens
NCDKHKSIL

SEQ ID NO: 95788 - protein, 9 aa, Homo Sapiens
NHAAVRQML

SEQ ID NO: 95789 - protein, 9 aa, Homo Sapiens
NHADIGFCL

SEQ ID NO: 95790 - protein, 9 aa, Homo Sapiens
NHADPNSGL

SEQ ID NO: 95791 - protein, 9 aa, Homo Sapiens
NHAFHFHCI

SEQ ID NO: 95792 - protein, 9 aa, Homo Sapiens
NHAHHEWYL

SEQ ID NO: 95793 - protein, 9 aa, Homo Sapiens
NHALELLVI

SEQ ID NO: 95794 - protein, 9 aa, Homo Sapiens
NHALPLPGF

SEQ ID NO: 95795 - protein, 9 aa, Homo Sapiens
NHALPVYVF

SEQ ID NO: 95796 - protein, 9 aa, Homo Sapiens
NHANGLTLV

SEQ ID NO: 95797 - protein, 9 aa, Homo Sapiens
NHASAKLDF

SEQ ID NO: 95798 - protein, 9 aa, Homo Sapiens
NHASIIDGI

SEQ ID NO: 95799 - protein, 9 aa, Homo Sapiens
NHASLISAL

SEQ ID NO: 95800 - protein, 9 aa, Homo Sapiens
NHASMIQGI

SEQ ID NO: 95801 - protein, 9 aa, Homo Sapiens
NHCELLSRL

SEQ ID NO: 95802 - protein, 9 aa, Homo Sapiens
NHCMEVIRL

SEQ ID NO: 95803 - protein, 9 aa, Homo Sapiens
NHCPGAVMI

SEQ ID NO: 95804 - protein, 9 aa, Homo Sapiens
NHCSVSSEL

SEQ ID NO: 95805 - protein, 9 aa, Homo Sapiens
NHDDYTNQI

SEQ ID NO: 95806 - protein, 9 aa, Homo Sapiens
NHDEAIALL

SEQ ID NO: 95807 - protein, 9 aa, Homo Sapiens
NHDFQALAL

SEQ ID NO: 95808 - protein, 9 aa, Homo Sapiens
NHDFSPLEI

SEQ ID NO: 95809 - protein, 9 aa, Homo Sapiens
NHDFTPLEI

SEQ ID NO: 95810 - protein, 9 aa, Homo Sapiens
NHDGDPVEL

SEQ ID NO: 95811 - protein, 9 aa, Homo Sapiens
NHDGTRNIL

SEQ ID NO: 95812 - protein, 9 aa, Homo Sapiens
NHDIISMKL

SEQ ID NO: 95813 - protein, 9 aa, Homo Sapiens
NHDKLIPLL

SEQ ID NO: 95814 - protein, 9 aa, Homo Sapiens
NHDMTLTEF

SEQ ID NO: 95815 - protein, 9 aa, Homo Sapiens
NHDPNVEEF

SEQ ID NO: 95816 - protein, 9 aa, Homo Sapiens
NHDQHLLLL

SEQ ID NO: 95817 - protein, 9 aa, Homo Sapiens
NHDQKLLLI

SEQ ID NO: 95818 - protein, 9 aa, Homo Sapiens
NHDRPDVCI

SEQ ID NO: 95819 - protein, 9 aa, Homo Sapiens
NHDTGECRL

SEQ ID NO: 95820 - protein, 9 aa, Homo Sapiens
NHDTGEYVL

SEQ ID NO: 95821 - protein, 9 aa, Homo Sapiens
NHDTLRYLL

SEQ ID NO: 95822 - protein, 9 aa, Homo Sapiens
NHDVAQSEI

SEQ ID NO: 95823 - protein, 9 aa, Homo Sapiens
NHDVISLKL

SEQ ID NO: 95824 - protein, 9 aa, Homo Sapiens
NHDVQVILF

SEQ ID NO: 95825 - protein, 9 aa, Homo Sapiens
NHDYKHLYF

SEQ ID NO: 95826 - protein, 9 aa, Homo Sapiens
NHEDKEWKF

SEQ ID NO: 95827 - protein, 9 aa, Homo Sapiens
NHEDPTPEI

SEQ ID NO: 95828 - protein, 9 aa, Homo Sapiens
NHFDRSVVL

SEQ ID NO: 95829 - protein, 9 aa, Homo Sapiens
NHFMDNTTL

SEQ ID NO: 95830 - protein, 9 aa, Homo Sapiens
NHFPGSFQI

SEQ ID NO: 95831 - protein, 9 aa, Homo Sapiens
NHFSPCHFL

SEQ ID NO: 95832 - protein, 9 aa, Homo Sapiens
NHHNERMLF

SEQ ID NO: 95833 - protein, 9 aa, Homo Sapiens
NHIGWVQEF

SEQ ID NO: 95834 - protein, 9 aa, Homo Sapiens
NHIIDGVKV

SEQ ID NO: 95835 - protein, 9 aa, Homo Sapiens
NHILPGQSI

SEQ ID NO: 95836 - protein, 9 aa, Homo Sapiens
NHIQDLISL

SEQ ID NO: 95837 - protein, 9 aa, Homo Sapiens
NHIQLSSNL

SEQ ID NO: 95838 - protein, 9 aa, Homo Sapiens
NHISDLPLL

SEQ ID NO: 95839 - protein, 9 aa, Homo Sapiens
NHISELVQL

SEQ ID NO: 95840 - protein, 9 aa, Homo Sapiens
NHLALIFKI

SEQ ID NO: 95841 - protein, 9 aa, Homo Sapiens
NHLEKFFTL

SEQ ID NO: 95842 - protein, 9 aa, Homo Sapiens
NHLSFAELL

SEQ ID NO: 95843 - protein, 9 aa, Homo Sapiens
NHLYLFHLI

SEQ ID NO: 95844 - protein, 9 aa, Homo Sapiens
NHMAVAFVL

SEQ ID NO: 95845 - protein, 9 aa, Homo Sapiens
NHMRVHTGL

SEQ ID NO: 95846 - protein, 9 aa, Homo Sapiens
NHMVQQDYF

SEQ ID NO: 95847 - protein, 9 aa, Homo Sapiens
NHNEIGELI

SEQ ID NO: 95848 - protein, 9 aa, Homo Sapiens
NHNFSQQCL

SEQ ID NO: 95849 - protein, 9 aa, Homo Sapiens
NHNFTDHYL

SEQ ID NO: 95850 - protein, 9 aa, Homo Sapiens
NHNGSPLSI

SEQ ID NO: 95851 - protein, 9 aa, Homo Sapiens
NHNSGIDLL

SEQ ID NO: 95852 - protein, 9 aa, Homo Sapiens
NHNVAVYSI

SEQ ID NO: 95853 - protein, 9 aa, Homo Sapiens
NHQFTKLLI

SEQ ID NO: 95854 - protein, 9 aa, Homo Sapiens
NHQGGSVQL

SEQ ID NO: 95855 - protein, 9 aa, Homo Sapiens
NHQHEYFFL

SEQ ID NO: 95856 - protein, 9 aa, Homo Sapiens
NHQKDIQVL

SEQ ID NO: 95857 - protein, 9 aa, Homo Sapiens
NHSADFETV

SEQ ID NO: 95858 - protein, 9 aa, Homo Sapiens
NHSDSSQYI

SEQ ID NO: 95859 - protein, 9 aa, Homo Sapiens
NHSELAILL

SEQ ID NO: 95860 - protein, 9 aa, Homo Sapiens
NHSGISVNI

SEQ ID NO: 95861 - protein, 9 aa, Homo Sapiens
NHSHDQLVL

SEQ ID NO: 95862 - protein, 9 aa, Homo Sapiens
NHSHQTMEL

SEQ ID NO: 95863 - protein, 9 aa, Homo Sapiens
NHSIIEEEF

SEQ ID NO: 95864 - protein, 9 aa, Homo Sapiens
NHSLLRLDL

SEQ ID NO: 95865 - protein, 9 aa, Homo Sapiens
NHSLVTSDL

SEQ ID NO: 95866 - protein, 9 aa, Homo Sapiens
NHSNQFTQL

SEQ ID NO: 95867 - protein, 9 aa, Homo Sapiens
NHSQVGQGI

SEQ ID NO: 95868 - protein, 9 aa, Homo Sapiens
NHSRIVFNL

SEQ ID NO: 95869 - protein, 9 aa, Homo Sapiens
NHSSYGNGI

SEQ ID NO: 95870 - protein, 9 aa, Homo Sapiens
NHSYSDPLL

SEQ ID NO: 95871 - protein, 9 aa, Homo Sapiens
NHTEDYVLL

SEQ ID NO: 95872 - protein, 9 aa, Homo Sapiens
NHTIYINNL

SEQ ID NO: 95873 - protein, 9 aa, Homo Sapiens
NHTLSVEGF

SEQ ID NO: 95874 - protein, 9 aa, Homo Sapiens
NHTSIAELI

SEQ ID NO: 95875 - protein, 9 aa, Homo Sapiens
NHTSISSLF

SEQ ID NO: 95876 - protein, 9 aa, Homo Sapiens
NHVDPEEEI

SEQ ID NO: 95877 - protein, 9 aa, Homo Sapiens
NHVEVAELL

SEQ ID NO: 95878 - protein, 9 aa, Homo Sapiens
NHVPSGPSI

SEQ ID NO: 95879 - protein, 9 aa, Homo Sapiens
NHVPVITTL

SEQ ID NO: 95880 - protein, 9 aa, Homo Sapiens
NHYNNIMAL

SEQ ID NO: 95881 - protein, 9 aa, Homo Sapiens
NHYQKQLEI

SEQ ID NO: 95882 - protein, 9 aa, Homo Sapiens
NKSNDFEEL

SEQ ID NO: 95883 - protein, 9 aa, Homo Sapiens
NKTAIGDYL

SEQ ID NO: 95884 - protein, 9 aa, Homo Sapiens
NKTVIGDYL

SEQ ID NO: 95885 - protein, 9 aa, Homo Sapiens
NLVQVGDSL

SEQ ID NO: 95886 - protein, 9 aa, Homo Sapiens
NQDDLTHKL

SEQ ID NO: 95887 - protein, 9 aa, Homo Sapiens
NQDDNHQEL

SEQ ID NO: 95888 - protein, 9 aa, Homo Sapiens
NQDLTFQHI

SEQ ID NO: 95889 - protein, 9 aa, Homo Sapiens
NQDNLQLFL

SEQ ID NO: 95890 - protein, 9 aa, Homo Sapiens
NQSSVDLKL

SEQ ID NO: 95891 - protein, 9 aa, Homo Sapiens
NRAAAFEQL

SEQ ID NO: 95892 - protein, 9 aa, Homo Sapiens
NRAAAQYYL

SEQ ID NO: 95893 - protein, 9 aa, Homo Sapiens
NRDDSNLYI

SEQ ID NO: 95894 - protein, 9 aa, Homo Sapiens
NRDFILYRF

SEQ ID NO: 95895 - protein, 9 aa, Homo Sapiens
NRDRTQIAL

SEQ ID NO: 95896 - protein, 9 aa, Homo Sapiens
NRHYYSITI

SEQ ID NO: 95897 - protein, 9 aa, Homo Sapiens
NRIAIYELL

SEQ ID NO: 95898 - protein, 9 aa, Homo Sapiens
NRIQDLLEL

SEQ ID NO: 95899 - protein, 9 aa, Homo Sapiens
NRIRQQLRF

SEQ ID NO: 95900 - protein, 9 aa, Homo Sapiens
NRLGGEEKF

SEQ ID NO: 95901 - protein, 9 aa, Homo Sapiens
NRLLDLLYL

SEQ ID NO: 95902 - protein, 9 aa, Homo Sapiens
NRLNIEELL

SEQ ID NO: 95903 - protein, 9 aa, Homo Sapiens
NRMLKQMLF

SEQ ID NO: 95904 - protein, 9 aa, Homo Sapiens
NRSRIQVWL

SEQ ID NO: 95905 - protein, 9 aa, Homo Sapiens
QATAAGDVI

SEQ ID NO: 95906 - protein, 9 aa, Homo Sapiens
QDHRGAFLI

SEQ ID NO: 95907 - protein, 9 aa, Homo Sapiens
QEIRHGDSI

SEQ ID NO: 95908 - protein, 9 aa, Homo Sapiens
QHAASLLKL

SEQ ID NO: 95909 - protein, 9 aa, Homo Sapiens
QHAAVSEKL

SEQ ID NO: 95910 - protein, 9 aa, Homo Sapiens
QHADPPVQI

SEQ ID NO: 95911 - protein, 9 aa, Homo Sapiens
QHADVGKEL

SEQ ID NO: 95912 - protein, 9 aa, Homo Sapiens
QHAEVYYKL

SEQ ID NO: 95913 - protein, 9 aa, Homo Sapiens
QHAFIQEKI

SEQ ID NO: 95914 - protein, 9 aa, Homo Sapiens
QHAGKIDLL

SEQ ID NO: 95915 - protein, 9 aa, Homo Sapiens
QHAISTEKI

SEQ ID NO: 95916 - protein, 9 aa, Homo Sapiens
QHAIVFQHI

SEQ ID NO: 95917 - protein, 9 aa, Homo Sapiens
QHAKYTCSF

SEQ ID NO: 95918 - protein, 9 aa, Homo Sapiens
QHALLQEEL

SEQ ID NO: 95919 - protein, 9 aa, Homo Sapiens
QHAPANDYL

SEQ ID NO: 95920 - protein, 9 aa, Homo Sapiens
QHAVEAISL

SEQ ID NO: 95921 - protein, 9 aa, Homo Sapiens
QHAWAQLTF

SEQ ID NO: 95922 - protein, 9 aa, Homo Sapiens
QHCEQWIEF

SEQ ID NO: 95923 - protein, 9 aa, Homo Sapiens
QHCFIREVL

SEQ ID NO: 95924 - protein, 9 aa, Homo Sapiens
QHCVLPSRL

SEQ ID NO: 95925 - protein, 9 aa, Homo Sapiens
QHDAACRVI

SEQ ID NO: 95926 - protein, 9 aa, Homo Sapiens
QHDAAQLYL

SEQ ID NO: 95927 - protein, 9 aa, Homo Sapiens
QHDAPVKTI

SEQ ID NO: 95928 - protein, 9 aa, Homo Sapiens
QHDETYYMW

SEQ ID NO: 95929 - protein, 9 aa, Homo Sapiens
QHDEVETYF

SEQ ID NO: 95930 - protein, 9 aa, Homo Sapiens
QHDFQAPYL

SEQ ID NO: 95931 - protein, 9 aa, Homo Sapiens
QHDFQKVKL

SEQ ID NO: 95932 - protein, 9 aa, Homo Sapiens
QHDFRTPEF

SEQ ID NO: 95933 - protein, 9 aa, Homo Sapiens
QHDFTSQIF

SEQ ID NO: 95934 - protein, 9 aa, Homo Sapiens
QHDGPTKNL

SEQ ID NO: 95935 - protein, 9 aa, Homo Sapiens
QHDIHNAKL

SEQ ID NO: 95936 - protein, 9 aa, Homo Sapiens
QHDLALLRL

SEQ ID NO: 95937 - protein, 9 aa, Homo Sapiens
QHDLFDSGF

SEQ ID NO: 95938 - protein, 9 aa, Homo Sapiens
QHDLFFDTL

SEQ ID NO: 95939 - protein, 9 aa, Homo Sapiens
QHDLVYGDW

SEQ ID NO: 95940 - protein, 9 aa, Homo Sapiens
QHDNIIAYY

SEQ ID NO: 95941 - protein, 9 aa, Homo Sapiens
QHDPETSVL

SEQ ID NO: 95942 - protein, 9 aa, Homo Sapiens
QHDPGKMFI

SEQ ID NO: 95943 - protein, 9 aa, Homo Sapiens
QHDPLTTDL

SEQ ID NO: 95944 - protein, 9 aa, Homo Sapiens
QHDPSAVAV

SEQ ID NO: 95945 - protein, 9 aa, Homo Sapiens
QHDPYITSI

SEQ ID NO: 95946 - protein, 9 aa, Homo Sapiens
QHDRALERF

SEQ ID NO: 95947 - protein, 9 aa, Homo Sapiens
QHDTIGYLL

SEQ ID NO: 95948 - protein, 9 aa, Homo Sapiens
QHDVLFSYL

SEQ ID NO: 95949 - protein, 9 aa, Homo Sapiens
QHDVLKLEF

SEQ ID NO: 95950 - protein, 9 aa, Homo Sapiens
QHDVQTLLL

SEQ ID NO: 95951 - protein, 9 aa, Homo Sapiens
QHDVSQTLL

SEQ ID NO: 95952 - protein, 9 aa, Homo Sapiens
QHEAAVPQL

SEQ ID NO: 95953 - protein, 9 aa, Homo Sapiens
QHEAFIRSI

SEQ ID NO: 95954 - protein, 9 aa, Homo Sapiens
QHEAGSTSW

SEQ ID NO: 95955 - protein, 9 aa, Homo Sapiens
QHECIPQAI

SEQ ID NO: 95956 - protein, 9 aa, Homo Sapiens
QHEDNKYFL

SEQ ID NO: 95957 - protein, 9 aa, Homo Sapiens
QHEEFVTSL

SEQ ID NO: 95958 - protein, 9 aa, Homo Sapiens
QHEFPGPAF

SEQ ID NO: 95959 - protein, 9 aa, Homo Sapiens
QHEFTVHFL

SEQ ID NO: 95960 - protein, 9 aa, Homo Sapiens
QHEGGVQEL

SEQ ID NO: 95961 - protein, 9 aa, Homo Sapiens
QHEKAALYF

SEQ ID NO: 95962 - protein, 9 aa, Homo Sapiens
QHEKEGYTI

SEQ ID NO: 95963 - protein, 9 aa, Homo Sapiens
QHEKLIVRI

SEQ ID NO: 95964 - protein, 9 aa, Homo Sapiens
QHELGNVFL

SEQ ID NO: 95965 - protein, 9 aa, Homo Sapiens
QHENSSLLL

SEQ ID NO: 95966 - protein, 9 aa, Homo Sapiens
QHEQPGQGI

SEQ ID NO: 95967 - protein, 9 aa, Homo Sapiens
QHETSSPAL

SEQ ID NO: 95968 - protein, 9 aa, Homo Sapiens
QHFDSVMQL

SEQ ID NO: 95969 - protein, 9 aa, Homo Sapiens
QHFDTIYSI

SEQ ID NO: 95970 - protein, 9 aa, Homo Sapiens
QHFGMVELL

SEQ ID NO: 95971 - protein, 9 aa, Homo Sapiens
QHFIQEEQI

SEQ ID NO: 95972 - protein, 9 aa, Homo Sapiens
QHFLRGNEI

SEQ ID NO: 95973 - protein, 9 aa, Homo Sapiens
QHFNGLLEI

SEQ ID NO: 95974 - protein, 9 aa, Homo Sapiens
QHFPEQMKL

SEQ ID NO: 95975 - protein, 9 aa, Homo Sapiens
QHFYICENF

SEQ ID NO: 95976 - protein, 9 aa, Homo Sapiens
QHGDVVSAI

SEQ ID NO: 95977 - protein, 9 aa, Homo Sapiens
QHGTQQQDL

SEQ ID NO: 95978 - protein, 9 aa, Homo Sapiens
QHHAKPNIF

SEQ ID NO: 95979 - protein, 9 aa, Homo Sapiens
QHHHLPQHL

SEQ ID NO: 95980 - protein, 9 aa, Homo Sapiens
QHHKLVNTI

SEQ ID NO: 95981 - protein, 9 aa, Homo Sapiens
QHHVEQLDL

SEQ ID NO: 95982 - protein, 9 aa, Homo Sapiens
QHHVVQDML

SEQ ID NO: 95983 - protein, 9 aa, Homo Sapiens
QHIAQDSSL

SEQ ID NO: 95984 - protein, 9 aa, Homo Sapiens
QHIDAVARF

SEQ ID NO: 95985 - protein, 9 aa, Homo Sapiens
QHIDFVTAI

SEQ ID NO: 95986 - protein, 9 aa, Homo Sapiens
QHIDNITQI

SEQ ID NO: 95987 - protein, 9 aa, Homo Sapiens
QHIGEMSFL

SEQ ID NO: 95988 - protein, 9 aa, Homo Sapiens
QHIGKPSTI

SEQ ID NO: 95989 - protein, 9 aa, Homo Sapiens
QHIGNIFMF

SEQ ID NO: 95990 - protein, 9 aa, Homo Sapiens
QHIKSDVHL

SEQ ID NO: 95991 - protein, 9 aa, Homo Sapiens
QHILNPAFL

SEQ ID NO: 95992 - protein, 9 aa, Homo Sapiens
QHILSVQQF

SEQ ID NO: 95993 - protein, 9 aa, Homo Sapiens
QHIMMVNHL

SEQ ID NO: 95994 - protein, 9 aa, Homo Sapiens
QHIPTPLFV

SEQ ID NO: 95995 - protein, 9 aa, Homo Sapiens
QHISDSPII

SEQ ID NO: 95996 - protein, 9 aa, Homo Sapiens
QHLFIQTFW

SEQ ID NO: 95997 - protein, 9 aa, Homo Sapiens
QHLIDTNKI

SEQ ID NO: 95998 - protein, 9 aa, Homo Sapiens
QHLIIFDYI

SEQ ID NO: 95999 - protein, 9 aa, Homo Sapiens
QHLPLSERI

SEQ ID NO: 96000 - protein, 9 aa, Homo Sapiens
QHLPYIQIL

SEQ ID NO: 96001 - protein, 9 aa, Homo Sapiens
QHLQQSNEI

SEQ ID NO: 96002 - protein, 9 aa, Homo Sapiens
QHMDETVSF

SEQ ID NO: 96003 - protein, 9 aa, Homo Sapiens
QHMKLKLQF

SEQ ID NO: 96004 - protein, 9 aa, Homo Sapiens
QHNDLEFKL

SEQ ID NO: 96005 - protein, 9 aa, Homo Sapiens
QHNPVPDFI

SEQ ID NO: 96006 - protein, 9 aa, Homo Sapiens
QHQAWLQSI

SEQ ID NO: 96007 - protein, 9 aa, Homo Sapiens
QHQDRVQNL

SEQ ID NO: 96008 - protein, 9 aa, Homo Sapiens
QHQEFSFLL

SEQ ID NO: 96009 - protein, 9 aa, Homo Sapiens
QHQEKVLYL

SEQ ID NO: 96010 - protein, 9 aa, Homo Sapiens
QHQESIIQL

SEQ ID NO: 96011 - protein, 9 aa, Homo Sapiens
QHQETINTL

SEQ ID NO: 96012 - protein, 9 aa, Homo Sapiens
QHQETPVYL

SEQ ID NO: 96013 - protein, 9 aa, Homo Sapiens
QHQFRDQRW

SEQ ID NO: 96014 - protein, 9 aa, Homo Sapiens
QHQGAVELL

SEQ ID NO: 96015 - protein, 9 aa, Homo Sapiens
QHQLDTILF

SEQ ID NO: 96016 - protein, 9 aa, Homo Sapiens
QHQLQQQQL

SEQ ID NO: 96017 - protein, 9 aa, Homo Sapiens
QHQMDVAFL

SEQ ID NO: 96018 - protein, 9 aa, Homo Sapiens
QHQQHTTVI

SEQ ID NO: 96019 - protein, 9 aa, Homo Sapiens
QHQSGIVQL

SEQ ID NO: 96020 - protein, 9 aa, Homo Sapiens
QHQSVPQCL

SEQ ID NO: 96021 - protein, 9 aa, Homo Sapiens
QHSAAGATI

SEQ ID NO: 96022 - protein, 9 aa, Homo Sapiens
QHSDKIIRL

SEQ ID NO: 96023 - protein, 9 aa, Homo Sapiens
QHSDSCYKL

SEQ ID NO: 96024 - protein, 9 aa, Homo Sapiens
QHSEMLAKL

SEQ ID NO: 96025 - protein, 9 aa, Homo Sapiens
QHSGSYEVI

SEQ ID NO: 96026 - protein, 9 aa, Homo Sapiens
QHSILACKI

SEQ ID NO: 96027 - protein, 9 aa, Homo Sapiens
QHSIPVFIF

SEQ ID NO: 96028 - protein, 9 aa, Homo Sapiens
QHSKIIQAF

SEQ ID NO: 96029 - protein, 9 aa, Homo Sapiens
QHSLGGHRL

SEQ ID NO: 96030 - protein, 9 aa, Homo Sapiens
QHSMILEQI

SEQ ID NO: 96031 - protein, 9 aa, Homo Sapiens
QHSNASQSL

SEQ ID NO: 96032 - protein, 9 aa, Homo Sapiens
QHSNVVINL

SEQ ID NO: 96033 - protein, 9 aa, Homo Sapiens
QHSPALKAI

SEQ ID NO: 96034 - protein, 9 aa, Homo Sapiens
QHSPDLMSF

SEQ ID NO: 96035 - protein, 9 aa, Homo Sapiens
QHSPSEPFL

SEQ ID NO: 96036 - protein, 9 aa, Homo Sapiens
QHSQLGQDL

SEQ ID NO: 96037 - protein, 9 aa, Homo Sapiens
QHSSFFIFL

SEQ ID NO: 96038 - protein, 9 aa, Homo Sapiens
QHSSLSTRF

SEQ ID NO: 96039 - protein, 9 aa, Homo Sapiens
QHSTAQLNL

SEQ ID NO: 96040 - protein, 9 aa, Homo Sapiens
QHSVQVDQL

SEQ ID NO: 96041 - protein, 9 aa, Homo Sapiens
QHVIDDLSL

SEQ ID NO: 96042 - protein, 9 aa, Homo Sapiens
QHVQLLTQI

SEQ ID NO: 96043 - protein, 9 aa, Homo Sapiens
QHVTEAFQF

SEQ ID NO: 96044 - protein, 9 aa, Homo Sapiens
QHVTISQLF

SEQ ID NO: 96045 - protein, 9 aa, Homo Sapiens
QHYQGQSSI

SEQ ID NO: 96046 - protein, 9 aa, Homo Sapiens
QHYQIPDDF

SEQ ID NO: 96047 - protein, 9 aa, Homo Sapiens
QQADVRLML

SEQ ID NO: 96048 - protein, 9 aa, Homo Sapiens
QQDAHEFLI

SEQ ID NO: 96049 - protein, 9 aa, Homo Sapiens
QQDDGKMFI

SEQ ID NO: 96050 - protein, 9 aa, Homo Sapiens
QQDWVVQRI

SEQ ID NO: 96051 - protein, 9 aa, Homo Sapiens
QQSETFQFL

SEQ ID NO: 96052 - protein, 9 aa, Homo Sapiens
QQSVIGDYL

SEQ ID NO: 96053 - protein, 9 aa, Homo Sapiens
QRAHVQEFF

SEQ ID NO: 96054 - protein, 9 aa, Homo Sapiens
QRCDLEHHF

SEQ ID NO: 96055 - protein, 9 aa, Homo Sapiens
QRDFNQNFI

SEQ ID NO: 96056 - protein, 9 aa, Homo Sapiens
QRDNTVHSF

SEQ ID NO: 96057 - protein, 9 aa, Homo Sapiens
QRDSLLWKL

SEQ ID NO: 96058 - protein, 9 aa, Homo Sapiens
QRISSFETF

SEQ ID NO: 96059 - protein, 9 aa, Homo Sapiens
QRLAGNEQV

SEQ ID NO: 96060 - protein, 9 aa, Homo Sapiens
QRMIGCELL

SEQ ID NO: 96061 - protein, 9 aa, Homo Sapiens
QRTPGEEKI

SEQ ID NO: 96062 - protein, 9 aa, Homo Sapiens
QRYELAEAF

SEQ ID NO: 96063 - protein, 9 aa, Homo Sapiens
QSESELQKL

SEQ ID NO: 96064 - protein, 9 aa, Homo Sapiens
RDYSAILYL

SEQ ID NO: 96065 - protein, 9 aa, Homo Sapiens
RHAAEALLL

SEQ ID NO: 96066 - protein, 9 aa, Homo Sapiens
RHADLEIRL

SEQ ID NO: 96067 - protein, 9 aa, Homo Sapiens
RHAEPGFSL

SEQ ID NO: 96068 - protein, 9 aa, Homo Sapiens
RHAVVMELI

SEQ ID NO: 96069 - protein, 9 aa, Homo Sapiens
RHAYPDGRL

SEQ ID NO: 96070 - protein, 9 aa, Homo Sapiens
RHCDLQVRI

SEQ ID NO: 96071 - protein, 9 aa, Homo Sapiens
RHDDRPQVL

SEQ ID NO: 96072 - protein, 9 aa, Homo Sapiens
RHDDYLVML

SEQ ID NO: 96073 - protein, 9 aa, Homo Sapiens
RHDEVRTYF

SEQ ID NO: 96074 - protein, 9 aa, Homo Sapiens
RHDHAVSLL

SEQ ID NO: 96075 - protein, 9 aa, Homo Sapiens
RHDIAFVEF

SEQ ID NO: 96076 - protein, 9 aa, Homo Sapiens
RHDNKVTWL

SEQ ID NO: 96077 - protein, 9 aa, Homo Sapiens
RHDPQTTNL

SEQ ID NO: 96078 - protein, 9 aa, Homo Sapiens
RHDPYINRI

SEQ ID NO: 96079 - protein, 9 aa, Homo Sapiens
RHDVIVTII

SEQ ID NO: 96080 - protein, 9 aa, Homo Sapiens
RHEYGSPGI

SEQ ID NO: 96081 - protein, 9 aa, Homo Sapiens
RHFEELETI

SEQ ID NO: 96082 - protein, 9 aa, Homo Sapiens
RHHEASIRL

SEQ ID NO: 96083 - protein, 9 aa, Homo Sapiens
RHIEIFTDL

SEQ ID NO: 96084 - protein, 9 aa, Homo Sapiens
RHLDFFEML

SEQ ID NO: 96085 - protein, 9 aa, Homo Sapiens
RHLDSYEFL

SEQ ID NO: 96086 - protein, 9 aa, Homo Sapiens
RHMEVCYIF

SEQ ID NO: 96087 - protein, 9 aa, Homo Sapiens
RHMHVQLQL

SEQ ID NO: 96088 - protein, 9 aa, Homo Sapiens
RHMQIVHKI

SEQ ID NO: 96089 - protein, 9 aa, Homo Sapiens
RHMYHSLYL

SEQ ID NO: 96090 - protein, 9 aa, Homo Sapiens
RHSDELTSL

SEQ ID NO: 96091 - protein, 9 aa, Homo Sapiens
RHSDYPLSL

SEQ ID NO: 96092 - protein, 9 aa, Homo Sapiens
RHSGLIIHL

SEQ ID NO: 96093 - protein, 9 aa, Homo Sapiens
RHSNLVQLL

SEQ ID NO: 96094 - protein, 9 aa, Homo Sapiens
RHSNVNLTI

SEQ ID NO: 96095 - protein, 9 aa, Homo Sapiens
RHVDAHATL

SEQ ID NO: 96096 - protein, 9 aa, Homo Sapiens
RHYEEELRL

SEQ ID NO: 96097 - protein, 9 aa, Homo Sapiens
RHYVGKEYF

SEQ ID NO: 96098 - protein, 9 aa, Homo Sapiens
RLDETIQAI

SEQ ID NO: 96099 - protein, 9 aa, Homo Sapiens
RLVDTGDKF

SEQ ID NO: 96100 - protein, 9 aa, Homo Sapiens
RPAVIGDVL

SEQ ID NO: 96101 - protein, 9 aa, Homo Sapiens
RQDESIQRI

SEQ ID NO: 96102 - protein, 9 aa, Homo Sapiens
SHADVVNLL

SEQ ID NO: 96103 - protein, 9 aa, Homo Sapiens
SHAENILQI

SEQ ID NO: 96104 - protein, 9 aa, Homo Sapiens
SHAFTLDEL

SEQ ID NO: 96105 - protein, 9 aa, Homo Sapiens
SHAPQDVSL

SEQ ID NO: 96106 - protein, 9 aa, Homo Sapiens
SHAPSFNFL

SEQ ID NO: 96107 - protein, 9 aa, Homo Sapiens
SHAPYLLVF

SEQ ID NO: 96108 - protein, 9 aa, Homo Sapiens
SHASKDVAI

SEQ ID NO: 96109 - protein, 9 aa, Homo Sapiens
SHAVFQIYL

SEQ ID NO: 96110 - protein, 9 aa, Homo Sapiens
SHAVGPQEI

SEQ ID NO: 96111 - protein, 9 aa, Homo Sapiens
SHCAQPLAL

SEQ ID NO: 96112 - protein, 9 aa, Homo Sapiens
SHCDLSLKI

SEQ ID NO: 96113 - protein, 9 aa, Homo Sapiens
SHCDYQQNL

SEQ ID NO: 96114 - protein, 9 aa, Homo Sapiens
SHCPLLQKV

SEQ ID NO: 96115 - protein, 9 aa, Homo Sapiens
SHCQLVTLI

SEQ ID NO: 96116 - protein, 9 aa, Homo Sapiens
SHDDGNIDL

SEQ ID NO: 96117 - protein, 9 aa, Homo Sapiens
SHDDIVTEF

SEQ ID NO: 96118 - protein, 9 aa, Homo Sapiens
SHDDIVTRM

SEQ ID NO: 96119 - protein, 9 aa, Homo Sapiens
SHDDTILIW

SEQ ID NO: 96120 - protein, 9 aa, Homo Sapiens
SHDEINNYL

SEQ ID NO: 96121 - protein, 9 aa, Homo Sapiens
SHDEMFSDI

SEQ ID NO: 96122 - protein, 9 aa, Homo Sapiens
SHDERFIRL

SEQ ID NO: 96123 - protein, 9 aa, Homo Sapiens
SHDEVFVVL

SEQ ID NO: 96124 - protein, 9 aa, Homo Sapiens
SHDFLEIRF

SEQ ID NO: 96125 - protein, 9 aa, Homo Sapiens
SHDFLETRF

SEQ ID NO: 96126 - protein, 9 aa, Homo Sapiens
SHDFYSHEL

SEQ ID NO: 96127 - protein, 9 aa, Homo Sapiens
SHDGHINYW

SEQ ID NO: 96128 - protein, 9 aa, Homo Sapiens
SHDHGYTTL

SEQ ID NO: 96129 - protein, 9 aa, Homo Sapiens
SHDHLELFL

SEQ ID NO: 96130 - protein, 9 aa, Homo Sapiens
SHDHLTLFL

SEQ ID NO: 96131 - protein, 9 aa, Homo Sapiens
SHDLLYQEF

SEQ ID NO: 96132 - protein, 9 aa, Homo Sapiens
SHDLMLLRL

SEQ ID NO: 96133 - protein, 9 aa, Homo Sapiens
SHDNEVYAW

SEQ ID NO: 96134 - protein, 9 aa, Homo Sapiens
SHDNFIYLY

SEQ ID NO: 96135 - protein, 9 aa, Homo Sapiens
SHDNGSQFF

SEQ ID NO: 96136 - protein, 9 aa, Homo Sapiens
SHDNIICGI

SEQ ID NO: 96137 - protein, 9 aa, Homo Sapiens
SHDNIVQLI

SEQ ID NO: 96138 - protein, 9 aa, Homo Sapiens
SHDNLVYVY

SEQ ID NO: 96139 - protein, 9 aa, Homo Sapiens
SHDNVIYIY

SEQ ID NO: 96140 - protein, 9 aa, Homo Sapiens
SHDQHAYAL

SEQ ID NO: 96141 - protein, 9 aa, Homo Sapiens
SHDRVKIKL

SEQ ID NO: 96142 - protein, 9 aa, Homo Sapiens
SHDSANCEL

SEQ ID NO: 96143 - protein, 9 aa, Homo Sapiens
SHDSIKMEI

SEQ ID NO: 96144 - protein, 9 aa, Homo Sapiens
SHDTMTYCL

SEQ ID NO: 96145 - protein, 9 aa, Homo Sapiens
SHDVVFLLM

SEQ ID NO: 96146 - protein, 9 aa, Homo Sapiens
SHDYPGEGI

SEQ ID NO: 96147 - protein, 9 aa, Homo Sapiens
SHDYSLYSL

SEQ ID NO: 96148 - protein, 9 aa, Homo Sapiens
SHEAPIPTF

SEQ ID NO: 96149 - protein, 9 aa, Homo Sapiens
SHEDTLALL

SEQ ID NO: 96150 - protein, 9 aa, Homo Sapiens
SHEDYRVFI

SEQ ID NO: 96151 - protein, 9 aa, Homo Sapiens
SHEEVVQTL

SEQ ID NO: 96152 - protein, 9 aa, Homo Sapiens
SHEGETAYI

SEQ ID NO: 96153 - protein, 9 aa, Homo Sapiens
SHEGETSYI

SEQ ID NO: 96154 - protein, 9 aa, Homo Sapiens
SHEGHVYGF

SEQ ID NO: 96155 - protein, 9 aa, Homo Sapiens
SHEPKSPSL

SEQ ID NO: 96156 - protein, 9 aa, Homo Sapiens
SHEQMIDLL

SEQ ID NO: 96157 - protein, 9 aa, Homo Sapiens
SHETSLYYL

SEQ ID NO: 96158 - protein, 9 aa, Homo Sapiens
SHETVTIEL

SEQ ID NO: 96159 - protein, 9 aa, Homo Sapiens
SHFQVAHTI

SEQ ID NO: 96160 - protein, 9 aa, Homo Sapiens
SHFTKVERI

SEQ ID NO: 96161 - protein, 9 aa, Homo Sapiens
SHFVEPVYL

SEQ ID NO: 96162 - protein, 9 aa, Homo Sapiens
SHFVSDVVI

SEQ ID NO: 96163 - protein, 9 aa, Homo Sapiens
SHGPPTHRL

SEQ ID NO: 96164 - protein, 9 aa, Homo Sapiens
SHHEACVRL

SEQ ID NO: 96165 - protein, 9 aa, Homo Sapiens
SHHHVVVFL

SEQ ID NO: 96166 - protein, 9 aa, Homo Sapiens
SHHLVISHL

SEQ ID NO: 96167 - protein, 9 aa, Homo Sapiens
SHHPGQYNL

SEQ ID NO: 96168 - protein, 9 aa, Homo Sapiens
SHHQIFVFI

SEQ ID NO: 96169 - protein, 9 aa, Homo Sapiens
SHHSMVSML

SEQ ID NO: 96170 - protein, 9 aa, Homo Sapiens
SHIDQREKI

SEQ ID NO: 96171 - protein, 9 aa, Homo Sapiens
SHIGDAVVI

SEQ ID NO: 96172 - protein, 9 aa, Homo Sapiens
SHIIGDEEI

SEQ ID NO: 96173 - protein, 9 aa, Homo Sapiens
SHIITGNKI

SEQ ID NO: 96174 - protein, 9 aa, Homo Sapiens
SHINEMQKI

SEQ ID NO: 96175 - protein, 9 aa, Homo Sapiens
SHINTVFVL

SEQ ID NO: 96176 - protein, 9 aa, Homo Sapiens
SHIPEASFL

SEQ ID NO: 96177 - protein, 9 aa, Homo Sapiens
SHIPLIIQF

SEQ ID NO: 96178 - protein, 9 aa, Homo Sapiens
SHIQDDMHL

SEQ ID NO: 96179 - protein, 9 aa, Homo Sapiens
SHIQGAVHI

SEQ ID NO: 96180 - protein, 9 aa, Homo Sapiens
SHITPTQGF

SEQ ID NO: 96181 - protein, 9 aa, Homo Sapiens
SHLDYDITL

SEQ ID NO: 96182 - protein, 9 aa, Homo Sapiens
SHLEDYSGL

SEQ ID NO: 96183 - protein, 9 aa, Homo Sapiens
SHLEKAWLI

SEQ ID NO: 96184 - protein, 9 aa, Homo Sapiens
SHLIGHQRI

SEQ ID NO: 96185 - protein, 9 aa, Homo Sapiens
SHLPESERI

SEQ ID NO: 96186 - protein, 9 aa, Homo Sapiens
SHLPLVEEL

SEQ ID NO: 96187 - protein, 9 aa, Homo Sapiens
SHLPQQLKF

SEQ ID NO: 96188 - protein, 9 aa, Homo Sapiens
SHMEPQVCL

SEQ ID NO: 96189 - protein, 9 aa, Homo Sapiens
SHMETTMKL

SEQ ID NO: 96190 - protein, 9 aa, Homo Sapiens
SHMKQLLLI

SEQ ID NO: 96191 - protein, 9 aa, Homo Sapiens
SHNSSFELI

SEQ ID NO: 96192 - protein, 9 aa, Homo Sapiens
SHQDILSTI

SEQ ID NO: 96193 - protein, 9 aa, Homo Sapiens
SHQDLSQKI

SEQ ID NO: 96194 - protein, 9 aa, Homo Sapiens
SHQDSITRL

SEQ ID NO: 96195 - protein, 9 aa, Homo Sapiens
SHQEAISKI

SEQ ID NO: 96196 - protein, 9 aa, Homo Sapiens
SHQFPSHDL

SEQ ID NO: 96197 - protein, 9 aa, Homo Sapiens
SHQGDYAVL

SEQ ID NO: 96198 - protein, 9 aa, Homo Sapiens
SHQLDFNVL

SEQ ID NO: 96199 - protein, 9 aa, Homo Sapiens
SHQNFALFF

SEQ ID NO: 96200 - protein, 9 aa, Homo Sapiens
SHQQYFYKI

SEQ ID NO: 96201 - protein, 9 aa, Homo Sapiens
SHSDGAQYV

SEQ ID NO: 96202 - protein, 9 aa, Homo Sapiens
SHSDTIQAI

SEQ ID NO: 96203 - protein, 9 aa, Homo Sapiens
SHSEAVAML

SEQ ID NO: 96204 - protein, 9 aa, Homo Sapiens
SHSEAVEAI

SEQ ID NO: 96205 - protein, 9 aa, Homo Sapiens
SHSEAVQEV

SEQ ID NO: 96206 - protein, 9 aa, Homo Sapiens
SHSEFKDLI

SEQ ID NO: 96207 - protein, 9 aa, Homo Sapiens
SHSEGLLQI

SEQ ID NO: 96208 - protein, 9 aa, Homo Sapiens
SHSELIHNL

SEQ ID NO: 96209 - protein, 9 aa, Homo Sapiens
SHSELKCDI

SEQ ID NO: 96210 - protein, 9 aa, Homo Sapiens
SHSFVVNIL

SEQ ID NO: 96211 - protein, 9 aa, Homo Sapiens
SHSGITNKL

SEQ ID NO: 96212 - protein, 9 aa, Homo Sapiens
SHSHVGYTL

SEQ ID NO: 96213 - protein, 9 aa, Homo Sapiens
SHSIFTVKI

SEQ ID NO: 96214 - protein, 9 aa, Homo Sapiens
SHSITNMEI

SEQ ID NO: 96215 - protein, 9 aa, Homo Sapiens
SHSLCEQTM

SEQ ID NO: 96216 - protein, 9 aa, Homo Sapiens
SHSNIIAGI

SEQ ID NO: 96217 - protein, 9 aa, Homo Sapiens
SHSQLMQLI

SEQ ID NO: 96218 - protein, 9 aa, Homo Sapiens
SHSRALVGI

SEQ ID NO: 96219 - protein, 9 aa, Homo Sapiens
SHSRIEYMI

SEQ ID NO: 96220 - protein, 9 aa, Homo Sapiens
SHSSAQFLI

SEQ ID NO: 96221 - protein, 9 aa, Homo Sapiens
SHSSDLQGL

SEQ ID NO: 96222 - protein, 9 aa, Homo Sapiens
SHSSFQASL

SEQ ID NO: 96223 - protein, 9 aa, Homo Sapiens
SHSSIIHRL

SEQ ID NO: 96224 - protein, 9 aa, Homo Sapiens
SHSSIQFSF

SEQ ID NO: 96225 - protein, 9 aa, Homo Sapiens
SHSSKVLHF

SEQ ID NO: 96226 - protein, 9 aa, Homo Sapiens
SHSSSFLSL

SEQ ID NO: 96227 - protein, 9 aa, Homo Sapiens
SHSSSVQTL

SEQ ID NO: 96228 - protein, 9 aa, Homo Sapiens
SHSSVILKM

SEQ ID NO: 96229 - protein, 9 aa, Homo Sapiens
SHSSVSSCL

SEQ ID NO: 96230 - protein, 9 aa, Homo Sapiens
SHSVFQLQI

SEQ ID NO: 96231 - protein, 9 aa, Homo Sapiens
SHSVFSVTI

SEQ ID NO: 96232 - protein, 9 aa, Homo Sapiens
SHSVLNLLF

SEQ ID NO: 96233 - protein, 9 aa, Homo Sapiens
SHSVPDTAF

SEQ ID NO: 96234 - protein, 9 aa, Homo Sapiens
SHTAEGDVL

SEQ ID NO: 96235 - protein, 9 aa, Homo Sapiens
SHTDVVPVF

SEQ ID NO: 96236 - protein, 9 aa, Homo Sapiens
SHTHVSVVI

SEQ ID NO: 96237 - protein, 9 aa, Homo Sapiens
SHTPGDHQI

SEQ ID NO: 96238 - protein, 9 aa, Homo Sapiens
SHTPGEHQI

SEQ ID NO: 96239 - protein, 9 aa, Homo Sapiens
SHTSVGNIL

SEQ ID NO: 96240 - protein, 9 aa, Homo Sapiens
SHTSVPLLL

SEQ ID NO: 96241 - protein, 9 aa, Homo Sapiens
SHVDDEYRW

SEQ ID NO: 96242 - protein, 9 aa, Homo Sapiens
SHVEEGNVV

SEQ ID NO: 96243 - protein, 9 aa, Homo Sapiens
SHVHFDEKL

SEQ ID NO: 96244 - protein, 9 aa, Homo Sapiens
SHVLPEPGF

SEQ ID NO: 96245 - protein, 9 aa, Homo Sapiens
SHVPYPVAL

SEQ ID NO: 96246 - protein, 9 aa, Homo Sapiens
SHVSGISRI

SEQ ID NO: 96247 - protein, 9 aa, Homo Sapiens
SHVSGTTTL

SEQ ID NO: 96248 - protein, 9 aa, Homo Sapiens
SHWPFFEAF

SEQ ID NO: 96249 - protein, 9 aa, Homo Sapiens
SHWQQQSYL

SEQ ID NO: 96250 - protein, 9 aa, Homo Sapiens
SHYDEAYKW

SEQ ID NO: 96251 - protein, 9 aa, Homo Sapiens
SHYEKEYIL

SEQ ID NO: 96252 - protein, 9 aa, Homo Sapiens
SHYLFSEEI

SEQ ID NO: 96253 - protein, 9 aa, Homo Sapiens
SHYTTPMVL

SEQ ID NO: 96254 - protein, 9 aa, Homo Sapiens
SLADDNLKL

SEQ ID NO: 96255 - protein, 9 aa, Homo Sapiens
SLFRLQEQF

SEQ ID NO: 96256 - protein, 9 aa, Homo Sapiens
SNWFQPIYL

SEQ ID NO: 96257 - protein, 9 aa, Homo Sapiens
SPDEHEPLL

SEQ ID NO: 96258 - protein, 9 aa, Homo Sapiens
SPDGSDPKL

SEQ ID NO: 96259 - protein, 9 aa, Homo Sapiens
SQCPHIVRI

SEQ ID NO: 96260 - protein, 9 aa, Homo Sapiens
SQDGTLQSF

SEQ ID NO: 96261 - protein, 9 aa, Homo Sapiens
SQDPFPAAI

SEQ ID NO: 96262 - protein, 9 aa, Homo Sapiens
SQDPGTHVV

SEQ ID NO: 96263 - protein, 9 aa, Homo Sapiens
SQDPPEKSI

SEQ ID NO: 96264 - protein, 9 aa, Homo Sapiens
SQDTGKYCF

SEQ ID NO: 96265 - protein, 9 aa, Homo Sapiens
SQDYGKHLL

SEQ ID NO: 96266 - protein, 9 aa, Homo Sapiens
SQIADVARF

SEQ ID NO: 96267 - protein, 9 aa, Homo Sapiens
SRAAEKLYL

SEQ ID NO: 96268 - protein, 9 aa, Homo Sapiens
SRDDNMFQI

SEQ ID NO: 96269 - protein, 9 aa, Homo Sapiens
SRDKLKLFL

SEQ ID NO: 96270 - protein, 9 aa, Homo Sapiens
SRDKTIIMW

SEQ ID NO: 96271 - protein, 9 aa, Homo Sapiens
SRDPVQLNL

SEQ ID NO: 96272 - protein, 9 aa, Homo Sapiens
SRDRLIHVL

SEQ ID NO: 96273 - protein, 9 aa, Homo Sapiens
SRFEGLEKI

SEQ ID NO: 96274 - protein, 9 aa, Homo Sapiens
SRFEKEFSF

SEQ ID NO: 96275 - protein, 9 aa, Homo Sapiens
SRFLANEVL

SEQ ID NO: 96276 - protein, 9 aa, Homo Sapiens
SRIGGNEGI

SEQ ID NO: 96277 - protein, 9 aa, Homo Sapiens
SRLQGVERI

SEQ ID NO: 96278 - protein, 9 aa, Homo Sapiens
TDAHTVLAL

SEQ ID NO: 96279 - protein, 9 aa, Homo Sapiens
TEDDKQLLL

SEQ ID NO: 96280 - protein, 9 aa, Homo Sapiens
TEDGNILQL

SEQ ID NO: 96281 - protein, 9 aa, Homo Sapiens
TEDGYILCL

SEQ ID NO: 96282 - protein, 9 aa, Homo Sapiens
TEDITRYYL

SEQ ID NO: 96283 - protein, 9 aa, Homo Sapiens
TEDPTILRI

SEQ ID NO: 96284 - protein, 9 aa, Homo Sapiens
THAAQQILL

SEQ ID NO: 96285 - protein, 9 aa, Homo Sapiens
THAAQQLKL

SEQ ID NO: 96286 - protein, 9 aa, Homo Sapiens
THADCPQLL

SEQ ID NO: 96287 - protein, 9 aa, Homo Sapiens
THADFVLEM

SEQ ID NO: 96288 - protein, 9 aa, Homo Sapiens
THADVVQMF

SEQ ID NO: 96289 - protein, 9 aa, Homo Sapiens
THADYVLEM

SEQ ID NO: 96290 - protein, 9 aa, Homo Sapiens
THAEHIETI

SEQ ID NO: 96291 - protein, 9 aa, Homo Sapiens
THAEINQKL

SEQ ID NO: 96292 - protein, 9 aa, Homo Sapiens
THAEVHQSL

SEQ ID NO: 96293 - protein, 9 aa, Homo Sapiens
THAFSSDLM

SEQ ID NO: 96294 - protein, 9 aa, Homo Sapiens
THAGAHLDL

SEQ ID NO: 96295 - protein, 9 aa, Homo Sapiens
THAGVRLYF

SEQ ID NO: 96296 - protein, 9 aa, Homo Sapiens
THALEYVLF

SEQ ID NO: 96297 - protein, 9 aa, Homo Sapiens
THALLGDSL

SEQ ID NO: 96298 - protein, 9 aa, Homo Sapiens
THALLSVLL

SEQ ID NO: 96299 - protein, 9 aa, Homo Sapiens
THALPIPVI

SEQ ID NO: 96300 - protein, 9 aa, Homo Sapiens
THANDASAL

SEQ ID NO: 96301 - protein, 9 aa, Homo Sapiens
THANYKVTL

SEQ ID NO: 96302 - protein, 9 aa, Homo Sapiens
THAPISIYF

SEQ ID NO: 96303 - protein, 9 aa, Homo Sapiens
THAQDIVQI

SEQ ID NO: 96304 - protein, 9 aa, Homo Sapiens
THARNDYLL

SEQ ID NO: 96305 - protein, 9 aa, Homo Sapiens
THARVMTRF

SEQ ID NO: 96306 - protein, 9 aa, Homo Sapiens
THASQIELL

SEQ ID NO: 96307 - protein, 9 aa, Homo Sapiens
THAVVFAKL

SEQ ID NO: 96308 - protein, 9 aa, Homo Sapiens
THCAQDLAM

SEQ ID NO: 96309 - protein, 9 aa, Homo Sapiens
THCEIHPSM

SEQ ID NO: 96310 - protein, 9 aa, Homo Sapiens
THCGVPNYL

SEQ ID NO: 96311 - protein, 9 aa, Homo Sapiens
THCIDFSYL

SEQ ID NO: 96312 - protein, 9 aa, Homo Sapiens
THCLPEPHL

SEQ ID NO: 96313 - protein, 9 aa, Homo Sapiens
THCLWTDQL

SEQ ID NO: 96314 - protein, 9 aa, Homo Sapiens
THCPDTPLL

SEQ ID NO: 96315 - protein, 9 aa, Homo Sapiens
THCTISLAL

SEQ ID NO: 96316 - protein, 9 aa, Homo Sapiens
THDAPATTF

SEQ ID NO: 96317 - protein, 9 aa, Homo Sapiens
THDDVQQSF

SEQ ID NO: 96318 - protein, 9 aa, Homo Sapiens
THDEDFVEL

SEQ ID NO: 96319 - protein, 9 aa, Homo Sapiens
THDEGFYWW

SEQ ID NO: 96320 - protein, 9 aa, Homo Sapiens
THDELIQLV

SEQ ID NO: 96321 - protein, 9 aa, Homo Sapiens
THDGFGFML

SEQ ID NO: 96322 - protein, 9 aa, Homo Sapiens
THDGGFLSL

SEQ ID NO: 96323 - protein, 9 aa, Homo Sapiens
THDGSILIV

SEQ ID NO: 96324 - protein, 9 aa, Homo Sapiens
THDGSVYFW

SEQ ID NO: 96325 - protein, 9 aa, Homo Sapiens
THDHVKPLL

SEQ ID NO: 96326 - protein, 9 aa, Homo Sapiens
THDIHALIL

SEQ ID NO: 96327 - protein, 9 aa, Homo Sapiens
THDIPIKVI

SEQ ID NO: 96328 - protein, 9 aa, Homo Sapiens
THDITTISI

SEQ ID NO: 96329 - protein, 9 aa, Homo Sapiens
THDKLSHYL

SEQ ID NO: 96330 - protein, 9 aa, Homo Sapiens
THDLEGPPL

SEQ ID NO: 96331 - protein, 9 aa, Homo Sapiens
THDLKTLSL

SEQ ID NO: 96332 - protein, 9 aa, Homo Sapiens
THDLLDICL

SEQ ID NO: 96333 - protein, 9 aa, Homo Sapiens
THDLRIHQL

SEQ ID NO: 96334 - protein, 9 aa, Homo Sapiens
THDLVGPEL

SEQ ID NO: 96335 - protein, 9 aa, Homo Sapiens
THDPLHQEV

SEQ ID NO: 96336 - protein, 9 aa, Homo Sapiens
THDPNKEAL

SEQ ID NO: 96337 - protein, 9 aa, Homo Sapiens
THDPNKETF

SEQ ID NO: 96338 - protein, 9 aa, Homo Sapiens
THDPNKMAF

SEQ ID NO: 96339 - protein, 9 aa, Homo Sapiens
THDPRTVTL

SEQ ID NO: 96340 - protein, 9 aa, Homo Sapiens
THDQAVQAL

SEQ ID NO: 96341 - protein, 9 aa, Homo Sapiens
THDQMIDLL

SEQ ID NO: 96342 - protein, 9 aa, Homo Sapiens
THDRSFEEF

SEQ ID NO: 96343 - protein, 9 aa, Homo Sapiens
THDSGLITI

SEQ ID NO: 96344 - protein, 9 aa, Homo Sapiens
THDSNTDMF

SEQ ID NO: 96345 - protein, 9 aa, Homo Sapiens
THDSRAVKF

SEQ ID NO: 96346 - protein, 9 aa, Homo Sapiens
THDTFQNEL

SEQ ID NO: 96347 - protein, 9 aa, Homo Sapiens
THDTKIELL

SEQ ID NO: 96348 - protein, 9 aa, Homo Sapiens
THEAYVTVL

SEQ ID NO: 96349 - protein, 9 aa, Homo Sapiens
THEDAVAAM

SEQ ID NO: 96350 - protein, 9 aa, Homo Sapiens
THEDDKYRL

SEQ ID NO: 96351 - protein, 9 aa, Homo Sapiens
THEDGVLEL

SEQ ID NO: 96352 - protein, 9 aa, Homo Sapiens
THEDIEAQI

SEQ ID NO: 96353 - protein, 9 aa, Homo Sapiens
THEDSKILL

SEQ ID NO: 96354 - protein, 9 aa, Homo Sapiens
THEEAVTAL

SEQ ID NO: 96355 - protein, 9 aa, Homo Sapiens
THEEMPQSI

SEQ ID NO: 96356 - protein, 9 aa, Homo Sapiens
THEGFNVTL

SEQ ID NO: 96357 - protein, 9 aa, Homo Sapiens
THEITVLII

SEQ ID NO: 96358 - protein, 9 aa, Homo Sapiens
THELTNPGI

SEQ ID NO: 96359 - protein, 9 aa, Homo Sapiens
THEPNFTII

SEQ ID NO: 96360 - protein, 9 aa, Homo Sapiens
THEQAILRL

SEQ ID NO: 96361 - protein, 9 aa, Homo Sapiens
THESHAVRL

SEQ ID NO: 96362 - protein, 9 aa, Homo Sapiens
THEVFQQQL

SEQ ID NO: 96363 - protein, 9 aa, Homo Sapiens
THFESKTEL

SEQ ID NO: 96364 - protein, 9 aa, Homo Sapiens
THFFKVLIL

SEQ ID NO: 96365 - protein, 9 aa, Homo Sapiens
THFHELTAL

SEQ ID NO: 96366 - protein, 9 aa, Homo Sapiens
THFLQPIYL

SEQ ID NO: 96367 - protein, 9 aa, Homo Sapiens
THFNFAIVF

SEQ ID NO: 96368 - protein, 9 aa, Homo Sapiens
THFPDETEI

SEQ ID NO: 96369 - protein, 9 aa, Homo Sapiens
THFQLAYRL

SEQ ID NO: 96370 - protein, 9 aa, Homo Sapiens
THFSDHLYW

SEQ ID NO: 96371 - protein, 9 aa, Homo Sapiens
THFSFPLRL

SEQ ID NO: 96372 - protein, 9 aa, Homo Sapiens
THGDFDVAL

SEQ ID NO: 96373 - protein, 9 aa, Homo Sapiens
THGEAVQLL

SEQ ID NO: 96374 - protein, 9 aa, Homo Sapiens
THGEVERRI

SEQ ID NO: 96375 - protein, 9 aa, Homo Sapiens
THGGRIDYI

SEQ ID NO: 96376 - protein, 9 aa, Homo Sapiens
THGPENPKL

SEQ ID NO: 96377 - protein, 9 aa, Homo Sapiens
THGQFYDLL

SEQ ID NO: 96378 - protein, 9 aa, Homo Sapiens
THGQGGWLL

SEQ ID NO: 96379 - protein, 9 aa, Homo Sapiens
THGRVRLLL

SEQ ID NO: 96380 - protein, 9 aa, Homo Sapiens
THGVVHVTI

SEQ ID NO: 96381 - protein, 9 aa, Homo Sapiens
THHDALAIL

SEQ ID NO: 96382 - protein, 9 aa, Homo Sapiens
THHLFVIFF

SEQ ID NO: 96383 - protein, 9 aa, Homo Sapiens
THHNDTELI

SEQ ID NO: 96384 - protein, 9 aa, Homo Sapiens
THHQQDPAF

SEQ ID NO: 96385 - protein, 9 aa, Homo Sapiens
THHYHQTLL

SEQ ID NO: 96386 - protein, 9 aa, Homo Sapiens
THHYVPCSL

SEQ ID NO: 96387 - protein, 9 aa, Homo Sapiens
THIAEATGW

SEQ ID NO: 96388 - protein, 9 aa, Homo Sapiens
THIDINSKI

SEQ ID NO: 96389 - protein, 9 aa, Homo Sapiens
THIEAQNKI

SEQ ID NO: 96390 - protein, 9 aa, Homo Sapiens
THILDGNAV

SEQ ID NO: 96391 - protein, 9 aa, Homo Sapiens
THILTPQKL

SEQ ID NO: 96392 - protein, 9 aa, Homo Sapiens
THINGESVL

SEQ ID NO: 96393 - protein, 9 aa, Homo Sapiens
THIRDFLQV

SEQ ID NO: 96394 - protein, 9 aa, Homo Sapiens
THISPNAIF

SEQ ID NO: 96395 - protein, 9 aa, Homo Sapiens
THLAEFHQI

SEQ ID NO: 96396 - protein, 9 aa, Homo Sapiens
THLDFHLEF

SEQ ID NO: 96397 - protein, 9 aa, Homo Sapiens
THLDSVTKI

SEQ ID NO: 96398 - protein, 9 aa, Homo Sapiens
THLEAQNRI

SEQ ID NO: 96399 - protein, 9 aa, Homo Sapiens
THLEHQQRI

SEQ ID NO: 96400 - protein, 9 aa, Homo Sapiens
THLEYFSLW

SEQ ID NO: 96401 - protein, 9 aa, Homo Sapiens
THLKDLIAW

SEQ ID NO: 96402 - protein, 9 aa, Homo Sapiens
THLKQQLAL

SEQ ID NO: 96403 - protein, 9 aa, Homo Sapiens
THLNDHLQM

SEQ ID NO: 96404 - protein, 9 aa, Homo Sapiens
THLPQTLTI

SEQ ID NO: 96405 - protein, 9 aa, Homo Sapiens
THLSQSSNL

SEQ ID NO: 96406 - protein, 9 aa, Homo Sapiens
THLSSTEAF

SEQ ID NO: 96407 - protein, 9 aa, Homo Sapiens
THLSWIQNI

SEQ ID NO: 96408 - protein, 9 aa, Homo Sapiens
THLWLNEGF

SEQ ID NO: 96409 - protein, 9 aa, Homo Sapiens
THMELYSQL

SEQ ID NO: 96410 - protein, 9 aa, Homo Sapiens
THMEPEHRL

SEQ ID NO: 96411 - protein, 9 aa, Homo Sapiens
THMIESNDI

SEQ ID NO: 96412 - protein, 9 aa, Homo Sapiens
THMNSSEKL

SEQ ID NO: 96413 - protein, 9 aa, Homo Sapiens
THMQHAYDF

SEQ ID NO: 96414 - protein, 9 aa, Homo Sapiens
THMSPSWTL

SEQ ID NO: 96415 - protein, 9 aa, Homo Sapiens
THMTAIVGM

SEQ ID NO: 96416 - protein, 9 aa, Homo Sapiens
THMVCRTAL

SEQ ID NO: 96417 - protein, 9 aa, Homo Sapiens
THNEIYDKF

SEQ ID NO: 96418 - protein, 9 aa, Homo Sapiens
THNEPGVRL

SEQ ID NO: 96419 - protein, 9 aa, Homo Sapiens
THNESVSAL

SEQ ID NO: 96420 - protein, 9 aa, Homo Sapiens
THNLMELLI

SEQ ID NO: 96421 - protein, 9 aa, Homo Sapiens
THNLSFDEI

SEQ ID NO: 96422 - protein, 9 aa, Homo Sapiens
THNMDVPNI

SEQ ID NO: 96423 - protein, 9 aa, Homo Sapiens
THNPTNATL

SEQ ID NO: 96424 - protein, 9 aa, Homo Sapiens
THQEAVSAL

SEQ ID NO: 96425 - protein, 9 aa, Homo Sapiens
THQENGIEI

SEQ ID NO: 96426 - protein, 9 aa, Homo Sapiens
THQPVYHKI

SEQ ID NO: 96427 - protein, 9 aa, Homo Sapiens
THQQETQSI

SEQ ID NO: 96428 - protein, 9 aa, Homo Sapiens
THQQGQPAL

SEQ ID NO: 96429 - protein, 9 aa, Homo Sapiens
THQQKVLRL

SEQ ID NO: 96430 - protein, 9 aa, Homo Sapiens
THQQVVSRI

SEQ ID NO: 96431 - protein, 9 aa, Homo Sapiens
THSATKVLI

SEQ ID NO: 96432 - protein, 9 aa, Homo Sapiens
THSAVDNIL

SEQ ID NO: 96433 - protein, 9 aa, Homo Sapiens
THSDDVTQV

SEQ ID NO: 96434 - protein, 9 aa, Homo Sapiens
THSDIQVKL

SEQ ID NO: 96435 - protein, 9 aa, Homo Sapiens
THSDSALKI

SEQ ID NO: 96436 - protein, 9 aa, Homo Sapiens
THSEPLSTI

SEQ ID NO: 96437 - protein, 9 aa, Homo Sapiens
THSGLFTHL

SEQ ID NO: 96438 - protein, 9 aa, Homo Sapiens
THSHFLARL

SEQ ID NO: 96439 - protein, 9 aa, Homo Sapiens
THSINALLI

SEQ ID NO: 96440 - protein, 9 aa, Homo Sapiens
THSKRTLLI

SEQ ID NO: 96441 - protein, 9 aa, Homo Sapiens
THSKVTFEI

SEQ ID NO: 96442 - protein, 9 aa, Homo Sapiens
THSLETQEL

SEQ ID NO: 96443 - protein, 9 aa, Homo Sapiens
THSLPLLLF

SEQ ID NO: 96444 - protein, 9 aa, Homo Sapiens
THSLPVVVI

SEQ ID NO: 96445 - protein, 9 aa, Homo Sapiens
THSMDLVAL

SEQ ID NO: 96446 - protein, 9 aa, Homo Sapiens
THSNLHTSI

SEQ ID NO: 96447 - protein, 9 aa, Homo Sapiens
THSNMANAL

SEQ ID NO: 96448 - protein, 9 aa, Homo Sapiens
THSPDAPDF

SEQ ID NO: 96449 - protein, 9 aa, Homo Sapiens
THSPFCWHL

SEQ ID NO: 96450 - protein, 9 aa, Homo Sapiens
THSPKEVMF

SEQ ID NO: 96451 - protein, 9 aa, Homo Sapiens
THSPSNAQF

SEQ ID NO: 96452 - protein, 9 aa, Homo Sapiens
THSPSSSSI

SEQ ID NO: 96453 - protein, 9 aa, Homo Sapiens
THSPYVAQI

SEQ ID NO: 96454 - protein, 9 aa, Homo Sapiens
THSQELCKL

SEQ ID NO: 96455 - protein, 9 aa, Homo Sapiens
THSSLLDLI

SEQ ID NO: 96456 - protein, 9 aa, Homo Sapiens
THSSPSFNL

SEQ ID NO: 96457 - protein, 9 aa, Homo Sapiens
THSTIDAKM

SEQ ID NO: 96458 - protein, 9 aa, Homo Sapiens
THSTTSQAI

SEQ ID NO: 96459 - protein, 9 aa, Homo Sapiens
THTLDISQL

SEQ ID NO: 96460 - protein, 9 aa, Homo Sapiens
THTQPGVQL

SEQ ID NO: 96461 - protein, 9 aa, Homo Sapiens
THTSLMQRL

SEQ ID NO: 96462 - protein, 9 aa, Homo Sapiens
THTTVIHQL

SEQ ID NO: 96463 - protein, 9 aa, Homo Sapiens
THVDPILLI

SEQ ID NO: 96464 - protein, 9 aa, Homo Sapiens
THVDSMDLI

SEQ ID NO: 96465 - protein, 9 aa, Homo Sapiens
THVFVIAEL

SEQ ID NO: 96466 - protein, 9 aa, Homo Sapiens
THVGKVNIF

SEQ ID NO: 96467 - protein, 9 aa, Homo Sapiens
THVGPTPAI

SEQ ID NO: 96468 - protein, 9 aa, Homo Sapiens
THVIENIYL

SEQ ID NO: 96469 - protein, 9 aa, Homo Sapiens
THVKELWTW

SEQ ID NO: 96470 - protein, 9 aa, Homo Sapiens
THVLVPVWI

SEQ ID NO: 96471 - protein, 9 aa, Homo Sapiens
THVNDGTEF

SEQ ID NO: 96472 - protein, 9 aa, Homo Sapiens
THVPQPAFL

SEQ ID NO: 96473 - protein, 9 aa, Homo Sapiens
THVPSTEEI

SEQ ID NO: 96474 - protein, 9 aa, Homo Sapiens
THVRDWVMW

SEQ ID NO: 96475 - protein, 9 aa, Homo Sapiens
THVSNGCQL

SEQ ID NO: 96476 - protein, 9 aa, Homo Sapiens
THVTEIISF

SEQ ID NO: 96477 - protein, 9 aa, Homo Sapiens
THYGKVYLL

SEQ ID NO: 96478 - protein, 9 aa, Homo Sapiens
THYWSLEKL

SEQ ID NO: 96479 - protein, 9 aa, Homo Sapiens
TKIEIGDTI

SEQ ID NO: 96480 - protein, 9 aa, Homo Sapiens
TLCDLYETL

SEQ ID NO: 96481 - protein, 9 aa, Homo Sapiens
TLDPAEYNI

SEQ ID NO: 96482 - protein, 9 aa, Homo Sapiens
TLTELGDEL

SEQ ID NO: 96483 - protein, 9 aa, Homo Sapiens
TMATMGDTL

SEQ ID NO: 96484 - protein, 9 aa, Homo Sapiens
TPISIGDSI

SEQ ID NO: 96485 - protein, 9 aa, Homo Sapiens
TQCELLTQL

SEQ ID NO: 96486 - protein, 9 aa, Homo Sapiens
TQCGYDVRI

SEQ ID NO: 96487 - protein, 9 aa, Homo Sapiens
TQDAVPLTL

SEQ ID NO: 96488 - protein, 9 aa, Homo Sapiens
TQDECILHF

SEQ ID NO: 96489 - protein, 9 aa, Homo Sapiens
TQDGIKLMF

SEQ ID NO: 96490 - protein, 9 aa, Homo Sapiens
TQDGLLFTF

SEQ ID NO: 96491 - protein, 9 aa, Homo Sapiens
TQDGNIYQL

SEQ ID NO: 96492 - protein, 9 aa, Homo Sapiens
TQDPHVNAF

SEQ ID NO: 96493 - protein, 9 aa, Homo Sapiens
TQDPTAQSL

SEQ ID NO: 96494 - protein, 9 aa, Homo Sapiens
TQDPTVTRL

SEQ ID NO: 96495 - protein, 9 aa, Homo Sapiens
TQDQGMYRF

SEQ ID NO: 96496 - protein, 9 aa, Homo Sapiens
TQDSSFQGL

SEQ ID NO: 96497 - protein, 9 aa, Homo Sapiens
TQDSSILPL

SEQ ID NO: 96498 - protein, 9 aa, Homo Sapiens
TQDTQPHYI

SEQ ID NO: 96499 - protein, 9 aa, Homo Sapiens
TQESTFQEL

SEQ ID NO: 96500 - protein, 9 aa, Homo Sapiens
TQGPIEVYL

SEQ ID NO: 96501 - protein, 9 aa, Homo Sapiens
TQMDVKLVF

SEQ ID NO: 96502 - protein, 9 aa, Homo Sapiens
TQMPDPKTF

SEQ ID NO: 96503 - protein, 9 aa, Homo Sapiens
TQNLDVHFW

SEQ ID NO: 96504 - protein, 9 aa, Homo Sapiens
TQSEVDPHL

SEQ ID NO: 96505 - protein, 9 aa, Homo Sapiens
TQTAVITRI

SEQ ID NO: 96506 - protein, 9 aa, Homo Sapiens
TQVGPGPQI

SEQ ID NO: 96507 - protein, 9 aa, Homo Sapiens
TQVLIGNNI

SEQ ID NO: 96508 - protein, 9 aa, Homo Sapiens
TRAAVEEGI

SEQ ID NO: 96509 - protein, 9 aa, Homo Sapiens
TRALEEHRL

SEQ ID NO: 96510 - protein, 9 aa, Homo Sapiens
TRCIAILYI

SEQ ID NO: 96511 - protein, 9 aa, Homo Sapiens
TRCPLVLKL

SEQ ID NO: 96512 - protein, 9 aa, Homo Sapiens
TRCPYKDTL

SEQ ID NO: 96513 - protein, 9 aa, Homo Sapiens
TRCQFQTKF

SEQ ID NO: 96514 - protein, 9 aa, Homo Sapiens
TRDDSPLYI

SEQ ID NO: 96515 - protein, 9 aa, Homo Sapiens
TRDELEWKL

SEQ ID NO: 96516 - protein, 9 aa, Homo Sapiens
TRDETNYGI

SEQ ID NO: 96517 - protein, 9 aa, Homo Sapiens
TRDFTQPFI

SEQ ID NO: 96518 - protein, 9 aa, Homo Sapiens
TRDGNFLRL

SEQ ID NO: 96519 - protein, 9 aa, Homo Sapiens
TRDNTLIRI

SEQ ID NO: 96520 - protein, 9 aa, Homo Sapiens
TRDSNIIRL

SEQ ID NO: 96521 - protein, 9 aa, Homo Sapiens
TRDSVKTVL

SEQ ID NO: 96522 - protein, 9 aa, Homo Sapiens
TRDVHIYRL

SEQ ID NO: 96523 - protein, 9 aa, Homo Sapiens
TREEGAQTL

SEQ ID NO: 96524 - protein, 9 aa, Homo Sapiens
TREEGKALL

SEQ ID NO: 96525 - protein, 9 aa, Homo Sapiens
TRHNYYESF

SEQ ID NO: 96526 - protein, 9 aa, Homo Sapiens
TRIGVMSLI

SEQ ID NO: 96527 - protein, 9 aa, Homo Sapiens
TRIPKIQKL

SEQ ID NO: 96528 - protein, 9 aa, Homo Sapiens
TRLAIQEAL

SEQ ID NO: 96529 - protein, 9 aa, Homo Sapiens
TRLDQDESF

SEQ ID NO: 96530 - protein, 9 aa, Homo Sapiens
TRLEFQQQL

SEQ ID NO: 96531 - protein, 9 aa, Homo Sapiens
TRLLMKERF

SEQ ID NO: 96532 - protein, 9 aa, Homo Sapiens
TRSAEQHLI

SEQ ID NO: 96533 - protein, 9 aa, Homo Sapiens
TRSAIILHL

SEQ ID NO: 96534 - protein, 9 aa, Homo Sapiens
TRTPIGSFL

SEQ ID NO: 96535 - protein, 9 aa, Homo Sapiens
TRVQEEPEL

SEQ ID NO: 96536 - protein, 9 aa, Homo Sapiens
TRYQYCDFL

SEQ ID NO: 96537 - protein, 9 aa, Homo Sapiens
TSFWALLYL

SEQ ID NO: 96538 - protein, 9 aa, Homo Sapiens
VGGEALELR

SEQ ID NO: 96539 - protein, 9 aa, Homo Sapiens
VHAELADVL

SEQ ID NO: 96540 - protein, 9 aa, Homo Sapiens
VHAENGDII

SEQ ID NO: 96541 - protein, 9 aa, Homo Sapiens
VHAFPELFL

SEQ ID NO: 96542 - protein, 9 aa, Homo Sapiens
VHAQVQQFL

SEQ ID NO: 96543 - protein, 9 aa, Homo Sapiens
VHAVIGDEL

SEQ ID NO: 96544 - protein, 9 aa, Homo Sapiens
VHAYIISYL

SEQ ID NO: 96545 - protein, 9 aa, Homo Sapiens
VHDALVQII

SEQ ID NO: 96546 - protein, 9 aa, Homo Sapiens
VHDDVDIIL

SEQ ID NO: 96547 - protein, 9 aa, Homo Sapiens
VHDEGVWAL

SEQ ID NO: 96548 - protein, 9 aa, Homo Sapiens
VHDETCQVI

SEQ ID NO: 96549 - protein, 9 aa, Homo Sapiens
VHDGCVNTI

SEQ ID NO: 96550 - protein, 9 aa, Homo Sapiens
VHDKTPTHF

SEQ ID NO: 96551 - protein, 9 aa, Homo Sapiens
VHDNKVLRI

SEQ ID NO: 96552 - protein, 9 aa, Homo Sapiens
VHDNLAMKI

SEQ ID NO: 96553 - protein, 9 aa, Homo Sapiens
VHDSFQQLI

SEQ ID NO: 96554 - protein, 9 aa, Homo Sapiens
VHDSIDYRF

SEQ ID NO: 96555 - protein, 9 aa, Homo Sapiens
VHDTSTELL

SEQ ID NO: 96556 - protein, 9 aa, Homo Sapiens
VHEKDVIGI

SEQ ID NO: 96557 - protein, 9 aa, Homo Sapiens
VHFIKPLLL

SEQ ID NO: 96558 - protein, 9 aa, Homo Sapiens
VHHLDNNEF

SEQ ID NO: 96559 - protein, 9 aa, Homo Sapiens
VHHYSGNNI

SEQ ID NO: 96560 - protein, 9 aa, Homo Sapiens
VHIADVSYF

SEQ ID NO: 96561 - protein, 9 aa, Homo Sapiens
VHIANPDFI

SEQ ID NO: 96562 - protein, 9 aa, Homo Sapiens
VHIDLPLFF

SEQ ID NO: 96563 - protein, 9 aa, Homo Sapiens
VHIEVGNRV

SEQ ID NO: 96564 - protein, 9 aa, Homo Sapiens
VHILDTESF

SEQ ID NO: 96565 - protein, 9 aa, Homo Sapiens
VHILDTETF

SEQ ID NO: 96566 - protein, 9 aa, Homo Sapiens
VHIPEVYLI

SEQ ID NO: 96567 - protein, 9 aa, Homo Sapiens
VHNEGMQVL

SEQ ID NO: 96568 - protein, 9 aa, Homo Sapiens
VHSDFFQKL

SEQ ID NO: 96569 - protein, 9 aa, Homo Sapiens
VHSEQVFAL

SEQ ID NO: 96570 - protein, 9 aa, Homo Sapiens
VHSEYEPSW

SEQ ID NO: 96571 - protein, 9 aa, Homo Sapiens
VHSIFVLRL

SEQ ID NO: 96572 - protein, 9 aa, Homo Sapiens
VHSPYMQCL

SEQ ID NO: 96573 - protein, 9 aa, Homo Sapiens
VHSWLILQV

SEQ ID NO: 96574 - protein, 9 aa, Homo Sapiens
VHVDQELLI

SEQ ID NO: 96575 - protein, 9 aa, Homo Sapiens
VPCKVEPGL

SEQ ID NO: 96576 - protein, 9 aa, Homo Sapiens
VPDSTYEMI

SEQ ID NO: 96577 - protein, 9 aa, Homo Sapiens
VPDSVYQHL

SEQ ID NO: 96578 - protein, 9 aa, Homo Sapiens
WHAGKVWLI

SEQ ID NO: 96579 - protein, 9 aa, Homo Sapiens
WHDGKQVHL

SEQ ID NO: 96580 - protein, 9 aa, Homo Sapiens
WHDGVCPSV

SEQ ID NO: 96581 - protein, 9 aa, Homo Sapiens
WHDMEVYSF

SEQ ID NO: 96582 - protein, 9 aa, Homo Sapiens
WHDPYIQHF

SEQ ID NO: 96583 - protein, 9 aa, Homo Sapiens
WHDWMNNQF

SEQ ID NO: 96584 - protein, 9 aa, Homo Sapiens
WHEDITQDL

SEQ ID NO: 96585 - protein, 9 aa, Homo Sapiens
WHELAELYI

SEQ ID NO: 96586 - protein, 9 aa, Homo Sapiens
WHGDVAVKI

SEQ ID NO: 96587 - protein, 9 aa, Homo Sapiens
WHHDMVMDL

SEQ ID NO: 96588 - protein, 9 aa, Homo Sapiens
WHLDLVQLI

SEQ ID NO: 96589 - protein, 9 aa, Homo Sapiens
WHMTVEQKF

SEQ ID NO: 96590 - protein, 9 aa, Homo Sapiens
WHSDDEPSL

SEQ ID NO: 96591 - protein, 9 aa, Homo Sapiens
WHSDQCNMI

SEQ ID NO: 96592 - protein, 9 aa, Homo Sapiens
WHSFTQPRL

SEQ ID NO: 96593 - protein, 9 aa, Homo Sapiens
WHSPLDRFF

SEQ ID NO: 96594 - protein, 9 aa, Homo Sapiens
WHSYIDYEI

SEQ ID NO: 96595 - protein, 9 aa, Homo Sapiens
WQEGSVTRL

SEQ ID NO: 96596 - protein, 9 aa, Homo Sapiens
YHADIYDKV

SEQ ID NO: 96597 - protein, 9 aa, Homo Sapiens
YHAHFVSML

SEQ ID NO: 96598 - protein, 9 aa, Homo Sapiens
YHAIYLEEL

SEQ ID NO: 96599 - protein, 9 aa, Homo Sapiens
YHAKDPNNL

SEQ ID NO: 96600 - protein, 9 aa, Homo Sapiens
YHALCNEEF

SEQ ID NO: 96601 - protein, 9 aa, Homo Sapiens
YHALDSDHL

SEQ ID NO: 96602 - protein, 9 aa, Homo Sapiens
YHALPATVW

SEQ ID NO: 96603 - protein, 9 aa, Homo Sapiens
YHAQMPDSL

SEQ ID NO: 96604 - protein, 9 aa, Homo Sapiens
YHARVYEFL

SEQ ID NO: 96605 - protein, 9 aa, Homo Sapiens
YHASRKDML

SEQ ID NO: 96606 - protein, 9 aa, Homo Sapiens
YHATTETVI

SEQ ID NO: 96607 - protein, 9 aa, Homo Sapiens
YHCALILNL

SEQ ID NO: 96608 - protein, 9 aa, Homo Sapiens
YHDCVLLFL

SEQ ID NO: 96609 - protein, 9 aa, Homo Sapiens
YHDDKQPAF

SEQ ID NO: 96610 - protein, 9 aa, Homo Sapiens
YHDDTENSL

SEQ ID NO: 96611 - protein, 9 aa, Homo Sapiens
YHDEGWVAI

SEQ ID NO: 96612 - protein, 9 aa, Homo Sapiens
YHDFSVQNF

SEQ ID NO: 96613 - protein, 9 aa, Homo Sapiens
YHDGAATFL

SEQ ID NO: 96614 - protein, 9 aa, Homo Sapiens
YHDIAQQAF

SEQ ID NO: 96615 - protein, 9 aa, Homo Sapiens
YHDINVYSL

SEQ ID NO: 96616 - protein, 9 aa, Homo Sapiens
YHDIVVTFL

SEQ ID NO: 96617 - protein, 9 aa, Homo Sapiens
YHDKNIVLL

SEQ ID NO: 96618 - protein, 9 aa, Homo Sapiens
YHDLECQLI

SEQ ID NO: 96619 - protein, 9 aa, Homo Sapiens
YHDLSQASL

SEQ ID NO: 96620 - protein, 9 aa, Homo Sapiens
YHDRTNLKV

SEQ ID NO: 96621 - protein, 9 aa, Homo Sapiens
YHDTSPYRW

SEQ ID NO: 96622 - protein, 9 aa, Homo Sapiens
YHDYGHLEL

SEQ ID NO: 96623 - protein, 9 aa, Homo Sapiens
YHEDIHTYL

SEQ ID NO: 96624 - protein, 9 aa, Homo Sapiens
YHEEKERLM

SEQ ID NO: 96625 - protein, 9 aa, Homo Sapiens
YHEFLGQQI

SEQ ID NO: 96626 - protein, 9 aa, Homo Sapiens
YHEGKSFQL

SEQ ID NO: 96627 - protein, 9 aa, Homo Sapiens
YHEGLSDHI

SEQ ID NO: 96628 - protein, 9 aa, Homo Sapiens
YHEGSAPAL

SEQ ID NO: 96629 - protein, 9 aa, Homo Sapiens
YHEHQANLL

SEQ ID NO: 96630 - protein, 9 aa, Homo Sapiens
YHEKGRAFL

SEQ ID NO: 96631 - protein, 9 aa, Homo Sapiens
YHESGHAII

SEQ ID NO: 96632 - protein, 9 aa, Homo Sapiens
YHFEEVQKL

SEQ ID NO: 96633 - protein, 9 aa, Homo Sapiens
YHFMPEHRL

SEQ ID NO: 96634 - protein, 9 aa, Homo Sapiens
YHFPDQQEL

SEQ ID NO: 96635 - protein, 9 aa, Homo Sapiens
YHFPELVKI

SEQ ID NO: 96636 - protein, 9 aa, Homo Sapiens
YHGATPLHL

SEQ ID NO: 96637 - protein, 9 aa, Homo Sapiens
YHGDAGDSL

SEQ ID NO: 96638 - protein, 9 aa, Homo Sapiens
YHGDLNETF

SEQ ID NO: 96639 - protein, 9 aa, Homo Sapiens
YHGDLTEKL

SEQ ID NO: 96640 - protein, 9 aa, Homo Sapiens
YHGDSDLQL

SEQ ID NO: 96641 - protein, 9 aa, Homo Sapiens
YHGDTPLHI

SEQ ID NO: 96642 - protein, 9 aa, Homo Sapiens
YHGGDDALL

SEQ ID NO: 96643 - protein, 9 aa, Homo Sapiens
YHGIPMVGI

SEQ ID NO: 96644 - protein, 9 aa, Homo Sapiens
YHGLTVPLI

SEQ ID NO: 96645 - protein, 9 aa, Homo Sapiens
YHHALHSRW

SEQ ID NO: 96646 - protein, 9 aa, Homo Sapiens
YHHCVINKL

SEQ ID NO: 96647 - protein, 9 aa, Homo Sapiens
YHHGWFVMI

SEQ ID NO: 96648 - protein, 9 aa, Homo Sapiens
YHHRFPQAL

SEQ ID NO: 96649 - protein, 9 aa, Homo Sapiens
YHHTFFEML

SEQ ID NO: 96650 - protein, 9 aa, Homo Sapiens
YHHYMQDRI

SEQ ID NO: 96651 - protein, 9 aa, Homo Sapiens
YHIAKDFDI

SEQ ID NO: 96652 - protein, 9 aa, Homo Sapiens
YHIAVDEKL

SEQ ID NO: 96653 - protein, 9 aa, Homo Sapiens
YHIDLDPHF

SEQ ID NO: 96654 - protein, 9 aa, Homo Sapiens
YHIHLVELL

SEQ ID NO: 96655 - protein, 9 aa, Homo Sapiens
YHIIKPDVI

SEQ ID NO: 96656 - protein, 9 aa, Homo Sapiens
YHILNDPEL

SEQ ID NO: 96657 - protein, 9 aa, Homo Sapiens
YHIQQNEAL

SEQ ID NO: 96658 - protein, 9 aa, Homo Sapiens
YHISLEHEI

SEQ ID NO: 96659 - protein, 9 aa, Homo Sapiens
YHISLVDLL

SEQ ID NO: 96660 - protein, 9 aa, Homo Sapiens
YHISMDDRF

SEQ ID NO: 96661 - protein, 9 aa, Homo Sapiens
YHISVQNMM

SEQ ID NO: 96662 - protein, 9 aa, Homo Sapiens
YHITDIPII

SEQ ID NO: 96663 - protein, 9 aa, Homo Sapiens
YHITDQVHL

SEQ ID NO: 96664 - protein, 9 aa, Homo Sapiens
YHITDVPCI

SEQ ID NO: 96665 - protein, 9 aa, Homo Sapiens
YHIVQKFLI

SEQ ID NO: 96666 - protein, 9 aa, Homo Sapiens
YHLLAEEKL

SEQ ID NO: 96667 - protein, 9 aa, Homo Sapiens
YHLLLKELL

SEQ ID NO: 96668 - protein, 9 aa, Homo Sapiens
YHLQLFEEL

SEQ ID NO: 96669 - protein, 9 aa, Homo Sapiens
YHNLHPDYI

SEQ ID NO: 96670 - protein, 9 aa, Homo Sapiens
YHNQSQGLL

SEQ ID NO: 96671 - protein, 9 aa, Homo Sapiens
YHQDAFMQL

SEQ ID NO: 96672 - protein, 9 aa, Homo Sapiens
YHQDKEAAI

SEQ ID NO: 96673 - protein, 9 aa, Homo Sapiens
YHQEEIDVW

SEQ ID NO: 96674 - protein, 9 aa, Homo Sapiens
YHQGPEWLW

SEQ ID NO: 96675 - protein, 9 aa, Homo Sapiens
YHQHFAAHL

SEQ ID NO: 96676 - protein, 9 aa, Homo Sapiens
YHQHFDPVI

SEQ ID NO: 96677 - protein, 9 aa, Homo Sapiens
YHQHLQEQL

SEQ ID NO: 96678 - protein, 9 aa, Homo Sapiens
YHQKSVLIM

SEQ ID NO: 96679 - protein, 9 aa, Homo Sapiens
YHQPDLPEI

SEQ ID NO: 96680 - protein, 9 aa, Homo Sapiens
YHQSEALAL

SEQ ID NO: 96681 - protein, 9 aa, Homo Sapiens
YHSDDYIKF

SEQ ID NO: 96682 - protein, 9 aa, Homo Sapiens
YHSDEYIKF

SEQ ID NO: 96683 - protein, 9 aa, Homo Sapiens
YHSDIVQSL

SEQ ID NO: 96684 - protein, 9 aa, Homo Sapiens
YHSEVPVSL

SEQ ID NO: 96685 - protein, 9 aa, Homo Sapiens
YHSEYFLAL

SEQ ID NO: 96686 - protein, 9 aa, Homo Sapiens
YHSFSEQSF

SEQ ID NO: 96687 - protein, 9 aa, Homo Sapiens
YHSFVSSVF

SEQ ID NO: 96688 - protein, 9 aa, Homo Sapiens
YHSGYVHKF

SEQ ID NO: 96689 - protein, 9 aa, Homo Sapiens
YHSIEEDKW

SEQ ID NO: 96690 - protein, 9 aa, Homo Sapiens
YHSNQTLAL

SEQ ID NO: 96691 - protein, 9 aa, Homo Sapiens
YHSNQVVRM

SEQ ID NO: 96692 - protein, 9 aa, Homo Sapiens
YHSNSGAQL

SEQ ID NO: 96693 - protein, 9 aa, Homo Sapiens
YHSPADRVM

SEQ ID NO: 96694 - protein, 9 aa, Homo Sapiens
YHSQDRYEF

SEQ ID NO: 96695 - protein, 9 aa, Homo Sapiens
YHSSGGLEL

SEQ ID NO: 96696 - protein, 9 aa, Homo Sapiens
YHSTPDRLF

SEQ ID NO: 96697 - protein, 9 aa, Homo Sapiens
YHTDCNVLL

SEQ ID NO: 96698 - protein, 9 aa, Homo Sapiens
YHTDTTVKF

SEQ ID NO: 96699 - protein, 9 aa, Homo Sapiens
YHTLQILFF

SEQ ID NO: 96700 - protein, 9 aa, Homo Sapiens
YHTPNVVFI

SEQ ID NO: 96701 - protein, 9 aa, Homo Sapiens
YHTQDFLEW

SEQ ID NO: 96702 - protein, 9 aa, Homo Sapiens
YHTQTTPLI

SEQ ID NO: 96703 - protein, 9 aa, Homo Sapiens
YHTVAGNDI

SEQ ID NO: 96704 - protein, 9 aa, Homo Sapiens
YHVAEKETL

SEQ ID NO: 96705 - protein, 9 aa, Homo Sapiens
YHVDSLLQL

SEQ ID NO: 96706 - protein, 9 aa, Homo Sapiens
YHVHCIDRW

SEQ ID NO: 96707 - protein, 9 aa, Homo Sapiens
YHVLDMIEL

SEQ ID NO: 96708 - protein, 9 aa, Homo Sapiens
YHWADGTNI

SEQ ID NO: 96709 - protein, 9 aa, Homo Sapiens
YHWLEKEVI

SEQ ID NO: 96710 - protein, 9 aa, Homo Sapiens
YHYDPEQVI

SEQ ID NO: 96711 - protein, 9 aa, Homo Sapiens
YHYGFCDVI

SEQ ID NO: 96712 - protein, 9 aa, Homo Sapiens
YHYLEAQEW

SEQ ID NO: 96713 - protein, 9 aa, Homo Sapiens
YHYLLDPKI

SEQ ID NO: 96714 - protein, 9 aa, Homo Sapiens
YKADEDPAL

SEQ ID NO: 96715 - protein, 9 aa, Homo Sapiens
YKDEKEQLI

SEQ ID NO: 96716 - protein, 9 aa, Homo Sapiens
YKDKYSHLI

SEQ ID NO: 96717 - protein, 9 aa, Homo Sapiens
YKTAKGDEL

SEQ ID NO: 96718 - protein, 9 aa, Homo Sapiens
YPDEIEYIF

SEQ ID NO: 96719 - protein, 9 aa, Homo Sapiens
YPVDLGDKF

SEQ ID NO: 96720 - protein, 9 aa, Homo Sapiens
YPVEIHEYL

SEQ ID NO: 96721 - protein, 9 aa, Homo Sapiens
YQDECDRRL

SEQ ID NO: 96722 - protein, 9 aa, Homo Sapiens
YQHKEEYQL

SEQ ID NO: 96723 - protein, 9 aa, Homo Sapiens
YQIKEGDTI

SEQ ID NO: 96724 - protein, 9 aa, Homo Sapiens
YQSPTGDRI

SEQ ID NO: 96725 - protein, 9 aa, Homo Sapiens
YQTEIGQTL

SEQ ID NO: 96726 - protein, 9 aa, Homo Sapiens
YRDESSSEL

SEQ ID NO: 96727 - protein, 9 aa, Homo Sapiens
YRDIGEEML

SEQ ID NO: 96728 - protein, 9 aa, Homo Sapiens
YRYGREEML

SEQ ID NO: 96729 - protein, 10 aa, Homo Sapiens
AFSQNSALIL

SEQ ID NO: 96730 - protein, 10 aa, Homo Sapiens
AHAASDTVGW

SEQ ID NO: 96731 - protein, 10 aa, Homo Sapiens
AHCDFVHQAL

SEQ ID NO: 96732 - protein, 10 aa, Homo Sapiens
AHDGQRIYIL

SEQ ID NO: 96733 - protein, 10 aa, Homo Sapiens
AHDHFLSNLL

SEQ ID NO: 96734 - protein, 10 aa, Homo Sapiens
AHDPDPGPGV

SEQ ID NO: 96735 - protein, 10 aa, Homo Sapiens
AHDPQTTQEL

SEQ ID NO: 96736 - protein, 10 aa, Homo Sapiens
AHDRAENTQF

SEQ ID NO: 96737 - protein, 10 aa, Homo Sapiens
AHFGIHEEML

SEQ ID NO: 96738 - protein, 10 aa, Homo Sapiens
AHIDSGKTTL

SEQ ID NO: 96739 - protein, 10 aa, Homo Sapiens
AHIEKDFIAF

SEQ ID NO: 96740 - protein, 10 aa, Homo Sapiens
AHIFCTTDQL

SEQ ID NO: 96741 - protein, 10 aa, Homo Sapiens
AHIKEEHCIF

SEQ ID NO: 96742 - protein, 10 aa, Homo Sapiens
AHIQQLYDLL

SEQ ID NO: 96743 - protein, 10 aa, Homo Sapiens
AHLAGVKDQL

SEQ ID NO: 96744 - protein, 10 aa, Homo Sapiens
AHLQLLGESL

SEQ ID NO: 96745 - protein, 10 aa, Homo Sapiens
AHLRPEGQNL

SEQ ID NO: 96746 - protein, 10 aa, Homo Sapiens
AHLSIINEYL

SEQ ID NO: 96747 - protein, 10 aa, Homo Sapiens
AHMEFCYQEL

SEQ ID NO: 96748 - protein, 10 aa, Homo Sapiens
AHMQALAEEW

SEQ ID NO: 96749 - protein, 10 aa, Homo Sapiens
AHSRAALDRL

SEQ ID NO: 96750 - protein, 10 aa, Homo Sapiens
AHVDLTGDGL

SEQ ID NO: 96751 - protein, 10 aa, Homo Sapiens
AHVQELYQEW

SEQ ID NO: 96752 - protein, 10 aa, Homo Sapiens
AHYDPATEEF

SEQ ID NO: 96753 - protein, 10 aa, Homo Sapiens
ASHLSPGSII

SEQ ID NO: 96754 - protein, 10 aa, Homo Sapiens
CHDRNVVTIF

SEQ ID NO: 96755 - protein, 10 aa, Homo Sapiens
CHLFLPDEQF

SEQ ID NO: 96756 - protein, 10 aa, Homo Sapiens
DHAPAIGRYI

SEQ ID NO: 96757 - protein, 10 aa, Homo Sapiens
DHAWIKVEQL

SEQ ID NO: 96758 - protein, 10 aa, Homo Sapiens
DHDPVDKIVL

SEQ ID NO: 96759 - protein, 10 aa, Homo Sapiens
DHDSVDKIVI

SEQ ID NO: 96760 - protein, 10 aa, Homo Sapiens
DHESVCKYYL

SEQ ID NO: 96761 - protein, 10 aa, Homo Sapiens
DHIAHIIELL

SEQ ID NO: 96762 - protein, 10 aa, Homo Sapiens
DHIKDSFHSL

SEQ ID NO: 96763 - protein, 10 aa, Homo Sapiens
DHSFLTNDEL

SEQ ID NO: 96764 - protein, 10 aa, Homo Sapiens
DHSLIPEERL

SEQ ID NO: 96765 - protein, 10 aa, Homo Sapiens
DHSLPESDKI

SEQ ID NO: 96766 - protein, 10 aa, Homo Sapiens
DHSQAFLQAI

SEQ ID NO: 96767 - protein, 10 aa, Homo Sapiens
DHSSTVLQRL

SEQ ID NO: 96768 - protein, 10 aa, Homo Sapiens
DHTSSRLNLL

SEQ ID NO: 96769 - protein, 10 aa, Homo Sapiens
DHVEVNGEVF

SEQ ID NO: 96770 - protein, 10 aa, Homo Sapiens
DHYYGTGETF

SEQ ID NO: 96771 - protein, 10 aa, Homo Sapiens
DRFFSEYEKL

SEQ ID NO: 96772 - protein, 10 aa, Homo Sapiens
DRIKDEFQLL

SEQ ID NO: 96773 - protein, 10 aa, Homo Sapiens
EHAAPYFQQL

SEQ ID NO: 96774 - protein, 10 aa, Homo Sapiens
EHAGPQLTCI

SEQ ID NO: 96775 - protein, 10 aa, Homo Sapiens
EHAGSYFDEI

SEQ ID NO: 96776 - protein, 10 aa, Homo Sapiens
EHANLTEVTF

SEQ ID NO: 96777 - protein, 10 aa, Homo Sapiens
EHAPISYEDF

SEQ ID NO: 96778 - protein, 10 aa, Homo Sapiens
EHAQKELQKL

SEQ ID NO: 96779 - protein, 10 aa, Homo Sapiens
EHAREMCLRF

SEQ ID NO: 96780 - protein, 10 aa, Homo Sapiens
EHCSINLMYL

SEQ ID NO: 96781 - protein, 10 aa, Homo Sapiens
EHDDTLPSQL

SEQ ID NO: 96782 - protein, 10 aa, Homo Sapiens
EHDEGMLEYL

SEQ ID NO: 96783 - protein, 10 aa, Homo Sapiens
EHDGSLFQAV

SEQ ID NO: 96784 - protein, 10 aa, Homo Sapiens
EHDPHVLLAV

SEQ ID NO: 96785 - protein, 10 aa, Homo Sapiens
EHDPQYAVIL

SEQ ID NO: 96786 - protein, 10 aa, Homo Sapiens
EHDQTMLDKL

SEQ ID NO: 96787 - protein, 10 aa, Homo Sapiens
EHDWPVHNNF

SEQ ID NO: 96788 - protein, 10 aa, Homo Sapiens
EHEGPALYYM

SEQ ID NO: 96789 - protein, 10 aa, Homo Sapiens
EHFDDTVVCL

SEQ ID NO: 96790 - protein, 10 aa, Homo Sapiens
EHFNGVAELL

SEQ ID NO: 96791 - protein, 10 aa, Homo Sapiens
EHIEALLDKF

SEQ ID NO: 96792 - protein, 10 aa, Homo Sapiens
EHINEINAEL

SEQ ID NO: 96793 - protein, 10 aa, Homo Sapiens
EHIRVGWEQL

SEQ ID NO: 96794 - protein, 10 aa, Homo Sapiens
EHISFTTSKI

SEQ ID NO: 96795 - protein, 10 aa, Homo Sapiens
EHIVGQLDVL

SEQ ID NO: 96796 - protein, 10 aa, Homo Sapiens
EHMPVGPDAI

SEQ ID NO: 96797 - protein, 10 aa, Homo Sapiens
EHQPTTWVSF

SEQ ID NO: 96798 - protein, 10 aa, Homo Sapiens
EHSESTLNVM

SEQ ID NO: 96799 - protein, 10 aa, Homo Sapiens
EHSPFHEHVL

SEQ ID NO: 96800 - protein, 10 aa, Homo Sapiens
EHSPLSEDRF

SEQ ID NO: 96801 - protein, 10 aa, Homo Sapiens
EHSSDSEYTL

SEQ ID NO: 96802 - protein, 10 aa, Homo Sapiens
EHSSRVVQEL

SEQ ID NO: 96803 - protein, 10 aa, Homo Sapiens
EHTDPHVQQI

SEQ ID NO: 96804 - protein, 10 aa, Homo Sapiens
EHVEAIKIGL

SEQ ID NO: 96805 - protein, 10 aa, Homo Sapiens
EHVREMQEKL

SEQ ID NO: 96806 - protein, 10 aa, Homo Sapiens
EHVSRIPDYL

SEQ ID NO: 96807 - protein, 10 aa, Homo Sapiens
EKSPCQTDVL

SEQ ID NO: 96808 - protein, 10 aa, Homo Sapiens
ERFFSDKETF

SEQ ID NO: 96809 - protein, 10 aa, Homo Sapiens
FHADSDDESF

SEQ ID NO: 96810 - protein, 10 aa, Homo Sapiens
FHAGQIEDEL

SEQ ID NO: 96811 - protein, 10 aa, Homo Sapiens
FHAQLQLEQL

SEQ ID NO: 96812 - protein, 10 aa, Homo Sapiens
FHARNIHQTF

SEQ ID NO: 96813 - protein, 10 aa, Homo Sapiens
FHARPGLSTL

SEQ ID NO: 96814 - protein, 10 aa, Homo Sapiens
FHCDLNSDQF

SEQ ID NO: 96815 - protein, 10 aa, Homo Sapiens
FHCGGGLTDW

SEQ ID NO: 96816 - protein, 10 aa, Homo Sapiens
FHCGVINPSW

SEQ ID NO: 96817 - protein, 10 aa, Homo Sapiens
FHDDSDEDLL

SEQ ID NO: 96818 - protein, 10 aa, Homo Sapiens
FHDDSMKSFF

SEQ ID NO: 96819 - protein, 10 aa, Homo Sapiens
FHDESTQVQL

SEQ ID NO: 96820 - protein, 10 aa, Homo Sapiens
FHDEVGKFRF

SEQ ID NO: 96821 - protein, 10 aa, Homo Sapiens
FHDKGKFEKI

SEQ ID NO: 96822 - protein, 10 aa, Homo Sapiens
FHDKYGNAVL

SEQ ID NO: 96823 - protein, 10 aa, Homo Sapiens
FHDMGGVQLI

SEQ ID NO: 96824 - protein, 10 aa, Homo Sapiens
FHDPELSNHL

SEQ ID NO: 96825 - protein, 10 aa, Homo Sapiens
FHDSSDHHTF

SEQ ID NO: 96826 - protein, 10 aa, Homo Sapiens
FHDTSSPLLI

SEQ ID NO: 96827 - protein, 10 aa, Homo Sapiens
FHEEAGIFKL

SEQ ID NO: 96828 - protein, 10 aa, Homo Sapiens
FHEPGSSSVW

SEQ ID NO: 96829 - protein, 10 aa, Homo Sapiens
FHEPSAFNDF

SEQ ID NO: 96830 - protein, 10 aa, Homo Sapiens
FHETSNINDF

SEQ ID NO: 96831 - protein, 10 aa, Homo Sapiens
FHEVGIGSVL

SEQ ID NO: 96832 - protein, 10 aa, Homo Sapiens
FHEWLAGVGL

SEQ ID NO: 96833 - protein, 10 aa, Homo Sapiens
FHFNDSTVTL

SEQ ID NO: 96834 - protein, 10 aa, Homo Sapiens
FHFTSSTEVF

SEQ ID NO: 96835 - protein, 10 aa, Homo Sapiens
FHGDSEIDQL

SEQ ID NO: 96836 - protein, 10 aa, Homo Sapiens
FHGNIIKVSF

SEQ ID NO: 96837 - protein, 10 aa, Homo Sapiens
FHGNSEVNAI

SEQ ID NO: 96838 - protein, 10 aa, Homo Sapiens
FHGPPEPVLL

SEQ ID NO: 96839 - protein, 10 aa, Homo Sapiens
FHGVSNLQEF

SEQ ID NO: 96840 - protein, 10 aa, Homo Sapiens
FHHEEGASAW

SEQ ID NO: 96841 - protein, 10 aa, Homo Sapiens
FHIAGDNNPL

SEQ ID NO: 96842 - protein, 10 aa, Homo Sapiens
FHIQAQKLGL

SEQ ID NO: 96843 - protein, 10 aa, Homo Sapiens
FHIWSKKEKF

SEQ ID NO: 96844 - protein, 10 aa, Homo Sapiens
FHLDGSRESF

SEQ ID NO: 96845 - protein, 10 aa, Homo Sapiens
FHLGKIEELL

SEQ ID NO: 96846 - protein, 10 aa, Homo Sapiens
FHQDSRAHLL

SEQ ID NO: 96847 - protein, 10 aa, Homo Sapiens
FHQEQGHQLL

SEQ ID NO: 96848 - protein, 10 aa, Homo Sapiens
FHSAVVGTGL

SEQ ID NO: 96849 - protein, 10 aa, Homo Sapiens
FHSDSSHNEW

SEQ ID NO: 96850 - protein, 10 aa, Homo Sapiens
FHSEDYIDFL

SEQ ID NO: 96851 - protein, 10 aa, Homo Sapiens
FHSEEQQLLL

SEQ ID NO: 96852 - protein, 10 aa, Homo Sapiens
FHSEIEDFLL

SEQ ID NO: 96853 - protein, 10 aa, Homo Sapiens
FHSESGLFLF

SEQ ID NO: 96854 - protein, 10 aa, Homo Sapiens
FHSGDDSQVL

SEQ ID NO: 96855 - protein, 10 aa, Homo Sapiens
FHSNDGGNVL

SEQ ID NO: 96856 - protein, 10 aa, Homo Sapiens
FHSNDVATLL

SEQ ID NO: 96857 - protein, 10 aa, Homo Sapiens
FHSSVNLDEF

SEQ ID NO: 96858 - protein, 10 aa, Homo Sapiens
FHSVAEEELL

SEQ ID NO: 96859 - protein, 10 aa, Homo Sapiens
FHTEALTALL

SEQ ID NO: 96860 - protein, 10 aa, Homo Sapiens
FHVEPGLQRL

SEQ ID NO: 96861 - protein, 10 aa, Homo Sapiens
FHVGAFGELW

SEQ ID NO: 96862 - protein, 10 aa, Homo Sapiens
FHVGAHVNTF

SEQ ID NO: 96863 - protein, 10 aa, Homo Sapiens
FHVIDDFVQF

SEQ ID NO: 96864 - protein, 10 aa, Homo Sapiens
FHYNGTDVSF

SEQ ID NO: 96865 - protein, 10 aa, Homo Sapiens
FLYTGEGDTV

SEQ ID NO: 96866 - protein, 10 aa, Homo Sapiens
FVDCPGHDIL

SEQ ID NO: 96867 - protein, 10 aa, Homo Sapiens
GHDEYSTQSL

SEQ ID NO: 96868 - protein, 10 aa, Homo Sapiens
GHDPHLLYTL

SEQ ID NO: 96869 - protein, 10 aa, Homo Sapiens
GHDPKEPEQL

SEQ ID NO: 96870 - protein, 10 aa, Homo Sapiens
GHDPNLSLLL

SEQ ID NO: 96871 - protein, 10 aa, Homo Sapiens
GHDPRAQGTL

SEQ ID NO: 96872 - protein, 10 aa, Homo Sapiens
GHGPAETQTL

SEQ ID NO: 96873 - protein, 10 aa, Homo Sapiens
GHIFTVNDQF

SEQ ID NO: 96874 - protein, 10 aa, Homo Sapiens
GHLSVNGEAL

SEQ ID NO: 96875 - protein, 10 aa, Homo Sapiens
GHMDSRLDEL

SEQ ID NO: 96876 - protein, 10 aa, Homo Sapiens
GHTHFGNDNF

SEQ ID NO: 96877 - protein, 10 aa, Homo Sapiens
GHVEDDYILF

SEQ ID NO: 96878 - protein, 10 aa, Homo Sapiens
GHVHIVEELL

SEQ ID NO: 96879 - protein, 10 aa, Homo Sapiens
GHVYCKTDRL

SEQ ID NO: 96880 - protein, 10 aa, Homo Sapiens
HDADRIHNEL

SEQ ID NO: 96881 - protein, 10 aa, Homo Sapiens
HDGLTVHLVI

SEQ ID NO: 96882 - protein, 10 aa, Homo Sapiens
HDPSSIYLRI

SEQ ID NO: 96883 - protein, 10 aa, Homo Sapiens
HDVYKFTNLL

SEQ ID NO: 96884 - protein, 10 aa, Homo Sapiens
HEESELANKL

SEQ ID NO: 96885 - protein, 10 aa, Homo Sapiens
HELTALANQI

SEQ ID NO: 96886 - protein, 10 aa, Homo Sapiens
HFGSVVAQTI

SEQ ID NO: 96887 - protein, 10 aa, Homo Sapiens
HHADDSFLVL

SEQ ID NO: 96888 - protein, 10 aa, Homo Sapiens
HHAEPLAAVL

SEQ ID NO: 96889 - protein, 10 aa, Homo Sapiens
HHAEYLTELL

SEQ ID NO: 96890 - protein, 10 aa, Homo Sapiens
HHAQDYGGLL

SEQ ID NO: 96891 - protein, 10 aa, Homo Sapiens
HHATHLSNTL

SEQ ID NO: 96892 - protein, 10 aa, Homo Sapiens
HHCEHLLERL

SEQ ID NO: 96893 - protein, 10 aa, Homo Sapiens
HHCNSFLEEL

SEQ ID NO: 96894 - protein, 10 aa, Homo Sapiens
HHCPDVPILL

SEQ ID NO: 96895 - protein, 10 aa, Homo Sapiens
HHCPHTPILL

SEQ ID NO: 96896 - protein, 10 aa, Homo Sapiens
HHCPNTPIIL

SEQ ID NO: 96897 - protein, 10 aa, Homo Sapiens
HHCPSTPIIL

SEQ ID NO: 96898 - protein, 10 aa, Homo Sapiens
HHCVGEKYRW

SEQ ID NO: 96899 - protein, 10 aa, Homo Sapiens
HHCYEGTVSF

SEQ ID NO: 96900 - protein, 10 aa, Homo Sapiens
HHDFHHMNFI

SEQ ID NO: 96901 - protein, 10 aa, Homo Sapiens
HHDHHDEFCL

SEQ ID NO: 96902 - protein, 10 aa, Homo Sapiens
HHDMVMDLAF

SEQ ID NO: 96903 - protein, 10 aa, Homo Sapiens
HHDNTYTVKY

SEQ ID NO: 96904 - protein, 10 aa, Homo Sapiens
HHDSHSSVIL

SEQ ID NO: 96905 - protein, 10 aa, Homo Sapiens
HHDSPALEVF

SEQ ID NO: 96906 - protein, 10 aa, Homo Sapiens
HHDYIDSPSL

SEQ ID NO: 96907 - protein, 10 aa, Homo Sapiens
HHDYSTYTFL

SEQ ID NO: 96908 - protein, 10 aa, Homo Sapiens
HHEAITCLEW

SEQ ID NO: 96909 - protein, 10 aa, Homo Sapiens
HHEFQAPFGM

SEQ ID NO: 96910 - protein, 10 aa, Homo Sapiens
HHEGYVHADL

SEQ ID NO: 96911 - protein, 10 aa, Homo Sapiens
HHEHGSQPEL

SEQ ID NO: 96912 - protein, 10 aa, Homo Sapiens
HHELHAAHLL

SEQ ID NO: 96913 - protein, 10 aa, Homo Sapiens
HHELVYEAII

SEQ ID NO: 96914 - protein, 10 aa, Homo Sapiens
HHEPGVADRL

SEQ ID NO: 96915 - protein, 10 aa, Homo Sapiens
HHFKGIIEAF

SEQ ID NO: 96916 - protein, 10 aa, Homo Sapiens
HHFLIGNNFL

SEQ ID NO: 96917 - protein, 10 aa, Homo Sapiens
HHGEEEVETF

SEQ ID NO: 96918 - protein, 10 aa, Homo Sapiens
HHGPPGPTFF

SEQ ID NO: 96919 - protein, 10 aa, Homo Sapiens
HHGTAQLQAL

SEQ ID NO: 96920 - protein, 10 aa, Homo Sapiens
HHHHAVGLNL

SEQ ID NO: 96921 - protein, 10 aa, Homo Sapiens
HHHIASVEKL

SEQ ID NO: 96922 - protein, 10 aa, Homo Sapiens
HHHQGIYEHI

SEQ ID NO: 96923 - protein, 10 aa, Homo Sapiens
HHHYEGAVVI

SEQ ID NO: 96924 - protein, 10 aa, Homo Sapiens
HHIDPALPYI

SEQ ID NO: 96925 - protein, 10 aa, Homo Sapiens
HHIDSANALY

SEQ ID NO: 96926 - protein, 10 aa, Homo Sapiens
HHIEAQQRLL

SEQ ID NO: 96927 - protein, 10 aa, Homo Sapiens
HHIEQLNDKL

SEQ ID NO: 96928 - protein, 10 aa, Homo Sapiens
HHIHTGNKPF

SEQ ID NO: 96929 - protein, 10 aa, Homo Sapiens
HHINDTDTIL

SEQ ID NO: 96930 - protein, 10 aa, Homo Sapiens
HHIPDVITYL

SEQ ID NO: 96931 - protein, 10 aa, Homo Sapiens
HHIQEIMVQL

SEQ ID NO: 96932 - protein, 10 aa, Homo Sapiens
HHISSKYDEL

SEQ ID NO: 96933 - protein, 10 aa, Homo Sapiens
HHIYDKTSVL

SEQ ID NO: 96934 - protein, 10 aa, Homo Sapiens
HHLDALDQLL

SEQ ID NO: 96935 - protein, 10 aa, Homo Sapiens
HHLEPNMDLI

SEQ ID NO: 96936 - protein, 10 aa, Homo Sapiens
HHLIPVKENL

SEQ ID NO: 96937 - protein, 10 aa, Homo Sapiens
HHLLLEVEVI

SEQ ID NO: 96938 - protein, 10 aa, Homo Sapiens
HHLLVTNELL

SEQ ID NO: 96939 - protein, 10 aa, Homo Sapiens
HHLTPDNQLL

SEQ ID NO: 96940 - protein, 10 aa, Homo Sapiens
HHSPGQTPTL

SEQ ID NO: 96941 - protein, 10 aa, Homo Sapiens
HHTKPDKYQL

SEQ ID NO: 96942 - protein, 10 aa, Homo Sapiens
HHTNPVGTEW

SEQ ID NO: 96943 - protein, 10 aa, Homo Sapiens
HHVDSLHQLF

SEQ ID NO: 96944 - protein, 10 aa, Homo Sapiens
HHVGQDGQVL

SEQ ID NO: 96945 - protein, 10 aa, Homo Sapiens
HHVKIYIDRF

SEQ ID NO: 96946 - protein, 10 aa, Homo Sapiens
HHVNATLDLI

SEQ ID NO: 96947 - protein, 10 aa, Homo Sapiens
HHVRTKLDEL

SEQ ID NO: 96948 - protein, 10 aa, Homo Sapiens
HHVSPHETYF

SEQ ID NO: 96949 - protein, 10 aa, Homo Sapiens
HHVYSGKDLI

SEQ ID NO: 96950 - protein, 10 aa, Homo Sapiens
HHYEGAVVIL

SEQ ID NO: 96951 - protein, 10 aa, Homo Sapiens
HHYFSKADHF

SEQ ID NO: 96952 - protein, 10 aa, Homo Sapiens
HHYNSHYEKF

SEQ ID NO: 96953 - protein, 10 aa, Homo Sapiens
HHYPGPGNHF

SEQ ID NO: 96954 - protein, 10 aa, Homo Sapiens
HHYSGNNIEL

SEQ ID NO: 96955 - protein, 10 aa, Homo Sapiens
HLENAGCNKI

SEQ ID NO: 96956 - protein, 10 aa, Homo Sapiens
HPISDHEATL

SEQ ID NO: 96957 - protein, 10 aa, Homo Sapiens
HQDPGQPLYI

SEQ ID NO: 96958 - protein, 10 aa, Homo Sapiens
HQHEPFLDFL

SEQ ID NO: 96959 - protein, 10 aa, Homo Sapiens
HQNDDAEVSL

SEQ ID NO: 96960 - protein, 10 aa, Homo Sapiens
HRDIESGYRI

SEQ ID NO: 96961 - protein, 10 aa, Homo Sapiens
HRDTGILDSI

SEQ ID NO: 96962 - protein, 10 aa, Homo Sapiens
HRYGDGGSTF

SEQ ID NO: 96963 - protein, 10 aa, Homo Sapiens
HSTGVASNTI

SEQ ID NO: 96964 - protein, 10 aa, Homo Sapiens
IHAFVQDTTL

SEQ ID NO: 96965 - protein, 10 aa, Homo Sapiens
IHAGIIADEL

SEQ ID NO: 96966 - protein, 10 aa, Homo Sapiens
IHDADSEARI

SEQ ID NO: 96967 - protein, 10 aa, Homo Sapiens
IHDENGNNLL

SEQ ID NO: 96968 - protein, 10 aa, Homo Sapiens
IHDGAAGVHF

SEQ ID NO: 96969 - protein, 10 aa, Homo Sapiens
IHDGTVTHTF

SEQ ID NO: 96970 - protein, 10 aa, Homo Sapiens
IHDNEVIVGI

SEQ ID NO: 96971 - protein, 10 aa, Homo Sapiens
IHDPGRGAPL

SEQ ID NO: 96972 - protein, 10 aa, Homo Sapiens
IHDPYSEFMV

SEQ ID NO: 96973 - protein, 10 aa, Homo Sapiens
IHEGENSYKF

SEQ ID NO: 96974 - protein, 10 aa, Homo Sapiens
IHGDTVQNQL

SEQ ID NO: 96975 - protein, 10 aa, Homo Sapiens
IHGGAHLNNF

SEQ ID NO: 96976 - protein, 10 aa, Homo Sapiens
IHINIGALEL

SEQ ID NO: 96977 - protein, 10 aa, Homo Sapiens
IHIRDKLAAI

SEQ ID NO: 96978 - protein, 10 aa, Homo Sapiens
IHQENMGQAL

SEQ ID NO: 96979 - protein, 10 aa, Homo Sapiens
IHSLPGCQDI

SEQ ID NO: 96980 - protein, 10 aa, Homo Sapiens
IHVEVVHDNL

SEQ ID NO: 96981 - protein, 10 aa, Homo Sapiens
IHVGQAGVQI

SEQ ID NO: 96982 - protein, 10 aa, Homo Sapiens
IHVRHVRDLL

SEQ ID NO: 96983 - protein, 10 aa, Homo Sapiens
ILDNDGDRLF

SEQ ID NO: 96984 - protein, 10 aa, Homo Sapiens
IQAGQCGNQI

SEQ ID NO: 96985 - protein, 10 aa, Homo Sapiens
KHDPTSANLL

SEQ ID NO: 96986 - protein, 10 aa, Homo Sapiens
KHVKALTNLI

SEQ ID NO: 96987 - protein, 10 aa, Homo Sapiens
KHYVGHGNAI

SEQ ID NO: 96988 - protein, 10 aa, Homo Sapiens
KLIDDQDISI

SEQ ID NO: 96989 - protein, 10 aa, Homo Sapiens
KPMEGNFEEI

SEQ ID NO: 96990 - protein, 10 aa, Homo Sapiens
LHDATRDLVL

SEQ ID NO: 96991 - protein, 10 aa, Homo Sapiens
LHDQNPDAAL

SEQ ID NO: 96992 - protein, 10 aa, Homo Sapiens
LHEGDIILKI

SEQ ID NO: 96993 - protein, 10 aa, Homo Sapiens
LHSMEVVNRL

SEQ ID NO: 96994 - protein, 10 aa, Homo Sapiens
LHTSIGNSVW

SEQ ID NO: 96995 - protein, 10 aa, Homo Sapiens
LHVTSLLDQL

SEQ ID NO: 96996 - protein, 10 aa, Homo Sapiens
LHYDSEGNKL

SEQ ID NO: 96997 - protein, 10 aa, Homo Sapiens
LNSNHVLNLI

SEQ ID NO: 96998 - protein, 10 aa, Homo Sapiens
MHAPQVADAI

SEQ ID NO: 96999 - protein, 10 aa, Homo Sapiens
MHCGTTSDQF

SEQ ID NO: 97000 - protein, 10 aa, Homo Sapiens
MHDGTTPLIL

SEQ ID NO: 97001 - protein, 10 aa, Homo Sapiens
MHDKQGEVRL

SEQ ID NO: 97002 - protein, 10 aa, Homo Sapiens
MHDYDGNNLL

SEQ ID NO: 97003 - protein, 10 aa, Homo Sapiens
MHHFIPDLLF

SEQ ID NO: 97004 - protein, 10 aa, Homo Sapiens
MHISESQQEF

SEQ ID NO: 97005 - protein, 10 aa, Homo Sapiens
MHMPAEQAFW

SEQ ID NO: 97006 - protein, 10 aa, Homo Sapiens
MHSGVDTSVL

SEQ ID NO: 97007 - protein, 10 aa, Homo Sapiens
MHSIGGVQVL

SEQ ID NO: 97008 - protein, 10 aa, Homo Sapiens
MHSPPGTQNI

SEQ ID NO: 97009 - protein, 10 aa, Homo Sapiens
MHYNQTVDIW

SEQ ID NO: 97010 - protein, 10 aa, Homo Sapiens
MKEDFDVDHF

SEQ ID NO: 97011 - protein, 10 aa, Homo Sapiens
MQCDAKFDFL

SEQ ID NO: 97012 - protein, 10 aa, Homo Sapiens
MQCQAQVDQL

SEQ ID NO: 97013 - protein, 10 aa, Homo Sapiens
MRDPDDQYKL

SEQ ID NO: 97014 - protein, 10 aa, Homo Sapiens
NHAINYVNKI

SEQ ID NO: 97015 - protein, 10 aa, Homo Sapiens
NHAPGATDAF

SEQ ID NO: 97016 - protein, 10 aa, Homo Sapiens
NHAPLSGESL

SEQ ID NO: 97017 - protein, 10 aa, Homo Sapiens
NHASYYKDAL

SEQ ID NO: 97018 - protein, 10 aa, Homo Sapiens
NHCGLLQLGL

SEQ ID NO: 97019 - protein, 10 aa, Homo Sapiens
NHDKLIPLLL

SEQ ID NO: 97020 - protein, 10 aa, Homo Sapiens
NHDLGENHHL

SEQ ID NO: 97021 - protein, 10 aa, Homo Sapiens
NHDPNTHHCL

SEQ ID NO: 97022 - protein, 10 aa, Homo Sapiens
NHDRPDVCIL

SEQ ID NO: 97023 - protein, 10 aa, Homo Sapiens
NHEARANLRL

SEQ ID NO: 97024 - protein, 10 aa, Homo Sapiens
NHECASINRI

SEQ ID NO: 97025 - protein, 10 aa, Homo Sapiens
NHEDKIRVVL

SEQ ID NO: 97026 - protein, 10 aa, Homo Sapiens
NHEFLVKPSF

SEQ ID NO: 97027 - protein, 10 aa, Homo Sapiens
NHENEDIYKL

SEQ ID NO: 97028 - protein, 10 aa, Homo Sapiens
NHFSDCHVAW

SEQ ID NO: 97029 - protein, 10 aa, Homo Sapiens
NHHLDSQSRW

SEQ ID NO: 97030 - protein, 10 aa, Homo Sapiens
NHIEPLKIQL

SEQ ID NO: 97031 - protein, 10 aa, Homo Sapiens
NHIRNGIDIL

SEQ ID NO: 97032 - protein, 10 aa, Homo Sapiens
NHIWTLFENF

SEQ ID NO: 97033 - protein, 10 aa, Homo Sapiens
NHIYVSSDDI

SEQ ID NO: 97034 - protein, 10 aa, Homo Sapiens
NHNEPFLDRI

SEQ ID NO: 97035 - protein, 10 aa, Homo Sapiens
NHQEVVELLI

SEQ ID NO: 97036 - protein, 10 aa, Homo Sapiens
NHSDPESMSL

SEQ ID NO: 97037 - protein, 10 aa, Homo Sapiens
NHSLPEADRI

SEQ ID NO: 97038 - protein, 10 aa, Homo Sapiens
NHVAAHGQSL

SEQ ID NO: 97039 - protein, 10 aa, Homo Sapiens
NHVDKLYQKL

SEQ ID NO: 97040 - protein, 10 aa, Homo Sapiens
NHVTPPNVSL

SEQ ID NO: 97041 - protein, 10 aa, Homo Sapiens
NHWFTYNETM

SEQ ID NO: 97042 - protein, 10 aa, Homo Sapiens
NHYKSNVEIF

SEQ ID NO: 97043 - protein, 10 aa, Homo Sapiens
NQIGTVNDRL

SEQ ID NO: 97044 - protein, 10 aa, Homo Sapiens
NRFEDILSLF

SEQ ID NO: 97045 - protein, 10 aa, Homo Sapiens
NRIKGCTDNL

SEQ ID NO: 97046 - protein, 10 aa, Homo Sapiens
NRLEVVKEFL

SEQ ID NO: 97047 - protein, 10 aa, Homo Sapiens
NSHTSVGNIL

SEQ ID NO: 97048 - protein, 10 aa, Homo Sapiens
QHADPPVQIL

SEQ ID NO: 97049 - protein, 10 aa, Homo Sapiens
QHAEADREQL

SEQ ID NO: 97050 - protein, 10 aa, Homo Sapiens
QHAEHIFLSF

SEQ ID NO: 97051 - protein, 10 aa, Homo Sapiens
QHAYDGKDYI

SEQ ID NO: 97052 - protein, 10 aa, Homo Sapiens
QHCDLELSIL

SEQ ID NO: 97053 - protein, 10 aa, Homo Sapiens
QHCGSEMDYL

SEQ ID NO: 97054 - protein, 10 aa, Homo Sapiens
QHDAASLLKL

SEQ ID NO: 97055 - protein, 10 aa, Homo Sapiens
QHDEPCYWRL

SEQ ID NO: 97056 - protein, 10 aa, Homo Sapiens
QHDFGHLSVF

SEQ ID NO: 97057 - protein, 10 aa, Homo Sapiens
QHDFQAPYLL

SEQ ID NO: 97058 - protein, 10 aa, Homo Sapiens
QHDGPTKNLF

SEQ ID NO: 97059 - protein, 10 aa, Homo Sapiens
QHDITGRALL

SEQ ID NO: 97060 - protein, 10 aa, Homo Sapiens
QHDLSQSAFL

SEQ ID NO: 97061 - protein, 10 aa, Homo Sapiens
QHDPGQLLGW

SEQ ID NO: 97062 - protein, 10 aa, Homo Sapiens
QHDPKAETRL

SEQ ID NO: 97063 - protein, 10 aa, Homo Sapiens
QHDVFGDISF

SEQ ID NO: 97064 - protein, 10 aa, Homo Sapiens
QHECIPQAIL

SEQ ID NO: 97065 - protein, 10 aa, Homo Sapiens
QHEERRCQYL

SEQ ID NO: 97066 - protein, 10 aa, Homo Sapiens
QHELVTTQRL

SEQ ID NO: 97067 - protein, 10 aa, Homo Sapiens
QHENEAKSFF

SEQ ID NO: 97068 - protein, 10 aa, Homo Sapiens
QHENEDIYKL

SEQ ID NO: 97069 - protein, 10 aa, Homo Sapiens
QHFDLASTTI

SEQ ID NO: 97070 - protein, 10 aa, Homo Sapiens
QHGLEEDFML

SEQ ID NO: 97071 - protein, 10 aa, Homo Sapiens
QHIAGFLDGF

SEQ ID NO: 97072 - protein, 10 aa, Homo Sapiens
QHIGTGNLYI

SEQ ID NO: 97073 - protein, 10 aa, Homo Sapiens
QHIQDGALRL

SEQ ID NO: 97074 - protein, 10 aa, Homo Sapiens
QHIQVFIDRF

SEQ ID NO: 97075 - protein, 10 aa, Homo Sapiens
QHIREELAEL

SEQ ID NO: 97076 - protein, 10 aa, Homo Sapiens
QHIYKEIVNF

SEQ ID NO: 97077 - protein, 10 aa, Homo Sapiens
QHLANIVERL

SEQ ID NO: 97078 - protein, 10 aa, Homo Sapiens
QHLKSTTNEL

SEQ ID NO: 97079 - protein, 10 aa, Homo Sapiens
QHQDSQVNAL

SEQ ID NO: 97080 - protein, 10 aa, Homo Sapiens
QHQEVKPYTL

SEQ ID NO: 97081 - protein, 10 aa, Homo Sapiens
QHQLDTILFF

SEQ ID NO: 97082 - protein, 10 aa, Homo Sapiens
QHQQEALQSL

SEQ ID NO: 97083 - protein, 10 aa, Homo Sapiens
QHQSGIVQLL

SEQ ID NO: 97084 - protein, 10 aa, Homo Sapiens
QHSASSANVF

SEQ ID NO: 97085 - protein, 10 aa, Homo Sapiens
QHSLAITNNF

SEQ ID NO: 97086 - protein, 10 aa, Homo Sapiens
QHSNVVINLI

SEQ ID NO: 97087 - protein, 10 aa, Homo Sapiens
QHSPGSADSL

SEQ ID NO: 97088 - protein, 10 aa, Homo Sapiens
QHSQEFINRL

SEQ ID NO: 97089 - protein, 10 aa, Homo Sapiens
QHSSSGLQSV

SEQ ID NO: 97090 - protein, 10 aa, Homo Sapiens
QHTDTVVNFL

SEQ ID NO: 97091 - protein, 10 aa, Homo Sapiens
QHVASVTDSF

SEQ ID NO: 97092 - protein, 10 aa, Homo Sapiens
QHVDESGLSL

SEQ ID NO: 97093 - protein, 10 aa, Homo Sapiens
QHVDTGNSYL

SEQ ID NO: 97094 - protein, 10 aa, Homo Sapiens
QHVFLVSEYL

SEQ ID NO: 97095 - protein, 10 aa, Homo Sapiens
QHVGNVQDFL

SEQ ID NO: 97096 - protein, 10 aa, Homo Sapiens
QHVKYISDAL

SEQ ID NO: 97097 - protein, 10 aa, Homo Sapiens
QHVSTHSDIL

SEQ ID NO: 97098 - protein, 10 aa, Homo Sapiens
QHYDGKADLW

SEQ ID NO: 97099 - protein, 10 aa, Homo Sapiens
QQAPSSLQKL

SEQ ID NO: 97100 - protein, 10 aa, Homo Sapiens
QQDPVIYQRL

SEQ ID NO: 97101 - protein, 10 aa, Homo Sapiens
QQDSGCKVQI

SEQ ID NO: 97102 - protein, 10 aa, Homo Sapiens
QQMEAEHNTL

SEQ ID NO: 97103 - protein, 10 aa, Homo Sapiens
QRCPIVDTFW

SEQ ID NO: 97104 - protein, 10 aa, Homo Sapiens
QRIQTEFDQL

SEQ ID NO: 97105 - protein, 10 aa, Homo Sapiens
RHDPNMKYEL

SEQ ID NO: 97106 - protein, 10 aa, Homo Sapiens
RHDPQTTNLL

SEQ ID NO: 97107 - protein, 10 aa, Homo Sapiens
RHESGASIKI

SEQ ID NO: 97108 - protein, 10 aa, Homo Sapiens
RHIEDKSTVF

SEQ ID NO: 97109 - protein, 10 aa, Homo Sapiens
RHLDMEHERL

SEQ ID NO: 97110 - protein, 10 aa, Homo Sapiens
RHLETGGQKI

SEQ ID NO: 97111 - protein, 10 aa, Homo Sapiens
RHSPAGSQAL

SEQ ID NO: 97112 - protein, 10 aa, Homo Sapiens
RHVFLFTDVL

SEQ ID NO: 97113 - protein, 10 aa, Homo Sapiens
SHAENILQIF

SEQ ID NO: 97114 - protein, 10 aa, Homo Sapiens
SHAPPTQQVL

SEQ ID NO: 97115 - protein, 10 aa, Homo Sapiens
SHCNIIHTEI

SEQ ID NO: 97116 - protein, 10 aa, Homo Sapiens
SHCQKTDLKL

SEQ ID NO: 97117 - protein, 10 aa, Homo Sapiens
SHCTFVIEAL

SEQ ID NO: 97118 - protein, 10 aa, Homo Sapiens
SHDNGSQFFF

SEQ ID NO: 97119 - protein, 10 aa, Homo Sapiens
SHDVSGALLL

SEQ ID NO: 97120 - protein, 10 aa, Homo Sapiens
SHDVSLANRM

SEQ ID NO: 97121 - protein, 10 aa, Homo Sapiens
SHEAATKAVL

SEQ ID NO: 97122 - protein, 10 aa, Homo Sapiens
SHEEPAFQNF

SEQ ID NO: 97123 - protein, 10 aa, Homo Sapiens
SHEGEILQAF

SEQ ID NO: 97124 - protein, 10 aa, Homo Sapiens
SHEGLVLTKL

SEQ ID NO: 97125 - protein, 10 aa, Homo Sapiens
SHEGSSFQMF

SEQ ID NO: 97126 - protein, 10 aa, Homo Sapiens
SHESQLGNRI

SEQ ID NO: 97127 - protein, 10 aa, Homo Sapiens
SHFEGLITTI

SEQ ID NO: 97128 - protein, 10 aa, Homo Sapiens
SHFFMGGEKF

SEQ ID NO: 97129 - protein, 10 aa, Homo Sapiens
SHFFSENEDF

SEQ ID NO: 97130 - protein, 10 aa, Homo Sapiens
SHFQEAIDFI

SEQ ID NO: 97131 - protein, 10 aa, Homo Sapiens
SHGAAGGQAF

SEQ ID NO: 97132 - protein, 10 aa, Homo Sapiens
SHGEVHLDCL

SEQ ID NO: 97133 - protein, 10 aa, Homo Sapiens
SHHEAEFQHL

SEQ ID NO: 97134 - protein, 10 aa, Homo Sapiens
SHIEDQAEQF

SEQ ID NO: 97135 - protein, 10 aa, Homo Sapiens
SHIKDFAAKL

SEQ ID NO: 97136 - protein, 10 aa, Homo Sapiens
SHIKDNEQAL

SEQ ID NO: 97137 - protein, 10 aa, Homo Sapiens
SHILISGDGL

SEQ ID NO: 97138 - protein, 10 aa, Homo Sapiens
SHIQSTSDRI

SEQ ID NO: 97139 - protein, 10 aa, Homo Sapiens
SHIRPYMDEI

SEQ ID NO: 97140 - protein, 10 aa, Homo Sapiens
SHLAWFGDSL

SEQ ID NO: 97141 - protein, 10 aa, Homo Sapiens
SHLNALEERF

SEQ ID NO: 97142 - protein, 10 aa, Homo Sapiens
SHLPPFFDCL

SEQ ID NO: 97143 - protein, 10 aa, Homo Sapiens
SHMDWEKVAF

SEQ ID NO: 97144 - protein, 10 aa, Homo Sapiens
SHMLNTGNDL

SEQ ID NO: 97145 - protein, 10 aa, Homo Sapiens
SHMQSIIDKL

SEQ ID NO: 97146 - protein, 10 aa, Homo Sapiens
SHQDITEDSF

SEQ ID NO: 97147 - protein, 10 aa, Homo Sapiens
SHSAILDQKL

SEQ ID NO: 97148 - protein, 10 aa, Homo Sapiens
SHSDDGCLKL

SEQ ID NO: 97149 - protein, 10 aa, Homo Sapiens
SHSDGSFNLL

SEQ ID NO: 97150 - protein, 10 aa, Homo Sapiens
SHSEVPFQML

SEQ ID NO: 97151 - protein, 10 aa, Homo Sapiens
SHSPFGLDSF

SEQ ID NO: 97152 - protein, 10 aa, Homo Sapiens
SHSSYVLQQL

SEQ ID NO: 97153 - protein, 10 aa, Homo Sapiens
SHVKEPRYLL

SEQ ID NO: 97154 - protein, 10 aa, Homo Sapiens
SHVKVLQEML

SEQ ID NO: 97155 - protein, 10 aa, Homo Sapiens
SHVNYFLDQF

SEQ ID NO: 97156 - protein, 10 aa, Homo Sapiens
SHVRPDRQTL

SEQ ID NO: 97157 - protein, 10 aa, Homo Sapiens
SKDPGENYNL

SEQ ID NO: 97158 - protein, 10 aa, Homo Sapiens
SLRTLTNETF

SEQ ID NO: 97159 - protein, 10 aa, Homo Sapiens
SQLDDQYSRF

SEQ ID NO: 97160 - protein, 10 aa, Homo Sapiens
SRCPHLLDFF

SEQ ID NO: 97161 - protein, 10 aa, Homo Sapiens
SRYNGEPEHI

SEQ ID NO: 97162 - protein, 10 aa, Homo Sapiens
TEIDSKWQEL

SEQ ID NO: 97163 - protein, 10 aa, Homo Sapiens
THAELEGNLV

SEQ ID NO: 97164 - protein, 10 aa, Homo Sapiens
THAKSILNSM

SEQ ID NO: 97165 - protein, 10 aa, Homo Sapiens
THAQVEDGRL

SEQ ID NO: 97166 - protein, 10 aa, Homo Sapiens
THAVPIYEGF

SEQ ID NO: 97167 - protein, 10 aa, Homo Sapiens
THCEIHPSMI

SEQ ID NO: 97168 - protein, 10 aa, Homo Sapiens
THCLPEPHLL

SEQ ID NO: 97169 - protein, 10 aa, Homo Sapiens
THCLWTDQLL

SEQ ID NO: 97170 - protein, 10 aa, Homo Sapiens
THCPPSSIEL

SEQ ID NO: 97171 - protein, 10 aa, Homo Sapiens
THDDFVMIDF

SEQ ID NO: 97172 - protein, 10 aa, Homo Sapiens
THDDSHLVSL

SEQ ID NO: 97173 - protein, 10 aa, Homo Sapiens
THDDTGARYL

SEQ ID NO: 97174 - protein, 10 aa, Homo Sapiens
THDELIQLVL

SEQ ID NO: 97175 - protein, 10 aa, Homo Sapiens
THDPDPETPL

SEQ ID NO: 97176 - protein, 10 aa, Homo Sapiens
THDQSISQKL

SEQ ID NO: 97177 - protein, 10 aa, Homo Sapiens
THDQVLKTRL

SEQ ID NO: 97178 - protein, 10 aa, Homo Sapiens
THDSVTVLLF

SEQ ID NO: 97179 - protein, 10 aa, Homo Sapiens
THDVPYHDYF

SEQ ID NO: 97180 - protein, 10 aa, Homo Sapiens
THEDAVAAML

SEQ ID NO: 97181 - protein, 10 aa, Homo Sapiens
THEDPVIAVF

SEQ ID NO: 97182 - protein, 10 aa, Homo Sapiens
THEEGSYLFW

SEQ ID NO: 97183 - protein, 10 aa, Homo Sapiens
THEFFEAIGF

SEQ ID NO: 97184 - protein, 10 aa, Homo Sapiens
THEFTVEQCF

SEQ ID NO: 97185 - protein, 10 aa, Homo Sapiens
THENIYLWDI

SEQ ID NO: 97186 - protein, 10 aa, Homo Sapiens
THENLTYLQL

SEQ ID NO: 97187 - protein, 10 aa, Homo Sapiens
THENPGLYAL

SEQ ID NO: 97188 - protein, 10 aa, Homo Sapiens
THEPGEEASL

SEQ ID NO: 97189 - protein, 10 aa, Homo Sapiens
THEQTDGATL

SEQ ID NO: 97190 - protein, 10 aa, Homo Sapiens
THFDTIFEVF

SEQ ID NO: 97191 - protein, 10 aa, Homo Sapiens
THFESKTELL

SEQ ID NO: 97192 - protein, 10 aa, Homo Sapiens
THFQQGHEEL

SEQ ID NO: 97193 - protein, 10 aa, Homo Sapiens
THFSAGVLQL

SEQ ID NO: 97194 - protein, 10 aa, Homo Sapiens
THFTGNEVGF

SEQ ID NO: 97195 - protein, 10 aa, Homo Sapiens
THHKETYTEI

SEQ ID NO: 97196 - protein, 10 aa, Homo Sapiens
THIADGVFRF

SEQ ID NO: 97197 - protein, 10 aa, Homo Sapiens
THICPVYEGF

SEQ ID NO: 97198 - protein, 10 aa, Homo Sapiens
THIPNIFQKI

SEQ ID NO: 97199 - protein, 10 aa, Homo Sapiens
THISALLQYI

SEQ ID NO: 97200 - protein, 10 aa, Homo Sapiens
THISDSIIEI

SEQ ID NO: 97201 - protein, 10 aa, Homo Sapiens
THISPYKDLL

SEQ ID NO: 97202 - protein, 10 aa, Homo Sapiens
THISSQNSEL

SEQ ID NO: 97203 - protein, 10 aa, Homo Sapiens
THISSSGQNL

SEQ ID NO: 97204 - protein, 10 aa, Homo Sapiens
THITAQTAVL

SEQ ID NO: 97205 - protein, 10 aa, Homo Sapiens
THLGGTNLDF

SEQ ID NO: 97206 - protein, 10 aa, Homo Sapiens
THLSGLLDIF

SEQ ID NO: 97207 - protein, 10 aa, Homo Sapiens
THLTSMFEYL

SEQ ID NO: 97208 - protein, 10 aa, Homo Sapiens
THMSPSWTLL

SEQ ID NO: 97209 - protein, 10 aa, Homo Sapiens
THNEGLNQKL

SEQ ID NO: 97210 - protein, 10 aa, Homo Sapiens
THNPSQAEKL

SEQ ID NO: 97211 - protein, 10 aa, Homo Sapiens
THQEAVSALL

SEQ ID NO: 97212 - protein, 10 aa, Homo Sapiens
THQSGSLALL

SEQ ID NO: 97213 - protein, 10 aa, Homo Sapiens
THSAVDNILL

SEQ ID NO: 97214 - protein, 10 aa, Homo Sapiens
THSFIWNQDI

SEQ ID NO: 97215 - protein, 10 aa, Homo Sapiens
THSHSWNQHL

SEQ ID NO: 97216 - protein, 10 aa, Homo Sapiens
THSIPENTNF

SEQ ID NO: 97217 - protein, 10 aa, Homo Sapiens
THSLILHDLI

SEQ ID NO: 97218 - protein, 10 aa, Homo Sapiens
THSSVVLQGF

SEQ ID NO: 97219 - protein, 10 aa, Homo Sapiens
THTDVLKDGF

SEQ ID NO: 97220 - protein, 10 aa, Homo Sapiens
THTETGKVLF

SEQ ID NO: 97221 - protein, 10 aa, Homo Sapiens
THTPILRDFF

SEQ ID NO: 97222 - protein, 10 aa, Homo Sapiens
THTSPEDVSF

SEQ ID NO: 97223 - protein, 10 aa, Homo Sapiens
THVEDLNAKW

SEQ ID NO: 97224 - protein, 10 aa, Homo Sapiens
THVKEQLETL

SEQ ID NO: 97225 - protein, 10 aa, Homo Sapiens
THVQSQLEKL

SEQ ID NO: 97226 - protein, 10 aa, Homo Sapiens
THVSNGCQLL

SEQ ID NO: 97227 - protein, 10 aa, Homo Sapiens
THVTTMGQRL

SEQ ID NO: 97228 - protein, 10 aa, Homo Sapiens
THYDHVLIEL

SEQ ID NO: 97229 - protein, 10 aa, Homo Sapiens
TLASAGFDRL

SEQ ID NO: 97230 - protein, 10 aa, Homo Sapiens
TLIQSFTDRL

SEQ ID NO: 97231 - protein, 10 aa, Homo Sapiens
TQDFPESNRL

SEQ ID NO: 97232 - protein, 10 aa, Homo Sapiens
TQDPHVNAFF

SEQ ID NO: 97233 - protein, 10 aa, Homo Sapiens
TQEEPYSDII

SEQ ID NO: 97234 - protein, 10 aa, Homo Sapiens
TQIGGERYNF

SEQ ID NO: 97235 - protein, 10 aa, Homo Sapiens
TQLANEEDNP

SEQ ID NO: 97236 - protein, 10 aa, Homo Sapiens
TRAIETTDII

SEQ ID NO: 97237 - protein, 10 aa, Homo Sapiens
TRDIYKELLI

SEQ ID NO: 97238 - protein, 10 aa, Homo Sapiens
TRLDIISEDI

SEQ ID NO: 97239 - protein, 10 aa, Homo Sapiens
TTNHVEVNFI

SEQ ID NO: 97240 - protein, 10 aa, Homo Sapiens
TVSCSKMSSI

SEQ ID NO: 97241 - protein, 10 aa, Homo Sapiens
VEGGPNVISI

SEQ ID NO: 97242 - protein, 10 aa, Homo Sapiens
VHAGVVSNTL

SEQ ID NO: 97243 - protein, 10 aa, Homo Sapiens
VHAPPMQLGF

SEQ ID NO: 97244 - protein, 10 aa, Homo Sapiens
VHCGIIEPLM

SEQ ID NO: 97245 - protein, 10 aa, Homo Sapiens
VHDFTKNVGL

SEQ ID NO: 97246 - protein, 10 aa, Homo Sapiens
VHEDIVAVEL

SEQ ID NO: 97247 - protein, 10 aa, Homo Sapiens
VHEDRSIQQI

SEQ ID NO: 97248 - protein, 10 aa, Homo Sapiens
VHIADGLDYI

SEQ ID NO: 97249 - protein, 10 aa, Homo Sapiens
VHNIPGFDSI

SEQ ID NO: 97250 - protein, 10 aa, Homo Sapiens
VHSFEEGSEL

SEQ ID NO: 97251 - protein, 10 aa, Homo Sapiens
VHSNIATEHI

SEQ ID NO: 97252 - protein, 10 aa, Homo Sapiens
VHSTPGANVL

SEQ ID NO: 97253 - protein, 10 aa, Homo Sapiens
VHVNVSGNEL

SEQ ID NO: 97254 - protein, 10 aa, Homo Sapiens
VNVTYGHMPV

SEQ ID NO: 97255 - protein, 10 aa, Homo Sapiens
VPDSSGPERI

SEQ ID NO: 97256 - protein, 10 aa, Homo Sapiens
WHDEQGHNGL

SEQ ID NO: 97257 - protein, 10 aa, Homo Sapiens
WHEEMKNQII

SEQ ID NO: 97258 - protein, 10 aa, Homo Sapiens
WHFYDDREFI

SEQ ID NO: 97259 - protein, 10 aa, Homo Sapiens
WHIYSEEEYL

SEQ ID NO: 97260 - protein, 10 aa, Homo Sapiens
WHLEEFGQAF

SEQ ID NO: 97261 - protein, 10 aa, Homo Sapiens
WHQTGGEVTI

SEQ ID NO: 97262 - protein, 10 aa, Homo Sapiens
YHAEEVEERF

SEQ ID NO: 97263 - protein, 10 aa, Homo Sapiens
YHAKDPNNLF

SEQ ID NO: 97264 - protein, 10 aa, Homo Sapiens
YHAKLENARL

SEQ ID NO: 97265 - protein, 10 aa, Homo Sapiens
YHAPPRLHHL

SEQ ID NO: 97266 - protein, 10 aa, Homo Sapiens
YHAPTDCATI

SEQ ID NO: 97267 - protein, 10 aa, Homo Sapiens
YHAQPLEDNL

SEQ ID NO: 97268 - protein, 10 aa, Homo Sapiens
YHDEADQSAL

SEQ ID NO: 97269 - protein, 10 aa, Homo Sapiens
YHDFSVQNFI

SEQ ID NO: 97270 - protein, 10 aa, Homo Sapiens
YHDGNRNPKF

SEQ ID NO: 97271 - protein, 10 aa, Homo Sapiens
YHDISGCYIL

SEQ ID NO: 97272 - protein, 10 aa, Homo Sapiens
YHDNHIVIRW

SEQ ID NO: 97273 - protein, 10 aa, Homo Sapiens
YHDPMLKLSI

SEQ ID NO: 97274 - protein, 10 aa, Homo Sapiens
YHDYGHLELI

SEQ ID NO: 97275 - protein, 10 aa, Homo Sapiens
YHEGSAPALI

SEQ ID NO: 97276 - protein, 10 aa, Homo Sapiens
YHEGYACTSI

SEQ ID NO: 97277 - protein, 10 aa, Homo Sapiens
YHEQLSVAEI

SEQ ID NO: 97278 - protein, 10 aa, Homo Sapiens
YHEQLTVAEI

SEQ ID NO: 97279 - protein, 10 aa, Homo Sapiens
YHHEAGVTAL

SEQ ID NO: 97280 - protein, 10 aa, Homo Sapiens
YHHHGVGQGF

SEQ ID NO: 97281 - protein, 10 aa, Homo Sapiens
YHIDVGTQTF

SEQ ID NO: 97282 - protein, 10 aa, Homo Sapiens
YHILVDTNFI

SEQ ID NO: 97283 - protein, 10 aa, Homo Sapiens
YHISLEHEIL

SEQ ID NO: 97284 - protein, 10 aa, Homo Sapiens
YHLDEKTSRF

SEQ ID NO: 97285 - protein, 10 aa, Homo Sapiens
YHNEVEIEKL

SEQ ID NO: 97286 - protein, 10 aa, Homo Sapiens
YHQNVESHLL

SEQ ID NO: 97287 - protein, 10 aa, Homo Sapiens
YHQPAPIAQL

SEQ ID NO: 97288 - protein, 10 aa, Homo Sapiens
YHQSASEHGL

SEQ ID NO: 97289 - protein, 10 aa, Homo Sapiens
YHSDEYIKFL

SEQ ID NO: 97290 - protein, 10 aa, Homo Sapiens
YHSEESQIYL

SEQ ID NO: 97291 - protein, 10 aa, Homo Sapiens
YHSPEEEISL

SEQ ID NO: 97292 - protein, 10 aa, Homo Sapiens
YHTMDKNQKL

SEQ ID NO: 97293 - protein, 10 aa, Homo Sapiens
YHVASDTEKI

SEQ ID NO: 97294 - protein, 10 aa, Homo Sapiens
YHVEPHPEHL

SEQ ID NO: 97295 - protein, 10 aa, Homo Sapiens
YHVPSSDQNI

SEQ ID NO: 97296 - protein, 10 aa, Homo Sapiens
YHVSEKPYGI

SEQ ID NO: 97297 - protein, 10 aa, Homo Sapiens
YHYPSCDLYF

SEQ ID NO: 97298 - protein, 10 aa, Homo Sapiens
YQDPSNAQFL

SEQ ID NO: 97299 - protein, 10 aa, Homo Sapiens
YQQQGRLDKL

SEQ ID NO: 97300 - protein, 11 aa, Homo Sapiens
AHAAAGPGEVL

SEQ ID NO: 97301 - protein, 11 aa, Homo Sapiens
AHAPPGHHSVI

SEQ ID NO: 97302 - protein, 11 aa, Homo Sapiens
AHAQSIGMNRL

SEQ ID NO: 97303 - protein, 11 aa, Homo Sapiens
AHAQVSITNEI

SEQ ID NO: 97304 - protein, 11 aa, Homo Sapiens
AHCDLGAHHSL

SEQ ID NO: 97305 - protein, 11 aa, Homo Sapiens
AHDDSVMYLQF

SEQ ID NO: 97306 - protein, 11 aa, Homo Sapiens
AHDESPGNNVV

SEQ ID NO: 97307 - protein, 11 aa, Homo Sapiens
AHDGSATYLRF

SEQ ID NO: 97308 - protein, 11 aa, Homo Sapiens
AHDPQTLEQNI

SEQ ID NO: 97309 - protein, 11 aa, Homo Sapiens
AHDTDPKALRL

SEQ ID NO: 97310 - protein, 11 aa, Homo Sapiens
AHEENSQIYKF

SEQ ID NO: 97311 - protein, 11 aa, Homo Sapiens
AHEGTLAAITF

SEQ ID NO: 97312 - protein, 11 aa, Homo Sapiens
AHELVTSKIAL

SEQ ID NO: 97313 - protein, 11 aa, Homo Sapiens
AHEPVNELSAL

SEQ ID NO: 97314 - protein, 11 aa, Homo Sapiens
AHESAVTGLSL

SEQ ID NO: 97315 - protein, 11 aa, Homo Sapiens
AHGGNDVSNAI

SEQ ID NO: 97316 - protein, 11 aa, Homo Sapiens
AHLNPSDTEEW

SEQ ID NO: 97317 - protein, 11 aa, Homo Sapiens
AHLPASGLDIF

SEQ ID NO: 97318 - protein, 11 aa, Homo Sapiens
AHNLADNVQSI

SEQ ID NO: 97319 - protein, 11 aa, Homo Sapiens
AHSSDVLENVF

SEQ ID NO: 97320 - protein, 11 aa, Homo Sapiens
AHVPNFIFDEF

SEQ ID NO: 97321 - protein, 11 aa, Homo Sapiens
AHYADVLGLLL

SEQ ID NO: 97322 - protein, 11 aa, Homo Sapiens
ARWWGGAIEEF

SEQ ID NO: 97323 - protein, 11 aa, Homo Sapiens
CQASFPGANII

SEQ ID NO: 97324 - protein, 11 aa, Homo Sapiens
DHAGEYGANRI

SEQ ID NO: 97325 - protein, 11 aa, Homo Sapiens
DHDKTSLIQKM

SEQ ID NO: 97326 - protein, 11 aa, Homo Sapiens
DHDRYSGNVTI

SEQ ID NO: 97327 - protein, 11 aa, Homo Sapiens
DHIKGLETHLI

SEQ ID NO: 97328 - protein, 11 aa, Homo Sapiens
DHYKPGSSETL

SEQ ID NO: 97329 - protein, 11 aa, Homo Sapiens
DHYSQQMAQQL

SEQ ID NO: 97330 - protein, 11 aa, Homo Sapiens
EHADFAGVERL

SEQ ID NO: 97331 - protein, 11 aa, Homo Sapiens
EHAKINETDTF

SEQ ID NO: 97332 - protein, 11 aa, Homo Sapiens
EHAQNTLNQLL

SEQ ID NO: 97333 - protein, 11 aa, Homo Sapiens
EHCTRGSLQDL

SEQ ID NO: 97334 - protein, 11 aa, Homo Sapiens
EHCWVGELNGL

SEQ ID NO: 97335 - protein, 11 aa, Homo Sapiens
EHDPITKNKQV

SEQ ID NO: 97336 - protein, 11 aa, Homo Sapiens
EHDPSSIYLRI

SEQ ID NO: 97337 - protein, 11 aa, Homo Sapiens
EHEDTDKYRQL

SEQ ID NO: 97338 - protein, 11 aa, Homo Sapiens
EHEHVVECISW

SEQ ID NO: 97339 - protein, 11 aa, Homo Sapiens
EHILPINSEVL

SEQ ID NO: 97340 - protein, 11 aa, Homo Sapiens
EHINEGETAML

SEQ ID NO: 97341 - protein, 11 aa, Homo Sapiens
EHLKERLANEL

SEQ ID NO: 97342 - protein, 11 aa, Homo Sapiens
EHLPARLNEAL

SEQ ID NO: 97343 - protein, 11 aa, Homo Sapiens
EHLRKLEAERL

SEQ ID NO: 97344 - protein, 11 aa, Homo Sapiens
EHMGQLLHQLL

SEQ ID NO: 97345 - protein, 11 aa, Homo Sapiens
EHMPVGPDAIL

SEQ ID NO: 97346 - protein, 11 aa, Homo Sapiens
EHQGSHLTQKL

SEQ ID NO: 97347 - protein, 11 aa, Homo Sapiens
EHQPDNIKALF

SEQ ID NO: 97348 - protein, 11 aa, Homo Sapiens
EHQPPYIIAVL

SEQ ID NO: 97349 - protein, 11 aa, Homo Sapiens
EHQSNGGALVL

SEQ ID NO: 97350 - protein, 11 aa, Homo Sapiens
EHQSPVRFDTF

SEQ ID NO: 97351 - protein, 11 aa, Homo Sapiens
EHSGGRDLDSL

SEQ ID NO: 97352 - protein, 11 aa, Homo Sapiens
EHSKNVNTEKL

SEQ ID NO: 97353 - protein, 11 aa, Homo Sapiens
EHSPSDLEAHF

SEQ ID NO: 97354 - protein, 11 aa, Homo Sapiens
EHSPVPAGFGF

SEQ ID NO: 97355 - protein, 11 aa, Homo Sapiens
EHVRIHTQEQL

SEQ ID NO: 97356 - protein, 11 aa, Homo Sapiens
EHWDDKAKSLL

SEQ ID NO: 97357 - protein, 11 aa, Homo Sapiens
EHYADQLKEYL

SEQ ID NO: 97358 - protein, 11 aa, Homo Sapiens
EKASGYLQDSL

SEQ ID NO: 97359 - protein, 11 aa, Homo Sapiens
ERYDCKGGELF

SEQ ID NO: 97360 - protein, 11 aa, Homo Sapiens
FHCEPANILYI

SEQ ID NO: 97361 - protein, 11 aa, Homo Sapiens
FHDCEDAAREL

SEQ ID NO: 97362 - protein, 11 aa, Homo Sapiens
FHDDQGGVTRW

SEQ ID NO: 97363 - protein, 11 aa, Homo Sapiens
FHDKGSLTDYL

SEQ ID NO: 97364 - protein, 11 aa, Homo Sapiens
FHDPESAQQHF

SEQ ID NO: 97365 - protein, 11 aa, Homo Sapiens
FHDPNAIYSEL

SEQ ID NO: 97366 - protein, 11 aa, Homo Sapiens
FHEDDNQKSAF

SEQ ID NO: 97367 - protein, 11 aa, Homo Sapiens
FHEDPYSGEKL

SEQ ID NO: 97368 - protein, 11 aa, Homo Sapiens
FHEEYSRLYQL

SEQ ID NO: 97369 - protein, 11 aa, Homo Sapiens
FHEHPDLIVGF

SEQ ID NO: 97370 - protein, 11 aa, Homo Sapiens
FHELTALANQI

SEQ ID NO: 97371 - protein, 11 aa, Homo Sapiens
FHFTNRDCDSL

SEQ ID NO: 97372 - protein, 11 aa, Homo Sapiens
FHGDSEIDQLF

SEQ ID NO: 97373 - protein, 11 aa, Homo Sapiens
FHHGDGPGNAV

SEQ ID NO: 97374 - protein, 11 aa, Homo Sapiens
FHILSGQGDVL

SEQ ID NO: 97375 - protein, 11 aa, Homo Sapiens
FHLENSGWQKI

SEQ ID NO: 97376 - protein, 11 aa, Homo Sapiens
FHLTPLSYETL

SEQ ID NO: 97377 - protein, 11 aa, Homo Sapiens
FHNDIDSNSTI

SEQ ID NO: 97378 - protein, 11 aa, Homo Sapiens
FHQDPESYHTL

SEQ ID NO: 97379 - protein, 11 aa, Homo Sapiens
FHQPASAEQLL

SEQ ID NO: 97380 - protein, 11 aa, Homo Sapiens
FHSGGYGQDAL

SEQ ID NO: 97381 - protein, 11 aa, Homo Sapiens
FHVSPDPSVTL

SEQ ID NO: 97382 - protein, 11 aa, Homo Sapiens
FQAVHVQGEDL

SEQ ID NO: 97383 - protein, 11 aa, Homo Sapiens
FQENSTIGQKI

SEQ ID NO: 97384 - protein, 11 aa, Homo Sapiens
FVCDLTQADRL

SEQ ID NO: 97385 - protein, 11 aa, Homo Sapiens
GASSELQAVLS

SEQ ID NO: 97386 - protein, 11 aa, Homo Sapiens
GHDGTTESNCF

SEQ ID NO: 97387 - protein, 11 aa, Homo Sapiens
GHDPSSGVQEF

SEQ ID NO: 97388 - protein, 11 aa, Homo Sapiens
GHLDDPASQEI

SEQ ID NO: 97389 - protein, 11 aa, Homo Sapiens
GHQLPVKEATL

SEQ ID NO: 97390 - protein, 11 aa, Homo Sapiens
GHSDYINGNFI

SEQ ID NO: 97391 - protein, 11 aa, Homo Sapiens
GHSYPGSTQSL

SEQ ID NO: 97392 - protein, 11 aa, Homo Sapiens
GHVVPTILEKF

SEQ ID NO: 97393 - protein, 11 aa, Homo Sapiens
HHAEESTAMGF

SEQ ID NO: 97394 - protein, 11 aa, Homo Sapiens
HHAESKNGWTL

SEQ ID NO: 97395 - protein, 11 aa, Homo Sapiens
HHAQDLGVVNL

SEQ ID NO: 97396 - protein, 11 aa, Homo Sapiens
HHAQDYGGLLL

SEQ ID NO: 97397 - protein, 11 aa, Homo Sapiens
HHAVETVVNML

SEQ ID NO: 97398 - protein, 11 aa, Homo Sapiens
HHCPDVPILLV

SEQ ID NO: 97399 - protein, 11 aa, Homo Sapiens
HHCPSTPIILV

SEQ ID NO: 97400 - protein, 11 aa, Homo Sapiens
HHDASTFTINI

SEQ ID NO: 97401 - protein, 11 aa, Homo Sapiens
HHDDYCVWYSL

SEQ ID NO: 97402 - protein, 11 aa, Homo Sapiens
HHDDYTQNHSF

SEQ ID NO: 97403 - protein, 11 aa, Homo Sapiens
HHDESVLTNVF

SEQ ID NO: 97404 - protein, 11 aa, Homo Sapiens
HHDHAVVSGRL

SEQ ID NO: 97405 - protein, 11 aa, Homo Sapiens
HHDIHPINQYL

SEQ ID NO: 97406 - protein, 11 aa, Homo Sapiens
HHDIITDVATF

SEQ ID NO: 97407 - protein, 11 aa, Homo Sapiens
HHDKVQSLCYL

SEQ ID NO: 97408 - protein, 11 aa, Homo Sapiens
HHDNQSAVAEL

SEQ ID NO: 97409 - protein, 11 aa, Homo Sapiens
HHDVNELLSLL

SEQ ID NO: 97410 - protein, 11 aa, Homo Sapiens
HHEDGSQHIGL

SEQ ID NO: 97411 - protein, 11 aa, Homo Sapiens
HHEDRQMNTNW

SEQ ID NO: 97412 - protein, 11 aa, Homo Sapiens
HHEDYQFCYSF

SEQ ID NO: 97413 - protein, 11 aa, Homo Sapiens
HHEEIWSANSL

SEQ ID NO: 97414 - protein, 11 aa, Homo Sapiens
HHEESVREASL

SEQ ID NO: 97415 - protein, 11 aa, Homo Sapiens
HHENTHTGVKF

SEQ ID NO: 97416 - protein, 11 aa, Homo Sapiens
HHGDFSAEEVF

SEQ ID NO: 97417 - protein, 11 aa, Homo Sapiens
HHHGTSILTLF

SEQ ID NO: 97418 - protein, 11 aa, Homo Sapiens
HHHLGSVILIF

SEQ ID NO: 97419 - protein, 11 aa, Homo Sapiens
HHHYEGAVVIL

SEQ ID NO: 97420 - protein, 11 aa, Homo Sapiens
HHIPEQTTQLL

SEQ ID NO: 97421 - protein, 11 aa, Homo Sapiens
HHIVEDFLTDW

SEQ ID NO: 97422 - protein, 11 aa, Homo Sapiens
HHIYDKTSVLF

SEQ ID NO: 97423 - protein, 11 aa, Homo Sapiens
HHQVEEMLQKI

SEQ ID NO: 97424 - protein, 11 aa, Homo Sapiens
HHQYNPKFQTL

SEQ ID NO: 97425 - protein, 11 aa, Homo Sapiens
HHQYPSRSSGL

SEQ ID NO: 97426 - protein, 11 aa, Homo Sapiens
HHTEEALRELF

SEQ ID NO: 97427 - protein, 11 aa, Homo Sapiens
HHVAESSLSRL

SEQ ID NO: 97428 - protein, 11 aa, Homo Sapiens
HHVAFLEADVL

SEQ ID NO: 97429 - protein, 11 aa, Homo Sapiens
HHVIARHEYTF

SEQ ID NO: 97430 - protein, 11 aa, Homo Sapiens
HHYPGPGNHFW

SEQ ID NO: 97431 - protein, 11 aa, Homo Sapiens
HHYTEAERSLL

SEQ ID NO: 97432 - protein, 11 aa, Homo Sapiens
HQDESSSFHHL

SEQ ID NO: 97433 - protein, 11 aa, Homo Sapiens
HQDTSSVGNFI

SEQ ID NO: 97434 - protein, 11 aa, Homo Sapiens
HQIEAVDGEEL

SEQ ID NO: 97435 - protein, 11 aa, Homo Sapiens
HRAVEEEESRF

SEQ ID NO: 97436 - protein, 11 aa, Homo Sapiens
HRDELEGTYKI

SEQ ID NO: 97437 - protein, 11 aa, Homo Sapiens
HRKEVDYSDSL

SEQ ID NO: 97438 - protein, 11 aa, Homo Sapiens
HRLQVSYEEYL

SEQ ID NO: 97439 - protein, 11 aa, Homo Sapiens
IHASQQRWQQL

SEQ ID NO: 97440 - protein, 11 aa, Homo Sapiens
IHDDQDYLHSL

SEQ ID NO: 97441 - protein, 11 aa, Homo Sapiens
IHDGAAGVHFI

SEQ ID NO: 97442 - protein, 11 aa, Homo Sapiens
IHDGLTVHLVI

SEQ ID NO: 97443 - protein, 11 aa, Homo Sapiens
IHDNSVLRNFL

SEQ ID NO: 97444 - protein, 11 aa, Homo Sapiens
IHEEFSEHALL

SEQ ID NO: 97445 - protein, 11 aa, Homo Sapiens
IHEPEPHILLF

SEQ ID NO: 97446 - protein, 11 aa, Homo Sapiens
IHGDIKSSNVL

SEQ ID NO: 97447 - protein, 11 aa, Homo Sapiens
IHGDLTTSNML

SEQ ID NO: 97448 - protein, 11 aa, Homo Sapiens
IHIRPGQLDVL

SEQ ID NO: 97449 - protein, 11 aa, Homo Sapiens
IHLISSEANEI

SEQ ID NO: 97450 - protein, 11 aa, Homo Sapiens
IHNDDGVWLRL

SEQ ID NO: 97451 - protein, 11 aa, Homo Sapiens
IHSDPHPGNVL

SEQ ID NO: 97452 - protein, 11 aa, Homo Sapiens
IHYDDKAIERL

SEQ ID NO: 97453 - protein, 11 aa, Homo Sapiens
ILADLHSADQL

SEQ ID NO: 97454 - protein, 11 aa, Homo Sapiens
ILILDNDGDRL

SEQ ID NO: 97455 - protein, 11 aa, Homo Sapiens
ILINDAGEVRL

SEQ ID NO: 97456 - protein, 11 aa, Homo Sapiens
ILLDDTGLAYI

SEQ ID NO: 97457 - protein, 11 aa, Homo Sapiens
IPDGSEKGDFI

SEQ ID NO: 97458 - protein, 11 aa, Homo Sapiens
IPDLHSPMSPI

SEQ ID NO: 97459 - protein, 11 aa, Homo Sapiens
IQQRHGLANSI

SEQ ID NO: 97460 - protein, 11 aa, Homo Sapiens
IRDSLEKSDQL

SEQ ID NO: 97461 - protein, 11 aa, Homo Sapiens
IREWGSGSDTL

SEQ ID NO: 97462 - protein, 11 aa, Homo Sapiens
KHDDTTISSWL

SEQ ID NO: 97463 - protein, 11 aa, Homo Sapiens
KHENVVNLIEI

SEQ ID NO: 97464 - protein, 11 aa, Homo Sapiens
KHLPTISSETL

SEQ ID NO: 97465 - protein, 11 aa, Homo Sapiens
KHSEGVIIQQV

SEQ ID NO: 97466 - protein, 11 aa, Homo Sapiens
KHSMILLENQI

SEQ ID NO: 97467 - protein, 11 aa, Homo Sapiens
KHSNLLYVNVI

SEQ ID NO: 97468 - protein, 11 aa, Homo Sapiens
LEDPQTHSNRI

SEQ ID NO: 97469 - protein, 11 aa, Homo Sapiens
LHADVVPNATI

SEQ ID NO: 97470 - protein, 11 aa, Homo Sapiens
LHDADRIHNEL

SEQ ID NO: 97471 - protein, 11 aa, Homo Sapiens
LHDIETENQKL

SEQ ID NO: 97472 - protein, 11 aa, Homo Sapiens
LHDIIHTKETL

SEQ ID NO: 97473 - protein, 11 aa, Homo Sapiens
LHDKNGKSYRF

SEQ ID NO: 97474 - protein, 11 aa, Homo Sapiens
LHDQSIGTQQW

SEQ ID NO: 97475 - protein, 11 aa, Homo Sapiens
LHEGLFQSQLL

SEQ ID NO: 97476 - protein, 11 aa, Homo Sapiens
LHIEDGDSIRF

SEQ ID NO: 97477 - protein, 11 aa, Homo Sapiens
LHVLDVAGNRL

SEQ ID NO: 97478 - protein, 11 aa, Homo Sapiens
LHVNPYIGLFF

SEQ ID NO: 97479 - protein, 11 aa, Homo Sapiens
LPIDVTEGEVI

SEQ ID NO: 97480 - protein, 11 aa, Homo Sapiens
LPVRLPEGEAL

SEQ ID NO: 97481 - protein, 11 aa, Homo Sapiens
MHANAQRTDAL

SEQ ID NO: 97482 - protein, 11 aa, Homo Sapiens
MHAPQVADAIL

SEQ ID NO: 97483 - protein, 11 aa, Homo Sapiens
MHAQSAELQRL

SEQ ID NO: 97484 - protein, 11 aa, Homo Sapiens
MHCDADGLHSL

SEQ ID NO: 97485 - protein, 11 aa, Homo Sapiens
MHCGTTSDQFL

SEQ ID NO: 97486 - protein, 11 aa, Homo Sapiens
MHDEKVDLWSL

SEQ ID NO: 97487 - protein, 11 aa, Homo Sapiens
MHDGTIRDLAF

SEQ ID NO: 97488 - protein, 11 aa, Homo Sapiens
MHDLNTDQENL

SEQ ID NO: 97489 - protein, 11 aa, Homo Sapiens
MHDLSAYSDQF

SEQ ID NO: 97490 - protein, 11 aa, Homo Sapiens
MHDVYGMLLNL

SEQ ID NO: 97491 - protein, 11 aa, Homo Sapiens
MHFDPGFEEQL

SEQ ID NO: 97492 - protein, 11 aa, Homo Sapiens
MHGDSEYNIMF

SEQ ID NO: 97493 - protein, 11 aa, Homo Sapiens
MHIKSIILEGF

SEQ ID NO: 97494 - protein, 11 aa, Homo Sapiens
MHIQDPASQRL

SEQ ID NO: 97495 - protein, 11 aa, Homo Sapiens
MHISESQQEFF

SEQ ID NO: 97496 - protein, 11 aa, Homo Sapiens
MHLLPNFAECW

SEQ ID NO: 97497 - protein, 11 aa, Homo Sapiens
MHQAALLGQAL

SEQ ID NO: 97498 - protein, 11 aa, Homo Sapiens
MHSGPVVAMVW

SEQ ID NO: 97499 - protein, 11 aa, Homo Sapiens
MKCQYVGADVL

SEQ ID NO: 97500 - protein, 11 aa, Homo Sapiens
MKHGDLHAFLL

SEQ ID NO: 97501 - protein, 11 aa, Homo Sapiens
MKVNNNLSDEL

SEQ ID NO: 97502 - protein, 11 aa, Homo Sapiens
MRDSTGAGNSL

SEQ ID NO: 97503 - protein, 11 aa, Homo Sapiens
MRLDDSVFEGL

SEQ ID NO: 97504 - protein, 11 aa, Homo Sapiens
NHADERVLQAL

SEQ ID NO: 97505 - protein, 11 aa, Homo Sapiens
NHAPWSISDYF

SEQ ID NO: 97506 - protein, 11 aa, Homo Sapiens
NHCYIAILNII

SEQ ID NO: 97507 - protein, 11 aa, Homo Sapiens
NHDDLMSVVVF

SEQ ID NO: 97508 - protein, 11 aa, Homo Sapiens
NHDDPTGADAL

SEQ ID NO: 97509 - protein, 11 aa, Homo Sapiens
NHDDSRALYAI

SEQ ID NO: 97510 - protein, 11 aa, Homo Sapiens
NHDQHGRNSLL

SEQ ID NO: 97511 - protein, 11 aa, Homo Sapiens
NHDRPDVCILF

SEQ ID NO: 97512 - protein, 11 aa, Homo Sapiens
NHEASELANYF

SEQ ID NO: 97513 - protein, 11 aa, Homo Sapiens
NHEEATLGAFL

SEQ ID NO: 97514 - protein, 11 aa, Homo Sapiens
NHINITQSDKF

SEQ ID NO: 97515 - protein, 11 aa, Homo Sapiens
NHLDKQQVQLL

SEQ ID NO: 97516 - protein, 11 aa, Homo Sapiens
NHLEFLRDEEL

SEQ ID NO: 97517 - protein, 11 aa, Homo Sapiens
NHMEALGHDHL

SEQ ID NO: 97518 - protein, 11 aa, Homo Sapiens
NHMGIHIGEKL

SEQ ID NO: 97519 - protein, 11 aa, Homo Sapiens
NHMGIHTDEKL

SEQ ID NO: 97520 - protein, 11 aa, Homo Sapiens
NHQKQLESNKI

SEQ ID NO: 97521 - protein, 11 aa, Homo Sapiens
NHQLPSEHQTI

SEQ ID NO: 97522 - protein, 11 aa, Homo Sapiens
NHSIESKGNEI

SEQ ID NO: 97523 - protein, 11 aa, Homo Sapiens
NHSSLIYSNLL

SEQ ID NO: 97524 - protein, 11 aa, Homo Sapiens
NHVGELCGETL

SEQ ID NO: 97525 - protein, 11 aa, Homo Sapiens
NHVGLGPIESI

SEQ ID NO: 97526 - protein, 11 aa, Homo Sapiens
NHVKQLLSNEL

SEQ ID NO: 97527 - protein, 11 aa, Homo Sapiens
NHYEFSDCEKF

SEQ ID NO: 97528 - protein, 11 aa, Homo Sapiens
NKDNNEIVDKI

SEQ ID NO: 97529 - protein, 11 aa, Homo Sapiens
NQIPIISAEHL

SEQ ID NO: 97530 - protein, 11 aa, Homo Sapiens
NQIQAHSSDQL

SEQ ID NO: 97531 - protein, 11 aa, Homo Sapiens
NQVVSTKGERF

SEQ ID NO: 97532 - protein, 11 aa, Homo Sapiens
NREGSPDTNRI

SEQ ID NO: 97533 - protein, 11 aa, Homo Sapiens
NREGYCFTEVL

SEQ ID NO: 97534 - protein, 11 aa, Homo Sapiens
NRIGGVQQDTI

SEQ ID NO: 97535 - protein, 11 aa, Homo Sapiens
NRLFTSAEETF

SEQ ID NO: 97536 - protein, 11 aa, Homo Sapiens
NRLIGQIVSSI

SEQ ID NO: 97537 - protein, 11 aa, Homo Sapiens
PHSTGVASNTI

SEQ ID NO: 97538 - protein, 11 aa, Homo Sapiens
QHAGLPRSDVL

SEQ ID NO: 97539 - protein, 11 aa, Homo Sapiens
QHAIEESVVLI

SEQ ID NO: 97540 - protein, 11 aa, Homo Sapiens
QHALPQEAQSL

SEQ ID NO: 97541 - protein, 11 aa, Homo Sapiens
QHCLDTAFNFF

SEQ ID NO: 97542 - protein, 11 aa, Homo Sapiens
QHDAQEVLQCI

SEQ ID NO: 97543 - protein, 11 aa, Homo Sapiens
QHDEQVRLYKL

SEQ ID NO: 97544 - protein, 11 aa, Homo Sapiens
QHDFTSQIFSL

SEQ ID NO: 97545 - protein, 11 aa, Homo Sapiens
QHDPAPAHTSI

SEQ ID NO: 97546 - protein, 11 aa, Homo Sapiens
QHDPETSVLVL

SEQ ID NO: 97547 - protein, 11 aa, Homo Sapiens
QHDPSSNNAML

SEQ ID NO: 97548 - protein, 11 aa, Homo Sapiens
QHDQTHVQSQL

SEQ ID NO: 97549 - protein, 11 aa, Homo Sapiens
QHDSGAAVIQL

SEQ ID NO: 97550 - protein, 11 aa, Homo Sapiens
QHDTSLPHCRF

SEQ ID NO: 97551 - protein, 11 aa, Homo Sapiens
QHDVFGDISFL

SEQ ID NO: 97552 - protein, 11 aa, Homo Sapiens
QHEDLINLQSF

SEQ ID NO: 97553 - protein, 11 aa, Homo Sapiens
QHEEPESFFTW

SEQ ID NO: 97554 - protein, 11 aa, Homo Sapiens
QHEGLPEPVTL

SEQ ID NO: 97555 - protein, 11 aa, Homo Sapiens
QHEVEEATNIL

SEQ ID NO: 97556 - protein, 11 aa, Homo Sapiens
QHFQGNMMDFL

SEQ ID NO: 97557 - protein, 11 aa, Homo Sapiens
QHIEESFAEHL

SEQ ID NO: 97558 - protein, 11 aa, Homo Sapiens
QHIEESFSEHL

SEQ ID NO: 97559 - protein, 11 aa, Homo Sapiens
QHINPLLPACL

SEQ ID NO: 97560 - protein, 11 aa, Homo Sapiens
QHIVPCTISQL

SEQ ID NO: 97561 - protein, 11 aa, Homo Sapiens
QHIWESDSNEF

SEQ ID NO: 97562 - protein, 11 aa, Homo Sapiens
QHKIPTNDELL

SEQ ID NO: 97563 - protein, 11 aa, Homo Sapiens
QHLDLSSSEKF

SEQ ID NO: 97564 - protein, 11 aa, Homo Sapiens
QHLDPQGAQEL

SEQ ID NO: 97565 - protein, 11 aa, Homo Sapiens
QHLNLNNAEQL

SEQ ID NO: 97566 - protein, 11 aa, Homo Sapiens
QHLSSSQLQSL

SEQ ID NO: 97567 - protein, 11 aa, Homo Sapiens
QHMDVEESQCL

SEQ ID NO: 97568 - protein, 11 aa, Homo Sapiens
QHQENEGTNQL

SEQ ID NO: 97569 - protein, 11 aa, Homo Sapiens
QHQGAVELLVF

SEQ ID NO: 97570 - protein, 11 aa, Homo Sapiens
QHQLIDQQARL

SEQ ID NO: 97571 - protein, 11 aa, Homo Sapiens
QHQSGIVQLLW

SEQ ID NO: 97572 - protein, 11 aa, Homo Sapiens
QHSEYEYGNDL

SEQ ID NO: 97573 - protein, 11 aa, Homo Sapiens
QHSGQEVPQVL

SEQ ID NO: 97574 - protein, 11 aa, Homo Sapiens
QHSHLIEHQRI

SEQ ID NO: 97575 - protein, 11 aa, Homo Sapiens
QHSSQDVHVVL

SEQ ID NO: 97576 - protein, 11 aa, Homo Sapiens
QHTEAETIQKL

SEQ ID NO: 97577 - protein, 11 aa, Homo Sapiens
QHVDERKLIQF

SEQ ID NO: 97578 - protein, 11 aa, Homo Sapiens
QHYEDASCGLL

SEQ ID NO: 97579 - protein, 11 aa, Homo Sapiens
QHYELCSGNQV

SEQ ID NO: 97580 - protein, 11 aa, Homo Sapiens
QQDSYIEDQKL

SEQ ID NO: 97581 - protein, 11 aa, Homo Sapiens
QRDEQLLTNVL

SEQ ID NO: 97582 - protein, 11 aa, Homo Sapiens
QRIGLSSQELF

SEQ ID NO: 97583 - protein, 11 aa, Homo Sapiens
QRILAAETDRL

SEQ ID NO: 97584 - protein, 11 aa, Homo Sapiens
QRLKAIVAEKF

SEQ ID NO: 97585 - protein, 11 aa, Homo Sapiens
RHDDSWPFLKL

SEQ ID NO: 97586 - protein, 11 aa, Homo Sapiens
RHEDVVNSVVF

SEQ ID NO: 97587 - protein, 11 aa, Homo Sapiens
RHFGSVVAQTI

SEQ ID NO: 97588 - protein, 11 aa, Homo Sapiens
RHIEHMESDEL

SEQ ID NO: 97589 - protein, 11 aa, Homo Sapiens
RHLPVNSKEFL

SEQ ID NO: 97590 - protein, 11 aa, Homo Sapiens
SEFMNIIANEI

SEQ ID NO: 97591 - protein, 11 aa, Homo Sapiens
SHAMASAEQQL

SEQ ID NO: 97592 - protein, 11 aa, Homo Sapiens
SHATQAIFEIL

SEQ ID NO: 97593 - protein, 11 aa, Homo Sapiens
SHDASVKEWTI

SEQ ID NO: 97594 - protein, 11 aa, Homo Sapiens
SHDDTILIWDF

SEQ ID NO: 97595 - protein, 11 aa, Homo Sapiens
SHDGVSLHELL

SEQ ID NO: 97596 - protein, 11 aa, Homo Sapiens
SHDIVDGNHRL

SEQ ID NO: 97597 - protein, 11 aa, Homo Sapiens
SHDPLPSWAEL

SEQ ID NO: 97598 - protein, 11 aa, Homo Sapiens
SHDPSYFACLI

SEQ ID NO: 97599 - protein, 11 aa, Homo Sapiens
SHDPVSGTQGL

SEQ ID NO: 97600 - protein, 11 aa, Homo Sapiens
SHDSGSDHLAF

SEQ ID NO: 97601 - protein, 11 aa, Homo Sapiens
SHDSTSQLYTV

SEQ ID NO: 97602 - protein, 11 aa, Homo Sapiens
SHDYPGEGIYL

SEQ ID NO: 97603 - protein, 11 aa, Homo Sapiens
SHEANSNAVRF

SEQ ID NO: 97604 - protein, 11 aa, Homo Sapiens
SHEDVILGELL

SEQ ID NO: 97605 - protein, 11 aa, Homo Sapiens
SHEESELANKL

SEQ ID NO: 97606 - protein, 11 aa, Homo Sapiens
SHEHASGRLGI

SEQ ID NO: 97607 - protein, 11 aa, Homo Sapiens
SHESDTMSNRI

SEQ ID NO: 97608 - protein, 11 aa, Homo Sapiens
SHETRLPSNTL

SEQ ID NO: 97609 - protein, 11 aa, Homo Sapiens
SHFDDFVTNLI

SEQ ID NO: 97610 - protein, 11 aa, Homo Sapiens
SHFISGGKDCL

SEQ ID NO: 97611 - protein, 11 aa, Homo Sapiens
SHFNLKEKEYF

SEQ ID NO: 97612 - protein, 11 aa, Homo Sapiens
SHHREGLLAIF

SEQ ID NO: 97613 - protein, 11 aa, Homo Sapiens
SHIDLIDLDTI

SEQ ID NO: 97614 - protein, 11 aa, Homo Sapiens
SHIKESVEDKL

SEQ ID NO: 97615 - protein, 11 aa, Homo Sapiens
SHIKGLLINFI

SEQ ID NO: 97616 - protein, 11 aa, Homo Sapiens
SHILEQHPHTL

SEQ ID NO: 97617 - protein, 11 aa, Homo Sapiens
SHIQTSHCEVF

SEQ ID NO: 97618 - protein, 11 aa, Homo Sapiens
SHISTPNVNAL

SEQ ID NO: 97619 - protein, 11 aa, Homo Sapiens
SHITPSTQQHL

SEQ ID NO: 97620 - protein, 11 aa, Homo Sapiens
SHLSPMEMERF

SEQ ID NO: 97621 - protein, 11 aa, Homo Sapiens
SHLSVTEAEML

SEQ ID NO: 97622 - protein, 11 aa, Homo Sapiens
SHLTDQSSNLL

SEQ ID NO: 97623 - protein, 11 aa, Homo Sapiens
SHMGSIREETL

SEQ ID NO: 97624 - protein, 11 aa, Homo Sapiens
SHNEENILQKI

SEQ ID NO: 97625 - protein, 11 aa, Homo Sapiens
SHSLVELLNQI

SEQ ID NO: 97626 - protein, 11 aa, Homo Sapiens
SHSTSQLSQKL

SEQ ID NO: 97627 - protein, 11 aa, Homo Sapiens
SHTSVGNILGS

SEQ ID NO: 97628 - protein, 11 aa, Homo Sapiens
SHVLSKHNNEL

SEQ ID NO: 97629 - protein, 11 aa, Homo Sapiens
SHVPVHPYEAL

SEQ ID NO: 97630 - protein, 11 aa, Homo Sapiens
SHVSESVNNSI

SEQ ID NO: 97631 - protein, 11 aa, Homo Sapiens
SHYEFSDCEKF

SEQ ID NO: 97632 - protein, 11 aa, Homo Sapiens
SHYNSVANETF

SEQ ID NO: 97633 - protein, 11 aa, Homo Sapiens
SQDFSVHGNII

SEQ ID NO: 97634 - protein, 11 aa, Homo Sapiens
SQLALKAADMI

SEQ ID NO: 97635 - protein, 11 aa, Homo Sapiens
SQSPGSSENQM

SEQ ID NO: 97636 - protein, 11 aa, Homo Sapiens
SVLCQFPSQQI

SEQ ID NO: 97637 - protein, 11 aa, Homo Sapiens
TEEESQESNKI

SEQ ID NO: 97638 - protein, 11 aa, Homo Sapiens
THAAEDIVYTL

SEQ ID NO: 97639 - protein, 11 aa, Homo Sapiens
THAAQSWRERL

SEQ ID NO: 97640 - protein, 11 aa, Homo Sapiens
THADTPVDHCL

SEQ ID NO: 97641 - protein, 11 aa, Homo Sapiens
THAEPQEADYL

SEQ ID NO: 97642 - protein, 11 aa, Homo Sapiens
THALVEDGQLL

SEQ ID NO: 97643 - protein, 11 aa, Homo Sapiens
THANDASALRI

SEQ ID NO: 97644 - protein, 11 aa, Homo Sapiens
THAPFGLGAHF

SEQ ID NO: 97645 - protein, 11 aa, Homo Sapiens
THAPLPEVQLL

SEQ ID NO: 97646 - protein, 11 aa, Homo Sapiens
THAPPGEFNEV

SEQ ID NO: 97647 - protein, 11 aa, Homo Sapiens
THAPTHSDYTM

SEQ ID NO: 97648 - protein, 11 aa, Homo Sapiens
THAQISRNNEL

SEQ ID NO: 97649 - protein, 11 aa, Homo Sapiens
THAVVTVPAYF

SEQ ID NO: 97650 - protein, 11 aa, Homo Sapiens
THCIVGATIGF

SEQ ID NO: 97651 - protein, 11 aa, Homo Sapiens
THCTPLPAQNF

SEQ ID NO: 97652 - protein, 11 aa, Homo Sapiens
THCYDPGSNTW

SEQ ID NO: 97653 - protein, 11 aa, Homo Sapiens
THDASGQLVLI

SEQ ID NO: 97654 - protein, 11 aa, Homo Sapiens
THDATALASVV

SEQ ID NO: 97655 - protein, 11 aa, Homo Sapiens
THDERPHGQQI

SEQ ID NO: 97656 - protein, 11 aa, Homo Sapiens
THDGYLKLWQL

SEQ ID NO: 97657 - protein, 11 aa, Homo Sapiens
THDPLHQEVSF

SEQ ID NO: 97658 - protein, 11 aa, Homo Sapiens
THDSNTDMFQI

SEQ ID NO: 97659 - protein, 11 aa, Homo Sapiens
THDTKIELLKF

SEQ ID NO: 97660 - protein, 11 aa, Homo Sapiens
THEALTLKYKL

SEQ ID NO: 97661 - protein, 11 aa, Homo Sapiens
THEAVYPLYTI

SEQ ID NO: 97662 - protein, 11 aa, Homo Sapiens
THEGTSVTNLL

SEQ ID NO: 97663 - protein, 11 aa, Homo Sapiens
THELTIPNNLI

SEQ ID NO: 97664 - protein, 11 aa, Homo Sapiens
THEPISVEVQL

SEQ ID NO: 97665 - protein, 11 aa, Homo Sapiens
THEVDELTQII

SEQ ID NO: 97666 - protein, 11 aa, Homo Sapiens
THEYNEVANLF

SEQ ID NO: 97667 - protein, 11 aa, Homo Sapiens
THFSAGVLQLL

SEQ ID NO: 97668 - protein, 11 aa, Homo Sapiens
THHCPKTPFLL

SEQ ID NO: 97669 - protein, 11 aa, Homo Sapiens
THIGGTSSDEM

SEQ ID NO: 97670 - protein, 11 aa, Homo Sapiens
THIILDNADVL

SEQ ID NO: 97671 - protein, 11 aa, Homo Sapiens
THILALQEEEL

SEQ ID NO: 97672 - protein, 11 aa, Homo Sapiens
THISNDYGNNF

SEQ ID NO: 97673 - protein, 11 aa, Homo Sapiens
THKVIHTGEKL

SEQ ID NO: 97674 - protein, 11 aa, Homo Sapiens
THLDYVDTERI

SEQ ID NO: 97675 - protein, 11 aa, Homo Sapiens
THLGVNMFDKL

SEQ ID NO: 97676 - protein, 11 aa, Homo Sapiens
THLHRVVSELL

SEQ ID NO: 97677 - protein, 11 aa, Homo Sapiens
THLTVSSTNTL

SEQ ID NO: 97678 - protein, 11 aa, Homo Sapiens
THMNSSEKLQF

SEQ ID NO: 97679 - protein, 11 aa, Homo Sapiens
THMTAIVGMAL

SEQ ID NO: 97680 - protein, 11 aa, Homo Sapiens
THNAESPDFQL

SEQ ID NO: 97681 - protein, 11 aa, Homo Sapiens
THQDVHLGETL

SEQ ID NO: 97682 - protein, 11 aa, Homo Sapiens
THQKVTKGVSL

SEQ ID NO: 97683 - protein, 11 aa, Homo Sapiens
THQLPVAEAML

SEQ ID NO: 97684 - protein, 11 aa, Homo Sapiens
THQRIHPGEKL

SEQ ID NO: 97685 - protein, 11 aa, Homo Sapiens
THSDDVTQVRF

SEQ ID NO: 97686 - protein, 11 aa, Homo Sapiens
THSPSNAQFKL

SEQ ID NO: 97687 - protein, 11 aa, Homo Sapiens
THSPYVAQILL

SEQ ID NO: 97688 - protein, 11 aa, Homo Sapiens
THVDILNDFTL

SEQ ID NO: 97689 - protein, 11 aa, Homo Sapiens
THVDSHGHNVF

SEQ ID NO: 97690 - protein, 11 aa, Homo Sapiens
THVENQSANCL

SEQ ID NO: 97691 - protein, 11 aa, Homo Sapiens
THVLEGAGNKL

SEQ ID NO: 97692 - protein, 11 aa, Homo Sapiens
THVSLSTSSNI

SEQ ID NO: 97693 - protein, 11 aa, Homo Sapiens
THVVVYDGEHL

SEQ ID NO: 97694 - protein, 11 aa, Homo Sapiens
TKDDTWKADDL

SEQ ID NO: 97695 - protein, 11 aa, Homo Sapiens
TLIDLPGHESL

SEQ ID NO: 97696 - protein, 11 aa, Homo Sapiens
TLIPHTDGEKL

SEQ ID NO: 97697 - protein, 11 aa, Homo Sapiens
TLQVNGRHEYL

SEQ ID NO: 97698 - protein, 11 aa, Homo Sapiens
TPDGTEKGDFL

SEQ ID NO: 97699 - protein, 11 aa, Homo Sapiens
TQAESAQSNRL

SEQ ID NO: 97700 - protein, 11 aa, Homo Sapiens
TQANPGKGEGL

SEQ ID NO: 97701 - protein, 11 aa, Homo Sapiens
TQDQNSSSWLI

SEQ ID NO: 97702 - protein, 11 aa, Homo Sapiens
TQIQYDKTNVL

SEQ ID NO: 97703 - protein, 11 aa, Homo Sapiens
TRDETDTWAYI

SEQ ID NO: 97704 - protein, 11 aa, Homo Sapiens
TRDTNFGTNCI

SEQ ID NO: 97705 - protein, 11 aa, Homo Sapiens
TRLKEEGNEQF

SEQ ID NO: 97706 - protein, 11 aa, Homo Sapiens
VHDPMAALETL

SEQ ID NO: 97707 - protein, 11 aa, Homo Sapiens
VHDPNHSKMRL

SEQ ID NO: 97708 - protein, 11 aa, Homo Sapiens
VHDPVTGKTKL

SEQ ID NO: 97709 - protein, 11 aa, Homo Sapiens
VHDVTLHADAI

SEQ ID NO: 97710 - protein, 11 aa, Homo Sapiens
VHLAPFTDEQL

SEQ ID NO: 97711 - protein, 11 aa, Homo Sapiens
VHMDPNIGKRL

SEQ ID NO: 97712 - protein, 11 aa, Homo Sapiens
VHQAVKIGQSL

SEQ ID NO: 97713 - protein, 11 aa, Homo Sapiens
VHQGGVELQQL

SEQ ID NO: 97714 - protein, 11 aa, Homo Sapiens
VHSSDLQGNYI

SEQ ID NO: 97715 - protein, 11 aa, Homo Sapiens
VQDATPVSNSL

SEQ ID NO: 97716 - protein, 11 aa, Homo Sapiens
WHDEQGHNGLW

SEQ ID NO: 97717 - protein, 11 aa, Homo Sapiens
WHDIEKDNARF

SEQ ID NO: 97718 - protein, 11 aa, Homo Sapiens
YEIDDRDVNKI

SEQ ID NO: 97719 - protein, 11 aa, Homo Sapiens
YHADFLSEAAL

SEQ ID NO: 97720 - protein, 11 aa, Homo Sapiens
YHAGGSTQNSI

SEQ ID NO: 97721 - protein, 11 aa, Homo Sapiens
YHAPPLSAITF

SEQ ID NO: 97722 - protein, 11 aa, Homo Sapiens
YHAQPLEDNLF

SEQ ID NO: 97723 - protein, 11 aa, Homo Sapiens
YHARPDSDQRF

SEQ ID NO: 97724 - protein, 11 aa, Homo Sapiens
YHDDSYTATGY

SEQ ID NO: 97725 - protein, 11 aa, Homo Sapiens
YHDIAQQAFKF

SEQ ID NO: 97726 - protein, 11 aa, Homo Sapiens
YHDPNFVPAAF

SEQ ID NO: 97727 - protein, 11 aa, Homo Sapiens
YHDPTVKHSTF

SEQ ID NO: 97728 - protein, 11 aa, Homo Sapiens
YHDQQDVTSNF

SEQ ID NO: 97729 - protein, 11 aa, Homo Sapiens
YHEATDSLYVF

SEQ ID NO: 97730 - protein, 11 aa, Homo Sapiens
YHEHGSLFDYL

SEQ ID NO: 97731 - protein, 11 aa, Homo Sapiens
YHLDAYIPLQI

SEQ ID NO: 97732 - protein, 11 aa, Homo Sapiens
YHLENAGCNKI

SEQ ID NO: 97733 - protein, 11 aa, Homo Sapiens
YHLEYSEGESL

SEQ ID NO: 97734 - protein, 11 aa, Homo Sapiens
YHQIGSGKCEI

SEQ ID NO: 97735 - protein, 11 aa, Homo Sapiens
YHSDFNRQDRF

SEQ ID NO: 97736 - protein, 11 aa, Homo Sapiens
YHSDVAYHNSL

SEQ ID NO: 97737 - protein, 11 aa, Homo Sapiens
YHTVAGNDIKI

SEQ ID NO: 97738 - protein, 11 aa, Homo Sapiens
YHTVAIEGNTL

SEQ ID NO: 97739 - protein, 11 aa, Homo Sapiens
YHVESTVNSEL

SEQ ID NO: 97740 - protein, 11 aa, Homo Sapiens
YHVGYILTSVL

SEQ ID NO: 97741 - protein, 11 aa, Homo Sapiens
YHVYIKDVDHL

SEQ ID NO: 97742 - protein, 11 aa, Homo Sapiens
YQLDLPKANLL

SEQ ID NO: 97743 - protein, 8 aa, Homo Sapiens
AEAFAEEL

SEQ ID NO: 97744 - protein, 8 aa, Homo Sapiens
AEQPSVKL

SEQ ID NO: 97745 - protein, 8 aa, Homo Sapiens
AEYGAEAL

SEQ ID NO: 97746 - protein, 8 aa, Homo Sapiens
DPLGAIHL

SEQ ID NO: 97747 - protein, 8 aa, Homo Sapiens
EAHAKVRL

SEQ ID NO: 97748 - protein, 8 aa, Homo Sapiens
EAKEKIYL

SEQ ID NO: 97749 - protein, 8 aa, Homo Sapiens
EDLAHSSI

SEQ ID NO: 97750 - protein, 8 aa, Homo Sapiens
EEQLQQIR

SEQ ID NO: 97751 - protein, 8 aa, Homo Sapiens
EPPVDSEP

SEQ ID NO: 97752 - protein, 8 aa, Homo Sapiens
FEFPEFQL

SEQ ID NO: 97753 - protein, 8 aa, Homo Sapiens
FEGPDAKL

SEQ ID NO: 97754 - protein, 8 aa, Homo Sapiens
FEVDTVAP

SEQ ID NO: 97755 - protein, 8 aa, Homo Sapiens
GEAPPELL

SEQ ID NO: 97756 - protein, 8 aa, Homo Sapiens
GEHYSEKL

SEQ ID NO: 97757 - protein, 8 aa, Homo Sapiens
GEIKSHDL

SEQ ID NO: 97758 - protein, 8 aa, Homo Sapiens
GEIPTYGL

SEQ ID NO: 97759 - protein, 8 aa, Homo Sapiens
GEIRGYEL

SEQ ID NO: 97760 - protein, 8 aa, Homo Sapiens
GELPSWIL

SEQ ID NO: 97761 - protein, 8 aa, Homo Sapiens
GEVPVHKL

SEQ ID NO: 97762 - protein, 8 aa, Homo Sapiens
HEAPAVLL

SEQ ID NO: 97763 - protein, 8 aa, Homo Sapiens
HEDFVVEL

SEQ ID NO: 97764 - protein, 8 aa, Homo Sapiens
HEFHSPAL

SEQ ID NO: 97765 - protein, 8 aa, Homo Sapiens
HEGPTNQL

SEQ ID NO: 97766 - protein, 8 aa, Homo Sapiens
HEHQANLL

SEQ ID NO: 97767 - protein, 8 aa, Homo Sapiens
HEIQSDVL

SEQ ID NO: 97768 - protein, 8 aa, Homo Sapiens
HEQASNVL

SEQ ID NO: 97769 - protein, 8 aa, Homo Sapiens
HETVTIEL

SEQ ID NO: 97770 - protein, 8 aa, Homo Sapiens
IDGNKVTL

SEQ ID NO: 97771 - protein, 8 aa, Homo Sapiens
IEFVADRL

SEQ ID NO: 97772 - protein, 8 aa, Homo Sapiens
IEGPDAKL

SEQ ID NO: 97773 - protein, 8 aa, Homo Sapiens
IEGPIIKL

SEQ ID NO: 97774 - protein, 8 aa, Homo Sapiens
KEAELTEI

SEQ ID NO: 97775 - protein, 8 aa, Homo Sapiens
KELEANVL

SEQ ID NO: 97776 - protein, 8 aa, Homo Sapiens
KIEELRQR

SEQ ID NO: 97777 - protein, 8 aa, Homo Sapiens
LEFPAQEL

SEQ ID NO: 97778 - protein, 8 aa, Homo Sapiens
LGNGNIKL

SEQ ID NO: 97779 - protein, 8 aa, Homo Sapiens
QEADSPTL

SEQ ID NO: 97780 - protein, 8 aa, Homo Sapiens
QEFPAHSL

SEQ ID NO: 97781 - protein, 8 aa, Homo Sapiens
REIEGDLL

SEQ ID NO: 97782 - protein, 8 aa, Homo Sapiens
SDDSILRL

SEQ ID NO: 97783 - protein, 8 aa, Homo Sapiens
SEDRAALL

SEQ ID NO: 97784 - protein, 8 aa, Homo Sapiens
SEIKGEVL

SEQ ID NO: 97785 - protein, 8 aa, Homo Sapiens
SEKVSHVL

SEQ ID NO: 97786 - protein, 8 aa, Homo Sapiens
TETPSPVL

SEQ ID NO: 97787 - protein, 8 aa, Homo Sapiens
TEYPVEKL

SEQ ID NO: 97788 - protein, 8 aa, Homo Sapiens
VDGKQVEL

SEQ ID NO: 97789 - protein, 8 aa, Homo Sapiens
VDVEQHTL

SEQ ID NO: 97790 - protein, 8 aa, Homo Sapiens
VEQPAQEL

SEQ ID NO: 97791 - protein, 8 aa, Homo Sapiens
VERINQAL

SEQ ID NO: 97792 - protein, 8 aa, Homo Sapiens
YEDIAVKL

SEQ ID NO: 97793 - protein, 8 aa, Homo Sapiens
YEDISRGL

SEQ ID NO: 97794 - protein, 8 aa, Homo Sapiens
YESPEIAL

SEQ ID NO: 97795 - protein, 8 aa, Homo Sapiens
YEVKSENL

SEQ ID NO: 97796 - protein, 9 aa, Homo Sapiens
ADFAKVLEL

SEQ ID NO: 97797 - protein, 9 aa, Homo Sapiens
ADHVQSLLL

SEQ ID NO: 97798 - protein, 9 aa, Homo Sapiens
AEAAALEVL

SEQ ID NO: 97799 - protein, 9 aa, Homo Sapiens
AEAAVIEAM

SEQ ID NO: 97800 - protein, 9 aa, Homo Sapiens
AEADAIIQM

SEQ ID NO: 97801 - protein, 9 aa, Homo Sapiens
AEAEAAVGL

SEQ ID NO: 97802 - protein, 9 aa, Homo Sapiens
AEAEERGEL

SEQ ID NO: 97803 - protein, 9 aa, Homo Sapiens
AEAEHKIDL

SEQ ID NO: 97804 - protein, 9 aa, Homo Sapiens
AEAEIILQL

SEQ ID NO: 97805 - protein, 9 aa, Homo Sapiens
AEAEIIQLL

SEQ ID NO: 97806 - protein, 9 aa, Homo Sapiens
AEAEKKVQL

SEQ ID NO: 97807 - protein, 9 aa, Homo Sapiens
AEAGADLVL

SEQ ID NO: 97808 - protein, 9 aa, Homo Sapiens
AEAGGLEEL

SEQ ID NO: 97809 - protein, 9 aa, Homo Sapiens
AEAHAKVRL

SEQ ID NO: 97810 - protein, 9 aa, Homo Sapiens
AEAHARIHL

SEQ ID NO: 97811 - protein, 9 aa, Homo Sapiens
AEAKEKIYL

SEQ ID NO: 97812 - protein, 9 aa, Homo Sapiens
AEAKKIERL

SEQ ID NO: 97813 - protein, 9 aa, Homo Sapiens
AEAKPELSL

SEQ ID NO: 97814 - protein, 9 aa, Homo Sapiens
AEAKSVWAL

SEQ ID NO: 97815 - protein, 9 aa, Homo Sapiens
AEALATHIL

SEQ ID NO: 97816 - protein, 9 aa, Homo Sapiens
AEALEKLFL

SEQ ID NO: 97817 - protein, 9 aa, Homo Sapiens
AEALERMFL

SEQ ID NO: 97818 - protein, 9 aa, Homo Sapiens
AEALKAVLL

SEQ ID NO: 97819 - protein, 9 aa, Homo Sapiens
AEALKKLIL

SEQ ID NO: 97820 - protein, 9 aa, Homo Sapiens
AEANHFIDL

SEQ ID NO: 97821 - protein, 9 aa, Homo Sapiens
AEAPGEAFL

SEQ ID NO: 97822 - protein, 9 aa, Homo Sapiens
AEAPSQVRL

SEQ ID NO: 97823 - protein, 9 aa, Homo Sapiens
AEAQFTTAL

SEQ ID NO: 97824 - protein, 9 aa, Homo Sapiens
AEAQGSTTL

SEQ ID NO: 97825 - protein, 9 aa, Homo Sapiens
AEAQLAYEL

SEQ ID NO: 97826 - protein, 9 aa, Homo Sapiens
AEARINAQL

SEQ ID NO: 97827 - protein, 9 aa, Homo Sapiens
AEARKSPAL

SEQ ID NO: 97828 - protein, 9 aa, Homo Sapiens
AEASMISKL

SEQ ID NO: 97829 - protein, 9 aa, Homo Sapiens
AEASVDPSL

SEQ ID NO: 97830 - protein, 9 aa, Homo Sapiens
AEASVMTQL

SEQ ID NO: 97831 - protein, 9 aa, Homo Sapiens
AEATEEVSL

SEQ ID NO: 97832 - protein, 9 aa, Homo Sapiens
AEAVAALLL

SEQ ID NO: 97833 - protein, 9 aa, Homo Sapiens
AEAVLYEHL

SEQ ID NO: 97834 - protein, 9 aa, Homo Sapiens
AEAVVNDVL

SEQ ID NO: 97835 - protein, 9 aa, Homo Sapiens
AEAYHFFIL

SEQ ID NO: 97836 - protein, 9 aa, Homo Sapiens
AECAGKLFL

SEQ ID NO: 97837 - protein, 9 aa, Homo Sapiens
AECGKVFRL

SEQ ID NO: 97838 - protein, 9 aa, Homo Sapiens
AECRAPISL

SEQ ID NO: 97839 - protein, 9 aa, Homo Sapiens
AEDASKFEL

SEQ ID NO: 97840 - protein, 9 aa, Homo Sapiens
AEDEGTQRL

SEQ ID NO: 97841 - protein, 9 aa, Homo Sapiens
AEDGADPNL

SEQ ID NO: 97842 - protein, 9 aa, Homo Sapiens
AEDKDTPAL

SEQ ID NO: 97843 - protein, 9 aa, Homo Sapiens
AEDKPSTDL

SEQ ID NO: 97844 - protein, 9 aa, Homo Sapiens
AEDNIREML

SEQ ID NO: 97845 - protein, 9 aa, Homo Sapiens
AEDPLVQSL

SEQ ID NO: 97846 - protein, 9 aa, Homo Sapiens
AEDPTISLL

SEQ ID NO: 97847 - protein, 9 aa, Homo Sapiens
AEDTITALL

SEQ ID NO: 97848 - protein, 9 aa, Homo Sapiens
AEDTPVVQL

SEQ ID NO: 97849 - protein, 9 aa, Homo Sapiens
AEDTRLIEL

SEQ ID NO: 97850 - protein, 9 aa, Homo Sapiens
AEDVQHQIL

SEQ ID NO: 97851 - protein, 9 aa, Homo Sapiens
AEDYTESLL

SEQ ID NO: 97852 - protein, 9 aa, Homo Sapiens
AEEALKYLL

SEQ ID NO: 97853 - protein, 9 aa, Homo Sapiens
AEEAPKTPL

SEQ ID NO: 97854 - protein, 9 aa, Homo Sapiens
AEEDFYEKL

SEQ ID NO: 97855 - protein, 9 aa, Homo Sapiens
AEEGGAARL

SEQ ID NO: 97856 - protein, 9 aa, Homo Sapiens
AEEHNIVFM

SEQ ID NO: 97857 - protein, 9 aa, Homo Sapiens
AEEHSIATL

SEQ ID NO: 97858 - protein, 9 aa, Homo Sapiens
AEEKAAQAL

SEQ ID NO: 97859 - protein, 9 aa, Homo Sapiens
AEEKHLHVL

SEQ ID NO: 97860 - protein, 9 aa, Homo Sapiens
AEEKLPMTL

SEQ ID NO: 97861 - protein, 9 aa, Homo Sapiens
AEEKMPLSL

SEQ ID NO: 97862 - protein, 9 aa, Homo Sapiens
AEEKSIPTL

SEQ ID NO: 97863 - protein, 9 aa, Homo Sapiens
AEELLRIGL

SEQ ID NO: 97864 - protein, 9 aa, Homo Sapiens
AEEPAGTSL

SEQ ID NO: 97865 - protein, 9 aa, Homo Sapiens
AEEPHALEL

SEQ ID NO: 97866 - protein, 9 aa, Homo Sapiens
AEEPKARVL

SEQ ID NO: 97867 - protein, 9 aa, Homo Sapiens
AEEPPTPAL

SEQ ID NO: 97868 - protein, 9 aa, Homo Sapiens
AEEPRGSSL

SEQ ID NO: 97869 - protein, 9 aa, Homo Sapiens
AEERACQSL

SEQ ID NO: 97870 - protein, 9 aa, Homo Sapiens
AEEREKTVL

SEQ ID NO: 97871 - protein, 9 aa, Homo Sapiens
AEERPRVAL

SEQ ID NO: 97872 - protein, 9 aa, Homo Sapiens
AEERRDVSL

SEQ ID NO: 97873 - protein, 9 aa, Homo Sapiens
AEERVSFGL

SEQ ID NO: 97874 - protein, 9 aa, Homo Sapiens
AEERWEVVL

SEQ ID NO: 97875 - protein, 9 aa, Homo Sapiens
AEETGVHII

SEQ ID NO: 97876 - protein, 9 aa, Homo Sapiens
AEETSSPVI

SEQ ID NO: 97877 - protein, 9 aa, Homo Sapiens
AEEVGVEHL

SEQ ID NO: 97878 - protein, 9 aa, Homo Sapiens
AEEVTRELL

SEQ ID NO: 97879 - protein, 9 aa, Homo Sapiens
AEFAHHNYL

SEQ ID NO: 97880 - protein, 9 aa, Homo Sapiens
AEFEDLDSL

SEQ ID NO: 97881 - protein, 9 aa, Homo Sapiens
AEFIKFTVI

SEQ ID NO: 97882 - protein, 9 aa, Homo Sapiens
AEFKEAFQL

SEQ ID NO: 97883 - protein, 9 aa, Homo Sapiens
AEFKEAFSL

SEQ ID NO: 97884 - protein, 9 aa, Homo Sapiens
AEFKTKYKL

SEQ ID NO: 97885 - protein, 9 aa, Homo Sapiens
AEFNRIMSL

SEQ ID NO: 97886 - protein, 9 aa, Homo Sapiens
AEFPLDPQL

SEQ ID NO: 97887 - protein, 9 aa, Homo Sapiens
AEFPLEPML

SEQ ID NO: 97888 - protein, 9 aa, Homo Sapiens
AEFQRDIML

SEQ ID NO: 97889 - protein, 9 aa, Homo Sapiens
AEFTAKIAL

SEQ ID NO: 97890 - protein, 9 aa, Homo Sapiens
AEFVGVSHL

SEQ ID NO: 97891 - protein, 9 aa, Homo Sapiens
AEFVSTPEL

SEQ ID NO: 97892 - protein, 9 aa, Homo Sapiens
AEGAYQVRL

SEQ ID NO: 97893 - protein, 9 aa, Homo Sapiens
AEGEIYTKL

SEQ ID NO: 97894 - protein, 9 aa, Homo Sapiens
AEGHTDAVL

SEQ ID NO: 97895 - protein, 9 aa, Homo Sapiens
AEGLLQEAL

SEQ ID NO: 97896 - protein, 9 aa, Homo Sapiens
AEGPGETVL

SEQ ID NO: 97897 - protein, 9 aa, Homo Sapiens
AEGPPAASL

SEQ ID NO: 97898 - protein, 9 aa, Homo Sapiens
AEGPVGSTL

SEQ ID NO: 97899 - protein, 9 aa, Homo Sapiens
AEGPYKIIL

SEQ ID NO: 97900 - protein, 9 aa, Homo Sapiens
AEHADTVQL

SEQ ID NO: 97901 - protein, 9 aa, Homo Sapiens
AEHERELAL

SEQ ID NO: 97902 - protein, 9 aa, Homo Sapiens
AEHGETLAM

SEQ ID NO: 97903 - protein, 9 aa, Homo Sapiens
AEHIESRTL

SEQ ID NO: 97904 - protein, 9 aa, Homo Sapiens
AEHLEKSSL

SEQ ID NO: 97905 - protein, 9 aa, Homo Sapiens
AEHLGDCGL

SEQ ID NO: 97906 - protein, 9 aa, Homo Sapiens
AEHRTPDVL

SEQ ID NO: 97907 - protein, 9 aa, Homo Sapiens
AEHYTETAL

SEQ ID NO: 97908 - protein, 9 aa, Homo Sapiens
AEIAAKDKL

SEQ ID NO: 97909 - protein, 9 aa, Homo Sapiens
AEIAEKETL

SEQ ID NO: 97910 - protein, 9 aa, Homo Sapiens
AEIAQLMSL

SEQ ID NO: 97911 - protein, 9 aa, Homo Sapiens
AEIDSIHQL

SEQ ID NO: 97912 - protein, 9 aa, Homo Sapiens
AEIEDIRVL

SEQ ID NO: 97913 - protein, 9 aa, Homo Sapiens
AEIEEREAL

SEQ ID NO: 97914 - protein, 9 aa, Homo Sapiens
AEIEIVKDL

SEQ ID NO: 97915 - protein, 9 aa, Homo Sapiens
AEIKDGERL

SEQ ID NO: 97916 - protein, 9 aa, Homo Sapiens
AEINDLENL

SEQ ID NO: 97917 - protein, 9 aa, Homo Sapiens
AEINNIIKI

SEQ ID NO: 97918 - protein, 9 aa, Homo Sapiens
AEIPLVVCI

SEQ ID NO: 97919 - protein, 9 aa, Homo Sapiens
AEISQPPAL

SEQ ID NO: 97920 - protein, 9 aa, Homo Sapiens
AEITDKLGL

SEQ ID NO: 97921 - protein, 9 aa, Homo Sapiens
AEITKEQRL

SEQ ID NO: 97922 - protein, 9 aa, Homo Sapiens
AEITSGESL

SEQ ID NO: 97923 - protein, 9 aa, Homo Sapiens
AEKAYHEQL

SEQ ID NO: 97924 - protein, 9 aa, Homo Sapiens
AEKIQTIIL

SEQ ID NO: 97925 - protein, 9 aa, Homo Sapiens
AEKPVGALL

SEQ ID NO: 97926 - protein, 9 aa, Homo Sapiens
AEKSEQPTL

SEQ ID NO: 97927 - protein, 9 aa, Homo Sapiens
AEKVEIATL

SEQ ID NO: 97928 - protein, 9 aa, Homo Sapiens
AELAEEVNL

SEQ ID NO: 97929 - protein, 9 aa, Homo Sapiens
AELAVPIEL

SEQ ID NO: 97930 - protein, 9 aa, Homo Sapiens
AELERNVAL

SEQ ID NO: 97931 - protein, 9 aa, Homo Sapiens
AELGSSTSL

SEQ ID NO: 97932 - protein, 9 aa, Homo Sapiens
AELILHDAL

SEQ ID NO: 97933 - protein, 9 aa, Homo Sapiens
AELKNLEVL

SEQ ID NO: 97934 - protein, 9 aa, Homo Sapiens
AELKQAQTL

SEQ ID NO: 97935 - protein, 9 aa, Homo Sapiens
AELKQVQTL

SEQ ID NO: 97936 - protein, 9 aa, Homo Sapiens
AELMKVQAL

SEQ ID NO: 97937 - protein, 9 aa, Homo Sapiens
AELNKIFAL

SEQ ID NO: 97938 - protein, 9 aa, Homo Sapiens
AELPLRLFL

SEQ ID NO: 97939 - protein, 9 aa, Homo Sapiens
AELQHCWAL

SEQ ID NO: 97940 - protein, 9 aa, Homo Sapiens
AELQPTESL

SEQ ID NO: 97941 - protein, 9 aa, Homo Sapiens
AELRSTASL

SEQ ID NO: 97942 - protein, 9 aa, Homo Sapiens
AELTGDHQL

SEQ ID NO: 97943 - protein, 9 aa, Homo Sapiens
AELVPSEVL

SEQ ID NO: 97944 - protein, 9 aa, Homo Sapiens
AEMAMKVEL

SEQ ID NO: 97945 - protein, 9 aa, Homo Sapiens
AEMILKVVM

SEQ ID NO: 97946 - protein, 9 aa, Homo Sapiens
AEMLHNVTL

SEQ ID NO: 97947 - protein, 9 aa, Homo Sapiens
AEMPEKGAL

SEQ ID NO: 97948 - protein, 9 aa, Homo Sapiens
AENAGSYSL

SEQ ID NO: 97949 - protein, 9 aa, Homo Sapiens
AENGLTVRL

SEQ ID NO: 97950 - protein, 9 aa, Homo Sapiens
AENIPENPL

SEQ ID NO: 97951 - protein, 9 aa, Homo Sapiens
AENKDEIAL

SEQ ID NO: 97952 - protein, 9 aa, Homo Sapiens
AENPDTPAL

SEQ ID NO: 97953 - protein, 9 aa, Homo Sapiens
AEPAEALVL

SEQ ID NO: 97954 - protein, 9 aa, Homo Sapiens
AEPDIIEQL

SEQ ID NO: 97955 - protein, 9 aa, Homo Sapiens
AEPEDHYFL

SEQ ID NO: 97956 - protein, 9 aa, Homo Sapiens
AEPEEVEVL

SEQ ID NO: 97957 - protein, 9 aa, Homo Sapiens
AEPILPYAL

SEQ ID NO: 97958 - protein, 9 aa, Homo Sapiens
AEPKLAFVI

SEQ ID NO: 97959 - protein, 9 aa, Homo Sapiens
AEPPLTAVL

SEQ ID NO: 97960 - protein, 9 aa, Homo Sapiens
AEPTIVAQL

SEQ ID NO: 97961 - protein, 9 aa, Homo Sapiens
AEQATKSVL

SEQ ID NO: 97962 - protein, 9 aa, Homo Sapiens
AEQDLVQTL

SEQ ID NO: 97963 - protein, 9 aa, Homo Sapiens
AEQIGCVEL

SEQ ID NO: 97964 - protein, 9 aa, Homo Sapiens
AEQKVEYTL

SEQ ID NO: 97965 - protein, 9 aa, Homo Sapiens
AEQPTPQAL

SEQ ID NO: 97966 - protein, 9 aa, Homo Sapiens
AEQVDAVTL

SEQ ID NO: 97967 - protein, 9 aa, Homo Sapiens
AESAPAWRL

SEQ ID NO: 97968 - protein, 9 aa, Homo Sapiens
AESDGSFLL

SEQ ID NO: 97969 - protein, 9 aa, Homo Sapiens
AESDKPVVI

SEQ ID NO: 97970 - protein, 9 aa, Homo Sapiens
AESDTSPVL

SEQ ID NO: 97971 - protein, 9 aa, Homo Sapiens
AESGAKEEL

SEQ ID NO: 97972 - protein, 9 aa, Homo Sapiens
AESGCKIQI

SEQ ID NO: 97973 - protein, 9 aa, Homo Sapiens
AESHIILVL

SEQ ID NO: 97974 - protein, 9 aa, Homo Sapiens
AESIISPSL

SEQ ID NO: 97975 - protein, 9 aa, Homo Sapiens
AESISLLEL

SEQ ID NO: 97976 - protein, 9 aa, Homo Sapiens
AESLPPPTL

SEQ ID NO: 97977 - protein, 9 aa, Homo Sapiens
AESLVAEGL

SEQ ID NO: 97978 - protein, 9 aa, Homo Sapiens
AESPERVLL

SEQ ID NO: 97979 - protein, 9 aa, Homo Sapiens
AESPSFLSL

SEQ ID NO: 97980 - protein, 9 aa, Homo Sapiens
AESPTPQAL

SEQ ID NO: 97981 - protein, 9 aa, Homo Sapiens
AESRALAQL

SEQ ID NO: 97982 - protein, 9 aa, Homo Sapiens
AESVEEYVL

SEQ ID NO: 97983 - protein, 9 aa, Homo Sapiens
AETAEAVEL

SEQ ID NO: 97984 - protein, 9 aa, Homo Sapiens
AETEKQVAL

SEQ ID NO: 97985 - protein, 9 aa, Homo Sapiens
AETEVEQAL

SEQ ID NO: 97986 - protein, 9 aa, Homo Sapiens
AETFHTPSL

SEQ ID NO: 97987 - protein, 9 aa, Homo Sapiens
AETGKVVII

SEQ ID NO: 97988 - protein, 9 aa, Homo Sapiens
AETHDATAL

SEQ ID NO: 97989 - protein, 9 aa, Homo Sapiens
AETIIKDCL

SEQ ID NO: 97990 - protein, 9 aa, Homo Sapiens
AETLYKEIL

SEQ ID NO: 97991 - protein, 9 aa, Homo Sapiens
AETRAGLTL

SEQ ID NO: 97992 - protein, 9 aa, Homo Sapiens
AETRESTQL

SEQ ID NO: 97993 - protein, 9 aa, Homo Sapiens
AETRVGSAL

SEQ ID NO: 97994 - protein, 9 aa, Homo Sapiens
AETVDPASL

SEQ ID NO: 97995 - protein, 9 aa, Homo Sapiens
AEVAGQFVI

SEQ ID NO: 97996 - protein, 9 aa, Homo Sapiens
AEVDKNIEL

SEQ ID NO: 97997 - protein, 9 aa, Homo Sapiens
AEVDKVARL

SEQ ID NO: 97998 - protein, 9 aa, Homo Sapiens
AEVDPDTIL

SEQ ID NO: 97999 - protein, 9 aa, Homo Sapiens
AEVDTRESL

SEQ ID NO: 98000 - protein, 9 aa, Homo Sapiens
AEVEKQTSL

SEQ ID NO: 98001 - protein, 9 aa, Homo Sapiens
AEVEPGVHL

SEQ ID NO: 98002 - protein, 9 aa, Homo Sapiens
AEVETGDKL

SEQ ID NO: 98003 - protein, 9 aa, Homo Sapiens
AEVGIIESI

SEQ ID NO: 98004 - protein, 9 aa, Homo Sapiens
AEVHSEEAL

SEQ ID NO: 98005 - protein, 9 aa, Homo Sapiens
AEVKERVTL

SEQ ID NO: 98006 - protein, 9 aa, Homo Sapiens
AEVLNKHSL

SEQ ID NO: 98007 - protein, 9 aa, Homo Sapiens
AEVLRTMEL

SEQ ID NO: 98008 - protein, 9 aa, Homo Sapiens
AEVPESVFL

SEQ ID NO: 98009 - protein, 9 aa, Homo Sapiens
AEVRVCTVL

SEQ ID NO: 98010 - protein, 9 aa, Homo Sapiens
AEVVPTEGL

SEQ ID NO: 98011 - protein, 9 aa, Homo Sapiens
AEYIRTEML

SEQ ID NO: 98012 - protein, 9 aa, Homo Sapiens
AEYPEGFEI

SEQ ID NO: 98013 - protein, 9 aa, Homo Sapiens
AEYQDLTFL

SEQ ID NO: 98014 - protein, 9 aa, Homo Sapiens
AEYRLGPLL

SEQ ID NO: 98015 - protein, 9 aa, Homo Sapiens
AEYTAKIAL

SEQ ID NO: 98016 - protein, 9 aa, Homo Sapiens
DAVTKTVGL

SEQ ID NO: 98017 - protein, 9 aa, Homo Sapiens
DEIPETVSL

SEQ ID NO: 98018 - protein, 9 aa, Homo Sapiens
DTRGLKAEL

SEQ ID NO: 98019 - protein, 9 aa, Homo Sapiens
EDKKITVLL

SEQ ID NO: 98020 - protein, 9 aa, Homo Sapiens
EEAPVQPIL

SEQ ID NO: 98021 - protein, 9 aa, Homo Sapiens
EECRLIIHL

SEQ ID NO: 98022 - protein, 9 aa, Homo Sapiens
EEEKRNPAL

SEQ ID NO: 98023 - protein, 9 aa, Homo Sapiens
EEENSKVEL

SEQ ID NO: 98024 - protein, 9 aa, Homo Sapiens
EEEPGIHSL

SEQ ID NO: 98025 - protein, 9 aa, Homo Sapiens
EEEPLHTIL

SEQ ID NO: 98026 - protein, 9 aa, Homo Sapiens
EEKAAVTSL

SEQ ID NO: 98027 - protein, 9 aa, Homo Sapiens
EELGLVTHL

SEQ ID NO: 98028 - protein, 9 aa, Homo Sapiens
EENPEFTSL

SEQ ID NO: 98029 - protein, 9 aa, Homo Sapiens
EESAARVVL

SEQ ID NO: 98030 - protein, 9 aa, Homo Sapiens
EESGAQLLL

SEQ ID NO: 98031 - protein, 9 aa, Homo Sapiens
EESQIRIEL

SEQ ID NO: 98032 - protein, 9 aa, Homo Sapiens
EEVGLFNEL

SEQ ID NO: 98033 - protein, 9 aa, Homo Sapiens
EEVKDRCTL

SEQ ID NO: 98034 - protein, 9 aa, Homo Sapiens
EEVQEFHQL

SEQ ID NO: 98035 - protein, 9 aa, Homo Sapiens
EEYGGTWEL

SEQ ID NO: 98036 - protein, 9 aa, Homo Sapiens
EGEAVPVAI

SEQ ID NO: 98037 - protein, 9 aa, Homo Sapiens
EIEERGVKL

SEQ ID NO: 98038 - protein, 9 aa, Homo Sapiens
EIISEISKL

SEQ ID NO: 98039 - protein, 9 aa, Homo Sapiens
EIKDLEEQL

SEQ ID NO: 98040 - protein, 9 aa, Homo Sapiens
EISTPVTIS

SEQ ID NO: 98041 - protein, 9 aa, Homo Sapiens
ELIEGEREL

SEQ ID NO: 98042 - protein, 9 aa, Homo Sapiens
ELQSTGRLL

SEQ ID NO: 98043 - protein, 9 aa, Homo Sapiens
EMEKGSPSL

SEQ ID NO: 98044 - protein, 9 aa, Homo Sapiens
ENITKQVEI

SEQ ID NO: 98045 - protein, 9 aa, Homo Sapiens
EPNFPEILL

SEQ ID NO: 98046 - protein, 9 aa, Homo Sapiens
EQLNEQLVT

SEQ ID NO: 98047 - protein, 9 aa, Homo Sapiens
ESMVELLDL

SEQ ID NO: 98048 - protein, 9 aa, Homo Sapiens
EVDGKQVEL

SEQ ID NO: 98049 - protein, 9 aa, Homo Sapiens
FEAACPASL

SEQ ID NO: 98050 - protein, 9 aa, Homo Sapiens
FEAPDQKTL

SEQ ID NO: 98051 - protein, 9 aa, Homo Sapiens
FEAQGKPEL

SEQ ID NO: 98052 - protein, 9 aa, Homo Sapiens
FEDAAEIRL

SEQ ID NO: 98053 - protein, 9 aa, Homo Sapiens
FEDEKPALL

SEQ ID NO: 98054 - protein, 9 aa, Homo Sapiens
FEDESEGLL

SEQ ID NO: 98055 - protein, 9 aa, Homo Sapiens
FEDGQKIVV

SEQ ID NO: 98056 - protein, 9 aa, Homo Sapiens
FEDHNPPQL

SEQ ID NO: 98057 - protein, 9 aa, Homo Sapiens
FEDKSAYAL

SEQ ID NO: 98058 - protein, 9 aa, Homo Sapiens
FEDSFSSIL

SEQ ID NO: 98059 - protein, 9 aa, Homo Sapiens
FEDVGRQVL

SEQ ID NO: 98060 - protein, 9 aa, Homo Sapiens
FEEAERTYL

SEQ ID NO: 98061 - protein, 9 aa, Homo Sapiens
FEEDPEISL

SEQ ID NO: 98062 - protein, 9 aa, Homo Sapiens
FEEGKKISL

SEQ ID NO: 98063 - protein, 9 aa, Homo Sapiens
FEENTQHLL

SEQ ID NO: 98064 - protein, 9 aa, Homo Sapiens
FEFEYQTKV

SEQ ID NO: 98065 - protein, 9 aa, Homo Sapiens
FEFGGPEVL

SEQ ID NO: 98066 - protein, 9 aa, Homo Sapiens
FEFPNKVVL

SEQ ID NO: 98067 - protein, 9 aa, Homo Sapiens
FEHHGQVRL

SEQ ID NO: 98068 - protein, 9 aa, Homo Sapiens
FEIPIKVRL

SEQ ID NO: 98069 - protein, 9 aa, Homo Sapiens
FEITPPVVL

SEQ ID NO: 98070 - protein, 9 aa, Homo Sapiens
FEITQPPLL

SEQ ID NO: 98071 - protein, 9 aa, Homo Sapiens
FEKEETFTL

SEQ ID NO: 98072 - protein, 9 aa, Homo Sapiens
FELEKSESL

SEQ ID NO: 98073 - protein, 9 aa, Homo Sapiens
FEMATRAAL

SEQ ID NO: 98074 - protein, 9 aa, Homo Sapiens
FEMKELPQL

SEQ ID NO: 98075 - protein, 9 aa, Homo Sapiens
FEMPYVVRL

SEQ ID NO: 98076 - protein, 9 aa, Homo Sapiens
FEQQMVEKL

SEQ ID NO: 98077 - protein, 9 aa, Homo Sapiens
FESDLHSLL

SEQ ID NO: 98078 - protein, 9 aa, Homo Sapiens
FESEKEIEL

SEQ ID NO: 98079 - protein, 9 aa, Homo Sapiens
FESGISQAL

SEQ ID NO: 98080 - protein, 9 aa, Homo Sapiens
FESQDTVAL

SEQ ID NO: 98081 - protein, 9 aa, Homo Sapiens
FESQSEDEL

SEQ ID NO: 98082 - protein, 9 aa, Homo Sapiens
FESSPDPEL

SEQ ID NO: 98083 - protein, 9 aa, Homo Sapiens
FETEVDKIL

SEQ ID NO: 98084 - protein, 9 aa, Homo Sapiens
FETFNTPAM

SEQ ID NO: 98085 - protein, 9 aa, Homo Sapiens
FETPTEISL

SEQ ID NO: 98086 - protein, 9 aa, Homo Sapiens
FEVDSRVYL

SEQ ID NO: 98087 - protein, 9 aa, Homo Sapiens
FEVEKQALL

SEQ ID NO: 98088 - protein, 9 aa, Homo Sapiens
FEVETPAVL

SEQ ID NO: 98089 - protein, 9 aa, Homo Sapiens
FEVGKKICL

SEQ ID NO: 98090 - protein, 9 aa, Homo Sapiens
FEVNIPTDL

SEQ ID NO: 98091 - protein, 9 aa, Homo Sapiens
FEWAKNSPL

SEQ ID NO: 98092 - protein, 9 aa, Homo Sapiens
FSGANKEKL

SEQ ID NO: 98093 - protein, 9 aa, Homo Sapiens
GEAAKREIL

SEQ ID NO: 98094 - protein, 9 aa, Homo Sapiens
GEADPSIQL

SEQ ID NO: 98095 - protein, 9 aa, Homo Sapiens
GEAEKGAVL

SEQ ID NO: 98096 - protein, 9 aa, Homo Sapiens
GEAEVRTLL

SEQ ID NO: 98097 - protein, 9 aa, Homo Sapiens
GEAEYVVAL

SEQ ID NO: 98098 - protein, 9 aa, Homo Sapiens
GEAGPGRAL

SEQ ID NO: 98099 - protein, 9 aa, Homo Sapiens
GEAGPIHHL

SEQ ID NO: 98100 - protein, 9 aa, Homo Sapiens
GEAGSDVSL

SEQ ID NO: 98101 - protein, 9 aa, Homo Sapiens
GEAGSITHL

SEQ ID NO: 98102 - protein, 9 aa, Homo Sapiens
GEAHLKTIL

SEQ ID NO: 98103 - protein, 9 aa, Homo Sapiens
GEALGFVSL

SEQ ID NO: 98104 - protein, 9 aa, Homo Sapiens
GEANEEFAL

SEQ ID NO: 98105 - protein, 9 aa, Homo Sapiens
GEANVMKAL

SEQ ID NO: 98106 - protein, 9 aa, Homo Sapiens
GEAPVLIMI

SEQ ID NO: 98107 - protein, 9 aa, Homo Sapiens
GEAQSKETL

SEQ ID NO: 98108 - protein, 9 aa, Homo Sapiens
GEARKTEVL

SEQ ID NO: 98109 - protein, 9 aa, Homo Sapiens
GEARVGSEL

SEQ ID NO: 98110 - protein, 9 aa, Homo Sapiens
GEASFPVMV

SEQ ID NO: 98111 - protein, 9 aa, Homo Sapiens
GEAVDRSLL

SEQ ID NO: 98112 - protein, 9 aa, Homo Sapiens
GECGKAFTL

SEQ ID NO: 98113 - protein, 9 aa, Homo Sapiens
GECNPDLRL

SEQ ID NO: 98114 - protein, 9 aa, Homo Sapiens
GECRGVIAL

SEQ ID NO: 98115 - protein, 9 aa, Homo Sapiens
GECVADTQL

SEQ ID NO: 98116 - protein, 9 aa, Homo Sapiens
GEDDKMPPL

SEQ ID NO: 98117 - protein, 9 aa, Homo Sapiens
GEDEPLHAL

SEQ ID NO: 98118 - protein, 9 aa, Homo Sapiens
GEDHPEMAL

SEQ ID NO: 98119 - protein, 9 aa, Homo Sapiens
GEDIPREML

SEQ ID NO: 98120 - protein, 9 aa, Homo Sapiens
GEDKGGYVI

SEQ ID NO: 98121 - protein, 9 aa, Homo Sapiens
GEDKGIKAL

SEQ ID NO: 98122 - protein, 9 aa, Homo Sapiens
GEDLEKVTL

SEQ ID NO: 98123 - protein, 9 aa, Homo Sapiens
GEDLPTIVI

SEQ ID NO: 98124 - protein, 9 aa, Homo Sapiens
GEDMTPTLL

SEQ ID NO: 98125 - protein, 9 aa, Homo Sapiens
GEDPTSVAI

SEQ ID NO: 98126 - protein, 9 aa, Homo Sapiens
GEDSRPPRL

SEQ ID NO: 98127 - protein, 9 aa, Homo Sapiens
GEDTLMEYL

SEQ ID NO: 98128 - protein, 9 aa, Homo Sapiens
GEDTPVTKL

SEQ ID NO: 98129 - protein, 9 aa, Homo Sapiens
GEDVRSALL

SEQ ID NO: 98130 - protein, 9 aa, Homo Sapiens
GEEAKPIIL

SEQ ID NO: 98131 - protein, 9 aa, Homo Sapiens
GEEARVTQL

SEQ ID NO: 98132 - protein, 9 aa, Homo Sapiens
GEEAVPVAL

SEQ ID NO: 98133 - protein, 9 aa, Homo Sapiens
GEEEDGPVL

SEQ ID NO: 98134 - protein, 9 aa, Homo Sapiens
GEEEKKIFL

SEQ ID NO: 98135 - protein, 9 aa, Homo Sapiens
GEEELASKL

SEQ ID NO: 98136 - protein, 9 aa, Homo Sapiens
GEEGYGRSL

SEQ ID NO: 98137 - protein, 9 aa, Homo Sapiens
GEEILITVL

SEQ ID NO: 98138 - protein, 9 aa, Homo Sapiens
GEEKEAATL

SEQ ID NO: 98139 - protein, 9 aa, Homo Sapiens
GEEKLKEIL

SEQ ID NO: 98140 - protein, 9 aa, Homo Sapiens
GEELLHSVL

SEQ ID NO: 98141 - protein, 9 aa, Homo Sapiens
GEENGAHTI

SEQ ID NO: 98142 - protein, 9 aa, Homo Sapiens
GEENQVLEL

SEQ ID NO: 98143 - protein, 9 aa, Homo Sapiens
GEEPAGICL

SEQ ID NO: 98144 - protein, 9 aa, Homo Sapiens
GEEPGSQGL

SEQ ID NO: 98145 - protein, 9 aa, Homo Sapiens
GEEQNKEAL

SEQ ID NO: 98146 - protein, 9 aa, Homo Sapiens
GEEQNRVQL

SEQ ID NO: 98147 - protein, 9 aa, Homo Sapiens
GEEVEVHNL

SEQ ID NO: 98148 - protein, 9 aa, Homo Sapiens
GEFADPFKL

SEQ ID NO: 98149 - protein, 9 aa, Homo Sapiens
GEFEKIMQL

SEQ ID NO: 98150 - protein, 9 aa, Homo Sapiens
GEFGEIEAI

SEQ ID NO: 98151 - protein, 9 aa, Homo Sapiens
GEFQELMKL

SEQ ID NO: 98152 - protein, 9 aa, Homo Sapiens
GEFRAVTEL

SEQ ID NO: 98153 - protein, 9 aa, Homo Sapiens
GEFSASPML

SEQ ID NO: 98154 - protein, 9 aa, Homo Sapiens
GEFSEPVTL

SEQ ID NO: 98155 - protein, 9 aa, Homo Sapiens
GEGAPAWVL

SEQ ID NO: 98156 - protein, 9 aa, Homo Sapiens
GEGDLSCIL

SEQ ID NO: 98157 - protein, 9 aa, Homo Sapiens
GEGKPTPAL

SEQ ID NO: 98158 - protein, 9 aa, Homo Sapiens
GEGPLDVRL

SEQ ID NO: 98159 - protein, 9 aa, Homo Sapiens
GEGSGVEIL

SEQ ID NO: 98160 - protein, 9 aa, Homo Sapiens
GEGTGEVVL

SEQ ID NO: 98161 - protein, 9 aa, Homo Sapiens
GEHCDFTIL

SEQ ID NO: 98162 - protein, 9 aa, Homo Sapiens
GEHGLIIRV

SEQ ID NO: 98163 - protein, 9 aa, Homo Sapiens
GEHHSTPSL

SEQ ID NO: 98164 - protein, 9 aa, Homo Sapiens
GEHLKTDLL

SEQ ID NO: 98165 - protein, 9 aa, Homo Sapiens
GEHLVSVTL

SEQ ID NO: 98166 - protein, 9 aa, Homo Sapiens
GEHTLLVTV

SEQ ID NO: 98167 - protein, 9 aa, Homo Sapiens
GEHVKAIEI

SEQ ID NO: 98168 - protein, 9 aa, Homo Sapiens
GEIEECEVL

SEQ ID NO: 98169 - protein, 9 aa, Homo Sapiens
GEIGTKTTL

SEQ ID NO: 98170 - protein, 9 aa, Homo Sapiens
GEIINTHTL

SEQ ID NO: 98171 - protein, 9 aa, Homo Sapiens
GEIKHVSSL

SEQ ID NO: 98172 - protein, 9 aa, Homo Sapiens
GEIPVQEHL

SEQ ID NO: 98173 - protein, 9 aa, Homo Sapiens
GEIQAGAKL

SEQ ID NO: 98174 - protein, 9 aa, Homo Sapiens
GEIRTITVV

SEQ ID NO: 98175 - protein, 9 aa, Homo Sapiens
GEISEKAKL

SEQ ID NO: 98176 - protein, 9 aa, Homo Sapiens
GEISQEEVL

SEQ ID NO: 98177 - protein, 9 aa, Homo Sapiens
GEITGEVRM

SEQ ID NO: 98178 - protein, 9 aa, Homo Sapiens
GEIVEKIGV

SEQ ID NO: 98179 - protein, 9 aa, Homo Sapiens
GEKKDEVYL

SEQ ID NO: 98180 - protein, 9 aa, Homo Sapiens
GEKNVFEAL

SEQ ID NO: 98181 - protein, 9 aa, Homo Sapiens
GEKSGIEIL

SEQ ID NO: 98182 - protein, 9 aa, Homo Sapiens
GEKSQAPTL

SEQ ID NO: 98183 - protein, 9 aa, Homo Sapiens
GELAPSHGL

SEQ ID NO: 98184 - protein, 9 aa, Homo Sapiens
GELARAVVL

SEQ ID NO: 98185 - protein, 9 aa, Homo Sapiens
GELDHVVEI

SEQ ID NO: 98186 - protein, 9 aa, Homo Sapiens
GELEKDPKL

SEQ ID NO: 98187 - protein, 9 aa, Homo Sapiens
GELEYATKI

SEQ ID NO: 98188 - protein, 9 aa, Homo Sapiens
GELFSSPHL

SEQ ID NO: 98189 - protein, 9 aa, Homo Sapiens
GELHGHFML

SEQ ID NO: 98190 - protein, 9 aa, Homo Sapiens
GELIRPTTL

SEQ ID NO: 98191 - protein, 9 aa, Homo Sapiens
GELITQREL

SEQ ID NO: 98192 - protein, 9 aa, Homo Sapiens
GELKIAYQL

SEQ ID NO: 98193 - protein, 9 aa, Homo Sapiens
GELLMHPVL

SEQ ID NO: 98194 - protein, 9 aa, Homo Sapiens
GELQKAIDL

SEQ ID NO: 98195 - protein, 9 aa, Homo Sapiens
GELSIQPSL

SEQ ID NO: 98196 - protein, 9 aa, Homo Sapiens
GELSLPVHL

SEQ ID NO: 98197 - protein, 9 aa, Homo Sapiens
GELTDLHGL

SEQ ID NO: 98198 - protein, 9 aa, Homo Sapiens
GEMEHSAAL

SEQ ID NO: 98199 - protein, 9 aa, Homo Sapiens
GEMERDCQI

SEQ ID NO: 98200 - protein, 9 aa, Homo Sapiens
GEMKFQWDL

SEQ ID NO: 98201 - protein, 9 aa, Homo Sapiens
GEMREMQQL

SEQ ID NO: 98202 - protein, 9 aa, Homo Sapiens
GEMRNAVCI

SEQ ID NO: 98203 - protein, 9 aa, Homo Sapiens
GEMVALPPV

SEQ ID NO: 98204 - protein, 9 aa, Homo Sapiens
GENEDLLKL

SEQ ID NO: 98205 - protein, 9 aa, Homo Sapiens
GENLPTIIL

SEQ ID NO: 98206 - protein, 9 aa, Homo Sapiens
GENRGPILL

SEQ ID NO: 98207 - protein, 9 aa, Homo Sapiens
GENSRNSIL

SEQ ID NO: 98208 - protein, 9 aa, Homo Sapiens
GENVEKQQL

SEQ ID NO: 98209 - protein, 9 aa, Homo Sapiens
GEPDHNEAL

SEQ ID NO: 98210 - protein, 9 aa, Homo Sapiens
GEPENTYIL

SEQ ID NO: 98211 - protein, 9 aa, Homo Sapiens
GEPFASHSL

SEQ ID NO: 98212 - protein, 9 aa, Homo Sapiens
GEPHSSPEL

SEQ ID NO: 98213 - protein, 9 aa, Homo Sapiens
GEPMNFVHL

SEQ ID NO: 98214 - protein, 9 aa, Homo Sapiens
GEPNIDSPL

SEQ ID NO: 98215 - protein, 9 aa, Homo Sapiens
GEPSLYNSL

SEQ ID NO: 98216 - protein, 9 aa, Homo Sapiens
GEQPLQPVL

SEQ ID NO: 98217 - protein, 9 aa, Homo Sapiens
GEQREPETL

SEQ ID NO: 98218 - protein, 9 aa, Homo Sapiens
GEQSPNVSL

SEQ ID NO: 98219 - protein, 9 aa, Homo Sapiens
GESATLRSL

SEQ ID NO: 98220 - protein, 9 aa, Homo Sapiens
GESEKLVRL

SEQ ID NO: 98221 - protein, 9 aa, Homo Sapiens
GESGKSTFI

SEQ ID NO: 98222 - protein, 9 aa, Homo Sapiens
GESILPTTL

SEQ ID NO: 98223 - protein, 9 aa, Homo Sapiens
GESKYLMAL

SEQ ID NO: 98224 - protein, 9 aa, Homo Sapiens
GESLVREPL

SEQ ID NO: 98225 - protein, 9 aa, Homo Sapiens
GESQTDIEI

SEQ ID NO: 98226 - protein, 9 aa, Homo Sapiens
GESRVPLTL

SEQ ID NO: 98227 - protein, 9 aa, Homo Sapiens
GESSLSPSL

SEQ ID NO: 98228 - protein, 9 aa, Homo Sapiens
GESVTKLTL

SEQ ID NO: 98229 - protein, 9 aa, Homo Sapiens
GETAFAFHL

SEQ ID NO: 98230 - protein, 9 aa, Homo Sapiens
GETEESEKL

SEQ ID NO: 98231 - protein, 9 aa, Homo Sapiens
GETGKGTLL

SEQ ID NO: 98232 - protein, 9 aa, Homo Sapiens
GETKAKVLL

SEQ ID NO: 98233 - protein, 9 aa, Homo Sapiens
GETLGIIGL

SEQ ID NO: 98234 - protein, 9 aa, Homo Sapiens
GETLPEQHL

SEQ ID NO: 98235 - protein, 9 aa, Homo Sapiens
GETNDFELL

SEQ ID NO: 98236 - protein, 9 aa, Homo Sapiens
GETPEAAAL

SEQ ID NO: 98237 - protein, 9 aa, Homo Sapiens
GETPQVAVI

SEQ ID NO: 98238 - protein, 9 aa, Homo Sapiens
GETQDFHSL

SEQ ID NO: 98239 - protein, 9 aa, Homo Sapiens
GETQKTISL

SEQ ID NO: 98240 - protein, 9 aa, Homo Sapiens
GETSDIYVL

SEQ ID NO: 98241 - protein, 9 aa, Homo Sapiens
GETSIAECL

SEQ ID NO: 98242 - protein, 9 aa, Homo Sapiens
GETSTDLKL

SEQ ID NO: 98243 - protein, 9 aa, Homo Sapiens
GETSTVEKL

SEQ ID NO: 98244 - protein, 9 aa, Homo Sapiens
GEVDLPSEL

SEQ ID NO: 98245 - protein, 9 aa, Homo Sapiens
GEVDPKVAL

SEQ ID NO: 98246 - protein, 9 aa, Homo Sapiens
GEVGATSAL

SEQ ID NO: 98247 - protein, 9 aa, Homo Sapiens
GEVGHHIDL

SEQ ID NO: 98248 - protein, 9 aa, Homo Sapiens
GEVGSEVHL

SEQ ID NO: 98249 - protein, 9 aa, Homo Sapiens
GEVKDFPDL

SEQ ID NO: 98250 - protein, 9 aa, Homo Sapiens
GEVLEKSLL

SEQ ID NO: 98251 - protein, 9 aa, Homo Sapiens
GEVLIDTHL

SEQ ID NO: 98252 - protein, 9 aa, Homo Sapiens
GEVNVLDNL

SEQ ID NO: 98253 - protein, 9 aa, Homo Sapiens
GEVPFNHEI

SEQ ID NO: 98254 - protein, 9 aa, Homo Sapiens
GEVPKFKAL

SEQ ID NO: 98255 - protein, 9 aa, Homo Sapiens
GEVPTIESL

SEQ ID NO: 98256 - protein, 9 aa, Homo Sapiens
GEVREDLRL

SEQ ID NO: 98257 - protein, 9 aa, Homo Sapiens
GEVRLGGSL

SEQ ID NO: 98258 - protein, 9 aa, Homo Sapiens
GEVSARQEL

SEQ ID NO: 98259 - protein, 9 aa, Homo Sapiens
GEVTDFLRL

SEQ ID NO: 98260 - protein, 9 aa, Homo Sapiens
GEVTKQTVL

SEQ ID NO: 98261 - protein, 9 aa, Homo Sapiens
GEVTYVELL

SEQ ID NO: 98262 - protein, 9 aa, Homo Sapiens
GEVVDCVIM

SEQ ID NO: 98263 - protein, 9 aa, Homo Sapiens
GEVVGKFYL

SEQ ID NO: 98264 - protein, 9 aa, Homo Sapiens
GEYRAVTEL

SEQ ID NO: 98265 - protein, 9 aa, Homo Sapiens
GEYSDPVTL

SEQ ID NO: 98266 - protein, 9 aa, Homo Sapiens
HEAAARIQL

SEQ ID NO: 98267 - protein, 9 aa, Homo Sapiens
HEAATKAVL

SEQ ID NO: 98268 - protein, 9 aa, Homo Sapiens
HEADKTYML

SEQ ID NO: 98269 - protein, 9 aa, Homo Sapiens
HEADVDVLM

SEQ ID NO: 98270 - protein, 9 aa, Homo Sapiens
HEAEPVRTL

SEQ ID NO: 98271 - protein, 9 aa, Homo Sapiens
HEAERNIAL

SEQ ID NO: 98272 - protein, 9 aa, Homo Sapiens
HEAERTEVL

SEQ ID NO: 98273 - protein, 9 aa, Homo Sapiens
HEAVKAIVL

SEQ ID NO: 98274 - protein, 9 aa, Homo Sapiens
HECASINRI

SEQ ID NO: 98275 - protein, 9 aa, Homo Sapiens
HECIPQAIL

SEQ ID NO: 98276 - protein, 9 aa, Homo Sapiens
HEDCGVASL

SEQ ID NO: 98277 - protein, 9 aa, Homo Sapiens
HEDDHNFEL

SEQ ID NO: 98278 - protein, 9 aa, Homo Sapiens
HEDIVAVEL

SEQ ID NO: 98279 - protein, 9 aa, Homo Sapiens
HEDKIRVVL

SEQ ID NO: 98280 - protein, 9 aa, Homo Sapiens
HEDLGHVAL

SEQ ID NO: 98281 - protein, 9 aa, Homo Sapiens
HEDLLNITL

SEQ ID NO: 98282 - protein, 9 aa, Homo Sapiens
HEDPGQATL

SEQ ID NO: 98283 - protein, 9 aa, Homo Sapiens
HEDPVIAVF

SEQ ID NO: 98284 - protein, 9 aa, Homo Sapiens
HEEAGIFKL

SEQ ID NO: 98285 - protein, 9 aa, Homo Sapiens
HEEDRKDFL

SEQ ID NO: 98286 - protein, 9 aa, Homo Sapiens
HEEDRQELL

SEQ ID NO: 98287 - protein, 9 aa, Homo Sapiens
HEEFSEHAL

SEQ ID NO: 98288 - protein, 9 aa, Homo Sapiens
HEEIDLVSL

SEQ ID NO: 98289 - protein, 9 aa, Homo Sapiens
HEEQKSVRL

SEQ ID NO: 98290 - protein, 9 aa, Homo Sapiens
HEESQTATL

SEQ ID NO: 98291 - protein, 9 aa, Homo Sapiens
HEFDGDEEF

SEQ ID NO: 98292 - protein, 9 aa, Homo Sapiens
HEFEELFRL

SEQ ID NO: 98293 - protein, 9 aa, Homo Sapiens
HEFFHILNL

SEQ ID NO: 98294 - protein, 9 aa, Homo Sapiens
HEFHSQENL

SEQ ID NO: 98295 - protein, 9 aa, Homo Sapiens
HEFSKTEEL

SEQ ID NO: 98296 - protein, 9 aa, Homo Sapiens
HEFSREPSL

SEQ ID NO: 98297 - protein, 9 aa, Homo Sapiens
HEFSSPSHL

SEQ ID NO: 98298 - protein, 9 aa, Homo Sapiens
HEGKVFISL

SEQ ID NO: 98299 - protein, 9 aa, Homo Sapiens
HEGTDSYEL

SEQ ID NO: 98300 - protein, 9 aa, Homo Sapiens
HEGTDVIML

SEQ ID NO: 98301 - protein, 9 aa, Homo Sapiens
HEHRLPHVL

SEQ ID NO: 98302 - protein, 9 aa, Homo Sapiens
HEIDRYTAI

SEQ ID NO: 98303 - protein, 9 aa, Homo Sapiens
HEIGHIFGL

SEQ ID NO: 98304 - protein, 9 aa, Homo Sapiens
HEIHDPQHL

SEQ ID NO: 98305 - protein, 9 aa, Homo Sapiens
HEIKSLEDL

SEQ ID NO: 98306 - protein, 9 aa, Homo Sapiens
HEILCKLSL

SEQ ID NO: 98307 - protein, 9 aa, Homo Sapiens
HEILNEVDL

SEQ ID NO: 98308 - protein, 9 aa, Homo Sapiens
HEIQEKLGL

SEQ ID NO: 98309 - protein, 9 aa, Homo Sapiens
HEKQPDVIL

SEQ ID NO: 98310 - protein, 9 aa, Homo Sapiens
HELDQGQQL

SEQ ID NO: 98311 - protein, 9 aa, Homo Sapiens
HELEKKIEL

SEQ ID NO: 98312 - protein, 9 aa, Homo Sapiens
HELLERIGL

SEQ ID NO: 98313 - protein, 9 aa, Homo Sapiens
HELPESMCL

SEQ ID NO: 98314 - protein, 9 aa, Homo Sapiens
HEMALRIVL

SEQ ID NO: 98315 - protein, 9 aa, Homo Sapiens
HENEDIYKL

SEQ ID NO: 98316 - protein, 9 aa, Homo Sapiens
HENSDHIIL

SEQ ID NO: 98317 - protein, 9 aa, Homo Sapiens
HEPEKSFSL

SEQ ID NO: 98318 - protein, 9 aa, Homo Sapiens
HEQANVESL

SEQ ID NO: 98319 - protein, 9 aa, Homo Sapiens
HEQEEIFKL

SEQ ID NO: 98320 - protein, 9 aa, Homo Sapiens
HEQGLSTAL

SEQ ID NO: 98321 - protein, 9 aa, Homo Sapiens
HEQKEQISL

SEQ ID NO: 98322 - protein, 9 aa, Homo Sapiens
HESETTTSL

SEQ ID NO: 98323 - protein, 9 aa, Homo Sapiens
HESGASIKI

SEQ ID NO: 98324 - protein, 9 aa, Homo Sapiens
HESLQNPLL

SEQ ID NO: 98325 - protein, 9 aa, Homo Sapiens
HESQLSVEL

SEQ ID NO: 98326 - protein, 9 aa, Homo Sapiens
HETAVSVSL

SEQ ID NO: 98327 - protein, 9 aa, Homo Sapiens
HETECITFL

SEQ ID NO: 98328 - protein, 9 aa, Homo Sapiens
HETPVEVEL

SEQ ID NO: 98329 - protein, 9 aa, Homo Sapiens
HETSLPVQL

SEQ ID NO: 98330 - protein, 9 aa, Homo Sapiens
HEVEKMFTL

SEQ ID NO: 98331 - protein, 9 aa, Homo Sapiens
HEVGIGSVL

SEQ ID NO: 98332 - protein, 9 aa, Homo Sapiens
HEVKEAQTL

SEQ ID NO: 98333 - protein, 9 aa, Homo Sapiens
HEVMEQQTI

SEQ ID NO: 98334 - protein, 9 aa, Homo Sapiens
HEVPEKTSI

SEQ ID NO: 98335 - protein, 9 aa, Homo Sapiens
HEVPSGNSL

SEQ ID NO: 98336 - protein, 9 aa, Homo Sapiens
HEVRIQPSL

SEQ ID NO: 98337 - protein, 9 aa, Homo Sapiens
HEWGELVQL

SEQ ID NO: 98338 - protein, 9 aa, Homo Sapiens
HEWMKSEEL

SEQ ID NO: 98339 - protein, 9 aa, Homo Sapiens
HEYYQPTAL

SEQ ID NO: 98340 - protein, 9 aa, Homo Sapiens
IEAPVDADL

SEQ ID NO: 98341 - protein, 9 aa, Homo Sapiens
IECGWKDQL

SEQ ID NO: 98342 - protein, 9 aa, Homo Sapiens
IECIEKTLL

SEQ ID NO: 98343 - protein, 9 aa, Homo Sapiens
IEDEIATIL

SEQ ID NO: 98344 - protein, 9 aa, Homo Sapiens
IEDEYQVFL

SEQ ID NO: 98345 - protein, 9 aa, Homo Sapiens
IEDKVKALL

SEQ ID NO: 98346 - protein, 9 aa, Homo Sapiens
IEDSRVYEL

SEQ ID NO: 98347 - protein, 9 aa, Homo Sapiens
IEEERNVPL

SEQ ID NO: 98348 - protein, 9 aa, Homo Sapiens
IEENIPELL

SEQ ID NO: 98349 - protein, 9 aa, Homo Sapiens
IEESGEHII

SEQ ID NO: 98350 - protein, 9 aa, Homo Sapiens
IEFSDKESV

SEQ ID NO: 98351 - protein, 9 aa, Homo Sapiens
IEFSIPDSL

SEQ ID NO: 98352 - protein, 9 aa, Homo Sapiens
IEHEGQECL

SEQ ID NO: 98353 - protein, 9 aa, Homo Sapiens
IEHLLPLFL

SEQ ID NO: 98354 - protein, 9 aa, Homo Sapiens
IEIDSPYEI

SEQ ID NO: 98355 - protein, 9 aa, Homo Sapiens
IEIGDGAEL

SEQ ID NO: 98356 - protein, 9 aa, Homo Sapiens
IEMNEPVQL

SEQ ID NO: 98357 - protein, 9 aa, Homo Sapiens
IEMQAITAL

SEQ ID NO: 98358 - protein, 9 aa, Homo Sapiens
IENEEPVVL

SEQ ID NO: 98359 - protein, 9 aa, Homo Sapiens
IEPADAHVL

SEQ ID NO: 98360 - protein, 9 aa, Homo Sapiens
IEPGVSVSL

SEQ ID NO: 98361 - protein, 9 aa, Homo Sapiens
IEQEAAVEL

SEQ ID NO: 98362 - protein, 9 aa, Homo Sapiens
IEQEIRILL

SEQ ID NO: 98363 - protein, 9 aa, Homo Sapiens
IEQEQKLAL

SEQ ID NO: 98364 - protein, 9 aa, Homo Sapiens
IERCFQEML

SEQ ID NO: 98365 - protein, 9 aa, Homo Sapiens
IESHPDNAL

SEQ ID NO: 98366 - protein, 9 aa, Homo Sapiens
IESNHPIVL

SEQ ID NO: 98367 - protein, 9 aa, Homo Sapiens
IESPGQDLL

SEQ ID NO: 98368 - protein, 9 aa, Homo Sapiens
IESPLFLKL

SEQ ID NO: 98369 - protein, 9 aa, Homo Sapiens
IESSDVIRL

SEQ ID NO: 98370 - protein, 9 aa, Homo Sapiens
IESSVPCQL

SEQ ID NO: 98371 - protein, 9 aa, Homo Sapiens
IESVIKSNL

SEQ ID NO: 98372 - protein, 9 aa, Homo Sapiens
IEVENKEVL

SEQ ID NO: 98373 - protein, 9 aa, Homo Sapiens
IEVVCNDRL

SEQ ID NO: 98374 - protein, 9 aa, Homo Sapiens
IEYAKPTRL

SEQ ID NO: 98375 - protein, 9 aa, Homo Sapiens
IEYDSPEQL

SEQ ID NO: 98376 - protein, 9 aa, Homo Sapiens
IEYQGDPEL

SEQ ID NO: 98377 - protein, 9 aa, Homo Sapiens
KEAALSTAL

SEQ ID NO: 98378 - protein, 9 aa, Homo Sapiens
KEAEFLQKL

SEQ ID NO: 98379 - protein, 9 aa, Homo Sapiens
KEAEILEVL

SEQ ID NO: 98380 - protein, 9 aa, Homo Sapiens
KEAEKSPQL

SEQ ID NO: 98381 - protein, 9 aa, Homo Sapiens
KEAERDVSL

SEQ ID NO: 98382 - protein, 9 aa, Homo Sapiens
KEAEVQTWL

SEQ ID NO: 98383 - protein, 9 aa, Homo Sapiens
KEAFAKVDL

SEQ ID NO: 98384 - protein, 9 aa, Homo Sapiens
KEAGSIVRL

SEQ ID NO: 98385 - protein, 9 aa, Homo Sapiens
KEAPEEAQL

SEQ ID NO: 98386 - protein, 9 aa, Homo Sapiens
KEAPPPVLL

SEQ ID NO: 98387 - protein, 9 aa, Homo Sapiens
KEAPTAYSL

SEQ ID NO: 98388 - protein, 9 aa, Homo Sapiens
KEAVCEVAL

SEQ ID NO: 98389 - protein, 9 aa, Homo Sapiens
KEAVIKHSL

SEQ ID NO: 98390 - protein, 9 aa, Homo Sapiens
KECGKAFSI

SEQ ID NO: 98391 - protein, 9 aa, Homo Sapiens
KECNAKIMI

SEQ ID NO: 98392 - protein, 9 aa, Homo Sapiens
KECQKIIRL

SEQ ID NO: 98393 - protein, 9 aa, Homo Sapiens
KEDCFFYSL

SEQ ID NO: 98394 - protein, 9 aa, Homo Sapiens
KEDDLDVVL

SEQ ID NO: 98395 - protein, 9 aa, Homo Sapiens
KEDDPKAAL

SEQ ID NO: 98396 - protein, 9 aa, Homo Sapiens
KEDEIKQWL

SEQ ID NO: 98397 - protein, 9 aa, Homo Sapiens
KEDELRTVL

SEQ ID NO: 98398 - protein, 9 aa, Homo Sapiens
KEDENVPFL

SEQ ID NO: 98399 - protein, 9 aa, Homo Sapiens
KEDEQQQAL

SEQ ID NO: 98400 - protein, 9 aa, Homo Sapiens
KEDFSSFQL

SEQ ID NO: 98401 - protein, 9 aa, Homo Sapiens
KEDLGACLL

SEQ ID NO: 98402 - protein, 9 aa, Homo Sapiens
KEDNTIYRL

SEQ ID NO: 98403 - protein, 9 aa, Homo Sapiens
KEDPTSFRL

SEQ ID NO: 98404 - protein, 9 aa, Homo Sapiens
KEDQVIQLM

SEQ ID NO: 98405 - protein, 9 aa, Homo Sapiens
KEDSDEVHL

SEQ ID NO: 98406 - protein, 9 aa, Homo Sapiens
KEDSGKIKL

SEQ ID NO: 98407 - protein, 9 aa, Homo Sapiens
KEDSHPFDL

SEQ ID NO: 98408 - protein, 9 aa, Homo Sapiens
KEDSKLIAL

SEQ ID NO: 98409 - protein, 9 aa, Homo Sapiens
KEEDGSLSL

SEQ ID NO: 98410 - protein, 9 aa, Homo Sapiens
KEEDLQWVL

SEQ ID NO: 98411 - protein, 9 aa, Homo Sapiens
KEEEHAPEL

SEQ ID NO: 98412 - protein, 9 aa, Homo Sapiens
KEEEKPVML

SEQ ID NO: 98413 - protein, 9 aa, Homo Sapiens
KEEELQAAL

SEQ ID NO: 98414 - protein, 9 aa, Homo Sapiens
KEEEPSVKL

SEQ ID NO: 98415 - protein, 9 aa, Homo Sapiens
KEEHLYILI

SEQ ID NO: 98416 - protein, 9 aa, Homo Sapiens
KEEIGNVQL

SEQ ID NO: 98417 - protein, 9 aa, Homo Sapiens
KEEKDFTIL

SEQ ID NO: 98418 - protein, 9 aa, Homo Sapiens
KEEPDGPAL

SEQ ID NO: 98419 - protein, 9 aa, Homo Sapiens
KEEPVAPEL

SEQ ID NO: 98420 - protein, 9 aa, Homo Sapiens
KEESIVSSL

SEQ ID NO: 98421 - protein, 9 aa, Homo Sapiens
KEESMKETL

SEQ ID NO: 98422 - protein, 9 aa, Homo Sapiens
KEESQQMVL

SEQ ID NO: 98423 - protein, 9 aa, Homo Sapiens
KEESVESSL

SEQ ID NO: 98424 - protein, 9 aa, Homo Sapiens
KEETNIVKL

SEQ ID NO: 98425 - protein, 9 aa, Homo Sapiens
KEEVSRQEL

SEQ ID NO: 98426 - protein, 9 aa, Homo Sapiens
KEEYLKPVL

SEQ ID NO: 98427 - protein, 9 aa, Homo Sapiens
KEFAQIIKI

SEQ ID NO: 98428 - protein, 9 aa, Homo Sapiens
KEFDGKSLV

SEQ ID NO: 98429 - protein, 9 aa, Homo Sapiens
KEFDQNVKL

SEQ ID NO: 98430 - protein, 9 aa, Homo Sapiens
KEFEGKTLV

SEQ ID NO: 98431 - protein, 9 aa, Homo Sapiens
KEFIDNEMI

SEQ ID NO: 98432 - protein, 9 aa, Homo Sapiens
KEFKGDEIL

SEQ ID NO: 98433 - protein, 9 aa, Homo Sapiens
KEFNEDGAL

SEQ ID NO: 98434 - protein, 9 aa, Homo Sapiens
KEFPEKQEL

SEQ ID NO: 98435 - protein, 9 aa, Homo Sapiens
KEFSEENVL

SEQ ID NO: 98436 - protein, 9 aa, Homo Sapiens
KEFSGHSSL

SEQ ID NO: 98437 - protein, 9 aa, Homo Sapiens
KEGEEQPVL

SEQ ID NO: 98438 - protein, 9 aa, Homo Sapiens
KEGFPITAI

SEQ ID NO: 98439 - protein, 9 aa, Homo Sapiens
KEHEVTIFV

SEQ ID NO: 98440 - protein, 9 aa, Homo Sapiens
KEIDECVTL

SEQ ID NO: 98441 - protein, 9 aa, Homo Sapiens
KEIDIYANL

SEQ ID NO: 98442 - protein, 9 aa, Homo Sapiens
KEIDKEEHL

SEQ ID NO: 98443 - protein, 9 aa, Homo Sapiens
KEIEDFDSL

SEQ ID NO: 98444 - protein, 9 aa, Homo Sapiens
KEIEFGTSL

SEQ ID NO: 98445 - protein, 9 aa, Homo Sapiens
KEIEKDLRL

SEQ ID NO: 98446 - protein, 9 aa, Homo Sapiens
KEIESRVVF

SEQ ID NO: 98447 - protein, 9 aa, Homo Sapiens
KEIFLRELI

SEQ ID NO: 98448 - protein, 9 aa, Homo Sapiens
KEIGELTQL

SEQ ID NO: 98449 - protein, 9 aa, Homo Sapiens
KEIIQDVTL

SEQ ID NO: 98450 - protein, 9 aa, Homo Sapiens
KEIISSEML

SEQ ID NO: 98451 - protein, 9 aa, Homo Sapiens
KEIKEVIEL

SEQ ID NO: 98452 - protein, 9 aa, Homo Sapiens
KEILSGTKL

SEQ ID NO: 98453 - protein, 9 aa, Homo Sapiens
KEILSLDKL

SEQ ID NO: 98454 - protein, 9 aa, Homo Sapiens
KEINQNVEI

SEQ ID NO: 98455 - protein, 9 aa, Homo Sapiens
KEIPIPFYL

SEQ ID NO: 98456 - protein, 9 aa, Homo Sapiens
KEIQWETRL

SEQ ID NO: 98457 - protein, 9 aa, Homo Sapiens
KEISDLHYL

SEQ ID NO: 98458 - protein, 9 aa, Homo Sapiens
KEISNNDKL

SEQ ID NO: 98459 - protein, 9 aa, Homo Sapiens
KEITGETAL

SEQ ID NO: 98460 - protein, 9 aa, Homo Sapiens
KEKEFQEEL

SEQ ID NO: 98461 - protein, 9 aa, Homo Sapiens
KEKEPEEEL

SEQ ID NO: 98462 - protein, 9 aa, Homo Sapiens
KEKIQPEIL

SEQ ID NO: 98463 - protein, 9 aa, Homo Sapiens
KEKLCYVAL

SEQ ID NO: 98464 - protein, 9 aa, Homo Sapiens
KEKPEEESL

SEQ ID NO: 98465 - protein, 9 aa, Homo Sapiens
KEKPGSEVL

SEQ ID NO: 98466 - protein, 9 aa, Homo Sapiens
KEKVEPEVL

SEQ ID NO: 98467 - protein, 9 aa, Homo Sapiens
KELDTVEVL

SEQ ID NO: 98468 - protein, 9 aa, Homo Sapiens
KELEEEITL

SEQ ID NO: 98469 - protein, 9 aa, Homo Sapiens
KELEEIYML

SEQ ID NO: 98470 - protein, 9 aa, Homo Sapiens
KELEKTLAL

SEQ ID NO: 98471 - protein, 9 aa, Homo Sapiens
KELPEYYEL

SEQ ID NO: 98472 - protein, 9 aa, Homo Sapiens
KELSDSVTL

SEQ ID NO: 98473 - protein, 9 aa, Homo Sapiens
KELSMVTEL

SEQ ID NO: 98474 - protein, 9 aa, Homo Sapiens
KELTIGSKL

SEQ ID NO: 98475 - protein, 9 aa, Homo Sapiens
KEMEDTQRL

SEQ ID NO: 98476 - protein, 9 aa, Homo Sapiens
KEMESIWNL

SEQ ID NO: 98477 - protein, 9 aa, Homo Sapiens
KEMGQMQVL

SEQ ID NO: 98478 - protein, 9 aa, Homo Sapiens
KEMLPHVGV

SEQ ID NO: 98479 - protein, 9 aa, Homo Sapiens
KEMRNLIRL

SEQ ID NO: 98480 - protein, 9 aa, Homo Sapiens
KENATVAHL

SEQ ID NO: 98481 - protein, 9 aa, Homo Sapiens
KENEEKVCL

SEQ ID NO: 98482 - protein, 9 aa, Homo Sapiens
KENSAPVKL

SEQ ID NO: 98483 - protein, 9 aa, Homo Sapiens
KEPDVSEEL

SEQ ID NO: 98484 - protein, 9 aa, Homo Sapiens
KEPEINTTL

SEQ ID NO: 98485 - protein, 9 aa, Homo Sapiens
KEPPVDICL

SEQ ID NO: 98486 - protein, 9 aa, Homo Sapiens
KESDNNVKL

SEQ ID NO: 98487 - protein, 9 aa, Homo Sapiens
KESEDAELL

SEQ ID NO: 98488 - protein, 9 aa, Homo Sapiens
KESEDKPEI

SEQ ID NO: 98489 - protein, 9 aa, Homo Sapiens
KESEEKEVL

SEQ ID NO: 98490 - protein, 9 aa, Homo Sapiens
KESEKQLLL

SEQ ID NO: 98491 - protein, 9 aa, Homo Sapiens
KESEVFYEL

SEQ ID NO: 98492 - protein, 9 aa, Homo Sapiens
KESGNSIVL

SEQ ID NO: 98493 - protein, 9 aa, Homo Sapiens
KESGQVVAI

SEQ ID NO: 98494 - protein, 9 aa, Homo Sapiens
KESIIIHQL

SEQ ID NO: 98495 - protein, 9 aa, Homo Sapiens
KESPPHEDL

SEQ ID NO: 98496 - protein, 9 aa, Homo Sapiens
KESSTVFEL

SEQ ID NO: 98497 - protein, 9 aa, Homo Sapiens
KESTATTFL

SEQ ID NO: 98498 - protein, 9 aa, Homo Sapiens
KESTLHLVL

SEQ ID NO: 98499 - protein, 9 aa, Homo Sapiens
KETAVFINI

SEQ ID NO: 98500 - protein, 9 aa, Homo Sapiens
KETDLLILF

SEQ ID NO: 98501 - protein, 9 aa, Homo Sapiens
KETGGVEKL

SEQ ID NO: 98502 - protein, 9 aa, Homo Sapiens
KETGQIVAI

SEQ ID NO: 98503 - protein, 9 aa, Homo Sapiens
KETIEIIDL

SEQ ID NO: 98504 - protein, 9 aa, Homo Sapiens
KETKDVSAL

SEQ ID NO: 98505 - protein, 9 aa, Homo Sapiens
KETPDKVEL

SEQ ID NO: 98506 - protein, 9 aa, Homo Sapiens
KETTYYDVL

SEQ ID NO: 98507 - protein, 9 aa, Homo Sapiens
KEVADAIRL

SEQ ID NO: 98508 - protein, 9 aa, Homo Sapiens
KEVAELTRL

SEQ ID NO: 98509 - protein, 9 aa, Homo Sapiens
KEVAQAVLL

SEQ ID NO: 98510 - protein, 9 aa, Homo Sapiens
KEVATDVRL

SEQ ID NO: 98511 - protein, 9 aa, Homo Sapiens
KEVDALLHL

SEQ ID NO: 98512 - protein, 9 aa, Homo Sapiens
KEVDVSKQL

SEQ ID NO: 98513 - protein, 9 aa, Homo Sapiens
KEVEAVVYL

SEQ ID NO: 98514 - protein, 9 aa, Homo Sapiens
KEVEEISLL

SEQ ID NO: 98515 - protein, 9 aa, Homo Sapiens
KEVEQFTQV

SEQ ID NO: 98516 - protein, 9 aa, Homo Sapiens
KEVEQQTGL

SEQ ID NO: 98517 - protein, 9 aa, Homo Sapiens
KEVFDSAIL

SEQ ID NO: 98518 - protein, 9 aa, Homo Sapiens
KEVKEVATL

SEQ ID NO: 98519 - protein, 9 aa, Homo Sapiens
KEVMVDDRL

SEQ ID NO: 98520 - protein, 9 aa, Homo Sapiens
KEVNFTSEL

SEQ ID NO: 98521 - protein, 9 aa, Homo Sapiens
KEVQDGIEL

SEQ ID NO: 98522 - protein, 9 aa, Homo Sapiens
KEVSTGTVL

SEQ ID NO: 98523 - protein, 9 aa, Homo Sapiens
KEVVHTVSL

SEQ ID NO: 98524 - protein, 9 aa, Homo Sapiens
KEWEKVFEM

SEQ ID NO: 98525 - protein, 9 aa, Homo Sapiens
KEYDEPYVL

SEQ ID NO: 98526 - protein, 9 aa, Homo Sapiens
KEYEGKWLL

SEQ ID NO: 98527 - protein, 9 aa, Homo Sapiens
KEYENIIAL

SEQ ID NO: 98528 - protein, 9 aa, Homo Sapiens
KEYLDNVQL

SEQ ID NO: 98529 - protein, 9 aa, Homo Sapiens
KEYVGIVRL

SEQ ID NO: 98530 - protein, 9 aa, Homo Sapiens
KEYVQPVQL

SEQ ID NO: 98531 - protein, 9 aa, Homo Sapiens
KQQLELDSI

SEQ ID NO: 98532 - protein, 9 aa, Homo Sapiens
LEAAGIGKL

SEQ ID NO: 98533 - protein, 9 aa, Homo Sapiens
LEACVRDVL

SEQ ID NO: 98534 - protein, 9 aa, Homo Sapiens
LEADVNIKL

SEQ ID NO: 98535 - protein, 9 aa, Homo Sapiens
LEAFGDVKL

SEQ ID NO: 98536 - protein, 9 aa, Homo Sapiens
LEAKVKDLL

SEQ ID NO: 98537 - protein, 9 aa, Homo Sapiens
LEALVPVTI

SEQ ID NO: 98538 - protein, 9 aa, Homo Sapiens
LEAPDETTL

SEQ ID NO: 98539 - protein, 9 aa, Homo Sapiens
LEAPPEVSL

SEQ ID NO: 98540 - protein, 9 aa, Homo Sapiens
LECAKAYLL

SEQ ID NO: 98541 - protein, 9 aa, Homo Sapiens
LECQQHSQL

SEQ ID NO: 98542 - protein, 9 aa, Homo Sapiens
LEDFDIHEL

SEQ ID NO: 98543 - protein, 9 aa, Homo Sapiens
LEDFPTISL

SEQ ID NO: 98544 - protein, 9 aa, Homo Sapiens
LEDGQAVQL

SEQ ID NO: 98545 - protein, 9 aa, Homo Sapiens
LEDKYNLQL

SEQ ID NO: 98546 - protein, 9 aa, Homo Sapiens
LEDVVRAYL

SEQ ID NO: 98547 - protein, 9 aa, Homo Sapiens
LEEAADLLV

SEQ ID NO: 98548 - protein, 9 aa, Homo Sapiens
LEEKDPVPL

SEQ ID NO: 98549 - protein, 9 aa, Homo Sapiens
LEEKIGCLL

SEQ ID NO: 98550 - protein, 9 aa, Homo Sapiens
LEENSTPQL

SEQ ID NO: 98551 - protein, 9 aa, Homo Sapiens
LEENVHEVL

SEQ ID NO: 98552 - protein, 9 aa, Homo Sapiens
LEEPYEIQL

SEQ ID NO: 98553 - protein, 9 aa, Homo Sapiens
LEFDEKAVL

SEQ ID NO: 98554 - protein, 9 aa, Homo Sapiens
LEFGEPVLL

SEQ ID NO: 98555 - protein, 9 aa, Homo Sapiens
LEFGSEPSL

SEQ ID NO: 98556 - protein, 9 aa, Homo Sapiens
LEFLDRESI

SEQ ID NO: 98557 - protein, 9 aa, Homo Sapiens
LEFQTPELL

SEQ ID NO: 98558 - protein, 9 aa, Homo Sapiens
LEGQIHPEL

SEQ ID NO: 98559 - protein, 9 aa, Homo Sapiens
LEGSKDALL

SEQ ID NO: 98560 - protein, 9 aa, Homo Sapiens
LEHIKTHEL

SEQ ID NO: 98561 - protein, 9 aa, Homo Sapiens
LEHLTNEAL

SEQ ID NO: 98562 - protein, 9 aa, Homo Sapiens
LEHQVFTVL

SEQ ID NO: 98563 - protein, 9 aa, Homo Sapiens
LEHVPDTVL

SEQ ID NO: 98564 - protein, 9 aa, Homo Sapiens
LEIADPIVL

SEQ ID NO: 98565 - protein, 9 aa, Homo Sapiens
LEIQDKEYL

SEQ ID NO: 98566 - protein, 9 aa, Homo Sapiens
LEIQHTTAL

SEQ ID NO: 98567 - protein, 9 aa, Homo Sapiens
LEISKMEVL

SEQ ID NO: 98568 - protein, 9 aa, Homo Sapiens
LEKIADPTL

SEQ ID NO: 98569 - protein, 9 aa, Homo Sapiens
LENASDIKL

SEQ ID NO: 98570 - protein, 9 aa, Homo Sapiens
LENDGATAL

SEQ ID NO: 98571 - protein, 9 aa, Homo Sapiens
LENKDNIRL

SEQ ID NO: 98572 - protein, 9 aa, Homo Sapiens
LENKELCIL

SEQ ID NO: 98573 - protein, 9 aa, Homo Sapiens
LENMHIEQL

SEQ ID NO: 98574 - protein, 9 aa, Homo Sapiens
LENPEGVIL

SEQ ID NO: 98575 - protein, 9 aa, Homo Sapiens
LEPGHTELL

SEQ ID NO: 98576 - protein, 9 aa, Homo Sapiens
LEPHDSPVL

SEQ ID NO: 98577 - protein, 9 aa, Homo Sapiens
LEQDFKVTL

SEQ ID NO: 98578 - protein, 9 aa, Homo Sapiens
LEQQNKILL

SEQ ID NO: 98579 - protein, 9 aa, Homo Sapiens
LERIEETAL

SEQ ID NO: 98580 - protein, 9 aa, Homo Sapiens
LERLSELAL

SEQ ID NO: 98581 - protein, 9 aa, Homo Sapiens
LESDAVECL

SEQ ID NO: 98582 - protein, 9 aa, Homo Sapiens
LESDFRDVL

SEQ ID NO: 98583 - protein, 9 aa, Homo Sapiens
LESDNNTAL

SEQ ID NO: 98584 - protein, 9 aa, Homo Sapiens
LESEDEVKL

SEQ ID NO: 98585 - protein, 9 aa, Homo Sapiens
LESKTYHAL

SEQ ID NO: 98586 - protein, 9 aa, Homo Sapiens
LESLPSPTL

SEQ ID NO: 98587 - protein, 9 aa, Homo Sapiens
LESNDFEML

SEQ ID NO: 98588 - protein, 9 aa, Homo Sapiens
LESPTTPLL

SEQ ID NO: 98589 - protein, 9 aa, Homo Sapiens
LESPTVSTL

SEQ ID NO: 98590 - protein, 9 aa, Homo Sapiens
LESQGIERL

SEQ ID NO: 98591 - protein, 9 aa, Homo Sapiens
LESQVRELL

SEQ ID NO: 98592 - protein, 9 aa, Homo Sapiens
LESVDSEAL

SEQ ID NO: 98593 - protein, 9 aa, Homo Sapiens
LETDSVQRL

SEQ ID NO: 98594 - protein, 9 aa, Homo Sapiens
LETKVAELL

SEQ ID NO: 98595 - protein, 9 aa, Homo Sapiens
LETLVSPKL

SEQ ID NO: 98596 - protein, 9 aa, Homo Sapiens
LETSTGHSL

SEQ ID NO: 98597 - protein, 9 aa, Homo Sapiens
LETVTKDIL

SEQ ID NO: 98598 - protein, 9 aa, Homo Sapiens
LEVDKDEAL

SEQ ID NO: 98599 - protein, 9 aa, Homo Sapiens
LEVECATQL

SEQ ID NO: 98600 - protein, 9 aa, Homo Sapiens
LEVEDRTSL

SEQ ID NO: 98601 - protein, 9 aa, Homo Sapiens
LEVEKSLVL

SEQ ID NO: 98602 - protein, 9 aa, Homo Sapiens
LEVIEPEVL

SEQ ID NO: 98603 - protein, 9 aa, Homo Sapiens
LEVPSTTAL

SEQ ID NO: 98604 - protein, 9 aa, Homo Sapiens
LEVPVSDLL

SEQ ID NO: 98605 - protein, 9 aa, Homo Sapiens
LEVQVRESL

SEQ ID NO: 98606 - protein, 9 aa, Homo Sapiens
LEVVQTEKL

SEQ ID NO: 98607 - protein, 9 aa, Homo Sapiens
LEVVTPEVL

SEQ ID NO: 98608 - protein, 9 aa, Homo Sapiens
LEYGLPIQV

SEQ ID NO: 98609 - protein, 9 aa, Homo Sapiens
LEYGVPVTL

SEQ ID NO: 98610 - protein, 9 aa, Homo Sapiens
LEYLTAEVL

SEQ ID NO: 98611 - protein, 9 aa, Homo Sapiens
LTQALKDNK

SEQ ID NO: 98612 - protein, 9 aa, Homo Sapiens
MEDETQKEL

SEQ ID NO: 98613 - protein, 9 aa, Homo Sapiens
MEDGGVKLL

SEQ ID NO: 98614 - protein, 9 aa, Homo Sapiens
MEDGPIVKL

SEQ ID NO: 98615 - protein, 9 aa, Homo Sapiens
MEDKFIVCL

SEQ ID NO: 98616 - protein, 9 aa, Homo Sapiens
MEEKGSISL

SEQ ID NO: 98617 - protein, 9 aa, Homo Sapiens
MEEKTSHIL

SEQ ID NO: 98618 - protein, 9 aa, Homo Sapiens
MESDFEQKL

SEQ ID NO: 98619 - protein, 9 aa, Homo Sapiens
MESEGKTVL

SEQ ID NO: 98620 - protein, 9 aa, Homo Sapiens
METPELIEL

SEQ ID NO: 98621 - protein, 9 aa, Homo Sapiens
MEVAGVTAL

SEQ ID NO: 98622 - protein, 9 aa, Homo Sapiens
MEVSEPHIL

SEQ ID NO: 98623 - protein, 9 aa, Homo Sapiens
NEAIVKDVL

SEQ ID NO: 98624 - protein, 9 aa, Homo Sapiens
NEAKVKETL

SEQ ID NO: 98625 - protein, 9 aa, Homo Sapiens
NECGKVFIL

SEQ ID NO: 98626 - protein, 9 aa, Homo Sapiens
NEDGALAVL

SEQ ID NO: 98627 - protein, 9 aa, Homo Sapiens
NEEDSKIEL

SEQ ID NO: 98628 - protein, 9 aa, Homo Sapiens
NEFGEKWEL

SEQ ID NO: 98629 - protein, 9 aa, Homo Sapiens
NEFHSPIGL

SEQ ID NO: 98630 - protein, 9 aa, Homo Sapiens
NEFPEPIKL

SEQ ID NO: 98631 - protein, 9 aa, Homo Sapiens
NEFPVIVRL

SEQ ID NO: 98632 - protein, 9 aa, Homo Sapiens
NEIPVEVVL

SEQ ID NO: 98633 - protein, 9 aa, Homo Sapiens
NEIRTLIDL

SEQ ID NO: 98634 - protein, 9 aa, Homo Sapiens
NEISIYDKL

SEQ ID NO: 98635 - protein, 9 aa, Homo Sapiens
NESGVRELL

SEQ ID NO: 98636 - protein, 9 aa, Homo Sapiens
NESVVKEML

SEQ ID NO: 98637 - protein, 9 aa, Homo Sapiens
NETDTPAQL

SEQ ID NO: 98638 - protein, 9 aa, Homo Sapiens
NEVFNDVRL

SEQ ID NO: 98639 - protein, 9 aa, Homo Sapiens
NEYFTNEVL

SEQ ID NO: 98640 - protein, 9 aa, Homo Sapiens
NPIDSLPGE

SEQ ID NO: 98641 - protein, 9 aa, Homo Sapiens
PEADKGTVL

SEQ ID NO: 98642 - protein, 9 aa, Homo Sapiens
PECMVPVVL

SEQ ID NO: 98643 - protein, 9 aa, Homo Sapiens
QEADKCPTL

SEQ ID NO: 98644 - protein, 9 aa, Homo Sapiens
QEAESAVRL

SEQ ID NO: 98645 - protein, 9 aa, Homo Sapiens
QEDLDNPVL

SEQ ID NO: 98646 - protein, 9 aa, Homo Sapiens
QEDSKPITL

SEQ ID NO: 98647 - protein, 9 aa, Homo Sapiens
QEEASGVAL

SEQ ID NO: 98648 - protein, 9 aa, Homo Sapiens
QEEDRTVSL

SEQ ID NO: 98649 - protein, 9 aa, Homo Sapiens
QEEDTFHSL

SEQ ID NO: 98650 - protein, 9 aa, Homo Sapiens
QEEKPEPVL

SEQ ID NO: 98651 - protein, 9 aa, Homo Sapiens
QEENITRAL

SEQ ID NO: 98652 - protein, 9 aa, Homo Sapiens
QEEPATYCL

SEQ ID NO: 98653 - protein, 9 aa, Homo Sapiens
QEEPLPHEL

SEQ ID NO: 98654 - protein, 9 aa, Homo Sapiens
QEEPVQPLL

SEQ ID NO: 98655 - protein, 9 aa, Homo Sapiens
QEEQTRVAL

SEQ ID NO: 98656 - protein, 9 aa, Homo Sapiens
QEESLRTYL

SEQ ID NO: 98657 - protein, 9 aa, Homo Sapiens
QEEWFKAEL

SEQ ID NO: 98658 - protein, 9 aa, Homo Sapiens
QEFGADVRL

SEQ ID NO: 98659 - protein, 9 aa, Homo Sapiens
QEFLERIHL

SEQ ID NO: 98660 - protein, 9 aa, Homo Sapiens
QEFQPEPSL

SEQ ID NO: 98661 - protein, 9 aa, Homo Sapiens
QEFVKAFYL

SEQ ID NO: 98662 - protein, 9 aa, Homo Sapiens
QEGPVGSTL

SEQ ID NO: 98663 - protein, 9 aa, Homo Sapiens
QEHAQEVVL

SEQ ID NO: 98664 - protein, 9 aa, Homo Sapiens
QEHLQLQNL

SEQ ID NO: 98665 - protein, 9 aa, Homo Sapiens
QEHPCLVEL

SEQ ID NO: 98666 - protein, 9 aa, Homo Sapiens
QEHPELAVL

SEQ ID NO: 98667 - protein, 9 aa, Homo Sapiens
QEIEDWSKL

SEQ ID NO: 98668 - protein, 9 aa, Homo Sapiens
QEIEEFQKL

SEQ ID NO: 98669 - protein, 9 aa, Homo Sapiens
QEIKDIYGL

SEQ ID NO: 98670 - protein, 9 aa, Homo Sapiens
QEIQDQLSL

SEQ ID NO: 98671 - protein, 9 aa, Homo Sapiens
QEISQVCQL

SEQ ID NO: 98672 - protein, 9 aa, Homo Sapiens
QEKEAIERL

SEQ ID NO: 98673 - protein, 9 aa, Homo Sapiens
QELFLAHIL

SEQ ID NO: 98674 - protein, 9 aa, Homo Sapiens
QELFPAPIL

SEQ ID NO: 98675 - protein, 9 aa, Homo Sapiens
QELLSDTKL

SEQ ID NO: 98676 - protein, 9 aa, Homo Sapiens
QELYFFHEL

SEQ ID NO: 98677 - protein, 9 aa, Homo Sapiens
QEMPGDVPL

SEQ ID NO: 98678 - protein, 9 aa, Homo Sapiens
QENAEIIKL

SEQ ID NO: 98679 - protein, 9 aa, Homo Sapiens
QENVDYVIL

SEQ ID NO: 98680 - protein, 9 aa, Homo Sapiens
QENVQKIIL

SEQ ID NO: 98681 - protein, 9 aa, Homo Sapiens
QEPLHNEEL

SEQ ID NO: 98682 - protein, 9 aa, Homo Sapiens
QEQAAKAVL

SEQ ID NO: 98683 - protein, 9 aa, Homo Sapiens
QEQIEAVLL

SEQ ID NO: 98684 - protein, 9 aa, Homo Sapiens
QEQNQEQPI

SEQ ID NO: 98685 - protein, 9 aa, Homo Sapiens
QEQQENPRL

SEQ ID NO: 98686 - protein, 9 aa, Homo Sapiens
QESGCKIQI

SEQ ID NO: 98687 - protein, 9 aa, Homo Sapiens
QESLAQARL

SEQ ID NO: 98688 - protein, 9 aa, Homo Sapiens
QESNDHVCL

SEQ ID NO: 98689 - protein, 9 aa, Homo Sapiens
QESNVQLKL

SEQ ID NO: 98690 - protein, 9 aa, Homo Sapiens
QESNVRLKL

SEQ ID NO: 98691 - protein, 9 aa, Homo Sapiens
QESVPDPEL

SEQ ID NO: 98692 - protein, 9 aa, Homo Sapiens
QETAVAPSL

SEQ ID NO: 98693 - protein, 9 aa, Homo Sapiens
QETDVRAQI

SEQ ID NO: 98694 - protein, 9 aa, Homo Sapiens
QETEEKILL

SEQ ID NO: 98695 - protein, 9 aa, Homo Sapiens
QETEPSKEL

SEQ ID NO: 98696 - protein, 9 aa, Homo Sapiens
QEVISRAEL

SEQ ID NO: 98697 - protein, 9 aa, Homo Sapiens
QEVVDFEKL

SEQ ID NO: 98698 - protein, 9 aa, Homo Sapiens
RDSISKEDL

SEQ ID NO: 98699 - protein, 9 aa, Homo Sapiens
READFFWSL

SEQ ID NO: 98700 - protein, 9 aa, Homo Sapiens
REAEFTKSI

SEQ ID NO: 98701 - protein, 9 aa, Homo Sapiens
REAEIYQTV

SEQ ID NO: 98702 - protein, 9 aa, Homo Sapiens
REAESFTQL

SEQ ID NO: 98703 - protein, 9 aa, Homo Sapiens
REALTETTL

SEQ ID NO: 98704 - protein, 9 aa, Homo Sapiens
REAMNDPLL

SEQ ID NO: 98705 - protein, 9 aa, Homo Sapiens
REAPERPSL

SEQ ID NO: 98706 - protein, 9 aa, Homo Sapiens
REAPNPIHL

SEQ ID NO: 98707 - protein, 9 aa, Homo Sapiens
REAQMAAKL

SEQ ID NO: 98708 - protein, 9 aa, Homo Sapiens
REAQVFVRL

SEQ ID NO: 98709 - protein, 9 aa, Homo Sapiens
REAQVWEML

SEQ ID NO: 98710 - protein, 9 aa, Homo Sapiens
REAVPEPVL

SEQ ID NO: 98711 - protein, 9 aa, Homo Sapiens
REAVSKEDL

SEQ ID NO: 98712 - protein, 9 aa, Homo Sapiens
REAVSKTAL

SEQ ID NO: 98713 - protein, 9 aa, Homo Sapiens
RECENQLVL

SEQ ID NO: 98714 - protein, 9 aa, Homo Sapiens
REDEKPLVL

SEQ ID NO: 98715 - protein, 9 aa, Homo Sapiens
REDENKSIL

SEQ ID NO: 98716 - protein, 9 aa, Homo Sapiens
REDGSIVIV

SEQ ID NO: 98717 - protein, 9 aa, Homo Sapiens
REDINSLCM

SEQ ID NO: 98718 - protein, 9 aa, Homo Sapiens
REDISSIEI

SEQ ID NO: 98719 - protein, 9 aa, Homo Sapiens
REDKVHLKL

SEQ ID NO: 98720 - protein, 9 aa, Homo Sapiens
REDLTQVEL

SEQ ID NO: 98721 - protein, 9 aa, Homo Sapiens
REDPAPGLL

SEQ ID NO: 98722 - protein, 9 aa, Homo Sapiens
REDSGTFSL

SEQ ID NO: 98723 - protein, 9 aa, Homo Sapiens
REDTKAAVL

SEQ ID NO: 98724 - protein, 9 aa, Homo Sapiens
REDYIEPAL

SEQ ID NO: 98725 - protein, 9 aa, Homo Sapiens
REDYYDIQL

SEQ ID NO: 98726 - protein, 9 aa, Homo Sapiens
REEAIAVTM

SEQ ID NO: 98727 - protein, 9 aa, Homo Sapiens
REEDEETQL

SEQ ID NO: 98728 - protein, 9 aa, Homo Sapiens
REEEVSYQL

SEQ ID NO: 98729 - protein, 9 aa, Homo Sapiens
REEHIVVEL

SEQ ID NO: 98730 - protein, 9 aa, Homo Sapiens
REEIEKQAL

SEQ ID NO: 98731 - protein, 9 aa, Homo Sapiens
REEINFVEI

SEQ ID NO: 98732 - protein, 9 aa, Homo Sapiens
REEKVKAVL

SEQ ID NO: 98733 - protein, 9 aa, Homo Sapiens
REELLPHLL

SEQ ID NO: 98734 - protein, 9 aa, Homo Sapiens
REENKQIAL

SEQ ID NO: 98735 - protein, 9 aa, Homo Sapiens
REENPSSVL

SEQ ID NO: 98736 - protein, 9 aa, Homo Sapiens
REEPEKIIL

SEQ ID NO: 98737 - protein, 9 aa, Homo Sapiens
REEPSNPFL

SEQ ID NO: 98738 - protein, 9 aa, Homo Sapiens
REEQCILYL

SEQ ID NO: 98739 - protein, 9 aa, Homo Sapiens
REEVGNISI

SEQ ID NO: 98740 - protein, 9 aa, Homo Sapiens
REEVVVCEL

SEQ ID NO: 98741 - protein, 9 aa, Homo Sapiens
REEWKFDTL

SEQ ID NO: 98742 - protein, 9 aa, Homo Sapiens
REFDGTEVL

SEQ ID NO: 98743 - protein, 9 aa, Homo Sapiens
REFDQKALL

SEQ ID NO: 98744 - protein, 9 aa, Homo Sapiens
REFEERRSL

SEQ ID NO: 98745 - protein, 9 aa, Homo Sapiens
REFIAPVTL

SEQ ID NO: 98746 - protein, 9 aa, Homo Sapiens
REFNEEGAL

SEQ ID NO: 98747 - protein, 9 aa, Homo Sapiens
REFQNPPQL

SEQ ID NO: 98748 - protein, 9 aa, Homo Sapiens
REFREEESL

SEQ ID NO: 98749 - protein, 9 aa, Homo Sapiens
REFWAKPKP

SEQ ID NO: 98750 - protein, 9 aa, Homo Sapiens
REGDVITII

SEQ ID NO: 98751 - protein, 9 aa, Homo Sapiens
REGEIAQFL

SEQ ID NO: 98752 - protein, 9 aa, Homo Sapiens
REGLLFTAL

SEQ ID NO: 98753 - protein, 9 aa, Homo Sapiens
REGRPIWQL

SEQ ID NO: 98754 - protein, 9 aa, Homo Sapiens
REHDIAIKF

SEQ ID NO: 98755 - protein, 9 aa, Homo Sapiens
REHVEAIKI

SEQ ID NO: 98756 - protein, 9 aa, Homo Sapiens
REIADGLCL

SEQ ID NO: 98757 - protein, 9 aa, Homo Sapiens
REIAGKMDL

SEQ ID NO: 98758 - protein, 9 aa, Homo Sapiens
REIEELHKL

SEQ ID NO: 98759 - protein, 9 aa, Homo Sapiens
REIEGDLLL

SEQ ID NO: 98760 - protein, 9 aa, Homo Sapiens
REIFLFNDL

SEQ ID NO: 98761 - protein, 9 aa, Homo Sapiens
REIIQKLML

SEQ ID NO: 98762 - protein, 9 aa, Homo Sapiens
REIKFLDVL

SEQ ID NO: 98763 - protein, 9 aa, Homo Sapiens
REIKSSQGL

SEQ ID NO: 98764 - protein, 9 aa, Homo Sapiens
REIQEAIAV

SEQ ID NO: 98765 - protein, 9 aa, Homo Sapiens
REIQTAVRL

SEQ ID NO: 98766 - protein, 9 aa, Homo Sapiens
REIREENKL

SEQ ID NO: 98767 - protein, 9 aa, Homo Sapiens
REKDLEVYL

SEQ ID NO: 98768 - protein, 9 aa, Homo Sapiens
REKEIKSEL

SEQ ID NO: 98769 - protein, 9 aa, Homo Sapiens
REKIDQERL

SEQ ID NO: 98770 - protein, 9 aa, Homo Sapiens
REKKPEELI

SEQ ID NO: 98771 - protein, 9 aa, Homo Sapiens
REKLQEEML

SEQ ID NO: 98772 - protein, 9 aa, Homo Sapiens
REKQDTFAL

SEQ ID NO: 98773 - protein, 9 aa, Homo Sapiens
RELDIYNNL

SEQ ID NO: 98774 - protein, 9 aa, Homo Sapiens
RELDQKTWL

SEQ ID NO: 98775 - protein, 9 aa, Homo Sapiens
RELDVSYVL

SEQ ID NO: 98776 - protein, 9 aa, Homo Sapiens
RELECIREI

SEQ ID NO: 98777 - protein, 9 aa, Homo Sapiens
RELEKLFQL

SEQ ID NO: 98778 - protein, 9 aa, Homo Sapiens
RELGFSSNL

SEQ ID NO: 98779 - protein, 9 aa, Homo Sapiens
RELQGETKL

SEQ ID NO: 98780 - protein, 9 aa, Homo Sapiens
RELQSKEFL

SEQ ID NO: 98781 - protein, 9 aa, Homo Sapiens
RELYANVVL

SEQ ID NO: 98782 - protein, 9 aa, Homo Sapiens
RELYLFDVL

SEQ ID NO: 98783 - protein, 9 aa, Homo Sapiens
REMDEQIRL

SEQ ID NO: 98784 - protein, 9 aa, Homo Sapiens
REMEEKVTL

SEQ ID NO: 98785 - protein, 9 aa, Homo Sapiens
REMEENFAV

SEQ ID NO: 98786 - protein, 9 aa, Homo Sapiens
REMENKETL

SEQ ID NO: 98787 - protein, 9 aa, Homo Sapiens
REMFGYMKL

SEQ ID NO: 98788 - protein, 9 aa, Homo Sapiens
REMLIRVNM

SEQ ID NO: 98789 - protein, 9 aa, Homo Sapiens
RENDCIVRI

SEQ ID NO: 98790 - protein, 9 aa, Homo Sapiens
RENGQEILL

SEQ ID NO: 98791 - protein, 9 aa, Homo Sapiens
RENKTAVVV

SEQ ID NO: 98792 - protein, 9 aa, Homo Sapiens
RENWHEEVL

SEQ ID NO: 98793 - protein, 9 aa, Homo Sapiens
REPDQTFSL

SEQ ID NO: 98794 - protein, 9 aa, Homo Sapiens
REPELPCGL

SEQ ID NO: 98795 - protein, 9 aa, Homo Sapiens
REPESVEQL

SEQ ID NO: 98796 - protein, 9 aa, Homo Sapiens
REPLVRQVL

SEQ ID NO: 98797 - protein, 9 aa, Homo Sapiens
REPNVLICF

SEQ ID NO: 98798 - protein, 9 aa, Homo Sapiens
REPVQLETL

SEQ ID NO: 98799 - protein, 9 aa, Homo Sapiens
REQEEIVRL

SEQ ID NO: 98800 - protein, 9 aa, Homo Sapiens
REQRESLKL

SEQ ID NO: 98801 - protein, 9 aa, Homo Sapiens
RESERQLRL

SEQ ID NO: 98802 - protein, 9 aa, Homo Sapiens
RESLPIYKL

SEQ ID NO: 98803 - protein, 9 aa, Homo Sapiens
RESNEVVHL

SEQ ID NO: 98804 - protein, 9 aa, Homo Sapiens
RESPCHVKL

SEQ ID NO: 98805 - protein, 9 aa, Homo Sapiens
RESYVETEL

SEQ ID NO: 98806 - protein, 9 aa, Homo Sapiens
RETDDTLVL

SEQ ID NO: 98807 - protein, 9 aa, Homo Sapiens
RETDLQELF

SEQ ID NO: 98808 - protein, 9 aa, Homo Sapiens
RETEGGTVL

SEQ ID NO: 98809 - protein, 9 aa, Homo Sapiens
RETEHCVSL

SEQ ID NO: 98810 - protein, 9 aa, Homo Sapiens
RETELKVHL

SEQ ID NO: 98811 - protein, 9 aa, Homo Sapiens
RETGVIEKL

SEQ ID NO: 98812 - protein, 9 aa, Homo Sapiens
RETIIMNQI

SEQ ID NO: 98813 - protein, 9 aa, Homo Sapiens
RETKVLGAL

SEQ ID NO: 98814 - protein, 9 aa, Homo Sapiens
RETLQQHKL

SEQ ID NO: 98815 - protein, 9 aa, Homo Sapiens
RETSMVHEL

SEQ ID NO: 98816 - protein, 9 aa, Homo Sapiens
RETSSDVAL

SEQ ID NO: 98817 - protein, 9 aa, Homo Sapiens
RETTEVDLL

SEQ ID NO: 98818 - protein, 9 aa, Homo Sapiens
RETVIKQTM

SEQ ID NO: 98819 - protein, 9 aa, Homo Sapiens
REVDEQHQL

SEQ ID NO: 98820 - protein, 9 aa, Homo Sapiens
REVEDETVL

SEQ ID NO: 98821 - protein, 9 aa, Homo Sapiens
REVEIQSHL

SEQ ID NO: 98822 - protein, 9 aa, Homo Sapiens
REVIQSDSL

SEQ ID NO: 98823 - protein, 9 aa, Homo Sapiens
REVLPSTRL

SEQ ID NO: 98824 - protein, 9 aa, Homo Sapiens
REVSEEHNL

SEQ ID NO: 98825 - protein, 9 aa, Homo Sapiens
REVTPDQKL

SEQ ID NO: 98826 - protein, 9 aa, Homo Sapiens
REVVNKDVL

SEQ ID NO: 98827 - protein, 9 aa, Homo Sapiens
REWKGIDRL

SEQ ID NO: 98828 - protein, 9 aa, Homo Sapiens
REWPESVSL

SEQ ID NO: 98829 - protein, 9 aa, Homo Sapiens
REWQGRDLL

SEQ ID NO: 98830 - protein, 9 aa, Homo Sapiens
REWTEQETL

SEQ ID NO: 98831 - protein, 9 aa, Homo Sapiens
REWTGIDRL

SEQ ID NO: 98832 - protein, 9 aa, Homo Sapiens
REYTLMELL

SEQ ID NO: 98833 - protein, 9 aa, Homo Sapiens
RIDPESGDL

SEQ ID NO: 98834 - protein, 9 aa, Homo Sapiens
SEAAFIENL

SEQ ID NO: 98835 - protein, 9 aa, Homo Sapiens
SEADPAPLL

SEQ ID NO: 98836 - protein, 9 aa, Homo Sapiens
SEAEIFTTL

SEQ ID NO: 98837 - protein, 9 aa, Homo Sapiens
SEAEIRVFL

SEQ ID NO: 98838 - protein, 9 aa, Homo Sapiens
SEAERVSEL

SEQ ID NO: 98839 - protein, 9 aa, Homo Sapiens
SEAGSRIVL

SEQ ID NO: 98840 - protein, 9 aa, Homo Sapiens
SEAIVTVIM

SEQ ID NO: 98841 - protein, 9 aa, Homo Sapiens
SEAKDITCL

SEQ ID NO: 98842 - protein, 9 aa, Homo Sapiens
SEAKGLVTL

SEQ ID NO: 98843 - protein, 9 aa, Homo Sapiens
SEAMGLFCL

SEQ ID NO: 98844 - protein, 9 aa, Homo Sapiens
SEAPATVEL

SEQ ID NO: 98845 - protein, 9 aa, Homo Sapiens
SEAPEAPLL

SEQ ID NO: 98846 - protein, 9 aa, Homo Sapiens
SEAPFLHYL

SEQ ID NO: 98847 - protein, 9 aa, Homo Sapiens
SEAPGQRAL

SEQ ID NO: 98848 - protein, 9 aa, Homo Sapiens
SEAPSQPSL

SEQ ID NO: 98849 - protein, 9 aa, Homo Sapiens
SEAREKAVL

SEQ ID NO: 98850 - protein, 9 aa, Homo Sapiens
SEARLRDVL

SEQ ID NO: 98851 - protein, 9 aa, Homo Sapiens
SEARVKAEL

SEQ ID NO: 98852 - protein, 9 aa, Homo Sapiens
SEASFQEAL

SEQ ID NO: 98853 - protein, 9 aa, Homo Sapiens
SEAVFKEEL

SEQ ID NO: 98854 - protein, 9 aa, Homo Sapiens
SEAVIWEVL

SEQ ID NO: 98855 - protein, 9 aa, Homo Sapiens
SEAVLWEAL

SEQ ID NO: 98856 - protein, 9 aa, Homo Sapiens
SECDILHTL

SEQ ID NO: 98857 - protein, 9 aa, Homo Sapiens
SECGKAFSI

SEQ ID NO: 98858 - protein, 9 aa, Homo Sapiens
SECGPFIKL

SEQ ID NO: 98859 - protein, 9 aa, Homo Sapiens
SECKSRDVL

SEQ ID NO: 98860 - protein, 9 aa, Homo Sapiens
SECSKPEQL

SEQ ID NO: 98861 - protein, 9 aa, Homo Sapiens
SEDALCTVL

SEQ ID NO: 98862 - protein, 9 aa, Homo Sapiens
SEDASIHRL

SEQ ID NO: 98863 - protein, 9 aa, Homo Sapiens
SEDDTVLDL

SEQ ID NO: 98864 - protein, 9 aa, Homo Sapiens
SEDDVKMAL

SEQ ID NO: 98865 - protein, 9 aa, Homo Sapiens
SEDEVKLAL

SEQ ID NO: 98866 - protein, 9 aa, Homo Sapiens
SEDGAIHVI

SEQ ID NO: 98867 - protein, 9 aa, Homo Sapiens
SEDGDAHVL

SEQ ID NO: 98868 - protein, 9 aa, Homo Sapiens
SEDGQPMVL

SEQ ID NO: 98869 - protein, 9 aa, Homo Sapiens
SEDKKNIIL

SEQ ID NO: 98870 - protein, 9 aa, Homo Sapiens
SEDKQLHEL

SEQ ID NO: 98871 - protein, 9 aa, Homo Sapiens
SEDLNKHVL

SEQ ID NO: 98872 - protein, 9 aa, Homo Sapiens
SEDPEPLLL

SEQ ID NO: 98873 - protein, 9 aa, Homo Sapiens
SEDPNQAKL

SEQ ID NO: 98874 - protein, 9 aa, Homo Sapiens
SEDPSHPSM

SEQ ID NO: 98875 - protein, 9 aa, Homo Sapiens
SEDQSFVVL

SEQ ID NO: 98876 - protein, 9 aa, Homo Sapiens
SEDRMTLLL

SEQ ID NO: 98877 - protein, 9 aa, Homo Sapiens
SEDSHLESL

SEQ ID NO: 98878 - protein, 9 aa, Homo Sapiens
SEEAKSILL

SEQ ID NO: 98879 - protein, 9 aa, Homo Sapiens
SEEAVQVLI

SEQ ID NO: 98880 - protein, 9 aa, Homo Sapiens
SEEDRATVL

SEQ ID NO: 98881 - protein, 9 aa, Homo Sapiens
SEEDRVVVI

SEQ ID NO: 98882 - protein, 9 aa, Homo Sapiens
SEEETRVVF

SEQ ID NO: 98883 - protein, 9 aa, Homo Sapiens
SEEEVKLAL

SEQ ID NO: 98884 - protein, 9 aa, Homo Sapiens
SEEGGHVAV

SEQ ID NO: 98885 - protein, 9 aa, Homo Sapiens
SEEGLRNAL

SEQ ID NO: 98886 - protein, 9 aa, Homo Sapiens
SEEKCRITL

SEQ ID NO: 98887 - protein, 9 aa, Homo Sapiens
SEEMIKSEL

SEQ ID NO: 98888 - protein, 9 aa, Homo Sapiens
SEENITIKL

SEQ ID NO: 98889 - protein, 9 aa, Homo Sapiens
SEENKATPL

SEQ ID NO: 98890 - protein, 9 aa, Homo Sapiens
SEEPAGQIL

SEQ ID NO: 98891 - protein, 9 aa, Homo Sapiens
SEEPFTTVL

SEQ ID NO: 98892 - protein, 9 aa, Homo Sapiens
SEEPFVVKL

SEQ ID NO: 98893 - protein, 9 aa, Homo Sapiens
SEERAGAPL

SEQ ID NO: 98894 - protein, 9 aa, Homo Sapiens
SEERFHVEL

SEQ ID NO: 98895 - protein, 9 aa, Homo Sapiens
SEERVQVAL

SEQ ID NO: 98896 - protein, 9 aa, Homo Sapiens
SEESNVLCL

SEQ ID NO: 98897 - protein, 9 aa, Homo Sapiens
SEESRPQSL

SEQ ID NO: 98898 - protein, 9 aa, Homo Sapiens
SEEVHQAVL

SEQ ID NO: 98899 - protein, 9 aa, Homo Sapiens
SEEVSRSEL

SEQ ID NO: 98900 - protein, 9 aa, Homo Sapiens
SEEVVKAIL

SEQ ID NO: 98901 - protein, 9 aa, Homo Sapiens
SEFAKDPSL

SEQ ID NO: 98902 - protein, 9 aa, Homo Sapiens
SEFDFFERL

SEQ ID NO: 98903 - protein, 9 aa, Homo Sapiens
SEFEENTNL

SEQ ID NO: 98904 - protein, 9 aa, Homo Sapiens
SEFGAPVSV

SEQ ID NO: 98905 - protein, 9 aa, Homo Sapiens
SEFGRNYSL

SEQ ID NO: 98906 - protein, 9 aa, Homo Sapiens
SEFKAMDSI

SEQ ID NO: 98907 - protein, 9 aa, Homo Sapiens
SEFLKEEKL

SEQ ID NO: 98908 - protein, 9 aa, Homo Sapiens
SEFQDDPVL

SEQ ID NO: 98909 - protein, 9 aa, Homo Sapiens
SEFQKAVKL

SEQ ID NO: 98910 - protein, 9 aa, Homo Sapiens
SEFSLVDKL

SEQ ID NO: 98911 - protein, 9 aa, Homo Sapiens
SEFVDPSSL

SEQ ID NO: 98912 - protein, 9 aa, Homo Sapiens
SEFYEPEAL

SEQ ID NO: 98913 - protein, 9 aa, Homo Sapiens
SEFYKHIVL

SEQ ID NO: 98914 - protein, 9 aa, Homo Sapiens
SEGDPDLVL

SEQ ID NO: 98915 - protein, 9 aa, Homo Sapiens
SEGKCFSVL

SEQ ID NO: 98916 - protein, 9 aa, Homo Sapiens
SEGKDSVVL

SEQ ID NO: 98917 - protein, 9 aa, Homo Sapiens
SEGLPEPVL

SEQ ID NO: 98918 - protein, 9 aa, Homo Sapiens
SEGPAQVYL

SEQ ID NO: 98919 - protein, 9 aa, Homo Sapiens
SEGPHHVAL

SEQ ID NO: 98920 - protein, 9 aa, Homo Sapiens
SEGPIVATL

SEQ ID NO: 98921 - protein, 9 aa, Homo Sapiens
SEGPPAPAL

SEQ ID NO: 98922 - protein, 9 aa, Homo Sapiens
SEGVVAVLL

SEQ ID NO: 98923 - protein, 9 aa, Homo Sapiens
SEHAVEAML

SEQ ID NO: 98924 - protein, 9 aa, Homo Sapiens
SEHELDVAL

SEQ ID NO: 98925 - protein, 9 aa, Homo Sapiens
SEHGINIDL

SEQ ID NO: 98926 - protein, 9 aa, Homo Sapiens
SEHLAAIEI

SEQ ID NO: 98927 - protein, 9 aa, Homo Sapiens
SEHLTESIL

SEQ ID NO: 98928 - protein, 9 aa, Homo Sapiens
SEHSMDTLL

SEQ ID NO: 98929 - protein, 9 aa, Homo Sapiens
SEIEDAAFL

SEQ ID NO: 98930 - protein, 9 aa, Homo Sapiens
SEIEDVNTL

SEQ ID NO: 98931 - protein, 9 aa, Homo Sapiens
SEIEYYAML

SEQ ID NO: 98932 - protein, 9 aa, Homo Sapiens
SEIGQKQKL

SEQ ID NO: 98933 - protein, 9 aa, Homo Sapiens
SEILDGNQL

SEQ ID NO: 98934 - protein, 9 aa, Homo Sapiens
SEIQVLEHL

SEQ ID NO: 98935 - protein, 9 aa, Homo Sapiens
SEISQVFEI

SEQ ID NO: 98936 - protein, 9 aa, Homo Sapiens
SEISSATKL

SEQ ID NO: 98937 - protein, 9 aa, Homo Sapiens
SEKRNTCVL

SEQ ID NO: 98938 - protein, 9 aa, Homo Sapiens
SEKVDRAVL

SEQ ID NO: 98939 - protein, 9 aa, Homo Sapiens
SELATALAL

SEQ ID NO: 98940 - protein, 9 aa, Homo Sapiens
SELDLISRL

SEQ ID NO: 98941 - protein, 9 aa, Homo Sapiens
SELEKTFNL

SEQ ID NO: 98942 - protein, 9 aa, Homo Sapiens
SELGESSLI

SEQ ID NO: 98943 - protein, 9 aa, Homo Sapiens
SELIRNVTL

SEQ ID NO: 98944 - protein, 9 aa, Homo Sapiens
SELKETVEL

SEQ ID NO: 98945 - protein, 9 aa, Homo Sapiens
SELKKVVAL

SEQ ID NO: 98946 - protein, 9 aa, Homo Sapiens
SELMDITKL

SEQ ID NO: 98947 - protein, 9 aa, Homo Sapiens
SELNGHHTL

SEQ ID NO: 98948 - protein, 9 aa, Homo Sapiens
SELQVHSAL

SEQ ID NO: 98949 - protein, 9 aa, Homo Sapiens
SELRDIYDL

SEQ ID NO: 98950 - protein, 9 aa, Homo Sapiens
SELRSVEGL

SEQ ID NO: 98951 - protein, 9 aa, Homo Sapiens
SEMAVAHAL

SEQ ID NO: 98952 - protein, 9 aa, Homo Sapiens
SEMIDKLTL

SEQ ID NO: 98953 - protein, 9 aa, Homo Sapiens
SEMRFVQDL

SEQ ID NO: 98954 - protein, 9 aa, Homo Sapiens
SEMRYGIEI

SEQ ID NO: 98955 - protein, 9 aa, Homo Sapiens
SEMVELVEL

SEQ ID NO: 98956 - protein, 9 aa, Homo Sapiens
SENKLPAEL

SEQ ID NO: 98957 - protein, 9 aa, Homo Sapiens
SENNRIFTL

SEQ ID NO: 98958 - protein, 9 aa, Homo Sapiens
SENVLQVHL

SEQ ID NO: 98959 - protein, 9 aa, Homo Sapiens
SEPEIEIKL

SEQ ID NO: 98960 - protein, 9 aa, Homo Sapiens
SEPGKVIVL

SEQ ID NO: 98961 - protein, 9 aa, Homo Sapiens
SEPGPAEEL

SEQ ID NO: 98962 - protein, 9 aa, Homo Sapiens
SEPHILETL

SEQ ID NO: 98963 - protein, 9 aa, Homo Sapiens
SEPMICHTL

SEQ ID NO: 98964 - protein, 9 aa, Homo Sapiens
SEPPVYANL

SEQ ID NO: 98965 - protein, 9 aa, Homo Sapiens
SEPSQHVVL

SEQ ID NO: 98966 - protein, 9 aa, Homo Sapiens
SEPSSTVSL

SEQ ID NO: 98967 - protein, 9 aa, Homo Sapiens
SEQEEPIEL

SEQ ID NO: 98968 - protein, 9 aa, Homo Sapiens
SEQGLIEIL

SEQ ID NO: 98969 - protein, 9 aa, Homo Sapiens
SEQRLLIVL

SEQ ID NO: 98970 - protein, 9 aa, Homo Sapiens
SEQTGKELL

SEQ ID NO: 98971 - protein, 9 aa, Homo Sapiens
SESALPTSL

SEQ ID NO: 98972 - protein, 9 aa, Homo Sapiens
SESASPSAL

SEQ ID NO: 98973 - protein, 9 aa, Homo Sapiens
SESDKTAVL

SEQ ID NO: 98974 - protein, 9 aa, Homo Sapiens
SESHRFTVL

SEQ ID NO: 98975 - protein, 9 aa, Homo Sapiens
SESHVHSLL

SEQ ID NO: 98976 - protein, 9 aa, Homo Sapiens
SESKIRVLL

SEQ ID NO: 98977 - protein, 9 aa, Homo Sapiens
SESLPVETL

SEQ ID NO: 98978 - protein, 9 aa, Homo Sapiens
SESLVYTTL

SEQ ID NO: 98979 - protein, 9 aa, Homo Sapiens
SESNHLIHL

SEQ ID NO: 98980 - protein, 9 aa, Homo Sapiens
SESPGATEL

SEQ ID NO: 98981 - protein, 9 aa, Homo Sapiens
SESPIVVVL

SEQ ID NO: 98982 - protein, 9 aa, Homo Sapiens
SESPRSTSL

SEQ ID NO: 98983 - protein, 9 aa, Homo Sapiens
SESPVWVKL

SEQ ID NO: 98984 - protein, 9 aa, Homo Sapiens
SESQDQVFL

SEQ ID NO: 98985 - protein, 9 aa, Homo Sapiens
SESQKAVEL

SEQ ID NO: 98986 - protein, 9 aa, Homo Sapiens
SESRIFNEL

SEQ ID NO: 98987 - protein, 9 aa, Homo Sapiens
SESRYPQAL

SEQ ID NO: 98988 - protein, 9 aa, Homo Sapiens
SESSCKSWL

SEQ ID NO: 98989 - protein, 9 aa, Homo Sapiens
SESSVKVRL

SEQ ID NO: 98990 - protein, 9 aa, Homo Sapiens
SESTAESHL

SEQ ID NO: 98991 - protein, 9 aa, Homo Sapiens
SESVASSQL

SEQ ID NO: 98992 - protein, 9 aa, Homo Sapiens
SETEAKALL

SEQ ID NO: 98993 - protein, 9 aa, Homo Sapiens
SETEGTPKL

SEQ ID NO: 98994 - protein, 9 aa, Homo Sapiens
SETINTELL

SEQ ID NO: 98995 - protein, 9 aa, Homo Sapiens
SETLPLLAL

SEQ ID NO: 98996 - protein, 9 aa, Homo Sapiens
SETRVLVDI

SEQ ID NO: 98997 - protein, 9 aa, Homo Sapiens
SETSSVSHI

SEQ ID NO: 98998 - protein, 9 aa, Homo Sapiens
SETTAAHSL

SEQ ID NO: 98999 - protein, 9 aa, Homo Sapiens
SETTERTVL

SEQ ID NO: 99000 - protein, 9 aa, Homo Sapiens
SETTVAPSL

SEQ ID NO: 99001 - protein, 9 aa, Homo Sapiens
SETVVTGSL

SEQ ID NO: 99002 - protein, 9 aa, Homo Sapiens
SEVDINTTL

SEQ ID NO: 99003 - protein, 9 aa, Homo Sapiens
SEVDSPNVL

SEQ ID NO: 99004 - protein, 9 aa, Homo Sapiens
SEVEKGEAL

SEQ ID NO: 99005 - protein, 9 aa, Homo Sapiens
SEVGKTPTL

SEQ ID NO: 99006 - protein, 9 aa, Homo Sapiens
SEVGSDHEL

SEQ ID NO: 99007 - protein, 9 aa, Homo Sapiens
SEVGTDHKL

SEQ ID NO: 99008 - protein, 9 aa, Homo Sapiens
SEVIFGHVL

SEQ ID NO: 99009 - protein, 9 aa, Homo Sapiens
SEVIGPVSL

SEQ ID NO: 99010 - protein, 9 aa, Homo Sapiens
SEVKEDVVL

SEQ ID NO: 99011 - protein, 9 aa, Homo Sapiens
SEVMGEPHL

SEQ ID NO: 99012 - protein, 9 aa, Homo Sapiens
SEVNIPLSL

SEQ ID NO: 99013 - protein, 9 aa, Homo Sapiens
SEVNPSVEL

SEQ ID NO: 99014 - protein, 9 aa, Homo Sapiens
SEVQDRVML

SEQ ID NO: 99015 - protein, 9 aa, Homo Sapiens
SEVQGMVEL

SEQ ID NO: 99016 - protein, 9 aa, Homo Sapiens
SEVSTVLKL

SEQ ID NO: 99017 - protein, 9 aa, Homo Sapiens
SEVVEASSL

SEQ ID NO: 99018 - protein, 9 aa, Homo Sapiens
SEVVEIQAL

SEQ ID NO: 99019 - protein, 9 aa, Homo Sapiens
SEVVGSSTL

SEQ ID NO: 99020 - protein, 9 aa, Homo Sapiens
SEVVTGSGL

SEQ ID NO: 99021 - protein, 9 aa, Homo Sapiens
SEVYSNPCL

SEQ ID NO: 99022 - protein, 9 aa, Homo Sapiens
SEWDGHEEL

SEQ ID NO: 99023 - protein, 9 aa, Homo Sapiens
SEWDGIVTV

SEQ ID NO: 99024 - protein, 9 aa, Homo Sapiens
SEWNTVERL

SEQ ID NO: 99025 - protein, 9 aa, Homo Sapiens
SEYGEEPIL

SEQ ID NO: 99026 - protein, 9 aa, Homo Sapiens
SEYRFPEEL

SEQ ID NO: 99027 - protein, 9 aa, Homo Sapiens
SEYSVHSSL

SEQ ID NO: 99028 - protein, 9 aa, Homo Sapiens
TEAAHPIRL

SEQ ID NO: 99029 - protein, 9 aa, Homo Sapiens
TEAATRCQL

SEQ ID NO: 99030 - protein, 9 aa, Homo Sapiens
TEADVEEAL

SEQ ID NO: 99031 - protein, 9 aa, Homo Sapiens
TEADVKIVI

SEQ ID NO: 99032 - protein, 9 aa, Homo Sapiens
TEAEIDAHL

SEQ ID NO: 99033 - protein, 9 aa, Homo Sapiens
TEAFDIATL

SEQ ID NO: 99034 - protein, 9 aa, Homo Sapiens
TEALIRTCL

SEQ ID NO: 99035 - protein, 9 aa, Homo Sapiens
TEAQVTQEL

SEQ ID NO: 99036 - protein, 9 aa, Homo Sapiens
TEATAGNVL

SEQ ID NO: 99037 - protein, 9 aa, Homo Sapiens
TEAVVDSIL

SEQ ID NO: 99038 - protein, 9 aa, Homo Sapiens
TEAVVKEKL

SEQ ID NO: 99039 - protein, 9 aa, Homo Sapiens
TEAWLQEKL

SEQ ID NO: 99040 - protein, 9 aa, Homo Sapiens
TECQETVQL

SEQ ID NO: 99041 - protein, 9 aa, Homo Sapiens
TECSDPVEL

SEQ ID NO: 99042 - protein, 9 aa, Homo Sapiens
TECVKQICL

SEQ ID NO: 99043 - protein, 9 aa, Homo Sapiens
TEDDKQLLL

SEQ ID NO: 99044 - protein, 9 aa, Homo Sapiens
TEDHVMHLL

SEQ ID NO: 99045 - protein, 9 aa, Homo Sapiens
TEDITRYFL

SEQ ID NO: 99046 - protein, 9 aa, Homo Sapiens
TEDKISLLL

SEQ ID NO: 99047 - protein, 9 aa, Homo Sapiens
TEDQRFPQL

SEQ ID NO: 99048 - protein, 9 aa, Homo Sapiens
TEDRIQHAL

SEQ ID NO: 99049 - protein, 9 aa, Homo Sapiens
TEEDVKFYL

SEQ ID NO: 99050 - protein, 9 aa, Homo Sapiens
TEEGQKIVL

SEQ ID NO: 99051 - protein, 9 aa, Homo Sapiens
TEEKLTPVL

SEQ ID NO: 99052 - protein, 9 aa, Homo Sapiens
TEETTHVVM

SEQ ID NO: 99053 - protein, 9 aa, Homo Sapiens
TEEVCRIYL

SEQ ID NO: 99054 - protein, 9 aa, Homo Sapiens
TEFDAAQVL

SEQ ID NO: 99055 - protein, 9 aa, Homo Sapiens
TEFEQQERL

SEQ ID NO: 99056 - protein, 9 aa, Homo Sapiens
TEFLDISQL

SEQ ID NO: 99057 - protein, 9 aa, Homo Sapiens
TEFLIEPSL

SEQ ID NO: 99058 - protein, 9 aa, Homo Sapiens
TEGEDKITL

SEQ ID NO: 99059 - protein, 9 aa, Homo Sapiens
TEHEKVAIL

SEQ ID NO: 99060 - protein, 9 aa, Homo Sapiens
TEHGEFLAL

SEQ ID NO: 99061 - protein, 9 aa, Homo Sapiens
TEHGVEVVL

SEQ ID NO: 99062 - protein, 9 aa, Homo Sapiens
TEHINIHQL

SEQ ID NO: 99063 - protein, 9 aa, Homo Sapiens
TEHPENFNL

SEQ ID NO: 99064 - protein, 9 aa, Homo Sapiens
TEHPVPIIL

SEQ ID NO: 99065 - protein, 9 aa, Homo Sapiens
TEIDPICAL

SEQ ID NO: 99066 - protein, 9 aa, Homo Sapiens
TEIDPINAL

SEQ ID NO: 99067 - protein, 9 aa, Homo Sapiens
TEIEDMPTL

SEQ ID NO: 99068 - protein, 9 aa, Homo Sapiens
TEIEDSHTL

SEQ ID NO: 99069 - protein, 9 aa, Homo Sapiens
TEIEGTQKL

SEQ ID NO: 99070 - protein, 9 aa, Homo Sapiens
TEIGQTLDL

SEQ ID NO: 99071 - protein, 9 aa, Homo Sapiens
TEIKKTEVL

SEQ ID NO: 99072 - protein, 9 aa, Homo Sapiens
TEIQLVQSL

SEQ ID NO: 99073 - protein, 9 aa, Homo Sapiens
TEIQQQSAL

SEQ ID NO: 99074 - protein, 9 aa, Homo Sapiens
TEITHAVVI

SEQ ID NO: 99075 - protein, 9 aa, Homo Sapiens
TEKEDFIEL

SEQ ID NO: 99076 - protein, 9 aa, Homo Sapiens
TEKTKPEVL

SEQ ID NO: 99077 - protein, 9 aa, Homo Sapiens
TELEYIHAL

SEQ ID NO: 99078 - protein, 9 aa, Homo Sapiens
TELGDELTL

SEQ ID NO: 99079 - protein, 9 aa, Homo Sapiens
TELPVMVEL

SEQ ID NO: 99080 - protein, 9 aa, Homo Sapiens
TELTTKSSL

SEQ ID NO: 99081 - protein, 9 aa, Homo Sapiens
TEMEQDYQL

SEQ ID NO: 99082 - protein, 9 aa, Homo Sapiens
TENLVRELL

SEQ ID NO: 99083 - protein, 9 aa, Homo Sapiens
TENNDHINL

SEQ ID NO: 99084 - protein, 9 aa, Homo Sapiens
TESDIREMM

SEQ ID NO: 99085 - protein, 9 aa, Homo Sapiens
TESDTAVRL

SEQ ID NO: 99086 - protein, 9 aa, Homo Sapiens
TESGLNVTL

SEQ ID NO: 99087 - protein, 9 aa, Homo Sapiens
TESKDDPSL

SEQ ID NO: 99088 - protein, 9 aa, Homo Sapiens
TESPENVAL

SEQ ID NO: 99089 - protein, 9 aa, Homo Sapiens
TESQVVITL

SEQ ID NO: 99090 - protein, 9 aa, Homo Sapiens
TESRQVVEL

SEQ ID NO: 99091 - protein, 9 aa, Homo Sapiens
TESTARVEL

SEQ ID NO: 99092 - protein, 9 aa, Homo Sapiens
TETEIVTSL

SEQ ID NO: 99093 - protein, 9 aa, Homo Sapiens
TETEPPVAL

SEQ ID NO: 99094 - protein, 9 aa, Homo Sapiens
TETNVYFKL

SEQ ID NO: 99095 - protein, 9 aa, Homo Sapiens
TETQEKNPL

SEQ ID NO: 99096 - protein, 9 aa, Homo Sapiens
TETRLECLL

SEQ ID NO: 99097 - protein, 9 aa, Homo Sapiens
TETVVTEYL

SEQ ID NO: 99098 - protein, 9 aa, Homo Sapiens
TEVGEKIAL

SEQ ID NO: 99099 - protein, 9 aa, Homo Sapiens
TEVKTSTVI

SEQ ID NO: 99100 - protein, 9 aa, Homo Sapiens
TEVPVEPVL

SEQ ID NO: 99101 - protein, 9 aa, Homo Sapiens
TEVRELVSL

SEQ ID NO: 99102 - protein, 9 aa, Homo Sapiens
TEVRVANEL

SEQ ID NO: 99103 - protein, 9 aa, Homo Sapiens
TEVSKVPSL

SEQ ID NO: 99104 - protein, 9 aa, Homo Sapiens
TEYEKDFSL

SEQ ID NO: 99105 - protein, 9 aa, Homo Sapiens
TEYLEPVVL

SEQ ID NO: 99106 - protein, 9 aa, Homo Sapiens
TVLVPTRHP

SEQ ID NO: 99107 - protein, 9 aa, Homo Sapiens
VEADLVEAL

SEQ ID NO: 99108 - protein, 9 aa, Homo Sapiens
VEAIESYVL

SEQ ID NO: 99109 - protein, 9 aa, Homo Sapiens
VEALPGPSL

SEQ ID NO: 99110 - protein, 9 aa, Homo Sapiens
VEALTKEEL

SEQ ID NO: 99111 - protein, 9 aa, Homo Sapiens
VEANYPETL

SEQ ID NO: 99112 - protein, 9 aa, Homo Sapiens
VEAPPSVVL

SEQ ID NO: 99113 - protein, 9 aa, Homo Sapiens
VEASGGITL

SEQ ID NO: 99114 - protein, 9 aa, Homo Sapiens
VECQLKTTL

SEQ ID NO: 99115 - protein, 9 aa, Homo Sapiens
VEDDIQQLL

SEQ ID NO: 99116 - protein, 9 aa, Homo Sapiens
VEDITPPRL

SEQ ID NO: 99117 - protein, 9 aa, Homo Sapiens
VEDKGACRL

SEQ ID NO: 99118 - protein, 9 aa, Homo Sapiens
VEDPYTASL

SEQ ID NO: 99119 - protein, 9 aa, Homo Sapiens
VEDRPQDPL

SEQ ID NO: 99120 - protein, 9 aa, Homo Sapiens
VEDVSWHLL

SEQ ID NO: 99121 - protein, 9 aa, Homo Sapiens
VEEAQVITL

SEQ ID NO: 99122 - protein, 9 aa, Homo Sapiens
VEEGKSITL

SEQ ID NO: 99123 - protein, 9 aa, Homo Sapiens
VEEPTVLVL

SEQ ID NO: 99124 - protein, 9 aa, Homo Sapiens
VEEQRPPEL

SEQ ID NO: 99125 - protein, 9 aa, Homo Sapiens
VEERNTISL

SEQ ID NO: 99126 - protein, 9 aa, Homo Sapiens
VEERPAVSL

SEQ ID NO: 99127 - protein, 9 aa, Homo Sapiens
VEETSHQAL

SEQ ID NO: 99128 - protein, 9 aa, Homo Sapiens
VEFADEVRL

SEQ ID NO: 99129 - protein, 9 aa, Homo Sapiens
VEFDEVDSL

SEQ ID NO: 99130 - protein, 9 aa, Homo Sapiens
VEFEDGSQI

SEQ ID NO: 99131 - protein, 9 aa, Homo Sapiens
VEFFHVEDL

SEQ ID NO: 99132 - protein, 9 aa, Homo Sapiens
VEFPHSPEI

SEQ ID NO: 99133 - protein, 9 aa, Homo Sapiens
VEFPLDPAL

SEQ ID NO: 99134 - protein, 9 aa, Homo Sapiens
VEFREVTEL

SEQ ID NO: 99135 - protein, 9 aa, Homo Sapiens
VEGDPIVAL

SEQ ID NO: 99136 - protein, 9 aa, Homo Sapiens
VEHFMPILM

SEQ ID NO: 99137 - protein, 9 aa, Homo Sapiens
VEIHIPITL

SEQ ID NO: 99138 - protein, 9 aa, Homo Sapiens
VEMDIVEKL

SEQ ID NO: 99139 - protein, 9 aa, Homo Sapiens
VEMRDNPEL

SEQ ID NO: 99140 - protein, 9 aa, Homo Sapiens
VENNDIIIL

SEQ ID NO: 99141 - protein, 9 aa, Homo Sapiens
VEQPEDYTL

SEQ ID NO: 99142 - protein, 9 aa, Homo Sapiens
VESGLKTIL

SEQ ID NO: 99143 - protein, 9 aa, Homo Sapiens
VESHIQHSL

SEQ ID NO: 99144 - protein, 9 aa, Homo Sapiens
VESKVKDIL

SEQ ID NO: 99145 - protein, 9 aa, Homo Sapiens
VETAEGVAL

SEQ ID NO: 99146 - protein, 9 aa, Homo Sapiens
VETATELLL

SEQ ID NO: 99147 - protein, 9 aa, Homo Sapiens
VETVYTHVL

SEQ ID NO: 99148 - protein, 9 aa, Homo Sapiens
VEVPDGPTL

SEQ ID NO: 99149 - protein, 9 aa, Homo Sapiens
VEVSIPAKL

SEQ ID NO: 99150 - protein, 9 aa, Homo Sapiens
VEVTAGNRL

SEQ ID NO: 99151 - protein, 9 aa, Homo Sapiens
VEWNKKEEL

SEQ ID NO: 99152 - protein, 9 aa, Homo Sapiens
VSDAETESI

SEQ ID NO: 99153 - protein, 9 aa, Homo Sapiens
WEAQEPIQM

SEQ ID NO: 99154 - protein, 9 aa, Homo Sapiens
WEEERQPIL

SEQ ID NO: 99155 - protein, 9 aa, Homo Sapiens
WEIEDNQLL

SEQ ID NO: 99156 - protein, 9 aa, Homo Sapiens
WEISQKTVL

SEQ ID NO: 99157 - protein, 9 aa, Homo Sapiens
WESSIVDRL

SEQ ID NO: 99158 - protein, 9 aa, Homo Sapiens
WESSNKALL

SEQ ID NO: 99159 - protein, 9 aa, Homo Sapiens
WETEKICQL

SEQ ID NO: 99160 - protein, 9 aa, Homo Sapiens
WEYDESHVI

SEQ ID NO: 99161 - protein, 9 aa, Homo Sapiens
YEAGPDAVL

SEQ ID NO: 99162 - protein, 9 aa, Homo Sapiens
YEAPDVMNL

SEQ ID NO: 99163 - protein, 9 aa, Homo Sapiens
YEASLPHQI

SEQ ID NO: 99164 - protein, 9 aa, Homo Sapiens
YEDATKITV

SEQ ID NO: 99165 - protein, 9 aa, Homo Sapiens
YEDFHIVKL

SEQ ID NO: 99166 - protein, 9 aa, Homo Sapiens
YEDIKNVVL

SEQ ID NO: 99167 - protein, 9 aa, Homo Sapiens
YEDKTALSL

SEQ ID NO: 99168 - protein, 9 aa, Homo Sapiens
YEDPQHHPL

SEQ ID NO: 99169 - protein, 9 aa, Homo Sapiens
YEDQTKPVL

SEQ ID NO: 99170 - protein, 9 aa, Homo Sapiens
YEDVNPVLL

SEQ ID NO: 99171 - protein, 9 aa, Homo Sapiens
YEEDSKETL

SEQ ID NO: 99172 - protein, 9 aa, Homo Sapiens
YEEEQFTVL

SEQ ID NO: 99173 - protein, 9 aa, Homo Sapiens
YEEEVKKTL

SEQ ID NO: 99174 - protein, 9 aa, Homo Sapiens
YEEGINIHL

SEQ ID NO: 99175 - protein, 9 aa, Homo Sapiens
YEEGLRVVI

SEQ ID NO: 99176 - protein, 9 aa, Homo Sapiens
YEEILNTKL

SEQ ID NO: 99177 - protein, 9 aa, Homo Sapiens
YEEITKWYL

SEQ ID NO: 99178 - protein, 9 aa, Homo Sapiens
YEELVRMVL

SEQ ID NO: 99179 - protein, 9 aa, Homo Sapiens
YEENAKAEL

SEQ ID NO: 99180 - protein, 9 aa, Homo Sapiens
YEERVQAVV

SEQ ID NO: 99181 - protein, 9 aa, Homo Sapiens
YEETRQEVL

SEQ ID NO: 99182 - protein, 9 aa, Homo Sapiens
YEEVHVPAL

SEQ ID NO: 99183 - protein, 9 aa, Homo Sapiens
YEFEGGVKL

SEQ ID NO: 99184 - protein, 9 aa, Homo Sapiens
YEIDDVERL

SEQ ID NO: 99185 - protein, 9 aa, Homo Sapiens
YEIEKEPLL

SEQ ID NO: 99186 - protein, 9 aa, Homo Sapiens
YEIHDGMNL

SEQ ID NO: 99187 - protein, 9 aa, Homo Sapiens
YEILNNPEL

SEQ ID NO: 99188 - protein, 9 aa, Homo Sapiens
YELEKLWTL

SEQ ID NO: 99189 - protein, 9 aa, Homo Sapiens
YELGGPMTL

SEQ ID NO: 99190 - protein, 9 aa, Homo Sapiens
YELPDGQVI

SEQ ID NO: 99191 - protein, 9 aa, Homo Sapiens
YELYEKLEL

SEQ ID NO: 99192 - protein, 9 aa, Homo Sapiens
YEMEVSQRL

SEQ ID NO: 99193 - protein, 9 aa, Homo Sapiens
YENMVTEIM

SEQ ID NO: 99194 - protein, 9 aa, Homo Sapiens
YEPKLIIDL

SEQ ID NO: 99195 - protein, 9 aa, Homo Sapiens
YEQLLDVKI

SEQ ID NO: 99196 - protein, 9 aa, Homo Sapiens
YESGEYEML

SEQ ID NO: 99197 - protein, 9 aa, Homo Sapiens
YESHYALPL

SEQ ID NO: 99198 - protein, 9 aa, Homo Sapiens
YESPGKIFL

SEQ ID NO: 99199 - protein, 9 aa, Homo Sapiens
YETFISDVL

SEQ ID NO: 99200 - protein, 9 aa, Homo Sapiens
YETKDALCL

SEQ ID NO: 99201 - protein, 9 aa, Homo Sapiens
YEVQSEAKL

SEQ ID NO: 99202 - protein, 9 aa, Homo Sapiens
YEVVDKDSI

SEQ ID NO: 99203 - protein, 10 aa, Homo Sapiens
AEAAPDGPAL

SEQ ID NO: 99204 - protein, 10 aa, Homo Sapiens
AEADEIFQEL

SEQ ID NO: 99205 - protein, 10 aa, Homo Sapiens
AEADGAAWVL

SEQ ID NO: 99206 - protein, 10 aa, Homo Sapiens
AEADQIIEYL

SEQ ID NO: 99207 - protein, 10 aa, Homo Sapiens
AEAECQRQQL

SEQ ID NO: 99208 - protein, 10 aa, Homo Sapiens
AEAENKAAAL

SEQ ID NO: 99209 - protein, 10 aa, Homo Sapiens
AEAGADLVLL

SEQ ID NO: 99210 - protein, 10 aa, Homo Sapiens
AEAGSRMDKL

SEQ ID NO: 99211 - protein, 10 aa, Homo Sapiens
AEAKPITEML

SEQ ID NO: 99212 - protein, 10 aa, Homo Sapiens
AEALLTYETL

SEQ ID NO: 99213 - protein, 10 aa, Homo Sapiens
AEAMADKAEL

SEQ ID NO: 99214 - protein, 10 aa, Homo Sapiens
AEAPLPSPKL

SEQ ID NO: 99215 - protein, 10 aa, Homo Sapiens
AEAPVQEEKL

SEQ ID NO: 99216 - protein, 10 aa, Homo Sapiens
AEAQAGTTTL

SEQ ID NO: 99217 - protein, 10 aa, Homo Sapiens
AEAQALRQEL

SEQ ID NO: 99218 - protein, 10 aa, Homo Sapiens
AEAQGSTTLL

SEQ ID NO: 99219 - protein, 10 aa, Homo Sapiens
AEASSVKNEL

SEQ ID NO: 99220 - protein, 10 aa, Homo Sapiens
AEATLGSGNL

SEQ ID NO: 99221 - protein, 10 aa, Homo Sapiens
AEAWMSEQEL

SEQ ID NO: 99222 - protein, 10 aa, Homo Sapiens
AECGLRILAF

SEQ ID NO: 99223 - protein, 10 aa, Homo Sapiens
AECGPPPFFL

SEQ ID NO: 99224 - protein, 10 aa, Homo Sapiens
AECHLNPIIL

SEQ ID NO: 99225 - protein, 10 aa, Homo Sapiens
AECNAVRQAL

SEQ ID NO: 99226 - protein, 10 aa, Homo Sapiens
AECPIAEENL

SEQ ID NO: 99227 - protein, 10 aa, Homo Sapiens
AEDDIRGIQL

SEQ ID NO: 99228 - protein, 10 aa, Homo Sapiens
AEDELRDAVL

SEQ ID NO: 99229 - protein, 10 aa, Homo Sapiens
AEDENTQIAL

SEQ ID NO: 99230 - protein, 10 aa, Homo Sapiens
AEDITTGQVL

SEQ ID NO: 99231 - protein, 10 aa, Homo Sapiens
AEDNADTLAL

SEQ ID NO: 99232 - protein, 10 aa, Homo Sapiens
AEDPETQVVL

SEQ ID NO: 99233 - protein, 10 aa, Homo Sapiens
AEDPLGAIHL

SEQ ID NO: 99234 - protein, 10 aa, Homo Sapiens
AEDRQICPSL

SEQ ID NO: 99235 - protein, 10 aa, Homo Sapiens
AEDVPVRIAL

SEQ ID NO: 99236 - protein, 10 aa, Homo Sapiens
AEEALRTDIL

SEQ ID NO: 99237 - protein, 10 aa, Homo Sapiens
AEEDHVDLSL

SEQ ID NO: 99238 - protein, 10 aa, Homo Sapiens
AEEEAARVAL

SEQ ID NO: 99239 - protein, 10 aa, Homo Sapiens
AEEESTLTKL

SEQ ID NO: 99240 - protein, 10 aa, Homo Sapiens
AEEGEVHVAL

SEQ ID NO: 99241 - protein, 10 aa, Homo Sapiens
AEEGVMTPEL

SEQ ID NO: 99242 - protein, 10 aa, Homo Sapiens
AEEKAAVTSL

SEQ ID NO: 99243 - protein, 10 aa, Homo Sapiens
AEEKIPPSTL

SEQ ID NO: 99244 - protein, 10 aa, Homo Sapiens
AEEKLCPASL

SEQ ID NO: 99245 - protein, 10 aa, Homo Sapiens
AEELGRGIAL

SEQ ID NO: 99246 - protein, 10 aa, Homo Sapiens
AEEQKTSGIM

SEQ ID NO: 99247 - protein, 10 aa, Homo Sapiens
AEERAEVSEL

SEQ ID NO: 99248 - protein, 10 aa, Homo Sapiens
AEERPTFDYL

SEQ ID NO: 99249 - protein, 10 aa, Homo Sapiens
AEERSQFEIL

SEQ ID NO: 99250 - protein, 10 aa, Homo Sapiens
AEESAFSTVL

SEQ ID NO: 99251 - protein, 10 aa, Homo Sapiens
AEESQIRIEL

SEQ ID NO: 99252 - protein, 10 aa, Homo Sapiens
AEFDDRRGVL

SEQ ID NO: 99253 - protein, 10 aa, Homo Sapiens
AEFDTPGHTL

SEQ ID NO: 99254 - protein, 10 aa, Homo Sapiens
AEFEDLDSLL

SEQ ID NO: 99255 - protein, 10 aa, Homo Sapiens
AEFEQGHQFL

SEQ ID NO: 99256 - protein, 10 aa, Homo Sapiens
AEFFLQEERL

SEQ ID NO: 99257 - protein, 10 aa, Homo Sapiens
AEFHTELERL

SEQ ID NO: 99258 - protein, 10 aa, Homo Sapiens
AEFLMKNSDL

SEQ ID NO: 99259 - protein, 10 aa, Homo Sapiens
AEFLPDPSAL

SEQ ID NO: 99260 - protein, 10 aa, Homo Sapiens
AEFPEKEAQL

SEQ ID NO: 99261 - protein, 10 aa, Homo Sapiens
AEFPGLPEAL

SEQ ID NO: 99262 - protein, 10 aa, Homo Sapiens
AEFQEHEHAL

SEQ ID NO: 99263 - protein, 10 aa, Homo Sapiens
AEFQGYNVLL

SEQ ID NO: 99264 - protein, 10 aa, Homo Sapiens
AEFRDYPPVL

SEQ ID NO: 99265 - protein, 10 aa, Homo Sapiens
AEFREPLILL

SEQ ID NO: 99266 - protein, 10 aa, Homo Sapiens
AEFRKQEEVL

SEQ ID NO: 99267 - protein, 10 aa, Homo Sapiens
AEFSSAGHSL

SEQ ID NO: 99268 - protein, 10 aa, Homo Sapiens
AEGIVNGHTL

SEQ ID NO: 99269 - protein, 10 aa, Homo Sapiens
AEHEDFLLAL

SEQ ID NO: 99270 - protein, 10 aa, Homo Sapiens
AEHENMKAVL

SEQ ID NO: 99271 - protein, 10 aa, Homo Sapiens
AEHGGGMDSL

SEQ ID NO: 99272 - protein, 10 aa, Homo Sapiens
AEHKIFPAAL

SEQ ID NO: 99273 - protein, 10 aa, Homo Sapiens
AEHKPHIDKL

SEQ ID NO: 99274 - protein, 10 aa, Homo Sapiens
AEHPAGHLVL

SEQ ID NO: 99275 - protein, 10 aa, Homo Sapiens
AEIDAHLVAL

SEQ ID NO: 99276 - protein, 10 aa, Homo Sapiens
AEIDLRQGRL

SEQ ID NO: 99277 - protein, 10 aa, Homo Sapiens
AEIDSVKMTL

SEQ ID NO: 99278 - protein, 10 aa, Homo Sapiens
AEIEPPHHEL

SEQ ID NO: 99279 - protein, 10 aa, Homo Sapiens
AEIETRIAEL

SEQ ID NO: 99280 - protein, 10 aa, Homo Sapiens
AEIGQVKQEL

SEQ ID NO: 99281 - protein, 10 aa, Homo Sapiens
AEIKELFQYI

SEQ ID NO: 99282 - protein, 10 aa, Homo Sapiens
AEILEVLHSL

SEQ ID NO: 99283 - protein, 10 aa, Homo Sapiens
AEILHEIAVL

SEQ ID NO: 99284 - protein, 10 aa, Homo Sapiens
AEILQANDLL

SEQ ID NO: 99285 - protein, 10 aa, Homo Sapiens
AEINKSLLAL

SEQ ID NO: 99286 - protein, 10 aa, Homo Sapiens
AEIQAELERL

SEQ ID NO: 99287 - protein, 10 aa, Homo Sapiens
AEIQETITAL

SEQ ID NO: 99288 - protein, 10 aa, Homo Sapiens
AEIQHAEEFL

SEQ ID NO: 99289 - protein, 10 aa, Homo Sapiens
AEIRHVLVTL

SEQ ID NO: 99290 - protein, 10 aa, Homo Sapiens
AEISDVWEEM

SEQ ID NO: 99291 - protein, 10 aa, Homo Sapiens
AEKLGETEKL

SEQ ID NO: 99292 - protein, 10 aa, Homo Sapiens
AELAGTEEQL

SEQ ID NO: 99293 - protein, 10 aa, Homo Sapiens
AELASNKEWL

SEQ ID NO: 99294 - protein, 10 aa, Homo Sapiens
AELDEKISAL

SEQ ID NO: 99295 - protein, 10 aa, Homo Sapiens
AELDETKIIL

SEQ ID NO: 99296 - protein, 10 aa, Homo Sapiens
AELDPVEYTL

SEQ ID NO: 99297 - protein, 10 aa, Homo Sapiens
AELDSHTPAL

SEQ ID NO: 99298 - protein, 10 aa, Homo Sapiens
AELEELKQVL

SEQ ID NO: 99299 - protein, 10 aa, Homo Sapiens
AELEGRQEEL

SEQ ID NO: 99300 - protein, 10 aa, Homo Sapiens
AELEIQKDAL

SEQ ID NO: 99301 - protein, 10 aa, Homo Sapiens
AELEPLKEQL

SEQ ID NO: 99302 - protein, 10 aa, Homo Sapiens
AELESKTNTL

SEQ ID NO: 99303 - protein, 10 aa, Homo Sapiens
AELGHLVVSL

SEQ ID NO: 99304 - protein, 10 aa, Homo Sapiens
AELKEKYISL

SEQ ID NO: 99305 - protein, 10 aa, Homo Sapiens
AELKIVADQL

SEQ ID NO: 99306 - protein, 10 aa, Homo Sapiens
AELKMTGNCL

SEQ ID NO: 99307 - protein, 10 aa, Homo Sapiens
AELKQELATL

SEQ ID NO: 99308 - protein, 10 aa, Homo Sapiens
AELKSSTVGL

SEQ ID NO: 99309 - protein, 10 aa, Homo Sapiens
AELLLKSSDL

SEQ ID NO: 99310 - protein, 10 aa, Homo Sapiens
AELMQQVNVL

SEQ ID NO: 99311 - protein, 10 aa, Homo Sapiens
AELPASVHAL

SEQ ID NO: 99312 - protein, 10 aa, Homo Sapiens
AELQEKFLSL

SEQ ID NO: 99313 - protein, 10 aa, Homo Sapiens
AELQQQQAVL

SEQ ID NO: 99314 - protein, 10 aa, Homo Sapiens
AELRSTASLL

SEQ ID NO: 99315 - protein, 10 aa, Homo Sapiens
AELSEKSGML

SEQ ID NO: 99316 - protein, 10 aa, Homo Sapiens
AELTIAKDQL

SEQ ID NO: 99317 - protein, 10 aa, Homo Sapiens
AEMAQNAVRL

SEQ ID NO: 99318 - protein, 10 aa, Homo Sapiens
AEMDARTILL

SEQ ID NO: 99319 - protein, 10 aa, Homo Sapiens
AEMETFRDIL

SEQ ID NO: 99320 - protein, 10 aa, Homo Sapiens
AEMPDSAAAL

SEQ ID NO: 99321 - protein, 10 aa, Homo Sapiens
AEMQEVGVGL

SEQ ID NO: 99322 - protein, 10 aa, Homo Sapiens
AEMVSENDVI

SEQ ID NO: 99323 - protein, 10 aa, Homo Sapiens
AENEPENACL

SEQ ID NO: 99324 - protein, 10 aa, Homo Sapiens
AENPGKYNIL

SEQ ID NO: 99325 - protein, 10 aa, Homo Sapiens
AEPAVTEPGL

SEQ ID NO: 99326 - protein, 10 aa, Homo Sapiens
AEPDYVQPQL

SEQ ID NO: 99327 - protein, 10 aa, Homo Sapiens
AEPEDHYFLL

SEQ ID NO: 99328 - protein, 10 aa, Homo Sapiens
AEPELQYVAL

SEQ ID NO: 99329 - protein, 10 aa, Homo Sapiens
AEPLEIILHL

SEQ ID NO: 99330 - protein, 10 aa, Homo Sapiens
AEPLRPGPAL

SEQ ID NO: 99331 - protein, 10 aa, Homo Sapiens
AEPVLINPVL

SEQ ID NO: 99332 - protein, 10 aa, Homo Sapiens
AEPWPENATL

SEQ ID NO: 99333 - protein, 10 aa, Homo Sapiens
AEQAKASPAL

SEQ ID NO: 99334 - protein, 10 aa, Homo Sapiens
AEQEIARLVL

SEQ ID NO: 99335 - protein, 10 aa, Homo Sapiens
AEQHFADVVL

SEQ ID NO: 99336 - protein, 10 aa, Homo Sapiens
AEQKIKADIL

SEQ ID NO: 99337 - protein, 10 aa, Homo Sapiens
AEQLGTFTTL

SEQ ID NO: 99338 - protein, 10 aa, Homo Sapiens
AEQNGKGVAL

SEQ ID NO: 99339 - protein, 10 aa, Homo Sapiens
AEQQGKGVAL

SEQ ID NO: 99340 - protein, 10 aa, Homo Sapiens
AESAVSRDHL

SEQ ID NO: 99341 - protein, 10 aa, Homo Sapiens
AESEDGKLTL

SEQ ID NO: 99342 - protein, 10 aa, Homo Sapiens
AESEEYDQVL

SEQ ID NO: 99343 - protein, 10 aa, Homo Sapiens
AESELTVTQL

SEQ ID NO: 99344 - protein, 10 aa, Homo Sapiens
AESGVERQVL

SEQ ID NO: 99345 - protein, 10 aa, Homo Sapiens
AESHPSSNLL

SEQ ID NO: 99346 - protein, 10 aa, Homo Sapiens
AESSPDPQAL

SEQ ID NO: 99347 - protein, 10 aa, Homo Sapiens
AETDPGMVHL

SEQ ID NO: 99348 - protein, 10 aa, Homo Sapiens
AETEEIKTIL

SEQ ID NO: 99349 - protein, 10 aa, Homo Sapiens
AETEHENTVL

SEQ ID NO: 99350 - protein, 10 aa, Homo Sapiens
AETHIKGFTL

SEQ ID NO: 99351 - protein, 10 aa, Homo Sapiens
AETKAESEQL

SEQ ID NO: 99352 - protein, 10 aa, Homo Sapiens
AETPGHTPSL

SEQ ID NO: 99353 - protein, 10 aa, Homo Sapiens
AEVAAKNQSL

SEQ ID NO: 99354 - protein, 10 aa, Homo Sapiens
AEVAATEIKM

SEQ ID NO: 99355 - protein, 10 aa, Homo Sapiens
AEVAEHVQYM

SEQ ID NO: 99356 - protein, 10 aa, Homo Sapiens
AEVAEMRQML

SEQ ID NO: 99357 - protein, 10 aa, Homo Sapiens
AEVANEIENL

SEQ ID NO: 99358 - protein, 10 aa, Homo Sapiens
AEVCPTPARL

SEQ ID NO: 99359 - protein, 10 aa, Homo Sapiens
AEVDGASFLL

SEQ ID NO: 99360 - protein, 10 aa, Homo Sapiens
AEVDKNIELL

SEQ ID NO: 99361 - protein, 10 aa, Homo Sapiens
AEVEEKIDQL

SEQ ID NO: 99362 - protein, 10 aa, Homo Sapiens
AEVEGIGEAL

SEQ ID NO: 99363 - protein, 10 aa, Homo Sapiens
AEVEHLTEVL

SEQ ID NO: 99364 - protein, 10 aa, Homo Sapiens
AEVEIPGEFL

SEQ ID NO: 99365 - protein, 10 aa, Homo Sapiens
AEVERVKDVL

SEQ ID NO: 99366 - protein, 10 aa, Homo Sapiens
AEVETRIEAL

SEQ ID NO: 99367 - protein, 10 aa, Homo Sapiens
AEVETRKVVL

SEQ ID NO: 99368 - protein, 10 aa, Homo Sapiens
AEVFALIHEL

SEQ ID NO: 99369 - protein, 10 aa, Homo Sapiens
AEVKDMEQLL

SEQ ID NO: 99370 - protein, 10 aa, Homo Sapiens
AEVKEEGSQL

SEQ ID NO: 99371 - protein, 10 aa, Homo Sapiens
AEVKVSKEIF

SEQ ID NO: 99372 - protein, 10 aa, Homo Sapiens
AEVLAKKEEL

SEQ ID NO: 99373 - protein, 10 aa, Homo Sapiens
AEVLIQQGGL

SEQ ID NO: 99374 - protein, 10 aa, Homo Sapiens
AEVLVKSNNL

SEQ ID NO: 99375 - protein, 10 aa, Homo Sapiens
AEVPAVKDML

SEQ ID NO: 99376 - protein, 10 aa, Homo Sapiens
AEVSELETRL

SEQ ID NO: 99377 - protein, 10 aa, Homo Sapiens
AEVSIVDCIL

SEQ ID NO: 99378 - protein, 10 aa, Homo Sapiens
AEVSQNIEKL

SEQ ID NO: 99379 - protein, 10 aa, Homo Sapiens
AEVSQRFEQL

SEQ ID NO: 99380 - protein, 10 aa, Homo Sapiens
AEVSRACDFL

SEQ ID NO: 99381 - protein, 10 aa, Homo Sapiens
AEWAAANHVL

SEQ ID NO: 99382 - protein, 10 aa, Homo Sapiens
AEYAHPLETL

SEQ ID NO: 99383 - protein, 10 aa, Homo Sapiens
AEYESLRDLL

SEQ ID NO: 99384 - protein, 10 aa, Homo Sapiens
AEYIQKNVQL

SEQ ID NO: 99385 - protein, 10 aa, Homo Sapiens
AVEEEKGEEL

SEQ ID NO: 99386 - protein, 10 aa, Homo Sapiens
CKTWHSAWVI

SEQ ID NO: 99387 - protein, 10 aa, Homo Sapiens
DDIVHSFVSL

SEQ ID NO: 99388 - protein, 10 aa, Homo Sapiens
DEVHLLNDTL

SEQ ID NO: 99389 - protein, 10 aa, Homo Sapiens
DTDSSVHVQV

SEQ ID NO: 99390 - protein, 10 aa, Homo Sapiens
EEFEHKEEVL

SEQ ID NO: 99391 - protein, 10 aa, Homo Sapiens
EEVEIEREVL

SEQ ID NO: 99392 - protein, 10 aa, Homo Sapiens
EEVNIAGDSL

SEQ ID NO: 99393 - protein, 10 aa, Homo Sapiens
EEVYLVHDEL

SEQ ID NO: 99394 - protein, 10 aa, Homo Sapiens
ETGGSEKLSL

SEQ ID NO: 99395 - protein, 10 aa, Homo Sapiens
FEAEVLHTVL

SEQ ID NO: 99396 - protein, 10 aa, Homo Sapiens
FEDPHCEVGL

SEQ ID NO: 99397 - protein, 10 aa, Homo Sapiens
FEEGLETTAL

SEQ ID NO: 99398 - protein, 10 aa, Homo Sapiens
FEEHNSMNEL

SEQ ID NO: 99399 - protein, 10 aa, Homo Sapiens
FEEISRSGEL

SEQ ID NO: 99400 - protein, 10 aa, Homo Sapiens
FEEKSGRTFL

SEQ ID NO: 99401 - protein, 10 aa, Homo Sapiens
FEFDEQGREL

SEQ ID NO: 99402 - protein, 10 aa, Homo Sapiens
FEFGSLDQKL

SEQ ID NO: 99403 - protein, 10 aa, Homo Sapiens
FEFGSLEQKL

SEQ ID NO: 99404 - protein, 10 aa, Homo Sapiens
FEIHDDIEVL

SEQ ID NO: 99405 - protein, 10 aa, Homo Sapiens
FEISDIGAKI

SEQ ID NO: 99406 - protein, 10 aa, Homo Sapiens
FELLEKEVGL

SEQ ID NO: 99407 - protein, 10 aa, Homo Sapiens
FENGKELVEL

SEQ ID NO: 99408 - protein, 10 aa, Homo Sapiens
FEQANIKTQL

SEQ ID NO: 99409 - protein, 10 aa, Homo Sapiens
FESGISQALL

SEQ ID NO: 99410 - protein, 10 aa, Homo Sapiens
FEVDDGTSVL

SEQ ID NO: 99411 - protein, 10 aa, Homo Sapiens
FEVDLSHVYL

SEQ ID NO: 99412 - protein, 10 aa, Homo Sapiens
FEVEKELFAL

SEQ ID NO: 99413 - protein, 10 aa, Homo Sapiens
FEVLVEKEWL

SEQ ID NO: 99414 - protein, 10 aa, Homo Sapiens
FEVSPDGSFL

SEQ ID NO: 99415 - protein, 10 aa, Homo Sapiens
FEYFGPDFKL

SEQ ID NO: 99416 - protein, 10 aa, Homo Sapiens
GEAAEKNLYL

SEQ ID NO: 99417 - protein, 10 aa, Homo Sapiens
GEADNLDEFL

SEQ ID NO: 99418 - protein, 10 aa, Homo Sapiens
GEAGLHFDEL

SEQ ID NO: 99419 - protein, 10 aa, Homo Sapiens
GEAGPSAEAL

SEQ ID NO: 99420 - protein, 10 aa, Homo Sapiens
GEAHAELDSL

SEQ ID NO: 99421 - protein, 10 aa, Homo Sapiens
GEAKTDPAGL

SEQ ID NO: 99422 - protein, 10 aa, Homo Sapiens
GEANVTGSQL

SEQ ID NO: 99423 - protein, 10 aa, Homo Sapiens
GEAPAEMGAL

SEQ ID NO: 99424 - protein, 10 aa, Homo Sapiens
GEAPAKSSTL

SEQ ID NO: 99425 - protein, 10 aa, Homo Sapiens
GEAPPELLCL

SEQ ID NO: 99426 - protein, 10 aa, Homo Sapiens
GEAPPPTESL

SEQ ID NO: 99427 - protein, 10 aa, Homo Sapiens
GEAQRLIEIL

SEQ ID NO: 99428 - protein, 10 aa, Homo Sapiens
GEAQVGKTSL

SEQ ID NO: 99429 - protein, 10 aa, Homo Sapiens
GEAVEVIHKL

SEQ ID NO: 99430 - protein, 10 aa, Homo Sapiens
GECGLDFDRL

SEQ ID NO: 99431 - protein, 10 aa, Homo Sapiens
GECPPQRSIL

SEQ ID NO: 99432 - protein, 10 aa, Homo Sapiens
GECYEKLNQL

SEQ ID NO: 99433 - protein, 10 aa, Homo Sapiens
GEDARNVTVL

SEQ ID NO: 99434 - protein, 10 aa, Homo Sapiens
GEDEGYFQEL

SEQ ID NO: 99435 - protein, 10 aa, Homo Sapiens
GEDGAGKTSL

SEQ ID NO: 99436 - protein, 10 aa, Homo Sapiens
GEDGLPTPAL

SEQ ID NO: 99437 - protein, 10 aa, Homo Sapiens
GEDGSGKTTL

SEQ ID NO: 99438 - protein, 10 aa, Homo Sapiens
GEDHPEMALL

SEQ ID NO: 99439 - protein, 10 aa, Homo Sapiens
GEDLGADYNL

SEQ ID NO: 99440 - protein, 10 aa, Homo Sapiens
GEDPNKAEEL

SEQ ID NO: 99441 - protein, 10 aa, Homo Sapiens
GEDQTQDTEL

SEQ ID NO: 99442 - protein, 10 aa, Homo Sapiens
GEDRSPPTAL

SEQ ID NO: 99443 - protein, 10 aa, Homo Sapiens
GEDSGARALL

SEQ ID NO: 99444 - protein, 10 aa, Homo Sapiens
GEEALLRYVL

SEQ ID NO: 99445 - protein, 10 aa, Homo Sapiens
GEEGDLKTSL

SEQ ID NO: 99446 - protein, 10 aa, Homo Sapiens
GEEGTRPEAL

SEQ ID NO: 99447 - protein, 10 aa, Homo Sapiens
GEEHFKGLVL

SEQ ID NO: 99448 - protein, 10 aa, Homo Sapiens
GEEHPRGSIL

SEQ ID NO: 99449 - protein, 10 aa, Homo Sapiens
GEENKGHQML

SEQ ID NO: 99450 - protein, 10 aa, Homo Sapiens
GEEPGIKSQL

SEQ ID NO: 99451 - protein, 10 aa, Homo Sapiens
GEEQTQDTEL

SEQ ID NO: 99452 - protein, 10 aa, Homo Sapiens
GEETGIDVTL

SEQ ID NO: 99453 - protein, 10 aa, Homo Sapiens
GEEVGPSVYL

SEQ ID NO: 99454 - protein, 10 aa, Homo Sapiens
GEFDPSKERL

SEQ ID NO: 99455 - protein, 10 aa, Homo Sapiens
GEFGTIPLVL

SEQ ID NO: 99456 - protein, 10 aa, Homo Sapiens
GEFNEQVLRL

SEQ ID NO: 99457 - protein, 10 aa, Homo Sapiens
GEFQIVNPHL

SEQ ID NO: 99458 - protein, 10 aa, Homo Sapiens
GEFSDKLLSL

SEQ ID NO: 99459 - protein, 10 aa, Homo Sapiens
GEFSTCFTEL

SEQ ID NO: 99460 - protein, 10 aa, Homo Sapiens
GEFTSARAVL

SEQ ID NO: 99461 - protein, 10 aa, Homo Sapiens
GEGALVNDVL

SEQ ID NO: 99462 - protein, 10 aa, Homo Sapiens
GEGHFGKVSL

SEQ ID NO: 99463 - protein, 10 aa, Homo Sapiens
GEGHTQDTEL

SEQ ID NO: 99464 - protein, 10 aa, Homo Sapiens
GEGKNGTIEL

SEQ ID NO: 99465 - protein, 10 aa, Homo Sapiens
GEGMGISHEL

SEQ ID NO: 99466 - protein, 10 aa, Homo Sapiens
GEGSFSTVVL

SEQ ID NO: 99467 - protein, 10 aa, Homo Sapiens
GEHEIDYILL

SEQ ID NO: 99468 - protein, 10 aa, Homo Sapiens
GEHGTEYDTL

SEQ ID NO: 99469 - protein, 10 aa, Homo Sapiens
GEHHEKAVEL

SEQ ID NO: 99470 - protein, 10 aa, Homo Sapiens
GEHQINQIAL

SEQ ID NO: 99471 - protein, 10 aa, Homo Sapiens
GEHSGRYEEL

SEQ ID NO: 99472 - protein, 10 aa, Homo Sapiens
GEIAKSYAEL

SEQ ID NO: 99473 - protein, 10 aa, Homo Sapiens
GEIATSQERL

SEQ ID NO: 99474 - protein, 10 aa, Homo Sapiens
GEIDGNKVTL

SEQ ID NO: 99475 - protein, 10 aa, Homo Sapiens
GEIDVPSHEL

SEQ ID NO: 99476 - protein, 10 aa, Homo Sapiens
GEIEGLNDTF

SEQ ID NO: 99477 - protein, 10 aa, Homo Sapiens
GEIFELKAEL

SEQ ID NO: 99478 - protein, 10 aa, Homo Sapiens
GEIFSEHSCL

SEQ ID NO: 99479 - protein, 10 aa, Homo Sapiens
GEIHDLKDML

SEQ ID NO: 99480 - protein, 10 aa, Homo Sapiens
GEIHDSKMRL

SEQ ID NO: 99481 - protein, 10 aa, Homo Sapiens
GEIIMGNIEL

SEQ ID NO: 99482 - protein, 10 aa, Homo Sapiens
GEIINTHTLL

SEQ ID NO: 99483 - protein, 10 aa, Homo Sapiens
GEIKNIHLNL

SEQ ID NO: 99484 - protein, 10 aa, Homo Sapiens
GEILHDAKTL

SEQ ID NO: 99485 - protein, 10 aa, Homo Sapiens
GEIQQIPVQL

SEQ ID NO: 99486 - protein, 10 aa, Homo Sapiens
GEIRNVGTGL

SEQ ID NO: 99487 - protein, 10 aa, Homo Sapiens
GEISDIHTKL

SEQ ID NO: 99488 - protein, 10 aa, Homo Sapiens
GEITEERDIL

SEQ ID NO: 99489 - protein, 10 aa, Homo Sapiens
GEKRPEEVAL

SEQ ID NO: 99490 - protein, 10 aa, Homo Sapiens
GELAVGREIL

SEQ ID NO: 99491 - protein, 10 aa, Homo Sapiens
GELDHVVEIL

SEQ ID NO: 99492 - protein, 10 aa, Homo Sapiens
GELEAERQAL

SEQ ID NO: 99493 - protein, 10 aa, Homo Sapiens
GELESHADRL

SEQ ID NO: 99494 - protein, 10 aa, Homo Sapiens
GELGNGNIKL

SEQ ID NO: 99495 - protein, 10 aa, Homo Sapiens
GELKHGPLAL

SEQ ID NO: 99496 - protein, 10 aa, Homo Sapiens
GELKYVRIVL

SEQ ID NO: 99497 - protein, 10 aa, Homo Sapiens
GELPEINGKL

SEQ ID NO: 99498 - protein, 10 aa, Homo Sapiens
GELPGEACTL

SEQ ID NO: 99499 - protein, 10 aa, Homo Sapiens
GELQESQSRL

SEQ ID NO: 99500 - protein, 10 aa, Homo Sapiens
GELQGERGEL

SEQ ID NO: 99501 - protein, 10 aa, Homo Sapiens
GELQHASAVL

SEQ ID NO: 99502 - protein, 10 aa, Homo Sapiens
GELREQLKAL

SEQ ID NO: 99503 - protein, 10 aa, Homo Sapiens
GELSGDFEKL

SEQ ID NO: 99504 - protein, 10 aa, Homo Sapiens
GELTENGLTL

SEQ ID NO: 99505 - protein, 10 aa, Homo Sapiens
GELTLEGGAL

SEQ ID NO: 99506 - protein, 10 aa, Homo Sapiens
GEMKAEVTKL

SEQ ID NO: 99507 - protein, 10 aa, Homo Sapiens
GEMKELPEQL

SEQ ID NO: 99508 - protein, 10 aa, Homo Sapiens
GEMKSGVPVL

SEQ ID NO: 99509 - protein, 10 aa, Homo Sapiens
GEMTALREEL

SEQ ID NO: 99510 - protein, 10 aa, Homo Sapiens
GENEDNRIGL

SEQ ID NO: 99511 - protein, 10 aa, Homo Sapiens
GEPAGTDPGL

SEQ ID NO: 99512 - protein, 10 aa, Homo Sapiens
GEPEEDIVGL

SEQ ID NO: 99513 - protein, 10 aa, Homo Sapiens
GEPEKLGQAL

SEQ ID NO: 99514 - protein, 10 aa, Homo Sapiens
GEPESFGDNL

SEQ ID NO: 99515 - protein, 10 aa, Homo Sapiens
GEPEVQYVAL

SEQ ID NO: 99516 - protein, 10 aa, Homo Sapiens
GEPFSEEATL

SEQ ID NO: 99517 - protein, 10 aa, Homo Sapiens
GEPLDNFESL

SEQ ID NO: 99518 - protein, 10 aa, Homo Sapiens
GEQGGGKLVL

SEQ ID NO: 99519 - protein, 10 aa, Homo Sapiens
GEQGVGKSTL

SEQ ID NO: 99520 - protein, 10 aa, Homo Sapiens
GESAETRALL

SEQ ID NO: 99521 - protein, 10 aa, Homo Sapiens
GESAVGKSSL

SEQ ID NO: 99522 - protein, 10 aa, Homo Sapiens
GESDDSILRL

SEQ ID NO: 99523 - protein, 10 aa, Homo Sapiens
GESEDLASRL

SEQ ID NO: 99524 - protein, 10 aa, Homo Sapiens
GESGIKVAVL

SEQ ID NO: 99525 - protein, 10 aa, Homo Sapiens
GESGNIKAGL

SEQ ID NO: 99526 - protein, 10 aa, Homo Sapiens
GESHIGGVLL

SEQ ID NO: 99527 - protein, 10 aa, Homo Sapiens
GESPLDGICL

SEQ ID NO: 99528 - protein, 10 aa, Homo Sapiens
GESPVPHTVL

SEQ ID NO: 99529 - protein, 10 aa, Homo Sapiens
GESSGKNVTL

SEQ ID NO: 99530 - protein, 10 aa, Homo Sapiens
GETETRLECL

SEQ ID NO: 99531 - protein, 10 aa, Homo Sapiens
GETGIGKSTL

SEQ ID NO: 99532 - protein, 10 aa, Homo Sapiens
GETKISQSEL

SEQ ID NO: 99533 - protein, 10 aa, Homo Sapiens
GETSVGKTSL

SEQ ID NO: 99534 - protein, 10 aa, Homo Sapiens
GEVAKEWQEL

SEQ ID NO: 99535 - protein, 10 aa, Homo Sapiens
GEVDDGARKL

SEQ ID NO: 99536 - protein, 10 aa, Homo Sapiens
GEVDLRECVV

SEQ ID NO: 99537 - protein, 10 aa, Homo Sapiens
GEVDVEQHTL

SEQ ID NO: 99538 - protein, 10 aa, Homo Sapiens
GEVELVEPGL

SEQ ID NO: 99539 - protein, 10 aa, Homo Sapiens
GEVFPTTEVL

SEQ ID NO: 99540 - protein, 10 aa, Homo Sapiens
GEVFRVVDTL

SEQ ID NO: 99541 - protein, 10 aa, Homo Sapiens
GEVGSAHSSL

SEQ ID NO: 99542 - protein, 10 aa, Homo Sapiens
GEVHIGGVML

SEQ ID NO: 99543 - protein, 10 aa, Homo Sapiens
GEVIRTLPSL

SEQ ID NO: 99544 - protein, 10 aa, Homo Sapiens
GEVKGTSGSL

SEQ ID NO: 99545 - protein, 10 aa, Homo Sapiens
GEVLDILTRL

SEQ ID NO: 99546 - protein, 10 aa, Homo Sapiens
GEVLEPANLL

SEQ ID NO: 99547 - protein, 10 aa, Homo Sapiens
GEVLPDIDTL

SEQ ID NO: 99548 - protein, 10 aa, Homo Sapiens
GEVPFNHEIL

SEQ ID NO: 99549 - protein, 10 aa, Homo Sapiens
GEVQDKYECL

SEQ ID NO: 99550 - protein, 10 aa, Homo Sapiens
GEVQDLLVRL

SEQ ID NO: 99551 - protein, 10 aa, Homo Sapiens
GEVRFSAVAL

SEQ ID NO: 99552 - protein, 10 aa, Homo Sapiens
GEVTEGLDVL

SEQ ID NO: 99553 - protein, 10 aa, Homo Sapiens
GEVTNDFVML

SEQ ID NO: 99554 - protein, 10 aa, Homo Sapiens
GEWEESEVKL

SEQ ID NO: 99555 - protein, 10 aa, Homo Sapiens
GEYFPGTGDL

SEQ ID NO: 99556 - protein, 10 aa, Homo Sapiens
GEYGKFFVTI

SEQ ID NO: 99557 - protein, 10 aa, Homo Sapiens
GEYSEAIPIL

SEQ ID NO: 99558 - protein, 10 aa, Homo Sapiens
GQDIAENLQL

SEQ ID NO: 99559 - protein, 10 aa, Homo Sapiens
HEAEVHAESL

SEQ ID NO: 99560 - protein, 10 aa, Homo Sapiens
HEAPSSEPSL

SEQ ID NO: 99561 - protein, 10 aa, Homo Sapiens
HEAQHGVTSL

SEQ ID NO: 99562 - protein, 10 aa, Homo Sapiens
HEAQLKNGSL

SEQ ID NO: 99563 - protein, 10 aa, Homo Sapiens
HEASAILVHL

SEQ ID NO: 99564 - protein, 10 aa, Homo Sapiens
HEATLRCWAL

SEQ ID NO: 99565 - protein, 10 aa, Homo Sapiens
HECMAPLTAL

SEQ ID NO: 99566 - protein, 10 aa, Homo Sapiens
HECTLVHADL

SEQ ID NO: 99567 - protein, 10 aa, Homo Sapiens
HEDSSHIIAL

SEQ ID NO: 99568 - protein, 10 aa, Homo Sapiens
HEEALSFVSL

SEQ ID NO: 99569 - protein, 10 aa, Homo Sapiens
HEEFSEHALL

SEQ ID NO: 99570 - protein, 10 aa, Homo Sapiens
HEEQPRPFVL

SEQ ID NO: 99571 - protein, 10 aa, Homo Sapiens
HEESQTATLL

SEQ ID NO: 99572 - protein, 10 aa, Homo Sapiens
HEFDPSADML

SEQ ID NO: 99573 - protein, 10 aa, Homo Sapiens
HEFECNVEML

SEQ ID NO: 99574 - protein, 10 aa, Homo Sapiens
HEFEEATNLL

SEQ ID NO: 99575 - protein, 10 aa, Homo Sapiens
HEFSSPSHLL

SEQ ID NO: 99576 - protein, 10 aa, Homo Sapiens
HEGLPEPVTL

SEQ ID NO: 99577 - protein, 10 aa, Homo Sapiens
HEHRGTPVGL

SEQ ID NO: 99578 - protein, 10 aa, Homo Sapiens
HEIEVIDQRL

SEQ ID NO: 99579 - protein, 10 aa, Homo Sapiens
HEIEVIGGYL

SEQ ID NO: 99580 - protein, 10 aa, Homo Sapiens
HEILREAYAL

SEQ ID NO: 99581 - protein, 10 aa, Homo Sapiens
HEIQDGTIHL

SEQ ID NO: 99582 - protein, 10 aa, Homo Sapiens
HEIQRTENSL

SEQ ID NO: 99583 - protein, 10 aa, Homo Sapiens
HELDMQVAAL

SEQ ID NO: 99584 - protein, 10 aa, Homo Sapiens
HELLQPFNVL

SEQ ID NO: 99585 - protein, 10 aa, Homo Sapiens
HEMLAHRAVL

SEQ ID NO: 99586 - protein, 10 aa, Homo Sapiens
HEQQALPVDL

SEQ ID NO: 99587 - protein, 10 aa, Homo Sapiens
HESAVTGLSL

SEQ ID NO: 99588 - protein, 10 aa, Homo Sapiens
HESEGGRTPL

SEQ ID NO: 99589 - protein, 10 aa, Homo Sapiens
HEVDTQYSAL

SEQ ID NO: 99590 - protein, 10 aa, Homo Sapiens
HEVEEATNIL

SEQ ID NO: 99591 - protein, 10 aa, Homo Sapiens
HEVEPRYVVL

SEQ ID NO: 99592 - protein, 10 aa, Homo Sapiens
HEVEQGCAVL

SEQ ID NO: 99593 - protein, 10 aa, Homo Sapiens
HEVPSGNSLL

SEQ ID NO: 99594 - protein, 10 aa, Homo Sapiens
HEVSEIIDGL

SEQ ID NO: 99595 - protein, 10 aa, Homo Sapiens
HEVSGETVVF

SEQ ID NO: 99596 - protein, 10 aa, Homo Sapiens
HEVTSQTSHL

SEQ ID NO: 99597 - protein, 10 aa, Homo Sapiens
HEYFPEMQIL

SEQ ID NO: 99598 - protein, 10 aa, Homo Sapiens
HEYKGPKADL

SEQ ID NO: 99599 - protein, 10 aa, Homo Sapiens
IATNIAETSI

SEQ ID NO: 99600 - protein, 10 aa, Homo Sapiens
IEAQINNEDL

SEQ ID NO: 99601 - protein, 10 aa, Homo Sapiens
IEDNELNIVL

SEQ ID NO: 99602 - protein, 10 aa, Homo Sapiens
IEDPGQAYVL

SEQ ID NO: 99603 - protein, 10 aa, Homo Sapiens
IEECISQIVL

SEQ ID NO: 99604 - protein, 10 aa, Homo Sapiens
IEEHCKPQTL

SEQ ID NO: 99605 - protein, 10 aa, Homo Sapiens
IEEKGAVEAL

SEQ ID NO: 99606 - protein, 10 aa, Homo Sapiens
IEESSKPVRL

SEQ ID NO: 99607 - protein, 10 aa, Homo Sapiens
IEGLIEREYL

SEQ ID NO: 99608 - protein, 10 aa, Homo Sapiens
IEIHEQEAIL

SEQ ID NO: 99609 - protein, 10 aa, Homo Sapiens
IEISMQHEQL

SEQ ID NO: 99610 - protein, 10 aa, Homo Sapiens
IENDEAFAIL

SEQ ID NO: 99611 - protein, 10 aa, Homo Sapiens
IENEDMRVQL

SEQ ID NO: 99612 - protein, 10 aa, Homo Sapiens
IENGEKITSL

SEQ ID NO: 99613 - protein, 10 aa, Homo Sapiens
IETKPCGEEL

SEQ ID NO: 99614 - protein, 10 aa, Homo Sapiens
IEVDGKQVEL

SEQ ID NO: 99615 - protein, 10 aa, Homo Sapiens
IEVDLAHTTL

SEQ ID NO: 99616 - protein, 10 aa, Homo Sapiens
IEVEIAKQAL

SEQ ID NO: 99617 - protein, 10 aa, Homo Sapiens
IEWRDRRITL

SEQ ID NO: 99618 - protein, 10 aa, Homo Sapiens
KEAAIGVLVL

SEQ ID NO: 99619 - protein, 10 aa, Homo Sapiens
KEAEGKEPEL

SEQ ID NO: 99620 - protein, 10 aa, Homo Sapiens
KEAELHLTYL

SEQ ID NO: 99621 - protein, 10 aa, Homo Sapiens
KEAELKDLLL

SEQ ID NO: 99622 - protein, 10 aa, Homo Sapiens
KEAENPREVL

SEQ ID NO: 99623 - protein, 10 aa, Homo Sapiens
KEAFLKACTL

SEQ ID NO: 99624 - protein, 10 aa, Homo Sapiens
KEAGNINTSL

SEQ ID NO: 99625 - protein, 10 aa, Homo Sapiens
KEAIVTSEEL

SEQ ID NO: 99626 - protein, 10 aa, Homo Sapiens
KEALENCITL

SEQ ID NO: 99627 - protein, 10 aa, Homo Sapiens
KEALQDPFTL

SEQ ID NO: 99628 - protein, 10 aa, Homo Sapiens
KEALTYDGAL

SEQ ID NO: 99629 - protein, 10 aa, Homo Sapiens
KEASVKFHVL

SEQ ID NO: 99630 - protein, 10 aa, Homo Sapiens
KEATDHATAL

SEQ ID NO: 99631 - protein, 10 aa, Homo Sapiens
KECGETFISL

SEQ ID NO: 99632 - protein, 10 aa, Homo Sapiens
KEDEDDKTVL

SEQ ID NO: 99633 - protein, 10 aa, Homo Sapiens
KEDEIQDISL

SEQ ID NO: 99634 - protein, 10 aa, Homo Sapiens
KEDNIGNQLL

SEQ ID NO: 99635 - protein, 10 aa, Homo Sapiens
KEDPTVSALL

SEQ ID NO: 99636 - protein, 10 aa, Homo Sapiens
KEDRGRPYTL

SEQ ID NO: 99637 - protein, 10 aa, Homo Sapiens
KEDSAVFYEL

SEQ ID NO: 99638 - protein, 10 aa, Homo Sapiens
KEEEGIGEEL

SEQ ID NO: 99639 - protein, 10 aa, Homo Sapiens
KEEENLQVVL

SEQ ID NO: 99640 - protein, 10 aa, Homo Sapiens
KEEEVDCLVL

SEQ ID NO: 99641 - protein, 10 aa, Homo Sapiens
KEEEVQQQKL

SEQ ID NO: 99642 - protein, 10 aa, Homo Sapiens
KEEGNLEAVL

SEQ ID NO: 99643 - protein, 10 aa, Homo Sapiens
KEEGPKEMTL

SEQ ID NO: 99644 - protein, 10 aa, Homo Sapiens
KEEMGIGGVL

SEQ ID NO: 99645 - protein, 10 aa, Homo Sapiens
KEEPSNNVKL

SEQ ID NO: 99646 - protein, 10 aa, Homo Sapiens
KEESAATQAL

SEQ ID NO: 99647 - protein, 10 aa, Homo Sapiens
KEESGADQEL

SEQ ID NO: 99648 - protein, 10 aa, Homo Sapiens
KEETQPPVAL

SEQ ID NO: 99649 - protein, 10 aa, Homo Sapiens
KEFCAFSQTL

SEQ ID NO: 99650 - protein, 10 aa, Homo Sapiens
KEFDAGIIEL

SEQ ID NO: 99651 - protein, 10 aa, Homo Sapiens
KEFDGTKVFL

SEQ ID NO: 99652 - protein, 10 aa, Homo Sapiens
KEFDNGHLLL

SEQ ID NO: 99653 - protein, 10 aa, Homo Sapiens
KEFEDKKVEL

SEQ ID NO: 99654 - protein, 10 aa, Homo Sapiens
KEFEENTQHL

SEQ ID NO: 99655 - protein, 10 aa, Homo Sapiens
KEFEQLAPVL

SEQ ID NO: 99656 - protein, 10 aa, Homo Sapiens
KEFESHLDKL

SEQ ID NO: 99657 - protein, 10 aa, Homo Sapiens
KEFETAETLL

SEQ ID NO: 99658 - protein, 10 aa, Homo Sapiens
KEFEVKDPEL

SEQ ID NO: 99659 - protein, 10 aa, Homo Sapiens
KEFGDDKVQL

SEQ ID NO: 99660 - protein, 10 aa, Homo Sapiens
KEFHLEYDKL

SEQ ID NO: 99661 - protein, 10 aa, Homo Sapiens
KEFLSRSDQL

SEQ ID NO: 99662 - protein, 10 aa, Homo Sapiens
KEFNIPLEML

SEQ ID NO: 99663 - protein, 10 aa, Homo Sapiens
KEFQDLREVM

SEQ ID NO: 99664 - protein, 10 aa, Homo Sapiens
KEFVSEVDVL

SEQ ID NO: 99665 - protein, 10 aa, Homo Sapiens
KEHVDKAIAL

SEQ ID NO: 99666 - protein, 10 aa, Homo Sapiens
KEHVIEKEEL

SEQ ID NO: 99667 - protein, 10 aa, Homo Sapiens
KEIAEAYDVL

SEQ ID NO: 99668 - protein, 10 aa, Homo Sapiens
KEIASEIIGL

SEQ ID NO: 99669 - protein, 10 aa, Homo Sapiens
KEIDECVTLL

SEQ ID NO: 99670 - protein, 10 aa, Homo Sapiens
KEIDEVGDLL

SEQ ID NO: 99671 - protein, 10 aa, Homo Sapiens
KEIEAEKVEL

SEQ ID NO: 99672 - protein, 10 aa, Homo Sapiens
KEIEELKELL

SEQ ID NO: 99673 - protein, 10 aa, Homo Sapiens
KEIEERLHGL

SEQ ID NO: 99674 - protein, 10 aa, Homo Sapiens
KEIEGEEIEI

SEQ ID NO: 99675 - protein, 10 aa, Homo Sapiens
KEIESTKGEL

SEQ ID NO: 99676 - protein, 10 aa, Homo Sapiens
KEIFDKIHSL

SEQ ID NO: 99677 - protein, 10 aa, Homo Sapiens
KEIFETPTEI

SEQ ID NO: 99678 - protein, 10 aa, Homo Sapiens
KEILDQLESL

SEQ ID NO: 99679 - protein, 10 aa, Homo Sapiens
KEINEKSNIL

SEQ ID NO: 99680 - protein, 10 aa, Homo Sapiens
KEINEKSSQL

SEQ ID NO: 99681 - protein, 10 aa, Homo Sapiens
KEINTNQEAL

SEQ ID NO: 99682 - protein, 10 aa, Homo Sapiens
KEIQELEQLL

SEQ ID NO: 99683 - protein, 10 aa, Homo Sapiens
KEISFAYEVL

SEQ ID NO: 99684 - protein, 10 aa, Homo Sapiens
KEIVAEAERL

SEQ ID NO: 99685 - protein, 10 aa, Homo Sapiens
KEIYDDLQAL

SEQ ID NO: 99686 - protein, 10 aa, Homo Sapiens
KEIYNEKELL

SEQ ID NO: 99687 - protein, 10 aa, Homo Sapiens
KEKDFSPEAL

SEQ ID NO: 99688 - protein, 10 aa, Homo Sapiens
KEKEPDYVLL

SEQ ID NO: 99689 - protein, 10 aa, Homo Sapiens
KEKQWSRDEL

SEQ ID NO: 99690 - protein, 10 aa, Homo Sapiens
KEKYIDQEEL

SEQ ID NO: 99691 - protein, 10 aa, Homo Sapiens
KEKYPDAVYL

SEQ ID NO: 99692 - protein, 10 aa, Homo Sapiens
KELEAFREEL

SEQ ID NO: 99693 - protein, 10 aa, Homo Sapiens
KELEALIQNL

SEQ ID NO: 99694 - protein, 10 aa, Homo Sapiens
KELEEELQHL

SEQ ID NO: 99695 - protein, 10 aa, Homo Sapiens
KELEEEWVKL

SEQ ID NO: 99696 - protein, 10 aa, Homo Sapiens
KELEEKVAEL

SEQ ID NO: 99697 - protein, 10 aa, Homo Sapiens
KELEEKVMEL

SEQ ID NO: 99698 - protein, 10 aa, Homo Sapiens
KELEENKRSL

SEQ ID NO: 99699 - protein, 10 aa, Homo Sapiens
KELENANDLL

SEQ ID NO: 99700 - protein, 10 aa, Homo Sapiens
KELEQKKSYL

SEQ ID NO: 99701 - protein, 10 aa, Homo Sapiens
KELESEKEQL

SEQ ID NO: 99702 - protein, 10 aa, Homo Sapiens
KELESVGIRL

SEQ ID NO: 99703 - protein, 10 aa, Homo Sapiens
KELFIHTEEL

SEQ ID NO: 99704 - protein, 10 aa, Homo Sapiens
KELGLAEHQL

SEQ ID NO: 99705 - protein, 10 aa, Homo Sapiens
KELGSSTNAL

SEQ ID NO: 99706 - protein, 10 aa, Homo Sapiens
KELHEKFDRL

SEQ ID NO: 99707 - protein, 10 aa, Homo Sapiens
KELHIQGNRL

SEQ ID NO: 99708 - protein, 10 aa, Homo Sapiens
KELKDAGAGL

SEQ ID NO: 99709 - protein, 10 aa, Homo Sapiens
KELLGQGLLL

SEQ ID NO: 99710 - protein, 10 aa, Homo Sapiens
KELPITGTDL

SEQ ID NO: 99711 - protein, 10 aa, Homo Sapiens
KELQDVGQSL

SEQ ID NO: 99712 - protein, 10 aa, Homo Sapiens
KELQLLSETL

SEQ ID NO: 99713 - protein, 10 aa, Homo Sapiens
KELYVPENKL

SEQ ID NO: 99714 - protein, 10 aa, Homo Sapiens
KEMDIVVHTL

SEQ ID NO: 99715 - protein, 10 aa, Homo Sapiens
KEMDLSVETL

SEQ ID NO: 99716 - protein, 10 aa, Homo Sapiens
KEMDLSVVRL

SEQ ID NO: 99717 - protein, 10 aa, Homo Sapiens
KEMEDWISSL

SEQ ID NO: 99718 - protein, 10 aa, Homo Sapiens
KEMQDVQGAL

SEQ ID NO: 99719 - protein, 10 aa, Homo Sapiens
KENDELDIQL

SEQ ID NO: 99720 - protein, 10 aa, Homo Sapiens
KENDFDRLVL

SEQ ID NO: 99721 - protein, 10 aa, Homo Sapiens
KENSPEKFAL

SEQ ID NO: 99722 - protein, 10 aa, Homo Sapiens
KEPAFEDITL

SEQ ID NO: 99723 - protein, 10 aa, Homo Sapiens
KEPDSEQQPL

SEQ ID NO: 99724 - protein, 10 aa, Homo Sapiens
KEQESYDNRL

SEQ ID NO: 99725 - protein, 10 aa, Homo Sapiens
KEQNYSDDVL

SEQ ID NO: 99726 - protein, 10 aa, Homo Sapiens
KESAAINQIL

SEQ ID NO: 99727 - protein, 10 aa, Homo Sapiens
KESAEFQTQL

SEQ ID NO: 99728 - protein, 10 aa, Homo Sapiens
KESEKIIAEL

SEQ ID NO: 99729 - protein, 10 aa, Homo Sapiens
KESGAINTSL

SEQ ID NO: 99730 - protein, 10 aa, Homo Sapiens
KESHEMGQAL

SEQ ID NO: 99731 - protein, 10 aa, Homo Sapiens
KESQFLKEEL

SEQ ID NO: 99732 - protein, 10 aa, Homo Sapiens
KESSHSGVVL

SEQ ID NO: 99733 - protein, 10 aa, Homo Sapiens
KESSIIGVTL

SEQ ID NO: 99734 - protein, 10 aa, Homo Sapiens
KESVEDKLEL

SEQ ID NO: 99735 - protein, 10 aa, Homo Sapiens
KETEARKVVL

SEQ ID NO: 99736 - protein, 10 aa, Homo Sapiens
KETEVGNVSL

SEQ ID NO: 99737 - protein, 10 aa, Homo Sapiens
KETGLPKCVL

SEQ ID NO: 99738 - protein, 10 aa, Homo Sapiens
KETQEKMTIL

SEQ ID NO: 99739 - protein, 10 aa, Homo Sapiens
KETTIDGEEL

SEQ ID NO: 99740 - protein, 10 aa, Homo Sapiens
KEVANSTANL

SEQ ID NO: 99741 - protein, 10 aa, Homo Sapiens
KEVDPSTGEL

SEQ ID NO: 99742 - protein, 10 aa, Homo Sapiens
KEVEASHLAL

SEQ ID NO: 99743 - protein, 10 aa, Homo Sapiens
KEVGEAFTIL

SEQ ID NO: 99744 - protein, 10 aa, Homo Sapiens
KEVGIEFMDL

SEQ ID NO: 99745 - protein, 10 aa, Homo Sapiens
KEVHQERIAL

SEQ ID NO: 99746 - protein, 10 aa, Homo Sapiens
KEVIGGLCSL

SEQ ID NO: 99747 - protein, 10 aa, Homo Sapiens
KEVLLENTNL

SEQ ID NO: 99748 - protein, 10 aa, Homo Sapiens
KEVMQEVAQL

SEQ ID NO: 99749 - protein, 10 aa, Homo Sapiens
KEVNEGIQAL

SEQ ID NO: 99750 - protein, 10 aa, Homo Sapiens
KEVQEAFLTL

SEQ ID NO: 99751 - protein, 10 aa, Homo Sapiens
KEVRDLKETL

SEQ ID NO: 99752 - protein, 10 aa, Homo Sapiens
KEVSMDDHKL

SEQ ID NO: 99753 - protein, 10 aa, Homo Sapiens
KEVTAAREAL

SEQ ID NO: 99754 - protein, 10 aa, Homo Sapiens
KEVTEKEVTL

SEQ ID NO: 99755 - protein, 10 aa, Homo Sapiens
KEWSGLLEEL

SEQ ID NO: 99756 - protein, 10 aa, Homo Sapiens
KEYDEPYVLL

SEQ ID NO: 99757 - protein, 10 aa, Homo Sapiens
KEYEKTQTVL

SEQ ID NO: 99758 - protein, 10 aa, Homo Sapiens
KEYSDDKVQL

SEQ ID NO: 99759 - protein, 10 aa, Homo Sapiens
LEAEADKIGL

SEQ ID NO: 99760 - protein, 10 aa, Homo Sapiens
LEAEIAHGSL

SEQ ID NO: 99761 - protein, 10 aa, Homo Sapiens
LEAEIKEAQL

SEQ ID NO: 99762 - protein, 10 aa, Homo Sapiens
LEAHLTRDEL

SEQ ID NO: 99763 - protein, 10 aa, Homo Sapiens
LEALPTGTVL

SEQ ID NO: 99764 - protein, 10 aa, Homo Sapiens
LEALVNEGSL

SEQ ID NO: 99765 - protein, 10 aa, Homo Sapiens
LEEPSADAKL

SEQ ID NO: 99766 - protein, 10 aa, Homo Sapiens
LEFEGDPHCL

SEQ ID NO: 99767 - protein, 10 aa, Homo Sapiens
LEFEGGEVSL

SEQ ID NO: 99768 - protein, 10 aa, Homo Sapiens
LEFQKSLETL

SEQ ID NO: 99769 - protein, 10 aa, Homo Sapiens
LEFSPKNTVL

SEQ ID NO: 99770 - protein, 10 aa, Homo Sapiens
LEIDGLEEKL

SEQ ID NO: 99771 - protein, 10 aa, Homo Sapiens
LEIVPNGITL

SEQ ID NO: 99772 - protein, 10 aa, Homo Sapiens
LEQSCAQVVL

SEQ ID NO: 99773 - protein, 10 aa, Homo Sapiens
LESEITYDKL

SEQ ID NO: 99774 - protein, 10 aa, Homo Sapiens
LESEPQTVTL

SEQ ID NO: 99775 - protein, 10 aa, Homo Sapiens
LEVDLRDPVL

SEQ ID NO: 99776 - protein, 10 aa, Homo Sapiens
LEVEVIEGTL

SEQ ID NO: 99777 - protein, 10 aa, Homo Sapiens
LEVIIKDNSL

SEQ ID NO: 99778 - protein, 10 aa, Homo Sapiens
LEVIPGYEEL

SEQ ID NO: 99779 - protein, 10 aa, Homo Sapiens
LEVKENSGYL

SEQ ID NO: 99780 - protein, 10 aa, Homo Sapiens
MEAPGDVEAL

SEQ ID NO: 99781 - protein, 10 aa, Homo Sapiens
MEFEERNAAL

SEQ ID NO: 99782 - protein, 10 aa, Homo Sapiens
MEHAGKNQVL

SEQ ID NO: 99783 - protein, 10 aa, Homo Sapiens
MEIDIPHVWL

SEQ ID NO: 99784 - protein, 10 aa, Homo Sapiens
MEIIHEIAVL

SEQ ID NO: 99785 - protein, 10 aa, Homo Sapiens
MEISELNAKL

SEQ ID NO: 99786 - protein, 10 aa, Homo Sapiens
MELLDGKQTL

SEQ ID NO: 99787 - protein, 10 aa, Homo Sapiens
MEVDTERAML

SEQ ID NO: 99788 - protein, 10 aa, Homo Sapiens
MEYIPEGEIL

SEQ ID NO: 99789 - protein, 10 aa, Homo Sapiens
MEYLESKQFL

SEQ ID NO: 99790 - protein, 10 aa, Homo Sapiens
NEAKIKCEQL

SEQ ID NO: 99791 - protein, 10 aa, Homo Sapiens
NEANLREEVL

SEQ ID NO: 99792 - protein, 10 aa, Homo Sapiens
NEFNPMGDTL

SEQ ID NO: 99793 - protein, 10 aa, Homo Sapiens
NEHPGGEEVL

SEQ ID NO: 99794 - protein, 10 aa, Homo Sapiens
NEILSDPEVL

SEQ ID NO: 99795 - protein, 10 aa, Homo Sapiens
NERAIAGALI

SEQ ID NO: 99796 - protein, 10 aa, Homo Sapiens
NESRAVITSL

SEQ ID NO: 99797 - protein, 10 aa, Homo Sapiens
PEARIFEETL

SEQ ID NO: 99798 - protein, 10 aa, Homo Sapiens
PEARIYEETL

SEQ ID NO: 99799 - protein, 10 aa, Homo Sapiens
PIGRGTKVIL

SEQ ID NO: 99800 - protein, 10 aa, Homo Sapiens
PPVADSLANP

SEQ ID NO: 99801 - protein, 10 aa, Homo Sapiens
PSEDDGTVLL

SEQ ID NO: 99802 - protein, 10 aa, Homo Sapiens
QEAEEAGAAL

SEQ ID NO: 99803 - protein, 10 aa, Homo Sapiens
QEAKPSTEDL

SEQ ID NO: 99804 - protein, 10 aa, Homo Sapiens
QEALEPAVRL

SEQ ID NO: 99805 - protein, 10 aa, Homo Sapiens
QEATPEKESL

SEQ ID NO: 99806 - protein, 10 aa, Homo Sapiens
QEAVAGAAVL

SEQ ID NO: 99807 - protein, 10 aa, Homo Sapiens
QEDEVMRAYL

SEQ ID NO: 99808 - protein, 10 aa, Homo Sapiens
QEDLWTKIIL

SEQ ID NO: 99809 - protein, 10 aa, Homo Sapiens
QEDNPSGVIL

SEQ ID NO: 99810 - protein, 10 aa, Homo Sapiens
QEDVIATANL

SEQ ID NO: 99811 - protein, 10 aa, Homo Sapiens
QEEDYRYEVL

SEQ ID NO: 99812 - protein, 10 aa, Homo Sapiens
QEEPLPPLAL

SEQ ID NO: 99813 - protein, 10 aa, Homo Sapiens
QEETGVRVEL

SEQ ID NO: 99814 - protein, 10 aa, Homo Sapiens
QEFGIPIERL

SEQ ID NO: 99815 - protein, 10 aa, Homo Sapiens
QEFVYKEPAI

SEQ ID NO: 99816 - protein, 10 aa, Homo Sapiens
QEGDLPNAVL

SEQ ID NO: 99817 - protein, 10 aa, Homo Sapiens
QEHEEMNAKL

SEQ ID NO: 99818 - protein, 10 aa, Homo Sapiens
QEHQGALVCL

SEQ ID NO: 99819 - protein, 10 aa, Homo Sapiens
QEIADAHGLL

SEQ ID NO: 99820 - protein, 10 aa, Homo Sapiens
QEIDGKSLLL

SEQ ID NO: 99821 - protein, 10 aa, Homo Sapiens
QEIDLTGVKL

SEQ ID NO: 99822 - protein, 10 aa, Homo Sapiens
QEIEEFKERL

SEQ ID NO: 99823 - protein, 10 aa, Homo Sapiens
QEIIIRDGSL

SEQ ID NO: 99824 - protein, 10 aa, Homo Sapiens
QEIQQAGERL

SEQ ID NO: 99825 - protein, 10 aa, Homo Sapiens
QEIQTSVATL

SEQ ID NO: 99826 - protein, 10 aa, Homo Sapiens
QEKLPDEVVL

SEQ ID NO: 99827 - protein, 10 aa, Homo Sapiens
QELEILTDRL

SEQ ID NO: 99828 - protein, 10 aa, Homo Sapiens
QELNSENERL

SEQ ID NO: 99829 - protein, 10 aa, Homo Sapiens
QELPSHGVPL

SEQ ID NO: 99830 - protein, 10 aa, Homo Sapiens
QENEIRGLCL

SEQ ID NO: 99831 - protein, 10 aa, Homo Sapiens
QENEPEPLSL

SEQ ID NO: 99832 - protein, 10 aa, Homo Sapiens
QESGNGRDVL

SEQ ID NO: 99833 - protein, 10 aa, Homo Sapiens
QETKVTRDAL

SEQ ID NO: 99834 - protein, 10 aa, Homo Sapiens
QETMIKTDFL

SEQ ID NO: 99835 - protein, 10 aa, Homo Sapiens
QETPGPREAL

SEQ ID NO: 99836 - protein, 10 aa, Homo Sapiens
QEVDAIGQTL

SEQ ID NO: 99837 - protein, 10 aa, Homo Sapiens
QEVESSSVKL

SEQ ID NO: 99838 - protein, 10 aa, Homo Sapiens
QEVFEKATFI

SEQ ID NO: 99839 - protein, 10 aa, Homo Sapiens
QEVPGPAAAL

SEQ ID NO: 99840 - protein, 10 aa, Homo Sapiens
QEVQAMFDTL

SEQ ID NO: 99841 - protein, 10 aa, Homo Sapiens
QEVQERLNFL

SEQ ID NO: 99842 - protein, 10 aa, Homo Sapiens
QEVSQCFGVL

SEQ ID NO: 99843 - protein, 10 aa, Homo Sapiens
QEYSSISEKL

SEQ ID NO: 99844 - protein, 10 aa, Homo Sapiens
REAAYNAITL

SEQ ID NO: 99845 - protein, 10 aa, Homo Sapiens
REACGVIVEL

SEQ ID NO: 99846 - protein, 10 aa, Homo Sapiens
READEESLQL

SEQ ID NO: 99847 - protein, 10 aa, Homo Sapiens
REAECKKEML

SEQ ID NO: 99848 - protein, 10 aa, Homo Sapiens
REAEETQSTL

SEQ ID NO: 99849 - protein, 10 aa, Homo Sapiens
REAEHGYASL

SEQ ID NO: 99850 - protein, 10 aa, Homo Sapiens
REAEHLYHTL

SEQ ID NO: 99851 - protein, 10 aa, Homo Sapiens
REAELRKQRL

SEQ ID NO: 99852 - protein, 10 aa, Homo Sapiens
REAEMRNSIL

SEQ ID NO: 99853 - protein, 10 aa, Homo Sapiens
REAEQSNVAL

SEQ ID NO: 99854 - protein, 10 aa, Homo Sapiens
REAFEAEYRL

SEQ ID NO: 99855 - protein, 10 aa, Homo Sapiens
REAFLVNSDL

SEQ ID NO: 99856 - protein, 10 aa, Homo Sapiens
REAFVHVVTL

SEQ ID NO: 99857 - protein, 10 aa, Homo Sapiens
REAGIQPSLL

SEQ ID NO: 99858 - protein, 10 aa, Homo Sapiens
REAITAATCL

SEQ ID NO: 99859 - protein, 10 aa, Homo Sapiens
REALGHQEKL

SEQ ID NO: 99860 - protein, 10 aa, Homo Sapiens
REAPESAQCL

SEQ ID NO: 99861 - protein, 10 aa, Homo Sapiens
REAPPAFSHL

SEQ ID NO: 99862 - protein, 10 aa, Homo Sapiens
REAQELEAQL

SEQ ID NO: 99863 - protein, 10 aa, Homo Sapiens
REASPSNSCL

SEQ ID NO: 99864 - protein, 10 aa, Homo Sapiens
REAVPEPVLL

SEQ ID NO: 99865 - protein, 10 aa, Homo Sapiens
REAVVNTQEL

SEQ ID NO: 99866 - protein, 10 aa, Homo Sapiens
RECENQLVLL

SEQ ID NO: 99867 - protein, 10 aa, Homo Sapiens
RECKEKGVQF

SEQ ID NO: 99868 - protein, 10 aa, Homo Sapiens
RECLQALEFL

SEQ ID NO: 99869 - protein, 10 aa, Homo Sapiens
RECMEITESL

SEQ ID NO: 99870 - protein, 10 aa, Homo Sapiens
REDAPIGPHL

SEQ ID NO: 99871 - protein, 10 aa, Homo Sapiens
REDEDGLFTL

SEQ ID NO: 99872 - protein, 10 aa, Homo Sapiens
REDEEQNVKL

SEQ ID NO: 99873 - protein, 10 aa, Homo Sapiens
REDESYGYVL

SEQ ID NO: 99874 - protein, 10 aa, Homo Sapiens
REDIVVPVYL

SEQ ID NO: 99875 - protein, 10 aa, Homo Sapiens
REDLALGTQL

SEQ ID NO: 99876 - protein, 10 aa, Homo Sapiens
REDQDKVAVL

SEQ ID NO: 99877 - protein, 10 aa, Homo Sapiens
REDQVYACKL

SEQ ID NO: 99878 - protein, 10 aa, Homo Sapiens
REDYPQKEIL

SEQ ID NO: 99879 - protein, 10 aa, Homo Sapiens
REDYTRYNQL

SEQ ID NO: 99880 - protein, 10 aa, Homo Sapiens
REEAIHQSQL

SEQ ID NO: 99881 - protein, 10 aa, Homo Sapiens
REEDAEKAVI

SEQ ID NO: 99882 - protein, 10 aa, Homo Sapiens
REEDLAPFSL

SEQ ID NO: 99883 - protein, 10 aa, Homo Sapiens
REEDVGQPRL

SEQ ID NO: 99884 - protein, 10 aa, Homo Sapiens
REEEAELVRL

SEQ ID NO: 99885 - protein, 10 aa, Homo Sapiens
REEGAAEPAL

SEQ ID NO: 99886 - protein, 10 aa, Homo Sapiens
REENAEQQAL

SEQ ID NO: 99887 - protein, 10 aa, Homo Sapiens
REENPEFTSL

SEQ ID NO: 99888 - protein, 10 aa, Homo Sapiens
REEQAKYYEL

SEQ ID NO: 99889 - protein, 10 aa, Homo Sapiens
REESAARVVL

SEQ ID NO: 99890 - protein, 10 aa, Homo Sapiens
REESESVLTL

SEQ ID NO: 99891 - protein, 10 aa, Homo Sapiens
REESGARINI

SEQ ID NO: 99892 - protein, 10 aa, Homo Sapiens
REESNTKIDL

SEQ ID NO: 99893 - protein, 10 aa, Homo Sapiens
REEVGNISIL

SEQ ID NO: 99894 - protein, 10 aa, Homo Sapiens
REFDAFVETL

SEQ ID NO: 99895 - protein, 10 aa, Homo Sapiens
REFDYVINDL

SEQ ID NO: 99896 - protein, 10 aa, Homo Sapiens
REFEDVVNIL

SEQ ID NO: 99897 - protein, 10 aa, Homo Sapiens
REFEKMNQSL

SEQ ID NO: 99898 - protein, 10 aa, Homo Sapiens
REFLQNLDAL

SEQ ID NO: 99899 - protein, 10 aa, Homo Sapiens
REFPTHRSVL

SEQ ID NO: 99900 - protein, 10 aa, Homo Sapiens
REFQVISEQL

SEQ ID NO: 99901 - protein, 10 aa, Homo Sapiens
REGHEEMVAL

SEQ ID NO: 99902 - protein, 10 aa, Homo Sapiens
REGSASTEVL

SEQ ID NO: 99903 - protein, 10 aa, Homo Sapiens
REGYCFTEVL

SEQ ID NO: 99904 - protein, 10 aa, Homo Sapiens
REHAEKLMKL

SEQ ID NO: 99905 - protein, 10 aa, Homo Sapiens
REHALLAYTL

SEQ ID NO: 99906 - protein, 10 aa, Homo Sapiens
REIADLGEAL

SEQ ID NO: 99907 - protein, 10 aa, Homo Sapiens
REIAEVNKKL

SEQ ID NO: 99908 - protein, 10 aa, Homo Sapiens
REIDDHDAVL

SEQ ID NO: 99909 - protein, 10 aa, Homo Sapiens
REIDERNRPL

SEQ ID NO: 99910 - protein, 10 aa, Homo Sapiens
REIEEKLHKL

SEQ ID NO: 99911 - protein, 10 aa, Homo Sapiens
REIEGRAIRL

SEQ ID NO: 99912 - protein, 10 aa, Homo Sapiens
REIEGSQVTF

SEQ ID NO: 99913 - protein, 10 aa, Homo Sapiens
REIEIRFDQL

SEQ ID NO: 99914 - protein, 10 aa, Homo Sapiens
REIFLSQPIL

SEQ ID NO: 99915 - protein, 10 aa, Homo Sapiens
REIGTVIDQI

SEQ ID NO: 99916 - protein, 10 aa, Homo Sapiens
REIKDTQAQL

SEQ ID NO: 99917 - protein, 10 aa, Homo Sapiens
REIMGTPEYL

SEQ ID NO: 99918 - protein, 10 aa, Homo Sapiens
REIQDAYLQL

SEQ ID NO: 99919 - protein, 10 aa, Homo Sapiens
REIQDDMQTL

SEQ ID NO: 99920 - protein, 10 aa, Homo Sapiens
REISDHVLRM

SEQ ID NO: 99921 - protein, 10 aa, Homo Sapiens
REITEKEVKL

SEQ ID NO: 99922 - protein, 10 aa, Homo Sapiens
REITKPLRPL

SEQ ID NO: 99923 - protein, 10 aa, Homo Sapiens
REKDDANFKL

SEQ ID NO: 99924 - protein, 10 aa, Homo Sapiens
REKDDDVVSL

SEQ ID NO: 99925 - protein, 10 aa, Homo Sapiens
RELAEDDSIL

SEQ ID NO: 99926 - protein, 10 aa, Homo Sapiens
RELAGIVCTL

SEQ ID NO: 99927 - protein, 10 aa, Homo Sapiens
RELAQPASVL

SEQ ID NO: 99928 - protein, 10 aa, Homo Sapiens
RELDALGHEL

SEQ ID NO: 99929 - protein, 10 aa, Homo Sapiens
RELDATATVL

SEQ ID NO: 99930 - protein, 10 aa, Homo Sapiens
RELDLEENKL

SEQ ID NO: 99931 - protein, 10 aa, Homo Sapiens
RELDQQKLWL

SEQ ID NO: 99932 - protein, 10 aa, Homo Sapiens
RELEDMYLKL

SEQ ID NO: 99933 - protein, 10 aa, Homo Sapiens
RELEEEFYSL

SEQ ID NO: 99934 - protein, 10 aa, Homo Sapiens
RELEEIRAKL

SEQ ID NO: 99935 - protein, 10 aa, Homo Sapiens
RELEETNQKL

SEQ ID NO: 99936 - protein, 10 aa, Homo Sapiens
RELEIGQDCL

SEQ ID NO: 99937 - protein, 10 aa, Homo Sapiens
RELESQISEL

SEQ ID NO: 99938 - protein, 10 aa, Homo Sapiens
RELESQLHVL

SEQ ID NO: 99939 - protein, 10 aa, Homo Sapiens
RELESREAEL

SEQ ID NO: 99940 - protein, 10 aa, Homo Sapiens
RELETVRELL

SEQ ID NO: 99941 - protein, 10 aa, Homo Sapiens
RELFEPWNNL

SEQ ID NO: 99942 - protein, 10 aa, Homo Sapiens
RELGFSSNLL

SEQ ID NO: 99943 - protein, 10 aa, Homo Sapiens
RELHEKFEHL

SEQ ID NO: 99944 - protein, 10 aa, Homo Sapiens
RELKEKEATL

SEQ ID NO: 99945 - protein, 10 aa, Homo Sapiens
RELLESNFTL

SEQ ID NO: 99946 - protein, 10 aa, Homo Sapiens
RELLPGSVML

SEQ ID NO: 99947 - protein, 10 aa, Homo Sapiens
RELPETDADL

SEQ ID NO: 99948 - protein, 10 aa, Homo Sapiens
RELPGHTGYL

SEQ ID NO: 99949 - protein, 10 aa, Homo Sapiens
RELQAKFEHL

SEQ ID NO: 99950 - protein, 10 aa, Homo Sapiens
RELQEAPLSL

SEQ ID NO: 99951 - protein, 10 aa, Homo Sapiens
RELQELQDSL

SEQ ID NO: 99952 - protein, 10 aa, Homo Sapiens
RELQEVESTL

SEQ ID NO: 99953 - protein, 10 aa, Homo Sapiens
RELQGRHEQL

SEQ ID NO: 99954 - protein, 10 aa, Homo Sapiens
RELREREALL

SEQ ID NO: 99955 - protein, 10 aa, Homo Sapiens
RELRVEQESL

SEQ ID NO: 99956 - protein, 10 aa, Homo Sapiens
RELVEKNSQL

SEQ ID NO: 99957 - protein, 10 aa, Homo Sapiens
REMDESLANL

SEQ ID NO: 99958 - protein, 10 aa, Homo Sapiens
REMEEEAEKL

SEQ ID NO: 99959 - protein, 10 aa, Homo Sapiens
REMEEKVTLL

SEQ ID NO: 99960 - protein, 10 aa, Homo Sapiens
REMEQSMNML

SEQ ID NO: 99961 - protein, 10 aa, Homo Sapiens
REMESNWVSL

SEQ ID NO: 99962 - protein, 10 aa, Homo Sapiens
REMQEKLARL

SEQ ID NO: 99963 - protein, 10 aa, Homo Sapiens
RENEVLKVQL

SEQ ID NO: 99964 - protein, 10 aa, Homo Sapiens
RENVDQEALL

SEQ ID NO: 99965 - protein, 10 aa, Homo Sapiens
REPFPDGAEL

SEQ ID NO: 99966 - protein, 10 aa, Homo Sapiens
REPGENGTSL

SEQ ID NO: 99967 - protein, 10 aa, Homo Sapiens
REPLLVNESL

SEQ ID NO: 99968 - protein, 10 aa, Homo Sapiens
REQEAREPVL

SEQ ID NO: 99969 - protein, 10 aa, Homo Sapiens
REQHDAQVRL

SEQ ID NO: 99970 - protein, 10 aa, Homo Sapiens
REQWANLEQL

SEQ ID NO: 99971 - protein, 10 aa, Homo Sapiens
RESFDGRNIL

SEQ ID NO: 99972 - protein, 10 aa, Homo Sapiens
RESLETENVL

SEQ ID NO: 99973 - protein, 10 aa, Homo Sapiens
RETEKTLTEL

SEQ ID NO: 99974 - protein, 10 aa, Homo Sapiens
RETELSSVTL

SEQ ID NO: 99975 - protein, 10 aa, Homo Sapiens
RETLPAEQDL

SEQ ID NO: 99976 - protein, 10 aa, Homo Sapiens
RETQAINSSL

SEQ ID NO: 99977 - protein, 10 aa, Homo Sapiens
REVEEENRAL

SEQ ID NO: 99978 - protein, 10 aa, Homo Sapiens
REVEELKSEL

SEQ ID NO: 99979 - protein, 10 aa, Homo Sapiens
REVEGLKDLL

SEQ ID NO: 99980 - protein, 10 aa, Homo Sapiens
REVENPQNQL

SEQ ID NO: 99981 - protein, 10 aa, Homo Sapiens
REVLEKQPVL

SEQ ID NO: 99982 - protein, 10 aa, Homo Sapiens
REVLSALSQL

SEQ ID NO: 99983 - protein, 10 aa, Homo Sapiens
REVNLVELAL

SEQ ID NO: 99984 - protein, 10 aa, Homo Sapiens
REVQAEIGKL

SEQ ID NO: 99985 - protein, 10 aa, Homo Sapiens
REVSEEHNLL

SEQ ID NO: 99986 - protein, 10 aa, Homo Sapiens
REVSSLKNKL

SEQ ID NO: 99987 - protein, 10 aa, Homo Sapiens
REVVAGSHEL

SEQ ID NO: 99988 - protein, 10 aa, Homo Sapiens
REVWPEGDVF

SEQ ID NO: 99989 - protein, 10 aa, Homo Sapiens
REWGSGSDTL

SEQ ID NO: 99990 - protein, 10 aa, Homo Sapiens
REYEDGPLSL

SEQ ID NO: 99991 - protein, 10 aa, Homo Sapiens
REYRPEYERL

SEQ ID NO: 99992 - protein, 10 aa, Homo Sapiens
SEAAIRSVEL

SEQ ID NO: 99993 - protein, 10 aa, Homo Sapiens
SEAASSGISL

SEQ ID NO: 99994 - protein, 10 aa, Homo Sapiens
SEAEPGGGSL

SEQ ID NO: 99995 - protein, 10 aa, Homo Sapiens
SEAKPLAVCL

SEQ ID NO: 99996 - protein, 10 aa, Homo Sapiens
SEAPPSKMVL

SEQ ID NO: 99997 - protein, 10 aa, Homo Sapiens
SEAQLRQFTL

SEQ ID NO: 99998 - protein, 10 aa, Homo Sapiens
SEAREDMAAL

SEQ ID NO: 99999 - protein, 10 aa, Homo Sapiens
SEAVERLSVL

SEQ ID NO: 100000 - protein, 10 aa, Homo Sapiens
SEAYGQKDLL

SEQ ID NO: 100001 - protein, 10 aa, Homo Sapiens
SEDAAAGTVL

SEQ ID NO: 100002 - protein, 10 aa, Homo Sapiens
SEDGDAHVLL

SEQ ID NO: 100003 - protein, 10 aa, Homo Sapiens
SEDGDTLVHL

SEQ ID NO: 100004 - protein, 10 aa, Homo Sapiens
SEDKGALAKL

SEQ ID NO: 100005 - protein, 10 aa, Homo Sapiens
SEDKQLAVCL

SEQ ID NO: 100006 - protein, 10 aa, Homo Sapiens
SEDPGTKVLL

SEQ ID NO: 100007 - protein, 10 aa, Homo Sapiens
SEDPYGIFCL

SEQ ID NO: 100008 - protein, 10 aa, Homo Sapiens
SEDRNAGVIL

SEQ ID NO: 100009 - protein, 10 aa, Homo Sapiens
SEDRSVQEVL

SEQ ID NO: 100010 - protein, 10 aa, Homo Sapiens
SEDSSNVVQL

SEQ ID NO: 100011 - protein, 10 aa, Homo Sapiens
SEDTSKLYAL

SEQ ID NO: 100012 - protein, 10 aa, Homo Sapiens
SEEENSKVEL

SEQ ID NO: 100013 - protein, 10 aa, Homo Sapiens
SEEGITKSTL

SEQ ID NO: 100014 - protein, 10 aa, Homo Sapiens
SEEHIELVVL

SEQ ID NO: 100015 - protein, 10 aa, Homo Sapiens
SEEITSGCQL

SEQ ID NO: 100016 - protein, 10 aa, Homo Sapiens
SEEKGGVEVL

SEQ ID NO: 100017 - protein, 10 aa, Homo Sapiens
SEERETEISL

SEQ ID NO: 100018 - protein, 10 aa, Homo Sapiens
SEERPPAQAL

SEQ ID NO: 100019 - protein, 10 aa, Homo Sapiens
SEESVKSTTL

SEQ ID NO: 100020 - protein, 10 aa, Homo Sapiens
SEESYKDSTL

SEQ ID NO: 100021 - protein, 10 aa, Homo Sapiens
SEFDFKPQQL

SEQ ID NO: 100022 - protein, 10 aa, Homo Sapiens
SEFDIEREQL

SEQ ID NO: 100023 - protein, 10 aa, Homo Sapiens
SEFEARVISL

SEQ ID NO: 100024 - protein, 10 aa, Homo Sapiens
SEFGSKIILL

SEQ ID NO: 100025 - protein, 10 aa, Homo Sapiens
SEFHPNPDVL

SEQ ID NO: 100026 - protein, 10 aa, Homo Sapiens
SEFKGDLETL

SEQ ID NO: 100027 - protein, 10 aa, Homo Sapiens
SEFLLTHPVL

SEQ ID NO: 100028 - protein, 10 aa, Homo Sapiens
SEFQRVVEVL

SEQ ID NO: 100029 - protein, 10 aa, Homo Sapiens
SEFSGDVDSL

SEQ ID NO: 100030 - protein, 10 aa, Homo Sapiens
SEFTNSNNHL

SEQ ID NO: 100031 - protein, 10 aa, Homo Sapiens
SEHSGPPIVI

SEQ ID NO: 100032 - protein, 10 aa, Homo Sapiens
SEHTGAIDVL

SEQ ID NO: 100033 - protein, 10 aa, Homo Sapiens
SEHVASSPAL

SEQ ID NO: 100034 - protein, 10 aa, Homo Sapiens
SEHVVQGDAL

SEQ ID NO: 100035 - protein, 10 aa, Homo Sapiens
SEIEEFYQKL

SEQ ID NO: 100036 - protein, 10 aa, Homo Sapiens
SEIEQAVQSL

SEQ ID NO: 100037 - protein, 10 aa, Homo Sapiens
SEIFHSQSFL

SEQ ID NO: 100038 - protein, 10 aa, Homo Sapiens
SEIILRQEVL

SEQ ID NO: 100039 - protein, 10 aa, Homo Sapiens
SEIKELQLVL

SEQ ID NO: 100040 - protein, 10 aa, Homo Sapiens
SEIKGEVLYL

SEQ ID NO: 100041 - protein, 10 aa, Homo Sapiens
SEIKVPDVEL

SEQ ID NO: 100042 - protein, 10 aa, Homo Sapiens
SEILPTKETL

SEQ ID NO: 100043 - protein, 10 aa, Homo Sapiens
SEINSNSDSL

SEQ ID NO: 100044 - protein, 10 aa, Homo Sapiens
SEIPPKGGAL

SEQ ID NO: 100045 - protein, 10 aa, Homo Sapiens
SEIRSDLEQL

SEQ ID NO: 100046 - protein, 10 aa, Homo Sapiens
SEITDPESFL

SEQ ID NO: 100047 - protein, 10 aa, Homo Sapiens
SEIYIHGLGL

SEQ ID NO: 100048 - protein, 10 aa, Homo Sapiens
SEKDTKEEIL

SEQ ID NO: 100049 - protein, 10 aa, Homo Sapiens
SEKSLENETL

SEQ ID NO: 100050 - protein, 10 aa, Homo Sapiens
SELDDRADAL

SEQ ID NO: 100051 - protein, 10 aa, Homo Sapiens
SELDVPVEIL

SEQ ID NO: 100052 - protein, 10 aa, Homo Sapiens
SELEDGHTAL

SEQ ID NO: 100053 - protein, 10 aa, Homo Sapiens
SELEEEKQQL

SEQ ID NO: 100054 - protein, 10 aa, Homo Sapiens
SELEGDTITL

SEQ ID NO: 100055 - protein, 10 aa, Homo Sapiens
SELEHENAQL

SEQ ID NO: 100056 - protein, 10 aa, Homo Sapiens
SELESIQEVL

SEQ ID NO: 100057 - protein, 10 aa, Homo Sapiens
SELFESPVYL

SEQ ID NO: 100058 - protein, 10 aa, Homo Sapiens
SELILSKEQL

SEQ ID NO: 100059 - protein, 10 aa, Homo Sapiens
SELKSENESL

SEQ ID NO: 100060 - protein, 10 aa, Homo Sapiens
SELPIVTPAL

SEQ ID NO: 100061 - protein, 10 aa, Homo Sapiens
SELQAIKTEL

SEQ ID NO: 100062 - protein, 10 aa, Homo Sapiens
SELRETPSSL

SEQ ID NO: 100063 - protein, 10 aa, Homo Sapiens
SELRNQYVTL

SEQ ID NO: 100064 - protein, 10 aa, Homo Sapiens
SELVPGKEEL

SEQ ID NO: 100065 - protein, 10 aa, Homo Sapiens
SELYEESSDL

SEQ ID NO: 100066 - protein, 10 aa, Homo Sapiens
SEMEEEKSIL

SEQ ID NO: 100067 - protein, 10 aa, Homo Sapiens
SEMHVPSVAL

SEQ ID NO: 100068 - protein, 10 aa, Homo Sapiens
SEMPAEIVEL

SEQ ID NO: 100069 - protein, 10 aa, Homo Sapiens
SENKEEPVKL

SEQ ID NO: 100070 - protein, 10 aa, Homo Sapiens
SEPDAVHVVL

SEQ ID NO: 100071 - protein, 10 aa, Homo Sapiens
SEPDIAKVPL

SEQ ID NO: 100072 - protein, 10 aa, Homo Sapiens
SEPEIPEPSL

SEQ ID NO: 100073 - protein, 10 aa, Homo Sapiens
SEPQEHRYTL

SEQ ID NO: 100074 - protein, 10 aa, Homo Sapiens
SEQDILRQEL

SEQ ID NO: 100075 - protein, 10 aa, Homo Sapiens
SESAAVKEIL

SEQ ID NO: 100076 - protein, 10 aa, Homo Sapiens
SESAPGDFSL

SEQ ID NO: 100077 - protein, 10 aa, Homo Sapiens
SESEAVAVAL

SEQ ID NO: 100078 - protein, 10 aa, Homo Sapiens
SESGAIMTDL

SEQ ID NO: 100079 - protein, 10 aa, Homo Sapiens
SESKANITCL

SEQ ID NO: 100080 - protein, 10 aa, Homo Sapiens
SESQCRVVVL

SEQ ID NO: 100081 - protein, 10 aa, Homo Sapiens
SESQPHSSAL

SEQ ID NO: 100082 - protein, 10 aa, Homo Sapiens
SESRLEKAEL

SEQ ID NO: 100083 - protein, 10 aa, Homo Sapiens
SESSLSGEEL

SEQ ID NO: 100084 - protein, 10 aa, Homo Sapiens
SETEPEPVTL

SEQ ID NO: 100085 - protein, 10 aa, Homo Sapiens
SETHKAIQAL

SEQ ID NO: 100086 - protein, 10 aa, Homo Sapiens
SETLKGSFSL

SEQ ID NO: 100087 - protein, 10 aa, Homo Sapiens
SETNKGAFSL

SEQ ID NO: 100088 - protein, 10 aa, Homo Sapiens
SETYETKTAL

SEQ ID NO: 100089 - protein, 10 aa, Homo Sapiens
SEVDGNRMTL

SEQ ID NO: 100090 - protein, 10 aa, Homo Sapiens
SEVDKTKEEL

SEQ ID NO: 100091 - protein, 10 aa, Homo Sapiens
SEVEGGRTAL

SEQ ID NO: 100092 - protein, 10 aa, Homo Sapiens
SEVESTASIL

SEQ ID NO: 100093 - protein, 10 aa, Homo Sapiens
SEVESVKEFL

SEQ ID NO: 100094 - protein, 10 aa, Homo Sapiens
SEVHDLRVVL

SEQ ID NO: 100095 - protein, 10 aa, Homo Sapiens
SEVMSKEEIL

SEQ ID NO: 100096 - protein, 10 aa, Homo Sapiens
SEVRCSGQEL

SEQ ID NO: 100097 - protein, 10 aa, Homo Sapiens
SEVSQVKETL

SEQ ID NO: 100098 - protein, 10 aa, Homo Sapiens
SEVVLAGERL

SEQ ID NO: 100099 - protein, 10 aa, Homo Sapiens
SEVVVVKEEL

SEQ ID NO: 100100 - protein, 10 aa, Homo Sapiens
SEWKDTNYTL

SEQ ID NO: 100101 - protein, 10 aa, Homo Sapiens
SEYEKEITSL

SEQ ID NO: 100102 - protein, 10 aa, Homo Sapiens
SEYKTVHEEL

SEQ ID NO: 100103 - protein, 10 aa, Homo Sapiens
SEYSRSEITL

SEQ ID NO: 100104 - protein, 10 aa, Homo Sapiens
TEAAVPKVTL

SEQ ID NO: 100105 - protein, 10 aa, Homo Sapiens
TEADNTGCHL

SEQ ID NO: 100106 - protein, 10 aa, Homo Sapiens
TEAGALHVLL

SEQ ID NO: 100107 - protein, 10 aa, Homo Sapiens
TEANVIKEAL

SEQ ID NO: 100108 - protein, 10 aa, Homo Sapiens
TEATQEKYVL

SEQ ID NO: 100109 - protein, 10 aa, Homo Sapiens
TECDVREVEL

SEQ ID NO: 100110 - protein, 10 aa, Homo Sapiens
TEDECSFVSL

SEQ ID NO: 100111 - protein, 10 aa, Homo Sapiens
TEDVGSGVAL

SEQ ID NO: 100112 - protein, 10 aa, Homo Sapiens
TEEKLTPVLL

SEQ ID NO: 100113 - protein, 10 aa, Homo Sapiens
TEEPGTGVRL

SEQ ID NO: 100114 - protein, 10 aa, Homo Sapiens
TEFQGHKVIL

SEQ ID NO: 100115 - protein, 10 aa, Homo Sapiens
TEIAEERQYL

SEQ ID NO: 100116 - protein, 10 aa, Homo Sapiens
TEIDDLKTQL

SEQ ID NO: 100117 - protein, 10 aa, Homo Sapiens
TEIDGRSISL

SEQ ID NO: 100118 - protein, 10 aa, Homo Sapiens
TEIDSKWQEL

SEQ ID NO: 100119 - protein, 10 aa, Homo Sapiens
TEIEEELKSL

SEQ ID NO: 100120 - protein, 10 aa, Homo Sapiens
TEIFIHSLEL

SEQ ID NO: 100121 - protein, 10 aa, Homo Sapiens
TEIGEKGVNL

SEQ ID NO: 100122 - protein, 10 aa, Homo Sapiens
TEIGKDVIGL

SEQ ID NO: 100123 - protein, 10 aa, Homo Sapiens
TEIGQTLDLL

SEQ ID NO: 100124 - protein, 10 aa, Homo Sapiens
TEILERKTVL

SEQ ID NO: 100125 - protein, 10 aa, Homo Sapiens
TEIPPALISL

SEQ ID NO: 100126 - protein, 10 aa, Homo Sapiens
TEIQGENVTL

SEQ ID NO: 100127 - protein, 10 aa, Homo Sapiens
TEISLKDSTL

SEQ ID NO: 100128 - protein, 10 aa, Homo Sapiens
TELEAKLQVL

SEQ ID NO: 100129 - protein, 10 aa, Homo Sapiens
TELLWPGAAL

SEQ ID NO: 100130 - protein, 10 aa, Homo Sapiens
TELQGMNEYL

SEQ ID NO: 100131 - protein, 10 aa, Homo Sapiens
TEMEHEVACL

SEQ ID NO: 100132 - protein, 10 aa, Homo Sapiens
TEMESMKTTL

SEQ ID NO: 100133 - protein, 10 aa, Homo Sapiens
TENEIRGLCL

SEQ ID NO: 100134 - protein, 10 aa, Homo Sapiens
TENLNDDEKL

SEQ ID NO: 100135 - protein, 10 aa, Homo Sapiens
TESDPDNVVL

SEQ ID NO: 100136 - protein, 10 aa, Homo Sapiens
TETQAEKVVL

SEQ ID NO: 100137 - protein, 10 aa, Homo Sapiens
TEVDMKEVEL

SEQ ID NO: 100138 - protein, 10 aa, Homo Sapiens
TEVEIINQQL

SEQ ID NO: 100139 - protein, 10 aa, Homo Sapiens
TEVEIVDEKM

SEQ ID NO: 100140 - protein, 10 aa, Homo Sapiens
TEVGITNVDL

SEQ ID NO: 100141 - protein, 10 aa, Homo Sapiens
TEVLEEANTL

SEQ ID NO: 100142 - protein, 10 aa, Homo Sapiens
TEVLVTAEKL

SEQ ID NO: 100143 - protein, 10 aa, Homo Sapiens
TEYPEKEVTL

SEQ ID NO: 100144 - protein, 10 aa, Homo Sapiens
TLRGGEHEAI

SEQ ID NO: 100145 - protein, 10 aa, Homo Sapiens
VEAKDCLNVL

SEQ ID NO: 100146 - protein, 10 aa, Homo Sapiens
VEAKFVQDTL

SEQ ID NO: 100147 - protein, 10 aa, Homo Sapiens
VEALPYNTSL

SEQ ID NO: 100148 - protein, 10 aa, Homo Sapiens
VEDPTFLNQL

SEQ ID NO: 100149 - protein, 10 aa, Homo Sapiens
VEEGKISTSL

SEQ ID NO: 100150 - protein, 10 aa, Homo Sapiens
VEEPSDGTIL

SEQ ID NO: 100151 - protein, 10 aa, Homo Sapiens
VEESGEHVIL

SEQ ID NO: 100152 - protein, 10 aa, Homo Sapiens
VEFNHSGELL

SEQ ID NO: 100153 - protein, 10 aa, Homo Sapiens
VEFRNDYEEL

SEQ ID NO: 100154 - protein, 10 aa, Homo Sapiens
VEHDAFIFAL

SEQ ID NO: 100155 - protein, 10 aa, Homo Sapiens
VEHTDGQSVL

SEQ ID NO: 100156 - protein, 10 aa, Homo Sapiens
VEHVPGADIL

SEQ ID NO: 100157 - protein, 10 aa, Homo Sapiens
VEHWGLDQPL

SEQ ID NO: 100158 - protein, 10 aa, Homo Sapiens
VEIDGERIKI

SEQ ID NO: 100159 - protein, 10 aa, Homo Sapiens
VEIEERGVKL

SEQ ID NO: 100160 - protein, 10 aa, Homo Sapiens
VEIEQKVVAL

SEQ ID NO: 100161 - protein, 10 aa, Homo Sapiens
VEIGAHKDEL

SEQ ID NO: 100162 - protein, 10 aa, Homo Sapiens
VEIKELQGQL

SEQ ID NO: 100163 - protein, 10 aa, Homo Sapiens
VEINEKFTEL

SEQ ID NO: 100164 - protein, 10 aa, Homo Sapiens
VELDPEGVAL

SEQ ID NO: 100165 - protein, 10 aa, Homo Sapiens
VESSLDKVVL

SEQ ID NO: 100166 - protein, 10 aa, Homo Sapiens
VETDWHMITV

SEQ ID NO: 100167 - protein, 10 aa, Homo Sapiens
VETEIKELIL

SEQ ID NO: 100168 - protein, 10 aa, Homo Sapiens
VEVETQGDDL

SEQ ID NO: 100169 - protein, 10 aa, Homo Sapiens
VEVGGSGGCL

SEQ ID NO: 100170 - protein, 10 aa, Homo Sapiens
VEVINFGDCL

SEQ ID NO: 100171 - protein, 10 aa, Homo Sapiens
VEVQGPDWHL

SEQ ID NO: 100172 - protein, 10 aa, Homo Sapiens
VEVQLKDLIL

SEQ ID NO: 100173 - protein, 10 aa, Homo Sapiens
VSEASLVSSI

SEQ ID NO: 100174 - protein, 10 aa, Homo Sapiens
WEAGTHEELL

SEQ ID NO: 100175 - protein, 10 aa, Homo Sapiens
WEEAAHDLAL

SEQ ID NO: 100176 - protein, 10 aa, Homo Sapiens
WEEKPINTAL

SEQ ID NO: 100177 - protein, 10 aa, Homo Sapiens
WEGAFLDRVL

SEQ ID NO: 100178 - protein, 10 aa, Homo Sapiens
YEAAGEIVRL

SEQ ID NO: 100179 - protein, 10 aa, Homo Sapiens
YEAFPHDSQL

SEQ ID NO: 100180 - protein, 10 aa, Homo Sapiens
YEAYRTLAIL

SEQ ID NO: 100181 - protein, 10 aa, Homo Sapiens
YECEESFTTL

SEQ ID NO: 100182 - protein, 10 aa, Homo Sapiens
YEEQGKPEVL

SEQ ID NO: 100183 - protein, 10 aa, Homo Sapiens
YEGSPIKVTL

SEQ ID NO: 100184 - protein, 10 aa, Homo Sapiens
YEHNSIDSEL

SEQ ID NO: 100185 - protein, 10 aa, Homo Sapiens
YEIDMKQYTL

SEQ ID NO: 100186 - protein, 10 aa, Homo Sapiens
YEIERTIVQL

SEQ ID NO: 100187 - protein, 10 aa, Homo Sapiens
YELDLREPAL

SEQ ID NO: 100188 - protein, 10 aa, Homo Sapiens
YELLIKGLGL

SEQ ID NO: 100189 - protein, 10 aa, Homo Sapiens
YELQESNVQL

SEQ ID NO: 100190 - protein, 10 aa, Homo Sapiens
YELQESNVRL

SEQ ID NO: 100191 - protein, 10 aa, Homo Sapiens
YEVCKEGDVL

SEQ ID NO: 100192 - protein, 10 aa, Homo Sapiens
YEVKNKKDEL

SEQ ID NO: 100193 - protein, 10 aa, Homo Sapiens
YEVSDSAPHL

SEQ ID NO: 100194 - protein, 10 aa, Homo Sapiens
YEVVPQQPAL

SEQ ID NO: 100195 - protein, 11 aa, Homo Sapiens
AEAAEKGDVGL

SEQ ID NO: 100196 - protein, 11 aa, Homo Sapiens
AEAATGFLEQL

SEQ ID NO: 100197 - protein, 11 aa, Homo Sapiens
AEAEERGELAL

SEQ ID NO: 100198 - protein, 11 aa, Homo Sapiens
AEAFEAIPRAL

SEQ ID NO: 100199 - protein, 11 aa, Homo Sapiens
AEAGARCDFAL

SEQ ID NO: 100200 - protein, 11 aa, Homo Sapiens
AEAIIHGLSSL

SEQ ID NO: 100201 - protein, 11 aa, Homo Sapiens
AEALPRPNWEL

SEQ ID NO: 100202 - protein, 11 aa, Homo Sapiens
AEARQIACDEL

SEQ ID NO: 100203 - protein, 11 aa, Homo Sapiens
AECIDEAAERL

SEQ ID NO: 100204 - protein, 11 aa, Homo Sapiens
AECLEKFTVSL

SEQ ID NO: 100205 - protein, 11 aa, Homo Sapiens
AECQTSEKALL

SEQ ID NO: 100206 - protein, 11 aa, Homo Sapiens
AEDELRDAVLL

SEQ ID NO: 100207 - protein, 11 aa, Homo Sapiens
AEDPALKEIVL

SEQ ID NO: 100208 - protein, 11 aa, Homo Sapiens
AEEDMPQRVVL

SEQ ID NO: 100209 - protein, 11 aa, Homo Sapiens
AEEIANYRPTL

SEQ ID NO: 100210 - protein, 11 aa, Homo Sapiens
AEENGNVQALL

SEQ ID NO: 100211 - protein, 11 aa, Homo Sapiens
AEEQSGGQYEL

SEQ ID NO: 100212 - protein, 11 aa, Homo Sapiens
AEESKALIPSL

SEQ ID NO: 100213 - protein, 11 aa, Homo Sapiens
AEFAALHGPAL

SEQ ID NO: 100214 - protein, 11 aa, Homo Sapiens
AEFAERSVAKL

SEQ ID NO: 100215 - protein, 11 aa, Homo Sapiens
AEFAERTVAKL

SEQ ID NO: 100216 - protein, 11 aa, Homo Sapiens
AEFEKSAKENL

SEQ ID NO: 100217 - protein, 11 aa, Homo Sapiens
AEFLDDQETRL

SEQ ID NO: 100218 - protein, 11 aa, Homo Sapiens
AEHLRKYNEAL

SEQ ID NO: 100219 - protein, 11 aa, Homo Sapiens
AEHNPQYLIEL

SEQ ID NO: 100220 - protein, 11 aa, Homo Sapiens
AEIAHIALETL

SEQ ID NO: 100221 - protein, 11 aa, Homo Sapiens
AEIDASNIVSL

SEQ ID NO: 100222 - protein, 11 aa, Homo Sapiens
AEIDREMISSL

SEQ ID NO: 100223 - protein, 11 aa, Homo Sapiens
AEIEKFDKSKL

SEQ ID NO: 100224 - protein, 11 aa, Homo Sapiens
AEIENENGPTL

SEQ ID NO: 100225 - protein, 11 aa, Homo Sapiens
AEIKEKICDYL

SEQ ID NO: 100226 - protein, 11 aa, Homo Sapiens
AEIKTTNEVVL

SEQ ID NO: 100227 - protein, 11 aa, Homo Sapiens
AEIKVKELEVL

SEQ ID NO: 100228 - protein, 11 aa, Homo Sapiens
AEINSRTGSKL

SEQ ID NO: 100229 - protein, 11 aa, Homo Sapiens
AEIPLNEQTTL

SEQ ID NO: 100230 - protein, 11 aa, Homo Sapiens
AEIPNIKPDIL

SEQ ID NO: 100231 - protein, 11 aa, Homo Sapiens
AEIQNVEGQNL

SEQ ID NO: 100232 - protein, 11 aa, Homo Sapiens
AEIRDQMQQQL

SEQ ID NO: 100233 - protein, 11 aa, Homo Sapiens
AEIRETLTQGL

SEQ ID NO: 100234 - protein, 11 aa, Homo Sapiens
AEKWEVAEVVL

SEQ ID NO: 100235 - protein, 11 aa, Homo Sapiens
AELEELKQVLL

SEQ ID NO: 100236 - protein, 11 aa, Homo Sapiens
AELEGRQEELL

SEQ ID NO: 100237 - protein, 11 aa, Homo Sapiens
AELELLGLEKL

SEQ ID NO: 100238 - protein, 11 aa, Homo Sapiens
AELHDLKEVVL

SEQ ID NO: 100239 - protein, 11 aa, Homo Sapiens
AELIEEEVAKL

SEQ ID NO: 100240 - protein, 11 aa, Homo Sapiens
AELKGLDVDSL

SEQ ID NO: 100241 - protein, 11 aa, Homo Sapiens
AELKQIVDQSL

SEQ ID NO: 100242 - protein, 11 aa, Homo Sapiens
AELKTDVFQSL

SEQ ID NO: 100243 - protein, 11 aa, Homo Sapiens
AELLDATQHTL

SEQ ID NO: 100244 - protein, 11 aa, Homo Sapiens
AELLVSHGASL

SEQ ID NO: 100245 - protein, 11 aa, Homo Sapiens
AELPEPQQTAL

SEQ ID NO: 100246 - protein, 11 aa, Homo Sapiens
AELPGSSAVRL

SEQ ID NO: 100247 - protein, 11 aa, Homo Sapiens
AEMALFEQEVL

SEQ ID NO: 100248 - protein, 11 aa, Homo Sapiens
AEMDERFQQIL

SEQ ID NO: 100249 - protein, 11 aa, Homo Sapiens
AEMGSERALVL

SEQ ID NO: 100250 - protein, 11 aa, Homo Sapiens
AEMPDSAAALL

SEQ ID NO: 100251 - protein, 11 aa, Homo Sapiens
AENEKIQNEQL

SEQ ID NO: 100252 - protein, 11 aa, Homo Sapiens
AENEPPEKETL

SEQ ID NO: 100253 - protein, 11 aa, Homo Sapiens
AENKDEIALVL

SEQ ID NO: 100254 - protein, 11 aa, Homo Sapiens
AENPAMTRELL

SEQ ID NO: 100255 - protein, 11 aa, Homo Sapiens
AENRLTEMETL

SEQ ID NO: 100256 - protein, 11 aa, Homo Sapiens
AENTSEVSTVL

SEQ ID NO: 100257 - protein, 11 aa, Homo Sapiens
AEPDLEQAAHL

SEQ ID NO: 100258 - protein, 11 aa, Homo Sapiens
AEPEADKGTVL

SEQ ID NO: 100259 - protein, 11 aa, Homo Sapiens
AEPRNKKPSVL

SEQ ID NO: 100260 - protein, 11 aa, Homo Sapiens
AEPSSDLASKL

SEQ ID NO: 100261 - protein, 11 aa, Homo Sapiens
AEQPPDLHCVL

SEQ ID NO: 100262 - protein, 11 aa, Homo Sapiens
AERNVYTSEVL

SEQ ID NO: 100263 - protein, 11 aa, Homo Sapiens
AESDEGKLHVL

SEQ ID NO: 100264 - protein, 11 aa, Homo Sapiens
AESGAMEGETL

SEQ ID NO: 100265 - protein, 11 aa, Homo Sapiens
AESSPAKKDVL

SEQ ID NO: 100266 - protein, 11 aa, Homo Sapiens
AESTSGRGQCL

SEQ ID NO: 100267 - protein, 11 aa, Homo Sapiens
AETGQVQKIVL

SEQ ID NO: 100268 - protein, 11 aa, Homo Sapiens
AETKDIPAAIL

SEQ ID NO: 100269 - protein, 11 aa, Homo Sapiens
AEVAQREAETL

SEQ ID NO: 100270 - protein, 11 aa, Homo Sapiens
AEVEAQKAQQL

SEQ ID NO: 100271 - protein, 11 aa, Homo Sapiens
AEVEDVASHVL

SEQ ID NO: 100272 - protein, 11 aa, Homo Sapiens
AEVELKKGATL

SEQ ID NO: 100273 - protein, 11 aa, Homo Sapiens
AEVEVSIPAKL

SEQ ID NO: 100274 - protein, 11 aa, Homo Sapiens
AEVLEQSAQTL

SEQ ID NO: 100275 - protein, 11 aa, Homo Sapiens
AEVRGPAHCLL

SEQ ID NO: 100276 - protein, 11 aa, Homo Sapiens
AEVSPDAKTSL

SEQ ID NO: 100277 - protein, 11 aa, Homo Sapiens
AEVSQEVTRSL

SEQ ID NO: 100278 - protein, 11 aa, Homo Sapiens
AEVTTKSQIPL

SEQ ID NO: 100279 - protein, 11 aa, Homo Sapiens
AEYGAEALERM

SEQ ID NO: 100280 - protein, 11 aa, Homo Sapiens
AEYGEIKNIHL

SEQ ID NO: 100281 - protein, 11 aa, Homo Sapiens
AEYGGHDQIDL

SEQ ID NO: 100282 - protein, 11 aa, Homo Sapiens
AEYQELLDVKL

SEQ ID NO: 100283 - protein, 11 aa, Homo Sapiens
EASDPLPPTAL

SEQ ID NO: 100284 - protein, 11 aa, Homo Sapiens
EEFDRGIDVSL

SEQ ID NO: 100285 - protein, 11 aa, Homo Sapiens
EEFQNISPEEL

SEQ ID NO: 100286 - protein, 11 aa, Homo Sapiens
EELASLGLDRL

SEQ ID NO: 100287 - protein, 11 aa, Homo Sapiens
EEVNLNGSGKL

SEQ ID NO: 100288 - protein, 11 aa, Homo Sapiens
FEARLVQGSIL

SEQ ID NO: 100289 - protein, 11 aa, Homo Sapiens
FEEDKQRIELL

SEQ ID NO: 100290 - protein, 11 aa, Homo Sapiens
FEEKPEEPVVL

SEQ ID NO: 100291 - protein, 11 aa, Homo Sapiens
FELDYPKYEVL

SEQ ID NO: 100292 - protein, 11 aa, Homo Sapiens
GEADAQNITVL

SEQ ID NO: 100293 - protein, 11 aa, Homo Sapiens
GEAHQAETEVL

SEQ ID NO: 100294 - protein, 11 aa, Homo Sapiens
GEALPFSHLIL

SEQ ID NO: 100295 - protein, 11 aa, Homo Sapiens
GEALPHVVPTL

SEQ ID NO: 100296 - protein, 11 aa, Homo Sapiens
GEANAELCRYL

SEQ ID NO: 100297 - protein, 11 aa, Homo Sapiens
GEAPGAETPSL

SEQ ID NO: 100298 - protein, 11 aa, Homo Sapiens
GEAVRGLETAL

SEQ ID NO: 100299 - protein, 11 aa, Homo Sapiens
GECTDFKIPIL

SEQ ID NO: 100300 - protein, 11 aa, Homo Sapiens
GEDAECHAAKL

SEQ ID NO: 100301 - protein, 11 aa, Homo Sapiens
GEDAMGHTIVL

SEQ ID NO: 100302 - protein, 11 aa, Homo Sapiens
GEDGAWQGSQL

SEQ ID NO: 100303 - protein, 11 aa, Homo Sapiens
GEDNGQRGYLL

SEQ ID NO: 100304 - protein, 11 aa, Homo Sapiens
GEDREATGVLL

SEQ ID NO: 100305 - protein, 11 aa, Homo Sapiens
GEDSAVLMERL

SEQ ID NO: 100306 - protein, 11 aa, Homo Sapiens
GEDSSFLVVRL

SEQ ID NO: 100307 - protein, 11 aa, Homo Sapiens
GEEEFSYGYSL

SEQ ID NO: 100308 - protein, 11 aa, Homo Sapiens
GEEEGCASIRL

SEQ ID NO: 100309 - protein, 11 aa, Homo Sapiens
GEEENQKRYYL

SEQ ID NO: 100310 - protein, 11 aa, Homo Sapiens
GEEFFNNCEVL

SEQ ID NO: 100311 - protein, 11 aa, Homo Sapiens
GEEGSFRGSVL

SEQ ID NO: 100312 - protein, 11 aa, Homo Sapiens
GEEHYNCISAL

SEQ ID NO: 100313 - protein, 11 aa, Homo Sapiens
GEELPHPKSML

SEQ ID NO: 100314 - protein, 11 aa, Homo Sapiens
GEENIGGVEWL

SEQ ID NO: 100315 - protein, 11 aa, Homo Sapiens
GEEPAPEAEAL

SEQ ID NO: 100316 - protein, 11 aa, Homo Sapiens
GEEPGQSGASL

SEQ ID NO: 100317 - protein, 11 aa, Homo Sapiens
GEERATEAGSL

SEQ ID NO: 100318 - protein, 11 aa, Homo Sapiens
GEERQEASSSL

SEQ ID NO: 100319 - protein, 11 aa, Homo Sapiens
GEERVDSLVSL

SEQ ID NO: 100320 - protein, 11 aa, Homo Sapiens
GEESEGIHEVL

SEQ ID NO: 100321 - protein, 11 aa, Homo Sapiens
GEEYKLQNETL

SEQ ID NO: 100322 - protein, 11 aa, Homo Sapiens
GEFEKKYVATL

SEQ ID NO: 100323 - protein, 11 aa, Homo Sapiens
GEFGEIEAIEL

SEQ ID NO: 100324 - protein, 11 aa, Homo Sapiens
GEFGKKADGLL

SEQ ID NO: 100325 - protein, 11 aa, Homo Sapiens
GEFGYDKDTSL

SEQ ID NO: 100326 - protein, 11 aa, Homo Sapiens
GEFKKYLEVVL

SEQ ID NO: 100327 - protein, 11 aa, Homo Sapiens
GEFQIVNPHLL

SEQ ID NO: 100328 - protein, 11 aa, Homo Sapiens
GEFSGANKEKL

SEQ ID NO: 100329 - protein, 11 aa, Homo Sapiens
GEFSLHEQTVL

SEQ ID NO: 100330 - protein, 11 aa, Homo Sapiens
GEFSPNVPKSL

SEQ ID NO: 100331 - protein, 11 aa, Homo Sapiens
GEFTLHGRAIL

SEQ ID NO: 100332 - protein, 11 aa, Homo Sapiens
GEGDSVITQVL

SEQ ID NO: 100333 - protein, 11 aa, Homo Sapiens
GEGTQGPELSL

SEQ ID NO: 100334 - protein, 11 aa, Homo Sapiens
GEHHEKAVELL

SEQ ID NO: 100335 - protein, 11 aa, Homo Sapiens
GEHIIAGAGEL

SEQ ID NO: 100336 - protein, 11 aa, Homo Sapiens
GEHREHGTVLL

SEQ ID NO: 100337 - protein, 11 aa, Homo Sapiens
GEHSSRVVQEL

SEQ ID NO: 100338 - protein, 11 aa, Homo Sapiens
GEHVILGTGEL

SEQ ID NO: 100339 - protein, 11 aa, Homo Sapiens
GEIASFDKAKL

SEQ ID NO: 100340 - protein, 11 aa, Homo Sapiens
GEICEEGLHVL

SEQ ID NO: 100341 - protein, 11 aa, Homo Sapiens
GEIDEETDSAL

SEQ ID NO: 100342 - protein, 11 aa, Homo Sapiens
GEIEARYSTGL

SEQ ID NO: 100343 - protein, 11 aa, Homo Sapiens
GEIEELQQCLL

SEQ ID NO: 100344 - protein, 11 aa, Homo Sapiens
GEIKDGLEVML

SEQ ID NO: 100345 - protein, 11 aa, Homo Sapiens
GEIKRDFIATL

SEQ ID NO: 100346 - protein, 11 aa, Homo Sapiens
GEINVIGEPFL

SEQ ID NO: 100347 - protein, 11 aa, Homo Sapiens
GEIQEIVKTGL

SEQ ID NO: 100348 - protein, 11 aa, Homo Sapiens
GEIREQNGDSL

SEQ ID NO: 100349 - protein, 11 aa, Homo Sapiens
GEIVEKIGVHL

SEQ ID NO: 100350 - protein, 11 aa, Homo Sapiens
GEKFEDENFIL

SEQ ID NO: 100351 - protein, 11 aa, Homo Sapiens
GEKLLPGIEVL

SEQ ID NO: 100352 - protein, 11 aa, Homo Sapiens
GELANEVKVLL

SEQ ID NO: 100353 - protein, 11 aa, Homo Sapiens
GELDLDKQSEL

SEQ ID NO: 100354 - protein, 11 aa, Homo Sapiens
GELDLERAPAL

SEQ ID NO: 100355 - protein, 11 aa, Homo Sapiens
GELEAAKALVL

SEQ ID NO: 100356 - protein, 11 aa, Homo Sapiens
GELEAKLNENL

SEQ ID NO: 100357 - protein, 11 aa, Homo Sapiens
GELPTSPLHLL

SEQ ID NO: 100358 - protein, 11 aa, Homo Sapiens
GEMTLKSALAL

SEQ ID NO: 100359 - protein, 11 aa, Homo Sapiens
GENDETVQTTL

SEQ ID NO: 100360 - protein, 11 aa, Homo Sapiens
GENPASHSYVL

SEQ ID NO: 100361 - protein, 11 aa, Homo Sapiens
GEPAEVTTTVL

SEQ ID NO: 100362 - protein, 11 aa, Homo Sapiens
GEPHGLENMEL

SEQ ID NO: 100363 - protein, 11 aa, Homo Sapiens
GEPRYALTTTL

SEQ ID NO: 100364 - protein, 11 aa, Homo Sapiens
GEPVDDKSATL

SEQ ID NO: 100365 - protein, 11 aa, Homo Sapiens
GESHVSGTTTL

SEQ ID NO: 100366 - protein, 11 aa, Homo Sapiens
GETETRLECLL

SEQ ID NO: 100367 - protein, 11 aa, Homo Sapiens
GETLAMKGLTL

SEQ ID NO: 100368 - protein, 11 aa, Homo Sapiens
GETVAREATEL

SEQ ID NO: 100369 - protein, 11 aa, Homo Sapiens
GEVDGKAIPDL

SEQ ID NO: 100370 - protein, 11 aa, Homo Sapiens
GEVEGHPVWAL

SEQ ID NO: 100371 - protein, 11 aa, Homo Sapiens
GEVFPTTEVLL

SEQ ID NO: 100372 - protein, 11 aa, Homo Sapiens
GEVLEQEKGAL

SEQ ID NO: 100373 - protein, 11 aa, Homo Sapiens
GEVVDQGSTNL

SEQ ID NO: 100374 - protein, 11 aa, Homo Sapiens
GEVYSADREDL

SEQ ID NO: 100375 - protein, 11 aa, Homo Sapiens
GISLEDTQKEL

SEQ ID NO: 100376 - protein, 11 aa, Homo Sapiens
HEAPSLQEAAL

SEQ ID NO: 100377 - protein, 11 aa, Homo Sapiens
HEAQAVLGVLL

SEQ ID NO: 100378 - protein, 11 aa, Homo Sapiens
HEAQLSEKISL

SEQ ID NO: 100379 - protein, 11 aa, Homo Sapiens
HEAWQGLGEVL

SEQ ID NO: 100380 - protein, 11 aa, Homo Sapiens
HECLVKSGDLL

SEQ ID NO: 100381 - protein, 11 aa, Homo Sapiens
HEDYCGARTEL

SEQ ID NO: 100382 - protein, 11 aa, Homo Sapiens
HEEDHTLGNSL

SEQ ID NO: 100383 - protein, 11 aa, Homo Sapiens
HEELIGAATAL

SEQ ID NO: 100384 - protein, 11 aa, Homo Sapiens
HEILSRDPLLL

SEQ ID NO: 100385 - protein, 11 aa, Homo Sapiens
HEKLDNKKECL

SEQ ID NO: 100386 - protein, 11 aa, Homo Sapiens
HELLEGSEIYL

SEQ ID NO: 100387 - protein, 11 aa, Homo Sapiens
HELQENTICSL

SEQ ID NO: 100388 - protein, 11 aa, Homo Sapiens
HELQLLNTDYL

SEQ ID NO: 100389 - protein, 11 aa, Homo Sapiens
HELSGLNKEEL

SEQ ID NO: 100390 - protein, 11 aa, Homo Sapiens
HEMDTSNGVLL

SEQ ID NO: 100391 - protein, 11 aa, Homo Sapiens
HEMEIQLKDAL

SEQ ID NO: 100392 - protein, 11 aa, Homo Sapiens
HEMIESGVINL

SEQ ID NO: 100393 - protein, 11 aa, Homo Sapiens
HESACGRTVSL

SEQ ID NO: 100394 - protein, 11 aa, Homo Sapiens
HESGYDAGKAL

SEQ ID NO: 100395 - protein, 11 aa, Homo Sapiens
HETLEQRLLVT

SEQ ID NO: 100396 - protein, 11 aa, Homo Sapiens
HEVEVNGTDTL

SEQ ID NO: 100397 - protein, 11 aa, Homo Sapiens
HEVMEQGRVTI

SEQ ID NO: 100398 - protein, 11 aa, Homo Sapiens
HEVQEHFPEAL

SEQ ID NO: 100399 - protein, 11 aa, Homo Sapiens
HEWEESNVQIL

SEQ ID NO: 100400 - protein, 11 aa, Homo Sapiens
IEASNIDNVVL

SEQ ID NO: 100401 - protein, 11 aa, Homo Sapiens
IEELPTQISSL

SEQ ID NO: 100402 - protein, 11 aa, Homo Sapiens
IEEPSAKINVL

SEQ ID NO: 100403 - protein, 11 aa, Homo Sapiens
IEESIDRVYSL

SEQ ID NO: 100404 - protein, 11 aa, Homo Sapiens
IEFDPSKPFSL

SEQ ID NO: 100405 - protein, 11 aa, Homo Sapiens
IEFKETQALVL

SEQ ID NO: 100406 - protein, 11 aa, Homo Sapiens
IEHALGGSSAL

SEQ ID NO: 100407 - protein, 11 aa, Homo Sapiens
IELDPRFNDIL

SEQ ID NO: 100408 - protein, 11 aa, Homo Sapiens
IENRDVAKSVL

SEQ ID NO: 100409 - protein, 11 aa, Homo Sapiens
IENRDVAKTVL

SEQ ID NO: 100410 - protein, 11 aa, Homo Sapiens
IEVDPDTKEML

SEQ ID NO: 100411 - protein, 11 aa, Homo Sapiens
IEVIENRMAVL

SEQ ID NO: 100412 - protein, 11 aa, Homo Sapiens
KEAEPDLLAVL

SEQ ID NO: 100413 - protein, 11 aa, Homo Sapiens
KEALIAASETL

SEQ ID NO: 100414 - protein, 11 aa, Homo Sapiens
KEALTYDGALL

SEQ ID NO: 100415 - protein, 11 aa, Homo Sapiens
KEAPTPKEGTL

SEQ ID NO: 100416 - protein, 11 aa, Homo Sapiens
KEAQKTAAVAL

SEQ ID NO: 100417 - protein, 11 aa, Homo Sapiens
KECQEKLQAVL

SEQ ID NO: 100418 - protein, 11 aa, Homo Sapiens
KECQEKLQVAL

SEQ ID NO: 100419 - protein, 11 aa, Homo Sapiens
KEDEIPETVSL

SEQ ID NO: 100420 - protein, 11 aa, Homo Sapiens
KEDEQPQVVVL

SEQ ID NO: 100421 - protein, 11 aa, Homo Sapiens
KEDGAISTIVL

SEQ ID NO: 100422 - protein, 11 aa, Homo Sapiens
KEDNGIGILTL

SEQ ID NO: 100423 - protein, 11 aa, Homo Sapiens
KEDPMGWQSLL

SEQ ID NO: 100424 - protein, 11 aa, Homo Sapiens
KEEADGVHNTL

SEQ ID NO: 100425 - protein, 11 aa, Homo Sapiens
KEEESQQQAVL

SEQ ID NO: 100426 - protein, 11 aa, Homo Sapiens
KEEETNSVATL

SEQ ID NO: 100427 - protein, 11 aa, Homo Sapiens
KEEGAGLGFSL

SEQ ID NO: 100428 - protein, 11 aa, Homo Sapiens
KEELLECIQQL

SEQ ID NO: 100429 - protein, 11 aa, Homo Sapiens
KEENSTEEQAL

SEQ ID NO: 100430 - protein, 11 aa, Homo Sapiens
KEENTQEAAVL

SEQ ID NO: 100431 - protein, 11 aa, Homo Sapiens
KEENVGLHQTL

SEQ ID NO: 100432 - protein, 11 aa, Homo Sapiens
KEEQMDGTVTL

SEQ ID NO: 100433 - protein, 11 aa, Homo Sapiens
KEESIVSSLRL

SEQ ID NO: 100434 - protein, 11 aa, Homo Sapiens
KEFAGEDTSDL

SEQ ID NO: 100435 - protein, 11 aa, Homo Sapiens
KEFDGKSLVSV

SEQ ID NO: 100436 - protein, 11 aa, Homo Sapiens
KEFEENTQHLL

SEQ ID NO: 100437 - protein, 11 aa, Homo Sapiens
KEFMPPGLQEL

SEQ ID NO: 100438 - protein, 11 aa, Homo Sapiens
KEFNFPEEAVL

SEQ ID NO: 100439 - protein, 11 aa, Homo Sapiens
KEFSLQDIEVL

SEQ ID NO: 100440 - protein, 11 aa, Homo Sapiens
KEGEIQAGAKL

SEQ ID NO: 100441 - protein, 11 aa, Homo Sapiens
KEHEVEKMFTL

SEQ ID NO: 100442 - protein, 11 aa, Homo Sapiens
KEIAENQEAKL

SEQ ID NO: 100443 - protein, 11 aa, Homo Sapiens
KEIAFPKAEEL

SEQ ID NO: 100444 - protein, 11 aa, Homo Sapiens
KEIDMLLKEYL

SEQ ID NO: 100445 - protein, 11 aa, Homo Sapiens
KEIEDAEKYSF

SEQ ID NO: 100446 - protein, 11 aa, Homo Sapiens
KEIEQEAAVEL

SEQ ID NO: 100447 - protein, 11 aa, Homo Sapiens
KEISSVDCIAL

SEQ ID NO: 100448 - protein, 11 aa, Homo Sapiens
KEITEKTRVAL

SEQ ID NO: 100449 - protein, 11 aa, Homo Sapiens
KEIYNQVNVVL

SEQ ID NO: 100450 - protein, 11 aa, Homo Sapiens
KELDEEHSQEL

SEQ ID NO: 100451 - protein, 11 aa, Homo Sapiens
KELDSNPFASL

SEQ ID NO: 100452 - protein, 11 aa, Homo Sapiens
KELEDSLLARL

SEQ ID NO: 100453 - protein, 11 aa, Homo Sapiens
KELGLVDGQEL

SEQ ID NO: 100454 - protein, 11 aa, Homo Sapiens
KELILHNPVTL

SEQ ID NO: 100455 - protein, 11 aa, Homo Sapiens
KELKDAGAGLL

SEQ ID NO: 100456 - protein, 11 aa, Homo Sapiens
KELQAHGADEL

SEQ ID NO: 100457 - protein, 11 aa, Homo Sapiens
KEMGGHHIVAL

SEQ ID NO: 100458 - protein, 11 aa, Homo Sapiens
KEMQPTHPIRL

SEQ ID NO: 100459 - protein, 11 aa, Homo Sapiens
KENDAVTIQVL

SEQ ID NO: 100460 - protein, 11 aa, Homo Sapiens
KENLELNGSIL

SEQ ID NO: 100461 - protein, 11 aa, Homo Sapiens
KEPDRIVGEFL

SEQ ID NO: 100462 - protein, 11 aa, Homo Sapiens
KEQLEAEAQAL

SEQ ID NO: 100463 - protein, 11 aa, Homo Sapiens
KESEGVVNDEL

SEQ ID NO: 100464 - protein, 11 aa, Homo Sapiens
KESESSLDVSL

SEQ ID NO: 100465 - protein, 11 aa, Homo Sapiens
KETFLTSPEEL

SEQ ID NO: 100466 - protein, 11 aa, Homo Sapiens
KETSPLTAEKL

SEQ ID NO: 100467 - protein, 11 aa, Homo Sapiens
KEVDEDFDSKL

SEQ ID NO: 100468 - protein, 11 aa, Homo Sapiens
KEVDIEGTTVI

SEQ ID NO: 100469 - protein, 11 aa, Homo Sapiens
KEVEETIEGML

SEQ ID NO: 100470 - protein, 11 aa, Homo Sapiens
KEVEKNLKSCL

SEQ ID NO: 100471 - protein, 11 aa, Homo Sapiens
KEVFEDKQSVL

SEQ ID NO: 100472 - protein, 11 aa, Homo Sapiens
KEVYAAAAEVL

SEQ ID NO: 100473 - protein, 11 aa, Homo Sapiens
KEVYEGEVTEL

SEQ ID NO: 100474 - protein, 11 aa, Homo Sapiens
KEYEEKGGEYL

SEQ ID NO: 100475 - protein, 11 aa, Homo Sapiens
KEYESKSLEEL

SEQ ID NO: 100476 - protein, 11 aa, Homo Sapiens
KEYFSTFGEVL

SEQ ID NO: 100477 - protein, 11 aa, Homo Sapiens
KEYPNRGNTCL

SEQ ID NO: 100478 - protein, 11 aa, Homo Sapiens
KEYQNVHEEVL

SEQ ID NO: 100479 - protein, 11 aa, Homo Sapiens
KIENKIESIGL

SEQ ID NO: 100480 - protein, 11 aa, Homo Sapiens
LEAPVSGNQQL

SEQ ID NO: 100481 - protein, 11 aa, Homo Sapiens
LEDAETKNVAL

SEQ ID NO: 100482 - protein, 11 aa, Homo Sapiens
LEEPRGQQEVL

SEQ ID NO: 100483 - protein, 11 aa, Homo Sapiens
LEFDPAQRITL

SEQ ID NO: 100484 - protein, 11 aa, Homo Sapiens
LEHDPQYAVIL

SEQ ID NO: 100485 - protein, 11 aa, Homo Sapiens
LEMNSDLKAQL

SEQ ID NO: 100486 - protein, 11 aa, Homo Sapiens
LEVAEGGKAEL

SEQ ID NO: 100487 - protein, 11 aa, Homo Sapiens
LEYDPTQRITL

SEQ ID NO: 100488 - protein, 11 aa, Homo Sapiens
LLAENPQSTPQ

SEQ ID NO: 100489 - protein, 11 aa, Homo Sapiens
LVVPANCLAQL

SEQ ID NO: 100490 - protein, 11 aa, Homo Sapiens
MEAIGHAGTCL

SEQ ID NO: 100491 - protein, 11 aa, Homo Sapiens
MEENPGIFAVL

SEQ ID NO: 100492 - protein, 11 aa, Homo Sapiens
MELPTEKEVAL

SEQ ID NO: 100493 - protein, 11 aa, Homo Sapiens
MESKEKDRQVL

SEQ ID NO: 100494 - protein, 11 aa, Homo Sapiens
NEFKEKGIGTL

SEQ ID NO: 100495 - protein, 11 aa, Homo Sapiens
PVTDGAISTLL

SEQ ID NO: 100496 - protein, 11 aa, Homo Sapiens
QEACEAYLVGL

SEQ ID NO: 100497 - protein, 11 aa, Homo Sapiens
QEAPSSTSQEL

SEQ ID NO: 100498 - protein, 11 aa, Homo Sapiens
QEASEAYLVGL

SEQ ID NO: 100499 - protein, 11 aa, Homo Sapiens
QEDNVANKQTL

SEQ ID NO: 100500 - protein, 11 aa, Homo Sapiens
QEEDESPRSVL

SEQ ID NO: 100501 - protein, 11 aa, Homo Sapiens
QEEMDSNKVSL

SEQ ID NO: 100502 - protein, 11 aa, Homo Sapiens
QEFGVGDGSKL

SEQ ID NO: 100503 - protein, 11 aa, Homo Sapiens
QEFTSCLKETL

SEQ ID NO: 100504 - protein, 11 aa, Homo Sapiens
QEHPASAEFVL

SEQ ID NO: 100505 - protein, 11 aa, Homo Sapiens
QEIDPTKENQL

SEQ ID NO: 100506 - protein, 11 aa, Homo Sapiens
QELEDTKVTAL

SEQ ID NO: 100507 - protein, 11 aa, Homo Sapiens
QELNELSAISL

SEQ ID NO: 100508 - protein, 11 aa, Homo Sapiens
QEMGNGKANRL

SEQ ID NO: 100509 - protein, 11 aa, Homo Sapiens
QEPLEGTEQTL

SEQ ID NO: 100510 - protein, 11 aa, Homo Sapiens
QETADVKASVL

SEQ ID NO: 100511 - protein, 11 aa, Homo Sapiens
QEVGDGTNFVL

SEQ ID NO: 100512 - protein, 11 aa, Homo Sapiens
QFDDQGKAVIL

SEQ ID NO: 100513 - protein, 11 aa, Homo Sapiens
QREEAAEVASL

SEQ ID NO: 100514 - protein, 11 aa, Homo Sapiens
REAAAVFQETL

SEQ ID NO: 100515 - protein, 11 aa, Homo Sapiens
REAAEKAKCEL

SEQ ID NO: 100516 - protein, 11 aa, Homo Sapiens
REAATQAQQTL

SEQ ID NO: 100517 - protein, 11 aa, Homo Sapiens
REACETVGATL

SEQ ID NO: 100518 - protein, 11 aa, Homo Sapiens
READAALFSEL

SEQ ID NO: 100519 - protein, 11 aa, Homo Sapiens
REAIDSPVSFL

SEQ ID NO: 100520 - protein, 11 aa, Homo Sapiens
REANQAINPKL

SEQ ID NO: 100521 - protein, 11 aa, Homo Sapiens
REAQAELAQKL

SEQ ID NO: 100522 - protein, 11 aa, Homo Sapiens
REAQNDLEQVL

SEQ ID NO: 100523 - protein, 11 aa, Homo Sapiens
REASIYTGITL

SEQ ID NO: 100524 - protein, 11 aa, Homo Sapiens
REASLSILEQL

SEQ ID NO: 100525 - protein, 11 aa, Homo Sapiens
REATSTPEISL

SEQ ID NO: 100526 - protein, 11 aa, Homo Sapiens
REAVEAAGQEL

SEQ ID NO: 100527 - protein, 11 aa, Homo Sapiens
REAVVNTQELL

SEQ ID NO: 100528 - protein, 11 aa, Homo Sapiens
REDDPGEAASM

SEQ ID NO: 100529 - protein, 11 aa, Homo Sapiens
REDDSDKYCKL

SEQ ID NO: 100530 - protein, 11 aa, Homo Sapiens
REDDVGTGAGL

SEQ ID NO: 100531 - protein, 11 aa, Homo Sapiens
REDETDVKAVL

SEQ ID NO: 100532 - protein, 11 aa, Homo Sapiens
REDFKGKKIEL

SEQ ID NO: 100533 - protein, 11 aa, Homo Sapiens
REDGSFSFYSL

SEQ ID NO: 100534 - protein, 11 aa, Homo Sapiens
REDPSGVILTL

SEQ ID NO: 100535 - protein, 11 aa, Homo Sapiens
REDSLDSVLFL

SEQ ID NO: 100536 - protein, 11 aa, Homo Sapiens
REDSNLESSQL

SEQ ID NO: 100537 - protein, 11 aa, Homo Sapiens
REDSQRPGAHL

SEQ ID NO: 100538 - protein, 11 aa, Homo Sapiens
REDSVKPGAHL

SEQ ID NO: 100539 - protein, 11 aa, Homo Sapiens
REEAVALGVGL

SEQ ID NO: 100540 - protein, 11 aa, Homo Sapiens
REEEQAFLVSL

SEQ ID NO: 100541 - protein, 11 aa, Homo Sapiens
REEGFDRSTSL

SEQ ID NO: 100542 - protein, 11 aa, Homo Sapiens
REEGKENAFSL

SEQ ID NO: 100543 - protein, 11 aa, Homo Sapiens
REEKDGELNVL

SEQ ID NO: 100544 - protein, 11 aa, Homo Sapiens
REELSNVLAAM

SEQ ID NO: 100545 - protein, 11 aa, Homo Sapiens
REENNESEVSL

SEQ ID NO: 100546 - protein, 11 aa, Homo Sapiens
REEQGSGGYSL

SEQ ID NO: 100547 - protein, 11 aa, Homo Sapiens
REESDSLGQDL

SEQ ID NO: 100548 - protein, 11 aa, Homo Sapiens
REESLAEVVCL

SEQ ID NO: 100549 - protein, 11 aa, Homo Sapiens
REFEDQKLTML

SEQ ID NO: 100550 - protein, 11 aa, Homo Sapiens
REFFDSNGNFL

SEQ ID NO: 100551 - protein, 11 aa, Homo Sapiens
REFGEEALNSL

SEQ ID NO: 100552 - protein, 11 aa, Homo Sapiens
REFPEADAEKL

SEQ ID NO: 100553 - protein, 11 aa, Homo Sapiens
REFTDSAEAKL

SEQ ID NO: 100554 - protein, 11 aa, Homo Sapiens
REGDMPIHELL

SEQ ID NO: 100555 - protein, 11 aa, Homo Sapiens
REHEIGEWEAF

SEQ ID NO: 100556 - protein, 11 aa, Homo Sapiens
REHFTPEATQL

SEQ ID NO: 100557 - protein, 11 aa, Homo Sapiens
REHMGQLLHQL

SEQ ID NO: 100558 - protein, 11 aa, Homo Sapiens
REHSSLGHADL

SEQ ID NO: 100559 - protein, 11 aa, Homo Sapiens
REHSVHDSVEL

SEQ ID NO: 100560 - protein, 11 aa, Homo Sapiens
REHVEAIKIGL

SEQ ID NO: 100561 - protein, 11 aa, Homo Sapiens
REIAQDFKTDL

SEQ ID NO: 100562 - protein, 11 aa, Homo Sapiens
REIATEKKNSL

SEQ ID NO: 100563 - protein, 11 aa, Homo Sapiens
REIESSPQYRL

SEQ ID NO: 100564 - protein, 11 aa, Homo Sapiens
REIFLSQPILL

SEQ ID NO: 100565 - protein, 11 aa, Homo Sapiens
REILETLIKGL

SEQ ID NO: 100566 - protein, 11 aa, Homo Sapiens
REIRHPNIITL

SEQ ID NO: 100567 - protein, 11 aa, Homo Sapiens
REITDKKKINL

SEQ ID NO: 100568 - protein, 11 aa, Homo Sapiens
REITFENGEEL

SEQ ID NO: 100569 - protein, 11 aa, Homo Sapiens
REIVAISSAQL

SEQ ID NO: 100570 - protein, 11 aa, Homo Sapiens
REIVIGVLHQL

SEQ ID NO: 100571 - protein, 11 aa, Homo Sapiens
REIVRDIKEKL

SEQ ID NO: 100572 - protein, 11 aa, Homo Sapiens
REKAEGDVAAL

SEQ ID NO: 100573 - protein, 11 aa, Homo Sapiens
REKEAAYQERL

SEQ ID NO: 100574 - protein, 11 aa, Homo Sapiens
REKEDLVDLVL

SEQ ID NO: 100575 - protein, 11 aa, Homo Sapiens
REKLAEKKELL

SEQ ID NO: 100576 - protein, 11 aa, Homo Sapiens
REKLTSKEECL

SEQ ID NO: 100577 - protein, 11 aa, Homo Sapiens
REKQPMVPESL

SEQ ID NO: 100578 - protein, 11 aa, Homo Sapiens
REKVIKGAEIL

SEQ ID NO: 100579 - protein, 11 aa, Homo Sapiens
RELEDPESAML

SEQ ID NO: 100580 - protein, 11 aa, Homo Sapiens
RELEEKAMEEL

SEQ ID NO: 100581 - protein, 11 aa, Homo Sapiens
RELEEKEQERL

SEQ ID NO: 100582 - protein, 11 aa, Homo Sapiens
RELEGASDPLL

SEQ ID NO: 100583 - protein, 11 aa, Homo Sapiens
RELISDLEHRL

SEQ ID NO: 100584 - protein, 11 aa, Homo Sapiens
RELISNASDAL

SEQ ID NO: 100585 - protein, 11 aa, Homo Sapiens
RELREREGPSL

SEQ ID NO: 100586 - protein, 11 aa, Homo Sapiens
RELWNQGAGLL

SEQ ID NO: 100587 - protein, 11 aa, Homo Sapiens
REMTSKLLSDL

SEQ ID NO: 100588 - protein, 11 aa, Homo Sapiens
RENEVDWLTEL

SEQ ID NO: 100589 - protein, 11 aa, Homo Sapiens
RENGEATDTIL

SEQ ID NO: 100590 - protein, 11 aa, Homo Sapiens
RENIESLAHAL

SEQ ID NO: 100591 - protein, 11 aa, Homo Sapiens
RENLEEEAIIM

SEQ ID NO: 100592 - protein, 11 aa, Homo Sapiens
RENMAYTVECL

SEQ ID NO: 100593 - protein, 11 aa, Homo Sapiens
RENPGGSEESL

SEQ ID NO: 100594 - protein, 11 aa, Homo Sapiens
RENVVNFIDCL

SEQ ID NO: 100595 - protein, 11 aa, Homo Sapiens
RENYDRGYSSL

SEQ ID NO: 100596 - protein, 11 aa, Homo Sapiens
REQESKYIEEL

SEQ ID NO: 100597 - protein, 11 aa, Homo Sapiens
REQHGVAASCL

SEQ ID NO: 100598 - protein, 11 aa, Homo Sapiens
REQIDNLATEL

SEQ ID NO: 100599 - protein, 11 aa, Homo Sapiens
REQQAGKDVTL

SEQ ID NO: 100600 - protein, 11 aa, Homo Sapiens
RESDSAKPASL

SEQ ID NO: 100601 - protein, 11 aa, Homo Sapiens
RESEIETNTEL

SEQ ID NO: 100602 - protein, 11 aa, Homo Sapiens
RESIVLHGATL

SEQ ID NO: 100603 - protein, 11 aa, Homo Sapiens
RESQVSILQSL

SEQ ID NO: 100604 - protein, 11 aa, Homo Sapiens
RETAEALLQVL

SEQ ID NO: 100605 - protein, 11 aa, Homo Sapiens
RETDEETKQIL

SEQ ID NO: 100606 - protein, 11 aa, Homo Sapiens
RETVSEESNVL

SEQ ID NO: 100607 - protein, 11 aa, Homo Sapiens
REVDLKNGHNL

SEQ ID NO: 100608 - protein, 11 aa, Homo Sapiens
REVELDPDIQL

SEQ ID NO: 100609 - protein, 11 aa, Homo Sapiens
REVGIPPEQSL

SEQ ID NO: 100610 - protein, 11 aa, Homo Sapiens
REVLPEHVSVL

SEQ ID NO: 100611 - protein, 11 aa, Homo Sapiens
REVLPESLPVL

SEQ ID NO: 100612 - protein, 11 aa, Homo Sapiens
REVSPAHQYAL

SEQ ID NO: 100613 - protein, 11 aa, Homo Sapiens
REWGEELQAVL

SEQ ID NO: 100614 - protein, 11 aa, Homo Sapiens
REYEAELETQL

SEQ ID NO: 100615 - protein, 11 aa, Homo Sapiens
REYEDNDEVHI

SEQ ID NO: 100616 - protein, 11 aa, Homo Sapiens
REYNEVEPIIL

SEQ ID NO: 100617 - protein, 11 aa, Homo Sapiens
REYNEYENIKL

SEQ ID NO: 100618 - protein, 11 aa, Homo Sapiens
REYQDLLNVKM

SEQ ID NO: 100619 - protein, 11 aa, Homo Sapiens
REYQELMSVKL

SEQ ID NO: 100620 - protein, 11 aa, Homo Sapiens
SDTPLGTVALL

SEQ ID NO: 100621 - protein, 11 aa, Homo Sapiens
SEAADSKSLVL

SEQ ID NO: 100622 - protein, 11 aa, Homo Sapiens
SEAANRNNDAL

SEQ ID NO: 100623 - protein, 11 aa, Homo Sapiens
SEAPVDLASKL

SEQ ID NO: 100624 - protein, 11 aa, Homo Sapiens
SECNSNRDSVL

SEQ ID NO: 100625 - protein, 11 aa, Homo Sapiens
SECQTSVGTLL

SEQ ID NO: 100626 - protein, 11 aa, Homo Sapiens
SEDFRGSMTSL

SEQ ID NO: 100627 - protein, 11 aa, Homo Sapiens
SEDGGHIFCTL

SEQ ID NO: 100628 - protein, 11 aa, Homo Sapiens
SEDGLPEGIHL

SEQ ID NO: 100629 - protein, 11 aa, Homo Sapiens
SEDGSGKGAAL

SEQ ID NO: 100630 - protein, 11 aa, Homo Sapiens
SEDGSLHVFVL

SEQ ID NO: 100631 - protein, 11 aa, Homo Sapiens
SEDPSGKKAVL

SEQ ID NO: 100632 - protein, 11 aa, Homo Sapiens
SEDYIKSGALL

SEQ ID NO: 100633 - protein, 11 aa, Homo Sapiens
SEEEDSGKQAL

SEQ ID NO: 100634 - protein, 11 aa, Homo Sapiens
SEEKLDSACLL

SEQ ID NO: 100635 - protein, 11 aa, Homo Sapiens
SEEQNSQFQSL

SEQ ID NO: 100636 - protein, 11 aa, Homo Sapiens
SEFEQNLSEKL

SEQ ID NO: 100637 - protein, 11 aa, Homo Sapiens
SEFHEKLLNTL

SEQ ID NO: 100638 - protein, 11 aa, Homo Sapiens
SEFKYNKPAFL

SEQ ID NO: 100639 - protein, 11 aa, Homo Sapiens
SEFREDMPSIL

SEQ ID NO: 100640 - protein, 11 aa, Homo Sapiens
SEFTPLPREVL

SEQ ID NO: 100641 - protein, 11 aa, Homo Sapiens
SEHPDQAQAIL

SEQ ID NO: 100642 - protein, 11 aa, Homo Sapiens
SEHQSRTVATL

SEQ ID NO: 100643 - protein, 11 aa, Homo Sapiens
SEHSTEGSVSL

SEQ ID NO: 100644 - protein, 11 aa, Homo Sapiens
SEIDPRENPDL

SEQ ID NO: 100645 - protein, 11 aa, Homo Sapiens
SEIGEKQDTEL

SEQ ID NO: 100646 - protein, 11 aa, Homo Sapiens
SEIHSGNSVSL

SEQ ID NO: 100647 - protein, 11 aa, Homo Sapiens
SEILETSSTKL

SEQ ID NO: 100648 - protein, 11 aa, Homo Sapiens
SEILSKKQNEL

SEQ ID NO: 100649 - protein, 11 aa, Homo Sapiens
SEITGLSTAVL

SEQ ID NO: 100650 - protein, 11 aa, Homo Sapiens
SELDEEKKIRL

SEQ ID NO: 100651 - protein, 11 aa, Homo Sapiens
SELDLPLGTQL

SEQ ID NO: 100652 - protein, 11 aa, Homo Sapiens
SELISKSSEIL

SEQ ID NO: 100653 - protein, 11 aa, Homo Sapiens
SELPDSIESAL

SEQ ID NO: 100654 - protein, 11 aa, Homo Sapiens
SELQGERIVSL

SEQ ID NO: 100655 - protein, 11 aa, Homo Sapiens
SELREPLKVVL

SEQ ID NO: 100656 - protein, 11 aa, Homo Sapiens
SELRSICTTVL

SEQ ID NO: 100657 - protein, 11 aa, Homo Sapiens
SEMDPSTQISL

SEQ ID NO: 100658 - protein, 11 aa, Homo Sapiens
SEMEDKTTANL

SEQ ID NO: 100659 - protein, 11 aa, Homo Sapiens
SEMSEEKRAKL

SEQ ID NO: 100660 - protein, 11 aa, Homo Sapiens
SENQEKVKALL

SEQ ID NO: 100661 - protein, 11 aa, Homo Sapiens
SEPQDPAAVSL

SEQ ID NO: 100662 - protein, 11 aa, Homo Sapiens
SEQLSRDCDAL

SEQ ID NO: 100663 - protein, 11 aa, Homo Sapiens
SESDKTAVLTL

SEQ ID NO: 100664 - protein, 11 aa, Homo Sapiens
SESMATRDVVL

SEQ ID NO: 100665 - protein, 11 aa, Homo Sapiens
SETAVAKNQAL

SEQ ID NO: 100666 - protein, 11 aa, Homo Sapiens
SETETATSNAL

SEQ ID NO: 100667 - protein, 11 aa, Homo Sapiens
SETSGHTQESL

SEQ ID NO: 100668 - protein, 11 aa, Homo Sapiens
SETYETKTALL

SEQ ID NO: 100669 - protein, 11 aa, Homo Sapiens
SEVEPSVNADL

SEQ ID NO: 100670 - protein, 11 aa, Homo Sapiens
SEVKDEIRTSL

SEQ ID NO: 100671 - protein, 11 aa, Homo Sapiens
SEVKGLDAFVL

SEQ ID NO: 100672 - protein, 11 aa, Homo Sapiens
SEVSQDGKSLL

SEQ ID NO: 100673 - protein, 11 aa, Homo Sapiens
SEVTEPDHPVL

SEQ ID NO: 100674 - protein, 11 aa, Homo Sapiens
SEYLPEVKDLL

SEQ ID NO: 100675 - protein, 11 aa, Homo Sapiens
TEADVEEALRL

SEQ ID NO: 100676 - protein, 11 aa, Homo Sapiens
TEAEAAALEVL

SEQ ID NO: 100677 - protein, 11 aa, Homo Sapiens
TEAISCIKEVL

SEQ ID NO: 100678 - protein, 11 aa, Homo Sapiens
TEAQLRYGSAL

SEQ ID NO: 100679 - protein, 11 aa, Homo Sapiens
TEARTMAAEVL

SEQ ID NO: 100680 - protein, 11 aa, Homo Sapiens
TEAVEDLTTTL

SEQ ID NO: 100681 - protein, 11 aa, Homo Sapiens
TECVSDNQVHL

SEQ ID NO: 100682 - protein, 11 aa, Homo Sapiens
TEDEKSKLTVL

SEQ ID NO: 100683 - protein, 11 aa, Homo Sapiens
TEEEASKLTAL

SEQ ID NO: 100684 - protein, 11 aa, Homo Sapiens
TEEEVSERVTL

SEQ ID NO: 100685 - protein, 11 aa, Homo Sapiens
TEFEDTPTSQL

SEQ ID NO: 100686 - protein, 11 aa, Homo Sapiens
TEIAPTGIESL

SEQ ID NO: 100687 - protein, 11 aa, Homo Sapiens
TEIDEKEYISL

SEQ ID NO: 100688 - protein, 11 aa, Homo Sapiens
TEISSAEKVAL

SEQ ID NO: 100689 - protein, 11 aa, Homo Sapiens
TELESDFRDVL

SEQ ID NO: 100690 - protein, 11 aa, Homo Sapiens
TELLWPGAALL

SEQ ID NO: 100691 - protein, 11 aa, Homo Sapiens
TELRDICNDVL

SEQ ID NO: 100692 - protein, 11 aa, Homo Sapiens
TEMEEGKDLSL

SEQ ID NO: 100693 - protein, 11 aa, Homo Sapiens
TENQEAKRVAL

SEQ ID NO: 100694 - protein, 11 aa, Homo Sapiens
TEPTEDSGISL

SEQ ID NO: 100695 - protein, 11 aa, Homo Sapiens
TESDEKSSIAL

SEQ ID NO: 100696 - protein, 11 aa, Homo Sapiens
TETIDTSRVSL

SEQ ID NO: 100697 - protein, 11 aa, Homo Sapiens
TEVAPAKDVTL

SEQ ID NO: 100698 - protein, 11 aa, Homo Sapiens
TEVLEGNPTVL

SEQ ID NO: 100699 - protein, 11 aa, Homo Sapiens
TEVTPVTGASL

SEQ ID NO: 100700 - protein, 11 aa, Homo Sapiens
TEYLSNADERL

SEQ ID NO: 100701 - protein, 11 aa, Homo Sapiens
VEADIKEFTTL

SEQ ID NO: 100702 - protein, 11 aa, Homo Sapiens
VEALIQSADTL

SEQ ID NO: 100703 - protein, 11 aa, Homo Sapiens
VEDDARGTVVL

SEQ ID NO: 100704 - protein, 11 aa, Homo Sapiens
VEEAVATRTAL

SEQ ID NO: 100705 - protein, 11 aa, Homo Sapiens
VEENWTHLQSL

SEQ ID NO: 100706 - protein, 11 aa, Homo Sapiens
VEESVTGVHRL

SEQ ID NO: 100707 - protein, 11 aa, Homo Sapiens
VEFESQNKEFL

SEQ ID NO: 100708 - protein, 11 aa, Homo Sapiens
VEFFDEKLNSL

SEQ ID NO: 100709 - protein, 11 aa, Homo Sapiens
VEHLDDLPGAL

SEQ ID NO: 100710 - protein, 11 aa, Homo Sapiens
VEIGDSTFTVL

SEQ ID NO: 100711 - protein, 11 aa, Homo Sapiens
VEITEESKALL

SEQ ID NO: 100712 - protein, 11 aa, Homo Sapiens
VEIVKNDDGVI

SEQ ID NO: 100713 - protein, 11 aa, Homo Sapiens
VELDDLGKDEL

SEQ ID NO: 100714 - protein, 11 aa, Homo Sapiens
VENEDKKGVQL

SEQ ID NO: 100715 - protein, 11 aa, Homo Sapiens
VETPTGYIESL

SEQ ID NO: 100716 - protein, 11 aa, Homo Sapiens
VEVDDPLKAQM

SEQ ID NO: 100717 - protein, 11 aa, Homo Sapiens
WEEGKAALEQL

SEQ ID NO: 100718 - protein, 11 aa, Homo Sapiens
WEIDPKDLTFL

SEQ ID NO: 100719 - protein, 11 aa, Homo Sapiens
WESKSDALETL

SEQ ID NO: 100720 - protein, 11 aa, Homo Sapiens
YEADPLKKELL

SEQ ID NO: 100721 - protein, 11 aa, Homo Sapiens
YEALLNLAERL

SEQ ID NO: 100722 - protein, 11 aa, Homo Sapiens
YEAQDPEIASL

SEQ ID NO: 100723 - protein, 11 aa, Homo Sapiens
YEFDTKDLVCL

SEQ ID NO: 100724 - protein, 11 aa, Homo Sapiens
YEHEDIKKGIL

SEQ ID NO: 100725 - protein, 11 aa, Homo Sapiens
YEHETGRESTL

SEQ ID NO: 100726 - protein, 11 aa, Homo Sapiens
YEIDDRDVNKI

SEQ ID NO: 100727 - protein, 11 aa, Homo Sapiens
YEIHDGMNLEL

SEQ ID NO: 100728 - protein, 11 aa, Homo Sapiens
YEKEDSDEVHL

SEQ ID NO: 100729 - protein, 11 aa, Homo Sapiens
YELPTDSHASL

SEQ ID NO: 100730 - protein, 11 aa, Homo Sapiens
YEVDINGPEIL

SEQ ID NO: 100731 - protein, 11 aa, Homo Sapiens
YEVGDPGQRTL

SEQ ID NO: 100732 - protein, 8 aa, Homo Sapiens
ADAVAVTM

SEQ ID NO: 100733 - protein, 8 aa, Homo Sapiens
ADFETVRM

SEQ ID NO: 100734 - protein, 8 aa, Homo Sapiens
ADFPALVV

SEQ ID NO: 100735 - protein, 8 aa, Homo Sapiens
ADIIMEKL

SEQ ID NO: 100736 - protein, 8 aa, Homo Sapiens
ADVIIHEI

SEQ ID NO: 100737 - protein, 8 aa, Homo Sapiens
ADVIVHRL

SEQ ID NO: 100738 - protein, 8 aa, Homo Sapiens
ADVKVHIL

SEQ ID NO: 100739 - protein, 8 aa, Homo Sapiens
ADWAAKKL

SEQ ID NO: 100740 - protein, 8 aa, Homo Sapiens
ADYKPPAT

SEQ ID NO: 100741 - protein, 8 aa, Homo Sapiens
ADYLAHES

SEQ ID NO: 100742 - protein, 8 aa, Homo Sapiens
AEAVRTTL

SEQ ID NO: 100743 - protein, 8 aa, Homo Sapiens
AEAVSRVL

SEQ ID NO: 100744 - protein, 8 aa, Homo Sapiens
AECALEKL

SEQ ID NO: 100745 - protein, 8 aa, Homo Sapiens
AEDPKVTL

SEQ ID NO: 100746 - protein, 8 aa, Homo Sapiens
AEFEVPKL

SEQ ID NO: 100747 - protein, 8 aa, Homo Sapiens
AEFHVQRV

SEQ ID NO: 100748 - protein, 8 aa, Homo Sapiens
AEFKVRAL

SEQ ID NO: 100749 - protein, 8 aa, Homo Sapiens
AEFLLHML

SEQ ID NO: 100750 - protein, 8 aa, Homo Sapiens
AEGPAVSL

SEQ ID NO: 100751 - protein, 8 aa, Homo Sapiens
AEGPITAL

SEQ ID NO: 100752 - protein, 8 aa, Homo Sapiens
AEHHVATL

SEQ ID NO: 100753 - protein, 8 aa, Homo Sapiens
AEHKPLVL

SEQ ID NO: 100754 - protein, 8 aa, Homo Sapiens
AEHKVQSL

SEQ ID NO: 100755 - protein, 8 aa, Homo Sapiens
AEHPNVTL

SEQ ID NO: 100756 - protein, 8 aa, Homo Sapiens
AEIAKAEL

SEQ ID NO: 100757 - protein, 8 aa, Homo Sapiens
AEIAKVEL

SEQ ID NO: 100758 - protein, 8 aa, Homo Sapiens
AEIAVNAV

SEQ ID NO: 100759 - protein, 8 aa, Homo Sapiens
AEIDAHLV

SEQ ID NO: 100760 - protein, 8 aa, Homo Sapiens
AEIEHHEM

SEQ ID NO: 100761 - protein, 8 aa, Homo Sapiens
AEIEQYRL

SEQ ID NO: 100762 - protein, 8 aa, Homo Sapiens
AEIHVPTL

SEQ ID NO: 100763 - protein, 8 aa, Homo Sapiens
AEIPLRMV

SEQ ID NO: 100764 - protein, 8 aa, Homo Sapiens
AEIQKSAL

SEQ ID NO: 100765 - protein, 8 aa, Homo Sapiens
AEIRVHTV

SEQ ID NO: 100766 - protein, 8 aa, Homo Sapiens
AEIVLRSL

SEQ ID NO: 100767 - protein, 8 aa, Homo Sapiens
AEIVTKTI

SEQ ID NO: 100768 - protein, 8 aa, Homo Sapiens
AEKPEEEL

SEQ ID NO: 100769 - protein, 8 aa, Homo Sapiens
AELKIKRL

SEQ ID NO: 100770 - protein, 8 aa, Homo Sapiens
AELKQECL

SEQ ID NO: 100771 - protein, 8 aa, Homo Sapiens
AELLILKR

SEQ ID NO: 100772 - protein, 8 aa, Homo Sapiens
AEMAQNAV

SEQ ID NO: 100773 - protein, 8 aa, Homo Sapiens
AEMKAQEV

SEQ ID NO: 100774 - protein, 8 aa, Homo Sapiens
AEMTTRMV

SEQ ID NO: 100775 - protein, 8 aa, Homo Sapiens
AEMVRHAL

SEQ ID NO: 100776 - protein, 8 aa, Homo Sapiens
AEMYVAKF

SEQ ID NO: 100777 - protein, 8 aa, Homo Sapiens
AEQAKVVL

SEQ ID NO: 100778 - protein, 8 aa, Homo Sapiens
AEQIKHIL

SEQ ID NO: 100779 - protein, 8 aa, Homo Sapiens
AEQPSVKL

SEQ ID NO: 100780 - protein, 8 aa, Homo Sapiens
AERAIEKM

SEQ ID NO: 100781 - protein, 8 aa, Homo Sapiens
AERIKPVL

SEQ ID NO: 100782 - protein, 8 aa, Homo Sapiens
AETEARTL

SEQ ID NO: 100783 - protein, 8 aa, Homo Sapiens
AETKGVAL

SEQ ID NO: 100784 - protein, 8 aa, Homo Sapiens
AETKNVAL

SEQ ID NO: 100785 - protein, 8 aa, Homo Sapiens
AETPVYRF

SEQ ID NO: 100786 - protein, 8 aa, Homo Sapiens
AEVFIVKM

SEQ ID NO: 100787 - protein, 8 aa, Homo Sapiens
AEVIVRQL

SEQ ID NO: 100788 - protein, 8 aa, Homo Sapiens
AEVSQPRL

SEQ ID NO: 100789 - protein, 8 aa, Homo Sapiens
AEVTKVVV

SEQ ID NO: 100790 - protein, 8 aa, Homo Sapiens
AEWKATKL

SEQ ID NO: 100791 - protein, 8 aa, Homo Sapiens
AEYMPIKL

SEQ ID NO: 100792 - protein, 8 aa, Homo Sapiens
AEYPAVKF

SEQ ID NO: 100793 - protein, 8 aa, Homo Sapiens
AEYSAFKL

SEQ ID NO: 100794 - protein, 8 aa, Homo Sapiens
CRPLSKTV

SEQ ID NO: 100795 - protein, 8 aa, Homo Sapiens
DRQQQITV

SEQ ID NO: 100796 - protein, 8 aa, Homo Sapiens
EAHAKVRL

SEQ ID NO: 100797 - protein, 8 aa, Homo Sapiens
EAKKIERL

SEQ ID NO: 100798 - protein, 8 aa, Homo Sapiens
EATLLQKL

SEQ ID NO: 100799 - protein, 8 aa, Homo Sapiens
EEHEVAVL

SEQ ID NO: 100800 - protein, 8 aa, Homo Sapiens
EEQLQQIR

SEQ ID NO: 100801 - protein, 8 aa, Homo Sapiens
ESKNEEIL

SEQ ID NO: 100802 - protein, 8 aa, Homo Sapiens
ETAVLPKL

SEQ ID NO: 100803 - protein, 8 aa, Homo Sapiens
FEHKEEVL

SEQ ID NO: 100804 - protein, 8 aa, Homo Sapiens
FEKEQQQL

SEQ ID NO: 100805 - protein, 8 aa, Homo Sapiens
FETAVKKL

SEQ ID NO: 100806 - protein, 8 aa, Homo Sapiens
FETKVTTL

SEQ ID NO: 100807 - protein, 8 aa, Homo Sapiens
GEAKIEDL

SEQ ID NO: 100808 - protein, 8 aa, Homo Sapiens
GEAKVEQL

SEQ ID NO: 100809 - protein, 8 aa, Homo Sapiens
GEAPSKTL

SEQ ID NO: 100810 - protein, 8 aa, Homo Sapiens
GEEVVRVL

SEQ ID NO: 100811 - protein, 8 aa, Homo Sapiens
GEFKVHRV

SEQ ID NO: 100812 - protein, 8 aa, Homo Sapiens
GEFRTTTV

SEQ ID NO: 100813 - protein, 8 aa, Homo Sapiens
GEGKLFSL

SEQ ID NO: 100814 - protein, 8 aa, Homo Sapiens
GEGRPPVL

SEQ ID NO: 100815 - protein, 8 aa, Homo Sapiens
GEGRVEVL

SEQ ID NO: 100816 - protein, 8 aa, Homo Sapiens
GEHPGLSI

SEQ ID NO: 100817 - protein, 8 aa, Homo Sapiens
GEIDGNKV

SEQ ID NO: 100818 - protein, 8 aa, Homo Sapiens
GEIDLAKL

SEQ ID NO: 100819 - protein, 8 aa, Homo Sapiens
GEIKIHKM

SEQ ID NO: 100820 - protein, 8 aa, Homo Sapiens
GEIKSHDL

SEQ ID NO: 100821 - protein, 8 aa, Homo Sapiens
GEIPTYGL

SEQ ID NO: 100822 - protein, 8 aa, Homo Sapiens
GEIPVVAI

SEQ ID NO: 100823 - protein, 8 aa, Homo Sapiens
GEIRATAF

SEQ ID NO: 100824 - protein, 8 aa, Homo Sapiens
GELAKHAV

SEQ ID NO: 100825 - protein, 8 aa, Homo Sapiens
GELKITSV

SEQ ID NO: 100826 - protein, 8 aa, Homo Sapiens
GELKTVRL

SEQ ID NO: 100827 - protein, 8 aa, Homo Sapiens
GELKVYKT

SEQ ID NO: 100828 - protein, 8 aa, Homo Sapiens
GELRAMVL

SEQ ID NO: 100829 - protein, 8 aa, Homo Sapiens
GEMIIDRV

SEQ ID NO: 100830 - protein, 8 aa, Homo Sapiens
GERKVEHL

SEQ ID NO: 100831 - protein, 8 aa, Homo Sapiens
GETPQVAV

SEQ ID NO: 100832 - protein, 8 aa, Homo Sapiens
GETTILQL

SEQ ID NO: 100833 - protein, 8 aa, Homo Sapiens
GETTSHLM

SEQ ID NO: 100834 - protein, 8 aa, Homo Sapiens
GEVGGNTL

SEQ ID NO: 100835 - protein, 8 aa, Homo Sapiens
GEVHIKTM

SEQ ID NO: 100836 - protein, 8 aa, Homo Sapiens
GEVLISRV

SEQ ID NO: 100837 - protein, 8 aa, Homo Sapiens
GEVPVHKL

SEQ ID NO: 100838 - protein, 8 aa, Homo Sapiens
GEVRIWDL

SEQ ID NO: 100839 - protein, 8 aa, Homo Sapiens
GEVRIWNL

SEQ ID NO: 100840 - protein, 8 aa, Homo Sapiens
GEWEPPVI

SEQ ID NO: 100841 - protein, 8 aa, Homo Sapiens
GEYPLTAM

SEQ ID NO: 100842 - protein, 8 aa, Homo Sapiens
HDAEIVRL

SEQ ID NO: 100843 - protein, 8 aa, Homo Sapiens
HDFQAPYL

SEQ ID NO: 100844 - protein, 8 aa, Homo Sapiens
HDFVVVET

SEQ ID NO: 100845 - protein, 8 aa, Homo Sapiens
HDIGIVTM

SEQ ID NO: 100846 - protein, 8 aa, Homo Sapiens
HDILIRKF

SEQ ID NO: 100847 - protein, 8 aa, Homo Sapiens
HDIQIVST

SEQ ID NO: 100848 - protein, 8 aa, Homo Sapiens
HDKIVIVL

SEQ ID NO: 100849 - protein, 8 aa, Homo Sapiens
HDLLVHKA

SEQ ID NO: 100850 - protein, 8 aa, Homo Sapiens
HEAQIQEM

SEQ ID NO: 100851 - protein, 8 aa, Homo Sapiens
HEFHSPAL

SEQ ID NO: 100852 - protein, 8 aa, Homo Sapiens
HEFLQTEI

SEQ ID NO: 100853 - protein, 8 aa, Homo Sapiens
HEGPVWQV

SEQ ID NO: 100854 - protein, 8 aa, Homo Sapiens
HEHFVTSL

SEQ ID NO: 100855 - protein, 8 aa, Homo Sapiens
HEHQANLL

SEQ ID NO: 100856 - protein, 8 aa, Homo Sapiens
HEIAVLEL

SEQ ID NO: 100857 - protein, 8 aa, Homo Sapiens
HEIEVETI

SEQ ID NO: 100858 - protein, 8 aa, Homo Sapiens
HELRIARL

SEQ ID NO: 100859 - protein, 8 aa, Homo Sapiens
HELVIKTL

SEQ ID NO: 100860 - protein, 8 aa, Homo Sapiens
HEQVVERL

SEQ ID NO: 100861 - protein, 8 aa, Homo Sapiens
HERPEFIA

SEQ ID NO: 100862 - protein, 8 aa, Homo Sapiens
HESPAVKL

SEQ ID NO: 100863 - protein, 8 aa, Homo Sapiens
HETQPPSV

SEQ ID NO: 100864 - protein, 8 aa, Homo Sapiens
HETVTIEL

SEQ ID NO: 100865 - protein, 8 aa, Homo Sapiens
HEVFLQRL

SEQ ID NO: 100866 - protein, 8 aa, Homo Sapiens
HEVIVSAA

SEQ ID NO: 100867 - protein, 8 aa, Homo Sapiens
HEVKKVTL

SEQ ID NO: 100868 - protein, 8 aa, Homo Sapiens
IDITGPKV

SEQ ID NO: 100869 - protein, 8 aa, Homo Sapiens
IDKYTEVL

SEQ ID NO: 100870 - protein, 8 aa, Homo Sapiens
IDVSGPKV

SEQ ID NO: 100871 - protein, 8 aa, Homo Sapiens
IDYTGQQL

SEQ ID NO: 100872 - protein, 8 aa, Homo Sapiens
IEFVADRL

SEQ ID NO: 100873 - protein, 8 aa, Homo Sapiens
IEVETRSL

SEQ ID NO: 100874 - protein, 8 aa, Homo Sapiens
IEVGVVTV

SEQ ID NO: 100875 - protein, 8 aa, Homo Sapiens
KDFIIFEA

SEQ ID NO: 100876 - protein, 8 aa, Homo Sapiens
KDFRVQEL

SEQ ID NO: 100877 - protein, 8 aa, Homo Sapiens
KDFSIHRL

SEQ ID NO: 100878 - protein, 8 aa, Homo Sapiens
KDFSPEAL

SEQ ID NO: 100879 - protein, 8 aa, Homo Sapiens
KDLEIERL

SEQ ID NO: 100880 - protein, 8 aa, Homo Sapiens
KDVEMVRL

SEQ ID NO: 100881 - protein, 8 aa, Homo Sapiens
KDVLSVAF

SEQ ID NO: 100882 - protein, 8 aa, Homo Sapiens
KDVNIPTL

SEQ ID NO: 100883 - protein, 8 aa, Homo Sapiens
KDVNQQEF

SEQ ID NO: 100884 - protein, 8 aa, Homo Sapiens
KDVVIHRF

SEQ ID NO: 100885 - protein, 8 aa, Homo Sapiens
KEEIIKTL

SEQ ID NO: 100886 - protein, 8 aa, Homo Sapiens
KEFALHKL

SEQ ID NO: 100887 - protein, 8 aa, Homo Sapiens
KEFDGKSL

SEQ ID NO: 100888 - protein, 8 aa, Homo Sapiens
KEFEFSQL

SEQ ID NO: 100889 - protein, 8 aa, Homo Sapiens
KEFEGKTL

SEQ ID NO: 100890 - protein, 8 aa, Homo Sapiens
KEFQKIAM

SEQ ID NO: 100891 - protein, 8 aa, Homo Sapiens
KEGKIYRL

SEQ ID NO: 100892 - protein, 8 aa, Homo Sapiens
KEHVIEAL

SEQ ID NO: 100893 - protein, 8 aa, Homo Sapiens
KEIEKVAL

SEQ ID NO: 100894 - protein, 8 aa, Homo Sapiens
KEILIPVF

SEQ ID NO: 100895 - protein, 8 aa, Homo Sapiens
KEILQKEL

SEQ ID NO: 100896 - protein, 8 aa, Homo Sapiens
KEKLQPRL

SEQ ID NO: 100897 - protein, 8 aa, Homo Sapiens
KELEVLLM

SEQ ID NO: 100898 - protein, 8 aa, Homo Sapiens
KELEVPHF

SEQ ID NO: 100899 - protein, 8 aa, Homo Sapiens
KELEVRKL

SEQ ID NO: 100900 - protein, 8 aa, Homo Sapiens
KELGITAL

SEQ ID NO: 100901 - protein, 8 aa, Homo Sapiens
KELLTREL

SEQ ID NO: 100902 - protein, 8 aa, Homo Sapiens
KENPVVVA

SEQ ID NO: 100903 - protein, 8 aa, Homo Sapiens
KERSGVSL

SEQ ID NO: 100904 - protein, 8 aa, Homo Sapiens
KESEVKAL

SEQ ID NO: 100905 - protein, 8 aa, Homo Sapiens
KETIAKCI

SEQ ID NO: 100906 - protein, 8 aa, Homo Sapiens
KETQALVL

SEQ ID NO: 100907 - protein, 8 aa, Homo Sapiens
KEVAVKKL

SEQ ID NO: 100908 - protein, 8 aa, Homo Sapiens
KEVDIYTV

SEQ ID NO: 100909 - protein, 8 aa, Homo Sapiens
KEVEATKL

SEQ ID NO: 100910 - protein, 8 aa, Homo Sapiens
KEVPIHRV

SEQ ID NO: 100911 - protein, 8 aa, Homo Sapiens
KEVPNYKL

SEQ ID NO: 100912 - protein, 8 aa, Homo Sapiens
KEVQTNEL

SEQ ID NO: 100913 - protein, 8 aa, Homo Sapiens
KEWVAKQT

SEQ ID NO: 100914 - protein, 8 aa, Homo Sapiens
KEYAVNEV

SEQ ID NO: 100915 - protein, 8 aa, Homo Sapiens
KQLDEWLK

SEQ ID NO: 100916 - protein, 8 aa, Homo Sapiens
KQQLLQGI

SEQ ID NO: 100917 - protein, 8 aa, Homo Sapiens
LDIIIHSL

SEQ ID NO: 100918 - protein, 8 aa, Homo Sapiens
LDRETEEI

SEQ ID NO: 100919 - protein, 8 aa, Homo Sapiens
LDWPVRTL

SEQ ID NO: 100920 - protein, 8 aa, Homo Sapiens
LEANLAVL

SEQ ID NO: 100921 - protein, 8 aa, Homo Sapiens
LEARLVSL

SEQ ID NO: 100922 - protein, 8 aa, Homo Sapiens
LEQRVVEL

SEQ ID NO: 100923 - protein, 8 aa, Homo Sapiens
LERAIESL

SEQ ID NO: 100924 - protein, 8 aa, Homo Sapiens
LERAVEAL

SEQ ID NO: 100925 - protein, 8 aa, Homo Sapiens
LERKVESL

SEQ ID NO: 100926 - protein, 8 aa, Homo Sapiens
LERSLSKL

SEQ ID NO: 100927 - protein, 8 aa, Homo Sapiens
LESKTNTL

SEQ ID NO: 100928 - protein, 8 aa, Homo Sapiens
LPPAAPGK

SEQ ID NO: 100929 - protein, 8 aa, Homo Sapiens
LRELIRKL

SEQ ID NO: 100930 - protein, 8 aa, Homo Sapiens
MEIDGQKL

SEQ ID NO: 100931 - protein, 8 aa, Homo Sapiens
MEKIQPAL

SEQ ID NO: 100932 - protein, 8 aa, Homo Sapiens
NDIKVWDL

SEQ ID NO: 100933 - protein, 8 aa, Homo Sapiens
NDIVVKVL

SEQ ID NO: 100934 - protein, 8 aa, Homo Sapiens
NDWVAVHV

SEQ ID NO: 100935 - protein, 8 aa, Homo Sapiens
NEFLTREL

SEQ ID NO: 100936 - protein, 8 aa, Homo Sapiens
NEFTTHVM

SEQ ID NO: 100937 - protein, 8 aa, Homo Sapiens
NELITNAL

SEQ ID NO: 100938 - protein, 8 aa, Homo Sapiens
NEQPPVVL

SEQ ID NO: 100939 - protein, 8 aa, Homo Sapiens
NEVKIYSL

SEQ ID NO: 100940 - protein, 8 aa, Homo Sapiens
NEVPVKEL

SEQ ID NO: 100941 - protein, 8 aa, Homo Sapiens
NEYKGWVL

SEQ ID NO: 100942 - protein, 8 aa, Homo Sapiens
PVFNSVEL

SEQ ID NO: 100943 - protein, 8 aa, Homo Sapiens
QDFQIQAF

SEQ ID NO: 100944 - protein, 8 aa, Homo Sapiens
QDISVHKL

SEQ ID NO: 100945 - protein, 8 aa, Homo Sapiens
QEHQQQVL

SEQ ID NO: 100946 - protein, 8 aa, Homo Sapiens
QEIQVVKL

SEQ ID NO: 100947 - protein, 8 aa, Homo Sapiens
QEKPERPL

SEQ ID NO: 100948 - protein, 8 aa, Homo Sapiens
QELPSHGV

SEQ ID NO: 100949 - protein, 8 aa, Homo Sapiens
QELSLEKL

SEQ ID NO: 100950 - protein, 8 aa, Homo Sapiens
QEWEVKAL

SEQ ID NO: 100951 - protein, 8 aa, Homo Sapiens
RDFEGKVV

SEQ ID NO: 100952 - protein, 8 aa, Homo Sapiens
RDFKAYSL

SEQ ID NO: 100953 - protein, 8 aa, Homo Sapiens
RDFKGKVL

SEQ ID NO: 100954 - protein, 8 aa, Homo Sapiens
RDFKVVLL

SEQ ID NO: 100955 - protein, 8 aa, Homo Sapiens
RDFTVSAM

SEQ ID NO: 100956 - protein, 8 aa, Homo Sapiens
RDFVARNV

SEQ ID NO: 100957 - protein, 8 aa, Homo Sapiens
RDFVLVKL

SEQ ID NO: 100958 - protein, 8 aa, Homo Sapiens
RDMVSKKL

SEQ ID NO: 100959 - protein, 8 aa, Homo Sapiens
RDVIMREF

SEQ ID NO: 100960 - protein, 8 aa, Homo Sapiens
RDWFSSQL

SEQ ID NO: 100961 - protein, 8 aa, Homo Sapiens
RDWVLNEF

SEQ ID NO: 100962 - protein, 8 aa, Homo Sapiens
RDYVAPTA

SEQ ID NO: 100963 - protein, 8 aa, Homo Sapiens
REARDPSL

SEQ ID NO: 100964 - protein, 8 aa, Homo Sapiens
REDQKPVM

SEQ ID NO: 100965 - protein, 8 aa, Homo Sapiens
REELSNVL

SEQ ID NO: 100966 - protein, 8 aa, Homo Sapiens
REFKLSKV

SEQ ID NO: 100967 - protein, 8 aa, Homo Sapiens
REFQTSAI

SEQ ID NO: 100968 - protein, 8 aa, Homo Sapiens
REFQTSVV

SEQ ID NO: 100969 - protein, 8 aa, Homo Sapiens
REGNAVAV

SEQ ID NO: 100970 - protein, 8 aa, Homo Sapiens
REHEKEVL

SEQ ID NO: 100971 - protein, 8 aa, Homo Sapiens
REIEGDLL

SEQ ID NO: 100972 - protein, 8 aa, Homo Sapiens
REIEGRAI

SEQ ID NO: 100973 - protein, 8 aa, Homo Sapiens
REIIINAV

SEQ ID NO: 100974 - protein, 8 aa, Homo Sapiens
REKPDDPL

SEQ ID NO: 100975 - protein, 8 aa, Homo Sapiens
REKQAPEL

SEQ ID NO: 100976 - protein, 8 aa, Homo Sapiens
REKVESEL

SEQ ID NO: 100977 - protein, 8 aa, Homo Sapiens
RELDGRTL

SEQ ID NO: 100978 - protein, 8 aa, Homo Sapiens
RELKGAKL

SEQ ID NO: 100979 - protein, 8 aa, Homo Sapiens
RELRIRKL

SEQ ID NO: 100980 - protein, 8 aa, Homo Sapiens
RELVAHHL

SEQ ID NO: 100981 - protein, 8 aa, Homo Sapiens
RENTQTTI

SEQ ID NO: 100982 - protein, 8 aa, Homo Sapiens
REQLKHKL

SEQ ID NO: 100983 - protein, 8 aa, Homo Sapiens
RERAVELL

SEQ ID NO: 100984 - protein, 8 aa, Homo Sapiens
REVEKVKL

SEQ ID NO: 100985 - protein, 8 aa, Homo Sapiens
REVKVAQL

SEQ ID NO: 100986 - protein, 8 aa, Homo Sapiens
REVQTNDL

SEQ ID NO: 100987 - protein, 8 aa, Homo Sapiens
REVSVPTF

SEQ ID NO: 100988 - protein, 8 aa, Homo Sapiens
SDFEARQL

SEQ ID NO: 100989 - protein, 8 aa, Homo Sapiens
SDFPIHNL

SEQ ID NO: 100990 - protein, 8 aa, Homo Sapiens
SDFVVHEI

SEQ ID NO: 100991 - protein, 8 aa, Homo Sapiens
SDIKGSVL

SEQ ID NO: 100992 - protein, 8 aa, Homo Sapiens
SDIQIRRL

SEQ ID NO: 100993 - protein, 8 aa, Homo Sapiens
SDIQVHVT

SEQ ID NO: 100994 - protein, 8 aa, Homo Sapiens
SDIQVKEL

SEQ ID NO: 100995 - protein, 8 aa, Homo Sapiens
SDIVVHRL

SEQ ID NO: 100996 - protein, 8 aa, Homo Sapiens
SDKETYEL

SEQ ID NO: 100997 - protein, 8 aa, Homo Sapiens
SDLHAHKL

SEQ ID NO: 100998 - protein, 8 aa, Homo Sapiens
SDLKAEAL

SEQ ID NO: 100999 - protein, 8 aa, Homo Sapiens
SDLKVIVM

SEQ ID NO: 101000 - protein, 8 aa, Homo Sapiens
SDVKIYKV

SEQ ID NO: 101001 - protein, 8 aa, Homo Sapiens
SDYEIVRL

SEQ ID NO: 101002 - protein, 8 aa, Homo Sapiens
SDYIIRTL

SEQ ID NO: 101003 - protein, 8 aa, Homo Sapiens
SDYTPLSL

SEQ ID NO: 101004 - protein, 8 aa, Homo Sapiens
SEAGSHTI

SEQ ID NO: 101005 - protein, 8 aa, Homo Sapiens
SEARIQQL

SEQ ID NO: 101006 - protein, 8 aa, Homo Sapiens
SEAYLVGL

SEQ ID NO: 101007 - protein, 8 aa, Homo Sapiens
SEFKNITV

SEQ ID NO: 101008 - protein, 8 aa, Homo Sapiens
SEFPIRTL

SEQ ID NO: 101009 - protein, 8 aa, Homo Sapiens
SEFQIPTA

SEQ ID NO: 101010 - protein, 8 aa, Homo Sapiens
SEGKAYSL

SEQ ID NO: 101011 - protein, 8 aa, Homo Sapiens
SEGKCFSV

SEQ ID NO: 101012 - protein, 8 aa, Homo Sapiens
SEHPNVTL

SEQ ID NO: 101013 - protein, 8 aa, Homo Sapiens
SEIESVKI

SEQ ID NO: 101014 - protein, 8 aa, Homo Sapiens
SEIKGEVL

SEQ ID NO: 101015 - protein, 8 aa, Homo Sapiens
SEITTKDL

SEQ ID NO: 101016 - protein, 8 aa, Homo Sapiens
SEIYIHGL

SEQ ID NO: 101017 - protein, 8 aa, Homo Sapiens
SEKVSHVL

SEQ ID NO: 101018 - protein, 8 aa, Homo Sapiens
SELGICAV

SEQ ID NO: 101019 - protein, 8 aa, Homo Sapiens
SELITKAV

SEQ ID NO: 101020 - protein, 8 aa, Homo Sapiens
SELPAKRL

SEQ ID NO: 101021 - protein, 8 aa, Homo Sapiens
SELQVHSA

SEQ ID NO: 101022 - protein, 8 aa, Homo Sapiens
SELTQPKL

SEQ ID NO: 101023 - protein, 8 aa, Homo Sapiens
SELVLTRL

SEQ ID NO: 101024 - protein, 8 aa, Homo Sapiens
SENPAKRL

SEQ ID NO: 101025 - protein, 8 aa, Homo Sapiens
SEQAVWAL

SEQ ID NO: 101026 - protein, 8 aa, Homo Sapiens
SEQPIAAL

SEQ ID NO: 101027 - protein, 8 aa, Homo Sapiens
SESPVKAV

SEQ ID NO: 101028 - protein, 8 aa, Homo Sapiens
SETETPKL

SEQ ID NO: 101029 - protein, 8 aa, Homo Sapiens
SETHIYQV

SEQ ID NO: 101030 - protein, 8 aa, Homo Sapiens
SETKIFTA

SEQ ID NO: 101031 - protein, 8 aa, Homo Sapiens
SETKTRVL

SEQ ID NO: 101032 - protein, 8 aa, Homo Sapiens
SETKVFTA

SEQ ID NO: 101033 - protein, 8 aa, Homo Sapiens
SETLFQRL

SEQ ID NO: 101034 - protein, 8 aa, Homo Sapiens
SETQFSHL

SEQ ID NO: 101035 - protein, 8 aa, Homo Sapiens
SEVELMKV

SEQ ID NO: 101036 - protein, 8 aa, Homo Sapiens
SEWKPGSL

SEQ ID NO: 101037 - protein, 8 aa, Homo Sapiens
SEWTGASL

SEQ ID NO: 101038 - protein, 8 aa, Homo Sapiens
SEYITHEI

SEQ ID NO: 101039 - protein, 8 aa, Homo Sapiens
TDAVGIVL

SEQ ID NO: 101040 - protein, 8 aa, Homo Sapiens
TDFIAHLL

SEQ ID NO: 101041 - protein, 8 aa, Homo Sapiens
TDFISHLF

SEQ ID NO: 101042 - protein, 8 aa, Homo Sapiens
TDFKIPIL

SEQ ID NO: 101043 - protein, 8 aa, Homo Sapiens
TEELAYLK

SEQ ID NO: 101044 - protein, 8 aa, Homo Sapiens
TEFPGVVV

SEQ ID NO: 101045 - protein, 8 aa, Homo Sapiens
TEIFIHSL

SEQ ID NO: 101046 - protein, 8 aa, Homo Sapiens
TEIKKTEV

SEQ ID NO: 101047 - protein, 8 aa, Homo Sapiens
TEILLRKL

SEQ ID NO: 101048 - protein, 8 aa, Homo Sapiens
TEIRMARM

SEQ ID NO: 101049 - protein, 8 aa, Homo Sapiens
TESPVRTL

SEQ ID NO: 101050 - protein, 8 aa, Homo Sapiens
TETIAPKI

SEQ ID NO: 101051 - protein, 8 aa, Homo Sapiens
TETVVCAL

SEQ ID NO: 101052 - protein, 8 aa, Homo Sapiens
TEVFLHVV

SEQ ID NO: 101053 - protein, 8 aa, Homo Sapiens
TEVKSVEM

SEQ ID NO: 101054 - protein, 8 aa, Homo Sapiens
TEYPVEKL

SEQ ID NO: 101055 - protein, 8 aa, Homo Sapiens
TEYPVKIV

SEQ ID NO: 101056 - protein, 8 aa, Homo Sapiens
VDAKAQKL

SEQ ID NO: 101057 - protein, 8 aa, Homo Sapiens
VDIKGPKV

SEQ ID NO: 101058 - protein, 8 aa, Homo Sapiens
VDVEQHTL

SEQ ID NO: 101059 - protein, 8 aa, Homo Sapiens
VDVSGPKL

SEQ ID NO: 101060 - protein, 8 aa, Homo Sapiens
VDWLTEKM

SEQ ID NO: 101061 - protein, 8 aa, Homo Sapiens
VEAEVHRL

SEQ ID NO: 101062 - protein, 8 aa, Homo Sapiens
VEAPMPKL

SEQ ID NO: 101063 - protein, 8 aa, Homo Sapiens
VECQSHRL

SEQ ID NO: 101064 - protein, 8 aa, Homo Sapiens
VEFPVRNL

SEQ ID NO: 101065 - protein, 8 aa, Homo Sapiens
VEIAKQSV

SEQ ID NO: 101066 - protein, 8 aa, Homo Sapiens
VEIILHVV

SEQ ID NO: 101067 - protein, 8 aa, Homo Sapiens
VEKKVPLL

SEQ ID NO: 101068 - protein, 8 aa, Homo Sapiens
VEQPAQEL

SEQ ID NO: 101069 - protein, 8 aa, Homo Sapiens
VERVIQQL

SEQ ID NO: 101070 - protein, 8 aa, Homo Sapiens
VETAITCL

SEQ ID NO: 101071 - protein, 8 aa, Homo Sapiens
VETAITKV

SEQ ID NO: 101072 - protein, 8 aa, Homo Sapiens
VETPVQKL

SEQ ID NO: 101073 - protein, 8 aa, Homo Sapiens
YDPTAPTL

SEQ ID NO: 101074 - protein, 8 aa, Homo Sapiens
YDVRTILL

SEQ ID NO: 101075 - protein, 8 aa, Homo Sapiens
YEAVREVL

SEQ ID NO: 101076 - protein, 8 aa, Homo Sapiens
YEDIAQKS

SEQ ID NO: 101077 - protein, 8 aa, Homo Sapiens
YEEIVKEV

SEQ ID NO: 101078 - protein, 8 aa, Homo Sapiens
YEEQHPEL

SEQ ID NO: 101079 - protein, 8 aa, Homo Sapiens
YEEVARKL

SEQ ID NO: 101080 - protein, 8 aa, Homo Sapiens
YETKPPKL

SEQ ID NO: 101081 - protein, 8 aa, Homo Sapiens
YEVHHQKL

SEQ ID NO: 101082 - protein, 8 aa, Homo Sapiens
YEVKSENL

SEQ ID NO: 101083 - protein, 9 aa, Homo Sapiens
AAPAYSRAL

SEQ ID NO: 101084 - protein, 9 aa, Homo Sapiens
AAWLQVLPV

SEQ ID NO: 101085 - protein, 9 aa, Homo Sapiens
ADFAGVERL

SEQ ID NO: 101086 - protein, 9 aa, Homo Sapiens
ADFAKVLEL

SEQ ID NO: 101087 - protein, 9 aa, Homo Sapiens
ADFAVQPAV

SEQ ID NO: 101088 - protein, 9 aa, Homo Sapiens
ADFEAHNIL

SEQ ID NO: 101089 - protein, 9 aa, Homo Sapiens
ADFEIGHFL

SEQ ID NO: 101090 - protein, 9 aa, Homo Sapiens
ADFGLARAF

SEQ ID NO: 101091 - protein, 9 aa, Homo Sapiens
ADFKAGKAL

SEQ ID NO: 101092 - protein, 9 aa, Homo Sapiens
ADFREPVAV

SEQ ID NO: 101093 - protein, 9 aa, Homo Sapiens
ADILVQPTL

SEQ ID NO: 101094 - protein, 9 aa, Homo Sapiens
ADRMVGQVL

SEQ ID NO: 101095 - protein, 9 aa, Homo Sapiens
ADVIAKVAF

SEQ ID NO: 101096 - protein, 9 aa, Homo Sapiens
ADVINPMAL

SEQ ID NO: 101097 - protein, 9 aa, Homo Sapiens
ADVVLQPRL

SEQ ID NO: 101098 - protein, 9 aa, Homo Sapiens
AEAAALEVL

SEQ ID NO: 101099 - protein, 9 aa, Homo Sapiens
AEADKPRRL

SEQ ID NO: 101100 - protein, 9 aa, Homo Sapiens
AEADKTIKV

SEQ ID NO: 101101 - protein, 9 aa, Homo Sapiens
AEAEKIRKI

SEQ ID NO: 101102 - protein, 9 aa, Homo Sapiens
AEAEKKVQL

SEQ ID NO: 101103 - protein, 9 aa, Homo Sapiens
AEAFSPPRL

SEQ ID NO: 101104 - protein, 9 aa, Homo Sapiens
AEAFVRAFL

SEQ ID NO: 101105 - protein, 9 aa, Homo Sapiens
AEAGGMHTV

SEQ ID NO: 101106 - protein, 9 aa, Homo Sapiens
AEAGPLASV

SEQ ID NO: 101107 - protein, 9 aa, Homo Sapiens
AEAHAKVRL

SEQ ID NO: 101108 - protein, 9 aa, Homo Sapiens
AEAHARIHL

SEQ ID NO: 101109 - protein, 9 aa, Homo Sapiens
AEAHRIQQI

SEQ ID NO: 101110 - protein, 9 aa, Homo Sapiens
AEAIRILAA

SEQ ID NO: 101111 - protein, 9 aa, Homo Sapiens
AEAKEKIYL

SEQ ID NO: 101112 - protein, 9 aa, Homo Sapiens
AEAKKIERL

SEQ ID NO: 101113 - protein, 9 aa, Homo Sapiens
AEALATHIL

SEQ ID NO: 101114 - protein, 9 aa, Homo Sapiens
AEALIKHKP

SEQ ID NO: 101115 - protein, 9 aa, Homo Sapiens
AEALKEVSL

SEQ ID NO: 101116 - protein, 9 aa, Homo Sapiens
AEALKKLIL

SEQ ID NO: 101117 - protein, 9 aa, Homo Sapiens
AEALPKQSV

SEQ ID NO: 101118 - protein, 9 aa, Homo Sapiens
AEALRQPVL

SEQ ID NO: 101119 - protein, 9 aa, Homo Sapiens
AEALVSKGL

SEQ ID NO: 101120 - protein, 9 aa, Homo Sapiens
AEANHFIDL

SEQ ID NO: 101121 - protein, 9 aa, Homo Sapiens
AEAPAGPAL

SEQ ID NO: 101122 - protein, 9 aa, Homo Sapiens
AEAPGLVDV

SEQ ID NO: 101123 - protein, 9 aa, Homo Sapiens
AEAPHLVQV

SEQ ID NO: 101124 - protein, 9 aa, Homo Sapiens
AEAPPPSVV

SEQ ID NO: 101125 - protein, 9 aa, Homo Sapiens
AEAPSQVRL

SEQ ID NO: 101126 - protein, 9 aa, Homo Sapiens
AEAQGSTTL

SEQ ID NO: 101127 - protein, 9 aa, Homo Sapiens
AEAQQLITI

SEQ ID NO: 101128 - protein, 9 aa, Homo Sapiens
AEARHNPSI

SEQ ID NO: 101129 - protein, 9 aa, Homo Sapiens
AEARINAQL

SEQ ID NO: 101130 - protein, 9 aa, Homo Sapiens
AEARKIWCF

SEQ ID NO: 101131 - protein, 9 aa, Homo Sapiens
AEARKSPAL

SEQ ID NO: 101132 - protein, 9 aa, Homo Sapiens
AEASMISKL

SEQ ID NO: 101133 - protein, 9 aa, Homo Sapiens
AEASVDPSL

SEQ ID NO: 101134 - protein, 9 aa, Homo Sapiens
AEASVMTQL

SEQ ID NO: 101135 - protein, 9 aa, Homo Sapiens
AEAVFASEV

SEQ ID NO: 101136 - protein, 9 aa, Homo Sapiens
AEAVLYEHL

SEQ ID NO: 101137 - protein, 9 aa, Homo Sapiens
AECGAFRTG

SEQ ID NO: 101138 - protein, 9 aa, Homo Sapiens
AECGKVFRL

SEQ ID NO: 101139 - protein, 9 aa, Homo Sapiens
AECRVLQKL

SEQ ID NO: 101140 - protein, 9 aa, Homo Sapiens
AEDENKNVL

SEQ ID NO: 101141 - protein, 9 aa, Homo Sapiens
AEDGPRVVF

SEQ ID NO: 101142 - protein, 9 aa, Homo Sapiens
AEDKDTPAL

SEQ ID NO: 101143 - protein, 9 aa, Homo Sapiens
AEDKPRAQL

SEQ ID NO: 101144 - protein, 9 aa, Homo Sapiens
AEDPLVQSL

SEQ ID NO: 101145 - protein, 9 aa, Homo Sapiens
AEDTAHPKL

SEQ ID NO: 101146 - protein, 9 aa, Homo Sapiens
AEDTPVVQL

SEQ ID NO: 101147 - protein, 9 aa, Homo Sapiens
AEDVQHQIL

SEQ ID NO: 101148 - protein, 9 aa, Homo Sapiens
AEEAPKTPL

SEQ ID NO: 101149 - protein, 9 aa, Homo Sapiens
AEEFKVPAA

SEQ ID NO: 101150 - protein, 9 aa, Homo Sapiens
AEEKLPMTL

SEQ ID NO: 101151 - protein, 9 aa, Homo Sapiens
AEEKMPLSL

SEQ ID NO: 101152 - protein, 9 aa, Homo Sapiens
AEEKPAPQM

SEQ ID NO: 101153 - protein, 9 aa, Homo Sapiens
AEEKSIPTL

SEQ ID NO: 101154 - protein, 9 aa, Homo Sapiens
AEELLRIGL

SEQ ID NO: 101155 - protein, 9 aa, Homo Sapiens
AEEPKARVL

SEQ ID NO: 101156 - protein, 9 aa, Homo Sapiens
AEEPPTPAL

SEQ ID NO: 101157 - protein, 9 aa, Homo Sapiens
AEERPRIAL

SEQ ID NO: 101158 - protein, 9 aa, Homo Sapiens
AEERPRVAL

SEQ ID NO: 101159 - protein, 9 aa, Homo Sapiens
AEERRKYTL

SEQ ID NO: 101160 - protein, 9 aa, Homo Sapiens
AEFAERSVA

SEQ ID NO: 101161 - protein, 9 aa, Homo Sapiens
AEFAERTVA

SEQ ID NO: 101162 - protein, 9 aa, Homo Sapiens
AEFEDLDSL

SEQ ID NO: 101163 - protein, 9 aa, Homo Sapiens
AEFEEPRVI

SEQ ID NO: 101164 - protein, 9 aa, Homo Sapiens
AEFEKIQKL

SEQ ID NO: 101165 - protein, 9 aa, Homo Sapiens
AEFELPKTM

SEQ ID NO: 101166 - protein, 9 aa, Homo Sapiens
AEFEQGHQF

SEQ ID NO: 101167 - protein, 9 aa, Homo Sapiens
AEFEVVRTI

SEQ ID NO: 101168 - protein, 9 aa, Homo Sapiens
AEFEWENKV

SEQ ID NO: 101169 - protein, 9 aa, Homo Sapiens
AEFHQIEGV

SEQ ID NO: 101170 - protein, 9 aa, Homo Sapiens
AEFIKFTVI

SEQ ID NO: 101171 - protein, 9 aa, Homo Sapiens
AEFIVAKAI

SEQ ID NO: 101172 - protein, 9 aa, Homo Sapiens
AEFKEAFQL

SEQ ID NO: 101173 - protein, 9 aa, Homo Sapiens
AEFKEAFSL

SEQ ID NO: 101174 - protein, 9 aa, Homo Sapiens
AEFKLIPGL

SEQ ID NO: 101175 - protein, 9 aa, Homo Sapiens
AEFKRAVKV

SEQ ID NO: 101176 - protein, 9 aa, Homo Sapiens
AEFKTKYKL

SEQ ID NO: 101177 - protein, 9 aa, Homo Sapiens
AEFLDKHVT

SEQ ID NO: 101178 - protein, 9 aa, Homo Sapiens
AEFPLDPQL

SEQ ID NO: 101179 - protein, 9 aa, Homo Sapiens
AEFPLEPML

SEQ ID NO: 101180 - protein, 9 aa, Homo Sapiens
AEFQELLKV

SEQ ID NO: 101181 - protein, 9 aa, Homo Sapiens
AEFQRDIML

SEQ ID NO: 101182 - protein, 9 aa, Homo Sapiens
AEFSKTWEF

SEQ ID NO: 101183 - protein, 9 aa, Homo Sapiens
AEFVGVSHL

SEQ ID NO: 101184 - protein, 9 aa, Homo Sapiens
AEFVSTPEL

SEQ ID NO: 101185 - protein, 9 aa, Homo Sapiens
AEGAGLHAL

SEQ ID NO: 101186 - protein, 9 aa, Homo Sapiens
AEGDLIEHF

SEQ ID NO: 101187 - protein, 9 aa, Homo Sapiens
AEGDLVRLL

SEQ ID NO: 101188 - protein, 9 aa, Homo Sapiens
AEGEPRYAL

SEQ ID NO: 101189 - protein, 9 aa, Homo Sapiens
AEGHPAPQI

SEQ ID NO: 101190 - protein, 9 aa, Homo Sapiens
AEGHTKAVL

SEQ ID NO: 101191 - protein, 9 aa, Homo Sapiens
AEGLLQEAL

SEQ ID NO: 101192 - protein, 9 aa, Homo Sapiens
AEGPEVICA

SEQ ID NO: 101193 - protein, 9 aa, Homo Sapiens
AEGPPRLAI

SEQ ID NO: 101194 - protein, 9 aa, Homo Sapiens
AEGPVAVVV

SEQ ID NO: 101195 - protein, 9 aa, Homo Sapiens
AEGPVVEKI

SEQ ID NO: 101196 - protein, 9 aa, Homo Sapiens
AEGPYKIIL

SEQ ID NO: 101197 - protein, 9 aa, Homo Sapiens
AEGREAPAL

SEQ ID NO: 101198 - protein, 9 aa, Homo Sapiens
AEGRIIDVI

SEQ ID NO: 101199 - protein, 9 aa, Homo Sapiens
AEGTVVSNL

SEQ ID NO: 101200 - protein, 9 aa, Homo Sapiens
AEHADTVQL

SEQ ID NO: 101201 - protein, 9 aa, Homo Sapiens
AEHERELAL

SEQ ID NO: 101202 - protein, 9 aa, Homo Sapiens
AEHFLEQQM

SEQ ID NO: 101203 - protein, 9 aa, Homo Sapiens
AEHGETLAM

SEQ ID NO: 101204 - protein, 9 aa, Homo Sapiens
AEHIESRTL

SEQ ID NO: 101205 - protein, 9 aa, Homo Sapiens
AEHLEKSSL

SEQ ID NO: 101206 - protein, 9 aa, Homo Sapiens
AEHLKTLSL

SEQ ID NO: 101207 - protein, 9 aa, Homo Sapiens
AEHNFVAKA

SEQ ID NO: 101208 - protein, 9 aa, Homo Sapiens
AEHRTPDVL

SEQ ID NO: 101209 - protein, 9 aa, Homo Sapiens
AEHSTVITF

SEQ ID NO: 101210 - protein, 9 aa, Homo Sapiens
AEHVVQPKA

SEQ ID NO: 101211 - protein, 9 aa, Homo Sapiens
AEHYTETAL

SEQ ID NO: 101212 - protein, 9 aa, Homo Sapiens
AEIAAKDKL

SEQ ID NO: 101213 - protein, 9 aa, Homo Sapiens
AEIAHNVSS

SEQ ID NO: 101214 - protein, 9 aa, Homo Sapiens
AEIDAHLVA

SEQ ID NO: 101215 - protein, 9 aa, Homo Sapiens
AEIDDRKQL

SEQ ID NO: 101216 - protein, 9 aa, Homo Sapiens
AEIDRRISA

SEQ ID NO: 101217 - protein, 9 aa, Homo Sapiens
AEIDSIHQL

SEQ ID NO: 101218 - protein, 9 aa, Homo Sapiens
AEIEDIRVL

SEQ ID NO: 101219 - protein, 9 aa, Homo Sapiens
AEIEDPPIP

SEQ ID NO: 101220 - protein, 9 aa, Homo Sapiens
AEIEDVKPA

SEQ ID NO: 101221 - protein, 9 aa, Homo Sapiens
AEIEIVKDL

SEQ ID NO: 101222 - protein, 9 aa, Homo Sapiens
AEIGRNYSM

SEQ ID NO: 101223 - protein, 9 aa, Homo Sapiens
AEIIQHDQL

SEQ ID NO: 101224 - protein, 9 aa, Homo Sapiens
AEIKDGERL

SEQ ID NO: 101225 - protein, 9 aa, Homo Sapiens
AEIKTTNEV

SEQ ID NO: 101226 - protein, 9 aa, Homo Sapiens
AEILQESRM

SEQ ID NO: 101227 - protein, 9 aa, Homo Sapiens
AEINDLENL

SEQ ID NO: 101228 - protein, 9 aa, Homo Sapiens
AEINEIIRV

SEQ ID NO: 101229 - protein, 9 aa, Homo Sapiens
AEINNIIKI

SEQ ID NO: 101230 - protein, 9 aa, Homo Sapiens
AEINQKWNL

SEQ ID NO: 101231 - protein, 9 aa, Homo Sapiens
AEIPGVRSV

SEQ ID NO: 101232 - protein, 9 aa, Homo Sapiens
AEIQGVIDA

SEQ ID NO: 101233 - protein, 9 aa, Homo Sapiens
AEIRAINEA

SEQ ID NO: 101234 - protein, 9 aa, Homo Sapiens
AEIRHVLVT

SEQ ID NO: 101235 - protein, 9 aa, Homo Sapiens
AEIRRFSSV

SEQ ID NO: 101236 - protein, 9 aa, Homo Sapiens
AEISKYLTL

SEQ ID NO: 101237 - protein, 9 aa, Homo Sapiens
AEISQPPAL

SEQ ID NO: 101238 - protein, 9 aa, Homo Sapiens
AEITDKLGL

SEQ ID NO: 101239 - protein, 9 aa, Homo Sapiens
AEITKEQRL

SEQ ID NO: 101240 - protein, 9 aa, Homo Sapiens
AEIYGVTHT

SEQ ID NO: 101241 - protein, 9 aa, Homo Sapiens
AEKALFRAL

SEQ ID NO: 101242 - protein, 9 aa, Homo Sapiens
AEKAYHEQL

SEQ ID NO: 101243 - protein, 9 aa, Homo Sapiens
AEKELHEKF

SEQ ID NO: 101244 - protein, 9 aa, Homo Sapiens
AEKELVTII

SEQ ID NO: 101245 - protein, 9 aa, Homo Sapiens
AEKEPINKM

SEQ ID NO: 101246 - protein, 9 aa, Homo Sapiens
AEKGPMIVL

SEQ ID NO: 101247 - protein, 9 aa, Homo Sapiens
AEKGVARVV

SEQ ID NO: 101248 - protein, 9 aa, Homo Sapiens
AEKHYSNTL

SEQ ID NO: 101249 - protein, 9 aa, Homo Sapiens
AEKIPGEST

SEQ ID NO: 101250 - protein, 9 aa, Homo Sapiens
AEKIQTIIL

SEQ ID NO: 101251 - protein, 9 aa, Homo Sapiens
AEKKIEVVM

SEQ ID NO: 101252 - protein, 9 aa, Homo Sapiens
AEKKLRPHL

SEQ ID NO: 101253 - protein, 9 aa, Homo Sapiens
AEKLDEIYV

SEQ ID NO: 101254 - protein, 9 aa, Homo Sapiens
AEKLEALSV

SEQ ID NO: 101255 - protein, 9 aa, Homo Sapiens
AEKLGFAGL

SEQ ID NO: 101256 - protein, 9 aa, Homo Sapiens
AEKLGGSAV

SEQ ID NO: 101257 - protein, 9 aa, Homo Sapiens
AEKLITQTF

SEQ ID NO: 101258 - protein, 9 aa, Homo Sapiens
AEKLKDFKI

SEQ ID NO: 101259 - protein, 9 aa, Homo Sapiens
AEKLQRITV

SEQ ID NO: 101260 - protein, 9 aa, Homo Sapiens
AEKNFELVI

SEQ ID NO: 101261 - protein, 9 aa, Homo Sapiens
AEKPAVPET

SEQ ID NO: 101262 - protein, 9 aa, Homo Sapiens
AEKPKTVQL

SEQ ID NO: 101263 - protein, 9 aa, Homo Sapiens
AEKPVLTAV

SEQ ID NO: 101264 - protein, 9 aa, Homo Sapiens
AEKQLELRL

SEQ ID NO: 101265 - protein, 9 aa, Homo Sapiens
AEKSEQPTL

SEQ ID NO: 101266 - protein, 9 aa, Homo Sapiens
AEKSPQLGL

SEQ ID NO: 101267 - protein, 9 aa, Homo Sapiens
AEKTPYVVV

SEQ ID NO: 101268 - protein, 9 aa, Homo Sapiens
AEKVATRGL

SEQ ID NO: 101269 - protein, 9 aa, Homo Sapiens
AEKVEIATL

SEQ ID NO: 101270 - protein, 9 aa, Homo Sapiens
AEKVHMRAM

SEQ ID NO: 101271 - protein, 9 aa, Homo Sapiens
AEKYAKESL

SEQ ID NO: 101272 - protein, 9 aa, Homo Sapiens
AEKYQTVIA

SEQ ID NO: 101273 - protein, 9 aa, Homo Sapiens
AELATRAIP

SEQ ID NO: 101274 - protein, 9 aa, Homo Sapiens
AELDIPQSV

SEQ ID NO: 101275 - protein, 9 aa, Homo Sapiens
AELDTTNSL

SEQ ID NO: 101276 - protein, 9 aa, Homo Sapiens
AELEDRRQL

SEQ ID NO: 101277 - protein, 9 aa, Homo Sapiens
AELELQKQL

SEQ ID NO: 101278 - protein, 9 aa, Homo Sapiens
AELERNVAL

SEQ ID NO: 101279 - protein, 9 aa, Homo Sapiens
AELERQAVL

SEQ ID NO: 101280 - protein, 9 aa, Homo Sapiens
AELFAVVKT

SEQ ID NO: 101281 - protein, 9 aa, Homo Sapiens
AELGSSTSL

SEQ ID NO: 101282 - protein, 9 aa, Homo Sapiens
AELHQEHDL

SEQ ID NO: 101283 - protein, 9 aa, Homo Sapiens
AELILHDAL

SEQ ID NO: 101284 - protein, 9 aa, Homo Sapiens
AELIMSRCI

SEQ ID NO: 101285 - protein, 9 aa, Homo Sapiens
AELKEKIVL

SEQ ID NO: 101286 - protein, 9 aa, Homo Sapiens
AELKQAQTL

SEQ ID NO: 101287 - protein, 9 aa, Homo Sapiens
AELKQVQTL

SEQ ID NO: 101288 - protein, 9 aa, Homo Sapiens
AELLKKEKI

SEQ ID NO: 101289 - protein, 9 aa, Homo Sapiens
AELLLIPKV

SEQ ID NO: 101290 - protein, 9 aa, Homo Sapiens
AELLQKIEV

SEQ ID NO: 101291 - protein, 9 aa, Homo Sapiens
AELNKIFAL

SEQ ID NO: 101292 - protein, 9 aa, Homo Sapiens
AELPAKILV

SEQ ID NO: 101293 - protein, 9 aa, Homo Sapiens
AELPDQKQL

SEQ ID NO: 101294 - protein, 9 aa, Homo Sapiens
AELPGSSAV

SEQ ID NO: 101295 - protein, 9 aa, Homo Sapiens
AELPLDYKF

SEQ ID NO: 101296 - protein, 9 aa, Homo Sapiens
AELQEVVKV

SEQ ID NO: 101297 - protein, 9 aa, Homo Sapiens
AELQRVQKV

SEQ ID NO: 101298 - protein, 9 aa, Homo Sapiens
AELRLCNKL

SEQ ID NO: 101299 - protein, 9 aa, Homo Sapiens
AELRSTASL

SEQ ID NO: 101300 - protein, 9 aa, Homo Sapiens
AELTGDHQL

SEQ ID NO: 101301 - protein, 9 aa, Homo Sapiens
AELTKVFEI

SEQ ID NO: 101302 - protein, 9 aa, Homo Sapiens
AEMEKATEV

SEQ ID NO: 101303 - protein, 9 aa, Homo Sapiens
AEMGAYVSL

SEQ ID NO: 101304 - protein, 9 aa, Homo Sapiens
AEMLKENKV

SEQ ID NO: 101305 - protein, 9 aa, Homo Sapiens
AEMLKVNKT

SEQ ID NO: 101306 - protein, 9 aa, Homo Sapiens
AEMPDSAAA

SEQ ID NO: 101307 - protein, 9 aa, Homo Sapiens
AEMPEKGAL

SEQ ID NO: 101308 - protein, 9 aa, Homo Sapiens
AEMREKLRL

SEQ ID NO: 101309 - protein, 9 aa, Homo Sapiens
AENAGSYSL

SEQ ID NO: 101310 - protein, 9 aa, Homo Sapiens
AENEYQTAI

SEQ ID NO: 101311 - protein, 9 aa, Homo Sapiens
AENFAEHVL

SEQ ID NO: 101312 - protein, 9 aa, Homo Sapiens
AENGKAPHL

SEQ ID NO: 101313 - protein, 9 aa, Homo Sapiens
AENGKSNFL

SEQ ID NO: 101314 - protein, 9 aa, Homo Sapiens
AENGLTVRL

SEQ ID NO: 101315 - protein, 9 aa, Homo Sapiens
AENKDEIAL

SEQ ID NO: 101316 - protein, 9 aa, Homo Sapiens
AENKSAVEM

SEQ ID NO: 101317 - protein, 9 aa, Homo Sapiens
AENNIQPIF

SEQ ID NO: 101318 - protein, 9 aa, Homo Sapiens
AENPDTPAL

SEQ ID NO: 101319 - protein, 9 aa, Homo Sapiens
AENPFLTHL

SEQ ID NO: 101320 - protein, 9 aa, Homo Sapiens
AENPGKYNI

SEQ ID NO: 101321 - protein, 9 aa, Homo Sapiens
AENQRITAV

SEQ ID NO: 101322 - protein, 9 aa, Homo Sapiens
AENRRLHEL

SEQ ID NO: 101323 - protein, 9 aa, Homo Sapiens
AENVAVPEA

SEQ ID NO: 101324 - protein, 9 aa, Homo Sapiens
AEPAPVQSL

SEQ ID NO: 101325 - protein, 9 aa, Homo Sapiens
AEPDIIEQL

SEQ ID NO: 101326 - protein, 9 aa, Homo Sapiens
AEPEALQSL

SEQ ID NO: 101327 - protein, 9 aa, Homo Sapiens
AEPEKAPAL

SEQ ID NO: 101328 - protein, 9 aa, Homo Sapiens
AEPGPRPAL

SEQ ID NO: 101329 - protein, 9 aa, Homo Sapiens
AEPILPYAL

SEQ ID NO: 101330 - protein, 9 aa, Homo Sapiens
AEPKLAFVI

SEQ ID NO: 101331 - protein, 9 aa, Homo Sapiens
AEPKSIPAL

SEQ ID NO: 101332 - protein, 9 aa, Homo Sapiens
AEPPPIKSA

SEQ ID NO: 101333 - protein, 9 aa, Homo Sapiens
AEPTVTNIL

SEQ ID NO: 101334 - protein, 9 aa, Homo Sapiens
AEQASILSL

SEQ ID NO: 101335 - protein, 9 aa, Homo Sapiens
AEQDLIREL

SEQ ID NO: 101336 - protein, 9 aa, Homo Sapiens
AEQDLVQTL

SEQ ID NO: 101337 - protein, 9 aa, Homo Sapiens
AEQEKTLAL

SEQ ID NO: 101338 - protein, 9 aa, Homo Sapiens
AEQFKKTSL

SEQ ID NO: 101339 - protein, 9 aa, Homo Sapiens
AEQHKRVLL

SEQ ID NO: 101340 - protein, 9 aa, Homo Sapiens
AEQHVTQLM

SEQ ID NO: 101341 - protein, 9 aa, Homo Sapiens
AEQIGCVEL

SEQ ID NO: 101342 - protein, 9 aa, Homo Sapiens
AEQKLQQTL

SEQ ID NO: 101343 - protein, 9 aa, Homo Sapiens
AEQKVEYTL

SEQ ID NO: 101344 - protein, 9 aa, Homo Sapiens
AEQKVIAKL

SEQ ID NO: 101345 - protein, 9 aa, Homo Sapiens
AEQMRKIAL

SEQ ID NO: 101346 - protein, 9 aa, Homo Sapiens
AEQPTPQAL

SEQ ID NO: 101347 - protein, 9 aa, Homo Sapiens
AEQRVPLSV

SEQ ID NO: 101348 - protein, 9 aa, Homo Sapiens
AEQVYISSL

SEQ ID NO: 101349 - protein, 9 aa, Homo Sapiens
AEREEKRVL

SEQ ID NO: 101350 - protein, 9 aa, Homo Sapiens
AERENFHRL

SEQ ID NO: 101351 - protein, 9 aa, Homo Sapiens
AEREQALRL

SEQ ID NO: 101352 - protein, 9 aa, Homo Sapiens
AERFHFEAL

SEQ ID NO: 101353 - protein, 9 aa, Homo Sapiens
AERIGVDHV

SEQ ID NO: 101354 - protein, 9 aa, Homo Sapiens
AERLGLRSL

SEQ ID NO: 101355 - protein, 9 aa, Homo Sapiens
AERLGVTRL

SEQ ID NO: 101356 - protein, 9 aa, Homo Sapiens
AERPERQQL

SEQ ID NO: 101357 - protein, 9 aa, Homo Sapiens
AERPGEAAV

SEQ ID NO: 101358 - protein, 9 aa, Homo Sapiens
AERPQEWAM

SEQ ID NO: 101359 - protein, 9 aa, Homo Sapiens
AERPTVARI

SEQ ID NO: 101360 - protein, 9 aa, Homo Sapiens
AERQRQIQL

SEQ ID NO: 101361 - protein, 9 aa, Homo Sapiens
AERSIHDAL

SEQ ID NO: 101362 - protein, 9 aa, Homo Sapiens
AERVDDPEL

SEQ ID NO: 101363 - protein, 9 aa, Homo Sapiens
AERVGLHKV

SEQ ID NO: 101364 - protein, 9 aa, Homo Sapiens
AERVKQENL

SEQ ID NO: 101365 - protein, 9 aa, Homo Sapiens
AERVPAILM

SEQ ID NO: 101366 - protein, 9 aa, Homo Sapiens
AERYGINTT

SEQ ID NO: 101367 - protein, 9 aa, Homo Sapiens
AERYKLERL

SEQ ID NO: 101368 - protein, 9 aa, Homo Sapiens
AESAPAWRL

SEQ ID NO: 101369 - protein, 9 aa, Homo Sapiens
AESDKPVVI

SEQ ID NO: 101370 - protein, 9 aa, Homo Sapiens
AESGAKEEL

SEQ ID NO: 101371 - protein, 9 aa, Homo Sapiens
AESGRGQVM

SEQ ID NO: 101372 - protein, 9 aa, Homo Sapiens
AESHIILVL

SEQ ID NO: 101373 - protein, 9 aa, Homo Sapiens
AESISLLEL

SEQ ID NO: 101374 - protein, 9 aa, Homo Sapiens
AESLIAKKI

SEQ ID NO: 101375 - protein, 9 aa, Homo Sapiens
AESLPPPTL

SEQ ID NO: 101376 - protein, 9 aa, Homo Sapiens
AESPAGHSF

SEQ ID NO: 101377 - protein, 9 aa, Homo Sapiens
AESPSRDVV

SEQ ID NO: 101378 - protein, 9 aa, Homo Sapiens
AESPTPQAL

SEQ ID NO: 101379 - protein, 9 aa, Homo Sapiens
AESTSSRML

SEQ ID NO: 101380 - protein, 9 aa, Homo Sapiens
AESVVPARM

SEQ ID NO: 101381 - protein, 9 aa, Homo Sapiens
AETARLTSF

SEQ ID NO: 101382 - protein, 9 aa, Homo Sapiens
AETDHLFDL

SEQ ID NO: 101383 - protein, 9 aa, Homo Sapiens
AETDRLREI

SEQ ID NO: 101384 - protein, 9 aa, Homo Sapiens
AETEALSKL

SEQ ID NO: 101385 - protein, 9 aa, Homo Sapiens
AETEPIVKM

SEQ ID NO: 101386 - protein, 9 aa, Homo Sapiens
AETEQHIKV

SEQ ID NO: 101387 - protein, 9 aa, Homo Sapiens
AETFHTPSL

SEQ ID NO: 101388 - protein, 9 aa, Homo Sapiens
AETGCKIMV

SEQ ID NO: 101389 - protein, 9 aa, Homo Sapiens
AETGKVVII

SEQ ID NO: 101390 - protein, 9 aa, Homo Sapiens
AETGQVQKI

SEQ ID NO: 101391 - protein, 9 aa, Homo Sapiens
AETGSGKTL

SEQ ID NO: 101392 - protein, 9 aa, Homo Sapiens
AETGVGKTV

SEQ ID NO: 101393 - protein, 9 aa, Homo Sapiens
AETHIVLLF

SEQ ID NO: 101394 - protein, 9 aa, Homo Sapiens
AETHYQLGL

SEQ ID NO: 101395 - protein, 9 aa, Homo Sapiens
AETIIKDCL

SEQ ID NO: 101396 - protein, 9 aa, Homo Sapiens
AETLKKEKL

SEQ ID NO: 101397 - protein, 9 aa, Homo Sapiens
AETPARPGL

SEQ ID NO: 101398 - protein, 9 aa, Homo Sapiens
AETPDIKLF

SEQ ID NO: 101399 - protein, 9 aa, Homo Sapiens
AETPEGHAV

SEQ ID NO: 101400 - protein, 9 aa, Homo Sapiens
AETQQPPAA

SEQ ID NO: 101401 - protein, 9 aa, Homo Sapiens
AETRESTQL

SEQ ID NO: 101402 - protein, 9 aa, Homo Sapiens
AETVNLRSL

SEQ ID NO: 101403 - protein, 9 aa, Homo Sapiens
AETVRPEEV

SEQ ID NO: 101404 - protein, 9 aa, Homo Sapiens
AEVADEKML

SEQ ID NO: 101405 - protein, 9 aa, Homo Sapiens
AEVAGQFVI

SEQ ID NO: 101406 - protein, 9 aa, Homo Sapiens
AEVAKLLDL

SEQ ID NO: 101407 - protein, 9 aa, Homo Sapiens
AEVAPVKDM

SEQ ID NO: 101408 - protein, 9 aa, Homo Sapiens
AEVDKLELM

SEQ ID NO: 101409 - protein, 9 aa, Homo Sapiens
AEVDKVARL

SEQ ID NO: 101410 - protein, 9 aa, Homo Sapiens
AEVDYLEQF

SEQ ID NO: 101411 - protein, 9 aa, Homo Sapiens
AEVEGRLPA

SEQ ID NO: 101412 - protein, 9 aa, Homo Sapiens
AEVEHVVNA

SEQ ID NO: 101413 - protein, 9 aa, Homo Sapiens
AEVEKIIAV

SEQ ID NO: 101414 - protein, 9 aa, Homo Sapiens
AEVEPGVHL

SEQ ID NO: 101415 - protein, 9 aa, Homo Sapiens
AEVFPLKVF

SEQ ID NO: 101416 - protein, 9 aa, Homo Sapiens
AEVGRVLQV

SEQ ID NO: 101417 - protein, 9 aa, Homo Sapiens
AEVGVPVSV

SEQ ID NO: 101418 - protein, 9 aa, Homo Sapiens
AEVHRLVVV

SEQ ID NO: 101419 - protein, 9 aa, Homo Sapiens
AEVHSEEAL

SEQ ID NO: 101420 - protein, 9 aa, Homo Sapiens
AEVKERVTL

SEQ ID NO: 101421 - protein, 9 aa, Homo Sapiens
AEVKGVYQF

SEQ ID NO: 101422 - protein, 9 aa, Homo Sapiens
AEVKPILQA

SEQ ID NO: 101423 - protein, 9 aa, Homo Sapiens
AEVKSRTTL

SEQ ID NO: 101424 - protein, 9 aa, Homo Sapiens
AEVLNKHSL

SEQ ID NO: 101425 - protein, 9 aa, Homo Sapiens
AEVLRTMEL

SEQ ID NO: 101426 - protein, 9 aa, Homo Sapiens
AEVPDVTAT

SEQ ID NO: 101427 - protein, 9 aa, Homo Sapiens
AEVPGAGAV

SEQ ID NO: 101428 - protein, 9 aa, Homo Sapiens
AEVPHSTGV

SEQ ID NO: 101429 - protein, 9 aa, Homo Sapiens
AEVPVPSSL

SEQ ID NO: 101430 - protein, 9 aa, Homo Sapiens
AEVRKIIRV

SEQ ID NO: 101431 - protein, 9 aa, Homo Sapiens
AEVRVCTVL

SEQ ID NO: 101432 - protein, 9 aa, Homo Sapiens
AEVSPMYGV

SEQ ID NO: 101433 - protein, 9 aa, Homo Sapiens
AEVTPLLNL

SEQ ID NO: 101434 - protein, 9 aa, Homo Sapiens
AEVTTKSQI

SEQ ID NO: 101435 - protein, 9 aa, Homo Sapiens
AEVVKAPQV

SEQ ID NO: 101436 - protein, 9 aa, Homo Sapiens
AEVYKELRL

SEQ ID NO: 101437 - protein, 9 aa, Homo Sapiens
AEVYRILSV

SEQ ID NO: 101438 - protein, 9 aa, Homo Sapiens
AEWLGVLKA

SEQ ID NO: 101439 - protein, 9 aa, Homo Sapiens
AEWRHAHGM

SEQ ID NO: 101440 - protein, 9 aa, Homo Sapiens
AEYAGLKVA

SEQ ID NO: 101441 - protein, 9 aa, Homo Sapiens
AEYFCKPTV

SEQ ID NO: 101442 - protein, 9 aa, Homo Sapiens
AEYGEIKNI

SEQ ID NO: 101443 - protein, 9 aa, Homo Sapiens
AEYIRTEML

SEQ ID NO: 101444 - protein, 9 aa, Homo Sapiens
AEYKGRVTL

SEQ ID NO: 101445 - protein, 9 aa, Homo Sapiens
AEYPEGFEI

SEQ ID NO: 101446 - protein, 9 aa, Homo Sapiens
AEYRHLRKL

SEQ ID NO: 101447 - protein, 9 aa, Homo Sapiens
AEYRLGPLL

SEQ ID NO: 101448 - protein, 9 aa, Homo Sapiens
AEYTAKIAL

SEQ ID NO: 101449 - protein, 9 aa, Homo Sapiens
AKVKFEERY

SEQ ID NO: 101450 - protein, 9 aa, Homo Sapiens
AQAFIHNSL

SEQ ID NO: 101451 - protein, 9 aa, Homo Sapiens
AQFEHTILL

SEQ ID NO: 101452 - protein, 9 aa, Homo Sapiens
AQFKGTQSL

SEQ ID NO: 101453 - protein, 9 aa, Homo Sapiens
AQLKQRNTL

SEQ ID NO: 101454 - protein, 9 aa, Homo Sapiens
AQVGKLPCL

SEQ ID NO: 101455 - protein, 9 aa, Homo Sapiens
ASDKETYEL

SEQ ID NO: 101456 - protein, 9 aa, Homo Sapiens
ATASFPEAL

SEQ ID NO: 101457 - protein, 9 aa, Homo Sapiens
DAAPVAPSV

SEQ ID NO: 101458 - protein, 9 aa, Homo Sapiens
DATASIVMD

SEQ ID NO: 101459 - protein, 9 aa, Homo Sapiens
DECPHLIAL

SEQ ID NO: 101460 - protein, 9 aa, Homo Sapiens
DEHAGVISV

SEQ ID NO: 101461 - protein, 9 aa, Homo Sapiens
DEYEKLQVL

SEQ ID NO: 101462 - protein, 9 aa, Homo Sapiens
DEYQFVERL

SEQ ID NO: 101463 - protein, 9 aa, Homo Sapiens
DNLAIEGGI

SEQ ID NO: 101464 - protein, 9 aa, Homo Sapiens
DQLLRTLDI

SEQ ID NO: 101465 - protein, 9 aa, Homo Sapiens
DSDFPIHNL

SEQ ID NO: 101466 - protein, 9 aa, Homo Sapiens
DSDILVRKV

SEQ ID NO: 101467 - protein, 9 aa, Homo Sapiens
DTIVNVQQI

SEQ ID NO: 101468 - protein, 9 aa, Homo Sapiens
EDVKMITSL

SEQ ID NO: 101469 - protein, 9 aa, Homo Sapiens
EEAASAPAV

SEQ ID NO: 101470 - protein, 9 aa, Homo Sapiens
EEAPSRPAL

SEQ ID NO: 101471 - protein, 9 aa, Homo Sapiens
EEAPVQPIL

SEQ ID NO: 101472 - protein, 9 aa, Homo Sapiens
EEFKKIRSA

SEQ ID NO: 101473 - protein, 9 aa, Homo Sapiens
EEFLSKVSI

SEQ ID NO: 101474 - protein, 9 aa, Homo Sapiens
EEFNQPLSV

SEQ ID NO: 101475 - protein, 9 aa, Homo Sapiens
EEFPNTCKM

SEQ ID NO: 101476 - protein, 9 aa, Homo Sapiens
EEFQFIKKA

SEQ ID NO: 101477 - protein, 9 aa, Homo Sapiens
EEGPPVTTV

SEQ ID NO: 101478 - protein, 9 aa, Homo Sapiens
EEHNSMNEL

SEQ ID NO: 101479 - protein, 9 aa, Homo Sapiens
EEIAKVEKL

SEQ ID NO: 101480 - protein, 9 aa, Homo Sapiens
EEIIKAWSV

SEQ ID NO: 101481 - protein, 9 aa, Homo Sapiens
EEIKEMHGL

SEQ ID NO: 101482 - protein, 9 aa, Homo Sapiens
EEISGIVEV

SEQ ID NO: 101483 - protein, 9 aa, Homo Sapiens
EEKEIEHAL

SEQ ID NO: 101484 - protein, 9 aa, Homo Sapiens
EELIESPKL

SEQ ID NO: 101485 - protein, 9 aa, Homo Sapiens
EELPHIHAF

SEQ ID NO: 101486 - protein, 9 aa, Homo Sapiens
EELQGVRSL

SEQ ID NO: 101487 - protein, 9 aa, Homo Sapiens
EELQKRFIL

SEQ ID NO: 101488 - protein, 9 aa, Homo Sapiens
EELTGFREL

SEQ ID NO: 101489 - protein, 9 aa, Homo Sapiens
EELVVQPLL

SEQ ID NO: 101490 - protein, 9 aa, Homo Sapiens
EEREIKERI

SEQ ID NO: 101491 - protein, 9 aa, Homo Sapiens
EEREPTPVL

SEQ ID NO: 101492 - protein, 9 aa, Homo Sapiens
EERRVKEVV

SEQ ID NO: 101493 - protein, 9 aa, Homo Sapiens
EETQPPVAL

SEQ ID NO: 101494 - protein, 9 aa, Homo Sapiens
EEVQFLKTL

SEQ ID NO: 101495 - protein, 9 aa, Homo Sapiens
EEWNDPPAV

SEQ ID NO: 101496 - protein, 9 aa, Homo Sapiens
EEWPNPPTL

SEQ ID NO: 101497 - protein, 9 aa, Homo Sapiens
EEYGKILEV

SEQ ID NO: 101498 - protein, 9 aa, Homo Sapiens
EEYPNKPPT

SEQ ID NO: 101499 - protein, 9 aa, Homo Sapiens
EEYPSVSTL

SEQ ID NO: 101500 - protein, 9 aa, Homo Sapiens
EEYQNPHTV

SEQ ID NO: 101501 - protein, 9 aa, Homo Sapiens
EKLGETEKL

SEQ ID NO: 101502 - protein, 9 aa, Homo Sapiens
ELENRAPGL

SEQ ID NO: 101503 - protein, 9 aa, Homo Sapiens
ELIEGEREL

SEQ ID NO: 101504 - protein, 9 aa, Homo Sapiens
ELNEKLTPL

SEQ ID NO: 101505 - protein, 9 aa, Homo Sapiens
ETKLLASEI

SEQ ID NO: 101506 - protein, 9 aa, Homo Sapiens
FEAPDQKTL

SEQ ID NO: 101507 - protein, 9 aa, Homo Sapiens
FEAPNQEKV

SEQ ID NO: 101508 - protein, 9 aa, Homo Sapiens
FEAQGKPEL

SEQ ID NO: 101509 - protein, 9 aa, Homo Sapiens
FEDGQKIVV

SEQ ID NO: 101510 - protein, 9 aa, Homo Sapiens
FEDVGRQVL

SEQ ID NO: 101511 - protein, 9 aa, Homo Sapiens
FEEAQLPRL

SEQ ID NO: 101512 - protein, 9 aa, Homo Sapiens
FEEGKKISL

SEQ ID NO: 101513 - protein, 9 aa, Homo Sapiens
FEFEYQTKV

SEQ ID NO: 101514 - protein, 9 aa, Homo Sapiens
FEGAVIRTV

SEQ ID NO: 101515 - protein, 9 aa, Homo Sapiens
FEGILIKKL

SEQ ID NO: 101516 - protein, 9 aa, Homo Sapiens
FEGVSPKSL

SEQ ID NO: 101517 - protein, 9 aa, Homo Sapiens
FEHHGQVRL

SEQ ID NO: 101518 - protein, 9 aa, Homo Sapiens
FEHPNVVRL

SEQ ID NO: 101519 - protein, 9 aa, Homo Sapiens
FEHQRAPRV

SEQ ID NO: 101520 - protein, 9 aa, Homo Sapiens
FEIPIKVRL

SEQ ID NO: 101521 - protein, 9 aa, Homo Sapiens
FEITPPVVL

SEQ ID NO: 101522 - protein, 9 aa, Homo Sapiens
FEITQPPLL

SEQ ID NO: 101523 - protein, 9 aa, Homo Sapiens
FEKEWIECA

SEQ ID NO: 101524 - protein, 9 aa, Homo Sapiens
FEKIHQETF

SEQ ID NO: 101525 - protein, 9 aa, Homo Sapiens
FEKKYVATL

SEQ ID NO: 101526 - protein, 9 aa, Homo Sapiens
FELDLPTVH

SEQ ID NO: 101527 - protein, 9 aa, Homo Sapiens
FELEKSESL

SEQ ID NO: 101528 - protein, 9 aa, Homo Sapiens
FEMATRAAL

SEQ ID NO: 101529 - protein, 9 aa, Homo Sapiens
FENPKQGKL

SEQ ID NO: 101530 - protein, 9 aa, Homo Sapiens
FEQGGARVV

SEQ ID NO: 101531 - protein, 9 aa, Homo Sapiens
FEQQMVEKL

SEQ ID NO: 101532 - protein, 9 aa, Homo Sapiens
FEQVSGVTV

SEQ ID NO: 101533 - protein, 9 aa, Homo Sapiens
FERNKAIKV

SEQ ID NO: 101534 - protein, 9 aa, Homo Sapiens
FERPQYAEI

SEQ ID NO: 101535 - protein, 9 aa, Homo Sapiens
FESDLHSLL

SEQ ID NO: 101536 - protein, 9 aa, Homo Sapiens
FESGDVKAT

SEQ ID NO: 101537 - protein, 9 aa, Homo Sapiens
FESGISQAL

SEQ ID NO: 101538 - protein, 9 aa, Homo Sapiens
FESSGIHVA

SEQ ID NO: 101539 - protein, 9 aa, Homo Sapiens
FESSPDPEL

SEQ ID NO: 101540 - protein, 9 aa, Homo Sapiens
FETEPVSKL

SEQ ID NO: 101541 - protein, 9 aa, Homo Sapiens
FETIVKQQI

SEQ ID NO: 101542 - protein, 9 aa, Homo Sapiens
FEVEKQALL

SEQ ID NO: 101543 - protein, 9 aa, Homo Sapiens
FEVGKKICL

SEQ ID NO: 101544 - protein, 9 aa, Homo Sapiens
FEVGSSRQL

SEQ ID NO: 101545 - protein, 9 aa, Homo Sapiens
FEVKKWNAV

SEQ ID NO: 101546 - protein, 9 aa, Homo Sapiens
FEVTGQETV

SEQ ID NO: 101547 - protein, 9 aa, Homo Sapiens
FEWAKNSPL

SEQ ID NO: 101548 - protein, 9 aa, Homo Sapiens
FEWENKVTV

SEQ ID NO: 101549 - protein, 9 aa, Homo Sapiens
GDFKEISSV

SEQ ID NO: 101550 - protein, 9 aa, Homo Sapiens
GDYVPPEKL

SEQ ID NO: 101551 - protein, 9 aa, Homo Sapiens
GEAAKREIL

SEQ ID NO: 101552 - protein, 9 aa, Homo Sapiens
GEADPSIQL

SEQ ID NO: 101553 - protein, 9 aa, Homo Sapiens
GEAEGLMKV

SEQ ID NO: 101554 - protein, 9 aa, Homo Sapiens
GEAEYIQRL

SEQ ID NO: 101555 - protein, 9 aa, Homo Sapiens
GEAGPIHHL

SEQ ID NO: 101556 - protein, 9 aa, Homo Sapiens
GEAGPVGNM

SEQ ID NO: 101557 - protein, 9 aa, Homo Sapiens
GEAGSITHL

SEQ ID NO: 101558 - protein, 9 aa, Homo Sapiens
GEAHLKTIL

SEQ ID NO: 101559 - protein, 9 aa, Homo Sapiens
GEAKKMEFL

SEQ ID NO: 101560 - protein, 9 aa, Homo Sapiens
GEALAPRQV

SEQ ID NO: 101561 - protein, 9 aa, Homo Sapiens
GEALPFSHL

SEQ ID NO: 101562 - protein, 9 aa, Homo Sapiens
GEAPGVVRM

SEQ ID NO: 101563 - protein, 9 aa, Homo Sapiens
GEAPVPASV

SEQ ID NO: 101564 - protein, 9 aa, Homo Sapiens
GEAQKIDRM

SEQ ID NO: 101565 - protein, 9 aa, Homo Sapiens
GEARKQVEV

SEQ ID NO: 101566 - protein, 9 aa, Homo Sapiens
GEARVGSEL

SEQ ID NO: 101567 - protein, 9 aa, Homo Sapiens
GECAQTIRL

SEQ ID NO: 101568 - protein, 9 aa, Homo Sapiens
GECGKAFRV

SEQ ID NO: 101569 - protein, 9 aa, Homo Sapiens
GECGKAFTL

SEQ ID NO: 101570 - protein, 9 aa, Homo Sapiens
GECTKIHDL

SEQ ID NO: 101571 - protein, 9 aa, Homo Sapiens
GEDEPLHAL

SEQ ID NO: 101572 - protein, 9 aa, Homo Sapiens
GEDIPREML

SEQ ID NO: 101573 - protein, 9 aa, Homo Sapiens
GEDKGGYVI

SEQ ID NO: 101574 - protein, 9 aa, Homo Sapiens
GEDKGIKAL

SEQ ID NO: 101575 - protein, 9 aa, Homo Sapiens
GEDWFRPKL

SEQ ID NO: 101576 - protein, 9 aa, Homo Sapiens
GEEAVPVAL

SEQ ID NO: 101577 - protein, 9 aa, Homo Sapiens
GEEGYGRSL

SEQ ID NO: 101578 - protein, 9 aa, Homo Sapiens
GEEKLIASV

SEQ ID NO: 101579 - protein, 9 aa, Homo Sapiens
GEELQMEPV

SEQ ID NO: 101580 - protein, 9 aa, Homo Sapiens
GEELVTKPV

SEQ ID NO: 101581 - protein, 9 aa, Homo Sapiens
GEESKRPPL

SEQ ID NO: 101582 - protein, 9 aa, Homo Sapiens
GEEVPRPIL

SEQ ID NO: 101583 - protein, 9 aa, Homo Sapiens
GEEWKGYVV

SEQ ID NO: 101584 - protein, 9 aa, Homo Sapiens
GEFADPFKL

SEQ ID NO: 101585 - protein, 9 aa, Homo Sapiens
GEFDNAGAM

SEQ ID NO: 101586 - protein, 9 aa, Homo Sapiens
GEFEKKYVA

SEQ ID NO: 101587 - protein, 9 aa, Homo Sapiens
GEFGGFGSV

SEQ ID NO: 101588 - protein, 9 aa, Homo Sapiens
GEFGKPYFI

SEQ ID NO: 101589 - protein, 9 aa, Homo Sapiens
GEFIIGRVI

SEQ ID NO: 101590 - protein, 9 aa, Homo Sapiens
GEFILKTYV

SEQ ID NO: 101591 - protein, 9 aa, Homo Sapiens
GEFKKYLEV

SEQ ID NO: 101592 - protein, 9 aa, Homo Sapiens
GEFPDLHRT

SEQ ID NO: 101593 - protein, 9 aa, Homo Sapiens
GEFQELMKL

SEQ ID NO: 101594 - protein, 9 aa, Homo Sapiens
GEFRAVTEL

SEQ ID NO: 101595 - protein, 9 aa, Homo Sapiens
GEFSITYKP

SEQ ID NO: 101596 - protein, 9 aa, Homo Sapiens
GEFTSARAV

SEQ ID NO: 101597 - protein, 9 aa, Homo Sapiens
GEFVDDYTV

SEQ ID NO: 101598 - protein, 9 aa, Homo Sapiens
GEGDIVPKI

SEQ ID NO: 101599 - protein, 9 aa, Homo Sapiens
GEGDTHTAL

SEQ ID NO: 101600 - protein, 9 aa, Homo Sapiens
GEGEPVKEV

SEQ ID NO: 101601 - protein, 9 aa, Homo Sapiens
GEGGSFGEL

SEQ ID NO: 101602 - protein, 9 aa, Homo Sapiens
GEGKPTPAL

SEQ ID NO: 101603 - protein, 9 aa, Homo Sapiens
GEGLIIVKM

SEQ ID NO: 101604 - protein, 9 aa, Homo Sapiens
GEGLKRSAL

SEQ ID NO: 101605 - protein, 9 aa, Homo Sapiens
GEGPVITAL

SEQ ID NO: 101606 - protein, 9 aa, Homo Sapiens
GEGTFGRVV

SEQ ID NO: 101607 - protein, 9 aa, Homo Sapiens
GEHCDFTIL

SEQ ID NO: 101608 - protein, 9 aa, Homo Sapiens
GEHGLIIRV

SEQ ID NO: 101609 - protein, 9 aa, Homo Sapiens
GEHHSTPSL

SEQ ID NO: 101610 - protein, 9 aa, Homo Sapiens
GEHLHIREF

SEQ ID NO: 101611 - protein, 9 aa, Homo Sapiens
GEHLKTDLL

SEQ ID NO: 101612 - protein, 9 aa, Homo Sapiens
GEHTLLVTV

SEQ ID NO: 101613 - protein, 9 aa, Homo Sapiens
GEIASFDKA

SEQ ID NO: 101614 - protein, 9 aa, Homo Sapiens
GEIDKRVEV

SEQ ID NO: 101615 - protein, 9 aa, Homo Sapiens
GEIDRARAI

SEQ ID NO: 101616 - protein, 9 aa, Homo Sapiens
GEIDTRFSF

SEQ ID NO: 101617 - protein, 9 aa, Homo Sapiens
GEIERLINL

SEQ ID NO: 101618 - protein, 9 aa, Homo Sapiens
GEIETIARF

SEQ ID NO: 101619 - protein, 9 aa, Homo Sapiens
GEIETVKQL

SEQ ID NO: 101620 - protein, 9 aa, Homo Sapiens
GEIGTKTTL

SEQ ID NO: 101621 - protein, 9 aa, Homo Sapiens
GEIIGVKVL

SEQ ID NO: 101622 - protein, 9 aa, Homo Sapiens
GEIKHVSSL

SEQ ID NO: 101623 - protein, 9 aa, Homo Sapiens
GEIKVLQGF

SEQ ID NO: 101624 - protein, 9 aa, Homo Sapiens
GEIPKQVKV

SEQ ID NO: 101625 - protein, 9 aa, Homo Sapiens
GEIPTLKTL

SEQ ID NO: 101626 - protein, 9 aa, Homo Sapiens
GEIPVQEHL

SEQ ID NO: 101627 - protein, 9 aa, Homo Sapiens
GEIQAGAKL

SEQ ID NO: 101628 - protein, 9 aa, Homo Sapiens
GEIQEIVKT

SEQ ID NO: 101629 - protein, 9 aa, Homo Sapiens
GEIQNAKTL

SEQ ID NO: 101630 - protein, 9 aa, Homo Sapiens
GEIRELKQL

SEQ ID NO: 101631 - protein, 9 aa, Homo Sapiens
GEIRNLEKF

SEQ ID NO: 101632 - protein, 9 aa, Homo Sapiens
GEIRTITVV

SEQ ID NO: 101633 - protein, 9 aa, Homo Sapiens
GEISEKAKL

SEQ ID NO: 101634 - protein, 9 aa, Homo Sapiens
GEISTIDKV

SEQ ID NO: 101635 - protein, 9 aa, Homo Sapiens
GEITGEVRM

SEQ ID NO: 101636 - protein, 9 aa, Homo Sapiens
GEIVALKKV

SEQ ID NO: 101637 - protein, 9 aa, Homo Sapiens
GEIVEKIGV

SEQ ID NO: 101638 - protein, 9 aa, Homo Sapiens
GEIVQQVRV

SEQ ID NO: 101639 - protein, 9 aa, Homo Sapiens
GEKAVNPFL

SEQ ID NO: 101640 - protein, 9 aa, Homo Sapiens
GEKDLKQQL

SEQ ID NO: 101641 - protein, 9 aa, Homo Sapiens
GEKEPPTTL

SEQ ID NO: 101642 - protein, 9 aa, Homo Sapiens
GEKFEFSGL

SEQ ID NO: 101643 - protein, 9 aa, Homo Sapiens
GEKFHSEVA

SEQ ID NO: 101644 - protein, 9 aa, Homo Sapiens
GEKGAVKVL

SEQ ID NO: 101645 - protein, 9 aa, Homo Sapiens
GEKGEFHKL

SEQ ID NO: 101646 - protein, 9 aa, Homo Sapiens
GEKGIDIII

SEQ ID NO: 101647 - protein, 9 aa, Homo Sapiens
GEKGPVKVL

SEQ ID NO: 101648 - protein, 9 aa, Homo Sapiens
GEKHRELRL

SEQ ID NO: 101649 - protein, 9 aa, Homo Sapiens
GEKIGIAEF

SEQ ID NO: 101650 - protein, 9 aa, Homo Sapiens
GEKIIQEFL

SEQ ID NO: 101651 - protein, 9 aa, Homo Sapiens
GEKIRTRAI

SEQ ID NO: 101652 - protein, 9 aa, Homo Sapiens
GEKKAYVRL

SEQ ID NO: 101653 - protein, 9 aa, Homo Sapiens
GEKKDEVYL

SEQ ID NO: 101654 - protein, 9 aa, Homo Sapiens
GEKLLRPSL

SEQ ID NO: 101655 - protein, 9 aa, Homo Sapiens
GEKLQDLEL

SEQ ID NO: 101656 - protein, 9 aa, Homo Sapiens
GEKNVFEAL

SEQ ID NO: 101657 - protein, 9 aa, Homo Sapiens
GEKPFQCTF

SEQ ID NO: 101658 - protein, 9 aa, Homo Sapiens
GEKQPELQI

SEQ ID NO: 101659 - protein, 9 aa, Homo Sapiens
GEKSESISV

SEQ ID NO: 101660 - protein, 9 aa, Homo Sapiens
GEKSQAPTL

SEQ ID NO: 101661 - protein, 9 aa, Homo Sapiens
GEKTAGINV

SEQ ID NO: 101662 - protein, 9 aa, Homo Sapiens
GEKTISVVL

SEQ ID NO: 101663 - protein, 9 aa, Homo Sapiens
GEKTVAAVM

SEQ ID NO: 101664 - protein, 9 aa, Homo Sapiens
GEKVAHTSL

SEQ ID NO: 101665 - protein, 9 aa, Homo Sapiens
GEKVKQVLL

SEQ ID NO: 101666 - protein, 9 aa, Homo Sapiens
GEKVNIISV

SEQ ID NO: 101667 - protein, 9 aa, Homo Sapiens
GEKVVKTAL

SEQ ID NO: 101668 - protein, 9 aa, Homo Sapiens
GELANEVKV

SEQ ID NO: 101669 - protein, 9 aa, Homo Sapiens
GELAPSHGL

SEQ ID NO: 101670 - protein, 9 aa, Homo Sapiens
GELARAVVL

SEQ ID NO: 101671 - protein, 9 aa, Homo Sapiens
GELDHVVEI

SEQ ID NO: 101672 - protein, 9 aa, Homo Sapiens
GELEYATKI

SEQ ID NO: 101673 - protein, 9 aa, Homo Sapiens
GELFQVLKM

SEQ ID NO: 101674 - protein, 9 aa, Homo Sapiens
GELFSSPHL

SEQ ID NO: 101675 - protein, 9 aa, Homo Sapiens
GELHGHFML

SEQ ID NO: 101676 - protein, 9 aa, Homo Sapiens
GELIRPTTL

SEQ ID NO: 101677 - protein, 9 aa, Homo Sapiens
GELITQREL

SEQ ID NO: 101678 - protein, 9 aa, Homo Sapiens
GELKIAYQL

SEQ ID NO: 101679 - protein, 9 aa, Homo Sapiens
GELKRRLGL

SEQ ID NO: 101680 - protein, 9 aa, Homo Sapiens
GELKSPKVL

SEQ ID NO: 101681 - protein, 9 aa, Homo Sapiens
GELKSVPTT

SEQ ID NO: 101682 - protein, 9 aa, Homo Sapiens
GELLKQADL

SEQ ID NO: 101683 - protein, 9 aa, Homo Sapiens
GELLMHPVL

SEQ ID NO: 101684 - protein, 9 aa, Homo Sapiens
GELPEHAKI

SEQ ID NO: 101685 - protein, 9 aa, Homo Sapiens
GELPRQPTT

SEQ ID NO: 101686 - protein, 9 aa, Homo Sapiens
GELRHITKL

SEQ ID NO: 101687 - protein, 9 aa, Homo Sapiens
GELSKVTKV

SEQ ID NO: 101688 - protein, 9 aa, Homo Sapiens
GELSLPVHL

SEQ ID NO: 101689 - protein, 9 aa, Homo Sapiens
GELTDLHGL

SEQ ID NO: 101690 - protein, 9 aa, Homo Sapiens
GELVHPKAL

SEQ ID NO: 101691 - protein, 9 aa, Homo Sapiens
GELVKAIVV

SEQ ID NO: 101692 - protein, 9 aa, Homo Sapiens
GELYNEVKV

SEQ ID NO: 101693 - protein, 9 aa, Homo Sapiens
GEMQKQAQL

SEQ ID NO: 101694 - protein, 9 aa, Homo Sapiens
GEMRNAVCI

SEQ ID NO: 101695 - protein, 9 aa, Homo Sapiens
GENAHNVTL

SEQ ID NO: 101696 - protein, 9 aa, Homo Sapiens
GENDRGVSF

SEQ ID NO: 101697 - protein, 9 aa, Homo Sapiens
GENEDLLKL

SEQ ID NO: 101698 - protein, 9 aa, Homo Sapiens
GENKPRPSL

SEQ ID NO: 101699 - protein, 9 aa, Homo Sapiens
GENLKVLTV

SEQ ID NO: 101700 - protein, 9 aa, Homo Sapiens
GENPFACKV

SEQ ID NO: 101701 - protein, 9 aa, Homo Sapiens
GENPQRQGL

SEQ ID NO: 101702 - protein, 9 aa, Homo Sapiens
GENPQVPKL

SEQ ID NO: 101703 - protein, 9 aa, Homo Sapiens
GENPSGKSL

SEQ ID NO: 101704 - protein, 9 aa, Homo Sapiens
GENRPIATL

SEQ ID NO: 101705 - protein, 9 aa, Homo Sapiens
GENSRVARL

SEQ ID NO: 101706 - protein, 9 aa, Homo Sapiens
GENVFGVCH

SEQ ID NO: 101707 - protein, 9 aa, Homo Sapiens
GENVIISHF

SEQ ID NO: 101708 - protein, 9 aa, Homo Sapiens
GEPDHNEAL

SEQ ID NO: 101709 - protein, 9 aa, Homo Sapiens
GEPENTYIL

SEQ ID NO: 101710 - protein, 9 aa, Homo Sapiens
GEPEPTPVV

SEQ ID NO: 101711 - protein, 9 aa, Homo Sapiens
GEPFASHSL

SEQ ID NO: 101712 - protein, 9 aa, Homo Sapiens
GEPGAQPQL

SEQ ID NO: 101713 - protein, 9 aa, Homo Sapiens
GEPGPVRSV

SEQ ID NO: 101714 - protein, 9 aa, Homo Sapiens
GEPHSSPEL

SEQ ID NO: 101715 - protein, 9 aa, Homo Sapiens
GEPNIDSPL

SEQ ID NO: 101716 - protein, 9 aa, Homo Sapiens
GEPQVQFKL

SEQ ID NO: 101717 - protein, 9 aa, Homo Sapiens
GEPSLYNSL

SEQ ID NO: 101718 - protein, 9 aa, Homo Sapiens
GEQEDRPGL

SEQ ID NO: 101719 - protein, 9 aa, Homo Sapiens
GERIRLEKV

SEQ ID NO: 101720 - protein, 9 aa, Homo Sapiens
GERLNQDQL

SEQ ID NO: 101721 - protein, 9 aa, Homo Sapiens
GERLPRETL

SEQ ID NO: 101722 - protein, 9 aa, Homo Sapiens
GERPGGEEL

SEQ ID NO: 101723 - protein, 9 aa, Homo Sapiens
GERPPPKRL

SEQ ID NO: 101724 - protein, 9 aa, Homo Sapiens
GERVALNTL

SEQ ID NO: 101725 - protein, 9 aa, Homo Sapiens
GERVIVEHA

SEQ ID NO: 101726 - protein, 9 aa, Homo Sapiens
GESATLRSL

SEQ ID NO: 101727 - protein, 9 aa, Homo Sapiens
GESDPMKGV

SEQ ID NO: 101728 - protein, 9 aa, Homo Sapiens
GESEKLVRL

SEQ ID NO: 101729 - protein, 9 aa, Homo Sapiens
GESGIKVAV

SEQ ID NO: 101730 - protein, 9 aa, Homo Sapiens
GESGKSTIV

SEQ ID NO: 101731 - protein, 9 aa, Homo Sapiens
GESKYLMAL

SEQ ID NO: 101732 - protein, 9 aa, Homo Sapiens
GESLLIKTL

SEQ ID NO: 101733 - protein, 9 aa, Homo Sapiens
GESNKIPRL

SEQ ID NO: 101734 - protein, 9 aa, Homo Sapiens
GESQPVKMF

SEQ ID NO: 101735 - protein, 9 aa, Homo Sapiens
GESVKVHQL

SEQ ID NO: 101736 - protein, 9 aa, Homo Sapiens
GESVPVTKT

SEQ ID NO: 101737 - protein, 9 aa, Homo Sapiens
GESVTKLTL

SEQ ID NO: 101738 - protein, 9 aa, Homo Sapiens
GETAFAFHL

SEQ ID NO: 101739 - protein, 9 aa, Homo Sapiens
GETEKLYQL

SEQ ID NO: 101740 - protein, 9 aa, Homo Sapiens
GETELREYF

SEQ ID NO: 101741 - protein, 9 aa, Homo Sapiens
GETESVKTM

SEQ ID NO: 101742 - protein, 9 aa, Homo Sapiens
GETEVLKVI

SEQ ID NO: 101743 - protein, 9 aa, Homo Sapiens
GETGTLVDM

SEQ ID NO: 101744 - protein, 9 aa, Homo Sapiens
GETIHIPTM

SEQ ID NO: 101745 - protein, 9 aa, Homo Sapiens
GETKAKVLL

SEQ ID NO: 101746 - protein, 9 aa, Homo Sapiens
GETPEAAAL

SEQ ID NO: 101747 - protein, 9 aa, Homo Sapiens
GETPEQPGL

SEQ ID NO: 101748 - protein, 9 aa, Homo Sapiens
GETPKHFAV

SEQ ID NO: 101749 - protein, 9 aa, Homo Sapiens
GETPQVAVI

SEQ ID NO: 101750 - protein, 9 aa, Homo Sapiens
GETQDFHSL

SEQ ID NO: 101751 - protein, 9 aa, Homo Sapiens
GETQKTISL

SEQ ID NO: 101752 - protein, 9 aa, Homo Sapiens
GETSIAECL

SEQ ID NO: 101753 - protein, 9 aa, Homo Sapiens
GETSTDLKL

SEQ ID NO: 101754 - protein, 9 aa, Homo Sapiens
GETSTVEKL

SEQ ID NO: 101755 - protein, 9 aa, Homo Sapiens
GETYNGHLV

SEQ ID NO: 101756 - protein, 9 aa, Homo Sapiens
GEVDFKEFI

SEQ ID NO: 101757 - protein, 9 aa, Homo Sapiens
GEVDKRELI

SEQ ID NO: 101758 - protein, 9 aa, Homo Sapiens
GEVDPKVAL

SEQ ID NO: 101759 - protein, 9 aa, Homo Sapiens
GEVEGHPVW

SEQ ID NO: 101760 - protein, 9 aa, Homo Sapiens
GEVEKYQQL

SEQ ID NO: 101761 - protein, 9 aa, Homo Sapiens
GEVGATSAL

SEQ ID NO: 101762 - protein, 9 aa, Homo Sapiens
GEVGKTTGI

SEQ ID NO: 101763 - protein, 9 aa, Homo Sapiens
GEVHTGTTI

SEQ ID NO: 101764 - protein, 9 aa, Homo Sapiens
GEVIGVNTM

SEQ ID NO: 101765 - protein, 9 aa, Homo Sapiens
GEVIHVKIL

SEQ ID NO: 101766 - protein, 9 aa, Homo Sapiens
GEVKDFPDL

SEQ ID NO: 101767 - protein, 9 aa, Homo Sapiens
GEVKLCEKM

SEQ ID NO: 101768 - protein, 9 aa, Homo Sapiens
GEVLIDTHL

SEQ ID NO: 101769 - protein, 9 aa, Homo Sapiens
GEVNVLDNL

SEQ ID NO: 101770 - protein, 9 aa, Homo Sapiens
GEVPFNHEI

SEQ ID NO: 101771 - protein, 9 aa, Homo Sapiens
GEVPKFKAL

SEQ ID NO: 101772 - protein, 9 aa, Homo Sapiens
GEVRLGGSL

SEQ ID NO: 101773 - protein, 9 aa, Homo Sapiens
GEVRPVETL

SEQ ID NO: 101774 - protein, 9 aa, Homo Sapiens
GEVRTHIRV

SEQ ID NO: 101775 - protein, 9 aa, Homo Sapiens
GEVSARQEL

SEQ ID NO: 101776 - protein, 9 aa, Homo Sapiens
GEVTKQTVL

SEQ ID NO: 101777 - protein, 9 aa, Homo Sapiens
GEVTNVTTA

SEQ ID NO: 101778 - protein, 9 aa, Homo Sapiens
GEVVGKFYL

SEQ ID NO: 101779 - protein, 9 aa, Homo Sapiens
GEVYAIETF

SEQ ID NO: 101780 - protein, 9 aa, Homo Sapiens
GEWDKALSI

SEQ ID NO: 101781 - protein, 9 aa, Homo Sapiens
GEWERAAAV

SEQ ID NO: 101782 - protein, 9 aa, Homo Sapiens
GEWPDQPRI

SEQ ID NO: 101783 - protein, 9 aa, Homo Sapiens
GEWPTQLDV

SEQ ID NO: 101784 - protein, 9 aa, Homo Sapiens
GEYGKFFVT

SEQ ID NO: 101785 - protein, 9 aa, Homo Sapiens
GEYIAPEKI

SEQ ID NO: 101786 - protein, 9 aa, Homo Sapiens
GEYKDNALL

SEQ ID NO: 101787 - protein, 9 aa, Homo Sapiens
GEYPKLLRL

SEQ ID NO: 101788 - protein, 9 aa, Homo Sapiens
GEYQRMGVM

SEQ ID NO: 101789 - protein, 9 aa, Homo Sapiens
GEYSDPVTL

SEQ ID NO: 101790 - protein, 9 aa, Homo Sapiens
GGPGGVGGL

SEQ ID NO: 101791 - protein, 9 aa, Homo Sapiens
GQAPPGKAL

SEQ ID NO: 101792 - protein, 9 aa, Homo Sapiens
GQNPTEAEL

SEQ ID NO: 101793 - protein, 9 aa, Homo Sapiens
GQWKEEQKL

SEQ ID NO: 101794 - protein, 9 aa, Homo Sapiens
GQWKKGFVL

SEQ ID NO: 101795 - protein, 9 aa, Homo Sapiens
HDFKSVDHL

SEQ ID NO: 101796 - protein, 9 aa, Homo Sapiens
HDFQAPYLL

SEQ ID NO: 101797 - protein, 9 aa, Homo Sapiens
HDFVVVETV

SEQ ID NO: 101798 - protein, 9 aa, Homo Sapiens
HDITVPLEV

SEQ ID NO: 101799 - protein, 9 aa, Homo Sapiens
HDLALPLCL

SEQ ID NO: 101800 - protein, 9 aa, Homo Sapiens
HDLEVAQTT

SEQ ID NO: 101801 - protein, 9 aa, Homo Sapiens
HDVGICKAV

SEQ ID NO: 101802 - protein, 9 aa, Homo Sapiens
HDVVILDSL

SEQ ID NO: 101803 - protein, 9 aa, Homo Sapiens
HDVVVENNL

SEQ ID NO: 101804 - protein, 9 aa, Homo Sapiens
HEAAFPIAV

SEQ ID NO: 101805 - protein, 9 aa, Homo Sapiens
HEAATKAVL

SEQ ID NO: 101806 - protein, 9 aa, Homo Sapiens
HEADKTYML

SEQ ID NO: 101807 - protein, 9 aa, Homo Sapiens
HEADVDVLM

SEQ ID NO: 101808 - protein, 9 aa, Homo Sapiens
HEAEPVRTL

SEQ ID NO: 101809 - protein, 9 aa, Homo Sapiens
HEAERNIAL

SEQ ID NO: 101810 - protein, 9 aa, Homo Sapiens
HEAEVLKQL

SEQ ID NO: 101811 - protein, 9 aa, Homo Sapiens
HEAMEQQTI

SEQ ID NO: 101812 - protein, 9 aa, Homo Sapiens
HEASGKAVF

SEQ ID NO: 101813 - protein, 9 aa, Homo Sapiens
HEAVPLSVF

SEQ ID NO: 101814 - protein, 9 aa, Homo Sapiens
HEAWLIHKT

SEQ ID NO: 101815 - protein, 9 aa, Homo Sapiens
HECASINRI

SEQ ID NO: 101816 - protein, 9 aa, Homo Sapiens
HECQELQRL

SEQ ID NO: 101817 - protein, 9 aa, Homo Sapiens
HEDDHNFEL

SEQ ID NO: 101818 - protein, 9 aa, Homo Sapiens
HEDLGHVAL

SEQ ID NO: 101819 - protein, 9 aa, Homo Sapiens
HEDPGQATL

SEQ ID NO: 101820 - protein, 9 aa, Homo Sapiens
HEEKVFRAV

SEQ ID NO: 101821 - protein, 9 aa, Homo Sapiens
HEESREYSL

SEQ ID NO: 101822 - protein, 9 aa, Homo Sapiens
HEETNMPTM

SEQ ID NO: 101823 - protein, 9 aa, Homo Sapiens
HEFAENPGL

SEQ ID NO: 101824 - protein, 9 aa, Homo Sapiens
HEFDGDEEF

SEQ ID NO: 101825 - protein, 9 aa, Homo Sapiens
HEFDGRTGL

SEQ ID NO: 101826 - protein, 9 aa, Homo Sapiens
HEFFHILNL

SEQ ID NO: 101827 - protein, 9 aa, Homo Sapiens
HEFGAITFV

SEQ ID NO: 101828 - protein, 9 aa, Homo Sapiens
HEFHSQENL

SEQ ID NO: 101829 - protein, 9 aa, Homo Sapiens
HEFLVKPSF

SEQ ID NO: 101830 - protein, 9 aa, Homo Sapiens
HEFQAPFGM

SEQ ID NO: 101831 - protein, 9 aa, Homo Sapiens
HEFRDKLAA

SEQ ID NO: 101832 - protein, 9 aa, Homo Sapiens
HEFSKTEEL

SEQ ID NO: 101833 - protein, 9 aa, Homo Sapiens
HEFSREPSL

SEQ ID NO: 101834 - protein, 9 aa, Homo Sapiens
HEFSSPSHL

SEQ ID NO: 101835 - protein, 9 aa, Homo Sapiens
HEGDIILKI

SEQ ID NO: 101836 - protein, 9 aa, Homo Sapiens
HEGKVFISL

SEQ ID NO: 101837 - protein, 9 aa, Homo Sapiens
HEGLPGLAV

SEQ ID NO: 101838 - protein, 9 aa, Homo Sapiens
HEGTLVHAV

SEQ ID NO: 101839 - protein, 9 aa, Homo Sapiens
HEHIEILTV

SEQ ID NO: 101840 - protein, 9 aa, Homo Sapiens
HEHIHSCQF

SEQ ID NO: 101841 - protein, 9 aa, Homo Sapiens
HEHRLPHVL

SEQ ID NO: 101842 - protein, 9 aa, Homo Sapiens
HEIDRYTAI

SEQ ID NO: 101843 - protein, 9 aa, Homo Sapiens
HEIEALKSF

SEQ ID NO: 101844 - protein, 9 aa, Homo Sapiens
HEIGEWEAF

SEQ ID NO: 101845 - protein, 9 aa, Homo Sapiens
HEIGFGSKV

SEQ ID NO: 101846 - protein, 9 aa, Homo Sapiens
HEIGHIFGL

SEQ ID NO: 101847 - protein, 9 aa, Homo Sapiens
HEIITPEQF

SEQ ID NO: 101848 - protein, 9 aa, Homo Sapiens
HEIKSLEDL

SEQ ID NO: 101849 - protein, 9 aa, Homo Sapiens
HEILCKLSL

SEQ ID NO: 101850 - protein, 9 aa, Homo Sapiens
HEKDLVWKL

SEQ ID NO: 101851 - protein, 9 aa, Homo Sapiens
HEKVVRPAL

SEQ ID NO: 101852 - protein, 9 aa, Homo Sapiens
HELDQGQQL

SEQ ID NO: 101853 - protein, 9 aa, Homo Sapiens
HELEKKIEL

SEQ ID NO: 101854 - protein, 9 aa, Homo Sapiens
HELFTPPVI

SEQ ID NO: 101855 - protein, 9 aa, Homo Sapiens
HELLKTNAA

SEQ ID NO: 101856 - protein, 9 aa, Homo Sapiens
HELTIPNNL

SEQ ID NO: 101857 - protein, 9 aa, Homo Sapiens
HELVPEHVV

SEQ ID NO: 101858 - protein, 9 aa, Homo Sapiens
HEMEKAFAF

SEQ ID NO: 101859 - protein, 9 aa, Homo Sapiens
HENDAIHKI

SEQ ID NO: 101860 - protein, 9 aa, Homo Sapiens
HENEDIYKL

SEQ ID NO: 101861 - protein, 9 aa, Homo Sapiens
HENESVYKA

SEQ ID NO: 101862 - protein, 9 aa, Homo Sapiens
HENLLINEL

SEQ ID NO: 101863 - protein, 9 aa, Homo Sapiens
HENPKMQTM

SEQ ID NO: 101864 - protein, 9 aa, Homo Sapiens
HEPEKSFSL

SEQ ID NO: 101865 - protein, 9 aa, Homo Sapiens
HEPFIFHEV

SEQ ID NO: 101866 - protein, 9 aa, Homo Sapiens
HEQANVESL

SEQ ID NO: 101867 - protein, 9 aa, Homo Sapiens
HEQEEIFKL

SEQ ID NO: 101868 - protein, 9 aa, Homo Sapiens
HEQFIPIAA

SEQ ID NO: 101869 - protein, 9 aa, Homo Sapiens
HEQSGVYEL

SEQ ID NO: 101870 - protein, 9 aa, Homo Sapiens
HERAAILSV

SEQ ID NO: 101871 - protein, 9 aa, Homo Sapiens
HEREKEVVL

SEQ ID NO: 101872 - protein, 9 aa, Homo Sapiens
HERILAIGL

SEQ ID NO: 101873 - protein, 9 aa, Homo Sapiens
HESACGRTV

SEQ ID NO: 101874 - protein, 9 aa, Homo Sapiens
HESETTTSL

SEQ ID NO: 101875 - protein, 9 aa, Homo Sapiens
HESGASIKI

SEQ ID NO: 101876 - protein, 9 aa, Homo Sapiens
HESGHAIIA

SEQ ID NO: 101877 - protein, 9 aa, Homo Sapiens
HESPAVKLM

SEQ ID NO: 101878 - protein, 9 aa, Homo Sapiens
HESRQITQV

SEQ ID NO: 101879 - protein, 9 aa, Homo Sapiens
HETPKQPVV

SEQ ID NO: 101880 - protein, 9 aa, Homo Sapiens
HETQTLVKT

SEQ ID NO: 101881 - protein, 9 aa, Homo Sapiens
HETSKMKVL

SEQ ID NO: 101882 - protein, 9 aa, Homo Sapiens
HETSNINDF

SEQ ID NO: 101883 - protein, 9 aa, Homo Sapiens
HEVDKLYKV

SEQ ID NO: 101884 - protein, 9 aa, Homo Sapiens
HEVEKMFTL

SEQ ID NO: 101885 - protein, 9 aa, Homo Sapiens
HEVFNHREV

SEQ ID NO: 101886 - protein, 9 aa, Homo Sapiens
HEVGIGSVL

SEQ ID NO: 101887 - protein, 9 aa, Homo Sapiens
HEVKEAQTL

SEQ ID NO: 101888 - protein, 9 aa, Homo Sapiens
HEVMEQQTI

SEQ ID NO: 101889 - protein, 9 aa, Homo Sapiens
HEVNRILKV

SEQ ID NO: 101890 - protein, 9 aa, Homo Sapiens
HEVPGHQSV

SEQ ID NO: 101891 - protein, 9 aa, Homo Sapiens
HEVPSGNSL

SEQ ID NO: 101892 - protein, 9 aa, Homo Sapiens
HEVPYTTSF

SEQ ID NO: 101893 - protein, 9 aa, Homo Sapiens
HEVRIQPSL

SEQ ID NO: 101894 - protein, 9 aa, Homo Sapiens
HEWHKRVAL

SEQ ID NO: 101895 - protein, 9 aa, Homo Sapiens
HEWLQQHGI

SEQ ID NO: 101896 - protein, 9 aa, Homo Sapiens
HEWMKSEEL

SEQ ID NO: 101897 - protein, 9 aa, Homo Sapiens
HEYYQPTAL

SEQ ID NO: 101898 - protein, 9 aa, Homo Sapiens
HQYDGLVEL

SEQ ID NO: 101899 - protein, 9 aa, Homo Sapiens
HVGKTPIVG

SEQ ID NO: 101900 - protein, 9 aa, Homo Sapiens
IEAKFYEEV

SEQ ID NO: 101901 - protein, 9 aa, Homo Sapiens
IEATKQYAL

SEQ ID NO: 101902 - protein, 9 aa, Homo Sapiens
IEDNPHPRL

SEQ ID NO: 101903 - protein, 9 aa, Homo Sapiens
IEDPVRPEV

SEQ ID NO: 101904 - protein, 9 aa, Homo Sapiens
IEDRPMPKL

SEQ ID NO: 101905 - protein, 9 aa, Homo Sapiens
IEFKETQAL

SEQ ID NO: 101906 - protein, 9 aa, Homo Sapiens
IEFSDKESV

SEQ ID NO: 101907 - protein, 9 aa, Homo Sapiens
IEFSIPDSL

SEQ ID NO: 101908 - protein, 9 aa, Homo Sapiens
IEHDVVMKA

SEQ ID NO: 101909 - protein, 9 aa, Homo Sapiens
IEHEGQECL

SEQ ID NO: 101910 - protein, 9 aa, Homo Sapiens
IEHFIHIIT

SEQ ID NO: 101911 - protein, 9 aa, Homo Sapiens
IEHLIGKKL

SEQ ID NO: 101912 - protein, 9 aa, Homo Sapiens
IEHRNEAEL

SEQ ID NO: 101913 - protein, 9 aa, Homo Sapiens
IEIEKGEAV

SEQ ID NO: 101914 - protein, 9 aa, Homo Sapiens
IEKAQLKSL

SEQ ID NO: 101915 - protein, 9 aa, Homo Sapiens
IEKCGEAAL

SEQ ID NO: 101916 - protein, 9 aa, Homo Sapiens
IEKEGEFTL

SEQ ID NO: 101917 - protein, 9 aa, Homo Sapiens
IEKEHVEEI

SEQ ID NO: 101918 - protein, 9 aa, Homo Sapiens
IEKETKEYF

SEQ ID NO: 101919 - protein, 9 aa, Homo Sapiens
IEKFDKSKL

SEQ ID NO: 101920 - protein, 9 aa, Homo Sapiens
IEKKLKETL

SEQ ID NO: 101921 - protein, 9 aa, Homo Sapiens
IEKNLETPL

SEQ ID NO: 101922 - protein, 9 aa, Homo Sapiens
IEKPGGIIV

SEQ ID NO: 101923 - protein, 9 aa, Homo Sapiens
IEKQPPQVL

SEQ ID NO: 101924 - protein, 9 aa, Homo Sapiens
IEKSTQEKL

SEQ ID NO: 101925 - protein, 9 aa, Homo Sapiens
IEKTDPTTL

SEQ ID NO: 101926 - protein, 9 aa, Homo Sapiens
IEKVEHSDL

SEQ ID NO: 101927 - protein, 9 aa, Homo Sapiens
IELEGSQSL

SEQ ID NO: 101928 - protein, 9 aa, Homo Sapiens
IELPNIQKV

SEQ ID NO: 101929 - protein, 9 aa, Homo Sapiens
IEMETKTSI

SEQ ID NO: 101930 - protein, 9 aa, Homo Sapiens
IEMNEPVQL

SEQ ID NO: 101931 - protein, 9 aa, Homo Sapiens
IENGGVAVL

SEQ ID NO: 101932 - protein, 9 aa, Homo Sapiens
IENGHIFTV

SEQ ID NO: 101933 - protein, 9 aa, Homo Sapiens
IEPADAHVL

SEQ ID NO: 101934 - protein, 9 aa, Homo Sapiens
IEPGVSVSL

SEQ ID NO: 101935 - protein, 9 aa, Homo Sapiens
IEQEIRILL

SEQ ID NO: 101936 - protein, 9 aa, Homo Sapiens
IEQEKQRSL

SEQ ID NO: 101937 - protein, 9 aa, Homo Sapiens
IEQEKRSEI

SEQ ID NO: 101938 - protein, 9 aa, Homo Sapiens
IEQEQKLAL

SEQ ID NO: 101939 - protein, 9 aa, Homo Sapiens
IEQGNTKAL

SEQ ID NO: 101940 - protein, 9 aa, Homo Sapiens
IERALQPCI

SEQ ID NO: 101941 - protein, 9 aa, Homo Sapiens
IERENAAQL

SEQ ID NO: 101942 - protein, 9 aa, Homo Sapiens
IERPVTVFL

SEQ ID NO: 101943 - protein, 9 aa, Homo Sapiens
IERYPEETL

SEQ ID NO: 101944 - protein, 9 aa, Homo Sapiens
IESNHPIVL

SEQ ID NO: 101945 - protein, 9 aa, Homo Sapiens
IESPLFLKL

SEQ ID NO: 101946 - protein, 9 aa, Homo Sapiens
IESQDRPKL

SEQ ID NO: 101947 - protein, 9 aa, Homo Sapiens
IESSPQYRL

SEQ ID NO: 101948 - protein, 9 aa, Homo Sapiens
IESSVGKSL

SEQ ID NO: 101949 - protein, 9 aa, Homo Sapiens
IETINFHEV

SEQ ID NO: 101950 - protein, 9 aa, Homo Sapiens
IEVAKTQAL

SEQ ID NO: 101951 - protein, 9 aa, Homo Sapiens
IEVEKPFAI

SEQ ID NO: 101952 - protein, 9 aa, Homo Sapiens
IEVENKEVL

SEQ ID NO: 101953 - protein, 9 aa, Homo Sapiens
IEVENKNNL

SEQ ID NO: 101954 - protein, 9 aa, Homo Sapiens
IEYAKPTRL

SEQ ID NO: 101955 - protein, 9 aa, Homo Sapiens
IEYEHERDM

SEQ ID NO: 101956 - protein, 9 aa, Homo Sapiens
IEYEKKQTL

SEQ ID NO: 101957 - protein, 9 aa, Homo Sapiens
IEYENKEKL

SEQ ID NO: 101958 - protein, 9 aa, Homo Sapiens
IEYQEKPLL

SEQ ID NO: 101959 - protein, 9 aa, Homo Sapiens
IEYQSKPLL

SEQ ID NO: 101960 - protein, 9 aa, Homo Sapiens
IEYVKPSDL

SEQ ID NO: 101961 - protein, 9 aa, Homo Sapiens
IKADHVSTY

SEQ ID NO: 101962 - protein, 9 aa, Homo Sapiens
IKSWVIGAI

SEQ ID NO: 101963 - protein, 9 aa, Homo Sapiens
KDAYLPLRL

SEQ ID NO: 101964 - protein, 9 aa, Homo Sapiens
KDFEQLISI

SEQ ID NO: 101965 - protein, 9 aa, Homo Sapiens
KDFEQPLAI

SEQ ID NO: 101966 - protein, 9 aa, Homo Sapiens
KDILKPEIM

SEQ ID NO: 101967 - protein, 9 aa, Homo Sapiens
KDIPVVHQL

SEQ ID NO: 101968 - protein, 9 aa, Homo Sapiens
KDIQHWESL

SEQ ID NO: 101969 - protein, 9 aa, Homo Sapiens
KDLANQVSV

SEQ ID NO: 101970 - protein, 9 aa, Homo Sapiens
KDLVVPEKW

SEQ ID NO: 101971 - protein, 9 aa, Homo Sapiens
KDPKISTSL

SEQ ID NO: 101972 - protein, 9 aa, Homo Sapiens
KDSTLIMQL

SEQ ID NO: 101973 - protein, 9 aa, Homo Sapiens
KDTTLPASA

SEQ ID NO: 101974 - protein, 9 aa, Homo Sapiens
KDVDGAYMT

SEQ ID NO: 101975 - protein, 9 aa, Homo Sapiens
KDVKLPVQL

SEQ ID NO: 101976 - protein, 9 aa, Homo Sapiens
KDWEMHVHF

SEQ ID NO: 101977 - protein, 9 aa, Homo Sapiens
KEAALSTAL

SEQ ID NO: 101978 - protein, 9 aa, Homo Sapiens
KEAAVKTCL

SEQ ID NO: 101979 - protein, 9 aa, Homo Sapiens
KEAEFLQKL

SEQ ID NO: 101980 - protein, 9 aa, Homo Sapiens
KEAEILEVL

SEQ ID NO: 101981 - protein, 9 aa, Homo Sapiens
KEAEILSVL

SEQ ID NO: 101982 - protein, 9 aa, Homo Sapiens
KEAEKSPQL

SEQ ID NO: 101983 - protein, 9 aa, Homo Sapiens
KEAERDVSL

SEQ ID NO: 101984 - protein, 9 aa, Homo Sapiens
KEAETRAEF

SEQ ID NO: 101985 - protein, 9 aa, Homo Sapiens
KEAKFAQTL

SEQ ID NO: 101986 - protein, 9 aa, Homo Sapiens
KEALKQEVM

SEQ ID NO: 101987 - protein, 9 aa, Homo Sapiens
KEALVQVEV

SEQ ID NO: 101988 - protein, 9 aa, Homo Sapiens
KEAPAKVEV

SEQ ID NO: 101989 - protein, 9 aa, Homo Sapiens
KEAPAPPKA

SEQ ID NO: 101990 - protein, 9 aa, Homo Sapiens
KEAPPMEKP

SEQ ID NO: 101991 - protein, 9 aa, Homo Sapiens
KEAPPPVLL

SEQ ID NO: 101992 - protein, 9 aa, Homo Sapiens
KEAPTAYSL

SEQ ID NO: 101993 - protein, 9 aa, Homo Sapiens
KEAQRIMTL

SEQ ID NO: 101994 - protein, 9 aa, Homo Sapiens
KEASTTVRV

SEQ ID NO: 101995 - protein, 9 aa, Homo Sapiens
KEAVIKHSL

SEQ ID NO: 101996 - protein, 9 aa, Homo Sapiens
KECDFQTKF

SEQ ID NO: 101997 - protein, 9 aa, Homo Sapiens
KECGKAFTV

SEQ ID NO: 101998 - protein, 9 aa, Homo Sapiens
KECQKIIRL

SEQ ID NO: 101999 - protein, 9 aa, Homo Sapiens
KEDDPKAAL

SEQ ID NO: 102000 - protein, 9 aa, Homo Sapiens
KEDLPKVVV

SEQ ID NO: 102001 - protein, 9 aa, Homo Sapiens
KEDSKLIAL

SEQ ID NO: 102002 - protein, 9 aa, Homo Sapiens
KEEPPQPQL

SEQ ID NO: 102003 - protein, 9 aa, Homo Sapiens
KEEPVKLAV

SEQ ID NO: 102004 - protein, 9 aa, Homo Sapiens
KEESIVSSL

SEQ ID NO: 102005 - protein, 9 aa, Homo Sapiens
KEEVTPEQL

SEQ ID NO: 102006 - protein, 9 aa, Homo Sapiens
KEEYLKPVL

SEQ ID NO: 102007 - protein, 9 aa, Homo Sapiens
KEFAQIIKI

SEQ ID NO: 102008 - protein, 9 aa, Homo Sapiens
KEFDGKSLV

SEQ ID NO: 102009 - protein, 9 aa, Homo Sapiens
KEFEEKRGL

SEQ ID NO: 102010 - protein, 9 aa, Homo Sapiens
KEFEGKTLV

SEQ ID NO: 102011 - protein, 9 aa, Homo Sapiens
KEFEKEISA

SEQ ID NO: 102012 - protein, 9 aa, Homo Sapiens
KEFEKRKML

SEQ ID NO: 102013 - protein, 9 aa, Homo Sapiens
KEFETPEKA

SEQ ID NO: 102014 - protein, 9 aa, Homo Sapiens
KEFIKIVEA

SEQ ID NO: 102015 - protein, 9 aa, Homo Sapiens
KEFKNGYNL

SEQ ID NO: 102016 - protein, 9 aa, Homo Sapiens
KEFLKPEKF

SEQ ID NO: 102017 - protein, 9 aa, Homo Sapiens
KEFNEPRVL

SEQ ID NO: 102018 - protein, 9 aa, Homo Sapiens
KEFPEKQEL

SEQ ID NO: 102019 - protein, 9 aa, Homo Sapiens
KEFSEENVL

SEQ ID NO: 102020 - protein, 9 aa, Homo Sapiens
KEFSGHSSL

SEQ ID NO: 102021 - protein, 9 aa, Homo Sapiens
KEFVGKPTI

SEQ ID NO: 102022 - protein, 9 aa, Homo Sapiens
KEGDIVTLI

SEQ ID NO: 102023 - protein, 9 aa, Homo Sapiens
KEGEEQPVL

SEQ ID NO: 102024 - protein, 9 aa, Homo Sapiens
KEGEFVAQF

SEQ ID NO: 102025 - protein, 9 aa, Homo Sapiens
KEGEIIHLI

SEQ ID NO: 102026 - protein, 9 aa, Homo Sapiens
KEGFPITAI

SEQ ID NO: 102027 - protein, 9 aa, Homo Sapiens
KEGFPITSL

SEQ ID NO: 102028 - protein, 9 aa, Homo Sapiens
KEGIVFKSL

SEQ ID NO: 102029 - protein, 9 aa, Homo Sapiens
KEGKPPISV

SEQ ID NO: 102030 - protein, 9 aa, Homo Sapiens
KEGLPTRAL

SEQ ID NO: 102031 - protein, 9 aa, Homo Sapiens
KEGVFAKEV

SEQ ID NO: 102032 - protein, 9 aa, Homo Sapiens
KEGVVYVEV

SEQ ID NO: 102033 - protein, 9 aa, Homo Sapiens
KEHEAITKV

SEQ ID NO: 102034 - protein, 9 aa, Homo Sapiens
KEHEVTIFV

SEQ ID NO: 102035 - protein, 9 aa, Homo Sapiens
KEHLYFETV

SEQ ID NO: 102036 - protein, 9 aa, Homo Sapiens
KEHPFILNL

SEQ ID NO: 102037 - protein, 9 aa, Homo Sapiens
KEHPLFKKL

SEQ ID NO: 102038 - protein, 9 aa, Homo Sapiens
KEIDIYANL

SEQ ID NO: 102039 - protein, 9 aa, Homo Sapiens
KEIDKEEHL

SEQ ID NO: 102040 - protein, 9 aa, Homo Sapiens
KEIEDFDSL

SEQ ID NO: 102041 - protein, 9 aa, Homo Sapiens
KEIEGIFHA

SEQ ID NO: 102042 - protein, 9 aa, Homo Sapiens
KEIEGVTKT

SEQ ID NO: 102043 - protein, 9 aa, Homo Sapiens
KEIEKDLRL

SEQ ID NO: 102044 - protein, 9 aa, Homo Sapiens
KEIESRVVF

SEQ ID NO: 102045 - protein, 9 aa, Homo Sapiens
KEIFLRELI

SEQ ID NO: 102046 - protein, 9 aa, Homo Sapiens
KEIGADLVL

SEQ ID NO: 102047 - protein, 9 aa, Homo Sapiens
KEIGDIAGV

SEQ ID NO: 102048 - protein, 9 aa, Homo Sapiens
KEIGELTQL

SEQ ID NO: 102049 - protein, 9 aa, Homo Sapiens
KEIGTKQSF

SEQ ID NO: 102050 - protein, 9 aa, Homo Sapiens
KEIHIQPHL

SEQ ID NO: 102051 - protein, 9 aa, Homo Sapiens
KEIIQDVTL

SEQ ID NO: 102052 - protein, 9 aa, Homo Sapiens
KEIKEVIEL

SEQ ID NO: 102053 - protein, 9 aa, Homo Sapiens
KEILKEIGV

SEQ ID NO: 102054 - protein, 9 aa, Homo Sapiens
KEILKEREL

SEQ ID NO: 102055 - protein, 9 aa, Homo Sapiens
KEILPAAEI

SEQ ID NO: 102056 - protein, 9 aa, Homo Sapiens
KEISDLHYL

SEQ ID NO: 102057 - protein, 9 aa, Homo Sapiens
KEISITHHV

SEQ ID NO: 102058 - protein, 9 aa, Homo Sapiens
KEITEGKTV

SEQ ID NO: 102059 - protein, 9 aa, Homo Sapiens
KEIVGVVNV

SEQ ID NO: 102060 - protein, 9 aa, Homo Sapiens
KEKAEIERM

SEQ ID NO: 102061 - protein, 9 aa, Homo Sapiens
KEKASWSSL

SEQ ID NO: 102062 - protein, 9 aa, Homo Sapiens
KEKEFEETM

SEQ ID NO: 102063 - protein, 9 aa, Homo Sapiens
KEKEFQEEL

SEQ ID NO: 102064 - protein, 9 aa, Homo Sapiens
KEKEGIAKI

SEQ ID NO: 102065 - protein, 9 aa, Homo Sapiens
KEKELVTTV

SEQ ID NO: 102066 - protein, 9 aa, Homo Sapiens
KEKEPEEEL

SEQ ID NO: 102067 - protein, 9 aa, Homo Sapiens
KEKGSTLDL

SEQ ID NO: 102068 - protein, 9 aa, Homo Sapiens
KEKKDRLAL

SEQ ID NO: 102069 - protein, 9 aa, Homo Sapiens
KEKKEEQVI

SEQ ID NO: 102070 - protein, 9 aa, Homo Sapiens
KEKLCYVAL

SEQ ID NO: 102071 - protein, 9 aa, Homo Sapiens
KEKLFRERL

SEQ ID NO: 102072 - protein, 9 aa, Homo Sapiens
KEKPDIFQL

SEQ ID NO: 102073 - protein, 9 aa, Homo Sapiens
KEKPDPNNL

SEQ ID NO: 102074 - protein, 9 aa, Homo Sapiens
KEKPEEESL

SEQ ID NO: 102075 - protein, 9 aa, Homo Sapiens
KEKPGSEVL

SEQ ID NO: 102076 - protein, 9 aa, Homo Sapiens
KEKPNDPTL

SEQ ID NO: 102077 - protein, 9 aa, Homo Sapiens
KEKTIHLTL

SEQ ID NO: 102078 - protein, 9 aa, Homo Sapiens
KEKVIKAVV

SEQ ID NO: 102079 - protein, 9 aa, Homo Sapiens
KEKVLATVT

SEQ ID NO: 102080 - protein, 9 aa, Homo Sapiens
KEKVPGITI

SEQ ID NO: 102081 - protein, 9 aa, Homo Sapiens
KEKVTRIIL

SEQ ID NO: 102082 - protein, 9 aa, Homo Sapiens
KELATVRTI

SEQ ID NO: 102083 - protein, 9 aa, Homo Sapiens
KELDKFDNL

SEQ ID NO: 102084 - protein, 9 aa, Homo Sapiens
KELDPIQKL

SEQ ID NO: 102085 - protein, 9 aa, Homo Sapiens
KELEEEITL

SEQ ID NO: 102086 - protein, 9 aa, Homo Sapiens
KELEEQRKL

SEQ ID NO: 102087 - protein, 9 aa, Homo Sapiens
KELEKTLAL

SEQ ID NO: 102088 - protein, 9 aa, Homo Sapiens
KELEKTYSA

SEQ ID NO: 102089 - protein, 9 aa, Homo Sapiens
KELEPLKEM

SEQ ID NO: 102090 - protein, 9 aa, Homo Sapiens
KELERVTSL

SEQ ID NO: 102091 - protein, 9 aa, Homo Sapiens
KELIKPPTI

SEQ ID NO: 102092 - protein, 9 aa, Homo Sapiens
KELKLLQTI

SEQ ID NO: 102093 - protein, 9 aa, Homo Sapiens
KELLGPPEA

SEQ ID NO: 102094 - protein, 9 aa, Homo Sapiens
KELNILHEM

SEQ ID NO: 102095 - protein, 9 aa, Homo Sapiens
KELPEYYEL

SEQ ID NO: 102096 - protein, 9 aa, Homo Sapiens
KELSDSVTL

SEQ ID NO: 102097 - protein, 9 aa, Homo Sapiens
KEMEQLLEM

SEQ ID NO: 102098 - protein, 9 aa, Homo Sapiens
KEMEVSPSA

SEQ ID NO: 102099 - protein, 9 aa, Homo Sapiens
KEMGQMQVL

SEQ ID NO: 102100 - protein, 9 aa, Homo Sapiens
KEMPVKVEA

SEQ ID NO: 102101 - protein, 9 aa, Homo Sapiens
KENDPSVRL

SEQ ID NO: 102102 - protein, 9 aa, Homo Sapiens
KENEEKVCL

SEQ ID NO: 102103 - protein, 9 aa, Homo Sapiens
KENKKFPVF

SEQ ID NO: 102104 - protein, 9 aa, Homo Sapiens
KENKVLKTL

SEQ ID NO: 102105 - protein, 9 aa, Homo Sapiens
KENPSTVGV

SEQ ID NO: 102106 - protein, 9 aa, Homo Sapiens
KENQNIAYV

SEQ ID NO: 102107 - protein, 9 aa, Homo Sapiens
KENRGINTL

SEQ ID NO: 102108 - protein, 9 aa, Homo Sapiens
KENSLHRAL

SEQ ID NO: 102109 - protein, 9 aa, Homo Sapiens
KENSYVKKF

SEQ ID NO: 102110 - protein, 9 aa, Homo Sapiens
KENTIEHLL

SEQ ID NO: 102111 - protein, 9 aa, Homo Sapiens
KENVIRPIL

SEQ ID NO: 102112 - protein, 9 aa, Homo Sapiens
KENYQMLTL

SEQ ID NO: 102113 - protein, 9 aa, Homo Sapiens
KEPDVSEEL

SEQ ID NO: 102114 - protein, 9 aa, Homo Sapiens
KEPEINTTL

SEQ ID NO: 102115 - protein, 9 aa, Homo Sapiens
KEPELFQTV

SEQ ID NO: 102116 - protein, 9 aa, Homo Sapiens
KEPVTPSAL

SEQ ID NO: 102117 - protein, 9 aa, Homo Sapiens
KEQAQQAGL

SEQ ID NO: 102118 - protein, 9 aa, Homo Sapiens
KEQDKPPNL

SEQ ID NO: 102119 - protein, 9 aa, Homo Sapiens
KEQDVEKEL

SEQ ID NO: 102120 - protein, 9 aa, Homo Sapiens
KEQELQQTL

SEQ ID NO: 102121 - protein, 9 aa, Homo Sapiens
KEQEPMPTV

SEQ ID NO: 102122 - protein, 9 aa, Homo Sapiens
KEQERIFQL

SEQ ID NO: 102123 - protein, 9 aa, Homo Sapiens
KEQMKVESL

SEQ ID NO: 102124 - protein, 9 aa, Homo Sapiens
KEQVPPPAV

SEQ ID NO: 102125 - protein, 9 aa, Homo Sapiens
KESEKQLLL

SEQ ID NO: 102126 - protein, 9 aa, Homo Sapiens
KESEVFYEL

SEQ ID NO: 102127 - protein, 9 aa, Homo Sapiens
KESEVVMKF

SEQ ID NO: 102128 - protein, 9 aa, Homo Sapiens
KESEVYKML

SEQ ID NO: 102129 - protein, 9 aa, Homo Sapiens
KESGLKPTL

SEQ ID NO: 102130 - protein, 9 aa, Homo Sapiens
KESSTVFEL

SEQ ID NO: 102131 - protein, 9 aa, Homo Sapiens
KESTITRKL

SEQ ID NO: 102132 - protein, 9 aa, Homo Sapiens
KESTLHLVL

SEQ ID NO: 102133 - protein, 9 aa, Homo Sapiens
KETAVFINI

SEQ ID NO: 102134 - protein, 9 aa, Homo Sapiens
KETEIVKKL

SEQ ID NO: 102135 - protein, 9 aa, Homo Sapiens
KETGDIKEL

SEQ ID NO: 102136 - protein, 9 aa, Homo Sapiens
KETGGVEKL

SEQ ID NO: 102137 - protein, 9 aa, Homo Sapiens
KETGQIVAI

SEQ ID NO: 102138 - protein, 9 aa, Homo Sapiens
KETGTPISM

SEQ ID NO: 102139 - protein, 9 aa, Homo Sapiens
KETIDNNSV

SEQ ID NO: 102140 - protein, 9 aa, Homo Sapiens
KETKDVSAL

SEQ ID NO: 102141 - protein, 9 aa, Homo Sapiens
KETLKIDIL

SEQ ID NO: 102142 - protein, 9 aa, Homo Sapiens
KETPDKVEL

SEQ ID NO: 102143 - protein, 9 aa, Homo Sapiens
KETPQSLAF

SEQ ID NO: 102144 - protein, 9 aa, Homo Sapiens
KETTYYDVL

SEQ ID NO: 102145 - protein, 9 aa, Homo Sapiens
KEVAELTRL

SEQ ID NO: 102146 - protein, 9 aa, Homo Sapiens
KEVAQAVLL

SEQ ID NO: 102147 - protein, 9 aa, Homo Sapiens
KEVATVTKL

SEQ ID NO: 102148 - protein, 9 aa, Homo Sapiens
KEVDALLHL

SEQ ID NO: 102149 - protein, 9 aa, Homo Sapiens
KEVDVGLAA

SEQ ID NO: 102150 - protein, 9 aa, Homo Sapiens
KEVDVSKQL

SEQ ID NO: 102151 - protein, 9 aa, Homo Sapiens
KEVEEISLL

SEQ ID NO: 102152 - protein, 9 aa, Homo Sapiens
KEVEQFTQV

SEQ ID NO: 102153 - protein, 9 aa, Homo Sapiens
KEVERILGL

SEQ ID NO: 102154 - protein, 9 aa, Homo Sapiens
KEVFLDRKL

SEQ ID NO: 102155 - protein, 9 aa, Homo Sapiens
KEVKEVATL

SEQ ID NO: 102156 - protein, 9 aa, Homo Sapiens
KEVNETYKL

SEQ ID NO: 102157 - protein, 9 aa, Homo Sapiens
KEVNFTSEL

SEQ ID NO: 102158 - protein, 9 aa, Homo Sapiens
KEVQDGIEL

SEQ ID NO: 102159 - protein, 9 aa, Homo Sapiens
KEWEKVFEM

SEQ ID NO: 102160 - protein, 9 aa, Homo Sapiens
KEWETIRSF

SEQ ID NO: 102161 - protein, 9 aa, Homo Sapiens
KEWMPVTKL

SEQ ID NO: 102162 - protein, 9 aa, Homo Sapiens
KEWVTPKEF

SEQ ID NO: 102163 - protein, 9 aa, Homo Sapiens
KEYDSISRL

SEQ ID NO: 102164 - protein, 9 aa, Homo Sapiens
KEYIQPVQL

SEQ ID NO: 102165 - protein, 9 aa, Homo Sapiens
KEYVAPRVL

SEQ ID NO: 102166 - protein, 9 aa, Homo Sapiens
KEYVGIVRL

SEQ ID NO: 102167 - protein, 9 aa, Homo Sapiens
KQFEKQVEL

SEQ ID NO: 102168 - protein, 9 aa, Homo Sapiens
KQFGNILIL

SEQ ID NO: 102169 - protein, 9 aa, Homo Sapiens
KQLEDGRTL

SEQ ID NO: 102170 - protein, 9 aa, Homo Sapiens
KQQLELDSI

SEQ ID NO: 102171 - protein, 9 aa, Homo Sapiens
LEAAIPERV

SEQ ID NO: 102172 - protein, 9 aa, Homo Sapiens
LEADRMAAL

SEQ ID NO: 102173 - protein, 9 aa, Homo Sapiens
LEAEPQFSL

SEQ ID NO: 102174 - protein, 9 aa, Homo Sapiens
LEAHFVPLV

SEQ ID NO: 102175 - protein, 9 aa, Homo Sapiens
LEAKNTQTL

SEQ ID NO: 102176 - protein, 9 aa, Homo Sapiens
LECAKAYLL

SEQ ID NO: 102177 - protein, 9 aa, Homo Sapiens
LEGQIHPEL

SEQ ID NO: 102178 - protein, 9 aa, Homo Sapiens
LEHEGLVSL

SEQ ID NO: 102179 - protein, 9 aa, Homo Sapiens
LEHEYIQNF

SEQ ID NO: 102180 - protein, 9 aa, Homo Sapiens
LEHGADPTV

SEQ ID NO: 102181 - protein, 9 aa, Homo Sapiens
LEHIKTHEL

SEQ ID NO: 102182 - protein, 9 aa, Homo Sapiens
LEHKIIIRV

SEQ ID NO: 102183 - protein, 9 aa, Homo Sapiens
LEHLTNEAL

SEQ ID NO: 102184 - protein, 9 aa, Homo Sapiens
LEHQVFTVL

SEQ ID NO: 102185 - protein, 9 aa, Homo Sapiens
LEHVPDTVL

SEQ ID NO: 102186 - protein, 9 aa, Homo Sapiens
LEHVQPWSV

SEQ ID NO: 102187 - protein, 9 aa, Homo Sapiens
LEIQEKPAL

SEQ ID NO: 102188 - protein, 9 aa, Homo Sapiens
LEKAAEPTL

SEQ ID NO: 102189 - protein, 9 aa, Homo Sapiens
LEKAKAKEL

SEQ ID NO: 102190 - protein, 9 aa, Homo Sapiens
LEKAVQHCL

SEQ ID NO: 102191 - protein, 9 aa, Homo Sapiens
LEKAVVLEL

SEQ ID NO: 102192 - protein, 9 aa, Homo Sapiens
LEKDAQNRL

SEQ ID NO: 102193 - protein, 9 aa, Homo Sapiens
LEKERQEQL

SEQ ID NO: 102194 - protein, 9 aa, Homo Sapiens
LEKGKETLL

SEQ ID NO: 102195 - protein, 9 aa, Homo Sapiens
LEKGLATSL

SEQ ID NO: 102196 - protein, 9 aa, Homo Sapiens
LEKIADPTL

SEQ ID NO: 102197 - protein, 9 aa, Homo Sapiens
LEKKETPSL

SEQ ID NO: 102198 - protein, 9 aa, Homo Sapiens
LEKKFGIQL

SEQ ID NO: 102199 - protein, 9 aa, Homo Sapiens
LEKKIEQEL

SEQ ID NO: 102200 - protein, 9 aa, Homo Sapiens
LEKKIGKSI

SEQ ID NO: 102201 - protein, 9 aa, Homo Sapiens
LEKKKDYKL

SEQ ID NO: 102202 - protein, 9 aa, Homo Sapiens
LEKNIADLM

SEQ ID NO: 102203 - protein, 9 aa, Homo Sapiens
LEKNKIPAL

SEQ ID NO: 102204 - protein, 9 aa, Homo Sapiens
LELGPKPEV

SEQ ID NO: 102205 - protein, 9 aa, Homo Sapiens
LELPGQPSV

SEQ ID NO: 102206 - protein, 9 aa, Homo Sapiens
LEMIEPRTL

SEQ ID NO: 102207 - protein, 9 aa, Homo Sapiens
LEMIQQEKL

SEQ ID NO: 102208 - protein, 9 aa, Homo Sapiens
LENDGATAL

SEQ ID NO: 102209 - protein, 9 aa, Homo Sapiens
LENDKTIKL

SEQ ID NO: 102210 - protein, 9 aa, Homo Sapiens
LENMHIEQL

SEQ ID NO: 102211 - protein, 9 aa, Homo Sapiens
LENSKQPSV

SEQ ID NO: 102212 - protein, 9 aa, Homo Sapiens
LENVIRDAV

SEQ ID NO: 102213 - protein, 9 aa, Homo Sapiens
LEPHDSPVL

SEQ ID NO: 102214 - protein, 9 aa, Homo Sapiens
LEQEKTQAL

SEQ ID NO: 102215 - protein, 9 aa, Homo Sapiens
LEQKIQQEL

SEQ ID NO: 102216 - protein, 9 aa, Homo Sapiens
LEQQNKILL

SEQ ID NO: 102217 - protein, 9 aa, Homo Sapiens
LERDQTCKL

SEQ ID NO: 102218 - protein, 9 aa, Homo Sapiens
LERFVEECF

SEQ ID NO: 102219 - protein, 9 aa, Homo Sapiens
LERIEETAL

SEQ ID NO: 102220 - protein, 9 aa, Homo Sapiens
LERLGSLTL

SEQ ID NO: 102221 - protein, 9 aa, Homo Sapiens
LERLSELAL

SEQ ID NO: 102222 - protein, 9 aa, Homo Sapiens
LERMGANSL

SEQ ID NO: 102223 - protein, 9 aa, Homo Sapiens
LERNITIKL

SEQ ID NO: 102224 - protein, 9 aa, Homo Sapiens
LERQGQGQL

SEQ ID NO: 102225 - protein, 9 aa, Homo Sapiens
LESDNNTAL

SEQ ID NO: 102226 - protein, 9 aa, Homo Sapiens
LESEHPKVM

SEQ ID NO: 102227 - protein, 9 aa, Homo Sapiens
LESGGFRSL

SEQ ID NO: 102228 - protein, 9 aa, Homo Sapiens
LESKTYHAL

SEQ ID NO: 102229 - protein, 9 aa, Homo Sapiens
LETDSVQRL

SEQ ID NO: 102230 - protein, 9 aa, Homo Sapiens
LETLVSPKL

SEQ ID NO: 102231 - protein, 9 aa, Homo Sapiens
LETPWELTV

SEQ ID NO: 102232 - protein, 9 aa, Homo Sapiens
LETSTGHSL

SEQ ID NO: 102233 - protein, 9 aa, Homo Sapiens
LETTGGHSV

SEQ ID NO: 102234 - protein, 9 aa, Homo Sapiens
LEVECATQL

SEQ ID NO: 102235 - protein, 9 aa, Homo Sapiens
LEVEDRTSL

SEQ ID NO: 102236 - protein, 9 aa, Homo Sapiens
LEVEKSLVL

SEQ ID NO: 102237 - protein, 9 aa, Homo Sapiens
LEVGELAKL

SEQ ID NO: 102238 - protein, 9 aa, Homo Sapiens
LEVVQTEKL

SEQ ID NO: 102239 - protein, 9 aa, Homo Sapiens
LKERESILK

SEQ ID NO: 102240 - protein, 9 aa, Homo Sapiens
LQIDNARLA

SEQ ID NO: 102241 - protein, 9 aa, Homo Sapiens
LRELELQRR

SEQ ID NO: 102242 - protein, 9 aa, Homo Sapiens
LTQALKDNK

SEQ ID NO: 102243 - protein, 9 aa, Homo Sapiens
MEDETQKEL

SEQ ID NO: 102244 - protein, 9 aa, Homo Sapiens
MEFERQAEI

SEQ ID NO: 102245 - protein, 9 aa, Homo Sapiens
MEFKAVQQV

SEQ ID NO: 102246 - protein, 9 aa, Homo Sapiens
MEGKWLLCM

SEQ ID NO: 102247 - protein, 9 aa, Homo Sapiens
MEGPAPPVL

SEQ ID NO: 102248 - protein, 9 aa, Homo Sapiens
MEHGTVTVV

SEQ ID NO: 102249 - protein, 9 aa, Homo Sapiens
MEHPYFYTV

SEQ ID NO: 102250 - protein, 9 aa, Homo Sapiens
MEKEDGESL

SEQ ID NO: 102251 - protein, 9 aa, Homo Sapiens
MEKTDETRL

SEQ ID NO: 102252 - protein, 9 aa, Homo Sapiens
MENKIRSTL

SEQ ID NO: 102253 - protein, 9 aa, Homo Sapiens
MEQSIKSVL

SEQ ID NO: 102254 - protein, 9 aa, Homo Sapiens
MESGIEPSV

SEQ ID NO: 102255 - protein, 9 aa, Homo Sapiens
METLILKEL

SEQ ID NO: 102256 - protein, 9 aa, Homo Sapiens
MEVAGVTAL

SEQ ID NO: 102257 - protein, 9 aa, Homo Sapiens
NDVLVPKPF

SEQ ID NO: 102258 - protein, 9 aa, Homo Sapiens
NEASVLHNL

SEQ ID NO: 102259 - protein, 9 aa, Homo Sapiens
NECVVVIRV

SEQ ID NO: 102260 - protein, 9 aa, Homo Sapiens
NEFDAIQKA

SEQ ID NO: 102261 - protein, 9 aa, Homo Sapiens
NEFHSPIGL

SEQ ID NO: 102262 - protein, 9 aa, Homo Sapiens
NEFKNIPEI

SEQ ID NO: 102263 - protein, 9 aa, Homo Sapiens
NEFPEPIKL

SEQ ID NO: 102264 - protein, 9 aa, Homo Sapiens
NEFPVIVRL

SEQ ID NO: 102265 - protein, 9 aa, Homo Sapiens
NEFQGAEAM

SEQ ID NO: 102266 - protein, 9 aa, Homo Sapiens
NEFVHINNL

SEQ ID NO: 102267 - protein, 9 aa, Homo Sapiens
NEHHVNATL

SEQ ID NO: 102268 - protein, 9 aa, Homo Sapiens
NEIKDSVVA

SEQ ID NO: 102269 - protein, 9 aa, Homo Sapiens
NEIRTLIDL

SEQ ID NO: 102270 - protein, 9 aa, Homo Sapiens
NEITIPVTF

SEQ ID NO: 102271 - protein, 9 aa, Homo Sapiens
NEITKLTSL

SEQ ID NO: 102272 - protein, 9 aa, Homo Sapiens
NEIVTIERL

SEQ ID NO: 102273 - protein, 9 aa, Homo Sapiens
NEKQISQVL

SEQ ID NO: 102274 - protein, 9 aa, Homo Sapiens
NELEKLPSL

SEQ ID NO: 102275 - protein, 9 aa, Homo Sapiens
NELIRQEKL

SEQ ID NO: 102276 - protein, 9 aa, Homo Sapiens
NENSLFKSL

SEQ ID NO: 102277 - protein, 9 aa, Homo Sapiens
NENSNIQVL

SEQ ID NO: 102278 - protein, 9 aa, Homo Sapiens
NERDPIRAL

SEQ ID NO: 102279 - protein, 9 aa, Homo Sapiens
NERPIIFAL

SEQ ID NO: 102280 - protein, 9 aa, Homo Sapiens
NERYLHLAA

SEQ ID NO: 102281 - protein, 9 aa, Homo Sapiens
NETEIIKCL

SEQ ID NO: 102282 - protein, 9 aa, Homo Sapiens
NETTGLYSL

SEQ ID NO: 102283 - protein, 9 aa, Homo Sapiens
NEVEKQWRL

SEQ ID NO: 102284 - protein, 9 aa, Homo Sapiens
NEVEQRHTL

SEQ ID NO: 102285 - protein, 9 aa, Homo Sapiens
NEVIGIRQL

SEQ ID NO: 102286 - protein, 9 aa, Homo Sapiens
NEVVQVHAA

SEQ ID NO: 102287 - protein, 9 aa, Homo Sapiens
NEWIAVNTV

SEQ ID NO: 102288 - protein, 9 aa, Homo Sapiens
NEYFTNEVL

SEQ ID NO: 102289 - protein, 9 aa, Homo Sapiens
NEYGPVLHM

SEQ ID NO: 102290 - protein, 9 aa, Homo Sapiens
NEYLLPESV

SEQ ID NO: 102291 - protein, 9 aa, Homo Sapiens
PAYHSSLMD

SEQ ID NO: 102292 - protein, 9 aa, Homo Sapiens
PEAAEGPEV

SEQ ID NO: 102293 - protein, 9 aa, Homo Sapiens
PEFNLIHSL

SEQ ID NO: 102294 - protein, 9 aa, Homo Sapiens
PEYGEVIQL

SEQ ID NO: 102295 - protein, 9 aa, Homo Sapiens
PSIVHRKCF

SEQ ID NO: 102296 - protein, 9 aa, Homo Sapiens
QDRISLVSV

SEQ ID NO: 102297 - protein, 9 aa, Homo Sapiens
QDVVLNYPM

SEQ ID NO: 102298 - protein, 9 aa, Homo Sapiens
QDVVQPLTL

SEQ ID NO: 102299 - protein, 9 aa, Homo Sapiens
QEACEAYLV

SEQ ID NO: 102300 - protein, 9 aa, Homo Sapiens
QEADKCPTL

SEQ ID NO: 102301 - protein, 9 aa, Homo Sapiens
QEAPALVRL

SEQ ID NO: 102302 - protein, 9 aa, Homo Sapiens
QEASEAYLV

SEQ ID NO: 102303 - protein, 9 aa, Homo Sapiens
QECEKLKKL

SEQ ID NO: 102304 - protein, 9 aa, Homo Sapiens
QEENITRAL

SEQ ID NO: 102305 - protein, 9 aa, Homo Sapiens
QEEPLPHEL

SEQ ID NO: 102306 - protein, 9 aa, Homo Sapiens
QEEQRYQAL

SEQ ID NO: 102307 - protein, 9 aa, Homo Sapiens
QEETNFKSL

SEQ ID NO: 102308 - protein, 9 aa, Homo Sapiens
QEFGADVRL

SEQ ID NO: 102309 - protein, 9 aa, Homo Sapiens
QEFGILDKV

SEQ ID NO: 102310 - protein, 9 aa, Homo Sapiens
QEFPEHHKM

SEQ ID NO: 102311 - protein, 9 aa, Homo Sapiens
QEHAQEVVL

SEQ ID NO: 102312 - protein, 9 aa, Homo Sapiens
QEHLQLQNL

SEQ ID NO: 102313 - protein, 9 aa, Homo Sapiens
QEHPAIRTL

SEQ ID NO: 102314 - protein, 9 aa, Homo Sapiens
QEHPCLVEL

SEQ ID NO: 102315 - protein, 9 aa, Homo Sapiens
QEHPSIRTL

SEQ ID NO: 102316 - protein, 9 aa, Homo Sapiens
QEHQGHQTF

SEQ ID NO: 102317 - protein, 9 aa, Homo Sapiens
QEIEELTKI

SEQ ID NO: 102318 - protein, 9 aa, Homo Sapiens
QEIEKPVAV

SEQ ID NO: 102319 - protein, 9 aa, Homo Sapiens
QEIEQKLEV

SEQ ID NO: 102320 - protein, 9 aa, Homo Sapiens
QEIEVRPGI

SEQ ID NO: 102321 - protein, 9 aa, Homo Sapiens
QEIKDIYGL

SEQ ID NO: 102322 - protein, 9 aa, Homo Sapiens
QEIKTAHKL

SEQ ID NO: 102323 - protein, 9 aa, Homo Sapiens
QEIPEPLQL

SEQ ID NO: 102324 - protein, 9 aa, Homo Sapiens
QEIQDQLSL

SEQ ID NO: 102325 - protein, 9 aa, Homo Sapiens
QEITNRLSL

SEQ ID NO: 102326 - protein, 9 aa, Homo Sapiens
QEKAIPLAL

SEQ ID NO: 102327 - protein, 9 aa, Homo Sapiens
QEKEAIERL

SEQ ID NO: 102328 - protein, 9 aa, Homo Sapiens
QEKHHRISL

SEQ ID NO: 102329 - protein, 9 aa, Homo Sapiens
QEKHPGQAL

SEQ ID NO: 102330 - protein, 9 aa, Homo Sapiens
QEKKVVVYL

SEQ ID NO: 102331 - protein, 9 aa, Homo Sapiens
QEKLFIQKL

SEQ ID NO: 102332 - protein, 9 aa, Homo Sapiens
QEKPLLRAL

SEQ ID NO: 102333 - protein, 9 aa, Homo Sapiens
QEKQIEAKI

SEQ ID NO: 102334 - protein, 9 aa, Homo Sapiens
QELDSRPQL

SEQ ID NO: 102335 - protein, 9 aa, Homo Sapiens
QELENVKTL

SEQ ID NO: 102336 - protein, 9 aa, Homo Sapiens
QELGPRFTL

SEQ ID NO: 102337 - protein, 9 aa, Homo Sapiens
QELLKTEAL

SEQ ID NO: 102338 - protein, 9 aa, Homo Sapiens
QELPIPSKL

SEQ ID NO: 102339 - protein, 9 aa, Homo Sapiens
QELYFFHEL

SEQ ID NO: 102340 - protein, 9 aa, Homo Sapiens
QEMPWNVRM

SEQ ID NO: 102341 - protein, 9 aa, Homo Sapiens
QENAEIIKL

SEQ ID NO: 102342 - protein, 9 aa, Homo Sapiens
QENDRVVMV

SEQ ID NO: 102343 - protein, 9 aa, Homo Sapiens
QENGSLVEI

SEQ ID NO: 102344 - protein, 9 aa, Homo Sapiens
QENSRVIVM

SEQ ID NO: 102345 - protein, 9 aa, Homo Sapiens
QENTQTPTV

SEQ ID NO: 102346 - protein, 9 aa, Homo Sapiens
QENVVKTLL

SEQ ID NO: 102347 - protein, 9 aa, Homo Sapiens
QEQAAKAVL

SEQ ID NO: 102348 - protein, 9 aa, Homo Sapiens
QEQEIEHHL

SEQ ID NO: 102349 - protein, 9 aa, Homo Sapiens
QEQEIEQRL

SEQ ID NO: 102350 - protein, 9 aa, Homo Sapiens
QEQPGTACL

SEQ ID NO: 102351 - protein, 9 aa, Homo Sapiens
QERDVVIRL

SEQ ID NO: 102352 - protein, 9 aa, Homo Sapiens
QESLAQARL

SEQ ID NO: 102353 - protein, 9 aa, Homo Sapiens
QESNVQLKL

SEQ ID NO: 102354 - protein, 9 aa, Homo Sapiens
QESNVRLKL

SEQ ID NO: 102355 - protein, 9 aa, Homo Sapiens
QESRCQPKV

SEQ ID NO: 102356 - protein, 9 aa, Homo Sapiens
QETAVAPSL

SEQ ID NO: 102357 - protein, 9 aa, Homo Sapiens
QETDVRAQI

SEQ ID NO: 102358 - protein, 9 aa, Homo Sapiens
QETEEKILL

SEQ ID NO: 102359 - protein, 9 aa, Homo Sapiens
QETPYLVKL

SEQ ID NO: 102360 - protein, 9 aa, Homo Sapiens
QETSVIHKI

SEQ ID NO: 102361 - protein, 9 aa, Homo Sapiens
QEVEDRPEV

SEQ ID NO: 102362 - protein, 9 aa, Homo Sapiens
QEVENFKKV

SEQ ID NO: 102363 - protein, 9 aa, Homo Sapiens
QEVRDLFQM

SEQ ID NO: 102364 - protein, 9 aa, Homo Sapiens
QEYAQVIKM

SEQ ID NO: 102365 - protein, 9 aa, Homo Sapiens
QEYIDSQKL

SEQ ID NO: 102366 - protein, 9 aa, Homo Sapiens
QEYPDLIHI

SEQ ID NO: 102367 - protein, 9 aa, Homo Sapiens
QEYQAREQL

SEQ ID NO: 102368 - protein, 9 aa, Homo Sapiens
QEYSCVVKM

SEQ ID NO: 102369 - protein, 9 aa, Homo Sapiens
QEYVPSAHL

SEQ ID NO: 102370 - protein, 9 aa, Homo Sapiens
RAESTTPEL

SEQ ID NO: 102371 - protein, 9 aa, Homo Sapiens
RDAIVFVTV

SEQ ID NO: 102372 - protein, 9 aa, Homo Sapiens
RDFEVKDLL

SEQ ID NO: 102373 - protein, 9 aa, Homo Sapiens
RDFLLKPEL

SEQ ID NO: 102374 - protein, 9 aa, Homo Sapiens
RDFQHVEKL

SEQ ID NO: 102375 - protein, 9 aa, Homo Sapiens
RDHAVVVGV

SEQ ID NO: 102376 - protein, 9 aa, Homo Sapiens
RDIKIVKKL

SEQ ID NO: 102377 - protein, 9 aa, Homo Sapiens
RDIPIVHRV

SEQ ID NO: 102378 - protein, 9 aa, Homo Sapiens
RDLEWVERL

SEQ ID NO: 102379 - protein, 9 aa, Homo Sapiens
RDMDIIMKL

SEQ ID NO: 102380 - protein, 9 aa, Homo Sapiens
RDMTMFVTA

SEQ ID NO: 102381 - protein, 9 aa, Homo Sapiens
RDPDINPCL

SEQ ID NO: 102382 - protein, 9 aa, Homo Sapiens
RDTALETAL

SEQ ID NO: 102383 - protein, 9 aa, Homo Sapiens
RDTTLETAL

SEQ ID NO: 102384 - protein, 9 aa, Homo Sapiens
RDVQHIIVF

SEQ ID NO: 102385 - protein, 9 aa, Homo Sapiens
RDWQSGRAL

SEQ ID NO: 102386 - protein, 9 aa, Homo Sapiens
REAEFTKSI

SEQ ID NO: 102387 - protein, 9 aa, Homo Sapiens
REAEKIKTL

SEQ ID NO: 102388 - protein, 9 aa, Homo Sapiens
REAESFTQL

SEQ ID NO: 102389 - protein, 9 aa, Homo Sapiens
REAFPAHKV

SEQ ID NO: 102390 - protein, 9 aa, Homo Sapiens
REAGFQVKA

SEQ ID NO: 102391 - protein, 9 aa, Homo Sapiens
REAPERPSL

SEQ ID NO: 102392 - protein, 9 aa, Homo Sapiens
REAPNPIHL

SEQ ID NO: 102393 - protein, 9 aa, Homo Sapiens
REAQMAAKL

SEQ ID NO: 102394 - protein, 9 aa, Homo Sapiens
REAQVFVRL

SEQ ID NO: 102395 - protein, 9 aa, Homo Sapiens
REARITEKL

SEQ ID NO: 102396 - protein, 9 aa, Homo Sapiens
REAVRPGVL

SEQ ID NO: 102397 - protein, 9 aa, Homo Sapiens
REAVSKTAL

SEQ ID NO: 102398 - protein, 9 aa, Homo Sapiens
RECENQLVL

SEQ ID NO: 102399 - protein, 9 aa, Homo Sapiens
RECKLMKKL

SEQ ID NO: 102400 - protein, 9 aa, Homo Sapiens
RECTIEATA

SEQ ID NO: 102401 - protein, 9 aa, Homo Sapiens
REDEKPLVL

SEQ ID NO: 102402 - protein, 9 aa, Homo Sapiens
REDFCPRKL

SEQ ID NO: 102403 - protein, 9 aa, Homo Sapiens
REDKKLQCL

SEQ ID NO: 102404 - protein, 9 aa, Homo Sapiens
REDKVHLKL

SEQ ID NO: 102405 - protein, 9 aa, Homo Sapiens
REDNQTNRL

SEQ ID NO: 102406 - protein, 9 aa, Homo Sapiens
REDQINRLI

SEQ ID NO: 102407 - protein, 9 aa, Homo Sapiens
REEEKVSAV

SEQ ID NO: 102408 - protein, 9 aa, Homo Sapiens
REEGTPLTL

SEQ ID NO: 102409 - protein, 9 aa, Homo Sapiens
REEKVKAVL

SEQ ID NO: 102410 - protein, 9 aa, Homo Sapiens
REELFIQKL

SEQ ID NO: 102411 - protein, 9 aa, Homo Sapiens
REENKQIAL

SEQ ID NO: 102412 - protein, 9 aa, Homo Sapiens
REEWKFDTL

SEQ ID NO: 102413 - protein, 9 aa, Homo Sapiens
REEWKLDTL

SEQ ID NO: 102414 - protein, 9 aa, Homo Sapiens
REFAVVTDM

SEQ ID NO: 102415 - protein, 9 aa, Homo Sapiens
REFDFFNKI

SEQ ID NO: 102416 - protein, 9 aa, Homo Sapiens
REFEERRSL

SEQ ID NO: 102417 - protein, 9 aa, Homo Sapiens
REFGKALQL

SEQ ID NO: 102418 - protein, 9 aa, Homo Sapiens
REFGNLTRM

SEQ ID NO: 102419 - protein, 9 aa, Homo Sapiens
REFHNKLKL

SEQ ID NO: 102420 - protein, 9 aa, Homo Sapiens
REFIAPVTL

SEQ ID NO: 102421 - protein, 9 aa, Homo Sapiens
REFNEEGAL

SEQ ID NO: 102422 - protein, 9 aa, Homo Sapiens
REFQKTEDM

SEQ ID NO: 102423 - protein, 9 aa, Homo Sapiens
REFQNPPQL

SEQ ID NO: 102424 - protein, 9 aa, Homo Sapiens
REFQVIQDL

SEQ ID NO: 102425 - protein, 9 aa, Homo Sapiens
REFVEREVI

SEQ ID NO: 102426 - protein, 9 aa, Homo Sapiens
REFVRQYYT

SEQ ID NO: 102427 - protein, 9 aa, Homo Sapiens
REFWAKPKP

SEQ ID NO: 102428 - protein, 9 aa, Homo Sapiens
REGDLLFTV

SEQ ID NO: 102429 - protein, 9 aa, Homo Sapiens
REGDLTNLL

SEQ ID NO: 102430 - protein, 9 aa, Homo Sapiens
REGDVITII

SEQ ID NO: 102431 - protein, 9 aa, Homo Sapiens
REGEGGLSL

SEQ ID NO: 102432 - protein, 9 aa, Homo Sapiens
REGEIAQFL

SEQ ID NO: 102433 - protein, 9 aa, Homo Sapiens
REGEYSKVL

SEQ ID NO: 102434 - protein, 9 aa, Homo Sapiens
REGFFTNGL

SEQ ID NO: 102435 - protein, 9 aa, Homo Sapiens
REGKLEHTL

SEQ ID NO: 102436 - protein, 9 aa, Homo Sapiens
REGLLFTAL

SEQ ID NO: 102437 - protein, 9 aa, Homo Sapiens
REGPGGLVM

SEQ ID NO: 102438 - protein, 9 aa, Homo Sapiens
REGSFKETI

SEQ ID NO: 102439 - protein, 9 aa, Homo Sapiens
REHDIAIKF

SEQ ID NO: 102440 - protein, 9 aa, Homo Sapiens
REHEEYLKL

SEQ ID NO: 102441 - protein, 9 aa, Homo Sapiens
REHEPPGAL

SEQ ID NO: 102442 - protein, 9 aa, Homo Sapiens
REHIKVQQL

SEQ ID NO: 102443 - protein, 9 aa, Homo Sapiens
REHTALLKI

SEQ ID NO: 102444 - protein, 9 aa, Homo Sapiens
REHVEAIKI

SEQ ID NO: 102445 - protein, 9 aa, Homo Sapiens
REIAGKMDL

SEQ ID NO: 102446 - protein, 9 aa, Homo Sapiens
REIAQDFKT

SEQ ID NO: 102447 - protein, 9 aa, Homo Sapiens
REIEELHKL

SEQ ID NO: 102448 - protein, 9 aa, Homo Sapiens
REIEGDLLL

SEQ ID NO: 102449 - protein, 9 aa, Homo Sapiens
REIEIQAHL

SEQ ID NO: 102450 - protein, 9 aa, Homo Sapiens
REIENGNSF

SEQ ID NO: 102451 - protein, 9 aa, Homo Sapiens
REIENIEKT

SEQ ID NO: 102452 - protein, 9 aa, Homo Sapiens
REIFKPRQL

SEQ ID NO: 102453 - protein, 9 aa, Homo Sapiens
REIFRNEKL

SEQ ID NO: 102454 - protein, 9 aa, Homo Sapiens
REIIQKLML

SEQ ID NO: 102455 - protein, 9 aa, Homo Sapiens
REINGMTGL

SEQ ID NO: 102456 - protein, 9 aa, Homo Sapiens
REIPIVHRV

SEQ ID NO: 102457 - protein, 9 aa, Homo Sapiens
REIQEAIAV

SEQ ID NO: 102458 - protein, 9 aa, Homo Sapiens
REIQKVTKL

SEQ ID NO: 102459 - protein, 9 aa, Homo Sapiens
REIQTAVRL

SEQ ID NO: 102460 - protein, 9 aa, Homo Sapiens
REIRKELKI

SEQ ID NO: 102461 - protein, 9 aa, Homo Sapiens
REIVTSEGL

SEQ ID NO: 102462 - protein, 9 aa, Homo Sapiens
REKAEIIRF

SEQ ID NO: 102463 - protein, 9 aa, Homo Sapiens
REKASKTFL

SEQ ID NO: 102464 - protein, 9 aa, Homo Sapiens
REKDVERFF

SEQ ID NO: 102465 - protein, 9 aa, Homo Sapiens
REKEDLVDL

SEQ ID NO: 102466 - protein, 9 aa, Homo Sapiens
REKEIKSEL

SEQ ID NO: 102467 - protein, 9 aa, Homo Sapiens
REKELEARV

SEQ ID NO: 102468 - protein, 9 aa, Homo Sapiens
REKENVTVL

SEQ ID NO: 102469 - protein, 9 aa, Homo Sapiens
REKEPDLKL

SEQ ID NO: 102470 - protein, 9 aa, Homo Sapiens
REKEQFRKL

SEQ ID NO: 102471 - protein, 9 aa, Homo Sapiens
REKFPHVKL

SEQ ID NO: 102472 - protein, 9 aa, Homo Sapiens
REKFYEAKL

SEQ ID NO: 102473 - protein, 9 aa, Homo Sapiens
REKIDQERL

SEQ ID NO: 102474 - protein, 9 aa, Homo Sapiens
REKITAQSI

SEQ ID NO: 102475 - protein, 9 aa, Homo Sapiens
REKIVEVMF

SEQ ID NO: 102476 - protein, 9 aa, Homo Sapiens
REKIYNRSL

SEQ ID NO: 102477 - protein, 9 aa, Homo Sapiens
REKKPEELI

SEQ ID NO: 102478 - protein, 9 aa, Homo Sapiens
REKLKHPVM

SEQ ID NO: 102479 - protein, 9 aa, Homo Sapiens
REKLPPSKL

SEQ ID NO: 102480 - protein, 9 aa, Homo Sapiens
REKLQEEML

SEQ ID NO: 102481 - protein, 9 aa, Homo Sapiens
REKLQQKEL

SEQ ID NO: 102482 - protein, 9 aa, Homo Sapiens
REKMTQIMF

SEQ ID NO: 102483 - protein, 9 aa, Homo Sapiens
REKQSKFIL

SEQ ID NO: 102484 - protein, 9 aa, Homo Sapiens
REKSEKFAF

SEQ ID NO: 102485 - protein, 9 aa, Homo Sapiens
REKYGDKML

SEQ ID NO: 102486 - protein, 9 aa, Homo Sapiens
RELAKAEKL

SEQ ID NO: 102487 - protein, 9 aa, Homo Sapiens
RELDIYNNL

SEQ ID NO: 102488 - protein, 9 aa, Homo Sapiens
RELDKIKGL

SEQ ID NO: 102489 - protein, 9 aa, Homo Sapiens
RELDQKTWL

SEQ ID NO: 102490 - protein, 9 aa, Homo Sapiens
RELECIREI

SEQ ID NO: 102491 - protein, 9 aa, Homo Sapiens
RELEKLFQL

SEQ ID NO: 102492 - protein, 9 aa, Homo Sapiens
RELEVQHPA

SEQ ID NO: 102493 - protein, 9 aa, Homo Sapiens
RELGFSSNL

SEQ ID NO: 102494 - protein, 9 aa, Homo Sapiens
RELIPRSIL

SEQ ID NO: 102495 - protein, 9 aa, Homo Sapiens
RELLPVKKF

SEQ ID NO: 102496 - protein, 9 aa, Homo Sapiens
RELQGETKL

SEQ ID NO: 102497 - protein, 9 aa, Homo Sapiens
RELTHLSEM

SEQ ID NO: 102498 - protein, 9 aa, Homo Sapiens
RELVAIKKV

SEQ ID NO: 102499 - protein, 9 aa, Homo Sapiens
RELVKNWVP

SEQ ID NO: 102500 - protein, 9 aa, Homo Sapiens
RELYANVVL

SEQ ID NO: 102501 - protein, 9 aa, Homo Sapiens
REMDEQIRL

SEQ ID NO: 102502 - protein, 9 aa, Homo Sapiens
REMENYEKI

SEQ ID NO: 102503 - protein, 9 aa, Homo Sapiens
REMEVKCKP

SEQ ID NO: 102504 - protein, 9 aa, Homo Sapiens
REMIPFAVV

SEQ ID NO: 102505 - protein, 9 aa, Homo Sapiens
REMLIRVNM

SEQ ID NO: 102506 - protein, 9 aa, Homo Sapiens
REMLQQSKI

SEQ ID NO: 102507 - protein, 9 aa, Homo Sapiens
REMPVKVEA

SEQ ID NO: 102508 - protein, 9 aa, Homo Sapiens
RENDCIVRI

SEQ ID NO: 102509 - protein, 9 aa, Homo Sapiens
RENDIKSYF

SEQ ID NO: 102510 - protein, 9 aa, Homo Sapiens
RENEQKRIL

SEQ ID NO: 102511 - protein, 9 aa, Homo Sapiens
RENIATHHL

SEQ ID NO: 102512 - protein, 9 aa, Homo Sapiens
RENKTAVVV

SEQ ID NO: 102513 - protein, 9 aa, Homo Sapiens
RENVNLAQI

SEQ ID NO: 102514 - protein, 9 aa, Homo Sapiens
REPDQTFSL

SEQ ID NO: 102515 - protein, 9 aa, Homo Sapiens
REPKLFRAV

SEQ ID NO: 102516 - protein, 9 aa, Homo Sapiens
REPLVRQVL

SEQ ID NO: 102517 - protein, 9 aa, Homo Sapiens
REPNVLICF

SEQ ID NO: 102518 - protein, 9 aa, Homo Sapiens
REPRPFPKL

SEQ ID NO: 102519 - protein, 9 aa, Homo Sapiens
REPVQLETL

SEQ ID NO: 102520 - protein, 9 aa, Homo Sapiens
REQGAIPRL

SEQ ID NO: 102521 - protein, 9 aa, Homo Sapiens
RERDFLKKV

SEQ ID NO: 102522 - protein, 9 aa, Homo Sapiens
REREEFYRL

SEQ ID NO: 102523 - protein, 9 aa, Homo Sapiens
RERESVLRL

SEQ ID NO: 102524 - protein, 9 aa, Homo Sapiens
REREVEERL

SEQ ID NO: 102525 - protein, 9 aa, Homo Sapiens
RERIIPRSV

SEQ ID NO: 102526 - protein, 9 aa, Homo Sapiens
RERIVPRAV

SEQ ID NO: 102527 - protein, 9 aa, Homo Sapiens
RERVTVAKL

SEQ ID NO: 102528 - protein, 9 aa, Homo Sapiens
RESERQLRL

SEQ ID NO: 102529 - protein, 9 aa, Homo Sapiens
RESIKLVSI

SEQ ID NO: 102530 - protein, 9 aa, Homo Sapiens
RESLPIYKL

SEQ ID NO: 102531 - protein, 9 aa, Homo Sapiens
RESPCHVKL

SEQ ID NO: 102532 - protein, 9 aa, Homo Sapiens
RESPRPLQL

SEQ ID NO: 102533 - protein, 9 aa, Homo Sapiens
RESTKISSL

SEQ ID NO: 102534 - protein, 9 aa, Homo Sapiens
RETDDTLVL

SEQ ID NO: 102535 - protein, 9 aa, Homo Sapiens
RETEHCVSL

SEQ ID NO: 102536 - protein, 9 aa, Homo Sapiens
RETGVIEKL

SEQ ID NO: 102537 - protein, 9 aa, Homo Sapiens
RETGYPLAV

SEQ ID NO: 102538 - protein, 9 aa, Homo Sapiens
RETHEIVAL

SEQ ID NO: 102539 - protein, 9 aa, Homo Sapiens
RETIIMNQI

SEQ ID NO: 102540 - protein, 9 aa, Homo Sapiens
RETLQQHKL

SEQ ID NO: 102541 - protein, 9 aa, Homo Sapiens
RETPPKSKL

SEQ ID NO: 102542 - protein, 9 aa, Homo Sapiens
RETSEKFKL

SEQ ID NO: 102543 - protein, 9 aa, Homo Sapiens
RETSHVTMV

SEQ ID NO: 102544 - protein, 9 aa, Homo Sapiens
RETSQTKVL

SEQ ID NO: 102545 - protein, 9 aa, Homo Sapiens
RETVIKQTM

SEQ ID NO: 102546 - protein, 9 aa, Homo Sapiens
REVALLRRL

SEQ ID NO: 102547 - protein, 9 aa, Homo Sapiens
REVDEQHQL

SEQ ID NO: 102548 - protein, 9 aa, Homo Sapiens
REVDPNEQL

SEQ ID NO: 102549 - protein, 9 aa, Homo Sapiens
REVDQVKRL

SEQ ID NO: 102550 - protein, 9 aa, Homo Sapiens
REVEIQSHL

SEQ ID NO: 102551 - protein, 9 aa, Homo Sapiens
REVIQSDSL

SEQ ID NO: 102552 - protein, 9 aa, Homo Sapiens
REVLKSKEL

SEQ ID NO: 102553 - protein, 9 aa, Homo Sapiens
REVLPSTRL

SEQ ID NO: 102554 - protein, 9 aa, Homo Sapiens
REVLRLTKL

SEQ ID NO: 102555 - protein, 9 aa, Homo Sapiens
REVNYIDKI

SEQ ID NO: 102556 - protein, 9 aa, Homo Sapiens
REVRQKVQL

SEQ ID NO: 102557 - protein, 9 aa, Homo Sapiens
REVSEEHNL

SEQ ID NO: 102558 - protein, 9 aa, Homo Sapiens
REVVFVEDV

SEQ ID NO: 102559 - protein, 9 aa, Homo Sapiens
REVVNKDVL

SEQ ID NO: 102560 - protein, 9 aa, Homo Sapiens
REVYLQDSF

SEQ ID NO: 102561 - protein, 9 aa, Homo Sapiens
REWAIKKHL

SEQ ID NO: 102562 - protein, 9 aa, Homo Sapiens
REWKGIDRL

SEQ ID NO: 102563 - protein, 9 aa, Homo Sapiens
REWTEQETL

SEQ ID NO: 102564 - protein, 9 aa, Homo Sapiens
REWTGIDRL

SEQ ID NO: 102565 - protein, 9 aa, Homo Sapiens
REWVAPEKA

SEQ ID NO: 102566 - protein, 9 aa, Homo Sapiens
REYDVPYHI

SEQ ID NO: 102567 - protein, 9 aa, Homo Sapiens
REYEPDHNL

SEQ ID NO: 102568 - protein, 9 aa, Homo Sapiens
REYHTDTTV

SEQ ID NO: 102569 - protein, 9 aa, Homo Sapiens
REYQDLLNV

SEQ ID NO: 102570 - protein, 9 aa, Homo Sapiens
RMFGGPGTA

SEQ ID NO: 102571 - protein, 9 aa, Homo Sapiens
RQADFVQVL

SEQ ID NO: 102572 - protein, 9 aa, Homo Sapiens
RQAPPHIEL

SEQ ID NO: 102573 - protein, 9 aa, Homo Sapiens
RQIEEQKAL

SEQ ID NO: 102574 - protein, 9 aa, Homo Sapiens
RQNKLTYTM

SEQ ID NO: 102575 - protein, 9 aa, Homo Sapiens
SDFLTPKAI

SEQ ID NO: 102576 - protein, 9 aa, Homo Sapiens
SDFRMEESF

SEQ ID NO: 102577 - protein, 9 aa, Homo Sapiens
SDIIDPVAL

SEQ ID NO: 102578 - protein, 9 aa, Homo Sapiens
SDIPIHNAL

SEQ ID NO: 102579 - protein, 9 aa, Homo Sapiens
SDVAYHNSL

SEQ ID NO: 102580 - protein, 9 aa, Homo Sapiens
SDVEIPATV

SEQ ID NO: 102581 - protein, 9 aa, Homo Sapiens
SDVEVPASV

SEQ ID NO: 102582 - protein, 9 aa, Homo Sapiens
SDVVQPAAV

SEQ ID NO: 102583 - protein, 9 aa, Homo Sapiens
SDWSLPATA

SEQ ID NO: 102584 - protein, 9 aa, Homo Sapiens
SEADKIKVA

SEQ ID NO: 102585 - protein, 9 aa, Homo Sapiens
SEAEKVYIV

SEQ ID NO: 102586 - protein, 9 aa, Homo Sapiens
SEAERVSEL

SEQ ID NO: 102587 - protein, 9 aa, Homo Sapiens
SEAFVIKGL

SEQ ID NO: 102588 - protein, 9 aa, Homo Sapiens
SEAGQPQAL

SEQ ID NO: 102589 - protein, 9 aa, Homo Sapiens
SEAGSRIVL

SEQ ID NO: 102590 - protein, 9 aa, Homo Sapiens
SEAKGLVTL

SEQ ID NO: 102591 - protein, 9 aa, Homo Sapiens
SEALGFEHM

SEQ ID NO: 102592 - protein, 9 aa, Homo Sapiens
SEALHAQSL

SEQ ID NO: 102593 - protein, 9 aa, Homo Sapiens
SEAMGLFCL

SEQ ID NO: 102594 - protein, 9 aa, Homo Sapiens
SEAPATVEL

SEQ ID NO: 102595 - protein, 9 aa, Homo Sapiens
SEAPEAPLL

SEQ ID NO: 102596 - protein, 9 aa, Homo Sapiens
SEAPFLHYL

SEQ ID NO: 102597 - protein, 9 aa, Homo Sapiens
SEAPGQRAL

SEQ ID NO: 102598 - protein, 9 aa, Homo Sapiens
SEAPKPASL

SEQ ID NO: 102599 - protein, 9 aa, Homo Sapiens
SEAPPSKMV

SEQ ID NO: 102600 - protein, 9 aa, Homo Sapiens
SEAPSQPSL

SEQ ID NO: 102601 - protein, 9 aa, Homo Sapiens
SEASGFCYV

SEQ ID NO: 102602 - protein, 9 aa, Homo Sapiens
SEAVFKEEL

SEQ ID NO: 102603 - protein, 9 aa, Homo Sapiens
SECDILHTL

SEQ ID NO: 102604 - protein, 9 aa, Homo Sapiens
SECGKAFSI

SEQ ID NO: 102605 - protein, 9 aa, Homo Sapiens
SECGKLFSF

SEQ ID NO: 102606 - protein, 9 aa, Homo Sapiens
SECGKTFTV

SEQ ID NO: 102607 - protein, 9 aa, Homo Sapiens
SECKSRDVL

SEQ ID NO: 102608 - protein, 9 aa, Homo Sapiens
SEDAEKKVL

SEQ ID NO: 102609 - protein, 9 aa, Homo Sapiens
SEDDVKMAL

SEQ ID NO: 102610 - protein, 9 aa, Homo Sapiens
SEDEPTRSL

SEQ ID NO: 102611 - protein, 9 aa, Homo Sapiens
SEDEVKLAL

SEQ ID NO: 102612 - protein, 9 aa, Homo Sapiens
SEDFPRPLV

SEQ ID NO: 102613 - protein, 9 aa, Homo Sapiens
SEDLNKHVL

SEQ ID NO: 102614 - protein, 9 aa, Homo Sapiens
SEDPSHPSM

SEQ ID NO: 102615 - protein, 9 aa, Homo Sapiens
SEEDFIRSL

SEQ ID NO: 102616 - protein, 9 aa, Homo Sapiens
SEEEVKLAL

SEQ ID NO: 102617 - protein, 9 aa, Homo Sapiens
SEEGGHVAV

SEQ ID NO: 102618 - protein, 9 aa, Homo Sapiens
SEEGLRNAL

SEQ ID NO: 102619 - protein, 9 aa, Homo Sapiens
SEEKPVPAA

SEQ ID NO: 102620 - protein, 9 aa, Homo Sapiens
SEERAGAPL

SEQ ID NO: 102621 - protein, 9 aa, Homo Sapiens
SEERFRPSL

SEQ ID NO: 102622 - protein, 9 aa, Homo Sapiens
SEEVVSREV

SEQ ID NO: 102623 - protein, 9 aa, Homo Sapiens
SEFAKDPSL

SEQ ID NO: 102624 - protein, 9 aa, Homo Sapiens
SEFDDEPKF

SEQ ID NO: 102625 - protein, 9 aa, Homo Sapiens
SEFEGHKRI

SEQ ID NO: 102626 - protein, 9 aa, Homo Sapiens
SEFGAPVSV

SEQ ID NO: 102627 - protein, 9 aa, Homo Sapiens
SEFICRNTF

SEQ ID NO: 102628 - protein, 9 aa, Homo Sapiens
SEFIKEKSA

SEQ ID NO: 102629 - protein, 9 aa, Homo Sapiens
SEFKAMDSI

SEQ ID NO: 102630 - protein, 9 aa, Homo Sapiens
SEFLKEEKL

SEQ ID NO: 102631 - protein, 9 aa, Homo Sapiens
SEFQERHEV

SEQ ID NO: 102632 - protein, 9 aa, Homo Sapiens
SEFQKAVKL

SEQ ID NO: 102633 - protein, 9 aa, Homo Sapiens
SEFRAFSSF

SEQ ID NO: 102634 - protein, 9 aa, Homo Sapiens
SEFYEPEAL

SEQ ID NO: 102635 - protein, 9 aa, Homo Sapiens
SEFYKHIVL

SEQ ID NO: 102636 - protein, 9 aa, Homo Sapiens
SEGHNTPKL

SEQ ID NO: 102637 - protein, 9 aa, Homo Sapiens
SEGKCFSVL

SEQ ID NO: 102638 - protein, 9 aa, Homo Sapiens
SEGLPEPVL

SEQ ID NO: 102639 - protein, 9 aa, Homo Sapiens
SEGNITKQL

SEQ ID NO: 102640 - protein, 9 aa, Homo Sapiens
SEGPHHVAL

SEQ ID NO: 102641 - protein, 9 aa, Homo Sapiens
SEGPIVATL

SEQ ID NO: 102642 - protein, 9 aa, Homo Sapiens
SEGPKVVSV

SEQ ID NO: 102643 - protein, 9 aa, Homo Sapiens
SEGPLVGSV

SEQ ID NO: 102644 - protein, 9 aa, Homo Sapiens
SEGPPAPAL

SEQ ID NO: 102645 - protein, 9 aa, Homo Sapiens
SEGPPLTSF

SEQ ID NO: 102646 - protein, 9 aa, Homo Sapiens
SEGPQRPPL

SEQ ID NO: 102647 - protein, 9 aa, Homo Sapiens
SEGPSRPVL

SEQ ID NO: 102648 - protein, 9 aa, Homo Sapiens
SEGRPVGPA

SEQ ID NO: 102649 - protein, 9 aa, Homo Sapiens
SEGTFGIHV

SEQ ID NO: 102650 - protein, 9 aa, Homo Sapiens
SEGTPVNKL

SEQ ID NO: 102651 - protein, 9 aa, Homo Sapiens
SEGVQVPSV

SEQ ID NO: 102652 - protein, 9 aa, Homo Sapiens
SEGVRVNVV

SEQ ID NO: 102653 - protein, 9 aa, Homo Sapiens
SEGVVAVLL

SEQ ID NO: 102654 - protein, 9 aa, Homo Sapiens
SEHAVNKQL

SEQ ID NO: 102655 - protein, 9 aa, Homo Sapiens
SEHGINIDL

SEQ ID NO: 102656 - protein, 9 aa, Homo Sapiens
SEHGLVVIA

SEQ ID NO: 102657 - protein, 9 aa, Homo Sapiens
SEHGVGIYV

SEQ ID NO: 102658 - protein, 9 aa, Homo Sapiens
SEHGVPTSV

SEQ ID NO: 102659 - protein, 9 aa, Homo Sapiens
SEHLPLSKL

SEQ ID NO: 102660 - protein, 9 aa, Homo Sapiens
SEHPFVNGV

SEQ ID NO: 102661 - protein, 9 aa, Homo Sapiens
SEHRLSNKL

SEQ ID NO: 102662 - protein, 9 aa, Homo Sapiens
SEHSKVRLV

SEQ ID NO: 102663 - protein, 9 aa, Homo Sapiens
SEHSMDTLL

SEQ ID NO: 102664 - protein, 9 aa, Homo Sapiens
SEHSSINVL

SEQ ID NO: 102665 - protein, 9 aa, Homo Sapiens
SEHVKLEQL

SEQ ID NO: 102666 - protein, 9 aa, Homo Sapiens
SEHVMPYAA

SEQ ID NO: 102667 - protein, 9 aa, Homo Sapiens
SEIDMSVKA

SEQ ID NO: 102668 - protein, 9 aa, Homo Sapiens
SEIDQINKV

SEQ ID NO: 102669 - protein, 9 aa, Homo Sapiens
SEIDQLFRI

SEQ ID NO: 102670 - protein, 9 aa, Homo Sapiens
SEIEDVNTL

SEQ ID NO: 102671 - protein, 9 aa, Homo Sapiens
SEIEIKKEM

SEQ ID NO: 102672 - protein, 9 aa, Homo Sapiens
SEIENVHGF

SEQ ID NO: 102673 - protein, 9 aa, Homo Sapiens
SEIERQAQV

SEQ ID NO: 102674 - protein, 9 aa, Homo Sapiens
SEIGKNYSM

SEQ ID NO: 102675 - protein, 9 aa, Homo Sapiens
SEIGQKQKL

SEQ ID NO: 102676 - protein, 9 aa, Homo Sapiens
SEIHFKVKM

SEQ ID NO: 102677 - protein, 9 aa, Homo Sapiens
SEIHSGNSV

SEQ ID NO: 102678 - protein, 9 aa, Homo Sapiens
SEIIKPCSV

SEQ ID NO: 102679 - protein, 9 aa, Homo Sapiens
SEIKGVCSV

SEQ ID NO: 102680 - protein, 9 aa, Homo Sapiens
SEIKQINHL

SEQ ID NO: 102681 - protein, 9 aa, Homo Sapiens
SEIKRVMQM

SEQ ID NO: 102682 - protein, 9 aa, Homo Sapiens
SEIKSIPGV

SEQ ID NO: 102683 - protein, 9 aa, Homo Sapiens
SEILDGNQL

SEQ ID NO: 102684 - protein, 9 aa, Homo Sapiens
SEILPTKET

SEQ ID NO: 102685 - protein, 9 aa, Homo Sapiens
SEINSLPTI

SEQ ID NO: 102686 - protein, 9 aa, Homo Sapiens
SEIPKLPAV

SEQ ID NO: 102687 - protein, 9 aa, Homo Sapiens
SEIPQTERM

SEQ ID NO: 102688 - protein, 9 aa, Homo Sapiens
SEIQNVLGV

SEQ ID NO: 102689 - protein, 9 aa, Homo Sapiens
SEIQVLEHL

SEQ ID NO: 102690 - protein, 9 aa, Homo Sapiens
SEIRHLLTL

SEQ ID NO: 102691 - protein, 9 aa, Homo Sapiens
SEISSATKL

SEQ ID NO: 102692 - protein, 9 aa, Homo Sapiens
SEIVGSIKM

SEQ ID NO: 102693 - protein, 9 aa, Homo Sapiens
SEIVKQSVF

SEQ ID NO: 102694 - protein, 9 aa, Homo Sapiens
SEKDHMVTM

SEQ ID NO: 102695 - protein, 9 aa, Homo Sapiens
SEKDIGNQL

SEQ ID NO: 102696 - protein, 9 aa, Homo Sapiens
SEKDSVVSL

SEQ ID NO: 102697 - protein, 9 aa, Homo Sapiens
SEKDTKQIL

SEQ ID NO: 102698 - protein, 9 aa, Homo Sapiens
SEKDVQTAL

SEQ ID NO: 102699 - protein, 9 aa, Homo Sapiens
SEKEATPVV

SEQ ID NO: 102700 - protein, 9 aa, Homo Sapiens
SEKEEEARL

SEQ ID NO: 102701 - protein, 9 aa, Homo Sapiens
SEKFIKAAI

SEQ ID NO: 102702 - protein, 9 aa, Homo Sapiens
SEKGQVEVF

SEQ ID NO: 102703 - protein, 9 aa, Homo Sapiens
SEKHIEVEV

SEQ ID NO: 102704 - protein, 9 aa, Homo Sapiens
SEKILLLCV

SEQ ID NO: 102705 - protein, 9 aa, Homo Sapiens
SEKISNTAI

SEQ ID NO: 102706 - protein, 9 aa, Homo Sapiens
SEKKDPPQL

SEQ ID NO: 102707 - protein, 9 aa, Homo Sapiens
SEKKIFIGL

SEQ ID NO: 102708 - protein, 9 aa, Homo Sapiens
SEKNLKALL

SEQ ID NO: 102709 - protein, 9 aa, Homo Sapiens
SEKNMISKL

SEQ ID NO: 102710 - protein, 9 aa, Homo Sapiens
SEKNPVTLL

SEQ ID NO: 102711 - protein, 9 aa, Homo Sapiens
SEKPAGADL

SEQ ID NO: 102712 - protein, 9 aa, Homo Sapiens
SEKPETEAV

SEQ ID NO: 102713 - protein, 9 aa, Homo Sapiens
SEKPLSERL

SEQ ID NO: 102714 - protein, 9 aa, Homo Sapiens
SEKPTVQQL

SEQ ID NO: 102715 - protein, 9 aa, Homo Sapiens
SEKPTVTTV

SEQ ID NO: 102716 - protein, 9 aa, Homo Sapiens
SEKPYILEA

SEQ ID NO: 102717 - protein, 9 aa, Homo Sapiens
SEKSINSIL

SEQ ID NO: 102718 - protein, 9 aa, Homo Sapiens
SEKSTEQIL

SEQ ID NO: 102719 - protein, 9 aa, Homo Sapiens
SEKVAHNIL

SEQ ID NO: 102720 - protein, 9 aa, Homo Sapiens
SEKVDRAVL

SEQ ID NO: 102721 - protein, 9 aa, Homo Sapiens
SEKVHVNLL

SEQ ID NO: 102722 - protein, 9 aa, Homo Sapiens
SELAKERVV

SEQ ID NO: 102723 - protein, 9 aa, Homo Sapiens
SELDLISRL

SEQ ID NO: 102724 - protein, 9 aa, Homo Sapiens
SELEAARML

SEQ ID NO: 102725 - protein, 9 aa, Homo Sapiens
SELEKPQKV

SEQ ID NO: 102726 - protein, 9 aa, Homo Sapiens
SELEKTFNL

SEQ ID NO: 102727 - protein, 9 aa, Homo Sapiens
SELERPHKV

SEQ ID NO: 102728 - protein, 9 aa, Homo Sapiens
SELFDNKSL

SEQ ID NO: 102729 - protein, 9 aa, Homo Sapiens
SELGGIWSV

SEQ ID NO: 102730 - protein, 9 aa, Homo Sapiens
SELGKICSV

SEQ ID NO: 102731 - protein, 9 aa, Homo Sapiens
SELGPIVQF

SEQ ID NO: 102732 - protein, 9 aa, Homo Sapiens
SELIQVHKL

SEQ ID NO: 102733 - protein, 9 aa, Homo Sapiens
SELIRNVTL

SEQ ID NO: 102734 - protein, 9 aa, Homo Sapiens
SELITKAVA

SEQ ID NO: 102735 - protein, 9 aa, Homo Sapiens
SELITPHAI

SEQ ID NO: 102736 - protein, 9 aa, Homo Sapiens
SELKKEVTL

SEQ ID NO: 102737 - protein, 9 aa, Homo Sapiens
SELKKVVAL

SEQ ID NO: 102738 - protein, 9 aa, Homo Sapiens
SELLKRTAL

SEQ ID NO: 102739 - protein, 9 aa, Homo Sapiens
SELMDITKL

SEQ ID NO: 102740 - protein, 9 aa, Homo Sapiens
SELNGHHTL

SEQ ID NO: 102741 - protein, 9 aa, Homo Sapiens
SELPEQVQV

SEQ ID NO: 102742 - protein, 9 aa, Homo Sapiens
SELPGAFEA

SEQ ID NO: 102743 - protein, 9 aa, Homo Sapiens
SELPIVTPA

SEQ ID NO: 102744 - protein, 9 aa, Homo Sapiens
SELQAPPLM

SEQ ID NO: 102745 - protein, 9 aa, Homo Sapiens
SELQKIHKA

SEQ ID NO: 102746 - protein, 9 aa, Homo Sapiens
SELQLPFQA

SEQ ID NO: 102747 - protein, 9 aa, Homo Sapiens
SELQVHSAL

SEQ ID NO: 102748 - protein, 9 aa, Homo Sapiens
SELRSVEGL

SEQ ID NO: 102749 - protein, 9 aa, Homo Sapiens
SELVQKAKL

SEQ ID NO: 102750 - protein, 9 aa, Homo Sapiens
SELYLPSST

SEQ ID NO: 102751 - protein, 9 aa, Homo Sapiens
SEMAGPPQM

SEQ ID NO: 102752 - protein, 9 aa, Homo Sapiens
SEMDRVPFV

SEQ ID NO: 102753 - protein, 9 aa, Homo Sapiens
SEMFPKTSV

SEQ ID NO: 102754 - protein, 9 aa, Homo Sapiens
SEMPAAKRL

SEQ ID NO: 102755 - protein, 9 aa, Homo Sapiens
SEMRAPPAA

SEQ ID NO: 102756 - protein, 9 aa, Homo Sapiens
SEMRAVIKA

SEQ ID NO: 102757 - protein, 9 aa, Homo Sapiens
SEMRFVQDL

SEQ ID NO: 102758 - protein, 9 aa, Homo Sapiens
SEMSRVIRV

SEQ ID NO: 102759 - protein, 9 aa, Homo Sapiens
SEMTQVKEV

SEQ ID NO: 102760 - protein, 9 aa, Homo Sapiens
SEMVKLYDL

SEQ ID NO: 102761 - protein, 9 aa, Homo Sapiens
SENAIVWKI

SEQ ID NO: 102762 - protein, 9 aa, Homo Sapiens
SENASVPSL

SEQ ID NO: 102763 - protein, 9 aa, Homo Sapiens
SENEEFVEV

SEQ ID NO: 102764 - protein, 9 aa, Homo Sapiens
SENKLPAEL

SEQ ID NO: 102765 - protein, 9 aa, Homo Sapiens
SENNRIFTL

SEQ ID NO: 102766 - protein, 9 aa, Homo Sapiens
SENPERPFL

SEQ ID NO: 102767 - protein, 9 aa, Homo Sapiens
SENPVPLTV

SEQ ID NO: 102768 - protein, 9 aa, Homo Sapiens
SENQPFPSL

SEQ ID NO: 102769 - protein, 9 aa, Homo Sapiens
SENRDLKTV

SEQ ID NO: 102770 - protein, 9 aa, Homo Sapiens
SENSQPAHL

SEQ ID NO: 102771 - protein, 9 aa, Homo Sapiens
SENVLQVHL

SEQ ID NO: 102772 - protein, 9 aa, Homo Sapiens
SEPACAHAL

SEQ ID NO: 102773 - protein, 9 aa, Homo Sapiens
SEPDFVAKF

SEQ ID NO: 102774 - protein, 9 aa, Homo Sapiens
SEPHILETL

SEQ ID NO: 102775 - protein, 9 aa, Homo Sapiens
SEPRISESL

SEQ ID NO: 102776 - protein, 9 aa, Homo Sapiens
SEPVTPASL

SEQ ID NO: 102777 - protein, 9 aa, Homo Sapiens
SEQEHFLIV

SEQ ID NO: 102778 - protein, 9 aa, Homo Sapiens
SEQGLAKAV

SEQ ID NO: 102779 - protein, 9 aa, Homo Sapiens
SEQKFLIGL

SEQ ID NO: 102780 - protein, 9 aa, Homo Sapiens
SEQSLGQKL

SEQ ID NO: 102781 - protein, 9 aa, Homo Sapiens
SERALPWQL

SEQ ID NO: 102782 - protein, 9 aa, Homo Sapiens
SERELFNAV

SEQ ID NO: 102783 - protein, 9 aa, Homo Sapiens
SEREMRNTL

SEQ ID NO: 102784 - protein, 9 aa, Homo Sapiens
SERPKEIKV

SEQ ID NO: 102785 - protein, 9 aa, Homo Sapiens
SERPLPRAA

SEQ ID NO: 102786 - protein, 9 aa, Homo Sapiens
SERVTIEHA

SEQ ID NO: 102787 - protein, 9 aa, Homo Sapiens
SERVVQEAL

SEQ ID NO: 102788 - protein, 9 aa, Homo Sapiens
SESAQSKML

SEQ ID NO: 102789 - protein, 9 aa, Homo Sapiens
SESASPSAL

SEQ ID NO: 102790 - protein, 9 aa, Homo Sapiens
SESDKTAVL

SEQ ID NO: 102791 - protein, 9 aa, Homo Sapiens
SESEKQWKA

SEQ ID NO: 102792 - protein, 9 aa, Homo Sapiens
SESHRFTVL

SEQ ID NO: 102793 - protein, 9 aa, Homo Sapiens
SESIPKDSL

SEQ ID NO: 102794 - protein, 9 aa, Homo Sapiens
SESKIRVLL

SEQ ID NO: 102795 - protein, 9 aa, Homo Sapiens
SESLPVRTL

SEQ ID NO: 102796 - protein, 9 aa, Homo Sapiens
SESPIVVVL

SEQ ID NO: 102797 - protein, 9 aa, Homo Sapiens
SESPRPCSL

SEQ ID NO: 102798 - protein, 9 aa, Homo Sapiens
SESPRSTSL

SEQ ID NO: 102799 - protein, 9 aa, Homo Sapiens
SESPVITKA

SEQ ID NO: 102800 - protein, 9 aa, Homo Sapiens
SESQKIPGM

SEQ ID NO: 102801 - protein, 9 aa, Homo Sapiens
SESRIFNEL

SEQ ID NO: 102802 - protein, 9 aa, Homo Sapiens
SESRYPQAL

SEQ ID NO: 102803 - protein, 9 aa, Homo Sapiens
SESSPPKAM

SEQ ID NO: 102804 - protein, 9 aa, Homo Sapiens
SESSTVRTV

SEQ ID NO: 102805 - protein, 9 aa, Homo Sapiens
SESSVKVRL

SEQ ID NO: 102806 - protein, 9 aa, Homo Sapiens
SESTKQPKL

SEQ ID NO: 102807 - protein, 9 aa, Homo Sapiens
SESTNQRVL

SEQ ID NO: 102808 - protein, 9 aa, Homo Sapiens
SESVPVIAA

SEQ ID NO: 102809 - protein, 9 aa, Homo Sapiens
SETDMVRQI

SEQ ID NO: 102810 - protein, 9 aa, Homo Sapiens
SETEGTPKL

SEQ ID NO: 102811 - protein, 9 aa, Homo Sapiens
SETFLLPHL

SEQ ID NO: 102812 - protein, 9 aa, Homo Sapiens
SETGHVYTF

SEQ ID NO: 102813 - protein, 9 aa, Homo Sapiens
SETGKLIML

SEQ ID NO: 102814 - protein, 9 aa, Homo Sapiens
SETKDVFQL

SEQ ID NO: 102815 - protein, 9 aa, Homo Sapiens
SETPTFAKV

SEQ ID NO: 102816 - protein, 9 aa, Homo Sapiens
SETRVLVDI

SEQ ID NO: 102817 - protein, 9 aa, Homo Sapiens
SETTAAHSL

SEQ ID NO: 102818 - protein, 9 aa, Homo Sapiens
SETTPKAVV

SEQ ID NO: 102819 - protein, 9 aa, Homo Sapiens
SETTQIVKL

SEQ ID NO: 102820 - protein, 9 aa, Homo Sapiens
SEVDGLMDL

SEQ ID NO: 102821 - protein, 9 aa, Homo Sapiens
SEVDGLNSL

SEQ ID NO: 102822 - protein, 9 aa, Homo Sapiens
SEVDSPNVL

SEQ ID NO: 102823 - protein, 9 aa, Homo Sapiens
SEVEKGEAL

SEQ ID NO: 102824 - protein, 9 aa, Homo Sapiens
SEVELMKVA

SEQ ID NO: 102825 - protein, 9 aa, Homo Sapiens
SEVGKLLSA

SEQ ID NO: 102826 - protein, 9 aa, Homo Sapiens
SEVGKTPTL

SEQ ID NO: 102827 - protein, 9 aa, Homo Sapiens
SEVGPVVSF

SEQ ID NO: 102828 - protein, 9 aa, Homo Sapiens
SEVGSVVSF

SEQ ID NO: 102829 - protein, 9 aa, Homo Sapiens
SEVGTDHKL

SEQ ID NO: 102830 - protein, 9 aa, Homo Sapiens
SEVHSPPNV

SEQ ID NO: 102831 - protein, 9 aa, Homo Sapiens
SEVIFGHVL

SEQ ID NO: 102832 - protein, 9 aa, Homo Sapiens
SEVIGPVSL

SEQ ID NO: 102833 - protein, 9 aa, Homo Sapiens
SEVISQHLV

SEQ ID NO: 102834 - protein, 9 aa, Homo Sapiens
SEVKGLDAF

SEQ ID NO: 102835 - protein, 9 aa, Homo Sapiens
SEVKSRQTL

SEQ ID NO: 102836 - protein, 9 aa, Homo Sapiens
SEVMGEPHL

SEQ ID NO: 102837 - protein, 9 aa, Homo Sapiens
SEVNIPLSL

SEQ ID NO: 102838 - protein, 9 aa, Homo Sapiens
SEVNKLYKL

SEQ ID NO: 102839 - protein, 9 aa, Homo Sapiens
SEVPNGKEV

SEQ ID NO: 102840 - protein, 9 aa, Homo Sapiens
SEVQDRVML

SEQ ID NO: 102841 - protein, 9 aa, Homo Sapiens
SEVSKIVTV

SEQ ID NO: 102842 - protein, 9 aa, Homo Sapiens
SEVSTVLKL

SEQ ID NO: 102843 - protein, 9 aa, Homo Sapiens
SEVTAALRV

SEQ ID NO: 102844 - protein, 9 aa, Homo Sapiens
SEVTDPLSV

SEQ ID NO: 102845 - protein, 9 aa, Homo Sapiens
SEVVGSSTL

SEQ ID NO: 102846 - protein, 9 aa, Homo Sapiens
SEVVVNSVF

SEQ ID NO: 102847 - protein, 9 aa, Homo Sapiens
SEVYSNPCL

SEQ ID NO: 102848 - protein, 9 aa, Homo Sapiens
SEWDGIVTV

SEQ ID NO: 102849 - protein, 9 aa, Homo Sapiens
SEWKSGTKV

SEQ ID NO: 102850 - protein, 9 aa, Homo Sapiens
SEWNTVERL

SEQ ID NO: 102851 - protein, 9 aa, Homo Sapiens
SEWVSCVRF

SEQ ID NO: 102852 - protein, 9 aa, Homo Sapiens
SEYARPHVM

SEQ ID NO: 102853 - protein, 9 aa, Homo Sapiens
SEYDDPPGL

SEQ ID NO: 102854 - protein, 9 aa, Homo Sapiens
SEYFYQEEF

SEQ ID NO: 102855 - protein, 9 aa, Homo Sapiens
SEYRFPEEL

SEQ ID NO: 102856 - protein, 9 aa, Homo Sapiens
SEYRWHINF

SEQ ID NO: 102857 - protein, 9 aa, Homo Sapiens
SEYSQSPKM

SEQ ID NO: 102858 - protein, 9 aa, Homo Sapiens
SEYSVHSSL

SEQ ID NO: 102859 - protein, 9 aa, Homo Sapiens
SEYTSGHSV

SEQ ID NO: 102860 - protein, 9 aa, Homo Sapiens
SQANIAQVL

SEQ ID NO: 102861 - protein, 9 aa, Homo Sapiens
SQFGTEHVL

SEQ ID NO: 102862 - protein, 9 aa, Homo Sapiens
SQIPAQPSV

SEQ ID NO: 102863 - protein, 9 aa, Homo Sapiens
SSDVVVQVL

SEQ ID NO: 102864 - protein, 9 aa, Homo Sapiens
SSEFEAPSL

SEQ ID NO: 102865 - protein, 9 aa, Homo Sapiens
SSEFQIPTA

SEQ ID NO: 102866 - protein, 9 aa, Homo Sapiens
SSLLEKGLD

SEQ ID NO: 102867 - protein, 9 aa, Homo Sapiens
STKREIQEI

SEQ ID NO: 102868 - protein, 9 aa, Homo Sapiens
TDREDINSL

SEQ ID NO: 102869 - protein, 9 aa, Homo Sapiens
TEAETIQKL

SEQ ID NO: 102870 - protein, 9 aa, Homo Sapiens
TEAKIKQKL

SEQ ID NO: 102871 - protein, 9 aa, Homo Sapiens
TEALPVKLI

SEQ ID NO: 102872 - protein, 9 aa, Homo Sapiens
TEAPIAVVT

SEQ ID NO: 102873 - protein, 9 aa, Homo Sapiens
TEAPPIIFA

SEQ ID NO: 102874 - protein, 9 aa, Homo Sapiens
TEAPVPVSV

SEQ ID NO: 102875 - protein, 9 aa, Homo Sapiens
TEAQVTQEL

SEQ ID NO: 102876 - protein, 9 aa, Homo Sapiens
TEARCFYGF

SEQ ID NO: 102877 - protein, 9 aa, Homo Sapiens
TEASEQQAL

SEQ ID NO: 102878 - protein, 9 aa, Homo Sapiens
TEAVVKEKL

SEQ ID NO: 102879 - protein, 9 aa, Homo Sapiens
TEDRIQHAL

SEQ ID NO: 102880 - protein, 9 aa, Homo Sapiens
TEEERRAEL

SEQ ID NO: 102881 - protein, 9 aa, Homo Sapiens
TEFEKILKT

SEQ ID NO: 102882 - protein, 9 aa, Homo Sapiens
TEFEQQERL

SEQ ID NO: 102883 - protein, 9 aa, Homo Sapiens
TEFGHPAAI

SEQ ID NO: 102884 - protein, 9 aa, Homo Sapiens
TEFHELEKI

SEQ ID NO: 102885 - protein, 9 aa, Homo Sapiens
TEFHHVRTL

SEQ ID NO: 102886 - protein, 9 aa, Homo Sapiens
TEFQHPCFL

SEQ ID NO: 102887 - protein, 9 aa, Homo Sapiens
TEFQLGSKL

SEQ ID NO: 102888 - protein, 9 aa, Homo Sapiens
TEFRNIQKL

SEQ ID NO: 102889 - protein, 9 aa, Homo Sapiens
TEGDIICVF

SEQ ID NO: 102890 - protein, 9 aa, Homo Sapiens
TEGKVGYEL

SEQ ID NO: 102891 - protein, 9 aa, Homo Sapiens
TEHAHQVVV

SEQ ID NO: 102892 - protein, 9 aa, Homo Sapiens
TEHEKVAIL

SEQ ID NO: 102893 - protein, 9 aa, Homo Sapiens
TEHGVEVVL

SEQ ID NO: 102894 - protein, 9 aa, Homo Sapiens
TEHGVKVTA

SEQ ID NO: 102895 - protein, 9 aa, Homo Sapiens
TEHINIHQL

SEQ ID NO: 102896 - protein, 9 aa, Homo Sapiens
TEHPRSTEL

SEQ ID NO: 102897 - protein, 9 aa, Homo Sapiens
TEHPVPIIL

SEQ ID NO: 102898 - protein, 9 aa, Homo Sapiens
TEHYDIPKV

SEQ ID NO: 102899 - protein, 9 aa, Homo Sapiens
TEHYSPLSL

SEQ ID NO: 102900 - protein, 9 aa, Homo Sapiens
TEIDPICAL

SEQ ID NO: 102901 - protein, 9 aa, Homo Sapiens
TEIDPINAL

SEQ ID NO: 102902 - protein, 9 aa, Homo Sapiens
TEIEDMPTL

SEQ ID NO: 102903 - protein, 9 aa, Homo Sapiens
TEIEDSHTL

SEQ ID NO: 102904 - protein, 9 aa, Homo Sapiens
TEIEGTQKL

SEQ ID NO: 102905 - protein, 9 aa, Homo Sapiens
TEIEKARAV

SEQ ID NO: 102906 - protein, 9 aa, Homo Sapiens
TEIEKSISA

SEQ ID NO: 102907 - protein, 9 aa, Homo Sapiens
TEIGPMSCF

SEQ ID NO: 102908 - protein, 9 aa, Homo Sapiens
TEIGPRMTL

SEQ ID NO: 102909 - protein, 9 aa, Homo Sapiens
TEIGSIHSA

SEQ ID NO: 102910 - protein, 9 aa, Homo Sapiens
TEIHNINII

SEQ ID NO: 102911 - protein, 9 aa, Homo Sapiens
TEIKKTEVL

SEQ ID NO: 102912 - protein, 9 aa, Homo Sapiens
TEINFTQKL

SEQ ID NO: 102913 - protein, 9 aa, Homo Sapiens
TEIPTKITI

SEQ ID NO: 102914 - protein, 9 aa, Homo Sapiens
TEIQLVQSL

SEQ ID NO: 102915 - protein, 9 aa, Homo Sapiens
TEIQQQSAL

SEQ ID NO: 102916 - protein, 9 aa, Homo Sapiens
TEISLQQRL

SEQ ID NO: 102917 - protein, 9 aa, Homo Sapiens
TEISSAEKV

SEQ ID NO: 102918 - protein, 9 aa, Homo Sapiens
TEISWENKL

SEQ ID NO: 102919 - protein, 9 aa, Homo Sapiens
TEITHAVVI

SEQ ID NO: 102920 - protein, 9 aa, Homo Sapiens
TEKAPEPHV

SEQ ID NO: 102921 - protein, 9 aa, Homo Sapiens
TEKDFLEAV

SEQ ID NO: 102922 - protein, 9 aa, Homo Sapiens
TEKDLVTSL

SEQ ID NO: 102923 - protein, 9 aa, Homo Sapiens
TEKEDFIEL

SEQ ID NO: 102924 - protein, 9 aa, Homo Sapiens
TEKGNLEVL

SEQ ID NO: 102925 - protein, 9 aa, Homo Sapiens
TEKHFFHKV

SEQ ID NO: 102926 - protein, 9 aa, Homo Sapiens
TEKHVQVAV

SEQ ID NO: 102927 - protein, 9 aa, Homo Sapiens
TEKIISAEL

SEQ ID NO: 102928 - protein, 9 aa, Homo Sapiens
TEKKELCEL

SEQ ID NO: 102929 - protein, 9 aa, Homo Sapiens
TEKKIARAL

SEQ ID NO: 102930 - protein, 9 aa, Homo Sapiens
TEKKIPVVF

SEQ ID NO: 102931 - protein, 9 aa, Homo Sapiens
TEKNVIAAL

SEQ ID NO: 102932 - protein, 9 aa, Homo Sapiens
TEKQYIATI

SEQ ID NO: 102933 - protein, 9 aa, Homo Sapiens
TEKSPEVTL

SEQ ID NO: 102934 - protein, 9 aa, Homo Sapiens
TEKSPNPSL

SEQ ID NO: 102935 - protein, 9 aa, Homo Sapiens
TEKTKPEVL

SEQ ID NO: 102936 - protein, 9 aa, Homo Sapiens
TEKTVLVAL

SEQ ID NO: 102937 - protein, 9 aa, Homo Sapiens
TELEYIHAL

SEQ ID NO: 102938 - protein, 9 aa, Homo Sapiens
TELHHVRTL

SEQ ID NO: 102939 - protein, 9 aa, Homo Sapiens
TELIKVDKV

SEQ ID NO: 102940 - protein, 9 aa, Homo Sapiens
TELIQKAKL

SEQ ID NO: 102941 - protein, 9 aa, Homo Sapiens
TELKGLSKI

SEQ ID NO: 102942 - protein, 9 aa, Homo Sapiens
TELNIREST

SEQ ID NO: 102943 - protein, 9 aa, Homo Sapiens
TELTTKSSL

SEQ ID NO: 102944 - protein, 9 aa, Homo Sapiens
TEMEQDYQL

SEQ ID NO: 102945 - protein, 9 aa, Homo Sapiens
TEMESQKQL

SEQ ID NO: 102946 - protein, 9 aa, Homo Sapiens
TENAPCRPL

SEQ ID NO: 102947 - protein, 9 aa, Homo Sapiens
TENLVRELL

SEQ ID NO: 102948 - protein, 9 aa, Homo Sapiens
TENPHGARL

SEQ ID NO: 102949 - protein, 9 aa, Homo Sapiens
TENPVIMGL

SEQ ID NO: 102950 - protein, 9 aa, Homo Sapiens
TEQKQTSVL

SEQ ID NO: 102951 - protein, 9 aa, Homo Sapiens
TEQTVSQVL

SEQ ID NO: 102952 - protein, 9 aa, Homo Sapiens
TERAKDFSL

SEQ ID NO: 102953 - protein, 9 aa, Homo Sapiens
TERANSMGL

SEQ ID NO: 102954 - protein, 9 aa, Homo Sapiens
TERIEKERM

SEQ ID NO: 102955 - protein, 9 aa, Homo Sapiens
TERLIKHAV

SEQ ID NO: 102956 - protein, 9 aa, Homo Sapiens
TERPQPQTL

SEQ ID NO: 102957 - protein, 9 aa, Homo Sapiens
TERQKVHCL

SEQ ID NO: 102958 - protein, 9 aa, Homo Sapiens
TESGLNVTL

SEQ ID NO: 102959 - protein, 9 aa, Homo Sapiens
TESTARVEL

SEQ ID NO: 102960 - protein, 9 aa, Homo Sapiens
TESTPITAV

SEQ ID NO: 102961 - protein, 9 aa, Homo Sapiens
TETARIAQL

SEQ ID NO: 102962 - protein, 9 aa, Homo Sapiens
TETEPPVAL

SEQ ID NO: 102963 - protein, 9 aa, Homo Sapiens
TETHVERVL

SEQ ID NO: 102964 - protein, 9 aa, Homo Sapiens
TETLALTKL

SEQ ID NO: 102965 - protein, 9 aa, Homo Sapiens
TETNVYFKL

SEQ ID NO: 102966 - protein, 9 aa, Homo Sapiens
TETSIAKEL

SEQ ID NO: 102967 - protein, 9 aa, Homo Sapiens
TETTKFEKL

SEQ ID NO: 102968 - protein, 9 aa, Homo Sapiens
TETTVKKVV

SEQ ID NO: 102969 - protein, 9 aa, Homo Sapiens
TETVHIFKL

SEQ ID NO: 102970 - protein, 9 aa, Homo Sapiens
TETVLRQAI

SEQ ID NO: 102971 - protein, 9 aa, Homo Sapiens
TETVVTEYL

SEQ ID NO: 102972 - protein, 9 aa, Homo Sapiens
TEVDKILKV

SEQ ID NO: 102973 - protein, 9 aa, Homo Sapiens
TEVDTSHRL

SEQ ID NO: 102974 - protein, 9 aa, Homo Sapiens
TEVGEKIAL

SEQ ID NO: 102975 - protein, 9 aa, Homo Sapiens
TEVGPRFEL

SEQ ID NO: 102976 - protein, 9 aa, Homo Sapiens
TEVIHTGTL

SEQ ID NO: 102977 - protein, 9 aa, Homo Sapiens
TEVKKIYKL

SEQ ID NO: 102978 - protein, 9 aa, Homo Sapiens
TEVLKTHGL

SEQ ID NO: 102979 - protein, 9 aa, Homo Sapiens
TEVPVEPVL

SEQ ID NO: 102980 - protein, 9 aa, Homo Sapiens
TEVQKNQVL

SEQ ID NO: 102981 - protein, 9 aa, Homo Sapiens
TEVRVANEL

SEQ ID NO: 102982 - protein, 9 aa, Homo Sapiens
TEVSKVPSL

SEQ ID NO: 102983 - protein, 9 aa, Homo Sapiens
TEVTLPKSI

SEQ ID NO: 102984 - protein, 9 aa, Homo Sapiens
TEWEKVAQL

SEQ ID NO: 102985 - protein, 9 aa, Homo Sapiens
TEWERVARL

SEQ ID NO: 102986 - protein, 9 aa, Homo Sapiens
TEWIRAIQM

SEQ ID NO: 102987 - protein, 9 aa, Homo Sapiens
TEYETQVKV

SEQ ID NO: 102988 - protein, 9 aa, Homo Sapiens
TEYSFLKEV

SEQ ID NO: 102989 - protein, 9 aa, Homo Sapiens
VAPGKDLTK

SEQ ID NO: 102990 - protein, 9 aa, Homo Sapiens
VDFVIPKEL

SEQ ID NO: 102991 - protein, 9 aa, Homo Sapiens
VDITTPKAA

SEQ ID NO: 102992 - protein, 9 aa, Homo Sapiens
VDTAVRHVL

SEQ ID NO: 102993 - protein, 9 aa, Homo Sapiens
VDVQIPECF

SEQ ID NO: 102994 - protein, 9 aa, Homo Sapiens
VDYELERTL

SEQ ID NO: 102995 - protein, 9 aa, Homo Sapiens
VEAGGMQAL

SEQ ID NO: 102996 - protein, 9 aa, Homo Sapiens
VEAPPSVVL

SEQ ID NO: 102997 - protein, 9 aa, Homo Sapiens
VEAQKAQQL

SEQ ID NO: 102998 - protein, 9 aa, Homo Sapiens
VEEENIRVV

SEQ ID NO: 102999 - protein, 9 aa, Homo Sapiens
VEEPSRPSA

SEQ ID NO: 103000 - protein, 9 aa, Homo Sapiens
VEFDEVDSL

SEQ ID NO: 103001 - protein, 9 aa, Homo Sapiens
VEFEELLKA

SEQ ID NO: 103002 - protein, 9 aa, Homo Sapiens
VEFFHVEDL

SEQ ID NO: 103003 - protein, 9 aa, Homo Sapiens
VEFNGKLLA

SEQ ID NO: 103004 - protein, 9 aa, Homo Sapiens
VEFPHSPEI

SEQ ID NO: 103005 - protein, 9 aa, Homo Sapiens
VEFREVTEL

SEQ ID NO: 103006 - protein, 9 aa, Homo Sapiens
VEFSGKPAA

SEQ ID NO: 103007 - protein, 9 aa, Homo Sapiens
VEFVKSFNL

SEQ ID NO: 103008 - protein, 9 aa, Homo Sapiens
VEFVVEKAL

SEQ ID NO: 103009 - protein, 9 aa, Homo Sapiens
VEGDPIVAL

SEQ ID NO: 103010 - protein, 9 aa, Homo Sapiens
VEGPGGRPL

SEQ ID NO: 103011 - protein, 9 aa, Homo Sapiens
VEGQVPHSL

SEQ ID NO: 103012 - protein, 9 aa, Homo Sapiens
VEHANIIKV

SEQ ID NO: 103013 - protein, 9 aa, Homo Sapiens
VEHDHPHAL

SEQ ID NO: 103014 - protein, 9 aa, Homo Sapiens
VEHPAAKVL

SEQ ID NO: 103015 - protein, 9 aa, Homo Sapiens
VEHPGHPEV

SEQ ID NO: 103016 - protein, 9 aa, Homo Sapiens
VEIEREVLL

SEQ ID NO: 103017 - protein, 9 aa, Homo Sapiens
VEIGPRFVL

SEQ ID NO: 103018 - protein, 9 aa, Homo Sapiens
VEIQCPEQV

SEQ ID NO: 103019 - protein, 9 aa, Homo Sapiens
VEKEFEPLL

SEQ ID NO: 103020 - protein, 9 aa, Homo Sapiens
VEKEGIHVL

SEQ ID NO: 103021 - protein, 9 aa, Homo Sapiens
VEKEMRVTL

SEQ ID NO: 103022 - protein, 9 aa, Homo Sapiens
VEKFGDLIL

SEQ ID NO: 103023 - protein, 9 aa, Homo Sapiens
VEKGHFAEL

SEQ ID NO: 103024 - protein, 9 aa, Homo Sapiens
VEKHVVQSI

SEQ ID NO: 103025 - protein, 9 aa, Homo Sapiens
VEKIDFDSV

SEQ ID NO: 103026 - protein, 9 aa, Homo Sapiens
VEKKPLVAL

SEQ ID NO: 103027 - protein, 9 aa, Homo Sapiens
VEKKSVAKL

SEQ ID NO: 103028 - protein, 9 aa, Homo Sapiens
VEKLGAYEL

SEQ ID NO: 103029 - protein, 9 aa, Homo Sapiens
VEKPAETHL

SEQ ID NO: 103030 - protein, 9 aa, Homo Sapiens
VEKPLKLVL

SEQ ID NO: 103031 - protein, 9 aa, Homo Sapiens
VEKPSPLTL

SEQ ID NO: 103032 - protein, 9 aa, Homo Sapiens
VEKPVGVAA

SEQ ID NO: 103033 - protein, 9 aa, Homo Sapiens
VEKQPPQVL

SEQ ID NO: 103034 - protein, 9 aa, Homo Sapiens
VEKVPNPSL

SEQ ID NO: 103035 - protein, 9 aa, Homo Sapiens
VEKVVVVIL

SEQ ID NO: 103036 - protein, 9 aa, Homo Sapiens
VEKYIEEQL

SEQ ID NO: 103037 - protein, 9 aa, Homo Sapiens
VELEIRELL

SEQ ID NO: 103038 - protein, 9 aa, Homo Sapiens
VELPEQPAV

SEQ ID NO: 103039 - protein, 9 aa, Homo Sapiens
VEMGFSRSL

SEQ ID NO: 103040 - protein, 9 aa, Homo Sapiens
VEQNGKPSL

SEQ ID NO: 103041 - protein, 9 aa, Homo Sapiens
VERNKVKAL

SEQ ID NO: 103042 - protein, 9 aa, Homo Sapiens
VERQVSTAM

SEQ ID NO: 103043 - protein, 9 aa, Homo Sapiens
VERVIVVSM

SEQ ID NO: 103044 - protein, 9 aa, Homo Sapiens
VESHIQHSL

SEQ ID NO: 103045 - protein, 9 aa, Homo Sapiens
VESIISPKV

SEQ ID NO: 103046 - protein, 9 aa, Homo Sapiens
VESPVICKI

SEQ ID NO: 103047 - protein, 9 aa, Homo Sapiens
VETAKVYQL

SEQ ID NO: 103048 - protein, 9 aa, Homo Sapiens
VETGHLAAF

SEQ ID NO: 103049 - protein, 9 aa, Homo Sapiens
VEVPDGPTL

SEQ ID NO: 103050 - protein, 9 aa, Homo Sapiens
VEVPETPKA

SEQ ID NO: 103051 - protein, 9 aa, Homo Sapiens
VEVRSDWEV

SEQ ID NO: 103052 - protein, 9 aa, Homo Sapiens
VEVSIPAKL

SEQ ID NO: 103053 - protein, 9 aa, Homo Sapiens
VEVVKTFNL

SEQ ID NO: 103054 - protein, 9 aa, Homo Sapiens
VEWKGTSQL

SEQ ID NO: 103055 - protein, 9 aa, Homo Sapiens
VEWNKKEEL

SEQ ID NO: 103056 - protein, 9 aa, Homo Sapiens
VEYQMKSVL

SEQ ID NO: 103057 - protein, 9 aa, Homo Sapiens
VGTKSELII

SEQ ID NO: 103058 - protein, 9 aa, Homo Sapiens
WEEERQPIL

SEQ ID NO: 103059 - protein, 9 aa, Homo Sapiens
WEISQKTVL

SEQ ID NO: 103060 - protein, 9 aa, Homo Sapiens
WELEKKSAV

SEQ ID NO: 103061 - protein, 9 aa, Homo Sapiens
WEQGFSQSF

SEQ ID NO: 103062 - protein, 9 aa, Homo Sapiens
YEALPQHKL

SEQ ID NO: 103063 - protein, 9 aa, Homo Sapiens
YEASLPHQI

SEQ ID NO: 103064 - protein, 9 aa, Homo Sapiens
YEAYLPETF

SEQ ID NO: 103065 - protein, 9 aa, Homo Sapiens
YEDATKITV

SEQ ID NO: 103066 - protein, 9 aa, Homo Sapiens
YEDGSIRIF

SEQ ID NO: 103067 - protein, 9 aa, Homo Sapiens
YEDQTKPVL

SEQ ID NO: 103068 - protein, 9 aa, Homo Sapiens
YEEEVKKTL

SEQ ID NO: 103069 - protein, 9 aa, Homo Sapiens
YEEGPGKNL

SEQ ID NO: 103070 - protein, 9 aa, Homo Sapiens
YEELVRMVL

SEQ ID NO: 103071 - protein, 9 aa, Homo Sapiens
YEERVQAVV

SEQ ID NO: 103072 - protein, 9 aa, Homo Sapiens
YEETRQEVL

SEQ ID NO: 103073 - protein, 9 aa, Homo Sapiens
YEEVHVPAL

SEQ ID NO: 103074 - protein, 9 aa, Homo Sapiens
YEFERTTSI

SEQ ID NO: 103075 - protein, 9 aa, Homo Sapiens
YEGPAKIEV

SEQ ID NO: 103076 - protein, 9 aa, Homo Sapiens
YEHPKDLKL

SEQ ID NO: 103077 - protein, 9 aa, Homo Sapiens
YEHRYVELF

SEQ ID NO: 103078 - protein, 9 aa, Homo Sapiens
YEIDKTLGI

SEQ ID NO: 103079 - protein, 9 aa, Homo Sapiens
YEIHDGMNL

SEQ ID NO: 103080 - protein, 9 aa, Homo Sapiens
YEILNNPEL

SEQ ID NO: 103081 - protein, 9 aa, Homo Sapiens
YEITEQRKI

SEQ ID NO: 103082 - protein, 9 aa, Homo Sapiens
YEKDFQSCF

SEQ ID NO: 103083 - protein, 9 aa, Homo Sapiens
YEKIDLTLL

SEQ ID NO: 103084 - protein, 9 aa, Homo Sapiens
YEKIHKDHL

SEQ ID NO: 103085 - protein, 9 aa, Homo Sapiens
YEKILFTEA

SEQ ID NO: 103086 - protein, 9 aa, Homo Sapiens
YEKINVNEI

SEQ ID NO: 103087 - protein, 9 aa, Homo Sapiens
YEKPEAPEL

SEQ ID NO: 103088 - protein, 9 aa, Homo Sapiens
YEKTIAQMI

SEQ ID NO: 103089 - protein, 9 aa, Homo Sapiens
YEKTPFDQL

SEQ ID NO: 103090 - protein, 9 aa, Homo Sapiens
YELEKQKKL

SEQ ID NO: 103091 - protein, 9 aa, Homo Sapiens
YELGGPMTL

SEQ ID NO: 103092 - protein, 9 aa, Homo Sapiens
YELKEGRQI

SEQ ID NO: 103093 - protein, 9 aa, Homo Sapiens
YELLMPHRI

SEQ ID NO: 103094 - protein, 9 aa, Homo Sapiens
YELPDGQVI

SEQ ID NO: 103095 - protein, 9 aa, Homo Sapiens
YEMEVSQRL

SEQ ID NO: 103096 - protein, 9 aa, Homo Sapiens
YENEKLTKL

SEQ ID NO: 103097 - protein, 9 aa, Homo Sapiens
YENFKVQVL

SEQ ID NO: 103098 - protein, 9 aa, Homo Sapiens
YEPPVQESV

SEQ ID NO: 103099 - protein, 9 aa, Homo Sapiens
YEQILNTKL

SEQ ID NO: 103100 - protein, 9 aa, Homo Sapiens
YEQLLDVKI

SEQ ID NO: 103101 - protein, 9 aa, Homo Sapiens
YEQRKIVEF

SEQ ID NO: 103102 - protein, 9 aa, Homo Sapiens
YEQVSTPEI

SEQ ID NO: 103103 - protein, 9 aa, Homo Sapiens
YERDHAVVV

SEQ ID NO: 103104 - protein, 9 aa, Homo Sapiens
YESEKVGVA

SEQ ID NO: 103105 - protein, 9 aa, Homo Sapiens
YESHYALPL

SEQ ID NO: 103106 - protein, 9 aa, Homo Sapiens
YESPGKIFL

SEQ ID NO: 103107 - protein, 9 aa, Homo Sapiens
YETEGIRGL

SEQ ID NO: 103108 - protein, 9 aa, Homo Sapiens
YETNKQPGL

SEQ ID NO: 103109 - protein, 9 aa, Homo Sapiens
YETPTGIKV

SEQ ID NO: 103110 - protein, 9 aa, Homo Sapiens
YEVERCQQL

SEQ ID NO: 103111 - protein, 9 aa, Homo Sapiens
YEVGQRHGL

SEQ ID NO: 103112 - protein, 9 aa, Homo Sapiens
YEYKKRLTL

SEQ ID NO: 103113 - protein, 10 aa, Homo Sapiens
ADASIRLLKA

SEQ ID NO: 103114 - protein, 10 aa, Homo Sapiens
AEAAEVILRV

SEQ ID NO: 103115 - protein, 10 aa, Homo Sapiens
AEAECQRQQL

SEQ ID NO: 103116 - protein, 10 aa, Homo Sapiens
AEAEKLFKQA

SEQ ID NO: 103117 - protein, 10 aa, Homo Sapiens
AEAEKSQLIM

SEQ ID NO: 103118 - protein, 10 aa, Homo Sapiens
AEAENKAAAL

SEQ ID NO: 103119 - protein, 10 aa, Homo Sapiens
AEAILGQNAA

SEQ ID NO: 103120 - protein, 10 aa, Homo Sapiens
AEAKPITEML

SEQ ID NO: 103121 - protein, 10 aa, Homo Sapiens
AEAKQIVRKL

SEQ ID NO: 103122 - protein, 10 aa, Homo Sapiens
AEALKQGNAI

SEQ ID NO: 103123 - protein, 10 aa, Homo Sapiens
AEALRSLQQL

SEQ ID NO: 103124 - protein, 10 aa, Homo Sapiens
AEAPLPSPKL

SEQ ID NO: 103125 - protein, 10 aa, Homo Sapiens
AEAQAGTTTL

SEQ ID NO: 103126 - protein, 10 aa, Homo Sapiens
AEAQLRFIQA

SEQ ID NO: 103127 - protein, 10 aa, Homo Sapiens
AEARHIKAEM

SEQ ID NO: 103128 - protein, 10 aa, Homo Sapiens
AEASSVKNEL

SEQ ID NO: 103129 - protein, 10 aa, Homo Sapiens
AEATALVHTL

SEQ ID NO: 103130 - protein, 10 aa, Homo Sapiens
AEAVAGGRVL

SEQ ID NO: 103131 - protein, 10 aa, Homo Sapiens
AEAYLGKTVT

SEQ ID NO: 103132 - protein, 10 aa, Homo Sapiens
AECAGKLFLF

SEQ ID NO: 103133 - protein, 10 aa, Homo Sapiens
AECNAVRQAL

SEQ ID NO: 103134 - protein, 10 aa, Homo Sapiens
AECTERIHRL

SEQ ID NO: 103135 - protein, 10 aa, Homo Sapiens
AEDGSRVYVV

SEQ ID NO: 103136 - protein, 10 aa, Homo Sapiens
AEDITTGQVL

SEQ ID NO: 103137 - protein, 10 aa, Homo Sapiens
AEDPLGAIHL

SEQ ID NO: 103138 - protein, 10 aa, Homo Sapiens
AEDRQICPSL

SEQ ID NO: 103139 - protein, 10 aa, Homo Sapiens
AEEKAAVTSL

SEQ ID NO: 103140 - protein, 10 aa, Homo Sapiens
AEFDDRRGVL

SEQ ID NO: 103141 - protein, 10 aa, Homo Sapiens
AEFDTPGHTL

SEQ ID NO: 103142 - protein, 10 aa, Homo Sapiens
AEFEQKINRL

SEQ ID NO: 103143 - protein, 10 aa, Homo Sapiens
AEFHTELERL

SEQ ID NO: 103144 - protein, 10 aa, Homo Sapiens
AEFKEAFQLF

SEQ ID NO: 103145 - protein, 10 aa, Homo Sapiens
AEFKEAFSLF

SEQ ID NO: 103146 - protein, 10 aa, Homo Sapiens
AEFKEGKKEL

SEQ ID NO: 103147 - protein, 10 aa, Homo Sapiens
AEFLMKNSDL

SEQ ID NO: 103148 - protein, 10 aa, Homo Sapiens
AEFLPDPSAL

SEQ ID NO: 103149 - protein, 10 aa, Homo Sapiens
AEFNSTPAVF

SEQ ID NO: 103150 - protein, 10 aa, Homo Sapiens
AEFPGLPEAL

SEQ ID NO: 103151 - protein, 10 aa, Homo Sapiens
AEFQEHEHAL

SEQ ID NO: 103152 - protein, 10 aa, Homo Sapiens
AEFRDYPPVL

SEQ ID NO: 103153 - protein, 10 aa, Homo Sapiens
AEFSSAGHSL

SEQ ID NO: 103154 - protein, 10 aa, Homo Sapiens
AEFTKSIAKF

SEQ ID NO: 103155 - protein, 10 aa, Homo Sapiens
AEGDRVMVVL

SEQ ID NO: 103156 - protein, 10 aa, Homo Sapiens
AEGIVNGHTL

SEQ ID NO: 103157 - protein, 10 aa, Homo Sapiens
AEGKKQAQIL

SEQ ID NO: 103158 - protein, 10 aa, Homo Sapiens
AEHENMKAVL

SEQ ID NO: 103159 - protein, 10 aa, Homo Sapiens
AEHKEFITAL

SEQ ID NO: 103160 - protein, 10 aa, Homo Sapiens
AEHKIFPAAL

SEQ ID NO: 103161 - protein, 10 aa, Homo Sapiens
AEHNDLQYAA

SEQ ID NO: 103162 - protein, 10 aa, Homo Sapiens
AEHPAGHLVL

SEQ ID NO: 103163 - protein, 10 aa, Homo Sapiens
AEHPGDCLIF

SEQ ID NO: 103164 - protein, 10 aa, Homo Sapiens
AEHQVPVEKL

SEQ ID NO: 103165 - protein, 10 aa, Homo Sapiens
AEHRYYGKSL

SEQ ID NO: 103166 - protein, 10 aa, Homo Sapiens
AEHSESGQLV

SEQ ID NO: 103167 - protein, 10 aa, Homo Sapiens
AEIDAHLVAL

SEQ ID NO: 103168 - protein, 10 aa, Homo Sapiens
AEIDARNDSF

SEQ ID NO: 103169 - protein, 10 aa, Homo Sapiens
AEIDLRQGRL

SEQ ID NO: 103170 - protein, 10 aa, Homo Sapiens
AEIDSVKMTL

SEQ ID NO: 103171 - protein, 10 aa, Homo Sapiens
AEIEPPHHEL

SEQ ID NO: 103172 - protein, 10 aa, Homo Sapiens
AEIESHHPRL

SEQ ID NO: 103173 - protein, 10 aa, Homo Sapiens
AEIETRIAEL

SEQ ID NO: 103174 - protein, 10 aa, Homo Sapiens
AEIGQVKQEL

SEQ ID NO: 103175 - protein, 10 aa, Homo Sapiens
AEIKRINKEL

SEQ ID NO: 103176 - protein, 10 aa, Homo Sapiens
AEIKVKLIEA

SEQ ID NO: 103177 - protein, 10 aa, Homo Sapiens
AEILHEIAVL

SEQ ID NO: 103178 - protein, 10 aa, Homo Sapiens
AEINKSLLAL

SEQ ID NO: 103179 - protein, 10 aa, Homo Sapiens
AEINNIIKIV

SEQ ID NO: 103180 - protein, 10 aa, Homo Sapiens
AEIPRAIQSL

SEQ ID NO: 103181 - protein, 10 aa, Homo Sapiens
AEIQAELERL

SEQ ID NO: 103182 - protein, 10 aa, Homo Sapiens
AEIQDMKQEL

SEQ ID NO: 103183 - protein, 10 aa, Homo Sapiens
AEIQELHQSV

SEQ ID NO: 103184 - protein, 10 aa, Homo Sapiens
AEIQETITAL

SEQ ID NO: 103185 - protein, 10 aa, Homo Sapiens
AEIQGNINKV

SEQ ID NO: 103186 - protein, 10 aa, Homo Sapiens
AEIRHVLVTL

SEQ ID NO: 103187 - protein, 10 aa, Homo Sapiens
AEIRQQIPVF

SEQ ID NO: 103188 - protein, 10 aa, Homo Sapiens
AEISLLKQQL

SEQ ID NO: 103189 - protein, 10 aa, Homo Sapiens
AEITPKGRAL

SEQ ID NO: 103190 - protein, 10 aa, Homo Sapiens
AEKAVTKEEF

SEQ ID NO: 103191 - protein, 10 aa, Homo Sapiens
AEKCPNLTHL

SEQ ID NO: 103192 - protein, 10 aa, Homo Sapiens
AEKDNAEIRV

SEQ ID NO: 103193 - protein, 10 aa, Homo Sapiens
AEKLGETEKL

SEQ ID NO: 103194 - protein, 10 aa, Homo Sapiens
AEKLGGSAVI

SEQ ID NO: 103195 - protein, 10 aa, Homo Sapiens
AEKLPNLTHL

SEQ ID NO: 103196 - protein, 10 aa, Homo Sapiens
AEKNSNVETL

SEQ ID NO: 103197 - protein, 10 aa, Homo Sapiens
AEKPAVPETA

SEQ ID NO: 103198 - protein, 10 aa, Homo Sapiens
AEKVANAESL

SEQ ID NO: 103199 - protein, 10 aa, Homo Sapiens
AEKVQREPLL

SEQ ID NO: 103200 - protein, 10 aa, Homo Sapiens
AELAGEGISV

SEQ ID NO: 103201 - protein, 10 aa, Homo Sapiens
AELDEKISAL

SEQ ID NO: 103202 - protein, 10 aa, Homo Sapiens
AELDKRIEAL

SEQ ID NO: 103203 - protein, 10 aa, Homo Sapiens
AELDPGTISV

SEQ ID NO: 103204 - protein, 10 aa, Homo Sapiens
AELDPVEYTL

SEQ ID NO: 103205 - protein, 10 aa, Homo Sapiens
AELEGRQEEL

SEQ ID NO: 103206 - protein, 10 aa, Homo Sapiens
AELEKLQAEL

SEQ ID NO: 103207 - protein, 10 aa, Homo Sapiens
AELEREKEKL

SEQ ID NO: 103208 - protein, 10 aa, Homo Sapiens
AELESKTNTL

SEQ ID NO: 103209 - protein, 10 aa, Homo Sapiens
AELGLAPSAL

SEQ ID NO: 103210 - protein, 10 aa, Homo Sapiens
AELIRGICEM

SEQ ID NO: 103211 - protein, 10 aa, Homo Sapiens
AELKMTGNCL

SEQ ID NO: 103212 - protein, 10 aa, Homo Sapiens
AELKSSTVGL

SEQ ID NO: 103213 - protein, 10 aa, Homo Sapiens
AELLLKSSDL

SEQ ID NO: 103214 - protein, 10 aa, Homo Sapiens
AELLTELHQL

SEQ ID NO: 103215 - protein, 10 aa, Homo Sapiens
AELLVKGYEI

SEQ ID NO: 103216 - protein, 10 aa, Homo Sapiens
AELMQQVNVL

SEQ ID NO: 103217 - protein, 10 aa, Homo Sapiens
AELNLRSNEL

SEQ ID NO: 103218 - protein, 10 aa, Homo Sapiens
AELPASVHAL

SEQ ID NO: 103219 - protein, 10 aa, Homo Sapiens
AELQCEVAAL

SEQ ID NO: 103220 - protein, 10 aa, Homo Sapiens
AELQEKFLSL

SEQ ID NO: 103221 - protein, 10 aa, Homo Sapiens
AELQQQQAVL

SEQ ID NO: 103222 - protein, 10 aa, Homo Sapiens
AELQSRLAAL

SEQ ID NO: 103223 - protein, 10 aa, Homo Sapiens
AELRHVMTNL

SEQ ID NO: 103224 - protein, 10 aa, Homo Sapiens
AELRKRQAEL

SEQ ID NO: 103225 - protein, 10 aa, Homo Sapiens
AELRNASAVM

SEQ ID NO: 103226 - protein, 10 aa, Homo Sapiens
AELSPVEQKL

SEQ ID NO: 103227 - protein, 10 aa, Homo Sapiens
AELVKRKQEL

SEQ ID NO: 103228 - protein, 10 aa, Homo Sapiens
AELWKNPTAF

SEQ ID NO: 103229 - protein, 10 aa, Homo Sapiens
AEMAQNAVRL

SEQ ID NO: 103230 - protein, 10 aa, Homo Sapiens
AEMETQKEKI

SEQ ID NO: 103231 - protein, 10 aa, Homo Sapiens
AEMLYGLIHA

SEQ ID NO: 103232 - protein, 10 aa, Homo Sapiens
AEMPDSAAAL

SEQ ID NO: 103233 - protein, 10 aa, Homo Sapiens
AEMRPPLIET

SEQ ID NO: 103234 - protein, 10 aa, Homo Sapiens
AENDAQKPSL

SEQ ID NO: 103235 - protein, 10 aa, Homo Sapiens
AENELGVVVA

SEQ ID NO: 103236 - protein, 10 aa, Homo Sapiens
AENGFLPIHL

SEQ ID NO: 103237 - protein, 10 aa, Homo Sapiens
AENPFVVSMF

SEQ ID NO: 103238 - protein, 10 aa, Homo Sapiens
AENPGKYNIL

SEQ ID NO: 103239 - protein, 10 aa, Homo Sapiens
AENPHSEYGL

SEQ ID NO: 103240 - protein, 10 aa, Homo Sapiens
AEPARPQAVL

SEQ ID NO: 103241 - protein, 10 aa, Homo Sapiens
AEPDYVQPQL

SEQ ID NO: 103242 - protein, 10 aa, Homo Sapiens
AEPEDHYFLL

SEQ ID NO: 103243 - protein, 10 aa, Homo Sapiens
AEPELQYVAL

SEQ ID NO: 103244 - protein, 10 aa, Homo Sapiens
AEPLRPGPAL

SEQ ID NO: 103245 - protein, 10 aa, Homo Sapiens
AEPMKGPIAM

SEQ ID NO: 103246 - protein, 10 aa, Homo Sapiens
AEPVNLFQHL

SEQ ID NO: 103247 - protein, 10 aa, Homo Sapiens
AEQAKASPAL

SEQ ID NO: 103248 - protein, 10 aa, Homo Sapiens
AEQKRLKTVL

SEQ ID NO: 103249 - protein, 10 aa, Homo Sapiens
AEQQGKGVAL

SEQ ID NO: 103250 - protein, 10 aa, Homo Sapiens
AEQQKAQFTA

SEQ ID NO: 103251 - protein, 10 aa, Homo Sapiens
AEQSVAKASL

SEQ ID NO: 103252 - protein, 10 aa, Homo Sapiens
AEQSVLFKSL

SEQ ID NO: 103253 - protein, 10 aa, Homo Sapiens
AERDSALETL

SEQ ID NO: 103254 - protein, 10 aa, Homo Sapiens
AEREAEIRSL

SEQ ID NO: 103255 - protein, 10 aa, Homo Sapiens
AERFNVPVSL

SEQ ID NO: 103256 - protein, 10 aa, Homo Sapiens
AERIGETPEL

SEQ ID NO: 103257 - protein, 10 aa, Homo Sapiens
AERKNISQEL

SEQ ID NO: 103258 - protein, 10 aa, Homo Sapiens
AERPGEAAVA

SEQ ID NO: 103259 - protein, 10 aa, Homo Sapiens
AERQPLGHVT

SEQ ID NO: 103260 - protein, 10 aa, Homo Sapiens
AESEKWQQAL

SEQ ID NO: 103261 - protein, 10 aa, Homo Sapiens
AESGVERQVL

SEQ ID NO: 103262 - protein, 10 aa, Homo Sapiens
AESLIVPVRM

SEQ ID NO: 103263 - protein, 10 aa, Homo Sapiens
AESQELIYTF

SEQ ID NO: 103264 - protein, 10 aa, Homo Sapiens
AESWGTGRAV

SEQ ID NO: 103265 - protein, 10 aa, Homo Sapiens
AETAKATPRL

SEQ ID NO: 103266 - protein, 10 aa, Homo Sapiens
AETDRRTLQM

SEQ ID NO: 103267 - protein, 10 aa, Homo Sapiens
AETDVLFNKV

SEQ ID NO: 103268 - protein, 10 aa, Homo Sapiens
AETHFGFETV

SEQ ID NO: 103269 - protein, 10 aa, Homo Sapiens
AETPGHTPSL

SEQ ID NO: 103270 - protein, 10 aa, Homo Sapiens
AEVAAKNQSL

SEQ ID NO: 103271 - protein, 10 aa, Homo Sapiens
AEVAATEIKM

SEQ ID NO: 103272 - protein, 10 aa, Homo Sapiens
AEVARAQAAL

SEQ ID NO: 103273 - protein, 10 aa, Homo Sapiens
AEVCPTPARL

SEQ ID NO: 103274 - protein, 10 aa, Homo Sapiens
AEVDRIIAQL

SEQ ID NO: 103275 - protein, 10 aa, Homo Sapiens
AEVEGIGEAL

SEQ ID NO: 103276 - protein, 10 aa, Homo Sapiens
AEVEHLTEVL

SEQ ID NO: 103277 - protein, 10 aa, Homo Sapiens
AEVELKRDEA

SEQ ID NO: 103278 - protein, 10 aa, Homo Sapiens
AEVENVFHSL

SEQ ID NO: 103279 - protein, 10 aa, Homo Sapiens
AEVERVKDVL

SEQ ID NO: 103280 - protein, 10 aa, Homo Sapiens
AEVETRKVVL

SEQ ID NO: 103281 - protein, 10 aa, Homo Sapiens
AEVGDGTTSV

SEQ ID NO: 103282 - protein, 10 aa, Homo Sapiens
AEVGVKAHHL

SEQ ID NO: 103283 - protein, 10 aa, Homo Sapiens
AEVIAKNNSF

SEQ ID NO: 103284 - protein, 10 aa, Homo Sapiens
AEVKDMEQLL

SEQ ID NO: 103285 - protein, 10 aa, Homo Sapiens
AEVKIEKRTT

SEQ ID NO: 103286 - protein, 10 aa, Homo Sapiens
AEVKRPGESL

SEQ ID NO: 103287 - protein, 10 aa, Homo Sapiens
AEVKRVGDTL

SEQ ID NO: 103288 - protein, 10 aa, Homo Sapiens
AEVLIQQGGL

SEQ ID NO: 103289 - protein, 10 aa, Homo Sapiens
AEVLITTRTA

SEQ ID NO: 103290 - protein, 10 aa, Homo Sapiens
AEVLVKSNNL

SEQ ID NO: 103291 - protein, 10 aa, Homo Sapiens
AEVMPAQWEF

SEQ ID NO: 103292 - protein, 10 aa, Homo Sapiens
AEVRGPAHCL

SEQ ID NO: 103293 - protein, 10 aa, Homo Sapiens
AEVRVQQQTA

SEQ ID NO: 103294 - protein, 10 aa, Homo Sapiens
AEVSELETRL

SEQ ID NO: 103295 - protein, 10 aa, Homo Sapiens
AEVSNTFVRL

SEQ ID NO: 103296 - protein, 10 aa, Homo Sapiens
AEVSQNIEKL

SEQ ID NO: 103297 - protein, 10 aa, Homo Sapiens
AEWAAANHVL

SEQ ID NO: 103298 - protein, 10 aa, Homo Sapiens
AEWKKEEERL

SEQ ID NO: 103299 - protein, 10 aa, Homo Sapiens
AEWREALRAL

SEQ ID NO: 103300 - protein, 10 aa, Homo Sapiens
AEYAHPLETL

SEQ ID NO: 103301 - protein, 10 aa, Homo Sapiens
AEYDFRNDSV

SEQ ID NO: 103302 - protein, 10 aa, Homo Sapiens
AEYDNFFQHL

SEQ ID NO: 103303 - protein, 10 aa, Homo Sapiens
AEYENLTNKL

SEQ ID NO: 103304 - protein, 10 aa, Homo Sapiens
AEYHKLARKL

SEQ ID NO: 103305 - protein, 10 aa, Homo Sapiens
AEYIQKNVQL

SEQ ID NO: 103306 - protein, 10 aa, Homo Sapiens
AEYPGSSAQL

SEQ ID NO: 103307 - protein, 10 aa, Homo Sapiens
AEYSTKNNAL

SEQ ID NO: 103308 - protein, 10 aa, Homo Sapiens
EEGKNIIVIM

SEQ ID NO: 103309 - protein, 10 aa, Homo Sapiens
EEIANYRPTL

SEQ ID NO: 103310 - protein, 10 aa, Homo Sapiens
EEIKDFLLTA

SEQ ID NO: 103311 - protein, 10 aa, Homo Sapiens
EEMDSNKVSL

SEQ ID NO: 103312 - protein, 10 aa, Homo Sapiens
EEQLQQIRAE

SEQ ID NO: 103313 - protein, 10 aa, Homo Sapiens
EEVQSLPLPL

SEQ ID NO: 103314 - protein, 10 aa, Homo Sapiens
EEWHGHVTAL

SEQ ID NO: 103315 - protein, 10 aa, Homo Sapiens
EGDNEFERIL

SEQ ID NO: 103316 - protein, 10 aa, Homo Sapiens
ELAAPGQAKI

SEQ ID NO: 103317 - protein, 10 aa, Homo Sapiens
ELLKPTELVP

SEQ ID NO: 103318 - protein, 10 aa, Homo Sapiens
ELPQAAPPQI

SEQ ID NO: 103319 - protein, 10 aa, Homo Sapiens
EREKLASEIL

SEQ ID NO: 103320 - protein, 10 aa, Homo Sapiens
ESRLEKAELS

SEQ ID NO: 103321 - protein, 10 aa, Homo Sapiens
ETLDLSHNQL

SEQ ID NO: 103322 - protein, 10 aa, Homo Sapiens
FEFDEQGREL

SEQ ID NO: 103323 - protein, 10 aa, Homo Sapiens
FEFGSLDQKL

SEQ ID NO: 103324 - protein, 10 aa, Homo Sapiens
FEFTGSHLTV

SEQ ID NO: 103325 - protein, 10 aa, Homo Sapiens
FEISDIGAKI

SEQ ID NO: 103326 - protein, 10 aa, Homo Sapiens
FEREVGRQSV

SEQ ID NO: 103327 - protein, 10 aa, Homo Sapiens
FERPQYAEIL

SEQ ID NO: 103328 - protein, 10 aa, Homo Sapiens
FEWVAERVEL

SEQ ID NO: 103329 - protein, 10 aa, Homo Sapiens
GEAAAVFKTL

SEQ ID NO: 103330 - protein, 10 aa, Homo Sapiens
GEAELNWSRL

SEQ ID NO: 103331 - protein, 10 aa, Homo Sapiens
GEAGAKFIEV

SEQ ID NO: 103332 - protein, 10 aa, Homo Sapiens
GEAGPSAEAL

SEQ ID NO: 103333 - protein, 10 aa, Homo Sapiens
GEAKVKKQLV

SEQ ID NO: 103334 - protein, 10 aa, Homo Sapiens
GEALAPRQVL

SEQ ID NO: 103335 - protein, 10 aa, Homo Sapiens
GEANVPFITV

SEQ ID NO: 103336 - protein, 10 aa, Homo Sapiens
GEAPAKSSTL

SEQ ID NO: 103337 - protein, 10 aa, Homo Sapiens
GEAQVGKTSL

SEQ ID NO: 103338 - protein, 10 aa, Homo Sapiens
GEARKQVEVF

SEQ ID NO: 103339 - protein, 10 aa, Homo Sapiens
GEAVEVIHKL

SEQ ID NO: 103340 - protein, 10 aa, Homo Sapiens
GECDVFKEIL

SEQ ID NO: 103341 - protein, 10 aa, Homo Sapiens
GECGFRPTIF

SEQ ID NO: 103342 - protein, 10 aa, Homo Sapiens
GECRPLSKTV

SEQ ID NO: 103343 - protein, 10 aa, Homo Sapiens
GECYEKLNQL

SEQ ID NO: 103344 - protein, 10 aa, Homo Sapiens
GEDLNKWQAL

SEQ ID NO: 103345 - protein, 10 aa, Homo Sapiens
GEDPDKRISI

SEQ ID NO: 103346 - protein, 10 aa, Homo Sapiens
GEDPNKAEEL

SEQ ID NO: 103347 - protein, 10 aa, Homo Sapiens
GEDRSPPTAL

SEQ ID NO: 103348 - protein, 10 aa, Homo Sapiens
GEFDNAGAMM

SEQ ID NO: 103349 - protein, 10 aa, Homo Sapiens
GEFDNAGGMM

SEQ ID NO: 103350 - protein, 10 aa, Homo Sapiens
GEFEKGGKSV

SEQ ID NO: 103351 - protein, 10 aa, Homo Sapiens
GEFEKKYVAT

SEQ ID NO: 103352 - protein, 10 aa, Homo Sapiens
GEFGHIQKDC

SEQ ID NO: 103353 - protein, 10 aa, Homo Sapiens
GEFKLNQPEL

SEQ ID NO: 103354 - protein, 10 aa, Homo Sapiens
GEFKVSERYL

SEQ ID NO: 103355 - protein, 10 aa, Homo Sapiens
GEFNEQVLRL

SEQ ID NO: 103356 - protein, 10 aa, Homo Sapiens
GEFQIVNPHL

SEQ ID NO: 103357 - protein, 10 aa, Homo Sapiens
GEFRQGLISA

SEQ ID NO: 103358 - protein, 10 aa, Homo Sapiens
GEFRTGKTQI

SEQ ID NO: 103359 - protein, 10 aa, Homo Sapiens
GEFSDKLLSL

SEQ ID NO: 103360 - protein, 10 aa, Homo Sapiens
GEFSDTNAAV

SEQ ID NO: 103361 - protein, 10 aa, Homo Sapiens
GEFSLRGKEL

SEQ ID NO: 103362 - protein, 10 aa, Homo Sapiens
GEFTDLKQQL

SEQ ID NO: 103363 - protein, 10 aa, Homo Sapiens
GEGCVGKTSL

SEQ ID NO: 103364 - protein, 10 aa, Homo Sapiens
GEGKLFSLEL

SEQ ID NO: 103365 - protein, 10 aa, Homo Sapiens
GEGKNGTIEL

SEQ ID NO: 103366 - protein, 10 aa, Homo Sapiens
GEGMGISHEL

SEQ ID NO: 103367 - protein, 10 aa, Homo Sapiens
GEGNWSKILL

SEQ ID NO: 103368 - protein, 10 aa, Homo Sapiens
GEGQFGEVHL

SEQ ID NO: 103369 - protein, 10 aa, Homo Sapiens
GEGSFSTVVL

SEQ ID NO: 103370 - protein, 10 aa, Homo Sapiens
GEHDTTEYKL

SEQ ID NO: 103371 - protein, 10 aa, Homo Sapiens
GEHEIDYILL

SEQ ID NO: 103372 - protein, 10 aa, Homo Sapiens
GEHGDSSVAV

SEQ ID NO: 103373 - protein, 10 aa, Homo Sapiens
GEHGLIIRVK

SEQ ID NO: 103374 - protein, 10 aa, Homo Sapiens
GEHQINQIAL

SEQ ID NO: 103375 - protein, 10 aa, Homo Sapiens
GEIADAIKTL

SEQ ID NO: 103376 - protein, 10 aa, Homo Sapiens
GEIDGNKVTL

SEQ ID NO: 103377 - protein, 10 aa, Homo Sapiens
GEIDVPSHEL

SEQ ID NO: 103378 - protein, 10 aa, Homo Sapiens
GEIEGLNDTF

SEQ ID NO: 103379 - protein, 10 aa, Homo Sapiens
GEIFSEHSCL

SEQ ID NO: 103380 - protein, 10 aa, Homo Sapiens
GEIHDSKMRL

SEQ ID NO: 103381 - protein, 10 aa, Homo Sapiens
GEIINTHTLL

SEQ ID NO: 103382 - protein, 10 aa, Homo Sapiens
GEIKNIHLNL

SEQ ID NO: 103383 - protein, 10 aa, Homo Sapiens
GEIQQIPVQL

SEQ ID NO: 103384 - protein, 10 aa, Homo Sapiens
GEIRDLKTKT

SEQ ID NO: 103385 - protein, 10 aa, Homo Sapiens
GEIRNVGTGL

SEQ ID NO: 103386 - protein, 10 aa, Homo Sapiens
GEISDIHTKL

SEQ ID NO: 103387 - protein, 10 aa, Homo Sapiens
GEISKKVAQI

SEQ ID NO: 103388 - protein, 10 aa, Homo Sapiens
GEISLLKQQL

SEQ ID NO: 103389 - protein, 10 aa, Homo Sapiens
GEISMEKVKV

SEQ ID NO: 103390 - protein, 10 aa, Homo Sapiens
GEITTLNHKL

SEQ ID NO: 103391 - protein, 10 aa, Homo Sapiens
GEIVIGGQNI

SEQ ID NO: 103392 - protein, 10 aa, Homo Sapiens
GEIVTTIPTI

SEQ ID NO: 103393 - protein, 10 aa, Homo Sapiens
GEIVYCGQVF

SEQ ID NO: 103394 - protein, 10 aa, Homo Sapiens
GEKKPIDQRL

SEQ ID NO: 103395 - protein, 10 aa, Homo Sapiens
GEKNIAIEFL

SEQ ID NO: 103396 - protein, 10 aa, Homo Sapiens
GEKQFSEERI

SEQ ID NO: 103397 - protein, 10 aa, Homo Sapiens
GEKQINQEYL

SEQ ID NO: 103398 - protein, 10 aa, Homo Sapiens
GEKSPEPLGL

SEQ ID NO: 103399 - protein, 10 aa, Homo Sapiens
GELAANKSEM

SEQ ID NO: 103400 - protein, 10 aa, Homo Sapiens
GELDLPILKV

SEQ ID NO: 103401 - protein, 10 aa, Homo Sapiens
GELEAERQAL

SEQ ID NO: 103402 - protein, 10 aa, Homo Sapiens
GELEKENHQL

SEQ ID NO: 103403 - protein, 10 aa, Homo Sapiens
GELGNGNIKL

SEQ ID NO: 103404 - protein, 10 aa, Homo Sapiens
GELKDLTQKV

SEQ ID NO: 103405 - protein, 10 aa, Homo Sapiens
GELKHGPLAL

SEQ ID NO: 103406 - protein, 10 aa, Homo Sapiens
GELNVDSLIT

SEQ ID NO: 103407 - protein, 10 aa, Homo Sapiens
GELPQGFARL

SEQ ID NO: 103408 - protein, 10 aa, Homo Sapiens
GELQHASAVL

SEQ ID NO: 103409 - protein, 10 aa, Homo Sapiens
GELQKAILEL

SEQ ID NO: 103410 - protein, 10 aa, Homo Sapiens
GELQSLRPIL

SEQ ID NO: 103411 - protein, 10 aa, Homo Sapiens
GELREQLKAL

SEQ ID NO: 103412 - protein, 10 aa, Homo Sapiens
GELVSVAHAL

SEQ ID NO: 103413 - protein, 10 aa, Homo Sapiens
GEMKSGVPVL

SEQ ID NO: 103414 - protein, 10 aa, Homo Sapiens
GENKMGQLGL

SEQ ID NO: 103415 - protein, 10 aa, Homo Sapiens
GENPFATVKL

SEQ ID NO: 103416 - protein, 10 aa, Homo Sapiens
GENPHGVKAV

SEQ ID NO: 103417 - protein, 10 aa, Homo Sapiens
GEPEKLGQAL

SEQ ID NO: 103418 - protein, 10 aa, Homo Sapiens
GEPGFPLNAI

SEQ ID NO: 103419 - protein, 10 aa, Homo Sapiens
GEPRVKHFEA

SEQ ID NO: 103420 - protein, 10 aa, Homo Sapiens
GEPTNFVHTA

SEQ ID NO: 103421 - protein, 10 aa, Homo Sapiens
GEPVNGRHTL

SEQ ID NO: 103422 - protein, 10 aa, Homo Sapiens
GEQGGGKLVL

SEQ ID NO: 103423 - protein, 10 aa, Homo Sapiens
GERESGLRSL

SEQ ID NO: 103424 - protein, 10 aa, Homo Sapiens
GERESGVVAV

SEQ ID NO: 103425 - protein, 10 aa, Homo Sapiens
GERSGLKPPL

SEQ ID NO: 103426 - protein, 10 aa, Homo Sapiens
GESAVGKSSL

SEQ ID NO: 103427 - protein, 10 aa, Homo Sapiens
GESDDSILRL

SEQ ID NO: 103428 - protein, 10 aa, Homo Sapiens
GESGIKVAVL

SEQ ID NO: 103429 - protein, 10 aa, Homo Sapiens
GESGLGKSTL

SEQ ID NO: 103430 - protein, 10 aa, Homo Sapiens
GESGQSWPRL

SEQ ID NO: 103431 - protein, 10 aa, Homo Sapiens
GESHIGGVLL

SEQ ID NO: 103432 - protein, 10 aa, Homo Sapiens
GESIDIITRA

SEQ ID NO: 103433 - protein, 10 aa, Homo Sapiens
GESKLGGNEI

SEQ ID NO: 103434 - protein, 10 aa, Homo Sapiens
GESSGKNVTL

SEQ ID NO: 103435 - protein, 10 aa, Homo Sapiens
GESTVRTIAM

SEQ ID NO: 103436 - protein, 10 aa, Homo Sapiens
GETDKRQIAI

SEQ ID NO: 103437 - protein, 10 aa, Homo Sapiens
GETDWKLIAI

SEQ ID NO: 103438 - protein, 10 aa, Homo Sapiens
GETETRLECL

SEQ ID NO: 103439 - protein, 10 aa, Homo Sapiens
GETGIGKSTL

SEQ ID NO: 103440 - protein, 10 aa, Homo Sapiens
GETKISQSEL

SEQ ID NO: 103441 - protein, 10 aa, Homo Sapiens
GETPSGVKRL

SEQ ID NO: 103442 - protein, 10 aa, Homo Sapiens
GETREKSPKL

SEQ ID NO: 103443 - protein, 10 aa, Homo Sapiens
GETSVGKTSL

SEQ ID NO: 103444 - protein, 10 aa, Homo Sapiens
GEVDLRECVV

SEQ ID NO: 103445 - protein, 10 aa, Homo Sapiens
GEVDVEQHTL

SEQ ID NO: 103446 - protein, 10 aa, Homo Sapiens
GEVELLQQKL

SEQ ID NO: 103447 - protein, 10 aa, Homo Sapiens
GEVFRVVDTL

SEQ ID NO: 103448 - protein, 10 aa, Homo Sapiens
GEVHIGGVML

SEQ ID NO: 103449 - protein, 10 aa, Homo Sapiens
GEVHTGTTIM

SEQ ID NO: 103450 - protein, 10 aa, Homo Sapiens
GEVIPPMKEF

SEQ ID NO: 103451 - protein, 10 aa, Homo Sapiens
GEVIRTLPSL

SEQ ID NO: 103452 - protein, 10 aa, Homo Sapiens
GEVKPVLQKL

SEQ ID NO: 103453 - protein, 10 aa, Homo Sapiens
GEVLIDTHLF

SEQ ID NO: 103454 - protein, 10 aa, Homo Sapiens
GEVNLGPNKM

SEQ ID NO: 103455 - protein, 10 aa, Homo Sapiens
GEVPFNHEIL

SEQ ID NO: 103456 - protein, 10 aa, Homo Sapiens
GEVQDLLVRL

SEQ ID NO: 103457 - protein, 10 aa, Homo Sapiens
GEVSGLMRKV

SEQ ID NO: 103458 - protein, 10 aa, Homo Sapiens
GEWEESEVKL

SEQ ID NO: 103459 - protein, 10 aa, Homo Sapiens
GEWNRKSPNL

SEQ ID NO: 103460 - protein, 10 aa, Homo Sapiens
GEWTAPAPEF

SEQ ID NO: 103461 - protein, 10 aa, Homo Sapiens
GEWVERTQQL

SEQ ID NO: 103462 - protein, 10 aa, Homo Sapiens
GEWYIRGQTI

SEQ ID NO: 103463 - protein, 10 aa, Homo Sapiens
GEYDMTVPKL

SEQ ID NO: 103464 - protein, 10 aa, Homo Sapiens
GEYDVTMPKV

SEQ ID NO: 103465 - protein, 10 aa, Homo Sapiens
GEYDVTVPKL

SEQ ID NO: 103466 - protein, 10 aa, Homo Sapiens
GEYEKGVDHL

SEQ ID NO: 103467 - protein, 10 aa, Homo Sapiens
GEYFPGTGDL

SEQ ID NO: 103468 - protein, 10 aa, Homo Sapiens
GEYKKTLLKL

SEQ ID NO: 103469 - protein, 10 aa, Homo Sapiens
GEYPLTAMTL

SEQ ID NO: 103470 - protein, 10 aa, Homo Sapiens
GEYPSGINTW

SEQ ID NO: 103471 - protein, 10 aa, Homo Sapiens
GEYRGSDFTA

SEQ ID NO: 103472 - protein, 10 aa, Homo Sapiens
GEYTEHLHSA

SEQ ID NO: 103473 - protein, 10 aa, Homo Sapiens
GSDPVVIVSA

SEQ ID NO: 103474 - protein, 10 aa, Homo Sapiens
GVEARTLLKL

SEQ ID NO: 103475 - protein, 10 aa, Homo Sapiens
HEAAFPIAVV

SEQ ID NO: 103476 - protein, 10 aa, Homo Sapiens
HEAEDLKMLI

SEQ ID NO: 103477 - protein, 10 aa, Homo Sapiens
HEALKENGVT

SEQ ID NO: 103478 - protein, 10 aa, Homo Sapiens
HEAQHGVTSL

SEQ ID NO: 103479 - protein, 10 aa, Homo Sapiens
HEAQLKNGSL

SEQ ID NO: 103480 - protein, 10 aa, Homo Sapiens
HEASAILVHL

SEQ ID NO: 103481 - protein, 10 aa, Homo Sapiens
HEATLRCWAL

SEQ ID NO: 103482 - protein, 10 aa, Homo Sapiens
HEAVIEKHVF

SEQ ID NO: 103483 - protein, 10 aa, Homo Sapiens
HEFLHEVPAA

SEQ ID NO: 103484 - protein, 10 aa, Homo Sapiens
HEGEGNIRSV

SEQ ID NO: 103485 - protein, 10 aa, Homo Sapiens
HEHRGTPVGL

SEQ ID NO: 103486 - protein, 10 aa, Homo Sapiens
HEIESLYTKL

SEQ ID NO: 103487 - protein, 10 aa, Homo Sapiens
HEIESRILDL

SEQ ID NO: 103488 - protein, 10 aa, Homo Sapiens
HEIEVIDQRL

SEQ ID NO: 103489 - protein, 10 aa, Homo Sapiens
HEIEVIGGYL

SEQ ID NO: 103490 - protein, 10 aa, Homo Sapiens
HEIGELQQRL

SEQ ID NO: 103491 - protein, 10 aa, Homo Sapiens
HEIGHGIAAI

SEQ ID NO: 103492 - protein, 10 aa, Homo Sapiens
HEINGLLVGF

SEQ ID NO: 103493 - protein, 10 aa, Homo Sapiens
HEIQRTENSL

SEQ ID NO: 103494 - protein, 10 aa, Homo Sapiens
HEIQSDVLTI

SEQ ID NO: 103495 - protein, 10 aa, Homo Sapiens
HEIRTGVRTL

SEQ ID NO: 103496 - protein, 10 aa, Homo Sapiens
HEISEGNVAT

SEQ ID NO: 103497 - protein, 10 aa, Homo Sapiens
HEISNAVREM

SEQ ID NO: 103498 - protein, 10 aa, Homo Sapiens
HEKPEIFTEL

SEQ ID NO: 103499 - protein, 10 aa, Homo Sapiens
HEKQVYDIAA

SEQ ID NO: 103500 - protein, 10 aa, Homo Sapiens
HELVPEHVVM

SEQ ID NO: 103501 - protein, 10 aa, Homo Sapiens
HEMEEIRKKL

SEQ ID NO: 103502 - protein, 10 aa, Homo Sapiens
HEMQIQHPTA

SEQ ID NO: 103503 - protein, 10 aa, Homo Sapiens
HENPDIIIAT

SEQ ID NO: 103504 - protein, 10 aa, Homo Sapiens
HERNLQSDVL

SEQ ID NO: 103505 - protein, 10 aa, Homo Sapiens
HERTIHTDVL

SEQ ID NO: 103506 - protein, 10 aa, Homo Sapiens
HESAVTGLSL

SEQ ID NO: 103507 - protein, 10 aa, Homo Sapiens
HEVDELTQII

SEQ ID NO: 103508 - protein, 10 aa, Homo Sapiens
HEVEQGCAVL

SEQ ID NO: 103509 - protein, 10 aa, Homo Sapiens
HEVHPISSGL

SEQ ID NO: 103510 - protein, 10 aa, Homo Sapiens
HEWEERRDAL

SEQ ID NO: 103511 - protein, 10 aa, Homo Sapiens
HEYFPEMQIL

SEQ ID NO: 103512 - protein, 10 aa, Homo Sapiens
HEYKGPKADL

SEQ ID NO: 103513 - protein, 10 aa, Homo Sapiens
HEYNERVRTL

SEQ ID NO: 103514 - protein, 10 aa, Homo Sapiens
HEYSEELEKL

SEQ ID NO: 103515 - protein, 10 aa, Homo Sapiens
IEFVADRLML

SEQ ID NO: 103516 - protein, 10 aa, Homo Sapiens
IEKEGVEHQL

SEQ ID NO: 103517 - protein, 10 aa, Homo Sapiens
IEKKKGDFVL

SEQ ID NO: 103518 - protein, 10 aa, Homo Sapiens
IENGEKITSL

SEQ ID NO: 103519 - protein, 10 aa, Homo Sapiens
IEPFSSPPEL

SEQ ID NO: 103520 - protein, 10 aa, Homo Sapiens
IEVDGKQVEL

SEQ ID NO: 103521 - protein, 10 aa, Homo Sapiens
IEWRDRRITL

SEQ ID NO: 103522 - protein, 10 aa, Homo Sapiens
KEAADIIQKL

SEQ ID NO: 103523 - protein, 10 aa, Homo Sapiens
KEAAGEGPAL

SEQ ID NO: 103524 - protein, 10 aa, Homo Sapiens
KEAAIGVLVL

SEQ ID NO: 103525 - protein, 10 aa, Homo Sapiens
KEAEKIIKNL

SEQ ID NO: 103526 - protein, 10 aa, Homo Sapiens
KEAEKLERQL

SEQ ID NO: 103527 - protein, 10 aa, Homo Sapiens
KEAELKDLLL

SEQ ID NO: 103528 - protein, 10 aa, Homo Sapiens
KEAGNINRSL

SEQ ID NO: 103529 - protein, 10 aa, Homo Sapiens
KEAGNINTSL

SEQ ID NO: 103530 - protein, 10 aa, Homo Sapiens
KEAIETIVAA

SEQ ID NO: 103531 - protein, 10 aa, Homo Sapiens
KEALENCITL

SEQ ID NO: 103532 - protein, 10 aa, Homo Sapiens
KEALGIPAAA

SEQ ID NO: 103533 - protein, 10 aa, Homo Sapiens
KEANPAVPEV

SEQ ID NO: 103534 - protein, 10 aa, Homo Sapiens
KEAQLYAAQA

SEQ ID NO: 103535 - protein, 10 aa, Homo Sapiens
KEAVQCVQEL

SEQ ID NO: 103536 - protein, 10 aa, Homo Sapiens
KEDDVRQYVV

SEQ ID NO: 103537 - protein, 10 aa, Homo Sapiens
KEDRGRPYTL

SEQ ID NO: 103538 - protein, 10 aa, Homo Sapiens
KEEEAGVKEL

SEQ ID NO: 103539 - protein, 10 aa, Homo Sapiens
KEETQPPVAL

SEQ ID NO: 103540 - protein, 10 aa, Homo Sapiens
KEFDGKSLVS

SEQ ID NO: 103541 - protein, 10 aa, Homo Sapiens
KEFDGTKVFL

SEQ ID NO: 103542 - protein, 10 aa, Homo Sapiens
KEFEDAVRKV

SEQ ID NO: 103543 - protein, 10 aa, Homo Sapiens
KEFEDKKVEL

SEQ ID NO: 103544 - protein, 10 aa, Homo Sapiens
KEFEENTQHL

SEQ ID NO: 103545 - protein, 10 aa, Homo Sapiens
KEFEGKTLVS

SEQ ID NO: 103546 - protein, 10 aa, Homo Sapiens
KEFEKASKIL

SEQ ID NO: 103547 - protein, 10 aa, Homo Sapiens
KEFEQLAPVL

SEQ ID NO: 103548 - protein, 10 aa, Homo Sapiens
KEFETAETLL

SEQ ID NO: 103549 - protein, 10 aa, Homo Sapiens
KEFEVKDPEL

SEQ ID NO: 103550 - protein, 10 aa, Homo Sapiens
KEFGDDKVQL

SEQ ID NO: 103551 - protein, 10 aa, Homo Sapiens
KEFIEGVSQF

SEQ ID NO: 103552 - protein, 10 aa, Homo Sapiens
KEFLPEGQDI

SEQ ID NO: 103553 - protein, 10 aa, Homo Sapiens
KEFSGNPIKV

SEQ ID NO: 103554 - protein, 10 aa, Homo Sapiens
KEGANINKSL

SEQ ID NO: 103555 - protein, 10 aa, Homo Sapiens
KEGDFNNLTA

SEQ ID NO: 103556 - protein, 10 aa, Homo Sapiens
KEGEDLIQQL

SEQ ID NO: 103557 - protein, 10 aa, Homo Sapiens
KEIAAVIETV

SEQ ID NO: 103558 - protein, 10 aa, Homo Sapiens
KEIDGRLKEL

SEQ ID NO: 103559 - protein, 10 aa, Homo Sapiens
KEIEELQSQA

SEQ ID NO: 103560 - protein, 10 aa, Homo Sapiens
KEIELPSGQL

SEQ ID NO: 103561 - protein, 10 aa, Homo Sapiens
KEIENTYANV

SEQ ID NO: 103562 - protein, 10 aa, Homo Sapiens
KEIESTKGEL

SEQ ID NO: 103563 - protein, 10 aa, Homo Sapiens
KEIFFHYSEF

SEQ ID NO: 103564 - protein, 10 aa, Homo Sapiens
KEILGTAQSV

SEQ ID NO: 103565 - protein, 10 aa, Homo Sapiens
KEINEKSNIL

SEQ ID NO: 103566 - protein, 10 aa, Homo Sapiens
KEINKAQNAI

SEQ ID NO: 103567 - protein, 10 aa, Homo Sapiens
KEINTNQEAL

SEQ ID NO: 103568 - protein, 10 aa, Homo Sapiens
KEIQGFLDCA

SEQ ID NO: 103569 - protein, 10 aa, Homo Sapiens
KEIQGHQPRI

SEQ ID NO: 103570 - protein, 10 aa, Homo Sapiens
KEIQKLETEL

SEQ ID NO: 103571 - protein, 10 aa, Homo Sapiens
KEISYFVAEF

SEQ ID NO: 103572 - protein, 10 aa, Homo Sapiens
KEITQEMQTL

SEQ ID NO: 103573 - protein, 10 aa, Homo Sapiens
KEIYDDLQAL

SEQ ID NO: 103574 - protein, 10 aa, Homo Sapiens
KEKAIEVERI

SEQ ID NO: 103575 - protein, 10 aa, Homo Sapiens
KEKAILQATL

SEQ ID NO: 103576 - protein, 10 aa, Homo Sapiens
KEKDFSPEAL

SEQ ID NO: 103577 - protein, 10 aa, Homo Sapiens
KEKDNIDITL

SEQ ID NO: 103578 - protein, 10 aa, Homo Sapiens
KEKEGEVFTL

SEQ ID NO: 103579 - protein, 10 aa, Homo Sapiens
KEKELPGQTL

SEQ ID NO: 103580 - protein, 10 aa, Homo Sapiens
KEKEPDYVLL

SEQ ID NO: 103581 - protein, 10 aa, Homo Sapiens
KEKEPEYTLL

SEQ ID NO: 103582 - protein, 10 aa, Homo Sapiens
KEKGLEHVTV

SEQ ID NO: 103583 - protein, 10 aa, Homo Sapiens
KEKKLLEDRI

SEQ ID NO: 103584 - protein, 10 aa, Homo Sapiens
KEKKLVKEVI

SEQ ID NO: 103585 - protein, 10 aa, Homo Sapiens
KEKLIQEGKL

SEQ ID NO: 103586 - protein, 10 aa, Homo Sapiens
KEKSFLDLVV

SEQ ID NO: 103587 - protein, 10 aa, Homo Sapiens
KEKTLGKEVL

SEQ ID NO: 103588 - protein, 10 aa, Homo Sapiens
KEKYIDQEEL

SEQ ID NO: 103589 - protein, 10 aa, Homo Sapiens
KEKYPDAVYL

SEQ ID NO: 103590 - protein, 10 aa, Homo Sapiens
KELDQWIEQL

SEQ ID NO: 103591 - protein, 10 aa, Homo Sapiens
KELDSKTIRA

SEQ ID NO: 103592 - protein, 10 aa, Homo Sapiens
KELDVQIIGV

SEQ ID NO: 103593 - protein, 10 aa, Homo Sapiens
KELEAFREEL

SEQ ID NO: 103594 - protein, 10 aa, Homo Sapiens
KELEEKVMEL

SEQ ID NO: 103595 - protein, 10 aa, Homo Sapiens
KELEENKRSL

SEQ ID NO: 103596 - protein, 10 aa, Homo Sapiens
KELEGPQIAV

SEQ ID NO: 103597 - protein, 10 aa, Homo Sapiens
KELGLAEHQL

SEQ ID NO: 103598 - protein, 10 aa, Homo Sapiens
KELGSSTNAL

SEQ ID NO: 103599 - protein, 10 aa, Homo Sapiens
KELHIQGNRL

SEQ ID NO: 103600 - protein, 10 aa, Homo Sapiens
KELKAFNIRL

SEQ ID NO: 103601 - protein, 10 aa, Homo Sapiens
KELLGQGLLL

SEQ ID NO: 103602 - protein, 10 aa, Homo Sapiens
KELLLQPVTI

SEQ ID NO: 103603 - protein, 10 aa, Homo Sapiens
KELNEAVAAL

SEQ ID NO: 103604 - protein, 10 aa, Homo Sapiens
KELQDVGQSL

SEQ ID NO: 103605 - protein, 10 aa, Homo Sapiens
KELTLENSEL

SEQ ID NO: 103606 - protein, 10 aa, Homo Sapiens
KELYVPENKL

SEQ ID NO: 103607 - protein, 10 aa, Homo Sapiens
KEMDLSVVRL

SEQ ID NO: 103608 - protein, 10 aa, Homo Sapiens
KEMEVKPSSV

SEQ ID NO: 103609 - protein, 10 aa, Homo Sapiens
KEMGTPDVRI

SEQ ID NO: 103610 - protein, 10 aa, Homo Sapiens
KEMQDVQGAL

SEQ ID NO: 103611 - protein, 10 aa, Homo Sapiens
KEMSEYCSTL

SEQ ID NO: 103612 - protein, 10 aa, Homo Sapiens
KENDFDRLVL

SEQ ID NO: 103613 - protein, 10 aa, Homo Sapiens
KENQHVQQTL

SEQ ID NO: 103614 - protein, 10 aa, Homo Sapiens
KENRPGAYEL

SEQ ID NO: 103615 - protein, 10 aa, Homo Sapiens
KENSALKECL

SEQ ID NO: 103616 - protein, 10 aa, Homo Sapiens
KENSPEKFAL

SEQ ID NO: 103617 - protein, 10 aa, Homo Sapiens
KEPESILQVL

SEQ ID NO: 103618 - protein, 10 aa, Homo Sapiens
KERELDQQKL

SEQ ID NO: 103619 - protein, 10 aa, Homo Sapiens
KESAAINQIL

SEQ ID NO: 103620 - protein, 10 aa, Homo Sapiens
KESAEFQTQL

SEQ ID NO: 103621 - protein, 10 aa, Homo Sapiens
KESEKIIAEL

SEQ ID NO: 103622 - protein, 10 aa, Homo Sapiens
KESGAINTSL

SEQ ID NO: 103623 - protein, 10 aa, Homo Sapiens
KESHEMGQAL

SEQ ID NO: 103624 - protein, 10 aa, Homo Sapiens
KESQVYVHAL

SEQ ID NO: 103625 - protein, 10 aa, Homo Sapiens
KESSIIGVTL

SEQ ID NO: 103626 - protein, 10 aa, Homo Sapiens
KESTQGVSSL

SEQ ID NO: 103627 - protein, 10 aa, Homo Sapiens
KETEIKEITV

SEQ ID NO: 103628 - protein, 10 aa, Homo Sapiens
KEVDDLTAEL

SEQ ID NO: 103629 - protein, 10 aa, Homo Sapiens
KEVDIYTVKV

SEQ ID NO: 103630 - protein, 10 aa, Homo Sapiens
KEVDNFVDKL

SEQ ID NO: 103631 - protein, 10 aa, Homo Sapiens
KEVDPGTKTA

SEQ ID NO: 103632 - protein, 10 aa, Homo Sapiens
KEVDSKSQVI

SEQ ID NO: 103633 - protein, 10 aa, Homo Sapiens
KEVEASHLAL

SEQ ID NO: 103634 - protein, 10 aa, Homo Sapiens
KEVEIAYSDV

SEQ ID NO: 103635 - protein, 10 aa, Homo Sapiens
KEVEIRKKVL

SEQ ID NO: 103636 - protein, 10 aa, Homo Sapiens
KEVEQFTQVA

SEQ ID NO: 103637 - protein, 10 aa, Homo Sapiens
KEVIGGLCSL

SEQ ID NO: 103638 - protein, 10 aa, Homo Sapiens
KEVLLENTNL

SEQ ID NO: 103639 - protein, 10 aa, Homo Sapiens
KEVSMDDHKL

SEQ ID NO: 103640 - protein, 10 aa, Homo Sapiens
KEVTAAREAL

SEQ ID NO: 103641 - protein, 10 aa, Homo Sapiens
KEWKKKYVTL

SEQ ID NO: 103642 - protein, 10 aa, Homo Sapiens
KEYAVNEVVA

SEQ ID NO: 103643 - protein, 10 aa, Homo Sapiens
KEYEKTQTVL

SEQ ID NO: 103644 - protein, 10 aa, Homo Sapiens
KEYSDDKVQL

SEQ ID NO: 103645 - protein, 10 aa, Homo Sapiens
LEANLAVLKL

SEQ ID NO: 103646 - protein, 10 aa, Homo Sapiens
LEFEGDPHCL

SEQ ID NO: 103647 - protein, 10 aa, Homo Sapiens
LEFENQKTRL

SEQ ID NO: 103648 - protein, 10 aa, Homo Sapiens
LEFQKSLETL

SEQ ID NO: 103649 - protein, 10 aa, Homo Sapiens
LEIDGLEEKL

SEQ ID NO: 103650 - protein, 10 aa, Homo Sapiens
LEKAGVEHQL

SEQ ID NO: 103651 - protein, 10 aa, Homo Sapiens
LEKNGADEKL

SEQ ID NO: 103652 - protein, 10 aa, Homo Sapiens
LEKSGVLDTL

SEQ ID NO: 103653 - protein, 10 aa, Homo Sapiens
LENPHQPASL

SEQ ID NO: 103654 - protein, 10 aa, Homo Sapiens
LERAPGETAL

SEQ ID NO: 103655 - protein, 10 aa, Homo Sapiens
LERDISQDSL

SEQ ID NO: 103656 - protein, 10 aa, Homo Sapiens
LERGDGPICL

SEQ ID NO: 103657 - protein, 10 aa, Homo Sapiens
LERTEGLSVL

SEQ ID NO: 103658 - protein, 10 aa, Homo Sapiens
LEVDGHFVTM

SEQ ID NO: 103659 - protein, 10 aa, Homo Sapiens
LEVIIKDNSL

SEQ ID NO: 103660 - protein, 10 aa, Homo Sapiens
LEYQIKTNQL

SEQ ID NO: 103661 - protein, 10 aa, Homo Sapiens
LGEGKVKAIG

SEQ ID NO: 103662 - protein, 10 aa, Homo Sapiens
LSKPFLDIVL

SEQ ID NO: 103663 - protein, 10 aa, Homo Sapiens
MELLDGKQTL

SEQ ID NO: 103664 - protein, 10 aa, Homo Sapiens
MEVEVDGQKF

SEQ ID NO: 103665 - protein, 10 aa, Homo Sapiens
MEYKGYLVSV

SEQ ID NO: 103666 - protein, 10 aa, Homo Sapiens
MSIDALKDLL

SEQ ID NO: 103667 - protein, 10 aa, Homo Sapiens
NEIENLKNEL

SEQ ID NO: 103668 - protein, 10 aa, Homo Sapiens
NEIGVPLPRL

SEQ ID NO: 103669 - protein, 10 aa, Homo Sapiens
NEILNGIKVL

SEQ ID NO: 103670 - protein, 10 aa, Homo Sapiens
QATTFTLTGL

SEQ ID NO: 103671 - protein, 10 aa, Homo Sapiens
QEAEMAQNAV

SEQ ID NO: 103672 - protein, 10 aa, Homo Sapiens
QEAVAGAAVL

SEQ ID NO: 103673 - protein, 10 aa, Homo Sapiens
QECEGLIRQL

SEQ ID NO: 103674 - protein, 10 aa, Homo Sapiens
QEFAGRLNSV

SEQ ID NO: 103675 - protein, 10 aa, Homo Sapiens
QEFELPYVSV

SEQ ID NO: 103676 - protein, 10 aa, Homo Sapiens
QEGAKMAVRL

SEQ ID NO: 103677 - protein, 10 aa, Homo Sapiens
QEIDGKSLLL

SEQ ID NO: 103678 - protein, 10 aa, Homo Sapiens
QEIDGRFTSI

SEQ ID NO: 103679 - protein, 10 aa, Homo Sapiens
QEIDLTGVKL

SEQ ID NO: 103680 - protein, 10 aa, Homo Sapiens
QEIEEFKERL

SEQ ID NO: 103681 - protein, 10 aa, Homo Sapiens
QEIIIRDGSL

SEQ ID NO: 103682 - protein, 10 aa, Homo Sapiens
QEIKTKIKEL

SEQ ID NO: 103683 - protein, 10 aa, Homo Sapiens
QEIQTSVATL

SEQ ID NO: 103684 - protein, 10 aa, Homo Sapiens
QEIRLEPQEV

SEQ ID NO: 103685 - protein, 10 aa, Homo Sapiens
QEKDIKKEEI

SEQ ID NO: 103686 - protein, 10 aa, Homo Sapiens
QEKLPDEVVL

SEQ ID NO: 103687 - protein, 10 aa, Homo Sapiens
QELDLSNNHL

SEQ ID NO: 103688 - protein, 10 aa, Homo Sapiens
QENEIRGLCL

SEQ ID NO: 103689 - protein, 10 aa, Homo Sapiens
QENEPEPLSL

SEQ ID NO: 103690 - protein, 10 aa, Homo Sapiens
QESAAKLHAL

SEQ ID NO: 103691 - protein, 10 aa, Homo Sapiens
QESEARIQQL

SEQ ID NO: 103692 - protein, 10 aa, Homo Sapiens
QEVDAIGQTL

SEQ ID NO: 103693 - protein, 10 aa, Homo Sapiens
QEVKNLHQRL

SEQ ID NO: 103694 - protein, 10 aa, Homo Sapiens
QEVYHKSMTL

SEQ ID NO: 103695 - protein, 10 aa, Homo Sapiens
QEWDGKESTI

SEQ ID NO: 103696 - protein, 10 aa, Homo Sapiens
QEYEDIAVKL

SEQ ID NO: 103697 - protein, 10 aa, Homo Sapiens
REAAYNAITL

SEQ ID NO: 103698 - protein, 10 aa, Homo Sapiens
READFKETLL

SEQ ID NO: 103699 - protein, 10 aa, Homo Sapiens
REAEAAIYHL

SEQ ID NO: 103700 - protein, 10 aa, Homo Sapiens
REAEDMVQKV

SEQ ID NO: 103701 - protein, 10 aa, Homo Sapiens
REAEETQSTL

SEQ ID NO: 103702 - protein, 10 aa, Homo Sapiens
REAEFTKSIA

SEQ ID NO: 103703 - protein, 10 aa, Homo Sapiens
REAEHGYASL

SEQ ID NO: 103704 - protein, 10 aa, Homo Sapiens
REAEHLYHTL

SEQ ID NO: 103705 - protein, 10 aa, Homo Sapiens
REAEKVLHYL

SEQ ID NO: 103706 - protein, 10 aa, Homo Sapiens
REAELLRKQL

SEQ ID NO: 103707 - protein, 10 aa, Homo Sapiens
REAELRKQRL

SEQ ID NO: 103708 - protein, 10 aa, Homo Sapiens
REAEMRNSIL

SEQ ID NO: 103709 - protein, 10 aa, Homo Sapiens
REAEQRRAYL

SEQ ID NO: 103710 - protein, 10 aa, Homo Sapiens
REAFLVNSDL

SEQ ID NO: 103711 - protein, 10 aa, Homo Sapiens
REAGIQPSLL

SEQ ID NO: 103712 - protein, 10 aa, Homo Sapiens
REAGQCFESF

SEQ ID NO: 103713 - protein, 10 aa, Homo Sapiens
REAHAQSIGM

SEQ ID NO: 103714 - protein, 10 aa, Homo Sapiens
REANFTVSSM

SEQ ID NO: 103715 - protein, 10 aa, Homo Sapiens
REAPESAQCL

SEQ ID NO: 103716 - protein, 10 aa, Homo Sapiens
REASPSNSCL

SEQ ID NO: 103717 - protein, 10 aa, Homo Sapiens
REAVVNTQEL

SEQ ID NO: 103718 - protein, 10 aa, Homo Sapiens
RECEIKYTGF

SEQ ID NO: 103719 - protein, 10 aa, Homo Sapiens
RECENQLVLL

SEQ ID NO: 103720 - protein, 10 aa, Homo Sapiens
RECVGKTVTL

SEQ ID NO: 103721 - protein, 10 aa, Homo Sapiens
REDGSHILTV

SEQ ID NO: 103722 - protein, 10 aa, Homo Sapiens
REFDYVINDL

SEQ ID NO: 103723 - protein, 10 aa, Homo Sapiens
REFEKMNQSL

SEQ ID NO: 103724 - protein, 10 aa, Homo Sapiens
REFLDGTRKT

SEQ ID NO: 103725 - protein, 10 aa, Homo Sapiens
REFPTHRSVL

SEQ ID NO: 103726 - protein, 10 aa, Homo Sapiens
REGDLLFTVA

SEQ ID NO: 103727 - protein, 10 aa, Homo Sapiens
REGEKLIRLH

SEQ ID NO: 103728 - protein, 10 aa, Homo Sapiens
REGERREQVL

SEQ ID NO: 103729 - protein, 10 aa, Homo Sapiens
REGETMILTL

SEQ ID NO: 103730 - protein, 10 aa, Homo Sapiens
REGGSIPVTL

SEQ ID NO: 103731 - protein, 10 aa, Homo Sapiens
REGHTSVHTL

SEQ ID NO: 103732 - protein, 10 aa, Homo Sapiens
REGKIAGRAV

SEQ ID NO: 103733 - protein, 10 aa, Homo Sapiens
REGNAVAVRL

SEQ ID NO: 103734 - protein, 10 aa, Homo Sapiens
REGNVPNIII

SEQ ID NO: 103735 - protein, 10 aa, Homo Sapiens
REGSASTEVL

SEQ ID NO: 103736 - protein, 10 aa, Homo Sapiens
REGYCFTEVL

SEQ ID NO: 103737 - protein, 10 aa, Homo Sapiens
REHDIAIKFF

SEQ ID NO: 103738 - protein, 10 aa, Homo Sapiens
REHVTKTQIL

SEQ ID NO: 103739 - protein, 10 aa, Homo Sapiens
REIADKLIEL

SEQ ID NO: 103740 - protein, 10 aa, Homo Sapiens
REIAEVNKKL

SEQ ID NO: 103741 - protein, 10 aa, Homo Sapiens
REIDKKMNSI

SEQ ID NO: 103742 - protein, 10 aa, Homo Sapiens
REIEEKLHKL

SEQ ID NO: 103743 - protein, 10 aa, Homo Sapiens
REIEENQKRI

SEQ ID NO: 103744 - protein, 10 aa, Homo Sapiens
REIEGRAIRL

SEQ ID NO: 103745 - protein, 10 aa, Homo Sapiens
REIEGSQVTF

SEQ ID NO: 103746 - protein, 10 aa, Homo Sapiens
REIEIRFDQL

SEQ ID NO: 103747 - protein, 10 aa, Homo Sapiens
REIELKVMKF

SEQ ID NO: 103748 - protein, 10 aa, Homo Sapiens
REIFLSQPIL

SEQ ID NO: 103749 - protein, 10 aa, Homo Sapiens
REIKDTQAQL

SEQ ID NO: 103750 - protein, 10 aa, Homo Sapiens
REILVEESNV

SEQ ID NO: 103751 - protein, 10 aa, Homo Sapiens
REILVKELTT

SEQ ID NO: 103752 - protein, 10 aa, Homo Sapiens
REIMGTPEYL

SEQ ID NO: 103753 - protein, 10 aa, Homo Sapiens
REIQDAYLQL

SEQ ID NO: 103754 - protein, 10 aa, Homo Sapiens
REIQDDMQTL

SEQ ID NO: 103755 - protein, 10 aa, Homo Sapiens
REIQGKKAAL

SEQ ID NO: 103756 - protein, 10 aa, Homo Sapiens
REIQTAVRLL

SEQ ID NO: 103757 - protein, 10 aa, Homo Sapiens
REIRKDNQFL

SEQ ID NO: 103758 - protein, 10 aa, Homo Sapiens
REIRRKLREL

SEQ ID NO: 103759 - protein, 10 aa, Homo Sapiens
REISDHVLRM

SEQ ID NO: 103760 - protein, 10 aa, Homo Sapiens
REITKPLRPL

SEQ ID NO: 103761 - protein, 10 aa, Homo Sapiens
REKAVRVDKL

SEQ ID NO: 103762 - protein, 10 aa, Homo Sapiens
REKDDANFKL

SEQ ID NO: 103763 - protein, 10 aa, Homo Sapiens
REKDDDVVSL

SEQ ID NO: 103764 - protein, 10 aa, Homo Sapiens
REKDPKYSAL

SEQ ID NO: 103765 - protein, 10 aa, Homo Sapiens
REKELAKVTI

SEQ ID NO: 103766 - protein, 10 aa, Homo Sapiens
REKETKALSL

SEQ ID NO: 103767 - protein, 10 aa, Homo Sapiens
REKHPDGKIL

SEQ ID NO: 103768 - protein, 10 aa, Homo Sapiens
REKIATQQRL

SEQ ID NO: 103769 - protein, 10 aa, Homo Sapiens
REKKILEVHI

SEQ ID NO: 103770 - protein, 10 aa, Homo Sapiens
REKLPSSEVV

SEQ ID NO: 103771 - protein, 10 aa, Homo Sapiens
REKMKGELGM

SEQ ID NO: 103772 - protein, 10 aa, Homo Sapiens
REKPDDPLNY

SEQ ID NO: 103773 - protein, 10 aa, Homo Sapiens
REKQPPIDNI

SEQ ID NO: 103774 - protein, 10 aa, Homo Sapiens
REKTLITEKL

SEQ ID NO: 103775 - protein, 10 aa, Homo Sapiens
REKTLTEHAL

SEQ ID NO: 103776 - protein, 10 aa, Homo Sapiens
REKVIKGAEI

SEQ ID NO: 103777 - protein, 10 aa, Homo Sapiens
RELAQQIQKV

SEQ ID NO: 103778 - protein, 10 aa, Homo Sapiens
RELAQQVQQV

SEQ ID NO: 103779 - protein, 10 aa, Homo Sapiens
RELDATATVL

SEQ ID NO: 103780 - protein, 10 aa, Homo Sapiens
RELDLEENKL

SEQ ID NO: 103781 - protein, 10 aa, Homo Sapiens
RELDLYDNQI

SEQ ID NO: 103782 - protein, 10 aa, Homo Sapiens
RELDRERQKL

SEQ ID NO: 103783 - protein, 10 aa, Homo Sapiens
RELEDHIRKL

SEQ ID NO: 103784 - protein, 10 aa, Homo Sapiens
RELEETNQKL

SEQ ID NO: 103785 - protein, 10 aa, Homo Sapiens
RELEKAKVAA

SEQ ID NO: 103786 - protein, 10 aa, Homo Sapiens
RELENGNLEV

SEQ ID NO: 103787 - protein, 10 aa, Homo Sapiens
RELESQLHVL

SEQ ID NO: 103788 - protein, 10 aa, Homo Sapiens
RELEVQHPAA

SEQ ID NO: 103789 - protein, 10 aa, Homo Sapiens
RELGFSSNLL

SEQ ID NO: 103790 - protein, 10 aa, Homo Sapiens
RELLKPNASV

SEQ ID NO: 103791 - protein, 10 aa, Homo Sapiens
RELLNPVVEF

SEQ ID NO: 103792 - protein, 10 aa, Homo Sapiens
RELMGGIGKT

SEQ ID NO: 103793 - protein, 10 aa, Homo Sapiens
RELPAGINSI

SEQ ID NO: 103794 - protein, 10 aa, Homo Sapiens
RELQEAPLSL

SEQ ID NO: 103795 - protein, 10 aa, Homo Sapiens
RELQLQEVAL

SEQ ID NO: 103796 - protein, 10 aa, Homo Sapiens
RELQPGVKAV

SEQ ID NO: 103797 - protein, 10 aa, Homo Sapiens
RELQQENKEL

SEQ ID NO: 103798 - protein, 10 aa, Homo Sapiens
RELVEKNSQL

SEQ ID NO: 103799 - protein, 10 aa, Homo Sapiens
RELVSGGRSV

SEQ ID NO: 103800 - protein, 10 aa, Homo Sapiens
REMENIIATV

SEQ ID NO: 103801 - protein, 10 aa, Homo Sapiens
REMERLIKKL

SEQ ID NO: 103802 - protein, 10 aa, Homo Sapiens
REMKDLKEKM

SEQ ID NO: 103803 - protein, 10 aa, Homo Sapiens
REMQEKLARL

SEQ ID NO: 103804 - protein, 10 aa, Homo Sapiens
REMVATQQEM

SEQ ID NO: 103805 - protein, 10 aa, Homo Sapiens
RENEVLKVQL

SEQ ID NO: 103806 - protein, 10 aa, Homo Sapiens
RENGKTVIRV

SEQ ID NO: 103807 - protein, 10 aa, Homo Sapiens
RENNKPRTVL

SEQ ID NO: 103808 - protein, 10 aa, Homo Sapiens
RENPQLLQQI

SEQ ID NO: 103809 - protein, 10 aa, Homo Sapiens
RENPVVPIGC

SEQ ID NO: 103810 - protein, 10 aa, Homo Sapiens
RENTQTTIKL

SEQ ID NO: 103811 - protein, 10 aa, Homo Sapiens
REQEAREPVL

SEQ ID NO: 103812 - protein, 10 aa, Homo Sapiens
RERDLGAQRL

SEQ ID NO: 103813 - protein, 10 aa, Homo Sapiens
RERFLKGEGL

SEQ ID NO: 103814 - protein, 10 aa, Homo Sapiens
RERIIPRSVL

SEQ ID NO: 103815 - protein, 10 aa, Homo Sapiens
RERPPEEVAA

SEQ ID NO: 103816 - protein, 10 aa, Homo Sapiens
RERQDRISRL

SEQ ID NO: 103817 - protein, 10 aa, Homo Sapiens
RESEKTVRQF

SEQ ID NO: 103818 - protein, 10 aa, Homo Sapiens
RESPLIVNTM

SEQ ID NO: 103819 - protein, 10 aa, Homo Sapiens
RETADVIAKV

SEQ ID NO: 103820 - protein, 10 aa, Homo Sapiens
RETAQAIKGM

SEQ ID NO: 103821 - protein, 10 aa, Homo Sapiens
RETDFYLQSV

SEQ ID NO: 103822 - protein, 10 aa, Homo Sapiens
RETEKTLTEL

SEQ ID NO: 103823 - protein, 10 aa, Homo Sapiens
RETLTQGLEF

SEQ ID NO: 103824 - protein, 10 aa, Homo Sapiens
RETQAINSSL

SEQ ID NO: 103825 - protein, 10 aa, Homo Sapiens
RETVNKAVAL

SEQ ID NO: 103826 - protein, 10 aa, Homo Sapiens
REVEGLKDLL

SEQ ID NO: 103827 - protein, 10 aa, Homo Sapiens
REVENPQNQL

SEQ ID NO: 103828 - protein, 10 aa, Homo Sapiens
REVLEKQPVL

SEQ ID NO: 103829 - protein, 10 aa, Homo Sapiens
REVNKLKVQM

SEQ ID NO: 103830 - protein, 10 aa, Homo Sapiens
REVSSLKNKL

SEQ ID NO: 103831 - protein, 10 aa, Homo Sapiens
REVVAGSHEL

SEQ ID NO: 103832 - protein, 10 aa, Homo Sapiens
REVVIGTPTL

SEQ ID NO: 103833 - protein, 10 aa, Homo Sapiens
REWTEQETLL

SEQ ID NO: 103834 - protein, 10 aa, Homo Sapiens
REYDGNIRQA

SEQ ID NO: 103835 - protein, 10 aa, Homo Sapiens
REYEDGPLSL

SEQ ID NO: 103836 - protein, 10 aa, Homo Sapiens
REYEKIKSQL

SEQ ID NO: 103837 - protein, 10 aa, Homo Sapiens
REYELRKNNF

SEQ ID NO: 103838 - protein, 10 aa, Homo Sapiens
REYKVVGRCL

SEQ ID NO: 103839 - protein, 10 aa, Homo Sapiens
REYRPEYERL

SEQ ID NO: 103840 - protein, 10 aa, Homo Sapiens
RQADLKNWSL

SEQ ID NO: 103841 - protein, 10 aa, Homo Sapiens
RQFSGARNQL

SEQ ID NO: 103842 - protein, 10 aa, Homo Sapiens
SDFIAPLHSG

SEQ ID NO: 103843 - protein, 10 aa, Homo Sapiens
SEAAIRSVEL

SEQ ID NO: 103844 - protein, 10 aa, Homo Sapiens
SEAECQRQQL

SEQ ID NO: 103845 - protein, 10 aa, Homo Sapiens
SEAEGLKFSL

SEQ ID NO: 103846 - protein, 10 aa, Homo Sapiens
SEAKPAAVAA

SEQ ID NO: 103847 - protein, 10 aa, Homo Sapiens
SEAKPLAVCL

SEQ ID NO: 103848 - protein, 10 aa, Homo Sapiens
SEALEAARIC

SEQ ID NO: 103849 - protein, 10 aa, Homo Sapiens
SEAPPSKMVL

SEQ ID NO: 103850 - protein, 10 aa, Homo Sapiens
SEAQLRQFTL

SEQ ID NO: 103851 - protein, 10 aa, Homo Sapiens
SEARKGFSYL

SEQ ID NO: 103852 - protein, 10 aa, Homo Sapiens
SEASQGFRFL

SEQ ID NO: 103853 - protein, 10 aa, Homo Sapiens
SEDKRKTYSL

SEQ ID NO: 103854 - protein, 10 aa, Homo Sapiens
SEDRSVQEVL

SEQ ID NO: 103855 - protein, 10 aa, Homo Sapiens
SEFDFKPQQL

SEQ ID NO: 103856 - protein, 10 aa, Homo Sapiens
SEFEGGKSTV

SEQ ID NO: 103857 - protein, 10 aa, Homo Sapiens
SEFGSKIILL

SEQ ID NO: 103858 - protein, 10 aa, Homo Sapiens
SEFHQSSFLL

SEQ ID NO: 103859 - protein, 10 aa, Homo Sapiens
SEFKEFSQSF

SEQ ID NO: 103860 - protein, 10 aa, Homo Sapiens
SEFKGDLETL

SEQ ID NO: 103861 - protein, 10 aa, Homo Sapiens
SEFRPKIKST

SEQ ID NO: 103862 - protein, 10 aa, Homo Sapiens
SEFSGDVDSL

SEQ ID NO: 103863 - protein, 10 aa, Homo Sapiens
SEFTNSNNHL

SEQ ID NO: 103864 - protein, 10 aa, Homo Sapiens
SEHQAIVQHL

SEQ ID NO: 103865 - protein, 10 aa, Homo Sapiens
SEHSGPPIVI

SEQ ID NO: 103866 - protein, 10 aa, Homo Sapiens
SEIASQGREL

SEQ ID NO: 103867 - protein, 10 aa, Homo Sapiens
SEIDQLFRIF

SEQ ID NO: 103868 - protein, 10 aa, Homo Sapiens
SEIDQVVPAA

SEQ ID NO: 103869 - protein, 10 aa, Homo Sapiens
SEIEEFYQKL

SEQ ID NO: 103870 - protein, 10 aa, Homo Sapiens
SEIEQAVQSL

SEQ ID NO: 103871 - protein, 10 aa, Homo Sapiens
SEIESVKISA

SEQ ID NO: 103872 - protein, 10 aa, Homo Sapiens
SEIEVPREAL

SEQ ID NO: 103873 - protein, 10 aa, Homo Sapiens
SEIHNLQNKF

SEQ ID NO: 103874 - protein, 10 aa, Homo Sapiens
SEIHSLVHRL

SEQ ID NO: 103875 - protein, 10 aa, Homo Sapiens
SEIILRQEVL

SEQ ID NO: 103876 - protein, 10 aa, Homo Sapiens
SEIKGEVLYL

SEQ ID NO: 103877 - protein, 10 aa, Homo Sapiens
SEIKVPDVEL

SEQ ID NO: 103878 - protein, 10 aa, Homo Sapiens
SEILPTKETL

SEQ ID NO: 103879 - protein, 10 aa, Homo Sapiens
SEILQKEVYL

SEQ ID NO: 103880 - protein, 10 aa, Homo Sapiens
SEIRAPIVTV

SEQ ID NO: 103881 - protein, 10 aa, Homo Sapiens
SEIRDIILGM

SEQ ID NO: 103882 - protein, 10 aa, Homo Sapiens
SEIRSAWQAL

SEQ ID NO: 103883 - protein, 10 aa, Homo Sapiens
SEIYIHGLGL

SEQ ID NO: 103884 - protein, 10 aa, Homo Sapiens
SEKDTKEEIL

SEQ ID NO: 103885 - protein, 10 aa, Homo Sapiens
SEKENLTNEL

SEQ ID NO: 103886 - protein, 10 aa, Homo Sapiens
SEKGFQQISF

SEQ ID NO: 103887 - protein, 10 aa, Homo Sapiens
SEKHVRLEHL

SEQ ID NO: 103888 - protein, 10 aa, Homo Sapiens
SEKKVGIQEL

SEQ ID NO: 103889 - protein, 10 aa, Homo Sapiens
SEKKVVVEQL

SEQ ID NO: 103890 - protein, 10 aa, Homo Sapiens
SEKLFGETTL

SEQ ID NO: 103891 - protein, 10 aa, Homo Sapiens
SEKNPSEVTL

SEQ ID NO: 103892 - protein, 10 aa, Homo Sapiens
SEKSLENETL

SEQ ID NO: 103893 - protein, 10 aa, Homo Sapiens
SELEDGHTAL

SEQ ID NO: 103894 - protein, 10 aa, Homo Sapiens
SELEGNLQTL

SEQ ID NO: 103895 - protein, 10 aa, Homo Sapiens
SELEKKLVAI

SEQ ID NO: 103896 - protein, 10 aa, Homo Sapiens
SELITKAVAA

SEQ ID NO: 103897 - protein, 10 aa, Homo Sapiens
SELKIKNQQL

SEQ ID NO: 103898 - protein, 10 aa, Homo Sapiens
SELPIVTPAL

SEQ ID NO: 103899 - protein, 10 aa, Homo Sapiens
SELQAIKTEL

SEQ ID NO: 103900 - protein, 10 aa, Homo Sapiens
SELRNQYVTL

SEQ ID NO: 103901 - protein, 10 aa, Homo Sapiens
SELTQPKLAL

SEQ ID NO: 103902 - protein, 10 aa, Homo Sapiens
SEMEQLKQKL

SEQ ID NO: 103903 - protein, 10 aa, Homo Sapiens
SEMHVPSVAL

SEQ ID NO: 103904 - protein, 10 aa, Homo Sapiens
SEMRERQMAM

SEQ ID NO: 103905 - protein, 10 aa, Homo Sapiens
SENDKKIKAL

SEQ ID NO: 103906 - protein, 10 aa, Homo Sapiens
SENSKGVYCL

SEQ ID NO: 103907 - protein, 10 aa, Homo Sapiens
SEPDAVHVVL

SEQ ID NO: 103908 - protein, 10 aa, Homo Sapiens
SEPLHNVQVL

SEQ ID NO: 103909 - protein, 10 aa, Homo Sapiens
SEPVKGTGAL

SEQ ID NO: 103910 - protein, 10 aa, Homo Sapiens
SEQQIVSNTL

SEQ ID NO: 103911 - protein, 10 aa, Homo Sapiens
SEQRFPVATM

SEQ ID NO: 103912 - protein, 10 aa, Homo Sapiens
SERGPQEEVL

SEQ ID NO: 103913 - protein, 10 aa, Homo Sapiens
SESGSNLHAL

SEQ ID NO: 103914 - protein, 10 aa, Homo Sapiens
SESISRAYAL

SEQ ID NO: 103915 - protein, 10 aa, Homo Sapiens
SESQCRVVVL

SEQ ID NO: 103916 - protein, 10 aa, Homo Sapiens
SESRLEKAEL

SEQ ID NO: 103917 - protein, 10 aa, Homo Sapiens
SESVAGSHRL

SEQ ID NO: 103918 - protein, 10 aa, Homo Sapiens
SETHKAIQAL

SEQ ID NO: 103919 - protein, 10 aa, Homo Sapiens
SETTKGAYSL

SEQ ID NO: 103920 - protein, 10 aa, Homo Sapiens
SEVAQAGKAV

SEQ ID NO: 103921 - protein, 10 aa, Homo Sapiens
SEVDGNRMTL

SEQ ID NO: 103922 - protein, 10 aa, Homo Sapiens
SEVKPILEKL

SEQ ID NO: 103923 - protein, 10 aa, Homo Sapiens
SEVNKHETAL

SEQ ID NO: 103924 - protein, 10 aa, Homo Sapiens
SEVNPNTRVM

SEQ ID NO: 103925 - protein, 10 aa, Homo Sapiens
SEVQFGHAGA

SEQ ID NO: 103926 - protein, 10 aa, Homo Sapiens
SEVRCSGQEL

SEQ ID NO: 103927 - protein, 10 aa, Homo Sapiens
SEVTFALHSA

SEQ ID NO: 103928 - protein, 10 aa, Homo Sapiens
SEVTKPPPCL

SEQ ID NO: 103929 - protein, 10 aa, Homo Sapiens
SEWEGRTHAL

SEQ ID NO: 103930 - protein, 10 aa, Homo Sapiens
SEWKDTNYTL

SEQ ID NO: 103931 - protein, 10 aa, Homo Sapiens
SEWKEHKVAL

SEQ ID NO: 103932 - protein, 10 aa, Homo Sapiens
SEYDRGVNTF

SEQ ID NO: 103933 - protein, 10 aa, Homo Sapiens
SEYEKKLQAM

SEQ ID NO: 103934 - protein, 10 aa, Homo Sapiens
SEYHRIQHQL

SEQ ID NO: 103935 - protein, 10 aa, Homo Sapiens
SEYLRYEDTL

SEQ ID NO: 103936 - protein, 10 aa, Homo Sapiens
SEYMNNKEAL

SEQ ID NO: 103937 - protein, 10 aa, Homo Sapiens
SEYPIVDGKL

SEQ ID NO: 103938 - protein, 10 aa, Homo Sapiens
SEYSKQMQRF

SEQ ID NO: 103939 - protein, 10 aa, Homo Sapiens
TAAARLPPSV

SEQ ID NO: 103940 - protein, 10 aa, Homo Sapiens
TAKAAPLPSV

SEQ ID NO: 103941 - protein, 10 aa, Homo Sapiens
TEAAVPKVTL

SEQ ID NO: 103942 - protein, 10 aa, Homo Sapiens
TEAEVRGLCI

SEQ ID NO: 103943 - protein, 10 aa, Homo Sapiens
TEAHLPSQTL

SEQ ID NO: 103944 - protein, 10 aa, Homo Sapiens
TEAIGIISKM

SEQ ID NO: 103945 - protein, 10 aa, Homo Sapiens
TEAQANQISL

SEQ ID NO: 103946 - protein, 10 aa, Homo Sapiens
TECSNTFKSL

SEQ ID NO: 103947 - protein, 10 aa, Homo Sapiens
TEDSKRIAVV

SEQ ID NO: 103948 - protein, 10 aa, Homo Sapiens
TEFEQRHHCL

SEQ ID NO: 103949 - protein, 10 aa, Homo Sapiens
TEFGGVTQHL

SEQ ID NO: 103950 - protein, 10 aa, Homo Sapiens
TEFQGHKVIL

SEQ ID NO: 103951 - protein, 10 aa, Homo Sapiens
TEFRSLHHKL

SEQ ID NO: 103952 - protein, 10 aa, Homo Sapiens
TEGREVVPTF

SEQ ID NO: 103953 - protein, 10 aa, Homo Sapiens
TEIDGRSISL

SEQ ID NO: 103954 - protein, 10 aa, Homo Sapiens
TEIDSKWQEL

SEQ ID NO: 103955 - protein, 10 aa, Homo Sapiens
TEIEKKLPRL

SEQ ID NO: 103956 - protein, 10 aa, Homo Sapiens
TEIEQFAETL

SEQ ID NO: 103957 - protein, 10 aa, Homo Sapiens
TEIKEITVSF

SEQ ID NO: 103958 - protein, 10 aa, Homo Sapiens
TEIKELKETL

SEQ ID NO: 103959 - protein, 10 aa, Homo Sapiens
TEISLKDSTL

SEQ ID NO: 103960 - protein, 10 aa, Homo Sapiens
TEIYEFHKTL

SEQ ID NO: 103961 - protein, 10 aa, Homo Sapiens
TEKEVEDSEL

SEQ ID NO: 103962 - protein, 10 aa, Homo Sapiens
TEKSGICNVL

SEQ ID NO: 103963 - protein, 10 aa, Homo Sapiens
TEKWNTDNTL

SEQ ID NO: 103964 - protein, 10 aa, Homo Sapiens
TELILTNNSL

SEQ ID NO: 103965 - protein, 10 aa, Homo Sapiens
TELLWPGAAL

SEQ ID NO: 103966 - protein, 10 aa, Homo Sapiens
TEMESMKTTL

SEQ ID NO: 103967 - protein, 10 aa, Homo Sapiens
TENEIRGLCL

SEQ ID NO: 103968 - protein, 10 aa, Homo Sapiens
TENGVLLPSL

SEQ ID NO: 103969 - protein, 10 aa, Homo Sapiens
TENMPIKINL

SEQ ID NO: 103970 - protein, 10 aa, Homo Sapiens
TENPHGVKAV

SEQ ID NO: 103971 - protein, 10 aa, Homo Sapiens
TEPHHIWPTL

SEQ ID NO: 103972 - protein, 10 aa, Homo Sapiens
TEQHHTQPVL

SEQ ID NO: 103973 - protein, 10 aa, Homo Sapiens
TESYLKNVAL

SEQ ID NO: 103974 - protein, 10 aa, Homo Sapiens
TEVDMKEVEL

SEQ ID NO: 103975 - protein, 10 aa, Homo Sapiens
TEVEIINQQL

SEQ ID NO: 103976 - protein, 10 aa, Homo Sapiens
TEVKPNTPVL

SEQ ID NO: 103977 - protein, 10 aa, Homo Sapiens
TEVRICPVEF

SEQ ID NO: 103978 - protein, 10 aa, Homo Sapiens
TEWPGRTQVL

SEQ ID NO: 103979 - protein, 10 aa, Homo Sapiens
TEYRKKWDAL

SEQ ID NO: 103980 - protein, 10 aa, Homo Sapiens
TEYRRQVQSL

SEQ ID NO: 103981 - protein, 10 aa, Homo Sapiens
TEYSKSEEKL

SEQ ID NO: 103982 - protein, 10 aa, Homo Sapiens
TYTISSKYIL

SEQ ID NO: 103983 - protein, 10 aa, Homo Sapiens
VEGQRLVYQF

SEQ ID NO: 103984 - protein, 10 aa, Homo Sapiens
VEIQCPEQVV

SEQ ID NO: 103985 - protein, 10 aa, Homo Sapiens
VEKKGEKLIL

SEQ ID NO: 103986 - protein, 10 aa, Homo Sapiens
VEKPPDNQKL

SEQ ID NO: 103987 - protein, 10 aa, Homo Sapiens
VEKYIEEQLL

SEQ ID NO: 103988 - protein, 10 aa, Homo Sapiens
VENSGQRESL

SEQ ID NO: 103989 - protein, 10 aa, Homo Sapiens
VETPRGKPPL

SEQ ID NO: 103990 - protein, 10 aa, Homo Sapiens
VEVKDIELVM

SEQ ID NO: 103991 - protein, 10 aa, Homo Sapiens
YEAFPHDSQL

SEQ ID NO: 103992 - protein, 10 aa, Homo Sapiens
YEALKENEKL

SEQ ID NO: 103993 - protein, 10 aa, Homo Sapiens
YEDEDSLKTL

SEQ ID NO: 103994 - protein, 10 aa, Homo Sapiens
YEEGPGKNLP

SEQ ID NO: 103995 - protein, 10 aa, Homo Sapiens
YEGSPIKVTL

SEQ ID NO: 103996 - protein, 10 aa, Homo Sapiens
YEHDDIVSTV

SEQ ID NO: 103997 - protein, 10 aa, Homo Sapiens
YEIERTIVQL

SEQ ID NO: 103998 - protein, 10 aa, Homo Sapiens
YEIKQFLECA

SEQ ID NO: 103999 - protein, 10 aa, Homo Sapiens
YEIQHGDLKL

SEQ ID NO: 104000 - protein, 10 aa, Homo Sapiens
YEKEKLNERL

SEQ ID NO: 104001 - protein, 10 aa, Homo Sapiens
YELLFKEGVM

SEQ ID NO: 104002 - protein, 10 aa, Homo Sapiens
YELQESNVQL

SEQ ID NO: 104003 - protein, 10 aa, Homo Sapiens
YELQESNVRL

SEQ ID NO: 104004 - protein, 10 aa, Homo Sapiens
YESINHVVVF

SEQ ID NO: 104005 - protein, 10 aa, Homo Sapiens
YETERLIQEL

SEQ ID NO: 104006 - protein, 10 aa, Homo Sapiens
YEVCKEGDVL

SEQ ID NO: 104007 - protein, 10 aa, Homo Sapiens
YEVRLTQTVA

SEQ ID NO: 104008 - protein, 10 aa, Homo Sapiens
YEYEGGHIKT

SEQ ID NO: 104009 - protein, 10 aa, Homo Sapiens
YEYKDGSRKL

SEQ ID NO: 104010 - protein, 11 aa, Homo Sapiens
AEADRTAIHEV

SEQ ID NO: 104011 - protein, 11 aa, Homo Sapiens
AEAEERGELAL

SEQ ID NO: 104012 - protein, 11 aa, Homo Sapiens
AEAEGLSGTTL

SEQ ID NO: 104013 - protein, 11 aa, Homo Sapiens
AEAFEAIPRAL

SEQ ID NO: 104014 - protein, 11 aa, Homo Sapiens
AEAGHLEGHCL

SEQ ID NO: 104015 - protein, 11 aa, Homo Sapiens
AEAIIHGLSSL

SEQ ID NO: 104016 - protein, 11 aa, Homo Sapiens
AEALATHILSL

SEQ ID NO: 104017 - protein, 11 aa, Homo Sapiens
AEALIKHKPSV

SEQ ID NO: 104018 - protein, 11 aa, Homo Sapiens
AEALPRPNWEL

SEQ ID NO: 104019 - protein, 11 aa, Homo Sapiens
AEAPSESKPAA

SEQ ID NO: 104020 - protein, 11 aa, Homo Sapiens
AEASALYGRAL

SEQ ID NO: 104021 - protein, 11 aa, Homo Sapiens
AEAVSRVLNKL

SEQ ID NO: 104022 - protein, 11 aa, Homo Sapiens
AEDGSAGVRVL

SEQ ID NO: 104023 - protein, 11 aa, Homo Sapiens
AEDPALKEIVL

SEQ ID NO: 104024 - protein, 11 aa, Homo Sapiens
AEDPSKSYVKL

SEQ ID NO: 104025 - protein, 11 aa, Homo Sapiens
AEDSVSQRAVL

SEQ ID NO: 104026 - protein, 11 aa, Homo Sapiens
AEFAERSVAKL

SEQ ID NO: 104027 - protein, 11 aa, Homo Sapiens
AEFEKSAKENL

SEQ ID NO: 104028 - protein, 11 aa, Homo Sapiens
AEFGAAGVNRL

SEQ ID NO: 104029 - protein, 11 aa, Homo Sapiens
AEFHQIEGVVA

SEQ ID NO: 104030 - protein, 11 aa, Homo Sapiens
AEHLRKYNEAL

SEQ ID NO: 104031 - protein, 11 aa, Homo Sapiens
AEIDPKQLVDI

SEQ ID NO: 104032 - protein, 11 aa, Homo Sapiens
AEIDREMISSL

SEQ ID NO: 104033 - protein, 11 aa, Homo Sapiens
AEIEKFDKSKL

SEQ ID NO: 104034 - protein, 11 aa, Homo Sapiens
AEIGAAAQQSL

SEQ ID NO: 104035 - protein, 11 aa, Homo Sapiens
AEIKTTNEVVL

SEQ ID NO: 104036 - protein, 11 aa, Homo Sapiens
AEILELAGNAA

SEQ ID NO: 104037 - protein, 11 aa, Homo Sapiens
AEILNGKEISA

SEQ ID NO: 104038 - protein, 11 aa, Homo Sapiens
AEIPLNEQTTL

SEQ ID NO: 104039 - protein, 11 aa, Homo Sapiens
AEIQNVEGQNL

SEQ ID NO: 104040 - protein, 11 aa, Homo Sapiens
AEIRDQMQQQL

SEQ ID NO: 104041 - protein, 11 aa, Homo Sapiens
AEISSKSPVAV

SEQ ID NO: 104042 - protein, 11 aa, Homo Sapiens
AEIVKKDDFVL

SEQ ID NO: 104043 - protein, 11 aa, Homo Sapiens
AEKAAQTAERL

SEQ ID NO: 104044 - protein, 11 aa, Homo Sapiens
AEKFKVQGEAV

SEQ ID NO: 104045 - protein, 11 aa, Homo Sapiens
AEKILKEQERL

SEQ ID NO: 104046 - protein, 11 aa, Homo Sapiens
AEKRDPQELVA

SEQ ID NO: 104047 - protein, 11 aa, Homo Sapiens
AEKREHEKEVL

SEQ ID NO: 104048 - protein, 11 aa, Homo Sapiens
AELATRAIPEL

SEQ ID NO: 104049 - protein, 11 aa, Homo Sapiens
AELEKDAQNRL

SEQ ID NO: 104050 - protein, 11 aa, Homo Sapiens
AELFKGKKGVL

SEQ ID NO: 104051 - protein, 11 aa, Homo Sapiens
AELKGHTSRVL

SEQ ID NO: 104052 - protein, 11 aa, Homo Sapiens
AELKQIVDQSL

SEQ ID NO: 104053 - protein, 11 aa, Homo Sapiens
AELKTDVFQSL

SEQ ID NO: 104054 - protein, 11 aa, Homo Sapiens
AELLDATQHTL

SEQ ID NO: 104055 - protein, 11 aa, Homo Sapiens
AELLVSHGASL

SEQ ID NO: 104056 - protein, 11 aa, Homo Sapiens
AELPAKILVEF

SEQ ID NO: 104057 - protein, 11 aa, Homo Sapiens
AELRSHALPGA

SEQ ID NO: 104058 - protein, 11 aa, Homo Sapiens
AEMPDSAAALL

SEQ ID NO: 104059 - protein, 11 aa, Homo Sapiens
AEMVALVEQRA

SEQ ID NO: 104060 - protein, 11 aa, Homo Sapiens
AENNTLSKLQL

SEQ ID NO: 104061 - protein, 11 aa, Homo Sapiens
AENPAMTRELL

SEQ ID NO: 104062 - protein, 11 aa, Homo Sapiens
AEPEVGVPSSL

SEQ ID NO: 104063 - protein, 11 aa, Homo Sapiens
AERDVYTGDAL

SEQ ID NO: 104064 - protein, 11 aa, Homo Sapiens
AERNVYTSEVL

SEQ ID NO: 104065 - protein, 11 aa, Homo Sapiens
AESERVVQEAL

SEQ ID NO: 104066 - protein, 11 aa, Homo Sapiens
AESQGRSEILM

SEQ ID NO: 104067 - protein, 11 aa, Homo Sapiens
AETVVVSAHSL

SEQ ID NO: 104068 - protein, 11 aa, Homo Sapiens
AEVDASVVREI

SEQ ID NO: 104069 - protein, 11 aa, Homo Sapiens
AEVDPDTILKA

SEQ ID NO: 104070 - protein, 11 aa, Homo Sapiens
AEVEAQKAQQL

SEQ ID NO: 104071 - protein, 11 aa, Homo Sapiens
AEVELKKGATL

SEQ ID NO: 104072 - protein, 11 aa, Homo Sapiens
AEVEVSIPAKL

SEQ ID NO: 104073 - protein, 11 aa, Homo Sapiens
AEVLEQSAQTL

SEQ ID NO: 104074 - protein, 11 aa, Homo Sapiens
AEVNLKKKSYL

SEQ ID NO: 104075 - protein, 11 aa, Homo Sapiens
AEVNQETIQRL

SEQ ID NO: 104076 - protein, 11 aa, Homo Sapiens
AEVSPDAKTSL

SEQ ID NO: 104077 - protein, 11 aa, Homo Sapiens
AEVSQEVTRSL

SEQ ID NO: 104078 - protein, 11 aa, Homo Sapiens
AEVTTKSQIPL

SEQ ID NO: 104079 - protein, 11 aa, Homo Sapiens
AEWEESQTQKI

SEQ ID NO: 104080 - protein, 11 aa, Homo Sapiens
AEYGEIKNIHL

SEQ ID NO: 104081 - protein, 11 aa, Homo Sapiens
AEYNKTIVDAL

SEQ ID NO: 104082 - protein, 11 aa, Homo Sapiens
AVEAKKTYVRD

SEQ ID NO: 104083 - protein, 11 aa, Homo Sapiens
EEFNTGPLSVL

SEQ ID NO: 104084 - protein, 11 aa, Homo Sapiens
EEIEATKNHVL

SEQ ID NO: 104085 - protein, 11 aa, Homo Sapiens
EEVNLNGSGKL

SEQ ID NO: 104086 - protein, 11 aa, Homo Sapiens
EEYDDRTARVL

SEQ ID NO: 104087 - protein, 11 aa, Homo Sapiens
EEYGPELHVAL

SEQ ID NO: 104088 - protein, 11 aa, Homo Sapiens
EIMIPASKAGL

SEQ ID NO: 104089 - protein, 11 aa, Homo Sapiens
FEADPPGQVAA

SEQ ID NO: 104090 - protein, 11 aa, Homo Sapiens
GEADAQNITVL

SEQ ID NO: 104091 - protein, 11 aa, Homo Sapiens
GEAEFNRIMSL

SEQ ID NO: 104092 - protein, 11 aa, Homo Sapiens
GEALPHVVPTL

SEQ ID NO: 104093 - protein, 11 aa, Homo Sapiens
GEANAELCRYL

SEQ ID NO: 104094 - protein, 11 aa, Homo Sapiens
GEAPSKTLVET

SEQ ID NO: 104095 - protein, 11 aa, Homo Sapiens
GEDNGQRGYLL

SEQ ID NO: 104096 - protein, 11 aa, Homo Sapiens
GEFDYSGSQAI

SEQ ID NO: 104097 - protein, 11 aa, Homo Sapiens
GEFEKKYVATL

SEQ ID NO: 104098 - protein, 11 aa, Homo Sapiens
GEFEPDGCLKI

SEQ ID NO: 104099 - protein, 11 aa, Homo Sapiens
GEFGKPYFIKL

SEQ ID NO: 104100 - protein, 11 aa, Homo Sapiens
GEFHPDGCLQI

SEQ ID NO: 104101 - protein, 11 aa, Homo Sapiens
GEFPGEKSKRL

SEQ ID NO: 104102 - protein, 11 aa, Homo Sapiens
GEFQIVNPHLL

SEQ ID NO: 104103 - protein, 11 aa, Homo Sapiens
GEFSGANKEKL

SEQ ID NO: 104104 - protein, 11 aa, Homo Sapiens
GEFSPNVPKSL

SEQ ID NO: 104105 - protein, 11 aa, Homo Sapiens
GEFTLHGRAIL

SEQ ID NO: 104106 - protein, 11 aa, Homo Sapiens
GEGDSVITQVL

SEQ ID NO: 104107 - protein, 11 aa, Homo Sapiens
GEGGSFGELAL

SEQ ID NO: 104108 - protein, 11 aa, Homo Sapiens
GEHIIAGAGEL

SEQ ID NO: 104109 - protein, 11 aa, Homo Sapiens
GEIASFDKAKL

SEQ ID NO: 104110 - protein, 11 aa, Homo Sapiens
GEIGGTEEYKI

SEQ ID NO: 104111 - protein, 11 aa, Homo Sapiens
GEIKRDFIATL

SEQ ID NO: 104112 - protein, 11 aa, Homo Sapiens
GEIQEIVKTGL

SEQ ID NO: 104113 - protein, 11 aa, Homo Sapiens
GEISPGKINSV

SEQ ID NO: 104114 - protein, 11 aa, Homo Sapiens
GEKGTGKTLSL

SEQ ID NO: 104115 - protein, 11 aa, Homo Sapiens
GEKLLPGIEVL

SEQ ID NO: 104116 - protein, 11 aa, Homo Sapiens
GELDLERAPAL

SEQ ID NO: 104117 - protein, 11 aa, Homo Sapiens
GELEAAKALVL

SEQ ID NO: 104118 - protein, 11 aa, Homo Sapiens
GELEPKTRASL

SEQ ID NO: 104119 - protein, 11 aa, Homo Sapiens
GELKNNRGVKL

SEQ ID NO: 104120 - protein, 11 aa, Homo Sapiens
GELKPRQQQDL

SEQ ID NO: 104121 - protein, 11 aa, Homo Sapiens
GELSKYRVPNL

SEQ ID NO: 104122 - protein, 11 aa, Homo Sapiens
GELTDGHPLTL

SEQ ID NO: 104123 - protein, 11 aa, Homo Sapiens
GEMTLKSALAL

SEQ ID NO: 104124 - protein, 11 aa, Homo Sapiens
GENDRGVSFTF

SEQ ID NO: 104125 - protein, 11 aa, Homo Sapiens
GENPASHSYVL

SEQ ID NO: 104126 - protein, 11 aa, Homo Sapiens
GENSILGQLKA

SEQ ID NO: 104127 - protein, 11 aa, Homo Sapiens
GENVFGVCHIF

SEQ ID NO: 104128 - protein, 11 aa, Homo Sapiens
GEPHGLENMEL

SEQ ID NO: 104129 - protein, 11 aa, Homo Sapiens
GEQGAAGARVL

SEQ ID NO: 104130 - protein, 11 aa, Homo Sapiens
GERDEFNIQVL

SEQ ID NO: 104131 - protein, 11 aa, Homo Sapiens
GERDSQTQAIL

SEQ ID NO: 104132 - protein, 11 aa, Homo Sapiens
GESAGAASVSL

SEQ ID NO: 104133 - protein, 11 aa, Homo Sapiens
GESDDSILRLA

SEQ ID NO: 104134 - protein, 11 aa, Homo Sapiens
GESGLGKSTLI

SEQ ID NO: 104135 - protein, 11 aa, Homo Sapiens
GESHVSGTTTL

SEQ ID NO: 104136 - protein, 11 aa, Homo Sapiens
GETTPDKLFTL

SEQ ID NO: 104137 - protein, 11 aa, Homo Sapiens
GEVCIKGTNVF

SEQ ID NO: 104138 - protein, 11 aa, Homo Sapiens
GEVDGKAIPDL

SEQ ID NO: 104139 - protein, 11 aa, Homo Sapiens
GEVDHRVRTSV

SEQ ID NO: 104140 - protein, 11 aa, Homo Sapiens
GEVDKRELIAL

SEQ ID NO: 104141 - protein, 11 aa, Homo Sapiens
GEVEGHPVWAL

SEQ ID NO: 104142 - protein, 11 aa, Homo Sapiens
GEVIQRPANAI

SEQ ID NO: 104143 - protein, 11 aa, Homo Sapiens
GEVIVKGATSA

SEQ ID NO: 104144 - protein, 11 aa, Homo Sapiens
GEVPPQKLQAL

SEQ ID NO: 104145 - protein, 11 aa, Homo Sapiens
GEVSFINIKTL

SEQ ID NO: 104146 - protein, 11 aa, Homo Sapiens
GEVYPFGIVGM

SEQ ID NO: 104147 - protein, 11 aa, Homo Sapiens
GEWASGGVRSF

SEQ ID NO: 104148 - protein, 11 aa, Homo Sapiens
GEYQNQEIHNL

SEQ ID NO: 104149 - protein, 11 aa, Homo Sapiens
GEYSEAIPILR

SEQ ID NO: 104150 - protein, 11 aa, Homo Sapiens
GSIDFGKTVVS

SEQ ID NO: 104151 - protein, 11 aa, Homo Sapiens
GVTEVGLSAYA

SEQ ID NO: 104152 - protein, 11 aa, Homo Sapiens
HEAEKLYKNIL

SEQ ID NO: 104153 - protein, 11 aa, Homo Sapiens
HEAPSLQEAAL

SEQ ID NO: 104154 - protein, 11 aa, Homo Sapiens
HEAQLSEKISL

SEQ ID NO: 104155 - protein, 11 aa, Homo Sapiens
HEFKPQSGAEI

SEQ ID NO: 104156 - protein, 11 aa, Homo Sapiens
HEFSKTEELKL

SEQ ID NO: 104157 - protein, 11 aa, Homo Sapiens
HEFVEEKTKVA

SEQ ID NO: 104158 - protein, 11 aa, Homo Sapiens
HEGDDFGKLAL

SEQ ID NO: 104159 - protein, 11 aa, Homo Sapiens
HEKDPQVKEKL

SEQ ID NO: 104160 - protein, 11 aa, Homo Sapiens
HEKEDGAISTI

SEQ ID NO: 104161 - protein, 11 aa, Homo Sapiens
HELLEQQKRAA

SEQ ID NO: 104162 - protein, 11 aa, Homo Sapiens
HELQENTICSL

SEQ ID NO: 104163 - protein, 11 aa, Homo Sapiens
HEMDTSNGVLL

SEQ ID NO: 104164 - protein, 11 aa, Homo Sapiens
HENESVYKASL

SEQ ID NO: 104165 - protein, 11 aa, Homo Sapiens
HESAAHAIVSV

SEQ ID NO: 104166 - protein, 11 aa, Homo Sapiens
HESETTTSLVL

SEQ ID NO: 104167 - protein, 11 aa, Homo Sapiens
HEVDPEGDRTI

SEQ ID NO: 104168 - protein, 11 aa, Homo Sapiens
HEVGIGSVLSL

SEQ ID NO: 104169 - protein, 11 aa, Homo Sapiens
HEVPSVLGTPL

SEQ ID NO: 104170 - protein, 11 aa, Homo Sapiens
HEWEESNVQIL

SEQ ID NO: 104171 - protein, 11 aa, Homo Sapiens
HEYQVNGKRIL

SEQ ID NO: 104172 - protein, 11 aa, Homo Sapiens
IEATGIAVHAL

SEQ ID NO: 104173 - protein, 11 aa, Homo Sapiens
IEHNLSKIMKL

SEQ ID NO: 104174 - protein, 11 aa, Homo Sapiens
IENRDVAKTVL

SEQ ID NO: 104175 - protein, 11 aa, Homo Sapiens
IKNNLLSKKLP

SEQ ID NO: 104176 - protein, 11 aa, Homo Sapiens
KEADPSNFANF

SEQ ID NO: 104177 - protein, 11 aa, Homo Sapiens
KEAELRGSPSL

SEQ ID NO: 104178 - protein, 11 aa, Homo Sapiens
KEAEPDLLAVL

SEQ ID NO: 104179 - protein, 11 aa, Homo Sapiens
KEAIETIVAAM

SEQ ID NO: 104180 - protein, 11 aa, Homo Sapiens
KEAPVGVLASL

SEQ ID NO: 104181 - protein, 11 aa, Homo Sapiens
KEDATKGKFAF

SEQ ID NO: 104182 - protein, 11 aa, Homo Sapiens
KEDGAISTIVL

SEQ ID NO: 104183 - protein, 11 aa, Homo Sapiens
KEFDGKSLVSV

SEQ ID NO: 104184 - protein, 11 aa, Homo Sapiens
KEFEGKTLVSV

SEQ ID NO: 104185 - protein, 11 aa, Homo Sapiens
KEFMPPGLQEL

SEQ ID NO: 104186 - protein, 11 aa, Homo Sapiens
KEHEVEKMFTL

SEQ ID NO: 104187 - protein, 11 aa, Homo Sapiens
KEIADLKKQEL

SEQ ID NO: 104188 - protein, 11 aa, Homo Sapiens
KEIELPSGQLM

SEQ ID NO: 104189 - protein, 11 aa, Homo Sapiens
KEIENGHIFTV

SEQ ID NO: 104190 - protein, 11 aa, Homo Sapiens
KEIENTYANVA

SEQ ID NO: 104191 - protein, 11 aa, Homo Sapiens
KEIEQEAAVEL

SEQ ID NO: 104192 - protein, 11 aa, Homo Sapiens
KEIEVGGGRKA

SEQ ID NO: 104193 - protein, 11 aa, Homo Sapiens
KEIGTKQSFSL

SEQ ID NO: 104194 - protein, 11 aa, Homo Sapiens
KEIIGLEGVEL

SEQ ID NO: 104195 - protein, 11 aa, Homo Sapiens
KEIQGFLDCAA

SEQ ID NO: 104196 - protein, 11 aa, Homo Sapiens
KEITEKTRVAL

SEQ ID NO: 104197 - protein, 11 aa, Homo Sapiens
KEIYNQVNVVL

SEQ ID NO: 104198 - protein, 11 aa, Homo Sapiens
KEKEESMKETL

SEQ ID NO: 104199 - protein, 11 aa, Homo Sapiens
KEKEKVSTAVL

SEQ ID NO: 104200 - protein, 11 aa, Homo Sapiens
KEKLIKRQEEL

SEQ ID NO: 104201 - protein, 11 aa, Homo Sapiens
KELEFSKDKIL

SEQ ID NO: 104202 - protein, 11 aa, Homo Sapiens
KELEPLKEMTA

SEQ ID NO: 104203 - protein, 11 aa, Homo Sapiens
KELILHNPVTL

SEQ ID NO: 104204 - protein, 11 aa, Homo Sapiens
KELRHPNIVSL

SEQ ID NO: 104205 - protein, 11 aa, Homo Sapiens
KELSSSLHQKL

SEQ ID NO: 104206 - protein, 11 aa, Homo Sapiens
KEMFPIEAGAI

SEQ ID NO: 104207 - protein, 11 aa, Homo Sapiens
KEMGGHHIVAL

SEQ ID NO: 104208 - protein, 11 aa, Homo Sapiens
KEMPSVFQNVL

SEQ ID NO: 104209 - protein, 11 aa, Homo Sapiens
KEMQPTHPIRL

SEQ ID NO: 104210 - protein, 11 aa, Homo Sapiens
KENDAVTIQVL

SEQ ID NO: 104211 - protein, 11 aa, Homo Sapiens
KENGEPGTRVV

SEQ ID NO: 104212 - protein, 11 aa, Homo Sapiens
KENQNIAYVSL

SEQ ID NO: 104213 - protein, 11 aa, Homo Sapiens
KEPEKEIRPAL

SEQ ID NO: 104214 - protein, 11 aa, Homo Sapiens
KEQSPQTLLEL

SEQ ID NO: 104215 - protein, 11 aa, Homo Sapiens
KEREVVNKDVL

SEQ ID NO: 104216 - protein, 11 aa, Homo Sapiens
KERSGVSLAAL

SEQ ID NO: 104217 - protein, 11 aa, Homo Sapiens
KESDHIHIIAL

SEQ ID NO: 104218 - protein, 11 aa, Homo Sapiens
KESPVVKGNAL

SEQ ID NO: 104219 - protein, 11 aa, Homo Sapiens
KESTLHLVLRL

SEQ ID NO: 104220 - protein, 11 aa, Homo Sapiens
KETESLRKIAL

SEQ ID NO: 104221 - protein, 11 aa, Homo Sapiens
KETHVMDYRAL

SEQ ID NO: 104222 - protein, 11 aa, Homo Sapiens
KETSATGINSL

SEQ ID NO: 104223 - protein, 11 aa, Homo Sapiens
KEVDPQGLRTI

SEQ ID NO: 104224 - protein, 11 aa, Homo Sapiens
KEVEKNLKSCL

SEQ ID NO: 104225 - protein, 11 aa, Homo Sapiens
KEVTPEGLQMV

SEQ ID NO: 104226 - protein, 11 aa, Homo Sapiens
KEYEEDGARSI

SEQ ID NO: 104227 - protein, 11 aa, Homo Sapiens
KEYPNRGNTCL

SEQ ID NO: 104228 - protein, 11 aa, Homo Sapiens
KEYSEELVQQL

SEQ ID NO: 104229 - protein, 11 aa, Homo Sapiens
LEAAQRAVGVG

SEQ ID NO: 104230 - protein, 11 aa, Homo Sapiens
LEFDPAQRITL

SEQ ID NO: 104231 - protein, 11 aa, Homo Sapiens
LEKPNGATPVF

SEQ ID NO: 104232 - protein, 11 aa, Homo Sapiens
LEKSPCQTDVL

SEQ ID NO: 104233 - protein, 11 aa, Homo Sapiens
LEMNSDLKAQL

SEQ ID NO: 104234 - protein, 11 aa, Homo Sapiens
LERGLESATSL

SEQ ID NO: 104235 - protein, 11 aa, Homo Sapiens
LEWDQSGSRLL

SEQ ID NO: 104236 - protein, 11 aa, Homo Sapiens
LEWLDKSKSSF

SEQ ID NO: 104237 - protein, 11 aa, Homo Sapiens
LEYDPAKRITL

SEQ ID NO: 104238 - protein, 11 aa, Homo Sapiens
LTAEEGKNITI

SEQ ID NO: 104239 - protein, 11 aa, Homo Sapiens
MEAIGHAGTCL

SEQ ID NO: 104240 - protein, 11 aa, Homo Sapiens
MEDPRRAASSL

SEQ ID NO: 104241 - protein, 11 aa, Homo Sapiens
MEKQNIEYEAL

SEQ ID NO: 104242 - protein, 11 aa, Homo Sapiens
MESDPGVFTEL

SEQ ID NO: 104243 - protein, 11 aa, Homo Sapiens
MESKEKDRQVL

SEQ ID NO: 104244 - protein, 11 aa, Homo Sapiens
PPSLFTAVFVL

SEQ ID NO: 104245 - protein, 11 aa, Homo Sapiens
PVTDGAISTLL

SEQ ID NO: 104246 - protein, 11 aa, Homo Sapiens
QEALQRASTAL

SEQ ID NO: 104247 - protein, 11 aa, Homo Sapiens
QEFEEKSGRTF

SEQ ID NO: 104248 - protein, 11 aa, Homo Sapiens
QEFLTDMKQVF

SEQ ID NO: 104249 - protein, 11 aa, Homo Sapiens
QEHVADLSRSL

SEQ ID NO: 104250 - protein, 11 aa, Homo Sapiens
QELDPAGHKSL

SEQ ID NO: 104251 - protein, 11 aa, Homo Sapiens
QELKLIGEYGL

SEQ ID NO: 104252 - protein, 11 aa, Homo Sapiens
QEMDAQTIAKL

SEQ ID NO: 104253 - protein, 11 aa, Homo Sapiens
QESPLFNNVKL

SEQ ID NO: 104254 - protein, 11 aa, Homo Sapiens
QEVLLQTGRAL

SEQ ID NO: 104255 - protein, 11 aa, Homo Sapiens
QEYQEKGVRVL

SEQ ID NO: 104256 - protein, 11 aa, Homo Sapiens
REAAAVFQETL

SEQ ID NO: 104257 - protein, 11 aa, Homo Sapiens
REAATQAQQTL

SEQ ID NO: 104258 - protein, 11 aa, Homo Sapiens
REAATSNLKKL

SEQ ID NO: 104259 - protein, 11 aa, Homo Sapiens
READGTEKLVF

SEQ ID NO: 104260 - protein, 11 aa, Homo Sapiens
REAEAGRLRTL

SEQ ID NO: 104261 - protein, 11 aa, Homo Sapiens
REAEALKQKEL

SEQ ID NO: 104262 - protein, 11 aa, Homo Sapiens
REAESLIAKKI

SEQ ID NO: 104263 - protein, 11 aa, Homo Sapiens
REAGEGAVAAV

SEQ ID NO: 104264 - protein, 11 aa, Homo Sapiens
REAGITEKVVF

SEQ ID NO: 104265 - protein, 11 aa, Homo Sapiens
REAKVERPSTL

SEQ ID NO: 104266 - protein, 11 aa, Homo Sapiens
REANQAINPKL

SEQ ID NO: 104267 - protein, 11 aa, Homo Sapiens
REASIYTGITL

SEQ ID NO: 104268 - protein, 11 aa, Homo Sapiens
REASLGEASKL

SEQ ID NO: 104269 - protein, 11 aa, Homo Sapiens
REATKAAREAL

SEQ ID NO: 104270 - protein, 11 aa, Homo Sapiens
RECESVLVNDF

SEQ ID NO: 104271 - protein, 11 aa, Homo Sapiens
REDSQRPGAHL

SEQ ID NO: 104272 - protein, 11 aa, Homo Sapiens
REELREKDRLL

SEQ ID NO: 104273 - protein, 11 aa, Homo Sapiens
REFDKKKLISV

SEQ ID NO: 104274 - protein, 11 aa, Homo Sapiens
REFEALRSCFA

SEQ ID NO: 104275 - protein, 11 aa, Homo Sapiens
REFEDQKLTML

SEQ ID NO: 104276 - protein, 11 aa, Homo Sapiens
REFGEEALNSL

SEQ ID NO: 104277 - protein, 11 aa, Homo Sapiens
REFGNPNRPVA

SEQ ID NO: 104278 - protein, 11 aa, Homo Sapiens
REFLFNAIETM

SEQ ID NO: 104279 - protein, 11 aa, Homo Sapiens
REGGFLLLHTL

SEQ ID NO: 104280 - protein, 11 aa, Homo Sapiens
REHMGQLLHQL

SEQ ID NO: 104281 - protein, 11 aa, Homo Sapiens
REHVEAIKIGL

SEQ ID NO: 104282 - protein, 11 aa, Homo Sapiens
REHVVAASKAM

SEQ ID NO: 104283 - protein, 11 aa, Homo Sapiens
REIAQDFKTDL

SEQ ID NO: 104284 - protein, 11 aa, Homo Sapiens
REIATEKKNSL

SEQ ID NO: 104285 - protein, 11 aa, Homo Sapiens
REIDVRIDRNA

SEQ ID NO: 104286 - protein, 11 aa, Homo Sapiens
REIEQVNERVL

SEQ ID NO: 104287 - protein, 11 aa, Homo Sapiens
REIESSPQYRL

SEQ ID NO: 104288 - protein, 11 aa, Homo Sapiens
REIFLSQPILL

SEQ ID NO: 104289 - protein, 11 aa, Homo Sapiens
REIRHPNIITL

SEQ ID NO: 104290 - protein, 11 aa, Homo Sapiens
REIVAISSAQL

SEQ ID NO: 104291 - protein, 11 aa, Homo Sapiens
REIVIGVLHQL

SEQ ID NO: 104292 - protein, 11 aa, Homo Sapiens
REIVRDIKEKL

SEQ ID NO: 104293 - protein, 11 aa, Homo Sapiens
REKALEDVVVL

SEQ ID NO: 104294 - protein, 11 aa, Homo Sapiens
REKEAAYQERL

SEQ ID NO: 104295 - protein, 11 aa, Homo Sapiens
REKEDLVDLVL

SEQ ID NO: 104296 - protein, 11 aa, Homo Sapiens
REKEPNRLESL

SEQ ID NO: 104297 - protein, 11 aa, Homo Sapiens
REKIEASRNEL

SEQ ID NO: 104298 - protein, 11 aa, Homo Sapiens
REKLAEKKELL

SEQ ID NO: 104299 - protein, 11 aa, Homo Sapiens
REKLTSKEECL

SEQ ID NO: 104300 - protein, 11 aa, Homo Sapiens
REKPDDPLNYF

SEQ ID NO: 104301 - protein, 11 aa, Homo Sapiens
REKQHTKAIEL

SEQ ID NO: 104302 - protein, 11 aa, Homo Sapiens
REKQLAAENRL

SEQ ID NO: 104303 - protein, 11 aa, Homo Sapiens
REKQPMVPESL

SEQ ID NO: 104304 - protein, 11 aa, Homo Sapiens
REKVIKGAEIL

SEQ ID NO: 104305 - protein, 11 aa, Homo Sapiens
RELAQQVQQVA

SEQ ID NO: 104306 - protein, 11 aa, Homo Sapiens
RELDGDRSKQL

SEQ ID NO: 104307 - protein, 11 aa, Homo Sapiens
RELENLIGISC

SEQ ID NO: 104308 - protein, 11 aa, Homo Sapiens
RELEQYGQCVA

SEQ ID NO: 104309 - protein, 11 aa, Homo Sapiens
RELKPARIYGL

SEQ ID NO: 104310 - protein, 11 aa, Homo Sapiens
RELMGGIGKTM

SEQ ID NO: 104311 - protein, 11 aa, Homo Sapiens
REMRHKLKTAF

SEQ ID NO: 104312 - protein, 11 aa, Homo Sapiens
REMVELAAQRL

SEQ ID NO: 104313 - protein, 11 aa, Homo Sapiens
RENGKTVIRVL

SEQ ID NO: 104314 - protein, 11 aa, Homo Sapiens
RENLEEEAIIM

SEQ ID NO: 104315 - protein, 11 aa, Homo Sapiens
RENVFQEHQTL

SEQ ID NO: 104316 - protein, 11 aa, Homo Sapiens
RENYDRGYSSL

SEQ ID NO: 104317 - protein, 11 aa, Homo Sapiens
REPALDGGFQM

SEQ ID NO: 104318 - protein, 11 aa, Homo Sapiens
REQLKHKLEQL

SEQ ID NO: 104319 - protein, 11 aa, Homo Sapiens
REQTHTRHYEL

SEQ ID NO: 104320 - protein, 11 aa, Homo Sapiens
RERHPGSFDVV

SEQ ID NO: 104321 - protein, 11 aa, Homo Sapiens
RERITSEAEDL

SEQ ID NO: 104322 - protein, 11 aa, Homo Sapiens
RESNVGGIQQL

SEQ ID NO: 104323 - protein, 11 aa, Homo Sapiens
RESQVSILQSL

SEQ ID NO: 104324 - protein, 11 aa, Homo Sapiens
RESTGAQVQVA

SEQ ID NO: 104325 - protein, 11 aa, Homo Sapiens
RETEPPPKAAL

SEQ ID NO: 104326 - protein, 11 aa, Homo Sapiens
RETVSEESNVL

SEQ ID NO: 104327 - protein, 11 aa, Homo Sapiens
REVDLKNGHNL

SEQ ID NO: 104328 - protein, 11 aa, Homo Sapiens
REVDPDGRRTL

SEQ ID NO: 104329 - protein, 11 aa, Homo Sapiens
REVGIPPEQSL

SEQ ID NO: 104330 - protein, 11 aa, Homo Sapiens
REVLPEHVSVL

SEQ ID NO: 104331 - protein, 11 aa, Homo Sapiens
REVSPAHQYAL

SEQ ID NO: 104332 - protein, 11 aa, Homo Sapiens
REVTGSSQQTL

SEQ ID NO: 104333 - protein, 11 aa, Homo Sapiens
REWKEQGSKTF

SEQ ID NO: 104334 - protein, 11 aa, Homo Sapiens
REYDVPYHIRL

SEQ ID NO: 104335 - protein, 11 aa, Homo Sapiens
REYHTDTTVKF

SEQ ID NO: 104336 - protein, 11 aa, Homo Sapiens
REYNEVEPIIL

SEQ ID NO: 104337 - protein, 11 aa, Homo Sapiens
REYNEYENIKL

SEQ ID NO: 104338 - protein, 11 aa, Homo Sapiens
REYQDLLNVKM

SEQ ID NO: 104339 - protein, 11 aa, Homo Sapiens
RGFSLRKDGPL

SEQ ID NO: 104340 - protein, 11 aa, Homo Sapiens
SEAAAHAVATL

SEQ ID NO: 104341 - protein, 11 aa, Homo Sapiens
SEAARPATSTL

SEQ ID NO: 104342 - protein, 11 aa, Homo Sapiens
SEADPSGVASI

SEQ ID NO: 104343 - protein, 11 aa, Homo Sapiens
SEAEACVSRAL

SEQ ID NO: 104344 - protein, 11 aa, Homo Sapiens
SECAKKALEQL

SEQ ID NO: 104345 - protein, 11 aa, Homo Sapiens
SECNSNRDSVL

SEQ ID NO: 104346 - protein, 11 aa, Homo Sapiens
SEDGGHIFCTL

SEQ ID NO: 104347 - protein, 11 aa, Homo Sapiens
SEDPSHPSMAL

SEQ ID NO: 104348 - protein, 11 aa, Homo Sapiens
SEDRARASLVL

SEQ ID NO: 104349 - protein, 11 aa, Homo Sapiens
SEFDPPGPNVA

SEQ ID NO: 104350 - protein, 11 aa, Homo Sapiens
SEFKYNKPAFL

SEQ ID NO: 104351 - protein, 11 aa, Homo Sapiens
SEFLSTAPRSL

SEQ ID NO: 104352 - protein, 11 aa, Homo Sapiens
SEGVHTVDQVL

SEQ ID NO: 104353 - protein, 11 aa, Homo Sapiens
SEHPDQAQAIL

SEQ ID NO: 104354 - protein, 11 aa, Homo Sapiens
SEHSTEGSVSL

SEQ ID NO: 104355 - protein, 11 aa, Homo Sapiens
SEIEWNPATKL

SEQ ID NO: 104356 - protein, 11 aa, Homo Sapiens
SEIHSGNSVSL

SEQ ID NO: 104357 - protein, 11 aa, Homo Sapiens
SEIKISNPTEF

SEQ ID NO: 104358 - protein, 11 aa, Homo Sapiens
SEILSKKQNEL

SEQ ID NO: 104359 - protein, 11 aa, Homo Sapiens
SELNISEIQKL

SEQ ID NO: 104360 - protein, 11 aa, Homo Sapiens
SELSDLHAHKL

SEQ ID NO: 104361 - protein, 11 aa, Homo Sapiens
SEMPQTHHHAL

SEQ ID NO: 104362 - protein, 11 aa, Homo Sapiens
SEMSEEKRAKL

SEQ ID NO: 104363 - protein, 11 aa, Homo Sapiens
SENGDRSQHLL

SEQ ID NO: 104364 - protein, 11 aa, Homo Sapiens
SENQNRAYVTL

SEQ ID NO: 104365 - protein, 11 aa, Homo Sapiens
SESDKTAVLTL

SEQ ID NO: 104366 - protein, 11 aa, Homo Sapiens
SESGERPQITI

SEQ ID NO: 104367 - protein, 11 aa, Homo Sapiens
SESQKIPGMTL

SEQ ID NO: 104368 - protein, 11 aa, Homo Sapiens
SESSSSDRPVL

SEQ ID NO: 104369 - protein, 11 aa, Homo Sapiens
SETAVAKNQAL

SEQ ID NO: 104370 - protein, 11 aa, Homo Sapiens
SEVDLTRSFSF

SEQ ID NO: 104371 - protein, 11 aa, Homo Sapiens
SEVDPKLVSNL

SEQ ID NO: 104372 - protein, 11 aa, Homo Sapiens
SEVTVQPSPYL

SEQ ID NO: 104373 - protein, 11 aa, Homo Sapiens
SEWKAGKGRVL

SEQ ID NO: 104374 - protein, 11 aa, Homo Sapiens
SEYPAERKQAL

SEQ ID NO: 104375 - protein, 11 aa, Homo Sapiens
SEYWDRETRSA

SEQ ID NO: 104376 - protein, 11 aa, Homo Sapiens
SIGLALTVSAL

SEQ ID NO: 104377 - protein, 11 aa, Homo Sapiens
TADQPGLIPRL

SEQ ID NO: 104378 - protein, 11 aa, Homo Sapiens
TEASLLRQCPL

SEQ ID NO: 104379 - protein, 11 aa, Homo Sapiens
TEDFKHLARKL

SEQ ID NO: 104380 - protein, 11 aa, Homo Sapiens
TEFDARKLHKL

SEQ ID NO: 104381 - protein, 11 aa, Homo Sapiens
TEFGGSIYQKV

SEQ ID NO: 104382 - protein, 11 aa, Homo Sapiens
TEFTPPGCISL

SEQ ID NO: 104383 - protein, 11 aa, Homo Sapiens
TEFVHQNSQEI

SEQ ID NO: 104384 - protein, 11 aa, Homo Sapiens
TEIAPTGIESL

SEQ ID NO: 104385 - protein, 11 aa, Homo Sapiens
TEISSAEKVAL

SEQ ID NO: 104386 - protein, 11 aa, Homo Sapiens
TEMLPSILNQL

SEQ ID NO: 104387 - protein, 11 aa, Homo Sapiens
TENPHGARLSL

SEQ ID NO: 104388 - protein, 11 aa, Homo Sapiens
TERKKLPKETL

SEQ ID NO: 104389 - protein, 11 aa, Homo Sapiens
TESAAIACVKL

SEQ ID NO: 104390 - protein, 11 aa, Homo Sapiens
TETDLHGSLRV

SEQ ID NO: 104391 - protein, 11 aa, Homo Sapiens
TEVTPVTGASL

SEQ ID NO: 104392 - protein, 11 aa, Homo Sapiens
TEWLDGKHVVF

SEQ ID NO: 104393 - protein, 11 aa, Homo Sapiens
TEYENFKVQVL

SEQ ID NO: 104394 - protein, 11 aa, Homo Sapiens
VEDDARGTVVL

SEQ ID NO: 104395 - protein, 11 aa, Homo Sapiens
VEFFDEKLNSL

SEQ ID NO: 104396 - protein, 11 aa, Homo Sapiens
VEKQRVREEIL

SEQ ID NO: 104397 - protein, 11 aa, Homo Sapiens
VESDVKSQTIL

SEQ ID NO: 104398 - protein, 11 aa, Homo Sapiens
VEWDPTGRYVV

SEQ ID NO: 104399 - protein, 11 aa, Homo Sapiens
VEYDGERKKTL

SEQ ID NO: 104400 - protein, 11 aa, Homo Sapiens
VEYEVPEAAQL

SEQ ID NO: 104401 - protein, 11 aa, Homo Sapiens
VGAEDAMIQIL

SEQ ID NO: 104402 - protein, 11 aa, Homo Sapiens
WEQQEPGERKL

SEQ ID NO: 104403 - protein, 11 aa, Homo Sapiens
WEYDESHVITA

SEQ ID NO: 104404 - protein, 11 aa, Homo Sapiens
YEAPFDAQASL

SEQ ID NO: 104405 - protein, 11 aa, Homo Sapiens
YEKTSGSEMAL

SEQ ID NO: 104406 - protein, 11 aa, Homo Sapiens
YELPTDSHASL

SEQ ID NO: 104407 - protein, 11 aa, Homo Sapiens
YEVGDPGQRTL

SEQ ID NO: 104408 - protein, 11 aa, Homo Sapiens
YEVTPDDKRKA

SEQ ID NO: 104409 - protein, 11 aa, Homo Sapiens
YEWDVAEARKI

SEQ ID NO: 104410 - protein, 8 aa, Homo Sapiens
ADIQVSAA

SEQ ID NO: 104411 - protein, 8 aa, Homo Sapiens
ADIRGFVA

SEQ ID NO: 104412 - protein, 8 aa, Homo Sapiens
ADIRLWVN

SEQ ID NO: 104413 - protein, 8 aa, Homo Sapiens
ADYLAHES

SEQ ID NO: 104414 - protein, 8 aa, Homo Sapiens
AEARLISA

SEQ ID NO: 104415 - protein, 8 aa, Homo Sapiens
AEASMVIA

SEQ ID NO: 104416 - protein, 8 aa, Homo Sapiens
AEFAAKAA

SEQ ID NO: 104417 - protein, 8 aa, Homo Sapiens
AEFIVAKA

SEQ ID NO: 104418 - protein, 8 aa, Homo Sapiens
AEHPIVIV

SEQ ID NO: 104419 - protein, 8 aa, Homo Sapiens
AEHQQLIP

SEQ ID NO: 104420 - protein, 8 aa, Homo Sapiens
AEHVQYMA

SEQ ID NO: 104421 - protein, 8 aa, Homo Sapiens
AEIAHNVS

SEQ ID NO: 104422 - protein, 8 aa, Homo Sapiens
AEIKHFVS

SEQ ID NO: 104423 - protein, 8 aa, Homo Sapiens
AEIKLTMA

SEQ ID NO: 104424 - protein, 8 aa, Homo Sapiens
AEIKVREA

SEQ ID NO: 104425 - protein, 8 aa, Homo Sapiens
AEILHEIA

SEQ ID NO: 104426 - protein, 8 aa, Homo Sapiens
AEIRIIPA

SEQ ID NO: 104427 - protein, 8 aa, Homo Sapiens
AEIRVHTV

SEQ ID NO: 104428 - protein, 8 aa, Homo Sapiens
AEKVIPAA

SEQ ID NO: 104429 - protein, 8 aa, Homo Sapiens
AELILHDA

SEQ ID NO: 104430 - protein, 8 aa, Homo Sapiens
AELKQLVA

SEQ ID NO: 104431 - protein, 8 aa, Homo Sapiens
AELQLRAA

SEQ ID NO: 104432 - protein, 8 aa, Homo Sapiens
AESRVLSN

SEQ ID NO: 104433 - protein, 8 aa, Homo Sapiens
AETKVLQA

SEQ ID NO: 104434 - protein, 8 aa, Homo Sapiens
AETPIRSP

SEQ ID NO: 104435 - protein, 8 aa, Homo Sapiens
AETVVVSA

SEQ ID NO: 104436 - protein, 8 aa, Homo Sapiens
AEVLLRTA

SEQ ID NO: 104437 - protein, 8 aa, Homo Sapiens
AEVSQFAA

SEQ ID NO: 104438 - protein, 8 aa, Homo Sapiens
AEVTVHAA

SEQ ID NO: 104439 - protein, 8 aa, Homo Sapiens
AEWEPPEA

SEQ ID NO: 104440 - protein, 8 aa, Homo Sapiens
AEYLQPKA

SEQ ID NO: 104441 - protein, 8 aa, Homo Sapiens
EALIKHKP

SEQ ID NO: 104442 - protein, 8 aa, Homo Sapiens
EHNFVAKA

SEQ ID NO: 104443 - protein, 8 aa, Homo Sapiens
EIRAIRQA

SEQ ID NO: 104444 - protein, 8 aa, Homo Sapiens
FNEKSKEL

SEQ ID NO: 104445 - protein, 8 aa, Homo Sapiens
GDVKLPKA

SEQ ID NO: 104446 - protein, 8 aa, Homo Sapiens
GEALMYHT

SEQ ID NO: 104447 - protein, 8 aa, Homo Sapiens
GEFKQPIP

SEQ ID NO: 104448 - protein, 8 aa, Homo Sapiens
GEFSITYK

SEQ ID NO: 104449 - protein, 8 aa, Homo Sapiens
GEHIHYGA

SEQ ID NO: 104450 - protein, 8 aa, Homo Sapiens
GEIILHSV

SEQ ID NO: 104451 - protein, 8 aa, Homo Sapiens
GEIKQFVS

SEQ ID NO: 104452 - protein, 8 aa, Homo Sapiens
GELILHKV

SEQ ID NO: 104453 - protein, 8 aa, Homo Sapiens
GELKLVTA

SEQ ID NO: 104454 - protein, 8 aa, Homo Sapiens
GELNQYSA

SEQ ID NO: 104455 - protein, 8 aa, Homo Sapiens
GELVHPKA

SEQ ID NO: 104456 - protein, 8 aa, Homo Sapiens
GEMKPVAA

SEQ ID NO: 104457 - protein, 8 aa, Homo Sapiens
GETKLLQA

SEQ ID NO: 104458 - protein, 8 aa, Homo Sapiens
GETLLHIA

SEQ ID NO: 104459 - protein, 8 aa, Homo Sapiens
GETLLHRA

SEQ ID NO: 104460 - protein, 8 aa, Homo Sapiens
GETPLHTA

SEQ ID NO: 104461 - protein, 8 aa, Homo Sapiens
GETRQWQT

SEQ ID NO: 104462 - protein, 8 aa, Homo Sapiens
GEVAHVSA

SEQ ID NO: 104463 - protein, 8 aa, Homo Sapiens
GEVIQRPA

SEQ ID NO: 104464 - protein, 8 aa, Homo Sapiens
GEVIVKGA

SEQ ID NO: 104465 - protein, 8 aa, Homo Sapiens
GEVLMVQV

SEQ ID NO: 104466 - protein, 8 aa, Homo Sapiens
GEVVQIRP

SEQ ID NO: 104467 - protein, 8 aa, Homo Sapiens
GEYFAIKA

SEQ ID NO: 104468 - protein, 8 aa, Homo Sapiens
GEYKIMVA

SEQ ID NO: 104469 - protein, 8 aa, Homo Sapiens
HDITDWVV

SEQ ID NO: 104470 - protein, 8 aa, Homo Sapiens
HDLLVHKA

SEQ ID NO: 104471 - protein, 8 aa, Homo Sapiens
HEGPVYAV

SEQ ID NO: 104472 - protein, 8 aa, Homo Sapiens
HEHPLYRA

SEQ ID NO: 104473 - protein, 8 aa, Homo Sapiens
HEIIQHEV

SEQ ID NO: 104474 - protein, 8 aa, Homo Sapiens
HEMVIYEA

SEQ ID NO: 104475 - protein, 8 aa, Homo Sapiens
HEMVVYEA

SEQ ID NO: 104476 - protein, 8 aa, Homo Sapiens
HEQFIPIA

SEQ ID NO: 104477 - protein, 8 aa, Homo Sapiens
HETHLFTA

SEQ ID NO: 104478 - protein, 8 aa, Homo Sapiens
HEVIVSAA

SEQ ID NO: 104479 - protein, 8 aa, Homo Sapiens
HEVLLISA

SEQ ID NO: 104480 - protein, 8 aa, Homo Sapiens
HEWVVKES

SEQ ID NO: 104481 - protein, 8 aa, Homo Sapiens
IEFPVSEA

SEQ ID NO: 104482 - protein, 8 aa, Homo Sapiens
IEIPIHIV

SEQ ID NO: 104483 - protein, 8 aa, Homo Sapiens
KDFIIFEA

SEQ ID NO: 104484 - protein, 8 aa, Homo Sapiens
KDIAAYRA

SEQ ID NO: 104485 - protein, 8 aa, Homo Sapiens
KDINAVAA

SEQ ID NO: 104486 - protein, 8 aa, Homo Sapiens
KDIVINEA

SEQ ID NO: 104487 - protein, 8 aa, Homo Sapiens
KDVFISAA

SEQ ID NO: 104488 - protein, 8 aa, Homo Sapiens
KDYLAAIA

SEQ ID NO: 104489 - protein, 8 aa, Homo Sapiens
KEAILKEA

SEQ ID NO: 104490 - protein, 8 aa, Homo Sapiens
KEAPLHVA

SEQ ID NO: 104491 - protein, 8 aa, Homo Sapiens
KEAQLYAA

SEQ ID NO: 104492 - protein, 8 aa, Homo Sapiens
KEFKAYVS

SEQ ID NO: 104493 - protein, 8 aa, Homo Sapiens
KEFPITEA

SEQ ID NO: 104494 - protein, 8 aa, Homo Sapiens
KEFQVPMA

SEQ ID NO: 104495 - protein, 8 aa, Homo Sapiens
KEILAQVA

SEQ ID NO: 104496 - protein, 8 aa, Homo Sapiens
KEILLKAV

SEQ ID NO: 104497 - protein, 8 aa, Homo Sapiens
KEIRMEAA

SEQ ID NO: 104498 - protein, 8 aa, Homo Sapiens
KEIVVFEA

SEQ ID NO: 104499 - protein, 8 aa, Homo Sapiens
KEIYVISA

SEQ ID NO: 104500 - protein, 8 aa, Homo Sapiens
KELALNTA

SEQ ID NO: 104501 - protein, 8 aa, Homo Sapiens
KELKQLAA

SEQ ID NO: 104502 - protein, 8 aa, Homo Sapiens
KEMIQHCV

SEQ ID NO: 104503 - protein, 8 aa, Homo Sapiens
KENPVVVA

SEQ ID NO: 104504 - protein, 8 aa, Homo Sapiens
KEVKIHVA

SEQ ID NO: 104505 - protein, 8 aa, Homo Sapiens
KEVPIHRV

SEQ ID NO: 104506 - protein, 8 aa, Homo Sapiens
KEVVIVSA

SEQ ID NO: 104507 - protein, 8 aa, Homo Sapiens
LDVVHPAA

SEQ ID NO: 104508 - protein, 8 aa, Homo Sapiens
LEVQHPAA

SEQ ID NO: 104509 - protein, 8 aa, Homo Sapiens
MEVELPAA

SEQ ID NO: 104510 - protein, 8 aa, Homo Sapiens
NDVLAHQA

SEQ ID NO: 104511 - protein, 8 aa, Homo Sapiens
QEFPQVEA

SEQ ID NO: 104512 - protein, 8 aa, Homo Sapiens
QEVQITEA

SEQ ID NO: 104513 - protein, 8 aa, Homo Sapiens
RDFAARLV

SEQ ID NO: 104514 - protein, 8 aa, Homo Sapiens
RDFEGKVV

SEQ ID NO: 104515 - protein, 8 aa, Homo Sapiens
RDFVARNV

SEQ ID NO: 104516 - protein, 8 aa, Homo Sapiens
RDIVQFVP

SEQ ID NO: 104517 - protein, 8 aa, Homo Sapiens
RDYVAPTA

SEQ ID NO: 104518 - protein, 8 aa, Homo Sapiens
REFKLSKV

SEQ ID NO: 104519 - protein, 8 aa, Homo Sapiens
REFLAHSA

SEQ ID NO: 104520 - protein, 8 aa, Homo Sapiens
REFLTKTA

SEQ ID NO: 104521 - protein, 8 aa, Homo Sapiens
REFPQFEP

SEQ ID NO: 104522 - protein, 8 aa, Homo Sapiens
REFQTSVV

SEQ ID NO: 104523 - protein, 8 aa, Homo Sapiens
REFRLVAA

SEQ ID NO: 104524 - protein, 8 aa, Homo Sapiens
REFVMQEA

SEQ ID NO: 104525 - protein, 8 aa, Homo Sapiens
REIIINAV

SEQ ID NO: 104526 - protein, 8 aa, Homo Sapiens
REINITSA

SEQ ID NO: 104527 - protein, 8 aa, Homo Sapiens
REMLIRVN

SEQ ID NO: 104528 - protein, 8 aa, Homo Sapiens
RERIQEVA

SEQ ID NO: 104529 - protein, 8 aa, Homo Sapiens
RETLLNSA

SEQ ID NO: 104530 - protein, 8 aa, Homo Sapiens
RETTISKV

SEQ ID NO: 104531 - protein, 8 aa, Homo Sapiens
REVVVVGA

SEQ ID NO: 104532 - protein, 8 aa, Homo Sapiens
SEAVLWEA

SEQ ID NO: 104533 - protein, 8 aa, Homo Sapiens
SEFEIVKA

SEQ ID NO: 104534 - protein, 8 aa, Homo Sapiens
SEFQIPTA

SEQ ID NO: 104535 - protein, 8 aa, Homo Sapiens
SEIEMAKA

SEQ ID NO: 104536 - protein, 8 aa, Homo Sapiens
SEIEVAQA

SEQ ID NO: 104537 - protein, 8 aa, Homo Sapiens
SEIKMEQA

SEQ ID NO: 104538 - protein, 8 aa, Homo Sapiens
SEIPMKLA

SEQ ID NO: 104539 - protein, 8 aa, Homo Sapiens
SEIRVYSA

SEQ ID NO: 104540 - protein, 8 aa, Homo Sapiens
SELRAFVA

SEQ ID NO: 104541 - protein, 8 aa, Homo Sapiens
SETAMFSV

SEQ ID NO: 104542 - protein, 8 aa, Homo Sapiens
SETKIFTA

SEQ ID NO: 104543 - protein, 8 aa, Homo Sapiens
SETKVFTA

SEQ ID NO: 104544 - protein, 8 aa, Homo Sapiens
SEVKALCA

SEQ ID NO: 104545 - protein, 8 aa, Homo Sapiens
SEVVIHSA

SEQ ID NO: 104546 - protein, 8 aa, Homo Sapiens
SEWLIRPP

SEQ ID NO: 104547 - protein, 8 aa, Homo Sapiens
SEYRTFAA

SEQ ID NO: 104548 - protein, 8 aa, Homo Sapiens
TEFGHPAA

SEQ ID NO: 104549 - protein, 8 aa, Homo Sapiens
TEFLFHTA

SEQ ID NO: 104550 - protein, 8 aa, Homo Sapiens
TEFPGVVA

SEQ ID NO: 104551 - protein, 8 aa, Homo Sapiens
TELELFKA

SEQ ID NO: 104552 - protein, 8 aa, Homo Sapiens
TELIQHSA

SEQ ID NO: 104553 - protein, 8 aa, Homo Sapiens
TEVKIPKP

SEQ ID NO: 104554 - protein, 8 aa, Homo Sapiens
TVGNNKTL

SEQ ID NO: 104555 - protein, 8 aa, Homo Sapiens
VDFYAPTA

SEQ ID NO: 104556 - protein, 8 aa, Homo Sapiens
VDITTPKA

SEQ ID NO: 104557 - protein, 8 aa, Homo Sapiens
VDVTLPKA

SEQ ID NO: 104558 - protein, 8 aa, Homo Sapiens
VEALIHAA

SEQ ID NO: 104559 - protein, 8 aa, Homo Sapiens
VEFTIKEA

SEQ ID NO: 104560 - protein, 8 aa, Homo Sapiens
VEIILHVV

SEQ ID NO: 104561 - protein, 8 aa, Homo Sapiens
WEVPLPKV

SEQ ID NO: 104562 - protein, 8 aa, Homo Sapiens
YEILLHEV

SEQ ID NO: 104563 - protein, 8 aa, Homo Sapiens
YEKLLWTT

SEQ ID NO: 104564 - protein, 9 aa, Homo Sapiens
AAPAKKPYR

SEQ ID NO: 104565 - protein, 9 aa, Homo Sapiens
AAPAYSRAL

SEQ ID NO: 104566 - protein, 9 aa, Homo Sapiens
ADHVSTYAA

SEQ ID NO: 104567 - protein, 9 aa, Homo Sapiens
ADINTKWAA

SEQ ID NO: 104568 - protein, 9 aa, Homo Sapiens
ADLVFPSSA

SEQ ID NO: 104569 - protein, 9 aa, Homo Sapiens
ADTIFVTAP

SEQ ID NO: 104570 - protein, 9 aa, Homo Sapiens
AEAAAAVVA

SEQ ID NO: 104571 - protein, 9 aa, Homo Sapiens
AEAASKWAA

SEQ ID NO: 104572 - protein, 9 aa, Homo Sapiens
AEAAYQTGA

SEQ ID NO: 104573 - protein, 9 aa, Homo Sapiens
AEAFGKIVA

SEQ ID NO: 104574 - protein, 9 aa, Homo Sapiens
AEAFRLPTA

SEQ ID NO: 104575 - protein, 9 aa, Homo Sapiens
AEAGFIHCP

SEQ ID NO: 104576 - protein, 9 aa, Homo Sapiens
AEAGGMHTV

SEQ ID NO: 104577 - protein, 9 aa, Homo Sapiens
AEAIKAWTA

SEQ ID NO: 104578 - protein, 9 aa, Homo Sapiens
AEAIRILAA

SEQ ID NO: 104579 - protein, 9 aa, Homo Sapiens
AEAKFFTES

SEQ ID NO: 104580 - protein, 9 aa, Homo Sapiens
AEALIKHKP

SEQ ID NO: 104581 - protein, 9 aa, Homo Sapiens
AEALPSLAA

SEQ ID NO: 104582 - protein, 9 aa, Homo Sapiens
AEALQLPVV

SEQ ID NO: 104583 - protein, 9 aa, Homo Sapiens
AEAPNMAVV

SEQ ID NO: 104584 - protein, 9 aa, Homo Sapiens
AEAPPSVAP

SEQ ID NO: 104585 - protein, 9 aa, Homo Sapiens
AEAQLHTTA

SEQ ID NO: 104586 - protein, 9 aa, Homo Sapiens
AEAQPMAVV

SEQ ID NO: 104587 - protein, 9 aa, Homo Sapiens
AEAQVTPKP

SEQ ID NO: 104588 - protein, 9 aa, Homo Sapiens
AEAVAHFEA

SEQ ID NO: 104589 - protein, 9 aa, Homo Sapiens
AEAVFASEV

SEQ ID NO: 104590 - protein, 9 aa, Homo Sapiens
AEAVLKHIA

SEQ ID NO: 104591 - protein, 9 aa, Homo Sapiens
AEAYRSLAS

SEQ ID NO: 104592 - protein, 9 aa, Homo Sapiens
AECAGPPVP

SEQ ID NO: 104593 - protein, 9 aa, Homo Sapiens
AECGAFRTG

SEQ ID NO: 104594 - protein, 9 aa, Homo Sapiens
AECGLRILA

SEQ ID NO: 104595 - protein, 9 aa, Homo Sapiens
AECNILRKA

SEQ ID NO: 104596 - protein, 9 aa, Homo Sapiens
AEEFKVPAA

SEQ ID NO: 104597 - protein, 9 aa, Homo Sapiens
AEEFVIVKA

SEQ ID NO: 104598 - protein, 9 aa, Homo Sapiens
AEFAERSVA

SEQ ID NO: 104599 - protein, 9 aa, Homo Sapiens
AEFAERTVA

SEQ ID NO: 104600 - protein, 9 aa, Homo Sapiens
AEFEWENKV

SEQ ID NO: 104601 - protein, 9 aa, Homo Sapiens
AEFFLSQQA

SEQ ID NO: 104602 - protein, 9 aa, Homo Sapiens
AEFGLLQRT

SEQ ID NO: 104603 - protein, 9 aa, Homo Sapiens
AEFGQAESA

SEQ ID NO: 104604 - protein, 9 aa, Homo Sapiens
AEFGTLKKA

SEQ ID NO: 104605 - protein, 9 aa, Homo Sapiens
AEFHQIEGV

SEQ ID NO: 104606 - protein, 9 aa, Homo Sapiens
AEFIKFTVI

SEQ ID NO: 104607 - protein, 9 aa, Homo Sapiens
AEFKIDFPT

SEQ ID NO: 104608 - protein, 9 aa, Homo Sapiens
AEFKLIPGL

SEQ ID NO: 104609 - protein, 9 aa, Homo Sapiens
AEFKQIRSI

SEQ ID NO: 104610 - protein, 9 aa, Homo Sapiens
AEFKRAVKV

SEQ ID NO: 104611 - protein, 9 aa, Homo Sapiens
AEFLIGQGA

SEQ ID NO: 104612 - protein, 9 aa, Homo Sapiens
AEFLKQVKP

SEQ ID NO: 104613 - protein, 9 aa, Homo Sapiens
AEFLKVFIP

SEQ ID NO: 104614 - protein, 9 aa, Homo Sapiens
AEFLQKLLP

SEQ ID NO: 104615 - protein, 9 aa, Homo Sapiens
AEFNLVNNA

SEQ ID NO: 104616 - protein, 9 aa, Homo Sapiens
AEFPHSFLV

SEQ ID NO: 104617 - protein, 9 aa, Homo Sapiens
AEFQELLKV

SEQ ID NO: 104618 - protein, 9 aa, Homo Sapiens
AEFQVKITA

SEQ ID NO: 104619 - protein, 9 aa, Homo Sapiens
AEFVGVSHL

SEQ ID NO: 104620 - protein, 9 aa, Homo Sapiens
AEFVPQLEA

SEQ ID NO: 104621 - protein, 9 aa, Homo Sapiens
AEFYRQVAS

SEQ ID NO: 104622 - protein, 9 aa, Homo Sapiens
AEFYRQVSA

SEQ ID NO: 104623 - protein, 9 aa, Homo Sapiens
AEGAFPNLA

SEQ ID NO: 104624 - protein, 9 aa, Homo Sapiens
AEGEGISKV

SEQ ID NO: 104625 - protein, 9 aa, Homo Sapiens
AEGKFFHRS

SEQ ID NO: 104626 - protein, 9 aa, Homo Sapiens
AEGPEVICA

SEQ ID NO: 104627 - protein, 9 aa, Homo Sapiens
AEGPVAVVV

SEQ ID NO: 104628 - protein, 9 aa, Homo Sapiens
AEGQRLFSA

SEQ ID NO: 104629 - protein, 9 aa, Homo Sapiens
AEHENLRTP

SEQ ID NO: 104630 - protein, 9 aa, Homo Sapiens
AEHFSMIRA

SEQ ID NO: 104631 - protein, 9 aa, Homo Sapiens
AEHGIFLPP

SEQ ID NO: 104632 - protein, 9 aa, Homo Sapiens
AEHGSFRVT

SEQ ID NO: 104633 - protein, 9 aa, Homo Sapiens
AEHKEFITA

SEQ ID NO: 104634 - protein, 9 aa, Homo Sapiens
AEHNAALQA

SEQ ID NO: 104635 - protein, 9 aa, Homo Sapiens
AEHNFVAKA

SEQ ID NO: 104636 - protein, 9 aa, Homo Sapiens
AEHPGFMKT

SEQ ID NO: 104637 - protein, 9 aa, Homo Sapiens
AEHRPILCV

SEQ ID NO: 104638 - protein, 9 aa, Homo Sapiens
AEHVVQPKA

SEQ ID NO: 104639 - protein, 9 aa, Homo Sapiens
AEIAHLYIA

SEQ ID NO: 104640 - protein, 9 aa, Homo Sapiens
AEIAHNVSS

SEQ ID NO: 104641 - protein, 9 aa, Homo Sapiens
AEIAKLKAA

SEQ ID NO: 104642 - protein, 9 aa, Homo Sapiens
AEIDAHLVA

SEQ ID NO: 104643 - protein, 9 aa, Homo Sapiens
AEIDAITAP

SEQ ID NO: 104644 - protein, 9 aa, Homo Sapiens
AEIDARLKA

SEQ ID NO: 104645 - protein, 9 aa, Homo Sapiens
AEIDEEPVS

SEQ ID NO: 104646 - protein, 9 aa, Homo Sapiens
AEIDITNVA

SEQ ID NO: 104647 - protein, 9 aa, Homo Sapiens
AEIDLFRAA

SEQ ID NO: 104648 - protein, 9 aa, Homo Sapiens
AEIDRRISA

SEQ ID NO: 104649 - protein, 9 aa, Homo Sapiens
AEIEDPPIP

SEQ ID NO: 104650 - protein, 9 aa, Homo Sapiens
AEIEDVKPA

SEQ ID NO: 104651 - protein, 9 aa, Homo Sapiens
AEIEKFDKS

SEQ ID NO: 104652 - protein, 9 aa, Homo Sapiens
AEIIFNPSA

SEQ ID NO: 104653 - protein, 9 aa, Homo Sapiens
AEIINPKTA

SEQ ID NO: 104654 - protein, 9 aa, Homo Sapiens
AEIIQLVNA

SEQ ID NO: 104655 - protein, 9 aa, Homo Sapiens
AEIKIIREA

SEQ ID NO: 104656 - protein, 9 aa, Homo Sapiens
AEIKKCVTA

SEQ ID NO: 104657 - protein, 9 aa, Homo Sapiens
AEINGTMNA

SEQ ID NO: 104658 - protein, 9 aa, Homo Sapiens
AEINNIIKI

SEQ ID NO: 104659 - protein, 9 aa, Homo Sapiens
AEIPEGYVP

SEQ ID NO: 104660 - protein, 9 aa, Homo Sapiens
AEIPEHFGA

SEQ ID NO: 104661 - protein, 9 aa, Homo Sapiens
AEIQELHQS

SEQ ID NO: 104662 - protein, 9 aa, Homo Sapiens
AEIQETITA

SEQ ID NO: 104663 - protein, 9 aa, Homo Sapiens
AEIQGVIDA

SEQ ID NO: 104664 - protein, 9 aa, Homo Sapiens
AEIRAINEA

SEQ ID NO: 104665 - protein, 9 aa, Homo Sapiens
AEIRHVLVT

SEQ ID NO: 104666 - protein, 9 aa, Homo Sapiens
AEIRKDISA

SEQ ID NO: 104667 - protein, 9 aa, Homo Sapiens
AEIRRFIKA

SEQ ID NO: 104668 - protein, 9 aa, Homo Sapiens
AEISAMLKA

SEQ ID NO: 104669 - protein, 9 aa, Homo Sapiens
AEITNIRPS

SEQ ID NO: 104670 - protein, 9 aa, Homo Sapiens
AEIYEQHVT

SEQ ID NO: 104671 - protein, 9 aa, Homo Sapiens
AEKCFGTGA

SEQ ID NO: 104672 - protein, 9 aa, Homo Sapiens
AEKEPVPVP

SEQ ID NO: 104673 - protein, 9 aa, Homo Sapiens
AEKLEALSV

SEQ ID NO: 104674 - protein, 9 aa, Homo Sapiens
AEKPLQVAA

SEQ ID NO: 104675 - protein, 9 aa, Homo Sapiens
AEKSITQVA

SEQ ID NO: 104676 - protein, 9 aa, Homo Sapiens
AEKVEEIVA

SEQ ID NO: 104677 - protein, 9 aa, Homo Sapiens
AEKYEWDVA

SEQ ID NO: 104678 - protein, 9 aa, Homo Sapiens
AEKYQTVIA

SEQ ID NO: 104679 - protein, 9 aa, Homo Sapiens
AELATRAIP

SEQ ID NO: 104680 - protein, 9 aa, Homo Sapiens
AELDKLTSV

SEQ ID NO: 104681 - protein, 9 aa, Homo Sapiens
AELDQLLAV

SEQ ID NO: 104682 - protein, 9 aa, Homo Sapiens
AELEKAHLA

SEQ ID NO: 104683 - protein, 9 aa, Homo Sapiens
AELEKHMAA

SEQ ID NO: 104684 - protein, 9 aa, Homo Sapiens
AELETDIRA

SEQ ID NO: 104685 - protein, 9 aa, Homo Sapiens
AELGALHSA

SEQ ID NO: 104686 - protein, 9 aa, Homo Sapiens
AELGKLYSV

SEQ ID NO: 104687 - protein, 9 aa, Homo Sapiens
AELGLTRAA

SEQ ID NO: 104688 - protein, 9 aa, Homo Sapiens
AELGMEHQA

SEQ ID NO: 104689 - protein, 9 aa, Homo Sapiens
AELIHQIEA

SEQ ID NO: 104690 - protein, 9 aa, Homo Sapiens
AELLLIPKV

SEQ ID NO: 104691 - protein, 9 aa, Homo Sapiens
AELLPLVSA

SEQ ID NO: 104692 - protein, 9 aa, Homo Sapiens
AELLQKIEV

SEQ ID NO: 104693 - protein, 9 aa, Homo Sapiens
AELLRGFVA

SEQ ID NO: 104694 - protein, 9 aa, Homo Sapiens
AELLVKHGA

SEQ ID NO: 104695 - protein, 9 aa, Homo Sapiens
AELLVRHGA

SEQ ID NO: 104696 - protein, 9 aa, Homo Sapiens
AELLVSHGA

SEQ ID NO: 104697 - protein, 9 aa, Homo Sapiens
AELMGLKQV

SEQ ID NO: 104698 - protein, 9 aa, Homo Sapiens
AELPWAVKP

SEQ ID NO: 104699 - protein, 9 aa, Homo Sapiens
AELQARIQA

SEQ ID NO: 104700 - protein, 9 aa, Homo Sapiens
AELQEQLKA

SEQ ID NO: 104701 - protein, 9 aa, Homo Sapiens
AELQEQLRA

SEQ ID NO: 104702 - protein, 9 aa, Homo Sapiens
AELQKQWEV

SEQ ID NO: 104703 - protein, 9 aa, Homo Sapiens
AELQQHDVA

SEQ ID NO: 104704 - protein, 9 aa, Homo Sapiens
AELQRLVAA

SEQ ID NO: 104705 - protein, 9 aa, Homo Sapiens
AELSELHSA

SEQ ID NO: 104706 - protein, 9 aa, Homo Sapiens
AELSQPLTA

SEQ ID NO: 104707 - protein, 9 aa, Homo Sapiens
AELTCLNEA

SEQ ID NO: 104708 - protein, 9 aa, Homo Sapiens
AELVRLREA

SEQ ID NO: 104709 - protein, 9 aa, Homo Sapiens
AELWKNPTA

SEQ ID NO: 104710 - protein, 9 aa, Homo Sapiens
AELYFHDSA

SEQ ID NO: 104711 - protein, 9 aa, Homo Sapiens
AELYHIISS

SEQ ID NO: 104712 - protein, 9 aa, Homo Sapiens
AEMDGFKPN

SEQ ID NO: 104713 - protein, 9 aa, Homo Sapiens
AEMKAQEVA

SEQ ID NO: 104714 - protein, 9 aa, Homo Sapiens
AEMLEIVQA

SEQ ID NO: 104715 - protein, 9 aa, Homo Sapiens
AEMPDSAAA

SEQ ID NO: 104716 - protein, 9 aa, Homo Sapiens
AEMPQNYRP

SEQ ID NO: 104717 - protein, 9 aa, Homo Sapiens
AEMRLFYTT

SEQ ID NO: 104718 - protein, 9 aa, Homo Sapiens
AEMTTRMVA

SEQ ID NO: 104719 - protein, 9 aa, Homo Sapiens
AENPKLISA

SEQ ID NO: 104720 - protein, 9 aa, Homo Sapiens
AENQGFVAA

SEQ ID NO: 104721 - protein, 9 aa, Homo Sapiens
AENQRITAV

SEQ ID NO: 104722 - protein, 9 aa, Homo Sapiens
AENTIQNEA

SEQ ID NO: 104723 - protein, 9 aa, Homo Sapiens
AENVAVPEA

SEQ ID NO: 104724 - protein, 9 aa, Homo Sapiens
AENVTFWKA

SEQ ID NO: 104725 - protein, 9 aa, Homo Sapiens
AENYDIPSA

SEQ ID NO: 104726 - protein, 9 aa, Homo Sapiens
AENYLGHTA

SEQ ID NO: 104727 - protein, 9 aa, Homo Sapiens
AEPPPIKSA

SEQ ID NO: 104728 - protein, 9 aa, Homo Sapiens
AEQIVPLSA

SEQ ID NO: 104729 - protein, 9 aa, Homo Sapiens
AEQPYFIEA

SEQ ID NO: 104730 - protein, 9 aa, Homo Sapiens
AEQVVARVA

SEQ ID NO: 104731 - protein, 9 aa, Homo Sapiens
AERDFIHTA

SEQ ID NO: 104732 - protein, 9 aa, Homo Sapiens
AEREKEFVA

SEQ ID NO: 104733 - protein, 9 aa, Homo Sapiens
AERESAEVV

SEQ ID NO: 104734 - protein, 9 aa, Homo Sapiens
AERPGEAAV

SEQ ID NO: 104735 - protein, 9 aa, Homo Sapiens
AERPPSKPP

SEQ ID NO: 104736 - protein, 9 aa, Homo Sapiens
AERYDDMAA

SEQ ID NO: 104737 - protein, 9 aa, Homo Sapiens
AESKVSVAV

SEQ ID NO: 104738 - protein, 9 aa, Homo Sapiens
AESLGQYAA

SEQ ID NO: 104739 - protein, 9 aa, Homo Sapiens
AESLQPVAA

SEQ ID NO: 104740 - protein, 9 aa, Homo Sapiens
AESPGFSQA

SEQ ID NO: 104741 - protein, 9 aa, Homo Sapiens
AESPGVPVA

SEQ ID NO: 104742 - protein, 9 aa, Homo Sapiens
AESTVIAKV

SEQ ID NO: 104743 - protein, 9 aa, Homo Sapiens
AESVGIKST

SEQ ID NO: 104744 - protein, 9 aa, Homo Sapiens
AESVVKLTA

SEQ ID NO: 104745 - protein, 9 aa, Homo Sapiens
AETAVSVIP

SEQ ID NO: 104746 - protein, 9 aa, Homo Sapiens
AETDKIVVG

SEQ ID NO: 104747 - protein, 9 aa, Homo Sapiens
AETEFFSKA

SEQ ID NO: 104748 - protein, 9 aa, Homo Sapiens
AETELQRAA

SEQ ID NO: 104749 - protein, 9 aa, Homo Sapiens
AETILLKAV

SEQ ID NO: 104750 - protein, 9 aa, Homo Sapiens
AETKDIPAA

SEQ ID NO: 104751 - protein, 9 aa, Homo Sapiens
AETKDLLVA

SEQ ID NO: 104752 - protein, 9 aa, Homo Sapiens
AETLALLKA

SEQ ID NO: 104753 - protein, 9 aa, Homo Sapiens
AETPGVPSP

SEQ ID NO: 104754 - protein, 9 aa, Homo Sapiens
AETQNIAPS

SEQ ID NO: 104755 - protein, 9 aa, Homo Sapiens
AETQQPPAA

SEQ ID NO: 104756 - protein, 9 aa, Homo Sapiens
AETRFCHVV

SEQ ID NO: 104757 - protein, 9 aa, Homo Sapiens
AETRVFLEV

SEQ ID NO: 104758 - protein, 9 aa, Homo Sapiens
AETTKLSKP

SEQ ID NO: 104759 - protein, 9 aa, Homo Sapiens
AETYYQTAP

SEQ ID NO: 104760 - protein, 9 aa, Homo Sapiens
AEVAGILEP

SEQ ID NO: 104761 - protein, 9 aa, Homo Sapiens
AEVAGQFVI

SEQ ID NO: 104762 - protein, 9 aa, Homo Sapiens
AEVAPMLKA

SEQ ID NO: 104763 - protein, 9 aa, Homo Sapiens
AEVAPVISS

SEQ ID NO: 104764 - protein, 9 aa, Homo Sapiens
AEVDAAMAA

SEQ ID NO: 104765 - protein, 9 aa, Homo Sapiens
AEVDKLRAA

SEQ ID NO: 104766 - protein, 9 aa, Homo Sapiens
AEVEGRLPA

SEQ ID NO: 104767 - protein, 9 aa, Homo Sapiens
AEVEHVVNA

SEQ ID NO: 104768 - protein, 9 aa, Homo Sapiens
AEVEIQVKP

SEQ ID NO: 104769 - protein, 9 aa, Homo Sapiens
AEVEKIIAV

SEQ ID NO: 104770 - protein, 9 aa, Homo Sapiens
AEVELKKGA

SEQ ID NO: 104771 - protein, 9 aa, Homo Sapiens
AEVEPTPEA

SEQ ID NO: 104772 - protein, 9 aa, Homo Sapiens
AEVETRIEA

SEQ ID NO: 104773 - protein, 9 aa, Homo Sapiens
AEVGKWLQA

SEQ ID NO: 104774 - protein, 9 aa, Homo Sapiens
AEVHRLVVV

SEQ ID NO: 104775 - protein, 9 aa, Homo Sapiens
AEVIQAFSA

SEQ ID NO: 104776 - protein, 9 aa, Homo Sapiens
AEVIVDWRP

SEQ ID NO: 104777 - protein, 9 aa, Homo Sapiens
AEVKPILQA

SEQ ID NO: 104778 - protein, 9 aa, Homo Sapiens
AEVKQELAA

SEQ ID NO: 104779 - protein, 9 aa, Homo Sapiens
AEVKVEAIP

SEQ ID NO: 104780 - protein, 9 aa, Homo Sapiens
AEVLITTRT

SEQ ID NO: 104781 - protein, 9 aa, Homo Sapiens
AEVNGLKAS

SEQ ID NO: 104782 - protein, 9 aa, Homo Sapiens
AEVPNLWSV

SEQ ID NO: 104783 - protein, 9 aa, Homo Sapiens
AEVQGMQEA

SEQ ID NO: 104784 - protein, 9 aa, Homo Sapiens
AEVQVQAPP

SEQ ID NO: 104785 - protein, 9 aa, Homo Sapiens
AEVRVIAPP

SEQ ID NO: 104786 - protein, 9 aa, Homo Sapiens
AEVSPMYGV

SEQ ID NO: 104787 - protein, 9 aa, Homo Sapiens
AEVSTLKDT

SEQ ID NO: 104788 - protein, 9 aa, Homo Sapiens
AEVVKLGAA

SEQ ID NO: 104789 - protein, 9 aa, Homo Sapiens
AEVYRILSV

SEQ ID NO: 104790 - protein, 9 aa, Homo Sapiens
AEWDMVNTV

SEQ ID NO: 104791 - protein, 9 aa, Homo Sapiens
AEWKLCRSA

SEQ ID NO: 104792 - protein, 9 aa, Homo Sapiens
AEWLGVLKA

SEQ ID NO: 104793 - protein, 9 aa, Homo Sapiens
AEWREALRA

SEQ ID NO: 104794 - protein, 9 aa, Homo Sapiens
AEWVSLSKA

SEQ ID NO: 104795 - protein, 9 aa, Homo Sapiens
AEYAGLKVA

SEQ ID NO: 104796 - protein, 9 aa, Homo Sapiens
AEYAHPLET

SEQ ID NO: 104797 - protein, 9 aa, Homo Sapiens
AEYAYVLRV

SEQ ID NO: 104798 - protein, 9 aa, Homo Sapiens
AEYGEIKNI

SEQ ID NO: 104799 - protein, 9 aa, Homo Sapiens
AEYGHFVDI

SEQ ID NO: 104800 - protein, 9 aa, Homo Sapiens
AEYHQSILA

SEQ ID NO: 104801 - protein, 9 aa, Homo Sapiens
AEYINEAAA

SEQ ID NO: 104802 - protein, 9 aa, Homo Sapiens
AEYKNWVKA

SEQ ID NO: 104803 - protein, 9 aa, Homo Sapiens
AEYLQPKAA

SEQ ID NO: 104804 - protein, 9 aa, Homo Sapiens
AEYLYFFRV

SEQ ID NO: 104805 - protein, 9 aa, Homo Sapiens
AEYMAPEVV

SEQ ID NO: 104806 - protein, 9 aa, Homo Sapiens
AEYNGRLAA

SEQ ID NO: 104807 - protein, 9 aa, Homo Sapiens
AEYNSIKGT

SEQ ID NO: 104808 - protein, 9 aa, Homo Sapiens
AEYQAFREA

SEQ ID NO: 104809 - protein, 9 aa, Homo Sapiens
AEYQALVKA

SEQ ID NO: 104810 - protein, 9 aa, Homo Sapiens
AEYRHPTVP

SEQ ID NO: 104811 - protein, 9 aa, Homo Sapiens
AEYSYVKST

SEQ ID NO: 104812 - protein, 9 aa, Homo Sapiens
AEYVGHLRA

SEQ ID NO: 104813 - protein, 9 aa, Homo Sapiens
ASDFLSPEA

SEQ ID NO: 104814 - protein, 9 aa, Homo Sapiens
DAAPPSAPP

SEQ ID NO: 104815 - protein, 9 aa, Homo Sapiens
DEFEFLEKA

SEQ ID NO: 104816 - protein, 9 aa, Homo Sapiens
DEFHPFIEA

SEQ ID NO: 104817 - protein, 9 aa, Homo Sapiens
EEFDAITKA

SEQ ID NO: 104818 - protein, 9 aa, Homo Sapiens
EEFDHLPPP

SEQ ID NO: 104819 - protein, 9 aa, Homo Sapiens
EEFEKVMVA

SEQ ID NO: 104820 - protein, 9 aa, Homo Sapiens
EEFERIHQA

SEQ ID NO: 104821 - protein, 9 aa, Homo Sapiens
EEFKKIRSA

SEQ ID NO: 104822 - protein, 9 aa, Homo Sapiens
EEFPAFPRA

SEQ ID NO: 104823 - protein, 9 aa, Homo Sapiens
EEFQFIKKA

SEQ ID NO: 104824 - protein, 9 aa, Homo Sapiens
EEFQKILKA

SEQ ID NO: 104825 - protein, 9 aa, Homo Sapiens
EEFSFIPSA

SEQ ID NO: 104826 - protein, 9 aa, Homo Sapiens
EEFVFIHAV

SEQ ID NO: 104827 - protein, 9 aa, Homo Sapiens
EEFVFIPAA

SEQ ID NO: 104828 - protein, 9 aa, Homo Sapiens
EEHEWFIPA

SEQ ID NO: 104829 - protein, 9 aa, Homo Sapiens
EEHNIVFMP

SEQ ID NO: 104830 - protein, 9 aa, Homo Sapiens
EEIQIKEPA

SEQ ID NO: 104831 - protein, 9 aa, Homo Sapiens
EEISGIVEV

SEQ ID NO: 104832 - protein, 9 aa, Homo Sapiens
EELRDIPQA

SEQ ID NO: 104833 - protein, 9 aa, Homo Sapiens
EEMPQVHTP

SEQ ID NO: 104834 - protein, 9 aa, Homo Sapiens
EEVQSLPLP

SEQ ID NO: 104835 - protein, 9 aa, Homo Sapiens
EEWHGHVTA

SEQ ID NO: 104836 - protein, 9 aa, Homo Sapiens
EEYEWKETA

SEQ ID NO: 104837 - protein, 9 aa, Homo Sapiens
EEYGKILEV

SEQ ID NO: 104838 - protein, 9 aa, Homo Sapiens
ETISALLQA

SEQ ID NO: 104839 - protein, 9 aa, Homo Sapiens
ETKKINPTA

SEQ ID NO: 104840 - protein, 9 aa, Homo Sapiens
FEAPNQEKV

SEQ ID NO: 104841 - protein, 9 aa, Homo Sapiens
FEARIALLP

SEQ ID NO: 104842 - protein, 9 aa, Homo Sapiens
FEFDTKTSA

SEQ ID NO: 104843 - protein, 9 aa, Homo Sapiens
FEFEYQTKV

SEQ ID NO: 104844 - protein, 9 aa, Homo Sapiens
FEFKDMRVP

SEQ ID NO: 104845 - protein, 9 aa, Homo Sapiens
FEFKKPVRP

SEQ ID NO: 104846 - protein, 9 aa, Homo Sapiens
FEFLTKELA

SEQ ID NO: 104847 - protein, 9 aa, Homo Sapiens
FEFMQVEKP

SEQ ID NO: 104848 - protein, 9 aa, Homo Sapiens
FEFPDYCTP

SEQ ID NO: 104849 - protein, 9 aa, Homo Sapiens
FEFTHVEKP

SEQ ID NO: 104850 - protein, 9 aa, Homo Sapiens
FEGAVIRTV

SEQ ID NO: 104851 - protein, 9 aa, Homo Sapiens
FEHAHNMRV

SEQ ID NO: 104852 - protein, 9 aa, Homo Sapiens
FEIKKPPVS

SEQ ID NO: 104853 - protein, 9 aa, Homo Sapiens
FEKALEEKP

SEQ ID NO: 104854 - protein, 9 aa, Homo Sapiens
FEKEPLPPP

SEQ ID NO: 104855 - protein, 9 aa, Homo Sapiens
FEKEWIECA

SEQ ID NO: 104856 - protein, 9 aa, Homo Sapiens
FEKIEEVSA

SEQ ID NO: 104857 - protein, 9 aa, Homo Sapiens
FEKNEAIQA

SEQ ID NO: 104858 - protein, 9 aa, Homo Sapiens
FEKPFLWLA

SEQ ID NO: 104859 - protein, 9 aa, Homo Sapiens
FEKSPPVSA

SEQ ID NO: 104860 - protein, 9 aa, Homo Sapiens
FENLGIQPP

SEQ ID NO: 104861 - protein, 9 aa, Homo Sapiens
FENQDIHSA

SEQ ID NO: 104862 - protein, 9 aa, Homo Sapiens
FEQEMATAA

SEQ ID NO: 104863 - protein, 9 aa, Homo Sapiens
FESGDVKAT

SEQ ID NO: 104864 - protein, 9 aa, Homo Sapiens
FESHPAPSA

SEQ ID NO: 104865 - protein, 9 aa, Homo Sapiens
FESPNISVP

SEQ ID NO: 104866 - protein, 9 aa, Homo Sapiens
FESSGIHVA

SEQ ID NO: 104867 - protein, 9 aa, Homo Sapiens
FETPIGWHA

SEQ ID NO: 104868 - protein, 9 aa, Homo Sapiens
FEVALPKTA

SEQ ID NO: 104869 - protein, 9 aa, Homo Sapiens
FEVKKWNAV

SEQ ID NO: 104870 - protein, 9 aa, Homo Sapiens
FEWENKVTV

SEQ ID NO: 104871 - protein, 9 aa, Homo Sapiens
FEYILSHVA

SEQ ID NO: 104872 - protein, 9 aa, Homo Sapiens
FEYVKVPLA

SEQ ID NO: 104873 - protein, 9 aa, Homo Sapiens
GDRLIVGTA

SEQ ID NO: 104874 - protein, 9 aa, Homo Sapiens
GDRPEPLSA

SEQ ID NO: 104875 - protein, 9 aa, Homo Sapiens
GDVLTPEQA

SEQ ID NO: 104876 - protein, 9 aa, Homo Sapiens
GEAEGLMKV

SEQ ID NO: 104877 - protein, 9 aa, Homo Sapiens
GEALGLKQA

SEQ ID NO: 104878 - protein, 9 aa, Homo Sapiens
GEAPKVPVT

SEQ ID NO: 104879 - protein, 9 aa, Homo Sapiens
GEAPPGTPP

SEQ ID NO: 104880 - protein, 9 aa, Homo Sapiens
GEARPGPTA

SEQ ID NO: 104881 - protein, 9 aa, Homo Sapiens
GECGHAFSA

SEQ ID NO: 104882 - protein, 9 aa, Homo Sapiens
GECGKAFRV

SEQ ID NO: 104883 - protein, 9 aa, Homo Sapiens
GECGKAVVP

SEQ ID NO: 104884 - protein, 9 aa, Homo Sapiens
GEEGPQAVA

SEQ ID NO: 104885 - protein, 9 aa, Homo Sapiens
GEFAKLSKI

SEQ ID NO: 104886 - protein, 9 aa, Homo Sapiens
GEFEKKYVA

SEQ ID NO: 104887 - protein, 9 aa, Homo Sapiens
GEFGDINAV

SEQ ID NO: 104888 - protein, 9 aa, Homo Sapiens
GEFGGFGSV

SEQ ID NO: 104889 - protein, 9 aa, Homo Sapiens
GEFHKMREV

SEQ ID NO: 104890 - protein, 9 aa, Homo Sapiens
GEFHLWYQV

SEQ ID NO: 104891 - protein, 9 aa, Homo Sapiens
GEFKEQLQA

SEQ ID NO: 104892 - protein, 9 aa, Homo Sapiens
GEFKKYLEV

SEQ ID NO: 104893 - protein, 9 aa, Homo Sapiens
GEFKQPIPA

SEQ ID NO: 104894 - protein, 9 aa, Homo Sapiens
GEFLAFQTV

SEQ ID NO: 104895 - protein, 9 aa, Homo Sapiens
GEFLPIQPA

SEQ ID NO: 104896 - protein, 9 aa, Homo Sapiens
GEFLSQHKA

SEQ ID NO: 104897 - protein, 9 aa, Homo Sapiens
GEFPCQHSP

SEQ ID NO: 104898 - protein, 9 aa, Homo Sapiens
GEFPDLHRT

SEQ ID NO: 104899 - protein, 9 aa, Homo Sapiens
GEFPQAIKA

SEQ ID NO: 104900 - protein, 9 aa, Homo Sapiens
GEFPVRVQV

SEQ ID NO: 104901 - protein, 9 aa, Homo Sapiens
GEFQEVVRA

SEQ ID NO: 104902 - protein, 9 aa, Homo Sapiens
GEFQLIRQT

SEQ ID NO: 104903 - protein, 9 aa, Homo Sapiens
GEFREPRPP

SEQ ID NO: 104904 - protein, 9 aa, Homo Sapiens
GEFSDTNAA

SEQ ID NO: 104905 - protein, 9 aa, Homo Sapiens
GEFSITYKP

SEQ ID NO: 104906 - protein, 9 aa, Homo Sapiens
GEFTHEMQV

SEQ ID NO: 104907 - protein, 9 aa, Homo Sapiens
GEFTSARAV

SEQ ID NO: 104908 - protein, 9 aa, Homo Sapiens
GEFVDLYVP

SEQ ID NO: 104909 - protein, 9 aa, Homo Sapiens
GEGKFPSAA

SEQ ID NO: 104910 - protein, 9 aa, Homo Sapiens
GEGTFGRVV

SEQ ID NO: 104911 - protein, 9 aa, Homo Sapiens
GEHGLIIRV

SEQ ID NO: 104912 - protein, 9 aa, Homo Sapiens
GEHLNAVQA

SEQ ID NO: 104913 - protein, 9 aa, Homo Sapiens
GEHRLVTVT

SEQ ID NO: 104914 - protein, 9 aa, Homo Sapiens
GEHTIRNYP

SEQ ID NO: 104915 - protein, 9 aa, Homo Sapiens
GEHTLLVTV

SEQ ID NO: 104916 - protein, 9 aa, Homo Sapiens
GEIASFDKA

SEQ ID NO: 104917 - protein, 9 aa, Homo Sapiens
GEIDASLKA

SEQ ID NO: 104918 - protein, 9 aa, Homo Sapiens
GEIENIELP

SEQ ID NO: 104919 - protein, 9 aa, Homo Sapiens
GEIGLLPKA

SEQ ID NO: 104920 - protein, 9 aa, Homo Sapiens
GEIIPHIPA

SEQ ID NO: 104921 - protein, 9 aa, Homo Sapiens
GEILKKIIP

SEQ ID NO: 104922 - protein, 9 aa, Homo Sapiens
GEINPVKVA

SEQ ID NO: 104923 - protein, 9 aa, Homo Sapiens
GEINVIGEP

SEQ ID NO: 104924 - protein, 9 aa, Homo Sapiens
GEINVVVKV

SEQ ID NO: 104925 - protein, 9 aa, Homo Sapiens
GEIPKVLVA

SEQ ID NO: 104926 - protein, 9 aa, Homo Sapiens
GEIQEIVKT

SEQ ID NO: 104927 - protein, 9 aa, Homo Sapiens
GEIQHMSQA

SEQ ID NO: 104928 - protein, 9 aa, Homo Sapiens
GEIQRLKSA

SEQ ID NO: 104929 - protein, 9 aa, Homo Sapiens
GEIRGFETA

SEQ ID NO: 104930 - protein, 9 aa, Homo Sapiens
GEIRTITVV

SEQ ID NO: 104931 - protein, 9 aa, Homo Sapiens
GEISRMREV

SEQ ID NO: 104932 - protein, 9 aa, Homo Sapiens
GEISTIDKV

SEQ ID NO: 104933 - protein, 9 aa, Homo Sapiens
GEIVALKKV

SEQ ID NO: 104934 - protein, 9 aa, Homo Sapiens
GEIVRLTTP

SEQ ID NO: 104935 - protein, 9 aa, Homo Sapiens
GEKALLVSA

SEQ ID NO: 104936 - protein, 9 aa, Homo Sapiens
GEKFHSEVA

SEQ ID NO: 104937 - protein, 9 aa, Homo Sapiens
GEKGTWVQP

SEQ ID NO: 104938 - protein, 9 aa, Homo Sapiens
GEKKLFCIP

SEQ ID NO: 104939 - protein, 9 aa, Homo Sapiens
GEKPPPPPA

SEQ ID NO: 104940 - protein, 9 aa, Homo Sapiens
GEKRFADAA

SEQ ID NO: 104941 - protein, 9 aa, Homo Sapiens
GEKVLVKAA

SEQ ID NO: 104942 - protein, 9 aa, Homo Sapiens
GELERALSA

SEQ ID NO: 104943 - protein, 9 aa, Homo Sapiens
GELKEQYST

SEQ ID NO: 104944 - protein, 9 aa, Homo Sapiens
GELKSVPTT

SEQ ID NO: 104945 - protein, 9 aa, Homo Sapiens
GELKVVNGA

SEQ ID NO: 104946 - protein, 9 aa, Homo Sapiens
GELLFVHSA

SEQ ID NO: 104947 - protein, 9 aa, Homo Sapiens
GELLIKPCA

SEQ ID NO: 104948 - protein, 9 aa, Homo Sapiens
GELPRQPTT

SEQ ID NO: 104949 - protein, 9 aa, Homo Sapiens
GELREQLKA

SEQ ID NO: 104950 - protein, 9 aa, Homo Sapiens
GELRISVLP

SEQ ID NO: 104951 - protein, 9 aa, Homo Sapiens
GELSKVTKV

SEQ ID NO: 104952 - protein, 9 aa, Homo Sapiens
GEMEPPALP

SEQ ID NO: 104953 - protein, 9 aa, Homo Sapiens
GEMKEIERP

SEQ ID NO: 104954 - protein, 9 aa, Homo Sapiens
GEMKGSAIT

SEQ ID NO: 104955 - protein, 9 aa, Homo Sapiens
GEMPRHFAA

SEQ ID NO: 104956 - protein, 9 aa, Homo Sapiens
GEMVALPPV

SEQ ID NO: 104957 - protein, 9 aa, Homo Sapiens
GEMVPSRQA

SEQ ID NO: 104958 - protein, 9 aa, Homo Sapiens
GEMWNNTAA

SEQ ID NO: 104959 - protein, 9 aa, Homo Sapiens
GENHGVRPP

SEQ ID NO: 104960 - protein, 9 aa, Homo Sapiens
GENLLTHLP

SEQ ID NO: 104961 - protein, 9 aa, Homo Sapiens
GENPHPITP

SEQ ID NO: 104962 - protein, 9 aa, Homo Sapiens
GENPLQVLV

SEQ ID NO: 104963 - protein, 9 aa, Homo Sapiens
GENPYIRMT

SEQ ID NO: 104964 - protein, 9 aa, Homo Sapiens
GENTRIAQP

SEQ ID NO: 104965 - protein, 9 aa, Homo Sapiens
GENTRSVIP

SEQ ID NO: 104966 - protein, 9 aa, Homo Sapiens
GEPDPPPAA

SEQ ID NO: 104967 - protein, 9 aa, Homo Sapiens
GEPGTRVVA

SEQ ID NO: 104968 - protein, 9 aa, Homo Sapiens
GEQEPPPPP

SEQ ID NO: 104969 - protein, 9 aa, Homo Sapiens
GEQSRVPSA

SEQ ID NO: 104970 - protein, 9 aa, Homo Sapiens
GEQTLHYIA

SEQ ID NO: 104971 - protein, 9 aa, Homo Sapiens
GERDFGVKA

SEQ ID NO: 104972 - protein, 9 aa, Homo Sapiens
GERDFQTSA

SEQ ID NO: 104973 - protein, 9 aa, Homo Sapiens
GERLIGDAA

SEQ ID NO: 104974 - protein, 9 aa, Homo Sapiens
GERPELCRV

SEQ ID NO: 104975 - protein, 9 aa, Homo Sapiens
GERSGLKPP

SEQ ID NO: 104976 - protein, 9 aa, Homo Sapiens
GERVIVEHA

SEQ ID NO: 104977 - protein, 9 aa, Homo Sapiens
GESNRLLSA

SEQ ID NO: 104978 - protein, 9 aa, Homo Sapiens
GESPTHFKA

SEQ ID NO: 104979 - protein, 9 aa, Homo Sapiens
GESVLVHGA

SEQ ID NO: 104980 - protein, 9 aa, Homo Sapiens
GETDLIQKA

SEQ ID NO: 104981 - protein, 9 aa, Homo Sapiens
GETEILRKA

SEQ ID NO: 104982 - protein, 9 aa, Homo Sapiens
GETEVLKVI

SEQ ID NO: 104983 - protein, 9 aa, Homo Sapiens
GETFKFKEA

SEQ ID NO: 104984 - protein, 9 aa, Homo Sapiens
GETGRIILP

SEQ ID NO: 104985 - protein, 9 aa, Homo Sapiens
GETIFVERP

SEQ ID NO: 104986 - protein, 9 aa, Homo Sapiens
GETIFVTAP

SEQ ID NO: 104987 - protein, 9 aa, Homo Sapiens
GETLLQRAA

SEQ ID NO: 104988 - protein, 9 aa, Homo Sapiens
GETPKHFAV

SEQ ID NO: 104989 - protein, 9 aa, Homo Sapiens
GETPLIKAT

SEQ ID NO: 104990 - protein, 9 aa, Homo Sapiens
GETRQWQTA

SEQ ID NO: 104991 - protein, 9 aa, Homo Sapiens
GETSVRFTA

SEQ ID NO: 104992 - protein, 9 aa, Homo Sapiens
GETVFHYAV

SEQ ID NO: 104993 - protein, 9 aa, Homo Sapiens
GETVPAPSA

SEQ ID NO: 104994 - protein, 9 aa, Homo Sapiens
GEVAILNST

SEQ ID NO: 104995 - protein, 9 aa, Homo Sapiens
GEVGKKFSA

SEQ ID NO: 104996 - protein, 9 aa, Homo Sapiens
GEVGKLRIA

SEQ ID NO: 104997 - protein, 9 aa, Homo Sapiens
GEVGRQPEP

SEQ ID NO: 104998 - protein, 9 aa, Homo Sapiens
GEVPKIERA

SEQ ID NO: 104999 - protein, 9 aa, Homo Sapiens
GEVPTAVAP

SEQ ID NO: 105000 - protein, 9 aa, Homo Sapiens
GEVSKIVAS

SEQ ID NO: 105001 - protein, 9 aa, Homo Sapiens
GEVTNVTTA

SEQ ID NO: 105002 - protein, 9 aa, Homo Sapiens
GEWDKALSI

SEQ ID NO: 105003 - protein, 9 aa, Homo Sapiens
GEWDLAQKA

SEQ ID NO: 105004 - protein, 9 aa, Homo Sapiens
GEWERAAAV

SEQ ID NO: 105005 - protein, 9 aa, Homo Sapiens
GEWFGPNTV

SEQ ID NO: 105006 - protein, 9 aa, Homo Sapiens
GEWKGPQVS

SEQ ID NO: 105007 - protein, 9 aa, Homo Sapiens
GEWPDQPRI

SEQ ID NO: 105008 - protein, 9 aa, Homo Sapiens
GEWPTQLDV

SEQ ID NO: 105009 - protein, 9 aa, Homo Sapiens
GEWSDQPRI

SEQ ID NO: 105010 - protein, 9 aa, Homo Sapiens
GEYAKLEKI

SEQ ID NO: 105011 - protein, 9 aa, Homo Sapiens
GEYEWVHKP

SEQ ID NO: 105012 - protein, 9 aa, Homo Sapiens
GEYGGWYKA

SEQ ID NO: 105013 - protein, 9 aa, Homo Sapiens
GEYGKFFVT

SEQ ID NO: 105014 - protein, 9 aa, Homo Sapiens
GEYGNLVTI

SEQ ID NO: 105015 - protein, 9 aa, Homo Sapiens
GEYIKTWRP

SEQ ID NO: 105016 - protein, 9 aa, Homo Sapiens
GEYINQIAA

SEQ ID NO: 105017 - protein, 9 aa, Homo Sapiens
GEYKMILVV

SEQ ID NO: 105018 - protein, 9 aa, Homo Sapiens
GEYLEKIIP

SEQ ID NO: 105019 - protein, 9 aa, Homo Sapiens
GEYLPSKGA

SEQ ID NO: 105020 - protein, 9 aa, Homo Sapiens
GEYQGIPRA

SEQ ID NO: 105021 - protein, 9 aa, Homo Sapiens
GEYSKVLAI

SEQ ID NO: 105022 - protein, 9 aa, Homo Sapiens
HDITVPLEV

SEQ ID NO: 105023 - protein, 9 aa, Homo Sapiens
HDVLLPEEA

SEQ ID NO: 105024 - protein, 9 aa, Homo Sapiens
HEAAFPIAV

SEQ ID NO: 105025 - protein, 9 aa, Homo Sapiens
HEACLSISA

SEQ ID NO: 105026 - protein, 9 aa, Homo Sapiens
HEAPSLQEA

SEQ ID NO: 105027 - protein, 9 aa, Homo Sapiens
HEATAMMKA

SEQ ID NO: 105028 - protein, 9 aa, Homo Sapiens
HEAWLIHKT

SEQ ID NO: 105029 - protein, 9 aa, Homo Sapiens
HECFVSPVA

SEQ ID NO: 105030 - protein, 9 aa, Homo Sapiens
HEEAIHAVA

SEQ ID NO: 105031 - protein, 9 aa, Homo Sapiens
HEFDEQVAA

SEQ ID NO: 105032 - protein, 9 aa, Homo Sapiens
HEFGAITFV

SEQ ID NO: 105033 - protein, 9 aa, Homo Sapiens
HEFLHEVPA

SEQ ID NO: 105034 - protein, 9 aa, Homo Sapiens
HEFPMNFNP

SEQ ID NO: 105035 - protein, 9 aa, Homo Sapiens
HEFRDKLAA

SEQ ID NO: 105036 - protein, 9 aa, Homo Sapiens
HEHHTTIVA

SEQ ID NO: 105037 - protein, 9 aa, Homo Sapiens
HEHIEILTV

SEQ ID NO: 105038 - protein, 9 aa, Homo Sapiens
HEHYLVHKP

SEQ ID NO: 105039 - protein, 9 aa, Homo Sapiens
HEIDYILLV

SEQ ID NO: 105040 - protein, 9 aa, Homo Sapiens
HEIEVETIP

SEQ ID NO: 105041 - protein, 9 aa, Homo Sapiens
HEIGHGIAA

SEQ ID NO: 105042 - protein, 9 aa, Homo Sapiens
HEISEGNVA

SEQ ID NO: 105043 - protein, 9 aa, Homo Sapiens
HEKDVIGIA

SEQ ID NO: 105044 - protein, 9 aa, Homo Sapiens
HEKQVYDIA

SEQ ID NO: 105045 - protein, 9 aa, Homo Sapiens
HELDMQVAA

SEQ ID NO: 105046 - protein, 9 aa, Homo Sapiens
HELHFVEKA

SEQ ID NO: 105047 - protein, 9 aa, Homo Sapiens
HELITTERA

SEQ ID NO: 105048 - protein, 9 aa, Homo Sapiens
HELLAIREA

SEQ ID NO: 105049 - protein, 9 aa, Homo Sapiens
HELLKTNAA

SEQ ID NO: 105050 - protein, 9 aa, Homo Sapiens
HELPRIHKA

SEQ ID NO: 105051 - protein, 9 aa, Homo Sapiens
HELRVLTAP

SEQ ID NO: 105052 - protein, 9 aa, Homo Sapiens
HELVNIYCP

SEQ ID NO: 105053 - protein, 9 aa, Homo Sapiens
HEMDRQVAA

SEQ ID NO: 105054 - protein, 9 aa, Homo Sapiens
HEMQIQHPT

SEQ ID NO: 105055 - protein, 9 aa, Homo Sapiens
HEMVVYEAA

SEQ ID NO: 105056 - protein, 9 aa, Homo Sapiens
HENESVYKA

SEQ ID NO: 105057 - protein, 9 aa, Homo Sapiens
HENPDIIIA

SEQ ID NO: 105058 - protein, 9 aa, Homo Sapiens
HENPEWEKA

SEQ ID NO: 105059 - protein, 9 aa, Homo Sapiens
HEQFIPIAA

SEQ ID NO: 105060 - protein, 9 aa, Homo Sapiens
HEQQFAHPP

SEQ ID NO: 105061 - protein, 9 aa, Homo Sapiens
HESAAHAIV

SEQ ID NO: 105062 - protein, 9 aa, Homo Sapiens
HESGHAIIA

SEQ ID NO: 105063 - protein, 9 aa, Homo Sapiens
HESRQITQV

SEQ ID NO: 105064 - protein, 9 aa, Homo Sapiens
HEVDKLYKV

SEQ ID NO: 105065 - protein, 9 aa, Homo Sapiens
HEVDTQYSA

SEQ ID NO: 105066 - protein, 9 aa, Homo Sapiens
HEVGALVRA

SEQ ID NO: 105067 - protein, 9 aa, Homo Sapiens
HEVIVSFTP

SEQ ID NO: 105068 - protein, 9 aa, Homo Sapiens
HEVQMDHRP

SEQ ID NO: 105069 - protein, 9 aa, Homo Sapiens
HEVRIKIIA

SEQ ID NO: 105070 - protein, 9 aa, Homo Sapiens
HEVVAHWIA

SEQ ID NO: 105071 - protein, 9 aa, Homo Sapiens
HEVVGVFTV

SEQ ID NO: 105072 - protein, 9 aa, Homo Sapiens
HEYFALQHA

SEQ ID NO: 105073 - protein, 9 aa, Homo Sapiens
HEYNSQPSV

SEQ ID NO: 105074 - protein, 9 aa, Homo Sapiens
HEYPWILSA

SEQ ID NO: 105075 - protein, 9 aa, Homo Sapiens
HEYVPWVTV

SEQ ID NO: 105076 - protein, 9 aa, Homo Sapiens
IEFSRIREA

SEQ ID NO: 105077 - protein, 9 aa, Homo Sapiens
IEGDMIVCA

SEQ ID NO: 105078 - protein, 9 aa, Homo Sapiens
IEHDVVMKA

SEQ ID NO: 105079 - protein, 9 aa, Homo Sapiens
IEHFIHIIT

SEQ ID NO: 105080 - protein, 9 aa, Homo Sapiens
IEKFEKEAA

SEQ ID NO: 105081 - protein, 9 aa, Homo Sapiens
IEKPVDPPP

SEQ ID NO: 105082 - protein, 9 aa, Homo Sapiens
IEKQIVLPP

SEQ ID NO: 105083 - protein, 9 aa, Homo Sapiens
IELDMRTIA

SEQ ID NO: 105084 - protein, 9 aa, Homo Sapiens
IELPNIQKV

SEQ ID NO: 105085 - protein, 9 aa, Homo Sapiens
IELPSMAVA

SEQ ID NO: 105086 - protein, 9 aa, Homo Sapiens
IELRGAAAA

SEQ ID NO: 105087 - protein, 9 aa, Homo Sapiens
IEMHLPYTA

SEQ ID NO: 105088 - protein, 9 aa, Homo Sapiens
IENIQRVAA

SEQ ID NO: 105089 - protein, 9 aa, Homo Sapiens
IEPVIKWTA

SEQ ID NO: 105090 - protein, 9 aa, Homo Sapiens
IEQETPVSA

SEQ ID NO: 105091 - protein, 9 aa, Homo Sapiens
IESRTLAIA

SEQ ID NO: 105092 - protein, 9 aa, Homo Sapiens
IETENIRLT

SEQ ID NO: 105093 - protein, 9 aa, Homo Sapiens
IEVGICNEA

SEQ ID NO: 105094 - protein, 9 aa, Homo Sapiens
IEVSLPEAA

SEQ ID NO: 105095 - protein, 9 aa, Homo Sapiens
IEWDKPPVP

SEQ ID NO: 105096 - protein, 9 aa, Homo Sapiens
IEWNLSPVG

SEQ ID NO: 105097 - protein, 9 aa, Homo Sapiens
IEYIHQETA

SEQ ID NO: 105098 - protein, 9 aa, Homo Sapiens
IEYPTLHVV

SEQ ID NO: 105099 - protein, 9 aa, Homo Sapiens
KDFAQTTSA

SEQ ID NO: 105100 - protein, 9 aa, Homo Sapiens
KDFEAIIQA

SEQ ID NO: 105101 - protein, 9 aa, Homo Sapiens
KDFGGDVAA

SEQ ID NO: 105102 - protein, 9 aa, Homo Sapiens
KDFIIFEAA

SEQ ID NO: 105103 - protein, 9 aa, Homo Sapiens
KDTTLPASA

SEQ ID NO: 105104 - protein, 9 aa, Homo Sapiens
KEADLPMTA

SEQ ID NO: 105105 - protein, 9 aa, Homo Sapiens
KEAEQILAT

SEQ ID NO: 105106 - protein, 9 aa, Homo Sapiens
KEAFAIVSV

SEQ ID NO: 105107 - protein, 9 aa, Homo Sapiens
KEAGFLMGA

SEQ ID NO: 105108 - protein, 9 aa, Homo Sapiens
KEAGVVAQA

SEQ ID NO: 105109 - protein, 9 aa, Homo Sapiens
KEALGIPAA

SEQ ID NO: 105110 - protein, 9 aa, Homo Sapiens
KEANVKLRA

SEQ ID NO: 105111 - protein, 9 aa, Homo Sapiens
KEAPAPPKA

SEQ ID NO: 105112 - protein, 9 aa, Homo Sapiens
KEAPAQPAP

SEQ ID NO: 105113 - protein, 9 aa, Homo Sapiens
KEAPPMEKP

SEQ ID NO: 105114 - protein, 9 aa, Homo Sapiens
KEASEVKPP

SEQ ID NO: 105115 - protein, 9 aa, Homo Sapiens
KECGKAFRV

SEQ ID NO: 105116 - protein, 9 aa, Homo Sapiens
KECGKAFTV

SEQ ID NO: 105117 - protein, 9 aa, Homo Sapiens
KEFAAIVDV

SEQ ID NO: 105118 - protein, 9 aa, Homo Sapiens
KEFCENLSA

SEQ ID NO: 105119 - protein, 9 aa, Homo Sapiens
KEFDSPETA

SEQ ID NO: 105120 - protein, 9 aa, Homo Sapiens
KEFEGKTLV

SEQ ID NO: 105121 - protein, 9 aa, Homo Sapiens
KEFEKEISA

SEQ ID NO: 105122 - protein, 9 aa, Homo Sapiens
KEFENPEVP

SEQ ID NO: 105123 - protein, 9 aa, Homo Sapiens
KEFEQLRKV

SEQ ID NO: 105124 - protein, 9 aa, Homo Sapiens
KEFETPEKA

SEQ ID NO: 105125 - protein, 9 aa, Homo Sapiens
KEFGAVSKV

SEQ ID NO: 105126 - protein, 9 aa, Homo Sapiens
KEFGDQAEA

SEQ ID NO: 105127 - protein, 9 aa, Homo Sapiens
KEFHKQITA

SEQ ID NO: 105128 - protein, 9 aa, Homo Sapiens
KEFIKIVEA

SEQ ID NO: 105129 - protein, 9 aa, Homo Sapiens
KEFKEHIAA

SEQ ID NO: 105130 - protein, 9 aa, Homo Sapiens
KEFLEFRKA

SEQ ID NO: 105131 - protein, 9 aa, Homo Sapiens
KEFLGHRIV

SEQ ID NO: 105132 - protein, 9 aa, Homo Sapiens
KEFLMENRV

SEQ ID NO: 105133 - protein, 9 aa, Homo Sapiens
KEFLNPVAT

SEQ ID NO: 105134 - protein, 9 aa, Homo Sapiens
KEFLVVASV

SEQ ID NO: 105135 - protein, 9 aa, Homo Sapiens
KEFNFPEEA

SEQ ID NO: 105136 - protein, 9 aa, Homo Sapiens
KEFPITEAV

SEQ ID NO: 105137 - protein, 9 aa, Homo Sapiens
KEFPNQTGA

SEQ ID NO: 105138 - protein, 9 aa, Homo Sapiens
KEFQDLREV

SEQ ID NO: 105139 - protein, 9 aa, Homo Sapiens
KEFQKIAMA

SEQ ID NO: 105140 - protein, 9 aa, Homo Sapiens
KEFQKSLGA

SEQ ID NO: 105141 - protein, 9 aa, Homo Sapiens
KEFQLFQGV

SEQ ID NO: 105142 - protein, 9 aa, Homo Sapiens
KEFSQSFDA

SEQ ID NO: 105143 - protein, 9 aa, Homo Sapiens
KEFSVQSSA

SEQ ID NO: 105144 - protein, 9 aa, Homo Sapiens
KEFTEAVEA

SEQ ID NO: 105145 - protein, 9 aa, Homo Sapiens
KEFTKLEEV

SEQ ID NO: 105146 - protein, 9 aa, Homo Sapiens
KEFVGGNTP

SEQ ID NO: 105147 - protein, 9 aa, Homo Sapiens
KEGAVVSAP

SEQ ID NO: 105148 - protein, 9 aa, Homo Sapiens
KEGILPERA

SEQ ID NO: 105149 - protein, 9 aa, Homo Sapiens
KEGLVMVEV

SEQ ID NO: 105150 - protein, 9 aa, Homo Sapiens
KEGMNIVEA

SEQ ID NO: 105151 - protein, 9 aa, Homo Sapiens
KEGNVQITA

SEQ ID NO: 105152 - protein, 9 aa, Homo Sapiens
KEGPVASPP

SEQ ID NO: 105153 - protein, 9 aa, Homo Sapiens
KEGVFAKEV

SEQ ID NO: 105154 - protein, 9 aa, Homo Sapiens
KEHEAITKV

SEQ ID NO: 105155 - protein, 9 aa, Homo Sapiens
KEHEVTIFV

SEQ ID NO: 105156 - protein, 9 aa, Homo Sapiens
KEHEYRLLA

SEQ ID NO: 105157 - protein, 9 aa, Homo Sapiens
KEHGVVPQA

SEQ ID NO: 105158 - protein, 9 aa, Homo Sapiens
KEHLYFETV

SEQ ID NO: 105159 - protein, 9 aa, Homo Sapiens
KEHQVVVVA

SEQ ID NO: 105160 - protein, 9 aa, Homo Sapiens
KEHVKWVHA

SEQ ID NO: 105161 - protein, 9 aa, Homo Sapiens
KEIDVDAVA

SEQ ID NO: 105162 - protein, 9 aa, Homo Sapiens
KEIDVISIP

SEQ ID NO: 105163 - protein, 9 aa, Homo Sapiens
KEIEELSEA

SEQ ID NO: 105164 - protein, 9 aa, Homo Sapiens
KEIEGIFHA

SEQ ID NO: 105165 - protein, 9 aa, Homo Sapiens
KEIEIDIEP

SEQ ID NO: 105166 - protein, 9 aa, Homo Sapiens
KEIEKVALP

SEQ ID NO: 105167 - protein, 9 aa, Homo Sapiens
KEIESIVKA

SEQ ID NO: 105168 - protein, 9 aa, Homo Sapiens
KEIEYVETV

SEQ ID NO: 105169 - protein, 9 aa, Homo Sapiens
KEIFLRELI

SEQ ID NO: 105170 - protein, 9 aa, Homo Sapiens
KEIFQTTVP

SEQ ID NO: 105171 - protein, 9 aa, Homo Sapiens
KEIGDIAGV

SEQ ID NO: 105172 - protein, 9 aa, Homo Sapiens
KEIGGLTQV

SEQ ID NO: 105173 - protein, 9 aa, Homo Sapiens
KEILQVITS

SEQ ID NO: 105174 - protein, 9 aa, Homo Sapiens
KEILTIREA

SEQ ID NO: 105175 - protein, 9 aa, Homo Sapiens
KEINKIVAA

SEQ ID NO: 105176 - protein, 9 aa, Homo Sapiens
KEIPHLVAV

SEQ ID NO: 105177 - protein, 9 aa, Homo Sapiens
KEIQAPASA

SEQ ID NO: 105178 - protein, 9 aa, Homo Sapiens
KEIQETWTV

SEQ ID NO: 105179 - protein, 9 aa, Homo Sapiens
KEIQYGIRA

SEQ ID NO: 105180 - protein, 9 aa, Homo Sapiens
KEIRFTEAV

SEQ ID NO: 105181 - protein, 9 aa, Homo Sapiens
KEISAQIRA

SEQ ID NO: 105182 - protein, 9 aa, Homo Sapiens
KEISFAYEV

SEQ ID NO: 105183 - protein, 9 aa, Homo Sapiens
KEISITHHV

SEQ ID NO: 105184 - protein, 9 aa, Homo Sapiens
KEISLWFKP

SEQ ID NO: 105185 - protein, 9 aa, Homo Sapiens
KEKEEFAVP

SEQ ID NO: 105186 - protein, 9 aa, Homo Sapiens
KEKEIQWET

SEQ ID NO: 105187 - protein, 9 aa, Homo Sapiens
KEKSIFLVA

SEQ ID NO: 105188 - protein, 9 aa, Homo Sapiens
KELDKVVTT

SEQ ID NO: 105189 - protein, 9 aa, Homo Sapiens
KELEDLLSP

SEQ ID NO: 105190 - protein, 9 aa, Homo Sapiens
KELEEIVQP

SEQ ID NO: 105191 - protein, 9 aa, Homo Sapiens
KELEKQLVA

SEQ ID NO: 105192 - protein, 9 aa, Homo Sapiens
KELEKTYSA

SEQ ID NO: 105193 - protein, 9 aa, Homo Sapiens
KELEKVCNP

SEQ ID NO: 105194 - protein, 9 aa, Homo Sapiens
KELELPFEV

SEQ ID NO: 105195 - protein, 9 aa, Homo Sapiens
KELELVTKA

SEQ ID NO: 105196 - protein, 9 aa, Homo Sapiens
KELERLKSV

SEQ ID NO: 105197 - protein, 9 aa, Homo Sapiens
KELETILET

SEQ ID NO: 105198 - protein, 9 aa, Homo Sapiens
KELEYIVSV

SEQ ID NO: 105199 - protein, 9 aa, Homo Sapiens
KELFILDEA

SEQ ID NO: 105200 - protein, 9 aa, Homo Sapiens
KELGSLTTA

SEQ ID NO: 105201 - protein, 9 aa, Homo Sapiens
KELHHIWQS

SEQ ID NO: 105202 - protein, 9 aa, Homo Sapiens
KELIFEETA

SEQ ID NO: 105203 - protein, 9 aa, Homo Sapiens
KELIFQETA

SEQ ID NO: 105204 - protein, 9 aa, Homo Sapiens
KELKIDIIP

SEQ ID NO: 105205 - protein, 9 aa, Homo Sapiens
KELLGPPEA

SEQ ID NO: 105206 - protein, 9 aa, Homo Sapiens
KELNEAVAA

SEQ ID NO: 105207 - protein, 9 aa, Homo Sapiens
KELPQLVAS

SEQ ID NO: 105208 - protein, 9 aa, Homo Sapiens
KELPSHVQA

SEQ ID NO: 105209 - protein, 9 aa, Homo Sapiens
KELSRIEEA

SEQ ID NO: 105210 - protein, 9 aa, Homo Sapiens
KELTDLHKA

SEQ ID NO: 105211 - protein, 9 aa, Homo Sapiens
KELTGLNEA

SEQ ID NO: 105212 - protein, 9 aa, Homo Sapiens
KELVIPDSA

SEQ ID NO: 105213 - protein, 9 aa, Homo Sapiens
KEMEKSFEV

SEQ ID NO: 105214 - protein, 9 aa, Homo Sapiens
KEMENFEAP

SEQ ID NO: 105215 - protein, 9 aa, Homo Sapiens
KEMEVSPSA

SEQ ID NO: 105216 - protein, 9 aa, Homo Sapiens
KEMFLDYRA

SEQ ID NO: 105217 - protein, 9 aa, Homo Sapiens
KEMFPIEAG

SEQ ID NO: 105218 - protein, 9 aa, Homo Sapiens
KEMGGHHIV

SEQ ID NO: 105219 - protein, 9 aa, Homo Sapiens
KEMIFRDMA

SEQ ID NO: 105220 - protein, 9 aa, Homo Sapiens
KEMPVKVEA

SEQ ID NO: 105221 - protein, 9 aa, Homo Sapiens
KEMTEVPRV

SEQ ID NO: 105222 - protein, 9 aa, Homo Sapiens
KENQISVRA

SEQ ID NO: 105223 - protein, 9 aa, Homo Sapiens
KEQEPMPTV

SEQ ID NO: 105224 - protein, 9 aa, Homo Sapiens
KEQIIHHVA

SEQ ID NO: 105225 - protein, 9 aa, Homo Sapiens
KEQVSIKAA

SEQ ID NO: 105226 - protein, 9 aa, Homo Sapiens
KERPEISPP

SEQ ID NO: 105227 - protein, 9 aa, Homo Sapiens
KESDIVLYA

SEQ ID NO: 105228 - protein, 9 aa, Homo Sapiens
KESDIYIVA

SEQ ID NO: 105229 - protein, 9 aa, Homo Sapiens
KESDVGFIP

SEQ ID NO: 105230 - protein, 9 aa, Homo Sapiens
KESGVDIAA

SEQ ID NO: 105231 - protein, 9 aa, Homo Sapiens
KESQVYVHA

SEQ ID NO: 105232 - protein, 9 aa, Homo Sapiens
KETCLIPAV

SEQ ID NO: 105233 - protein, 9 aa, Homo Sapiens
KETLQLESA

SEQ ID NO: 105234 - protein, 9 aa, Homo Sapiens
KETLSIVAV

SEQ ID NO: 105235 - protein, 9 aa, Homo Sapiens
KETPCILSV

SEQ ID NO: 105236 - protein, 9 aa, Homo Sapiens
KETVFTKSP

SEQ ID NO: 105237 - protein, 9 aa, Homo Sapiens
KETVVTTQA

SEQ ID NO: 105238 - protein, 9 aa, Homo Sapiens
KEVDLIPKV

SEQ ID NO: 105239 - protein, 9 aa, Homo Sapiens
KEVDVGLAA

SEQ ID NO: 105240 - protein, 9 aa, Homo Sapiens
KEVEASHLA

SEQ ID NO: 105241 - protein, 9 aa, Homo Sapiens
KEVEPKLAA

SEQ ID NO: 105242 - protein, 9 aa, Homo Sapiens
KEVEQFDVA

SEQ ID NO: 105243 - protein, 9 aa, Homo Sapiens
KEVEQFTQV

SEQ ID NO: 105244 - protein, 9 aa, Homo Sapiens
KEVEVIGGA

SEQ ID NO: 105245 - protein, 9 aa, Homo Sapiens
KEVEYFTGA

SEQ ID NO: 105246 - protein, 9 aa, Homo Sapiens
KEVEYIVST

SEQ ID NO: 105247 - protein, 9 aa, Homo Sapiens
KEVLVLTSV

SEQ ID NO: 105248 - protein, 9 aa, Homo Sapiens
KEVNKFQMA

SEQ ID NO: 105249 - protein, 9 aa, Homo Sapiens
KEVNLFLQA

SEQ ID NO: 105250 - protein, 9 aa, Homo Sapiens
KEVPIHRVA

SEQ ID NO: 105251 - protein, 9 aa, Homo Sapiens
KEVPLAQTA

SEQ ID NO: 105252 - protein, 9 aa, Homo Sapiens
KEVQDLFEA

SEQ ID NO: 105253 - protein, 9 aa, Homo Sapiens
KEVSVVFIP

SEQ ID NO: 105254 - protein, 9 aa, Homo Sapiens
KEVVGTFKA

SEQ ID NO: 105255 - protein, 9 aa, Homo Sapiens
KEVVLSEKP

SEQ ID NO: 105256 - protein, 9 aa, Homo Sapiens
KEWDEFQKA

SEQ ID NO: 105257 - protein, 9 aa, Homo Sapiens
KEWIQIIQA

SEQ ID NO: 105258 - protein, 9 aa, Homo Sapiens
KEWIRPLAS

SEQ ID NO: 105259 - protein, 9 aa, Homo Sapiens
KEWPQTHQA

SEQ ID NO: 105260 - protein, 9 aa, Homo Sapiens
KEWTGLHDA

SEQ ID NO: 105261 - protein, 9 aa, Homo Sapiens
KEYAVNEVV

SEQ ID NO: 105262 - protein, 9 aa, Homo Sapiens
KEYDALKAA

SEQ ID NO: 105263 - protein, 9 aa, Homo Sapiens
KEYFGIVSV

SEQ ID NO: 105264 - protein, 9 aa, Homo Sapiens
KEYFPVQVV

SEQ ID NO: 105265 - protein, 9 aa, Homo Sapiens
KEYGQIESV

SEQ ID NO: 105266 - protein, 9 aa, Homo Sapiens
KEYILVEEA

SEQ ID NO: 105267 - protein, 9 aa, Homo Sapiens
KEYLAILKA

SEQ ID NO: 105268 - protein, 9 aa, Homo Sapiens
KEYLFYAEA

SEQ ID NO: 105269 - protein, 9 aa, Homo Sapiens
KEYLKALAA

SEQ ID NO: 105270 - protein, 9 aa, Homo Sapiens
KEYLQGLEA

SEQ ID NO: 105271 - protein, 9 aa, Homo Sapiens
KEYPFILDA

SEQ ID NO: 105272 - protein, 9 aa, Homo Sapiens
KQFAEMYVA

SEQ ID NO: 105273 - protein, 9 aa, Homo Sapiens
KQQAPPPPP

SEQ ID NO: 105274 - protein, 9 aa, Homo Sapiens
LDFLAPAKA

SEQ ID NO: 105275 - protein, 9 aa, Homo Sapiens
LEAHFVPLV

SEQ ID NO: 105276 - protein, 9 aa, Homo Sapiens
LEALPQIAA

SEQ ID NO: 105277 - protein, 9 aa, Homo Sapiens
LECSGAISA

SEQ ID NO: 105278 - protein, 9 aa, Homo Sapiens
LECSGVISA

SEQ ID NO: 105279 - protein, 9 aa, Homo Sapiens
LECTKQLAA

SEQ ID NO: 105280 - protein, 9 aa, Homo Sapiens
LEFEHQRAP

SEQ ID NO: 105281 - protein, 9 aa, Homo Sapiens
LEFENPHVT

SEQ ID NO: 105282 - protein, 9 aa, Homo Sapiens
LEFPQLIRV

SEQ ID NO: 105283 - protein, 9 aa, Homo Sapiens
LEFSKILCT

SEQ ID NO: 105284 - protein, 9 aa, Homo Sapiens
LEHDVPHQP

SEQ ID NO: 105285 - protein, 9 aa, Homo Sapiens
LEHKIIIRV

SEQ ID NO: 105286 - protein, 9 aa, Homo Sapiens
LEHQIQVRP

SEQ ID NO: 105287 - protein, 9 aa, Homo Sapiens
LEHYFHAVV

SEQ ID NO: 105288 - protein, 9 aa, Homo Sapiens
LEIAKANAA

SEQ ID NO: 105289 - protein, 9 aa, Homo Sapiens
LEIPRLPPP

SEQ ID NO: 105290 - protein, 9 aa, Homo Sapiens
LEIVNPQAA

SEQ ID NO: 105291 - protein, 9 aa, Homo Sapiens
LEKPNEPVP

SEQ ID NO: 105292 - protein, 9 aa, Homo Sapiens
LEKQDWEHA

SEQ ID NO: 105293 - protein, 9 aa, Homo Sapiens
LELDTNLPA

SEQ ID NO: 105294 - protein, 9 aa, Homo Sapiens
LELIGHAVA

SEQ ID NO: 105295 - protein, 9 aa, Homo Sapiens
LELPGQPVA

SEQ ID NO: 105296 - protein, 9 aa, Homo Sapiens
LELQSPPKA

SEQ ID NO: 105297 - protein, 9 aa, Homo Sapiens
LELVNIHAV

SEQ ID NO: 105298 - protein, 9 aa, Homo Sapiens
LEMEQVWRA

SEQ ID NO: 105299 - protein, 9 aa, Homo Sapiens
LENSKQPSV

SEQ ID NO: 105300 - protein, 9 aa, Homo Sapiens
LEQEKAYQA

SEQ ID NO: 105301 - protein, 9 aa, Homo Sapiens
LEQGGLRAA

SEQ ID NO: 105302 - protein, 9 aa, Homo Sapiens
LERDPIPAA

SEQ ID NO: 105303 - protein, 9 aa, Homo Sapiens
LESELIKSA

SEQ ID NO: 105304 - protein, 9 aa, Homo Sapiens
LETASILRS

SEQ ID NO: 105305 - protein, 9 aa, Homo Sapiens
LETDAGPAA

SEQ ID NO: 105306 - protein, 9 aa, Homo Sapiens
LETTVQKVA

SEQ ID NO: 105307 - protein, 9 aa, Homo Sapiens
LEVAKSLSA

SEQ ID NO: 105308 - protein, 9 aa, Homo Sapiens
LEVEKITTS

SEQ ID NO: 105309 - protein, 9 aa, Homo Sapiens
LEYHVPVTA

SEQ ID NO: 105310 - protein, 9 aa, Homo Sapiens
LEYTGIYRV

SEQ ID NO: 105311 - protein, 9 aa, Homo Sapiens
LEYTQILQT

SEQ ID NO: 105312 - protein, 9 aa, Homo Sapiens
LSEFMNPSP

SEQ ID NO: 105313 - protein, 9 aa, Homo Sapiens
LTQALKDNK

SEQ ID NO: 105314 - protein, 9 aa, Homo Sapiens
MEALPLLAA

SEQ ID NO: 105315 - protein, 9 aa, Homo Sapiens
MEFAQISRV

SEQ ID NO: 105316 - protein, 9 aa, Homo Sapiens
MEFKAVQQV

SEQ ID NO: 105317 - protein, 9 aa, Homo Sapiens
MEFPKIESV

SEQ ID NO: 105318 - protein, 9 aa, Homo Sapiens
MEFQRFVTP

SEQ ID NO: 105319 - protein, 9 aa, Homo Sapiens
MEHIHKLKA

SEQ ID NO: 105320 - protein, 9 aa, Homo Sapiens
MEHPYFYTV

SEQ ID NO: 105321 - protein, 9 aa, Homo Sapiens
MELERIVSA

SEQ ID NO: 105322 - protein, 9 aa, Homo Sapiens
MELITPISA

SEQ ID NO: 105323 - protein, 9 aa, Homo Sapiens
MELQRMIAA

SEQ ID NO: 105324 - protein, 9 aa, Homo Sapiens
MESCGIHET

SEQ ID NO: 105325 - protein, 9 aa, Homo Sapiens
MEVELPAAA

SEQ ID NO: 105326 - protein, 9 aa, Homo Sapiens
MEVNDIKKA

SEQ ID NO: 105327 - protein, 9 aa, Homo Sapiens
MEYKGYLVS

SEQ ID NO: 105328 - protein, 9 aa, Homo Sapiens
MEYPNFEET

SEQ ID NO: 105329 - protein, 9 aa, Homo Sapiens
NEFDAIQKA

SEQ ID NO: 105330 - protein, 9 aa, Homo Sapiens
NEFMRIPCV

SEQ ID NO: 105331 - protein, 9 aa, Homo Sapiens
NEFPFGCPP

SEQ ID NO: 105332 - protein, 9 aa, Homo Sapiens
NEFRENISA

SEQ ID NO: 105333 - protein, 9 aa, Homo Sapiens
NEFSILKSP

SEQ ID NO: 105334 - protein, 9 aa, Homo Sapiens
NEIGAIEKA

SEQ ID NO: 105335 - protein, 9 aa, Homo Sapiens
NEIIFPHCA

SEQ ID NO: 105336 - protein, 9 aa, Homo Sapiens
NEIKDSVVA

SEQ ID NO: 105337 - protein, 9 aa, Homo Sapiens
NELPQPPVP

SEQ ID NO: 105338 - protein, 9 aa, Homo Sapiens
NEVRHIFTA

SEQ ID NO: 105339 - protein, 9 aa, Homo Sapiens
NEVVQVHAA

SEQ ID NO: 105340 - protein, 9 aa, Homo Sapiens
NKPVFIVPP

SEQ ID NO: 105341 - protein, 9 aa, Homo Sapiens
PEFKFWHAA

SEQ ID NO: 105342 - protein, 9 aa, Homo Sapiens
PIRLLAAAA

SEQ ID NO: 105343 - protein, 9 aa, Homo Sapiens
PRIEPRLPP

SEQ ID NO: 105344 - protein, 9 aa, Homo Sapiens
QEAPPIHSS

SEQ ID NO: 105345 - protein, 9 aa, Homo Sapiens
QEAQKIFKA

SEQ ID NO: 105346 - protein, 9 aa, Homo Sapiens
QEFEAALKA

SEQ ID NO: 105347 - protein, 9 aa, Homo Sapiens
QEFLLSKSA

SEQ ID NO: 105348 - protein, 9 aa, Homo Sapiens
QEFNRLLEA

SEQ ID NO: 105349 - protein, 9 aa, Homo Sapiens
QEFPFPETP

SEQ ID NO: 105350 - protein, 9 aa, Homo Sapiens
QEFQRAQAA

SEQ ID NO: 105351 - protein, 9 aa, Homo Sapiens
QEFSFFDKV

SEQ ID NO: 105352 - protein, 9 aa, Homo Sapiens
QEFSNIVIP

SEQ ID NO: 105353 - protein, 9 aa, Homo Sapiens
QEFVRALAA

SEQ ID NO: 105354 - protein, 9 aa, Homo Sapiens
QEHPVVLLP

SEQ ID NO: 105355 - protein, 9 aa, Homo Sapiens
QEIADLKTA

SEQ ID NO: 105356 - protein, 9 aa, Homo Sapiens
QEIATVVVP

SEQ ID NO: 105357 - protein, 9 aa, Homo Sapiens
QEIDQLRNA

SEQ ID NO: 105358 - protein, 9 aa, Homo Sapiens
QEILMHHPP

SEQ ID NO: 105359 - protein, 9 aa, Homo Sapiens
QEIMTVPPP

SEQ ID NO: 105360 - protein, 9 aa, Homo Sapiens
QEINTLLEA

SEQ ID NO: 105361 - protein, 9 aa, Homo Sapiens
QELEFLRVA

SEQ ID NO: 105362 - protein, 9 aa, Homo Sapiens
QELGGLHSA

SEQ ID NO: 105363 - protein, 9 aa, Homo Sapiens
QELHFIEKA

SEQ ID NO: 105364 - protein, 9 aa, Homo Sapiens
QELPGLPAP

SEQ ID NO: 105365 - protein, 9 aa, Homo Sapiens
QELPGLPLV

SEQ ID NO: 105366 - protein, 9 aa, Homo Sapiens
QEMPVQFQV

SEQ ID NO: 105367 - protein, 9 aa, Homo Sapiens
QENTQTPTV

SEQ ID NO: 105368 - protein, 9 aa, Homo Sapiens
QESKLIILA

SEQ ID NO: 105369 - protein, 9 aa, Homo Sapiens
QETEFLSPP

SEQ ID NO: 105370 - protein, 9 aa, Homo Sapiens
QETISLVVV

SEQ ID NO: 105371 - protein, 9 aa, Homo Sapiens
QETLVKIQA

SEQ ID NO: 105372 - protein, 9 aa, Homo Sapiens
QETSFTKEA

SEQ ID NO: 105373 - protein, 9 aa, Homo Sapiens
QETSSIVSV

SEQ ID NO: 105374 - protein, 9 aa, Homo Sapiens
QETVAQIKA

SEQ ID NO: 105375 - protein, 9 aa, Homo Sapiens
QEVDRIKEA

SEQ ID NO: 105376 - protein, 9 aa, Homo Sapiens
QEVENLVRA

SEQ ID NO: 105377 - protein, 9 aa, Homo Sapiens
QEVLVITRA

SEQ ID NO: 105378 - protein, 9 aa, Homo Sapiens
QEVNGLYRA

SEQ ID NO: 105379 - protein, 9 aa, Homo Sapiens
QEVSRIPAS

SEQ ID NO: 105380 - protein, 9 aa, Homo Sapiens
QEVVLDKSA

SEQ ID NO: 105381 - protein, 9 aa, Homo Sapiens
QEVYIPFSA

SEQ ID NO: 105382 - protein, 9 aa, Homo Sapiens
QEYDALAKV

SEQ ID NO: 105383 - protein, 9 aa, Homo Sapiens
QEYEAIYLA

SEQ ID NO: 105384 - protein, 9 aa, Homo Sapiens
QEYFGSLAA

SEQ ID NO: 105385 - protein, 9 aa, Homo Sapiens
QEYNQFCVI

SEQ ID NO: 105386 - protein, 9 aa, Homo Sapiens
QEYPTLKVP

SEQ ID NO: 105387 - protein, 9 aa, Homo Sapiens
QTMLAPVAA

SEQ ID NO: 105388 - protein, 9 aa, Homo Sapiens
QVPNFLLAA

SEQ ID NO: 105389 - protein, 9 aa, Homo Sapiens
RAFKALIAA

SEQ ID NO: 105390 - protein, 9 aa, Homo Sapiens
RDFAARLVA

SEQ ID NO: 105391 - protein, 9 aa, Homo Sapiens
RDFDRFIGA

SEQ ID NO: 105392 - protein, 9 aa, Homo Sapiens
RDFLAPHRA

SEQ ID NO: 105393 - protein, 9 aa, Homo Sapiens
RDFLQRHRA

SEQ ID NO: 105394 - protein, 9 aa, Homo Sapiens
RDFLTHVSA

SEQ ID NO: 105395 - protein, 9 aa, Homo Sapiens
RDGSFTVSA

SEQ ID NO: 105396 - protein, 9 aa, Homo Sapiens
RDISIVFTP

SEQ ID NO: 105397 - protein, 9 aa, Homo Sapiens
RDKYEPAAV

SEQ ID NO: 105398 - protein, 9 aa, Homo Sapiens
RDLLQPRRA

SEQ ID NO: 105399 - protein, 9 aa, Homo Sapiens
RDMTMFVTA

SEQ ID NO: 105400 - protein, 9 aa, Homo Sapiens
RDVAIEFSP

SEQ ID NO: 105401 - protein, 9 aa, Homo Sapiens
RDWEQFHQP

SEQ ID NO: 105402 - protein, 9 aa, Homo Sapiens
RDYYQPLAA

SEQ ID NO: 105403 - protein, 9 aa, Homo Sapiens
READFARVA

SEQ ID NO: 105404 - protein, 9 aa, Homo Sapiens
READGILKP

SEQ ID NO: 105405 - protein, 9 aa, Homo Sapiens
READPMTKV

SEQ ID NO: 105406 - protein, 9 aa, Homo Sapiens
REAEARLAA

SEQ ID NO: 105407 - protein, 9 aa, Homo Sapiens
REAEILHKA

SEQ ID NO: 105408 - protein, 9 aa, Homo Sapiens
REAEIYQTV

SEQ ID NO: 105409 - protein, 9 aa, Homo Sapiens
REAELGARA

SEQ ID NO: 105410 - protein, 9 aa, Homo Sapiens
REAFGFEQA

SEQ ID NO: 105411 - protein, 9 aa, Homo Sapiens
REAGFQVKA

SEQ ID NO: 105412 - protein, 9 aa, Homo Sapiens
REALVKFEA

SEQ ID NO: 105413 - protein, 9 aa, Homo Sapiens
REANFTVSS

SEQ ID NO: 105414 - protein, 9 aa, Homo Sapiens
REAQFGTTA

SEQ ID NO: 105415 - protein, 9 aa, Homo Sapiens
REAQKFALA

SEQ ID NO: 105416 - protein, 9 aa, Homo Sapiens
REAQSFISA

SEQ ID NO: 105417 - protein, 9 aa, Homo Sapiens
RECEIKLEA

SEQ ID NO: 105418 - protein, 9 aa, Homo Sapiens
RECTIEATA

SEQ ID NO: 105419 - protein, 9 aa, Homo Sapiens
REEIIPVAA

SEQ ID NO: 105420 - protein, 9 aa, Homo Sapiens
REEKLLRDA

SEQ ID NO: 105421 - protein, 9 aa, Homo Sapiens
REESSIPRA

SEQ ID NO: 105422 - protein, 9 aa, Homo Sapiens
REFAFPPPV

SEQ ID NO: 105423 - protein, 9 aa, Homo Sapiens
REFAKALET

SEQ ID NO: 105424 - protein, 9 aa, Homo Sapiens
REFDFFNKI

SEQ ID NO: 105425 - protein, 9 aa, Homo Sapiens
REFDKRFTS

SEQ ID NO: 105426 - protein, 9 aa, Homo Sapiens
REFEERHIP

SEQ ID NO: 105427 - protein, 9 aa, Homo Sapiens
REFEIIWVT

SEQ ID NO: 105428 - protein, 9 aa, Homo Sapiens
REFEKMNQS

SEQ ID NO: 105429 - protein, 9 aa, Homo Sapiens
REFEPMLQV

SEQ ID NO: 105430 - protein, 9 aa, Homo Sapiens
REFGNPNRP

SEQ ID NO: 105431 - protein, 9 aa, Homo Sapiens
REFIERQHA

SEQ ID NO: 105432 - protein, 9 aa, Homo Sapiens
REFLQNLDA

SEQ ID NO: 105433 - protein, 9 aa, Homo Sapiens
REFPTHRSV

SEQ ID NO: 105434 - protein, 9 aa, Homo Sapiens
REFPVISVV

SEQ ID NO: 105435 - protein, 9 aa, Homo Sapiens
REFQWLRAN

SEQ ID NO: 105436 - protein, 9 aa, Homo Sapiens
REFRFTSEV

SEQ ID NO: 105437 - protein, 9 aa, Homo Sapiens
REFSDFIRV

SEQ ID NO: 105438 - protein, 9 aa, Homo Sapiens
REFVAVTGA

SEQ ID NO: 105439 - protein, 9 aa, Homo Sapiens
REFVGQLVA

SEQ ID NO: 105440 - protein, 9 aa, Homo Sapiens
REFVMQVKV

SEQ ID NO: 105441 - protein, 9 aa, Homo Sapiens
REFVRQYYT

SEQ ID NO: 105442 - protein, 9 aa, Homo Sapiens
REFVSGLSA

SEQ ID NO: 105443 - protein, 9 aa, Homo Sapiens
REFVSISSP

SEQ ID NO: 105444 - protein, 9 aa, Homo Sapiens
REFWAKPKP

SEQ ID NO: 105445 - protein, 9 aa, Homo Sapiens
REGDLLFTV

SEQ ID NO: 105446 - protein, 9 aa, Homo Sapiens
REGMFERIP

SEQ ID NO: 105447 - protein, 9 aa, Homo Sapiens
REGNLRYSA

SEQ ID NO: 105448 - protein, 9 aa, Homo Sapiens
REGTFALRA

SEQ ID NO: 105449 - protein, 9 aa, Homo Sapiens
REGWFSVTP

SEQ ID NO: 105450 - protein, 9 aa, Homo Sapiens
REHAPFLVA

SEQ ID NO: 105451 - protein, 9 aa, Homo Sapiens
REHCVLLKI

SEQ ID NO: 105452 - protein, 9 aa, Homo Sapiens
REHDIAIKF

SEQ ID NO: 105453 - protein, 9 aa, Homo Sapiens
REHEVLIHV

SEQ ID NO: 105454 - protein, 9 aa, Homo Sapiens
REHFFTSRA

SEQ ID NO: 105455 - protein, 9 aa, Homo Sapiens
REHFQHVAA

SEQ ID NO: 105456 - protein, 9 aa, Homo Sapiens
REHLNPQAA

SEQ ID NO: 105457 - protein, 9 aa, Homo Sapiens
REHPKLKAP

SEQ ID NO: 105458 - protein, 9 aa, Homo Sapiens
REHPVPLLP

SEQ ID NO: 105459 - protein, 9 aa, Homo Sapiens
REHPWEVMP

SEQ ID NO: 105460 - protein, 9 aa, Homo Sapiens
REHSVFTGV

SEQ ID NO: 105461 - protein, 9 aa, Homo Sapiens
REIAQDFKT

SEQ ID NO: 105462 - protein, 9 aa, Homo Sapiens
REIDDFFKA

SEQ ID NO: 105463 - protein, 9 aa, Homo Sapiens
REIEATNAV

SEQ ID NO: 105464 - protein, 9 aa, Homo Sapiens
REIEEQLRA

SEQ ID NO: 105465 - protein, 9 aa, Homo Sapiens
REIENIEKT

SEQ ID NO: 105466 - protein, 9 aa, Homo Sapiens
REIEWREKA

SEQ ID NO: 105467 - protein, 9 aa, Homo Sapiens
REIFFPETA

SEQ ID NO: 105468 - protein, 9 aa, Homo Sapiens
REIKFTVQA

SEQ ID NO: 105469 - protein, 9 aa, Homo Sapiens
REILRPWHA

SEQ ID NO: 105470 - protein, 9 aa, Homo Sapiens
REILVNQTA

SEQ ID NO: 105471 - protein, 9 aa, Homo Sapiens
REINTILKA

SEQ ID NO: 105472 - protein, 9 aa, Homo Sapiens
REINYILRV

SEQ ID NO: 105473 - protein, 9 aa, Homo Sapiens
REIPDPDSA

SEQ ID NO: 105474 - protein, 9 aa, Homo Sapiens
REIPIVHRV

SEQ ID NO: 105475 - protein, 9 aa, Homo Sapiens
REIPMDPEA

SEQ ID NO: 105476 - protein, 9 aa, Homo Sapiens
REIQEAIAV

SEQ ID NO: 105477 - protein, 9 aa, Homo Sapiens
REIQGQVQA

SEQ ID NO: 105478 - protein, 9 aa, Homo Sapiens
REIQVQHPA

SEQ ID NO: 105479 - protein, 9 aa, Homo Sapiens
REIRIYTDA

SEQ ID NO: 105480 - protein, 9 aa, Homo Sapiens
REITNQVVP

SEQ ID NO: 105481 - protein, 9 aa, Homo Sapiens
REIVAISSA

SEQ ID NO: 105482 - protein, 9 aa, Homo Sapiens
REKEEELEV

SEQ ID NO: 105483 - protein, 9 aa, Homo Sapiens
REKELIRQA

SEQ ID NO: 105484 - protein, 9 aa, Homo Sapiens
REKFPEKIP

SEQ ID NO: 105485 - protein, 9 aa, Homo Sapiens
REKKFSVEV

SEQ ID NO: 105486 - protein, 9 aa, Homo Sapiens
REKKLFVIA

SEQ ID NO: 105487 - protein, 9 aa, Homo Sapiens
REKPEEFQT

SEQ ID NO: 105488 - protein, 9 aa, Homo Sapiens
REKVEVFRA

SEQ ID NO: 105489 - protein, 9 aa, Homo Sapiens
RELANQLEA

SEQ ID NO: 105490 - protein, 9 aa, Homo Sapiens
RELAQPASV

SEQ ID NO: 105491 - protein, 9 aa, Homo Sapiens
RELECIREI

SEQ ID NO: 105492 - protein, 9 aa, Homo Sapiens
RELEKAKVA

SEQ ID NO: 105493 - protein, 9 aa, Homo Sapiens
RELEVQHPA

SEQ ID NO: 105494 - protein, 9 aa, Homo Sapiens
RELGEFRTT

SEQ ID NO: 105495 - protein, 9 aa, Homo Sapiens
RELGLIRKP

SEQ ID NO: 105496 - protein, 9 aa, Homo Sapiens
RELIAEHKP

SEQ ID NO: 105497 - protein, 9 aa, Homo Sapiens
RELKKLLVA

SEQ ID NO: 105498 - protein, 9 aa, Homo Sapiens
RELKTKISA

SEQ ID NO: 105499 - protein, 9 aa, Homo Sapiens
RELLNVHSA

SEQ ID NO: 105500 - protein, 9 aa, Homo Sapiens
RELLRIPQA

SEQ ID NO: 105501 - protein, 9 aa, Homo Sapiens
RELNQPASA

SEQ ID NO: 105502 - protein, 9 aa, Homo Sapiens
RELPFTKSA

SEQ ID NO: 105503 - protein, 9 aa, Homo Sapiens
RELPHFTEA

SEQ ID NO: 105504 - protein, 9 aa, Homo Sapiens
RELSFQSAP

SEQ ID NO: 105505 - protein, 9 aa, Homo Sapiens
RELTAQIAA

SEQ ID NO: 105506 - protein, 9 aa, Homo Sapiens
RELTSRVTA

SEQ ID NO: 105507 - protein, 9 aa, Homo Sapiens
RELVAIKKV

SEQ ID NO: 105508 - protein, 9 aa, Homo Sapiens
RELVKNWVP

SEQ ID NO: 105509 - protein, 9 aa, Homo Sapiens
REMDQTMAA

SEQ ID NO: 105510 - protein, 9 aa, Homo Sapiens
REMEENFAV

SEQ ID NO: 105511 - protein, 9 aa, Homo Sapiens
REMENIIAT

SEQ ID NO: 105512 - protein, 9 aa, Homo Sapiens
REMEVKCKP

SEQ ID NO: 105513 - protein, 9 aa, Homo Sapiens
REMFNPMYA

SEQ ID NO: 105514 - protein, 9 aa, Homo Sapiens
REMIPFAVV

SEQ ID NO: 105515 - protein, 9 aa, Homo Sapiens
REMIQKECA

SEQ ID NO: 105516 - protein, 9 aa, Homo Sapiens
REMPGVWGA

SEQ ID NO: 105517 - protein, 9 aa, Homo Sapiens
REMPVKVEA

SEQ ID NO: 105518 - protein, 9 aa, Homo Sapiens
REMRGLTSA

SEQ ID NO: 105519 - protein, 9 aa, Homo Sapiens
REMTILGSA

SEQ ID NO: 105520 - protein, 9 aa, Homo Sapiens
RENFFPVTV

SEQ ID NO: 105521 - protein, 9 aa, Homo Sapiens
RENKTAVVV

SEQ ID NO: 105522 - protein, 9 aa, Homo Sapiens
RENVFKLLP

SEQ ID NO: 105523 - protein, 9 aa, Homo Sapiens
REPPLNTAA

SEQ ID NO: 105524 - protein, 9 aa, Homo Sapiens
REQERQWRA

SEQ ID NO: 105525 - protein, 9 aa, Homo Sapiens
REQINKLEA

SEQ ID NO: 105526 - protein, 9 aa, Homo Sapiens
REQVLKICA

SEQ ID NO: 105527 - protein, 9 aa, Homo Sapiens
REQVLKVCA

SEQ ID NO: 105528 - protein, 9 aa, Homo Sapiens
RERADAPSV

SEQ ID NO: 105529 - protein, 9 aa, Homo Sapiens
REREVEERL

SEQ ID NO: 105530 - protein, 9 aa, Homo Sapiens
RERIIPRSV

SEQ ID NO: 105531 - protein, 9 aa, Homo Sapiens
RERLEQQVP

SEQ ID NO: 105532 - protein, 9 aa, Homo Sapiens
RERPEFQAV

SEQ ID NO: 105533 - protein, 9 aa, Homo Sapiens
RERPPEEVA

SEQ ID NO: 105534 - protein, 9 aa, Homo Sapiens
RERRDNYVP

SEQ ID NO: 105535 - protein, 9 aa, Homo Sapiens
RERWNFDFV

SEQ ID NO: 105536 - protein, 9 aa, Homo Sapiens
RESDKMWLV

SEQ ID NO: 105537 - protein, 9 aa, Homo Sapiens
RESFFRVVP

SEQ ID NO: 105538 - protein, 9 aa, Homo Sapiens
RESIVLHGA

SEQ ID NO: 105539 - protein, 9 aa, Homo Sapiens
RESKVVVPP

SEQ ID NO: 105540 - protein, 9 aa, Homo Sapiens
RESNNMVVP

SEQ ID NO: 105541 - protein, 9 aa, Homo Sapiens
RESPFSTSA

SEQ ID NO: 105542 - protein, 9 aa, Homo Sapiens
RESSFQPEA

SEQ ID NO: 105543 - protein, 9 aa, Homo Sapiens
RETAFTHAV

SEQ ID NO: 105544 - protein, 9 aa, Homo Sapiens
RETGQQFAV

SEQ ID NO: 105545 - protein, 9 aa, Homo Sapiens
RETHILRQV

SEQ ID NO: 105546 - protein, 9 aa, Homo Sapiens
RETQNLQVP

SEQ ID NO: 105547 - protein, 9 aa, Homo Sapiens
RETSHVTMV

SEQ ID NO: 105548 - protein, 9 aa, Homo Sapiens
RETVAYLQA

SEQ ID NO: 105549 - protein, 9 aa, Homo Sapiens
RETYGHLGA

SEQ ID NO: 105550 - protein, 9 aa, Homo Sapiens
RETYGHLSA

SEQ ID NO: 105551 - protein, 9 aa, Homo Sapiens
REVAAAVRA

SEQ ID NO: 105552 - protein, 9 aa, Homo Sapiens
REVDAEYEA

SEQ ID NO: 105553 - protein, 9 aa, Homo Sapiens
REVEHFLKA

SEQ ID NO: 105554 - protein, 9 aa, Homo Sapiens
REVEILNKT

SEQ ID NO: 105555 - protein, 9 aa, Homo Sapiens
REVEMLYQC

SEQ ID NO: 105556 - protein, 9 aa, Homo Sapiens
REVEVFKSS

SEQ ID NO: 105557 - protein, 9 aa, Homo Sapiens
REVIHPLAT

SEQ ID NO: 105558 - protein, 9 aa, Homo Sapiens
REVIQKECA

SEQ ID NO: 105559 - protein, 9 aa, Homo Sapiens
REVLPLNQA

SEQ ID NO: 105560 - protein, 9 aa, Homo Sapiens
REVTIVEKA

SEQ ID NO: 105561 - protein, 9 aa, Homo Sapiens
REVVFVEDV

SEQ ID NO: 105562 - protein, 9 aa, Homo Sapiens
REVWLYEQV

SEQ ID NO: 105563 - protein, 9 aa, Homo Sapiens
REWAHPRSI

SEQ ID NO: 105564 - protein, 9 aa, Homo Sapiens
REWERPPMA

SEQ ID NO: 105565 - protein, 9 aa, Homo Sapiens
REWGEELQA

SEQ ID NO: 105566 - protein, 9 aa, Homo Sapiens
REWHHFLVV

SEQ ID NO: 105567 - protein, 9 aa, Homo Sapiens
REWKGIDRL

SEQ ID NO: 105568 - protein, 9 aa, Homo Sapiens
REWLRVTTV

SEQ ID NO: 105569 - protein, 9 aa, Homo Sapiens
REWVAPEKA

SEQ ID NO: 105570 - protein, 9 aa, Homo Sapiens
REYIEIITS

SEQ ID NO: 105571 - protein, 9 aa, Homo Sapiens
REYKTSFHA

SEQ ID NO: 105572 - protein, 9 aa, Homo Sapiens
REYLRVNVV

SEQ ID NO: 105573 - protein, 9 aa, Homo Sapiens
REYMGFIQA

SEQ ID NO: 105574 - protein, 9 aa, Homo Sapiens
REYPNLVTI

SEQ ID NO: 105575 - protein, 9 aa, Homo Sapiens
REYPRMQVT

SEQ ID NO: 105576 - protein, 9 aa, Homo Sapiens
REYQDLLNV

SEQ ID NO: 105577 - protein, 9 aa, Homo Sapiens
REYQELMSV

SEQ ID NO: 105578 - protein, 9 aa, Homo Sapiens
REYQLVVQT

SEQ ID NO: 105579 - protein, 9 aa, Homo Sapiens
REYQVKLQA

SEQ ID NO: 105580 - protein, 9 aa, Homo Sapiens
REYSRYLHA

SEQ ID NO: 105581 - protein, 9 aa, Homo Sapiens
REYSVAVEA

SEQ ID NO: 105582 - protein, 9 aa, Homo Sapiens
REYWNEQSA

SEQ ID NO: 105583 - protein, 9 aa, Homo Sapiens
RGYAFNHSA

SEQ ID NO: 105584 - protein, 9 aa, Homo Sapiens
RGYSFTTTA

SEQ ID NO: 105585 - protein, 9 aa, Homo Sapiens
RPEAPPPPP

SEQ ID NO: 105586 - protein, 9 aa, Homo Sapiens
RPMSPPPPP

SEQ ID NO: 105587 - protein, 9 aa, Homo Sapiens
SADLRDLAT

SEQ ID NO: 105588 - protein, 9 aa, Homo Sapiens
SDPVVIVSA

SEQ ID NO: 105589 - protein, 9 aa, Homo Sapiens
SEADKIKVA

SEQ ID NO: 105590 - protein, 9 aa, Homo Sapiens
SEAEIQAKA

SEQ ID NO: 105591 - protein, 9 aa, Homo Sapiens
SEAEKVYIV

SEQ ID NO: 105592 - protein, 9 aa, Homo Sapiens
SEAKIIQQA

SEQ ID NO: 105593 - protein, 9 aa, Homo Sapiens
SEAKQMPRA

SEQ ID NO: 105594 - protein, 9 aa, Homo Sapiens
SEAKSVPKP

SEQ ID NO: 105595 - protein, 9 aa, Homo Sapiens
SEAPLEHKP

SEQ ID NO: 105596 - protein, 9 aa, Homo Sapiens
SEAQPQPEV

SEQ ID NO: 105597 - protein, 9 aa, Homo Sapiens
SECGIIEKA

SEQ ID NO: 105598 - protein, 9 aa, Homo Sapiens
SECGKTFTV

SEQ ID NO: 105599 - protein, 9 aa, Homo Sapiens
SEEKPVPAA

SEQ ID NO: 105600 - protein, 9 aa, Homo Sapiens
SEFASIPAN

SEQ ID NO: 105601 - protein, 9 aa, Homo Sapiens
SEFGAPVSV

SEQ ID NO: 105602 - protein, 9 aa, Homo Sapiens
SEFGKLERV

SEQ ID NO: 105603 - protein, 9 aa, Homo Sapiens
SEFIKEKSA

SEQ ID NO: 105604 - protein, 9 aa, Homo Sapiens
SEFKDLILP

SEQ ID NO: 105605 - protein, 9 aa, Homo Sapiens
SEFKEFSQS

SEQ ID NO: 105606 - protein, 9 aa, Homo Sapiens
SEFKSIKKT

SEQ ID NO: 105607 - protein, 9 aa, Homo Sapiens
SEFKTLPET

SEQ ID NO: 105608 - protein, 9 aa, Homo Sapiens
SEFKYNKPA

SEQ ID NO: 105609 - protein, 9 aa, Homo Sapiens
SEFMFEKAP

SEQ ID NO: 105610 - protein, 9 aa, Homo Sapiens
SEFMKWKEA

SEQ ID NO: 105611 - protein, 9 aa, Homo Sapiens
SEFPDNYEA

SEQ ID NO: 105612 - protein, 9 aa, Homo Sapiens
SEFPGHTGP

SEQ ID NO: 105613 - protein, 9 aa, Homo Sapiens
SEFVKIMEP

SEQ ID NO: 105614 - protein, 9 aa, Homo Sapiens
SEFYTLHEV

SEQ ID NO: 105615 - protein, 9 aa, Homo Sapiens
SEGNVVNKP

SEQ ID NO: 105616 - protein, 9 aa, Homo Sapiens
SEGRPVGPA

SEQ ID NO: 105617 - protein, 9 aa, Homo Sapiens
SEHASSPVP

SEQ ID NO: 105618 - protein, 9 aa, Homo Sapiens
SEHGLVVIA

SEQ ID NO: 105619 - protein, 9 aa, Homo Sapiens
SEHPFVNGV

SEQ ID NO: 105620 - protein, 9 aa, Homo Sapiens
SEHSKAILA

SEQ ID NO: 105621 - protein, 9 aa, Homo Sapiens
SEHSVIKPP

SEQ ID NO: 105622 - protein, 9 aa, Homo Sapiens
SEHVIAIRA

SEQ ID NO: 105623 - protein, 9 aa, Homo Sapiens
SEHVMPYAA

SEQ ID NO: 105624 - protein, 9 aa, Homo Sapiens
SEHWLVLVP

SEQ ID NO: 105625 - protein, 9 aa, Homo Sapiens
SEIAFHTIP

SEQ ID NO: 105626 - protein, 9 aa, Homo Sapiens
SEIDMSVKA

SEQ ID NO: 105627 - protein, 9 aa, Homo Sapiens
SEIDQINKV

SEQ ID NO: 105628 - protein, 9 aa, Homo Sapiens
SEIDQVVPA

SEQ ID NO: 105629 - protein, 9 aa, Homo Sapiens
SEIEARIAA

SEQ ID NO: 105630 - protein, 9 aa, Homo Sapiens
SEIEKLSAA

SEQ ID NO: 105631 - protein, 9 aa, Homo Sapiens
SEIERQAQV

SEQ ID NO: 105632 - protein, 9 aa, Homo Sapiens
SEIEVPREA

SEQ ID NO: 105633 - protein, 9 aa, Homo Sapiens
SEIFPLFRA

SEQ ID NO: 105634 - protein, 9 aa, Homo Sapiens
SEIHIKVKP

SEQ ID NO: 105635 - protein, 9 aa, Homo Sapiens
SEIKGVCSV

SEQ ID NO: 105636 - protein, 9 aa, Homo Sapiens
SEIKSIPGV

SEQ ID NO: 105637 - protein, 9 aa, Homo Sapiens
SEINSLPTI

SEQ ID NO: 105638 - protein, 9 aa, Homo Sapiens
SEIPKLPAV

SEQ ID NO: 105639 - protein, 9 aa, Homo Sapiens
SEIRAIRQA

SEQ ID NO: 105640 - protein, 9 aa, Homo Sapiens
SEIRLPLKA

SEQ ID NO: 105641 - protein, 9 aa, Homo Sapiens
SEIRSAWQA

SEQ ID NO: 105642 - protein, 9 aa, Homo Sapiens
SEITGLSTA

SEQ ID NO: 105643 - protein, 9 aa, Homo Sapiens
SEIYGLMKA

SEQ ID NO: 105644 - protein, 9 aa, Homo Sapiens
SEKEATPVV

SEQ ID NO: 105645 - protein, 9 aa, Homo Sapiens
SEKHIEVEV

SEQ ID NO: 105646 - protein, 9 aa, Homo Sapiens
SEKKAEIPP

SEQ ID NO: 105647 - protein, 9 aa, Homo Sapiens
SEKLASYQA

SEQ ID NO: 105648 - protein, 9 aa, Homo Sapiens
SELAFPITA

SEQ ID NO: 105649 - protein, 9 aa, Homo Sapiens
SELATAVKA

SEQ ID NO: 105650 - protein, 9 aa, Homo Sapiens
SELAVILKA

SEQ ID NO: 105651 - protein, 9 aa, Homo Sapiens
SELEKTQVA

SEQ ID NO: 105652 - protein, 9 aa, Homo Sapiens
SELEQYFTA

SEQ ID NO: 105653 - protein, 9 aa, Homo Sapiens
SELERLIVP

SEQ ID NO: 105654 - protein, 9 aa, Homo Sapiens
SELGGIWSV

SEQ ID NO: 105655 - protein, 9 aa, Homo Sapiens
SELGKICSV

SEQ ID NO: 105656 - protein, 9 aa, Homo Sapiens
SELILLPVT

SEQ ID NO: 105657 - protein, 9 aa, Homo Sapiens
SELIQLVAV

SEQ ID NO: 105658 - protein, 9 aa, Homo Sapiens
SELITKAVA

SEQ ID NO: 105659 - protein, 9 aa, Homo Sapiens
SELKAIRPP

SEQ ID NO: 105660 - protein, 9 aa, Homo Sapiens
SELPGAFEA

SEQ ID NO: 105661 - protein, 9 aa, Homo Sapiens
SELPIVTPA

SEQ ID NO: 105662 - protein, 9 aa, Homo Sapiens
SELPPKPAA

SEQ ID NO: 105663 - protein, 9 aa, Homo Sapiens
SELPTQSKA

SEQ ID NO: 105664 - protein, 9 aa, Homo Sapiens
SELPVSEVA

SEQ ID NO: 105665 - protein, 9 aa, Homo Sapiens
SELQKIHKA

SEQ ID NO: 105666 - protein, 9 aa, Homo Sapiens
SELQKIHRA

SEQ ID NO: 105667 - protein, 9 aa, Homo Sapiens
SELQLPFQA

SEQ ID NO: 105668 - protein, 9 aa, Homo Sapiens
SELRAMAKA

SEQ ID NO: 105669 - protein, 9 aa, Homo Sapiens
SELREFPAA

SEQ ID NO: 105670 - protein, 9 aa, Homo Sapiens
SELRSLPPP

SEQ ID NO: 105671 - protein, 9 aa, Homo Sapiens
SELSRSPVA

SEQ ID NO: 105672 - protein, 9 aa, Homo Sapiens
SELSRTYLP

SEQ ID NO: 105673 - protein, 9 aa, Homo Sapiens
SELSSNPAA

SEQ ID NO: 105674 - protein, 9 aa, Homo Sapiens
SELTPMLAA

SEQ ID NO: 105675 - protein, 9 aa, Homo Sapiens
SEMAPVCAV

SEQ ID NO: 105676 - protein, 9 aa, Homo Sapiens
SEMDRVPFV

SEQ ID NO: 105677 - protein, 9 aa, Homo Sapiens
SEMRAPPAA

SEQ ID NO: 105678 - protein, 9 aa, Homo Sapiens
SEMRAVIKA

SEQ ID NO: 105679 - protein, 9 aa, Homo Sapiens
SEMSKVSKP

SEQ ID NO: 105680 - protein, 9 aa, Homo Sapiens
SENAHIIEA

SEQ ID NO: 105681 - protein, 9 aa, Homo Sapiens
SENAIGVAA

SEQ ID NO: 105682 - protein, 9 aa, Homo Sapiens
SENEYIMKA

SEQ ID NO: 105683 - protein, 9 aa, Homo Sapiens
SENPSVYVP

SEQ ID NO: 105684 - protein, 9 aa, Homo Sapiens
SENQHLVSP

SEQ ID NO: 105685 - protein, 9 aa, Homo Sapiens
SENVYVNTA

SEQ ID NO: 105686 - protein, 9 aa, Homo Sapiens
SEQIMKTGA

SEQ ID NO: 105687 - protein, 9 aa, Homo Sapiens
SEQPTLVTA

SEQ ID NO: 105688 - protein, 9 aa, Homo Sapiens
SERDPIQPP

SEQ ID NO: 105689 - protein, 9 aa, Homo Sapiens
SERIIVRAS

SEQ ID NO: 105690 - protein, 9 aa, Homo Sapiens
SERPLPRAA

SEQ ID NO: 105691 - protein, 9 aa, Homo Sapiens
SERVEVVSP

SEQ ID NO: 105692 - protein, 9 aa, Homo Sapiens
SERVTIEHA

SEQ ID NO: 105693 - protein, 9 aa, Homo Sapiens
SESEKQWKA

SEQ ID NO: 105694 - protein, 9 aa, Homo Sapiens
SESFIQHIV

SEQ ID NO: 105695 - protein, 9 aa, Homo Sapiens
SESGIQMVP

SEQ ID NO: 105696 - protein, 9 aa, Homo Sapiens
SESPVITKA

SEQ ID NO: 105697 - protein, 9 aa, Homo Sapiens
SESRFFVSS

SEQ ID NO: 105698 - protein, 9 aa, Homo Sapiens
SESSTILVV

SEQ ID NO: 105699 - protein, 9 aa, Homo Sapiens
SESVNLRIA

SEQ ID NO: 105700 - protein, 9 aa, Homo Sapiens
SETALIHIA

SEQ ID NO: 105701 - protein, 9 aa, Homo Sapiens
SETANYISA

SEQ ID NO: 105702 - protein, 9 aa, Homo Sapiens
SETDFKVMA

SEQ ID NO: 105703 - protein, 9 aa, Homo Sapiens
SETKVFTAS

SEQ ID NO: 105704 - protein, 9 aa, Homo Sapiens
SETPAICPP

SEQ ID NO: 105705 - protein, 9 aa, Homo Sapiens
SETPQLFTV

SEQ ID NO: 105706 - protein, 9 aa, Homo Sapiens
SETSALPRP

SEQ ID NO: 105707 - protein, 9 aa, Homo Sapiens
SETSGIARP

SEQ ID NO: 105708 - protein, 9 aa, Homo Sapiens
SETSLIGTA

SEQ ID NO: 105709 - protein, 9 aa, Homo Sapiens
SETSNWIAA

SEQ ID NO: 105710 - protein, 9 aa, Homo Sapiens
SETVMVHQA

SEQ ID NO: 105711 - protein, 9 aa, Homo Sapiens
SEVCKFLSA

SEQ ID NO: 105712 - protein, 9 aa, Homo Sapiens
SEVELMKVA

SEQ ID NO: 105713 - protein, 9 aa, Homo Sapiens
SEVENKNVP

SEQ ID NO: 105714 - protein, 9 aa, Homo Sapiens
SEVESLRPP

SEQ ID NO: 105715 - protein, 9 aa, Homo Sapiens
SEVEVIHVP

SEQ ID NO: 105716 - protein, 9 aa, Homo Sapiens
SEVGKLLSA

SEQ ID NO: 105717 - protein, 9 aa, Homo Sapiens
SEVILPVPA

SEQ ID NO: 105718 - protein, 9 aa, Homo Sapiens
SEVKFAVQA

SEQ ID NO: 105719 - protein, 9 aa, Homo Sapiens
SEVLLRHIA

SEQ ID NO: 105720 - protein, 9 aa, Homo Sapiens
SEVNLFLVP

SEQ ID NO: 105721 - protein, 9 aa, Homo Sapiens
SEVQDLHLA

SEQ ID NO: 105722 - protein, 9 aa, Homo Sapiens
SEVRVETSA

SEQ ID NO: 105723 - protein, 9 aa, Homo Sapiens
SEVSIDHKA

SEQ ID NO: 105724 - protein, 9 aa, Homo Sapiens
SEVSKIVTV

SEQ ID NO: 105725 - protein, 9 aa, Homo Sapiens
SEVTVQPSP

SEQ ID NO: 105726 - protein, 9 aa, Homo Sapiens
SEWDGIVTV

SEQ ID NO: 105727 - protein, 9 aa, Homo Sapiens
SEWEKMRQS

SEQ ID NO: 105728 - protein, 9 aa, Homo Sapiens
SEWLGVLKA

SEQ ID NO: 105729 - protein, 9 aa, Homo Sapiens
SEYEGILDA

SEQ ID NO: 105730 - protein, 9 aa, Homo Sapiens
SEYEIQRQA

SEQ ID NO: 105731 - protein, 9 aa, Homo Sapiens
SEYEKLLHS

SEQ ID NO: 105732 - protein, 9 aa, Homo Sapiens
SEYEKPEAP

SEQ ID NO: 105733 - protein, 9 aa, Homo Sapiens
SEYERIEIP

SEQ ID NO: 105734 - protein, 9 aa, Homo Sapiens
SEYLCKQVA

SEQ ID NO: 105735 - protein, 9 aa, Homo Sapiens
SEYLQQHVA

SEQ ID NO: 105736 - protein, 9 aa, Homo Sapiens
SEYNMLWHA

SEQ ID NO: 105737 - protein, 9 aa, Homo Sapiens
SEYQWITSP

SEQ ID NO: 105738 - protein, 9 aa, Homo Sapiens
SEYTGPTSA

SEQ ID NO: 105739 - protein, 9 aa, Homo Sapiens
SSDFQSNIA

SEQ ID NO: 105740 - protein, 9 aa, Homo Sapiens
SSEFQIPTA

SEQ ID NO: 105741 - protein, 9 aa, Homo Sapiens
SSEVVIHSA

SEQ ID NO: 105742 - protein, 9 aa, Homo Sapiens
TEADIFHQA

SEQ ID NO: 105743 - protein, 9 aa, Homo Sapiens
TEADLQFRP

SEQ ID NO: 105744 - protein, 9 aa, Homo Sapiens
TEAKPAVVA

SEQ ID NO: 105745 - protein, 9 aa, Homo Sapiens
TEALHFVAA

SEQ ID NO: 105746 - protein, 9 aa, Homo Sapiens
TEAPLNPKA

SEQ ID NO: 105747 - protein, 9 aa, Homo Sapiens
TEAPPIIFA

SEQ ID NO: 105748 - protein, 9 aa, Homo Sapiens
TEFDRQAEV

SEQ ID NO: 105749 - protein, 9 aa, Homo Sapiens
TEFEDIKSG

SEQ ID NO: 105750 - protein, 9 aa, Homo Sapiens
TEFEKILKT

SEQ ID NO: 105751 - protein, 9 aa, Homo Sapiens
TEFIHLISS

SEQ ID NO: 105752 - protein, 9 aa, Homo Sapiens
TEFQGKITP

SEQ ID NO: 105753 - protein, 9 aa, Homo Sapiens
TEHAHQVVV

SEQ ID NO: 105754 - protein, 9 aa, Homo Sapiens
TEHGVKVTA

SEQ ID NO: 105755 - protein, 9 aa, Homo Sapiens
TEIAINVKA

SEQ ID NO: 105756 - protein, 9 aa, Homo Sapiens
TEIEKSISA

SEQ ID NO: 105757 - protein, 9 aa, Homo Sapiens
TEIGSIHSA

SEQ ID NO: 105758 - protein, 9 aa, Homo Sapiens
TEIGVLAKA

SEQ ID NO: 105759 - protein, 9 aa, Homo Sapiens
TEINRLPSA

SEQ ID NO: 105760 - protein, 9 aa, Homo Sapiens
TEIPEQLVP

SEQ ID NO: 105761 - protein, 9 aa, Homo Sapiens
TEIRALVAA

SEQ ID NO: 105762 - protein, 9 aa, Homo Sapiens
TEKALPLSA

SEQ ID NO: 105763 - protein, 9 aa, Homo Sapiens
TEKAVELAA

SEQ ID NO: 105764 - protein, 9 aa, Homo Sapiens
TEKLQEPPA

SEQ ID NO: 105765 - protein, 9 aa, Homo Sapiens
TEKNKEFLP

SEQ ID NO: 105766 - protein, 9 aa, Homo Sapiens
TEKRDFVSA

SEQ ID NO: 105767 - protein, 9 aa, Homo Sapiens
TELDKIRQA

SEQ ID NO: 105768 - protein, 9 aa, Homo Sapiens
TELDRVHIV

SEQ ID NO: 105769 - protein, 9 aa, Homo Sapiens
TELELFKAA

SEQ ID NO: 105770 - protein, 9 aa, Homo Sapiens
TEMEISRAA

SEQ ID NO: 105771 - protein, 9 aa, Homo Sapiens
TERLIGDAA

SEQ ID NO: 105772 - protein, 9 aa, Homo Sapiens
TESQALVSA

SEQ ID NO: 105773 - protein, 9 aa, Homo Sapiens
TESSHFYSA

SEQ ID NO: 105774 - protein, 9 aa, Homo Sapiens
TETDSLVSA

SEQ ID NO: 105775 - protein, 9 aa, Homo Sapiens
TETYVRWSP

SEQ ID NO: 105776 - protein, 9 aa, Homo Sapiens
TEVANIPVA

SEQ ID NO: 105777 - protein, 9 aa, Homo Sapiens
TEVAPLKEA

SEQ ID NO: 105778 - protein, 9 aa, Homo Sapiens
TEVAPPPPP

SEQ ID NO: 105779 - protein, 9 aa, Homo Sapiens
TEVDKILKV

SEQ ID NO: 105780 - protein, 9 aa, Homo Sapiens
TEVKDLPGA

SEQ ID NO: 105781 - protein, 9 aa, Homo Sapiens
TEVSKTPEA

SEQ ID NO: 105782 - protein, 9 aa, Homo Sapiens
TEWDDIHVV

SEQ ID NO: 105783 - protein, 9 aa, Homo Sapiens
TEWLEPLEA

SEQ ID NO: 105784 - protein, 9 aa, Homo Sapiens
TEYEVKDQA

SEQ ID NO: 105785 - protein, 9 aa, Homo Sapiens
TEYSFLKEV

SEQ ID NO: 105786 - protein, 9 aa, Homo Sapiens
TEYTKLWTP

SEQ ID NO: 105787 - protein, 9 aa, Homo Sapiens
VDITTPKAA

SEQ ID NO: 105788 - protein, 9 aa, Homo Sapiens
VEAFLKEAA

SEQ ID NO: 105789 - protein, 9 aa, Homo Sapiens
VEFAKQLAT

SEQ ID NO: 105790 - protein, 9 aa, Homo Sapiens
VEFATHEEA

SEQ ID NO: 105791 - protein, 9 aa, Homo Sapiens
VEFDSVQSA

SEQ ID NO: 105792 - protein, 9 aa, Homo Sapiens
VEFEDVLGA

SEQ ID NO: 105793 - protein, 9 aa, Homo Sapiens
VEFEELLKA

SEQ ID NO: 105794 - protein, 9 aa, Homo Sapiens
VEFETKEQA

SEQ ID NO: 105795 - protein, 9 aa, Homo Sapiens
VEFGNHMES

SEQ ID NO: 105796 - protein, 9 aa, Homo Sapiens
VEFHRLWSA

SEQ ID NO: 105797 - protein, 9 aa, Homo Sapiens
VEFMHYIIA

SEQ ID NO: 105798 - protein, 9 aa, Homo Sapiens
VEFNGKLLA

SEQ ID NO: 105799 - protein, 9 aa, Homo Sapiens
VEFSGKPAA

SEQ ID NO: 105800 - protein, 9 aa, Homo Sapiens
VEHGGFYRT

SEQ ID NO: 105801 - protein, 9 aa, Homo Sapiens
VEHNIRIMA

SEQ ID NO: 105802 - protein, 9 aa, Homo Sapiens
VEIAIDNTA

SEQ ID NO: 105803 - protein, 9 aa, Homo Sapiens
VEIKKIMKA

SEQ ID NO: 105804 - protein, 9 aa, Homo Sapiens
VEILIPVAA

SEQ ID NO: 105805 - protein, 9 aa, Homo Sapiens
VEKPPHLAA

SEQ ID NO: 105806 - protein, 9 aa, Homo Sapiens
VEKPVGVAA

SEQ ID NO: 105807 - protein, 9 aa, Homo Sapiens
VELNKIPTV

SEQ ID NO: 105808 - protein, 9 aa, Homo Sapiens
VELSQLRVA

SEQ ID NO: 105809 - protein, 9 aa, Homo Sapiens
VENPGGYVA

SEQ ID NO: 105810 - protein, 9 aa, Homo Sapiens
VERPAEPVA

SEQ ID NO: 105811 - protein, 9 aa, Homo Sapiens
VERVEELRR

SEQ ID NO: 105812 - protein, 9 aa, Homo Sapiens
VERVIEFAA

SEQ ID NO: 105813 - protein, 9 aa, Homo Sapiens
VETDHIVAA

SEQ ID NO: 105814 - protein, 9 aa, Homo Sapiens
VETNKVPVA

SEQ ID NO: 105815 - protein, 9 aa, Homo Sapiens
VETSKKWAA

SEQ ID NO: 105816 - protein, 9 aa, Homo Sapiens
VEVPETPKA

SEQ ID NO: 105817 - protein, 9 aa, Homo Sapiens
VEVRFVSSA

SEQ ID NO: 105818 - protein, 9 aa, Homo Sapiens
VEVVVKHEA

SEQ ID NO: 105819 - protein, 9 aa, Homo Sapiens
VEWDYKLVP

SEQ ID NO: 105820 - protein, 9 aa, Homo Sapiens
VEYEVPEAA

SEQ ID NO: 105821 - protein, 9 aa, Homo Sapiens
VEYKGLRAG

SEQ ID NO: 105822 - protein, 9 aa, Homo Sapiens
WEIENNPTV

SEQ ID NO: 105823 - protein, 9 aa, Homo Sapiens
WEKPDDFIP

SEQ ID NO: 105824 - protein, 9 aa, Homo Sapiens
WELGSISKP

SEQ ID NO: 105825 - protein, 9 aa, Homo Sapiens
WEMNNIHSV

SEQ ID NO: 105826 - protein, 9 aa, Homo Sapiens
WENISRPEA

SEQ ID NO: 105827 - protein, 9 aa, Homo Sapiens
WEVYLRETA

SEQ ID NO: 105828 - protein, 9 aa, Homo Sapiens
WEYGDPHSP

SEQ ID NO: 105829 - protein, 9 aa, Homo Sapiens
YDYKAEAAA

SEQ ID NO: 105830 - protein, 9 aa, Homo Sapiens
YEAPGVREA

SEQ ID NO: 105831 - protein, 9 aa, Homo Sapiens
YEFAPKKAA

SEQ ID NO: 105832 - protein, 9 aa, Homo Sapiens
YEFGQIINA

SEQ ID NO: 105833 - protein, 9 aa, Homo Sapiens
YEFKGLHKV

SEQ ID NO: 105834 - protein, 9 aa, Homo Sapiens
YEFLKSWTV

SEQ ID NO: 105835 - protein, 9 aa, Homo Sapiens
YEFLVGKPP

SEQ ID NO: 105836 - protein, 9 aa, Homo Sapiens
YEFSKLIFT

SEQ ID NO: 105837 - protein, 9 aa, Homo Sapiens
YEFSQRLEA

SEQ ID NO: 105838 - protein, 9 aa, Homo Sapiens
YEHDDIVST

SEQ ID NO: 105839 - protein, 9 aa, Homo Sapiens
YEHIQVSRA

SEQ ID NO: 105840 - protein, 9 aa, Homo Sapiens
YEKEGEFVA

SEQ ID NO: 105841 - protein, 9 aa, Homo Sapiens
YEKEKELCV

SEQ ID NO: 105842 - protein, 9 aa, Homo Sapiens
YEKILFTEA

SEQ ID NO: 105843 - protein, 9 aa, Homo Sapiens
YEKLTEIIP

SEQ ID NO: 105844 - protein, 9 aa, Homo Sapiens
YELLFKEGV

SEQ ID NO: 105845 - protein, 9 aa, Homo Sapiens
YELLKHAEA

SEQ ID NO: 105846 - protein, 9 aa, Homo Sapiens
YENVPIPCV

SEQ ID NO: 105847 - protein, 9 aa, Homo Sapiens
YERDHAVVV

SEQ ID NO: 105848 - protein, 9 aa, Homo Sapiens
YEREQVIAA

SEQ ID NO: 105849 - protein, 9 aa, Homo Sapiens
YERIYNEIP

SEQ ID NO: 105850 - protein, 9 aa, Homo Sapiens
YERKLIEVA

SEQ ID NO: 105851 - protein, 9 aa, Homo Sapiens
YESEKVGVA

SEQ ID NO: 105852 - protein, 9 aa, Homo Sapiens
YESLVHAVA

SEQ ID NO: 105853 - protein, 9 aa, Homo Sapiens
YETLTITQA

SEQ ID NO: 105854 - protein, 9 aa, Homo Sapiens
YETVVKVKP

SEQ ID NO: 105855 - protein, 9 aa, Homo Sapiens
YEVAVRKSA

SEQ ID NO: 105856 - protein, 9 aa, Homo Sapiens
YEVIYLTEP

SEQ ID NO: 105857 - protein, 9 aa, Homo Sapiens
YEVKELYVP

SEQ ID NO: 105858 - protein, 9 aa, Homo Sapiens
YEVQQVPKV

SEQ ID NO: 105859 - protein, 9 aa, Homo Sapiens
YEVRLTQTV

SEQ ID NO: 105860 - protein, 9 aa, Homo Sapiens
YEWARDHRA

SEQ ID NO: 105861 - protein, 9 aa, Homo Sapiens
YPGPDEKAP

SEQ ID NO: 105862 - protein, 10 aa, Homo Sapiens
AAGPPISEGK

SEQ ID NO: 105863 - protein, 10 aa, Homo Sapiens
AEAAAAVVAA

SEQ ID NO: 105864 - protein, 10 aa, Homo Sapiens
AEAEKLFKQA

SEQ ID NO: 105865 - protein, 10 aa, Homo Sapiens
AEAEPGADPP

SEQ ID NO: 105866 - protein, 10 aa, Homo Sapiens
AEAFEAIPRA

SEQ ID NO: 105867 - protein, 10 aa, Homo Sapiens
AEAFLRQQQA

SEQ ID NO: 105868 - protein, 10 aa, Homo Sapiens
AEAGALPAAA

SEQ ID NO: 105869 - protein, 10 aa, Homo Sapiens
AEAILGQNAA

SEQ ID NO: 105870 - protein, 10 aa, Homo Sapiens
AEALLHPFFA

SEQ ID NO: 105871 - protein, 10 aa, Homo Sapiens
AEALLKKHEA

SEQ ID NO: 105872 - protein, 10 aa, Homo Sapiens
AEALNVFQQA

SEQ ID NO: 105873 - protein, 10 aa, Homo Sapiens
AEALVREAEA

SEQ ID NO: 105874 - protein, 10 aa, Homo Sapiens
AEAMALGREA

SEQ ID NO: 105875 - protein, 10 aa, Homo Sapiens
AEANLVGREA

SEQ ID NO: 105876 - protein, 10 aa, Homo Sapiens
AEAQCIANQV

SEQ ID NO: 105877 - protein, 10 aa, Homo Sapiens
AEAQLRFIQA

SEQ ID NO: 105878 - protein, 10 aa, Homo Sapiens
AEAQLRIDSA

SEQ ID NO: 105879 - protein, 10 aa, Homo Sapiens
AEAQVLSVVA

SEQ ID NO: 105880 - protein, 10 aa, Homo Sapiens
AEATLKLLQA

SEQ ID NO: 105881 - protein, 10 aa, Homo Sapiens
AEAYLGKTVT

SEQ ID NO: 105882 - protein, 10 aa, Homo Sapiens
AECGAFRTGP

SEQ ID NO: 105883 - protein, 10 aa, Homo Sapiens
AECGKAFVES

SEQ ID NO: 105884 - protein, 10 aa, Homo Sapiens
AEDGSRVYVV

SEQ ID NO: 105885 - protein, 10 aa, Homo Sapiens
AEEGPGVPAA

SEQ ID NO: 105886 - protein, 10 aa, Homo Sapiens
AEERIEGRVA

SEQ ID NO: 105887 - protein, 10 aa, Homo Sapiens
AEFKEAFQLF

SEQ ID NO: 105888 - protein, 10 aa, Homo Sapiens
AEFKEAFSLF

SEQ ID NO: 105889 - protein, 10 aa, Homo Sapiens
AEFLEKRRAA

SEQ ID NO: 105890 - protein, 10 aa, Homo Sapiens
AEFLTSKLIA

SEQ ID NO: 105891 - protein, 10 aa, Homo Sapiens
AEFNSTPAVF

SEQ ID NO: 105892 - protein, 10 aa, Homo Sapiens
AEFPGLPEAL

SEQ ID NO: 105893 - protein, 10 aa, Homo Sapiens
AEFTVETRSA

SEQ ID NO: 105894 - protein, 10 aa, Homo Sapiens
AEGEFFIHDA

SEQ ID NO: 105895 - protein, 10 aa, Homo Sapiens
AEGKGGFIRA

SEQ ID NO: 105896 - protein, 10 aa, Homo Sapiens
AEGTGLQIPP

SEQ ID NO: 105897 - protein, 10 aa, Homo Sapiens
AEHNDLQYAA

SEQ ID NO: 105898 - protein, 10 aa, Homo Sapiens
AEIASSLPAA

SEQ ID NO: 105899 - protein, 10 aa, Homo Sapiens
AEIDALYKDL

SEQ ID NO: 105900 - protein, 10 aa, Homo Sapiens
AEIDLGVPPP

SEQ ID NO: 105901 - protein, 10 aa, Homo Sapiens
AEIDMLDIRA

SEQ ID NO: 105902 - protein, 10 aa, Homo Sapiens
AEIEELTASA

SEQ ID NO: 105903 - protein, 10 aa, Homo Sapiens
AEIEIVKDLA

SEQ ID NO: 105904 - protein, 10 aa, Homo Sapiens
AEIELPDVEP

SEQ ID NO: 105905 - protein, 10 aa, Homo Sapiens
AEIGKLRAQA

SEQ ID NO: 105906 - protein, 10 aa, Homo Sapiens
AEIKAIIKKA

SEQ ID NO: 105907 - protein, 10 aa, Homo Sapiens
AEIKMLYEQL

SEQ ID NO: 105908 - protein, 10 aa, Homo Sapiens
AEIKNLFTKT

SEQ ID NO: 105909 - protein, 10 aa, Homo Sapiens
AEIKQGIREV

SEQ ID NO: 105910 - protein, 10 aa, Homo Sapiens
AEIKSGLCVP

SEQ ID NO: 105911 - protein, 10 aa, Homo Sapiens
AEIKVKLIEA

SEQ ID NO: 105912 - protein, 10 aa, Homo Sapiens
AEILKEIREA

SEQ ID NO: 105913 - protein, 10 aa, Homo Sapiens
AEILLSNHYT

SEQ ID NO: 105914 - protein, 10 aa, Homo Sapiens
AEINNIIKIV

SEQ ID NO: 105915 - protein, 10 aa, Homo Sapiens
AEINQKLPVA

SEQ ID NO: 105916 - protein, 10 aa, Homo Sapiens
AEIQELHQSV

SEQ ID NO: 105917 - protein, 10 aa, Homo Sapiens
AEIQGNINKV

SEQ ID NO: 105918 - protein, 10 aa, Homo Sapiens
AEIQRFAFSA

SEQ ID NO: 105919 - protein, 10 aa, Homo Sapiens
AEIRLDKVVP

SEQ ID NO: 105920 - protein, 10 aa, Homo Sapiens
AEIRSVCTEA

SEQ ID NO: 105921 - protein, 10 aa, Homo Sapiens
AEISSKSPVA

SEQ ID NO: 105922 - protein, 10 aa, Homo Sapiens
AEITELIHIA

SEQ ID NO: 105923 - protein, 10 aa, Homo Sapiens
AEITELILKA

SEQ ID NO: 105924 - protein, 10 aa, Homo Sapiens
AEIVPVTTTV

SEQ ID NO: 105925 - protein, 10 aa, Homo Sapiens
AEKHPEVLPA

SEQ ID NO: 105926 - protein, 10 aa, Homo Sapiens
AEKIDGVFAA

SEQ ID NO: 105927 - protein, 10 aa, Homo Sapiens
AEKKFIDIAA

SEQ ID NO: 105928 - protein, 10 aa, Homo Sapiens
AEKPAVPETA

SEQ ID NO: 105929 - protein, 10 aa, Homo Sapiens
AELADVLTEA

SEQ ID NO: 105930 - protein, 10 aa, Homo Sapiens
AELDSVFSSA

SEQ ID NO: 105931 - protein, 10 aa, Homo Sapiens
AELEEKLPVA

SEQ ID NO: 105932 - protein, 10 aa, Homo Sapiens
AELEGREQVA

SEQ ID NO: 105933 - protein, 10 aa, Homo Sapiens
AELEKHMAAA

SEQ ID NO: 105934 - protein, 10 aa, Homo Sapiens
AELENLVNQA

SEQ ID NO: 105935 - protein, 10 aa, Homo Sapiens
AELEVVPIIA

SEQ ID NO: 105936 - protein, 10 aa, Homo Sapiens
AELLINHAQA

SEQ ID NO: 105937 - protein, 10 aa, Homo Sapiens
AELNAQIITA

SEQ ID NO: 105938 - protein, 10 aa, Homo Sapiens
AELPAIMTHA

SEQ ID NO: 105939 - protein, 10 aa, Homo Sapiens
AELQRRFQAA

SEQ ID NO: 105940 - protein, 10 aa, Homo Sapiens
AELYGPFTSA

SEQ ID NO: 105941 - protein, 10 aa, Homo Sapiens
AEMGKNLKEA

SEQ ID NO: 105942 - protein, 10 aa, Homo Sapiens
AEMLYGLIHA

SEQ ID NO: 105943 - protein, 10 aa, Homo Sapiens
AEMNGKLIAA

SEQ ID NO: 105944 - protein, 10 aa, Homo Sapiens
AEMTTRMVAS

SEQ ID NO: 105945 - protein, 10 aa, Homo Sapiens
AEMYVAKFAA

SEQ ID NO: 105946 - protein, 10 aa, Homo Sapiens
AENAGLSSTA

SEQ ID NO: 105947 - protein, 10 aa, Homo Sapiens
AENELGVVVA

SEQ ID NO: 105948 - protein, 10 aa, Homo Sapiens
AENNVFHLVA

SEQ ID NO: 105949 - protein, 10 aa, Homo Sapiens
AEPSFPFQVA

SEQ ID NO: 105950 - protein, 10 aa, Homo Sapiens
AEPYMIFKEA

SEQ ID NO: 105951 - protein, 10 aa, Homo Sapiens
AEQAGCMVSA

SEQ ID NO: 105952 - protein, 10 aa, Homo Sapiens
AEQPSELVSA

SEQ ID NO: 105953 - protein, 10 aa, Homo Sapiens
AEQQKAQFTA

SEQ ID NO: 105954 - protein, 10 aa, Homo Sapiens
AEQRLKAIVA

SEQ ID NO: 105955 - protein, 10 aa, Homo Sapiens
AERIGVDHVA

SEQ ID NO: 105956 - protein, 10 aa, Homo Sapiens
AERLFPANVA

SEQ ID NO: 105957 - protein, 10 aa, Homo Sapiens
AERPGEAAVA

SEQ ID NO: 105958 - protein, 10 aa, Homo Sapiens
AESGCKIQIA

SEQ ID NO: 105959 - protein, 10 aa, Homo Sapiens
AESYHQHFAA

SEQ ID NO: 105960 - protein, 10 aa, Homo Sapiens
AETDVLFNKV

SEQ ID NO: 105961 - protein, 10 aa, Homo Sapiens
AETHYQLGLA

SEQ ID NO: 105962 - protein, 10 aa, Homo Sapiens
AETKDLLVAA

SEQ ID NO: 105963 - protein, 10 aa, Homo Sapiens
AETLFDILVA

SEQ ID NO: 105964 - protein, 10 aa, Homo Sapiens
AETSAVCTAA

SEQ ID NO: 105965 - protein, 10 aa, Homo Sapiens
AETTHALPIP

SEQ ID NO: 105966 - protein, 10 aa, Homo Sapiens
AEVAKITAEA

SEQ ID NO: 105967 - protein, 10 aa, Homo Sapiens
AEVAPVISSA

SEQ ID NO: 105968 - protein, 10 aa, Homo Sapiens
AEVAPVKDMA

SEQ ID NO: 105969 - protein, 10 aa, Homo Sapiens
AEVELKRDEA

SEQ ID NO: 105970 - protein, 10 aa, Homo Sapiens
AEVIILPKKH

SEQ ID NO: 105971 - protein, 10 aa, Homo Sapiens
AEVILKKQQA

SEQ ID NO: 105972 - protein, 10 aa, Homo Sapiens
AEVKGVCTEA

SEQ ID NO: 105973 - protein, 10 aa, Homo Sapiens
AEVLEVFHPT

SEQ ID NO: 105974 - protein, 10 aa, Homo Sapiens
AEVLITTRTA

SEQ ID NO: 105975 - protein, 10 aa, Homo Sapiens
AEVNGGLPSA

SEQ ID NO: 105976 - protein, 10 aa, Homo Sapiens
AEVPDVTATP

SEQ ID NO: 105977 - protein, 10 aa, Homo Sapiens
AEVRVQQQTA

SEQ ID NO: 105978 - protein, 10 aa, Homo Sapiens
AEWEGKGTAS

SEQ ID NO: 105979 - protein, 10 aa, Homo Sapiens
AEWEPPEARA

SEQ ID NO: 105980 - protein, 10 aa, Homo Sapiens
AEWKDGLNEA

SEQ ID NO: 105981 - protein, 10 aa, Homo Sapiens
AEYALKRQEA

SEQ ID NO: 105982 - protein, 10 aa, Homo Sapiens
AEYDNFFQHL

SEQ ID NO: 105983 - protein, 10 aa, Homo Sapiens
AEYDRPNLLP

SEQ ID NO: 105984 - protein, 10 aa, Homo Sapiens
AEYHKLARKL

SEQ ID NO: 105985 - protein, 10 aa, Homo Sapiens
AEYIPLTPAA

SEQ ID NO: 105986 - protein, 10 aa, Homo Sapiens
AEYLLGPLYA

SEQ ID NO: 105987 - protein, 10 aa, Homo Sapiens
AEYNPKRFAA

SEQ ID NO: 105988 - protein, 10 aa, Homo Sapiens
EAKDLQEFIP

SEQ ID NO: 105989 - protein, 10 aa, Homo Sapiens
EEIKDFLLTA

SEQ ID NO: 105990 - protein, 10 aa, Homo Sapiens
EEINLQRNIA

SEQ ID NO: 105991 - protein, 10 aa, Homo Sapiens
EEIQKKLEAA

SEQ ID NO: 105992 - protein, 10 aa, Homo Sapiens
EKLDVREKSK

SEQ ID NO: 105993 - protein, 10 aa, Homo Sapiens
FEANFGKIQA

SEQ ID NO: 105994 - protein, 10 aa, Homo Sapiens
FEAPATINSA

SEQ ID NO: 105995 - protein, 10 aa, Homo Sapiens
FEFTGSHLTV

SEQ ID NO: 105996 - protein, 10 aa, Homo Sapiens
FESEDVAKIV

SEQ ID NO: 105997 - protein, 10 aa, Homo Sapiens
FESSGIHVAA

SEQ ID NO: 105998 - protein, 10 aa, Homo Sapiens
FEVAMQKMIP

SEQ ID NO: 105999 - protein, 10 aa, Homo Sapiens
FEVCDLPVRA

SEQ ID NO: 106000 - protein, 10 aa, Homo Sapiens
FEVKKWNAVA

SEQ ID NO: 106001 - protein, 10 aa, Homo Sapiens
FEVTGQETVA

SEQ ID NO: 106002 - protein, 10 aa, Homo Sapiens
GAEMIRAAPP

SEQ ID NO: 106003 - protein, 10 aa, Homo Sapiens
GEADVPFYYA

SEQ ID NO: 106004 - protein, 10 aa, Homo Sapiens
GEAEAFAIGA

SEQ ID NO: 106005 - protein, 10 aa, Homo Sapiens
GEAFRSLVPA

SEQ ID NO: 106006 - protein, 10 aa, Homo Sapiens
GEALFALPCA

SEQ ID NO: 106007 - protein, 10 aa, Homo Sapiens
GEASAVLAKA

SEQ ID NO: 106008 - protein, 10 aa, Homo Sapiens
GECGFTSQTA

SEQ ID NO: 106009 - protein, 10 aa, Homo Sapiens
GECRPLSKTV

SEQ ID NO: 106010 - protein, 10 aa, Homo Sapiens
GEFEKKYVAT

SEQ ID NO: 106011 - protein, 10 aa, Homo Sapiens
GEFFLKNLVA

SEQ ID NO: 106012 - protein, 10 aa, Homo Sapiens
GEFGGFGSVT

SEQ ID NO: 106013 - protein, 10 aa, Homo Sapiens
GEFGHIQKDC

SEQ ID NO: 106014 - protein, 10 aa, Homo Sapiens
GEFGTIPLVL

SEQ ID NO: 106015 - protein, 10 aa, Homo Sapiens
GEFREAFKEA

SEQ ID NO: 106016 - protein, 10 aa, Homo Sapiens
GEFRQGLISA

SEQ ID NO: 106017 - protein, 10 aa, Homo Sapiens
GEFSFEEIRA

SEQ ID NO: 106018 - protein, 10 aa, Homo Sapiens
GEHERPEFIA

SEQ ID NO: 106019 - protein, 10 aa, Homo Sapiens
GEIALLMNRP

SEQ ID NO: 106020 - protein, 10 aa, Homo Sapiens
GEIDASLKAP

SEQ ID NO: 106021 - protein, 10 aa, Homo Sapiens
GEIESKFNQA

SEQ ID NO: 106022 - protein, 10 aa, Homo Sapiens
GEIPAELRAA

SEQ ID NO: 106023 - protein, 10 aa, Homo Sapiens
GEIQQIPVQL

SEQ ID NO: 106024 - protein, 10 aa, Homo Sapiens
GEIRDLKTKT

SEQ ID NO: 106025 - protein, 10 aa, Homo Sapiens
GEITQLLVPP

SEQ ID NO: 106026 - protein, 10 aa, Homo Sapiens
GEKNNAFIVA

SEQ ID NO: 106027 - protein, 10 aa, Homo Sapiens
GELAGERVAA

SEQ ID NO: 106028 - protein, 10 aa, Homo Sapiens
GELKTQMTSA

SEQ ID NO: 106029 - protein, 10 aa, Homo Sapiens
GELLFVVPRA

SEQ ID NO: 106030 - protein, 10 aa, Homo Sapiens
GELNVDSLIT

SEQ ID NO: 106031 - protein, 10 aa, Homo Sapiens
GELRSYLVSV

SEQ ID NO: 106032 - protein, 10 aa, Homo Sapiens
GELSDTIPVV

SEQ ID NO: 106033 - protein, 10 aa, Homo Sapiens
GEMDPNFISV

SEQ ID NO: 106034 - protein, 10 aa, Homo Sapiens
GEMKPVAAGA

SEQ ID NO: 106035 - protein, 10 aa, Homo Sapiens
GEMKSGVPVL

SEQ ID NO: 106036 - protein, 10 aa, Homo Sapiens
GEMLGRHIVA

SEQ ID NO: 106037 - protein, 10 aa, Homo Sapiens
GEMMVEQRAA

SEQ ID NO: 106038 - protein, 10 aa, Homo Sapiens
GENPHGVKAV

SEQ ID NO: 106039 - protein, 10 aa, Homo Sapiens
GEPRVKHFEA

SEQ ID NO: 106040 - protein, 10 aa, Homo Sapiens
GEPTNFVHTA

SEQ ID NO: 106041 - protein, 10 aa, Homo Sapiens
GEQEGAMVAA

SEQ ID NO: 106042 - protein, 10 aa, Homo Sapiens
GEQRFASIVA

SEQ ID NO: 106043 - protein, 10 aa, Homo Sapiens
GESIDIITRA

SEQ ID NO: 106044 - protein, 10 aa, Homo Sapiens
GETPQVAVIV

SEQ ID NO: 106045 - protein, 10 aa, Homo Sapiens
GETSYIRVYP

SEQ ID NO: 106046 - protein, 10 aa, Homo Sapiens
GEVDLRECVV

SEQ ID NO: 106047 - protein, 10 aa, Homo Sapiens
GEVGDGFKVA

SEQ ID NO: 106048 - protein, 10 aa, Homo Sapiens
GEVIVTKDDA

SEQ ID NO: 106049 - protein, 10 aa, Homo Sapiens
GEVNVLDNLA

SEQ ID NO: 106050 - protein, 10 aa, Homo Sapiens
GEVPCTVTSA

SEQ ID NO: 106051 - protein, 10 aa, Homo Sapiens
GEYDVTMPKV

SEQ ID NO: 106052 - protein, 10 aa, Homo Sapiens
GEYIPGACSA

SEQ ID NO: 106053 - protein, 10 aa, Homo Sapiens
GEYRGSDFTA

SEQ ID NO: 106054 - protein, 10 aa, Homo Sapiens
GEYTDHLHSA

SEQ ID NO: 106055 - protein, 10 aa, Homo Sapiens
GEYTEHLHSA

SEQ ID NO: 106056 - protein, 10 aa, Homo Sapiens
HEAAFPIAVV

SEQ ID NO: 106057 - protein, 10 aa, Homo Sapiens
HEAKGLPRAA

SEQ ID NO: 106058 - protein, 10 aa, Homo Sapiens
HEFLHEVPAA

SEQ ID NO: 106059 - protein, 10 aa, Homo Sapiens
HEIDRYTAIA

SEQ ID NO: 106060 - protein, 10 aa, Homo Sapiens
HEIESLYTKL

SEQ ID NO: 106061 - protein, 10 aa, Homo Sapiens
HEIGPSLYAA

SEQ ID NO: 106062 - protein, 10 aa, Homo Sapiens
HEISNLKNLV

SEQ ID NO: 106063 - protein, 10 aa, Homo Sapiens
HEKQVYDIAA

SEQ ID NO: 106064 - protein, 10 aa, Homo Sapiens
HEMFPAVHAA

SEQ ID NO: 106065 - protein, 10 aa, Homo Sapiens
HEMQIQHPTA

SEQ ID NO: 106066 - protein, 10 aa, Homo Sapiens
HEMQPLAHGA

SEQ ID NO: 106067 - protein, 10 aa, Homo Sapiens
HENILGFIAA

SEQ ID NO: 106068 - protein, 10 aa, Homo Sapiens
HEQEYKNNIA

SEQ ID NO: 106069 - protein, 10 aa, Homo Sapiens
HEVACLDITP

SEQ ID NO: 106070 - protein, 10 aa, Homo Sapiens
HEVEDLIKTA

SEQ ID NO: 106071 - protein, 10 aa, Homo Sapiens
HEVTICNYEA

SEQ ID NO: 106072 - protein, 10 aa, Homo Sapiens
HEVVGVFTVP

SEQ ID NO: 106073 - protein, 10 aa, Homo Sapiens
HEYVHGDIKA

SEQ ID NO: 106074 - protein, 10 aa, Homo Sapiens
HNPADILLHP

SEQ ID NO: 106075 - protein, 10 aa, Homo Sapiens
IEAHLKENAA

SEQ ID NO: 106076 - protein, 10 aa, Homo Sapiens
IEGKDVFREA

SEQ ID NO: 106077 - protein, 10 aa, Homo Sapiens
IEGQGVFREA

SEQ ID NO: 106078 - protein, 10 aa, Homo Sapiens
IEHIIENIVA

SEQ ID NO: 106079 - protein, 10 aa, Homo Sapiens
IEVSLPEAAA

SEQ ID NO: 106080 - protein, 10 aa, Homo Sapiens
KEADFLAQEA

SEQ ID NO: 106081 - protein, 10 aa, Homo Sapiens
KEADLPMTAA

SEQ ID NO: 106082 - protein, 10 aa, Homo Sapiens
KEAEPIPETV

SEQ ID NO: 106083 - protein, 10 aa, Homo Sapiens
KEAEQILATA

SEQ ID NO: 106084 - protein, 10 aa, Homo Sapiens
KEAGFCIQEA

SEQ ID NO: 106085 - protein, 10 aa, Homo Sapiens
KEAIETIVAA

SEQ ID NO: 106086 - protein, 10 aa, Homo Sapiens
KEALGIPAAA

SEQ ID NO: 106087 - protein, 10 aa, Homo Sapiens
KEAQLYAAQA

SEQ ID NO: 106088 - protein, 10 aa, Homo Sapiens
KEAVLNGLVA

SEQ ID NO: 106089 - protein, 10 aa, Homo Sapiens
KEAYVNANQA

SEQ ID NO: 106090 - protein, 10 aa, Homo Sapiens
KECEGIVPVP

SEQ ID NO: 106091 - protein, 10 aa, Homo Sapiens
KEFDGKSLVS

SEQ ID NO: 106092 - protein, 10 aa, Homo Sapiens
KEFEGKTLVS

SEQ ID NO: 106093 - protein, 10 aa, Homo Sapiens
KEFEQLAPVL

SEQ ID NO: 106094 - protein, 10 aa, Homo Sapiens
KEFGDQAEAA

SEQ ID NO: 106095 - protein, 10 aa, Homo Sapiens
KEFKGFGTEV

SEQ ID NO: 106096 - protein, 10 aa, Homo Sapiens
KEFSQSFDAA

SEQ ID NO: 106097 - protein, 10 aa, Homo Sapiens
KEGDFNNLTA

SEQ ID NO: 106098 - protein, 10 aa, Homo Sapiens
KEGDLIAAQA

SEQ ID NO: 106099 - protein, 10 aa, Homo Sapiens
KEGQFKDIIT

SEQ ID NO: 106100 - protein, 10 aa, Homo Sapiens
KEHEEFQITA

SEQ ID NO: 106101 - protein, 10 aa, Homo Sapiens
KEHEVTIFVR

SEQ ID NO: 106102 - protein, 10 aa, Homo Sapiens
KEIAAVIETV

SEQ ID NO: 106103 - protein, 10 aa, Homo Sapiens
KEICADPRVP

SEQ ID NO: 106104 - protein, 10 aa, Homo Sapiens
KEIDAYIVQA

SEQ ID NO: 106105 - protein, 10 aa, Homo Sapiens
KEIEELQSQA

SEQ ID NO: 106106 - protein, 10 aa, Homo Sapiens
KEIEEYIHKP

SEQ ID NO: 106107 - protein, 10 aa, Homo Sapiens
KEIEGIFHAT

SEQ ID NO: 106108 - protein, 10 aa, Homo Sapiens
KEIEQGDVTA

SEQ ID NO: 106109 - protein, 10 aa, Homo Sapiens
KEIFLRELIS

SEQ ID NO: 106110 - protein, 10 aa, Homo Sapiens
KEIGDVENWA

SEQ ID NO: 106111 - protein, 10 aa, Homo Sapiens
KEIHIQPHLA

SEQ ID NO: 106112 - protein, 10 aa, Homo Sapiens
KEIQGFLDCA

SEQ ID NO: 106113 - protein, 10 aa, Homo Sapiens
KEIQSAFVSV

SEQ ID NO: 106114 - protein, 10 aa, Homo Sapiens
KEISKLYQDM

SEQ ID NO: 106115 - protein, 10 aa, Homo Sapiens
KEIYPGQFQP

SEQ ID NO: 106116 - protein, 10 aa, Homo Sapiens
KEKDPKVPSA

SEQ ID NO: 106117 - protein, 10 aa, Homo Sapiens
KEKYIDQEEL

SEQ ID NO: 106118 - protein, 10 aa, Homo Sapiens
KELASALKSA

SEQ ID NO: 106119 - protein, 10 aa, Homo Sapiens
KELDSKTIRA

SEQ ID NO: 106120 - protein, 10 aa, Homo Sapiens
KELEALMPSA

SEQ ID NO: 106121 - protein, 10 aa, Homo Sapiens
KELEGPQIAV

SEQ ID NO: 106122 - protein, 10 aa, Homo Sapiens
KELEGVITKA

SEQ ID NO: 106123 - protein, 10 aa, Homo Sapiens
KELEKILTTA

SEQ ID NO: 106124 - protein, 10 aa, Homo Sapiens
KELTGLLTTA

SEQ ID NO: 106125 - protein, 10 aa, Homo Sapiens
KELYADFIAA

SEQ ID NO: 106126 - protein, 10 aa, Homo Sapiens
KELYKGINQA

SEQ ID NO: 106127 - protein, 10 aa, Homo Sapiens
KELYPGQFKP

SEQ ID NO: 106128 - protein, 10 aa, Homo Sapiens
KEMEAFLVSV

SEQ ID NO: 106129 - protein, 10 aa, Homo Sapiens
KEMEHNTVCA

SEQ ID NO: 106130 - protein, 10 aa, Homo Sapiens
KEMEKSFEVV

SEQ ID NO: 106131 - protein, 10 aa, Homo Sapiens
KEMELPAKEA

SEQ ID NO: 106132 - protein, 10 aa, Homo Sapiens
KEMGLPVGTA

SEQ ID NO: 106133 - protein, 10 aa, Homo Sapiens
KENDRIFVSV

SEQ ID NO: 106134 - protein, 10 aa, Homo Sapiens
KEPELFQTVA

SEQ ID NO: 106135 - protein, 10 aa, Homo Sapiens
KEPEYVPWTA

SEQ ID NO: 106136 - protein, 10 aa, Homo Sapiens
KEQDHIIIIP

SEQ ID NO: 106137 - protein, 10 aa, Homo Sapiens
KESEVKALCA

SEQ ID NO: 106138 - protein, 10 aa, Homo Sapiens
KETDSLKVAA

SEQ ID NO: 106139 - protein, 10 aa, Homo Sapiens
KETELNKVIA

SEQ ID NO: 106140 - protein, 10 aa, Homo Sapiens
KETPFELIEA

SEQ ID NO: 106141 - protein, 10 aa, Homo Sapiens
KEVATAIRGA

SEQ ID NO: 106142 - protein, 10 aa, Homo Sapiens
KEVDWSQNTA

SEQ ID NO: 106143 - protein, 10 aa, Homo Sapiens
KEVEQFTQVA

SEQ ID NO: 106144 - protein, 10 aa, Homo Sapiens
KEVIVKAISA

SEQ ID NO: 106145 - protein, 10 aa, Homo Sapiens
KEWAHATIIP

SEQ ID NO: 106146 - protein, 10 aa, Homo Sapiens
KEWEKFQEEA

SEQ ID NO: 106147 - protein, 10 aa, Homo Sapiens
KEWSQHINGA

SEQ ID NO: 106148 - protein, 10 aa, Homo Sapiens
KEYAAFVLGA

SEQ ID NO: 106149 - protein, 10 aa, Homo Sapiens
KEYAVNEVVA

SEQ ID NO: 106150 - protein, 10 aa, Homo Sapiens
KEYDGFTITI

SEQ ID NO: 106151 - protein, 10 aa, Homo Sapiens
LEAANLSHAA

SEQ ID NO: 106152 - protein, 10 aa, Homo Sapiens
LEAIITPPPA

SEQ ID NO: 106153 - protein, 10 aa, Homo Sapiens
LEGENIVSAA

SEQ ID NO: 106154 - protein, 10 aa, Homo Sapiens
LEHYFHAVVA

SEQ ID NO: 106155 - protein, 10 aa, Homo Sapiens
LEIEFKETQA

SEQ ID NO: 106156 - protein, 10 aa, Homo Sapiens
LEKITEGQAA

SEQ ID NO: 106157 - protein, 10 aa, Homo Sapiens
LEKSEGGLSA

SEQ ID NO: 106158 - protein, 10 aa, Homo Sapiens
LELEDAIHTA

SEQ ID NO: 106159 - protein, 10 aa, Homo Sapiens
LELQLHQIAA

SEQ ID NO: 106160 - protein, 10 aa, Homo Sapiens
LEMDLKDLEA

SEQ ID NO: 106161 - protein, 10 aa, Homo Sapiens
LENSRKLLSA

SEQ ID NO: 106162 - protein, 10 aa, Homo Sapiens
LETTALFVAA

SEQ ID NO: 106163 - protein, 10 aa, Homo Sapiens
MEFAPCQVEA

SEQ ID NO: 106164 - protein, 10 aa, Homo Sapiens
MEVKPSSVTA

SEQ ID NO: 106165 - protein, 10 aa, Homo Sapiens
MEYKGYLVSV

SEQ ID NO: 106166 - protein, 10 aa, Homo Sapiens
NEAWNGFVAA

SEQ ID NO: 106167 - protein, 10 aa, Homo Sapiens
NEINGNWISA

SEQ ID NO: 106168 - protein, 10 aa, Homo Sapiens
NEVFLAKLIA

SEQ ID NO: 106169 - protein, 10 aa, Homo Sapiens
NEYRFAWVEA

SEQ ID NO: 106170 - protein, 10 aa, Homo Sapiens
PARLATAPAP

SEQ ID NO: 106171 - protein, 10 aa, Homo Sapiens
PQEAGLPAGA

SEQ ID NO: 106172 - protein, 10 aa, Homo Sapiens
QECRNIVWIA

SEQ ID NO: 106173 - protein, 10 aa, Homo Sapiens
QEFAEGFVKA

SEQ ID NO: 106174 - protein, 10 aa, Homo Sapiens
QEFDYQPIAA

SEQ ID NO: 106175 - protein, 10 aa, Homo Sapiens
QELDVKRREA

SEQ ID NO: 106176 - protein, 10 aa, Homo Sapiens
QEVDASIFKA

SEQ ID NO: 106177 - protein, 10 aa, Homo Sapiens
QEWPGAGSSA

SEQ ID NO: 106178 - protein, 10 aa, Homo Sapiens
QEYDFKMAQA

SEQ ID NO: 106179 - protein, 10 aa, Homo Sapiens
QEYPMSIQQA

SEQ ID NO: 106180 - protein, 10 aa, Homo Sapiens
REAAEGLRMA

SEQ ID NO: 106181 - protein, 10 aa, Homo Sapiens
REAAKVALSA

SEQ ID NO: 106182 - protein, 10 aa, Homo Sapiens
READLDHYSA

SEQ ID NO: 106183 - protein, 10 aa, Homo Sapiens
REAEFTKSIA

SEQ ID NO: 106184 - protein, 10 aa, Homo Sapiens
REAEHLYHTL

SEQ ID NO: 106185 - protein, 10 aa, Homo Sapiens
REAERLVRQA

SEQ ID NO: 106186 - protein, 10 aa, Homo Sapiens
REAFEAIKAA

SEQ ID NO: 106187 - protein, 10 aa, Homo Sapiens
REALFNEFVA

SEQ ID NO: 106188 - protein, 10 aa, Homo Sapiens
REALRALRAA

SEQ ID NO: 106189 - protein, 10 aa, Homo Sapiens
REALVKKFGA

SEQ ID NO: 106190 - protein, 10 aa, Homo Sapiens
REAPPLPTVA

SEQ ID NO: 106191 - protein, 10 aa, Homo Sapiens
REAQPPCPEA

SEQ ID NO: 106192 - protein, 10 aa, Homo Sapiens
REAQRGFNKV

SEQ ID NO: 106193 - protein, 10 aa, Homo Sapiens
REARDVFAQV

SEQ ID NO: 106194 - protein, 10 aa, Homo Sapiens
REASDLQIAA

SEQ ID NO: 106195 - protein, 10 aa, Homo Sapiens
RECEIKLEAA

SEQ ID NO: 106196 - protein, 10 aa, Homo Sapiens
RECLNQAITA

SEQ ID NO: 106197 - protein, 10 aa, Homo Sapiens
RECVAGPNIA

SEQ ID NO: 106198 - protein, 10 aa, Homo Sapiens
REFDAFVETL

SEQ ID NO: 106199 - protein, 10 aa, Homo Sapiens
REFDELNPSA

SEQ ID NO: 106200 - protein, 10 aa, Homo Sapiens
REFDKRFTSV

SEQ ID NO: 106201 - protein, 10 aa, Homo Sapiens
REFDVGRHIA

SEQ ID NO: 106202 - protein, 10 aa, Homo Sapiens
REFESAIVEA

SEQ ID NO: 106203 - protein, 10 aa, Homo Sapiens
REFEVEKQTA

SEQ ID NO: 106204 - protein, 10 aa, Homo Sapiens
REFGNLHNTV

SEQ ID NO: 106205 - protein, 10 aa, Homo Sapiens
REFKPGPRIP

SEQ ID NO: 106206 - protein, 10 aa, Homo Sapiens
REFLFNAIET

SEQ ID NO: 106207 - protein, 10 aa, Homo Sapiens
REFNFEKWNA

SEQ ID NO: 106208 - protein, 10 aa, Homo Sapiens
REFSDFIQAV

SEQ ID NO: 106209 - protein, 10 aa, Homo Sapiens
REFTYHFRVA

SEQ ID NO: 106210 - protein, 10 aa, Homo Sapiens
REGDKIIYQA

SEQ ID NO: 106211 - protein, 10 aa, Homo Sapiens
REGDLLFTVA

SEQ ID NO: 106212 - protein, 10 aa, Homo Sapiens
REGDREAIVA

SEQ ID NO: 106213 - protein, 10 aa, Homo Sapiens
REGSFKVLVA

SEQ ID NO: 106214 - protein, 10 aa, Homo Sapiens
REGSFRVTTA

SEQ ID NO: 106215 - protein, 10 aa, Homo Sapiens
REHAIDAFRP

SEQ ID NO: 106216 - protein, 10 aa, Homo Sapiens
REHDIAIKFF

SEQ ID NO: 106217 - protein, 10 aa, Homo Sapiens
REHEIGEWEA

SEQ ID NO: 106218 - protein, 10 aa, Homo Sapiens
REHGIRLLEA

SEQ ID NO: 106219 - protein, 10 aa, Homo Sapiens
REHMGNVVEA

SEQ ID NO: 106220 - protein, 10 aa, Homo Sapiens
REHQFYETLP

SEQ ID NO: 106221 - protein, 10 aa, Homo Sapiens
REIAVQIHSV

SEQ ID NO: 106222 - protein, 10 aa, Homo Sapiens
REIDDYIVQA

SEQ ID NO: 106223 - protein, 10 aa, Homo Sapiens
REIEATGLQT

SEQ ID NO: 106224 - protein, 10 aa, Homo Sapiens
REIEEGQPEA

SEQ ID NO: 106225 - protein, 10 aa, Homo Sapiens
REIEELLAEA

SEQ ID NO: 106226 - protein, 10 aa, Homo Sapiens
REIELKVMKF

SEQ ID NO: 106227 - protein, 10 aa, Homo Sapiens
REIFDKARQA

SEQ ID NO: 106228 - protein, 10 aa, Homo Sapiens
REIKDFFEVA

SEQ ID NO: 106229 - protein, 10 aa, Homo Sapiens
REIKDIFYKA

SEQ ID NO: 106230 - protein, 10 aa, Homo Sapiens
REIKSVMNTA

SEQ ID NO: 106231 - protein, 10 aa, Homo Sapiens
REILAGKPAA

SEQ ID NO: 106232 - protein, 10 aa, Homo Sapiens
REILHHVNQA

SEQ ID NO: 106233 - protein, 10 aa, Homo Sapiens
REILLETPAP

SEQ ID NO: 106234 - protein, 10 aa, Homo Sapiens
REILVKELTT

SEQ ID NO: 106235 - protein, 10 aa, Homo Sapiens
REIMPVSTQA

SEQ ID NO: 106236 - protein, 10 aa, Homo Sapiens
REIQDAVARA

SEQ ID NO: 106237 - protein, 10 aa, Homo Sapiens
REIQGLFDEL

SEQ ID NO: 106238 - protein, 10 aa, Homo Sapiens
REIQVQHPAA

SEQ ID NO: 106239 - protein, 10 aa, Homo Sapiens
REKGPVKEVP

SEQ ID NO: 106240 - protein, 10 aa, Homo Sapiens
REKLIQDHMA

SEQ ID NO: 106241 - protein, 10 aa, Homo Sapiens
RELACAGNVA

SEQ ID NO: 106242 - protein, 10 aa, Homo Sapiens
RELDPSLVSA

SEQ ID NO: 106243 - protein, 10 aa, Homo Sapiens
RELEDATETA

SEQ ID NO: 106244 - protein, 10 aa, Homo Sapiens
RELEDLIIEA

SEQ ID NO: 106245 - protein, 10 aa, Homo Sapiens
RELEKAKVAA

SEQ ID NO: 106246 - protein, 10 aa, Homo Sapiens
RELELLPPPP

SEQ ID NO: 106247 - protein, 10 aa, Homo Sapiens
RELENGNLEV

SEQ ID NO: 106248 - protein, 10 aa, Homo Sapiens
RELENIIQET

SEQ ID NO: 106249 - protein, 10 aa, Homo Sapiens
RELENSLHEA

SEQ ID NO: 106250 - protein, 10 aa, Homo Sapiens
RELEVQHPAA

SEQ ID NO: 106251 - protein, 10 aa, Homo Sapiens
RELGVKIAKA

SEQ ID NO: 106252 - protein, 10 aa, Homo Sapiens
RELHLMRNEA

SEQ ID NO: 106253 - protein, 10 aa, Homo Sapiens
RELLIIGGVA

SEQ ID NO: 106254 - protein, 10 aa, Homo Sapiens
RELMGGIGKT

SEQ ID NO: 106255 - protein, 10 aa, Homo Sapiens
RELQGLQNFP

SEQ ID NO: 106256 - protein, 10 aa, Homo Sapiens
RELQICPATA

SEQ ID NO: 106257 - protein, 10 aa, Homo Sapiens
RELQPGVKAV

SEQ ID NO: 106258 - protein, 10 aa, Homo Sapiens
RELQSQIQEA

SEQ ID NO: 106259 - protein, 10 aa, Homo Sapiens
RELQTKINEA

SEQ ID NO: 106260 - protein, 10 aa, Homo Sapiens
RELSEQIQRA

SEQ ID NO: 106261 - protein, 10 aa, Homo Sapiens
REMENIIATV

SEQ ID NO: 106262 - protein, 10 aa, Homo Sapiens
REMILADFQA

SEQ ID NO: 106263 - protein, 10 aa, Homo Sapiens
RENGFHGLVA

SEQ ID NO: 106264 - protein, 10 aa, Homo Sapiens
REQEITAVQA

SEQ ID NO: 106265 - protein, 10 aa, Homo Sapiens
REQGEVRFSA

SEQ ID NO: 106266 - protein, 10 aa, Homo Sapiens
RERFIEQEKA

SEQ ID NO: 106267 - protein, 10 aa, Homo Sapiens
RERFLEDLVA

SEQ ID NO: 106268 - protein, 10 aa, Homo Sapiens
RERGPPQPLP

SEQ ID NO: 106269 - protein, 10 aa, Homo Sapiens
RERPPEEVAA

SEQ ID NO: 106270 - protein, 10 aa, Homo Sapiens
RERVFSEDRA

SEQ ID NO: 106271 - protein, 10 aa, Homo Sapiens
RESACVKVVA

SEQ ID NO: 106272 - protein, 10 aa, Homo Sapiens
RESCIPAQVV

SEQ ID NO: 106273 - protein, 10 aa, Homo Sapiens
RESELQVHSA

SEQ ID NO: 106274 - protein, 10 aa, Homo Sapiens
RESIVKDFAA

SEQ ID NO: 106275 - protein, 10 aa, Homo Sapiens
RETLLAQPAA

SEQ ID NO: 106276 - protein, 10 aa, Homo Sapiens
RETQALILAP

SEQ ID NO: 106277 - protein, 10 aa, Homo Sapiens
REVDIGIPDA

SEQ ID NO: 106278 - protein, 10 aa, Homo Sapiens
REVDPLRIPP

SEQ ID NO: 106279 - protein, 10 aa, Homo Sapiens
REVERVAMTA

SEQ ID NO: 106280 - protein, 10 aa, Homo Sapiens
REVIITPNSA

SEQ ID NO: 106281 - protein, 10 aa, Homo Sapiens
REVIKAMTKA

SEQ ID NO: 106282 - protein, 10 aa, Homo Sapiens
REVQSALSTA

SEQ ID NO: 106283 - protein, 10 aa, Homo Sapiens
REVQYLLNKA

SEQ ID NO: 106284 - protein, 10 aa, Homo Sapiens
REVSDGIIAP

SEQ ID NO: 106285 - protein, 10 aa, Homo Sapiens
REVSQHFNQA

SEQ ID NO: 106286 - protein, 10 aa, Homo Sapiens
REVTVKGIDA

SEQ ID NO: 106287 - protein, 10 aa, Homo Sapiens
REVYVKGLLA

SEQ ID NO: 106288 - protein, 10 aa, Homo Sapiens
REWEAQDMRV

SEQ ID NO: 106289 - protein, 10 aa, Homo Sapiens
REWEEAERQA

SEQ ID NO: 106290 - protein, 10 aa, Homo Sapiens
REYDGNIRQA

SEQ ID NO: 106291 - protein, 10 aa, Homo Sapiens
REYDTSKIEA

SEQ ID NO: 106292 - protein, 10 aa, Homo Sapiens
REYEIEFIYA

SEQ ID NO: 106293 - protein, 10 aa, Homo Sapiens
REYEKYVQDV

SEQ ID NO: 106294 - protein, 10 aa, Homo Sapiens
REYLIKKINA

SEQ ID NO: 106295 - protein, 10 aa, Homo Sapiens
REYMGFIQAM

SEQ ID NO: 106296 - protein, 10 aa, Homo Sapiens
REYQAGDFEA

SEQ ID NO: 106297 - protein, 10 aa, Homo Sapiens
REYQLNDSAA

SEQ ID NO: 106298 - protein, 10 aa, Homo Sapiens
SEAAELRSTA

SEQ ID NO: 106299 - protein, 10 aa, Homo Sapiens
SEADIRGFVA

SEQ ID NO: 106300 - protein, 10 aa, Homo Sapiens
SEADMRFYAA

SEQ ID NO: 106301 - protein, 10 aa, Homo Sapiens
SEAKMRLKAA

SEQ ID NO: 106302 - protein, 10 aa, Homo Sapiens
SEAKPAAVAA

SEQ ID NO: 106303 - protein, 10 aa, Homo Sapiens
SEARGRIPVA

SEQ ID NO: 106304 - protein, 10 aa, Homo Sapiens
SECRDAIQVV

SEQ ID NO: 106305 - protein, 10 aa, Homo Sapiens
SEFGQFLPEA

SEQ ID NO: 106306 - protein, 10 aa, Homo Sapiens
SEFINSKLTA

SEQ ID NO: 106307 - protein, 10 aa, Homo Sapiens
SEFLPSMQSA

SEQ ID NO: 106308 - protein, 10 aa, Homo Sapiens
SEFQPSFHQA

SEQ ID NO: 106309 - protein, 10 aa, Homo Sapiens
SEFSFEELRA

SEQ ID NO: 106310 - protein, 10 aa, Homo Sapiens
SEGARNIVAA

SEQ ID NO: 106311 - protein, 10 aa, Homo Sapiens
SEGFAVIKEA

SEQ ID NO: 106312 - protein, 10 aa, Homo Sapiens
SEGTFGIHVA

SEQ ID NO: 106313 - protein, 10 aa, Homo Sapiens
SEHGLVVIAP

SEQ ID NO: 106314 - protein, 10 aa, Homo Sapiens
SEHKIKQLSA

SEQ ID NO: 106315 - protein, 10 aa, Homo Sapiens
SEIAALLVKP

SEQ ID NO: 106316 - protein, 10 aa, Homo Sapiens
SEIDQVVPAA

SEQ ID NO: 106317 - protein, 10 aa, Homo Sapiens
SEIERQAQVA

SEQ ID NO: 106318 - protein, 10 aa, Homo Sapiens
SEIESKVREA

SEQ ID NO: 106319 - protein, 10 aa, Homo Sapiens
SEIESVKISA

SEQ ID NO: 106320 - protein, 10 aa, Homo Sapiens
SEILDKPHEA

SEQ ID NO: 106321 - protein, 10 aa, Homo Sapiens
SEILMQNWDA

SEQ ID NO: 106322 - protein, 10 aa, Homo Sapiens
SEIPKKILSA

SEQ ID NO: 106323 - protein, 10 aa, Homo Sapiens
SEKSAPEVTA

SEQ ID NO: 106324 - protein, 10 aa, Homo Sapiens
SELGKGPLAA

SEQ ID NO: 106325 - protein, 10 aa, Homo Sapiens
SELITKAVAA

SEQ ID NO: 106326 - protein, 10 aa, Homo Sapiens
SELLKGIPLA

SEQ ID NO: 106327 - protein, 10 aa, Homo Sapiens
SELPGAFEAA

SEQ ID NO: 106328 - protein, 10 aa, Homo Sapiens
SELRAMAKAA

SEQ ID NO: 106329 - protein, 10 aa, Homo Sapiens
SELSGVISSA

SEQ ID NO: 106330 - protein, 10 aa, Homo Sapiens
SETDALRSSA

SEQ ID NO: 106331 - protein, 10 aa, Homo Sapiens
SETDLSLLTA

SEQ ID NO: 106332 - protein, 10 aa, Homo Sapiens
SETSLIGTAA

SEQ ID NO: 106333 - protein, 10 aa, Homo Sapiens
SEVAELKIVA

SEQ ID NO: 106334 - protein, 10 aa, Homo Sapiens
SEVIVRDWLV

SEQ ID NO: 106335 - protein, 10 aa, Homo Sapiens
SEVKALCAKA

SEQ ID NO: 106336 - protein, 10 aa, Homo Sapiens
SEVKNIIDKA

SEQ ID NO: 106337 - protein, 10 aa, Homo Sapiens
SEVQFGHAGA

SEQ ID NO: 106338 - protein, 10 aa, Homo Sapiens
SEVTFALHSA

SEQ ID NO: 106339 - protein, 10 aa, Homo Sapiens
SEWKFTITPP

SEQ ID NO: 106340 - protein, 10 aa, Homo Sapiens
SEYNFEDLSA

SEQ ID NO: 106341 - protein, 10 aa, Homo Sapiens
SEYRNFQACL

SEQ ID NO: 106342 - protein, 10 aa, Homo Sapiens
SEYTPGNPEA

SEQ ID NO: 106343 - protein, 10 aa, Homo Sapiens
TATPGAPAQP

SEQ ID NO: 106344 - protein, 10 aa, Homo Sapiens
TEINSQRIAA

SEQ ID NO: 106345 - protein, 10 aa, Homo Sapiens
TEMDAKTVTA

SEQ ID NO: 106346 - protein, 10 aa, Homo Sapiens
TEVQSLYREI

SEQ ID NO: 106347 - protein, 10 aa, Homo Sapiens
TISSNVASKA

SEQ ID NO: 106348 - protein, 10 aa, Homo Sapiens
TTPTIVPVIP

SEQ ID NO: 106349 - protein, 10 aa, Homo Sapiens
VEAVLAGHEA

SEQ ID NO: 106350 - protein, 10 aa, Homo Sapiens
VEFMHYIIAA

SEQ ID NO: 106351 - protein, 10 aa, Homo Sapiens
VEFNGKLLAS

SEQ ID NO: 106352 - protein, 10 aa, Homo Sapiens
VEIDAHIGCA

SEQ ID NO: 106353 - protein, 10 aa, Homo Sapiens
VEIRSGFLAA

SEQ ID NO: 106354 - protein, 10 aa, Homo Sapiens
VEVDMEKIAA

SEQ ID NO: 106355 - protein, 10 aa, Homo Sapiens
VLSAADKGNV

SEQ ID NO: 106356 - protein, 10 aa, Homo Sapiens
WEVDVQGSKA

SEQ ID NO: 106357 - protein, 10 aa, Homo Sapiens
WEVDVSKKTA

SEQ ID NO: 106358 - protein, 10 aa, Homo Sapiens
WEVDVTGKEA

SEQ ID NO: 106359 - protein, 10 aa, Homo Sapiens
YEAADKWVAA

SEQ ID NO: 106360 - protein, 10 aa, Homo Sapiens
YEGKDLIAQA

SEQ ID NO: 106361 - protein, 10 aa, Homo Sapiens
YEIEKRLSTA

SEQ ID NO: 106362 - protein, 10 aa, Homo Sapiens
YEIKQFLECA

SEQ ID NO: 106363 - protein, 10 aa, Homo Sapiens
YEIQNAPEQA

SEQ ID NO: 106364 - protein, 10 aa, Homo Sapiens
YELGQGHAQA

SEQ ID NO: 106365 - protein, 10 aa, Homo Sapiens
YEQSLHIKSA

SEQ ID NO: 106366 - protein, 10 aa, Homo Sapiens
YESQPIRQTA

SEQ ID NO: 106367 - protein, 10 aa, Homo Sapiens
YETPTGIKVV

SEQ ID NO: 106368 - protein, 10 aa, Homo Sapiens
YETVLPVVEK

SEQ ID NO: 106369 - protein, 10 aa, Homo Sapiens
YEVEILDAKT

SEQ ID NO: 106370 - protein, 10 aa, Homo Sapiens
YEVRLTQTVA

SEQ ID NO: 106371 - protein, 10 aa, Homo Sapiens
YEWSLGIKSV

SEQ ID NO: 106372 - protein, 11 aa, Homo Sapiens
ADAAPDEKVLD

SEQ ID NO: 106373 - protein, 11 aa, Homo Sapiens
AEAALGGLVNA

SEQ ID NO: 106374 - protein, 11 aa, Homo Sapiens
AEADKIGLLLA

SEQ ID NO: 106375 - protein, 11 aa, Homo Sapiens
AEADRTAIHEV

SEQ ID NO: 106376 - protein, 11 aa, Homo Sapiens
AEAEFYRQVSA

SEQ ID NO: 106377 - protein, 11 aa, Homo Sapiens
AEAGPLASVPA

SEQ ID NO: 106378 - protein, 11 aa, Homo Sapiens
AEAKPITEMLP

SEQ ID NO: 106379 - protein, 11 aa, Homo Sapiens
AEASCAALVKA

SEQ ID NO: 106380 - protein, 11 aa, Homo Sapiens
AEEAGAALRTA

SEQ ID NO: 106381 - protein, 11 aa, Homo Sapiens
AEFHQIEGVVA

SEQ ID NO: 106382 - protein, 11 aa, Homo Sapiens
AEFLLEKGYEV

SEQ ID NO: 106383 - protein, 11 aa, Homo Sapiens
AEFPLGPVTTA

SEQ ID NO: 106384 - protein, 11 aa, Homo Sapiens
AEFVSTPELAA

SEQ ID NO: 106385 - protein, 11 aa, Homo Sapiens
AEGPYKIILTA

SEQ ID NO: 106386 - protein, 11 aa, Homo Sapiens
AEHDSILAEKA

SEQ ID NO: 106387 - protein, 11 aa, Homo Sapiens
AEHPLSRAEAA

SEQ ID NO: 106388 - protein, 11 aa, Homo Sapiens
AEIDAHLVALA

SEQ ID NO: 106389 - protein, 11 aa, Homo Sapiens
AEIDSIHQLVV

SEQ ID NO: 106390 - protein, 11 aa, Homo Sapiens
AEIIEKNLKSA

SEQ ID NO: 106391 - protein, 11 aa, Homo Sapiens
AEILELAGNAA

SEQ ID NO: 106392 - protein, 11 aa, Homo Sapiens
AEILNGKEISA

SEQ ID NO: 106393 - protein, 11 aa, Homo Sapiens
AEINKSDHVAA

SEQ ID NO: 106394 - protein, 11 aa, Homo Sapiens
AEIPAGPGREP

SEQ ID NO: 106395 - protein, 11 aa, Homo Sapiens
AEITNACFEPA

SEQ ID NO: 106396 - protein, 11 aa, Homo Sapiens
AEKRDPQELVA

SEQ ID NO: 106397 - protein, 11 aa, Homo Sapiens
AELENLVNQAA

SEQ ID NO: 106398 - protein, 11 aa, Homo Sapiens
AELKALLQSSA

SEQ ID NO: 106399 - protein, 11 aa, Homo Sapiens
AELLFNTIQAA

SEQ ID NO: 106400 - protein, 11 aa, Homo Sapiens
AELLQSQGSQA

SEQ ID NO: 106401 - protein, 11 aa, Homo Sapiens
AELNSYVPVTA

SEQ ID NO: 106402 - protein, 11 aa, Homo Sapiens
AELPAAAQPSA

SEQ ID NO: 106403 - protein, 11 aa, Homo Sapiens
AELRRMQEMIA

SEQ ID NO: 106404 - protein, 11 aa, Homo Sapiens
AEMDKVEGHVA

SEQ ID NO: 106405 - protein, 11 aa, Homo Sapiens
AEMPADSGYPA

SEQ ID NO: 106406 - protein, 11 aa, Homo Sapiens
AEMVALVEQRA

SEQ ID NO: 106407 - protein, 11 aa, Homo Sapiens
AENRRLHELRI

SEQ ID NO: 106408 - protein, 11 aa, Homo Sapiens
AERDLERAEVA

SEQ ID NO: 106409 - protein, 11 aa, Homo Sapiens
AERNSNLVGAA

SEQ ID NO: 106410 - protein, 11 aa, Homo Sapiens
AESGELSRLRA

SEQ ID NO: 106411 - protein, 11 aa, Homo Sapiens
AETDKITLEVA

SEQ ID NO: 106412 - protein, 11 aa, Homo Sapiens
AETKDIPAAIL

SEQ ID NO: 106413 - protein, 11 aa, Homo Sapiens
AETKQLTEMLP

SEQ ID NO: 106414 - protein, 11 aa, Homo Sapiens
AEVDPDTILKA

SEQ ID NO: 106415 - protein, 11 aa, Homo Sapiens
AEVEGLGKGVA

SEQ ID NO: 106416 - protein, 11 aa, Homo Sapiens
AEVLITTRTAA

SEQ ID NO: 106417 - protein, 11 aa, Homo Sapiens
AEVSVPKELVA

SEQ ID NO: 106418 - protein, 11 aa, Homo Sapiens
AEWEIKTITSA

SEQ ID NO: 106419 - protein, 11 aa, Homo Sapiens
AEYIPLTPAAA

SEQ ID NO: 106420 - protein, 11 aa, Homo Sapiens
FEADPPGQVAA

SEQ ID NO: 106421 - protein, 11 aa, Homo Sapiens
FEALVGTLKAA

SEQ ID NO: 106422 - protein, 11 aa, Homo Sapiens
FECDTKLYTSA

SEQ ID NO: 106423 - protein, 11 aa, Homo Sapiens
FEHAVGYALLA

SEQ ID NO: 106424 - protein, 11 aa, Homo Sapiens
FELDADKICRA

SEQ ID NO: 106425 - protein, 11 aa, Homo Sapiens
FEMATRAALQA

SEQ ID NO: 106426 - protein, 11 aa, Homo Sapiens
FEVNIPTDLRA

SEQ ID NO: 106427 - protein, 11 aa, Homo Sapiens
GEALASISHVA

SEQ ID NO: 106428 - protein, 11 aa, Homo Sapiens
GEAPSKTLVET

SEQ ID NO: 106429 - protein, 11 aa, Homo Sapiens
GEARVGSELCA

SEQ ID NO: 106430 - protein, 11 aa, Homo Sapiens
GEAYAPQGWIA

SEQ ID NO: 106431 - protein, 11 aa, Homo Sapiens
GEFAKLSKIEL

SEQ ID NO: 106432 - protein, 11 aa, Homo Sapiens
GEFEIIDDHRA

SEQ ID NO: 106433 - protein, 11 aa, Homo Sapiens
GEFGEIEAIEL

SEQ ID NO: 106434 - protein, 11 aa, Homo Sapiens
GEFGGFGSVTG

SEQ ID NO: 106435 - protein, 11 aa, Homo Sapiens
GEFIIGRVIKA

SEQ ID NO: 106436 - protein, 11 aa, Homo Sapiens
GEFLSQHKAEA

SEQ ID NO: 106437 - protein, 11 aa, Homo Sapiens
GEFPDLHRTIV

SEQ ID NO: 106438 - protein, 11 aa, Homo Sapiens
GEGSFGKAILV

SEQ ID NO: 106439 - protein, 11 aa, Homo Sapiens
GEIIIDGINIA

SEQ ID NO: 106440 - protein, 11 aa, Homo Sapiens
GEIPAELRAAA

SEQ ID NO: 106441 - protein, 11 aa, Homo Sapiens
GEIPVVAIRTA

SEQ ID NO: 106442 - protein, 11 aa, Homo Sapiens
GEIRVGPSHQA

SEQ ID NO: 106443 - protein, 11 aa, Homo Sapiens
GEITLRGLVLP

SEQ ID NO: 106444 - protein, 11 aa, Homo Sapiens
GEITTGPRVSA

SEQ ID NO: 106445 - protein, 11 aa, Homo Sapiens
GEIWVNSPHTA

SEQ ID NO: 106446 - protein, 11 aa, Homo Sapiens
GEKGIGGAVTA

SEQ ID NO: 106447 - protein, 11 aa, Homo Sapiens
GELHDLRGQVA

SEQ ID NO: 106448 - protein, 11 aa, Homo Sapiens
GELKLADFGLA

SEQ ID NO: 106449 - protein, 11 aa, Homo Sapiens
GELKVVNGAAA

SEQ ID NO: 106450 - protein, 11 aa, Homo Sapiens
GELLFVVPRAA

SEQ ID NO: 106451 - protein, 11 aa, Homo Sapiens
GEMASAQYITA

SEQ ID NO: 106452 - protein, 11 aa, Homo Sapiens
GEMKGSAITGP

SEQ ID NO: 106453 - protein, 11 aa, Homo Sapiens
GENSILGQLKA

SEQ ID NO: 106454 - protein, 11 aa, Homo Sapiens
GERIITQGEKA

SEQ ID NO: 106455 - protein, 11 aa, Homo Sapiens
GESDDSILRLA

SEQ ID NO: 106456 - protein, 11 aa, Homo Sapiens
GESIASSHVKA

SEQ ID NO: 106457 - protein, 11 aa, Homo Sapiens
GETPQVAVIVR

SEQ ID NO: 106458 - protein, 11 aa, Homo Sapiens
GEVDLRECVVA

SEQ ID NO: 106459 - protein, 11 aa, Homo Sapiens
GEVIVKGATSA

SEQ ID NO: 106460 - protein, 11 aa, Homo Sapiens
GEVNVLDNLAA

SEQ ID NO: 106461 - protein, 11 aa, Homo Sapiens
GEYAGLATIRA

SEQ ID NO: 106462 - protein, 11 aa, Homo Sapiens
GEYRGSDFTAA

SEQ ID NO: 106463 - protein, 11 aa, Homo Sapiens
GEYVSLGKVEA

SEQ ID NO: 106464 - protein, 11 aa, Homo Sapiens
GLSSEFQIPTA

SEQ ID NO: 106465 - protein, 11 aa, Homo Sapiens
GSIDFGKTVVS

SEQ ID NO: 106466 - protein, 11 aa, Homo Sapiens
HEAAFPIAVVA

SEQ ID NO: 106467 - protein, 11 aa, Homo Sapiens
HEAEPPLFQTA

SEQ ID NO: 106468 - protein, 11 aa, Homo Sapiens
HEASGTTAITA

SEQ ID NO: 106469 - protein, 11 aa, Homo Sapiens
HEFADLNLVQA

SEQ ID NO: 106470 - protein, 11 aa, Homo Sapiens
HEFANLNLVQA

SEQ ID NO: 106471 - protein, 11 aa, Homo Sapiens
HEFQAPFGMEA

SEQ ID NO: 106472 - protein, 11 aa, Homo Sapiens
HEFTDLNLVQA

SEQ ID NO: 106473 - protein, 11 aa, Homo Sapiens
HEFVEEKTKVA

SEQ ID NO: 106474 - protein, 11 aa, Homo Sapiens
HEIEVIGGYLA

SEQ ID NO: 106475 - protein, 11 aa, Homo Sapiens
HEISEGNVATA

SEQ ID NO: 106476 - protein, 11 aa, Homo Sapiens
HELLEQQKRAA

SEQ ID NO: 106477 - protein, 11 aa, Homo Sapiens
HENDAIHKICA

SEQ ID NO: 106478 - protein, 11 aa, Homo Sapiens
HESGELNQYSA

SEQ ID NO: 106479 - protein, 11 aa, Homo Sapiens
HETDLHSSHTP

SEQ ID NO: 106480 - protein, 11 aa, Homo Sapiens
HETPKQPVVRF

SEQ ID NO: 106481 - protein, 11 aa, Homo Sapiens
IELTPPKGYEA

SEQ ID NO: 106482 - protein, 11 aa, Homo Sapiens
IEYARQLEMIV

SEQ ID NO: 106483 - protein, 11 aa, Homo Sapiens
KEAEAQLWWAA

SEQ ID NO: 106484 - protein, 11 aa, Homo Sapiens
KEAEFLQKLLP

SEQ ID NO: 106485 - protein, 11 aa, Homo Sapiens
KEAGDFHFQPA

SEQ ID NO: 106486 - protein, 11 aa, Homo Sapiens
KEAPAPPKAEA

SEQ ID NO: 106487 - protein, 11 aa, Homo Sapiens
KEARIFDRAVA

SEQ ID NO: 106488 - protein, 11 aa, Homo Sapiens
KEATYGERVVA

SEQ ID NO: 106489 - protein, 11 aa, Homo Sapiens
KEFAPVYPIMV

SEQ ID NO: 106490 - protein, 11 aa, Homo Sapiens
KEFDGKSLVSV

SEQ ID NO: 106491 - protein, 11 aa, Homo Sapiens
KEFEGKTLVSV

SEQ ID NO: 106492 - protein, 11 aa, Homo Sapiens
KEFGAVSKVDF

SEQ ID NO: 106493 - protein, 11 aa, Homo Sapiens
KEFGLLKPTSA

SEQ ID NO: 106494 - protein, 11 aa, Homo Sapiens
KEFIGNMITTA

SEQ ID NO: 106495 - protein, 11 aa, Homo Sapiens
KEFKGDEILAA

SEQ ID NO: 106496 - protein, 11 aa, Homo Sapiens
KEFKPLPGRTA

SEQ ID NO: 106497 - protein, 11 aa, Homo Sapiens
KEGDFNNLTAA

SEQ ID NO: 106498 - protein, 11 aa, Homo Sapiens
KEIDAEGKYMA

SEQ ID NO: 106499 - protein, 11 aa, Homo Sapiens
KEIENGHIFTV

SEQ ID NO: 106500 - protein, 11 aa, Homo Sapiens
KEIENTYANVA

SEQ ID NO: 106501 - protein, 11 aa, Homo Sapiens
KEIESRVVFQA

SEQ ID NO: 106502 - protein, 11 aa, Homo Sapiens
KEIEVGGGRKA

SEQ ID NO: 106503 - protein, 11 aa, Homo Sapiens
KEIFISNITQA

SEQ ID NO: 106504 - protein, 11 aa, Homo Sapiens
KEIQGFLDCAA

SEQ ID NO: 106505 - protein, 11 aa, Homo Sapiens
KEIQSSNLETA

SEQ ID NO: 106506 - protein, 11 aa, Homo Sapiens
KELDYGSMTEA

SEQ ID NO: 106507 - protein, 11 aa, Homo Sapiens
KELEPLKEMTA

SEQ ID NO: 106508 - protein, 11 aa, Homo Sapiens
KELEVTNDIIA

SEQ ID NO: 106509 - protein, 11 aa, Homo Sapiens
KELHESAIVKA

SEQ ID NO: 106510 - protein, 11 aa, Homo Sapiens
KENPNQYNYIA

SEQ ID NO: 106511 - protein, 11 aa, Homo Sapiens
KEPSSGTIPQA

SEQ ID NO: 106512 - protein, 11 aa, Homo Sapiens
KESWPKPLAVP

SEQ ID NO: 106513 - protein, 11 aa, Homo Sapiens
KETPCILSVNV

SEQ ID NO: 106514 - protein, 11 aa, Homo Sapiens
KEVEASHLALA

SEQ ID NO: 106515 - protein, 11 aa, Homo Sapiens
KEVEIAYSDVA

SEQ ID NO: 106516 - protein, 11 aa, Homo Sapiens
KEVEILKDIRA

SEQ ID NO: 106517 - protein, 11 aa, Homo Sapiens
KEVFDSAILSA

SEQ ID NO: 106518 - protein, 11 aa, Homo Sapiens
KEYGQIESVRF

SEQ ID NO: 106519 - protein, 11 aa, Homo Sapiens
KEYSFDSRHKP

SEQ ID NO: 106520 - protein, 11 aa, Homo Sapiens
LADKEAGAVAA

SEQ ID NO: 106521 - protein, 11 aa, Homo Sapiens
LAGEYFLQAEL

SEQ ID NO: 106522 - protein, 11 aa, Homo Sapiens
LDLGNNNIATV

SEQ ID NO: 106523 - protein, 11 aa, Homo Sapiens
LEAEKAAVGYS

SEQ ID NO: 106524 - protein, 11 aa, Homo Sapiens
LEFADQENQVA

SEQ ID NO: 106525 - protein, 11 aa, Homo Sapiens
LEIAPHALLQA

SEQ ID NO: 106526 - protein, 11 aa, Homo Sapiens
LEIIMKNGSTA

SEQ ID NO: 106527 - protein, 11 aa, Homo Sapiens
LELDVDKRLTA

SEQ ID NO: 106528 - protein, 11 aa, Homo Sapiens
LELEMNSDLKA

SEQ ID NO: 106529 - protein, 11 aa, Homo Sapiens
LEMLTGQERVA

SEQ ID NO: 106530 - protein, 11 aa, Homo Sapiens
LEVKIGDFGLA

SEQ ID NO: 106531 - protein, 11 aa, Homo Sapiens
LEYDPLSNYSA

SEQ ID NO: 106532 - protein, 11 aa, Homo Sapiens
MEIDQKKPLSA

SEQ ID NO: 106533 - protein, 11 aa, Homo Sapiens
MEIQVNGGTVA

SEQ ID NO: 106534 - protein, 11 aa, Homo Sapiens
NERAIAGALIA

SEQ ID NO: 106535 - protein, 11 aa, Homo Sapiens
NNGSFLAIKAA

SEQ ID NO: 106536 - protein, 11 aa, Homo Sapiens
QEFEIPTGREA

SEQ ID NO: 106537 - protein, 11 aa, Homo Sapiens
QEHMSISGSSA

SEQ ID NO: 106538 - protein, 11 aa, Homo Sapiens
REAAAVRALVA

SEQ ID NO: 106539 - protein, 11 aa, Homo Sapiens
REAELKKLQEA

SEQ ID NO: 106540 - protein, 11 aa, Homo Sapiens
REAEMRNSILA

SEQ ID NO: 106541 - protein, 11 aa, Homo Sapiens
REAEREALLAA

SEQ ID NO: 106542 - protein, 11 aa, Homo Sapiens
REAGEGAVAAV

SEQ ID NO: 106543 - protein, 11 aa, Homo Sapiens
REALFNEFVAA

SEQ ID NO: 106544 - protein, 11 aa, Homo Sapiens
REALTHRKIIA

SEQ ID NO: 106545 - protein, 11 aa, Homo Sapiens
REAPAGALAAV

SEQ ID NO: 106546 - protein, 11 aa, Homo Sapiens
REASSEELKAA

SEQ ID NO: 106547 - protein, 11 aa, Homo Sapiens
REFEALRSCFA

SEQ ID NO: 106548 - protein, 11 aa, Homo Sapiens
REFEPASAREA

SEQ ID NO: 106549 - protein, 11 aa, Homo Sapiens
REFGNPNRPVA

SEQ ID NO: 106550 - protein, 11 aa, Homo Sapiens
REFLWQEGHSA

SEQ ID NO: 106551 - protein, 11 aa, Homo Sapiens
REGNVPNIIIA

SEQ ID NO: 106552 - protein, 11 aa, Homo Sapiens
REIDVRIDRNA

SEQ ID NO: 106553 - protein, 11 aa, Homo Sapiens
REIFLSQPILL

SEQ ID NO: 106554 - protein, 11 aa, Homo Sapiens
REITDQEHNVA

SEQ ID NO: 106555 - protein, 11 aa, Homo Sapiens
REKEPNRLESL

SEQ ID NO: 106556 - protein, 11 aa, Homo Sapiens
REKNPDGFLSA

SEQ ID NO: 106557 - protein, 11 aa, Homo Sapiens
RELAQQVQQVA

SEQ ID NO: 106558 - protein, 11 aa, Homo Sapiens
RELDVEEAHAA

SEQ ID NO: 106559 - protein, 11 aa, Homo Sapiens
RELEAERQIVA

SEQ ID NO: 106560 - protein, 11 aa, Homo Sapiens
RELENLIGISC

SEQ ID NO: 106561 - protein, 11 aa, Homo Sapiens
RELEQTAENKP

SEQ ID NO: 106562 - protein, 11 aa, Homo Sapiens
RELEQYGQCVA

SEQ ID NO: 106563 - protein, 11 aa, Homo Sapiens
RELEVERQIVA

SEQ ID NO: 106564 - protein, 11 aa, Homo Sapiens
RELGFSSNLLC

SEQ ID NO: 106565 - protein, 11 aa, Homo Sapiens
RELIEKGHTAA

SEQ ID NO: 106566 - protein, 11 aa, Homo Sapiens
RELLIIGGVAA

SEQ ID NO: 106567 - protein, 11 aa, Homo Sapiens
RELNRGVIKQV

SEQ ID NO: 106568 - protein, 11 aa, Homo Sapiens
RELQSKEFLSA

SEQ ID NO: 106569 - protein, 11 aa, Homo Sapiens
RELVPQDLWAA

SEQ ID NO: 106570 - protein, 11 aa, Homo Sapiens
REMANLPVPSL

SEQ ID NO: 106571 - protein, 11 aa, Homo Sapiens
REMEEKYIVSA

SEQ ID NO: 106572 - protein, 11 aa, Homo Sapiens
REMEENFAVEA

SEQ ID NO: 106573 - protein, 11 aa, Homo Sapiens
REMSPLVDNIA

SEQ ID NO: 106574 - protein, 11 aa, Homo Sapiens
REMSWIADTYA

SEQ ID NO: 106575 - protein, 11 aa, Homo Sapiens
RENVIMSQILP

SEQ ID NO: 106576 - protein, 11 aa, Homo Sapiens
REPPADVWTPP

SEQ ID NO: 106577 - protein, 11 aa, Homo Sapiens
RERHPGSFDVV

SEQ ID NO: 106578 - protein, 11 aa, Homo Sapiens
RERNPQARISA

SEQ ID NO: 106579 - protein, 11 aa, Homo Sapiens
RESAFAYAIAA

SEQ ID NO: 106580 - protein, 11 aa, Homo Sapiens
RESCIPAQVVA

SEQ ID NO: 106581 - protein, 11 aa, Homo Sapiens
RESEAFHLIKA

SEQ ID NO: 106582 - protein, 11 aa, Homo Sapiens
RESELSSNPAA

SEQ ID NO: 106583 - protein, 11 aa, Homo Sapiens
RESEVVSTITA

SEQ ID NO: 106584 - protein, 11 aa, Homo Sapiens
RESSLILAVTP

SEQ ID NO: 106585 - protein, 11 aa, Homo Sapiens
RESTGAQVQVA

SEQ ID NO: 106586 - protein, 11 aa, Homo Sapiens
RESTKISSLLA

SEQ ID NO: 106587 - protein, 11 aa, Homo Sapiens
RETEGGTVLTA

SEQ ID NO: 106588 - protein, 11 aa, Homo Sapiens
RETGVIEKLLT

SEQ ID NO: 106589 - protein, 11 aa, Homo Sapiens
RETIIMNQILP

SEQ ID NO: 106590 - protein, 11 aa, Homo Sapiens
RETSHVTMVVA

SEQ ID NO: 106591 - protein, 11 aa, Homo Sapiens
REVADFAVQPA

SEQ ID NO: 106592 - protein, 11 aa, Homo Sapiens
REVDDLEQWIA

SEQ ID NO: 106593 - protein, 11 aa, Homo Sapiens
REVDSIGLEEA

SEQ ID NO: 106594 - protein, 11 aa, Homo Sapiens
REVKTGALLSA

SEQ ID NO: 106595 - protein, 11 aa, Homo Sapiens
REVLPVDITTA

SEQ ID NO: 106596 - protein, 11 aa, Homo Sapiens
REVLVDHVVEF

SEQ ID NO: 106597 - protein, 11 aa, Homo Sapiens
REVSTGTTIMA

SEQ ID NO: 106598 - protein, 11 aa, Homo Sapiens
REWYSAKITIA

SEQ ID NO: 106599 - protein, 11 aa, Homo Sapiens
REYDRFYVINY

SEQ ID NO: 106600 - protein, 11 aa, Homo Sapiens
REYDTSKIEAA

SEQ ID NO: 106601 - protein, 11 aa, Homo Sapiens
REYEIPSNLTP

SEQ ID NO: 106602 - protein, 11 aa, Homo Sapiens
REYELVTPVST

SEQ ID NO: 106603 - protein, 11 aa, Homo Sapiens
REYNEVEPIIL

SEQ ID NO: 106604 - protein, 11 aa, Homo Sapiens
REYNWNVKNKA

SEQ ID NO: 106605 - protein, 11 aa, Homo Sapiens
REYQAGDFEAA

SEQ ID NO: 106606 - protein, 11 aa, Homo Sapiens
RMWATQGLAVA

SEQ ID NO: 106607 - protein, 11 aa, Homo Sapiens
SEADIRGFVAA

SEQ ID NO: 106608 - protein, 11 aa, Homo Sapiens
SEAELLTKTLP

SEQ ID NO: 106609 - protein, 11 aa, Homo Sapiens
SEAHSEFLKAA

SEQ ID NO: 106610 - protein, 11 aa, Homo Sapiens
SEALALTQTWA

SEQ ID NO: 106611 - protein, 11 aa, Homo Sapiens
SEFDPPGPNVA

SEQ ID NO: 106612 - protein, 11 aa, Homo Sapiens
SEFLGKRPWFA

SEQ ID NO: 106613 - protein, 11 aa, Homo Sapiens
SEHVFDHPWET

SEQ ID NO: 106614 - protein, 11 aa, Homo Sapiens
SEIAPPGVRGA

SEQ ID NO: 106615 - protein, 11 aa, Homo Sapiens
SEIDESVKLIP

SEQ ID NO: 106616 - protein, 11 aa, Homo Sapiens
SEINLPGNCVA

SEQ ID NO: 106617 - protein, 11 aa, Homo Sapiens
SEIPEKVIQVA

SEQ ID NO: 106618 - protein, 11 aa, Homo Sapiens
SEIQASEVLVA

SEQ ID NO: 106619 - protein, 11 aa, Homo Sapiens
SESRIFNELKT

SEQ ID NO: 106620 - protein, 11 aa, Homo Sapiens
SETLSQAGQKA

SEQ ID NO: 106621 - protein, 11 aa, Homo Sapiens
SEVCLPGAWQA

SEQ ID NO: 106622 - protein, 11 aa, Homo Sapiens
SEVKPPRDITA

SEQ ID NO: 106623 - protein, 11 aa, Homo Sapiens
SEVQLGKTTTA

SEQ ID NO: 106624 - protein, 11 aa, Homo Sapiens
SEVSAENILTV

SEQ ID NO: 106625 - protein, 11 aa, Homo Sapiens
SEWMATGKSTA

SEQ ID NO: 106626 - protein, 11 aa, Homo Sapiens
SEYNNFKSMVV

SEQ ID NO: 106627 - protein, 11 aa, Homo Sapiens
SEYQQYQDATA

SEQ ID NO: 106628 - protein, 11 aa, Homo Sapiens
SEYWDRETRSA

SEQ ID NO: 106629 - protein, 11 aa, Homo Sapiens
TEADPEMIKRA

SEQ ID NO: 106630 - protein, 11 aa, Homo Sapiens
TEAPPIIFATP

SEQ ID NO: 106631 - protein, 11 aa, Homo Sapiens
TEFEQQERLLA

SEQ ID NO: 106632 - protein, 11 aa, Homo Sapiens
TEGNGTESLNS

SEQ ID NO: 106633 - protein, 11 aa, Homo Sapiens
TEIALPGEVSA

SEQ ID NO: 106634 - protein, 11 aa, Homo Sapiens
TEIDPICALQA

SEQ ID NO: 106635 - protein, 11 aa, Homo Sapiens
TEIDPINALQA

SEQ ID NO: 106636 - protein, 11 aa, Homo Sapiens
TELRTEEKVVA

SEQ ID NO: 106637 - protein, 11 aa, Homo Sapiens
TELSFSREYTA

SEQ ID NO: 106638 - protein, 11 aa, Homo Sapiens
TETDLHGSLRV

SEQ ID NO: 106639 - protein, 11 aa, Homo Sapiens
VEFATHEEAVA

SEQ ID NO: 106640 - protein, 11 aa, Homo Sapiens
VEFQHIIPISA

SEQ ID NO: 106641 - protein, 11 aa, Homo Sapiens
VEIDPSMLEVA

SEQ ID NO: 106642 - protein, 11 aa, Homo Sapiens
VESASETIRSA

SEQ ID NO: 106643 - protein, 11 aa, Homo Sapiens
WEREIDERNRP

SEQ ID NO: 106644 - protein, 11 aa, Homo Sapiens
WEYDESHVITA

SEQ ID NO: 106645 - protein, 11 aa, Homo Sapiens
YEAALNSKDAA

SEQ ID NO: 106646 - protein, 11 aa, Homo Sapiens
YEFGESDLRSA

SEQ ID NO: 106647 - protein, 11 aa, Homo Sapiens
YEKEEDWRNAA

SEQ ID NO: 106648 - protein, 11 aa, Homo Sapiens
YELDLGLNHVV

SEQ ID NO: 106649 - protein, 11 aa, Homo Sapiens
YELGEDTIRQA

SEQ ID NO: 106650 - protein, 11 aa, Homo Sapiens
YESLVHAVAGA

SEQ ID NO: 106651 - protein, 11 aa, Homo Sapiens
YEVTPDDKRKA

SEQ ID NO: 106652 - protein, 11 aa, Homo Sapiens
YEYEGGHIKGA

SEQ ID NO: 106653 - protein, 11 aa, Homo Sapiens
YEYEGGHIKTA

SEQ ID NO: 106654 - protein, 8 aa, Homo Sapiens
APAPRPSL

SEQ ID NO: 106655 - protein, 8 aa, Homo Sapiens
APEEHPVL

SEQ ID NO: 106656 - protein, 8 aa, Homo Sapiens
APILKRAL

SEQ ID NO: 106657 - protein, 8 aa, Homo Sapiens
APKDSFAL

SEQ ID NO: 106658 - protein, 8 aa, Homo Sapiens
APLALHLL

SEQ ID NO: 106659 - protein, 8 aa, Homo Sapiens
APLLRWVL

SEQ ID NO: 106660 - protein, 8 aa, Homo Sapiens
APQLLIVL

SEQ ID NO: 106661 - protein, 8 aa, Homo Sapiens
APQTHLGL

SEQ ID NO: 106662 - protein, 8 aa, Homo Sapiens
APRIPVTL

SEQ ID NO: 106663 - protein, 8 aa, Homo Sapiens
APTPVPAL

SEQ ID NO: 106664 - protein, 8 aa, Homo Sapiens
APVQRPKL

SEQ ID NO: 106665 - protein, 8 aa, Homo Sapiens
APYERRAM

SEQ ID NO: 106666 - protein, 8 aa, Homo Sapiens
APYFKPKV

SEQ ID NO: 106667 - protein, 8 aa, Homo Sapiens
APYGRITL

SEQ ID NO: 106668 - protein, 8 aa, Homo Sapiens
APYMRSMM

SEQ ID NO: 106669 - protein, 8 aa, Homo Sapiens
APYNKPSL

SEQ ID NO: 106670 - protein, 8 aa, Homo Sapiens
APYPSPVL

SEQ ID NO: 106671 - protein, 8 aa, Homo Sapiens
CPNHFEGL

SEQ ID NO: 106672 - protein, 8 aa, Homo Sapiens
CPRPGVVL

SEQ ID NO: 106673 - protein, 8 aa, Homo Sapiens
EIAALVID

SEQ ID NO: 106674 - protein, 8 aa, Homo Sapiens
ETYVPKEF

SEQ ID NO: 106675 - protein, 8 aa, Homo Sapiens
FPHPLPSL

SEQ ID NO: 106676 - protein, 8 aa, Homo Sapiens
FPKAVSVF

SEQ ID NO: 106677 - protein, 8 aa, Homo Sapiens
FPKEPVEL

SEQ ID NO: 106678 - protein, 8 aa, Homo Sapiens
FPKKLLEL

SEQ ID NO: 106679 - protein, 8 aa, Homo Sapiens
GPKKGSVL

SEQ ID NO: 106680 - protein, 8 aa, Homo Sapiens
GPKVGVEV

SEQ ID NO: 106681 - protein, 8 aa, Homo Sapiens
HEVKKVTL

SEQ ID NO: 106682 - protein, 8 aa, Homo Sapiens
HPKPVPGF

SEQ ID NO: 106683 - protein, 8 aa, Homo Sapiens
HPMYGNIL

SEQ ID NO: 106684 - protein, 8 aa, Homo Sapiens
HPNVLPVL

SEQ ID NO: 106685 - protein, 8 aa, Homo Sapiens
HPPSHWPL

SEQ ID NO: 106686 - protein, 8 aa, Homo Sapiens
ILKDNLAI

SEQ ID NO: 106687 - protein, 8 aa, Homo Sapiens
IPHIHKSL

SEQ ID NO: 106688 - protein, 8 aa, Homo Sapiens
IPKDPRQW

SEQ ID NO: 106689 - protein, 8 aa, Homo Sapiens
IPMLPHLL

SEQ ID NO: 106690 - protein, 8 aa, Homo Sapiens
IPNARIEL

SEQ ID NO: 106691 - protein, 8 aa, Homo Sapiens
IPPPIKSF

SEQ ID NO: 106692 - protein, 8 aa, Homo Sapiens
IPWNHIRL

SEQ ID NO: 106693 - protein, 8 aa, Homo Sapiens
IPYAGETL

SEQ ID NO: 106694 - protein, 8 aa, Homo Sapiens
IPYAQPPL

SEQ ID NO: 106695 - protein, 8 aa, Homo Sapiens
KPFLGIGL

SEQ ID NO: 106696 - protein, 8 aa, Homo Sapiens
KPKDPVEV

SEQ ID NO: 106697 - protein, 8 aa, Homo Sapiens
KPKGGVIF

SEQ ID NO: 106698 - protein, 8 aa, Homo Sapiens
KPKSWVRL

SEQ ID NO: 106699 - protein, 8 aa, Homo Sapiens
KPRPPQGL

SEQ ID NO: 106700 - protein, 8 aa, Homo Sapiens
KPVNRISL

SEQ ID NO: 106701 - protein, 8 aa, Homo Sapiens
KPYIRTSL

SEQ ID NO: 106702 - protein, 8 aa, Homo Sapiens
KPYQKVGL

SEQ ID NO: 106703 - protein, 8 aa, Homo Sapiens
KPYVRVTM

SEQ ID NO: 106704 - protein, 8 aa, Homo Sapiens
LKMRPSLL

SEQ ID NO: 106705 - protein, 8 aa, Homo Sapiens
LLTTAKNL

SEQ ID NO: 106706 - protein, 8 aa, Homo Sapiens
LMEHIHKL

SEQ ID NO: 106707 - protein, 8 aa, Homo Sapiens
LPAPLPGL

SEQ ID NO: 106708 - protein, 8 aa, Homo Sapiens
LPHSTAAL

SEQ ID NO: 106709 - protein, 8 aa, Homo Sapiens
LPIVTPAL

SEQ ID NO: 106710 - protein, 8 aa, Homo Sapiens
LPKKLALL

SEQ ID NO: 106711 - protein, 8 aa, Homo Sapiens
LPKKPVGL

SEQ ID NO: 106712 - protein, 8 aa, Homo Sapiens
LPKLPISL

SEQ ID NO: 106713 - protein, 8 aa, Homo Sapiens
LPKQPVIV

SEQ ID NO: 106714 - protein, 8 aa, Homo Sapiens
LPKYGVKV

SEQ ID NO: 106715 - protein, 8 aa, Homo Sapiens
LPMTTEVL

SEQ ID NO: 106716 - protein, 8 aa, Homo Sapiens
LPPPPKLL

SEQ ID NO: 106717 - protein, 8 aa, Homo Sapiens
LPQRKPSL

SEQ ID NO: 106718 - protein, 8 aa, Homo Sapiens
LPRKFPSL

SEQ ID NO: 106719 - protein, 8 aa, Homo Sapiens
LPSEWRPL

SEQ ID NO: 106720 - protein, 8 aa, Homo Sapiens
LPTNFRDL

SEQ ID NO: 106721 - protein, 8 aa, Homo Sapiens
LPWVGKEL

SEQ ID NO: 106722 - protein, 8 aa, Homo Sapiens
LPYNGVVL

SEQ ID NO: 106723 - protein, 8 aa, Homo Sapiens
LQAPVLVA

SEQ ID NO: 106724 - protein, 8 aa, Homo Sapiens
MPESGVAL

SEQ ID NO: 106725 - protein, 8 aa, Homo Sapiens
MPGALPSL

SEQ ID NO: 106726 - protein, 8 aa, Homo Sapiens
MPKPPITL

SEQ ID NO: 106727 - protein, 8 aa, Homo Sapiens
MPMKVKQL

SEQ ID NO: 106728 - protein, 8 aa, Homo Sapiens
MPRIGCGL

SEQ ID NO: 106729 - protein, 8 aa, Homo Sapiens
NPKTGPTL

SEQ ID NO: 106730 - protein, 8 aa, Homo Sapiens
NPKVQASL

SEQ ID NO: 106731 - protein, 8 aa, Homo Sapiens
NPRQGYSL

SEQ ID NO: 106732 - protein, 8 aa, Homo Sapiens
PAAKRVKL

SEQ ID NO: 106733 - protein, 8 aa, Homo Sapiens
PAEPKLAF

SEQ ID NO: 106734 - protein, 8 aa, Homo Sapiens
PAKLHNSL

SEQ ID NO: 106735 - protein, 8 aa, Homo Sapiens
PASKRPPL

SEQ ID NO: 106736 - protein, 8 aa, Homo Sapiens
PDGQVITI

SEQ ID NO: 106737 - protein, 8 aa, Homo Sapiens
PEAKKPRL

SEQ ID NO: 106738 - protein, 8 aa, Homo Sapiens
PFSFHHVL

SEQ ID NO: 106739 - protein, 8 aa, Homo Sapiens
PHLVGPHL

SEQ ID NO: 106740 - protein, 8 aa, Homo Sapiens
PINGNGKQ

SEQ ID NO: 106741 - protein, 8 aa, Homo Sapiens
PKLHIVKV

SEQ ID NO: 106742 - protein, 8 aa, Homo Sapiens
PKPKAKTL

SEQ ID NO: 106743 - protein, 8 aa, Homo Sapiens
PKRPPSAF

SEQ ID NO: 106744 - protein, 8 aa, Homo Sapiens
PKSAVGEL

SEQ ID NO: 106745 - protein, 8 aa, Homo Sapiens
PLDSIHSL

SEQ ID NO: 106746 - protein, 8 aa, Homo Sapiens
PLSKIKTL

SEQ ID NO: 106747 - protein, 8 aa, Homo Sapiens
PPEVSKKL

SEQ ID NO: 106748 - protein, 8 aa, Homo Sapiens
PPPPHRLP

SEQ ID NO: 106749 - protein, 8 aa, Homo Sapiens
PQAKKIKL

SEQ ID NO: 106750 - protein, 8 aa, Homo Sapiens
PQKPHLKL

SEQ ID NO: 106751 - protein, 8 aa, Homo Sapiens
PQRVRVTL

SEQ ID NO: 106752 - protein, 8 aa, Homo Sapiens
PRGFARGL

SEQ ID NO: 106753 - protein, 8 aa, Homo Sapiens
PRPPHGEL

SEQ ID NO: 106754 - protein, 8 aa, Homo Sapiens
PRPPPKPM

SEQ ID NO: 106755 - protein, 8 aa, Homo Sapiens
PRSPPRAL

SEQ ID NO: 106756 - protein, 8 aa, Homo Sapiens
PRSPQPEL

SEQ ID NO: 106757 - protein, 8 aa, Homo Sapiens
PSGSKKVI

SEQ ID NO: 106758 - protein, 8 aa, Homo Sapiens
PYSRPKQL

SEQ ID NO: 106759 - protein, 8 aa, Homo Sapiens
QPYAGFVL

SEQ ID NO: 106760 - protein, 8 aa, Homo Sapiens
QPYLTHRL

SEQ ID NO: 106761 - protein, 8 aa, Homo Sapiens
RPFLLRRI

SEQ ID NO: 106762 - protein, 8 aa, Homo Sapiens
RPHNLPVV

SEQ ID NO: 106763 - protein, 8 aa, Homo Sapiens
RPKIQQQF

SEQ ID NO: 106764 - protein, 8 aa, Homo Sapiens
RPKMQEVV

SEQ ID NO: 106765 - protein, 8 aa, Homo Sapiens
RPKVGLGA

SEQ ID NO: 106766 - protein, 8 aa, Homo Sapiens
RPKVLMRL

SEQ ID NO: 106767 - protein, 8 aa, Homo Sapiens
RPLKRPRL

SEQ ID NO: 106768 - protein, 8 aa, Homo Sapiens
RPRDSPTL

SEQ ID NO: 106769 - protein, 8 aa, Homo Sapiens
RPRKAFLL

SEQ ID NO: 106770 - protein, 8 aa, Homo Sapiens
RPRLPRKL

SEQ ID NO: 106771 - protein, 8 aa, Homo Sapiens
RPRPGTGL

SEQ ID NO: 106772 - protein, 8 aa, Homo Sapiens
RPRPPRQL

SEQ ID NO: 106773 - protein, 8 aa, Homo Sapiens
RPRPPTLL

SEQ ID NO: 106774 - protein, 8 aa, Homo Sapiens
RPRTEVSL

SEQ ID NO: 106775 - protein, 8 aa, Homo Sapiens
RPSERPSL

SEQ ID NO: 106776 - protein, 8 aa, Homo Sapiens
RPTCKAVL

SEQ ID NO: 106777 - protein, 8 aa, Homo Sapiens
RPTTGNTL

SEQ ID NO: 106778 - protein, 8 aa, Homo Sapiens
RPVKLFRV

SEQ ID NO: 106779 - protein, 8 aa, Homo Sapiens
RPYAKHWL

SEQ ID NO: 106780 - protein, 8 aa, Homo Sapiens
RPYEKGRL

SEQ ID NO: 106781 - protein, 8 aa, Homo Sapiens
RPYKLQVL

SEQ ID NO: 106782 - protein, 8 aa, Homo Sapiens
RPYKPVVL

SEQ ID NO: 106783 - protein, 8 aa, Homo Sapiens
RPYVRVEL

SEQ ID NO: 106784 - protein, 8 aa, Homo Sapiens
SPAILPPL

SEQ ID NO: 106785 - protein, 8 aa, Homo Sapiens
SPAKLHEL

SEQ ID NO: 106786 - protein, 8 aa, Homo Sapiens
SPAPRTAL

SEQ ID NO: 106787 - protein, 8 aa, Homo Sapiens
SPAVLRPI

SEQ ID NO: 106788 - protein, 8 aa, Homo Sapiens
SPCGHIGL

SEQ ID NO: 106789 - protein, 8 aa, Homo Sapiens
SPFLQPKL

SEQ ID NO: 106790 - protein, 8 aa, Homo Sapiens
SPFPLEAV

SEQ ID NO: 106791 - protein, 8 aa, Homo Sapiens
SPHLLEAL

SEQ ID NO: 106792 - protein, 8 aa, Homo Sapiens
SPHLQVML

SEQ ID NO: 106793 - protein, 8 aa, Homo Sapiens
SPKASLEL

SEQ ID NO: 106794 - protein, 8 aa, Homo Sapiens
SPKEPEQL

SEQ ID NO: 106795 - protein, 8 aa, Homo Sapiens
SPKLLHKF

SEQ ID NO: 106796 - protein, 8 aa, Homo Sapiens
SPKPPVAV

SEQ ID NO: 106797 - protein, 8 aa, Homo Sapiens
SPKQGVSL

SEQ ID NO: 106798 - protein, 8 aa, Homo Sapiens
SPKSDPTL

SEQ ID NO: 106799 - protein, 8 aa, Homo Sapiens
SPKVDPSL

SEQ ID NO: 106800 - protein, 8 aa, Homo Sapiens
SPKVPRTL

SEQ ID NO: 106801 - protein, 8 aa, Homo Sapiens
SPLGSPEL

SEQ ID NO: 106802 - protein, 8 aa, Homo Sapiens
SPNGLYVL

SEQ ID NO: 106803 - protein, 8 aa, Homo Sapiens
SPNKLYTL

SEQ ID NO: 106804 - protein, 8 aa, Homo Sapiens
SPPPVKEL

SEQ ID NO: 106805 - protein, 8 aa, Homo Sapiens
SPQELYEL

SEQ ID NO: 106806 - protein, 8 aa, Homo Sapiens
SPTLLNCL

SEQ ID NO: 106807 - protein, 8 aa, Homo Sapiens
SPTQLPIL

SEQ ID NO: 106808 - protein, 8 aa, Homo Sapiens
SPVVHSVL

SEQ ID NO: 106809 - protein, 8 aa, Homo Sapiens
SPVVRVAV

SEQ ID NO: 106810 - protein, 8 aa, Homo Sapiens
SPYIRTKL

SEQ ID NO: 106811 - protein, 8 aa, Homo Sapiens
SPYYRTKL

SEQ ID NO: 106812 - protein, 8 aa, Homo Sapiens
SVKKGFEF

SEQ ID NO: 106813 - protein, 8 aa, Homo Sapiens
SVKRGFEF

SEQ ID NO: 106814 - protein, 8 aa, Homo Sapiens
TAKRQPIL

SEQ ID NO: 106815 - protein, 8 aa, Homo Sapiens
TPAALAAL

SEQ ID NO: 106816 - protein, 8 aa, Homo Sapiens
TPATLHIL

SEQ ID NO: 106817 - protein, 8 aa, Homo Sapiens
TPAVHASL

SEQ ID NO: 106818 - protein, 8 aa, Homo Sapiens
TPFIRPVM

SEQ ID NO: 106819 - protein, 8 aa, Homo Sapiens
TPHLHSIL

SEQ ID NO: 106820 - protein, 8 aa, Homo Sapiens
TPKPGTCV

SEQ ID NO: 106821 - protein, 8 aa, Homo Sapiens
TPKPIPIL

SEQ ID NO: 106822 - protein, 8 aa, Homo Sapiens
TPLHLAVI

SEQ ID NO: 106823 - protein, 8 aa, Homo Sapiens
TPLLMQAL

SEQ ID NO: 106824 - protein, 8 aa, Homo Sapiens
TPMLLRAL

SEQ ID NO: 106825 - protein, 8 aa, Homo Sapiens
TPQKLPSL

SEQ ID NO: 106826 - protein, 8 aa, Homo Sapiens
TPQRLFAL

SEQ ID NO: 106827 - protein, 8 aa, Homo Sapiens
TPRPGQEL

SEQ ID NO: 106828 - protein, 8 aa, Homo Sapiens
TPTQGSVL

SEQ ID NO: 106829 - protein, 8 aa, Homo Sapiens
VKPVKVSA

SEQ ID NO: 106830 - protein, 8 aa, Homo Sapiens
VPFNHEIL

SEQ ID NO: 106831 - protein, 8 aa, Homo Sapiens
VPHDPVAL

SEQ ID NO: 106832 - protein, 8 aa, Homo Sapiens
VPKEGKVV

SEQ ID NO: 106833 - protein, 8 aa, Homo Sapiens
VPKLQPQI

SEQ ID NO: 106834 - protein, 8 aa, Homo Sapiens
VPKTHLEL

SEQ ID NO: 106835 - protein, 8 aa, Homo Sapiens
VPLKQPTL

SEQ ID NO: 106836 - protein, 8 aa, Homo Sapiens
VPNVHGAL

SEQ ID NO: 106837 - protein, 8 aa, Homo Sapiens
VPPYGVAL

SEQ ID NO: 106838 - protein, 8 aa, Homo Sapiens
VPQALTGL

SEQ ID NO: 106839 - protein, 8 aa, Homo Sapiens
VPRNTRAL

SEQ ID NO: 106840 - protein, 8 aa, Homo Sapiens
VPRPPATL

SEQ ID NO: 106841 - protein, 8 aa, Homo Sapiens
VPSPKVVL

SEQ ID NO: 106842 - protein, 8 aa, Homo Sapiens
VPWKEVLL

SEQ ID NO: 106843 - protein, 8 aa, Homo Sapiens
VQVHIEVL

SEQ ID NO: 106844 - protein, 8 aa, Homo Sapiens
WISKQEYD

SEQ ID NO: 106845 - protein, 8 aa, Homo Sapiens
YPHLLEQL

SEQ ID NO: 106846 - protein, 8 aa, Homo Sapiens
YPLILKEL

SEQ ID NO: 106847 - protein, 8 aa, Homo Sapiens
YPNPLPVL

SEQ ID NO: 106848 - protein, 8 aa, Homo Sapiens
YPYRYPAL

SEQ ID NO: 106849 - protein, 9 aa, Homo Sapiens
AAKAAGVSF

SEQ ID NO: 106850 - protein, 9 aa, Homo Sapiens
AAKAGLLAL

SEQ ID NO: 106851 - protein, 9 aa, Homo Sapiens
AAKDPSPSV

SEQ ID NO: 106852 - protein, 9 aa, Homo Sapiens
AAKLVSEKL

SEQ ID NO: 106853 - protein, 9 aa, Homo Sapiens
AAKRSGLAV

SEQ ID NO: 106854 - protein, 9 aa, Homo Sapiens
AAKTVFEAL

SEQ ID NO: 106855 - protein, 9 aa, Homo Sapiens
AARPATSTL

SEQ ID NO: 106856 - protein, 9 aa, Homo Sapiens
AAYLRALSL

SEQ ID NO: 106857 - protein, 9 aa, Homo Sapiens
AIKNVNTAL

SEQ ID NO: 106858 - protein, 9 aa, Homo Sapiens
ALGRPSPTL

SEQ ID NO: 106859 - protein, 9 aa, Homo Sapiens
ALKKAGLSL

SEQ ID NO: 106860 - protein, 9 aa, Homo Sapiens
ALKNVTVSF

SEQ ID NO: 106861 - protein, 9 aa, Homo Sapiens
APAAAGAAL

SEQ ID NO: 106862 - protein, 9 aa, Homo Sapiens
APAAAPSSL

SEQ ID NO: 106863 - protein, 9 aa, Homo Sapiens
APAAATVAV

SEQ ID NO: 106864 - protein, 9 aa, Homo Sapiens
APAAAVPTL

SEQ ID NO: 106865 - protein, 9 aa, Homo Sapiens
APAAPGLSL

SEQ ID NO: 106866 - protein, 9 aa, Homo Sapiens
APADTSDPL

SEQ ID NO: 106867 - protein, 9 aa, Homo Sapiens
APADYFRIL

SEQ ID NO: 106868 - protein, 9 aa, Homo Sapiens
APAERQIDL

SEQ ID NO: 106869 - protein, 9 aa, Homo Sapiens
APAGSLPKI

SEQ ID NO: 106870 - protein, 9 aa, Homo Sapiens
APALPGPAL

SEQ ID NO: 106871 - protein, 9 aa, Homo Sapiens
APALPGPQF

SEQ ID NO: 106872 - protein, 9 aa, Homo Sapiens
APALVSKKL

SEQ ID NO: 106873 - protein, 9 aa, Homo Sapiens
APAPAAHVA

SEQ ID NO: 106874 - protein, 9 aa, Homo Sapiens
APAPASISL

SEQ ID NO: 106875 - protein, 9 aa, Homo Sapiens
APAPIHNQF

SEQ ID NO: 106876 - protein, 9 aa, Homo Sapiens
APAPKAYVL

SEQ ID NO: 106877 - protein, 9 aa, Homo Sapiens
APAPPKAEA

SEQ ID NO: 106878 - protein, 9 aa, Homo Sapiens
APAPPSKVI

SEQ ID NO: 106879 - protein, 9 aa, Homo Sapiens
APAPTAVVL

SEQ ID NO: 106880 - protein, 9 aa, Homo Sapiens
APAPVQPPM

SEQ ID NO: 106881 - protein, 9 aa, Homo Sapiens
APAQPQPQL

SEQ ID NO: 106882 - protein, 9 aa, Homo Sapiens
APARAVSAV

SEQ ID NO: 106883 - protein, 9 aa, Homo Sapiens
APASRLLAL

SEQ ID NO: 106884 - protein, 9 aa, Homo Sapiens
APASVHSEI

SEQ ID NO: 106885 - protein, 9 aa, Homo Sapiens
APATVGLAF

SEQ ID NO: 106886 - protein, 9 aa, Homo Sapiens
APAYLPRSL

SEQ ID NO: 106887 - protein, 9 aa, Homo Sapiens
APCEVTVPA

SEQ ID NO: 106888 - protein, 9 aa, Homo Sapiens
APCKQRISV

SEQ ID NO: 106889 - protein, 9 aa, Homo Sapiens
APDAKSFVL

SEQ ID NO: 106890 - protein, 9 aa, Homo Sapiens
APDEAAEAL

SEQ ID NO: 106891 - protein, 9 aa, Homo Sapiens
APEDKKEIL

SEQ ID NO: 106892 - protein, 9 aa, Homo Sapiens
APEERPAAL

SEQ ID NO: 106893 - protein, 9 aa, Homo Sapiens
APELLRALL

SEQ ID NO: 106894 - protein, 9 aa, Homo Sapiens
APELPIKIL

SEQ ID NO: 106895 - protein, 9 aa, Homo Sapiens
APELQRHEL

SEQ ID NO: 106896 - protein, 9 aa, Homo Sapiens
APEVTREEL

SEQ ID NO: 106897 - protein, 9 aa, Homo Sapiens
APFCQGHEM

SEQ ID NO: 106898 - protein, 9 aa, Homo Sapiens
APFGPIKSI

SEQ ID NO: 106899 - protein, 9 aa, Homo Sapiens
APFKFDMEL

SEQ ID NO: 106900 - protein, 9 aa, Homo Sapiens
APFLRNVEL

SEQ ID NO: 106901 - protein, 9 aa, Homo Sapiens
APFLRQEFI

SEQ ID NO: 106902 - protein, 9 aa, Homo Sapiens
APFRSEVCF

SEQ ID NO: 106903 - protein, 9 aa, Homo Sapiens
APFTAGTSL

SEQ ID NO: 106904 - protein, 9 aa, Homo Sapiens
APGEVGSVL

SEQ ID NO: 106905 - protein, 9 aa, Homo Sapiens
APGGAIASV

SEQ ID NO: 106906 - protein, 9 aa, Homo Sapiens
APGIRSWSL

SEQ ID NO: 106907 - protein, 9 aa, Homo Sapiens
APGLGPRAV

SEQ ID NO: 106908 - protein, 9 aa, Homo Sapiens
APGLIGNVM

SEQ ID NO: 106909 - protein, 9 aa, Homo Sapiens
APGPGRKEL

SEQ ID NO: 106910 - protein, 9 aa, Homo Sapiens
APGPINFTM

SEQ ID NO: 106911 - protein, 9 aa, Homo Sapiens
APGPPGRSM

SEQ ID NO: 106912 - protein, 9 aa, Homo Sapiens
APGPSGQSV

SEQ ID NO: 106913 - protein, 9 aa, Homo Sapiens
APGSARRPL

SEQ ID NO: 106914 - protein, 9 aa, Homo Sapiens
APGYLPTSL

SEQ ID NO: 106915 - protein, 9 aa, Homo Sapiens
APHAPGPPA

SEQ ID NO: 106916 - protein, 9 aa, Homo Sapiens
APHEILIQI

SEQ ID NO: 106917 - protein, 9 aa, Homo Sapiens
APHEPVKTL

SEQ ID NO: 106918 - protein, 9 aa, Homo Sapiens
APHLSKVSM

SEQ ID NO: 106919 - protein, 9 aa, Homo Sapiens
APHLTHHTL

SEQ ID NO: 106920 - protein, 9 aa, Homo Sapiens
APHLVGPHL

SEQ ID NO: 106921 - protein, 9 aa, Homo Sapiens
APHWRMKQL

SEQ ID NO: 106922 - protein, 9 aa, Homo Sapiens
APIASIHSF

SEQ ID NO: 106923 - protein, 9 aa, Homo Sapiens
APIEAQVRL

SEQ ID NO: 106924 - protein, 9 aa, Homo Sapiens
APISVRVEL

SEQ ID NO: 106925 - protein, 9 aa, Homo Sapiens
APKAGPGVV

SEQ ID NO: 106926 - protein, 9 aa, Homo Sapiens
APKEINIDF

SEQ ID NO: 106927 - protein, 9 aa, Homo Sapiens
APKIGPLGL

SEQ ID NO: 106928 - protein, 9 aa, Homo Sapiens
APKIIDEQL

SEQ ID NO: 106929 - protein, 9 aa, Homo Sapiens
APKKSATQF

SEQ ID NO: 106930 - protein, 9 aa, Homo Sapiens
APKLDPEEM

SEQ ID NO: 106931 - protein, 9 aa, Homo Sapiens
APKPGGLSL

SEQ ID NO: 106932 - protein, 9 aa, Homo Sapiens
APKPKWTQL

SEQ ID NO: 106933 - protein, 9 aa, Homo Sapiens
APKPPFQSH

SEQ ID NO: 106934 - protein, 9 aa, Homo Sapiens
APKPQGPAF

SEQ ID NO: 106935 - protein, 9 aa, Homo Sapiens
APKPQGTKI

SEQ ID NO: 106936 - protein, 9 aa, Homo Sapiens
APKPRLNQL

SEQ ID NO: 106937 - protein, 9 aa, Homo Sapiens
APKPTLLWL

SEQ ID NO: 106938 - protein, 9 aa, Homo Sapiens
APKQLSSCL

SEQ ID NO: 106939 - protein, 9 aa, Homo Sapiens
APKRPPLAF

SEQ ID NO: 106940 - protein, 9 aa, Homo Sapiens
APKRPPSAF

SEQ ID NO: 106941 - protein, 9 aa, Homo Sapiens
APKRPPSGF

SEQ ID NO: 106942 - protein, 9 aa, Homo Sapiens
APKSMQSAI

SEQ ID NO: 106943 - protein, 9 aa, Homo Sapiens
APKSPSQDV

SEQ ID NO: 106944 - protein, 9 aa, Homo Sapiens
APKSQIVML

SEQ ID NO: 106945 - protein, 9 aa, Homo Sapiens
APKVSPEAV

SEQ ID NO: 106946 - protein, 9 aa, Homo Sapiens
APKYILEQF

SEQ ID NO: 106947 - protein, 9 aa, Homo Sapiens
APLAVFQML

SEQ ID NO: 106948 - protein, 9 aa, Homo Sapiens
APLDSIHSL

SEQ ID NO: 106949 - protein, 9 aa, Homo Sapiens
APLFTAEAL

SEQ ID NO: 106950 - protein, 9 aa, Homo Sapiens
APLGGTPTL

SEQ ID NO: 106951 - protein, 9 aa, Homo Sapiens
APLGQFVSL

SEQ ID NO: 106952 - protein, 9 aa, Homo Sapiens
APLLKKQTL

SEQ ID NO: 106953 - protein, 9 aa, Homo Sapiens
APLPGMTSL

SEQ ID NO: 106954 - protein, 9 aa, Homo Sapiens
APLPSIKEI

SEQ ID NO: 106955 - protein, 9 aa, Homo Sapiens
APLQHRHVL

SEQ ID NO: 106956 - protein, 9 aa, Homo Sapiens
APLQRSQSL

SEQ ID NO: 106957 - protein, 9 aa, Homo Sapiens
APMIKKIAF

SEQ ID NO: 106958 - protein, 9 aa, Homo Sapiens
APMKAPKRM

SEQ ID NO: 106959 - protein, 9 aa, Homo Sapiens
APMMVSNIL

SEQ ID NO: 106960 - protein, 9 aa, Homo Sapiens
APMNVRRGL

SEQ ID NO: 106961 - protein, 9 aa, Homo Sapiens
APMPPIIHA

SEQ ID NO: 106962 - protein, 9 aa, Homo Sapiens
APMQEKVTL

SEQ ID NO: 106963 - protein, 9 aa, Homo Sapiens
APMSAAHQL

SEQ ID NO: 106964 - protein, 9 aa, Homo Sapiens
APMSEPRVL

SEQ ID NO: 106965 - protein, 9 aa, Homo Sapiens
APMSPSTAL

SEQ ID NO: 106966 - protein, 9 aa, Homo Sapiens
APMTPKQIL

SEQ ID NO: 106967 - protein, 9 aa, Homo Sapiens
APNEKMKQV

SEQ ID NO: 106968 - protein, 9 aa, Homo Sapiens
APNERPYSL

SEQ ID NO: 106969 - protein, 9 aa, Homo Sapiens
APNGAGLVL

SEQ ID NO: 106970 - protein, 9 aa, Homo Sapiens
APNYRLKSL

SEQ ID NO: 106971 - protein, 9 aa, Homo Sapiens
APPDVWKKV

SEQ ID NO: 106972 - protein, 9 aa, Homo Sapiens
APPPGGWPL

SEQ ID NO: 106973 - protein, 9 aa, Homo Sapiens
APPRPGSSF

SEQ ID NO: 106974 - protein, 9 aa, Homo Sapiens
APPTETKSL

SEQ ID NO: 106975 - protein, 9 aa, Homo Sapiens
APQGGMAAL

SEQ ID NO: 106976 - protein, 9 aa, Homo Sapiens
APQLPNPEV

SEQ ID NO: 106977 - protein, 9 aa, Homo Sapiens
APQPAKPRL

SEQ ID NO: 106978 - protein, 9 aa, Homo Sapiens
APQPAQVAL

SEQ ID NO: 106979 - protein, 9 aa, Homo Sapiens
APQPGKYVI

SEQ ID NO: 106980 - protein, 9 aa, Homo Sapiens
APQRAHEVL

SEQ ID NO: 106981 - protein, 9 aa, Homo Sapiens
APQRVRVTL

SEQ ID NO: 106982 - protein, 9 aa, Homo Sapiens
APQSFRAEL

SEQ ID NO: 106983 - protein, 9 aa, Homo Sapiens
APQSNKERL

SEQ ID NO: 106984 - protein, 9 aa, Homo Sapiens
APQTSTPSL

SEQ ID NO: 106985 - protein, 9 aa, Homo Sapiens
APQVHIFSL

SEQ ID NO: 106986 - protein, 9 aa, Homo Sapiens
APRAAREAL

SEQ ID NO: 106987 - protein, 9 aa, Homo Sapiens
APRAVFPSI

SEQ ID NO: 106988 - protein, 9 aa, Homo Sapiens
APRDGRVVF

SEQ ID NO: 106989 - protein, 9 aa, Homo Sapiens
APRDPIPYL

SEQ ID NO: 106990 - protein, 9 aa, Homo Sapiens
APRDSLRSL

SEQ ID NO: 106991 - protein, 9 aa, Homo Sapiens
APRDSYHLV

SEQ ID NO: 106992 - protein, 9 aa, Homo Sapiens
APRELGLGL

SEQ ID NO: 106993 - protein, 9 aa, Homo Sapiens
APRGDKEEL

SEQ ID NO: 106994 - protein, 9 aa, Homo Sapiens
APRGPGAEL

SEQ ID NO: 106995 - protein, 9 aa, Homo Sapiens
APRHGLQSL

SEQ ID NO: 106996 - protein, 9 aa, Homo Sapiens
APRKPDWDL

SEQ ID NO: 106997 - protein, 9 aa, Homo Sapiens
APRLPITGL

SEQ ID NO: 106998 - protein, 9 aa, Homo Sapiens
APRLQSEVA

SEQ ID NO: 106999 - protein, 9 aa, Homo Sapiens
APRPAGSYL

SEQ ID NO: 107000 - protein, 9 aa, Homo Sapiens
APRPGPRAV

SEQ ID NO: 107001 - protein, 9 aa, Homo Sapiens
APRPPPARL

SEQ ID NO: 107002 - protein, 9 aa, Homo Sapiens
APRPPPKPM

SEQ ID NO: 107003 - protein, 9 aa, Homo Sapiens
APRPPVSAA

SEQ ID NO: 107004 - protein, 9 aa, Homo Sapiens
APRQPGLMA

SEQ ID NO: 107005 - protein, 9 aa, Homo Sapiens
APRSEVEAL

SEQ ID NO: 107006 - protein, 9 aa, Homo Sapiens
APRSTEESL

SEQ ID NO: 107007 - protein, 9 aa, Homo Sapiens
APRVKEGPL

SEQ ID NO: 107008 - protein, 9 aa, Homo Sapiens
APRVPVQAL

SEQ ID NO: 107009 - protein, 9 aa, Homo Sapiens
APRYSAPVI

SEQ ID NO: 107010 - protein, 9 aa, Homo Sapiens
APSAKVKLL

SEQ ID NO: 107011 - protein, 9 aa, Homo Sapiens
APSESFVVL

SEQ ID NO: 107012 - protein, 9 aa, Homo Sapiens
APSGIGSIF

SEQ ID NO: 107013 - protein, 9 aa, Homo Sapiens
APSLKQFSL

SEQ ID NO: 107014 - protein, 9 aa, Homo Sapiens
APSLVAPAL

SEQ ID NO: 107015 - protein, 9 aa, Homo Sapiens
APSPLQPAL

SEQ ID NO: 107016 - protein, 9 aa, Homo Sapiens
APSPLSSSL

SEQ ID NO: 107017 - protein, 9 aa, Homo Sapiens
APSPPLRAL

SEQ ID NO: 107018 - protein, 9 aa, Homo Sapiens
APSPRPLSL

SEQ ID NO: 107019 - protein, 9 aa, Homo Sapiens
APSPVIPRL

SEQ ID NO: 107020 - protein, 9 aa, Homo Sapiens
APSRSLNEL

SEQ ID NO: 107021 - protein, 9 aa, Homo Sapiens
APSSPRPAL

SEQ ID NO: 107022 - protein, 9 aa, Homo Sapiens
APSTIIFHL

SEQ ID NO: 107023 - protein, 9 aa, Homo Sapiens
APSYPMASL

SEQ ID NO: 107024 - protein, 9 aa, Homo Sapiens
APTDVLEAL

SEQ ID NO: 107025 - protein, 9 aa, Homo Sapiens
APTGSGKTI

SEQ ID NO: 107026 - protein, 9 aa, Homo Sapiens
APTPARPVL

SEQ ID NO: 107027 - protein, 9 aa, Homo Sapiens
APTPLRPGF

SEQ ID NO: 107028 - protein, 9 aa, Homo Sapiens
APVAPHFAL

SEQ ID NO: 107029 - protein, 9 aa, Homo Sapiens
APVFRDYVF

SEQ ID NO: 107030 - protein, 9 aa, Homo Sapiens
APVGIRHRL

SEQ ID NO: 107031 - protein, 9 aa, Homo Sapiens
APVGSGSAL

SEQ ID NO: 107032 - protein, 9 aa, Homo Sapiens
APVGVHPSL

SEQ ID NO: 107033 - protein, 9 aa, Homo Sapiens
APVLPHTAV

SEQ ID NO: 107034 - protein, 9 aa, Homo Sapiens
APVSPRPGL

SEQ ID NO: 107035 - protein, 9 aa, Homo Sapiens
APVYFPEEL

SEQ ID NO: 107036 - protein, 9 aa, Homo Sapiens
APVYLAAVI

SEQ ID NO: 107037 - protein, 9 aa, Homo Sapiens
APWARVDEM

SEQ ID NO: 107038 - protein, 9 aa, Homo Sapiens
APWDRVVDL

SEQ ID NO: 107039 - protein, 9 aa, Homo Sapiens
APWEKRVDL

SEQ ID NO: 107040 - protein, 9 aa, Homo Sapiens
APYFKGTAV

SEQ ID NO: 107041 - protein, 9 aa, Homo Sapiens
APYGGPIAL

SEQ ID NO: 107042 - protein, 9 aa, Homo Sapiens
APYSRPKQL

SEQ ID NO: 107043 - protein, 9 aa, Homo Sapiens
ASVKKPHTL

SEQ ID NO: 107044 - protein, 9 aa, Homo Sapiens
ATKRIFSAL

SEQ ID NO: 107045 - protein, 9 aa, Homo Sapiens
AVEPGRPPL

SEQ ID NO: 107046 - protein, 9 aa, Homo Sapiens
AVKDVAKAL

SEQ ID NO: 107047 - protein, 9 aa, Homo Sapiens
AVKEKSPSL

SEQ ID NO: 107048 - protein, 9 aa, Homo Sapiens
AVKESTITL

SEQ ID NO: 107049 - protein, 9 aa, Homo Sapiens
AVKKVIASM

SEQ ID NO: 107050 - protein, 9 aa, Homo Sapiens
AVKPAVTTL

SEQ ID NO: 107051 - protein, 9 aa, Homo Sapiens
AVKPSVTCV

SEQ ID NO: 107052 - protein, 9 aa, Homo Sapiens
AVKQRGISL

SEQ ID NO: 107053 - protein, 9 aa, Homo Sapiens
AVPRPGAPA

SEQ ID NO: 107054 - protein, 9 aa, Homo Sapiens
AVRKPAISL

SEQ ID NO: 107055 - protein, 9 aa, Homo Sapiens
CPRPGVVLL

SEQ ID NO: 107056 - protein, 9 aa, Homo Sapiens
DAIKLNPRL

SEQ ID NO: 107057 - protein, 9 aa, Homo Sapiens
DPKSKFFEL

SEQ ID NO: 107058 - protein, 9 aa, Homo Sapiens
EPCGLRGAL

SEQ ID NO: 107059 - protein, 9 aa, Homo Sapiens
EPCNGRTAL

SEQ ID NO: 107060 - protein, 9 aa, Homo Sapiens
EPLRPGPAL

SEQ ID NO: 107061 - protein, 9 aa, Homo Sapiens
EPPDIVKKL

SEQ ID NO: 107062 - protein, 9 aa, Homo Sapiens
EPPEKKMAL

SEQ ID NO: 107063 - protein, 9 aa, Homo Sapiens
EPPPVKIAW

SEQ ID NO: 107064 - protein, 9 aa, Homo Sapiens
EPQAKNISV

SEQ ID NO: 107065 - protein, 9 aa, Homo Sapiens
EPQGPRPVL

SEQ ID NO: 107066 - protein, 9 aa, Homo Sapiens
EPQPERSSV

SEQ ID NO: 107067 - protein, 9 aa, Homo Sapiens
EPQPPHSVL

SEQ ID NO: 107068 - protein, 9 aa, Homo Sapiens
EPRHEFPEL

SEQ ID NO: 107069 - protein, 9 aa, Homo Sapiens
EPRPAEPPA

SEQ ID NO: 107070 - protein, 9 aa, Homo Sapiens
EPRPNEECL

SEQ ID NO: 107071 - protein, 9 aa, Homo Sapiens
EPRPPHGEL

SEQ ID NO: 107072 - protein, 9 aa, Homo Sapiens
EPRYPPHSL

SEQ ID NO: 107073 - protein, 9 aa, Homo Sapiens
EPSDAIRVV

SEQ ID NO: 107074 - protein, 9 aa, Homo Sapiens
EVKPNTPVL

SEQ ID NO: 107075 - protein, 9 aa, Homo Sapiens
EVKPVGPDL

SEQ ID NO: 107076 - protein, 9 aa, Homo Sapiens
EVKPYSIEM

SEQ ID NO: 107077 - protein, 9 aa, Homo Sapiens
EVKRPGESL

SEQ ID NO: 107078 - protein, 9 aa, Homo Sapiens
FPAGIVRVF

SEQ ID NO: 107079 - protein, 9 aa, Homo Sapiens
FPAPDRKKL

SEQ ID NO: 107080 - protein, 9 aa, Homo Sapiens
FPCEPFKFL

SEQ ID NO: 107081 - protein, 9 aa, Homo Sapiens
FPEPSRPPL

SEQ ID NO: 107082 - protein, 9 aa, Homo Sapiens
FPESERPEM

SEQ ID NO: 107083 - protein, 9 aa, Homo Sapiens
FPFSRPELL

SEQ ID NO: 107084 - protein, 9 aa, Homo Sapiens
FPGISVKSV

SEQ ID NO: 107085 - protein, 9 aa, Homo Sapiens
FPGVTPRVL

SEQ ID NO: 107086 - protein, 9 aa, Homo Sapiens
FPHKRLQQL

SEQ ID NO: 107087 - protein, 9 aa, Homo Sapiens
FPHLVHAEL

SEQ ID NO: 107088 - protein, 9 aa, Homo Sapiens
FPIEVRHYL

SEQ ID NO: 107089 - protein, 9 aa, Homo Sapiens
FPIHVQTSL

SEQ ID NO: 107090 - protein, 9 aa, Homo Sapiens
FPKAAIKRL

SEQ ID NO: 107091 - protein, 9 aa, Homo Sapiens
FPKAVSVFF

SEQ ID NO: 107092 - protein, 9 aa, Homo Sapiens
FPKDPVYTF

SEQ ID NO: 107093 - protein, 9 aa, Homo Sapiens
FPKGFSVEL

SEQ ID NO: 107094 - protein, 9 aa, Homo Sapiens
FPKGSRSVV

SEQ ID NO: 107095 - protein, 9 aa, Homo Sapiens
FPKIPPHSL

SEQ ID NO: 107096 - protein, 9 aa, Homo Sapiens
FPKRPKHML

SEQ ID NO: 107097 - protein, 9 aa, Homo Sapiens
FPKWFHEGL

SEQ ID NO: 107098 - protein, 9 aa, Homo Sapiens
FPMEIRQYL

SEQ ID NO: 107099 - protein, 9 aa, Homo Sapiens
FPMELRQFL

SEQ ID NO: 107100 - protein, 9 aa, Homo Sapiens
FPMSPVTSV

SEQ ID NO: 107101 - protein, 9 aa, Homo Sapiens
FPNAIEHTL

SEQ ID NO: 107102 - protein, 9 aa, Homo Sapiens
FPNIPGKSL

SEQ ID NO: 107103 - protein, 9 aa, Homo Sapiens
FPNKQGYVL

SEQ ID NO: 107104 - protein, 9 aa, Homo Sapiens
FPPKKLFSL

SEQ ID NO: 107105 - protein, 9 aa, Homo Sapiens
FPPPVSPRL

SEQ ID NO: 107106 - protein, 9 aa, Homo Sapiens
FPQEGMHQM

SEQ ID NO: 107107 - protein, 9 aa, Homo Sapiens
FPQEIRQDL

SEQ ID NO: 107108 - protein, 9 aa, Homo Sapiens
FPQEVKDLL

SEQ ID NO: 107109 - protein, 9 aa, Homo Sapiens
FPQHLRHLL

SEQ ID NO: 107110 - protein, 9 aa, Homo Sapiens
FPQHTIASL

SEQ ID NO: 107111 - protein, 9 aa, Homo Sapiens
FPQVGRTAL

SEQ ID NO: 107112 - protein, 9 aa, Homo Sapiens
FPRDKLAEL

SEQ ID NO: 107113 - protein, 9 aa, Homo Sapiens
FPRDPEIEM

SEQ ID NO: 107114 - protein, 9 aa, Homo Sapiens
FPREPRPKL

SEQ ID NO: 107115 - protein, 9 aa, Homo Sapiens
FPRFPHRGL

SEQ ID NO: 107116 - protein, 9 aa, Homo Sapiens
FPRHIEPEL

SEQ ID NO: 107117 - protein, 9 aa, Homo Sapiens
FPRRAQPKM

SEQ ID NO: 107118 - protein, 9 aa, Homo Sapiens
FPRTPARSV

SEQ ID NO: 107119 - protein, 9 aa, Homo Sapiens
FPSNFIKEL

SEQ ID NO: 107120 - protein, 9 aa, Homo Sapiens
FPTGNIHMF

SEQ ID NO: 107121 - protein, 9 aa, Homo Sapiens
FPTVQHQEL

SEQ ID NO: 107122 - protein, 9 aa, Homo Sapiens
FPVGRVHRL

SEQ ID NO: 107123 - protein, 9 aa, Homo Sapiens
FPWEKPTTL

SEQ ID NO: 107124 - protein, 9 aa, Homo Sapiens
FPWEVPKKL

SEQ ID NO: 107125 - protein, 9 aa, Homo Sapiens
FPYMTHPSV

SEQ ID NO: 107126 - protein, 9 aa, Homo Sapiens
FSKPPNPAL

SEQ ID NO: 107127 - protein, 9 aa, Homo Sapiens
FVKKIGGIF

SEQ ID NO: 107128 - protein, 9 aa, Homo Sapiens
GEYKFQNAL

SEQ ID NO: 107129 - protein, 9 aa, Homo Sapiens
GIKEYFNVM

SEQ ID NO: 107130 - protein, 9 aa, Homo Sapiens
GPAPSRPAL

SEQ ID NO: 107131 - protein, 9 aa, Homo Sapiens
GPASDHPSL

SEQ ID NO: 107132 - protein, 9 aa, Homo Sapiens
GPESRTISL

SEQ ID NO: 107133 - protein, 9 aa, Homo Sapiens
GPFFRTEQL

SEQ ID NO: 107134 - protein, 9 aa, Homo Sapiens
GPIYPGHGM

SEQ ID NO: 107135 - protein, 9 aa, Homo Sapiens
GPKAHIRKL

SEQ ID NO: 107136 - protein, 9 aa, Homo Sapiens
GPKDAIRAL

SEQ ID NO: 107137 - protein, 9 aa, Homo Sapiens
GPKGTMKML

SEQ ID NO: 107138 - protein, 9 aa, Homo Sapiens
GPKPKTFLL

SEQ ID NO: 107139 - protein, 9 aa, Homo Sapiens
GPKPLFRRM

SEQ ID NO: 107140 - protein, 9 aa, Homo Sapiens
GPKPTEVVL

SEQ ID NO: 107141 - protein, 9 aa, Homo Sapiens
GPKQQFSTL

SEQ ID NO: 107142 - protein, 9 aa, Homo Sapiens
GPLPPHLAL

SEQ ID NO: 107143 - protein, 9 aa, Homo Sapiens
GPMPKHIAF

SEQ ID NO: 107144 - protein, 9 aa, Homo Sapiens
GPNAVIFTL

SEQ ID NO: 107145 - protein, 9 aa, Homo Sapiens
GPNSNIRTV

SEQ ID NO: 107146 - protein, 9 aa, Homo Sapiens
GPPGTGKTI

SEQ ID NO: 107147 - protein, 9 aa, Homo Sapiens
GPQAVRAAL

SEQ ID NO: 107148 - protein, 9 aa, Homo Sapiens
GPQEKKVVV

SEQ ID NO: 107149 - protein, 9 aa, Homo Sapiens
GPRAPGPSL

SEQ ID NO: 107150 - protein, 9 aa, Homo Sapiens
GPREAFRQL

SEQ ID NO: 107151 - protein, 9 aa, Homo Sapiens
GPREQEPEL

SEQ ID NO: 107152 - protein, 9 aa, Homo Sapiens
GPRGMGTAL

SEQ ID NO: 107153 - protein, 9 aa, Homo Sapiens
GPRSSLRVL

SEQ ID NO: 107154 - protein, 9 aa, Homo Sapiens
GPRWADPQI

SEQ ID NO: 107155 - protein, 9 aa, Homo Sapiens
GPSNVFKIV

SEQ ID NO: 107156 - protein, 9 aa, Homo Sapiens
GVKKPTKAL

SEQ ID NO: 107157 - protein, 9 aa, Homo Sapiens
GVRPPAPSL

SEQ ID NO: 107158 - protein, 9 aa, Homo Sapiens
HAKEYIQQL

SEQ ID NO: 107159 - protein, 9 aa, Homo Sapiens
HAKMIFMEL

SEQ ID NO: 107160 - protein, 9 aa, Homo Sapiens
HAKPPTPSL

SEQ ID NO: 107161 - protein, 9 aa, Homo Sapiens
HIKDSFHSL

SEQ ID NO: 107162 - protein, 9 aa, Homo Sapiens
HLKPISREL

SEQ ID NO: 107163 - protein, 9 aa, Homo Sapiens
HLKPLVPSL

SEQ ID NO: 107164 - protein, 9 aa, Homo Sapiens
HPAAFPLPV

SEQ ID NO: 107165 - protein, 9 aa, Homo Sapiens
HPAAKMIVM

SEQ ID NO: 107166 - protein, 9 aa, Homo Sapiens
HPADSVVSV

SEQ ID NO: 107167 - protein, 9 aa, Homo Sapiens
HPAGPRTVF

SEQ ID NO: 107168 - protein, 9 aa, Homo Sapiens
HPDQAQAIL

SEQ ID NO: 107169 - protein, 9 aa, Homo Sapiens
HPEPPKAEL

SEQ ID NO: 107170 - protein, 9 aa, Homo Sapiens
HPEQCIKVL

SEQ ID NO: 107171 - protein, 9 aa, Homo Sapiens
HPESERISM

SEQ ID NO: 107172 - protein, 9 aa, Homo Sapiens
HPESVSQSL

SEQ ID NO: 107173 - protein, 9 aa, Homo Sapiens
HPFFGRVVL

SEQ ID NO: 107174 - protein, 9 aa, Homo Sapiens
HPFFKDMSL

SEQ ID NO: 107175 - protein, 9 aa, Homo Sapiens
HPFHILIAL

SEQ ID NO: 107176 - protein, 9 aa, Homo Sapiens
HPFLQRQQL

SEQ ID NO: 107177 - protein, 9 aa, Homo Sapiens
HPFPFHPSL

SEQ ID NO: 107178 - protein, 9 aa, Homo Sapiens
HPGPVNSEL

SEQ ID NO: 107179 - protein, 9 aa, Homo Sapiens
HPHGSYSRL

SEQ ID NO: 107180 - protein, 9 aa, Homo Sapiens
HPHLVAEAF

SEQ ID NO: 107181 - protein, 9 aa, Homo Sapiens
HPINPRVAL

SEQ ID NO: 107182 - protein, 9 aa, Homo Sapiens
HPIRVVNAL

SEQ ID NO: 107183 - protein, 9 aa, Homo Sapiens
HPISNNNSL

SEQ ID NO: 107184 - protein, 9 aa, Homo Sapiens
HPIYNIKSL

SEQ ID NO: 107185 - protein, 9 aa, Homo Sapiens
HPKCLIVDF

SEQ ID NO: 107186 - protein, 9 aa, Homo Sapiens
HPKDNLIKL

SEQ ID NO: 107187 - protein, 9 aa, Homo Sapiens
HPKENIIAV

SEQ ID NO: 107188 - protein, 9 aa, Homo Sapiens
HPKFVGKTL

SEQ ID NO: 107189 - protein, 9 aa, Homo Sapiens
HPKKPGPSL

SEQ ID NO: 107190 - protein, 9 aa, Homo Sapiens
HPKNPEVGL

SEQ ID NO: 107191 - protein, 9 aa, Homo Sapiens
HPKPEGLAA

SEQ ID NO: 107192 - protein, 9 aa, Homo Sapiens
HPKPSDLHL

SEQ ID NO: 107193 - protein, 9 aa, Homo Sapiens
HPKPTQRTF

SEQ ID NO: 107194 - protein, 9 aa, Homo Sapiens
HPKRPLLAF

SEQ ID NO: 107195 - protein, 9 aa, Homo Sapiens
HPKSVIVGL

SEQ ID NO: 107196 - protein, 9 aa, Homo Sapiens
HPKTGRISV

SEQ ID NO: 107197 - protein, 9 aa, Homo Sapiens
HPKVGRVSI

SEQ ID NO: 107198 - protein, 9 aa, Homo Sapiens
HPKYGSIPK

SEQ ID NO: 107199 - protein, 9 aa, Homo Sapiens
HPLDPIGCL

SEQ ID NO: 107200 - protein, 9 aa, Homo Sapiens
HPLEGTHEL

SEQ ID NO: 107201 - protein, 9 aa, Homo Sapiens
HPLINPVAF

SEQ ID NO: 107202 - protein, 9 aa, Homo Sapiens
HPLSNPAEL

SEQ ID NO: 107203 - protein, 9 aa, Homo Sapiens
HPMAYQLQL

SEQ ID NO: 107204 - protein, 9 aa, Homo Sapiens
HPMGGLNAM

SEQ ID NO: 107205 - protein, 9 aa, Homo Sapiens
HPMNSISSL

SEQ ID NO: 107206 - protein, 9 aa, Homo Sapiens
HPMPRVNEI

SEQ ID NO: 107207 - protein, 9 aa, Homo Sapiens
HPNFTEKTI

SEQ ID NO: 107208 - protein, 9 aa, Homo Sapiens
HPNGNITEL

SEQ ID NO: 107209 - protein, 9 aa, Homo Sapiens
HPNLHGPEI

SEQ ID NO: 107210 - protein, 9 aa, Homo Sapiens
HPNSLMKKI

SEQ ID NO: 107211 - protein, 9 aa, Homo Sapiens
HPQPGAVEL

SEQ ID NO: 107212 - protein, 9 aa, Homo Sapiens
HPQTHETAL

SEQ ID NO: 107213 - protein, 9 aa, Homo Sapiens
HPRAYFMQL

SEQ ID NO: 107214 - protein, 9 aa, Homo Sapiens
HPRDFFSRL

SEQ ID NO: 107215 - protein, 9 aa, Homo Sapiens
HPRDPNLLL

SEQ ID NO: 107216 - protein, 9 aa, Homo Sapiens
HPRLVVIVL

SEQ ID NO: 107217 - protein, 9 aa, Homo Sapiens
HPRPYFKSV

SEQ ID NO: 107218 - protein, 9 aa, Homo Sapiens
HPRSPTPTL

SEQ ID NO: 107219 - protein, 9 aa, Homo Sapiens
HPRTCPRPL

SEQ ID NO: 107220 - protein, 9 aa, Homo Sapiens
HPRYFGPNL

SEQ ID NO: 107221 - protein, 9 aa, Homo Sapiens
HPRYNLIVV

SEQ ID NO: 107222 - protein, 9 aa, Homo Sapiens
HPSASYNQL

SEQ ID NO: 107223 - protein, 9 aa, Homo Sapiens
HPSDIEVDL

SEQ ID NO: 107224 - protein, 9 aa, Homo Sapiens
HPSFQVKEL

SEQ ID NO: 107225 - protein, 9 aa, Homo Sapiens
HPSGATPTL

SEQ ID NO: 107226 - protein, 9 aa, Homo Sapiens
HPSLPASSL

SEQ ID NO: 107227 - protein, 9 aa, Homo Sapiens
HPSNVLHFF

SEQ ID NO: 107228 - protein, 9 aa, Homo Sapiens
HPSSYTKVI

SEQ ID NO: 107229 - protein, 9 aa, Homo Sapiens
HPTAAVKML

SEQ ID NO: 107230 - protein, 9 aa, Homo Sapiens
HPTDERVAL

SEQ ID NO: 107231 - protein, 9 aa, Homo Sapiens
HPTFNLKSL

SEQ ID NO: 107232 - protein, 9 aa, Homo Sapiens
HPTGKMFIL

SEQ ID NO: 107233 - protein, 9 aa, Homo Sapiens
HPVNAFKLM

SEQ ID NO: 107234 - protein, 9 aa, Homo Sapiens
HPVSREWTL

SEQ ID NO: 107235 - protein, 9 aa, Homo Sapiens
HPYIQYNVL

SEQ ID NO: 107236 - protein, 9 aa, Homo Sapiens
HPYLFPVAA

SEQ ID NO: 107237 - protein, 9 aa, Homo Sapiens
HPYNKLWSL

SEQ ID NO: 107238 - protein, 9 aa, Homo Sapiens
HPYNPHPGF

SEQ ID NO: 107239 - protein, 9 aa, Homo Sapiens
HPYQRIVTA

SEQ ID NO: 107240 - protein, 9 aa, Homo Sapiens
HVNCTIKEL

SEQ ID NO: 107241 - protein, 9 aa, Homo Sapiens
HVQQNRAVL

SEQ ID NO: 107242 - protein, 9 aa, Homo Sapiens
IAEMVRHAL

SEQ ID NO: 107243 - protein, 9 aa, Homo Sapiens
IAHAKAVAA

SEQ ID NO: 107244 - protein, 9 aa, Homo Sapiens
IANAVVKEL

SEQ ID NO: 107245 - protein, 9 aa, Homo Sapiens
IARLPSSTL

SEQ ID NO: 107246 - protein, 9 aa, Homo Sapiens
IIRENSISL

SEQ ID NO: 107247 - protein, 9 aa, Homo Sapiens
ILKKVLEAL

SEQ ID NO: 107248 - protein, 9 aa, Homo Sapiens
ILKPTGNQL

SEQ ID NO: 107249 - protein, 9 aa, Homo Sapiens
ILMEHIHKL

SEQ ID NO: 107250 - protein, 9 aa, Homo Sapiens
ILPRSLALI

SEQ ID NO: 107251 - protein, 9 aa, Homo Sapiens
IPAAPVPSL

SEQ ID NO: 107252 - protein, 9 aa, Homo Sapiens
IPADTFAAL

SEQ ID NO: 107253 - protein, 9 aa, Homo Sapiens
IPAEGRVAL

SEQ ID NO: 107254 - protein, 9 aa, Homo Sapiens
IPAIRDITL

SEQ ID NO: 107255 - protein, 9 aa, Homo Sapiens
IPAKKYVKL

SEQ ID NO: 107256 - protein, 9 aa, Homo Sapiens
IPAKLHNSL

SEQ ID NO: 107257 - protein, 9 aa, Homo Sapiens
IPAKPPVSF

SEQ ID NO: 107258 - protein, 9 aa, Homo Sapiens
IPALRDISI

SEQ ID NO: 107259 - protein, 9 aa, Homo Sapiens
IPANPPMAF

SEQ ID NO: 107260 - protein, 9 aa, Homo Sapiens
IPAPKRVCL

SEQ ID NO: 107261 - protein, 9 aa, Homo Sapiens
IPASGLHLF

SEQ ID NO: 107262 - protein, 9 aa, Homo Sapiens
IPASKVFSL

SEQ ID NO: 107263 - protein, 9 aa, Homo Sapiens
IPAYKLETL

SEQ ID NO: 107264 - protein, 9 aa, Homo Sapiens
IPCPTVVLL

SEQ ID NO: 107265 - protein, 9 aa, Homo Sapiens
IPDHFRPPL

SEQ ID NO: 107266 - protein, 9 aa, Homo Sapiens
IPDSSKISL

SEQ ID NO: 107267 - protein, 9 aa, Homo Sapiens
IPEAGKALL

SEQ ID NO: 107268 - protein, 9 aa, Homo Sapiens
IPEELKPWL

SEQ ID NO: 107269 - protein, 9 aa, Homo Sapiens
IPEKFQHIL

SEQ ID NO: 107270 - protein, 9 aa, Homo Sapiens
IPELHRPVV

SEQ ID NO: 107271 - protein, 9 aa, Homo Sapiens
IPELPDPSL

SEQ ID NO: 107272 - protein, 9 aa, Homo Sapiens
IPESKLTSL

SEQ ID NO: 107273 - protein, 9 aa, Homo Sapiens
IPFAAPTAL

SEQ ID NO: 107274 - protein, 9 aa, Homo Sapiens
IPFEFPLHL

SEQ ID NO: 107275 - protein, 9 aa, Homo Sapiens
IPFEKKPAL

SEQ ID NO: 107276 - protein, 9 aa, Homo Sapiens
IPFWRNTAV

SEQ ID NO: 107277 - protein, 9 aa, Homo Sapiens
IPGEPGFPL

SEQ ID NO: 107278 - protein, 9 aa, Homo Sapiens
IPGLNLNAL

SEQ ID NO: 107279 - protein, 9 aa, Homo Sapiens
IPGMGGNSL

SEQ ID NO: 107280 - protein, 9 aa, Homo Sapiens
IPHMDIEAL

SEQ ID NO: 107281 - protein, 9 aa, Homo Sapiens
IPIKKSDPV

SEQ ID NO: 107282 - protein, 9 aa, Homo Sapiens
IPISLHTSL

SEQ ID NO: 107283 - protein, 9 aa, Homo Sapiens
IPKDNRLYL

SEQ ID NO: 107284 - protein, 9 aa, Homo Sapiens
IPKEHHRFV

SEQ ID NO: 107285 - protein, 9 aa, Homo Sapiens
IPKEIIEKL

SEQ ID NO: 107286 - protein, 9 aa, Homo Sapiens
IPKEKFWKI

SEQ ID NO: 107287 - protein, 9 aa, Homo Sapiens
IPKENFSCL

SEQ ID NO: 107288 - protein, 9 aa, Homo Sapiens
IPKEVADIF

SEQ ID NO: 107289 - protein, 9 aa, Homo Sapiens
IPKFAVATL

SEQ ID NO: 107290 - protein, 9 aa, Homo Sapiens
IPKGRPPKL

SEQ ID NO: 107291 - protein, 9 aa, Homo Sapiens
IPKGVSRKL

SEQ ID NO: 107292 - protein, 9 aa, Homo Sapiens
IPKHINPVA

SEQ ID NO: 107293 - protein, 9 aa, Homo Sapiens
IPKKEIHTV

SEQ ID NO: 107294 - protein, 9 aa, Homo Sapiens
IPKKEKPEL

SEQ ID NO: 107295 - protein, 9 aa, Homo Sapiens
IPKKGFVEV

SEQ ID NO: 107296 - protein, 9 aa, Homo Sapiens
IPKKHISQI

SEQ ID NO: 107297 - protein, 9 aa, Homo Sapiens
IPKKPIPRI

SEQ ID NO: 107298 - protein, 9 aa, Homo Sapiens
IPKNNPPTL

SEQ ID NO: 107299 - protein, 9 aa, Homo Sapiens
IPKNPPSGF

SEQ ID NO: 107300 - protein, 9 aa, Homo Sapiens
IPKNSPPTL

SEQ ID NO: 107301 - protein, 9 aa, Homo Sapiens
IPKNVATET

SEQ ID NO: 107302 - protein, 9 aa, Homo Sapiens
IPKPLNPAL

SEQ ID NO: 107303 - protein, 9 aa, Homo Sapiens
IPKPPVPEI

SEQ ID NO: 107304 - protein, 9 aa, Homo Sapiens
IPKPVHTRF

SEQ ID NO: 107305 - protein, 9 aa, Homo Sapiens
IPKRPIPTI

SEQ ID NO: 107306 - protein, 9 aa, Homo Sapiens
IPKSAIRVI

SEQ ID NO: 107307 - protein, 9 aa, Homo Sapiens
IPKSAVGEL

SEQ ID NO: 107308 - protein, 9 aa, Homo Sapiens
IPKSAVGTL

SEQ ID NO: 107309 - protein, 9 aa, Homo Sapiens
IPKSSDPEM

SEQ ID NO: 107310 - protein, 9 aa, Homo Sapiens
IPKVAVEVF

SEQ ID NO: 107311 - protein, 9 aa, Homo Sapiens
IPKVEWSAF

SEQ ID NO: 107312 - protein, 9 aa, Homo Sapiens
IPLADQPHL

SEQ ID NO: 107313 - protein, 9 aa, Homo Sapiens
IPLAKRVAL

SEQ ID NO: 107314 - protein, 9 aa, Homo Sapiens
IPLPLVKSL

SEQ ID NO: 107315 - protein, 9 aa, Homo Sapiens
IPLQTPHKL

SEQ ID NO: 107316 - protein, 9 aa, Homo Sapiens
IPLSGRNPL

SEQ ID NO: 107317 - protein, 9 aa, Homo Sapiens
IPLSKIKTL

SEQ ID NO: 107318 - protein, 9 aa, Homo Sapiens
IPMAKSYVL

SEQ ID NO: 107319 - protein, 9 aa, Homo Sapiens
IPMEFVNKM

SEQ ID NO: 107320 - protein, 9 aa, Homo Sapiens
IPMSDPQVL

SEQ ID NO: 107321 - protein, 9 aa, Homo Sapiens
IPMTGKPSL

SEQ ID NO: 107322 - protein, 9 aa, Homo Sapiens
IPMTPTSSF

SEQ ID NO: 107323 - protein, 9 aa, Homo Sapiens
IPNEIIHAL

SEQ ID NO: 107324 - protein, 9 aa, Homo Sapiens
IPNERTMQL

SEQ ID NO: 107325 - protein, 9 aa, Homo Sapiens
IPNFPRSTV

SEQ ID NO: 107326 - protein, 9 aa, Homo Sapiens
IPNGSSITV

SEQ ID NO: 107327 - protein, 9 aa, Homo Sapiens
IPNHYAEDL

SEQ ID NO: 107328 - protein, 9 aa, Homo Sapiens
IPNNVKTAV

SEQ ID NO: 107329 - protein, 9 aa, Homo Sapiens
IPNTQIKAL

SEQ ID NO: 107330 - protein, 9 aa, Homo Sapiens
IPPEHGKRL

SEQ ID NO: 107331 - protein, 9 aa, Homo Sapiens
IPPGTHEAL

SEQ ID NO: 107332 - protein, 9 aa, Homo Sapiens
IPPPGGTSL

SEQ ID NO: 107333 - protein, 9 aa, Homo Sapiens
IPPPPPPAM

SEQ ID NO: 107334 - protein, 9 aa, Homo Sapiens
IPPVKATPL

SEQ ID NO: 107335 - protein, 9 aa, Homo Sapiens
IPPYPASSL

SEQ ID NO: 107336 - protein, 9 aa, Homo Sapiens
IPQEFQKTV

SEQ ID NO: 107337 - protein, 9 aa, Homo Sapiens
IPQIRNPSL

SEQ ID NO: 107338 - protein, 9 aa, Homo Sapiens
IPQKFHRSV

SEQ ID NO: 107339 - protein, 9 aa, Homo Sapiens
IPQKPSQPA

SEQ ID NO: 107340 - protein, 9 aa, Homo Sapiens
IPQPPILQL

SEQ ID NO: 107341 - protein, 9 aa, Homo Sapiens
IPQPTPASL

SEQ ID NO: 107342 - protein, 9 aa, Homo Sapiens
IPQQLLTTL

SEQ ID NO: 107343 - protein, 9 aa, Homo Sapiens
IPQSIIECV

SEQ ID NO: 107344 - protein, 9 aa, Homo Sapiens
IPQVKYICL

SEQ ID NO: 107345 - protein, 9 aa, Homo Sapiens
IPRAKAEEM

SEQ ID NO: 107346 - protein, 9 aa, Homo Sapiens
IPREVSETL

SEQ ID NO: 107347 - protein, 9 aa, Homo Sapiens
IPRILGPGL

SEQ ID NO: 107348 - protein, 9 aa, Homo Sapiens
IPRKPDGKM

SEQ ID NO: 107349 - protein, 9 aa, Homo Sapiens
IPRNPPPRL

SEQ ID NO: 107350 - protein, 9 aa, Homo Sapiens
IPRNQLQSV

SEQ ID NO: 107351 - protein, 9 aa, Homo Sapiens
IPRQVAQTL

SEQ ID NO: 107352 - protein, 9 aa, Homo Sapiens
IPSEWHIEL

SEQ ID NO: 107353 - protein, 9 aa, Homo Sapiens
IPSGSVTAL

SEQ ID NO: 107354 - protein, 9 aa, Homo Sapiens
IPSPSLVSL

SEQ ID NO: 107355 - protein, 9 aa, Homo Sapiens
IPSPVLVKL

SEQ ID NO: 107356 - protein, 9 aa, Homo Sapiens
IPSSHPVSL

SEQ ID NO: 107357 - protein, 9 aa, Homo Sapiens
IPTGEGPPL

SEQ ID NO: 107358 - protein, 9 aa, Homo Sapiens
IPTVNPVAI

SEQ ID NO: 107359 - protein, 9 aa, Homo Sapiens
IPVEVKPCL

SEQ ID NO: 107360 - protein, 9 aa, Homo Sapiens
IPVKKRMAL

SEQ ID NO: 107361 - protein, 9 aa, Homo Sapiens
IPWVAPECL

SEQ ID NO: 107362 - protein, 9 aa, Homo Sapiens
IPYEGFASL

SEQ ID NO: 107363 - protein, 9 aa, Homo Sapiens
IPYGERITL

SEQ ID NO: 107364 - protein, 9 aa, Homo Sapiens
IPYKPNYSL

SEQ ID NO: 107365 - protein, 9 aa, Homo Sapiens
IPYKREESL

SEQ ID NO: 107366 - protein, 9 aa, Homo Sapiens
IPYMKKYKI

SEQ ID NO: 107367 - protein, 9 aa, Homo Sapiens
IPYPKREFL

SEQ ID NO: 107368 - protein, 9 aa, Homo Sapiens
IPYPRPIHL

SEQ ID NO: 107369 - protein, 9 aa, Homo Sapiens
IRSHSKAVL

SEQ ID NO: 107370 - protein, 9 aa, Homo Sapiens
ISKQFHHQL

SEQ ID NO: 107371 - protein, 9 aa, Homo Sapiens
ISLSKDLEL

SEQ ID NO: 107372 - protein, 9 aa, Homo Sapiens
ITKMPCQSL

SEQ ID NO: 107373 - protein, 9 aa, Homo Sapiens
ITKPPDGSA

SEQ ID NO: 107374 - protein, 9 aa, Homo Sapiens
IVIGVLHQL

SEQ ID NO: 107375 - protein, 9 aa, Homo Sapiens
IVKEIHEQL

SEQ ID NO: 107376 - protein, 9 aa, Homo Sapiens
IVKEVSTYI

SEQ ID NO: 107377 - protein, 9 aa, Homo Sapiens
IVKGPRGTL

SEQ ID NO: 107378 - protein, 9 aa, Homo Sapiens
IVKKQIVKL

SEQ ID NO: 107379 - protein, 9 aa, Homo Sapiens
IVKMVMISL

SEQ ID NO: 107380 - protein, 9 aa, Homo Sapiens
IVKPKPRAL

SEQ ID NO: 107381 - protein, 9 aa, Homo Sapiens
IVKPPVRKL

SEQ ID NO: 107382 - protein, 9 aa, Homo Sapiens
IVKPVKVSA

SEQ ID NO: 107383 - protein, 9 aa, Homo Sapiens
KAASVRPVL

SEQ ID NO: 107384 - protein, 9 aa, Homo Sapiens
KAFARPWSL

SEQ ID NO: 107385 - protein, 9 aa, Homo Sapiens
KAKDPFAHL

SEQ ID NO: 107386 - protein, 9 aa, Homo Sapiens
KAKPVTTNL

SEQ ID NO: 107387 - protein, 9 aa, Homo Sapiens
KAYERGISL

SEQ ID NO: 107388 - protein, 9 aa, Homo Sapiens
KAYFKRYQV

SEQ ID NO: 107389 - protein, 9 aa, Homo Sapiens
KAYLKKISM

SEQ ID NO: 107390 - protein, 9 aa, Homo Sapiens
KIKDNINCL

SEQ ID NO: 107391 - protein, 9 aa, Homo Sapiens
KIKNGTPPM

SEQ ID NO: 107392 - protein, 9 aa, Homo Sapiens
KIKNVVHEL

SEQ ID NO: 107393 - protein, 9 aa, Homo Sapiens
KIKPVSLTF

SEQ ID NO: 107394 - protein, 9 aa, Homo Sapiens
KIRDVTKCL

SEQ ID NO: 107395 - protein, 9 aa, Homo Sapiens
KIRPHIATL

SEQ ID NO: 107396 - protein, 9 aa, Homo Sapiens
KIRPHITTL

SEQ ID NO: 107397 - protein, 9 aa, Homo Sapiens
KLKENYQML

SEQ ID NO: 107398 - protein, 9 aa, Homo Sapiens
KLNPYAKTM

SEQ ID NO: 107399 - protein, 9 aa, Homo Sapiens
KPADLARHL

SEQ ID NO: 107400 - protein, 9 aa, Homo Sapiens
KPAEVVKIL

SEQ ID NO: 107401 - protein, 9 aa, Homo Sapiens
KPAHLIVSL

SEQ ID NO: 107402 - protein, 9 aa, Homo Sapiens
KPAKPQPKL

SEQ ID NO: 107403 - protein, 9 aa, Homo Sapiens
KPAKVKVEL

SEQ ID NO: 107404 - protein, 9 aa, Homo Sapiens
KPANVFITA

SEQ ID NO: 107405 - protein, 9 aa, Homo Sapiens
KPASVFVQL

SEQ ID NO: 107406 - protein, 9 aa, Homo Sapiens
KPATKTAEL

SEQ ID NO: 107407 - protein, 9 aa, Homo Sapiens
KPEGKDYAL

SEQ ID NO: 107408 - protein, 9 aa, Homo Sapiens
KPEIRVTSL

SEQ ID NO: 107409 - protein, 9 aa, Homo Sapiens
KPESKVAKL

SEQ ID NO: 107410 - protein, 9 aa, Homo Sapiens
KPESKYVSL

SEQ ID NO: 107411 - protein, 9 aa, Homo Sapiens
KPEVPREKL

SEQ ID NO: 107412 - protein, 9 aa, Homo Sapiens
KPEYGRPNV

SEQ ID NO: 107413 - protein, 9 aa, Homo Sapiens
KPFAEVRIL

SEQ ID NO: 107414 - protein, 9 aa, Homo Sapiens
KPFAGRPMI

SEQ ID NO: 107415 - protein, 9 aa, Homo Sapiens
KPFYVNVEF

SEQ ID NO: 107416 - protein, 9 aa, Homo Sapiens
KPGDFIHTL

SEQ ID NO: 107417 - protein, 9 aa, Homo Sapiens
KPGPVGPEL

SEQ ID NO: 107418 - protein, 9 aa, Homo Sapiens
KPGTFPKAL

SEQ ID NO: 107419 - protein, 9 aa, Homo Sapiens
KPGVSSKKF

SEQ ID NO: 107420 - protein, 9 aa, Homo Sapiens
KPHLITHGF

SEQ ID NO: 107421 - protein, 9 aa, Homo Sapiens
KPHNPGFGM

SEQ ID NO: 107422 - protein, 9 aa, Homo Sapiens
KPHSGFHVA

SEQ ID NO: 107423 - protein, 9 aa, Homo Sapiens
KPHVLPAVL

SEQ ID NO: 107424 - protein, 9 aa, Homo Sapiens
KPIEPRREL

SEQ ID NO: 107425 - protein, 9 aa, Homo Sapiens
KPILSTRSL

SEQ ID NO: 107426 - protein, 9 aa, Homo Sapiens
KPINFSVIL

SEQ ID NO: 107427 - protein, 9 aa, Homo Sapiens
KPIPSKPQL

SEQ ID NO: 107428 - protein, 9 aa, Homo Sapiens
KPIQPKPTV

SEQ ID NO: 107429 - protein, 9 aa, Homo Sapiens
KPIQRTILM

SEQ ID NO: 107430 - protein, 9 aa, Homo Sapiens
KPKAPPPSL

SEQ ID NO: 107431 - protein, 9 aa, Homo Sapiens
KPKEPASCL

SEQ ID NO: 107432 - protein, 9 aa, Homo Sapiens
KPKEPITDV

SEQ ID NO: 107433 - protein, 9 aa, Homo Sapiens
KPKEPQPEV

SEQ ID NO: 107434 - protein, 9 aa, Homo Sapiens
KPKFILSVL

SEQ ID NO: 107435 - protein, 9 aa, Homo Sapiens
KPKGKVTIL

SEQ ID NO: 107436 - protein, 9 aa, Homo Sapiens
KPKHQPYKL

SEQ ID NO: 107437 - protein, 9 aa, Homo Sapiens
KPKIATANL

SEQ ID NO: 107438 - protein, 9 aa, Homo Sapiens
KPKIQHVGL

SEQ ID NO: 107439 - protein, 9 aa, Homo Sapiens
KPKITPVTV

SEQ ID NO: 107440 - protein, 9 aa, Homo Sapiens
KPKKGIQFL

SEQ ID NO: 107441 - protein, 9 aa, Homo Sapiens
KPKMNYEKL

SEQ ID NO: 107442 - protein, 9 aa, Homo Sapiens
KPKNAIHTF

SEQ ID NO: 107443 - protein, 9 aa, Homo Sapiens
KPKNIVEKI

SEQ ID NO: 107444 - protein, 9 aa, Homo Sapiens
KPKNTIAIF

SEQ ID NO: 107445 - protein, 9 aa, Homo Sapiens
KPKPEDPKF

SEQ ID NO: 107446 - protein, 9 aa, Homo Sapiens
KPKPGNMPF

SEQ ID NO: 107447 - protein, 9 aa, Homo Sapiens
KPKPIDVQV

SEQ ID NO: 107448 - protein, 9 aa, Homo Sapiens
KPKPIGKLA

SEQ ID NO: 107449 - protein, 9 aa, Homo Sapiens
KPKPKKPTL

SEQ ID NO: 107450 - protein, 9 aa, Homo Sapiens
KPKPPEPSW

SEQ ID NO: 107451 - protein, 9 aa, Homo Sapiens
KPKPQINQW

SEQ ID NO: 107452 - protein, 9 aa, Homo Sapiens
KPKRSTWRF

SEQ ID NO: 107453 - protein, 9 aa, Homo Sapiens
KPKSLWKSV

SEQ ID NO: 107454 - protein, 9 aa, Homo Sapiens
KPKSSLPAV

SEQ ID NO: 107455 - protein, 9 aa, Homo Sapiens
KPKTFQAYL

SEQ ID NO: 107456 - protein, 9 aa, Homo Sapiens
KPKTGRSLL

SEQ ID NO: 107457 - protein, 9 aa, Homo Sapiens
KPKTTEPTF

SEQ ID NO: 107458 - protein, 9 aa, Homo Sapiens
KPLEPVSTV

SEQ ID NO: 107459 - protein, 9 aa, Homo Sapiens
KPLGIKTAL

SEQ ID NO: 107460 - protein, 9 aa, Homo Sapiens
KPLSIPKRL

SEQ ID NO: 107461 - protein, 9 aa, Homo Sapiens
KPLSNMKIL

SEQ ID NO: 107462 - protein, 9 aa, Homo Sapiens
KPMEGWIAV

SEQ ID NO: 107463 - protein, 9 aa, Homo Sapiens
KPMEKLLGL

SEQ ID NO: 107464 - protein, 9 aa, Homo Sapiens
KPMKSVLVV

SEQ ID NO: 107465 - protein, 9 aa, Homo Sapiens
KPMLNNNSF

SEQ ID NO: 107466 - protein, 9 aa, Homo Sapiens
KPMMKEFRF

SEQ ID NO: 107467 - protein, 9 aa, Homo Sapiens
KPNANRIAL

SEQ ID NO: 107468 - protein, 9 aa, Homo Sapiens
KPNGATPVF

SEQ ID NO: 107469 - protein, 9 aa, Homo Sapiens
KPNHTLVLL

SEQ ID NO: 107470 - protein, 9 aa, Homo Sapiens
KPPALSKGL

SEQ ID NO: 107471 - protein, 9 aa, Homo Sapiens
KPPKPVSKM

SEQ ID NO: 107472 - protein, 9 aa, Homo Sapiens
KPPPPPPAP

SEQ ID NO: 107473 - protein, 9 aa, Homo Sapiens
KPPPSKEEL

SEQ ID NO: 107474 - protein, 9 aa, Homo Sapiens
KPPSPGTVL

SEQ ID NO: 107475 - protein, 9 aa, Homo Sapiens
KPQDYKKRL

SEQ ID NO: 107476 - protein, 9 aa, Homo Sapiens
KPQGPRGFL

SEQ ID NO: 107477 - protein, 9 aa, Homo Sapiens
KPQHVFSVL

SEQ ID NO: 107478 - protein, 9 aa, Homo Sapiens
KPQHVTETF

SEQ ID NO: 107479 - protein, 9 aa, Homo Sapiens
KPQPRPQTL

SEQ ID NO: 107480 - protein, 9 aa, Homo Sapiens
KPQVDRYRL

SEQ ID NO: 107481 - protein, 9 aa, Homo Sapiens
KPRDSSVEV

SEQ ID NO: 107482 - protein, 9 aa, Homo Sapiens
KPRGFARGL

SEQ ID NO: 107483 - protein, 9 aa, Homo Sapiens
KPRGLFITI

SEQ ID NO: 107484 - protein, 9 aa, Homo Sapiens
KPRKLVNTI

SEQ ID NO: 107485 - protein, 9 aa, Homo Sapiens
KPRKPITFV

SEQ ID NO: 107486 - protein, 9 aa, Homo Sapiens
KPRPIIPML

SEQ ID NO: 107487 - protein, 9 aa, Homo Sapiens
KPRPPLHLL

SEQ ID NO: 107488 - protein, 9 aa, Homo Sapiens
KPRPPPSQL

SEQ ID NO: 107489 - protein, 9 aa, Homo Sapiens
KPRPVSQLV

SEQ ID NO: 107490 - protein, 9 aa, Homo Sapiens
KPRSPDHVL

SEQ ID NO: 107491 - protein, 9 aa, Homo Sapiens
KPRSPPRAL

SEQ ID NO: 107492 - protein, 9 aa, Homo Sapiens
KPRVTPVEV

SEQ ID NO: 107493 - protein, 9 aa, Homo Sapiens
KPSATGKVI

SEQ ID NO: 107494 - protein, 9 aa, Homo Sapiens
KPSFARTVL

SEQ ID NO: 107495 - protein, 9 aa, Homo Sapiens
KPSGVSAAL

SEQ ID NO: 107496 - protein, 9 aa, Homo Sapiens
KPSLPFTSL

SEQ ID NO: 107497 - protein, 9 aa, Homo Sapiens
KPSSTTPRL

SEQ ID NO: 107498 - protein, 9 aa, Homo Sapiens
KPSVVYRFF

SEQ ID NO: 107499 - protein, 9 aa, Homo Sapiens
KPTDKLRAL

SEQ ID NO: 107500 - protein, 9 aa, Homo Sapiens
KPTGTPKAL

SEQ ID NO: 107501 - protein, 9 aa, Homo Sapiens
KPTHVVVTL

SEQ ID NO: 107502 - protein, 9 aa, Homo Sapiens
KPTSKDQVL

SEQ ID NO: 107503 - protein, 9 aa, Homo Sapiens
KPVEKNYAF

SEQ ID NO: 107504 - protein, 9 aa, Homo Sapiens
KPVFLPRNL

SEQ ID NO: 107505 - protein, 9 aa, Homo Sapiens
KPVIPAAAL

SEQ ID NO: 107506 - protein, 9 aa, Homo Sapiens
KPVKPHSSF

SEQ ID NO: 107507 - protein, 9 aa, Homo Sapiens
KPVSLGQAL

SEQ ID NO: 107508 - protein, 9 aa, Homo Sapiens
KPVYPGQTL

SEQ ID NO: 107509 - protein, 9 aa, Homo Sapiens
KPWEKSPIL

SEQ ID NO: 107510 - protein, 9 aa, Homo Sapiens
KPYAFDRVF

SEQ ID NO: 107511 - protein, 9 aa, Homo Sapiens
KPYCRKDFL

SEQ ID NO: 107512 - protein, 9 aa, Homo Sapiens
KPYEGRPSF

SEQ ID NO: 107513 - protein, 9 aa, Homo Sapiens
KPYLPSRAL

SEQ ID NO: 107514 - protein, 9 aa, Homo Sapiens
KPYQGNPTF

SEQ ID NO: 107515 - protein, 9 aa, Homo Sapiens
KPYSGGLCL

SEQ ID NO: 107516 - protein, 9 aa, Homo Sapiens
KSKNPGEAL

SEQ ID NO: 107517 - protein, 9 aa, Homo Sapiens
KTKDPTAAL

SEQ ID NO: 107518 - protein, 9 aa, Homo Sapiens
KVHSLQSSL

SEQ ID NO: 107519 - protein, 9 aa, Homo Sapiens
KVKAEGPGL

SEQ ID NO: 107520 - protein, 9 aa, Homo Sapiens
KVKAFIVTL

SEQ ID NO: 107521 - protein, 9 aa, Homo Sapiens
KVKASGPGL

SEQ ID NO: 107522 - protein, 9 aa, Homo Sapiens
KVKEFCENL

SEQ ID NO: 107523 - protein, 9 aa, Homo Sapiens
KVKEFFEKL

SEQ ID NO: 107524 - protein, 9 aa, Homo Sapiens
KVKEKFQQL

SEQ ID NO: 107525 - protein, 9 aa, Homo Sapiens
KVKNSLLSL

SEQ ID NO: 107526 - protein, 9 aa, Homo Sapiens
KVKNVGIFL

SEQ ID NO: 107527 - protein, 9 aa, Homo Sapiens
KVKQLFNSL

SEQ ID NO: 107528 - protein, 9 aa, Homo Sapiens
KVKSILNSL

SEQ ID NO: 107529 - protein, 9 aa, Homo Sapiens
KVKSYIHEV

SEQ ID NO: 107530 - protein, 9 aa, Homo Sapiens
KVRDHMVTL

SEQ ID NO: 107531 - protein, 9 aa, Homo Sapiens
KVRVPRQSL

SEQ ID NO: 107532 - protein, 9 aa, Homo Sapiens
KVSGVLKKL

SEQ ID NO: 107533 - protein, 9 aa, Homo Sapiens
KVSYVIKKL

SEQ ID NO: 107534 - protein, 9 aa, Homo Sapiens
LAKNFFNEL

SEQ ID NO: 107535 - protein, 9 aa, Homo Sapiens
LAKPPVVSV

SEQ ID NO: 107536 - protein, 9 aa, Homo Sapiens
LAKTQGNVF

SEQ ID NO: 107537 - protein, 9 aa, Homo Sapiens
LANKDRPAL

SEQ ID NO: 107538 - protein, 9 aa, Homo Sapiens
LARPASAAL

SEQ ID NO: 107539 - protein, 9 aa, Homo Sapiens
LAYLQRIAL

SEQ ID NO: 107540 - protein, 9 aa, Homo Sapiens
LDPVLQNPL

SEQ ID NO: 107541 - protein, 9 aa, Homo Sapiens
LIKEGGVQL

SEQ ID NO: 107542 - protein, 9 aa, Homo Sapiens
LKERDFEIK

SEQ ID NO: 107543 - protein, 9 aa, Homo Sapiens
LLKDSIVQL

SEQ ID NO: 107544 - protein, 9 aa, Homo Sapiens
LPAAPASSL

SEQ ID NO: 107545 - protein, 9 aa, Homo Sapiens
LPAEFFEVL

SEQ ID NO: 107546 - protein, 9 aa, Homo Sapiens
LPAEGVKEL

SEQ ID NO: 107547 - protein, 9 aa, Homo Sapiens
LPAEQHPVL

SEQ ID NO: 107548 - protein, 9 aa, Homo Sapiens
LPAEVKEQI

SEQ ID NO: 107549 - protein, 9 aa, Homo Sapiens
LPAGIVAVL

SEQ ID NO: 107550 - protein, 9 aa, Homo Sapiens
LPAGSRVEL

SEQ ID NO: 107551 - protein, 9 aa, Homo Sapiens
LPAKFKKLL

SEQ ID NO: 107552 - protein, 9 aa, Homo Sapiens
LPAKILVEF

SEQ ID NO: 107553 - protein, 9 aa, Homo Sapiens
LPALPLAEL

SEQ ID NO: 107554 - protein, 9 aa, Homo Sapiens
LPALPTQAL

SEQ ID NO: 107555 - protein, 9 aa, Homo Sapiens
LPALRSIGL

SEQ ID NO: 107556 - protein, 9 aa, Homo Sapiens
LPAPKGPAL

SEQ ID NO: 107557 - protein, 9 aa, Homo Sapiens
LPAPPHIDV

SEQ ID NO: 107558 - protein, 9 aa, Homo Sapiens
LPAPPKIYF

SEQ ID NO: 107559 - protein, 9 aa, Homo Sapiens
LPAPPTQNM

SEQ ID NO: 107560 - protein, 9 aa, Homo Sapiens
LPARFYQAL

SEQ ID NO: 107561 - protein, 9 aa, Homo Sapiens
LPASGQIAL

SEQ ID NO: 107562 - protein, 9 aa, Homo Sapiens
LPASIPHVI

SEQ ID NO: 107563 - protein, 9 aa, Homo Sapiens
LPASPRARL

SEQ ID NO: 107564 - protein, 9 aa, Homo Sapiens
LPASVHPQL

SEQ ID NO: 107565 - protein, 9 aa, Homo Sapiens
LPATATMSL

SEQ ID NO: 107566 - protein, 9 aa, Homo Sapiens
LPATEKPVL

SEQ ID NO: 107567 - protein, 9 aa, Homo Sapiens
LPAWPHRGL

SEQ ID NO: 107568 - protein, 9 aa, Homo Sapiens
LPCPGKATL

SEQ ID NO: 107569 - protein, 9 aa, Homo Sapiens
LPDERTISL

SEQ ID NO: 107570 - protein, 9 aa, Homo Sapiens
LPDGQVITI

SEQ ID NO: 107571 - protein, 9 aa, Homo Sapiens
LPEAKKPRL

SEQ ID NO: 107572 - protein, 9 aa, Homo Sapiens
LPEDVGHCF

SEQ ID NO: 107573 - protein, 9 aa, Homo Sapiens
LPEEFMKTL

SEQ ID NO: 107574 - protein, 9 aa, Homo Sapiens
LPEEPVSQL

SEQ ID NO: 107575 - protein, 9 aa, Homo Sapiens
LPEKKGNTL

SEQ ID NO: 107576 - protein, 9 aa, Homo Sapiens
LPEKNRQML

SEQ ID NO: 107577 - protein, 9 aa, Homo Sapiens
LPFCKGDVL

SEQ ID NO: 107578 - protein, 9 aa, Homo Sapiens
LPFKKGEIL

SEQ ID NO: 107579 - protein, 9 aa, Homo Sapiens
LPFLRITSL

SEQ ID NO: 107580 - protein, 9 aa, Homo Sapiens
LPFPPGVPT

SEQ ID NO: 107581 - protein, 9 aa, Homo Sapiens
LPGELFHVV

SEQ ID NO: 107582 - protein, 9 aa, Homo Sapiens
LPHAPGVQM

SEQ ID NO: 107583 - protein, 9 aa, Homo Sapiens
LPHDIRWEL

SEQ ID NO: 107584 - protein, 9 aa, Homo Sapiens
LPHHRVIEV

SEQ ID NO: 107585 - protein, 9 aa, Homo Sapiens
LPHLPSLEI

SEQ ID NO: 107586 - protein, 9 aa, Homo Sapiens
LPHNRLVSL

SEQ ID NO: 107587 - protein, 9 aa, Homo Sapiens
LPHSATVTL

SEQ ID NO: 107588 - protein, 9 aa, Homo Sapiens
LPIAASSSL

SEQ ID NO: 107589 - protein, 9 aa, Homo Sapiens
LPIDCSPAL

SEQ ID NO: 107590 - protein, 9 aa, Homo Sapiens
LPIFHKNVF

SEQ ID NO: 107591 - protein, 9 aa, Homo Sapiens
LPKAKLITL

SEQ ID NO: 107592 - protein, 9 aa, Homo Sapiens
LPKAPGLEH

SEQ ID NO: 107593 - protein, 9 aa, Homo Sapiens
LPKARPMSL

SEQ ID NO: 107594 - protein, 9 aa, Homo Sapiens
LPKATILDL

SEQ ID NO: 107595 - protein, 9 aa, Homo Sapiens
LPKDAVKHL

SEQ ID NO: 107596 - protein, 9 aa, Homo Sapiens
LPKDKPRYL

SEQ ID NO: 107597 - protein, 9 aa, Homo Sapiens
LPKDQGITL

SEQ ID NO: 107598 - protein, 9 aa, Homo Sapiens
LPKEDPTAV

SEQ ID NO: 107599 - protein, 9 aa, Homo Sapiens
LPKEGIFAV

SEQ ID NO: 107600 - protein, 9 aa, Homo Sapiens
LPKEHAASL

SEQ ID NO: 107601 - protein, 9 aa, Homo Sapiens
LPKEKQPVA

SEQ ID NO: 107602 - protein, 9 aa, Homo Sapiens
LPKEKRHVL

SEQ ID NO: 107603 - protein, 9 aa, Homo Sapiens
LPKEPQGII

SEQ ID NO: 107604 - protein, 9 aa, Homo Sapiens
LPKESVKIL

SEQ ID NO: 107605 - protein, 9 aa, Homo Sapiens
LPKGKALEL

SEQ ID NO: 107606 - protein, 9 aa, Homo Sapiens
LPKGVVLKL

SEQ ID NO: 107607 - protein, 9 aa, Homo Sapiens
LPKHLLHSV

SEQ ID NO: 107608 - protein, 9 aa, Homo Sapiens
LPKKDIIKF

SEQ ID NO: 107609 - protein, 9 aa, Homo Sapiens
LPKKFIATI

SEQ ID NO: 107610 - protein, 9 aa, Homo Sapiens
LPKKGVTSI

SEQ ID NO: 107611 - protein, 9 aa, Homo Sapiens
LPKKNGLYL

SEQ ID NO: 107612 - protein, 9 aa, Homo Sapiens
LPKKPCKNL

SEQ ID NO: 107613 - protein, 9 aa, Homo Sapiens
LPKLGVHKV

SEQ ID NO: 107614 - protein, 9 aa, Homo Sapiens
LPKLHIVKV

SEQ ID NO: 107615 - protein, 9 aa, Homo Sapiens
LPKLHIVQV

SEQ ID NO: 107616 - protein, 9 aa, Homo Sapiens
LPKLPMNLL

SEQ ID NO: 107617 - protein, 9 aa, Homo Sapiens
LPKNPDLRI

SEQ ID NO: 107618 - protein, 9 aa, Homo Sapiens
LPKPFFRLL

SEQ ID NO: 107619 - protein, 9 aa, Homo Sapiens
LPKPKAKTL

SEQ ID NO: 107620 - protein, 9 aa, Homo Sapiens
LPKPPFGML

SEQ ID NO: 107621 - protein, 9 aa, Homo Sapiens
LPKPPGRGV

SEQ ID NO: 107622 - protein, 9 aa, Homo Sapiens
LPKPPKPVS

SEQ ID NO: 107623 - protein, 9 aa, Homo Sapiens
LPKPSSHGL

SEQ ID NO: 107624 - protein, 9 aa, Homo Sapiens
LPKPTEPPM

SEQ ID NO: 107625 - protein, 9 aa, Homo Sapiens
LPKQPPLAL

SEQ ID NO: 107626 - protein, 9 aa, Homo Sapiens
LPKQPPLML

SEQ ID NO: 107627 - protein, 9 aa, Homo Sapiens
LPKSIYSQI

SEQ ID NO: 107628 - protein, 9 aa, Homo Sapiens
LPKSPNPSF

SEQ ID NO: 107629 - protein, 9 aa, Homo Sapiens
LPKSTVNGV

SEQ ID NO: 107630 - protein, 9 aa, Homo Sapiens
LPKSVQNKL

SEQ ID NO: 107631 - protein, 9 aa, Homo Sapiens
LPKTCDISF

SEQ ID NO: 107632 - protein, 9 aa, Homo Sapiens
LPKTGTVSL

SEQ ID NO: 107633 - protein, 9 aa, Homo Sapiens
LPKTGVSQL

SEQ ID NO: 107634 - protein, 9 aa, Homo Sapiens
LPKTHIEQI

SEQ ID NO: 107635 - protein, 9 aa, Homo Sapiens
LPKTTALEL

SEQ ID NO: 107636 - protein, 9 aa, Homo Sapiens
LPKVQSIQL

SEQ ID NO: 107637 - protein, 9 aa, Homo Sapiens
LPLAHVLEL

SEQ ID NO: 107638 - protein, 9 aa, Homo Sapiens
LPLHKVKSL

SEQ ID NO: 107639 - protein, 9 aa, Homo Sapiens
LPLLSPVTF

SEQ ID NO: 107640 - protein, 9 aa, Homo Sapiens
LPNAKIKEL

SEQ ID NO: 107641 - protein, 9 aa, Homo Sapiens
LPNDVISSL

SEQ ID NO: 107642 - protein, 9 aa, Homo Sapiens
LPNEQTKTL

SEQ ID NO: 107643 - protein, 9 aa, Homo Sapiens
LPNGMIVTL

SEQ ID NO: 107644 - protein, 9 aa, Homo Sapiens
LPNNMIHQV

SEQ ID NO: 107645 - protein, 9 aa, Homo Sapiens
LPNQVLKSI

SEQ ID NO: 107646 - protein, 9 aa, Homo Sapiens
LPNVPSIAL

SEQ ID NO: 107647 - protein, 9 aa, Homo Sapiens
LPPDEIKEL

SEQ ID NO: 107648 - protein, 9 aa, Homo Sapiens
LPPGKIVAL

SEQ ID NO: 107649 - protein, 9 aa, Homo Sapiens
LPPMTPKTM

SEQ ID NO: 107650 - protein, 9 aa, Homo Sapiens
LPPPAAKTV

SEQ ID NO: 107651 - protein, 9 aa, Homo Sapiens
LPPPPHPSV

SEQ ID NO: 107652 - protein, 9 aa, Homo Sapiens
LPPPPPHAL

SEQ ID NO: 107653 - protein, 9 aa, Homo Sapiens
LPPSVANEL

SEQ ID NO: 107654 - protein, 9 aa, Homo Sapiens
LPQANRDTL

SEQ ID NO: 107655 - protein, 9 aa, Homo Sapiens
LPQEDLEAL

SEQ ID NO: 107656 - protein, 9 aa, Homo Sapiens
LPQEQKAKI

SEQ ID NO: 107657 - protein, 9 aa, Homo Sapiens
LPQGIVPAL

SEQ ID NO: 107658 - protein, 9 aa, Homo Sapiens
LPQGIVREL

SEQ ID NO: 107659 - protein, 9 aa, Homo Sapiens
LPQKPHLKL

SEQ ID NO: 107660 - protein, 9 aa, Homo Sapiens
LPQLAQPTL

SEQ ID NO: 107661 - protein, 9 aa, Homo Sapiens
LPQLTGPVL

SEQ ID NO: 107662 - protein, 9 aa, Homo Sapiens
LPQNEPKTL

SEQ ID NO: 107663 - protein, 9 aa, Homo Sapiens
LPQPDKKGL

SEQ ID NO: 107664 - protein, 9 aa, Homo Sapiens
LPQPPRDVL

SEQ ID NO: 107665 - protein, 9 aa, Homo Sapiens
LPRFQPRVL

SEQ ID NO: 107666 - protein, 9 aa, Homo Sapiens
LPRGKGIRL

SEQ ID NO: 107667 - protein, 9 aa, Homo Sapiens
LPRGSSRLL

SEQ ID NO: 107668 - protein, 9 aa, Homo Sapiens
LPRKQGSIL

SEQ ID NO: 107669 - protein, 9 aa, Homo Sapiens
LPRNAQVAL

SEQ ID NO: 107670 - protein, 9 aa, Homo Sapiens
LPRPPPPEM

SEQ ID NO: 107671 - protein, 9 aa, Homo Sapiens
LPRPVPQNL

SEQ ID NO: 107672 - protein, 9 aa, Homo Sapiens
LPRQPPMSL

SEQ ID NO: 107673 - protein, 9 aa, Homo Sapiens
LPRREGYEF

SEQ ID NO: 107674 - protein, 9 aa, Homo Sapiens
LPRRPLPPA

SEQ ID NO: 107675 - protein, 9 aa, Homo Sapiens
LPRRPLRAF

SEQ ID NO: 107676 - protein, 9 aa, Homo Sapiens
LPSAPGVVL

SEQ ID NO: 107677 - protein, 9 aa, Homo Sapiens
LPSEHQTIL

SEQ ID NO: 107678 - protein, 9 aa, Homo Sapiens
LPSESMKVV

SEQ ID NO: 107679 - protein, 9 aa, Homo Sapiens
LPSGSKKVI

SEQ ID NO: 107680 - protein, 9 aa, Homo Sapiens
LPSGVTRVV

SEQ ID NO: 107681 - protein, 9 aa, Homo Sapiens
LPSKPSSTL

SEQ ID NO: 107682 - protein, 9 aa, Homo Sapiens
LPSLPTAEL

SEQ ID NO: 107683 - protein, 9 aa, Homo Sapiens
LPSMPEPAL

SEQ ID NO: 107684 - protein, 9 aa, Homo Sapiens
LPSPFLRAL

SEQ ID NO: 107685 - protein, 9 aa, Homo Sapiens
LPSPPAVAV

SEQ ID NO: 107686 - protein, 9 aa, Homo Sapiens
LPSQKTASL

SEQ ID NO: 107687 - protein, 9 aa, Homo Sapiens
LPSQLAHRL

SEQ ID NO: 107688 - protein, 9 aa, Homo Sapiens
LPSQMGSVL

SEQ ID NO: 107689 - protein, 9 aa, Homo Sapiens
LPSQVSRVV

SEQ ID NO: 107690 - protein, 9 aa, Homo Sapiens
LPSRKLVAL

SEQ ID NO: 107691 - protein, 9 aa, Homo Sapiens
LPSSGRSSL

SEQ ID NO: 107692 - protein, 9 aa, Homo Sapiens
LPSSIMRNL

SEQ ID NO: 107693 - protein, 9 aa, Homo Sapiens
LPSSIYRLL

SEQ ID NO: 107694 - protein, 9 aa, Homo Sapiens
LPSSVISAI

SEQ ID NO: 107695 - protein, 9 aa, Homo Sapiens
LPSSVLHII

SEQ ID NO: 107696 - protein, 9 aa, Homo Sapiens
LPSTVKQAV

SEQ ID NO: 107697 - protein, 9 aa, Homo Sapiens
LPSWGRAEL

SEQ ID NO: 107698 - protein, 9 aa, Homo Sapiens
LPTDTLQEL

SEQ ID NO: 107699 - protein, 9 aa, Homo Sapiens
LPTPVVKTT

SEQ ID NO: 107700 - protein, 9 aa, Homo Sapiens
LPTSFVKEI

SEQ ID NO: 107701 - protein, 9 aa, Homo Sapiens
LPTSPGPAL

SEQ ID NO: 107702 - protein, 9 aa, Homo Sapiens
LPWASTHSL

SEQ ID NO: 107703 - protein, 9 aa, Homo Sapiens
LPWGGGTAL

SEQ ID NO: 107704 - protein, 9 aa, Homo Sapiens
LPWKRIVAV

SEQ ID NO: 107705 - protein, 9 aa, Homo Sapiens
LPWPARPAL

SEQ ID NO: 107706 - protein, 9 aa, Homo Sapiens
LPYAGDVSM

SEQ ID NO: 107707 - protein, 9 aa, Homo Sapiens
LPYCPGKTL

SEQ ID NO: 107708 - protein, 9 aa, Homo Sapiens
LPYGREDVL

SEQ ID NO: 107709 - protein, 9 aa, Homo Sapiens
LPYKAGLSL

SEQ ID NO: 107710 - protein, 9 aa, Homo Sapiens
LPYRRSVPT

SEQ ID NO: 107711 - protein, 9 aa, Homo Sapiens
LPYSVGRVL

SEQ ID NO: 107712 - protein, 9 aa, Homo Sapiens
LPYVSVTSL

SEQ ID NO: 107713 - protein, 9 aa, Homo Sapiens
LSKAAGPEL

SEQ ID NO: 107714 - protein, 9 aa, Homo Sapiens
LTPMLAPAL

SEQ ID NO: 107715 - protein, 9 aa, Homo Sapiens
LVKDALRQL

SEQ ID NO: 107716 - protein, 9 aa, Homo Sapiens
LVKDVFISA

SEQ ID NO: 107717 - protein, 9 aa, Homo Sapiens
LVKEYIIQL

SEQ ID NO: 107718 - protein, 9 aa, Homo Sapiens
LVKKYMNSL

SEQ ID NO: 107719 - protein, 9 aa, Homo Sapiens
LVKPEVWTL

SEQ ID NO: 107720 - protein, 9 aa, Homo Sapiens
LVKPVTINV

SEQ ID NO: 107721 - protein, 9 aa, Homo Sapiens
LVKSVDPTL

SEQ ID NO: 107722 - protein, 9 aa, Homo Sapiens
LVKVPDPQM

SEQ ID NO: 107723 - protein, 9 aa, Homo Sapiens
LVMAPRTVL

SEQ ID NO: 107724 - protein, 9 aa, Homo Sapiens
LVQENRPTL

SEQ ID NO: 107725 - protein, 9 aa, Homo Sapiens
LVRDVVSSL

SEQ ID NO: 107726 - protein, 9 aa, Homo Sapiens
LVRPPASSL

SEQ ID NO: 107727 - protein, 9 aa, Homo Sapiens
MAPLKMLAL

SEQ ID NO: 107728 - protein, 9 aa, Homo Sapiens
MIKGVTLGF

SEQ ID NO: 107729 - protein, 9 aa, Homo Sapiens
MIQNSRPSL

SEQ ID NO: 107730 - protein, 9 aa, Homo Sapiens
MIRAAPPPL

SEQ ID NO: 107731 - protein, 9 aa, Homo Sapiens
MPAAKKQKL

SEQ ID NO: 107732 - protein, 9 aa, Homo Sapiens
MPACAASSL

SEQ ID NO: 107733 - protein, 9 aa, Homo Sapiens
MPADSGYPA

SEQ ID NO: 107734 - protein, 9 aa, Homo Sapiens
MPADTNKAF

SEQ ID NO: 107735 - protein, 9 aa, Homo Sapiens
MPAFLRSAL

SEQ ID NO: 107736 - protein, 9 aa, Homo Sapiens
MPALRSINL

SEQ ID NO: 107737 - protein, 9 aa, Homo Sapiens
MPANSGLAL

SEQ ID NO: 107738 - protein, 9 aa, Homo Sapiens
MPEEPKLTL

SEQ ID NO: 107739 - protein, 9 aa, Homo Sapiens
MPEKPTTTV

SEQ ID NO: 107740 - protein, 9 aa, Homo Sapiens
MPEPASRCL

SEQ ID NO: 107741 - protein, 9 aa, Homo Sapiens
MPEPTVLSL

SEQ ID NO: 107742 - protein, 9 aa, Homo Sapiens
MPFGNVISA

SEQ ID NO: 107743 - protein, 9 aa, Homo Sapiens
MPFGNVVSA

SEQ ID NO: 107744 - protein, 9 aa, Homo Sapiens
MPFYNPAQL

SEQ ID NO: 107745 - protein, 9 aa, Homo Sapiens
MPGKTAIEL

SEQ ID NO: 107746 - protein, 9 aa, Homo Sapiens
MPHEKHYTL

SEQ ID NO: 107747 - protein, 9 aa, Homo Sapiens
MPHHTPHQL

SEQ ID NO: 107748 - protein, 9 aa, Homo Sapiens
MPHSSSAKL

SEQ ID NO: 107749 - protein, 9 aa, Homo Sapiens
MPHVPITTL

SEQ ID NO: 107750 - protein, 9 aa, Homo Sapiens
MPIQGQPCF

SEQ ID NO: 107751 - protein, 9 aa, Homo Sapiens
MPISSHVDL

SEQ ID NO: 107752 - protein, 9 aa, Homo Sapiens
MPKAEKNAV

SEQ ID NO: 107753 - protein, 9 aa, Homo Sapiens
MPKFSMPGF

SEQ ID NO: 107754 - protein, 9 aa, Homo Sapiens
MPKFSMPSL

SEQ ID NO: 107755 - protein, 9 aa, Homo Sapiens
MPKFSVPGF

SEQ ID NO: 107756 - protein, 9 aa, Homo Sapiens
MPKFSVSGL

SEQ ID NO: 107757 - protein, 9 aa, Homo Sapiens
MPKISMPGF

SEQ ID NO: 107758 - protein, 9 aa, Homo Sapiens
MPKKDARTL

SEQ ID NO: 107759 - protein, 9 aa, Homo Sapiens
MPKKDPVKI

SEQ ID NO: 107760 - protein, 9 aa, Homo Sapiens
MPKKNRIAI

SEQ ID NO: 107761 - protein, 9 aa, Homo Sapiens
MPKKSIKKL

SEQ ID NO: 107762 - protein, 9 aa, Homo Sapiens
MPKKSSVVL

SEQ ID NO: 107763 - protein, 9 aa, Homo Sapiens
MPKLKPVEL

SEQ ID NO: 107764 - protein, 9 aa, Homo Sapiens
MPKMDQDSL

SEQ ID NO: 107765 - protein, 9 aa, Homo Sapiens
MPKMKMPKF

SEQ ID NO: 107766 - protein, 9 aa, Homo Sapiens
MPKMKMPTF

SEQ ID NO: 107767 - protein, 9 aa, Homo Sapiens
MPKPNHDTL

SEQ ID NO: 107768 - protein, 9 aa, Homo Sapiens
MPKPPNLIM

SEQ ID NO: 107769 - protein, 9 aa, Homo Sapiens
MPKVKMPKF

SEQ ID NO: 107770 - protein, 9 aa, Homo Sapiens
MPKVKTIEL

SEQ ID NO: 107771 - protein, 9 aa, Homo Sapiens
MPKVSGPDL

SEQ ID NO: 107772 - protein, 9 aa, Homo Sapiens
MPLGTIHCI

SEQ ID NO: 107773 - protein, 9 aa, Homo Sapiens
MPLLKSEVA

SEQ ID NO: 107774 - protein, 9 aa, Homo Sapiens
MPLPGTKAL

SEQ ID NO: 107775 - protein, 9 aa, Homo Sapiens
MPLSTIREV

SEQ ID NO: 107776 - protein, 9 aa, Homo Sapiens
MPMERQMSV

SEQ ID NO: 107777 - protein, 9 aa, Homo Sapiens
MPNENIPEL

SEQ ID NO: 107778 - protein, 9 aa, Homo Sapiens
MPNGTVQRF

SEQ ID NO: 107779 - protein, 9 aa, Homo Sapiens
MPNSPAPHF

SEQ ID NO: 107780 - protein, 9 aa, Homo Sapiens
MPNVAPAAI

SEQ ID NO: 107781 - protein, 9 aa, Homo Sapiens
MPPFQRKTL

SEQ ID NO: 107782 - protein, 9 aa, Homo Sapiens
MPPLQPKHM

SEQ ID NO: 107783 - protein, 9 aa, Homo Sapiens
MPPPINPIL

SEQ ID NO: 107784 - protein, 9 aa, Homo Sapiens
MPPPVGMVA

SEQ ID NO: 107785 - protein, 9 aa, Homo Sapiens
MPQDLRSPA

SEQ ID NO: 107786 - protein, 9 aa, Homo Sapiens
MPQDLSEAL

SEQ ID NO: 107787 - protein, 9 aa, Homo Sapiens
MPQHIMAIL

SEQ ID NO: 107788 - protein, 9 aa, Homo Sapiens
MPQIPVASV

SEQ ID NO: 107789 - protein, 9 aa, Homo Sapiens
MPQKERESI

SEQ ID NO: 107790 - protein, 9 aa, Homo Sapiens
MPRHFAAKL

SEQ ID NO: 107791 - protein, 9 aa, Homo Sapiens
MPRHFATKL

SEQ ID NO: 107792 - protein, 9 aa, Homo Sapiens
MPRHNLHKI

SEQ ID NO: 107793 - protein, 9 aa, Homo Sapiens
MPRNLREYM

SEQ ID NO: 107794 - protein, 9 aa, Homo Sapiens
MPRPLPYHL

SEQ ID NO: 107795 - protein, 9 aa, Homo Sapiens
MPRPPETFL

SEQ ID NO: 107796 - protein, 9 aa, Homo Sapiens
MPSDVLEVT

SEQ ID NO: 107797 - protein, 9 aa, Homo Sapiens
MPSPVSPKL

SEQ ID NO: 107798 - protein, 9 aa, Homo Sapiens
MPSQFRDIL

SEQ ID NO: 107799 - protein, 9 aa, Homo Sapiens
MPSSAVRVL

SEQ ID NO: 107800 - protein, 9 aa, Homo Sapiens
MPSSRAYGL

SEQ ID NO: 107801 - protein, 9 aa, Homo Sapiens
MPSVFQNVL

SEQ ID NO: 107802 - protein, 9 aa, Homo Sapiens
MPTGGGKSL

SEQ ID NO: 107803 - protein, 9 aa, Homo Sapiens
MPTIPALAL

SEQ ID NO: 107804 - protein, 9 aa, Homo Sapiens
MPTIQITAL

SEQ ID NO: 107805 - protein, 9 aa, Homo Sapiens
MPTLPPPSV

SEQ ID NO: 107806 - protein, 9 aa, Homo Sapiens
MPTMRLLSF

SEQ ID NO: 107807 - protein, 9 aa, Homo Sapiens
MPTPVIKAF

SEQ ID NO: 107808 - protein, 9 aa, Homo Sapiens
MPTRPHQHL

SEQ ID NO: 107809 - protein, 9 aa, Homo Sapiens
MPVEKNITL

SEQ ID NO: 107810 - protein, 9 aa, Homo Sapiens
MPWFKGWKV

SEQ ID NO: 107811 - protein, 9 aa, Homo Sapiens
MPYHIQRTI

SEQ ID NO: 107812 - protein, 9 aa, Homo Sapiens
MPYLSHQQL

SEQ ID NO: 107813 - protein, 9 aa, Homo Sapiens
MPYTRPVKF

SEQ ID NO: 107814 - protein, 9 aa, Homo Sapiens
MTKPPVQEM

SEQ ID NO: 107815 - protein, 9 aa, Homo Sapiens
MTQQPRPVL

SEQ ID NO: 107816 - protein, 9 aa, Homo Sapiens
NAKDFFRVL

SEQ ID NO: 107817 - protein, 9 aa, Homo Sapiens
NIKAHIHML

SEQ ID NO: 107818 - protein, 9 aa, Homo Sapiens
NLKAHVVAV

SEQ ID NO: 107819 - protein, 9 aa, Homo Sapiens
NPAENFRVL

SEQ ID NO: 107820 - protein, 9 aa, Homo Sapiens
NPAPPIDAV

SEQ ID NO: 107821 - protein, 9 aa, Homo Sapiens
NPASKVIAL

SEQ ID NO: 107822 - protein, 9 aa, Homo Sapiens
NPEKRYNVL

SEQ ID NO: 107823 - protein, 9 aa, Homo Sapiens
NPEVRRAVL

SEQ ID NO: 107824 - protein, 9 aa, Homo Sapiens
NPHDRVVAL

SEQ ID NO: 107825 - protein, 9 aa, Homo Sapiens
NPHEPWNRL

SEQ ID NO: 107826 - protein, 9 aa, Homo Sapiens
NPHGARLSL

SEQ ID NO: 107827 - protein, 9 aa, Homo Sapiens
NPIPTHLSL

SEQ ID NO: 107828 - protein, 9 aa, Homo Sapiens
NPISTVTEL

SEQ ID NO: 107829 - protein, 9 aa, Homo Sapiens
NPKEAGQRL

SEQ ID NO: 107830 - protein, 9 aa, Homo Sapiens
NPKEFFWNV

SEQ ID NO: 107831 - protein, 9 aa, Homo Sapiens
NPKEFYHEV

SEQ ID NO: 107832 - protein, 9 aa, Homo Sapiens
NPKESSSSL

SEQ ID NO: 107833 - protein, 9 aa, Homo Sapiens
NPKFNDPHV

SEQ ID NO: 107834 - protein, 9 aa, Homo Sapiens
NPKGRIWTM

SEQ ID NO: 107835 - protein, 9 aa, Homo Sapiens
NPKIAVSKM

SEQ ID NO: 107836 - protein, 9 aa, Homo Sapiens
NPKKPITEI

SEQ ID NO: 107837 - protein, 9 aa, Homo Sapiens
NPKKPNANL

SEQ ID NO: 107838 - protein, 9 aa, Homo Sapiens
NPKNPGLWL

SEQ ID NO: 107839 - protein, 9 aa, Homo Sapiens
NPKNQSETL

SEQ ID NO: 107840 - protein, 9 aa, Homo Sapiens
NPKNVNRVL

SEQ ID NO: 107841 - protein, 9 aa, Homo Sapiens
NPKPASPRF

SEQ ID NO: 107842 - protein, 9 aa, Homo Sapiens
NPKPKFFVL

SEQ ID NO: 107843 - protein, 9 aa, Homo Sapiens
NPKRQTLVF

SEQ ID NO: 107844 - protein, 9 aa, Homo Sapiens
NPKSHILSI

SEQ ID NO: 107845 - protein, 9 aa, Homo Sapiens
NPKSLTTSL

SEQ ID NO: 107846 - protein, 9 aa, Homo Sapiens
NPKSSFWKL

SEQ ID NO: 107847 - protein, 9 aa, Homo Sapiens
NPKVQVEAI

SEQ ID NO: 107848 - protein, 9 aa, Homo Sapiens
NPLPSKETI

SEQ ID NO: 107849 - protein, 9 aa, Homo Sapiens
NPNHRTPTL

SEQ ID NO: 107850 - protein, 9 aa, Homo Sapiens
NPNKTQPIL

SEQ ID NO: 107851 - protein, 9 aa, Homo Sapiens
NPNLRKNVL

SEQ ID NO: 107852 - protein, 9 aa, Homo Sapiens
NPNLSGHLL

SEQ ID NO: 107853 - protein, 9 aa, Homo Sapiens
NPPDICQVV

SEQ ID NO: 107854 - protein, 9 aa, Homo Sapiens
NPPPIIKYL

SEQ ID NO: 107855 - protein, 9 aa, Homo Sapiens
NPQERTLTL

SEQ ID NO: 107856 - protein, 9 aa, Homo Sapiens
NPQEVGPLL

SEQ ID NO: 107857 - protein, 9 aa, Homo Sapiens
NPQKEKVRL

SEQ ID NO: 107858 - protein, 9 aa, Homo Sapiens
NPRIPYTEL

SEQ ID NO: 107859 - protein, 9 aa, Homo Sapiens
NPRKHITSL

SEQ ID NO: 107860 - protein, 9 aa, Homo Sapiens
NPRKYLRSV

SEQ ID NO: 107861 - protein, 9 aa, Homo Sapiens
NPRPTAQDL

SEQ ID NO: 107862 - protein, 9 aa, Homo Sapiens
NPRQAAYEM

SEQ ID NO: 107863 - protein, 9 aa, Homo Sapiens
NPRQINWTV

SEQ ID NO: 107864 - protein, 9 aa, Homo Sapiens
NPRQVFNLL

SEQ ID NO: 107865 - protein, 9 aa, Homo Sapiens
NPSSVIHVV

SEQ ID NO: 107866 - protein, 9 aa, Homo Sapiens
NPTATVKML

SEQ ID NO: 107867 - protein, 9 aa, Homo Sapiens
NPTWKRFSV

SEQ ID NO: 107868 - protein, 9 aa, Homo Sapiens
NPWKREVKL

SEQ ID NO: 107869 - protein, 9 aa, Homo Sapiens
NPYFENKVL

SEQ ID NO: 107870 - protein, 9 aa, Homo Sapiens
NPYFRNEGL

SEQ ID NO: 107871 - protein, 9 aa, Homo Sapiens
NPYIPHPGM

SEQ ID NO: 107872 - protein, 9 aa, Homo Sapiens
NVKNIIIAL

SEQ ID NO: 107873 - protein, 9 aa, Homo Sapiens
PASSKPISI

SEQ ID NO: 107874 - protein, 9 aa, Homo Sapiens
PAYHSSLMD

SEQ ID NO: 107875 - protein, 9 aa, Homo Sapiens
PDRSHPKLL

SEQ ID NO: 107876 - protein, 9 aa, Homo Sapiens
PKPGAGSKL

SEQ ID NO: 107877 - protein, 9 aa, Homo Sapiens
PKPGGAHSL

SEQ ID NO: 107878 - protein, 9 aa, Homo Sapiens
PKPSSRPSL

SEQ ID NO: 107879 - protein, 9 aa, Homo Sapiens
PKRIAKAVN

SEQ ID NO: 107880 - protein, 9 aa, Homo Sapiens
PKYGVKVGL

SEQ ID NO: 107881 - protein, 9 aa, Homo Sapiens
PLYKDSWLL

SEQ ID NO: 107882 - protein, 9 aa, Homo Sapiens
PPLPKRPAL

SEQ ID NO: 107883 - protein, 9 aa, Homo Sapiens
PPNHVGKPL

SEQ ID NO: 107884 - protein, 9 aa, Homo Sapiens
PREKKISIL

SEQ ID NO: 107885 - protein, 9 aa, Homo Sapiens
PSEERVREI

SEQ ID NO: 107886 - protein, 9 aa, Homo Sapiens
PSESTVVST

SEQ ID NO: 107887 - protein, 9 aa, Homo Sapiens
PSIVHRKCF

SEQ ID NO: 107888 - protein, 9 aa, Homo Sapiens
PSRTLFPSL

SEQ ID NO: 107889 - protein, 9 aa, Homo Sapiens
PSSKLIRIL

SEQ ID NO: 107890 - protein, 9 aa, Homo Sapiens
QAIKNGQAL

SEQ ID NO: 107891 - protein, 9 aa, Homo Sapiens
QAQPTKPAL

SEQ ID NO: 107892 - protein, 9 aa, Homo Sapiens
QAQTDRVSL

SEQ ID NO: 107893 - protein, 9 aa, Homo Sapiens
QAVKIGQSL

SEQ ID NO: 107894 - protein, 9 aa, Homo Sapiens
QIKPVNPVF

SEQ ID NO: 107895 - protein, 9 aa, Homo Sapiens
QISEVKPVL

SEQ ID NO: 107896 - protein, 9 aa, Homo Sapiens
QLKMPVRAL

SEQ ID NO: 107897 - protein, 9 aa, Homo Sapiens
QLQEERPEL

SEQ ID NO: 107898 - protein, 9 aa, Homo Sapiens
QPACKRLTL

SEQ ID NO: 107899 - protein, 9 aa, Homo Sapiens
QPAEMAAEL

SEQ ID NO: 107900 - protein, 9 aa, Homo Sapiens
QPAERHQLL

SEQ ID NO: 107901 - protein, 9 aa, Homo Sapiens
QPAGHRPAL

SEQ ID NO: 107902 - protein, 9 aa, Homo Sapiens
QPAPISPHL

SEQ ID NO: 107903 - protein, 9 aa, Homo Sapiens
QPASFAVSL

SEQ ID NO: 107904 - protein, 9 aa, Homo Sapiens
QPDPESVVL

SEQ ID NO: 107905 - protein, 9 aa, Homo Sapiens
QPFHREDQL

SEQ ID NO: 107906 - protein, 9 aa, Homo Sapiens
QPFSKGDRL

SEQ ID NO: 107907 - protein, 9 aa, Homo Sapiens
QPGRPLRVV

SEQ ID NO: 107908 - protein, 9 aa, Homo Sapiens
QPGSTVHVL

SEQ ID NO: 107909 - protein, 9 aa, Homo Sapiens
QPHLSRQDL

SEQ ID NO: 107910 - protein, 9 aa, Homo Sapiens
QPHRVSQVL

SEQ ID NO: 107911 - protein, 9 aa, Homo Sapiens
QPHTILRVV

SEQ ID NO: 107912 - protein, 9 aa, Homo Sapiens
QPITPGPSI

SEQ ID NO: 107913 - protein, 9 aa, Homo Sapiens
QPKLPITVL

SEQ ID NO: 107914 - protein, 9 aa, Homo Sapiens
QPKLPMRTL

SEQ ID NO: 107915 - protein, 9 aa, Homo Sapiens
QPKQRGFRF

SEQ ID NO: 107916 - protein, 9 aa, Homo Sapiens
QPKQRGMRF

SEQ ID NO: 107917 - protein, 9 aa, Homo Sapiens
QPKRHREFL

SEQ ID NO: 107918 - protein, 9 aa, Homo Sapiens
QPKVSTPVV

SEQ ID NO: 107919 - protein, 9 aa, Homo Sapiens
QPLARPNTL

SEQ ID NO: 107920 - protein, 9 aa, Homo Sapiens
QPLKAKTSL

SEQ ID NO: 107921 - protein, 9 aa, Homo Sapiens
QPMDIHVEL

SEQ ID NO: 107922 - protein, 9 aa, Homo Sapiens
QPNKPSKEL

SEQ ID NO: 107923 - protein, 9 aa, Homo Sapiens
QPNTTGKQL

SEQ ID NO: 107924 - protein, 9 aa, Homo Sapiens
QPPELGRPL

SEQ ID NO: 107925 - protein, 9 aa, Homo Sapiens
QPPGPGQEL

SEQ ID NO: 107926 - protein, 9 aa, Homo Sapiens
QPPGPVKEM

SEQ ID NO: 107927 - protein, 9 aa, Homo Sapiens
QPPKPLSSL

SEQ ID NO: 107928 - protein, 9 aa, Homo Sapiens
QPPYHLKAF

SEQ ID NO: 107929 - protein, 9 aa, Homo Sapiens
QPQAKIIVL

SEQ ID NO: 107930 - protein, 9 aa, Homo Sapiens
QPQDRNQAL

SEQ ID NO: 107931 - protein, 9 aa, Homo Sapiens
QPQFQRQGL

SEQ ID NO: 107932 - protein, 9 aa, Homo Sapiens
QPQHAFNAL

SEQ ID NO: 107933 - protein, 9 aa, Homo Sapiens
QPQPKHIKL

SEQ ID NO: 107934 - protein, 9 aa, Homo Sapiens
QPQPQPYAV

SEQ ID NO: 107935 - protein, 9 aa, Homo Sapiens
QPQSHETAL

SEQ ID NO: 107936 - protein, 9 aa, Homo Sapiens
QPRIQNPKF

SEQ ID NO: 107937 - protein, 9 aa, Homo Sapiens
QPRYPVNSV

SEQ ID NO: 107938 - protein, 9 aa, Homo Sapiens
QPSEVLRTV

SEQ ID NO: 107939 - protein, 9 aa, Homo Sapiens
QPSPMQHQF

SEQ ID NO: 107940 - protein, 9 aa, Homo Sapiens
QPTFTEHLL

SEQ ID NO: 107941 - protein, 9 aa, Homo Sapiens
QPTIERVAL

SEQ ID NO: 107942 - protein, 9 aa, Homo Sapiens
QPTVRITEL

SEQ ID NO: 107943 - protein, 9 aa, Homo Sapiens
QPVAGRPSL

SEQ ID NO: 107944 - protein, 9 aa, Homo Sapiens
QPVARPVSV

SEQ ID NO: 107945 - protein, 9 aa, Homo Sapiens
QPYNSRPAV

SEQ ID NO: 107946 - protein, 9 aa, Homo Sapiens
QPYRRPLNF

SEQ ID NO: 107947 - protein, 9 aa, Homo Sapiens
QPYSKDSPF

SEQ ID NO: 107948 - protein, 9 aa, Homo Sapiens
QVKEMNPAL

SEQ ID NO: 107949 - protein, 9 aa, Homo Sapiens
QVKYPVNSL

SEQ ID NO: 107950 - protein, 9 aa, Homo Sapiens
QVQGPRPVL

SEQ ID NO: 107951 - protein, 9 aa, Homo Sapiens
QVRPVTEKL

SEQ ID NO: 107952 - protein, 9 aa, Homo Sapiens
RAAPHRISL

SEQ ID NO: 107953 - protein, 9 aa, Homo Sapiens
RAARGAPPL

SEQ ID NO: 107954 - protein, 9 aa, Homo Sapiens
RAKEIRLSL

SEQ ID NO: 107955 - protein, 9 aa, Homo Sapiens
RAKELFHEL

SEQ ID NO: 107956 - protein, 9 aa, Homo Sapiens
RAKKPDPGL

SEQ ID NO: 107957 - protein, 9 aa, Homo Sapiens
RAKPDFKEL

SEQ ID NO: 107958 - protein, 9 aa, Homo Sapiens
RIKDTVQKL

SEQ ID NO: 107959 - protein, 9 aa, Homo Sapiens
RIKLGIKSL

SEQ ID NO: 107960 - protein, 9 aa, Homo Sapiens
RIKLYSESL

SEQ ID NO: 107961 - protein, 9 aa, Homo Sapiens
RIKNNDPKL

SEQ ID NO: 107962 - protein, 9 aa, Homo Sapiens
RLKAFKVAL

SEQ ID NO: 107963 - protein, 9 aa, Homo Sapiens
RLKPPSNVV

SEQ ID NO: 107964 - protein, 9 aa, Homo Sapiens
RLRNHMAVA

SEQ ID NO: 107965 - protein, 9 aa, Homo Sapiens
RPAANPIQF

SEQ ID NO: 107966 - protein, 9 aa, Homo Sapiens
RPADYLFML

SEQ ID NO: 107967 - protein, 9 aa, Homo Sapiens
RPAERLDYL

SEQ ID NO: 107968 - protein, 9 aa, Homo Sapiens
RPAFFAERL

SEQ ID NO: 107969 - protein, 9 aa, Homo Sapiens
RPAFPVKKL

SEQ ID NO: 107970 - protein, 9 aa, Homo Sapiens
RPALFANLF

SEQ ID NO: 107971 - protein, 9 aa, Homo Sapiens
RPALPRSEL

SEQ ID NO: 107972 - protein, 9 aa, Homo Sapiens
RPAPARPTM

SEQ ID NO: 107973 - protein, 9 aa, Homo Sapiens
RPAPLSAEL

SEQ ID NO: 107974 - protein, 9 aa, Homo Sapiens
RPAPPAQSL

SEQ ID NO: 107975 - protein, 9 aa, Homo Sapiens
RPAPPPEAL

SEQ ID NO: 107976 - protein, 9 aa, Homo Sapiens
RPAPPREEI

SEQ ID NO: 107977 - protein, 9 aa, Homo Sapiens
RPAPVAVAA

SEQ ID NO: 107978 - protein, 9 aa, Homo Sapiens
RPAQKHWVL

SEQ ID NO: 107979 - protein, 9 aa, Homo Sapiens
RPAQLHIGF

SEQ ID NO: 107980 - protein, 9 aa, Homo Sapiens
RPAQVSQPF

SEQ ID NO: 107981 - protein, 9 aa, Homo Sapiens
RPAVIGDVL

SEQ ID NO: 107982 - protein, 9 aa, Homo Sapiens
RPAYRKVFL

SEQ ID NO: 107983 - protein, 9 aa, Homo Sapiens
RPCDISRQL

SEQ ID NO: 107984 - protein, 9 aa, Homo Sapiens
RPDLRMAAI

SEQ ID NO: 107985 - protein, 9 aa, Homo Sapiens
RPDTLDPAL

SEQ ID NO: 107986 - protein, 9 aa, Homo Sapiens
RPEEGRPVV

SEQ ID NO: 107987 - protein, 9 aa, Homo Sapiens
RPEKAQPSL

SEQ ID NO: 107988 - protein, 9 aa, Homo Sapiens
RPENRSFYL

SEQ ID NO: 107989 - protein, 9 aa, Homo Sapiens
RPENYREAL

SEQ ID NO: 107990 - protein, 9 aa, Homo Sapiens
RPEQRLALL

SEQ ID NO: 107991 - protein, 9 aa, Homo Sapiens
RPFDKLEQL

SEQ ID NO: 107992 - protein, 9 aa, Homo Sapiens
RPFEDQTSL

SEQ ID NO: 107993 - protein, 9 aa, Homo Sapiens
RPFERTITM

SEQ ID NO: 107994 - protein, 9 aa, Homo Sapiens
RPFGTIRPM

SEQ ID NO: 107995 - protein, 9 aa, Homo Sapiens
RPFHGWTSL

SEQ ID NO: 107996 - protein, 9 aa, Homo Sapiens
RPFLRPNII

SEQ ID NO: 107997 - protein, 9 aa, Homo Sapiens
RPFPKLRIL

SEQ ID NO: 107998 - protein, 9 aa, Homo Sapiens
RPFPPHIQL

SEQ ID NO: 107999 - protein, 9 aa, Homo Sapiens
RPFWREEHI

SEQ ID NO: 108000 - protein, 9 aa, Homo Sapiens
RPGDLHVVL

SEQ ID NO: 108001 - protein, 9 aa, Homo Sapiens
RPGHKPSIL

SEQ ID NO: 108002 - protein, 9 aa, Homo Sapiens
RPGLEGYAL

SEQ ID NO: 108003 - protein, 9 aa, Homo Sapiens
RPGLLNSKL

SEQ ID NO: 108004 - protein, 9 aa, Homo Sapiens
RPGLVSETL

SEQ ID NO: 108005 - protein, 9 aa, Homo Sapiens
RPGPVLPAV

SEQ ID NO: 108006 - protein, 9 aa, Homo Sapiens
RPGRADPRF

SEQ ID NO: 108007 - protein, 9 aa, Homo Sapiens
RPGYCYTAL

SEQ ID NO: 108008 - protein, 9 aa, Homo Sapiens
RPHAFQVIL

SEQ ID NO: 108009 - protein, 9 aa, Homo Sapiens
RPHAPGRPA

SEQ ID NO: 108010 - protein, 9 aa, Homo Sapiens
RPHGRTVRL

SEQ ID NO: 108011 - protein, 9 aa, Homo Sapiens
RPHHKILDM

SEQ ID NO: 108012 - protein, 9 aa, Homo Sapiens
RPHIPISKL

SEQ ID NO: 108013 - protein, 9 aa, Homo Sapiens
RPHKPGLYL

SEQ ID NO: 108014 - protein, 9 aa, Homo Sapiens
RPHMFPKML

SEQ ID NO: 108015 - protein, 9 aa, Homo Sapiens
RPHPKPKQF

SEQ ID NO: 108016 - protein, 9 aa, Homo Sapiens
RPHRGILAV

SEQ ID NO: 108017 - protein, 9 aa, Homo Sapiens
RPHSSLREL

SEQ ID NO: 108018 - protein, 9 aa, Homo Sapiens
RPHTNETSL

SEQ ID NO: 108019 - protein, 9 aa, Homo Sapiens
RPHTVLTVI

SEQ ID NO: 108020 - protein, 9 aa, Homo Sapiens
RPHVAQPTL

SEQ ID NO: 108021 - protein, 9 aa, Homo Sapiens
RPHVTWCKL

SEQ ID NO: 108022 - protein, 9 aa, Homo Sapiens
RPHYSLRTL

SEQ ID NO: 108023 - protein, 9 aa, Homo Sapiens
RPIASGPVV

SEQ ID NO: 108024 - protein, 9 aa, Homo Sapiens
RPIDILEML

SEQ ID NO: 108025 - protein, 9 aa, Homo Sapiens
RPILIIVTL

SEQ ID NO: 108026 - protein, 9 aa, Homo Sapiens
RPILTIITL

SEQ ID NO: 108027 - protein, 9 aa, Homo Sapiens
RPINALDEL

SEQ ID NO: 108028 - protein, 9 aa, Homo Sapiens
RPIQPIAGL

SEQ ID NO: 108029 - protein, 9 aa, Homo Sapiens
RPITDSPVL

SEQ ID NO: 108030 - protein, 9 aa, Homo Sapiens
RPKALTQVL

SEQ ID NO: 108031 - protein, 9 aa, Homo Sapiens
RPKDFLSKF

SEQ ID NO: 108032 - protein, 9 aa, Homo Sapiens
RPKDPNNLL

SEQ ID NO: 108033 - protein, 9 aa, Homo Sapiens
RPKDYANTL

SEQ ID NO: 108034 - protein, 9 aa, Homo Sapiens
RPKEGTSTL

SEQ ID NO: 108035 - protein, 9 aa, Homo Sapiens
RPKEKRVTL

SEQ ID NO: 108036 - protein, 9 aa, Homo Sapiens
RPKEKSLVL

SEQ ID NO: 108037 - protein, 9 aa, Homo Sapiens
RPKELVEVI

SEQ ID NO: 108038 - protein, 9 aa, Homo Sapiens
RPKESMYSW

SEQ ID NO: 108039 - protein, 9 aa, Homo Sapiens
RPKEYTVRF

SEQ ID NO: 108040 - protein, 9 aa, Homo Sapiens
RPKFEQVNL

SEQ ID NO: 108041 - protein, 9 aa, Homo Sapiens
RPKGFYVET

SEQ ID NO: 108042 - protein, 9 aa, Homo Sapiens
RPKGLGVFF

SEQ ID NO: 108043 - protein, 9 aa, Homo Sapiens
RPKIKVSLI

SEQ ID NO: 108044 - protein, 9 aa, Homo Sapiens
RPKKPGQSF

SEQ ID NO: 108045 - protein, 9 aa, Homo Sapiens
RPKLIGEEL

SEQ ID NO: 108046 - protein, 9 aa, Homo Sapiens
RPKLNRENF

SEQ ID NO: 108047 - protein, 9 aa, Homo Sapiens
RPKLPDNEV

SEQ ID NO: 108048 - protein, 9 aa, Homo Sapiens
RPKLPLLKI

SEQ ID NO: 108049 - protein, 9 aa, Homo Sapiens
RPKLSSPAL

SEQ ID NO: 108050 - protein, 9 aa, Homo Sapiens
RPKLYIVNL

SEQ ID NO: 108051 - protein, 9 aa, Homo Sapiens
RPKMPGRRL

SEQ ID NO: 108052 - protein, 9 aa, Homo Sapiens
RPKMQEVVA

SEQ ID NO: 108053 - protein, 9 aa, Homo Sapiens
RPKNLMQTL

SEQ ID NO: 108054 - protein, 9 aa, Homo Sapiens
RPKNSLFKF

SEQ ID NO: 108055 - protein, 9 aa, Homo Sapiens
RPKNVVLRL

SEQ ID NO: 108056 - protein, 9 aa, Homo Sapiens
RPKPDYFAV

SEQ ID NO: 108057 - protein, 9 aa, Homo Sapiens
RPKPESQGI

SEQ ID NO: 108058 - protein, 9 aa, Homo Sapiens
RPKPIITSV

SEQ ID NO: 108059 - protein, 9 aa, Homo Sapiens
RPKPKIIQT

SEQ ID NO: 108060 - protein, 9 aa, Homo Sapiens
RPKPPNVRT

SEQ ID NO: 108061 - protein, 9 aa, Homo Sapiens
RPKSAFKVQ

SEQ ID NO: 108062 - protein, 9 aa, Homo Sapiens
RPKSNIVLL

SEQ ID NO: 108063 - protein, 9 aa, Homo Sapiens
RPKSYIYRT

SEQ ID NO: 108064 - protein, 9 aa, Homo Sapiens
RPKTFGMDM

SEQ ID NO: 108065 - protein, 9 aa, Homo Sapiens
RPKTGVRGL

SEQ ID NO: 108066 - protein, 9 aa, Homo Sapiens
RPKTPFKAW

SEQ ID NO: 108067 - protein, 9 aa, Homo Sapiens
RPKTPPVVI

SEQ ID NO: 108068 - protein, 9 aa, Homo Sapiens
RPKTVRDTL

SEQ ID NO: 108069 - protein, 9 aa, Homo Sapiens
RPKVPVLQL

SEQ ID NO: 108070 - protein, 9 aa, Homo Sapiens
RPKYAGYSF

SEQ ID NO: 108071 - protein, 9 aa, Homo Sapiens
RPKYPGIKF

SEQ ID NO: 108072 - protein, 9 aa, Homo Sapiens
RPKYQFLSL

SEQ ID NO: 108073 - protein, 9 aa, Homo Sapiens
RPLGKAASL

SEQ ID NO: 108074 - protein, 9 aa, Homo Sapiens
RPLKGRINL

SEQ ID NO: 108075 - protein, 9 aa, Homo Sapiens
RPLLKAITA

SEQ ID NO: 108076 - protein, 9 aa, Homo Sapiens
RPLPAQDLF

SEQ ID NO: 108077 - protein, 9 aa, Homo Sapiens
RPLPPPDTL

SEQ ID NO: 108078 - protein, 9 aa, Homo Sapiens
RPLSKTVRF

SEQ ID NO: 108079 - protein, 9 aa, Homo Sapiens
RPLTSPESL

SEQ ID NO: 108080 - protein, 9 aa, Homo Sapiens
RPLVKPKIV

SEQ ID NO: 108081 - protein, 9 aa, Homo Sapiens
RPLVVIHEL

SEQ ID NO: 108082 - protein, 9 aa, Homo Sapiens
RPLYKNIVL

SEQ ID NO: 108083 - protein, 9 aa, Homo Sapiens
RPMGAGEAL

SEQ ID NO: 108084 - protein, 9 aa, Homo Sapiens
RPMKVGHVT

SEQ ID NO: 108085 - protein, 9 aa, Homo Sapiens
RPMNENVQM

SEQ ID NO: 108086 - protein, 9 aa, Homo Sapiens
RPMQQVDTL

SEQ ID NO: 108087 - protein, 9 aa, Homo Sapiens
RPMYSKPSI

SEQ ID NO: 108088 - protein, 9 aa, Homo Sapiens
RPNDIMAEV

SEQ ID NO: 108089 - protein, 9 aa, Homo Sapiens
RPNDIYVNM

SEQ ID NO: 108090 - protein, 9 aa, Homo Sapiens
RPNFNIKGI

SEQ ID NO: 108091 - protein, 9 aa, Homo Sapiens
RPNGVITGL

SEQ ID NO: 108092 - protein, 9 aa, Homo Sapiens
RPNNAYTAM

SEQ ID NO: 108093 - protein, 9 aa, Homo Sapiens
RPNPGFSML

SEQ ID NO: 108094 - protein, 9 aa, Homo Sapiens
RPNPILARL

SEQ ID NO: 108095 - protein, 9 aa, Homo Sapiens
RPNPITVIL

SEQ ID NO: 108096 - protein, 9 aa, Homo Sapiens
RPNPPPVSV

SEQ ID NO: 108097 - protein, 9 aa, Homo Sapiens
RPNSIDPAL

SEQ ID NO: 108098 - protein, 9 aa, Homo Sapiens
RPPDPGPTL

SEQ ID NO: 108099 - protein, 9 aa, Homo Sapiens
RPPDTKATL

SEQ ID NO: 108100 - protein, 9 aa, Homo Sapiens
RPPGSIKAL

SEQ ID NO: 108101 - protein, 9 aa, Homo Sapiens
RPPLKKYSF

SEQ ID NO: 108102 - protein, 9 aa, Homo Sapiens
RPPLNPVSA

SEQ ID NO: 108103 - protein, 9 aa, Homo Sapiens
RPPNIVLIF

SEQ ID NO: 108104 - protein, 9 aa, Homo Sapiens
RPPPIGAEV

SEQ ID NO: 108105 - protein, 9 aa, Homo Sapiens
RPPPVGHSF

SEQ ID NO: 108106 - protein, 9 aa, Homo Sapiens
RPPQRQVVL

SEQ ID NO: 108107 - protein, 9 aa, Homo Sapiens
RPPSVGDVF

SEQ ID NO: 108108 - protein, 9 aa, Homo Sapiens
RPQDDYSVL

SEQ ID NO: 108109 - protein, 9 aa, Homo Sapiens
RPQDGVAVL

SEQ ID NO: 108110 - protein, 9 aa, Homo Sapiens
RPQDQTVVF

SEQ ID NO: 108111 - protein, 9 aa, Homo Sapiens
RPQEVSAYL

SEQ ID NO: 108112 - protein, 9 aa, Homo Sapiens
RPQIHGYDL

SEQ ID NO: 108113 - protein, 9 aa, Homo Sapiens
RPQKVCSFL

SEQ ID NO: 108114 - protein, 9 aa, Homo Sapiens
RPQLKGVVL

SEQ ID NO: 108115 - protein, 9 aa, Homo Sapiens
RPQLLKNAL

SEQ ID NO: 108116 - protein, 9 aa, Homo Sapiens
RPQLQRQVL

SEQ ID NO: 108117 - protein, 9 aa, Homo Sapiens
RPQLRSVLL

SEQ ID NO: 108118 - protein, 9 aa, Homo Sapiens
RPQPQTLQL

SEQ ID NO: 108119 - protein, 9 aa, Homo Sapiens
RPQPVLPLL

SEQ ID NO: 108120 - protein, 9 aa, Homo Sapiens
RPQVAKTLL

SEQ ID NO: 108121 - protein, 9 aa, Homo Sapiens
RPQVKSLGM

SEQ ID NO: 108122 - protein, 9 aa, Homo Sapiens
RPRAPIIAV

SEQ ID NO: 108123 - protein, 9 aa, Homo Sapiens
RPRDALPRL

SEQ ID NO: 108124 - protein, 9 aa, Homo Sapiens
RPRDPTPSF

SEQ ID NO: 108125 - protein, 9 aa, Homo Sapiens
RPRDYTVNL

SEQ ID NO: 108126 - protein, 9 aa, Homo Sapiens
RPREAEVRF

SEQ ID NO: 108127 - protein, 9 aa, Homo Sapiens
RPREEVRAL

SEQ ID NO: 108128 - protein, 9 aa, Homo Sapiens
RPREKKLGL

SEQ ID NO: 108129 - protein, 9 aa, Homo Sapiens
RPREVTVSL

SEQ ID NO: 108130 - protein, 9 aa, Homo Sapiens
RPRGPGLEF

SEQ ID NO: 108131 - protein, 9 aa, Homo Sapiens
RPRHQGVMV

SEQ ID NO: 108132 - protein, 9 aa, Homo Sapiens
RPRLALNVM

SEQ ID NO: 108133 - protein, 9 aa, Homo Sapiens
RPRLGATCL

SEQ ID NO: 108134 - protein, 9 aa, Homo Sapiens
RPRNALLLL

SEQ ID NO: 108135 - protein, 9 aa, Homo Sapiens
RPRPGNILL

SEQ ID NO: 108136 - protein, 9 aa, Homo Sapiens
RPRPPARSL

SEQ ID NO: 108137 - protein, 9 aa, Homo Sapiens
RPRPPITLL

SEQ ID NO: 108138 - protein, 9 aa, Homo Sapiens
RPRPPQKAL

SEQ ID NO: 108139 - protein, 9 aa, Homo Sapiens
RPRPPVLSV

SEQ ID NO: 108140 - protein, 9 aa, Homo Sapiens
RPRPSEDTF

SEQ ID NO: 108141 - protein, 9 aa, Homo Sapiens
RPRPTEATV

SEQ ID NO: 108142 - protein, 9 aa, Homo Sapiens
RPRPTWEEV

SEQ ID NO: 108143 - protein, 9 aa, Homo Sapiens
RPRPVLRSV

SEQ ID NO: 108144 - protein, 9 aa, Homo Sapiens
RPRQQDPHL

SEQ ID NO: 108145 - protein, 9 aa, Homo Sapiens
RPRTPPEAI

SEQ ID NO: 108146 - protein, 9 aa, Homo Sapiens
RPSAAGINL

SEQ ID NO: 108147 - protein, 9 aa, Homo Sapiens
RPSGPGPEL

SEQ ID NO: 108148 - protein, 9 aa, Homo Sapiens
RPSGPSKAL

SEQ ID NO: 108149 - protein, 9 aa, Homo Sapiens
RPSLRLQLL

SEQ ID NO: 108150 - protein, 9 aa, Homo Sapiens
RPSPPVQSV

SEQ ID NO: 108151 - protein, 9 aa, Homo Sapiens
RPSQFPHSL

SEQ ID NO: 108152 - protein, 9 aa, Homo Sapiens
RPSQLGQVF

SEQ ID NO: 108153 - protein, 9 aa, Homo Sapiens
RPSQVVAET

SEQ ID NO: 108154 - protein, 9 aa, Homo Sapiens
RPSTTVRVH

SEQ ID NO: 108155 - protein, 9 aa, Homo Sapiens
RPSVGVQSL

SEQ ID NO: 108156 - protein, 9 aa, Homo Sapiens
RPTDVAISF

SEQ ID NO: 108157 - protein, 9 aa, Homo Sapiens
RPTFFARKF

SEQ ID NO: 108158 - protein, 9 aa, Homo Sapiens
RPTLPVKSL

SEQ ID NO: 108159 - protein, 9 aa, Homo Sapiens
RPVPPPPSL

SEQ ID NO: 108160 - protein, 9 aa, Homo Sapiens
RPVQKLIRL

SEQ ID NO: 108161 - protein, 9 aa, Homo Sapiens
RPWLRPAAL

SEQ ID NO: 108162 - protein, 9 aa, Homo Sapiens
RPWSNSRGL

SEQ ID NO: 108163 - protein, 9 aa, Homo Sapiens
RPWTVMESL

SEQ ID NO: 108164 - protein, 9 aa, Homo Sapiens
RPYEPINSI

SEQ ID NO: 108165 - protein, 9 aa, Homo Sapiens
RPYQPLGAL

SEQ ID NO: 108166 - protein, 9 aa, Homo Sapiens
RPYSQVNVL

SEQ ID NO: 108167 - protein, 9 aa, Homo Sapiens
RPYYPRKAL

SEQ ID NO: 108168 - protein, 9 aa, Homo Sapiens
RTKASVHTL

SEQ ID NO: 108169 - protein, 9 aa, Homo Sapiens
RVKAPNKSL

SEQ ID NO: 108170 - protein, 9 aa, Homo Sapiens
RVKEIGSTM

SEQ ID NO: 108171 - protein, 9 aa, Homo Sapiens
RVKEPVKEL

SEQ ID NO: 108172 - protein, 9 aa, Homo Sapiens
RVKKLSLSL

SEQ ID NO: 108173 - protein, 9 aa, Homo Sapiens
RVKLPSKAL

SEQ ID NO: 108174 - protein, 9 aa, Homo Sapiens
RVKPAVFDL

SEQ ID NO: 108175 - protein, 9 aa, Homo Sapiens
RVKVFNIDL

SEQ ID NO: 108176 - protein, 9 aa, Homo Sapiens
RVKYNLNSL

SEQ ID NO: 108177 - protein, 9 aa, Homo Sapiens
RVMNVHKML

SEQ ID NO: 108178 - protein, 9 aa, Homo Sapiens
RVSSHLKHL

SEQ ID NO: 108179 - protein, 9 aa, Homo Sapiens
SAKPYAHIL

SEQ ID NO: 108180 - protein, 9 aa, Homo Sapiens
SAKTPGFSV

SEQ ID NO: 108181 - protein, 9 aa, Homo Sapiens
SAPPPKKSL

SEQ ID NO: 108182 - protein, 9 aa, Homo Sapiens
SARTPGPAV

SEQ ID NO: 108183 - protein, 9 aa, Homo Sapiens
SHKEILQVI

SEQ ID NO: 108184 - protein, 9 aa, Homo Sapiens
SIKDYFLEF

SEQ ID NO: 108185 - protein, 9 aa, Homo Sapiens
SPADIVKNL

SEQ ID NO: 108186 - protein, 9 aa, Homo Sapiens
SPAFRILSV

SEQ ID NO: 108187 - protein, 9 aa, Homo Sapiens
SPAFSTRVL

SEQ ID NO: 108188 - protein, 9 aa, Homo Sapiens
SPAGKTNAL

SEQ ID NO: 108189 - protein, 9 aa, Homo Sapiens
SPAGPGLSL

SEQ ID NO: 108190 - protein, 9 aa, Homo Sapiens
SPAGPILSI

SEQ ID NO: 108191 - protein, 9 aa, Homo Sapiens
SPAGVSATL

SEQ ID NO: 108192 - protein, 9 aa, Homo Sapiens
SPAHAVDAV

SEQ ID NO: 108193 - protein, 9 aa, Homo Sapiens
SPAHPKQTL

SEQ ID NO: 108194 - protein, 9 aa, Homo Sapiens
SPALKTTRL

SEQ ID NO: 108195 - protein, 9 aa, Homo Sapiens
SPALPGLKL

SEQ ID NO: 108196 - protein, 9 aa, Homo Sapiens
SPANPAHIL

SEQ ID NO: 108197 - protein, 9 aa, Homo Sapiens
SPAPPRPSL

SEQ ID NO: 108198 - protein, 9 aa, Homo Sapiens
SPAPTHNSL

SEQ ID NO: 108199 - protein, 9 aa, Homo Sapiens
SPAPTITSL

SEQ ID NO: 108200 - protein, 9 aa, Homo Sapiens
SPAQVKTSV

SEQ ID NO: 108201 - protein, 9 aa, Homo Sapiens
SPASPKISL

SEQ ID NO: 108202 - protein, 9 aa, Homo Sapiens
SPASRSISL

SEQ ID NO: 108203 - protein, 9 aa, Homo Sapiens
SPAYRDLAA

SEQ ID NO: 108204 - protein, 9 aa, Homo Sapiens
SPCFRDVQI

SEQ ID NO: 108205 - protein, 9 aa, Homo Sapiens
SPCLHPTDL

SEQ ID NO: 108206 - protein, 9 aa, Homo Sapiens
SPCLKVFEL

SEQ ID NO: 108207 - protein, 9 aa, Homo Sapiens
SPCQDVKQL

SEQ ID NO: 108208 - protein, 9 aa, Homo Sapiens
SPCTSRPML

SEQ ID NO: 108209 - protein, 9 aa, Homo Sapiens
SPDTKKIAL

SEQ ID NO: 108210 - protein, 9 aa, Homo Sapiens
SPDTVSPSL

SEQ ID NO: 108211 - protein, 9 aa, Homo Sapiens
SPEAPKPQL

SEQ ID NO: 108212 - protein, 9 aa, Homo Sapiens
SPEAQPKTL

SEQ ID NO: 108213 - protein, 9 aa, Homo Sapiens
SPEAVGPEL

SEQ ID NO: 108214 - protein, 9 aa, Homo Sapiens
SPEAYIRCL

SEQ ID NO: 108215 - protein, 9 aa, Homo Sapiens
SPEDPGAEV

SEQ ID NO: 108216 - protein, 9 aa, Homo Sapiens
SPEDRGSSL

SEQ ID NO: 108217 - protein, 9 aa, Homo Sapiens
SPEEKQEML

SEQ ID NO: 108218 - protein, 9 aa, Homo Sapiens
SPEETRAAL

SEQ ID NO: 108219 - protein, 9 aa, Homo Sapiens
SPEPSKIML

SEQ ID NO: 108220 - protein, 9 aa, Homo Sapiens
SPEPTREQL

SEQ ID NO: 108221 - protein, 9 aa, Homo Sapiens
SPEQSRNVL

SEQ ID NO: 108222 - protein, 9 aa, Homo Sapiens
SPETRENAL

SEQ ID NO: 108223 - protein, 9 aa, Homo Sapiens
SPEVPKPAL

SEQ ID NO: 108224 - protein, 9 aa, Homo Sapiens
SPFARGNVF

SEQ ID NO: 108225 - protein, 9 aa, Homo Sapiens
SPFKRQLSL

SEQ ID NO: 108226 - protein, 9 aa, Homo Sapiens
SPFLTITSM

SEQ ID NO: 108227 - protein, 9 aa, Homo Sapiens
SPFNDRFPL

SEQ ID NO: 108228 - protein, 9 aa, Homo Sapiens
SPFPSHPSL

SEQ ID NO: 108229 - protein, 9 aa, Homo Sapiens
SPFPTSTPL

SEQ ID NO: 108230 - protein, 9 aa, Homo Sapiens
SPFSFHHVL

SEQ ID NO: 108231 - protein, 9 aa, Homo Sapiens
SPFYLKEAF

SEQ ID NO: 108232 - protein, 9 aa, Homo Sapiens
SPGDFSISV

SEQ ID NO: 108233 - protein, 9 aa, Homo Sapiens
SPGEFSVSV

SEQ ID NO: 108234 - protein, 9 aa, Homo Sapiens
SPGKGVVSL

SEQ ID NO: 108235 - protein, 9 aa, Homo Sapiens
SPGLLPHLL

SEQ ID NO: 108236 - protein, 9 aa, Homo Sapiens
SPGLRDVAL

SEQ ID NO: 108237 - protein, 9 aa, Homo Sapiens
SPGNIGKLL

SEQ ID NO: 108238 - protein, 9 aa, Homo Sapiens
SPGPEKMAL

SEQ ID NO: 108239 - protein, 9 aa, Homo Sapiens
SPGPSRPGL

SEQ ID NO: 108240 - protein, 9 aa, Homo Sapiens
SPGQRSISL

SEQ ID NO: 108241 - protein, 9 aa, Homo Sapiens
SPGSPRPAL

SEQ ID NO: 108242 - protein, 9 aa, Homo Sapiens
SPGWVRLAL

SEQ ID NO: 108243 - protein, 9 aa, Homo Sapiens
SPHATAQGL

SEQ ID NO: 108244 - protein, 9 aa, Homo Sapiens
SPHDISNVL

SEQ ID NO: 108245 - protein, 9 aa, Homo Sapiens
SPHDVSSVL

SEQ ID NO: 108246 - protein, 9 aa, Homo Sapiens
SPHFKSGSL

SEQ ID NO: 108247 - protein, 9 aa, Homo Sapiens
SPHGHILVL

SEQ ID NO: 108248 - protein, 9 aa, Homo Sapiens
SPHGPSAKF

SEQ ID NO: 108249 - protein, 9 aa, Homo Sapiens
SPHLGPAPA

SEQ ID NO: 108250 - protein, 9 aa, Homo Sapiens
SPHLQYIAF

SEQ ID NO: 108251 - protein, 9 aa, Homo Sapiens
SPHPAATAL

SEQ ID NO: 108252 - protein, 9 aa, Homo Sapiens
SPHPQPTHL

SEQ ID NO: 108253 - protein, 9 aa, Homo Sapiens
SPHSVINIF

SEQ ID NO: 108254 - protein, 9 aa, Homo Sapiens
SPIEKSGVL

SEQ ID NO: 108255 - protein, 9 aa, Homo Sapiens
SPIERNEQL

SEQ ID NO: 108256 - protein, 9 aa, Homo Sapiens
SPIERQKSL

SEQ ID NO: 108257 - protein, 9 aa, Homo Sapiens
SPIKDQPVM

SEQ ID NO: 108258 - protein, 9 aa, Homo Sapiens
SPIKRALGL

SEQ ID NO: 108259 - protein, 9 aa, Homo Sapiens
SPILVATAV

SEQ ID NO: 108260 - protein, 9 aa, Homo Sapiens
SPINRIVQI

SEQ ID NO: 108261 - protein, 9 aa, Homo Sapiens
SPISHFLDL

SEQ ID NO: 108262 - protein, 9 aa, Homo Sapiens
SPITARDAL

SEQ ID NO: 108263 - protein, 9 aa, Homo Sapiens
SPITGRSKL

SEQ ID NO: 108264 - protein, 9 aa, Homo Sapiens
SPKADVKNL

SEQ ID NO: 108265 - protein, 9 aa, Homo Sapiens
SPKDKFSYI

SEQ ID NO: 108266 - protein, 9 aa, Homo Sapiens
SPKDNPSIF

SEQ ID NO: 108267 - protein, 9 aa, Homo Sapiens
SPKDVILKV

SEQ ID NO: 108268 - protein, 9 aa, Homo Sapiens
SPKELVVVL

SEQ ID NO: 108269 - protein, 9 aa, Homo Sapiens
SPKFPIWIV

SEQ ID NO: 108270 - protein, 9 aa, Homo Sapiens
SPKFSELVM

SEQ ID NO: 108271 - protein, 9 aa, Homo Sapiens
SPKGASVSI

SEQ ID NO: 108272 - protein, 9 aa, Homo Sapiens
SPKGCGTVL

SEQ ID NO: 108273 - protein, 9 aa, Homo Sapiens
SPKGHLTRL

SEQ ID NO: 108274 - protein, 9 aa, Homo Sapiens
SPKGKFSLF

SEQ ID NO: 108275 - protein, 9 aa, Homo Sapiens
SPKGTIENI

SEQ ID NO: 108276 - protein, 9 aa, Homo Sapiens
SPKHALMVF

SEQ ID NO: 108277 - protein, 9 aa, Homo Sapiens
SPKHGFTIM

SEQ ID NO: 108278 - protein, 9 aa, Homo Sapiens
SPKIASHQF

SEQ ID NO: 108279 - protein, 9 aa, Homo Sapiens
SPKIEVHFL

SEQ ID NO: 108280 - protein, 9 aa, Homo Sapiens
SPKIHARVF

SEQ ID NO: 108281 - protein, 9 aa, Homo Sapiens
SPKIRSHAV

SEQ ID NO: 108282 - protein, 9 aa, Homo Sapiens
SPKITTSLL

SEQ ID NO: 108283 - protein, 9 aa, Homo Sapiens
SPKKPVIVF

SEQ ID NO: 108284 - protein, 9 aa, Homo Sapiens
SPKLGLLMV

SEQ ID NO: 108285 - protein, 9 aa, Homo Sapiens
SPKLHAEAI

SEQ ID NO: 108286 - protein, 9 aa, Homo Sapiens
SPKLPVSSL

SEQ ID NO: 108287 - protein, 9 aa, Homo Sapiens
SPKLSNKEL

SEQ ID NO: 108288 - protein, 9 aa, Homo Sapiens
SPKMPLKTL

SEQ ID NO: 108289 - protein, 9 aa, Homo Sapiens
SPKNTVISV

SEQ ID NO: 108290 - protein, 9 aa, Homo Sapiens
SPKPAIKSI

SEQ ID NO: 108291 - protein, 9 aa, Homo Sapiens
SPKPAVVET

SEQ ID NO: 108292 - protein, 9 aa, Homo Sapiens
SPKPLLTGL

SEQ ID NO: 108293 - protein, 9 aa, Homo Sapiens
SPKPNGPVL

SEQ ID NO: 108294 - protein, 9 aa, Homo Sapiens
SPKPPSQQL

SEQ ID NO: 108295 - protein, 9 aa, Homo Sapiens
SPKPPTSMF

SEQ ID NO: 108296 - protein, 9 aa, Homo Sapiens
SPKPPVAVK

SEQ ID NO: 108297 - protein, 9 aa, Homo Sapiens
SPKPQIQAF

SEQ ID NO: 108298 - protein, 9 aa, Homo Sapiens
SPKPVSSTV

SEQ ID NO: 108299 - protein, 9 aa, Homo Sapiens
SPKPWIPVL

SEQ ID NO: 108300 - protein, 9 aa, Homo Sapiens
SPKQIGEHL

SEQ ID NO: 108301 - protein, 9 aa, Homo Sapiens
SPKQILDPA

SEQ ID NO: 108302 - protein, 9 aa, Homo Sapiens
SPKRDLIAL

SEQ ID NO: 108303 - protein, 9 aa, Homo Sapiens
SPKRPRLQL

SEQ ID NO: 108304 - protein, 9 aa, Homo Sapiens
SPKSFTLDF

SEQ ID NO: 108305 - protein, 9 aa, Homo Sapiens
SPKSMSNKL

SEQ ID NO: 108306 - protein, 9 aa, Homo Sapiens
SPKSPGLKA

SEQ ID NO: 108307 - protein, 9 aa, Homo Sapiens
SPKSPTAAL

SEQ ID NO: 108308 - protein, 9 aa, Homo Sapiens
SPKSTVESF

SEQ ID NO: 108309 - protein, 9 aa, Homo Sapiens
SPKSVVTLL

SEQ ID NO: 108310 - protein, 9 aa, Homo Sapiens
SPKSYLEIL

SEQ ID NO: 108311 - protein, 9 aa, Homo Sapiens
SPKTKVTTV

SEQ ID NO: 108312 - protein, 9 aa, Homo Sapiens
SPKTTISVA

SEQ ID NO: 108313 - protein, 9 aa, Homo Sapiens
SPKTTITMA

SEQ ID NO: 108314 - protein, 9 aa, Homo Sapiens
SPKVEPRAL

SEQ ID NO: 108315 - protein, 9 aa, Homo Sapiens
SPKVNKDTL

SEQ ID NO: 108316 - protein, 9 aa, Homo Sapiens
SPKVPRTLL

SEQ ID NO: 108317 - protein, 9 aa, Homo Sapiens
SPKVVIQTI

SEQ ID NO: 108318 - protein, 9 aa, Homo Sapiens
SPKYSLYEV

SEQ ID NO: 108319 - protein, 9 aa, Homo Sapiens
SPLAFEHVM

SEQ ID NO: 108320 - protein, 9 aa, Homo Sapiens
SPLAVDEAL

SEQ ID NO: 108321 - protein, 9 aa, Homo Sapiens
SPLDSIHTI

SEQ ID NO: 108322 - protein, 9 aa, Homo Sapiens
SPLFNNVKL

SEQ ID NO: 108323 - protein, 9 aa, Homo Sapiens
SPLGHRMQL

SEQ ID NO: 108324 - protein, 9 aa, Homo Sapiens
SPLGKEDTL

SEQ ID NO: 108325 - protein, 9 aa, Homo Sapiens
SPLKKEQPL

SEQ ID NO: 108326 - protein, 9 aa, Homo Sapiens
SPLLKQYIL

SEQ ID NO: 108327 - protein, 9 aa, Homo Sapiens
SPLNSSSAL

SEQ ID NO: 108328 - protein, 9 aa, Homo Sapiens
SPLPAGNAL

SEQ ID NO: 108329 - protein, 9 aa, Homo Sapiens
SPLPSPSAM

SEQ ID NO: 108330 - protein, 9 aa, Homo Sapiens
SPLQASSAL

SEQ ID NO: 108331 - protein, 9 aa, Homo Sapiens
SPLRPQNYL

SEQ ID NO: 108332 - protein, 9 aa, Homo Sapiens
SPLSSHPVV

SEQ ID NO: 108333 - protein, 9 aa, Homo Sapiens
SPLTKSISL

SEQ ID NO: 108334 - protein, 9 aa, Homo Sapiens
SPLYLAHEV

SEQ ID NO: 108335 - protein, 9 aa, Homo Sapiens
SPLYSPVSF

SEQ ID NO: 108336 - protein, 9 aa, Homo Sapiens
SPMADRSMM

SEQ ID NO: 108337 - protein, 9 aa, Homo Sapiens
SPMAERSMM

SEQ ID NO: 108338 - protein, 9 aa, Homo Sapiens
SPMEEREKL

SEQ ID NO: 108339 - protein, 9 aa, Homo Sapiens
SPMEMEDAL

SEQ ID NO: 108340 - protein, 9 aa, Homo Sapiens
SPMEVGKKL

SEQ ID NO: 108341 - protein, 9 aa, Homo Sapiens
SPMIPSIVV

SEQ ID NO: 108342 - protein, 9 aa, Homo Sapiens
SPMRDAPCL

SEQ ID NO: 108343 - protein, 9 aa, Homo Sapiens
SPMSVNAVM

SEQ ID NO: 108344 - protein, 9 aa, Homo Sapiens
SPNAEIHIL

SEQ ID NO: 108345 - protein, 9 aa, Homo Sapiens
SPNAIFKAL

SEQ ID NO: 108346 - protein, 9 aa, Homo Sapiens
SPNDFSVSL

SEQ ID NO: 108347 - protein, 9 aa, Homo Sapiens
SPNEFKVYM

SEQ ID NO: 108348 - protein, 9 aa, Homo Sapiens
SPNENFKTV

SEQ ID NO: 108349 - protein, 9 aa, Homo Sapiens
SPNGHRPQL

SEQ ID NO: 108350 - protein, 9 aa, Homo Sapiens
SPNKKPFSL

SEQ ID NO: 108351 - protein, 9 aa, Homo Sapiens
SPNLRLLDL

SEQ ID NO: 108352 - protein, 9 aa, Homo Sapiens
SPNPEIPAL

SEQ ID NO: 108353 - protein, 9 aa, Homo Sapiens
SPNRSFTEM

SEQ ID NO: 108354 - protein, 9 aa, Homo Sapiens
SPNSILKAA

SEQ ID NO: 108355 - protein, 9 aa, Homo Sapiens
SPNSKVNTL

SEQ ID NO: 108356 - protein, 9 aa, Homo Sapiens
SPNSVKPEM

SEQ ID NO: 108357 - protein, 9 aa, Homo Sapiens
SPNSYFMDV

SEQ ID NO: 108358 - protein, 9 aa, Homo Sapiens
SPNSYVVIM

SEQ ID NO: 108359 - protein, 9 aa, Homo Sapiens
SPNTDREVL

SEQ ID NO: 108360 - protein, 9 aa, Homo Sapiens
SPNVPSRCL

SEQ ID NO: 108361 - protein, 9 aa, Homo Sapiens
SPNYDHVVL

SEQ ID NO: 108362 - protein, 9 aa, Homo Sapiens
SPPAPHPTL

SEQ ID NO: 108363 - protein, 9 aa, Homo Sapiens
SPPATSKAL

SEQ ID NO: 108364 - protein, 9 aa, Homo Sapiens
SPPDLKLEL

SEQ ID NO: 108365 - protein, 9 aa, Homo Sapiens
SPPGPKPGF

SEQ ID NO: 108366 - protein, 9 aa, Homo Sapiens
SPPKAMKKF

SEQ ID NO: 108367 - protein, 9 aa, Homo Sapiens
SPPKIHVSA

SEQ ID NO: 108368 - protein, 9 aa, Homo Sapiens
SPPLHEHPL

SEQ ID NO: 108369 - protein, 9 aa, Homo Sapiens
SPPPPAIAV

SEQ ID NO: 108370 - protein, 9 aa, Homo Sapiens
SPPRPQPAF

SEQ ID NO: 108371 - protein, 9 aa, Homo Sapiens
SPPTKFLEL

SEQ ID NO: 108372 - protein, 9 aa, Homo Sapiens
SPPTPTVTL

SEQ ID NO: 108373 - protein, 9 aa, Homo Sapiens
SPQAEQPSL

SEQ ID NO: 108374 - protein, 9 aa, Homo Sapiens
SPQANRTYV

SEQ ID NO: 108375 - protein, 9 aa, Homo Sapiens
SPQAPTHFL

SEQ ID NO: 108376 - protein, 9 aa, Homo Sapiens
SPQASIIAM

SEQ ID NO: 108377 - protein, 9 aa, Homo Sapiens
SPQDKRTLL

SEQ ID NO: 108378 - protein, 9 aa, Homo Sapiens
SPQDLRRRL

SEQ ID NO: 108379 - protein, 9 aa, Homo Sapiens
SPQDSRLYL

SEQ ID NO: 108380 - protein, 9 aa, Homo Sapiens
SPQDTFEAL

SEQ ID NO: 108381 - protein, 9 aa, Homo Sapiens
SPQEARNML

SEQ ID NO: 108382 - protein, 9 aa, Homo Sapiens
SPQEDGVEL

SEQ ID NO: 108383 - protein, 9 aa, Homo Sapiens
SPQEFIHEL

SEQ ID NO: 108384 - protein, 9 aa, Homo Sapiens
SPQGLKPVV

SEQ ID NO: 108385 - protein, 9 aa, Homo Sapiens
SPQGPGALF

SEQ ID NO: 108386 - protein, 9 aa, Homo Sapiens
SPQGRVMTI

SEQ ID NO: 108387 - protein, 9 aa, Homo Sapiens
SPQGVSKTL

SEQ ID NO: 108388 - protein, 9 aa, Homo Sapiens
SPQKTMSVL

SEQ ID NO: 108389 - protein, 9 aa, Homo Sapiens
SPQKVTLYL

SEQ ID NO: 108390 - protein, 9 aa, Homo Sapiens
SPQPAQQKL

SEQ ID NO: 108391 - protein, 9 aa, Homo Sapiens
SPQPQRAQL

SEQ ID NO: 108392 - protein, 9 aa, Homo Sapiens
SPQPRLIYL

SEQ ID NO: 108393 - protein, 9 aa, Homo Sapiens
SPQPWGHML

SEQ ID NO: 108394 - protein, 9 aa, Homo Sapiens
SPQQKLVCL

SEQ ID NO: 108395 - protein, 9 aa, Homo Sapiens
SPQQVSAQL

SEQ ID NO: 108396 - protein, 9 aa, Homo Sapiens
SPQRPRPTL

SEQ ID NO: 108397 - protein, 9 aa, Homo Sapiens
SPQSNSPVL

SEQ ID NO: 108398 - protein, 9 aa, Homo Sapiens
SPQSPGDAL

SEQ ID NO: 108399 - protein, 9 aa, Homo Sapiens
SPQVCLKRL

SEQ ID NO: 108400 - protein, 9 aa, Homo Sapiens
SPQVQRPSF

SEQ ID NO: 108401 - protein, 9 aa, Homo Sapiens
SPRAPVQVI

SEQ ID NO: 108402 - protein, 9 aa, Homo Sapiens
SPRDKIYTI

SEQ ID NO: 108403 - protein, 9 aa, Homo Sapiens
SPRDPVLTL

SEQ ID NO: 108404 - protein, 9 aa, Homo Sapiens
SPREAARVL

SEQ ID NO: 108405 - protein, 9 aa, Homo Sapiens
SPREEQQLL

SEQ ID NO: 108406 - protein, 9 aa, Homo Sapiens
SPREVFFRV

SEQ ID NO: 108407 - protein, 9 aa, Homo Sapiens
SPRFPAQYL

SEQ ID NO: 108408 - protein, 9 aa, Homo Sapiens
SPRGSTDSL

SEQ ID NO: 108409 - protein, 9 aa, Homo Sapiens
SPRHSFNNL

SEQ ID NO: 108410 - protein, 9 aa, Homo Sapiens
SPRIYSNSL

SEQ ID NO: 108411 - protein, 9 aa, Homo Sapiens
SPRKLPTSL

SEQ ID NO: 108412 - protein, 9 aa, Homo Sapiens
SPRKPIDSL

SEQ ID NO: 108413 - protein, 9 aa, Homo Sapiens
SPRLMSNAL

SEQ ID NO: 108414 - protein, 9 aa, Homo Sapiens
SPRLPAREL

SEQ ID NO: 108415 - protein, 9 aa, Homo Sapiens
SPRLPVGGF

SEQ ID NO: 108416 - protein, 9 aa, Homo Sapiens
SPRNEVEAL

SEQ ID NO: 108417 - protein, 9 aa, Homo Sapiens
SPRPGGPYL

SEQ ID NO: 108418 - protein, 9 aa, Homo Sapiens
SPRPKMDAI

SEQ ID NO: 108419 - protein, 9 aa, Homo Sapiens
SPRPPAEGF

SEQ ID NO: 108420 - protein, 9 aa, Homo Sapiens
SPRPQPESV

SEQ ID NO: 108421 - protein, 9 aa, Homo Sapiens
SPRPTGSDL

SEQ ID NO: 108422 - protein, 9 aa, Homo Sapiens
SPRPVVVET

SEQ ID NO: 108423 - protein, 9 aa, Homo Sapiens
SPRSVIHHL

SEQ ID NO: 108424 - protein, 9 aa, Homo Sapiens
SPRSVLEEM

SEQ ID NO: 108425 - protein, 9 aa, Homo Sapiens
SPRTPSTRL

SEQ ID NO: 108426 - protein, 9 aa, Homo Sapiens
SPRVPASET

SEQ ID NO: 108427 - protein, 9 aa, Homo Sapiens
SPRVPNSSV

SEQ ID NO: 108428 - protein, 9 aa, Homo Sapiens
SPRVYWLGL

SEQ ID NO: 108429 - protein, 9 aa, Homo Sapiens
SPRYIFTML

SEQ ID NO: 108430 - protein, 9 aa, Homo Sapiens
SPSATLAAL

SEQ ID NO: 108431 - protein, 9 aa, Homo Sapiens
SPSDFSVSL

SEQ ID NO: 108432 - protein, 9 aa, Homo Sapiens
SPSDPSSSL

SEQ ID NO: 108433 - protein, 9 aa, Homo Sapiens
SPSDRPLSL

SEQ ID NO: 108434 - protein, 9 aa, Homo Sapiens
SPSDSFSVL

SEQ ID NO: 108435 - protein, 9 aa, Homo Sapiens
SPSEILQEL

SEQ ID NO: 108436 - protein, 9 aa, Homo Sapiens
SPSEIMESL

SEQ ID NO: 108437 - protein, 9 aa, Homo Sapiens
SPSEIVKQI

SEQ ID NO: 108438 - protein, 9 aa, Homo Sapiens
SPSETVSSL

SEQ ID NO: 108439 - protein, 9 aa, Homo Sapiens
SPSFPRPSL

SEQ ID NO: 108440 - protein, 9 aa, Homo Sapiens
SPSGAMSNL

SEQ ID NO: 108441 - protein, 9 aa, Homo Sapiens
SPSHAIFKL

SEQ ID NO: 108442 - protein, 9 aa, Homo Sapiens
SPSHNLKSL

SEQ ID NO: 108443 - protein, 9 aa, Homo Sapiens
SPSIKDLPA

SEQ ID NO: 108444 - protein, 9 aa, Homo Sapiens
SPSKPNPVF

SEQ ID NO: 108445 - protein, 9 aa, Homo Sapiens
SPSLPKKSL

SEQ ID NO: 108446 - protein, 9 aa, Homo Sapiens
SPSLPNITL

SEQ ID NO: 108447 - protein, 9 aa, Homo Sapiens
SPSLPTASL

SEQ ID NO: 108448 - protein, 9 aa, Homo Sapiens
SPSPAHPQL

SEQ ID NO: 108449 - protein, 9 aa, Homo Sapiens
SPSPRLKSV

SEQ ID NO: 108450 - protein, 9 aa, Homo Sapiens
SPSPSDPVL

SEQ ID NO: 108451 - protein, 9 aa, Homo Sapiens
SPSQPRDAL

SEQ ID NO: 108452 - protein, 9 aa, Homo Sapiens
SPSRPPPSL

SEQ ID NO: 108453 - protein, 9 aa, Homo Sapiens
SPSSILSTL

SEQ ID NO: 108454 - protein, 9 aa, Homo Sapiens
SPSSSATSL

SEQ ID NO: 108455 - protein, 9 aa, Homo Sapiens
SPTCTNKEL

SEQ ID NO: 108456 - protein, 9 aa, Homo Sapiens
SPTDVHRQF

SEQ ID NO: 108457 - protein, 9 aa, Homo Sapiens
SPTENSFTL

SEQ ID NO: 108458 - protein, 9 aa, Homo Sapiens
SPTQVVSQL

SEQ ID NO: 108459 - protein, 9 aa, Homo Sapiens
SPTTAFTVL

SEQ ID NO: 108460 - protein, 9 aa, Homo Sapiens
SPVFRLETL

SEQ ID NO: 108461 - protein, 9 aa, Homo Sapiens
SPWADNTAL

SEQ ID NO: 108462 - protein, 9 aa, Homo Sapiens
SPWKRQIDL

SEQ ID NO: 108463 - protein, 9 aa, Homo Sapiens
SPWLHAPSL

SEQ ID NO: 108464 - protein, 9 aa, Homo Sapiens
SPWLLRVEL

SEQ ID NO: 108465 - protein, 9 aa, Homo Sapiens
SPWSGLMAL

SEQ ID NO: 108466 - protein, 9 aa, Homo Sapiens
SPYERQLNL

SEQ ID NO: 108467 - protein, 9 aa, Homo Sapiens
SPYIRALGF

SEQ ID NO: 108468 - protein, 9 aa, Homo Sapiens
SPYKRDNTF

SEQ ID NO: 108469 - protein, 9 aa, Homo Sapiens
SPYQNIKIL

SEQ ID NO: 108470 - protein, 9 aa, Homo Sapiens
SPYQRKAGL

SEQ ID NO: 108471 - protein, 9 aa, Homo Sapiens
SPYVQPVCL

SEQ ID NO: 108472 - protein, 9 aa, Homo Sapiens
STLGICQTI

SEQ ID NO: 108473 - protein, 9 aa, Homo Sapiens
SVKAQVTSL

SEQ ID NO: 108474 - protein, 9 aa, Homo Sapiens
SVKEVLQSL

SEQ ID NO: 108475 - protein, 9 aa, Homo Sapiens
SVKPASSSF

SEQ ID NO: 108476 - protein, 9 aa, Homo Sapiens
SVKSPNQSL

SEQ ID NO: 108477 - protein, 9 aa, Homo Sapiens
SVKTKFYVL

SEQ ID NO: 108478 - protein, 9 aa, Homo Sapiens
SVKTPKISM

SEQ ID NO: 108479 - protein, 9 aa, Homo Sapiens
SVSPVVRVA

SEQ ID NO: 108480 - protein, 9 aa, Homo Sapiens
TAAAVGAVF

SEQ ID NO: 108481 - protein, 9 aa, Homo Sapiens
TAAPPAQPL

SEQ ID NO: 108482 - protein, 9 aa, Homo Sapiens
TAKATVAAF

SEQ ID NO: 108483 - protein, 9 aa, Homo Sapiens
TAKAVAVTL

SEQ ID NO: 108484 - protein, 9 aa, Homo Sapiens
TAKDSDPEL

SEQ ID NO: 108485 - protein, 9 aa, Homo Sapiens
TAKEVEESL

SEQ ID NO: 108486 - protein, 9 aa, Homo Sapiens
TAKFHFVDL

SEQ ID NO: 108487 - protein, 9 aa, Homo Sapiens
TAKGHIVLL

SEQ ID NO: 108488 - protein, 9 aa, Homo Sapiens
TAKRSGAVF

SEQ ID NO: 108489 - protein, 9 aa, Homo Sapiens
TAKSPQQVM

SEQ ID NO: 108490 - protein, 9 aa, Homo Sapiens
TAMKKGETL

SEQ ID NO: 108491 - protein, 9 aa, Homo Sapiens
TAPNTFKTL

SEQ ID NO: 108492 - protein, 9 aa, Homo Sapiens
TARPPGYEF

SEQ ID NO: 108493 - protein, 9 aa, Homo Sapiens
TASPVIKAV

SEQ ID NO: 108494 - protein, 9 aa, Homo Sapiens
TAYTRQQVL

SEQ ID NO: 108495 - protein, 9 aa, Homo Sapiens
TIKDMMFQL

SEQ ID NO: 108496 - protein, 9 aa, Homo Sapiens
TIRDKFARL

SEQ ID NO: 108497 - protein, 9 aa, Homo Sapiens
TIRSKRPAL

SEQ ID NO: 108498 - protein, 9 aa, Homo Sapiens
TISPIIKLL

SEQ ID NO: 108499 - protein, 9 aa, Homo Sapiens
TITQVIKVL

SEQ ID NO: 108500 - protein, 9 aa, Homo Sapiens
TLLPPIKVL

SEQ ID NO: 108501 - protein, 9 aa, Homo Sapiens
TLNSFIHVL

SEQ ID NO: 108502 - protein, 9 aa, Homo Sapiens
TPADGFTVL

SEQ ID NO: 108503 - protein, 9 aa, Homo Sapiens
TPAEVRQVL

SEQ ID NO: 108504 - protein, 9 aa, Homo Sapiens
TPAGNFVTL

SEQ ID NO: 108505 - protein, 9 aa, Homo Sapiens
TPAGQKTCL

SEQ ID NO: 108506 - protein, 9 aa, Homo Sapiens
TPAGVQVIL

SEQ ID NO: 108507 - protein, 9 aa, Homo Sapiens
TPAIKRSIL

SEQ ID NO: 108508 - protein, 9 aa, Homo Sapiens
TPAKAIAAV

SEQ ID NO: 108509 - protein, 9 aa, Homo Sapiens
TPAPPGPAT

SEQ ID NO: 108510 - protein, 9 aa, Homo Sapiens
TPAPPKAVL

SEQ ID NO: 108511 - protein, 9 aa, Homo Sapiens
TPAPPKKDI

SEQ ID NO: 108512 - protein, 9 aa, Homo Sapiens
TPAPPTHAL

SEQ ID NO: 108513 - protein, 9 aa, Homo Sapiens
TPAPVPTSL

SEQ ID NO: 108514 - protein, 9 aa, Homo Sapiens
TPARKEISL

SEQ ID NO: 108515 - protein, 9 aa, Homo Sapiens
TPASAGHVW

SEQ ID NO: 108516 - protein, 9 aa, Homo Sapiens
TPATTLHLL

SEQ ID NO: 108517 - protein, 9 aa, Homo Sapiens
TPAVGRLEV

SEQ ID NO: 108518 - protein, 9 aa, Homo Sapiens
TPAWVRQVL

SEQ ID NO: 108519 - protein, 9 aa, Homo Sapiens
TPCHFISSL

SEQ ID NO: 108520 - protein, 9 aa, Homo Sapiens
TPCHPLRSL

SEQ ID NO: 108521 - protein, 9 aa, Homo Sapiens
TPCTKRFEM

SEQ ID NO: 108522 - protein, 9 aa, Homo Sapiens
TPDPQRVPL

SEQ ID NO: 108523 - protein, 9 aa, Homo Sapiens
TPEEAKYKL

SEQ ID NO: 108524 - protein, 9 aa, Homo Sapiens
TPEEKLAAL

SEQ ID NO: 108525 - protein, 9 aa, Homo Sapiens
TPEERYQKL

SEQ ID NO: 108526 - protein, 9 aa, Homo Sapiens
TPEEVRLPL

SEQ ID NO: 108527 - protein, 9 aa, Homo Sapiens
TPETVRMVL

SEQ ID NO: 108528 - protein, 9 aa, Homo Sapiens
TPFPFRTGL

SEQ ID NO: 108529 - protein, 9 aa, Homo Sapiens
TPGEHQICL

SEQ ID NO: 108530 - protein, 9 aa, Homo Sapiens
TPGGSHPAL

SEQ ID NO: 108531 - protein, 9 aa, Homo Sapiens
TPGLVSPAL

SEQ ID NO: 108532 - protein, 9 aa, Homo Sapiens
TPGNFFHVL

SEQ ID NO: 108533 - protein, 9 aa, Homo Sapiens
TPGPVGLAL

SEQ ID NO: 108534 - protein, 9 aa, Homo Sapiens
TPHARIIEL

SEQ ID NO: 108535 - protein, 9 aa, Homo Sapiens
TPHAVGVLL

SEQ ID NO: 108536 - protein, 9 aa, Homo Sapiens
TPHFSGLAA

SEQ ID NO: 108537 - protein, 9 aa, Homo Sapiens
TPHLRNLAV

SEQ ID NO: 108538 - protein, 9 aa, Homo Sapiens
TPHQTFVRL

SEQ ID NO: 108539 - protein, 9 aa, Homo Sapiens
TPILKPVSL

SEQ ID NO: 108540 - protein, 9 aa, Homo Sapiens
TPINKRPVL

SEQ ID NO: 108541 - protein, 9 aa, Homo Sapiens
TPINRIPIM

SEQ ID NO: 108542 - protein, 9 aa, Homo Sapiens
TPIPGTIEM

SEQ ID NO: 108543 - protein, 9 aa, Homo Sapiens
TPIQGTSEL

SEQ ID NO: 108544 - protein, 9 aa, Homo Sapiens
TPIREQHVL

SEQ ID NO: 108545 - protein, 9 aa, Homo Sapiens
TPISRLVAL

SEQ ID NO: 108546 - protein, 9 aa, Homo Sapiens
TPKAESEQL

SEQ ID NO: 108547 - protein, 9 aa, Homo Sapiens
TPKEAFRQL

SEQ ID NO: 108548 - protein, 9 aa, Homo Sapiens
TPKEEAQSL

SEQ ID NO: 108549 - protein, 9 aa, Homo Sapiens
TPKGETRQL

SEQ ID NO: 108550 - protein, 9 aa, Homo Sapiens
TPKGLSPAM

SEQ ID NO: 108551 - protein, 9 aa, Homo Sapiens
TPKHISESL

SEQ ID NO: 108552 - protein, 9 aa, Homo Sapiens
TPKKPEAKF

SEQ ID NO: 108553 - protein, 9 aa, Homo Sapiens
TPKKTTPIL

SEQ ID NO: 108554 - protein, 9 aa, Homo Sapiens
TPKLFHEVV

SEQ ID NO: 108555 - protein, 9 aa, Homo Sapiens
TPKMPGQSV

SEQ ID NO: 108556 - protein, 9 aa, Homo Sapiens
TPKNTSVSL

SEQ ID NO: 108557 - protein, 9 aa, Homo Sapiens
TPKPMIRAF

SEQ ID NO: 108558 - protein, 9 aa, Homo Sapiens
TPKPQTKEL

SEQ ID NO: 108559 - protein, 9 aa, Homo Sapiens
TPKPSFFDF

SEQ ID NO: 108560 - protein, 9 aa, Homo Sapiens
TPKPVEPAA

SEQ ID NO: 108561 - protein, 9 aa, Homo Sapiens
TPKQEIQHL

SEQ ID NO: 108562 - protein, 9 aa, Homo Sapiens
TPKQPVVRF

SEQ ID NO: 108563 - protein, 9 aa, Homo Sapiens
TPKSQVGTL

SEQ ID NO: 108564 - protein, 9 aa, Homo Sapiens
TPKTNNDIL

SEQ ID NO: 108565 - protein, 9 aa, Homo Sapiens
TPKWITPVL

SEQ ID NO: 108566 - protein, 9 aa, Homo Sapiens
TPLARGDTL

SEQ ID NO: 108567 - protein, 9 aa, Homo Sapiens
TPLARIVAF

SEQ ID NO: 108568 - protein, 9 aa, Homo Sapiens
TPLASFKIL

SEQ ID NO: 108569 - protein, 9 aa, Homo Sapiens
TPLCPRPAL

SEQ ID NO: 108570 - protein, 9 aa, Homo Sapiens
TPLDFLHIF

SEQ ID NO: 108571 - protein, 9 aa, Homo Sapiens
TPLPAGHMI

SEQ ID NO: 108572 - protein, 9 aa, Homo Sapiens
TPLSSTVTL

SEQ ID NO: 108573 - protein, 9 aa, Homo Sapiens
TPLYKKKEL

SEQ ID NO: 108574 - protein, 9 aa, Homo Sapiens
TPMFREYSL

SEQ ID NO: 108575 - protein, 9 aa, Homo Sapiens
TPMGPGRTV

SEQ ID NO: 108576 - protein, 9 aa, Homo Sapiens
TPMHPPSSL

SEQ ID NO: 108577 - protein, 9 aa, Homo Sapiens
TPMNPANTI

SEQ ID NO: 108578 - protein, 9 aa, Homo Sapiens
TPMPSRPST

SEQ ID NO: 108579 - protein, 9 aa, Homo Sapiens
TPMQVVTCL

SEQ ID NO: 108580 - protein, 9 aa, Homo Sapiens
TPNENRQKL

SEQ ID NO: 108581 - protein, 9 aa, Homo Sapiens
TPNETISTL

SEQ ID NO: 108582 - protein, 9 aa, Homo Sapiens
TPNEYIKTL

SEQ ID NO: 108583 - protein, 9 aa, Homo Sapiens
TPNKAGPKL

SEQ ID NO: 108584 - protein, 9 aa, Homo Sapiens
TPNRATFVV

SEQ ID NO: 108585 - protein, 9 aa, Homo Sapiens
TPPAVSSVL

SEQ ID NO: 108586 - protein, 9 aa, Homo Sapiens
TPPEVSKKL

SEQ ID NO: 108587 - protein, 9 aa, Homo Sapiens
TPPIPKITI

SEQ ID NO: 108588 - protein, 9 aa, Homo Sapiens
TPPPVKEYL

SEQ ID NO: 108589 - protein, 9 aa, Homo Sapiens
TPQAKKIKL

SEQ ID NO: 108590 - protein, 9 aa, Homo Sapiens
TPQAQAQSL

SEQ ID NO: 108591 - protein, 9 aa, Homo Sapiens
TPQEPRCGF

SEQ ID NO: 108592 - protein, 9 aa, Homo Sapiens
TPQGFRSTL

SEQ ID NO: 108593 - protein, 9 aa, Homo Sapiens
TPQLNKNTL

SEQ ID NO: 108594 - protein, 9 aa, Homo Sapiens
TPQMPTQAM

SEQ ID NO: 108595 - protein, 9 aa, Homo Sapiens
TPQNGRYQI

SEQ ID NO: 108596 - protein, 9 aa, Homo Sapiens
TPQNKITVV

SEQ ID NO: 108597 - protein, 9 aa, Homo Sapiens
TPQQKGWPM

SEQ ID NO: 108598 - protein, 9 aa, Homo Sapiens
TPQSNRPVM

SEQ ID NO: 108599 - protein, 9 aa, Homo Sapiens
TPRHKQPTL

SEQ ID NO: 108600 - protein, 9 aa, Homo Sapiens
TPRHLDPSL

SEQ ID NO: 108601 - protein, 9 aa, Homo Sapiens
TPRLPQRNL

SEQ ID NO: 108602 - protein, 9 aa, Homo Sapiens
TPRPGSHTI

SEQ ID NO: 108603 - protein, 9 aa, Homo Sapiens
TPRPKFSVC

SEQ ID NO: 108604 - protein, 9 aa, Homo Sapiens
TPRPMTAEL

SEQ ID NO: 108605 - protein, 9 aa, Homo Sapiens
TPRPPGPGL

SEQ ID NO: 108606 - protein, 9 aa, Homo Sapiens
TPRPTAAEL

SEQ ID NO: 108607 - protein, 9 aa, Homo Sapiens
TPRRPAGLL

SEQ ID NO: 108608 - protein, 9 aa, Homo Sapiens
TPRVPDNSL

SEQ ID NO: 108609 - protein, 9 aa, Homo Sapiens
TPSAGKAML

SEQ ID NO: 108610 - protein, 9 aa, Homo Sapiens
TPSAQVKPI

SEQ ID NO: 108611 - protein, 9 aa, Homo Sapiens
TPSASRKSL

SEQ ID NO: 108612 - protein, 9 aa, Homo Sapiens
TPSAVFRVW

SEQ ID NO: 108613 - protein, 9 aa, Homo Sapiens
TPSDGRPEL

SEQ ID NO: 108614 - protein, 9 aa, Homo Sapiens
TPSEPHPVL

SEQ ID NO: 108615 - protein, 9 aa, Homo Sapiens
TPSERITSL

SEQ ID NO: 108616 - protein, 9 aa, Homo Sapiens
TPSNIAIVL

SEQ ID NO: 108617 - protein, 9 aa, Homo Sapiens
TPSPAPRTL

SEQ ID NO: 108618 - protein, 9 aa, Homo Sapiens
TPSPIIQQL

SEQ ID NO: 108619 - protein, 9 aa, Homo Sapiens
TPSPTRYSL

SEQ ID NO: 108620 - protein, 9 aa, Homo Sapiens
TPSPVIRST

SEQ ID NO: 108621 - protein, 9 aa, Homo Sapiens
TPSSRPASL

SEQ ID NO: 108622 - protein, 9 aa, Homo Sapiens
TPSSVRKQL

SEQ ID NO: 108623 - protein, 9 aa, Homo Sapiens
TPTEKPKLL

SEQ ID NO: 108624 - protein, 9 aa, Homo Sapiens
TPTGYIESL

SEQ ID NO: 108625 - protein, 9 aa, Homo Sapiens
TPTPFFHTF

SEQ ID NO: 108626 - protein, 9 aa, Homo Sapiens
TPTRPVQAL

SEQ ID NO: 108627 - protein, 9 aa, Homo Sapiens
TPTSVIRKM

SEQ ID NO: 108628 - protein, 9 aa, Homo Sapiens
TPTTIIKQV

SEQ ID NO: 108629 - protein, 9 aa, Homo Sapiens
TPVAGSQSL

SEQ ID NO: 108630 - protein, 9 aa, Homo Sapiens
TPVASRQSL

SEQ ID NO: 108631 - protein, 9 aa, Homo Sapiens
TPVDDRISL

SEQ ID NO: 108632 - protein, 9 aa, Homo Sapiens
TPWFKIIAA

SEQ ID NO: 108633 - protein, 9 aa, Homo Sapiens
TPYGRPANI

SEQ ID NO: 108634 - protein, 9 aa, Homo Sapiens
TPYIKKPSL

SEQ ID NO: 108635 - protein, 9 aa, Homo Sapiens
TPYNGTEAL

SEQ ID NO: 108636 - protein, 9 aa, Homo Sapiens
TPYNYPVPV

SEQ ID NO: 108637 - protein, 9 aa, Homo Sapiens
TTKPVGLLL

SEQ ID NO: 108638 - protein, 9 aa, Homo Sapiens
TVKATGPAL

SEQ ID NO: 108639 - protein, 9 aa, Homo Sapiens
TVKEVLPAL

SEQ ID NO: 108640 - protein, 9 aa, Homo Sapiens
TVKKPGPNL

SEQ ID NO: 108641 - protein, 9 aa, Homo Sapiens
TVKPLTLEL

SEQ ID NO: 108642 - protein, 9 aa, Homo Sapiens
TVKPPTSVA

SEQ ID NO: 108643 - protein, 9 aa, Homo Sapiens
TVKPYCNEI

SEQ ID NO: 108644 - protein, 9 aa, Homo Sapiens
TVKTHLTSL

SEQ ID NO: 108645 - protein, 9 aa, Homo Sapiens
TVKVHVVAL

SEQ ID NO: 108646 - protein, 9 aa, Homo Sapiens
TVRAVIATL

SEQ ID NO: 108647 - protein, 9 aa, Homo Sapiens
TVRDHVHCL

SEQ ID NO: 108648 - protein, 9 aa, Homo Sapiens
TVSDSIKKL

SEQ ID NO: 108649 - protein, 9 aa, Homo Sapiens
TVYLRDIAL

SEQ ID NO: 108650 - protein, 9 aa, Homo Sapiens
VAKAPSQAL

SEQ ID NO: 108651 - protein, 9 aa, Homo Sapiens
VAKAVTQAL

SEQ ID NO: 108652 - protein, 9 aa, Homo Sapiens
VAKEIIYTL

SEQ ID NO: 108653 - protein, 9 aa, Homo Sapiens
VAKPPVMSF

SEQ ID NO: 108654 - protein, 9 aa, Homo Sapiens
VARPLSTAL

SEQ ID NO: 108655 - protein, 9 aa, Homo Sapiens
VPAAVFGSL

SEQ ID NO: 108656 - protein, 9 aa, Homo Sapiens
VPADVLEAL

SEQ ID NO: 108657 - protein, 9 aa, Homo Sapiens
VPAEHQVAM

SEQ ID NO: 108658 - protein, 9 aa, Homo Sapiens
VPAENKSVL

SEQ ID NO: 108659 - protein, 9 aa, Homo Sapiens
VPAEPKLAF

SEQ ID NO: 108660 - protein, 9 aa, Homo Sapiens
VPAEPSSLL

SEQ ID NO: 108661 - protein, 9 aa, Homo Sapiens
VPAESAAVL

SEQ ID NO: 108662 - protein, 9 aa, Homo Sapiens
VPAFRDEHL

SEQ ID NO: 108663 - protein, 9 aa, Homo Sapiens
VPAGGAVAV

SEQ ID NO: 108664 - protein, 9 aa, Homo Sapiens
VPAKKITAA

SEQ ID NO: 108665 - protein, 9 aa, Homo Sapiens
VPAPLPKKI

SEQ ID NO: 108666 - protein, 9 aa, Homo Sapiens
VPAQSRPCV

SEQ ID NO: 108667 - protein, 9 aa, Homo Sapiens
VPASFRLQM

SEQ ID NO: 108668 - protein, 9 aa, Homo Sapiens
VPASKRPPL

SEQ ID NO: 108669 - protein, 9 aa, Homo Sapiens
VPASLMVSL

SEQ ID NO: 108670 - protein, 9 aa, Homo Sapiens
VPATDRNAL

SEQ ID NO: 108671 - protein, 9 aa, Homo Sapiens
VPATPRLPA

SEQ ID NO: 108672 - protein, 9 aa, Homo Sapiens
VPCGNIVGL

SEQ ID NO: 108673 - protein, 9 aa, Homo Sapiens
VPCTPVARL

SEQ ID NO: 108674 - protein, 9 aa, Homo Sapiens
VPDEHFSTL

SEQ ID NO: 108675 - protein, 9 aa, Homo Sapiens
VPDERRYSL

SEQ ID NO: 108676 - protein, 9 aa, Homo Sapiens
VPDGFLSEL

SEQ ID NO: 108677 - protein, 9 aa, Homo Sapiens
VPDQPHPEI

SEQ ID NO: 108678 - protein, 9 aa, Homo Sapiens
VPEEARPAL

SEQ ID NO: 108679 - protein, 9 aa, Homo Sapiens
VPEKPRPAL

SEQ ID NO: 108680 - protein, 9 aa, Homo Sapiens
VPELPGPSV

SEQ ID NO: 108681 - protein, 9 aa, Homo Sapiens
VPENKGISL

SEQ ID NO: 108682 - protein, 9 aa, Homo Sapiens
VPERPVTCM

SEQ ID NO: 108683 - protein, 9 aa, Homo Sapiens
VPFERPAVI

SEQ ID NO: 108684 - protein, 9 aa, Homo Sapiens
VPFFPARVL

SEQ ID NO: 108685 - protein, 9 aa, Homo Sapiens
VPFGPHRGL

SEQ ID NO: 108686 - protein, 9 aa, Homo Sapiens
VPFHLHINL

SEQ ID NO: 108687 - protein, 9 aa, Homo Sapiens
VPFHRVDTI

SEQ ID NO: 108688 - protein, 9 aa, Homo Sapiens
VPFLKKVGF

SEQ ID NO: 108689 - protein, 9 aa, Homo Sapiens
VPFPRLHFF

SEQ ID NO: 108690 - protein, 9 aa, Homo Sapiens
VPGKIQHIL

SEQ ID NO: 108691 - protein, 9 aa, Homo Sapiens
VPHGAGYEL

SEQ ID NO: 108692 - protein, 9 aa, Homo Sapiens
VPHGHITSL

SEQ ID NO: 108693 - protein, 9 aa, Homo Sapiens
VPHPVSRPL

SEQ ID NO: 108694 - protein, 9 aa, Homo Sapiens
VPIDITVKL

SEQ ID NO: 108695 - protein, 9 aa, Homo Sapiens
VPIPVKESI

SEQ ID NO: 108696 - protein, 9 aa, Homo Sapiens
VPIQSSVVL

SEQ ID NO: 108697 - protein, 9 aa, Homo Sapiens
VPKAHVDEF

SEQ ID NO: 108698 - protein, 9 aa, Homo Sapiens
VPKAQKETV

SEQ ID NO: 108699 - protein, 9 aa, Homo Sapiens
VPKDLTQPT

SEQ ID NO: 108700 - protein, 9 aa, Homo Sapiens
VPKEPPPEF

SEQ ID NO: 108701 - protein, 9 aa, Homo Sapiens
VPKESLVYF

SEQ ID NO: 108702 - protein, 9 aa, Homo Sapiens
VPKIAPDVL

SEQ ID NO: 108703 - protein, 9 aa, Homo Sapiens
VPKKAWRKL

SEQ ID NO: 108704 - protein, 9 aa, Homo Sapiens
VPKLKVCAL

SEQ ID NO: 108705 - protein, 9 aa, Homo Sapiens
VPKLVKEEV

SEQ ID NO: 108706 - protein, 9 aa, Homo Sapiens
VPKMKVPKF

SEQ ID NO: 108707 - protein, 9 aa, Homo Sapiens
VPKNYVTVM

SEQ ID NO: 108708 - protein, 9 aa, Homo Sapiens
VPKNYVVVL

SEQ ID NO: 108709 - protein, 9 aa, Homo Sapiens
VPKPFRPIL

SEQ ID NO: 108710 - protein, 9 aa, Homo Sapiens
VPKPGAFDL

SEQ ID NO: 108711 - protein, 9 aa, Homo Sapiens
VPKPIGGVV

SEQ ID NO: 108712 - protein, 9 aa, Homo Sapiens
VPKPLPKQL

SEQ ID NO: 108713 - protein, 9 aa, Homo Sapiens
VPKQPPKTL

SEQ ID NO: 108714 - protein, 9 aa, Homo Sapiens
VPKRPDACF

SEQ ID NO: 108715 - protein, 9 aa, Homo Sapiens
VPKSAVQQV

SEQ ID NO: 108716 - protein, 9 aa, Homo Sapiens
VPKSGTPQL

SEQ ID NO: 108717 - protein, 9 aa, Homo Sapiens
VPKSLVSNL

SEQ ID NO: 108718 - protein, 9 aa, Homo Sapiens
VPKSMRVKL

SEQ ID NO: 108719 - protein, 9 aa, Homo Sapiens
VPKSSVSRV

SEQ ID NO: 108720 - protein, 9 aa, Homo Sapiens
VPKTASTSF

SEQ ID NO: 108721 - protein, 9 aa, Homo Sapiens
VPKTQSPCF

SEQ ID NO: 108722 - protein, 9 aa, Homo Sapiens
VPKTVVSSW

SEQ ID NO: 108723 - protein, 9 aa, Homo Sapiens
VPKVMKVKL

SEQ ID NO: 108724 - protein, 9 aa, Homo Sapiens
VPKVVGSAV

SEQ ID NO: 108725 - protein, 9 aa, Homo Sapiens
VPKYWGSGL

SEQ ID NO: 108726 - protein, 9 aa, Homo Sapiens
VPLAQAQAL

SEQ ID NO: 108727 - protein, 9 aa, Homo Sapiens
VPLEQSPVL

SEQ ID NO: 108728 - protein, 9 aa, Homo Sapiens
VPLGAGIAL

SEQ ID NO: 108729 - protein, 9 aa, Homo Sapiens
VPLKQGRSL

SEQ ID NO: 108730 - protein, 9 aa, Homo Sapiens
VPLPVKVCF

SEQ ID NO: 108731 - protein, 9 aa, Homo Sapiens
VPLVREITF

SEQ ID NO: 108732 - protein, 9 aa, Homo Sapiens
VPLVRPVTM

SEQ ID NO: 108733 - protein, 9 aa, Homo Sapiens
VPMFRNVSL

SEQ ID NO: 108734 - protein, 9 aa, Homo Sapiens
VPMNSLRFL

SEQ ID NO: 108735 - protein, 9 aa, Homo Sapiens
VPMTPLRTV

SEQ ID NO: 108736 - protein, 9 aa, Homo Sapiens
VPMVQGECL

SEQ ID NO: 108737 - protein, 9 aa, Homo Sapiens
VPNATIRNV

SEQ ID NO: 108738 - protein, 9 aa, Homo Sapiens
VPNDIQSEL

SEQ ID NO: 108739 - protein, 9 aa, Homo Sapiens
VPNGDCKTF

SEQ ID NO: 108740 - protein, 9 aa, Homo Sapiens
VPNKVIQCF

SEQ ID NO: 108741 - protein, 9 aa, Homo Sapiens
VPNNKITVV

SEQ ID NO: 108742 - protein, 9 aa, Homo Sapiens
VPNPDPVTM

SEQ ID NO: 108743 - protein, 9 aa, Homo Sapiens
VPNPSLKTF

SEQ ID NO: 108744 - protein, 9 aa, Homo Sapiens
VPNQKRLTL

SEQ ID NO: 108745 - protein, 9 aa, Homo Sapiens
VPPEQAKVV

SEQ ID NO: 108746 - protein, 9 aa, Homo Sapiens
VPPLPGKAF

SEQ ID NO: 108747 - protein, 9 aa, Homo Sapiens
VPPLVPKVL

SEQ ID NO: 108748 - protein, 9 aa, Homo Sapiens
VPPPLAKAI

SEQ ID NO: 108749 - protein, 9 aa, Homo Sapiens
VPPPPEKSL

SEQ ID NO: 108750 - protein, 9 aa, Homo Sapiens
VPPPPHRPL

SEQ ID NO: 108751 - protein, 9 aa, Homo Sapiens
VPPPPKETL

SEQ ID NO: 108752 - protein, 9 aa, Homo Sapiens
VPPPPPVAL

SEQ ID NO: 108753 - protein, 9 aa, Homo Sapiens
VPPPVMKTF

SEQ ID NO: 108754 - protein, 9 aa, Homo Sapiens
VPPQKLQAL

SEQ ID NO: 108755 - protein, 9 aa, Homo Sapiens
VPPVQVSPL

SEQ ID NO: 108756 - protein, 9 aa, Homo Sapiens
VPQAKPVAV

SEQ ID NO: 108757 - protein, 9 aa, Homo Sapiens
VPQDTKLVL

SEQ ID NO: 108758 - protein, 9 aa, Homo Sapiens
VPQERTDHL

SEQ ID NO: 108759 - protein, 9 aa, Homo Sapiens
VPQESRFNL

SEQ ID NO: 108760 - protein, 9 aa, Homo Sapiens
VPQPHPQTL

SEQ ID NO: 108761 - protein, 9 aa, Homo Sapiens
VPQQPHPGF

SEQ ID NO: 108762 - protein, 9 aa, Homo Sapiens
VPQSGVPAL

SEQ ID NO: 108763 - protein, 9 aa, Homo Sapiens
VPQSVTECV

SEQ ID NO: 108764 - protein, 9 aa, Homo Sapiens
VPRAILVDL

SEQ ID NO: 108765 - protein, 9 aa, Homo Sapiens
VPRENMEAI

SEQ ID NO: 108766 - protein, 9 aa, Homo Sapiens
VPREPPVSL

SEQ ID NO: 108767 - protein, 9 aa, Homo Sapiens
VPRFQAVQI

SEQ ID NO: 108768 - protein, 9 aa, Homo Sapiens
VPRFYIRIL

SEQ ID NO: 108769 - protein, 9 aa, Homo Sapiens
VPRGQGSQF

SEQ ID NO: 108770 - protein, 9 aa, Homo Sapiens
VPRIQPQSL

SEQ ID NO: 108771 - protein, 9 aa, Homo Sapiens
VPRLFSLTL

SEQ ID NO: 108772 - protein, 9 aa, Homo Sapiens
VPRLKTWLL

SEQ ID NO: 108773 - protein, 9 aa, Homo Sapiens
VPRLPATAA

SEQ ID NO: 108774 - protein, 9 aa, Homo Sapiens
VPRLPGETL

SEQ ID NO: 108775 - protein, 9 aa, Homo Sapiens
VPRNYDPAL

SEQ ID NO: 108776 - protein, 9 aa, Homo Sapiens
VPRPASVSA

SEQ ID NO: 108777 - protein, 9 aa, Homo Sapiens
VPRPGKAAF

SEQ ID NO: 108778 - protein, 9 aa, Homo Sapiens
VPRPPQTSL

SEQ ID NO: 108779 - protein, 9 aa, Homo Sapiens
VPRPVLRAL

SEQ ID NO: 108780 - protein, 9 aa, Homo Sapiens
VPRQNVPVI

SEQ ID NO: 108781 - protein, 9 aa, Homo Sapiens
VPRSPVREL

SEQ ID NO: 108782 - protein, 9 aa, Homo Sapiens
VPRTIGAEL

SEQ ID NO: 108783 - protein, 9 aa, Homo Sapiens
VPRVLGSSV

SEQ ID NO: 108784 - protein, 9 aa, Homo Sapiens
VPRVPTHTL

SEQ ID NO: 108785 - protein, 9 aa, Homo Sapiens
VPSAAGYAL

SEQ ID NO: 108786 - protein, 9 aa, Homo Sapiens
VPSEGKKSL

SEQ ID NO: 108787 - protein, 9 aa, Homo Sapiens
VPSEPGGVL

SEQ ID NO: 108788 - protein, 9 aa, Homo Sapiens
VPSEPKLSL

SEQ ID NO: 108789 - protein, 9 aa, Homo Sapiens
VPSFRPYLL

SEQ ID NO: 108790 - protein, 9 aa, Homo Sapiens
VPSKPPMSL

SEQ ID NO: 108791 - protein, 9 aa, Homo Sapiens
VPSPAVPKL

SEQ ID NO: 108792 - protein, 9 aa, Homo Sapiens
VPSPYLSSL

SEQ ID NO: 108793 - protein, 9 aa, Homo Sapiens
VPSTAIREI

SEQ ID NO: 108794 - protein, 9 aa, Homo Sapiens
VPTPIHPIF

SEQ ID NO: 108795 - protein, 9 aa, Homo Sapiens
VPTPIQPTF

SEQ ID NO: 108796 - protein, 9 aa, Homo Sapiens
VPVAKTAEL

SEQ ID NO: 108797 - protein, 9 aa, Homo Sapiens
VPVGPHLSL

SEQ ID NO: 108798 - protein, 9 aa, Homo Sapiens
VPVLPKISL

SEQ ID NO: 108799 - protein, 9 aa, Homo Sapiens
VPVNHTQVM

SEQ ID NO: 108800 - protein, 9 aa, Homo Sapiens
VPVPHTTAL

SEQ ID NO: 108801 - protein, 9 aa, Homo Sapiens
VPVPPNVAF

SEQ ID NO: 108802 - protein, 9 aa, Homo Sapiens
VPYEKGFAL

SEQ ID NO: 108803 - protein, 9 aa, Homo Sapiens
VPYGTPLSV

SEQ ID NO: 108804 - protein, 9 aa, Homo Sapiens
VPYLKIFTV

SEQ ID NO: 108805 - protein, 9 aa, Homo Sapiens
VPYSTSASL

SEQ ID NO: 108806 - protein, 9 aa, Homo Sapiens
VTRLPDGPA

SEQ ID NO: 108807 - protein, 9 aa, Homo Sapiens
VVKMPSGEF

SEQ ID NO: 108808 - protein, 9 aa, Homo Sapiens
VVKNVGLTL

SEQ ID NO: 108809 - protein, 9 aa, Homo Sapiens
VVKPPGQDL

SEQ ID NO: 108810 - protein, 9 aa, Homo Sapiens
VVKPPGSSL

SEQ ID NO: 108811 - protein, 9 aa, Homo Sapiens
VVMNVVHQL

SEQ ID NO: 108812 - protein, 9 aa, Homo Sapiens
WAMDLRPEL

SEQ ID NO: 108813 - protein, 9 aa, Homo Sapiens
WIKEKIYVL

SEQ ID NO: 108814 - protein, 9 aa, Homo Sapiens
WPQPDKPMF

SEQ ID NO: 108815 - protein, 9 aa, Homo Sapiens
WVKEKVVAL

SEQ ID NO: 108816 - protein, 9 aa, Homo Sapiens
YAKKRGWVL

SEQ ID NO: 108817 - protein, 9 aa, Homo Sapiens
YAKRPGIGL

SEQ ID NO: 108818 - protein, 9 aa, Homo Sapiens
YPAAKRVKL

SEQ ID NO: 108819 - protein, 9 aa, Homo Sapiens
YPAAVPQAL

SEQ ID NO: 108820 - protein, 9 aa, Homo Sapiens
YPAERKQAL

SEQ ID NO: 108821 - protein, 9 aa, Homo Sapiens
YPASAGTSL

SEQ ID NO: 108822 - protein, 9 aa, Homo Sapiens
YPAYLGARL

SEQ ID NO: 108823 - protein, 9 aa, Homo Sapiens
YPDEKSVCL

SEQ ID NO: 108824 - protein, 9 aa, Homo Sapiens
YPEELKPVL

SEQ ID NO: 108825 - protein, 9 aa, Homo Sapiens
YPGQPHPAL

SEQ ID NO: 108826 - protein, 9 aa, Homo Sapiens
YPHEPTAVF

SEQ ID NO: 108827 - protein, 9 aa, Homo Sapiens
YPHLHNAEL

SEQ ID NO: 108828 - protein, 9 aa, Homo Sapiens
YPKANIVAY

SEQ ID NO: 108829 - protein, 9 aa, Homo Sapiens
YPKFKYALL

SEQ ID NO: 108830 - protein, 9 aa, Homo Sapiens
YPKGAGEML

SEQ ID NO: 108831 - protein, 9 aa, Homo Sapiens
YPKLKTDVL

SEQ ID NO: 108832 - protein, 9 aa, Homo Sapiens
YPKLPVWVV

SEQ ID NO: 108833 - protein, 9 aa, Homo Sapiens
YPKQGIFSV

SEQ ID NO: 108834 - protein, 9 aa, Homo Sapiens
YPKQSFTMV

SEQ ID NO: 108835 - protein, 9 aa, Homo Sapiens
YPKRPLLGL

SEQ ID NO: 108836 - protein, 9 aa, Homo Sapiens
YPLEKGHLF

SEQ ID NO: 108837 - protein, 9 aa, Homo Sapiens
YPLESRPSL

SEQ ID NO: 108838 - protein, 9 aa, Homo Sapiens
YPLLKNISM

SEQ ID NO: 108839 - protein, 9 aa, Homo Sapiens
YPNERFELL

SEQ ID NO: 108840 - protein, 9 aa, Homo Sapiens
YPNPKPEVL

SEQ ID NO: 108841 - protein, 9 aa, Homo Sapiens
YPNSHTHYF

SEQ ID NO: 108842 - protein, 9 aa, Homo Sapiens
YPNSYFTGL

SEQ ID NO: 108843 - protein, 9 aa, Homo Sapiens
YPNVNIHNF

SEQ ID NO: 108844 - protein, 9 aa, Homo Sapiens
YPNYLIRKF

SEQ ID NO: 108845 - protein, 9 aa, Homo Sapiens
YPPWPGKIV

SEQ ID NO: 108846 - protein, 9 aa, Homo Sapiens
YPQCLQKVL

SEQ ID NO: 108847 - protein, 9 aa, Homo Sapiens
YPQEVIPTF

SEQ ID NO: 108848 - protein, 9 aa, Homo Sapiens
YPQGQAPPL

SEQ ID NO: 108849 - protein, 9 aa, Homo Sapiens
YPRKGRIAV

SEQ ID NO: 108850 - protein, 9 aa, Homo Sapiens
YPRSLFPSL

SEQ ID NO: 108851 - protein, 9 aa, Homo Sapiens
YPSAYIKVF

SEQ ID NO: 108852 - protein, 9 aa, Homo Sapiens
YPTDERKLL

SEQ ID NO: 108853 - protein, 9 aa, Homo Sapiens
YPTISLHAL

SEQ ID NO: 108854 - protein, 9 aa, Homo Sapiens
YPYEHSYGL

SEQ ID NO: 108855 - protein, 9 aa, Homo Sapiens
YPYLGPSTL

SEQ ID NO: 108856 - protein, 9 aa, Homo Sapiens
YPYPYPHTL

SEQ ID NO: 108857 - protein, 9 aa, Homo Sapiens
YVALVHPDL

SEQ ID NO: 108858 - protein, 9 aa, Homo Sapiens
YVMDTRPKL

SEQ ID NO: 108859 - protein, 9 aa, Homo Sapiens
YVNLPTIAL

SEQ ID NO: 108860 - protein, 10 aa, Homo Sapiens
ADPLKVYPPL

SEQ ID NO: 108861 - protein, 10 aa, Homo Sapiens
AGIKEYFNVM

SEQ ID NO: 108862 - protein, 10 aa, Homo Sapiens
AGPARLSPAA

SEQ ID NO: 108863 - protein, 10 aa, Homo Sapiens
APAAGAGRLL

SEQ ID NO: 108864 - protein, 10 aa, Homo Sapiens
APAAGAVRAL

SEQ ID NO: 108865 - protein, 10 aa, Homo Sapiens
APAARAPQAL

SEQ ID NO: 108866 - protein, 10 aa, Homo Sapiens
APAEKVGGVL

SEQ ID NO: 108867 - protein, 10 aa, Homo Sapiens
APAPAEKTPV

SEQ ID NO: 108868 - protein, 10 aa, Homo Sapiens
APAPRSGECL

SEQ ID NO: 108869 - protein, 10 aa, Homo Sapiens
APAPSKGQTL

SEQ ID NO: 108870 - protein, 10 aa, Homo Sapiens
APDGSQRAVL

SEQ ID NO: 108871 - protein, 10 aa, Homo Sapiens
APFDREPFTL

SEQ ID NO: 108872 - protein, 10 aa, Homo Sapiens
APFDRRATSL

SEQ ID NO: 108873 - protein, 10 aa, Homo Sapiens
APFQGDQRSL

SEQ ID NO: 108874 - protein, 10 aa, Homo Sapiens
APHALLQAVL

SEQ ID NO: 108875 - protein, 10 aa, Homo Sapiens
APHARNGLSL

SEQ ID NO: 108876 - protein, 10 aa, Homo Sapiens
APHEPDGVAL

SEQ ID NO: 108877 - protein, 10 aa, Homo Sapiens
APHPFPHPAF

SEQ ID NO: 108878 - protein, 10 aa, Homo Sapiens
APIDRVGQTI

SEQ ID NO: 108879 - protein, 10 aa, Homo Sapiens
APIGPHLQSM

SEQ ID NO: 108880 - protein, 10 aa, Homo Sapiens
APIIRVGGAL

SEQ ID NO: 108881 - protein, 10 aa, Homo Sapiens
APIQGNREEL

SEQ ID NO: 108882 - protein, 10 aa, Homo Sapiens
APKANATIEV

SEQ ID NO: 108883 - protein, 10 aa, Homo Sapiens
APKASLRLGF

SEQ ID NO: 108884 - protein, 10 aa, Homo Sapiens
APKAVWLPAM

SEQ ID NO: 108885 - protein, 10 aa, Homo Sapiens
APKFPTPVIL

SEQ ID NO: 108886 - protein, 10 aa, Homo Sapiens
APKHFLPEML

SEQ ID NO: 108887 - protein, 10 aa, Homo Sapiens
APKHPISEEL

SEQ ID NO: 108888 - protein, 10 aa, Homo Sapiens
APKKPTGVDL

SEQ ID NO: 108889 - protein, 10 aa, Homo Sapiens
APKLPERTVL

SEQ ID NO: 108890 - protein, 10 aa, Homo Sapiens
APKMPVVTSV

SEQ ID NO: 108891 - protein, 10 aa, Homo Sapiens
APKPAAPTTL

SEQ ID NO: 108892 - protein, 10 aa, Homo Sapiens
APKPEASPSM

SEQ ID NO: 108893 - protein, 10 aa, Homo Sapiens
APKPEENPSL

SEQ ID NO: 108894 - protein, 10 aa, Homo Sapiens
APKPPFQSHF

SEQ ID NO: 108895 - protein, 10 aa, Homo Sapiens
APKPSSRPSL

SEQ ID NO: 108896 - protein, 10 aa, Homo Sapiens
APKQELPSAL

SEQ ID NO: 108897 - protein, 10 aa, Homo Sapiens
APKRPPSAFF

SEQ ID NO: 108898 - protein, 10 aa, Homo Sapiens
APKSGNTGEL

SEQ ID NO: 108899 - protein, 10 aa, Homo Sapiens
APKSMQSAIM

SEQ ID NO: 108900 - protein, 10 aa, Homo Sapiens
APKSPSSEWL

SEQ ID NO: 108901 - protein, 10 aa, Homo Sapiens
APKYGSYNVF

SEQ ID NO: 108902 - protein, 10 aa, Homo Sapiens
APLNEAMAVL

SEQ ID NO: 108903 - protein, 10 aa, Homo Sapiens
APMPCNLIKL

SEQ ID NO: 108904 - protein, 10 aa, Homo Sapiens
APNEKMKQVL

SEQ ID NO: 108905 - protein, 10 aa, Homo Sapiens
APPEYHRKAV

SEQ ID NO: 108906 - protein, 10 aa, Homo Sapiens
APPVLKRPIL

SEQ ID NO: 108907 - protein, 10 aa, Homo Sapiens
APQADPRPSM

SEQ ID NO: 108908 - protein, 10 aa, Homo Sapiens
APQPIRNIVF

SEQ ID NO: 108909 - protein, 10 aa, Homo Sapiens
APQTQHVSPM

SEQ ID NO: 108910 - protein, 10 aa, Homo Sapiens
APRAALVFAL

SEQ ID NO: 108911 - protein, 10 aa, Homo Sapiens
APRAASTESL

SEQ ID NO: 108912 - protein, 10 aa, Homo Sapiens
APRDAYWIAM

SEQ ID NO: 108913 - protein, 10 aa, Homo Sapiens
APREPFAHSL

SEQ ID NO: 108914 - protein, 10 aa, Homo Sapiens
APREPPPVEL

SEQ ID NO: 108915 - protein, 10 aa, Homo Sapiens
APRGTGIVSA

SEQ ID NO: 108916 - protein, 10 aa, Homo Sapiens
APRHPSTNSL

SEQ ID NO: 108917 - protein, 10 aa, Homo Sapiens
APRIALHTAL

SEQ ID NO: 108918 - protein, 10 aa, Homo Sapiens
APRPVDEPAM

SEQ ID NO: 108919 - protein, 10 aa, Homo Sapiens
APRSFHPPAA

SEQ ID NO: 108920 - protein, 10 aa, Homo Sapiens
APRSVAVSSI

SEQ ID NO: 108921 - protein, 10 aa, Homo Sapiens
APRTVALTAL

SEQ ID NO: 108922 - protein, 10 aa, Homo Sapiens
APRWGNPRAL

SEQ ID NO: 108923 - protein, 10 aa, Homo Sapiens
APSAARELSL

SEQ ID NO: 108924 - protein, 10 aa, Homo Sapiens
APSEKLEQIL

SEQ ID NO: 108925 - protein, 10 aa, Homo Sapiens
APSGSLAVPL

SEQ ID NO: 108926 - protein, 10 aa, Homo Sapiens
APSMKELQVL

SEQ ID NO: 108927 - protein, 10 aa, Homo Sapiens
APSPTHVAEL

SEQ ID NO: 108928 - protein, 10 aa, Homo Sapiens
APSSETGTSL

SEQ ID NO: 108929 - protein, 10 aa, Homo Sapiens
APSSPRPALP

SEQ ID NO: 108930 - protein, 10 aa, Homo Sapiens
APSWREPEVL

SEQ ID NO: 108931 - protein, 10 aa, Homo Sapiens
APTNRQIEIL

SEQ ID NO: 108932 - protein, 10 aa, Homo Sapiens
APTVTMVRVV

SEQ ID NO: 108933 - protein, 10 aa, Homo Sapiens
APVGRDAETL

SEQ ID NO: 108934 - protein, 10 aa, Homo Sapiens
APVPYVRPAI

SEQ ID NO: 108935 - protein, 10 aa, Homo Sapiens
APWSGRFYSL

SEQ ID NO: 108936 - protein, 10 aa, Homo Sapiens
APYERRAMEL

SEQ ID NO: 108937 - protein, 10 aa, Homo Sapiens
APYFKGTAVV

SEQ ID NO: 108938 - protein, 10 aa, Homo Sapiens
APYFLPEHIF

SEQ ID NO: 108939 - protein, 10 aa, Homo Sapiens
ASPKSPTAAL

SEQ ID NO: 108940 - protein, 10 aa, Homo Sapiens
AVDPNRAVPL

SEQ ID NO: 108941 - protein, 10 aa, Homo Sapiens
DTNADKQLSF

SEQ ID NO: 108942 - protein, 10 aa, Homo Sapiens
EPAPASVTAL

SEQ ID NO: 108943 - protein, 10 aa, Homo Sapiens
EPKVQPGVAM

SEQ ID NO: 108944 - protein, 10 aa, Homo Sapiens
EPNRRVLETL

SEQ ID NO: 108945 - protein, 10 aa, Homo Sapiens
FPAKPGSLTL

SEQ ID NO: 108946 - protein, 10 aa, Homo Sapiens
FPAPGKTVTL

SEQ ID NO: 108947 - protein, 10 aa, Homo Sapiens
FPEADKVRTM

SEQ ID NO: 108948 - protein, 10 aa, Homo Sapiens
FPHPVNQVTF

SEQ ID NO: 108949 - protein, 10 aa, Homo Sapiens
FPKGYRHPAL

SEQ ID NO: 108950 - protein, 10 aa, Homo Sapiens
FPKKALVVTI

SEQ ID NO: 108951 - protein, 10 aa, Homo Sapiens
FPQKLRPRLL

SEQ ID NO: 108952 - protein, 10 aa, Homo Sapiens
FPQLKSLETL

SEQ ID NO: 108953 - protein, 10 aa, Homo Sapiens
FPRPDQQHSV

SEQ ID NO: 108954 - protein, 10 aa, Homo Sapiens
GAAVRIGSVL

SEQ ID NO: 108955 - protein, 10 aa, Homo Sapiens
GPKPGGGPGL

SEQ ID NO: 108956 - protein, 10 aa, Homo Sapiens
GPRAPGPSLL

SEQ ID NO: 108957 - protein, 10 aa, Homo Sapiens
GPSIVHRKCF

SEQ ID NO: 108958 - protein, 10 aa, Homo Sapiens
GPWRDKDPAL

SEQ ID NO: 108959 - protein, 10 aa, Homo Sapiens
GVSSSHVRVL

SEQ ID NO: 108960 - protein, 10 aa, Homo Sapiens
GVSVKKGHEL

SEQ ID NO: 108961 - protein, 10 aa, Homo Sapiens
HPAARMLVEL

SEQ ID NO: 108962 - protein, 10 aa, Homo Sapiens
HPAGPRTVFF

SEQ ID NO: 108963 - protein, 10 aa, Homo Sapiens
HPFPESKPVL

SEQ ID NO: 108964 - protein, 10 aa, Homo Sapiens
HPFYTRAATM

SEQ ID NO: 108965 - protein, 10 aa, Homo Sapiens
HPHAVNEIAL

SEQ ID NO: 108966 - protein, 10 aa, Homo Sapiens
HPIDGFLQSL

SEQ ID NO: 108967 - protein, 10 aa, Homo Sapiens
HPIQGHRVEV

SEQ ID NO: 108968 - protein, 10 aa, Homo Sapiens
HPISDHEATL

SEQ ID NO: 108969 - protein, 10 aa, Homo Sapiens
HPKEDIFISV

SEQ ID NO: 108970 - protein, 10 aa, Homo Sapiens
HPKFQKPKQL

SEQ ID NO: 108971 - protein, 10 aa, Homo Sapiens
HPKLGSYTKI

SEQ ID NO: 108972 - protein, 10 aa, Homo Sapiens
HPKLSKENVI

SEQ ID NO: 108973 - protein, 10 aa, Homo Sapiens
HPKNPHAPTI

SEQ ID NO: 108974 - protein, 10 aa, Homo Sapiens
HPKPSGKPLP

SEQ ID NO: 108975 - protein, 10 aa, Homo Sapiens
HPKPVPGFQV

SEQ ID NO: 108976 - protein, 10 aa, Homo Sapiens
HPKRPMHILL

SEQ ID NO: 108977 - protein, 10 aa, Homo Sapiens
HPKTPLPPEL

SEQ ID NO: 108978 - protein, 10 aa, Homo Sapiens
HPKYGSIPKL

SEQ ID NO: 108979 - protein, 10 aa, Homo Sapiens
HPKYPDGKTF

SEQ ID NO: 108980 - protein, 10 aa, Homo Sapiens
HPMKPHRLAL

SEQ ID NO: 108981 - protein, 10 aa, Homo Sapiens
HPMYGAGHKF

SEQ ID NO: 108982 - protein, 10 aa, Homo Sapiens
HPNKPKDHVF

SEQ ID NO: 108983 - protein, 10 aa, Homo Sapiens
HPNSNIYNTL

SEQ ID NO: 108984 - protein, 10 aa, Homo Sapiens
HPNTRIGVFL

SEQ ID NO: 108985 - protein, 10 aa, Homo Sapiens
HPPPASPSSL

SEQ ID NO: 108986 - protein, 10 aa, Homo Sapiens
HPPYLVSKEL

SEQ ID NO: 108987 - protein, 10 aa, Homo Sapiens
HPQPGSANSL

SEQ ID NO: 108988 - protein, 10 aa, Homo Sapiens
HPREPLPPIQ

SEQ ID NO: 108989 - protein, 10 aa, Homo Sapiens
HPRGGVIQSV

SEQ ID NO: 108990 - protein, 10 aa, Homo Sapiens
HPRPAHKAIL

SEQ ID NO: 108991 - protein, 10 aa, Homo Sapiens
HPRPPIPLSL

SEQ ID NO: 108992 - protein, 10 aa, Homo Sapiens
HPRSPNVLSV

SEQ ID NO: 108993 - protein, 10 aa, Homo Sapiens
HPRTSITVVL

SEQ ID NO: 108994 - protein, 10 aa, Homo Sapiens
HPVVRNLAVL

SEQ ID NO: 108995 - protein, 10 aa, Homo Sapiens
HVKDANGNSF

SEQ ID NO: 108996 - protein, 10 aa, Homo Sapiens
IAKAYPPTSM

SEQ ID NO: 108997 - protein, 10 aa, Homo Sapiens
IAKRPPLQSL

SEQ ID NO: 108998 - protein, 10 aa, Homo Sapiens
IPAPGSGVSF

SEQ ID NO: 108999 - protein, 10 aa, Homo Sapiens
IPAVELIVKL

SEQ ID NO: 109000 - protein, 10 aa, Homo Sapiens
IPFERDQEIL

SEQ ID NO: 109001 - protein, 10 aa, Homo Sapiens
IPGLLSPHPL

SEQ ID NO: 109002 - protein, 10 aa, Homo Sapiens
IPKDYKTMAA

SEQ ID NO: 109003 - protein, 10 aa, Homo Sapiens
IPKEVDKIVF

SEQ ID NO: 109004 - protein, 10 aa, Homo Sapiens
IPKHINPVAA

SEQ ID NO: 109005 - protein, 10 aa, Homo Sapiens
IPKKNILLTI

SEQ ID NO: 109006 - protein, 10 aa, Homo Sapiens
IPKSILEPAL

SEQ ID NO: 109007 - protein, 10 aa, Homo Sapiens
IPKVQHVIHY

SEQ ID NO: 109008 - protein, 10 aa, Homo Sapiens
IPKVTKTSAL

SEQ ID NO: 109009 - protein, 10 aa, Homo Sapiens
IPLFHGTLAL

SEQ ID NO: 109010 - protein, 10 aa, Homo Sapiens
IPLPHGTHTF

SEQ ID NO: 109011 - protein, 10 aa, Homo Sapiens
IPMDPEHVEL

SEQ ID NO: 109012 - protein, 10 aa, Homo Sapiens
IPMPGHPVNF

SEQ ID NO: 109013 - protein, 10 aa, Homo Sapiens
IPNERTMQLL

SEQ ID NO: 109014 - protein, 10 aa, Homo Sapiens
IPNVRIQAVL

SEQ ID NO: 109015 - protein, 10 aa, Homo Sapiens
IPPPPPPVGF

SEQ ID NO: 109016 - protein, 10 aa, Homo Sapiens
IPPYALGKSL

SEQ ID NO: 109017 - protein, 10 aa, Homo Sapiens
IPQERGLSSL

SEQ ID NO: 109018 - protein, 10 aa, Homo Sapiens
IPQKQREITL

SEQ ID NO: 109019 - protein, 10 aa, Homo Sapiens
IPRDPSQQEL

SEQ ID NO: 109020 - protein, 10 aa, Homo Sapiens
IPRGVNVSAL

SEQ ID NO: 109021 - protein, 10 aa, Homo Sapiens
IPSANPAKTM

SEQ ID NO: 109022 - protein, 10 aa, Homo Sapiens
IPVSRDWELL

SEQ ID NO: 109023 - protein, 10 aa, Homo Sapiens
IPYMFEAREF

SEQ ID NO: 109024 - protein, 10 aa, Homo Sapiens
IPYMKKYKIQ

SEQ ID NO: 109025 - protein, 10 aa, Homo Sapiens
IVKECVDGVL

SEQ ID NO: 109026 - protein, 10 aa, Homo Sapiens
IVKGGRIVAM

SEQ ID NO: 109027 - protein, 10 aa, Homo Sapiens
IVSNTLVRAL

SEQ ID NO: 109028 - protein, 10 aa, Homo Sapiens
KPADRVNVTV

SEQ ID NO: 109029 - protein, 10 aa, Homo Sapiens
KPADVIGKSM

SEQ ID NO: 109030 - protein, 10 aa, Homo Sapiens
KPEERYFISH

SEQ ID NO: 109031 - protein, 10 aa, Homo Sapiens
KPFDQTTISL

SEQ ID NO: 109032 - protein, 10 aa, Homo Sapiens
KPFLPSIIAL

SEQ ID NO: 109033 - protein, 10 aa, Homo Sapiens
KPFSQHVRKL

SEQ ID NO: 109034 - protein, 10 aa, Homo Sapiens
KPHEGIIHSL

SEQ ID NO: 109035 - protein, 10 aa, Homo Sapiens
KPHSGFHVAF

SEQ ID NO: 109036 - protein, 10 aa, Homo Sapiens
KPHWNDGAIL

SEQ ID NO: 109037 - protein, 10 aa, Homo Sapiens
KPIEPRRELL

SEQ ID NO: 109038 - protein, 10 aa, Homo Sapiens
KPIFSKIVSL

SEQ ID NO: 109039 - protein, 10 aa, Homo Sapiens
KPIGSLHPGL

SEQ ID NO: 109040 - protein, 10 aa, Homo Sapiens
KPINVRVTTM

SEQ ID NO: 109041 - protein, 10 aa, Homo Sapiens
KPIVRKKLSL

SEQ ID NO: 109042 - protein, 10 aa, Homo Sapiens
KPKATAKAAL

SEQ ID NO: 109043 - protein, 10 aa, Homo Sapiens
KPKCGRMISF

SEQ ID NO: 109044 - protein, 10 aa, Homo Sapiens
KPKDMGFTRL

SEQ ID NO: 109045 - protein, 10 aa, Homo Sapiens
KPKDPLKISL

SEQ ID NO: 109046 - protein, 10 aa, Homo Sapiens
KPKEHKKLFL

SEQ ID NO: 109047 - protein, 10 aa, Homo Sapiens
KPKEPASCLL

SEQ ID NO: 109048 - protein, 10 aa, Homo Sapiens
KPKEVTTVKV

SEQ ID NO: 109049 - protein, 10 aa, Homo Sapiens
KPKFSGVEKI

SEQ ID NO: 109050 - protein, 10 aa, Homo Sapiens
KPKGFAFITF

SEQ ID NO: 109051 - protein, 10 aa, Homo Sapiens
KPKLTPQEKL

SEQ ID NO: 109052 - protein, 10 aa, Homo Sapiens
KPKNTIAIFC

SEQ ID NO: 109053 - protein, 10 aa, Homo Sapiens
KPKPAGVLGA

SEQ ID NO: 109054 - protein, 10 aa, Homo Sapiens
KPKPGHTPIF

SEQ ID NO: 109055 - protein, 10 aa, Homo Sapiens
KPKPIDVQVI

SEQ ID NO: 109056 - protein, 10 aa, Homo Sapiens
KPKPPAPEDL

SEQ ID NO: 109057 - protein, 10 aa, Homo Sapiens
KPKPTNPVEI

SEQ ID NO: 109058 - protein, 10 aa, Homo Sapiens
KPKPVKPVTF

SEQ ID NO: 109059 - protein, 10 aa, Homo Sapiens
KPKSAPWNSF

SEQ ID NO: 109060 - protein, 10 aa, Homo Sapiens
KPLVPREHQF

SEQ ID NO: 109061 - protein, 10 aa, Homo Sapiens
KPMEGNFEEI

SEQ ID NO: 109062 - protein, 10 aa, Homo Sapiens
KPMQPGPHVV

SEQ ID NO: 109063 - protein, 10 aa, Homo Sapiens
KPNEGAIVEV

SEQ ID NO: 109064 - protein, 10 aa, Homo Sapiens
KPNPNQIISV

SEQ ID NO: 109065 - protein, 10 aa, Homo Sapiens
KPNQISGTVF

SEQ ID NO: 109066 - protein, 10 aa, Homo Sapiens
KPPEPVKPEV

SEQ ID NO: 109067 - protein, 10 aa, Homo Sapiens
KPPSAEYKVV

SEQ ID NO: 109068 - protein, 10 aa, Homo Sapiens
KPRDVSSVEL

SEQ ID NO: 109069 - protein, 10 aa, Homo Sapiens
KPRNVQILNM

SEQ ID NO: 109070 - protein, 10 aa, Homo Sapiens
KPRNVVFVDM

SEQ ID NO: 109071 - protein, 10 aa, Homo Sapiens
KPRPDVTNEL

SEQ ID NO: 109072 - protein, 10 aa, Homo Sapiens
KPRTEGKITL

SEQ ID NO: 109073 - protein, 10 aa, Homo Sapiens
KPRVPPATAF

SEQ ID NO: 109074 - protein, 10 aa, Homo Sapiens
KPSDVMLVHF

SEQ ID NO: 109075 - protein, 10 aa, Homo Sapiens
KPSEERVREI

SEQ ID NO: 109076 - protein, 10 aa, Homo Sapiens
KPSESIYSAL

SEQ ID NO: 109077 - protein, 10 aa, Homo Sapiens
KPSPPPVKEL

SEQ ID NO: 109078 - protein, 10 aa, Homo Sapiens
KPSQITGTVF

SEQ ID NO: 109079 - protein, 10 aa, Homo Sapiens
KPTSERKVSL

SEQ ID NO: 109080 - protein, 10 aa, Homo Sapiens
KPYKNDPEIL

SEQ ID NO: 109081 - protein, 10 aa, Homo Sapiens
KVKQVHKEVL

SEQ ID NO: 109082 - protein, 10 aa, Homo Sapiens
KVPQLEIVPN

SEQ ID NO: 109083 - protein, 10 aa, Homo Sapiens
LIMGFLVLGL

SEQ ID NO: 109084 - protein, 10 aa, Homo Sapiens
LPAAAMARAM

SEQ ID NO: 109085 - protein, 10 aa, Homo Sapiens
LPAEFPDKVF

SEQ ID NO: 109086 - protein, 10 aa, Homo Sapiens
LPAPCTPLSL

SEQ ID NO: 109087 - protein, 10 aa, Homo Sapiens
LPCSFVTHAL

SEQ ID NO: 109088 - protein, 10 aa, Homo Sapiens
LPDSGHLHPL

SEQ ID NO: 109089 - protein, 10 aa, Homo Sapiens
LPFDHSRVIL

SEQ ID NO: 109090 - protein, 10 aa, Homo Sapiens
LPIPRPGEVL

SEQ ID NO: 109091 - protein, 10 aa, Homo Sapiens
LPKDQQITAL

SEQ ID NO: 109092 - protein, 10 aa, Homo Sapiens
LPKETCLITF

SEQ ID NO: 109093 - protein, 10 aa, Homo Sapiens
LPKIPSNATL

SEQ ID NO: 109094 - protein, 10 aa, Homo Sapiens
LPKKPCKNLL

SEQ ID NO: 109095 - protein, 10 aa, Homo Sapiens
LPKKPCKNLM

SEQ ID NO: 109096 - protein, 10 aa, Homo Sapiens
LPKKPKKVAF

SEQ ID NO: 109097 - protein, 10 aa, Homo Sapiens
LPKKSIDTGM

SEQ ID NO: 109098 - protein, 10 aa, Homo Sapiens
LPKPGGAHSL

SEQ ID NO: 109099 - protein, 10 aa, Homo Sapiens
LPKPHGIRAL

SEQ ID NO: 109100 - protein, 10 aa, Homo Sapiens
LPKPPPGVGL

SEQ ID NO: 109101 - protein, 10 aa, Homo Sapiens
LPKQEKRHVL

SEQ ID NO: 109102 - protein, 10 aa, Homo Sapiens
LPKRTIQEVL

SEQ ID NO: 109103 - protein, 10 aa, Homo Sapiens
LPKSPPYTAF

SEQ ID NO: 109104 - protein, 10 aa, Homo Sapiens
LPKSQVTDTL

SEQ ID NO: 109105 - protein, 10 aa, Homo Sapiens
LPKYGVKVGL

SEQ ID NO: 109106 - protein, 10 aa, Homo Sapiens
LPLDKITECL

SEQ ID NO: 109107 - protein, 10 aa, Homo Sapiens
LPLGPGREAL

SEQ ID NO: 109108 - protein, 10 aa, Homo Sapiens
LPLSAANITL

SEQ ID NO: 109109 - protein, 10 aa, Homo Sapiens
LPNYRWTQTL

SEQ ID NO: 109110 - protein, 10 aa, Homo Sapiens
LPPGLAVKEL

SEQ ID NO: 109111 - protein, 10 aa, Homo Sapiens
LPPLPKRPAL

SEQ ID NO: 109112 - protein, 10 aa, Homo Sapiens
LPQDKKEYRL

SEQ ID NO: 109113 - protein, 10 aa, Homo Sapiens
LPQQPLHPCM

SEQ ID NO: 109114 - protein, 10 aa, Homo Sapiens
LPQYKEREVV

SEQ ID NO: 109115 - protein, 10 aa, Homo Sapiens
LPRAVGTQTL

SEQ ID NO: 109116 - protein, 10 aa, Homo Sapiens
LPRGRKQLAL

SEQ ID NO: 109117 - protein, 10 aa, Homo Sapiens
LPRGSIPRSL

SEQ ID NO: 109118 - protein, 10 aa, Homo Sapiens
LPRPHASIMF

SEQ ID NO: 109119 - protein, 10 aa, Homo Sapiens
LPSALVSHVL

SEQ ID NO: 109120 - protein, 10 aa, Homo Sapiens
LPSDLRTISL

SEQ ID NO: 109121 - protein, 10 aa, Homo Sapiens
LPSEELNRQL

SEQ ID NO: 109122 - protein, 10 aa, Homo Sapiens
LPSNTKFVAL

SEQ ID NO: 109123 - protein, 10 aa, Homo Sapiens
LPSSKLIRIL

SEQ ID NO: 109124 - protein, 10 aa, Homo Sapiens
LPTSVQGHVL

SEQ ID NO: 109125 - protein, 10 aa, Homo Sapiens
LPVDHKGELL

SEQ ID NO: 109126 - protein, 10 aa, Homo Sapiens
LVKGLGILSL

SEQ ID NO: 109127 - protein, 10 aa, Homo Sapiens
LVRPHIDISF

SEQ ID NO: 109128 - protein, 10 aa, Homo Sapiens
MPALFSDHTF

SEQ ID NO: 109129 - protein, 10 aa, Homo Sapiens
MPANMDKHAL

SEQ ID NO: 109130 - protein, 10 aa, Homo Sapiens
MPCQALVRML

SEQ ID NO: 109131 - protein, 10 aa, Homo Sapiens
MPEEKLVEAL

SEQ ID NO: 109132 - protein, 10 aa, Homo Sapiens
MPEQAHKVCV

SEQ ID NO: 109133 - protein, 10 aa, Homo Sapiens
MPFKDRATSM

SEQ ID NO: 109134 - protein, 10 aa, Homo Sapiens
MPFQRAGVNF

SEQ ID NO: 109135 - protein, 10 aa, Homo Sapiens
MPHPATGKTV

SEQ ID NO: 109136 - protein, 10 aa, Homo Sapiens
MPHRGRLNVL

SEQ ID NO: 109137 - protein, 10 aa, Homo Sapiens
MPKDGTVHEL

SEQ ID NO: 109138 - protein, 10 aa, Homo Sapiens
MPKEPHIREM

SEQ ID NO: 109139 - protein, 10 aa, Homo Sapiens
MPKKDARTLL

SEQ ID NO: 109140 - protein, 10 aa, Homo Sapiens
MPKKGGRWWF

SEQ ID NO: 109141 - protein, 10 aa, Homo Sapiens
MPKKSGRWWF

SEQ ID NO: 109142 - protein, 10 aa, Homo Sapiens
MPKMNFANVF

SEQ ID NO: 109143 - protein, 10 aa, Homo Sapiens
MPKRIVNAKI

SEQ ID NO: 109144 - protein, 10 aa, Homo Sapiens
MPNGDHIVSA

SEQ ID NO: 109145 - protein, 10 aa, Homo Sapiens
MPNNSLTPSL

SEQ ID NO: 109146 - protein, 10 aa, Homo Sapiens
MPPEKVHKEL

SEQ ID NO: 109147 - protein, 10 aa, Homo Sapiens
MPPPANLPSL

SEQ ID NO: 109148 - protein, 10 aa, Homo Sapiens
MPQNPHIIAT

SEQ ID NO: 109149 - protein, 10 aa, Homo Sapiens
MPQSGTGVSV

SEQ ID NO: 109150 - protein, 10 aa, Homo Sapiens
MPRGIYHSAL

SEQ ID NO: 109151 - protein, 10 aa, Homo Sapiens
MPRQPSATRL

SEQ ID NO: 109152 - protein, 10 aa, Homo Sapiens
MPSASRVILL

SEQ ID NO: 109153 - protein, 10 aa, Homo Sapiens
MPSLKHIVEL

SEQ ID NO: 109154 - protein, 10 aa, Homo Sapiens
MPYDSNRVVL

SEQ ID NO: 109155 - protein, 10 aa, Homo Sapiens
MPYGSRENSL

SEQ ID NO: 109156 - protein, 10 aa, Homo Sapiens
MPYSNGRPAL

SEQ ID NO: 109157 - protein, 10 aa, Homo Sapiens
NPKDATSIHL

SEQ ID NO: 109158 - protein, 10 aa, Homo Sapiens
NPKPASPRFL

SEQ ID NO: 109159 - protein, 10 aa, Homo Sapiens
NPLFIPVAVM

SEQ ID NO: 109160 - protein, 10 aa, Homo Sapiens
NPLPNIDHEL

SEQ ID NO: 109161 - protein, 10 aa, Homo Sapiens
NPNQNKNVAL

SEQ ID NO: 109162 - protein, 10 aa, Homo Sapiens
PGSPFKAHVV

SEQ ID NO: 109163 - protein, 10 aa, Homo Sapiens
PHPKKPEHTL

SEQ ID NO: 109164 - protein, 10 aa, Homo Sapiens
PKTAENFRAL

SEQ ID NO: 109165 - protein, 10 aa, Homo Sapiens
PMLVAGLKGL

SEQ ID NO: 109166 - protein, 10 aa, Homo Sapiens
PRPSTGPHKL

SEQ ID NO: 109167 - protein, 10 aa, Homo Sapiens
PSITHGPRLS

SEQ ID NO: 109168 - protein, 10 aa, Homo Sapiens
PSVGQLAHKL

SEQ ID NO: 109169 - protein, 10 aa, Homo Sapiens
QPADRPREPL

SEQ ID NO: 109170 - protein, 10 aa, Homo Sapiens
QPANCKVESL

SEQ ID NO: 109171 - protein, 10 aa, Homo Sapiens
QPAPPREAHF

SEQ ID NO: 109172 - protein, 10 aa, Homo Sapiens
QPDQTRIVAL

SEQ ID NO: 109173 - protein, 10 aa, Homo Sapiens
QPFFQKRSEL

SEQ ID NO: 109174 - protein, 10 aa, Homo Sapiens
QPFSAKDLSI

SEQ ID NO: 109175 - protein, 10 aa, Homo Sapiens
QPIPFPKEAL

SEQ ID NO: 109176 - protein, 10 aa, Homo Sapiens
QPKKVKGVGF

SEQ ID NO: 109177 - protein, 10 aa, Homo Sapiens
QPKQKIRVAL

SEQ ID NO: 109178 - protein, 10 aa, Homo Sapiens
QPMQPHPQHL

SEQ ID NO: 109179 - protein, 10 aa, Homo Sapiens
QPMQPLPESL

SEQ ID NO: 109180 - protein, 10 aa, Homo Sapiens
QPNEQHPVSL

SEQ ID NO: 109181 - protein, 10 aa, Homo Sapiens
QPNGKVFKKL

SEQ ID NO: 109182 - protein, 10 aa, Homo Sapiens
QPNRYTNRVV

SEQ ID NO: 109183 - protein, 10 aa, Homo Sapiens
QPPDAVKPAI

SEQ ID NO: 109184 - protein, 10 aa, Homo Sapiens
QPPGAAKPAL

SEQ ID NO: 109185 - protein, 10 aa, Homo Sapiens
QPRNDFGNFF

SEQ ID NO: 109186 - protein, 10 aa, Homo Sapiens
QPRTEPMPSL

SEQ ID NO: 109187 - protein, 10 aa, Homo Sapiens
QPSPVSNQSL

SEQ ID NO: 109188 - protein, 10 aa, Homo Sapiens
QPYEKKAAKL

SEQ ID NO: 109189 - protein, 10 aa, Homo Sapiens
QPYLARRPKL

SEQ ID NO: 109190 - protein, 10 aa, Homo Sapiens
RAKPEDRESL

SEQ ID NO: 109191 - protein, 10 aa, Homo Sapiens
RLKPPPPVAI

SEQ ID NO: 109192 - protein, 10 aa, Homo Sapiens
RNKEVTWEVL

SEQ ID NO: 109193 - protein, 10 aa, Homo Sapiens
RPAAPGQTPL

SEQ ID NO: 109194 - protein, 10 aa, Homo Sapiens
RPADSMLNVL

SEQ ID NO: 109195 - protein, 10 aa, Homo Sapiens
RPADVIFATV

SEQ ID NO: 109196 - protein, 10 aa, Homo Sapiens
RPAELYTQII

SEQ ID NO: 109197 - protein, 10 aa, Homo Sapiens
RPAEVGGMQL

SEQ ID NO: 109198 - protein, 10 aa, Homo Sapiens
RPALQHVVKV

SEQ ID NO: 109199 - protein, 10 aa, Homo Sapiens
RPANHRQLTF

SEQ ID NO: 109200 - protein, 10 aa, Homo Sapiens
RPAPPLRPSA

SEQ ID NO: 109201 - protein, 10 aa, Homo Sapiens
RPAQPQEHPF

SEQ ID NO: 109202 - protein, 10 aa, Homo Sapiens
RPAVALIRKL

SEQ ID NO: 109203 - protein, 10 aa, Homo Sapiens
RPDDKRILEF

SEQ ID NO: 109204 - protein, 10 aa, Homo Sapiens
RPDERRFAVF

SEQ ID NO: 109205 - protein, 10 aa, Homo Sapiens
RPEILTDESL

SEQ ID NO: 109206 - protein, 10 aa, Homo Sapiens
RPEPATGYTL

SEQ ID NO: 109207 - protein, 10 aa, Homo Sapiens
RPFHNGVKCL

SEQ ID NO: 109208 - protein, 10 aa, Homo Sapiens
RPGGDYNTSL

SEQ ID NO: 109209 - protein, 10 aa, Homo Sapiens
RPHKVDGRVV

SEQ ID NO: 109210 - protein, 10 aa, Homo Sapiens
RPHNLKVHIL

SEQ ID NO: 109211 - protein, 10 aa, Homo Sapiens
RPHSIDGRVV

SEQ ID NO: 109212 - protein, 10 aa, Homo Sapiens
RPHVSPRHSF

SEQ ID NO: 109213 - protein, 10 aa, Homo Sapiens
RPHYGKLKEI

SEQ ID NO: 109214 - protein, 10 aa, Homo Sapiens
RPIFPGKHYL

SEQ ID NO: 109215 - protein, 10 aa, Homo Sapiens
RPIPNQPPTA

SEQ ID NO: 109216 - protein, 10 aa, Homo Sapiens
RPKAAIMETL

SEQ ID NO: 109217 - protein, 10 aa, Homo Sapiens
RPKAISPYHL

SEQ ID NO: 109218 - protein, 10 aa, Homo Sapiens
RPKAVREQLL

SEQ ID NO: 109219 - protein, 10 aa, Homo Sapiens
RPKCVDEVAF

SEQ ID NO: 109220 - protein, 10 aa, Homo Sapiens
RPKDMDPRLI

SEQ ID NO: 109221 - protein, 10 aa, Homo Sapiens
RPKEDTQKLL

SEQ ID NO: 109222 - protein, 10 aa, Homo Sapiens
RPKEIKVSKM

SEQ ID NO: 109223 - protein, 10 aa, Homo Sapiens
RPKEPQLSLL

SEQ ID NO: 109224 - protein, 10 aa, Homo Sapiens
RPKGESKDLL

SEQ ID NO: 109225 - protein, 10 aa, Homo Sapiens
RPKGFYVETV

SEQ ID NO: 109226 - protein, 10 aa, Homo Sapiens
RPKIPDPEAV

SEQ ID NO: 109227 - protein, 10 aa, Homo Sapiens
RPKLPEDPLL

SEQ ID NO: 109228 - protein, 10 aa, Homo Sapiens
RPKPKTLHEL

SEQ ID NO: 109229 - protein, 10 aa, Homo Sapiens
RPKPPNVRTA

SEQ ID NO: 109230 - protein, 10 aa, Homo Sapiens
RPKPSASEVL

SEQ ID NO: 109231 - protein, 10 aa, Homo Sapiens
RPKPSSSPVI

SEQ ID NO: 109232 - protein, 10 aa, Homo Sapiens
RPKQEKAFSL

SEQ ID NO: 109233 - protein, 10 aa, Homo Sapiens
RPKQPGPVKL

SEQ ID NO: 109234 - protein, 10 aa, Homo Sapiens
RPKSFILPKL

SEQ ID NO: 109235 - protein, 10 aa, Homo Sapiens
RPKSNIVLLS

SEQ ID NO: 109236 - protein, 10 aa, Homo Sapiens
RPKSSSPIRL

SEQ ID NO: 109237 - protein, 10 aa, Homo Sapiens
RPKSVDFDSL

SEQ ID NO: 109238 - protein, 10 aa, Homo Sapiens
RPKTVRDTLL

SEQ ID NO: 109239 - protein, 10 aa, Homo Sapiens
RPMAFLREYF

SEQ ID NO: 109240 - protein, 10 aa, Homo Sapiens
RPMPPEARRL

SEQ ID NO: 109241 - protein, 10 aa, Homo Sapiens
RPNGTKVAVL

SEQ ID NO: 109242 - protein, 10 aa, Homo Sapiens
RPNPILARLL

SEQ ID NO: 109243 - protein, 10 aa, Homo Sapiens
RPNQHNTVKL

SEQ ID NO: 109244 - protein, 10 aa, Homo Sapiens
RPPKVKITEL

SEQ ID NO: 109245 - protein, 10 aa, Homo Sapiens
RPQAPATVGL

SEQ ID NO: 109246 - protein, 10 aa, Homo Sapiens
RPQASAWKKL

SEQ ID NO: 109247 - protein, 10 aa, Homo Sapiens
RPQELDEAVL

SEQ ID NO: 109248 - protein, 10 aa, Homo Sapiens
RPQEVPAEAL

SEQ ID NO: 109249 - protein, 10 aa, Homo Sapiens
RPQLHKNTVL

SEQ ID NO: 109250 - protein, 10 aa, Homo Sapiens
RPQRATSNVF

SEQ ID NO: 109251 - protein, 10 aa, Homo Sapiens
RPRDASTLGL

SEQ ID NO: 109252 - protein, 10 aa, Homo Sapiens
RPRDKQMELL

SEQ ID NO: 109253 - protein, 10 aa, Homo Sapiens
RPRDSQLYAV

SEQ ID NO: 109254 - protein, 10 aa, Homo Sapiens
RPREAEVRFL

SEQ ID NO: 109255 - protein, 10 aa, Homo Sapiens
RPRGFAYVQF

SEQ ID NO: 109256 - protein, 10 aa, Homo Sapiens
RPRKAFLLLL

SEQ ID NO: 109257 - protein, 10 aa, Homo Sapiens
RPRLQHSFSF

SEQ ID NO: 109258 - protein, 10 aa, Homo Sapiens
RPRPDEERPL

SEQ ID NO: 109259 - protein, 10 aa, Homo Sapiens
RPRPDPSPEI

SEQ ID NO: 109260 - protein, 10 aa, Homo Sapiens
RPRPEYVAIF

SEQ ID NO: 109261 - protein, 10 aa, Homo Sapiens
RPRPHSAPSL

SEQ ID NO: 109262 - protein, 10 aa, Homo Sapiens
RPRPNTFVIR

SEQ ID NO: 109263 - protein, 10 aa, Homo Sapiens
RPRPPPVEQV

SEQ ID NO: 109264 - protein, 10 aa, Homo Sapiens
RPRPSEDTFL

SEQ ID NO: 109265 - protein, 10 aa, Homo Sapiens
RPRPSGEEVL

SEQ ID NO: 109266 - protein, 10 aa, Homo Sapiens
RPRPWRGNTL

SEQ ID NO: 109267 - protein, 10 aa, Homo Sapiens
RPRSWRELPL

SEQ ID NO: 109268 - protein, 10 aa, Homo Sapiens
RPRVALQQSF

SEQ ID NO: 109269 - protein, 10 aa, Homo Sapiens
RPSDEVIREL

SEQ ID NO: 109270 - protein, 10 aa, Homo Sapiens
RPSEKNQHIM

SEQ ID NO: 109271 - protein, 10 aa, Homo Sapiens
RPSGEAFVEL

SEQ ID NO: 109272 - protein, 10 aa, Homo Sapiens
RPSLNIATVL

SEQ ID NO: 109273 - protein, 10 aa, Homo Sapiens
RPSQNNTIGL

SEQ ID NO: 109274 - protein, 10 aa, Homo Sapiens
RPSSKKTYSL

SEQ ID NO: 109275 - protein, 10 aa, Homo Sapiens
RPSSQYIVAL

SEQ ID NO: 109276 - protein, 10 aa, Homo Sapiens
RPSTPHTITL

SEQ ID NO: 109277 - protein, 10 aa, Homo Sapiens
RPSTRIQQQL

SEQ ID NO: 109278 - protein, 10 aa, Homo Sapiens
RPVAPSGTAL

SEQ ID NO: 109279 - protein, 10 aa, Homo Sapiens
RPWEKNSTTL

SEQ ID NO: 109280 - protein, 10 aa, Homo Sapiens
RPWLEGRHTL

SEQ ID NO: 109281 - protein, 10 aa, Homo Sapiens
RPWVSGHRKL

SEQ ID NO: 109282 - protein, 10 aa, Homo Sapiens
RPYAAGGKKL

SEQ ID NO: 109283 - protein, 10 aa, Homo Sapiens
RPYPSPGAVL

SEQ ID NO: 109284 - protein, 10 aa, Homo Sapiens
RVAPEEHPVL

SEQ ID NO: 109285 - protein, 10 aa, Homo Sapiens
RVKEPVKELL

SEQ ID NO: 109286 - protein, 10 aa, Homo Sapiens
RVKGNNVYCL

SEQ ID NO: 109287 - protein, 10 aa, Homo Sapiens
RVKPYIRTSL

SEQ ID NO: 109288 - protein, 10 aa, Homo Sapiens
SARPADEIAV

SEQ ID NO: 109289 - protein, 10 aa, Homo Sapiens
SASVKKPHTL

SEQ ID NO: 109290 - protein, 10 aa, Homo Sapiens
SPAAPSPLAL

SEQ ID NO: 109291 - protein, 10 aa, Homo Sapiens
SPAGSIVHEL

SEQ ID NO: 109292 - protein, 10 aa, Homo Sapiens
SPALTISKVL

SEQ ID NO: 109293 - protein, 10 aa, Homo Sapiens
SPAPGRRLSL

SEQ ID NO: 109294 - protein, 10 aa, Homo Sapiens
SPASRSISLL

SEQ ID NO: 109295 - protein, 10 aa, Homo Sapiens
SPATTVVRTL

SEQ ID NO: 109296 - protein, 10 aa, Homo Sapiens
SPCERYLVTF

SEQ ID NO: 109297 - protein, 10 aa, Homo Sapiens
SPCQDFGKRM

SEQ ID NO: 109298 - protein, 10 aa, Homo Sapiens
SPDYERIINL

SEQ ID NO: 109299 - protein, 10 aa, Homo Sapiens
SPEGPSKPSL

SEQ ID NO: 109300 - protein, 10 aa, Homo Sapiens
SPGVVHLVAF

SEQ ID NO: 109301 - protein, 10 aa, Homo Sapiens
SPHPGVGVPT

SEQ ID NO: 109302 - protein, 10 aa, Homo Sapiens
SPIPAGSKKI

SEQ ID NO: 109303 - protein, 10 aa, Homo Sapiens
SPIRREKLAL

SEQ ID NO: 109304 - protein, 10 aa, Homo Sapiens
SPKAALRYAA

SEQ ID NO: 109305 - protein, 10 aa, Homo Sapiens
SPKAPDPEGL

SEQ ID NO: 109306 - protein, 10 aa, Homo Sapiens
SPKETFNASF

SEQ ID NO: 109307 - protein, 10 aa, Homo Sapiens
SPKGCGTVLL

SEQ ID NO: 109308 - protein, 10 aa, Homo Sapiens
SPKGTIENIL

SEQ ID NO: 109309 - protein, 10 aa, Homo Sapiens
SPKGTYLATF

SEQ ID NO: 109310 - protein, 10 aa, Homo Sapiens
SPKKPVIVFV

SEQ ID NO: 109311 - protein, 10 aa, Homo Sapiens
SPKPALCVTL

SEQ ID NO: 109312 - protein, 10 aa, Homo Sapiens
SPKPNNSYMF

SEQ ID NO: 109313 - protein, 10 aa, Homo Sapiens
SPKQILDPAA

SEQ ID NO: 109314 - protein, 10 aa, Homo Sapiens
SPKTPGCSDL

SEQ ID NO: 109315 - protein, 10 aa, Homo Sapiens
SPLCRSLQVL

SEQ ID NO: 109316 - protein, 10 aa, Homo Sapiens
SPLDMKDGFL

SEQ ID NO: 109317 - protein, 10 aa, Homo Sapiens
SPLSAARAAL

SEQ ID NO: 109318 - protein, 10 aa, Homo Sapiens
SPMDDGFVSL

SEQ ID NO: 109319 - protein, 10 aa, Homo Sapiens
SPMDGTSSAL

SEQ ID NO: 109320 - protein, 10 aa, Homo Sapiens
SPMEGTGISL

SEQ ID NO: 109321 - protein, 10 aa, Homo Sapiens
SPMPGTLTAL

SEQ ID NO: 109322 - protein, 10 aa, Homo Sapiens
SPMPWKGVTV

SEQ ID NO: 109323 - protein, 10 aa, Homo Sapiens
SPNACGGIAL

SEQ ID NO: 109324 - protein, 10 aa, Homo Sapiens
SPNEPKAATL

SEQ ID NO: 109325 - protein, 10 aa, Homo Sapiens
SPNGNLIRML

SEQ ID NO: 109326 - protein, 10 aa, Homo Sapiens
SPNPARGHSV

SEQ ID NO: 109327 - protein, 10 aa, Homo Sapiens
SPNPDREAIL

SEQ ID NO: 109328 - protein, 10 aa, Homo Sapiens
SPNSAHAVSL

SEQ ID NO: 109329 - protein, 10 aa, Homo Sapiens
SPNTAGLRSL

SEQ ID NO: 109330 - protein, 10 aa, Homo Sapiens
SPPELKRPRL

SEQ ID NO: 109331 - protein, 10 aa, Homo Sapiens
SPPPAKKLAL

SEQ ID NO: 109332 - protein, 10 aa, Homo Sapiens
SPPPTKFIVM

SEQ ID NO: 109333 - protein, 10 aa, Homo Sapiens
SPPSAARHSL

SEQ ID NO: 109334 - protein, 10 aa, Homo Sapiens
SPQKKNHLVL

SEQ ID NO: 109335 - protein, 10 aa, Homo Sapiens
SPQPPKKDSL

SEQ ID NO: 109336 - protein, 10 aa, Homo Sapiens
SPQSGNFRQL

SEQ ID NO: 109337 - protein, 10 aa, Homo Sapiens
SPQYRLRIAM

SEQ ID NO: 109338 - protein, 10 aa, Homo Sapiens
SPRDSPAVSL

SEQ ID NO: 109339 - protein, 10 aa, Homo Sapiens
SPREEPRAPW

SEQ ID NO: 109340 - protein, 10 aa, Homo Sapiens
SPRELTQNPL

SEQ ID NO: 109341 - protein, 10 aa, Homo Sapiens
SPRPALPALL

SEQ ID NO: 109342 - protein, 10 aa, Homo Sapiens
SPRPNHSYIF

SEQ ID NO: 109343 - protein, 10 aa, Homo Sapiens
SPRPPLGSSL

SEQ ID NO: 109344 - protein, 10 aa, Homo Sapiens
SPRRTLEHYF

SEQ ID NO: 109345 - protein, 10 aa, Homo Sapiens
SPRSPTQHCL

SEQ ID NO: 109346 - protein, 10 aa, Homo Sapiens
SPRSSTVHIL

SEQ ID NO: 109347 - protein, 10 aa, Homo Sapiens
SPSSVTGNAL

SEQ ID NO: 109348 - protein, 10 aa, Homo Sapiens
SPTPVSWHVM

SEQ ID NO: 109349 - protein, 10 aa, Homo Sapiens
SPVSYLRVSM

SEQ ID NO: 109350 - protein, 10 aa, Homo Sapiens
SPYDHSRVKL

SEQ ID NO: 109351 - protein, 10 aa, Homo Sapiens
SPYSKSGPAL

SEQ ID NO: 109352 - protein, 10 aa, Homo Sapiens
SSALRVNPAL

SEQ ID NO: 109353 - protein, 10 aa, Homo Sapiens
SSPKLPVSSL

SEQ ID NO: 109354 - protein, 10 aa, Homo Sapiens
SVMDKQYEIL

SEQ ID NO: 109355 - protein, 10 aa, Homo Sapiens
TAKPQQIQAL

SEQ ID NO: 109356 - protein, 10 aa, Homo Sapiens
TAKPQSTTSL

SEQ ID NO: 109357 - protein, 10 aa, Homo Sapiens
TDAIKLNPRL

SEQ ID NO: 109358 - protein, 10 aa, Homo Sapiens
TPAPPGPATM

SEQ ID NO: 109359 - protein, 10 aa, Homo Sapiens
TPAPSRTASF

SEQ ID NO: 109360 - protein, 10 aa, Homo Sapiens
TPDQGKARLL

SEQ ID NO: 109361 - protein, 10 aa, Homo Sapiens
TPHDFIEHIL

SEQ ID NO: 109362 - protein, 10 aa, Homo Sapiens
TPIGVQAEAL

SEQ ID NO: 109363 - protein, 10 aa, Homo Sapiens
TPKIGAISSL

SEQ ID NO: 109364 - protein, 10 aa, Homo Sapiens
TPKPQTKELM

SEQ ID NO: 109365 - protein, 10 aa, Homo Sapiens
TPKQKPKTPF

SEQ ID NO: 109366 - protein, 10 aa, Homo Sapiens
TPKSSASSTF

SEQ ID NO: 109367 - protein, 10 aa, Homo Sapiens
TPKTVFFESL

SEQ ID NO: 109368 - protein, 10 aa, Homo Sapiens
TPKWITPVLL

SEQ ID NO: 109369 - protein, 10 aa, Homo Sapiens
TPKYSQVLGL

SEQ ID NO: 109370 - protein, 10 aa, Homo Sapiens
TPLASTSNSL

SEQ ID NO: 109371 - protein, 10 aa, Homo Sapiens
TPLLMQALPM

SEQ ID NO: 109372 - protein, 10 aa, Homo Sapiens
TPLPQPNRAL

SEQ ID NO: 109373 - protein, 10 aa, Homo Sapiens
TPMSSHGRVL

SEQ ID NO: 109374 - protein, 10 aa, Homo Sapiens
TPNEHHDHLL

SEQ ID NO: 109375 - protein, 10 aa, Homo Sapiens
TPNPGYQPSM

SEQ ID NO: 109376 - protein, 10 aa, Homo Sapiens
TPPPLPKPAL

SEQ ID NO: 109377 - protein, 10 aa, Homo Sapiens
TPQALRFEEL

SEQ ID NO: 109378 - protein, 10 aa, Homo Sapiens
TPQERVEEVL

SEQ ID NO: 109379 - protein, 10 aa, Homo Sapiens
TPREPNRWAV

SEQ ID NO: 109380 - protein, 10 aa, Homo Sapiens
TPRGPDPALL

SEQ ID NO: 109381 - protein, 10 aa, Homo Sapiens
TPRPDDPSPL

SEQ ID NO: 109382 - protein, 10 aa, Homo Sapiens
TPRSYVGVTL

SEQ ID NO: 109383 - protein, 10 aa, Homo Sapiens
TPSLGKCRAL

SEQ ID NO: 109384 - protein, 10 aa, Homo Sapiens
TPSNNVHTSL

SEQ ID NO: 109385 - protein, 10 aa, Homo Sapiens
TPSPYDHDSL

SEQ ID NO: 109386 - protein, 10 aa, Homo Sapiens
TPSSSKKVTF

SEQ ID NO: 109387 - protein, 10 aa, Homo Sapiens
TPTSAPRSVM

SEQ ID NO: 109388 - protein, 10 aa, Homo Sapiens
TPVPIKDMEI

SEQ ID NO: 109389 - protein, 10 aa, Homo Sapiens
TVKDVNQQEF

SEQ ID NO: 109390 - protein, 10 aa, Homo Sapiens
TVKPHIGEVF

SEQ ID NO: 109391 - protein, 10 aa, Homo Sapiens
VLSAADKGNV

SEQ ID NO: 109392 - protein, 10 aa, Homo Sapiens
VPAAREPEVL

SEQ ID NO: 109393 - protein, 10 aa, Homo Sapiens
VPAARSILAL

SEQ ID NO: 109394 - protein, 10 aa, Homo Sapiens
VPAGIRPQSI

SEQ ID NO: 109395 - protein, 10 aa, Homo Sapiens
VPAPGKLFAL

SEQ ID NO: 109396 - protein, 10 aa, Homo Sapiens
VPAPSANKEL

SEQ ID NO: 109397 - protein, 10 aa, Homo Sapiens
VPAPVPLMSL

SEQ ID NO: 109398 - protein, 10 aa, Homo Sapiens
VPASQKLRQL

SEQ ID NO: 109399 - protein, 10 aa, Homo Sapiens
VPFSVPKIPL

SEQ ID NO: 109400 - protein, 10 aa, Homo Sapiens
VPIPRSPYTV

SEQ ID NO: 109401 - protein, 10 aa, Homo Sapiens
VPKADSGAFL

SEQ ID NO: 109402 - protein, 10 aa, Homo Sapiens
VPKAPGFAQM

SEQ ID NO: 109403 - protein, 10 aa, Homo Sapiens
VPKGNTAVSV

SEQ ID NO: 109404 - protein, 10 aa, Homo Sapiens
VPKIFMKPDF

SEQ ID NO: 109405 - protein, 10 aa, Homo Sapiens
VPKKISFKSL

SEQ ID NO: 109406 - protein, 10 aa, Homo Sapiens
VPKKPGPPVL

SEQ ID NO: 109407 - protein, 10 aa, Homo Sapiens
VPKLVKEEVF

SEQ ID NO: 109408 - protein, 10 aa, Homo Sapiens
VPKNFIDIQF

SEQ ID NO: 109409 - protein, 10 aa, Homo Sapiens
VPKNYKLVAA

SEQ ID NO: 109410 - protein, 10 aa, Homo Sapiens
VPKPGAGSKL

SEQ ID NO: 109411 - protein, 10 aa, Homo Sapiens
VPKPGKGADL

SEQ ID NO: 109412 - protein, 10 aa, Homo Sapiens
VPKPIGGVVV

SEQ ID NO: 109413 - protein, 10 aa, Homo Sapiens
VPKPPSIEEF

SEQ ID NO: 109414 - protein, 10 aa, Homo Sapiens
VPKPPVPAVL

SEQ ID NO: 109415 - protein, 10 aa, Homo Sapiens
VPKSALIPVI

SEQ ID NO: 109416 - protein, 10 aa, Homo Sapiens
VPLPPGKPAL

SEQ ID NO: 109417 - protein, 10 aa, Homo Sapiens
VPLPPKGRVL

SEQ ID NO: 109418 - protein, 10 aa, Homo Sapiens
VPMKCLQQAL

SEQ ID NO: 109419 - protein, 10 aa, Homo Sapiens
VPNGALKKSL

SEQ ID NO: 109420 - protein, 10 aa, Homo Sapiens
VPNPMVHPSF

SEQ ID NO: 109421 - protein, 10 aa, Homo Sapiens
VPPAVTGITF

SEQ ID NO: 109422 - protein, 10 aa, Homo Sapiens
VPPNHVGKPL

SEQ ID NO: 109423 - protein, 10 aa, Homo Sapiens
VPPREKSVAL

SEQ ID NO: 109424 - protein, 10 aa, Homo Sapiens
VPRFLMSSTM

SEQ ID NO: 109425 - protein, 10 aa, Homo Sapiens
VPRPAARVAL

SEQ ID NO: 109426 - protein, 10 aa, Homo Sapiens
VPRPPDTVST

SEQ ID NO: 109427 - protein, 10 aa, Homo Sapiens
VPRPPPLYSH

SEQ ID NO: 109428 - protein, 10 aa, Homo Sapiens
VPRPPSNPPA

SEQ ID NO: 109429 - protein, 10 aa, Homo Sapiens
VPRQPTVTSV

SEQ ID NO: 109430 - protein, 10 aa, Homo Sapiens
VPSLIKQQVL

SEQ ID NO: 109431 - protein, 10 aa, Homo Sapiens
VPSPAHIEKL

SEQ ID NO: 109432 - protein, 10 aa, Homo Sapiens
VPSPALPRSL

SEQ ID NO: 109433 - protein, 10 aa, Homo Sapiens
VPVGWESHLA

SEQ ID NO: 109434 - protein, 10 aa, Homo Sapiens
VPVLNTKKAL

SEQ ID NO: 109435 - protein, 10 aa, Homo Sapiens
VPVSTINHAF

SEQ ID NO: 109436 - protein, 10 aa, Homo Sapiens
VPVSVGAYFF

SEQ ID NO: 109437 - protein, 10 aa, Homo Sapiens
VPYPRIHFPL

SEQ ID NO: 109438 - protein, 10 aa, Homo Sapiens
VVPPFLQPEV

SEQ ID NO: 109439 - protein, 10 aa, Homo Sapiens
WPKDVGIVAL

SEQ ID NO: 109440 - protein, 10 aa, Homo Sapiens
YPFKPPKVAF

SEQ ID NO: 109441 - protein, 10 aa, Homo Sapiens
YPFKPPKVTF

SEQ ID NO: 109442 - protein, 10 aa, Homo Sapiens
YPIALTRAEM

SEQ ID NO: 109443 - protein, 10 aa, Homo Sapiens
YPKGIHVETL

SEQ ID NO: 109444 - protein, 10 aa, Homo Sapiens
YPKKPKDEAF

SEQ ID NO: 109445 - protein, 10 aa, Homo Sapiens
YPLERGFIYV

SEQ ID NO: 109446 - protein, 10 aa, Homo Sapiens
YPMDLGGRNF

SEQ ID NO: 109447 - protein, 10 aa, Homo Sapiens
YPNGVVVHYF

SEQ ID NO: 109448 - protein, 10 aa, Homo Sapiens
YPNPYSKHVL

SEQ ID NO: 109449 - protein, 10 aa, Homo Sapiens
YPSLPKSLPL

SEQ ID NO: 109450 - protein, 10 aa, Homo Sapiens
YPVKSEGKEL

SEQ ID NO: 109451 - protein, 10 aa, Homo Sapiens
YSKYYKTIDD

SEQ ID NO: 109452 - protein, 11 aa, Homo Sapiens
AAQDKPSAEVL

SEQ ID NO: 109453 - protein, 11 aa, Homo Sapiens
AASKERSGVSL

SEQ ID NO: 109454 - protein, 11 aa, Homo Sapiens
AGAAVRIGSVL

SEQ ID NO: 109455 - protein, 11 aa, Homo Sapiens
ALPHAILRLDL

SEQ ID NO: 109456 - protein, 11 aa, Homo Sapiens
APAAYPREVAL

SEQ ID NO: 109457 - protein, 11 aa, Homo Sapiens
APAGGLTEQEL

SEQ ID NO: 109458 - protein, 11 aa, Homo Sapiens
APAKHLIASML

SEQ ID NO: 109459 - protein, 11 aa, Homo Sapiens
APALARTLQSL

SEQ ID NO: 109460 - protein, 11 aa, Homo Sapiens
APAPQGCAVAL

SEQ ID NO: 109461 - protein, 11 aa, Homo Sapiens
APCSVAPGKSL

SEQ ID NO: 109462 - protein, 11 aa, Homo Sapiens
APDAAPAPASI

SEQ ID NO: 109463 - protein, 11 aa, Homo Sapiens
APDSIRGSFGL

SEQ ID NO: 109464 - protein, 11 aa, Homo Sapiens
APEPASQARVL

SEQ ID NO: 109465 - protein, 11 aa, Homo Sapiens
APESVQKAKMM

SEQ ID NO: 109466 - protein, 11 aa, Homo Sapiens
APGPEFSGHSL

SEQ ID NO: 109467 - protein, 11 aa, Homo Sapiens
APKCSQDQGVL

SEQ ID NO: 109468 - protein, 11 aa, Homo Sapiens
APKGLWSQNQL

SEQ ID NO: 109469 - protein, 11 aa, Homo Sapiens
APKGPSRESVV

SEQ ID NO: 109470 - protein, 11 aa, Homo Sapiens
APKGTKRDPAL

SEQ ID NO: 109471 - protein, 11 aa, Homo Sapiens
APKIGSNGVEM

SEQ ID NO: 109472 - protein, 11 aa, Homo Sapiens
APKPYHKFMAF

SEQ ID NO: 109473 - protein, 11 aa, Homo Sapiens
APKSRQELIAL

SEQ ID NO: 109474 - protein, 11 aa, Homo Sapiens
APLPPYFSRTL

SEQ ID NO: 109475 - protein, 11 aa, Homo Sapiens
APMGREGVTAM

SEQ ID NO: 109476 - protein, 11 aa, Homo Sapiens
APNLGRSFHIL

SEQ ID NO: 109477 - protein, 11 aa, Homo Sapiens
APNPAKATVTA

SEQ ID NO: 109478 - protein, 11 aa, Homo Sapiens
APNPYRSENCL

SEQ ID NO: 109479 - protein, 11 aa, Homo Sapiens
APPPVVGAKRL

SEQ ID NO: 109480 - protein, 11 aa, Homo Sapiens
APQAPGDNHVV

SEQ ID NO: 109481 - protein, 11 aa, Homo Sapiens
APQPGKYVICV

SEQ ID NO: 109482 - protein, 11 aa, Homo Sapiens
APQPHRHVLEI

SEQ ID NO: 109483 - protein, 11 aa, Homo Sapiens
APRADEITRRL

SEQ ID NO: 109484 - protein, 11 aa, Homo Sapiens
APREALAQTVL

SEQ ID NO: 109485 - protein, 11 aa, Homo Sapiens
APRHPSTNSLL

SEQ ID NO: 109486 - protein, 11 aa, Homo Sapiens
APRPDSRHHSL

SEQ ID NO: 109487 - protein, 11 aa, Homo Sapiens
APRPSTGPHKL

SEQ ID NO: 109488 - protein, 11 aa, Homo Sapiens
APRQPGLMAQM

SEQ ID NO: 109489 - protein, 11 aa, Homo Sapiens
APSAAKLLVQL

SEQ ID NO: 109490 - protein, 11 aa, Homo Sapiens
APSGLRSQVQF

SEQ ID NO: 109491 - protein, 11 aa, Homo Sapiens
APSGQHSQAQL

SEQ ID NO: 109492 - protein, 11 aa, Homo Sapiens
APSHLMALLTL

SEQ ID NO: 109493 - protein, 11 aa, Homo Sapiens
APSSSGPGHLV

SEQ ID NO: 109494 - protein, 11 aa, Homo Sapiens
APTQEKIFAVL

SEQ ID NO: 109495 - protein, 11 aa, Homo Sapiens
APYERRAMELL

SEQ ID NO: 109496 - protein, 11 aa, Homo Sapiens
APYGKNQVQAL

SEQ ID NO: 109497 - protein, 11 aa, Homo Sapiens
APYHSRSAYIA

SEQ ID NO: 109498 - protein, 11 aa, Homo Sapiens
APYMRSMMQSL

SEQ ID NO: 109499 - protein, 11 aa, Homo Sapiens
APYMRSMMQTL

SEQ ID NO: 109500 - protein, 11 aa, Homo Sapiens
DMEKIWHHTFY

SEQ ID NO: 109501 - protein, 11 aa, Homo Sapiens
EPEEFVVEKVL

SEQ ID NO: 109502 - protein, 11 aa, Homo Sapiens
EPREASPLHSL

SEQ ID NO: 109503 - protein, 11 aa, Homo Sapiens
EPRPFPKLRIL

SEQ ID NO: 109504 - protein, 11 aa, Homo Sapiens
EPRVATVTRIL

SEQ ID NO: 109505 - protein, 11 aa, Homo Sapiens
EPSRELAEQTL

SEQ ID NO: 109506 - protein, 11 aa, Homo Sapiens
FAKPVYPGQTL

SEQ ID NO: 109507 - protein, 11 aa, Homo Sapiens
FASKEIAENAL

SEQ ID NO: 109508 - protein, 11 aa, Homo Sapiens
FPETNNILKIV

SEQ ID NO: 109509 - protein, 11 aa, Homo Sapiens
FPISRGIPNML

SEQ ID NO: 109510 - protein, 11 aa, Homo Sapiens
FPKPGTLVQCL

SEQ ID NO: 109511 - protein, 11 aa, Homo Sapiens
FPMGDRLYIGL

SEQ ID NO: 109512 - protein, 11 aa, Homo Sapiens
FPNIVIKGSEL

SEQ ID NO: 109513 - protein, 11 aa, Homo Sapiens
FPPPSLPSKSV

SEQ ID NO: 109514 - protein, 11 aa, Homo Sapiens
FPRSYVQPVHL

SEQ ID NO: 109515 - protein, 11 aa, Homo Sapiens
FPRTAAPGHDL

SEQ ID NO: 109516 - protein, 11 aa, Homo Sapiens
FPTQVIPLKTL

SEQ ID NO: 109517 - protein, 11 aa, Homo Sapiens
FSASVKKPHTL

SEQ ID NO: 109518 - protein, 11 aa, Homo Sapiens
GMGQKDSYVGD

SEQ ID NO: 109519 - protein, 11 aa, Homo Sapiens
GPMPQTREHLL

SEQ ID NO: 109520 - protein, 11 aa, Homo Sapiens
GPSGAAAMRSM

SEQ ID NO: 109521 - protein, 11 aa, Homo Sapiens
GPSRSNVVKIL

SEQ ID NO: 109522 - protein, 11 aa, Homo Sapiens
GPYLTHQQKVL

SEQ ID NO: 109523 - protein, 11 aa, Homo Sapiens
HESEQLGSISV

SEQ ID NO: 109524 - protein, 11 aa, Homo Sapiens
HLAAPKLGVAL

SEQ ID NO: 109525 - protein, 11 aa, Homo Sapiens
HPADPGSRPHL

SEQ ID NO: 109526 - protein, 11 aa, Homo Sapiens
HPAPLCTIRTL

SEQ ID NO: 109527 - protein, 11 aa, Homo Sapiens
HPHSGSGRSVL

SEQ ID NO: 109528 - protein, 11 aa, Homo Sapiens
HPIPRVFQNRF

SEQ ID NO: 109529 - protein, 11 aa, Homo Sapiens
HPISSEELLSL

SEQ ID NO: 109530 - protein, 11 aa, Homo Sapiens
HPKGRDNIIDL

SEQ ID NO: 109531 - protein, 11 aa, Homo Sapiens
HPKPSACRNLF

SEQ ID NO: 109532 - protein, 11 aa, Homo Sapiens
HPKRPWILTSL

SEQ ID NO: 109533 - protein, 11 aa, Homo Sapiens
HPKVNVPGSQA

SEQ ID NO: 109534 - protein, 11 aa, Homo Sapiens
HPNKPKDHVFL

SEQ ID NO: 109535 - protein, 11 aa, Homo Sapiens
HPPLKIDGKTI

SEQ ID NO: 109536 - protein, 11 aa, Homo Sapiens
HPPLTIDGKTI

SEQ ID NO: 109537 - protein, 11 aa, Homo Sapiens
HPPTSGVEKVL

SEQ ID NO: 109538 - protein, 11 aa, Homo Sapiens
HPRDPNLLLSV

SEQ ID NO: 109539 - protein, 11 aa, Homo Sapiens
HPSASLIDRTI

SEQ ID NO: 109540 - protein, 11 aa, Homo Sapiens
HPSETRTLVAV

SEQ ID NO: 109541 - protein, 11 aa, Homo Sapiens
HPYGHRKFITM

SEQ ID NO: 109542 - protein, 11 aa, Homo Sapiens
HPYPPGPGVAL

SEQ ID NO: 109543 - protein, 11 aa, Homo Sapiens
IPCNNKGAHSV

SEQ ID NO: 109544 - protein, 11 aa, Homo Sapiens
IPDASKLQFIL

SEQ ID NO: 109545 - protein, 11 aa, Homo Sapiens
IPKDYKTMAAL

SEQ ID NO: 109546 - protein, 11 aa, Homo Sapiens
IPKDYKTMTAL

SEQ ID NO: 109547 - protein, 11 aa, Homo Sapiens
IPKFFKHFPEL

SEQ ID NO: 109548 - protein, 11 aa, Homo Sapiens
IPKKMENPHSL

SEQ ID NO: 109549 - protein, 11 aa, Homo Sapiens
IPKNVATETQL

SEQ ID NO: 109550 - protein, 11 aa, Homo Sapiens
IPKPSKDGVTV

SEQ ID NO: 109551 - protein, 11 aa, Homo Sapiens
IPKSKTKEQIL

SEQ ID NO: 109552 - protein, 11 aa, Homo Sapiens
IPLAKDFYVAF

SEQ ID NO: 109553 - protein, 11 aa, Homo Sapiens
IPLKPSPSKKF

SEQ ID NO: 109554 - protein, 11 aa, Homo Sapiens
IPNSHHHHQMM

SEQ ID NO: 109555 - protein, 11 aa, Homo Sapiens
IPPPYDKKKRM

SEQ ID NO: 109556 - protein, 11 aa, Homo Sapiens
IPPSYKSTVTL

SEQ ID NO: 109557 - protein, 11 aa, Homo Sapiens
IPQGGRGAIQF

SEQ ID NO: 109558 - protein, 11 aa, Homo Sapiens
IPQQSQSVKQL

SEQ ID NO: 109559 - protein, 11 aa, Homo Sapiens
IPQVTSDGKRL

SEQ ID NO: 109560 - protein, 11 aa, Homo Sapiens
IPRRQEHDISL

SEQ ID NO: 109561 - protein, 11 aa, Homo Sapiens
IPSADRHKSKL

SEQ ID NO: 109562 - protein, 11 aa, Homo Sapiens
IPSEDIARNLM

SEQ ID NO: 109563 - protein, 11 aa, Homo Sapiens
IPSPGQLQHRV

SEQ ID NO: 109564 - protein, 11 aa, Homo Sapiens
IPSSSHVSNNM

SEQ ID NO: 109565 - protein, 11 aa, Homo Sapiens
IPSSVIHPAMV

SEQ ID NO: 109566 - protein, 11 aa, Homo Sapiens
IPSTELAKQVI

SEQ ID NO: 109567 - protein, 11 aa, Homo Sapiens
IPYHSEVPVSL

SEQ ID NO: 109568 - protein, 11 aa, Homo Sapiens
IVSQKKADEVL

SEQ ID NO: 109569 - protein, 11 aa, Homo Sapiens
KIKPNNPKHTL

SEQ ID NO: 109570 - protein, 11 aa, Homo Sapiens
KLKPTSKDQVL

SEQ ID NO: 109571 - protein, 11 aa, Homo Sapiens
KPAASATPFAL

SEQ ID NO: 109572 - protein, 11 aa, Homo Sapiens
KPANAVLHKVL

SEQ ID NO: 109573 - protein, 11 aa, Homo Sapiens
KPFDKFQFERL

SEQ ID NO: 109574 - protein, 11 aa, Homo Sapiens
KPHFRNTVERM

SEQ ID NO: 109575 - protein, 11 aa, Homo Sapiens
KPIAGKVIHAL

SEQ ID NO: 109576 - protein, 11 aa, Homo Sapiens
KPKDPKVISEL

SEQ ID NO: 109577 - protein, 11 aa, Homo Sapiens
KPKENNFKAVL

SEQ ID NO: 109578 - protein, 11 aa, Homo Sapiens
KPKGPTSAELL

SEQ ID NO: 109579 - protein, 11 aa, Homo Sapiens
KPKKTEITDKL

SEQ ID NO: 109580 - protein, 11 aa, Homo Sapiens
KPKNPEFTSGL

SEQ ID NO: 109581 - protein, 11 aa, Homo Sapiens
KPKPFGSEEQL

SEQ ID NO: 109582 - protein, 11 aa, Homo Sapiens
KPKSEMTPEEL

SEQ ID NO: 109583 - protein, 11 aa, Homo Sapiens
KPKTPSLTVFL

SEQ ID NO: 109584 - protein, 11 aa, Homo Sapiens
KPKWNHLVHKF

SEQ ID NO: 109585 - protein, 11 aa, Homo Sapiens
KPNDSRALQLM

SEQ ID NO: 109586 - protein, 11 aa, Homo Sapiens
KPNDVSVFTTL

SEQ ID NO: 109587 - protein, 11 aa, Homo Sapiens
KPNEFASQINL

SEQ ID NO: 109588 - protein, 11 aa, Homo Sapiens
KPNGKVASVEM

SEQ ID NO: 109589 - protein, 11 aa, Homo Sapiens
KPNSFVKFRCM

SEQ ID NO: 109590 - protein, 11 aa, Homo Sapiens
KPPNPALGKTA

SEQ ID NO: 109591 - protein, 11 aa, Homo Sapiens
KPPPQKSLKEL

SEQ ID NO: 109592 - protein, 11 aa, Homo Sapiens
KPPPSECNPAL

SEQ ID NO: 109593 - protein, 11 aa, Homo Sapiens
KPPVSITKKKL

SEQ ID NO: 109594 - protein, 11 aa, Homo Sapiens
KPQDYKKRLSV

SEQ ID NO: 109595 - protein, 11 aa, Homo Sapiens
KPSAMKVGEKL

SEQ ID NO: 109596 - protein, 11 aa, Homo Sapiens
KPSLAQSIAKI

SEQ ID NO: 109597 - protein, 11 aa, Homo Sapiens
KPSNSKSETTL

SEQ ID NO: 109598 - protein, 11 aa, Homo Sapiens
KPSPLLVGREF

SEQ ID NO: 109599 - protein, 11 aa, Homo Sapiens
KPTPVKPNYAL

SEQ ID NO: 109600 - protein, 11 aa, Homo Sapiens
LPAAANSRKQF

SEQ ID NO: 109601 - protein, 11 aa, Homo Sapiens
LPDLQRSKQAL

SEQ ID NO: 109602 - protein, 11 aa, Homo Sapiens
LPDSGGVAKTM

SEQ ID NO: 109603 - protein, 11 aa, Homo Sapiens
LPESNNQVKTL

SEQ ID NO: 109604 - protein, 11 aa, Homo Sapiens
LPIERVKKNLL

SEQ ID NO: 109605 - protein, 11 aa, Homo Sapiens
LPKEIGELTQL

SEQ ID NO: 109606 - protein, 11 aa, Homo Sapiens
LPKKVGKWYQL

SEQ ID NO: 109607 - protein, 11 aa, Homo Sapiens
LPKPPKPVSKM

SEQ ID NO: 109608 - protein, 11 aa, Homo Sapiens
LPLFPEPLHVF

SEQ ID NO: 109609 - protein, 11 aa, Homo Sapiens
LPLPLRKPTTL

SEQ ID NO: 109610 - protein, 11 aa, Homo Sapiens
LPMGALPQGPM

SEQ ID NO: 109611 - protein, 11 aa, Homo Sapiens
LPMGRDSREML

SEQ ID NO: 109612 - protein, 11 aa, Homo Sapiens
LPQRVLEQHKL

SEQ ID NO: 109613 - protein, 11 aa, Homo Sapiens
LPQSTDPLRTF

SEQ ID NO: 109614 - protein, 11 aa, Homo Sapiens
LPRKNLPERLL

SEQ ID NO: 109615 - protein, 11 aa, Homo Sapiens
LPSDSHFKITF

SEQ ID NO: 109616 - protein, 11 aa, Homo Sapiens
LPSGDRVAVSV

SEQ ID NO: 109617 - protein, 11 aa, Homo Sapiens
LPSGNNNGKVL

SEQ ID NO: 109618 - protein, 11 aa, Homo Sapiens
LPSQSRNKETL

SEQ ID NO: 109619 - protein, 11 aa, Homo Sapiens
LPSRSLSVNTL

SEQ ID NO: 109620 - protein, 11 aa, Homo Sapiens
LPTAGTVGRVL

SEQ ID NO: 109621 - protein, 11 aa, Homo Sapiens
LPTTTGSAHAL

SEQ ID NO: 109622 - protein, 11 aa, Homo Sapiens
LPVGRSVDETL

SEQ ID NO: 109623 - protein, 11 aa, Homo Sapiens
LPVGRSVEETL

SEQ ID NO: 109624 - protein, 11 aa, Homo Sapiens
LPYDRNISNYF

SEQ ID NO: 109625 - protein, 11 aa, Homo Sapiens
LPYNNKDRDAL

SEQ ID NO: 109626 - protein, 11 aa, Homo Sapiens
LPYTERHFQRL

SEQ ID NO: 109627 - protein, 11 aa, Homo Sapiens
LSSPKLPVSSL

SEQ ID NO: 109628 - protein, 11 aa, Homo Sapiens
MAPSETQFSHL

SEQ ID NO: 109629 - protein, 11 aa, Homo Sapiens
MPAFSKIGGIL

SEQ ID NO: 109630 - protein, 11 aa, Homo Sapiens
MPDSLRSGEYL

SEQ ID NO: 109631 - protein, 11 aa, Homo Sapiens
MPDVGRSMQQL

SEQ ID NO: 109632 - protein, 11 aa, Homo Sapiens
MPKKSIKKLVL

SEQ ID NO: 109633 - protein, 11 aa, Homo Sapiens
MPKVSGPDLDL

SEQ ID NO: 109634 - protein, 11 aa, Homo Sapiens
MPNPQLNIKAL

SEQ ID NO: 109635 - protein, 11 aa, Homo Sapiens
MPNPSLAQVKI

SEQ ID NO: 109636 - protein, 11 aa, Homo Sapiens
MPPAHYDAKQL

SEQ ID NO: 109637 - protein, 11 aa, Homo Sapiens
MPQNRTIYVTL

SEQ ID NO: 109638 - protein, 11 aa, Homo Sapiens
MPRAPGGFECF

SEQ ID NO: 109639 - protein, 11 aa, Homo Sapiens
MPRLPEHCIEY

SEQ ID NO: 109640 - protein, 11 aa, Homo Sapiens
MPRPDTCPPEL

SEQ ID NO: 109641 - protein, 11 aa, Homo Sapiens
MPSPIMHPLIL

SEQ ID NO: 109642 - protein, 11 aa, Homo Sapiens
MPSSHRILHKL

SEQ ID NO: 109643 - protein, 11 aa, Homo Sapiens
MPSSSGSARSL

SEQ ID NO: 109644 - protein, 11 aa, Homo Sapiens
MPSSSKTKPVL

SEQ ID NO: 109645 - protein, 11 aa, Homo Sapiens
MPSTDLLMLKA

SEQ ID NO: 109646 - protein, 11 aa, Homo Sapiens
NADPLKVYPPL

SEQ ID NO: 109647 - protein, 11 aa, Homo Sapiens
NPDGVRIMHSL

SEQ ID NO: 109648 - protein, 11 aa, Homo Sapiens
NPISTHIGNEL

SEQ ID NO: 109649 - protein, 11 aa, Homo Sapiens
NPKFAEHGETL

SEQ ID NO: 109650 - protein, 11 aa, Homo Sapiens
NPKQAATQSEL

SEQ ID NO: 109651 - protein, 11 aa, Homo Sapiens
NPNAQQTKAVL

SEQ ID NO: 109652 - protein, 11 aa, Homo Sapiens
NPNGDKTKVMV

SEQ ID NO: 109653 - protein, 11 aa, Homo Sapiens
NPNSNTLGHIL

SEQ ID NO: 109654 - protein, 11 aa, Homo Sapiens
NPNTSEPQHLL

SEQ ID NO: 109655 - protein, 11 aa, Homo Sapiens
NPQKVGKDHTL

SEQ ID NO: 109656 - protein, 11 aa, Homo Sapiens
NPRQPLPASGL

SEQ ID NO: 109657 - protein, 11 aa, Homo Sapiens
PKFEVIEKPQA

SEQ ID NO: 109658 - protein, 11 aa, Homo Sapiens
PLKYPSSSTLI

SEQ ID NO: 109659 - protein, 11 aa, Homo Sapiens
QAAVRPKGEAA

SEQ ID NO: 109660 - protein, 11 aa, Homo Sapiens
QPCPSLAQHSL

SEQ ID NO: 109661 - protein, 11 aa, Homo Sapiens
QPFLQRYYEVL

SEQ ID NO: 109662 - protein, 11 aa, Homo Sapiens
QPHADRRREIL

SEQ ID NO: 109663 - protein, 11 aa, Homo Sapiens
QPIPILYEHQL

SEQ ID NO: 109664 - protein, 11 aa, Homo Sapiens
QPITTPQYHQL

SEQ ID NO: 109665 - protein, 11 aa, Homo Sapiens
QPKIVKWDRDM

SEQ ID NO: 109666 - protein, 11 aa, Homo Sapiens
QPLGTLPQAVM

SEQ ID NO: 109667 - protein, 11 aa, Homo Sapiens
QPNERQVRIQL

SEQ ID NO: 109668 - protein, 11 aa, Homo Sapiens
QPQAAAGSHQL

SEQ ID NO: 109669 - protein, 11 aa, Homo Sapiens
QPQNPDMTHVI

SEQ ID NO: 109670 - protein, 11 aa, Homo Sapiens
QPSSSLSARMM

SEQ ID NO: 109671 - protein, 11 aa, Homo Sapiens
QPYSKLPGVSL

SEQ ID NO: 109672 - protein, 11 aa, Homo Sapiens
QVAVHKIYQQL

SEQ ID NO: 109673 - protein, 11 aa, Homo Sapiens
RPADVYSYKQV

SEQ ID NO: 109674 - protein, 11 aa, Homo Sapiens
RPAGKDMMRKL

SEQ ID NO: 109675 - protein, 11 aa, Homo Sapiens
RPALQHVVKVL

SEQ ID NO: 109676 - protein, 11 aa, Homo Sapiens
RPAPQKALYST

SEQ ID NO: 109677 - protein, 11 aa, Homo Sapiens
RPASEATFNVF

SEQ ID NO: 109678 - protein, 11 aa, Homo Sapiens
RPDDRSQGAII

SEQ ID NO: 109679 - protein, 11 aa, Homo Sapiens
RPDDVHVNIRL

SEQ ID NO: 109680 - protein, 11 aa, Homo Sapiens
RPEERPTFEFL

SEQ ID NO: 109681 - protein, 11 aa, Homo Sapiens
RPFGSISRIYL

SEQ ID NO: 109682 - protein, 11 aa, Homo Sapiens
RPFHGISTVSL

SEQ ID NO: 109683 - protein, 11 aa, Homo Sapiens
RPGAHLTVKKI

SEQ ID NO: 109684 - protein, 11 aa, Homo Sapiens
RPGWRSIEEVL

SEQ ID NO: 109685 - protein, 11 aa, Homo Sapiens
RPHAPHSPIKF

SEQ ID NO: 109686 - protein, 11 aa, Homo Sapiens
RPHPLRPEAEL

SEQ ID NO: 109687 - protein, 11 aa, Homo Sapiens
RPIDTSRLTKI

SEQ ID NO: 109688 - protein, 11 aa, Homo Sapiens
RPIKTEMAHQL

SEQ ID NO: 109689 - protein, 11 aa, Homo Sapiens
RPITPGTLRQL

SEQ ID NO: 109690 - protein, 11 aa, Homo Sapiens
RPIYIDGRPVL

SEQ ID NO: 109691 - protein, 11 aa, Homo Sapiens
RPKASGATERL

SEQ ID NO: 109692 - protein, 11 aa, Homo Sapiens
RPKCPLDPYFI

SEQ ID NO: 109693 - protein, 11 aa, Homo Sapiens
RPKEAPEPMEL

SEQ ID NO: 109694 - protein, 11 aa, Homo Sapiens
RPKGSEMKYAL

SEQ ID NO: 109695 - protein, 11 aa, Homo Sapiens
RPKIDDVLHTL

SEQ ID NO: 109696 - protein, 11 aa, Homo Sapiens
RPKLNEGVVEF

SEQ ID NO: 109697 - protein, 11 aa, Homo Sapiens
RPKLQHSTSIL

SEQ ID NO: 109698 - protein, 11 aa, Homo Sapiens
RPKMQEVVANL

SEQ ID NO: 109699 - protein, 11 aa, Homo Sapiens
RPKPSSSPVIF

SEQ ID NO: 109700 - protein, 11 aa, Homo Sapiens
RPKQENHLHSL

SEQ ID NO: 109701 - protein, 11 aa, Homo Sapiens
RPKQPDKEGKL

SEQ ID NO: 109702 - protein, 11 aa, Homo Sapiens
RPKRFEVATSL

SEQ ID NO: 109703 - protein, 11 aa, Homo Sapiens
RPKRPPLKEFF

SEQ ID NO: 109704 - protein, 11 aa, Homo Sapiens
RPKSNIVLLSA

SEQ ID NO: 109705 - protein, 11 aa, Homo Sapiens
RPKSSQIGAVV

SEQ ID NO: 109706 - protein, 11 aa, Homo Sapiens
RPKSTVNTHYF

SEQ ID NO: 109707 - protein, 11 aa, Homo Sapiens
RPKVPAGVQEL

SEQ ID NO: 109708 - protein, 11 aa, Homo Sapiens
RPLEMIEPRTL

SEQ ID NO: 109709 - protein, 11 aa, Homo Sapiens
RPLEQQQPHHI

SEQ ID NO: 109710 - protein, 11 aa, Homo Sapiens
RPMSYDEKRQL

SEQ ID NO: 109711 - protein, 11 aa, Homo Sapiens
RPNDSRMLVAL

SEQ ID NO: 109712 - protein, 11 aa, Homo Sapiens
RPNFNIKGIRF

SEQ ID NO: 109713 - protein, 11 aa, Homo Sapiens
RPNGTKVAVLL

SEQ ID NO: 109714 - protein, 11 aa, Homo Sapiens
RPNMAYKVKVL

SEQ ID NO: 109715 - protein, 11 aa, Homo Sapiens
RPNTSEILRTL

SEQ ID NO: 109716 - protein, 11 aa, Homo Sapiens
RPPAYCDAKEI

SEQ ID NO: 109717 - protein, 11 aa, Homo Sapiens
RPPEITGQVSL

SEQ ID NO: 109718 - protein, 11 aa, Homo Sapiens
RPQAVQGGKAL

SEQ ID NO: 109719 - protein, 11 aa, Homo Sapiens
RPQCPVGFNTL

SEQ ID NO: 109720 - protein, 11 aa, Homo Sapiens
RPQIKDFKEKI

SEQ ID NO: 109721 - protein, 11 aa, Homo Sapiens
RPQSKAPDSTL

SEQ ID NO: 109722 - protein, 11 aa, Homo Sapiens
RPRAGASISTL

SEQ ID NO: 109723 - protein, 11 aa, Homo Sapiens
RPRHQGVMVGM

SEQ ID NO: 109724 - protein, 11 aa, Homo Sapiens
RPRNPAGRTGL

SEQ ID NO: 109725 - protein, 11 aa, Homo Sapiens
RPRPGNILLQL

SEQ ID NO: 109726 - protein, 11 aa, Homo Sapiens
RPRPTEATVSL

SEQ ID NO: 109727 - protein, 11 aa, Homo Sapiens
RPRQTPFAEKL

SEQ ID NO: 109728 - protein, 11 aa, Homo Sapiens
RPRTPPEAIAL

SEQ ID NO: 109729 - protein, 11 aa, Homo Sapiens
RPSGLHGDVSL

SEQ ID NO: 109730 - protein, 11 aa, Homo Sapiens
RPSHFLNFALL

SEQ ID NO: 109731 - protein, 11 aa, Homo Sapiens
RPSSCLTNFLL

SEQ ID NO: 109732 - protein, 11 aa, Homo Sapiens
RPSTGLLRHIL

SEQ ID NO: 109733 - protein, 11 aa, Homo Sapiens
RVFNRPRIETL

SEQ ID NO: 109734 - protein, 11 aa, Homo Sapiens
RVQGDKRLSSL

SEQ ID NO: 109735 - protein, 11 aa, Homo Sapiens
RVSHSHVGYTL

SEQ ID NO: 109736 - protein, 11 aa, Homo Sapiens
SDPILYRPVAV

SEQ ID NO: 109737 - protein, 11 aa, Homo Sapiens
SGPSIVHRKCF

SEQ ID NO: 109738 - protein, 11 aa, Homo Sapiens
SPADHRGYASL

SEQ ID NO: 109739 - protein, 11 aa, Homo Sapiens
SPADLRTNHTL

SEQ ID NO: 109740 - protein, 11 aa, Homo Sapiens
SPARHQLDHVF

SEQ ID NO: 109741 - protein, 11 aa, Homo Sapiens
SPASSTTARVI

SEQ ID NO: 109742 - protein, 11 aa, Homo Sapiens
SPCISGTTHTL

SEQ ID NO: 109743 - protein, 11 aa, Homo Sapiens
SPCQSSTVKEL

SEQ ID NO: 109744 - protein, 11 aa, Homo Sapiens
SPDHYLVDHTL

SEQ ID NO: 109745 - protein, 11 aa, Homo Sapiens
SPDLGKNLQTL

SEQ ID NO: 109746 - protein, 11 aa, Homo Sapiens
SPDPHKGLVLL

SEQ ID NO: 109747 - protein, 11 aa, Homo Sapiens
SPDPLRPLEFL

SEQ ID NO: 109748 - protein, 11 aa, Homo Sapiens
SPDVKRCLNAL

SEQ ID NO: 109749 - protein, 11 aa, Homo Sapiens
SPEARPAQEAL

SEQ ID NO: 109750 - protein, 11 aa, Homo Sapiens
SPEQPPKAKFL

SEQ ID NO: 109751 - protein, 11 aa, Homo Sapiens
SPFLPGFSQSL

SEQ ID NO: 109752 - protein, 11 aa, Homo Sapiens
SPILAHGGVRF

SEQ ID NO: 109753 - protein, 11 aa, Homo Sapiens
SPISSNSHRSL

SEQ ID NO: 109754 - protein, 11 aa, Homo Sapiens
SPKAALRYAAV

SEQ ID NO: 109755 - protein, 11 aa, Homo Sapiens
SPKASSKLAIM

SEQ ID NO: 109756 - protein, 11 aa, Homo Sapiens
SPKATSSPLYL

SEQ ID NO: 109757 - protein, 11 aa, Homo Sapiens
SPKEPPNGNAF

SEQ ID NO: 109758 - protein, 11 aa, Homo Sapiens
SPKFPDSQNQL

SEQ ID NO: 109759 - protein, 11 aa, Homo Sapiens
SPKKPGREIEL

SEQ ID NO: 109760 - protein, 11 aa, Homo Sapiens
SPKLPVSSLGL

SEQ ID NO: 109761 - protein, 11 aa, Homo Sapiens
SPKPGTGEPVL

SEQ ID NO: 109762 - protein, 11 aa, Homo Sapiens
SPKPPPQRVTL

SEQ ID NO: 109763 - protein, 11 aa, Homo Sapiens
SPKQWLPLEVL

SEQ ID NO: 109764 - protein, 11 aa, Homo Sapiens
SPKRPPSPIKF

SEQ ID NO: 109765 - protein, 11 aa, Homo Sapiens
SPKSALGSSAL

SEQ ID NO: 109766 - protein, 11 aa, Homo Sapiens
SPKSGEEAAVL

SEQ ID NO: 109767 - protein, 11 aa, Homo Sapiens
SPKSTAQEGTL

SEQ ID NO: 109768 - protein, 11 aa, Homo Sapiens
SPKSTGPRPSL

SEQ ID NO: 109769 - protein, 11 aa, Homo Sapiens
SPKSTGSVRQL

SEQ ID NO: 109770 - protein, 11 aa, Homo Sapiens
SPKVTKDGVTV

SEQ ID NO: 109771 - protein, 11 aa, Homo Sapiens
SPLTQTPEHRL

SEQ ID NO: 109772 - protein, 11 aa, Homo Sapiens
SPMERRLVEQL

SEQ ID NO: 109773 - protein, 11 aa, Homo Sapiens
SPMKEKGNIQL

SEQ ID NO: 109774 - protein, 11 aa, Homo Sapiens
SPMSADRVVAF

SEQ ID NO: 109775 - protein, 11 aa, Homo Sapiens
SPMSDVVSREL

SEQ ID NO: 109776 - protein, 11 aa, Homo Sapiens
SPNLSKCGEEL

SEQ ID NO: 109777 - protein, 11 aa, Homo Sapiens
SPNNDKQKYTL

SEQ ID NO: 109778 - protein, 11 aa, Homo Sapiens
SPNNPFSRVAL

SEQ ID NO: 109779 - protein, 11 aa, Homo Sapiens
SPNQARAQAAL

SEQ ID NO: 109780 - protein, 11 aa, Homo Sapiens
SPNQKLLAVSL

SEQ ID NO: 109781 - protein, 11 aa, Homo Sapiens
SPNSTSRPTLP

SEQ ID NO: 109782 - protein, 11 aa, Homo Sapiens
SPNYEGPLHSL

SEQ ID NO: 109783 - protein, 11 aa, Homo Sapiens
SPPDNPQVKEI

SEQ ID NO: 109784 - protein, 11 aa, Homo Sapiens
SPPPADLCHAL

SEQ ID NO: 109785 - protein, 11 aa, Homo Sapiens
SPPPSHPLKAV

SEQ ID NO: 109786 - protein, 11 aa, Homo Sapiens
SPQQIDHAKQL

SEQ ID NO: 109787 - protein, 11 aa, Homo Sapiens
SPQTSFPYKIM

SEQ ID NO: 109788 - protein, 11 aa, Homo Sapiens
SPRQGNSKNVL

SEQ ID NO: 109789 - protein, 11 aa, Homo Sapiens
SPSDRDFMETL

SEQ ID NO: 109790 - protein, 11 aa, Homo Sapiens
SPSPATDGKVF

SEQ ID NO: 109791 - protein, 11 aa, Homo Sapiens
SPSPINSSQAL

SEQ ID NO: 109792 - protein, 11 aa, Homo Sapiens
SPSYENSLHSL

SEQ ID NO: 109793 - protein, 11 aa, Homo Sapiens
SPTGNHVNEIL

SEQ ID NO: 109794 - protein, 11 aa, Homo Sapiens
SPVDNTPSHQL

SEQ ID NO: 109795 - protein, 11 aa, Homo Sapiens
SPVPSHWMVAL

SEQ ID NO: 109796 - protein, 11 aa, Homo Sapiens
TPAPHEPVKTL

SEQ ID NO: 109797 - protein, 11 aa, Homo Sapiens
TPAPVKKSGKL

SEQ ID NO: 109798 - protein, 11 aa, Homo Sapiens
TPDAMKAAMAL

SEQ ID NO: 109799 - protein, 11 aa, Homo Sapiens
TPEERDARTVF

SEQ ID NO: 109800 - protein, 11 aa, Homo Sapiens
TPGMLHAGQSL

SEQ ID NO: 109801 - protein, 11 aa, Homo Sapiens
TPGTSTTPGLR

SEQ ID NO: 109802 - protein, 11 aa, Homo Sapiens
TPHLRNLAVAM

SEQ ID NO: 109803 - protein, 11 aa, Homo Sapiens
TPIEGMLSHQL

SEQ ID NO: 109804 - protein, 11 aa, Homo Sapiens
TPIQRTPHEIM

SEQ ID NO: 109805 - protein, 11 aa, Homo Sapiens
TPIQWLPGHDL

SEQ ID NO: 109806 - protein, 11 aa, Homo Sapiens
TPKEAIEGTYI

SEQ ID NO: 109807 - protein, 11 aa, Homo Sapiens
TPKEVGDVIAL

SEQ ID NO: 109808 - protein, 11 aa, Homo Sapiens
TPKPSVGSISL

SEQ ID NO: 109809 - protein, 11 aa, Homo Sapiens
TPKRPSTSQTV

SEQ ID NO: 109810 - protein, 11 aa, Homo Sapiens
TPKSERYEHVL

SEQ ID NO: 109811 - protein, 11 aa, Homo Sapiens
TPKTPKGPSSV

SEQ ID NO: 109812 - protein, 11 aa, Homo Sapiens
TPKTTGARVEL

SEQ ID NO: 109813 - protein, 11 aa, Homo Sapiens
TPKVTQALNVL

SEQ ID NO: 109814 - protein, 11 aa, Homo Sapiens
TPMLKEGGISM

SEQ ID NO: 109815 - protein, 11 aa, Homo Sapiens
TPMPKDVRQSL

SEQ ID NO: 109816 - protein, 11 aa, Homo Sapiens
TPPTTVSGKVM

SEQ ID NO: 109817 - protein, 11 aa, Homo Sapiens
TPQEKEAIERL

SEQ ID NO: 109818 - protein, 11 aa, Homo Sapiens
TPQSVNSGKTF

SEQ ID NO: 109819 - protein, 11 aa, Homo Sapiens
TPRCYVGATVL

SEQ ID NO: 109820 - protein, 11 aa, Homo Sapiens
TPRPATEAELL

SEQ ID NO: 109821 - protein, 11 aa, Homo Sapiens
TPRPGSAESAL

SEQ ID NO: 109822 - protein, 11 aa, Homo Sapiens
TPRPGSHTIEF

SEQ ID NO: 109823 - protein, 11 aa, Homo Sapiens
TPRPPPVGHSF

SEQ ID NO: 109824 - protein, 11 aa, Homo Sapiens
TPSASTPYRQL

SEQ ID NO: 109825 - protein, 11 aa, Homo Sapiens
TPSLVKSTSQL

SEQ ID NO: 109826 - protein, 11 aa, Homo Sapiens
TPSTQQHLKKV

SEQ ID NO: 109827 - protein, 11 aa, Homo Sapiens
TPTQNNIFKVL

SEQ ID NO: 109828 - protein, 11 aa, Homo Sapiens
TPVMNSEAKVL

SEQ ID NO: 109829 - protein, 11 aa, Homo Sapiens
TVKPASGSQTL

SEQ ID NO: 109830 - protein, 11 aa, Homo Sapiens
TVKPNANRIAL

SEQ ID NO: 109831 - protein, 11 aa, Homo Sapiens
TVSSVGALHAL

SEQ ID NO: 109832 - protein, 11 aa, Homo Sapiens
TVWTRPGPEVL

SEQ ID NO: 109833 - protein, 11 aa, Homo Sapiens
VPAKSTLLQVL

SEQ ID NO: 109834 - protein, 11 aa, Homo Sapiens
VPCLENAVTAL

SEQ ID NO: 109835 - protein, 11 aa, Homo Sapiens
VPDSSGPERIL

SEQ ID NO: 109836 - protein, 11 aa, Homo Sapiens
VPDTSRIYVAL

SEQ ID NO: 109837 - protein, 11 aa, Homo Sapiens
VPFEKKDFVGL

SEQ ID NO: 109838 - protein, 11 aa, Homo Sapiens
VPHLSKPNHTL

SEQ ID NO: 109839 - protein, 11 aa, Homo Sapiens
VPHPKKPEHTL

SEQ ID NO: 109840 - protein, 11 aa, Homo Sapiens
VPHPKKPGHIL

SEQ ID NO: 109841 - protein, 11 aa, Homo Sapiens
VPHPNWPNHTL

SEQ ID NO: 109842 - protein, 11 aa, Homo Sapiens
VPIDVVSQHLM

SEQ ID NO: 109843 - protein, 11 aa, Homo Sapiens
VPIPNSPFKVA

SEQ ID NO: 109844 - protein, 11 aa, Homo Sapiens
VPKAPGFAQML

SEQ ID NO: 109845 - protein, 11 aa, Homo Sapiens
VPKGNTAVSVL

SEQ ID NO: 109846 - protein, 11 aa, Homo Sapiens
VPKLQPQITMI

SEQ ID NO: 109847 - protein, 11 aa, Homo Sapiens
VPKPGTAPTSL

SEQ ID NO: 109848 - protein, 11 aa, Homo Sapiens
VPKPIGGVVVF

SEQ ID NO: 109849 - protein, 11 aa, Homo Sapiens
VPKQVVTGTVL

SEQ ID NO: 109850 - protein, 11 aa, Homo Sapiens
VPKSPDASSAF

SEQ ID NO: 109851 - protein, 11 aa, Homo Sapiens
VPKTAENFRAL

SEQ ID NO: 109852 - protein, 11 aa, Homo Sapiens
VPKTTGEGTSL

SEQ ID NO: 109853 - protein, 11 aa, Homo Sapiens
VPKTVDNFVAL

SEQ ID NO: 109854 - protein, 11 aa, Homo Sapiens
VPLPISHKRVL

SEQ ID NO: 109855 - protein, 11 aa, Homo Sapiens
VPMEIKPGISL

SEQ ID NO: 109856 - protein, 11 aa, Homo Sapiens
VPMTAENFRCL

SEQ ID NO: 109857 - protein, 11 aa, Homo Sapiens
VPNAGRGLVRL

SEQ ID NO: 109858 - protein, 11 aa, Homo Sapiens
VPNDRPTWHIL

SEQ ID NO: 109859 - protein, 11 aa, Homo Sapiens
VPNKFLVTAEI

SEQ ID NO: 109860 - protein, 11 aa, Homo Sapiens
VPNLRGSEERL

SEQ ID NO: 109861 - protein, 11 aa, Homo Sapiens
VPNPRIKLIDF

SEQ ID NO: 109862 - protein, 11 aa, Homo Sapiens
VPNSAIYKRVL

SEQ ID NO: 109863 - protein, 11 aa, Homo Sapiens
VPQERQPEAEL

SEQ ID NO: 109864 - protein, 11 aa, Homo Sapiens
VPQQAIDSHSV

SEQ ID NO: 109865 - protein, 11 aa, Homo Sapiens
VPRIASKPIIV

SEQ ID NO: 109866 - protein, 11 aa, Homo Sapiens
VPRPAPYSKAL

SEQ ID NO: 109867 - protein, 11 aa, Homo Sapiens
VPRPVLRALSF

SEQ ID NO: 109868 - protein, 11 aa, Homo Sapiens
VPRTAENFRAL

SEQ ID NO: 109869 - protein, 11 aa, Homo Sapiens
VPSAGLRLFAL

SEQ ID NO: 109870 - protein, 11 aa, Homo Sapiens
VPSKVPTSMVL

SEQ ID NO: 109871 - protein, 11 aa, Homo Sapiens
VPSNSHLVLVL

SEQ ID NO: 109872 - protein, 11 aa, Homo Sapiens
VPSVSSISRIL

SEQ ID NO: 109873 - protein, 11 aa, Homo Sapiens
VPSWSKVNQGL

SEQ ID NO: 109874 - protein, 11 aa, Homo Sapiens
VPYKKDVGKTL

SEQ ID NO: 109875 - protein, 11 aa, Homo Sapiens
VSKPDMGLVAL

SEQ ID NO: 109876 - protein, 11 aa, Homo Sapiens
VVSEVDIAKAD

SEQ ID NO: 109877 - protein, 11 aa, Homo Sapiens
YPKEDKENRIL

SEQ ID NO: 109878 - protein, 11 aa, Homo Sapiens
YPKRPLLGLVL

SEQ ID NO: 109879 - protein, 11 aa, Homo Sapiens
YPMDLGGRNFL

SEQ ID NO: 109880 - protein, 11 aa, Homo Sapiens
YPMKSEKIHGL

SEQ ID NO: 109881 - protein, 11 aa, Homo Sapiens
YPNFAGPHAAL

SEQ ID NO: 109882 - protein, 11 aa, Homo Sapiens
YPSETTVKYVF

SEQ ID NO: 109883 - protein, 11 aa, Homo Sapiens
YPSVENVRTSL

SEQ ID NO: 109884 - protein, 11 aa, Homo Sapiens
YPSVGQLAHKL

SEQ ID NO: 109885 - protein, 11 aa, Homo Sapiens
YPVPASKRPPL

SEQ ID NO: 109886 - protein, 8 aa, Homo Sapiens
AEGLGFSY

SEQ ID NO: 109887 - protein, 8 aa, Homo Sapiens
AEIIASHW

SEQ ID NO: 109888 - protein, 8 aa, Homo Sapiens
NELPGLKW

SEQ ID NO: 109889 - protein, 8 aa, Homo Sapiens
RDFLGTNW

SEQ ID NO: 109890 - protein, 8 aa, Homo Sapiens
SDNLARLW

SEQ ID NO: 109891 - protein, 9 aa, Homo Sapiens
AAQDFFQRW

SEQ ID NO: 109892 - protein, 9 aa, Homo Sapiens
AEADKIYSF

SEQ ID NO: 109893 - protein, 9 aa, Homo Sapiens
AEADLRALL

SEQ ID NO: 109894 - protein, 9 aa, Homo Sapiens
AEAEIIQLL

SEQ ID NO: 109895 - protein, 9 aa, Homo Sapiens
AEAEQTLRF

SEQ ID NO: 109896 - protein, 9 aa, Homo Sapiens
AEAFLEHLW

SEQ ID NO: 109897 - protein, 9 aa, Homo Sapiens
AEAFLLRLY

SEQ ID NO: 109898 - protein, 9 aa, Homo Sapiens
AEAFLVHLF

SEQ ID NO: 109899 - protein, 9 aa, Homo Sapiens
AEAIVPTLF

SEQ ID NO: 109900 - protein, 9 aa, Homo Sapiens
AEALATHIL

SEQ ID NO: 109901 - protein, 9 aa, Homo Sapiens
AEALLHPFF

SEQ ID NO: 109902 - protein, 9 aa, Homo Sapiens
AEASVLILF

SEQ ID NO: 109903 - protein, 9 aa, Homo Sapiens
AEAYHFFIL

SEQ ID NO: 109904 - protein, 9 aa, Homo Sapiens
AEDELFNRY

SEQ ID NO: 109905 - protein, 9 aa, Homo Sapiens
AEDFTIKLI

SEQ ID NO: 109906 - protein, 9 aa, Homo Sapiens
AEDLVANFF

SEQ ID NO: 109907 - protein, 9 aa, Homo Sapiens
AEDRFMLLF

SEQ ID NO: 109908 - protein, 9 aa, Homo Sapiens
AEEEFVQRF

SEQ ID NO: 109909 - protein, 9 aa, Homo Sapiens
AEEFLYRFL

SEQ ID NO: 109910 - protein, 9 aa, Homo Sapiens
AEELLRIGL

SEQ ID NO: 109911 - protein, 9 aa, Homo Sapiens
AEELSILKW

SEQ ID NO: 109912 - protein, 9 aa, Homo Sapiens
AEENLFKLI

SEQ ID NO: 109913 - protein, 9 aa, Homo Sapiens
AEESLFRVF

SEQ ID NO: 109914 - protein, 9 aa, Homo Sapiens
AEFAISIKY

SEQ ID NO: 109915 - protein, 9 aa, Homo Sapiens
AEFAQVTNW

SEQ ID NO: 109916 - protein, 9 aa, Homo Sapiens
AEFELPKTM

SEQ ID NO: 109917 - protein, 9 aa, Homo Sapiens
AEFEVVRTI

SEQ ID NO: 109918 - protein, 9 aa, Homo Sapiens
AEFIRELGF

SEQ ID NO: 109919 - protein, 9 aa, Homo Sapiens
AEFIVAKAI

SEQ ID NO: 109920 - protein, 9 aa, Homo Sapiens
AEFKEAFQL

SEQ ID NO: 109921 - protein, 9 aa, Homo Sapiens
AEFLYQVLI

SEQ ID NO: 109922 - protein, 9 aa, Homo Sapiens
AEFNLRHDW

SEQ ID NO: 109923 - protein, 9 aa, Homo Sapiens
AEGDLIEHF

SEQ ID NO: 109924 - protein, 9 aa, Homo Sapiens
AEGDLVRLL

SEQ ID NO: 109925 - protein, 9 aa, Homo Sapiens
AEGDLYLHF

SEQ ID NO: 109926 - protein, 9 aa, Homo Sapiens
AEGITFIKF

SEQ ID NO: 109927 - protein, 9 aa, Homo Sapiens
AEGKFWTHW

SEQ ID NO: 109928 - protein, 9 aa, Homo Sapiens
AEGLLSHYL

SEQ ID NO: 109929 - protein, 9 aa, Homo Sapiens
AEGPPRLAI

SEQ ID NO: 109930 - protein, 9 aa, Homo Sapiens
AEGVIVGHW

SEQ ID NO: 109931 - protein, 9 aa, Homo Sapiens
AEIAALRFL

SEQ ID NO: 109932 - protein, 9 aa, Homo Sapiens
AEIDSIHQL

SEQ ID NO: 109933 - protein, 9 aa, Homo Sapiens
AEIEDIRVL

SEQ ID NO: 109934 - protein, 9 aa, Homo Sapiens
AEIEIVKDL

SEQ ID NO: 109935 - protein, 9 aa, Homo Sapiens
AEIELLQNL

SEQ ID NO: 109936 - protein, 9 aa, Homo Sapiens
AEIIKEDLW

SEQ ID NO: 109937 - protein, 9 aa, Homo Sapiens
AEIIKGELW

SEQ ID NO: 109938 - protein, 9 aa, Homo Sapiens
AEIIKNDLW

SEQ ID NO: 109939 - protein, 9 aa, Homo Sapiens
AEILLSNHY

SEQ ID NO: 109940 - protein, 9 aa, Homo Sapiens
AEIMAVLFF

SEQ ID NO: 109941 - protein, 9 aa, Homo Sapiens
AEINNIIKI

SEQ ID NO: 109942 - protein, 9 aa, Homo Sapiens
AEINYGIRF

SEQ ID NO: 109943 - protein, 9 aa, Homo Sapiens
AEIQFAQRL

SEQ ID NO: 109944 - protein, 9 aa, Homo Sapiens
AEIRSLVTW

SEQ ID NO: 109945 - protein, 9 aa, Homo Sapiens
AEKDNFLEW

SEQ ID NO: 109946 - protein, 9 aa, Homo Sapiens
AELAIFRVF

SEQ ID NO: 109947 - protein, 9 aa, Homo Sapiens
AELAVILKF

SEQ ID NO: 109948 - protein, 9 aa, Homo Sapiens
AELELLRQF

SEQ ID NO: 109949 - protein, 9 aa, Homo Sapiens
AELIISEVF

SEQ ID NO: 109950 - protein, 9 aa, Homo Sapiens
AELMQTLRF

SEQ ID NO: 109951 - protein, 9 aa, Homo Sapiens
AELNFFQRI

SEQ ID NO: 109952 - protein, 9 aa, Homo Sapiens
AELNKIFAL

SEQ ID NO: 109953 - protein, 9 aa, Homo Sapiens
AELPGVSRW

SEQ ID NO: 109954 - protein, 9 aa, Homo Sapiens
AEMEIIGQF

SEQ ID NO: 109955 - protein, 9 aa, Homo Sapiens
AEMGAFTFF

SEQ ID NO: 109956 - protein, 9 aa, Homo Sapiens
AEMLRSISF

SEQ ID NO: 109957 - protein, 9 aa, Homo Sapiens
AEMPLFKLY

SEQ ID NO: 109958 - protein, 9 aa, Homo Sapiens
AEMQWKRDY

SEQ ID NO: 109959 - protein, 9 aa, Homo Sapiens
AEMWLIRTY

SEQ ID NO: 109960 - protein, 9 aa, Homo Sapiens
AENDFLHSL

SEQ ID NO: 109961 - protein, 9 aa, Homo Sapiens
AENFAEHVL

SEQ ID NO: 109962 - protein, 9 aa, Homo Sapiens
AENGLTVRL

SEQ ID NO: 109963 - protein, 9 aa, Homo Sapiens
AENILQQDF

SEQ ID NO: 109964 - protein, 9 aa, Homo Sapiens
AENLFRAFL

SEQ ID NO: 109965 - protein, 9 aa, Homo Sapiens
AENMIQLQF

SEQ ID NO: 109966 - protein, 9 aa, Homo Sapiens
AENNEFITW

SEQ ID NO: 109967 - protein, 9 aa, Homo Sapiens
AENNIQPIF

SEQ ID NO: 109968 - protein, 9 aa, Homo Sapiens
AENPFLTHL

SEQ ID NO: 109969 - protein, 9 aa, Homo Sapiens
AENPSIQLL

SEQ ID NO: 109970 - protein, 9 aa, Homo Sapiens
AENQLALEL

SEQ ID NO: 109971 - protein, 9 aa, Homo Sapiens
AENTLSKLL

SEQ ID NO: 109972 - protein, 9 aa, Homo Sapiens
AENVSMWIF

SEQ ID NO: 109973 - protein, 9 aa, Homo Sapiens
AEPGSVISW

SEQ ID NO: 109974 - protein, 9 aa, Homo Sapiens
AEPIDIQTW

SEQ ID NO: 109975 - protein, 9 aa, Homo Sapiens
AEQDFISKF

SEQ ID NO: 109976 - protein, 9 aa, Homo Sapiens
AEQDLIREL

SEQ ID NO: 109977 - protein, 9 aa, Homo Sapiens
AEQDLVQTL

SEQ ID NO: 109978 - protein, 9 aa, Homo Sapiens
AEQFRLEQI

SEQ ID NO: 109979 - protein, 9 aa, Homo Sapiens
AEQIIFDHF

SEQ ID NO: 109980 - protein, 9 aa, Homo Sapiens
AEQIIQEIY

SEQ ID NO: 109981 - protein, 9 aa, Homo Sapiens
AEQLFHLNF

SEQ ID NO: 109982 - protein, 9 aa, Homo Sapiens
AERQLQVQW

SEQ ID NO: 109983 - protein, 9 aa, Homo Sapiens
AESALQLLY

SEQ ID NO: 109984 - protein, 9 aa, Homo Sapiens
AESFMFRTW

SEQ ID NO: 109985 - protein, 9 aa, Homo Sapiens
AESGLWQSF

SEQ ID NO: 109986 - protein, 9 aa, Homo Sapiens
AESHIILVL

SEQ ID NO: 109987 - protein, 9 aa, Homo Sapiens
AESLIAKKI

SEQ ID NO: 109988 - protein, 9 aa, Homo Sapiens
AESLYEIRF

SEQ ID NO: 109989 - protein, 9 aa, Homo Sapiens
AESPPRFYF

SEQ ID NO: 109990 - protein, 9 aa, Homo Sapiens
AESVSTLIW

SEQ ID NO: 109991 - protein, 9 aa, Homo Sapiens
AETAVQLFI

SEQ ID NO: 109992 - protein, 9 aa, Homo Sapiens
AETDAIRFL

SEQ ID NO: 109993 - protein, 9 aa, Homo Sapiens
AETFSPDVW

SEQ ID NO: 109994 - protein, 9 aa, Homo Sapiens
AETHIVLLF

SEQ ID NO: 109995 - protein, 9 aa, Homo Sapiens
AETLIFVKY

SEQ ID NO: 109996 - protein, 9 aa, Homo Sapiens
AETPDIKLF

SEQ ID NO: 109997 - protein, 9 aa, Homo Sapiens
AETQILTDW

SEQ ID NO: 109998 - protein, 9 aa, Homo Sapiens
AEVFPLKVF

SEQ ID NO: 109999 - protein, 9 aa, Homo Sapiens
AEVGFVRFF

SEQ ID NO: 110000 - protein, 9 aa, Homo Sapiens
AEVIDTPVF

SEQ ID NO: 110001 - protein, 9 aa, Homo Sapiens
AEVPFFETW

SEQ ID NO: 110002 - protein, 9 aa, Homo Sapiens
AEVTLKTYW

SEQ ID NO: 110003 - protein, 9 aa, Homo Sapiens
AEWEWKAGF

SEQ ID NO: 110004 - protein, 9 aa, Homo Sapiens
AEWLFPLAF

SEQ ID NO: 110005 - protein, 9 aa, Homo Sapiens
AEYLIKEGY

SEQ ID NO: 110006 - protein, 9 aa, Homo Sapiens
AEYLILHLI

SEQ ID NO: 110007 - protein, 9 aa, Homo Sapiens
AEYTGPKLF

SEQ ID NO: 110008 - protein, 9 aa, Homo Sapiens
AQLRFIQAW

SEQ ID NO: 110009 - protein, 9 aa, Homo Sapiens
DEEETYRLW

SEQ ID NO: 110010 - protein, 9 aa, Homo Sapiens
DEEQVFHFY

SEQ ID NO: 110011 - protein, 9 aa, Homo Sapiens
DELIQQSQW

SEQ ID NO: 110012 - protein, 9 aa, Homo Sapiens
DEMAAVMGF

SEQ ID NO: 110013 - protein, 9 aa, Homo Sapiens
DENGLIIVW

SEQ ID NO: 110014 - protein, 9 aa, Homo Sapiens
DENIKSFIW

SEQ ID NO: 110015 - protein, 9 aa, Homo Sapiens
DENPQQLKL

SEQ ID NO: 110016 - protein, 9 aa, Homo Sapiens
DENSVIKSF

SEQ ID NO: 110017 - protein, 9 aa, Homo Sapiens
EDAALFKAW

SEQ ID NO: 110018 - protein, 9 aa, Homo Sapiens
EDWIRGVEW

SEQ ID NO: 110019 - protein, 9 aa, Homo Sapiens
EEAEIIRKY

SEQ ID NO: 110020 - protein, 9 aa, Homo Sapiens
EEAEWQTRW

SEQ ID NO: 110021 - protein, 9 aa, Homo Sapiens
EEAFTSEHW

SEQ ID NO: 110022 - protein, 9 aa, Homo Sapiens
EEAGIFKLL

SEQ ID NO: 110023 - protein, 9 aa, Homo Sapiens
EEAPKFLAF

SEQ ID NO: 110024 - protein, 9 aa, Homo Sapiens
EEAPPPPLL

SEQ ID NO: 110025 - protein, 9 aa, Homo Sapiens
EEASIYSRW

SEQ ID NO: 110026 - protein, 9 aa, Homo Sapiens
EEASLLHQF

SEQ ID NO: 110027 - protein, 9 aa, Homo Sapiens
EEDRFYLVF

SEQ ID NO: 110028 - protein, 9 aa, Homo Sapiens
EEEFIERCF

SEQ ID NO: 110029 - protein, 9 aa, Homo Sapiens
EEFDFHVRW

SEQ ID NO: 110030 - protein, 9 aa, Homo Sapiens
EEFDSFRIF

SEQ ID NO: 110031 - protein, 9 aa, Homo Sapiens
EEFETIERF

SEQ ID NO: 110032 - protein, 9 aa, Homo Sapiens
EEFGQAFSF

SEQ ID NO: 110033 - protein, 9 aa, Homo Sapiens
EEFGRFASF

SEQ ID NO: 110034 - protein, 9 aa, Homo Sapiens
EEFHQSLQW

SEQ ID NO: 110035 - protein, 9 aa, Homo Sapiens
EEFISNTLF

SEQ ID NO: 110036 - protein, 9 aa, Homo Sapiens
EEGPDVLRW

SEQ ID NO: 110037 - protein, 9 aa, Homo Sapiens
EEHPLVFLF

SEQ ID NO: 110038 - protein, 9 aa, Homo Sapiens
EEIEILLRY

SEQ ID NO: 110039 - protein, 9 aa, Homo Sapiens
EEIFGTIGM

SEQ ID NO: 110040 - protein, 9 aa, Homo Sapiens
EEIFSLHGF

SEQ ID NO: 110041 - protein, 9 aa, Homo Sapiens
EEIIRGQVF

SEQ ID NO: 110042 - protein, 9 aa, Homo Sapiens
EEIPFEQSF

SEQ ID NO: 110043 - protein, 9 aa, Homo Sapiens
EEIPKIFQI

SEQ ID NO: 110044 - protein, 9 aa, Homo Sapiens
EEIPKNYSI

SEQ ID NO: 110045 - protein, 9 aa, Homo Sapiens
EEIPVHEEF

SEQ ID NO: 110046 - protein, 9 aa, Homo Sapiens
EEITVGQLI

SEQ ID NO: 110047 - protein, 9 aa, Homo Sapiens
EEKYAFVNW

SEQ ID NO: 110048 - protein, 9 aa, Homo Sapiens
EELDLPAVF

SEQ ID NO: 110049 - protein, 9 aa, Homo Sapiens
EELDVLKFL

SEQ ID NO: 110050 - protein, 9 aa, Homo Sapiens
EELERILVY

SEQ ID NO: 110051 - protein, 9 aa, Homo Sapiens
EELGFRPEY

SEQ ID NO: 110052 - protein, 9 aa, Homo Sapiens
EELGLVTHL

SEQ ID NO: 110053 - protein, 9 aa, Homo Sapiens
EELLGLVVW

SEQ ID NO: 110054 - protein, 9 aa, Homo Sapiens
EELPHIHAF

SEQ ID NO: 110055 - protein, 9 aa, Homo Sapiens
EELPTLLHF

SEQ ID NO: 110056 - protein, 9 aa, Homo Sapiens
EELPYSEYF

SEQ ID NO: 110057 - protein, 9 aa, Homo Sapiens
EELYTKKLW

SEQ ID NO: 110058 - protein, 9 aa, Homo Sapiens
EEMDFPQLM

SEQ ID NO: 110059 - protein, 9 aa, Homo Sapiens
EEMDLFTKY

SEQ ID NO: 110060 - protein, 9 aa, Homo Sapiens
EEMEWFNNY

SEQ ID NO: 110061 - protein, 9 aa, Homo Sapiens
EEMGFTIDI

SEQ ID NO: 110062 - protein, 9 aa, Homo Sapiens
EEMIFQIPW

SEQ ID NO: 110063 - protein, 9 aa, Homo Sapiens
EEMLEIRQL

SEQ ID NO: 110064 - protein, 9 aa, Homo Sapiens
EEMLLPRFF

SEQ ID NO: 110065 - protein, 9 aa, Homo Sapiens
EEMQWIQFF

SEQ ID NO: 110066 - protein, 9 aa, Homo Sapiens
EEMRFLREW

SEQ ID NO: 110067 - protein, 9 aa, Homo Sapiens
EENIQTLLI

SEQ ID NO: 110068 - protein, 9 aa, Homo Sapiens
EENPIVLEF

SEQ ID NO: 110069 - protein, 9 aa, Homo Sapiens
EENQKIFLL

SEQ ID NO: 110070 - protein, 9 aa, Homo Sapiens
EEPESFFTW

SEQ ID NO: 110071 - protein, 9 aa, Homo Sapiens
EEPHYIEIW

SEQ ID NO: 110072 - protein, 9 aa, Homo Sapiens
EEPPTTLLW

SEQ ID NO: 110073 - protein, 9 aa, Homo Sapiens
EEQDLVWKF

SEQ ID NO: 110074 - protein, 9 aa, Homo Sapiens
EEQGIGLQW

SEQ ID NO: 110075 - protein, 9 aa, Homo Sapiens
EEQLIAAKF

SEQ ID NO: 110076 - protein, 9 aa, Homo Sapiens
EESAVTVMF

SEQ ID NO: 110077 - protein, 9 aa, Homo Sapiens
EESFFILKY

SEQ ID NO: 110078 - protein, 9 aa, Homo Sapiens
EESQIRIEL

SEQ ID NO: 110079 - protein, 9 aa, Homo Sapiens
EESRIQIWF

SEQ ID NO: 110080 - protein, 9 aa, Homo Sapiens
EESRLLQLL

SEQ ID NO: 110081 - protein, 9 aa, Homo Sapiens
EESWFPKYI

SEQ ID NO: 110082 - protein, 9 aa, Homo Sapiens
EETFQLSRW

SEQ ID NO: 110083 - protein, 9 aa, Homo Sapiens
EETLLDQSF

SEQ ID NO: 110084 - protein, 9 aa, Homo Sapiens
EETPVVLQL

SEQ ID NO: 110085 - protein, 9 aa, Homo Sapiens
EETPYLVKI

SEQ ID NO: 110086 - protein, 9 aa, Homo Sapiens
EETVVPKTF

SEQ ID NO: 110087 - protein, 9 aa, Homo Sapiens
EEVALVQLF

SEQ ID NO: 110088 - protein, 9 aa, Homo Sapiens
EEVDMPVFF

SEQ ID NO: 110089 - protein, 9 aa, Homo Sapiens
EEVDVTPTF

SEQ ID NO: 110090 - protein, 9 aa, Homo Sapiens
EEVFRSYVF

SEQ ID NO: 110091 - protein, 9 aa, Homo Sapiens
EEWLPRELW

SEQ ID NO: 110092 - protein, 9 aa, Homo Sapiens
EEYLLRQVF

SEQ ID NO: 110093 - protein, 9 aa, Homo Sapiens
EEYLRLVIF

SEQ ID NO: 110094 - protein, 9 aa, Homo Sapiens
EEYLVIIRF

SEQ ID NO: 110095 - protein, 9 aa, Homo Sapiens
EEYQGVIAW

SEQ ID NO: 110096 - protein, 9 aa, Homo Sapiens
FEFEYASRW

SEQ ID NO: 110097 - protein, 9 aa, Homo Sapiens
FENEIILKL

SEQ ID NO: 110098 - protein, 9 aa, Homo Sapiens
FEYEYSQRW

SEQ ID NO: 110099 - protein, 9 aa, Homo Sapiens
GEAVVNRVF

SEQ ID NO: 110100 - protein, 9 aa, Homo Sapiens
GEDLGVAFW

SEQ ID NO: 110101 - protein, 9 aa, Homo Sapiens
GEDSTYKFF

SEQ ID NO: 110102 - protein, 9 aa, Homo Sapiens
GEDTFVHIW

SEQ ID NO: 110103 - protein, 9 aa, Homo Sapiens
GEFKALQEW

SEQ ID NO: 110104 - protein, 9 aa, Homo Sapiens
GEIDTRFSF

SEQ ID NO: 110105 - protein, 9 aa, Homo Sapiens
GEIETIARF

SEQ ID NO: 110106 - protein, 9 aa, Homo Sapiens
GEIQYLIKW

SEQ ID NO: 110107 - protein, 9 aa, Homo Sapiens
GELDILKDW

SEQ ID NO: 110108 - protein, 9 aa, Homo Sapiens
GELFLTKEF

SEQ ID NO: 110109 - protein, 9 aa, Homo Sapiens
GELMFLMKW

SEQ ID NO: 110110 - protein, 9 aa, Homo Sapiens
GELQLIKIF

SEQ ID NO: 110111 - protein, 9 aa, Homo Sapiens
GEMIIVLHF

SEQ ID NO: 110112 - protein, 9 aa, Homo Sapiens
GENHLTVTW

SEQ ID NO: 110113 - protein, 9 aa, Homo Sapiens
GENLPPLTY

SEQ ID NO: 110114 - protein, 9 aa, Homo Sapiens
GENPIPIFF

SEQ ID NO: 110115 - protein, 9 aa, Homo Sapiens
GEQELFVQF

SEQ ID NO: 110116 - protein, 9 aa, Homo Sapiens
GEQGYIRLI

SEQ ID NO: 110117 - protein, 9 aa, Homo Sapiens
GESKAILLW

SEQ ID NO: 110118 - protein, 9 aa, Homo Sapiens
GESVTFHLF

SEQ ID NO: 110119 - protein, 9 aa, Homo Sapiens
GETSYIRVY

SEQ ID NO: 110120 - protein, 9 aa, Homo Sapiens
GEVEGHPVW

SEQ ID NO: 110121 - protein, 9 aa, Homo Sapiens
GEVLISRVY

SEQ ID NO: 110122 - protein, 9 aa, Homo Sapiens
GEWERYIQW

SEQ ID NO: 110123 - protein, 9 aa, Homo Sapiens
HEAEVLKQL

SEQ ID NO: 110124 - protein, 9 aa, Homo Sapiens
HEFPLILIF

SEQ ID NO: 110125 - protein, 9 aa, Homo Sapiens
HEGEILQAF

SEQ ID NO: 110126 - protein, 9 aa, Homo Sapiens
HEIEALKSF

SEQ ID NO: 110127 - protein, 9 aa, Homo Sapiens
HEIIETIRW

SEQ ID NO: 110128 - protein, 9 aa, Homo Sapiens
HEVPYTTSF

SEQ ID NO: 110129 - protein, 9 aa, Homo Sapiens
HLLFWGVLA

SEQ ID NO: 110130 - protein, 9 aa, Homo Sapiens
IEFNKPQYF

SEQ ID NO: 110131 - protein, 9 aa, Homo Sapiens
IEIENFKSY

SEQ ID NO: 110132 - protein, 9 aa, Homo Sapiens
IEIFRYSFY

SEQ ID NO: 110133 - protein, 9 aa, Homo Sapiens
IEMPYVIEF

SEQ ID NO: 110134 - protein, 9 aa, Homo Sapiens
IENPALLRW

SEQ ID NO: 110135 - protein, 9 aa, Homo Sapiens
IENSFITKW

SEQ ID NO: 110136 - protein, 9 aa, Homo Sapiens
IESVIKELW

SEQ ID NO: 110137 - protein, 9 aa, Homo Sapiens
IETILVQSW

SEQ ID NO: 110138 - protein, 9 aa, Homo Sapiens
IEVNGKQSW

SEQ ID NO: 110139 - protein, 9 aa, Homo Sapiens
KDEIFQVHW

SEQ ID NO: 110140 - protein, 9 aa, Homo Sapiens
KDEIFQVQW

SEQ ID NO: 110141 - protein, 9 aa, Homo Sapiens
KEAFVVEEW

SEQ ID NO: 110142 - protein, 9 aa, Homo Sapiens
KEDLVFIFW

SEQ ID NO: 110143 - protein, 9 aa, Homo Sapiens
KEEDLLQAW

SEQ ID NO: 110144 - protein, 9 aa, Homo Sapiens
KEEELLLFW

SEQ ID NO: 110145 - protein, 9 aa, Homo Sapiens
KEEQVIQVW

SEQ ID NO: 110146 - protein, 9 aa, Homo Sapiens
KEIDLESIF

SEQ ID NO: 110147 - protein, 9 aa, Homo Sapiens
KEMWLQDYW

SEQ ID NO: 110148 - protein, 9 aa, Homo Sapiens
KETDLILTF

SEQ ID NO: 110149 - protein, 9 aa, Homo Sapiens
KETDLLILF

SEQ ID NO: 110150 - protein, 9 aa, Homo Sapiens
KETIIAFAW

SEQ ID NO: 110151 - protein, 9 aa, Homo Sapiens
KETNIAVFW

SEQ ID NO: 110152 - protein, 9 aa, Homo Sapiens
LEAILLQEL

SEQ ID NO: 110153 - protein, 9 aa, Homo Sapiens
LEFIKEIGY

SEQ ID NO: 110154 - protein, 9 aa, Homo Sapiens
LEHEYIQNF

SEQ ID NO: 110155 - protein, 9 aa, Homo Sapiens
LELGFSKVF

SEQ ID NO: 110156 - protein, 9 aa, Homo Sapiens
LENDIRTFF

SEQ ID NO: 110157 - protein, 9 aa, Homo Sapiens
LENGVFPRW

SEQ ID NO: 110158 - protein, 9 aa, Homo Sapiens
LESFIRQDF

SEQ ID NO: 110159 - protein, 9 aa, Homo Sapiens
MEEALFQHF

SEQ ID NO: 110160 - protein, 9 aa, Homo Sapiens
MEIDIPHVW

SEQ ID NO: 110161 - protein, 9 aa, Homo Sapiens
MELPDYRQW

SEQ ID NO: 110162 - protein, 9 aa, Homo Sapiens
MENDVRDFF

SEQ ID NO: 110163 - protein, 9 aa, Homo Sapiens
MENGIVRNW

SEQ ID NO: 110164 - protein, 9 aa, Homo Sapiens
MENLPLPEY

SEQ ID NO: 110165 - protein, 9 aa, Homo Sapiens
MEQSLFTRF

SEQ ID NO: 110166 - protein, 9 aa, Homo Sapiens
MEQVIFKYL

SEQ ID NO: 110167 - protein, 9 aa, Homo Sapiens
METAVPVYF

SEQ ID NO: 110168 - protein, 9 aa, Homo Sapiens
METDLYKLL

SEQ ID NO: 110169 - protein, 9 aa, Homo Sapiens
MEVFLPQSY

SEQ ID NO: 110170 - protein, 9 aa, Homo Sapiens
MEWDKIWAF

SEQ ID NO: 110171 - protein, 9 aa, Homo Sapiens
MEYVKSWFW

SEQ ID NO: 110172 - protein, 9 aa, Homo Sapiens
NEEGFVRLY

SEQ ID NO: 110173 - protein, 9 aa, Homo Sapiens
NEENYISLW

SEQ ID NO: 110174 - protein, 9 aa, Homo Sapiens
NEIGIPMVF

SEQ ID NO: 110175 - protein, 9 aa, Homo Sapiens
NEIIEPVYF

SEQ ID NO: 110176 - protein, 9 aa, Homo Sapiens
NEILGSLRW

SEQ ID NO: 110177 - protein, 9 aa, Homo Sapiens
NEILSQQLF

SEQ ID NO: 110178 - protein, 9 aa, Homo Sapiens
NEINEVLSW

SEQ ID NO: 110179 - protein, 9 aa, Homo Sapiens
NEITIPVTF

SEQ ID NO: 110180 - protein, 9 aa, Homo Sapiens
NEIVQSNLF

SEQ ID NO: 110181 - protein, 9 aa, Homo Sapiens
NELERNITI

SEQ ID NO: 110182 - protein, 9 aa, Homo Sapiens
NELIRFEEF

SEQ ID NO: 110183 - protein, 9 aa, Homo Sapiens
NELVSTHGY

SEQ ID NO: 110184 - protein, 9 aa, Homo Sapiens
NEMALVQEL

SEQ ID NO: 110185 - protein, 9 aa, Homo Sapiens
NEMPISQLL

SEQ ID NO: 110186 - protein, 9 aa, Homo Sapiens
NENDIITHF

SEQ ID NO: 110187 - protein, 9 aa, Homo Sapiens
NENPLRALY

SEQ ID NO: 110188 - protein, 9 aa, Homo Sapiens
NENSLFKSL

SEQ ID NO: 110189 - protein, 9 aa, Homo Sapiens
NEPYIFKVF

SEQ ID NO: 110190 - protein, 9 aa, Homo Sapiens
NEQPRQLFW

SEQ ID NO: 110191 - protein, 9 aa, Homo Sapiens
NESAIFHGW

SEQ ID NO: 110192 - protein, 9 aa, Homo Sapiens
NESIIVALF

SEQ ID NO: 110193 - protein, 9 aa, Homo Sapiens
NETLIVSKF

SEQ ID NO: 110194 - protein, 9 aa, Homo Sapiens
NEVFLAKLI

SEQ ID NO: 110195 - protein, 9 aa, Homo Sapiens
NEVIMTIGF

SEQ ID NO: 110196 - protein, 9 aa, Homo Sapiens
NEWARYLYY

SEQ ID NO: 110197 - protein, 9 aa, Homo Sapiens
QEAFILRLF

SEQ ID NO: 110198 - protein, 9 aa, Homo Sapiens
QEAIGFIDW

SEQ ID NO: 110199 - protein, 9 aa, Homo Sapiens
QEALIRTVF

SEQ ID NO: 110200 - protein, 9 aa, Homo Sapiens
QEALVNRLW

SEQ ID NO: 110201 - protein, 9 aa, Homo Sapiens
QEDLRTFSW

SEQ ID NO: 110202 - protein, 9 aa, Homo Sapiens
QEELITQYL

SEQ ID NO: 110203 - protein, 9 aa, Homo Sapiens
QEFDFIKSY

SEQ ID NO: 110204 - protein, 9 aa, Homo Sapiens
QEFGVPHQY

SEQ ID NO: 110205 - protein, 9 aa, Homo Sapiens
QEFIDNPKW

SEQ ID NO: 110206 - protein, 9 aa, Homo Sapiens
QEFIRVGYY

SEQ ID NO: 110207 - protein, 9 aa, Homo Sapiens
QEFNLPVRY

SEQ ID NO: 110208 - protein, 9 aa, Homo Sapiens
QEFVLEMRF

SEQ ID NO: 110209 - protein, 9 aa, Homo Sapiens
QEGDIILVL

SEQ ID NO: 110210 - protein, 9 aa, Homo Sapiens
QEGPQYWEW

SEQ ID NO: 110211 - protein, 9 aa, Homo Sapiens
QEIDILEDW

SEQ ID NO: 110212 - protein, 9 aa, Homo Sapiens
QEIEVRPGI

SEQ ID NO: 110213 - protein, 9 aa, Homo Sapiens
QELDDILKF

SEQ ID NO: 110214 - protein, 9 aa, Homo Sapiens
QELFFFHEL

SEQ ID NO: 110215 - protein, 9 aa, Homo Sapiens
QELFLAHIL

SEQ ID NO: 110216 - protein, 9 aa, Homo Sapiens
QELLLANNW

SEQ ID NO: 110217 - protein, 9 aa, Homo Sapiens
QELLQTQDF

SEQ ID NO: 110218 - protein, 9 aa, Homo Sapiens
QELYFFHEL

SEQ ID NO: 110219 - protein, 9 aa, Homo Sapiens
QENQWVTCF

SEQ ID NO: 110220 - protein, 9 aa, Homo Sapiens
QEQEIEQRL

SEQ ID NO: 110221 - protein, 9 aa, Homo Sapiens
QEQFLELSY

SEQ ID NO: 110222 - protein, 9 aa, Homo Sapiens
QEQLIRSLY

SEQ ID NO: 110223 - protein, 9 aa, Homo Sapiens
QESALIRKL

SEQ ID NO: 110224 - protein, 9 aa, Homo Sapiens
QESNVQLKL

SEQ ID NO: 110225 - protein, 9 aa, Homo Sapiens
QEVDFFQRY

SEQ ID NO: 110226 - protein, 9 aa, Homo Sapiens
QEVDLQQLI

SEQ ID NO: 110227 - protein, 9 aa, Homo Sapiens
QEVFRFAYY

SEQ ID NO: 110228 - protein, 9 aa, Homo Sapiens
QEVIKAYGF

SEQ ID NO: 110229 - protein, 9 aa, Homo Sapiens
QEVPIIIVF

SEQ ID NO: 110230 - protein, 9 aa, Homo Sapiens
REAEFTKSI

SEQ ID NO: 110231 - protein, 9 aa, Homo Sapiens
REAFLQEVW

SEQ ID NO: 110232 - protein, 9 aa, Homo Sapiens
REELQQITW

SEQ ID NO: 110233 - protein, 9 aa, Homo Sapiens
REFWPQEVW

SEQ ID NO: 110234 - protein, 9 aa, Homo Sapiens
REFYLSVYF

SEQ ID NO: 110235 - protein, 9 aa, Homo Sapiens
REGEIAQFL

SEQ ID NO: 110236 - protein, 9 aa, Homo Sapiens
REHDIAIKF

SEQ ID NO: 110237 - protein, 9 aa, Homo Sapiens
RELDLQRNY

SEQ ID NO: 110238 - protein, 9 aa, Homo Sapiens
RELELAVFW

SEQ ID NO: 110239 - protein, 9 aa, Homo Sapiens
RENDIKSYF

SEQ ID NO: 110240 - protein, 9 aa, Homo Sapiens
RENEVLEAW

SEQ ID NO: 110241 - protein, 9 aa, Homo Sapiens
RENFLQQLY

SEQ ID NO: 110242 - protein, 9 aa, Homo Sapiens
RENLPLIVW

SEQ ID NO: 110243 - protein, 9 aa, Homo Sapiens
REQDFTLIF

SEQ ID NO: 110244 - protein, 9 aa, Homo Sapiens
RETDLQELF

SEQ ID NO: 110245 - protein, 9 aa, Homo Sapiens
SDFETPIGW

SEQ ID NO: 110246 - protein, 9 aa, Homo Sapiens
SDVVLLNHW

SEQ ID NO: 110247 - protein, 9 aa, Homo Sapiens
SDWVRDVAW

SEQ ID NO: 110248 - protein, 9 aa, Homo Sapiens
SEAFVIKGL

SEQ ID NO: 110249 - protein, 9 aa, Homo Sapiens
SEANVREIF

SEQ ID NO: 110250 - protein, 9 aa, Homo Sapiens
SEAPEAPLL

SEQ ID NO: 110251 - protein, 9 aa, Homo Sapiens
SEAPFLHYL

SEQ ID NO: 110252 - protein, 9 aa, Homo Sapiens
SEAQVQKFL

SEQ ID NO: 110253 - protein, 9 aa, Homo Sapiens
SEAVIAQFY

SEQ ID NO: 110254 - protein, 9 aa, Homo Sapiens
SEDFTVQLW

SEQ ID NO: 110255 - protein, 9 aa, Homo Sapiens
SEDGKVFFW

SEQ ID NO: 110256 - protein, 9 aa, Homo Sapiens
SEDGLLKLW

SEQ ID NO: 110257 - protein, 9 aa, Homo Sapiens
SEDGSLWHW

SEQ ID NO: 110258 - protein, 9 aa, Homo Sapiens
SEDGTLRLW

SEQ ID NO: 110259 - protein, 9 aa, Homo Sapiens
SEDGTVRIW

SEQ ID NO: 110260 - protein, 9 aa, Homo Sapiens
SEDGWISLW

SEQ ID NO: 110261 - protein, 9 aa, Homo Sapiens
SEDLPLPTF

SEQ ID NO: 110262 - protein, 9 aa, Homo Sapiens
SEDNIMQIW

SEQ ID NO: 110263 - protein, 9 aa, Homo Sapiens
SEDNIMQVW

SEQ ID NO: 110264 - protein, 9 aa, Homo Sapiens
SEDNLVYIW

SEQ ID NO: 110265 - protein, 9 aa, Homo Sapiens
SEDNRILLW

SEQ ID NO: 110266 - protein, 9 aa, Homo Sapiens
SEEDLKVLF

SEQ ID NO: 110267 - protein, 9 aa, Homo Sapiens
SEEGLLRLY

SEQ ID NO: 110268 - protein, 9 aa, Homo Sapiens
SEENVIREF

SEQ ID NO: 110269 - protein, 9 aa, Homo Sapiens
SEEPILKWY

SEQ ID NO: 110270 - protein, 9 aa, Homo Sapiens
SEFALRPTF

SEQ ID NO: 110271 - protein, 9 aa, Homo Sapiens
SEFEIVKAI

SEQ ID NO: 110272 - protein, 9 aa, Homo Sapiens
SEFELLRSY

SEQ ID NO: 110273 - protein, 9 aa, Homo Sapiens
SEFGLKISF

SEQ ID NO: 110274 - protein, 9 aa, Homo Sapiens
SEFQRLLGF

SEQ ID NO: 110275 - protein, 9 aa, Homo Sapiens
SEFSEPSFI

SEQ ID NO: 110276 - protein, 9 aa, Homo Sapiens
SEFTGVWKY

SEQ ID NO: 110277 - protein, 9 aa, Homo Sapiens
SEGLIKALF

SEQ ID NO: 110278 - protein, 9 aa, Homo Sapiens
SEGPPLTSF

SEQ ID NO: 110279 - protein, 9 aa, Homo Sapiens
SEIEGIQSL

SEQ ID NO: 110280 - protein, 9 aa, Homo Sapiens
SEIELFRVF

SEQ ID NO: 110281 - protein, 9 aa, Homo Sapiens
SEIEYYAML

SEQ ID NO: 110282 - protein, 9 aa, Homo Sapiens
SEIKDVLVW

SEQ ID NO: 110283 - protein, 9 aa, Homo Sapiens
SEISQVFEI

SEQ ID NO: 110284 - protein, 9 aa, Homo Sapiens
SEKGVIQVY

SEQ ID NO: 110285 - protein, 9 aa, Homo Sapiens
SELDLAVPF

SEQ ID NO: 110286 - protein, 9 aa, Homo Sapiens
SELDLISRL

SEQ ID NO: 110287 - protein, 9 aa, Homo Sapiens
SELDQIQRY

SEQ ID NO: 110288 - protein, 9 aa, Homo Sapiens
SELEKTFGW

SEQ ID NO: 110289 - protein, 9 aa, Homo Sapiens
SELERVFLW

SEQ ID NO: 110290 - protein, 9 aa, Homo Sapiens
SELFLMKLI

SEQ ID NO: 110291 - protein, 9 aa, Homo Sapiens
SELLDKFTW

SEQ ID NO: 110292 - protein, 9 aa, Homo Sapiens
SELLSDVRF

SEQ ID NO: 110293 - protein, 9 aa, Homo Sapiens
SEMILVLEY

SEQ ID NO: 110294 - protein, 9 aa, Homo Sapiens
SEMRFVQDL

SEQ ID NO: 110295 - protein, 9 aa, Homo Sapiens
SENAIVWKI

SEQ ID NO: 110296 - protein, 9 aa, Homo Sapiens
SENDVIRLI

SEQ ID NO: 110297 - protein, 9 aa, Homo Sapiens
SENLLGKQF

SEQ ID NO: 110298 - protein, 9 aa, Homo Sapiens
SENNRIFTL

SEQ ID NO: 110299 - protein, 9 aa, Homo Sapiens
SENPMVQLF

SEQ ID NO: 110300 - protein, 9 aa, Homo Sapiens
SENSLIILL

SEQ ID NO: 110301 - protein, 9 aa, Homo Sapiens
SENVLQVHL

SEQ ID NO: 110302 - protein, 9 aa, Homo Sapiens
SEPDFVAKF

SEQ ID NO: 110303 - protein, 9 aa, Homo Sapiens
SEQEYQLYL

SEQ ID NO: 110304 - protein, 9 aa, Homo Sapiens
SEQGSLQLW

SEQ ID NO: 110305 - protein, 9 aa, Homo Sapiens
SESELTRLL

SEQ ID NO: 110306 - protein, 9 aa, Homo Sapiens
SESFISRLL

SEQ ID NO: 110307 - protein, 9 aa, Homo Sapiens
SESLVHESW

SEQ ID NO: 110308 - protein, 9 aa, Homo Sapiens
SESPIVVVL

SEQ ID NO: 110309 - protein, 9 aa, Homo Sapiens
SESQLELNW

SEQ ID NO: 110310 - protein, 9 aa, Homo Sapiens
SESRIFNEL

SEQ ID NO: 110311 - protein, 9 aa, Homo Sapiens
SETGDIYIW

SEQ ID NO: 110312 - protein, 9 aa, Homo Sapiens
SEVGGLFFW

SEQ ID NO: 110313 - protein, 9 aa, Homo Sapiens
SEVILHHEY

SEQ ID NO: 110314 - protein, 9 aa, Homo Sapiens
SEVNLSKLF

SEQ ID NO: 110315 - protein, 9 aa, Homo Sapiens
SEWSHPIHW

SEQ ID NO: 110316 - protein, 9 aa, Homo Sapiens
SLSTFQQMW

SEQ ID NO: 110317 - protein, 9 aa, Homo Sapiens
TEALILQLF

SEQ ID NO: 110318 - protein, 9 aa, Homo Sapiens
TEALYPAFW

SEQ ID NO: 110319 - protein, 9 aa, Homo Sapiens
TEFPIIKMY

SEQ ID NO: 110320 - protein, 9 aa, Homo Sapiens
TEFQMRLLW

SEQ ID NO: 110321 - protein, 9 aa, Homo Sapiens
TEFRNFIVW

SEQ ID NO: 110322 - protein, 9 aa, Homo Sapiens
TEHWLVRIY

SEQ ID NO: 110323 - protein, 9 aa, Homo Sapiens
TEIERLITW

SEQ ID NO: 110324 - protein, 9 aa, Homo Sapiens
TEINFTQKL

SEQ ID NO: 110325 - protein, 9 aa, Homo Sapiens
TEIQLVQSL

SEQ ID NO: 110326 - protein, 9 aa, Homo Sapiens
TELPKAEKW

SEQ ID NO: 110327 - protein, 9 aa, Homo Sapiens
TENDIANFF

SEQ ID NO: 110328 - protein, 9 aa, Homo Sapiens
TENDIRVMF

SEQ ID NO: 110329 - protein, 9 aa, Homo Sapiens
TENDIYNFF

SEQ ID NO: 110330 - protein, 9 aa, Homo Sapiens
TENKLYLVF

SEQ ID NO: 110331 - protein, 9 aa, Homo Sapiens
TENPVIMGL

SEQ ID NO: 110332 - protein, 9 aa, Homo Sapiens
TEQDLKEYF

SEQ ID NO: 110333 - protein, 9 aa, Homo Sapiens
TEQELELLI

SEQ ID NO: 110334 - protein, 9 aa, Homo Sapiens
TEQELNQIF

SEQ ID NO: 110335 - protein, 9 aa, Homo Sapiens
TESLLRLEW

SEQ ID NO: 110336 - protein, 9 aa, Homo Sapiens
TESQQIRYF

SEQ ID NO: 110337 - protein, 9 aa, Homo Sapiens
TEVDNYHFY

SEQ ID NO: 110338 - protein, 9 aa, Homo Sapiens
TEWTIYQDW

SEQ ID NO: 110339 - protein, 9 aa, Homo Sapiens
VEIINEELW

SEQ ID NO: 110340 - protein, 9 aa, Homo Sapiens
VEINIDHKF

SEQ ID NO: 110341 - protein, 9 aa, Homo Sapiens
VELTVVQRF

SEQ ID NO: 110342 - protein, 9 aa, Homo Sapiens
VELVTQQMW

SEQ ID NO: 110343 - protein, 9 aa, Homo Sapiens
VENNLILKM

SEQ ID NO: 110344 - protein, 9 aa, Homo Sapiens
VEQSFFNDW

SEQ ID NO: 110345 - protein, 9 aa, Homo Sapiens
VERPFYDLW

SEQ ID NO: 110346 - protein, 9 aa, Homo Sapiens
WEQGFSQSF

SEQ ID NO: 110347 - protein, 9 aa, Homo Sapiens
YEIDKTLGI

SEQ ID NO: 110348 - protein, 9 aa, Homo Sapiens
YEMEVSQRL

SEQ ID NO: 110349 - protein, 9 aa, Homo Sapiens
YEWSVKLNW

SEQ ID NO: 110350 - protein, 10 aa, Homo Sapiens
AEADEIFQEL

SEQ ID NO: 110351 - protein, 10 aa, Homo Sapiens
AEADKIGLLL

SEQ ID NO: 110352 - protein, 10 aa, Homo Sapiens
AEAEAVREVY

SEQ ID NO: 110353 - protein, 10 aa, Homo Sapiens
AEAEELKPFF

SEQ ID NO: 110354 - protein, 10 aa, Homo Sapiens
AEAESFAIQF

SEQ ID NO: 110355 - protein, 10 aa, Homo Sapiens
AEAGVAVFAW

SEQ ID NO: 110356 - protein, 10 aa, Homo Sapiens
AEAMPFPLNF

SEQ ID NO: 110357 - protein, 10 aa, Homo Sapiens
AEAWLNYPCF

SEQ ID NO: 110358 - protein, 10 aa, Homo Sapiens
AEDFADQFLR

SEQ ID NO: 110359 - protein, 10 aa, Homo Sapiens
AEDGLLFKFL

SEQ ID NO: 110360 - protein, 10 aa, Homo Sapiens
AEDKPYAELW

SEQ ID NO: 110361 - protein, 10 aa, Homo Sapiens
AEDPLGAIHL

SEQ ID NO: 110362 - protein, 10 aa, Homo Sapiens
AEEALKYIGF

SEQ ID NO: 110363 - protein, 10 aa, Homo Sapiens
AEEKAIVQQW

SEQ ID NO: 110364 - protein, 10 aa, Homo Sapiens
AEEKPIEIQW

SEQ ID NO: 110365 - protein, 10 aa, Homo Sapiens
AEELPHIHAF

SEQ ID NO: 110366 - protein, 10 aa, Homo Sapiens
AEESAIRVGF

SEQ ID NO: 110367 - protein, 10 aa, Homo Sapiens
AEFERLVAEF

SEQ ID NO: 110368 - protein, 10 aa, Homo Sapiens
AEFKEAFQLF

SEQ ID NO: 110369 - protein, 10 aa, Homo Sapiens
AEFKEAFSLF

SEQ ID NO: 110370 - protein, 10 aa, Homo Sapiens
AEFLERLHLF

SEQ ID NO: 110371 - protein, 10 aa, Homo Sapiens
AEFSRFFDAW

SEQ ID NO: 110372 - protein, 10 aa, Homo Sapiens
AEGDLYLHFF

SEQ ID NO: 110373 - protein, 10 aa, Homo Sapiens
AEGEVVQVKW

SEQ ID NO: 110374 - protein, 10 aa, Homo Sapiens
AEGEVVQVRW

SEQ ID NO: 110375 - protein, 10 aa, Homo Sapiens
AEGINLIKVF

SEQ ID NO: 110376 - protein, 10 aa, Homo Sapiens
AEGWFEDQVF

SEQ ID NO: 110377 - protein, 10 aa, Homo Sapiens
AEGWIWRWGW

SEQ ID NO: 110378 - protein, 10 aa, Homo Sapiens
AEHPTIKIFW

SEQ ID NO: 110379 - protein, 10 aa, Homo Sapiens
AEIDAHLVAL

SEQ ID NO: 110380 - protein, 10 aa, Homo Sapiens
AEIDARNDSF

SEQ ID NO: 110381 - protein, 10 aa, Homo Sapiens
AEIDFRLVSF

SEQ ID NO: 110382 - protein, 10 aa, Homo Sapiens
AEIDVIFKDF

SEQ ID NO: 110383 - protein, 10 aa, Homo Sapiens
AEIEETYANF

SEQ ID NO: 110384 - protein, 10 aa, Homo Sapiens
AEIEIVKEEF

SEQ ID NO: 110385 - protein, 10 aa, Homo Sapiens
AEIIRFLTNY

SEQ ID NO: 110386 - protein, 10 aa, Homo Sapiens
AEIKELFQYI

SEQ ID NO: 110387 - protein, 10 aa, Homo Sapiens
AEILEVLHSL

SEQ ID NO: 110388 - protein, 10 aa, Homo Sapiens
AEIMRLLDDF

SEQ ID NO: 110389 - protein, 10 aa, Homo Sapiens
AEIPDQLVSY

SEQ ID NO: 110390 - protein, 10 aa, Homo Sapiens
AEIPGLSINF

SEQ ID NO: 110391 - protein, 10 aa, Homo Sapiens
AEIPQQVVGY

SEQ ID NO: 110392 - protein, 10 aa, Homo Sapiens
AEITHEIIGF

SEQ ID NO: 110393 - protein, 10 aa, Homo Sapiens
AEKAPTNIVY

SEQ ID NO: 110394 - protein, 10 aa, Homo Sapiens
AEKLEQVLQW

SEQ ID NO: 110395 - protein, 10 aa, Homo Sapiens
AELAEIQEKW

SEQ ID NO: 110396 - protein, 10 aa, Homo Sapiens
AELAVGSRWY

SEQ ID NO: 110397 - protein, 10 aa, Homo Sapiens
AELGALHSAW

SEQ ID NO: 110398 - protein, 10 aa, Homo Sapiens
AELGGLLKYV

SEQ ID NO: 110399 - protein, 10 aa, Homo Sapiens
AELGTFPRAF

SEQ ID NO: 110400 - protein, 10 aa, Homo Sapiens
AELPKLQVGF

SEQ ID NO: 110401 - protein, 10 aa, Homo Sapiens
AELQEALWHW

SEQ ID NO: 110402 - protein, 10 aa, Homo Sapiens
AELSEQIKSF

SEQ ID NO: 110403 - protein, 10 aa, Homo Sapiens
AELSFEHDAW

SEQ ID NO: 110404 - protein, 10 aa, Homo Sapiens
AELTEEINKW

SEQ ID NO: 110405 - protein, 10 aa, Homo Sapiens
AELTTLLEQW

SEQ ID NO: 110406 - protein, 10 aa, Homo Sapiens
AELYINEHDY

SEQ ID NO: 110407 - protein, 10 aa, Homo Sapiens
AEMAQNAVRL

SEQ ID NO: 110408 - protein, 10 aa, Homo Sapiens
AEMDARTILL

SEQ ID NO: 110409 - protein, 10 aa, Homo Sapiens
AEMGLATQAF

SEQ ID NO: 110410 - protein, 10 aa, Homo Sapiens
AEMLSQLDLF

SEQ ID NO: 110411 - protein, 10 aa, Homo Sapiens
AEMQRFSDLL

SEQ ID NO: 110412 - protein, 10 aa, Homo Sapiens
AENAEFMRNF

SEQ ID NO: 110413 - protein, 10 aa, Homo Sapiens
AENGFLPIHL

SEQ ID NO: 110414 - protein, 10 aa, Homo Sapiens
AENMLEILGF

SEQ ID NO: 110415 - protein, 10 aa, Homo Sapiens
AENNPGKFWF

SEQ ID NO: 110416 - protein, 10 aa, Homo Sapiens
AENPFLTHLI

SEQ ID NO: 110417 - protein, 10 aa, Homo Sapiens
AENPFVVSMF

SEQ ID NO: 110418 - protein, 10 aa, Homo Sapiens
AENQGLVLKF

SEQ ID NO: 110419 - protein, 10 aa, Homo Sapiens
AENSLLAKVF

SEQ ID NO: 110420 - protein, 10 aa, Homo Sapiens
AENSYVETLF

SEQ ID NO: 110421 - protein, 10 aa, Homo Sapiens
AEPDFVVTDF

SEQ ID NO: 110422 - protein, 10 aa, Homo Sapiens
AEPLPSLEYW

SEQ ID NO: 110423 - protein, 10 aa, Homo Sapiens
AEPVNLFQHL

SEQ ID NO: 110424 - protein, 10 aa, Homo Sapiens
AEQDFISKFF

SEQ ID NO: 110425 - protein, 10 aa, Homo Sapiens
AEQDIVIITY

SEQ ID NO: 110426 - protein, 10 aa, Homo Sapiens
AEQKYQSTLW

SEQ ID NO: 110427 - protein, 10 aa, Homo Sapiens
AEQQVPLVLW

SEQ ID NO: 110428 - protein, 10 aa, Homo Sapiens
AEQRIGPLAF

SEQ ID NO: 110429 - protein, 10 aa, Homo Sapiens
AEQTPILLLF

SEQ ID NO: 110430 - protein, 10 aa, Homo Sapiens
AEQYDAFVKF

SEQ ID NO: 110431 - protein, 10 aa, Homo Sapiens
AEQYESFVKF

SEQ ID NO: 110432 - protein, 10 aa, Homo Sapiens
AESFVNVKRW

SEQ ID NO: 110433 - protein, 10 aa, Homo Sapiens
AESGFPVFAW

SEQ ID NO: 110434 - protein, 10 aa, Homo Sapiens
AESLVRNLQW

SEQ ID NO: 110435 - protein, 10 aa, Homo Sapiens
AESQELIYTF

SEQ ID NO: 110436 - protein, 10 aa, Homo Sapiens
AEVDKLELMF

SEQ ID NO: 110437 - protein, 10 aa, Homo Sapiens
AEVKSLIQYF

SEQ ID NO: 110438 - protein, 10 aa, Homo Sapiens
AEVLGLILRY

SEQ ID NO: 110439 - protein, 10 aa, Homo Sapiens
AEVLGQPIVW

SEQ ID NO: 110440 - protein, 10 aa, Homo Sapiens
AEVLIQQGGL

SEQ ID NO: 110441 - protein, 10 aa, Homo Sapiens
AEVLQSTQRF

SEQ ID NO: 110442 - protein, 10 aa, Homo Sapiens
AEVPIIAIDW

SEQ ID NO: 110443 - protein, 10 aa, Homo Sapiens
AEVSLMEVRF

SEQ ID NO: 110444 - protein, 10 aa, Homo Sapiens
AEVTVDFHCW

SEQ ID NO: 110445 - protein, 10 aa, Homo Sapiens
AEWASRFWLW

SEQ ID NO: 110446 - protein, 10 aa, Homo Sapiens
AEWEERISAW

SEQ ID NO: 110447 - protein, 10 aa, Homo Sapiens
AEWQLDQPSW

SEQ ID NO: 110448 - protein, 10 aa, Homo Sapiens
AEYNSDLHQF

SEQ ID NO: 110449 - protein, 10 aa, Homo Sapiens
DEFSHQVQEW

SEQ ID NO: 110450 - protein, 10 aa, Homo Sapiens
DEIERKFDKW

SEQ ID NO: 110451 - protein, 10 aa, Homo Sapiens
DEQTPIHISW

SEQ ID NO: 110452 - protein, 10 aa, Homo Sapiens
DEVIIPHSGW

SEQ ID NO: 110453 - protein, 10 aa, Homo Sapiens
EEALILDNKY

SEQ ID NO: 110454 - protein, 10 aa, Homo Sapiens
EEALKQLAEW

SEQ ID NO: 110455 - protein, 10 aa, Homo Sapiens
EEAPTDLRVF

SEQ ID NO: 110456 - protein, 10 aa, Homo Sapiens
EEATDLLAYW

SEQ ID NO: 110457 - protein, 10 aa, Homo Sapiens
EEDAALFKAW

SEQ ID NO: 110458 - protein, 10 aa, Homo Sapiens
EEDFPSLREY

SEQ ID NO: 110459 - protein, 10 aa, Homo Sapiens
EEDPNTHILY

SEQ ID NO: 110460 - protein, 10 aa, Homo Sapiens
EEDYRTLTNY

SEQ ID NO: 110461 - protein, 10 aa, Homo Sapiens
EEEGNLLRSW

SEQ ID NO: 110462 - protein, 10 aa, Homo Sapiens
EEEKYAFVNW

SEQ ID NO: 110463 - protein, 10 aa, Homo Sapiens
EEFAAALYHF

SEQ ID NO: 110464 - protein, 10 aa, Homo Sapiens
EEFDARWVTY

SEQ ID NO: 110465 - protein, 10 aa, Homo Sapiens
EEFEKLYASY

SEQ ID NO: 110466 - protein, 10 aa, Homo Sapiens
EEFELLGKAY

SEQ ID NO: 110467 - protein, 10 aa, Homo Sapiens
EEFQKELSQW

SEQ ID NO: 110468 - protein, 10 aa, Homo Sapiens
EEGDTLLHLF

SEQ ID NO: 110469 - protein, 10 aa, Homo Sapiens
EEGITFVPRW

SEQ ID NO: 110470 - protein, 10 aa, Homo Sapiens
EEIAMAVTAW

SEQ ID NO: 110471 - protein, 10 aa, Homo Sapiens
EEIAQLARQY

SEQ ID NO: 110472 - protein, 10 aa, Homo Sapiens
EEIDLRSVGW

SEQ ID NO: 110473 - protein, 10 aa, Homo Sapiens
EEIGNLELAW

SEQ ID NO: 110474 - protein, 10 aa, Homo Sapiens
EEIHATGFNY

SEQ ID NO: 110475 - protein, 10 aa, Homo Sapiens
EEIIRGQVFF

SEQ ID NO: 110476 - protein, 10 aa, Homo Sapiens
EEIREAFRVF

SEQ ID NO: 110477 - protein, 10 aa, Homo Sapiens
EEISNMIHSY

SEQ ID NO: 110478 - protein, 10 aa, Homo Sapiens
EEIVTYDRVY

SEQ ID NO: 110479 - protein, 10 aa, Homo Sapiens
EELAENILKW

SEQ ID NO: 110480 - protein, 10 aa, Homo Sapiens
EELASWGHEY

SEQ ID NO: 110481 - protein, 10 aa, Homo Sapiens
EELEQFARTF

SEQ ID NO: 110482 - protein, 10 aa, Homo Sapiens
EELERGIRSW

SEQ ID NO: 110483 - protein, 10 aa, Homo Sapiens
EELFIVSKLW

SEQ ID NO: 110484 - protein, 10 aa, Homo Sapiens
EELFRDGVNW

SEQ ID NO: 110485 - protein, 10 aa, Homo Sapiens
EELGELLQQF

SEQ ID NO: 110486 - protein, 10 aa, Homo Sapiens
EELLGDGHSY

SEQ ID NO: 110487 - protein, 10 aa, Homo Sapiens
EELNDLIQRF

SEQ ID NO: 110488 - protein, 10 aa, Homo Sapiens
EELNKLIQEF

SEQ ID NO: 110489 - protein, 10 aa, Homo Sapiens
EELPGLDSQW

SEQ ID NO: 110490 - protein, 10 aa, Homo Sapiens
EELPLDYHQY

SEQ ID NO: 110491 - protein, 10 aa, Homo Sapiens
EELPTMMQHF

SEQ ID NO: 110492 - protein, 10 aa, Homo Sapiens
EELQRQFHLF

SEQ ID NO: 110493 - protein, 10 aa, Homo Sapiens
EEMDFERGIW

SEQ ID NO: 110494 - protein, 10 aa, Homo Sapiens
EEMDLKVLQF

SEQ ID NO: 110495 - protein, 10 aa, Homo Sapiens
EEMEAFPEKF

SEQ ID NO: 110496 - protein, 10 aa, Homo Sapiens
EEMGDYIRSY

SEQ ID NO: 110497 - protein, 10 aa, Homo Sapiens
EEMMELREAF

SEQ ID NO: 110498 - protein, 10 aa, Homo Sapiens
EEMSVPLKEL

SEQ ID NO: 110499 - protein, 10 aa, Homo Sapiens
EENPSLNIQF

SEQ ID NO: 110500 - protein, 10 aa, Homo Sapiens
EENQELVTRW

SEQ ID NO: 110501 - protein, 10 aa, Homo Sapiens
EEQIKDIFYI

SEQ ID NO: 110502 - protein, 10 aa, Homo Sapiens
EEQILDHLAW

SEQ ID NO: 110503 - protein, 10 aa, Homo Sapiens
EEQPKNYQVW

SEQ ID NO: 110504 - protein, 10 aa, Homo Sapiens
EEQPQGWVSW

SEQ ID NO: 110505 - protein, 10 aa, Homo Sapiens
EEQQDILSKF

SEQ ID NO: 110506 - protein, 10 aa, Homo Sapiens
EEQRLVQQAF

SEQ ID NO: 110507 - protein, 10 aa, Homo Sapiens
EERAALLELW

SEQ ID NO: 110508 - protein, 10 aa, Homo Sapiens
EETQTLVREY

SEQ ID NO: 110509 - protein, 10 aa, Homo Sapiens
EETQVILREY

SEQ ID NO: 110510 - protein, 10 aa, Homo Sapiens
EEVAELFQRL

SEQ ID NO: 110511 - protein, 10 aa, Homo Sapiens
EEVFLIGKNF

SEQ ID NO: 110512 - protein, 10 aa, Homo Sapiens
EEVHDLERKY

SEQ ID NO: 110513 - protein, 10 aa, Homo Sapiens
EEVLAVFKSY

SEQ ID NO: 110514 - protein, 10 aa, Homo Sapiens
EEVLIPDQKY

SEQ ID NO: 110515 - protein, 10 aa, Homo Sapiens
EEVVSVLHVF

SEQ ID NO: 110516 - protein, 10 aa, Homo Sapiens
EEWGKLIYQW

SEQ ID NO: 110517 - protein, 10 aa, Homo Sapiens
EEYLKVDAQF

SEQ ID NO: 110518 - protein, 10 aa, Homo Sapiens
EEYLRLVIFW

SEQ ID NO: 110519 - protein, 10 aa, Homo Sapiens
FEAPNFFQKY

SEQ ID NO: 110520 - protein, 10 aa, Homo Sapiens
FEIEELNRKY

SEQ ID NO: 110521 - protein, 10 aa, Homo Sapiens
FEQLLSGAHW

SEQ ID NO: 110522 - protein, 10 aa, Homo Sapiens
GEIWLAIHHF

SEQ ID NO: 110523 - protein, 10 aa, Homo Sapiens
GELERAFSYY

SEQ ID NO: 110524 - protein, 10 aa, Homo Sapiens
GELLGEARYY

SEQ ID NO: 110525 - protein, 10 aa, Homo Sapiens
GEPPGFLHSW

SEQ ID NO: 110526 - protein, 10 aa, Homo Sapiens
GEQDQAVHLW

SEQ ID NO: 110527 - protein, 10 aa, Homo Sapiens
GESSFTYRAY

SEQ ID NO: 110528 - protein, 10 aa, Homo Sapiens
GEVPTLRQLW

SEQ ID NO: 110529 - protein, 10 aa, Homo Sapiens
GEWIRQNGGW

SEQ ID NO: 110530 - protein, 10 aa, Homo Sapiens
HEEPESFFTW

SEQ ID NO: 110531 - protein, 10 aa, Homo Sapiens
HEGPVWQVAW

SEQ ID NO: 110532 - protein, 10 aa, Homo Sapiens
HEINGLLVGF

SEQ ID NO: 110533 - protein, 10 aa, Homo Sapiens
HELWPGVPYW

SEQ ID NO: 110534 - protein, 10 aa, Homo Sapiens
HEQEAILHNF

SEQ ID NO: 110535 - protein, 10 aa, Homo Sapiens
IEDPQIQAHW

SEQ ID NO: 110536 - protein, 10 aa, Homo Sapiens
IELEETIKVW

SEQ ID NO: 110537 - protein, 10 aa, Homo Sapiens
IEMPNISYAW

SEQ ID NO: 110538 - protein, 10 aa, Homo Sapiens
IENEVVQITW

SEQ ID NO: 110539 - protein, 10 aa, Homo Sapiens
IEVTPGDRSW

SEQ ID NO: 110540 - protein, 10 aa, Homo Sapiens
KEFEDGIINW

SEQ ID NO: 110541 - protein, 10 aa, Homo Sapiens
KEFTGIDNLW

SEQ ID NO: 110542 - protein, 10 aa, Homo Sapiens
KEGDLPPLWW

SEQ ID NO: 110543 - protein, 10 aa, Homo Sapiens
KEIDMLLKEY

SEQ ID NO: 110544 - protein, 10 aa, Homo Sapiens
KEINTQILFW

SEQ ID NO: 110545 - protein, 10 aa, Homo Sapiens
KELDSPFRLY

SEQ ID NO: 110546 - protein, 10 aa, Homo Sapiens
KELFEGVQKW

SEQ ID NO: 110547 - protein, 10 aa, Homo Sapiens
KENAAYFQFF

SEQ ID NO: 110548 - protein, 10 aa, Homo Sapiens
KENGADIFLY

SEQ ID NO: 110549 - protein, 10 aa, Homo Sapiens
KENSDVIALW

SEQ ID NO: 110550 - protein, 10 aa, Homo Sapiens
KEPLTIVKLW

SEQ ID NO: 110551 - protein, 10 aa, Homo Sapiens
KEYEGEAILW

SEQ ID NO: 110552 - protein, 10 aa, Homo Sapiens
LEAHETFNEW

SEQ ID NO: 110553 - protein, 10 aa, Homo Sapiens
LEELYTKKLW

SEQ ID NO: 110554 - protein, 10 aa, Homo Sapiens
LEIEAENHYW

SEQ ID NO: 110555 - protein, 10 aa, Homo Sapiens
LEINDVTRAW

SEQ ID NO: 110556 - protein, 10 aa, Homo Sapiens
LENDKTIKLW

SEQ ID NO: 110557 - protein, 10 aa, Homo Sapiens
LEPEELYQTF

SEQ ID NO: 110558 - protein, 10 aa, Homo Sapiens
LESFIDTQKF

SEQ ID NO: 110559 - protein, 10 aa, Homo Sapiens
MEATYINHNF

SEQ ID NO: 110560 - protein, 10 aa, Homo Sapiens
MEFLFNKTGW

SEQ ID NO: 110561 - protein, 10 aa, Homo Sapiens
MEIDIPHVWL

SEQ ID NO: 110562 - protein, 10 aa, Homo Sapiens
MEITEELRQY

SEQ ID NO: 110563 - protein, 10 aa, Homo Sapiens
MELDEALRKF

SEQ ID NO: 110564 - protein, 10 aa, Homo Sapiens
MELQQLISVW

SEQ ID NO: 110565 - protein, 10 aa, Homo Sapiens
MEPQWVPISW

SEQ ID NO: 110566 - protein, 10 aa, Homo Sapiens
MEPSTAARAW

SEQ ID NO: 110567 - protein, 10 aa, Homo Sapiens
MEQFPHLAFW

SEQ ID NO: 110568 - protein, 10 aa, Homo Sapiens
MEQNTEGVKW

SEQ ID NO: 110569 - protein, 10 aa, Homo Sapiens
MEQSPLPMLL

SEQ ID NO: 110570 - protein, 10 aa, Homo Sapiens
MEVEVDGQKF

SEQ ID NO: 110571 - protein, 10 aa, Homo Sapiens
MEWQPEEQAW

SEQ ID NO: 110572 - protein, 10 aa, Homo Sapiens
NEASGLYQMF

SEQ ID NO: 110573 - protein, 10 aa, Homo Sapiens
NEATMVLVSW

SEQ ID NO: 110574 - protein, 10 aa, Homo Sapiens
NEAVKIIHDF

SEQ ID NO: 110575 - protein, 10 aa, Homo Sapiens
NEDNGIIKAF

SEQ ID NO: 110576 - protein, 10 aa, Homo Sapiens
NEDPQLKSLW

SEQ ID NO: 110577 - protein, 10 aa, Homo Sapiens
NEFGLTSLRW

SEQ ID NO: 110578 - protein, 10 aa, Homo Sapiens
NEIEDTFRQF

SEQ ID NO: 110579 - protein, 10 aa, Homo Sapiens
NEILDFFHGY

SEQ ID NO: 110580 - protein, 10 aa, Homo Sapiens
NEILDLCHSF

SEQ ID NO: 110581 - protein, 10 aa, Homo Sapiens
NELDAVQREY

SEQ ID NO: 110582 - protein, 10 aa, Homo Sapiens
NEMQPNGKVF

SEQ ID NO: 110583 - protein, 10 aa, Homo Sapiens
NEPILYGRSY

SEQ ID NO: 110584 - protein, 10 aa, Homo Sapiens
NEQPNRVEIY

SEQ ID NO: 110585 - protein, 10 aa, Homo Sapiens
NERDLLGTVW

SEQ ID NO: 110586 - protein, 10 aa, Homo Sapiens
QEAIDIYKRI

SEQ ID NO: 110587 - protein, 10 aa, Homo Sapiens
QEAIQDLWQW

SEQ ID NO: 110588 - protein, 10 aa, Homo Sapiens
QEALNLFKSI

SEQ ID NO: 110589 - protein, 10 aa, Homo Sapiens
QEARNIYQEF

SEQ ID NO: 110590 - protein, 10 aa, Homo Sapiens
QEDFGIFQAW

SEQ ID NO: 110591 - protein, 10 aa, Homo Sapiens
QEEAVLAAYW

SEQ ID NO: 110592 - protein, 10 aa, Homo Sapiens
QEELARSFFW

SEQ ID NO: 110593 - protein, 10 aa, Homo Sapiens
QEFDSGLLHW

SEQ ID NO: 110594 - protein, 10 aa, Homo Sapiens
QEFERNLARF

SEQ ID NO: 110595 - protein, 10 aa, Homo Sapiens
QEFVRALAAF

SEQ ID NO: 110596 - protein, 10 aa, Homo Sapiens
QEHILRFASW

SEQ ID NO: 110597 - protein, 10 aa, Homo Sapiens
QEIDILRTLY

SEQ ID NO: 110598 - protein, 10 aa, Homo Sapiens
QEISDETRVF

SEQ ID NO: 110599 - protein, 10 aa, Homo Sapiens
QEISSLVKYF

SEQ ID NO: 110600 - protein, 10 aa, Homo Sapiens
QEITDETRIF

SEQ ID NO: 110601 - protein, 10 aa, Homo Sapiens
QELASLLRTY

SEQ ID NO: 110602 - protein, 10 aa, Homo Sapiens
QELFPSPELW

SEQ ID NO: 110603 - protein, 10 aa, Homo Sapiens
QELLTIAERW

SEQ ID NO: 110604 - protein, 10 aa, Homo Sapiens
QELNDRFANY

SEQ ID NO: 110605 - protein, 10 aa, Homo Sapiens
QELNKILRSW

SEQ ID NO: 110606 - protein, 10 aa, Homo Sapiens
QELQEINRVY

SEQ ID NO: 110607 - protein, 10 aa, Homo Sapiens
QENEHIYNLW

SEQ ID NO: 110608 - protein, 10 aa, Homo Sapiens
QENHATLVSF

SEQ ID NO: 110609 - protein, 10 aa, Homo Sapiens
QENLTDLHQY

SEQ ID NO: 110610 - protein, 10 aa, Homo Sapiens
QEPKALVSEW

SEQ ID NO: 110611 - protein, 10 aa, Homo Sapiens
QEQEIEQRLL

SEQ ID NO: 110612 - protein, 10 aa, Homo Sapiens
QEQNIKPQFF

SEQ ID NO: 110613 - protein, 10 aa, Homo Sapiens
QESLRIQAQF

SEQ ID NO: 110614 - protein, 10 aa, Homo Sapiens
QEYFIPNKEF

SEQ ID NO: 110615 - protein, 10 aa, Homo Sapiens
QEYPDLIHIY

SEQ ID NO: 110616 - protein, 10 aa, Homo Sapiens
READRLLSLW

SEQ ID NO: 110617 - protein, 10 aa, Homo Sapiens
REFPDRLVGY

SEQ ID NO: 110618 - protein, 10 aa, Homo Sapiens
REHDIAIKFF

SEQ ID NO: 110619 - protein, 10 aa, Homo Sapiens
RELDAVEVFF

SEQ ID NO: 110620 - protein, 10 aa, Homo Sapiens
RELPEPLLTF

SEQ ID NO: 110621 - protein, 10 aa, Homo Sapiens
RELSAPARLY

SEQ ID NO: 110622 - protein, 10 aa, Homo Sapiens
RENYDIIKTY

SEQ ID NO: 110623 - protein, 10 aa, Homo Sapiens
REQEAGLLQF

SEQ ID NO: 110624 - protein, 10 aa, Homo Sapiens
REQEYYLVKW

SEQ ID NO: 110625 - protein, 10 aa, Homo Sapiens
RESDQLFKQY

SEQ ID NO: 110626 - protein, 10 aa, Homo Sapiens
REVSVPTFSW

SEQ ID NO: 110627 - protein, 10 aa, Homo Sapiens
SDTSDIVHIW

SEQ ID NO: 110628 - protein, 10 aa, Homo Sapiens
SEAFVQRLLW

SEQ ID NO: 110629 - protein, 10 aa, Homo Sapiens
SEALALTQTW

SEQ ID NO: 110630 - protein, 10 aa, Homo Sapiens
SEEAEIIRKY

SEQ ID NO: 110631 - protein, 10 aa, Homo Sapiens
SEELISEGKW

SEQ ID NO: 110632 - protein, 10 aa, Homo Sapiens
SEELPLASSW

SEQ ID NO: 110633 - protein, 10 aa, Homo Sapiens
SEEPLGRQLW

SEQ ID NO: 110634 - protein, 10 aa, Homo Sapiens
SEFIDSQRVW

SEQ ID NO: 110635 - protein, 10 aa, Homo Sapiens
SEFNFSSKTY

SEQ ID NO: 110636 - protein, 10 aa, Homo Sapiens
SEFVIPSVYW

SEQ ID NO: 110637 - protein, 10 aa, Homo Sapiens
SEGEDLIRFF

SEQ ID NO: 110638 - protein, 10 aa, Homo Sapiens
SEGELVELRW

SEQ ID NO: 110639 - protein, 10 aa, Homo Sapiens
SEGSFLLTTF

SEQ ID NO: 110640 - protein, 10 aa, Homo Sapiens
SEIADPTRFF

SEQ ID NO: 110641 - protein, 10 aa, Homo Sapiens
SEIDQINKVF

SEQ ID NO: 110642 - protein, 10 aa, Homo Sapiens
SEIDQLFRIF

SEQ ID NO: 110643 - protein, 10 aa, Homo Sapiens
SEIFQYTVVW

SEQ ID NO: 110644 - protein, 10 aa, Homo Sapiens
SEIGGITIAW

SEQ ID NO: 110645 - protein, 10 aa, Homo Sapiens
SEILRTLTVW

SEQ ID NO: 110646 - protein, 10 aa, Homo Sapiens
SEIPSDPKLF

SEQ ID NO: 110647 - protein, 10 aa, Homo Sapiens
SEIVWSIKSF

SEQ ID NO: 110648 - protein, 10 aa, Homo Sapiens
SEIYIHGLGL

SEQ ID NO: 110649 - protein, 10 aa, Homo Sapiens
SELATEVHFY

SEQ ID NO: 110650 - protein, 10 aa, Homo Sapiens
SELDNVTFSF

SEQ ID NO: 110651 - protein, 10 aa, Homo Sapiens
SELDQIQRYF

SEQ ID NO: 110652 - protein, 10 aa, Homo Sapiens
SELDRINAQY

SEQ ID NO: 110653 - protein, 10 aa, Homo Sapiens
SELKDFFQSY

SEQ ID NO: 110654 - protein, 10 aa, Homo Sapiens
SELLGLLKTY

SEQ ID NO: 110655 - protein, 10 aa, Homo Sapiens
SELNPNAEVW

SEQ ID NO: 110656 - protein, 10 aa, Homo Sapiens
SENFGSIHVY

SEQ ID NO: 110657 - protein, 10 aa, Homo Sapiens
SENITQKVVW

SEQ ID NO: 110658 - protein, 10 aa, Homo Sapiens
SENKIVGIGY

SEQ ID NO: 110659 - protein, 10 aa, Homo Sapiens
SENPLPTVEI

SEQ ID NO: 110660 - protein, 10 aa, Homo Sapiens
SENPNEVFRF

SEQ ID NO: 110661 - protein, 10 aa, Homo Sapiens
SENPSDVFRF

SEQ ID NO: 110662 - protein, 10 aa, Homo Sapiens
SENYITYKNF

SEQ ID NO: 110663 - protein, 10 aa, Homo Sapiens
SEPDFVAKFY

SEQ ID NO: 110664 - protein, 10 aa, Homo Sapiens
SEPDNLVITW

SEQ ID NO: 110665 - protein, 10 aa, Homo Sapiens
SEPVGIYQGF

SEQ ID NO: 110666 - protein, 10 aa, Homo Sapiens
SEQPFLLVTY

SEQ ID NO: 110667 - protein, 10 aa, Homo Sapiens
SESIIEVLRF

SEQ ID NO: 110668 - protein, 10 aa, Homo Sapiens
SESTNQRVLW

SEQ ID NO: 110669 - protein, 10 aa, Homo Sapiens
TEAFLADAKW

SEQ ID NO: 110670 - protein, 10 aa, Homo Sapiens
TEEFNREMFW

SEQ ID NO: 110671 - protein, 10 aa, Homo Sapiens
TEIERLITWY

SEQ ID NO: 110672 - protein, 10 aa, Homo Sapiens
TEIMPGINNW

SEQ ID NO: 110673 - protein, 10 aa, Homo Sapiens
TEITDDLHFY

SEQ ID NO: 110674 - protein, 10 aa, Homo Sapiens
TELELKWQHW

SEQ ID NO: 110675 - protein, 10 aa, Homo Sapiens
TELERAFGYY

SEQ ID NO: 110676 - protein, 10 aa, Homo Sapiens
TELGPEEVRW

SEQ ID NO: 110677 - protein, 10 aa, Homo Sapiens
TELLGYLQVF

SEQ ID NO: 110678 - protein, 10 aa, Homo Sapiens
TELQPVKTFW

SEQ ID NO: 110679 - protein, 10 aa, Homo Sapiens
TEMNGKNTFW

SEQ ID NO: 110680 - protein, 10 aa, Homo Sapiens
TEMWPVYVEL

SEQ ID NO: 110681 - protein, 10 aa, Homo Sapiens
TENDHVLLFW

SEQ ID NO: 110682 - protein, 10 aa, Homo Sapiens
TEVSLLRVGW

SEQ ID NO: 110683 - protein, 10 aa, Homo Sapiens
TEWVGATTDW

SEQ ID NO: 110684 - protein, 10 aa, Homo Sapiens
VEFFRVVSEY

SEQ ID NO: 110685 - protein, 10 aa, Homo Sapiens
VEQESLLTAF

SEQ ID NO: 110686 - protein, 10 aa, Homo Sapiens
VEQPTGSVLW

SEQ ID NO: 110687 - protein, 10 aa, Homo Sapiens
YEFDFSKVYW

SEQ ID NO: 110688 - protein, 10 aa, Homo Sapiens
YEILATHPTW

SEQ ID NO: 110689 - protein, 10 aa, Homo Sapiens
YEVEIDGKTY

SEQ ID NO: 110690 - protein, 11 aa, Homo Sapiens
AEAFEAIPRAL

SEQ ID NO: 110691 - protein, 11 aa, Homo Sapiens
AEALAAAQQHF

SEQ ID NO: 110692 - protein, 11 aa, Homo Sapiens
AEALGVPYEQW

SEQ ID NO: 110693 - protein, 11 aa, Homo Sapiens
AEALLSDLHAF

SEQ ID NO: 110694 - protein, 11 aa, Homo Sapiens
AEALPRPNWEL

SEQ ID NO: 110695 - protein, 11 aa, Homo Sapiens
AEALRLPYEQW

SEQ ID NO: 110696 - protein, 11 aa, Homo Sapiens
AEALSRGWALW

SEQ ID NO: 110697 - protein, 11 aa, Homo Sapiens
AEAQLRFIQAW

SEQ ID NO: 110698 - protein, 11 aa, Homo Sapiens
AEASALYGRAL

SEQ ID NO: 110699 - protein, 11 aa, Homo Sapiens
AEDEELVLHLL

SEQ ID NO: 110700 - protein, 11 aa, Homo Sapiens
AEDKENYKKFY

SEQ ID NO: 110701 - protein, 11 aa, Homo Sapiens
AEDLNSRVSYW

SEQ ID NO: 110702 - protein, 11 aa, Homo Sapiens
AEDLNTRVAYW

SEQ ID NO: 110703 - protein, 11 aa, Homo Sapiens
AEDPACIPIFW

SEQ ID NO: 110704 - protein, 11 aa, Homo Sapiens
AEDPNLNQPVW

SEQ ID NO: 110705 - protein, 11 aa, Homo Sapiens
AEEEIGTPRKF

SEQ ID NO: 110706 - protein, 11 aa, Homo Sapiens
AEFFQMESQKF

SEQ ID NO: 110707 - protein, 11 aa, Homo Sapiens
AEFQRTDLGAW

SEQ ID NO: 110708 - protein, 11 aa, Homo Sapiens
AEGDTGLPRVW

SEQ ID NO: 110709 - protein, 11 aa, Homo Sapiens
AEGIHTGQFVY

SEQ ID NO: 110710 - protein, 11 aa, Homo Sapiens
AEGKVIGLQIF

SEQ ID NO: 110711 - protein, 11 aa, Homo Sapiens
AEGLPTPIIYW

SEQ ID NO: 110712 - protein, 11 aa, Homo Sapiens
AEHIAQGLRLY

SEQ ID NO: 110713 - protein, 11 aa, Homo Sapiens
AEIAAQRTINW

SEQ ID NO: 110714 - protein, 11 aa, Homo Sapiens
AEINENNVREF

SEQ ID NO: 110715 - protein, 11 aa, Homo Sapiens
AEIPQQVVGYF

SEQ ID NO: 110716 - protein, 11 aa, Homo Sapiens
AEIQDGRFNLF

SEQ ID NO: 110717 - protein, 11 aa, Homo Sapiens
AEIQNVEGQNL

SEQ ID NO: 110718 - protein, 11 aa, Homo Sapiens
AEIVEGENHTY

SEQ ID NO: 110719 - protein, 11 aa, Homo Sapiens
AEKDLFISDFW

SEQ ID NO: 110720 - protein, 11 aa, Homo Sapiens
AEKGDGAELIW

SEQ ID NO: 110721 - protein, 11 aa, Homo Sapiens
AELDPHILAVF

SEQ ID NO: 110722 - protein, 11 aa, Homo Sapiens
AELDPSIAVGF

SEQ ID NO: 110723 - protein, 11 aa, Homo Sapiens
AELEADLPRSW

SEQ ID NO: 110724 - protein, 11 aa, Homo Sapiens
AELEPDQLLAW

SEQ ID NO: 110725 - protein, 11 aa, Homo Sapiens
AELFLDTVSTF

SEQ ID NO: 110726 - protein, 11 aa, Homo Sapiens
AELLNSKLPRW

SEQ ID NO: 110727 - protein, 11 aa, Homo Sapiens
AELLQKVITLY

SEQ ID NO: 110728 - protein, 11 aa, Homo Sapiens
AELRYDLPASY

SEQ ID NO: 110729 - protein, 11 aa, Homo Sapiens
AEMDERFQQIL

SEQ ID NO: 110730 - protein, 11 aa, Homo Sapiens
AEMNGVFDTTF

SEQ ID NO: 110731 - protein, 11 aa, Homo Sapiens
AEMPDSAAALL

SEQ ID NO: 110732 - protein, 11 aa, Homo Sapiens
AEMTGYVVTRW

SEQ ID NO: 110733 - protein, 11 aa, Homo Sapiens
AENGFLPIHLL

SEQ ID NO: 110734 - protein, 11 aa, Homo Sapiens
AEPLPSNILEW

SEQ ID NO: 110735 - protein, 11 aa, Homo Sapiens
AEQAAQLSRLL

SEQ ID NO: 110736 - protein, 11 aa, Homo Sapiens
AEQDVVVQETF

SEQ ID NO: 110737 - protein, 11 aa, Homo Sapiens
AEQELANLEKW

SEQ ID NO: 110738 - protein, 11 aa, Homo Sapiens
AEQLQEIIARL

SEQ ID NO: 110739 - protein, 11 aa, Homo Sapiens
AEQMFQGIILF

SEQ ID NO: 110740 - protein, 11 aa, Homo Sapiens
AEQQITEVFVL

SEQ ID NO: 110741 - protein, 11 aa, Homo Sapiens
AEQTLNNIKQF

SEQ ID NO: 110742 - protein, 11 aa, Homo Sapiens
AESSPDPQALW

SEQ ID NO: 110743 - protein, 11 aa, Homo Sapiens
AESSPFVERLL

SEQ ID NO: 110744 - protein, 11 aa, Homo Sapiens
AEVDLERVRVW

SEQ ID NO: 110745 - protein, 11 aa, Homo Sapiens
AEVFPLKVFGY

SEQ ID NO: 110746 - protein, 11 aa, Homo Sapiens
AEVGLNALEEW

SEQ ID NO: 110747 - protein, 11 aa, Homo Sapiens
AEYHYLEAQEW

SEQ ID NO: 110748 - protein, 11 aa, Homo Sapiens
AEYPFSSEQKW

SEQ ID NO: 110749 - protein, 11 aa, Homo Sapiens
DELEIIEGMKF

SEQ ID NO: 110750 - protein, 11 aa, Homo Sapiens
DEMTGYVATRW

SEQ ID NO: 110751 - protein, 11 aa, Homo Sapiens
EEADQLRALGW

SEQ ID NO: 110752 - protein, 11 aa, Homo Sapiens
EEALQTIFNRW

SEQ ID NO: 110753 - protein, 11 aa, Homo Sapiens
EEALRDLLAGW

SEQ ID NO: 110754 - protein, 11 aa, Homo Sapiens
EEANPFSFREF

SEQ ID NO: 110755 - protein, 11 aa, Homo Sapiens
EEAQFETKKLY

SEQ ID NO: 110756 - protein, 11 aa, Homo Sapiens
EEASFDGTFLW

SEQ ID NO: 110757 - protein, 11 aa, Homo Sapiens
EEAVTSIQQLF

SEQ ID NO: 110758 - protein, 11 aa, Homo Sapiens
EEAYNAVVRYF

SEQ ID NO: 110759 - protein, 11 aa, Homo Sapiens
EEEPPPVKIAW

SEQ ID NO: 110760 - protein, 11 aa, Homo Sapiens
EEIAIIPSKKL

SEQ ID NO: 110761 - protein, 11 aa, Homo Sapiens
EEIARDFNPNW

SEQ ID NO: 110762 - protein, 11 aa, Homo Sapiens
EEIDTSRLFEW

SEQ ID NO: 110763 - protein, 11 aa, Homo Sapiens
EEIEELLRSQW

SEQ ID NO: 110764 - protein, 11 aa, Homo Sapiens
EEIIDAIRQEL

SEQ ID NO: 110765 - protein, 11 aa, Homo Sapiens
EEIKQIWQQYF

SEQ ID NO: 110766 - protein, 11 aa, Homo Sapiens
EEINKIIRDLW

SEQ ID NO: 110767 - protein, 11 aa, Homo Sapiens
EEIPNLENSNF

SEQ ID NO: 110768 - protein, 11 aa, Homo Sapiens
EEIQEEAERMF

SEQ ID NO: 110769 - protein, 11 aa, Homo Sapiens
EEIYPPEVAEF

SEQ ID NO: 110770 - protein, 11 aa, Homo Sapiens
EEIYPPKLHQF

SEQ ID NO: 110771 - protein, 11 aa, Homo Sapiens
EELDPESREYW

SEQ ID NO: 110772 - protein, 11 aa, Homo Sapiens
EELKETIKKLL

SEQ ID NO: 110773 - protein, 11 aa, Homo Sapiens
EELTIDHVPIW

SEQ ID NO: 110774 - protein, 11 aa, Homo Sapiens
EELTLEGIKQF

SEQ ID NO: 110775 - protein, 11 aa, Homo Sapiens
EELTLEGIRQF

SEQ ID NO: 110776 - protein, 11 aa, Homo Sapiens
EELTVQVARVY

SEQ ID NO: 110777 - protein, 11 aa, Homo Sapiens
EEMPLNVADLI

SEQ ID NO: 110778 - protein, 11 aa, Homo Sapiens
EENDLGLFGYW

SEQ ID NO: 110779 - protein, 11 aa, Homo Sapiens
EENSAIIIQSW

SEQ ID NO: 110780 - protein, 11 aa, Homo Sapiens
EEQLPLGKASF

SEQ ID NO: 110781 - protein, 11 aa, Homo Sapiens
EESLLSLIRNW

SEQ ID NO: 110782 - protein, 11 aa, Homo Sapiens
EETHTNEFITW

SEQ ID NO: 110783 - protein, 11 aa, Homo Sapiens
EETPLTAAQLF

SEQ ID NO: 110784 - protein, 11 aa, Homo Sapiens
EEVFETIIHSY

SEQ ID NO: 110785 - protein, 11 aa, Homo Sapiens
EEVPTQESVKW

SEQ ID NO: 110786 - protein, 11 aa, Homo Sapiens
EEVTQEFTQYW

SEQ ID NO: 110787 - protein, 11 aa, Homo Sapiens
FEVYDPLSKRW

SEQ ID NO: 110788 - protein, 11 aa, Homo Sapiens
FHGEIEDLQQW

SEQ ID NO: 110789 - protein, 11 aa, Homo Sapiens
FVAPFPEVFGK

SEQ ID NO: 110790 - protein, 11 aa, Homo Sapiens
GEALPFIQRVY

SEQ ID NO: 110791 - protein, 11 aa, Homo Sapiens
GEIDLAKLKKF

SEQ ID NO: 110792 - protein, 11 aa, Homo Sapiens
GEIDYEAIVKL

SEQ ID NO: 110793 - protein, 11 aa, Homo Sapiens
GELDQRALQLF

SEQ ID NO: 110794 - protein, 11 aa, Homo Sapiens
GEWASGGVRSF

SEQ ID NO: 110795 - protein, 11 aa, Homo Sapiens
HEGLPGLAVQW

SEQ ID NO: 110796 - protein, 11 aa, Homo Sapiens
HELWPGVPYWW

SEQ ID NO: 110797 - protein, 11 aa, Homo Sapiens
HEQDLGPALEW

SEQ ID NO: 110798 - protein, 11 aa, Homo Sapiens
HEQVLDLGLTW

SEQ ID NO: 110799 - protein, 11 aa, Homo Sapiens
IEISELPVRTW

SEQ ID NO: 110800 - protein, 11 aa, Homo Sapiens
IGGTDTLEGGW

SEQ ID NO: 110801 - protein, 11 aa, Homo Sapiens
KEKYPDLANFW

SEQ ID NO: 110802 - protein, 11 aa, Homo Sapiens
KELLYVPLIGW

SEQ ID NO: 110803 - protein, 11 aa, Homo Sapiens
KEMDLSVETLF

SEQ ID NO: 110804 - protein, 11 aa, Homo Sapiens
KEPAESSFRFW

SEQ ID NO: 110805 - protein, 11 aa, Homo Sapiens
KESSIIGVTLF

SEQ ID NO: 110806 - protein, 11 aa, Homo Sapiens
LEEEGNLLRSW

SEQ ID NO: 110807 - protein, 11 aa, Homo Sapiens
LEHVPNSVRLW

SEQ ID NO: 110808 - protein, 11 aa, Homo Sapiens
LEILDDTVQRF

SEQ ID NO: 110809 - protein, 11 aa, Homo Sapiens
LEISAEDAERW

SEQ ID NO: 110810 - protein, 11 aa, Homo Sapiens
LELETDENRIY

SEQ ID NO: 110811 - protein, 11 aa, Homo Sapiens
LEQDPEGLHLW

SEQ ID NO: 110812 - protein, 11 aa, Homo Sapiens
MEIDIPHVWLY

SEQ ID NO: 110813 - protein, 11 aa, Homo Sapiens
MEITEELRQYF

SEQ ID NO: 110814 - protein, 11 aa, Homo Sapiens
MELSAVGERVF

SEQ ID NO: 110815 - protein, 11 aa, Homo Sapiens
NEDYPVEIHEY

SEQ ID NO: 110816 - protein, 11 aa, Homo Sapiens
NEIEDTFRQFL

SEQ ID NO: 110817 - protein, 11 aa, Homo Sapiens
NEILPNWETMW

SEQ ID NO: 110818 - protein, 11 aa, Homo Sapiens
NEIQEALSRSY

SEQ ID NO: 110819 - protein, 11 aa, Homo Sapiens
NEISERVVQHF

SEQ ID NO: 110820 - protein, 11 aa, Homo Sapiens
PPSKQILALKQ

SEQ ID NO: 110821 - protein, 11 aa, Homo Sapiens
QEAASLLGKKY

SEQ ID NO: 110822 - protein, 11 aa, Homo Sapiens
QEALNLFKSIW

SEQ ID NO: 110823 - protein, 11 aa, Homo Sapiens
QEAPLSLAEGW

SEQ ID NO: 110824 - protein, 11 aa, Homo Sapiens
QEATADVEWRW

SEQ ID NO: 110825 - protein, 11 aa, Homo Sapiens
QEDAARLQAAY

SEQ ID NO: 110826 - protein, 11 aa, Homo Sapiens
QEFEEKSGRTF

SEQ ID NO: 110827 - protein, 11 aa, Homo Sapiens
QEFLTDMKQVF

SEQ ID NO: 110828 - protein, 11 aa, Homo Sapiens
QEFQPSIAKKY

SEQ ID NO: 110829 - protein, 11 aa, Homo Sapiens
QEGLIPGSQFW

SEQ ID NO: 110830 - protein, 11 aa, Homo Sapiens
QEIGVLDQREY

SEQ ID NO: 110831 - protein, 11 aa, Homo Sapiens
QEIYGGSDSRF

SEQ ID NO: 110832 - protein, 11 aa, Homo Sapiens
QELEAGVGGRF

SEQ ID NO: 110833 - protein, 11 aa, Homo Sapiens
QELKLIGEYGL

SEQ ID NO: 110834 - protein, 11 aa, Homo Sapiens
QELPGLSHQYW

SEQ ID NO: 110835 - protein, 11 aa, Homo Sapiens
QEMFPQVPYHL

SEQ ID NO: 110836 - protein, 11 aa, Homo Sapiens
QENHFVEGLLY

SEQ ID NO: 110837 - protein, 11 aa, Homo Sapiens
QEPLYPALRLW

SEQ ID NO: 110838 - protein, 11 aa, Homo Sapiens
QEQEALVNRLW

SEQ ID NO: 110839 - protein, 11 aa, Homo Sapiens
QEQLPDLHSHF

SEQ ID NO: 110840 - protein, 11 aa, Homo Sapiens
QEQQALGVEAW

SEQ ID NO: 110841 - protein, 11 aa, Homo Sapiens
QESLPPVQFDW

SEQ ID NO: 110842 - protein, 11 aa, Homo Sapiens
QEVDASIFKAW

SEQ ID NO: 110843 - protein, 11 aa, Homo Sapiens
QEVNFQEYVTF

SEQ ID NO: 110844 - protein, 11 aa, Homo Sapiens
QEWDEFPNGRW

SEQ ID NO: 110845 - protein, 11 aa, Homo Sapiens
READLDFARQY

SEQ ID NO: 110846 - protein, 11 aa, Homo Sapiens
REAVTHIGRVY

SEQ ID NO: 110847 - protein, 11 aa, Homo Sapiens
REEDAALFKAW

SEQ ID NO: 110848 - protein, 11 aa, Homo Sapiens
REIENLPLRLF

SEQ ID NO: 110849 - protein, 11 aa, Homo Sapiens
REIQDAYLQLF

SEQ ID NO: 110850 - protein, 11 aa, Homo Sapiens
RELDGFGLYLY

SEQ ID NO: 110851 - protein, 11 aa, Homo Sapiens
RELLEIVKKNF

SEQ ID NO: 110852 - protein, 11 aa, Homo Sapiens
RELQPSEEVTW

SEQ ID NO: 110853 - protein, 11 aa, Homo Sapiens
REMVEIITKEF

SEQ ID NO: 110854 - protein, 11 aa, Homo Sapiens
RENEDRIFVYF

SEQ ID NO: 110855 - protein, 11 aa, Homo Sapiens
RENLRTALRYY

SEQ ID NO: 110856 - protein, 11 aa, Homo Sapiens
RENTQTTIKLF

SEQ ID NO: 110857 - protein, 11 aa, Homo Sapiens
SEALPGDNVGF

SEQ ID NO: 110858 - protein, 11 aa, Homo Sapiens
SEANLIVAKSW

SEQ ID NO: 110859 - protein, 11 aa, Homo Sapiens
SEAVSHLLQDW

SEQ ID NO: 110860 - protein, 11 aa, Homo Sapiens
SEFDSISKNTW

SEQ ID NO: 110861 - protein, 11 aa, Homo Sapiens
SEFLYDKALTF

SEQ ID NO: 110862 - protein, 11 aa, Homo Sapiens
SEFPEIDGQVF

SEQ ID NO: 110863 - protein, 11 aa, Homo Sapiens
SEFSEENIEFW

SEQ ID NO: 110864 - protein, 11 aa, Homo Sapiens
SEIEDSTKQVF

SEQ ID NO: 110865 - protein, 11 aa, Homo Sapiens
SEINERVVQHF

SEQ ID NO: 110866 - protein, 11 aa, Homo Sapiens
SEINFSFSRSF

SEQ ID NO: 110867 - protein, 11 aa, Homo Sapiens
SEIRSISVNQW

SEQ ID NO: 110868 - protein, 11 aa, Homo Sapiens
SEITYDKLNKW

SEQ ID NO: 110869 - protein, 11 aa, Homo Sapiens
SEKAGIIQDTW

SEQ ID NO: 110870 - protein, 11 aa, Homo Sapiens
SEKDIFDYIQW

SEQ ID NO: 110871 - protein, 11 aa, Homo Sapiens
SELFMSSFQSY

SEQ ID NO: 110872 - protein, 11 aa, Homo Sapiens
SELIAKIPNFW

SEQ ID NO: 110873 - protein, 11 aa, Homo Sapiens
SELRLDSVVQW

SEQ ID NO: 110874 - protein, 11 aa, Homo Sapiens
SELVPIATQTY

SEQ ID NO: 110875 - protein, 11 aa, Homo Sapiens
SENFGSIHVYF

SEQ ID NO: 110876 - protein, 11 aa, Homo Sapiens
SENPLITLREF

SEQ ID NO: 110877 - protein, 11 aa, Homo Sapiens
SENPNEVFRFL

SEQ ID NO: 110878 - protein, 11 aa, Homo Sapiens
SEQDWSAIQNF

SEQ ID NO: 110879 - protein, 11 aa, Homo Sapiens
SEQRDYIDTTW

SEQ ID NO: 110880 - protein, 11 aa, Homo Sapiens
SESLFVSNHAY

SEQ ID NO: 110881 - protein, 11 aa, Homo Sapiens
SESLLRGIYAY

SEQ ID NO: 110882 - protein, 11 aa, Homo Sapiens
SESQDQVFLRW

SEQ ID NO: 110883 - protein, 11 aa, Homo Sapiens
SETSVPDHVVW

SEQ ID NO: 110884 - protein, 11 aa, Homo Sapiens
SEVPGSIPNSW

SEQ ID NO: 110885 - protein, 11 aa, Homo Sapiens
TEADYYHTELW

SEQ ID NO: 110886 - protein, 11 aa, Homo Sapiens
TEALHFVAAAW

SEQ ID NO: 110887 - protein, 11 aa, Homo Sapiens
TEHQQLEGWRW

SEQ ID NO: 110888 - protein, 11 aa, Homo Sapiens
TEHYDIPKVSW

SEQ ID NO: 110889 - protein, 11 aa, Homo Sapiens
TELFRDSGTMW

SEQ ID NO: 110890 - protein, 11 aa, Homo Sapiens
TELGRPDAEYW

SEQ ID NO: 110891 - protein, 11 aa, Homo Sapiens
TEMLPSILNQL

SEQ ID NO: 110892 - protein, 11 aa, Homo Sapiens
TEQSQIKGYVW

SEQ ID NO: 110893 - protein, 11 aa, Homo Sapiens
VEAPSFLNGVW

SEQ ID NO: 110894 - protein, 11 aa, Homo Sapiens
VEIQFPAEHGW

SEQ ID NO: 110895 - protein, 11 aa, Homo Sapiens
VEITELPVRTW

SEQ ID NO: 110896 - protein, 11 aa, Homo Sapiens
VELPIEANLVW

SEQ ID NO: 110897 - protein, 11 aa, Homo Sapiens
VELTEKIAQLF

SEQ ID NO: 110898 - protein, 11 aa, Homo Sapiens
VEMYDPTRNEW

SEQ ID NO: 110899 - protein, 11 aa, Homo Sapiens
VEVSPATERQW

SEQ ID NO: 110900 - protein, 11 aa, Homo Sapiens
WEVDVTGKEAW

SEQ ID NO: 110901 - protein, 11 aa, Homo Sapiens
WEVEVGDRTSW

SEQ ID NO: 110902 - protein, 11 aa, Homo Sapiens
YEFDEQGHSTW

SEQ ID NO: 110903 - protein, 11 aa, Homo Sapiens
YEIQDIYENSW

SEQ ID NO: 110904 - protein, 8 aa, Homo Sapiens
AIIPSKKL

SEQ ID NO: 110905 - protein, 8 aa, Homo Sapiens
EEIEGFRY

SEQ ID NO: 110906 - protein, 8 aa, Homo Sapiens
NELPGLKW

SEQ ID NO: 110907 - protein, 9 aa, Homo Sapiens
ADRMFELLF

SEQ ID NO: 110908 - protein, 9 aa, Homo Sapiens
AEADLRALL

SEQ ID NO: 110909 - protein, 9 aa, Homo Sapiens
AEAEIIQLL

SEQ ID NO: 110910 - protein, 9 aa, Homo Sapiens
AEAFLEHLW

SEQ ID NO: 110911 - protein, 9 aa, Homo Sapiens
AEAFLLRLY

SEQ ID NO: 110912 - protein, 9 aa, Homo Sapiens
AEAFLVHLF

SEQ ID NO: 110913 - protein, 9 aa, Homo Sapiens
AEAFVRAFL

SEQ ID NO: 110914 - protein, 9 aa, Homo Sapiens
AEALLHPFF

SEQ ID NO: 110915 - protein, 9 aa, Homo Sapiens
AEAQQFLRY

SEQ ID NO: 110916 - protein, 9 aa, Homo Sapiens
AEAVVLTLL

SEQ ID NO: 110917 - protein, 9 aa, Homo Sapiens
AEDAMRLYY

SEQ ID NO: 110918 - protein, 9 aa, Homo Sapiens
AEDELFNRY

SEQ ID NO: 110919 - protein, 9 aa, Homo Sapiens
AEDGLLFKF

SEQ ID NO: 110920 - protein, 9 aa, Homo Sapiens
AEDLVANFF

SEQ ID NO: 110921 - protein, 9 aa, Homo Sapiens
AEDRFMLLF

SEQ ID NO: 110922 - protein, 9 aa, Homo Sapiens
AEEEFVQRF

SEQ ID NO: 110923 - protein, 9 aa, Homo Sapiens
AEEFVNVYY

SEQ ID NO: 110924 - protein, 9 aa, Homo Sapiens
AEELLRIGL

SEQ ID NO: 110925 - protein, 9 aa, Homo Sapiens
AEFAISIKY

SEQ ID NO: 110926 - protein, 9 aa, Homo Sapiens
AEFELPKTM

SEQ ID NO: 110927 - protein, 9 aa, Homo Sapiens
AEFEVHEVY

SEQ ID NO: 110928 - protein, 9 aa, Homo Sapiens
AEFEVVRTI

SEQ ID NO: 110929 - protein, 9 aa, Homo Sapiens
AEFFEPWVY

SEQ ID NO: 110930 - protein, 9 aa, Homo Sapiens
AEFIMLNHF

SEQ ID NO: 110931 - protein, 9 aa, Homo Sapiens
AEFIVAKAI

SEQ ID NO: 110932 - protein, 9 aa, Homo Sapiens
AEFKEAFQL

SEQ ID NO: 110933 - protein, 9 aa, Homo Sapiens
AEFNLRHDW

SEQ ID NO: 110934 - protein, 9 aa, Homo Sapiens
AEFRDPLGY

SEQ ID NO: 110935 - protein, 9 aa, Homo Sapiens
AEFVGVSHL

SEQ ID NO: 110936 - protein, 9 aa, Homo Sapiens
AEGDLIEHF

SEQ ID NO: 110937 - protein, 9 aa, Homo Sapiens
AEGDLVRLL

SEQ ID NO: 110938 - protein, 9 aa, Homo Sapiens
AEGKFWTHW

SEQ ID NO: 110939 - protein, 9 aa, Homo Sapiens
AEGLAKLMF

SEQ ID NO: 110940 - protein, 9 aa, Homo Sapiens
AEGPPRLAI

SEQ ID NO: 110941 - protein, 9 aa, Homo Sapiens
AEGVIVGHW

SEQ ID NO: 110942 - protein, 9 aa, Homo Sapiens
AEIAALRFL

SEQ ID NO: 110943 - protein, 9 aa, Homo Sapiens
AEIDSIHQL

SEQ ID NO: 110944 - protein, 9 aa, Homo Sapiens
AEIEDIRVL

SEQ ID NO: 110945 - protein, 9 aa, Homo Sapiens
AEIEIVKDL

SEQ ID NO: 110946 - protein, 9 aa, Homo Sapiens
AEIIKEDLW

SEQ ID NO: 110947 - protein, 9 aa, Homo Sapiens
AEIIKGELW

SEQ ID NO: 110948 - protein, 9 aa, Homo Sapiens
AEILLSNHY

SEQ ID NO: 110949 - protein, 9 aa, Homo Sapiens
AEINNIIKI

SEQ ID NO: 110950 - protein, 9 aa, Homo Sapiens
AEIPLVVCI

SEQ ID NO: 110951 - protein, 9 aa, Homo Sapiens
AEIRSLVTW

SEQ ID NO: 110952 - protein, 9 aa, Homo Sapiens
AEITDKLGL

SEQ ID NO: 110953 - protein, 9 aa, Homo Sapiens
AEIWEKLNF

SEQ ID NO: 110954 - protein, 9 aa, Homo Sapiens
AEKEISLWF

SEQ ID NO: 110955 - protein, 9 aa, Homo Sapiens
AEKLITQTF

SEQ ID NO: 110956 - protein, 9 aa, Homo Sapiens
AELAIFRVF

SEQ ID NO: 110957 - protein, 9 aa, Homo Sapiens
AELAVILKF

SEQ ID NO: 110958 - protein, 9 aa, Homo Sapiens
AELDIPQSV

SEQ ID NO: 110959 - protein, 9 aa, Homo Sapiens
AELGGLLKY

SEQ ID NO: 110960 - protein, 9 aa, Homo Sapiens
AELIISEVF

SEQ ID NO: 110961 - protein, 9 aa, Homo Sapiens
AELMQTLRF

SEQ ID NO: 110962 - protein, 9 aa, Homo Sapiens
AELPGVSRW

SEQ ID NO: 110963 - protein, 9 aa, Homo Sapiens
AELPLRLFL

SEQ ID NO: 110964 - protein, 9 aa, Homo Sapiens
AELTKVFEI

SEQ ID NO: 110965 - protein, 9 aa, Homo Sapiens
AELVHFLLL

SEQ ID NO: 110966 - protein, 9 aa, Homo Sapiens
AEMEIIGQF

SEQ ID NO: 110967 - protein, 9 aa, Homo Sapiens
AEMLRSISF

SEQ ID NO: 110968 - protein, 9 aa, Homo Sapiens
AENGLTVRL

SEQ ID NO: 110969 - protein, 9 aa, Homo Sapiens
AENLFRAFL

SEQ ID NO: 110970 - protein, 9 aa, Homo Sapiens
AENMIQLQF

SEQ ID NO: 110971 - protein, 9 aa, Homo Sapiens
AENNIQPIF

SEQ ID NO: 110972 - protein, 9 aa, Homo Sapiens
AENPFLTHL

SEQ ID NO: 110973 - protein, 9 aa, Homo Sapiens
AENPSIQLL

SEQ ID NO: 110974 - protein, 9 aa, Homo Sapiens
AENQLALEL

SEQ ID NO: 110975 - protein, 9 aa, Homo Sapiens
AEPIDIQTW

SEQ ID NO: 110976 - protein, 9 aa, Homo Sapiens
AEQAVFILF

SEQ ID NO: 110977 - protein, 9 aa, Homo Sapiens
AEQDFISKF

SEQ ID NO: 110978 - protein, 9 aa, Homo Sapiens
AEQDLVQTL

SEQ ID NO: 110979 - protein, 9 aa, Homo Sapiens
AEQLFHLNF

SEQ ID NO: 110980 - protein, 9 aa, Homo Sapiens
AERQLQVQW

SEQ ID NO: 110981 - protein, 9 aa, Homo Sapiens
AESHIILVL

SEQ ID NO: 110982 - protein, 9 aa, Homo Sapiens
AESLIAKKI

SEQ ID NO: 110983 - protein, 9 aa, Homo Sapiens
AESLYEIRF

SEQ ID NO: 110984 - protein, 9 aa, Homo Sapiens
AETAVQLFI

SEQ ID NO: 110985 - protein, 9 aa, Homo Sapiens
AETDAIRFL

SEQ ID NO: 110986 - protein, 9 aa, Homo Sapiens
AETDLPVVF

SEQ ID NO: 110987 - protein, 9 aa, Homo Sapiens
AETHIVLLF

SEQ ID NO: 110988 - protein, 9 aa, Homo Sapiens
AETPDIKLF

SEQ ID NO: 110989 - protein, 9 aa, Homo Sapiens
AEVAGQFVI

SEQ ID NO: 110990 - protein, 9 aa, Homo Sapiens
AEVDYLEQF

SEQ ID NO: 110991 - protein, 9 aa, Homo Sapiens
AEVFPLKVF

SEQ ID NO: 110992 - protein, 9 aa, Homo Sapiens
AEVGFVRFF

SEQ ID NO: 110993 - protein, 9 aa, Homo Sapiens
AEVTLKTYW

SEQ ID NO: 110994 - protein, 9 aa, Homo Sapiens
AEWEWKAGF

SEQ ID NO: 110995 - protein, 9 aa, Homo Sapiens
AEWLFPLAF

SEQ ID NO: 110996 - protein, 9 aa, Homo Sapiens
AEYLILHLI

SEQ ID NO: 110997 - protein, 9 aa, Homo Sapiens
DEALIGKKF

SEQ ID NO: 110998 - protein, 9 aa, Homo Sapiens
DEEETYRLW

SEQ ID NO: 110999 - protein, 9 aa, Homo Sapiens
DEFHLILEY

SEQ ID NO: 111000 - protein, 9 aa, Homo Sapiens
DELEIKAYY

SEQ ID NO: 111001 - protein, 9 aa, Homo Sapiens
DELIQQSQW

SEQ ID NO: 111002 - protein, 9 aa, Homo Sapiens
DELQIPVKW

SEQ ID NO: 111003 - protein, 9 aa, Homo Sapiens
DENGLIIVW

SEQ ID NO: 111004 - protein, 9 aa, Homo Sapiens
DENPQQLKL

SEQ ID NO: 111005 - protein, 9 aa, Homo Sapiens
DENSVIKSF

SEQ ID NO: 111006 - protein, 9 aa, Homo Sapiens
DEYIERLVW

SEQ ID NO: 111007 - protein, 9 aa, Homo Sapiens
EDAALFKAW

SEQ ID NO: 111008 - protein, 9 aa, Homo Sapiens
EEAEIIRKY

SEQ ID NO: 111009 - protein, 9 aa, Homo Sapiens
EEAEWQTRW

SEQ ID NO: 111010 - protein, 9 aa, Homo Sapiens
EEAHLNTSF

SEQ ID NO: 111011 - protein, 9 aa, Homo Sapiens
EEAPKFLAF

SEQ ID NO: 111012 - protein, 9 aa, Homo Sapiens
EEASIDFRF

SEQ ID NO: 111013 - protein, 9 aa, Homo Sapiens
EEASIYSRW

SEQ ID NO: 111014 - protein, 9 aa, Homo Sapiens
EEASLLHQF

SEQ ID NO: 111015 - protein, 9 aa, Homo Sapiens
EEDKFLLLY

SEQ ID NO: 111016 - protein, 9 aa, Homo Sapiens
EEDRFYLVF

SEQ ID NO: 111017 - protein, 9 aa, Homo Sapiens
EEENVVLKF

SEQ ID NO: 111018 - protein, 9 aa, Homo Sapiens
EEFDFHVRW

SEQ ID NO: 111019 - protein, 9 aa, Homo Sapiens
EEFETIERF

SEQ ID NO: 111020 - protein, 9 aa, Homo Sapiens
EEFGQAFSF

SEQ ID NO: 111021 - protein, 9 aa, Homo Sapiens
EEFGRFASF

SEQ ID NO: 111022 - protein, 9 aa, Homo Sapiens
EEFHQSLQW

SEQ ID NO: 111023 - protein, 9 aa, Homo Sapiens
EEFIGKIGI

SEQ ID NO: 111024 - protein, 9 aa, Homo Sapiens
EEFIKSIFY

SEQ ID NO: 111025 - protein, 9 aa, Homo Sapiens
EEFNREMFW

SEQ ID NO: 111026 - protein, 9 aa, Homo Sapiens
EEFPGGLTI

SEQ ID NO: 111027 - protein, 9 aa, Homo Sapiens
EEFRHVIAW

SEQ ID NO: 111028 - protein, 9 aa, Homo Sapiens
EEFTDPLSF

SEQ ID NO: 111029 - protein, 9 aa, Homo Sapiens
EEFYNLVRF

SEQ ID NO: 111030 - protein, 9 aa, Homo Sapiens
EEGMYVLRW

SEQ ID NO: 111031 - protein, 9 aa, Homo Sapiens
EEGPDVLRW

SEQ ID NO: 111032 - protein, 9 aa, Homo Sapiens
EEHPLVFLF

SEQ ID NO: 111033 - protein, 9 aa, Homo Sapiens
EEIAFLKKL

SEQ ID NO: 111034 - protein, 9 aa, Homo Sapiens
EEIDEKIGF

SEQ ID NO: 111035 - protein, 9 aa, Homo Sapiens
EEIEILLRY

SEQ ID NO: 111036 - protein, 9 aa, Homo Sapiens
EEIFGTIGM

SEQ ID NO: 111037 - protein, 9 aa, Homo Sapiens
EEIFSLHGF

SEQ ID NO: 111038 - protein, 9 aa, Homo Sapiens
EEIGNILAF

SEQ ID NO: 111039 - protein, 9 aa, Homo Sapiens
EEINLQRNI

SEQ ID NO: 111040 - protein, 9 aa, Homo Sapiens
EEIPKIFQI

SEQ ID NO: 111041 - protein, 9 aa, Homo Sapiens
EEIPKNYSI

SEQ ID NO: 111042 - protein, 9 aa, Homo Sapiens
EEIPVHEEF

SEQ ID NO: 111043 - protein, 9 aa, Homo Sapiens
EELDFQKNI

SEQ ID NO: 111044 - protein, 9 aa, Homo Sapiens
EELDLPAVF

SEQ ID NO: 111045 - protein, 9 aa, Homo Sapiens
EELDVLKFL

SEQ ID NO: 111046 - protein, 9 aa, Homo Sapiens
EELERILVY

SEQ ID NO: 111047 - protein, 9 aa, Homo Sapiens
EELFFDYRY

SEQ ID NO: 111048 - protein, 9 aa, Homo Sapiens
EELFHLLNF

SEQ ID NO: 111049 - protein, 9 aa, Homo Sapiens
EELGLVTHL

SEQ ID NO: 111050 - protein, 9 aa, Homo Sapiens
EELIVVTSY

SEQ ID NO: 111051 - protein, 9 aa, Homo Sapiens
EELLGLVVW

SEQ ID NO: 111052 - protein, 9 aa, Homo Sapiens
EELNLKTTW

SEQ ID NO: 111053 - protein, 9 aa, Homo Sapiens
EELPHIHAF

SEQ ID NO: 111054 - protein, 9 aa, Homo Sapiens
EELPTLLHF

SEQ ID NO: 111055 - protein, 9 aa, Homo Sapiens
EELYTKKLW

SEQ ID NO: 111056 - protein, 9 aa, Homo Sapiens
EEMDFPQLM

SEQ ID NO: 111057 - protein, 9 aa, Homo Sapiens
EEMDLFTKY

SEQ ID NO: 111058 - protein, 9 aa, Homo Sapiens
EEMEWFNNY

SEQ ID NO: 111059 - protein, 9 aa, Homo Sapiens
EEMIFQIPW

SEQ ID NO: 111060 - protein, 9 aa, Homo Sapiens
EEMQWIQFF

SEQ ID NO: 111061 - protein, 9 aa, Homo Sapiens
EENIYKIDF

SEQ ID NO: 111062 - protein, 9 aa, Homo Sapiens
EENPIVLEF

SEQ ID NO: 111063 - protein, 9 aa, Homo Sapiens
EENTNILKF

SEQ ID NO: 111064 - protein, 9 aa, Homo Sapiens
EEPESFFTW

SEQ ID NO: 111065 - protein, 9 aa, Homo Sapiens
EEPPTTLLW

SEQ ID NO: 111066 - protein, 9 aa, Homo Sapiens
EEPTVIKKY

SEQ ID NO: 111067 - protein, 9 aa, Homo Sapiens
EEQLIAAKF

SEQ ID NO: 111068 - protein, 9 aa, Homo Sapiens
EEQVFHFYW

SEQ ID NO: 111069 - protein, 9 aa, Homo Sapiens
EESFFILKY

SEQ ID NO: 111070 - protein, 9 aa, Homo Sapiens
EESFIPLTI

SEQ ID NO: 111071 - protein, 9 aa, Homo Sapiens
EESLNIVKY

SEQ ID NO: 111072 - protein, 9 aa, Homo Sapiens
EESRIQIWF

SEQ ID NO: 111073 - protein, 9 aa, Homo Sapiens
EETLLDQSF

SEQ ID NO: 111074 - protein, 9 aa, Homo Sapiens
EETLNILIY

SEQ ID NO: 111075 - protein, 9 aa, Homo Sapiens
EETPVVLQL

SEQ ID NO: 111076 - protein, 9 aa, Homo Sapiens
EETVVPKTF

SEQ ID NO: 111077 - protein, 9 aa, Homo Sapiens
EEVDMPVFF

SEQ ID NO: 111078 - protein, 9 aa, Homo Sapiens
EEVDVTPTF

SEQ ID NO: 111079 - protein, 9 aa, Homo Sapiens
EEVGVEHLL

SEQ ID NO: 111080 - protein, 9 aa, Homo Sapiens
EEVGYAIRF

SEQ ID NO: 111081 - protein, 9 aa, Homo Sapiens
EEVTEFLKF

SEQ ID NO: 111082 - protein, 9 aa, Homo Sapiens
EEWLPRELW

SEQ ID NO: 111083 - protein, 9 aa, Homo Sapiens
EEYLLRQVF

SEQ ID NO: 111084 - protein, 9 aa, Homo Sapiens
EEYLVIIRF

SEQ ID NO: 111085 - protein, 9 aa, Homo Sapiens
EEYMNKPTF

SEQ ID NO: 111086 - protein, 9 aa, Homo Sapiens
EEYQAFLVY

SEQ ID NO: 111087 - protein, 9 aa, Homo Sapiens
EEYQGVIAW

SEQ ID NO: 111088 - protein, 9 aa, Homo Sapiens
EEYQSLIRY

SEQ ID NO: 111089 - protein, 9 aa, Homo Sapiens
FEAPIKLVF

SEQ ID NO: 111090 - protein, 9 aa, Homo Sapiens
FEFEYASRW

SEQ ID NO: 111091 - protein, 9 aa, Homo Sapiens
FENEIILKL

SEQ ID NO: 111092 - protein, 9 aa, Homo Sapiens
FEYEYSQRW

SEQ ID NO: 111093 - protein, 9 aa, Homo Sapiens
GEADVPFYY

SEQ ID NO: 111094 - protein, 9 aa, Homo Sapiens
GEDTFVHIW

SEQ ID NO: 111095 - protein, 9 aa, Homo Sapiens
GEIDTRFSF

SEQ ID NO: 111096 - protein, 9 aa, Homo Sapiens
GEIRLLQSY

SEQ ID NO: 111097 - protein, 9 aa, Homo Sapiens
GELMFLMKW

SEQ ID NO: 111098 - protein, 9 aa, Homo Sapiens
GELQLIKIF

SEQ ID NO: 111099 - protein, 9 aa, Homo Sapiens
GENHLTVTW

SEQ ID NO: 111100 - protein, 9 aa, Homo Sapiens
GENLPPLTY

SEQ ID NO: 111101 - protein, 9 aa, Homo Sapiens
GETELREYF

SEQ ID NO: 111102 - protein, 9 aa, Homo Sapiens
GETEVLKVI

SEQ ID NO: 111103 - protein, 9 aa, Homo Sapiens
GETSYIRVY

SEQ ID NO: 111104 - protein, 9 aa, Homo Sapiens
GEVLISRVY

SEQ ID NO: 111105 - protein, 9 aa, Homo Sapiens
GEWERYIQW

SEQ ID NO: 111106 - protein, 9 aa, Homo Sapiens
HEAEVLKQL

SEQ ID NO: 111107 - protein, 9 aa, Homo Sapiens
HEFLVKPSF

SEQ ID NO: 111108 - protein, 9 aa, Homo Sapiens
HEFPLILIF

SEQ ID NO: 111109 - protein, 9 aa, Homo Sapiens
HEGDIILKI

SEQ ID NO: 111110 - protein, 9 aa, Homo Sapiens
HEGEILQAF

SEQ ID NO: 111111 - protein, 9 aa, Homo Sapiens
HEIEALKSF

SEQ ID NO: 111112 - protein, 9 aa, Homo Sapiens
HEIIETIRW

SEQ ID NO: 111113 - protein, 9 aa, Homo Sapiens
IEFDIPITY

SEQ ID NO: 111114 - protein, 9 aa, Homo Sapiens
IEFNKPQYF

SEQ ID NO: 111115 - protein, 9 aa, Homo Sapiens
IEHGIVTNW

SEQ ID NO: 111116 - protein, 9 aa, Homo Sapiens
IENPALLRW

SEQ ID NO: 111117 - protein, 9 aa, Homo Sapiens
IESVIKELW

SEQ ID NO: 111118 - protein, 9 aa, Homo Sapiens
IETILVQSW

SEQ ID NO: 111119 - protein, 9 aa, Homo Sapiens
KEAFVVEEW

SEQ ID NO: 111120 - protein, 9 aa, Homo Sapiens
KEDLVFIFW

SEQ ID NO: 111121 - protein, 9 aa, Homo Sapiens
KEELMFFLW

SEQ ID NO: 111122 - protein, 9 aa, Homo Sapiens
KEEQVIQVW

SEQ ID NO: 111123 - protein, 9 aa, Homo Sapiens
KEFEPLLNW

SEQ ID NO: 111124 - protein, 9 aa, Homo Sapiens
KEFSIDVGY

SEQ ID NO: 111125 - protein, 9 aa, Homo Sapiens
KEIFLRELI

SEQ ID NO: 111126 - protein, 9 aa, Homo Sapiens
KELAEFLTF

SEQ ID NO: 111127 - protein, 9 aa, Homo Sapiens
KETDLLILF

SEQ ID NO: 111128 - protein, 9 aa, Homo Sapiens
KETIIAFAW

SEQ ID NO: 111129 - protein, 9 aa, Homo Sapiens
KEYIPPLIW

SEQ ID NO: 111130 - protein, 9 aa, Homo Sapiens
LEADLPRSW

SEQ ID NO: 111131 - protein, 9 aa, Homo Sapiens
LEADVNIKL

SEQ ID NO: 111132 - protein, 9 aa, Homo Sapiens
LEHEYIQNF

SEQ ID NO: 111133 - protein, 9 aa, Homo Sapiens
LELGFSKVF

SEQ ID NO: 111134 - protein, 9 aa, Homo Sapiens
LSEVNIPLS

SEQ ID NO: 111135 - protein, 9 aa, Homo Sapiens
MEETIYQNY

SEQ ID NO: 111136 - protein, 9 aa, Homo Sapiens
MEIDIPHVW

SEQ ID NO: 111137 - protein, 9 aa, Homo Sapiens
MELDDTLKY

SEQ ID NO: 111138 - protein, 9 aa, Homo Sapiens
MENGIVRNW

SEQ ID NO: 111139 - protein, 9 aa, Homo Sapiens
MEQVIFKYL

SEQ ID NO: 111140 - protein, 9 aa, Homo Sapiens
METLILKEL

SEQ ID NO: 111141 - protein, 9 aa, Homo Sapiens
MEVFLPQSY

SEQ ID NO: 111142 - protein, 9 aa, Homo Sapiens
MEVPTYLNF

SEQ ID NO: 111143 - protein, 9 aa, Homo Sapiens
MEWDKIWAF

SEQ ID NO: 111144 - protein, 9 aa, Homo Sapiens
NEAVLHLRF

SEQ ID NO: 111145 - protein, 9 aa, Homo Sapiens
NEEGFVRLY

SEQ ID NO: 111146 - protein, 9 aa, Homo Sapiens
NEFLLPPVF

SEQ ID NO: 111147 - protein, 9 aa, Homo Sapiens
NEFPEPIKL

SEQ ID NO: 111148 - protein, 9 aa, Homo Sapiens
NEFPVPEQF

SEQ ID NO: 111149 - protein, 9 aa, Homo Sapiens
NEIGIPMVF

SEQ ID NO: 111150 - protein, 9 aa, Homo Sapiens
NEILGSLRW

SEQ ID NO: 111151 - protein, 9 aa, Homo Sapiens
NEINEVLSW

SEQ ID NO: 111152 - protein, 9 aa, Homo Sapiens
NEIPSLILW

SEQ ID NO: 111153 - protein, 9 aa, Homo Sapiens
NEITIPVTF

SEQ ID NO: 111154 - protein, 9 aa, Homo Sapiens
NENDIITHF

SEQ ID NO: 111155 - protein, 9 aa, Homo Sapiens
NEPYIFKVF

SEQ ID NO: 111156 - protein, 9 aa, Homo Sapiens
NESAIFHGW

SEQ ID NO: 111157 - protein, 9 aa, Homo Sapiens
NESEPIVVY

SEQ ID NO: 111158 - protein, 9 aa, Homo Sapiens
NESGVLLHF

SEQ ID NO: 111159 - protein, 9 aa, Homo Sapiens
NETLIVSKF

SEQ ID NO: 111160 - protein, 9 aa, Homo Sapiens
NEVEQLLYY

SEQ ID NO: 111161 - protein, 9 aa, Homo Sapiens
NEVFLAKLI

SEQ ID NO: 111162 - protein, 9 aa, Homo Sapiens
NEVIMTIGF

SEQ ID NO: 111163 - protein, 9 aa, Homo Sapiens
NEWARYLYY

SEQ ID NO: 111164 - protein, 9 aa, Homo Sapiens
QEAIGFIDW

SEQ ID NO: 111165 - protein, 9 aa, Homo Sapiens
QEALIRTVF

SEQ ID NO: 111166 - protein, 9 aa, Homo Sapiens
QEDLRTFSW

SEQ ID NO: 111167 - protein, 9 aa, Homo Sapiens
QEFGVPHQY

SEQ ID NO: 111168 - protein, 9 aa, Homo Sapiens
QEFNLPVRY

SEQ ID NO: 111169 - protein, 9 aa, Homo Sapiens
QEFRELLQY

SEQ ID NO: 111170 - protein, 9 aa, Homo Sapiens
QEGDIILVL

SEQ ID NO: 111171 - protein, 9 aa, Homo Sapiens
QEIDILEDW

SEQ ID NO: 111172 - protein, 9 aa, Homo Sapiens
QEIEVRPGI

SEQ ID NO: 111173 - protein, 9 aa, Homo Sapiens
QEIPGEFIY

SEQ ID NO: 111174 - protein, 9 aa, Homo Sapiens
QELDDILKF

SEQ ID NO: 111175 - protein, 9 aa, Homo Sapiens
QELFLAHIL

SEQ ID NO: 111176 - protein, 9 aa, Homo Sapiens
QELLQTQDF

SEQ ID NO: 111177 - protein, 9 aa, Homo Sapiens
QELNFLLRY

SEQ ID NO: 111178 - protein, 9 aa, Homo Sapiens
QELYFFHEL

SEQ ID NO: 111179 - protein, 9 aa, Homo Sapiens
QEQFLELSY

SEQ ID NO: 111180 - protein, 9 aa, Homo Sapiens
QEQLIRSLY

SEQ ID NO: 111181 - protein, 9 aa, Homo Sapiens
QESFIWVRY

SEQ ID NO: 111182 - protein, 9 aa, Homo Sapiens
QESNVQLKL

SEQ ID NO: 111183 - protein, 9 aa, Homo Sapiens
QEVERILYF

SEQ ID NO: 111184 - protein, 9 aa, Homo Sapiens
QEVGYSIRF

SEQ ID NO: 111185 - protein, 9 aa, Homo Sapiens
QEVGYTIRF

SEQ ID NO: 111186 - protein, 9 aa, Homo Sapiens
QEVNISLHY

SEQ ID NO: 111187 - protein, 9 aa, Homo Sapiens
QEVPIIIVF

SEQ ID NO: 111188 - protein, 9 aa, Homo Sapiens
QEVSPKVYF

SEQ ID NO: 111189 - protein, 9 aa, Homo Sapiens
QEVTNNLEF

SEQ ID NO: 111190 - protein, 9 aa, Homo Sapiens
QEYEEQFKF

SEQ ID NO: 111191 - protein, 9 aa, Homo Sapiens
REELQQITW

SEQ ID NO: 111192 - protein, 9 aa, Homo Sapiens
REFKLSKVW

SEQ ID NO: 111193 - protein, 9 aa, Homo Sapiens
REFNLNELY

SEQ ID NO: 111194 - protein, 9 aa, Homo Sapiens
REGAITFTW

SEQ ID NO: 111195 - protein, 9 aa, Homo Sapiens
RELELAVFW

SEQ ID NO: 111196 - protein, 9 aa, Homo Sapiens
RENDIKSYF

SEQ ID NO: 111197 - protein, 9 aa, Homo Sapiens
RENEVLEAW

SEQ ID NO: 111198 - protein, 9 aa, Homo Sapiens
RENLPLIVW

SEQ ID NO: 111199 - protein, 9 aa, Homo Sapiens
RETDLQELF

SEQ ID NO: 111200 - protein, 9 aa, Homo Sapiens
SEADFSIHF

SEQ ID NO: 111201 - protein, 9 aa, Homo Sapiens
SEAEMRLFY

SEQ ID NO: 111202 - protein, 9 aa, Homo Sapiens
SEAFVIKGL

SEQ ID NO: 111203 - protein, 9 aa, Homo Sapiens
SEAPFLHYL

SEQ ID NO: 111204 - protein, 9 aa, Homo Sapiens
SEAQVQKFL

SEQ ID NO: 111205 - protein, 9 aa, Homo Sapiens
SEAVVEYVF

SEQ ID NO: 111206 - protein, 9 aa, Homo Sapiens
SEDDPILQI

SEQ ID NO: 111207 - protein, 9 aa, Homo Sapiens
SEDEVKLAL

SEQ ID NO: 111208 - protein, 9 aa, Homo Sapiens
SEDFSLPAY

SEQ ID NO: 111209 - protein, 9 aa, Homo Sapiens
SEDGLLKLW

SEQ ID NO: 111210 - protein, 9 aa, Homo Sapiens
SEDGSLWHW

SEQ ID NO: 111211 - protein, 9 aa, Homo Sapiens
SEDGTLRLW

SEQ ID NO: 111212 - protein, 9 aa, Homo Sapiens
SEDGTVRIW

SEQ ID NO: 111213 - protein, 9 aa, Homo Sapiens
SEDLPLPTF

SEQ ID NO: 111214 - protein, 9 aa, Homo Sapiens
SEDNIMQIW

SEQ ID NO: 111215 - protein, 9 aa, Homo Sapiens
SEDNIMQVW

SEQ ID NO: 111216 - protein, 9 aa, Homo Sapiens
SEDNRILLW

SEQ ID NO: 111217 - protein, 9 aa, Homo Sapiens
SEEDLKVLF

SEQ ID NO: 111218 - protein, 9 aa, Homo Sapiens
SEEEFLRTY

SEQ ID NO: 111219 - protein, 9 aa, Homo Sapiens
SEEGLLRLY

SEQ ID NO: 111220 - protein, 9 aa, Homo Sapiens
SEELLSLKY

SEQ ID NO: 111221 - protein, 9 aa, Homo Sapiens
SEENVIREF

SEQ ID NO: 111222 - protein, 9 aa, Homo Sapiens
SEEPILKWY

SEQ ID NO: 111223 - protein, 9 aa, Homo Sapiens
SEFALRPTF

SEQ ID NO: 111224 - protein, 9 aa, Homo Sapiens
SEFDFFERL

SEQ ID NO: 111225 - protein, 9 aa, Homo Sapiens
SEFEIVKAI

SEQ ID NO: 111226 - protein, 9 aa, Homo Sapiens
SEFELLRSY

SEQ ID NO: 111227 - protein, 9 aa, Homo Sapiens
SEFGAPIKF

SEQ ID NO: 111228 - protein, 9 aa, Homo Sapiens
SEFGLKISF

SEQ ID NO: 111229 - protein, 9 aa, Homo Sapiens
SEFPKPQIL

SEQ ID NO: 111230 - protein, 9 aa, Homo Sapiens
SEFQRLLGF

SEQ ID NO: 111231 - protein, 9 aa, Homo Sapiens
SEFTGVWKY

SEQ ID NO: 111232 - protein, 9 aa, Homo Sapiens
SEFVIPSVY

SEQ ID NO: 111233 - protein, 9 aa, Homo Sapiens
SEGLIKALF

SEQ ID NO: 111234 - protein, 9 aa, Homo Sapiens
SEGPPLTSF

SEQ ID NO: 111235 - protein, 9 aa, Homo Sapiens
SEHLTYLEF

SEQ ID NO: 111236 - protein, 9 aa, Homo Sapiens
SEHVFQILF

SEQ ID NO: 111237 - protein, 9 aa, Homo Sapiens
SEIDQLFRI

SEQ ID NO: 111238 - protein, 9 aa, Homo Sapiens
SEIELFRVF

SEQ ID NO: 111239 - protein, 9 aa, Homo Sapiens
SEIEYYAML

SEQ ID NO: 111240 - protein, 9 aa, Homo Sapiens
SEILLKEFL

SEQ ID NO: 111241 - protein, 9 aa, Homo Sapiens
SEISQVFEI

SEQ ID NO: 111242 - protein, 9 aa, Homo Sapiens
SELDLAVPF

SEQ ID NO: 111243 - protein, 9 aa, Homo Sapiens
SELDLISRL

SEQ ID NO: 111244 - protein, 9 aa, Homo Sapiens
SELEKTFGW

SEQ ID NO: 111245 - protein, 9 aa, Homo Sapiens
SELLDKFTW

SEQ ID NO: 111246 - protein, 9 aa, Homo Sapiens
SELQVLLGY

SEQ ID NO: 111247 - protein, 9 aa, Homo Sapiens
SEMILVLEY

SEQ ID NO: 111248 - protein, 9 aa, Homo Sapiens
SENAERILF

SEQ ID NO: 111249 - protein, 9 aa, Homo Sapiens
SENAIVWKI

SEQ ID NO: 111250 - protein, 9 aa, Homo Sapiens
SENDVIRLI

SEQ ID NO: 111251 - protein, 9 aa, Homo Sapiens
SENSLIILL

SEQ ID NO: 111252 - protein, 9 aa, Homo Sapiens
SENVLQVHL

SEQ ID NO: 111253 - protein, 9 aa, Homo Sapiens
SEPDFVAKF

SEQ ID NO: 111254 - protein, 9 aa, Homo Sapiens
SEQEYQLYL

SEQ ID NO: 111255 - protein, 9 aa, Homo Sapiens
SESPIVVVL

SEQ ID NO: 111256 - protein, 9 aa, Homo Sapiens
SESQLELNW

SEQ ID NO: 111257 - protein, 9 aa, Homo Sapiens
SETKGIWMW

SEQ ID NO: 111258 - protein, 9 aa, Homo Sapiens
SETVLNLAF

SEQ ID NO: 111259 - protein, 9 aa, Homo Sapiens
SEVFVDLKW

SEQ ID NO: 111260 - protein, 9 aa, Homo Sapiens
SEVNIPLSL

SEQ ID NO: 111261 - protein, 9 aa, Homo Sapiens
SEVQAILAF

SEQ ID NO: 111262 - protein, 9 aa, Homo Sapiens
SEVVVNSVF

SEQ ID NO: 111263 - protein, 9 aa, Homo Sapiens
SEYDQIRYI

SEQ ID NO: 111264 - protein, 9 aa, Homo Sapiens
TEADVKIVI

SEQ ID NO: 111265 - protein, 9 aa, Homo Sapiens
TEAEARIFW

SEQ ID NO: 111266 - protein, 9 aa, Homo Sapiens
TEALPVKLI

SEQ ID NO: 111267 - protein, 9 aa, Homo Sapiens
TEDELVAHW

SEQ ID NO: 111268 - protein, 9 aa, Homo Sapiens
TEFRNFIVW

SEQ ID NO: 111269 - protein, 9 aa, Homo Sapiens
TEIDHWLEF

SEQ ID NO: 111270 - protein, 9 aa, Homo Sapiens
TEIELAKQI

SEQ ID NO: 111271 - protein, 9 aa, Homo Sapiens
TEIERLITW

SEQ ID NO: 111272 - protein, 9 aa, Homo Sapiens
TEIQLVQSL

SEQ ID NO: 111273 - protein, 9 aa, Homo Sapiens
TELDLHKRL

SEQ ID NO: 111274 - protein, 9 aa, Homo Sapiens
TELDQVRKW

SEQ ID NO: 111275 - protein, 9 aa, Homo Sapiens
TELLLKEGF

SEQ ID NO: 111276 - protein, 9 aa, Homo Sapiens
TELPKAEKW

SEQ ID NO: 111277 - protein, 9 aa, Homo Sapiens
TENDIANFF

SEQ ID NO: 111278 - protein, 9 aa, Homo Sapiens
TENDIRVMF

SEQ ID NO: 111279 - protein, 9 aa, Homo Sapiens
TENDIYNFF

SEQ ID NO: 111280 - protein, 9 aa, Homo Sapiens
TESLLRLEW

SEQ ID NO: 111281 - protein, 9 aa, Homo Sapiens
TESQVVITL

SEQ ID NO: 111282 - protein, 9 aa, Homo Sapiens
TETQVKIWF

SEQ ID NO: 111283 - protein, 9 aa, Homo Sapiens
TEVITGTLW

SEQ ID NO: 111284 - protein, 9 aa, Homo Sapiens
VEELFERKY

SEQ ID NO: 111285 - protein, 9 aa, Homo Sapiens
VEFGTILVY

SEQ ID NO: 111286 - protein, 9 aa, Homo Sapiens
VEINIDHKF

SEQ ID NO: 111287 - protein, 9 aa, Homo Sapiens
VELRILTNW

SEQ ID NO: 111288 - protein, 9 aa, Homo Sapiens
VENNLILKM

SEQ ID NO: 111289 - protein, 9 aa, Homo Sapiens
VEQSFFNDW

SEQ ID NO: 111290 - protein, 9 aa, Homo Sapiens
VESPLSVSF

SEQ ID NO: 111291 - protein, 9 aa, Homo Sapiens
VEVDLEHEW

SEQ ID NO: 111292 - protein, 9 aa, Homo Sapiens
VEVQLPELF

SEQ ID NO: 111293 - protein, 9 aa, Homo Sapiens
VIESPPEIN

SEQ ID NO: 111294 - protein, 9 aa, Homo Sapiens
YEWSVKLNW

SEQ ID NO: 111295 - protein, 10 aa, Homo Sapiens
AEADEIFQEL

SEQ ID NO: 111296 - protein, 10 aa, Homo Sapiens
AEAGVAVFAW

SEQ ID NO: 111297 - protein, 10 aa, Homo Sapiens
AEARLLLDNF

SEQ ID NO: 111298 - protein, 10 aa, Homo Sapiens
AEAWLNYPCF

SEQ ID NO: 111299 - protein, 10 aa, Homo Sapiens
AEDFLEKLAF

SEQ ID NO: 111300 - protein, 10 aa, Homo Sapiens
AEDGLLFKFL

SEQ ID NO: 111301 - protein, 10 aa, Homo Sapiens
AEDPLGAIHL

SEQ ID NO: 111302 - protein, 10 aa, Homo Sapiens
AEEKPIEIQW

SEQ ID NO: 111303 - protein, 10 aa, Homo Sapiens
AEFEDTLKTF

SEQ ID NO: 111304 - protein, 10 aa, Homo Sapiens
AEFKEAFQLF

SEQ ID NO: 111305 - protein, 10 aa, Homo Sapiens
AEFKEAFSLF

SEQ ID NO: 111306 - protein, 10 aa, Homo Sapiens
AEGEVVQVKW

SEQ ID NO: 111307 - protein, 10 aa, Homo Sapiens
AEGEVVQVRW

SEQ ID NO: 111308 - protein, 10 aa, Homo Sapiens
AEHDQLLLNY

SEQ ID NO: 111309 - protein, 10 aa, Homo Sapiens
AEHSPVPAGF

SEQ ID NO: 111310 - protein, 10 aa, Homo Sapiens
AEIDAHLVAL

SEQ ID NO: 111311 - protein, 10 aa, Homo Sapiens
AEIDFRLVSF

SEQ ID NO: 111312 - protein, 10 aa, Homo Sapiens
AEIDVIFKDF

SEQ ID NO: 111313 - protein, 10 aa, Homo Sapiens
AEIEIVKEEF

SEQ ID NO: 111314 - protein, 10 aa, Homo Sapiens
AEIKQIVSEY

SEQ ID NO: 111315 - protein, 10 aa, Homo Sapiens
AEIPDQLVSY

SEQ ID NO: 111316 - protein, 10 aa, Homo Sapiens
AEIPGLSINF

SEQ ID NO: 111317 - protein, 10 aa, Homo Sapiens
AELDRQIKSF

SEQ ID NO: 111318 - protein, 10 aa, Homo Sapiens
AELELQRFLY

SEQ ID NO: 111319 - protein, 10 aa, Homo Sapiens
AELGGLLKYV

SEQ ID NO: 111320 - protein, 10 aa, Homo Sapiens
AELGLEIPAY

SEQ ID NO: 111321 - protein, 10 aa, Homo Sapiens
AELGTFPRAF

SEQ ID NO: 111322 - protein, 10 aa, Homo Sapiens
AELKAPGISY

SEQ ID NO: 111323 - protein, 10 aa, Homo Sapiens
AELLVKGYEI

SEQ ID NO: 111324 - protein, 10 aa, Homo Sapiens
AELPLIRLDF

SEQ ID NO: 111325 - protein, 10 aa, Homo Sapiens
AELSEQIKSF

SEQ ID NO: 111326 - protein, 10 aa, Homo Sapiens
AELTTLLEQW

SEQ ID NO: 111327 - protein, 10 aa, Homo Sapiens
AELYINEHDY

SEQ ID NO: 111328 - protein, 10 aa, Homo Sapiens
AEMDARTILL

SEQ ID NO: 111329 - protein, 10 aa, Homo Sapiens
AENGFLPIHL

SEQ ID NO: 111330 - protein, 10 aa, Homo Sapiens
AENPFLTHLI

SEQ ID NO: 111331 - protein, 10 aa, Homo Sapiens
AENPFVVSMF

SEQ ID NO: 111332 - protein, 10 aa, Homo Sapiens
AEPDFVVTDF

SEQ ID NO: 111333 - protein, 10 aa, Homo Sapiens
AEPLEIILHL

SEQ ID NO: 111334 - protein, 10 aa, Homo Sapiens
AEQDFISKFF

SEQ ID NO: 111335 - protein, 10 aa, Homo Sapiens
AEQDIVIITY

SEQ ID NO: 111336 - protein, 10 aa, Homo Sapiens
AEQQVPLVLW

SEQ ID NO: 111337 - protein, 10 aa, Homo Sapiens
AESDLDYIQY

SEQ ID NO: 111338 - protein, 10 aa, Homo Sapiens
AESFVNVKRW

SEQ ID NO: 111339 - protein, 10 aa, Homo Sapiens
AESGFPVFAW

SEQ ID NO: 111340 - protein, 10 aa, Homo Sapiens
AESLVRNLQW

SEQ ID NO: 111341 - protein, 10 aa, Homo Sapiens
AETDFEKRDF

SEQ ID NO: 111342 - protein, 10 aa, Homo Sapiens
AEVDKLELMF

SEQ ID NO: 111343 - protein, 10 aa, Homo Sapiens
AEVDKVTGRF

SEQ ID NO: 111344 - protein, 10 aa, Homo Sapiens
AEVISVLQKY

SEQ ID NO: 111345 - protein, 10 aa, Homo Sapiens
AEVLGLILRY

SEQ ID NO: 111346 - protein, 10 aa, Homo Sapiens
AEVLIQQGGL

SEQ ID NO: 111347 - protein, 10 aa, Homo Sapiens
AEVLNFLLRY

SEQ ID NO: 111348 - protein, 10 aa, Homo Sapiens
AEVMPAQWEF

SEQ ID NO: 111349 - protein, 10 aa, Homo Sapiens
AEVPIIAIDW

SEQ ID NO: 111350 - protein, 10 aa, Homo Sapiens
AEVSLMEVRF

SEQ ID NO: 111351 - protein, 10 aa, Homo Sapiens
AEWASRFWLW

SEQ ID NO: 111352 - protein, 10 aa, Homo Sapiens
AEWEERISAW

SEQ ID NO: 111353 - protein, 10 aa, Homo Sapiens
AEWQLDQPSW

SEQ ID NO: 111354 - protein, 10 aa, Homo Sapiens
ALAPILDDGW

SEQ ID NO: 111355 - protein, 10 aa, Homo Sapiens
DEAPVLDVRY

SEQ ID NO: 111356 - protein, 10 aa, Homo Sapiens
DEFSEAIKAF

SEQ ID NO: 111357 - protein, 10 aa, Homo Sapiens
DEFSHQVQEW

SEQ ID NO: 111358 - protein, 10 aa, Homo Sapiens
DEHEGPALYY

SEQ ID NO: 111359 - protein, 10 aa, Homo Sapiens
DEIENVAKQF

SEQ ID NO: 111360 - protein, 10 aa, Homo Sapiens
DELKIPIRSW

SEQ ID NO: 111361 - protein, 10 aa, Homo Sapiens
DELPQSVLKW

SEQ ID NO: 111362 - protein, 10 aa, Homo Sapiens
DEQTPIHISW

SEQ ID NO: 111363 - protein, 10 aa, Homo Sapiens
DEVFFSEKIY

SEQ ID NO: 111364 - protein, 10 aa, Homo Sapiens
DEVIIPHSGW

SEQ ID NO: 111365 - protein, 10 aa, Homo Sapiens
EEAIIYSYGF

SEQ ID NO: 111366 - protein, 10 aa, Homo Sapiens
EEALILDNKY

SEQ ID NO: 111367 - protein, 10 aa, Homo Sapiens
EEAPLVTKAF

SEQ ID NO: 111368 - protein, 10 aa, Homo Sapiens
EEARPLVEFY

SEQ ID NO: 111369 - protein, 10 aa, Homo Sapiens
EEATDLLAYW

SEQ ID NO: 111370 - protein, 10 aa, Homo Sapiens
EEDAALFKAW

SEQ ID NO: 111371 - protein, 10 aa, Homo Sapiens
EEDPNTHILY

SEQ ID NO: 111372 - protein, 10 aa, Homo Sapiens
EEDRVVVIRF

SEQ ID NO: 111373 - protein, 10 aa, Homo Sapiens
EEEGNLLRSW

SEQ ID NO: 111374 - protein, 10 aa, Homo Sapiens
EEEKYAFVNW

SEQ ID NO: 111375 - protein, 10 aa, Homo Sapiens
EEFAAALYHF

SEQ ID NO: 111376 - protein, 10 aa, Homo Sapiens
EEFDARWVTY

SEQ ID NO: 111377 - protein, 10 aa, Homo Sapiens
EEFDRLVKEY

SEQ ID NO: 111378 - protein, 10 aa, Homo Sapiens
EEFEKALVWY

SEQ ID NO: 111379 - protein, 10 aa, Homo Sapiens
EEFEKLYASY

SEQ ID NO: 111380 - protein, 10 aa, Homo Sapiens
EEFELLGKAY

SEQ ID NO: 111381 - protein, 10 aa, Homo Sapiens
EEFFGDLNNF

SEQ ID NO: 111382 - protein, 10 aa, Homo Sapiens
EEFLNGRAVY

SEQ ID NO: 111383 - protein, 10 aa, Homo Sapiens
EEFQKELSQW

SEQ ID NO: 111384 - protein, 10 aa, Homo Sapiens
EEFVIVKALY

SEQ ID NO: 111385 - protein, 10 aa, Homo Sapiens
EEGEIPWLQY

SEQ ID NO: 111386 - protein, 10 aa, Homo Sapiens
EEGHDFIQEF

SEQ ID NO: 111387 - protein, 10 aa, Homo Sapiens
EEHVIIQAEF

SEQ ID NO: 111388 - protein, 10 aa, Homo Sapiens
EEIAQLARQY

SEQ ID NO: 111389 - protein, 10 aa, Homo Sapiens
EEIDLRSVGW

SEQ ID NO: 111390 - protein, 10 aa, Homo Sapiens
EEIHATGFNY

SEQ ID NO: 111391 - protein, 10 aa, Homo Sapiens
EEIKQIWQQY

SEQ ID NO: 111392 - protein, 10 aa, Homo Sapiens
EEIPLIKSAY

SEQ ID NO: 111393 - protein, 10 aa, Homo Sapiens
EEIQTVFNKY

SEQ ID NO: 111394 - protein, 10 aa, Homo Sapiens
EEIREAFRVF

SEQ ID NO: 111395 - protein, 10 aa, Homo Sapiens
EEIRNIILKL

SEQ ID NO: 111396 - protein, 10 aa, Homo Sapiens
EEISNMIHSY

SEQ ID NO: 111397 - protein, 10 aa, Homo Sapiens
EEISTLVQKL

SEQ ID NO: 111398 - protein, 10 aa, Homo Sapiens
EELAENILKW

SEQ ID NO: 111399 - protein, 10 aa, Homo Sapiens
EELASWGHEY

SEQ ID NO: 111400 - protein, 10 aa, Homo Sapiens
EELDFQKNIY

SEQ ID NO: 111401 - protein, 10 aa, Homo Sapiens
EELDGLFRRY

SEQ ID NO: 111402 - protein, 10 aa, Homo Sapiens
EELDLPAVFL

SEQ ID NO: 111403 - protein, 10 aa, Homo Sapiens
EELEVDFKKL

SEQ ID NO: 111404 - protein, 10 aa, Homo Sapiens
EELGELLQQF

SEQ ID NO: 111405 - protein, 10 aa, Homo Sapiens
EELGLIEQAY

SEQ ID NO: 111406 - protein, 10 aa, Homo Sapiens
EELLGDGHSY

SEQ ID NO: 111407 - protein, 10 aa, Homo Sapiens
EELNDLIQRF

SEQ ID NO: 111408 - protein, 10 aa, Homo Sapiens
EELNKLIQEF

SEQ ID NO: 111409 - protein, 10 aa, Homo Sapiens
EELPEKLKLY

SEQ ID NO: 111410 - protein, 10 aa, Homo Sapiens
EELPGLDSQW

SEQ ID NO: 111411 - protein, 10 aa, Homo Sapiens
EELQKIYKTY

SEQ ID NO: 111412 - protein, 10 aa, Homo Sapiens
EELRELAESW

SEQ ID NO: 111413 - protein, 10 aa, Homo Sapiens
EELYGLALRF

SEQ ID NO: 111414 - protein, 10 aa, Homo Sapiens
EEMDFERGIW

SEQ ID NO: 111415 - protein, 10 aa, Homo Sapiens
EEMDLKVLQF

SEQ ID NO: 111416 - protein, 10 aa, Homo Sapiens
EEMEAFPEKF

SEQ ID NO: 111417 - protein, 10 aa, Homo Sapiens
EEMGDYIRSY

SEQ ID NO: 111418 - protein, 10 aa, Homo Sapiens
EEMSVPLKEL

SEQ ID NO: 111419 - protein, 10 aa, Homo Sapiens
EEMYDIFGKY

SEQ ID NO: 111420 - protein, 10 aa, Homo Sapiens
EENPSLNIQF

SEQ ID NO: 111421 - protein, 10 aa, Homo Sapiens
EENQELVTRW

SEQ ID NO: 111422 - protein, 10 aa, Homo Sapiens
EEPDVIFQNF

SEQ ID NO: 111423 - protein, 10 aa, Homo Sapiens
EEPIYIITEY

SEQ ID NO: 111424 - protein, 10 aa, Homo Sapiens
EEQLIDGILY

SEQ ID NO: 111425 - protein, 10 aa, Homo Sapiens
EEQQDILSKF

SEQ ID NO: 111426 - protein, 10 aa, Homo Sapiens
EESFAEHLGY

SEQ ID NO: 111427 - protein, 10 aa, Homo Sapiens
EETHSIFLWY

SEQ ID NO: 111428 - protein, 10 aa, Homo Sapiens
EETQVILREY

SEQ ID NO: 111429 - protein, 10 aa, Homo Sapiens
EETTDLLAHW

SEQ ID NO: 111430 - protein, 10 aa, Homo Sapiens
EETVFYGLQY

SEQ ID NO: 111431 - protein, 10 aa, Homo Sapiens
EEVAELFQRL

SEQ ID NO: 111432 - protein, 10 aa, Homo Sapiens
EEVEAKFKRY

SEQ ID NO: 111433 - protein, 10 aa, Homo Sapiens
EEVFLIGKNF

SEQ ID NO: 111434 - protein, 10 aa, Homo Sapiens
EEVFPLAMNY

SEQ ID NO: 111435 - protein, 10 aa, Homo Sapiens
EEVGDFIQRY

SEQ ID NO: 111436 - protein, 10 aa, Homo Sapiens
EEVHDLERKY

SEQ ID NO: 111437 - protein, 10 aa, Homo Sapiens
EEVLAVFKSY

SEQ ID NO: 111438 - protein, 10 aa, Homo Sapiens
EEVLIHGVSY

SEQ ID NO: 111439 - protein, 10 aa, Homo Sapiens
EEVLIKNGEI

SEQ ID NO: 111440 - protein, 10 aa, Homo Sapiens
EEVLIPDQKY

SEQ ID NO: 111441 - protein, 10 aa, Homo Sapiens
EEVSPNLVRY

SEQ ID NO: 111442 - protein, 10 aa, Homo Sapiens
EEVSPQLFTF

SEQ ID NO: 111443 - protein, 10 aa, Homo Sapiens
EEVTELLARY

SEQ ID NO: 111444 - protein, 10 aa, Homo Sapiens
EEVVSVLHVF

SEQ ID NO: 111445 - protein, 10 aa, Homo Sapiens
EEWEAEFQRY

SEQ ID NO: 111446 - protein, 10 aa, Homo Sapiens
EEWGKLIYQW

SEQ ID NO: 111447 - protein, 10 aa, Homo Sapiens
EEYEREGITW

SEQ ID NO: 111448 - protein, 10 aa, Homo Sapiens
EEYFGFIEQY

SEQ ID NO: 111449 - protein, 10 aa, Homo Sapiens
FEIEELNRKY

SEQ ID NO: 111450 - protein, 10 aa, Homo Sapiens
FEIVLNDYKW

SEQ ID NO: 111451 - protein, 10 aa, Homo Sapiens
FEVESLFQKY

SEQ ID NO: 111452 - protein, 10 aa, Homo Sapiens
FEYDGKINAW

SEQ ID NO: 111453 - protein, 10 aa, Homo Sapiens
GEIDQQYSRF

SEQ ID NO: 111454 - protein, 10 aa, Homo Sapiens
GEIEGLNDTF

SEQ ID NO: 111455 - protein, 10 aa, Homo Sapiens
GELKIADFGW

SEQ ID NO: 111456 - protein, 10 aa, Homo Sapiens
GEVLIDTHLF

SEQ ID NO: 111457 - protein, 10 aa, Homo Sapiens
GEWIRQNGGW

SEQ ID NO: 111458 - protein, 10 aa, Homo Sapiens
GEWTPTLQHY

SEQ ID NO: 111459 - protein, 10 aa, Homo Sapiens
HEGPVWQVAW

SEQ ID NO: 111460 - protein, 10 aa, Homo Sapiens
HEILIGYLEY

SEQ ID NO: 111461 - protein, 10 aa, Homo Sapiens
HEILLHPRYF

SEQ ID NO: 111462 - protein, 10 aa, Homo Sapiens
HEINGLLVGF

SEQ ID NO: 111463 - protein, 10 aa, Homo Sapiens
HEIYTVGKRF

SEQ ID NO: 111464 - protein, 10 aa, Homo Sapiens
HELGNVFLKF

SEQ ID NO: 111465 - protein, 10 aa, Homo Sapiens
HEQEAILHNF

SEQ ID NO: 111466 - protein, 10 aa, Homo Sapiens
HESPALILLF

SEQ ID NO: 111467 - protein, 10 aa, Homo Sapiens
HEVILKNITW

SEQ ID NO: 111468 - protein, 10 aa, Homo Sapiens
IEFPGGKETW

SEQ ID NO: 111469 - protein, 10 aa, Homo Sapiens
IEIAGVKLLY

SEQ ID NO: 111470 - protein, 10 aa, Homo Sapiens
IELEETIKVW

SEQ ID NO: 111471 - protein, 10 aa, Homo Sapiens
KEFEDGIINW

SEQ ID NO: 111472 - protein, 10 aa, Homo Sapiens
KEFTGIDNLW

SEQ ID NO: 111473 - protein, 10 aa, Homo Sapiens
KEGDLPPLWW

SEQ ID NO: 111474 - protein, 10 aa, Homo Sapiens
KEIKDILIQY

SEQ ID NO: 111475 - protein, 10 aa, Homo Sapiens
KEINTQILFW

SEQ ID NO: 111476 - protein, 10 aa, Homo Sapiens
KELFEGVQKW

SEQ ID NO: 111477 - protein, 10 aa, Homo Sapiens
KELWAVLNGW

SEQ ID NO: 111478 - protein, 10 aa, Homo Sapiens
KENSDVIALW

SEQ ID NO: 111479 - protein, 10 aa, Homo Sapiens
LEAHETFNEW

SEQ ID NO: 111480 - protein, 10 aa, Homo Sapiens
LEELYTKKLW

SEQ ID NO: 111481 - protein, 10 aa, Homo Sapiens
LEEPTVIKKY

SEQ ID NO: 111482 - protein, 10 aa, Homo Sapiens
LEHPVLHVSW

SEQ ID NO: 111483 - protein, 10 aa, Homo Sapiens
LEIEAENHYW

SEQ ID NO: 111484 - protein, 10 aa, Homo Sapiens
LEINDVTRAW

SEQ ID NO: 111485 - protein, 10 aa, Homo Sapiens
LENDKTIKLW

SEQ ID NO: 111486 - protein, 10 aa, Homo Sapiens
LEPEELYQTF

SEQ ID NO: 111487 - protein, 10 aa, Homo Sapiens
LESFIDTQKF

SEQ ID NO: 111488 - protein, 10 aa, Homo Sapiens
LPDTQTARVW

SEQ ID NO: 111489 - protein, 10 aa, Homo Sapiens
MEDHLEILEW

SEQ ID NO: 111490 - protein, 10 aa, Homo Sapiens
MEFLFNKTGW

SEQ ID NO: 111491 - protein, 10 aa, Homo Sapiens
MEIDIPHVWL

SEQ ID NO: 111492 - protein, 10 aa, Homo Sapiens
MEIQEAFLRF

SEQ ID NO: 111493 - protein, 10 aa, Homo Sapiens
MEITEELRQY

SEQ ID NO: 111494 - protein, 10 aa, Homo Sapiens
MELPHGGEGW

SEQ ID NO: 111495 - protein, 10 aa, Homo Sapiens
MEQPIKVTEW

SEQ ID NO: 111496 - protein, 10 aa, Homo Sapiens
MEVDPIGHLY

SEQ ID NO: 111497 - protein, 10 aa, Homo Sapiens
MEVEVDGQKF

SEQ ID NO: 111498 - protein, 10 aa, Homo Sapiens
MEWQPEEQAW

SEQ ID NO: 111499 - protein, 10 aa, Homo Sapiens
NEDEPIRVSY

SEQ ID NO: 111500 - protein, 10 aa, Homo Sapiens
NEDNGIIKAF

SEQ ID NO: 111501 - protein, 10 aa, Homo Sapiens
NEDPQLKSLW

SEQ ID NO: 111502 - protein, 10 aa, Homo Sapiens
NEFGLTSLRW

SEQ ID NO: 111503 - protein, 10 aa, Homo Sapiens
NEIEDTFRQF

SEQ ID NO: 111504 - protein, 10 aa, Homo Sapiens
NELDLKLVSF

SEQ ID NO: 111505 - protein, 10 aa, Homo Sapiens
NELENFTKQF

SEQ ID NO: 111506 - protein, 10 aa, Homo Sapiens
NEPILYGRSY

SEQ ID NO: 111507 - protein, 10 aa, Homo Sapiens
NEVSVIKEGW

SEQ ID NO: 111508 - protein, 10 aa, Homo Sapiens
NEVVAGIKEY

SEQ ID NO: 111509 - protein, 10 aa, Homo Sapiens
NEVYEAVKNY

SEQ ID NO: 111510 - protein, 10 aa, Homo Sapiens
QEAIQDLWQW

SEQ ID NO: 111511 - protein, 10 aa, Homo Sapiens
QEALNLFKSI

SEQ ID NO: 111512 - protein, 10 aa, Homo Sapiens
QEARNIYQEF

SEQ ID NO: 111513 - protein, 10 aa, Homo Sapiens
QEDFGIFQAW

SEQ ID NO: 111514 - protein, 10 aa, Homo Sapiens
QEDPEAFLLY

SEQ ID NO: 111515 - protein, 10 aa, Homo Sapiens
QEFDSGLLHW

SEQ ID NO: 111516 - protein, 10 aa, Homo Sapiens
QEHIDLGIKY

SEQ ID NO: 111517 - protein, 10 aa, Homo Sapiens
QEIDILRTLY

SEQ ID NO: 111518 - protein, 10 aa, Homo Sapiens
QEIDLTGVKL

SEQ ID NO: 111519 - protein, 10 aa, Homo Sapiens
QEIRSLFEQY

SEQ ID NO: 111520 - protein, 10 aa, Homo Sapiens
QELADLFVNY

SEQ ID NO: 111521 - protein, 10 aa, Homo Sapiens
QELASLLRTY

SEQ ID NO: 111522 - protein, 10 aa, Homo Sapiens
QELELRSLGY

SEQ ID NO: 111523 - protein, 10 aa, Homo Sapiens
QELLTIAERW

SEQ ID NO: 111524 - protein, 10 aa, Homo Sapiens
QELLTVSERW

SEQ ID NO: 111525 - protein, 10 aa, Homo Sapiens
QELQEINRVY

SEQ ID NO: 111526 - protein, 10 aa, Homo Sapiens
QELQTISPLF

SEQ ID NO: 111527 - protein, 10 aa, Homo Sapiens
QENEHIYNLW

SEQ ID NO: 111528 - protein, 10 aa, Homo Sapiens
QEVLWPLPAY

SEQ ID NO: 111529 - protein, 10 aa, Homo Sapiens
QEYLDTLYRY

SEQ ID NO: 111530 - protein, 10 aa, Homo Sapiens
QEYPDLIHIY

SEQ ID NO: 111531 - protein, 10 aa, Homo Sapiens
RDMPIQAFLL

SEQ ID NO: 111532 - protein, 10 aa, Homo Sapiens
REHDIAIKFF

SEQ ID NO: 111533 - protein, 10 aa, Homo Sapiens
RELPEPLLTF

SEQ ID NO: 111534 - protein, 10 aa, Homo Sapiens
RELPEPLMTF

SEQ ID NO: 111535 - protein, 10 aa, Homo Sapiens
RENYDIIKTY

SEQ ID NO: 111536 - protein, 10 aa, Homo Sapiens
REVSVPTFSW

SEQ ID NO: 111537 - protein, 10 aa, Homo Sapiens
SEALALTQTW

SEQ ID NO: 111538 - protein, 10 aa, Homo Sapiens
SEAYIDARTL

SEQ ID NO: 111539 - protein, 10 aa, Homo Sapiens
SEEENVVLKF

SEQ ID NO: 111540 - protein, 10 aa, Homo Sapiens
SEEGPDVLRW

SEQ ID NO: 111541 - protein, 10 aa, Homo Sapiens
SEEPLGRQLW

SEQ ID NO: 111542 - protein, 10 aa, Homo Sapiens
SEFIDSQRVW

SEQ ID NO: 111543 - protein, 10 aa, Homo Sapiens
SEFKEFSQSF

SEQ ID NO: 111544 - protein, 10 aa, Homo Sapiens
SEFNFSSKTY

SEQ ID NO: 111545 - protein, 10 aa, Homo Sapiens
SEFVIPSVYW

SEQ ID NO: 111546 - protein, 10 aa, Homo Sapiens
SEGELVELRW

SEQ ID NO: 111547 - protein, 10 aa, Homo Sapiens
SEGSFLLTTF

SEQ ID NO: 111548 - protein, 10 aa, Homo Sapiens
SEIDQINKVF

SEQ ID NO: 111549 - protein, 10 aa, Homo Sapiens
SEIDQLFRIF

SEQ ID NO: 111550 - protein, 10 aa, Homo Sapiens
SEIGGITIAW

SEQ ID NO: 111551 - protein, 10 aa, Homo Sapiens
SEIYIHGLGL

SEQ ID NO: 111552 - protein, 10 aa, Homo Sapiens
SELDKLLSSF

SEQ ID NO: 111553 - protein, 10 aa, Homo Sapiens
SELDNVTFSF

SEQ ID NO: 111554 - protein, 10 aa, Homo Sapiens
SELKDFFQSY

SEQ ID NO: 111555 - protein, 10 aa, Homo Sapiens
SELLGLLKTY

SEQ ID NO: 111556 - protein, 10 aa, Homo Sapiens
SELNPNAEVW

SEQ ID NO: 111557 - protein, 10 aa, Homo Sapiens
SELTAEKLGF

SEQ ID NO: 111558 - protein, 10 aa, Homo Sapiens
SENITQKVVW

SEQ ID NO: 111559 - protein, 10 aa, Homo Sapiens
SEPDFVAKFY

SEQ ID NO: 111560 - protein, 10 aa, Homo Sapiens
SEPDNLVITW

SEQ ID NO: 111561 - protein, 10 aa, Homo Sapiens
SEPFHLIVSY

SEQ ID NO: 111562 - protein, 10 aa, Homo Sapiens
SEPVGIYQGF

SEQ ID NO: 111563 - protein, 10 aa, Homo Sapiens
SEQPFLLVTY

SEQ ID NO: 111564 - protein, 10 aa, Homo Sapiens
SESTNQRVLW

SEQ ID NO: 111565 - protein, 10 aa, Homo Sapiens
SEVEKPLMNF

SEQ ID NO: 111566 - protein, 10 aa, Homo Sapiens
SEVILPVPAF

SEQ ID NO: 111567 - protein, 10 aa, Homo Sapiens
SEVVTVFQYY

SEQ ID NO: 111568 - protein, 10 aa, Homo Sapiens
TEAPVLNIQF

SEQ ID NO: 111569 - protein, 10 aa, Homo Sapiens
TEEFNREMFW

SEQ ID NO: 111570 - protein, 10 aa, Homo Sapiens
TEILLRKLPF

SEQ ID NO: 111571 - protein, 10 aa, Homo Sapiens
TEITDDLHFY

SEQ ID NO: 111572 - protein, 10 aa, Homo Sapiens
TELELKWQHW

SEQ ID NO: 111573 - protein, 10 aa, Homo Sapiens
TENDHVLLFW

SEQ ID NO: 111574 - protein, 10 aa, Homo Sapiens
TEVKVEPMTY

SEQ ID NO: 111575 - protein, 10 aa, Homo Sapiens
TEVSLLRVGW

SEQ ID NO: 111576 - protein, 10 aa, Homo Sapiens
VEVPEGPRTW

SEQ ID NO: 111577 - protein, 10 aa, Homo Sapiens
YEFDFSKVYW

SEQ ID NO: 111578 - protein, 10 aa, Homo Sapiens
YEILATHPTW

SEQ ID NO: 111579 - protein, 10 aa, Homo Sapiens
YEVEIDGKTY

SEQ ID NO: 111580 - protein, 11 aa, Homo Sapiens
AEAFEAIPRAL

SEQ ID NO: 111581 - protein, 11 aa, Homo Sapiens
AEALGIVPLQY

SEQ ID NO: 111582 - protein, 11 aa, Homo Sapiens
AEALLSDLHAF

SEQ ID NO: 111583 - protein, 11 aa, Homo Sapiens
AEALPRPNWEL

SEQ ID NO: 111584 - protein, 11 aa, Homo Sapiens
AEAQLRFIQAW

SEQ ID NO: 111585 - protein, 11 aa, Homo Sapiens
AEASALYGRAL

SEQ ID NO: 111586 - protein, 11 aa, Homo Sapiens
AEDLNSRVSYW

SEQ ID NO: 111587 - protein, 11 aa, Homo Sapiens
AEDLNTRVAYW

SEQ ID NO: 111588 - protein, 11 aa, Homo Sapiens
AEDPACIPIFW

SEQ ID NO: 111589 - protein, 11 aa, Homo Sapiens
AEDPNLNQPVW

SEQ ID NO: 111590 - protein, 11 aa, Homo Sapiens
AEFEVPKLVQY

SEQ ID NO: 111591 - protein, 11 aa, Homo Sapiens
AEFLQKLLPGY

SEQ ID NO: 111592 - protein, 11 aa, Homo Sapiens
AEGDTGLPRVW

SEQ ID NO: 111593 - protein, 11 aa, Homo Sapiens
AEGIHTGQFVY

SEQ ID NO: 111594 - protein, 11 aa, Homo Sapiens
AEHIAQGLRLY

SEQ ID NO: 111595 - protein, 11 aa, Homo Sapiens
AEIAAQRTINW

SEQ ID NO: 111596 - protein, 11 aa, Homo Sapiens
AEIDLQELQGY

SEQ ID NO: 111597 - protein, 11 aa, Homo Sapiens
AEINENNVREF

SEQ ID NO: 111598 - protein, 11 aa, Homo Sapiens
AEIQDGRFNLF

SEQ ID NO: 111599 - protein, 11 aa, Homo Sapiens
AEIQNVEGQNL

SEQ ID NO: 111600 - protein, 11 aa, Homo Sapiens
AELDPHILAVF

SEQ ID NO: 111601 - protein, 11 aa, Homo Sapiens
AELDPSIAVGF

SEQ ID NO: 111602 - protein, 11 aa, Homo Sapiens
AELEDDFKEGY

SEQ ID NO: 111603 - protein, 11 aa, Homo Sapiens
AELLNSKLPRW

SEQ ID NO: 111604 - protein, 11 aa, Homo Sapiens
AELLQKVITLY

SEQ ID NO: 111605 - protein, 11 aa, Homo Sapiens
AELPAKILVEF

SEQ ID NO: 111606 - protein, 11 aa, Homo Sapiens
AEMLESVIKNY

SEQ ID NO: 111607 - protein, 11 aa, Homo Sapiens
AENIPENPLKY

SEQ ID NO: 111608 - protein, 11 aa, Homo Sapiens
AEPLPSNILEW

SEQ ID NO: 111609 - protein, 11 aa, Homo Sapiens
AEQELANLEKW

SEQ ID NO: 111610 - protein, 11 aa, Homo Sapiens
AEQMFQGIILF

SEQ ID NO: 111611 - protein, 11 aa, Homo Sapiens
AERIMEAIELY

SEQ ID NO: 111612 - protein, 11 aa, Homo Sapiens
AEVALATGQFL

SEQ ID NO: 111613 - protein, 11 aa, Homo Sapiens
AEVFPLKVFGY

SEQ ID NO: 111614 - protein, 11 aa, Homo Sapiens
AEWAIENPAVF

SEQ ID NO: 111615 - protein, 11 aa, Homo Sapiens
AEWKDGLNEAW

SEQ ID NO: 111616 - protein, 11 aa, Homo Sapiens
AEYIQKNVQLY

SEQ ID NO: 111617 - protein, 11 aa, Homo Sapiens
AEYPFSSEQKW

SEQ ID NO: 111618 - protein, 11 aa, Homo Sapiens
DEIDAIATKRF

SEQ ID NO: 111619 - protein, 11 aa, Homo Sapiens
DEIDAIGGARF

SEQ ID NO: 111620 - protein, 11 aa, Homo Sapiens
DELEIIEGMKF

SEQ ID NO: 111621 - protein, 11 aa, Homo Sapiens
DEMTGYVATRW

SEQ ID NO: 111622 - protein, 11 aa, Homo Sapiens
DGVTPLIGEVW

SEQ ID NO: 111623 - protein, 11 aa, Homo Sapiens
EEAALEQAVKF

SEQ ID NO: 111624 - protein, 11 aa, Homo Sapiens
EEADQLRALGW

SEQ ID NO: 111625 - protein, 11 aa, Homo Sapiens
EEAIIEPVIKW

SEQ ID NO: 111626 - protein, 11 aa, Homo Sapiens
EEALQTIFNRW

SEQ ID NO: 111627 - protein, 11 aa, Homo Sapiens
EEAQFETKKLY

SEQ ID NO: 111628 - protein, 11 aa, Homo Sapiens
EEASFDGTFLW

SEQ ID NO: 111629 - protein, 11 aa, Homo Sapiens
EEDQAAELRAY

SEQ ID NO: 111630 - protein, 11 aa, Homo Sapiens
EEFDARWVTYF

SEQ ID NO: 111631 - protein, 11 aa, Homo Sapiens
EEFKDVLLTAW

SEQ ID NO: 111632 - protein, 11 aa, Homo Sapiens
EEFSRAAEKLY

SEQ ID NO: 111633 - protein, 11 aa, Homo Sapiens
EEIAIIPSKKL

SEQ ID NO: 111634 - protein, 11 aa, Homo Sapiens
EEIDENFKALF

SEQ ID NO: 111635 - protein, 11 aa, Homo Sapiens
EEIDTSRLFEW

SEQ ID NO: 111636 - protein, 11 aa, Homo Sapiens
EEINKIIRDLW

SEQ ID NO: 111637 - protein, 11 aa, Homo Sapiens
EEIPNLENSNF

SEQ ID NO: 111638 - protein, 11 aa, Homo Sapiens
EEIYAPKLQEF

SEQ ID NO: 111639 - protein, 11 aa, Homo Sapiens
EEIYPPEVAEF

SEQ ID NO: 111640 - protein, 11 aa, Homo Sapiens
EEIYPPKLHQF

SEQ ID NO: 111641 - protein, 11 aa, Homo Sapiens
EELDPESREYW

SEQ ID NO: 111642 - protein, 11 aa, Homo Sapiens
EELDSLIKATI

SEQ ID NO: 111643 - protein, 11 aa, Homo Sapiens
EELTLEGIKQF

SEQ ID NO: 111644 - protein, 11 aa, Homo Sapiens
EELTLEGIRQF

SEQ ID NO: 111645 - protein, 11 aa, Homo Sapiens
EELTVQVARVY

SEQ ID NO: 111646 - protein, 11 aa, Homo Sapiens
EEMPLNVADLI

SEQ ID NO: 111647 - protein, 11 aa, Homo Sapiens
EENDLGLFGYW

SEQ ID NO: 111648 - protein, 11 aa, Homo Sapiens
EEPPYAIKAGW

SEQ ID NO: 111649 - protein, 11 aa, Homo Sapiens
EEQRIKDMDLW

SEQ ID NO: 111650 - protein, 11 aa, Homo Sapiens
EESDIKWASRW

SEQ ID NO: 111651 - protein, 11 aa, Homo Sapiens
EETHTNEFITW

SEQ ID NO: 111652 - protein, 11 aa, Homo Sapiens
EETPLTAAQLF

SEQ ID NO: 111653 - protein, 11 aa, Homo Sapiens
EEVDLSKDIQH

SEQ ID NO: 111654 - protein, 11 aa, Homo Sapiens
EEVFETIIHSY

SEQ ID NO: 111655 - protein, 11 aa, Homo Sapiens
EEVPTQESVKW

SEQ ID NO: 111656 - protein, 11 aa, Homo Sapiens
EEVSIEVLKTY

SEQ ID NO: 111657 - protein, 11 aa, Homo Sapiens
EEWNDPPAVKW

SEQ ID NO: 111658 - protein, 11 aa, Homo Sapiens
EEYPDRIMNTF

SEQ ID NO: 111659 - protein, 11 aa, Homo Sapiens
EEYYPNCEVVF

SEQ ID NO: 111660 - protein, 11 aa, Homo Sapiens
FEADSTVIEKW

SEQ ID NO: 111661 - protein, 11 aa, Homo Sapiens
GEHLPVGGFTY

SEQ ID NO: 111662 - protein, 11 aa, Homo Sapiens
GEIDLAKLKKF

SEQ ID NO: 111663 - protein, 11 aa, Homo Sapiens
GEWASGGVRSF

SEQ ID NO: 111664 - protein, 11 aa, Homo Sapiens
HEERFLKNIGW

SEQ ID NO: 111665 - protein, 11 aa, Homo Sapiens
IEFQPPEAKKF

SEQ ID NO: 111666 - protein, 11 aa, Homo Sapiens
IEISELPVRTW

SEQ ID NO: 111667 - protein, 11 aa, Homo Sapiens
IEVFDPDANTW

SEQ ID NO: 111668 - protein, 11 aa, Homo Sapiens
IGGTDTLEGGW

SEQ ID NO: 111669 - protein, 11 aa, Homo Sapiens
KEFSAENVTFW

SEQ ID NO: 111670 - protein, 11 aa, Homo Sapiens
KEFSEENVLFW

SEQ ID NO: 111671 - protein, 11 aa, Homo Sapiens
KEMDLSVETLF

SEQ ID NO: 111672 - protein, 11 aa, Homo Sapiens
LEHVPNSVRLW

SEQ ID NO: 111673 - protein, 11 aa, Homo Sapiens
LEISAEDAERW

SEQ ID NO: 111674 - protein, 11 aa, Homo Sapiens
MEIDIPHVWLY

SEQ ID NO: 111675 - protein, 11 aa, Homo Sapiens
MEITEELRQYF

SEQ ID NO: 111676 - protein, 11 aa, Homo Sapiens
MELSAVGERVF

SEQ ID NO: 111677 - protein, 11 aa, Homo Sapiens
NEFIDASRLVY

SEQ ID NO: 111678 - protein, 11 aa, Homo Sapiens
NEIQEALSRSY

SEQ ID NO: 111679 - protein, 11 aa, Homo Sapiens
NEISERVVQHF

SEQ ID NO: 111680 - protein, 11 aa, Homo Sapiens
NELGVGGTSQW

SEQ ID NO: 111681 - protein, 11 aa, Homo Sapiens
NEVDPGDWQKF

SEQ ID NO: 111682 - protein, 11 aa, Homo Sapiens
PPSKQILALKQ

SEQ ID NO: 111683 - protein, 11 aa, Homo Sapiens
QEAASLLGKKY

SEQ ID NO: 111684 - protein, 11 aa, Homo Sapiens
QEALNLFKSIW

SEQ ID NO: 111685 - protein, 11 aa, Homo Sapiens
QEAPESATVIF

SEQ ID NO: 111686 - protein, 11 aa, Homo Sapiens
QEFEEKSGRTF

SEQ ID NO: 111687 - protein, 11 aa, Homo Sapiens
QEFEESLRLKF

SEQ ID NO: 111688 - protein, 11 aa, Homo Sapiens
QEGLIPGSQFW

SEQ ID NO: 111689 - protein, 11 aa, Homo Sapiens
QEHTQGFIITF

SEQ ID NO: 111690 - protein, 11 aa, Homo Sapiens
QEIGVLDQREY

SEQ ID NO: 111691 - protein, 11 aa, Homo Sapiens
QELKLIGEYGL

SEQ ID NO: 111692 - protein, 11 aa, Homo Sapiens
QELPGLSHQYW

SEQ ID NO: 111693 - protein, 11 aa, Homo Sapiens
QENHFVEGLLY

SEQ ID NO: 111694 - protein, 11 aa, Homo Sapiens
QESLPPVQFDW

SEQ ID NO: 111695 - protein, 11 aa, Homo Sapiens
QEVDASIFKAW

SEQ ID NO: 111696 - protein, 11 aa, Homo Sapiens
QEVNFQEYVTF

SEQ ID NO: 111697 - protein, 11 aa, Homo Sapiens
QEVQITEARCF

SEQ ID NO: 111698 - protein, 11 aa, Homo Sapiens
QEVTHSVRIGF

SEQ ID NO: 111699 - protein, 11 aa, Homo Sapiens
QEWNLTNIKRW

SEQ ID NO: 111700 - protein, 11 aa, Homo Sapiens
REEDAALFKAW

SEQ ID NO: 111701 - protein, 11 aa, Homo Sapiens
REFSPEEGLYY

SEQ ID NO: 111702 - protein, 11 aa, Homo Sapiens
REIFLSQPILL

SEQ ID NO: 111703 - protein, 11 aa, Homo Sapiens
RELQPSEEVTW

SEQ ID NO: 111704 - protein, 11 aa, Homo Sapiens
RENTQTTIKLF

SEQ ID NO: 111705 - protein, 11 aa, Homo Sapiens
SEALPGDNVGF

SEQ ID NO: 111706 - protein, 11 aa, Homo Sapiens
SEDGTVRLWSL

SEQ ID NO: 111707 - protein, 11 aa, Homo Sapiens
SEFDSISKNTW

SEQ ID NO: 111708 - protein, 11 aa, Homo Sapiens
SEFSEENIEFW

SEQ ID NO: 111709 - protein, 11 aa, Homo Sapiens
SEIRSISVNQW

SEQ ID NO: 111710 - protein, 11 aa, Homo Sapiens
SELDLTYGNRY

SEQ ID NO: 111711 - protein, 11 aa, Homo Sapiens
SELFMSSFQSY

SEQ ID NO: 111712 - protein, 11 aa, Homo Sapiens
SELIAKIPNFW

SEQ ID NO: 111713 - protein, 11 aa, Homo Sapiens
SELPGNPNAVW

SEQ ID NO: 111714 - protein, 11 aa, Homo Sapiens
SELRLDSVVQW

SEQ ID NO: 111715 - protein, 11 aa, Homo Sapiens
SELVPIATQTY

SEQ ID NO: 111716 - protein, 11 aa, Homo Sapiens
SESQDQVFLRW

SEQ ID NO: 111717 - protein, 11 aa, Homo Sapiens
SESTNQRVLWW

SEQ ID NO: 111718 - protein, 11 aa, Homo Sapiens
SETSVPDHVVW

SEQ ID NO: 111719 - protein, 11 aa, Homo Sapiens
SEVDLTRSFSF

SEQ ID NO: 111720 - protein, 11 aa, Homo Sapiens
SEVESILNQSF

SEQ ID NO: 111721 - protein, 11 aa, Homo Sapiens
SEVPDSVYQHL

SEQ ID NO: 111722 - protein, 11 aa, Homo Sapiens
SEVPGSIPNSW

SEQ ID NO: 111723 - protein, 11 aa, Homo Sapiens
TEADYYHTELW

SEQ ID NO: 111724 - protein, 11 aa, Homo Sapiens
TEALHFVAAAW

SEQ ID NO: 111725 - protein, 11 aa, Homo Sapiens
TEHDLLGTEAW

SEQ ID NO: 111726 - protein, 11 aa, Homo Sapiens
TEHPENFNLMF

SEQ ID NO: 111727 - protein, 11 aa, Homo Sapiens
TEHQQLEGWRW

SEQ ID NO: 111728 - protein, 11 aa, Homo Sapiens
TEHYDIPKVSW

SEQ ID NO: 111729 - protein, 11 aa, Homo Sapiens
TEIDGRSISLY

SEQ ID NO: 111730 - protein, 11 aa, Homo Sapiens
TELGRPDAEYW

SEQ ID NO: 111731 - protein, 11 aa, Homo Sapiens
TEMLPSILNQL

SEQ ID NO: 111732 - protein, 11 aa, Homo Sapiens
TEQSQIKGYVW

SEQ ID NO: 111733 - protein, 11 aa, Homo Sapiens
TETPLEGDFAW

SEQ ID NO: 111734 - protein, 11 aa, Homo Sapiens
TEYGLTFTEKW

SEQ ID NO: 111735 - protein, 11 aa, Homo Sapiens
VEAPSFLNGVW

SEQ ID NO: 111736 - protein, 11 aa, Homo Sapiens
VEATHVLPLHW

SEQ ID NO: 111737 - protein, 11 aa, Homo Sapiens
VEFSEPTIILF

SEQ ID NO: 111738 - protein, 11 aa, Homo Sapiens
VEGDPIVALSW

SEQ ID NO: 111739 - protein, 11 aa, Homo Sapiens
VEIQFPAEHGW

SEQ ID NO: 111740 - protein, 11 aa, Homo Sapiens
VEITELPVRTW

SEQ ID NO: 111741 - protein, 11 aa, Homo Sapiens
VELMDHGIVSW

SEQ ID NO: 111742 - protein, 11 aa, Homo Sapiens
VELPIEANLVW

SEQ ID NO: 111743 - protein, 11 aa, Homo Sapiens
VEMYDPTRNEW

SEQ ID NO: 111744 - protein, 11 aa, Homo Sapiens
VEVAEESGRLW

SEQ ID NO: 111745 - protein, 11 aa, Homo Sapiens
VEVSPATERQW

SEQ ID NO: 111746 - protein, 11 aa, Homo Sapiens
WEVDVQGSKAY

SEQ ID NO: 111747 - protein, 11 aa, Homo Sapiens
WEVDVTGKEAW

SEQ ID NO: 111748 - protein, 11 aa, Homo Sapiens
WEVEVGDRTSW

SEQ ID NO: 111749 - protein, 11 aa, Homo Sapiens
YEFDEQGHSTW

SEQ ID NO: 111750 - protein, 8 aa, Homo Sapiens
AEDLSHVA

SEQ ID NO: 111751 - protein, 8 aa, Homo Sapiens
AEFIVAKA

SEQ ID NO: 111752 - protein, 8 aa, Homo Sapiens
AEGKGFIA

SEQ ID NO: 111753 - protein, 8 aa, Homo Sapiens
AEGLSHTP

SEQ ID NO: 111754 - protein, 8 aa, Homo Sapiens
AEHKIFPA

SEQ ID NO: 111755 - protein, 8 aa, Homo Sapiens
AENVFFVA

SEQ ID NO: 111756 - protein, 8 aa, Homo Sapiens
AESLQPVA

SEQ ID NO: 111757 - protein, 8 aa, Homo Sapiens
AEYLQPKA

SEQ ID NO: 111758 - protein, 8 aa, Homo Sapiens
CEFIVHSA

SEQ ID NO: 111759 - protein, 8 aa, Homo Sapiens
CEKEFVSA

SEQ ID NO: 111760 - protein, 8 aa, Homo Sapiens
EALIKHKP

SEQ ID NO: 111761 - protein, 8 aa, Homo Sapiens
EEFPSFGA

SEQ ID NO: 111762 - protein, 8 aa, Homo Sapiens
EEKVFRAV

SEQ ID NO: 111763 - protein, 8 aa, Homo Sapiens
EELPHIHA

SEQ ID NO: 111764 - protein, 8 aa, Homo Sapiens
EEMKGIAA

SEQ ID NO: 111765 - protein, 8 aa, Homo Sapiens
EENFAVEA

SEQ ID NO: 111766 - protein, 8 aa, Homo Sapiens
EEQASRQI

SEQ ID NO: 111767 - protein, 8 aa, Homo Sapiens
EEVEGHVA

SEQ ID NO: 111768 - protein, 8 aa, Homo Sapiens
EEVVSREV

SEQ ID NO: 111769 - protein, 8 aa, Homo Sapiens
EEYKATVA

SEQ ID NO: 111770 - protein, 8 aa, Homo Sapiens
EHENLRTP

SEQ ID NO: 111771 - protein, 8 aa, Homo Sapiens
EHNFVAKA

SEQ ID NO: 111772 - protein, 8 aa, Homo Sapiens
EKEMEGVA

SEQ ID NO: 111773 - protein, 8 aa, Homo Sapiens
HEMVVYEA

SEQ ID NO: 111774 - protein, 8 aa, Homo Sapiens
KSQLQEAP

SEQ ID NO: 111775 - protein, 8 aa, Homo Sapiens
NEYPSRVA

SEQ ID NO: 111776 - protein, 8 aa, Homo Sapiens
QEKIFIAA

SEQ ID NO: 111777 - protein, 8 aa, Homo Sapiens
QEVLGHAA

SEQ ID NO: 111778 - protein, 8 aa, Homo Sapiens
QEVYAQVA

SEQ ID NO: 111779 - protein, 8 aa, Homo Sapiens
SEHKVWSP

SEQ ID NO: 111780 - protein, 8 aa, Homo Sapiens
SEIRVYSA

SEQ ID NO: 111781 - protein, 8 aa, Homo Sapiens
SEQRFPVA

SEQ ID NO: 111782 - protein, 8 aa, Homo Sapiens
SETKIFTA

SEQ ID NO: 111783 - protein, 8 aa, Homo Sapiens
SETKVFTA

SEQ ID NO: 111784 - protein, 8 aa, Homo Sapiens
VSLTACKV

SEQ ID NO: 111785 - protein, 8 aa, Homo Sapiens
VVESTGVF

SEQ ID NO: 111786 - protein, 9 aa, Homo Sapiens
AEAAFGLGA

SEQ ID NO: 111787 - protein, 9 aa, Homo Sapiens
AEAARILAA

SEQ ID NO: 111788 - protein, 9 aa, Homo Sapiens
AEAASKWAA

SEQ ID NO: 111789 - protein, 9 aa, Homo Sapiens
AEAAVVLEA

SEQ ID NO: 111790 - protein, 9 aa, Homo Sapiens
AEAEALPWA

SEQ ID NO: 111791 - protein, 9 aa, Homo Sapiens
AEAEALYSA

SEQ ID NO: 111792 - protein, 9 aa, Homo Sapiens
AEAEFYRQV

SEQ ID NO: 111793 - protein, 9 aa, Homo Sapiens
AEAEGLRAA

SEQ ID NO: 111794 - protein, 9 aa, Homo Sapiens
AEAERWGVA

SEQ ID NO: 111795 - protein, 9 aa, Homo Sapiens
AEAFGKIVA

SEQ ID NO: 111796 - protein, 9 aa, Homo Sapiens
AEAFRLPTA

SEQ ID NO: 111797 - protein, 9 aa, Homo Sapiens
AEAFVSQIA

SEQ ID NO: 111798 - protein, 9 aa, Homo Sapiens
AEAGDAVVA

SEQ ID NO: 111799 - protein, 9 aa, Homo Sapiens
AEAGFIHCP

SEQ ID NO: 111800 - protein, 9 aa, Homo Sapiens
AEAGGMHTV

SEQ ID NO: 111801 - protein, 9 aa, Homo Sapiens
AEAGPLASV

SEQ ID NO: 111802 - protein, 9 aa, Homo Sapiens
AEAHPELQA

SEQ ID NO: 111803 - protein, 9 aa, Homo Sapiens
AEAIGADSA

SEQ ID NO: 111804 - protein, 9 aa, Homo Sapiens
AEAIHSPQV

SEQ ID NO: 111805 - protein, 9 aa, Homo Sapiens
AEAIIRSGA

SEQ ID NO: 111806 - protein, 9 aa, Homo Sapiens
AEAIKAWTA

SEQ ID NO: 111807 - protein, 9 aa, Homo Sapiens
AEAIPEPVV

SEQ ID NO: 111808 - protein, 9 aa, Homo Sapiens
AEAIPGLAA

SEQ ID NO: 111809 - protein, 9 aa, Homo Sapiens
AEAIRILAA

SEQ ID NO: 111810 - protein, 9 aa, Homo Sapiens
AEAKENPLP

SEQ ID NO: 111811 - protein, 9 aa, Homo Sapiens
AEAKFFTES

SEQ ID NO: 111812 - protein, 9 aa, Homo Sapiens
AEALAAFTA

SEQ ID NO: 111813 - protein, 9 aa, Homo Sapiens
AEALGSTEA

SEQ ID NO: 111814 - protein, 9 aa, Homo Sapiens
AEALIKHKP

SEQ ID NO: 111815 - protein, 9 aa, Homo Sapiens
AEALPSLAA

SEQ ID NO: 111816 - protein, 9 aa, Homo Sapiens
AEALREVSA

SEQ ID NO: 111817 - protein, 9 aa, Homo Sapiens
AEALSQAVA

SEQ ID NO: 111818 - protein, 9 aa, Homo Sapiens
AEANHFIDL

SEQ ID NO: 111819 - protein, 9 aa, Homo Sapiens
AEAPASPAP

SEQ ID NO: 111820 - protein, 9 aa, Homo Sapiens
AEAPDAPEA

SEQ ID NO: 111821 - protein, 9 aa, Homo Sapiens
AEAPHIVVG

SEQ ID NO: 111822 - protein, 9 aa, Homo Sapiens
AEAPHLVQV

SEQ ID NO: 111823 - protein, 9 aa, Homo Sapiens
AEAPKFPTP

SEQ ID NO: 111824 - protein, 9 aa, Homo Sapiens
AEAPNMAVV

SEQ ID NO: 111825 - protein, 9 aa, Homo Sapiens
AEAPPAYTP

SEQ ID NO: 111826 - protein, 9 aa, Homo Sapiens
AEAPPGVET

SEQ ID NO: 111827 - protein, 9 aa, Homo Sapiens
AEAPPPKIP

SEQ ID NO: 111828 - protein, 9 aa, Homo Sapiens
AEAPPPSVV

SEQ ID NO: 111829 - protein, 9 aa, Homo Sapiens
AEAPPSVAP

SEQ ID NO: 111830 - protein, 9 aa, Homo Sapiens
AEAPTALVP

SEQ ID NO: 111831 - protein, 9 aa, Homo Sapiens
AEAQHLYQS

SEQ ID NO: 111832 - protein, 9 aa, Homo Sapiens
AEAQKLGKP

SEQ ID NO: 111833 - protein, 9 aa, Homo Sapiens
AEAQLHTTA

SEQ ID NO: 111834 - protein, 9 aa, Homo Sapiens
AEAQLWWAA

SEQ ID NO: 111835 - protein, 9 aa, Homo Sapiens
AEAQPMAVV

SEQ ID NO: 111836 - protein, 9 aa, Homo Sapiens
AEAQRWVEA

SEQ ID NO: 111837 - protein, 9 aa, Homo Sapiens
AEAQVTPKP

SEQ ID NO: 111838 - protein, 9 aa, Homo Sapiens
AEARPFEVL

SEQ ID NO: 111839 - protein, 9 aa, Homo Sapiens
AEATGAYVP

SEQ ID NO: 111840 - protein, 9 aa, Homo Sapiens
AEAVAHFEA

SEQ ID NO: 111841 - protein, 9 aa, Homo Sapiens
AEAVFASEV

SEQ ID NO: 111842 - protein, 9 aa, Homo Sapiens
AEAVLKHIA

SEQ ID NO: 111843 - protein, 9 aa, Homo Sapiens
AEAVLYEHL

SEQ ID NO: 111844 - protein, 9 aa, Homo Sapiens
AEAVNFCTA

SEQ ID NO: 111845 - protein, 9 aa, Homo Sapiens
AEAVNVAIA

SEQ ID NO: 111846 - protein, 9 aa, Homo Sapiens
AECGAFRTG

SEQ ID NO: 111847 - protein, 9 aa, Homo Sapiens
AECPNPSTP

SEQ ID NO: 111848 - protein, 9 aa, Homo Sapiens
AECTLKESA

SEQ ID NO: 111849 - protein, 9 aa, Homo Sapiens
AEDDLNTVA

SEQ ID NO: 111850 - protein, 9 aa, Homo Sapiens
AEDEGTQRL

SEQ ID NO: 111851 - protein, 9 aa, Homo Sapiens
AEDEPPAPP

SEQ ID NO: 111852 - protein, 9 aa, Homo Sapiens
AEDEWKAQV

SEQ ID NO: 111853 - protein, 9 aa, Homo Sapiens
AEDFTIFKA

SEQ ID NO: 111854 - protein, 9 aa, Homo Sapiens
AEDGEFTSA

SEQ ID NO: 111855 - protein, 9 aa, Homo Sapiens
AEDGFFVPP

SEQ ID NO: 111856 - protein, 9 aa, Homo Sapiens
AEDKKTALP

SEQ ID NO: 111857 - protein, 9 aa, Homo Sapiens
AEDLNLLIA

SEQ ID NO: 111858 - protein, 9 aa, Homo Sapiens
AEDLNTRVA

SEQ ID NO: 111859 - protein, 9 aa, Homo Sapiens
AEDPETQVV

SEQ ID NO: 111860 - protein, 9 aa, Homo Sapiens
AEDPGPAVA

SEQ ID NO: 111861 - protein, 9 aa, Homo Sapiens
AEDPVSEVP

SEQ ID NO: 111862 - protein, 9 aa, Homo Sapiens
AEEADVHVA

SEQ ID NO: 111863 - protein, 9 aa, Homo Sapiens
AEEAGFPEV

SEQ ID NO: 111864 - protein, 9 aa, Homo Sapiens
AEEAKSAIA

SEQ ID NO: 111865 - protein, 9 aa, Homo Sapiens
AEEAPKMVP

SEQ ID NO: 111866 - protein, 9 aa, Homo Sapiens
AEEAPYDAI

SEQ ID NO: 111867 - protein, 9 aa, Homo Sapiens
AEEARQMAA

SEQ ID NO: 111868 - protein, 9 aa, Homo Sapiens
AEEAYNAVV

SEQ ID NO: 111869 - protein, 9 aa, Homo Sapiens
AEECFFERV

SEQ ID NO: 111870 - protein, 9 aa, Homo Sapiens
AEEDAALQA

SEQ ID NO: 111871 - protein, 9 aa, Homo Sapiens
AEEDAWLRA

SEQ ID NO: 111872 - protein, 9 aa, Homo Sapiens
AEEDFYEKL

SEQ ID NO: 111873 - protein, 9 aa, Homo Sapiens
AEEDPPWAP

SEQ ID NO: 111874 - protein, 9 aa, Homo Sapiens
AEEEKMALP

SEQ ID NO: 111875 - protein, 9 aa, Homo Sapiens
AEEENFKKP

SEQ ID NO: 111876 - protein, 9 aa, Homo Sapiens
AEEEPNRIP

SEQ ID NO: 111877 - protein, 9 aa, Homo Sapiens
AEEEQKIAA

SEQ ID NO: 111878 - protein, 9 aa, Homo Sapiens
AEEERLKAA

SEQ ID NO: 111879 - protein, 9 aa, Homo Sapiens
AEEERMIAV

SEQ ID NO: 111880 - protein, 9 aa, Homo Sapiens
AEEERRIAA

SEQ ID NO: 111881 - protein, 9 aa, Homo Sapiens
AEEERYFRA

SEQ ID NO: 111882 - protein, 9 aa, Homo Sapiens
AEEESRVLA

SEQ ID NO: 111883 - protein, 9 aa, Homo Sapiens
AEEEYGMKA

SEQ ID NO: 111884 - protein, 9 aa, Homo Sapiens
AEEFKVPAA

SEQ ID NO: 111885 - protein, 9 aa, Homo Sapiens
AEEFVIVKA

SEQ ID NO: 111886 - protein, 9 aa, Homo Sapiens
AEEGFTQVT

SEQ ID NO: 111887 - protein, 9 aa, Homo Sapiens
AEEGGFAVV

SEQ ID NO: 111888 - protein, 9 aa, Homo Sapiens
AEEGPPLGA

SEQ ID NO: 111889 - protein, 9 aa, Homo Sapiens
AEEHLTVDA

SEQ ID NO: 111890 - protein, 9 aa, Homo Sapiens
AEEIANYRP

SEQ ID NO: 111891 - protein, 9 aa, Homo Sapiens
AEEKAVLIA

SEQ ID NO: 111892 - protein, 9 aa, Homo Sapiens
AEEKDWKTA

SEQ ID NO: 111893 - protein, 9 aa, Homo Sapiens
AEEKFTIEP

SEQ ID NO: 111894 - protein, 9 aa, Homo Sapiens
AEEKPAPQM

SEQ ID NO: 111895 - protein, 9 aa, Homo Sapiens
AEEKSKPIP

SEQ ID NO: 111896 - protein, 9 aa, Homo Sapiens
AEELALEQA

SEQ ID NO: 111897 - protein, 9 aa, Homo Sapiens
AEELEPRAP

SEQ ID NO: 111898 - protein, 9 aa, Homo Sapiens
AEELPGSHA

SEQ ID NO: 111899 - protein, 9 aa, Homo Sapiens
AEELPHIHA

SEQ ID NO: 111900 - protein, 9 aa, Homo Sapiens
AEELRAQTA

SEQ ID NO: 111901 - protein, 9 aa, Homo Sapiens
AEENGAIAA

SEQ ID NO: 111902 - protein, 9 aa, Homo Sapiens
AEEPAAAAA

SEQ ID NO: 111903 - protein, 9 aa, Homo Sapiens
AEEPASVTP

SEQ ID NO: 111904 - protein, 9 aa, Homo Sapiens
AEEPDLHGP

SEQ ID NO: 111905 - protein, 9 aa, Homo Sapiens
AEEPKPVEA

SEQ ID NO: 111906 - protein, 9 aa, Homo Sapiens
AEEPNAAVP

SEQ ID NO: 111907 - protein, 9 aa, Homo Sapiens
AEEPPAHAP

SEQ ID NO: 111908 - protein, 9 aa, Homo Sapiens
AEEPWGEEA

SEQ ID NO: 111909 - protein, 9 aa, Homo Sapiens
AEEQLRLVV

SEQ ID NO: 111910 - protein, 9 aa, Homo Sapiens
AEESTAIIA

SEQ ID NO: 111911 - protein, 9 aa, Homo Sapiens
AEEVCIHIA

SEQ ID NO: 111912 - protein, 9 aa, Homo Sapiens
AEEVWARVA

SEQ ID NO: 111913 - protein, 9 aa, Homo Sapiens
AEEYGARVV

SEQ ID NO: 111914 - protein, 9 aa, Homo Sapiens
AEFAERSVA

SEQ ID NO: 111915 - protein, 9 aa, Homo Sapiens
AEFGQAESA

SEQ ID NO: 111916 - protein, 9 aa, Homo Sapiens
AEFLQKLLP

SEQ ID NO: 111917 - protein, 9 aa, Homo Sapiens
AEFPGLPEA

SEQ ID NO: 111918 - protein, 9 aa, Homo Sapiens
AEFQVKITA

SEQ ID NO: 111919 - protein, 9 aa, Homo Sapiens
AEGAFPNLA

SEQ ID NO: 111920 - protein, 9 aa, Homo Sapiens
AEGAYQVAA

SEQ ID NO: 111921 - protein, 9 aa, Homo Sapiens
AEGDISNVA

SEQ ID NO: 111922 - protein, 9 aa, Homo Sapiens
AEGIHNFAP

SEQ ID NO: 111923 - protein, 9 aa, Homo Sapiens
AEGIKVTDA

SEQ ID NO: 111924 - protein, 9 aa, Homo Sapiens
AEGKPGVEA

SEQ ID NO: 111925 - protein, 9 aa, Homo Sapiens
AEGKPPEAP

SEQ ID NO: 111926 - protein, 9 aa, Homo Sapiens
AEGKYMAEA

SEQ ID NO: 111927 - protein, 9 aa, Homo Sapiens
AEGLMKVEA

SEQ ID NO: 111928 - protein, 9 aa, Homo Sapiens
AEGPAVSLP

SEQ ID NO: 111929 - protein, 9 aa, Homo Sapiens
AEGPEVICA

SEQ ID NO: 111930 - protein, 9 aa, Homo Sapiens
AEGPPAMLP

SEQ ID NO: 111931 - protein, 9 aa, Homo Sapiens
AEGPPTNPP

SEQ ID NO: 111932 - protein, 9 aa, Homo Sapiens
AEGPVAVVV

SEQ ID NO: 111933 - protein, 9 aa, Homo Sapiens
AEGQRWLSA

SEQ ID NO: 111934 - protein, 9 aa, Homo Sapiens
AEGVPVRGA

SEQ ID NO: 111935 - protein, 9 aa, Homo Sapiens
AEGVRVLGP

SEQ ID NO: 111936 - protein, 9 aa, Homo Sapiens
AEHENLRTP

SEQ ID NO: 111937 - protein, 9 aa, Homo Sapiens
AEHFSIIRA

SEQ ID NO: 111938 - protein, 9 aa, Homo Sapiens
AEHFSMIRA

SEQ ID NO: 111939 - protein, 9 aa, Homo Sapiens
AEHGIFLPP

SEQ ID NO: 111940 - protein, 9 aa, Homo Sapiens
AEHGSFRVT

SEQ ID NO: 111941 - protein, 9 aa, Homo Sapiens
AEHGSVALP

SEQ ID NO: 111942 - protein, 9 aa, Homo Sapiens
AEHKEFITA

SEQ ID NO: 111943 - protein, 9 aa, Homo Sapiens
AEHKYPTLP

SEQ ID NO: 111944 - protein, 9 aa, Homo Sapiens
AEHLMLLEA

SEQ ID NO: 111945 - protein, 9 aa, Homo Sapiens
AEHMLMRVP

SEQ ID NO: 111946 - protein, 9 aa, Homo Sapiens
AEHNAALQA

SEQ ID NO: 111947 - protein, 9 aa, Homo Sapiens
AEHNFVAKA

SEQ ID NO: 111948 - protein, 9 aa, Homo Sapiens
AEHPGFMKT

SEQ ID NO: 111949 - protein, 9 aa, Homo Sapiens
AEHPTIAKS

SEQ ID NO: 111950 - protein, 9 aa, Homo Sapiens
AEHPVYNMV

SEQ ID NO: 111951 - protein, 9 aa, Homo Sapiens
AEHQSFLQA

SEQ ID NO: 111952 - protein, 9 aa, Homo Sapiens
AEHRIDFVA

SEQ ID NO: 111953 - protein, 9 aa, Homo Sapiens
AEHRMLVVA

SEQ ID NO: 111954 - protein, 9 aa, Homo Sapiens
AEHSELKSP

SEQ ID NO: 111955 - protein, 9 aa, Homo Sapiens
AEHSLLDLP

SEQ ID NO: 111956 - protein, 9 aa, Homo Sapiens
AEHSPYYEA

SEQ ID NO: 111957 - protein, 9 aa, Homo Sapiens
AEHVVQPKA

SEQ ID NO: 111958 - protein, 9 aa, Homo Sapiens
AEHYDILCA

SEQ ID NO: 111959 - protein, 9 aa, Homo Sapiens
AEHYLPIFA

SEQ ID NO: 111960 - protein, 9 aa, Homo Sapiens
AEIAESVQA

SEQ ID NO: 111961 - protein, 9 aa, Homo Sapiens
AEIAHLYIA

SEQ ID NO: 111962 - protein, 9 aa, Homo Sapiens
AEIAHNVSS

SEQ ID NO: 111963 - protein, 9 aa, Homo Sapiens
AEIAKLKAA

SEQ ID NO: 111964 - protein, 9 aa, Homo Sapiens
AEIDAHLVA

SEQ ID NO: 111965 - protein, 9 aa, Homo Sapiens
AEIDEEPVS

SEQ ID NO: 111966 - protein, 9 aa, Homo Sapiens
AEIDITNVA

SEQ ID NO: 111967 - protein, 9 aa, Homo Sapiens
AEIDRRISA

SEQ ID NO: 111968 - protein, 9 aa, Homo Sapiens
AEIEDPPIP

SEQ ID NO: 111969 - protein, 9 aa, Homo Sapiens
AEIEDVKPA

SEQ ID NO: 111970 - protein, 9 aa, Homo Sapiens
AEIEKFDKS

SEQ ID NO: 111971 - protein, 9 aa, Homo Sapiens
AEIEPEAQA

SEQ ID NO: 111972 - protein, 9 aa, Homo Sapiens
AEIESIVKP

SEQ ID NO: 111973 - protein, 9 aa, Homo Sapiens
AEIFHSADA

SEQ ID NO: 111974 - protein, 9 aa, Homo Sapiens
AEIGEHVAP

SEQ ID NO: 111975 - protein, 9 aa, Homo Sapiens
AEIIFNPSA

SEQ ID NO: 111976 - protein, 9 aa, Homo Sapiens
AEIKIIREA

SEQ ID NO: 111977 - protein, 9 aa, Homo Sapiens
AEIKKCVTA

SEQ ID NO: 111978 - protein, 9 aa, Homo Sapiens
AEINATMSV

SEQ ID NO: 111979 - protein, 9 aa, Homo Sapiens
AEINGTMNA

SEQ ID NO: 111980 - protein, 9 aa, Homo Sapiens
AEINNIIKI

SEQ ID NO: 111981 - protein, 9 aa, Homo Sapiens
AEIPEGYVP

SEQ ID NO: 111982 - protein, 9 aa, Homo Sapiens
AEIPETSNA

SEQ ID NO: 111983 - protein, 9 aa, Homo Sapiens
AEIPQIFDA

SEQ ID NO: 111984 - protein, 9 aa, Homo Sapiens
AEIQETITA

SEQ ID NO: 111985 - protein, 9 aa, Homo Sapiens
AEIRAINEA

SEQ ID NO: 111986 - protein, 9 aa, Homo Sapiens
AEKAEFYQI

SEQ ID NO: 111987 - protein, 9 aa, Homo Sapiens
AEKAGTFGP

SEQ ID NO: 111988 - protein, 9 aa, Homo Sapiens
AEKAMTALA

SEQ ID NO: 111989 - protein, 9 aa, Homo Sapiens
AEKAYHEQL

SEQ ID NO: 111990 - protein, 9 aa, Homo Sapiens
AEKCFGTGA

SEQ ID NO: 111991 - protein, 9 aa, Homo Sapiens
AEKDFWELA

SEQ ID NO: 111992 - protein, 9 aa, Homo Sapiens
AEKDGVKVP

SEQ ID NO: 111993 - protein, 9 aa, Homo Sapiens
AEKEPVPVP

SEQ ID NO: 111994 - protein, 9 aa, Homo Sapiens
AEKFRNPKA

SEQ ID NO: 111995 - protein, 9 aa, Homo Sapiens
AEKFWYDMA

SEQ ID NO: 111996 - protein, 9 aa, Homo Sapiens
AEKGNFEAA

SEQ ID NO: 111997 - protein, 9 aa, Homo Sapiens
AEKKFIDIA

SEQ ID NO: 111998 - protein, 9 aa, Homo Sapiens
AEKLGFAGL

SEQ ID NO: 111999 - protein, 9 aa, Homo Sapiens
AEKPLQVAA

SEQ ID NO: 112000 - protein, 9 aa, Homo Sapiens
AEKSDFEAV

SEQ ID NO: 112001 - protein, 9 aa, Homo Sapiens
AEKSRTYVA

SEQ ID NO: 112002 - protein, 9 aa, Homo Sapiens
AEKYEWDVA

SEQ ID NO: 112003 - protein, 9 aa, Homo Sapiens
AEKYIMTSA

SEQ ID NO: 112004 - protein, 9 aa, Homo Sapiens
AEKYQTVIA

SEQ ID NO: 112005 - protein, 9 aa, Homo Sapiens
AELAEIPEG

SEQ ID NO: 112006 - protein, 9 aa, Homo Sapiens
AELATRAIP

SEQ ID NO: 112007 - protein, 9 aa, Homo Sapiens
AELCGRPGP

SEQ ID NO: 112008 - protein, 9 aa, Homo Sapiens
AELDEKISA

SEQ ID NO: 112009 - protein, 9 aa, Homo Sapiens
AELEKAHLA

SEQ ID NO: 112010 - protein, 9 aa, Homo Sapiens
AELEKHMAA

SEQ ID NO: 112011 - protein, 9 aa, Homo Sapiens
AELFEKAAA

SEQ ID NO: 112012 - protein, 9 aa, Homo Sapiens
AELGALHSA

SEQ ID NO: 112013 - protein, 9 aa, Homo Sapiens
AELGHLVVS

SEQ ID NO: 112014 - protein, 9 aa, Homo Sapiens
AELGKLYSV

SEQ ID NO: 112015 - protein, 9 aa, Homo Sapiens
AELGLTRAA

SEQ ID NO: 112016 - protein, 9 aa, Homo Sapiens
AELGMEHQA

SEQ ID NO: 112017 - protein, 9 aa, Homo Sapiens
AELGTEIAA

SEQ ID NO: 112018 - protein, 9 aa, Homo Sapiens
AELLKTLAA

SEQ ID NO: 112019 - protein, 9 aa, Homo Sapiens
AELLVSHGA

SEQ ID NO: 112020 - protein, 9 aa, Homo Sapiens
AELQQHDVA

SEQ ID NO: 112021 - protein, 9 aa, Homo Sapiens
AELQRLVAA

SEQ ID NO: 112022 - protein, 9 aa, Homo Sapiens
AELQSRLAA

SEQ ID NO: 112023 - protein, 9 aa, Homo Sapiens
AELRPDSPA

SEQ ID NO: 112024 - protein, 9 aa, Homo Sapiens
AELSELHSA

SEQ ID NO: 112025 - protein, 9 aa, Homo Sapiens
AELVKTYCS

SEQ ID NO: 112026 - protein, 9 aa, Homo Sapiens
AELWKNPTA

SEQ ID NO: 112027 - protein, 9 aa, Homo Sapiens
AELYFHDSA

SEQ ID NO: 112028 - protein, 9 aa, Homo Sapiens
AELYHIISS

SEQ ID NO: 112029 - protein, 9 aa, Homo Sapiens
AEMAPYMKR

SEQ ID NO: 112030 - protein, 9 aa, Homo Sapiens
AEMAVQQNP

SEQ ID NO: 112031 - protein, 9 aa, Homo Sapiens
AEMEKATEV

SEQ ID NO: 112032 - protein, 9 aa, Homo Sapiens
AEMENIKAI

SEQ ID NO: 112033 - protein, 9 aa, Homo Sapiens
AEMGFCHVT

SEQ ID NO: 112034 - protein, 9 aa, Homo Sapiens
AEMKAQEVA

SEQ ID NO: 112035 - protein, 9 aa, Homo Sapiens
AEMLEIVQA

SEQ ID NO: 112036 - protein, 9 aa, Homo Sapiens
AEMNGKLIA

SEQ ID NO: 112037 - protein, 9 aa, Homo Sapiens
AEMPDMYPP

SEQ ID NO: 112038 - protein, 9 aa, Homo Sapiens
AEMPDSAAA

SEQ ID NO: 112039 - protein, 9 aa, Homo Sapiens
AEMPQNYRP

SEQ ID NO: 112040 - protein, 9 aa, Homo Sapiens
AEMPTQMSP

SEQ ID NO: 112041 - protein, 9 aa, Homo Sapiens
AEMRLFYTT

SEQ ID NO: 112042 - protein, 9 aa, Homo Sapiens
AEMRQKEIP

SEQ ID NO: 112043 - protein, 9 aa, Homo Sapiens
AEMSHIPQS

SEQ ID NO: 112044 - protein, 9 aa, Homo Sapiens
AEMTTRMVA

SEQ ID NO: 112045 - protein, 9 aa, Homo Sapiens
AEMVKPSTP

SEQ ID NO: 112046 - protein, 9 aa, Homo Sapiens
AENALDVAA

SEQ ID NO: 112047 - protein, 9 aa, Homo Sapiens
AENDPFVRP

SEQ ID NO: 112048 - protein, 9 aa, Homo Sapiens
AENDVKLGA

SEQ ID NO: 112049 - protein, 9 aa, Homo Sapiens
AENEQMLKP

SEQ ID NO: 112050 - protein, 9 aa, Homo Sapiens
AENGLLMTP

SEQ ID NO: 112051 - protein, 9 aa, Homo Sapiens
AENIPVHLP

SEQ ID NO: 112052 - protein, 9 aa, Homo Sapiens
AENISSVVA

SEQ ID NO: 112053 - protein, 9 aa, Homo Sapiens
AENLEKVQA

SEQ ID NO: 112054 - protein, 9 aa, Homo Sapiens
AENLLVKEA

SEQ ID NO: 112055 - protein, 9 aa, Homo Sapiens
AENNVFHLV

SEQ ID NO: 112056 - protein, 9 aa, Homo Sapiens
AENPDIFAV

SEQ ID NO: 112057 - protein, 9 aa, Homo Sapiens
AENPFLTHL

SEQ ID NO: 112058 - protein, 9 aa, Homo Sapiens
AENPGKYNI

SEQ ID NO: 112059 - protein, 9 aa, Homo Sapiens
AENPKLISA

SEQ ID NO: 112060 - protein, 9 aa, Homo Sapiens
AENQGFVAA

SEQ ID NO: 112061 - protein, 9 aa, Homo Sapiens
AENQRITAV

SEQ ID NO: 112062 - protein, 9 aa, Homo Sapiens
AENSAVPTA

SEQ ID NO: 112063 - protein, 9 aa, Homo Sapiens
AENTIQNEA

SEQ ID NO: 112064 - protein, 9 aa, Homo Sapiens
AENVAVPEA

SEQ ID NO: 112065 - protein, 9 aa, Homo Sapiens
AENVTFWKA

SEQ ID NO: 112066 - protein, 9 aa, Homo Sapiens
AENYDIPSA

SEQ ID NO: 112067 - protein, 9 aa, Homo Sapiens
AENYLGHTA

SEQ ID NO: 112068 - protein, 9 aa, Homo Sapiens
AEPVASTPA

SEQ ID NO: 112069 - protein, 9 aa, Homo Sapiens
AEQAKVVLA

SEQ ID NO: 112070 - protein, 9 aa, Homo Sapiens
AEQATTVKA

SEQ ID NO: 112071 - protein, 9 aa, Homo Sapiens
AEQAVLAAP

SEQ ID NO: 112072 - protein, 9 aa, Homo Sapiens
AEQDFWRAV

SEQ ID NO: 112073 - protein, 9 aa, Homo Sapiens
AEQEFLANA

SEQ ID NO: 112074 - protein, 9 aa, Homo Sapiens
AEQEYNATV

SEQ ID NO: 112075 - protein, 9 aa, Homo Sapiens
AEQFKLIQA

SEQ ID NO: 112076 - protein, 9 aa, Homo Sapiens
AEQFRLEQI

SEQ ID NO: 112077 - protein, 9 aa, Homo Sapiens
AEQGHLPPP

SEQ ID NO: 112078 - protein, 9 aa, Homo Sapiens
AEQHGVWTA

SEQ ID NO: 112079 - protein, 9 aa, Homo Sapiens
AEQIARWIA

SEQ ID NO: 112080 - protein, 9 aa, Homo Sapiens
AEQIATLCA

SEQ ID NO: 112081 - protein, 9 aa, Homo Sapiens
AEQIKHILA

SEQ ID NO: 112082 - protein, 9 aa, Homo Sapiens
AEQILQHMV

SEQ ID NO: 112083 - protein, 9 aa, Homo Sapiens
AEQINKMEA

SEQ ID NO: 112084 - protein, 9 aa, Homo Sapiens
AEQIQPEEA

SEQ ID NO: 112085 - protein, 9 aa, Homo Sapiens
AEQIVPLSA

SEQ ID NO: 112086 - protein, 9 aa, Homo Sapiens
AEQKDEMVP

SEQ ID NO: 112087 - protein, 9 aa, Homo Sapiens
AEQKLRIQA

SEQ ID NO: 112088 - protein, 9 aa, Homo Sapiens
AEQLAKWIA

SEQ ID NO: 112089 - protein, 9 aa, Homo Sapiens
AEQLPYLKC

SEQ ID NO: 112090 - protein, 9 aa, Homo Sapiens
AEQLQEIIA

SEQ ID NO: 112091 - protein, 9 aa, Homo Sapiens
AEQLRVLQA

SEQ ID NO: 112092 - protein, 9 aa, Homo Sapiens
AEQLSHSVA

SEQ ID NO: 112093 - protein, 9 aa, Homo Sapiens
AEQLSLVQA

SEQ ID NO: 112094 - protein, 9 aa, Homo Sapiens
AEQLVKEGA

SEQ ID NO: 112095 - protein, 9 aa, Homo Sapiens
AEQMRLAQV

SEQ ID NO: 112096 - protein, 9 aa, Homo Sapiens
AEQPPHLTP

SEQ ID NO: 112097 - protein, 9 aa, Homo Sapiens
AEQPPRPCP

SEQ ID NO: 112098 - protein, 9 aa, Homo Sapiens
AEQPYFIEA

SEQ ID NO: 112099 - protein, 9 aa, Homo Sapiens
AEQRFLAGA

SEQ ID NO: 112100 - protein, 9 aa, Homo Sapiens
AEQRPGVAP

SEQ ID NO: 112101 - protein, 9 aa, Homo Sapiens
AEQSEIIQA

SEQ ID NO: 112102 - protein, 9 aa, Homo Sapiens
AEQSKVLSA

SEQ ID NO: 112103 - protein, 9 aa, Homo Sapiens
AEQTLSQLP

SEQ ID NO: 112104 - protein, 9 aa, Homo Sapiens
AEQTMSHLP

SEQ ID NO: 112105 - protein, 9 aa, Homo Sapiens
AEQTRAVLA

SEQ ID NO: 112106 - protein, 9 aa, Homo Sapiens
AEQVSHHPP

SEQ ID NO: 112107 - protein, 9 aa, Homo Sapiens
AEQVVARVA

SEQ ID NO: 112108 - protein, 9 aa, Homo Sapiens
AEQWKTNEA

SEQ ID NO: 112109 - protein, 9 aa, Homo Sapiens
AEQWRFSSA

SEQ ID NO: 112110 - protein, 9 aa, Homo Sapiens
AERDFIHTA

SEQ ID NO: 112111 - protein, 9 aa, Homo Sapiens
AERDILVEA

SEQ ID NO: 112112 - protein, 9 aa, Homo Sapiens
AERLQTDAA

SEQ ID NO: 112113 - protein, 9 aa, Homo Sapiens
AERMGFTEV

SEQ ID NO: 112114 - protein, 9 aa, Homo Sapiens
AERPYFMSS

SEQ ID NO: 112115 - protein, 9 aa, Homo Sapiens
AERQPCFSA

SEQ ID NO: 112116 - protein, 9 aa, Homo Sapiens
AERYDDMAA

SEQ ID NO: 112117 - protein, 9 aa, Homo Sapiens
AESDHMAIP

SEQ ID NO: 112118 - protein, 9 aa, Homo Sapiens
AESDVRMVA

SEQ ID NO: 112119 - protein, 9 aa, Homo Sapiens
AESETFLTS

SEQ ID NO: 112120 - protein, 9 aa, Homo Sapiens
AESGALIEA

SEQ ID NO: 112121 - protein, 9 aa, Homo Sapiens
AESKASLAA

SEQ ID NO: 112122 - protein, 9 aa, Homo Sapiens
AESKVSVAV

SEQ ID NO: 112123 - protein, 9 aa, Homo Sapiens
AESLGQYAA

SEQ ID NO: 112124 - protein, 9 aa, Homo Sapiens
AESLPGVEA

SEQ ID NO: 112125 - protein, 9 aa, Homo Sapiens
AESLQPVAA

SEQ ID NO: 112126 - protein, 9 aa, Homo Sapiens
AESNKAFLA

SEQ ID NO: 112127 - protein, 9 aa, Homo Sapiens
AESPALVTP

SEQ ID NO: 112128 - protein, 9 aa, Homo Sapiens
AESPGEVQA

SEQ ID NO: 112129 - protein, 9 aa, Homo Sapiens
AESPGFSQA

SEQ ID NO: 112130 - protein, 9 aa, Homo Sapiens
AESPGVPVA

SEQ ID NO: 112131 - protein, 9 aa, Homo Sapiens
AESPSCLVA

SEQ ID NO: 112132 - protein, 9 aa, Homo Sapiens
AESPVNMMP

SEQ ID NO: 112133 - protein, 9 aa, Homo Sapiens
AESRPTPMG

SEQ ID NO: 112134 - protein, 9 aa, Homo Sapiens
AESVVKLTA

SEQ ID NO: 112135 - protein, 9 aa, Homo Sapiens
AETDSVVIA

SEQ ID NO: 112136 - protein, 9 aa, Homo Sapiens
AETEFFSKA

SEQ ID NO: 112137 - protein, 9 aa, Homo Sapiens
AETKDIPAA

SEQ ID NO: 112138 - protein, 9 aa, Homo Sapiens
AETKDLLVA

SEQ ID NO: 112139 - protein, 9 aa, Homo Sapiens
AETLPEVEA

SEQ ID NO: 112140 - protein, 9 aa, Homo Sapiens
AETPGTVSP

SEQ ID NO: 112141 - protein, 9 aa, Homo Sapiens
AETQQPPAA

SEQ ID NO: 112142 - protein, 9 aa, Homo Sapiens
AETSAVCTA

SEQ ID NO: 112143 - protein, 9 aa, Homo Sapiens
AETSHALVP

SEQ ID NO: 112144 - protein, 9 aa, Homo Sapiens
AETSPAPIP

SEQ ID NO: 112145 - protein, 9 aa, Homo Sapiens
AETTTTFSP

SEQ ID NO: 112146 - protein, 9 aa, Homo Sapiens
AETTVNVLV

SEQ ID NO: 112147 - protein, 9 aa, Homo Sapiens
AEVDAAMAA

SEQ ID NO: 112148 - protein, 9 aa, Homo Sapiens
AEVDKLRAA

SEQ ID NO: 112149 - protein, 9 aa, Homo Sapiens
AEVDRQVIP

SEQ ID NO: 112150 - protein, 9 aa, Homo Sapiens
AEVEGRLPA

SEQ ID NO: 112151 - protein, 9 aa, Homo Sapiens
AEVEHVVNA

SEQ ID NO: 112152 - protein, 9 aa, Homo Sapiens
AEVEPTPEA

SEQ ID NO: 112153 - protein, 9 aa, Homo Sapiens
AEVETRIEA

SEQ ID NO: 112154 - protein, 9 aa, Homo Sapiens
AEVIQAFSA

SEQ ID NO: 112155 - protein, 9 aa, Homo Sapiens
AEVKGSVSA

SEQ ID NO: 112156 - protein, 9 aa, Homo Sapiens
AEVKQELAA

SEQ ID NO: 112157 - protein, 9 aa, Homo Sapiens
AEVRVIAPP

SEQ ID NO: 112158 - protein, 9 aa, Homo Sapiens
AEVVDEIAA

SEQ ID NO: 112159 - protein, 9 aa, Homo Sapiens
AEYAGLKVA

SEQ ID NO: 112160 - protein, 9 aa, Homo Sapiens
AEYGEIKNI

SEQ ID NO: 112161 - protein, 9 aa, Homo Sapiens
AEYGGWYKA

SEQ ID NO: 112162 - protein, 9 aa, Homo Sapiens
AEYGHFVDI

SEQ ID NO: 112163 - protein, 9 aa, Homo Sapiens
AEYINEAAA

SEQ ID NO: 112164 - protein, 9 aa, Homo Sapiens
AEYLQPKAA

SEQ ID NO: 112165 - protein, 9 aa, Homo Sapiens
AEYNGRLAA

SEQ ID NO: 112166 - protein, 9 aa, Homo Sapiens
AEYQAFREA

SEQ ID NO: 112167 - protein, 9 aa, Homo Sapiens
AEYYRQQAA

SEQ ID NO: 112168 - protein, 9 aa, Homo Sapiens
APESLAPPA

SEQ ID NO: 112169 - protein, 9 aa, Homo Sapiens
CEAPGAFIA

SEQ ID NO: 112170 - protein, 9 aa, Homo Sapiens
CEDDKVMAA

SEQ ID NO: 112171 - protein, 9 aa, Homo Sapiens
CEGLIVRSA

SEQ ID NO: 112172 - protein, 9 aa, Homo Sapiens
CEGPKAVAA

SEQ ID NO: 112173 - protein, 9 aa, Homo Sapiens
CEHHSLYGA

SEQ ID NO: 112174 - protein, 9 aa, Homo Sapiens
CEHPNQVSP

SEQ ID NO: 112175 - protein, 9 aa, Homo Sapiens
CEIEKVVVA

SEQ ID NO: 112176 - protein, 9 aa, Homo Sapiens
CEIQSVPLA

SEQ ID NO: 112177 - protein, 9 aa, Homo Sapiens
CEKGNFNVA

SEQ ID NO: 112178 - protein, 9 aa, Homo Sapiens
CEKIHFIAP

SEQ ID NO: 112179 - protein, 9 aa, Homo Sapiens
CENSMILSA

SEQ ID NO: 112180 - protein, 9 aa, Homo Sapiens
CEQGPHQVP

SEQ ID NO: 112181 - protein, 9 aa, Homo Sapiens
CEQIGLKEA

SEQ ID NO: 112182 - protein, 9 aa, Homo Sapiens
CEQLSTVIP

SEQ ID NO: 112183 - protein, 9 aa, Homo Sapiens
CEQLVKEVA

SEQ ID NO: 112184 - protein, 9 aa, Homo Sapiens
CESPTFTVA

SEQ ID NO: 112185 - protein, 9 aa, Homo Sapiens
DAAPPSAPP

SEQ ID NO: 112186 - protein, 9 aa, Homo Sapiens
DEQNHLVVA

SEQ ID NO: 112187 - protein, 9 aa, Homo Sapiens
EAQPPPPPP

SEQ ID NO: 112188 - protein, 9 aa, Homo Sapiens
EAVDKGFPP

SEQ ID NO: 112189 - protein, 9 aa, Homo Sapiens
EDRVVVIRF

SEQ ID NO: 112190 - protein, 9 aa, Homo Sapiens
EEAAAVPAA

SEQ ID NO: 112191 - protein, 9 aa, Homo Sapiens
EEAASAPAV

SEQ ID NO: 112192 - protein, 9 aa, Homo Sapiens
EEAATRIPA

SEQ ID NO: 112193 - protein, 9 aa, Homo Sapiens
EEAAVAIKA

SEQ ID NO: 112194 - protein, 9 aa, Homo Sapiens
EEADAAMAA

SEQ ID NO: 112195 - protein, 9 aa, Homo Sapiens
EEAEILHSA

SEQ ID NO: 112196 - protein, 9 aa, Homo Sapiens
EEAKRWMEA

SEQ ID NO: 112197 - protein, 9 aa, Homo Sapiens
EEALPVTTA

SEQ ID NO: 112198 - protein, 9 aa, Homo Sapiens
EEALVDHVA

SEQ ID NO: 112199 - protein, 9 aa, Homo Sapiens
EEANKAFSA

SEQ ID NO: 112200 - protein, 9 aa, Homo Sapiens
EEAPAAMTA

SEQ ID NO: 112201 - protein, 9 aa, Homo Sapiens
EEAPALDAA

SEQ ID NO: 112202 - protein, 9 aa, Homo Sapiens
EEAPAQAKP

SEQ ID NO: 112203 - protein, 9 aa, Homo Sapiens
EEAPGEPSA

SEQ ID NO: 112204 - protein, 9 aa, Homo Sapiens
EEAPPGLSP

SEQ ID NO: 112205 - protein, 9 aa, Homo Sapiens
EEAPQTPVA

SEQ ID NO: 112206 - protein, 9 aa, Homo Sapiens
EEAQHFIKA

SEQ ID NO: 112207 - protein, 9 aa, Homo Sapiens
EEAQPMAAP

SEQ ID NO: 112208 - protein, 9 aa, Homo Sapiens
EEAQPQPQP

SEQ ID NO: 112209 - protein, 9 aa, Homo Sapiens
EEASPLHPA

SEQ ID NO: 112210 - protein, 9 aa, Homo Sapiens
EEAWRGFAA

SEQ ID NO: 112211 - protein, 9 aa, Homo Sapiens
EECLRLLEA

SEQ ID NO: 112212 - protein, 9 aa, Homo Sapiens
EECPMRNTP

SEQ ID NO: 112213 - protein, 9 aa, Homo Sapiens
EECTKLPEA

SEQ ID NO: 112214 - protein, 9 aa, Homo Sapiens
EECVRSIQA

SEQ ID NO: 112215 - protein, 9 aa, Homo Sapiens
EEDAALFKA

SEQ ID NO: 112216 - protein, 9 aa, Homo Sapiens
EEDIRDLAA

SEQ ID NO: 112217 - protein, 9 aa, Homo Sapiens
EEDPVTSIP

SEQ ID NO: 112218 - protein, 9 aa, Homo Sapiens
EEDVLKFLA

SEQ ID NO: 112219 - protein, 9 aa, Homo Sapiens
EEEAATRIP

SEQ ID NO: 112220 - protein, 9 aa, Homo Sapiens
EEEAFGILP

SEQ ID NO: 112221 - protein, 9 aa, Homo Sapiens
EEEAKTVSA

SEQ ID NO: 112222 - protein, 9 aa, Homo Sapiens
EEEDFIRAA

SEQ ID NO: 112223 - protein, 9 aa, Homo Sapiens
EEEEAQPMA

SEQ ID NO: 112224 - protein, 9 aa, Homo Sapiens
EEEEFLKLP

SEQ ID NO: 112225 - protein, 9 aa, Homo Sapiens
EEEEFNTGP

SEQ ID NO: 112226 - protein, 9 aa, Homo Sapiens
EEEEPQPLP

SEQ ID NO: 112227 - protein, 9 aa, Homo Sapiens
EEEEPVKEA

SEQ ID NO: 112228 - protein, 9 aa, Homo Sapiens
EEEEQRAIA

SEQ ID NO: 112229 - protein, 9 aa, Homo Sapiens
EEEETSIKA

SEQ ID NO: 112230 - protein, 9 aa, Homo Sapiens
EEEFFYEKA

SEQ ID NO: 112231 - protein, 9 aa, Homo Sapiens
EEEGITFVP

SEQ ID NO: 112232 - protein, 9 aa, Homo Sapiens
EEEHNFFLA

SEQ ID NO: 112233 - protein, 9 aa, Homo Sapiens
EEEIDAPKP

SEQ ID NO: 112234 - protein, 9 aa, Homo Sapiens
EEEKAVAVP

SEQ ID NO: 112235 - protein, 9 aa, Homo Sapiens
EEEKRMLEA

SEQ ID NO: 112236 - protein, 9 aa, Homo Sapiens
EEEKTTLRA

SEQ ID NO: 112237 - protein, 9 aa, Homo Sapiens
EEEKWVEVA

SEQ ID NO: 112238 - protein, 9 aa, Homo Sapiens
EEELFKMRA

SEQ ID NO: 112239 - protein, 9 aa, Homo Sapiens
EEELGLVGA

SEQ ID NO: 112240 - protein, 9 aa, Homo Sapiens
EEEMKGIAA

SEQ ID NO: 112241 - protein, 9 aa, Homo Sapiens
EEENFYLEP

SEQ ID NO: 112242 - protein, 9 aa, Homo Sapiens
EEEPFALGA

SEQ ID NO: 112243 - protein, 9 aa, Homo Sapiens
EEEPLYVNA

SEQ ID NO: 112244 - protein, 9 aa, Homo Sapiens
EEERAFLVA

SEQ ID NO: 112245 - protein, 9 aa, Homo Sapiens
EEEREFYNA

SEQ ID NO: 112246 - protein, 9 aa, Homo Sapiens
EEERNVPLA

SEQ ID NO: 112247 - protein, 9 aa, Homo Sapiens
EEESKEPVA

SEQ ID NO: 112248 - protein, 9 aa, Homo Sapiens
EEETPLHCA

SEQ ID NO: 112249 - protein, 9 aa, Homo Sapiens
EEETSIKAA

SEQ ID NO: 112250 - protein, 9 aa, Homo Sapiens
EEETVFPKA

SEQ ID NO: 112251 - protein, 9 aa, Homo Sapiens
EEEVMIAHA

SEQ ID NO: 112252 - protein, 9 aa, Homo Sapiens
EEEVQGPPA

SEQ ID NO: 112253 - protein, 9 aa, Homo Sapiens
EEEYPGITA

SEQ ID NO: 112254 - protein, 9 aa, Homo Sapiens
EEFDHLPPP

SEQ ID NO: 112255 - protein, 9 aa, Homo Sapiens
EEFPAFPRA

SEQ ID NO: 112256 - protein, 9 aa, Homo Sapiens
EEFSFIPSA

SEQ ID NO: 112257 - protein, 9 aa, Homo Sapiens
EEFVQMMTA

SEQ ID NO: 112258 - protein, 9 aa, Homo Sapiens
EEGPGKNLP

SEQ ID NO: 112259 - protein, 9 aa, Homo Sapiens
EEGPGVPAA

SEQ ID NO: 112260 - protein, 9 aa, Homo Sapiens
EEGSPTPVL

SEQ ID NO: 112261 - protein, 9 aa, Homo Sapiens
EEHEWFIPA

SEQ ID NO: 112262 - protein, 9 aa, Homo Sapiens
EEHNFFLAP

SEQ ID NO: 112263 - protein, 9 aa, Homo Sapiens
EEHNIVFMP

SEQ ID NO: 112264 - protein, 9 aa, Homo Sapiens
EEIAYKFTP

SEQ ID NO: 112265 - protein, 9 aa, Homo Sapiens
EEIDISKAA

SEQ ID NO: 112266 - protein, 9 aa, Homo Sapiens
EEIEGLISA

SEQ ID NO: 112267 - protein, 9 aa, Homo Sapiens
EEIGKVAAA

SEQ ID NO: 112268 - protein, 9 aa, Homo Sapiens
EEIIDELKA

SEQ ID NO: 112269 - protein, 9 aa, Homo Sapiens
EEIKDFLLT

SEQ ID NO: 112270 - protein, 9 aa, Homo Sapiens
EEILFKERA

SEQ ID NO: 112271 - protein, 9 aa, Homo Sapiens
EEINSTFCP

SEQ ID NO: 112272 - protein, 9 aa, Homo Sapiens
EEIPKIFQI

SEQ ID NO: 112273 - protein, 9 aa, Homo Sapiens
EEIQIKEPA

SEQ ID NO: 112274 - protein, 9 aa, Homo Sapiens
EEIQRLYEA

SEQ ID NO: 112275 - protein, 9 aa, Homo Sapiens
EEIRKTFNI

SEQ ID NO: 112276 - protein, 9 aa, Homo Sapiens
EEISNLKAA

SEQ ID NO: 112277 - protein, 9 aa, Homo Sapiens
EEKERWIRA

SEQ ID NO: 112278 - protein, 9 aa, Homo Sapiens
EEKESWIKA

SEQ ID NO: 112279 - protein, 9 aa, Homo Sapiens
EEKNNWMAA

SEQ ID NO: 112280 - protein, 9 aa, Homo Sapiens
EEKPHQWSA

SEQ ID NO: 112281 - protein, 9 aa, Homo Sapiens
EEKQKWLDA

SEQ ID NO: 112282 - protein, 9 aa, Homo Sapiens
EELDSLIKA

SEQ ID NO: 112283 - protein, 9 aa, Homo Sapiens
EELEHVSAP

SEQ ID NO: 112284 - protein, 9 aa, Homo Sapiens
EELEQTYHA

SEQ ID NO: 112285 - protein, 9 aa, Homo Sapiens
EELGGILKA

SEQ ID NO: 112286 - protein, 9 aa, Homo Sapiens
EELGLVHSP

SEQ ID NO: 112287 - protein, 9 aa, Homo Sapiens
EELIQLVAA

SEQ ID NO: 112288 - protein, 9 aa, Homo Sapiens
EELPDIAPP

SEQ ID NO: 112289 - protein, 9 aa, Homo Sapiens
EELPKSSSA

SEQ ID NO: 112290 - protein, 9 aa, Homo Sapiens
EELQKIYKT

SEQ ID NO: 112291 - protein, 9 aa, Homo Sapiens
EELRDIPQA

SEQ ID NO: 112292 - protein, 9 aa, Homo Sapiens
EELRRVVAA

SEQ ID NO: 112293 - protein, 9 aa, Homo Sapiens
EELSHLEVA

SEQ ID NO: 112294 - protein, 9 aa, Homo Sapiens
EELSNVLAA

SEQ ID NO: 112295 - protein, 9 aa, Homo Sapiens
EEMGVPVAA

SEQ ID NO: 112296 - protein, 9 aa, Homo Sapiens
EEMHQVAIA

SEQ ID NO: 112297 - protein, 9 aa, Homo Sapiens
EEMKGIAAV

SEQ ID NO: 112298 - protein, 9 aa, Homo Sapiens
EEMMELREA

SEQ ID NO: 112299 - protein, 9 aa, Homo Sapiens
EEMPQVHTP

SEQ ID NO: 112300 - protein, 9 aa, Homo Sapiens
EEMPSVARP

SEQ ID NO: 112301 - protein, 9 aa, Homo Sapiens
EEMRHIDMV

SEQ ID NO: 112302 - protein, 9 aa, Homo Sapiens
EENKIKVVA

SEQ ID NO: 112303 - protein, 9 aa, Homo Sapiens
EENKLIYTP

SEQ ID NO: 112304 - protein, 9 aa, Homo Sapiens
EENNIVHQA

SEQ ID NO: 112305 - protein, 9 aa, Homo Sapiens
EENPEFAVA

SEQ ID NO: 112306 - protein, 9 aa, Homo Sapiens
EENPGIFAV

SEQ ID NO: 112307 - protein, 9 aa, Homo Sapiens
EENSHLTSV

SEQ ID NO: 112308 - protein, 9 aa, Homo Sapiens
EENYNVVAP

SEQ ID NO: 112309 - protein, 9 aa, Homo Sapiens
EEQALTKAA

SEQ ID NO: 112310 - protein, 9 aa, Homo Sapiens
EEQDSVKVA

SEQ ID NO: 112311 - protein, 9 aa, Homo Sapiens
EEQIKVWTA

SEQ ID NO: 112312 - protein, 9 aa, Homo Sapiens
EEQKIVVKV

SEQ ID NO: 112313 - protein, 9 aa, Homo Sapiens
EEQPKNYQV

SEQ ID NO: 112314 - protein, 9 aa, Homo Sapiens
EEQPQEAVP

SEQ ID NO: 112315 - protein, 9 aa, Homo Sapiens
EEQPRFQSA

SEQ ID NO: 112316 - protein, 9 aa, Homo Sapiens
EEQPVFRLV

SEQ ID NO: 112317 - protein, 9 aa, Homo Sapiens
EEQQRLLEA

SEQ ID NO: 112318 - protein, 9 aa, Homo Sapiens
EEQQYVIKC

SEQ ID NO: 112319 - protein, 9 aa, Homo Sapiens
EEQRLVQQA

SEQ ID NO: 112320 - protein, 9 aa, Homo Sapiens
EEQRYTCHV

SEQ ID NO: 112321 - protein, 9 aa, Homo Sapiens
EEQSRLIAA

SEQ ID NO: 112322 - protein, 9 aa, Homo Sapiens
EEQTPLHIA

SEQ ID NO: 112323 - protein, 9 aa, Homo Sapiens
EEQVQCPKA

SEQ ID NO: 112324 - protein, 9 aa, Homo Sapiens
EEQVRSLEA

SEQ ID NO: 112325 - protein, 9 aa, Homo Sapiens
EERAKYLAA

SEQ ID NO: 112326 - protein, 9 aa, Homo Sapiens
EERNLLSVA

SEQ ID NO: 112327 - protein, 9 aa, Homo Sapiens
EERPLFPQI

SEQ ID NO: 112328 - protein, 9 aa, Homo Sapiens
EERPPTLSA

SEQ ID NO: 112329 - protein, 9 aa, Homo Sapiens
EERPWLWVV

SEQ ID NO: 112330 - protein, 9 aa, Homo Sapiens
EERQKYLEA

SEQ ID NO: 112331 - protein, 9 aa, Homo Sapiens
EERQPSPEP

SEQ ID NO: 112332 - protein, 9 aa, Homo Sapiens
EERRYLQSA

SEQ ID NO: 112333 - protein, 9 aa, Homo Sapiens
EERVQIVSA

SEQ ID NO: 112334 - protein, 9 aa, Homo Sapiens
EESKTFVSS

SEQ ID NO: 112335 - protein, 9 aa, Homo Sapiens
EESPTATVA

SEQ ID NO: 112336 - protein, 9 aa, Homo Sapiens
EESPVQYAA

SEQ ID NO: 112337 - protein, 9 aa, Homo Sapiens
EESSKIRAP

SEQ ID NO: 112338 - protein, 9 aa, Homo Sapiens
EESVFAVTA

SEQ ID NO: 112339 - protein, 9 aa, Homo Sapiens
EETKYLRVA

SEQ ID NO: 112340 - protein, 9 aa, Homo Sapiens
EETNQKLVA

SEQ ID NO: 112341 - protein, 9 aa, Homo Sapiens
EETPEQPTA

SEQ ID NO: 112342 - protein, 9 aa, Homo Sapiens
EETPITSVP

SEQ ID NO: 112343 - protein, 9 aa, Homo Sapiens
EETPLAVQA

SEQ ID NO: 112344 - protein, 9 aa, Homo Sapiens
EETPNILRI

SEQ ID NO: 112345 - protein, 9 aa, Homo Sapiens
EETRRNFEA

SEQ ID NO: 112346 - protein, 9 aa, Homo Sapiens
EEVKQEITA

SEQ ID NO: 112347 - protein, 9 aa, Homo Sapiens
EEVPGSPEA

SEQ ID NO: 112348 - protein, 9 aa, Homo Sapiens
EEVQSLPLP

SEQ ID NO: 112349 - protein, 9 aa, Homo Sapiens
EEWGQLKAP

SEQ ID NO: 112350 - protein, 9 aa, Homo Sapiens
EEYDKIQIA

SEQ ID NO: 112351 - protein, 9 aa, Homo Sapiens
EEYEWKETA

SEQ ID NO: 112352 - protein, 9 aa, Homo Sapiens
EKSDSLEQP

SEQ ID NO: 112353 - protein, 9 aa, Homo Sapiens
EPSSPPLAP

SEQ ID NO: 112354 - protein, 9 aa, Homo Sapiens
ESLAGILGT

SEQ ID NO: 112355 - protein, 9 aa, Homo Sapiens
FEKEWIECA

SEQ ID NO: 112356 - protein, 9 aa, Homo Sapiens
FENQDIHSA

SEQ ID NO: 112357 - protein, 9 aa, Homo Sapiens
FEQEMATAA

SEQ ID NO: 112358 - protein, 9 aa, Homo Sapiens
FESSGIHVA

SEQ ID NO: 112359 - protein, 9 aa, Homo Sapiens
GEAEVSPTA

SEQ ID NO: 112360 - protein, 9 aa, Homo Sapiens
GEAPAALEA

SEQ ID NO: 112361 - protein, 9 aa, Homo Sapiens
GEARPGPTA

SEQ ID NO: 112362 - protein, 9 aa, Homo Sapiens
GECGHAFSA

SEQ ID NO: 112363 - protein, 9 aa, Homo Sapiens
GEEADFHQA

SEQ ID NO: 112364 - protein, 9 aa, Homo Sapiens
GEEDFSLSA

SEQ ID NO: 112365 - protein, 9 aa, Homo Sapiens
GEEGPQAVA

SEQ ID NO: 112366 - protein, 9 aa, Homo Sapiens
GEFGGFGSV

SEQ ID NO: 112367 - protein, 9 aa, Homo Sapiens
GEHDKMVAA

SEQ ID NO: 112368 - protein, 9 aa, Homo Sapiens
GEHDPWYCP

SEQ ID NO: 112369 - protein, 9 aa, Homo Sapiens
GEIFDHLVA

SEQ ID NO: 112370 - protein, 9 aa, Homo Sapiens
GEIFDQCVA

SEQ ID NO: 112371 - protein, 9 aa, Homo Sapiens
GEKFHSEVA

SEQ ID NO: 112372 - protein, 9 aa, Homo Sapiens
GEKRFADAA

SEQ ID NO: 112373 - protein, 9 aa, Homo Sapiens
GEMAGAFVA

SEQ ID NO: 112374 - protein, 9 aa, Homo Sapiens
GEMWNNTAA

SEQ ID NO: 112375 - protein, 9 aa, Homo Sapiens
GEMWSEQSA

SEQ ID NO: 112376 - protein, 9 aa, Homo Sapiens
GEQEPPPPP

SEQ ID NO: 112377 - protein, 9 aa, Homo Sapiens
GERDFQTSA

SEQ ID NO: 112378 - protein, 9 aa, Homo Sapiens
GETVPAPSA

SEQ ID NO: 112379 - protein, 9 aa, Homo Sapiens
GEVFDYLVA

SEQ ID NO: 112380 - protein, 9 aa, Homo Sapiens
GEYEWVHKP

SEQ ID NO: 112381 - protein, 9 aa, Homo Sapiens
GPELEAPGL

SEQ ID NO: 112382 - protein, 9 aa, Homo Sapiens
HAIYEEITA

SEQ ID NO: 112383 - protein, 9 aa, Homo Sapiens
HECFVSPVA

SEQ ID NO: 112384 - protein, 9 aa, Homo Sapiens
HEEMNYITA

SEQ ID NO: 112385 - protein, 9 aa, Homo Sapiens
HEETGLKPP

SEQ ID NO: 112386 - protein, 9 aa, Homo Sapiens
HEIGHGIAA

SEQ ID NO: 112387 - protein, 9 aa, Homo Sapiens
HELLKTNAA

SEQ ID NO: 112388 - protein, 9 aa, Homo Sapiens
HEMVVYEAA

SEQ ID NO: 112389 - protein, 9 aa, Homo Sapiens
HENESVYKA

SEQ ID NO: 112390 - protein, 9 aa, Homo Sapiens
HEQFIPIAA

SEQ ID NO: 112391 - protein, 9 aa, Homo Sapiens
HEQQFAHPP

SEQ ID NO: 112392 - protein, 9 aa, Homo Sapiens
HEQQKLPAA

SEQ ID NO: 112393 - protein, 9 aa, Homo Sapiens
HESDINAVA

SEQ ID NO: 112394 - protein, 9 aa, Homo Sapiens
HESGHAIIA

SEQ ID NO: 112395 - protein, 9 aa, Homo Sapiens
HEYPWILSA

SEQ ID NO: 112396 - protein, 9 aa, Homo Sapiens
INPEDDTDP

SEQ ID NO: 112397 - protein, 9 aa, Homo Sapiens
KEALGIPAA

SEQ ID NO: 112398 - protein, 9 aa, Homo Sapiens
KEAPAPPKA

SEQ ID NO: 112399 - protein, 9 aa, Homo Sapiens
KEAPAQPAP

SEQ ID NO: 112400 - protein, 9 aa, Homo Sapiens
KEAPPMEKP

SEQ ID NO: 112401 - protein, 9 aa, Homo Sapiens
KEDKPPLAP

SEQ ID NO: 112402 - protein, 9 aa, Homo Sapiens
KEDPFVFIP

SEQ ID NO: 112403 - protein, 9 aa, Homo Sapiens
KEEAKFFTA

SEQ ID NO: 112404 - protein, 9 aa, Homo Sapiens
KEKPGWVTP

SEQ ID NO: 112405 - protein, 9 aa, Homo Sapiens
KELEKTYSA

SEQ ID NO: 112406 - protein, 9 aa, Homo Sapiens
KELIFQETA

SEQ ID NO: 112407 - protein, 9 aa, Homo Sapiens
KEMEKSFEV

SEQ ID NO: 112408 - protein, 9 aa, Homo Sapiens
KEMEVSPSA

SEQ ID NO: 112409 - protein, 9 aa, Homo Sapiens
KEMLETQVA

SEQ ID NO: 112410 - protein, 9 aa, Homo Sapiens
KENAFSLGA

SEQ ID NO: 112411 - protein, 9 aa, Homo Sapiens
KENSHFFVA

SEQ ID NO: 112412 - protein, 9 aa, Homo Sapiens
KEQEPMPTV

SEQ ID NO: 112413 - protein, 9 aa, Homo Sapiens
KEQPPQLSA

SEQ ID NO: 112414 - protein, 9 aa, Homo Sapiens
KEQTFYHVA

SEQ ID NO: 112415 - protein, 9 aa, Homo Sapiens
KESDIYIVA

SEQ ID NO: 112416 - protein, 9 aa, Homo Sapiens
KESGVDIAA

SEQ ID NO: 112417 - protein, 9 aa, Homo Sapiens
KEVDVGLAA

SEQ ID NO: 112418 - protein, 9 aa, Homo Sapiens
KIVKWDRDM

SEQ ID NO: 112419 - protein, 9 aa, Homo Sapiens
LEALPQIAA

SEQ ID NO: 112420 - protein, 9 aa, Homo Sapiens
LEEDNKFCA

SEQ ID NO: 112421 - protein, 9 aa, Homo Sapiens
LEENPDPSA

SEQ ID NO: 112422 - protein, 9 aa, Homo Sapiens
LEHEGLATA

SEQ ID NO: 112423 - protein, 9 aa, Homo Sapiens
LEKLFPDTP

SEQ ID NO: 112424 - protein, 9 aa, Homo Sapiens
LEMKPGPQA

SEQ ID NO: 112425 - protein, 9 aa, Homo Sapiens
LENALKLIP

SEQ ID NO: 112426 - protein, 9 aa, Homo Sapiens
LEQDHFQVA

SEQ ID NO: 112427 - protein, 9 aa, Homo Sapiens
LEQEKAYQA

SEQ ID NO: 112428 - protein, 9 aa, Homo Sapiens
LEQPTDPVA

SEQ ID NO: 112429 - protein, 9 aa, Homo Sapiens
LERDPIPAA

SEQ ID NO: 112430 - protein, 9 aa, Homo Sapiens
LESRPFPAA

SEQ ID NO: 112431 - protein, 9 aa, Homo Sapiens
LETDAGPAA

SEQ ID NO: 112432 - protein, 9 aa, Homo Sapiens
MEALPLLAA

SEQ ID NO: 112433 - protein, 9 aa, Homo Sapiens
MEAPHIIVG

SEQ ID NO: 112434 - protein, 9 aa, Homo Sapiens
MEAQKSAVP

SEQ ID NO: 112435 - protein, 9 aa, Homo Sapiens
MEAVAVAAA

SEQ ID NO: 112436 - protein, 9 aa, Homo Sapiens
MEDAHNCIP

SEQ ID NO: 112437 - protein, 9 aa, Homo Sapiens
MEDAKVYVA

SEQ ID NO: 112438 - protein, 9 aa, Homo Sapiens
MEDANVRVA

SEQ ID NO: 112439 - protein, 9 aa, Homo Sapiens
MEDDKVAEA

SEQ ID NO: 112440 - protein, 9 aa, Homo Sapiens
MEDIKILIA

SEQ ID NO: 112441 - protein, 9 aa, Homo Sapiens
MEDTGSYRA

SEQ ID NO: 112442 - protein, 9 aa, Homo Sapiens
MEEGVSAVA

SEQ ID NO: 112443 - protein, 9 aa, Homo Sapiens
MEEKYIVSA

SEQ ID NO: 112444 - protein, 9 aa, Homo Sapiens
MEELHNQEV

SEQ ID NO: 112445 - protein, 9 aa, Homo Sapiens
MEENFAVEA

SEQ ID NO: 112446 - protein, 9 aa, Homo Sapiens
MEENPGIFA

SEQ ID NO: 112447 - protein, 9 aa, Homo Sapiens
MEEPAVPAP

SEQ ID NO: 112448 - protein, 9 aa, Homo Sapiens
MEERAQLEA

SEQ ID NO: 112449 - protein, 9 aa, Homo Sapiens
MEERYQIAA

SEQ ID NO: 112450 - protein, 9 aa, Homo Sapiens
MEEVGRWVA

SEQ ID NO: 112451 - protein, 9 aa, Homo Sapiens
MEHNRVLEA

SEQ ID NO: 112452 - protein, 9 aa, Homo Sapiens
MEHPGLQAI

SEQ ID NO: 112453 - protein, 9 aa, Homo Sapiens
MEHPYFYTV

SEQ ID NO: 112454 - protein, 9 aa, Homo Sapiens
MEIEGEPAP

SEQ ID NO: 112455 - protein, 9 aa, Homo Sapiens
MEKAFAFQA

SEQ ID NO: 112456 - protein, 9 aa, Homo Sapiens
MELERIVSA

SEQ ID NO: 112457 - protein, 9 aa, Homo Sapiens
MELQRMIAA

SEQ ID NO: 112458 - protein, 9 aa, Homo Sapiens
MEMLVEHQA

SEQ ID NO: 112459 - protein, 9 aa, Homo Sapiens
MEMPSQPAP

SEQ ID NO: 112460 - protein, 9 aa, Homo Sapiens
MEMTFTRPA

SEQ ID NO: 112461 - protein, 9 aa, Homo Sapiens
MEMTNSHLA

SEQ ID NO: 112462 - protein, 9 aa, Homo Sapiens
MENANIPSV

SEQ ID NO: 112463 - protein, 9 aa, Homo Sapiens
MENEMAHYA

SEQ ID NO: 112464 - protein, 9 aa, Homo Sapiens
MENRPSVQA

SEQ ID NO: 112465 - protein, 9 aa, Homo Sapiens
MEQELAHAV

SEQ ID NO: 112466 - protein, 9 aa, Homo Sapiens
MEQGRVTIA

SEQ ID NO: 112467 - protein, 9 aa, Homo Sapiens
MEQPDAVPA

SEQ ID NO: 112468 - protein, 9 aa, Homo Sapiens
MEQQPTRPP

SEQ ID NO: 112469 - protein, 9 aa, Homo Sapiens
MEQQTISIA

SEQ ID NO: 112470 - protein, 9 aa, Homo Sapiens
MEQVFEMKV

SEQ ID NO: 112471 - protein, 9 aa, Homo Sapiens
MESCSVAQA

SEQ ID NO: 112472 - protein, 9 aa, Homo Sapiens
MESDKFICI

SEQ ID NO: 112473 - protein, 9 aa, Homo Sapiens
MESDKHLEA

SEQ ID NO: 112474 - protein, 9 aa, Homo Sapiens
MESNVELIA

SEQ ID NO: 112475 - protein, 9 aa, Homo Sapiens
NAEVWAYLA

SEQ ID NO: 112476 - protein, 9 aa, Homo Sapiens
NEDLRSWTA

SEQ ID NO: 112477 - protein, 9 aa, Homo Sapiens
NEEPKVATA

SEQ ID NO: 112478 - protein, 9 aa, Homo Sapiens
NEEPPALPP

SEQ ID NO: 112479 - protein, 9 aa, Homo Sapiens
NEEQRLASA

SEQ ID NO: 112480 - protein, 9 aa, Homo Sapiens
NEGVATYAA

SEQ ID NO: 112481 - protein, 9 aa, Homo Sapiens
NEGVTNHTP

SEQ ID NO: 112482 - protein, 9 aa, Homo Sapiens
NEIDAEPPA

SEQ ID NO: 112483 - protein, 9 aa, Homo Sapiens
NEIGAIEKA

SEQ ID NO: 112484 - protein, 9 aa, Homo Sapiens
NEIIFPHCA

SEQ ID NO: 112485 - protein, 9 aa, Homo Sapiens
NEIKDSVVA

SEQ ID NO: 112486 - protein, 9 aa, Homo Sapiens
NEKAWFQTP

SEQ ID NO: 112487 - protein, 9 aa, Homo Sapiens
NEKEGFPIT

SEQ ID NO: 112488 - protein, 9 aa, Homo Sapiens
NELPGLPRA

SEQ ID NO: 112489 - protein, 9 aa, Homo Sapiens
NELPLTHET

SEQ ID NO: 112490 - protein, 9 aa, Homo Sapiens
NENETVFAP

SEQ ID NO: 112491 - protein, 9 aa, Homo Sapiens
NENKNIPKA

SEQ ID NO: 112492 - protein, 9 aa, Homo Sapiens
NENYAGIAA

SEQ ID NO: 112493 - protein, 9 aa, Homo Sapiens
NEQAACYAA

SEQ ID NO: 112494 - protein, 9 aa, Homo Sapiens
NEQGNFPPP

SEQ ID NO: 112495 - protein, 9 aa, Homo Sapiens
NEQGSYVVA

SEQ ID NO: 112496 - protein, 9 aa, Homo Sapiens
NEQMHQLVA

SEQ ID NO: 112497 - protein, 9 aa, Homo Sapiens
NERFFGDSA

SEQ ID NO: 112498 - protein, 9 aa, Homo Sapiens
NESPGAPPA

SEQ ID NO: 112499 - protein, 9 aa, Homo Sapiens
NEVADELVA

SEQ ID NO: 112500 - protein, 9 aa, Homo Sapiens
NEVTDYAIA

SEQ ID NO: 112501 - protein, 9 aa, Homo Sapiens
NEVVQVHAA

SEQ ID NO: 112502 - protein, 9 aa, Homo Sapiens
PDLAEKNPP

SEQ ID NO: 112503 - protein, 9 aa, Homo Sapiens
PEAAEGPEV

SEQ ID NO: 112504 - protein, 9 aa, Homo Sapiens
QEAFENHCA

SEQ ID NO: 112505 - protein, 9 aa, Homo Sapiens
QEAFFQCQV

SEQ ID NO: 112506 - protein, 9 aa, Homo Sapiens
QEALREEVA

SEQ ID NO: 112507 - protein, 9 aa, Homo Sapiens
QEALSALTA

SEQ ID NO: 112508 - protein, 9 aa, Homo Sapiens
QEAQKIFKA

SEQ ID NO: 112509 - protein, 9 aa, Homo Sapiens
QEATHFPKV

SEQ ID NO: 112510 - protein, 9 aa, Homo Sapiens
QEAYFRYMA

SEQ ID NO: 112511 - protein, 9 aa, Homo Sapiens
QEDAARLQA

SEQ ID NO: 112512 - protein, 9 aa, Homo Sapiens
QEDPNSIIA

SEQ ID NO: 112513 - protein, 9 aa, Homo Sapiens
QEDRPGLHA

SEQ ID NO: 112514 - protein, 9 aa, Homo Sapiens
QEDSFSAEA

SEQ ID NO: 112515 - protein, 9 aa, Homo Sapiens
QEDSLNWVA

SEQ ID NO: 112516 - protein, 9 aa, Homo Sapiens
QEEAPGPAP

SEQ ID NO: 112517 - protein, 9 aa, Homo Sapiens
QEEDLKAQA

SEQ ID NO: 112518 - protein, 9 aa, Homo Sapiens
QEEDVYHTV

SEQ ID NO: 112519 - protein, 9 aa, Homo Sapiens
QEEFQEHEA

SEQ ID NO: 112520 - protein, 9 aa, Homo Sapiens
QEEFYRVYP

SEQ ID NO: 112521 - protein, 9 aa, Homo Sapiens
QEEGYIIAV

SEQ ID NO: 112522 - protein, 9 aa, Homo Sapiens
QEEKAMYSA

SEQ ID NO: 112523 - protein, 9 aa, Homo Sapiens
QEENFRLEA

SEQ ID NO: 112524 - protein, 9 aa, Homo Sapiens
QEEPDLVSA

SEQ ID NO: 112525 - protein, 9 aa, Homo Sapiens
QEEPEARVP

SEQ ID NO: 112526 - protein, 9 aa, Homo Sapiens
QEEPGQLLP

SEQ ID NO: 112527 - protein, 9 aa, Homo Sapiens
QEEPQSLQA

SEQ ID NO: 112528 - protein, 9 aa, Homo Sapiens
QEETFRLEA

SEQ ID NO: 112529 - protein, 9 aa, Homo Sapiens
QEEVFNTAV

SEQ ID NO: 112530 - protein, 9 aa, Homo Sapiens
QEEWNEHNA

SEQ ID NO: 112531 - protein, 9 aa, Homo Sapiens
QEFPFPETP

SEQ ID NO: 112532 - protein, 9 aa, Homo Sapiens
QEGAVAFAA

SEQ ID NO: 112533 - protein, 9 aa, Homo Sapiens
QEGDFQTEV

SEQ ID NO: 112534 - protein, 9 aa, Homo Sapiens
QEGPGSLAA

SEQ ID NO: 112535 - protein, 9 aa, Homo Sapiens
QEGPVGPAP

SEQ ID NO: 112536 - protein, 9 aa, Homo Sapiens
QEGSYFREA

SEQ ID NO: 112537 - protein, 9 aa, Homo Sapiens
QEGVEVRVA

SEQ ID NO: 112538 - protein, 9 aa, Homo Sapiens
QEHGLKYPA

SEQ ID NO: 112539 - protein, 9 aa, Homo Sapiens
QEHIIIEAA

SEQ ID NO: 112540 - protein, 9 aa, Homo Sapiens
QEHPELAVL

SEQ ID NO: 112541 - protein, 9 aa, Homo Sapiens
QEHPVVLLP

SEQ ID NO: 112542 - protein, 9 aa, Homo Sapiens
QEIATVVVP

SEQ ID NO: 112543 - protein, 9 aa, Homo Sapiens
QEIEQKLEV

SEQ ID NO: 112544 - protein, 9 aa, Homo Sapiens
QEIMTVPPP

SEQ ID NO: 112545 - protein, 9 aa, Homo Sapiens
QEINTLLEA

SEQ ID NO: 112546 - protein, 9 aa, Homo Sapiens
QEIPKYITA

SEQ ID NO: 112547 - protein, 9 aa, Homo Sapiens
QEIPVVSAP

SEQ ID NO: 112548 - protein, 9 aa, Homo Sapiens
QEISHLIEP

SEQ ID NO: 112549 - protein, 9 aa, Homo Sapiens
QEIVSSVVP

SEQ ID NO: 112550 - protein, 9 aa, Homo Sapiens
QEKALFAVP

SEQ ID NO: 112551 - protein, 9 aa, Homo Sapiens
QEKEAWIHA

SEQ ID NO: 112552 - protein, 9 aa, Homo Sapiens
QEKVQAVCA

SEQ ID NO: 112553 - protein, 9 aa, Homo Sapiens
QELGGLHSA

SEQ ID NO: 112554 - protein, 9 aa, Homo Sapiens
QELLDVHAA

SEQ ID NO: 112555 - protein, 9 aa, Homo Sapiens
QELPGLPAP

SEQ ID NO: 112556 - protein, 9 aa, Homo Sapiens
QELPGLPLV

SEQ ID NO: 112557 - protein, 9 aa, Homo Sapiens
QELPRLLSA

SEQ ID NO: 112558 - protein, 9 aa, Homo Sapiens
QELPTQPEA

SEQ ID NO: 112559 - protein, 9 aa, Homo Sapiens
QEMNRLFGA

SEQ ID NO: 112560 - protein, 9 aa, Homo Sapiens
QENDRVVMV

SEQ ID NO: 112561 - protein, 9 aa, Homo Sapiens
QENFLAVEA

SEQ ID NO: 112562 - protein, 9 aa, Homo Sapiens
QENKNLPQA

SEQ ID NO: 112563 - protein, 9 aa, Homo Sapiens
QENPNMRLS

SEQ ID NO: 112564 - protein, 9 aa, Homo Sapiens
QENTQTPTV

SEQ ID NO: 112565 - protein, 9 aa, Homo Sapiens
QEQAVSPKV

SEQ ID NO: 112566 - protein, 9 aa, Homo Sapiens
QEQFNSIAA

SEQ ID NO: 112567 - protein, 9 aa, Homo Sapiens
QEQLRLQLP

SEQ ID NO: 112568 - protein, 9 aa, Homo Sapiens
QEQMRPQLP

SEQ ID NO: 112569 - protein, 9 aa, Homo Sapiens
QEQQAFKEA

SEQ ID NO: 112570 - protein, 9 aa, Homo Sapiens
QEQRIMKEA

SEQ ID NO: 112571 - protein, 9 aa, Homo Sapiens
QEQRQAFAP

SEQ ID NO: 112572 - protein, 9 aa, Homo Sapiens
QEQSFVIRA

SEQ ID NO: 112573 - protein, 9 aa, Homo Sapiens
QEQVMAVTA

SEQ ID NO: 112574 - protein, 9 aa, Homo Sapiens
QEQVTAAVA

SEQ ID NO: 112575 - protein, 9 aa, Homo Sapiens
QESEMKVLA

SEQ ID NO: 112576 - protein, 9 aa, Homo Sapiens
QESGFSHSA

SEQ ID NO: 112577 - protein, 9 aa, Homo Sapiens
QESKLIILA

SEQ ID NO: 112578 - protein, 9 aa, Homo Sapiens
QESLPHAGP

SEQ ID NO: 112579 - protein, 9 aa, Homo Sapiens
QESPGGLEA

SEQ ID NO: 112580 - protein, 9 aa, Homo Sapiens
QESPGKVAA

SEQ ID NO: 112581 - protein, 9 aa, Homo Sapiens
QESPIMAKP

SEQ ID NO: 112582 - protein, 9 aa, Homo Sapiens
QESPINVTT

SEQ ID NO: 112583 - protein, 9 aa, Homo Sapiens
QETAFNEKA

SEQ ID NO: 112584 - protein, 9 aa, Homo Sapiens
QETDPLPVV

SEQ ID NO: 112585 - protein, 9 aa, Homo Sapiens
QETPLHLVA

SEQ ID NO: 112586 - protein, 9 aa, Homo Sapiens
QETSFTKEA

SEQ ID NO: 112587 - protein, 9 aa, Homo Sapiens
QEYFGSLAA

SEQ ID NO: 112588 - protein, 9 aa, Homo Sapiens
QEYPDLIHI

SEQ ID NO: 112589 - protein, 9 aa, Homo Sapiens
QEYPTLKVP

SEQ ID NO: 112590 - protein, 9 aa, Homo Sapiens
QREEAAEVA

SEQ ID NO: 112591 - protein, 9 aa, Homo Sapiens
REANFTVSS

SEQ ID NO: 112592 - protein, 9 aa, Homo Sapiens
REAQSFISA

SEQ ID NO: 112593 - protein, 9 aa, Homo Sapiens
RECTIEATA

SEQ ID NO: 112594 - protein, 9 aa, Homo Sapiens
REGITVIDV

SEQ ID NO: 112595 - protein, 9 aa, Homo Sapiens
REHAPFLVA

SEQ ID NO: 112596 - protein, 9 aa, Homo Sapiens
REHPKLKAP

SEQ ID NO: 112597 - protein, 9 aa, Homo Sapiens
REIFFPETA

SEQ ID NO: 112598 - protein, 9 aa, Homo Sapiens
REIKFTVQA

SEQ ID NO: 112599 - protein, 9 aa, Homo Sapiens
REILTELEA

SEQ ID NO: 112600 - protein, 9 aa, Homo Sapiens
REKETWQNV

SEQ ID NO: 112601 - protein, 9 aa, Homo Sapiens
REKMFVEEV

SEQ ID NO: 112602 - protein, 9 aa, Homo Sapiens
REKMGWAQV

SEQ ID NO: 112603 - protein, 9 aa, Homo Sapiens
RELEVQHPA

SEQ ID NO: 112604 - protein, 9 aa, Homo Sapiens
RELPFTKSA

SEQ ID NO: 112605 - protein, 9 aa, Homo Sapiens
REMDQTMAA

SEQ ID NO: 112606 - protein, 9 aa, Homo Sapiens
REMEENFAV

SEQ ID NO: 112607 - protein, 9 aa, Homo Sapiens
REMENIIAT

SEQ ID NO: 112608 - protein, 9 aa, Homo Sapiens
REMEVKCKP

SEQ ID NO: 112609 - protein, 9 aa, Homo Sapiens
REMPGVWGA

SEQ ID NO: 112610 - protein, 9 aa, Homo Sapiens
REMPVKVEA

SEQ ID NO: 112611 - protein, 9 aa, Homo Sapiens
REMRGLTSA

SEQ ID NO: 112612 - protein, 9 aa, Homo Sapiens
REMTILGSA

SEQ ID NO: 112613 - protein, 9 aa, Homo Sapiens
RENKNVVVA

SEQ ID NO: 112614 - protein, 9 aa, Homo Sapiens
RENVFKLLP

SEQ ID NO: 112615 - protein, 9 aa, Homo Sapiens
REQDQSFTA

SEQ ID NO: 112616 - protein, 9 aa, Homo Sapiens
REQTTGLAA

SEQ ID NO: 112617 - protein, 9 aa, Homo Sapiens
RESNNMVVP

SEQ ID NO: 112618 - protein, 9 aa, Homo Sapiens
RESPFSTSA

SEQ ID NO: 112619 - protein, 9 aa, Homo Sapiens
REVEHFLKA

SEQ ID NO: 112620 - protein, 9 aa, Homo Sapiens
REYMGFIQA

SEQ ID NO: 112621 - protein, 9 aa, Homo Sapiens
REYWNEQSA

SEQ ID NO: 112622 - protein, 9 aa, Homo Sapiens
RPEAPPPPP

SEQ ID NO: 112623 - protein, 9 aa, Homo Sapiens
RPMSPPPPP

SEQ ID NO: 112624 - protein, 9 aa, Homo Sapiens
SEAATPPVA

SEQ ID NO: 112625 - protein, 9 aa, Homo Sapiens
SEADKIKVA

SEQ ID NO: 112626 - protein, 9 aa, Homo Sapiens
SEADPSGVA

SEQ ID NO: 112627 - protein, 9 aa, Homo Sapiens
SEAEIQAKA

SEQ ID NO: 112628 - protein, 9 aa, Homo Sapiens
SEAEKVYIV

SEQ ID NO: 112629 - protein, 9 aa, Homo Sapiens
SEAFHLIKA

SEQ ID NO: 112630 - protein, 9 aa, Homo Sapiens
SEAFSVASA

SEQ ID NO: 112631 - protein, 9 aa, Homo Sapiens
SEAGPGPRP

SEQ ID NO: 112632 - protein, 9 aa, Homo Sapiens
SEAKPAAVA

SEQ ID NO: 112633 - protein, 9 aa, Homo Sapiens
SEAKQMPRA

SEQ ID NO: 112634 - protein, 9 aa, Homo Sapiens
SEALPSDIA

SEQ ID NO: 112635 - protein, 9 aa, Homo Sapiens
SEAPPSKMV

SEQ ID NO: 112636 - protein, 9 aa, Homo Sapiens
SEAPPTNQA

SEQ ID NO: 112637 - protein, 9 aa, Homo Sapiens
SEAPSPVNA

SEQ ID NO: 112638 - protein, 9 aa, Homo Sapiens
SEAQPQPEV

SEQ ID NO: 112639 - protein, 9 aa, Homo Sapiens
SEASETPMA

SEQ ID NO: 112640 - protein, 9 aa, Homo Sapiens
SEAWRCWKA

SEQ ID NO: 112641 - protein, 9 aa, Homo Sapiens
SECGKTFTV

SEQ ID NO: 112642 - protein, 9 aa, Homo Sapiens
SEDDPILQI

SEQ ID NO: 112643 - protein, 9 aa, Homo Sapiens
SEDEPTRSL

SEQ ID NO: 112644 - protein, 9 aa, Homo Sapiens
SEDNPTPGI

SEQ ID NO: 112645 - protein, 9 aa, Homo Sapiens
SEDPKNNIP

SEQ ID NO: 112646 - protein, 9 aa, Homo Sapiens
SEEAFVKES

SEQ ID NO: 112647 - protein, 9 aa, Homo Sapiens
SEEAIKVIA

SEQ ID NO: 112648 - protein, 9 aa, Homo Sapiens
SEEEGVPST

SEQ ID NO: 112649 - protein, 9 aa, Homo Sapiens
SEEEISFRA

SEQ ID NO: 112650 - protein, 9 aa, Homo Sapiens
SEEFPSFGA

SEQ ID NO: 112651 - protein, 9 aa, Homo Sapiens
SEEFPVPPA

SEQ ID NO: 112652 - protein, 9 aa, Homo Sapiens
SEEGGHVAV

SEQ ID NO: 112653 - protein, 9 aa, Homo Sapiens
SEEGHPFKA

SEQ ID NO: 112654 - protein, 9 aa, Homo Sapiens
SEEGSVYTA

SEQ ID NO: 112655 - protein, 9 aa, Homo Sapiens
SEEHNTWEP

SEQ ID NO: 112656 - protein, 9 aa, Homo Sapiens
SEEKLVISA

SEQ ID NO: 112657 - protein, 9 aa, Homo Sapiens
SEEKPHVVA

SEQ ID NO: 112658 - protein, 9 aa, Homo Sapiens
SEEKPVPAA

SEQ ID NO: 112659 - protein, 9 aa, Homo Sapiens
SEELPSTAV

SEQ ID NO: 112660 - protein, 9 aa, Homo Sapiens
SEEPETPAA

SEQ ID NO: 112661 - protein, 9 aa, Homo Sapiens
SEEPGAPLP

SEQ ID NO: 112662 - protein, 9 aa, Homo Sapiens
SEEPLLHVA

SEQ ID NO: 112663 - protein, 9 aa, Homo Sapiens
SEEPWTVLP

SEQ ID NO: 112664 - protein, 9 aa, Homo Sapiens
SEEQSRLAA

SEQ ID NO: 112665 - protein, 9 aa, Homo Sapiens
SEESPAIEA

SEQ ID NO: 112666 - protein, 9 aa, Homo Sapiens
SEETPAISP

SEQ ID NO: 112667 - protein, 9 aa, Homo Sapiens
SEETPLTAA

SEQ ID NO: 112668 - protein, 9 aa, Homo Sapiens
SEEVGIAEA

SEQ ID NO: 112669 - protein, 9 aa, Homo Sapiens
SEEVNIKTA

SEQ ID NO: 112670 - protein, 9 aa, Homo Sapiens
SEEYPNKPP

SEQ ID NO: 112671 - protein, 9 aa, Homo Sapiens
SEGGKTPVA

SEQ ID NO: 112672 - protein, 9 aa, Homo Sapiens
SEGNVVNKP

SEQ ID NO: 112673 - protein, 9 aa, Homo Sapiens
SEGVRVNVV

SEQ ID NO: 112674 - protein, 9 aa, Homo Sapiens
SEHASQSVP

SEQ ID NO: 112675 - protein, 9 aa, Homo Sapiens
SEHASSPVP

SEQ ID NO: 112676 - protein, 9 aa, Homo Sapiens
SEHGLVVIA

SEQ ID NO: 112677 - protein, 9 aa, Homo Sapiens
SEHPLLSEP

SEQ ID NO: 112678 - protein, 9 aa, Homo Sapiens
SEHPTLQAS

SEQ ID NO: 112679 - protein, 9 aa, Homo Sapiens
SEHSVIKPP

SEQ ID NO: 112680 - protein, 9 aa, Homo Sapiens
SEHVMPYAA

SEQ ID NO: 112681 - protein, 9 aa, Homo Sapiens
SEHWLVLVP

SEQ ID NO: 112682 - protein, 9 aa, Homo Sapiens
SEIDMSVKA

SEQ ID NO: 112683 - protein, 9 aa, Homo Sapiens
SEIDQVVPA

SEQ ID NO: 112684 - protein, 9 aa, Homo Sapiens
SEIEARIAA

SEQ ID NO: 112685 - protein, 9 aa, Homo Sapiens
SEIEKLSAA

SEQ ID NO: 112686 - protein, 9 aa, Homo Sapiens
SEIELVFRP

SEQ ID NO: 112687 - protein, 9 aa, Homo Sapiens
SEIERQAQV

SEQ ID NO: 112688 - protein, 9 aa, Homo Sapiens
SEIGGITIA

SEQ ID NO: 112689 - protein, 9 aa, Homo Sapiens
SEILYSAPP

SEQ ID NO: 112690 - protein, 9 aa, Homo Sapiens
SEIMAEKAA

SEQ ID NO: 112691 - protein, 9 aa, Homo Sapiens
SEIPKLPAV

SEQ ID NO: 112692 - protein, 9 aa, Homo Sapiens
SEITDTVAA

SEQ ID NO: 112693 - protein, 9 aa, Homo Sapiens
SEITGLSTA

SEQ ID NO: 112694 - protein, 9 aa, Homo Sapiens
SEKEATPVV

SEQ ID NO: 112695 - protein, 9 aa, Homo Sapiens
SEKFSPETA

SEQ ID NO: 112696 - protein, 9 aa, Homo Sapiens
SEKGGQPLP

SEQ ID NO: 112697 - protein, 9 aa, Homo Sapiens
SEKPYILEA

SEQ ID NO: 112698 - protein, 9 aa, Homo Sapiens
SEKWKQNAP

SEQ ID NO: 112699 - protein, 9 aa, Homo Sapiens
SELACIYSA

SEQ ID NO: 112700 - protein, 9 aa, Homo Sapiens
SELAFPITA

SEQ ID NO: 112701 - protein, 9 aa, Homo Sapiens
SELDRLLSA

SEQ ID NO: 112702 - protein, 9 aa, Homo Sapiens
SELEKTQVA

SEQ ID NO: 112703 - protein, 9 aa, Homo Sapiens
SELERLIVP

SEQ ID NO: 112704 - protein, 9 aa, Homo Sapiens
SELITKAVA

SEQ ID NO: 112705 - protein, 9 aa, Homo Sapiens
SELPGAFEA

SEQ ID NO: 112706 - protein, 9 aa, Homo Sapiens
SELPIVTPA

SEQ ID NO: 112707 - protein, 9 aa, Homo Sapiens
SELPVSEVA

SEQ ID NO: 112708 - protein, 9 aa, Homo Sapiens
SELQKIHKA

SEQ ID NO: 112709 - protein, 9 aa, Homo Sapiens
SELSQNISA

SEQ ID NO: 112710 - protein, 9 aa, Homo Sapiens
SELSRTYLP

SEQ ID NO: 112711 - protein, 9 aa, Homo Sapiens
SELSSNPAA

SEQ ID NO: 112712 - protein, 9 aa, Homo Sapiens
SELTPMLAA

SEQ ID NO: 112713 - protein, 9 aa, Homo Sapiens
SEMAPVCAV

SEQ ID NO: 112714 - protein, 9 aa, Homo Sapiens
SEMDRVPFV

SEQ ID NO: 112715 - protein, 9 aa, Homo Sapiens
SEMHLHDTA

SEQ ID NO: 112716 - protein, 9 aa, Homo Sapiens
SEMRAPPAA

SEQ ID NO: 112717 - protein, 9 aa, Homo Sapiens
SEMSGFCKA

SEQ ID NO: 112718 - protein, 9 aa, Homo Sapiens
SEMSKVSKP

SEQ ID NO: 112719 - protein, 9 aa, Homo Sapiens
SENAHIIEA

SEQ ID NO: 112720 - protein, 9 aa, Homo Sapiens
SENAIGVAA

SEQ ID NO: 112721 - protein, 9 aa, Homo Sapiens
SENEEFVEV

SEQ ID NO: 112722 - protein, 9 aa, Homo Sapiens
SENELCVRA

SEQ ID NO: 112723 - protein, 9 aa, Homo Sapiens
SENEYIMKA

SEQ ID NO: 112724 - protein, 9 aa, Homo Sapiens
SENGALPVV

SEQ ID NO: 112725 - protein, 9 aa, Homo Sapiens
SENIKVWAP

SEQ ID NO: 112726 - protein, 9 aa, Homo Sapiens
SENKAFISV

SEQ ID NO: 112727 - protein, 9 aa, Homo Sapiens
SENPSVYVP

SEQ ID NO: 112728 - protein, 9 aa, Homo Sapiens
SENPVPLTV

SEQ ID NO: 112729 - protein, 9 aa, Homo Sapiens
SENQHLVSP

SEQ ID NO: 112730 - protein, 9 aa, Homo Sapiens
SENVKLFSA

SEQ ID NO: 112731 - protein, 9 aa, Homo Sapiens
SENVYVNTA

SEQ ID NO: 112732 - protein, 9 aa, Homo Sapiens
SENWRVDSA

SEQ ID NO: 112733 - protein, 9 aa, Homo Sapiens
SEQEHFLIV

SEQ ID NO: 112734 - protein, 9 aa, Homo Sapiens
SEQETLVRP

SEQ ID NO: 112735 - protein, 9 aa, Homo Sapiens
SEQHIPVSA

SEQ ID NO: 112736 - protein, 9 aa, Homo Sapiens
SEQIMKTGA

SEQ ID NO: 112737 - protein, 9 aa, Homo Sapiens
SEQKPFPCA

SEQ ID NO: 112738 - protein, 9 aa, Homo Sapiens
SEQLHNVTA

SEQ ID NO: 112739 - protein, 9 aa, Homo Sapiens
SEQPTLVTA

SEQ ID NO: 112740 - protein, 9 aa, Homo Sapiens
SEQREFVMA

SEQ ID NO: 112741 - protein, 9 aa, Homo Sapiens
SEQTVCHVA

SEQ ID NO: 112742 - protein, 9 aa, Homo Sapiens
SEQVFKVAS

SEQ ID NO: 112743 - protein, 9 aa, Homo Sapiens
SEQVPLMSA

SEQ ID NO: 112744 - protein, 9 aa, Homo Sapiens
SEQVTRWAA

SEQ ID NO: 112745 - protein, 9 aa, Homo Sapiens
SERDFFQEV

SEQ ID NO: 112746 - protein, 9 aa, Homo Sapiens
SERDPIQPP

SEQ ID NO: 112747 - protein, 9 aa, Homo Sapiens
SERPGLRGA

SEQ ID NO: 112748 - protein, 9 aa, Homo Sapiens
SERWKTMSA

SEQ ID NO: 112749 - protein, 9 aa, Homo Sapiens
SESAGLATA

SEQ ID NO: 112750 - protein, 9 aa, Homo Sapiens
SESDEALVA

SEQ ID NO: 112751 - protein, 9 aa, Homo Sapiens
SESDYIVMP

SEQ ID NO: 112752 - protein, 9 aa, Homo Sapiens
SESEAVAVA

SEQ ID NO: 112753 - protein, 9 aa, Homo Sapiens
SESEDRLVA

SEQ ID NO: 112754 - protein, 9 aa, Homo Sapiens
SESEKQWKA

SEQ ID NO: 112755 - protein, 9 aa, Homo Sapiens
SESFIQHIV

SEQ ID NO: 112756 - protein, 9 aa, Homo Sapiens
SESFVSPEA

SEQ ID NO: 112757 - protein, 9 aa, Homo Sapiens
SESGIQMVP

SEQ ID NO: 112758 - protein, 9 aa, Homo Sapiens
SESPVILTP

SEQ ID NO: 112759 - protein, 9 aa, Homo Sapiens
SESPVITKA

SEQ ID NO: 112760 - protein, 9 aa, Homo Sapiens
SESPVTPSA

SEQ ID NO: 112761 - protein, 9 aa, Homo Sapiens
SESPWLHAP

SEQ ID NO: 112762 - protein, 9 aa, Homo Sapiens
SESRFFVSS

SEQ ID NO: 112763 - protein, 9 aa, Homo Sapiens
SESSAIPEA

SEQ ID NO: 112764 - protein, 9 aa, Homo Sapiens
SESTFMPVA

SEQ ID NO: 112765 - protein, 9 aa, Homo Sapiens
SESVNLRIA

SEQ ID NO: 112766 - protein, 9 aa, Homo Sapiens
SESVPVIAA

SEQ ID NO: 112767 - protein, 9 aa, Homo Sapiens
SETALIHIA

SEQ ID NO: 112768 - protein, 9 aa, Homo Sapiens
SETANYISA

SEQ ID NO: 112769 - protein, 9 aa, Homo Sapiens
SETDFKVMA

SEQ ID NO: 112770 - protein, 9 aa, Homo Sapiens
SETEATPVP

SEQ ID NO: 112771 - protein, 9 aa, Homo Sapiens
SETQTSHLP

SEQ ID NO: 112772 - protein, 9 aa, Homo Sapiens
SETSLIGTA

SEQ ID NO: 112773 - protein, 9 aa, Homo Sapiens
SETSNWIAA

SEQ ID NO: 112774 - protein, 9 aa, Homo Sapiens
SETSPFPPA

SEQ ID NO: 112775 - protein, 9 aa, Homo Sapiens
SETVMVHQA

SEQ ID NO: 112776 - protein, 9 aa, Homo Sapiens
SEVATLTAA

SEQ ID NO: 112777 - protein, 9 aa, Homo Sapiens
SEVEVIHVP

SEQ ID NO: 112778 - protein, 9 aa, Homo Sapiens
SEVGKLLSA

SEQ ID NO: 112779 - protein, 9 aa, Homo Sapiens
SEYEGILDA

SEQ ID NO: 112780 - protein, 9 aa, Homo Sapiens
SEYEMSIAA

SEQ ID NO: 112781 - protein, 9 aa, Homo Sapiens
SEYLCKQVA

SEQ ID NO: 112782 - protein, 9 aa, Homo Sapiens
SEYLQQHVA

SEQ ID NO: 112783 - protein, 9 aa, Homo Sapiens
SEYSGFVNP

SEQ ID NO: 112784 - protein, 9 aa, Homo Sapiens
SPSESTVVS

SEQ ID NO: 112785 - protein, 9 aa, Homo Sapiens
TEAEDMISA

SEQ ID NO: 112786 - protein, 9 aa, Homo Sapiens
TEAEIAHIA

SEQ ID NO: 112787 - protein, 9 aa, Homo Sapiens
TEAKPAVVA

SEQ ID NO: 112788 - protein, 9 aa, Homo Sapiens
TEALHFVAA

SEQ ID NO: 112789 - protein, 9 aa, Homo Sapiens
TEAPLNPKA

SEQ ID NO: 112790 - protein, 9 aa, Homo Sapiens
TEAPPQPPP

SEQ ID NO: 112791 - protein, 9 aa, Homo Sapiens
TEAPRWPLP

SEQ ID NO: 112792 - protein, 9 aa, Homo Sapiens
TEAQIKHLA

SEQ ID NO: 112793 - protein, 9 aa, Homo Sapiens
TEARFPDVA

SEQ ID NO: 112794 - protein, 9 aa, Homo Sapiens
TEDLPFPPA

SEQ ID NO: 112795 - protein, 9 aa, Homo Sapiens
TEEDPILRA

SEQ ID NO: 112796 - protein, 9 aa, Homo Sapiens
TEEEKNFKA

SEQ ID NO: 112797 - protein, 9 aa, Homo Sapiens
TEENKSFSA

SEQ ID NO: 112798 - protein, 9 aa, Homo Sapiens
TEGSHFVEA

SEQ ID NO: 112799 - protein, 9 aa, Homo Sapiens
TEHFLTAVA

SEQ ID NO: 112800 - protein, 9 aa, Homo Sapiens
TEIEKSISA

SEQ ID NO: 112801 - protein, 9 aa, Homo Sapiens
TEIGSIHSA

SEQ ID NO: 112802 - protein, 9 aa, Homo Sapiens
TEKKDVLVP

SEQ ID NO: 112803 - protein, 9 aa, Homo Sapiens
TEKRDFVSA

SEQ ID NO: 112804 - protein, 9 aa, Homo Sapiens
TEMEISRAA

SEQ ID NO: 112805 - protein, 9 aa, Homo Sapiens
TEQSWPHSA

SEQ ID NO: 112806 - protein, 9 aa, Homo Sapiens
TESPCALVA

SEQ ID NO: 112807 - protein, 9 aa, Homo Sapiens
TESPPSLAA

SEQ ID NO: 112808 - protein, 9 aa, Homo Sapiens
TESSHFYSA

SEQ ID NO: 112809 - protein, 9 aa, Homo Sapiens
TESSQSFVA

SEQ ID NO: 112810 - protein, 9 aa, Homo Sapiens
TETDSLVSA

SEQ ID NO: 112811 - protein, 9 aa, Homo Sapiens
TEVANIPVA

SEQ ID NO: 112812 - protein, 9 aa, Homo Sapiens
TEVAPPPPP

SEQ ID NO: 112813 - protein, 9 aa, Homo Sapiens
TEVSKTPEA

SEQ ID NO: 112814 - protein, 9 aa, Homo Sapiens
VAAAEAVIG

SEQ ID NO: 112815 - protein, 9 aa, Homo Sapiens
VEDRGTVVA

SEQ ID NO: 112816 - protein, 9 aa, Homo Sapiens
VEEEPRPAA

SEQ ID NO: 112817 - protein, 9 aa, Homo Sapiens
VEEPSNPEA

SEQ ID NO: 112818 - protein, 9 aa, Homo Sapiens
VEEPSRPSA

SEQ ID NO: 112819 - protein, 9 aa, Homo Sapiens
VEERPGLPA

SEQ ID NO: 112820 - protein, 9 aa, Homo Sapiens
VEHPSLQSP

SEQ ID NO: 112821 - protein, 9 aa, Homo Sapiens
VEKPVGVAA

SEQ ID NO: 112822 - protein, 9 aa, Homo Sapiens
VENDKLPPP

SEQ ID NO: 112823 - protein, 9 aa, Homo Sapiens
VENPGGYVA

SEQ ID NO: 112824 - protein, 9 aa, Homo Sapiens
VEPDHFKVA

SEQ ID NO: 112825 - protein, 9 aa, Homo Sapiens
VEREDFVEA

SEQ ID NO: 112826 - protein, 9 aa, Homo Sapiens
VETDHIVAA

SEQ ID NO: 112827 - protein, 9 aa, Homo Sapiens
VEVPETPKA

SEQ ID NO: 112828 - protein, 9 aa, Homo Sapiens
YEEAAMAIA

SEQ ID NO: 112829 - protein, 10 aa, Homo Sapiens
AARELAGPPA

SEQ ID NO: 112830 - protein, 10 aa, Homo Sapiens
ADASIRLLKA

SEQ ID NO: 112831 - protein, 10 aa, Homo Sapiens
AEAAAAVVAA

SEQ ID NO: 112832 - protein, 10 aa, Homo Sapiens
AEAAALEVLA

SEQ ID NO: 112833 - protein, 10 aa, Homo Sapiens
AEAEAFLKKA

SEQ ID NO: 112834 - protein, 10 aa, Homo Sapiens
AEAEALARSA

SEQ ID NO: 112835 - protein, 10 aa, Homo Sapiens
AEAEASRLTA

SEQ ID NO: 112836 - protein, 10 aa, Homo Sapiens
AEAFLRQQQA

SEQ ID NO: 112837 - protein, 10 aa, Homo Sapiens
AEAFPSGCTA

SEQ ID NO: 112838 - protein, 10 aa, Homo Sapiens
AEAGGYLHTA

SEQ ID NO: 112839 - protein, 10 aa, Homo Sapiens
AEAILGQNAA

SEQ ID NO: 112840 - protein, 10 aa, Homo Sapiens
AEAMALGREA

SEQ ID NO: 112841 - protein, 10 aa, Homo Sapiens
AEANLVGREA

SEQ ID NO: 112842 - protein, 10 aa, Homo Sapiens
AEANNLAAVA

SEQ ID NO: 112843 - protein, 10 aa, Homo Sapiens
AEAPGAVAGA

SEQ ID NO: 112844 - protein, 10 aa, Homo Sapiens
AEAPSPAPTP

SEQ ID NO: 112845 - protein, 10 aa, Homo Sapiens
AEAPSQKVTV

SEQ ID NO: 112846 - protein, 10 aa, Homo Sapiens
AEAVLYEHLF

SEQ ID NO: 112847 - protein, 10 aa, Homo Sapiens
AEAWLLGQEP

SEQ ID NO: 112848 - protein, 10 aa, Homo Sapiens
AECGAFRTGP

SEQ ID NO: 112849 - protein, 10 aa, Homo Sapiens
AEDDLNTVAA

SEQ ID NO: 112850 - protein, 10 aa, Homo Sapiens
AEEALVDHVA

SEQ ID NO: 112851 - protein, 10 aa, Homo Sapiens
AEEAPQLMRT

SEQ ID NO: 112852 - protein, 10 aa, Homo Sapiens
AEEDFLAVSP

SEQ ID NO: 112853 - protein, 10 aa, Homo Sapiens
AEEDVQGTQA

SEQ ID NO: 112854 - protein, 10 aa, Homo Sapiens
AEEEFFYEKA

SEQ ID NO: 112855 - protein, 10 aa, Homo Sapiens
AEEEGVKMSA

SEQ ID NO: 112856 - protein, 10 aa, Homo Sapiens
AEEELGELEA

SEQ ID NO: 112857 - protein, 10 aa, Homo Sapiens
AEEEPNRIPS

SEQ ID NO: 112858 - protein, 10 aa, Homo Sapiens
AEEFPNLAVA

SEQ ID NO: 112859 - protein, 10 aa, Homo Sapiens
AEEGPGVPAA

SEQ ID NO: 112860 - protein, 10 aa, Homo Sapiens
AEEGSLAAAA

SEQ ID NO: 112861 - protein, 10 aa, Homo Sapiens
AEEGTRNVVA

SEQ ID NO: 112862 - protein, 10 aa, Homo Sapiens
AEEIPSRIQA

SEQ ID NO: 112863 - protein, 10 aa, Homo Sapiens
AEELASGHLA

SEQ ID NO: 112864 - protein, 10 aa, Homo Sapiens
AEELGNNVKP

SEQ ID NO: 112865 - protein, 10 aa, Homo Sapiens
AEEMETGNVA

SEQ ID NO: 112866 - protein, 10 aa, Homo Sapiens
AEEPPTPALP

SEQ ID NO: 112867 - protein, 10 aa, Homo Sapiens
AEEQAAVVTA

SEQ ID NO: 112868 - protein, 10 aa, Homo Sapiens
AEERDKRLAA

SEQ ID NO: 112869 - protein, 10 aa, Homo Sapiens
AEERIEGRVA

SEQ ID NO: 112870 - protein, 10 aa, Homo Sapiens
AEEVLLGVHA

SEQ ID NO: 112871 - protein, 10 aa, Homo Sapiens
AEGGASRFSA

SEQ ID NO: 112872 - protein, 10 aa, Homo Sapiens
AEHAMDCVRA

SEQ ID NO: 112873 - protein, 10 aa, Homo Sapiens
AEHLGEAEVA

SEQ ID NO: 112874 - protein, 10 aa, Homo Sapiens
AEHNDLQYAA

SEQ ID NO: 112875 - protein, 10 aa, Homo Sapiens
AEHPTIAKSV

SEQ ID NO: 112876 - protein, 10 aa, Homo Sapiens
AEIASSLPAA

SEQ ID NO: 112877 - protein, 10 aa, Homo Sapiens
AEIKDGERLP

SEQ ID NO: 112878 - protein, 10 aa, Homo Sapiens
AEIRDKNFNA

SEQ ID NO: 112879 - protein, 10 aa, Homo Sapiens
AEIRYEGILY

SEQ ID NO: 112880 - protein, 10 aa, Homo Sapiens
AEISSKSPVA

SEQ ID NO: 112881 - protein, 10 aa, Homo Sapiens
AEISSRNLAA

SEQ ID NO: 112882 - protein, 10 aa, Homo Sapiens
AEKAFQEGIA

SEQ ID NO: 112883 - protein, 10 aa, Homo Sapiens
AEKEMTSVVA

SEQ ID NO: 112884 - protein, 10 aa, Homo Sapiens
AEKFPSTETA

SEQ ID NO: 112885 - protein, 10 aa, Homo Sapiens
AEKGDVGLVA

SEQ ID NO: 112886 - protein, 10 aa, Homo Sapiens
AEKIDGVFAA

SEQ ID NO: 112887 - protein, 10 aa, Homo Sapiens
AEKKFIDIAA

SEQ ID NO: 112888 - protein, 10 aa, Homo Sapiens
AEKLYPLPSA

SEQ ID NO: 112889 - protein, 10 aa, Homo Sapiens
AEMDARTILL

SEQ ID NO: 112890 - protein, 10 aa, Homo Sapiens
AEMEMKNRQV

SEQ ID NO: 112891 - protein, 10 aa, Homo Sapiens
AEMLYGLIHA

SEQ ID NO: 112892 - protein, 10 aa, Homo Sapiens
AEMNGKLIAA

SEQ ID NO: 112893 - protein, 10 aa, Homo Sapiens
AEMYVAKFAA

SEQ ID NO: 112894 - protein, 10 aa, Homo Sapiens
AENAYHIHQA

SEQ ID NO: 112895 - protein, 10 aa, Homo Sapiens
AENDFSVSQA

SEQ ID NO: 112896 - protein, 10 aa, Homo Sapiens
AENELGVVVA

SEQ ID NO: 112897 - protein, 10 aa, Homo Sapiens
AENPGKYNIL

SEQ ID NO: 112898 - protein, 10 aa, Homo Sapiens
AENQPFLIEA

SEQ ID NO: 112899 - protein, 10 aa, Homo Sapiens
AEQAERYDDM

SEQ ID NO: 112900 - protein, 10 aa, Homo Sapiens
AEQAFERISA

SEQ ID NO: 112901 - protein, 10 aa, Homo Sapiens
AEQAGCMVSA

SEQ ID NO: 112902 - protein, 10 aa, Homo Sapiens
AEQDFWRAVC

SEQ ID NO: 112903 - protein, 10 aa, Homo Sapiens
AEQEYNATVA

SEQ ID NO: 112904 - protein, 10 aa, Homo Sapiens
AEQGVQKPAA

SEQ ID NO: 112905 - protein, 10 aa, Homo Sapiens
AEQKAFEVIA

SEQ ID NO: 112906 - protein, 10 aa, Homo Sapiens
AEQLAEKINA

SEQ ID NO: 112907 - protein, 10 aa, Homo Sapiens
AEQLEPRVSA

SEQ ID NO: 112908 - protein, 10 aa, Homo Sapiens
AEQLMTLISA

SEQ ID NO: 112909 - protein, 10 aa, Homo Sapiens
AEQLTAPPSA

SEQ ID NO: 112910 - protein, 10 aa, Homo Sapiens
AEQMASVQNA

SEQ ID NO: 112911 - protein, 10 aa, Homo Sapiens
AEQPSELVSA

SEQ ID NO: 112912 - protein, 10 aa, Homo Sapiens
AEQQAALLLA

SEQ ID NO: 112913 - protein, 10 aa, Homo Sapiens
AEQQALRLEV

SEQ ID NO: 112914 - protein, 10 aa, Homo Sapiens
AEQQKAQFTA

SEQ ID NO: 112915 - protein, 10 aa, Homo Sapiens
AEQQRLFNEA

SEQ ID NO: 112916 - protein, 10 aa, Homo Sapiens
AEQRLKAIVA

SEQ ID NO: 112917 - protein, 10 aa, Homo Sapiens
AERDLRDIEA

SEQ ID NO: 112918 - protein, 10 aa, Homo Sapiens
AERDLRDIGA

SEQ ID NO: 112919 - protein, 10 aa, Homo Sapiens
AERDYLDLTA

SEQ ID NO: 112920 - protein, 10 aa, Homo Sapiens
AEREAFELLP

SEQ ID NO: 112921 - protein, 10 aa, Homo Sapiens
AERFYGKYTA

SEQ ID NO: 112922 - protein, 10 aa, Homo Sapiens
AERGAFIDQS

SEQ ID NO: 112923 - protein, 10 aa, Homo Sapiens
AERNSNLVGA

SEQ ID NO: 112924 - protein, 10 aa, Homo Sapiens
AERPGEAAVA

SEQ ID NO: 112925 - protein, 10 aa, Homo Sapiens
AERRSVLDAA

SEQ ID NO: 112926 - protein, 10 aa, Homo Sapiens
AESAPLPVSA

SEQ ID NO: 112927 - protein, 10 aa, Homo Sapiens
AESAQTRVAP

SEQ ID NO: 112928 - protein, 10 aa, Homo Sapiens
AESGCKIQIA

SEQ ID NO: 112929 - protein, 10 aa, Homo Sapiens
AESQTPTPSA

SEQ ID NO: 112930 - protein, 10 aa, Homo Sapiens
AESYHQHFAA

SEQ ID NO: 112931 - protein, 10 aa, Homo Sapiens
AEYALKRQEA

SEQ ID NO: 112932 - protein, 10 aa, Homo Sapiens
AEYDLTTRIA

SEQ ID NO: 112933 - protein, 10 aa, Homo Sapiens
AEYDNFFQHL

SEQ ID NO: 112934 - protein, 10 aa, Homo Sapiens
AEYENLTNKL

SEQ ID NO: 112935 - protein, 10 aa, Homo Sapiens
AEYLLGPLYA

SEQ ID NO: 112936 - protein, 10 aa, Homo Sapiens
AGHSLELIEP

SEQ ID NO: 112937 - protein, 10 aa, Homo Sapiens
ATHHMALEAP

SEQ ID NO: 112938 - protein, 10 aa, Homo Sapiens
CEHQFTIIVA

SEQ ID NO: 112939 - protein, 10 aa, Homo Sapiens
EEAALLHEEA

SEQ ID NO: 112940 - protein, 10 aa, Homo Sapiens
EEADFHQASA

SEQ ID NO: 112941 - protein, 10 aa, Homo Sapiens
EEAPAAMTAA

SEQ ID NO: 112942 - protein, 10 aa, Homo Sapiens
EEDPYLVVNP

SEQ ID NO: 112943 - protein, 10 aa, Homo Sapiens
EEEAATRIPA

SEQ ID NO: 112944 - protein, 10 aa, Homo Sapiens
EEEEAKTVSA

SEQ ID NO: 112945 - protein, 10 aa, Homo Sapiens
EEEEFRRLAA

SEQ ID NO: 112946 - protein, 10 aa, Homo Sapiens
EEEGPFHSLP

SEQ ID NO: 112947 - protein, 10 aa, Homo Sapiens
EEEPPQNMKP

SEQ ID NO: 112948 - protein, 10 aa, Homo Sapiens
EEHPTLLTEA

SEQ ID NO: 112949 - protein, 10 aa, Homo Sapiens
EEHPVLLTEA

SEQ ID NO: 112950 - protein, 10 aa, Homo Sapiens
EEIKDFLLTA

SEQ ID NO: 112951 - protein, 10 aa, Homo Sapiens
EEIQKKLEAA

SEQ ID NO: 112952 - protein, 10 aa, Homo Sapiens
EEMHQVAIAA

SEQ ID NO: 112953 - protein, 10 aa, Homo Sapiens
EEQHQLAVTA

SEQ ID NO: 112954 - protein, 10 aa, Homo Sapiens
EEVRAGAVSA

SEQ ID NO: 112955 - protein, 10 aa, Homo Sapiens
EEYGPELHVA

SEQ ID NO: 112956 - protein, 10 aa, Homo Sapiens
FEEEMKGIAA

SEQ ID NO: 112957 - protein, 10 aa, Homo Sapiens
GEAEAFAIGA

SEQ ID NO: 112958 - protein, 10 aa, Homo Sapiens
GEAPAAVTSA

SEQ ID NO: 112959 - protein, 10 aa, Homo Sapiens
GEQEGAMVAA

SEQ ID NO: 112960 - protein, 10 aa, Homo Sapiens
GETKSSYIAA

SEQ ID NO: 112961 - protein, 10 aa, Homo Sapiens
HEFLHEVPAA

SEQ ID NO: 112962 - protein, 10 aa, Homo Sapiens
HHSVEAAGPP

SEQ ID NO: 112963 - protein, 10 aa, Homo Sapiens
INTAVPLPAA

SEQ ID NO: 112964 - protein, 10 aa, Homo Sapiens
KEHEEFQITA

SEQ ID NO: 112965 - protein, 10 aa, Homo Sapiens
KEMEHNTVCA

SEQ ID NO: 112966 - protein, 10 aa, Homo Sapiens
KETDSLKVAA

SEQ ID NO: 112967 - protein, 10 aa, Homo Sapiens
MEEDSIRLPA

SEQ ID NO: 112968 - protein, 10 aa, Homo Sapiens
MEEQVTKAEA

SEQ ID NO: 112969 - protein, 10 aa, Homo Sapiens
MEIQTTQPAA

SEQ ID NO: 112970 - protein, 10 aa, Homo Sapiens
MENNLSRVIA

SEQ ID NO: 112971 - protein, 10 aa, Homo Sapiens
MEQSPDMHNA

SEQ ID NO: 112972 - protein, 10 aa, Homo Sapiens
MESLDGLHLP

SEQ ID NO: 112973 - protein, 10 aa, Homo Sapiens
NEATGGKYVP

SEQ ID NO: 112974 - protein, 10 aa, Homo Sapiens
NEEEIRANVA

SEQ ID NO: 112975 - protein, 10 aa, Homo Sapiens
NEEKASDIAA

SEQ ID NO: 112976 - protein, 10 aa, Homo Sapiens
NEKEGFPITA

SEQ ID NO: 112977 - protein, 10 aa, Homo Sapiens
NEQMHQLVAA

SEQ ID NO: 112978 - protein, 10 aa, Homo Sapiens
NERFFGDSAA

SEQ ID NO: 112979 - protein, 10 aa, Homo Sapiens
NKGNEPPPPP

SEQ ID NO: 112980 - protein, 10 aa, Homo Sapiens
PGSSAVPAAA

SEQ ID NO: 112981 - protein, 10 aa, Homo Sapiens
PQEAGLPAGA

SEQ ID NO: 112982 - protein, 10 aa, Homo Sapiens
QAESPLGIRP

SEQ ID NO: 112983 - protein, 10 aa, Homo Sapiens
QEADDIVRVA

SEQ ID NO: 112984 - protein, 10 aa, Homo Sapiens
QEAEAPGAVA

SEQ ID NO: 112985 - protein, 10 aa, Homo Sapiens
QEARPPLVSA

SEQ ID NO: 112986 - protein, 10 aa, Homo Sapiens
QEARVFNETP

SEQ ID NO: 112987 - protein, 10 aa, Homo Sapiens
QEDAARLQAA

SEQ ID NO: 112988 - protein, 10 aa, Homo Sapiens
QEDPAKRPSA

SEQ ID NO: 112989 - protein, 10 aa, Homo Sapiens
QEEEPQKKLP

SEQ ID NO: 112990 - protein, 10 aa, Homo Sapiens
QEENFRLEAA

SEQ ID NO: 112991 - protein, 10 aa, Homo Sapiens
QEEPEARVPA

SEQ ID NO: 112992 - protein, 10 aa, Homo Sapiens
QENDKLGTVA

SEQ ID NO: 112993 - protein, 10 aa, Homo Sapiens
QENEHIYNLW

SEQ ID NO: 112994 - protein, 10 aa, Homo Sapiens
QENERLYNQV

SEQ ID NO: 112995 - protein, 10 aa, Homo Sapiens
QENLGSRIAA

SEQ ID NO: 112996 - protein, 10 aa, Homo Sapiens
QEPDSPLPPA

SEQ ID NO: 112997 - protein, 10 aa, Homo Sapiens
QEQEIEHHLA

SEQ ID NO: 112998 - protein, 10 aa, Homo Sapiens
QEQIEAIHKA

SEQ ID NO: 112999 - protein, 10 aa, Homo Sapiens
QEQVSRFLAA

SEQ ID NO: 113000 - protein, 10 aa, Homo Sapiens
QETAVAMHVA

SEQ ID NO: 113001 - protein, 10 aa, Homo Sapiens
QEYDALAKVI

SEQ ID NO: 113002 - protein, 10 aa, Homo Sapiens
QEYPDLIHIY

SEQ ID NO: 113003 - protein, 10 aa, Homo Sapiens
REAEFTKSIA

SEQ ID NO: 113004 - protein, 10 aa, Homo Sapiens
REIDDYIVQA

SEQ ID NO: 113005 - protein, 10 aa, Homo Sapiens
SEAAPLLVHV

SEQ ID NO: 113006 - protein, 10 aa, Homo Sapiens
SEADIRGFVA

SEQ ID NO: 113007 - protein, 10 aa, Homo Sapiens
SEAEFLARTA

SEQ ID NO: 113008 - protein, 10 aa, Homo Sapiens
SEAKPAAVAA

SEQ ID NO: 113009 - protein, 10 aa, Homo Sapiens
SEALPSDIAA

SEQ ID NO: 113010 - protein, 10 aa, Homo Sapiens
SEAPGQRALP

SEQ ID NO: 113011 - protein, 10 aa, Homo Sapiens
SEDEKQQYLP

SEQ ID NO: 113012 - protein, 10 aa, Homo Sapiens
SEEAPAAMTA

SEQ ID NO: 113013 - protein, 10 aa, Homo Sapiens
SEEDFQGITP

SEQ ID NO: 113014 - protein, 10 aa, Homo Sapiens
SEEEAFGILP

SEQ ID NO: 113015 - protein, 10 aa, Homo Sapiens
SEEKAMDISA

SEQ ID NO: 113016 - protein, 10 aa, Homo Sapiens
SEEQGARLAA

SEQ ID NO: 113017 - protein, 10 aa, Homo Sapiens
SEESARLVAA

SEQ ID NO: 113018 - protein, 10 aa, Homo Sapiens
SEESVGGRVA

SEQ ID NO: 113019 - protein, 10 aa, Homo Sapiens
SEGTFGIHVA

SEQ ID NO: 113020 - protein, 10 aa, Homo Sapiens
SEHCFDLIFA

SEQ ID NO: 113021 - protein, 10 aa, Homo Sapiens
SEHGLVVIAP

SEQ ID NO: 113022 - protein, 10 aa, Homo Sapiens
SEIESVKISA

SEQ ID NO: 113023 - protein, 10 aa, Homo Sapiens
SEPDGPGIAA

SEQ ID NO: 113024 - protein, 10 aa, Homo Sapiens
SEQGLAKAVA

SEQ ID NO: 113025 - protein, 10 aa, Homo Sapiens
SEQNGAKIVA

SEQ ID NO: 113026 - protein, 10 aa, Homo Sapiens
SEQPPNSVLP

SEQ ID NO: 113027 - protein, 10 aa, Homo Sapiens
SERKIEFDSA

SEQ ID NO: 113028 - protein, 10 aa, Homo Sapiens
SETGAGKHVP

SEQ ID NO: 113029 - protein, 10 aa, Homo Sapiens
SETKAWLIAA

SEQ ID NO: 113030 - protein, 10 aa, Homo Sapiens
SETSLIGTAA

SEQ ID NO: 113031 - protein, 10 aa, Homo Sapiens
SEYLSSHLEA

SEQ ID NO: 113032 - protein, 10 aa, Homo Sapiens
SQQQEAETPP

SEQ ID NO: 113033 - protein, 10 aa, Homo Sapiens
TEMDAKTVTA

SEQ ID NO: 113034 - protein, 10 aa, Homo Sapiens
VEQDFHLEIA

SEQ ID NO: 113035 - protein, 10 aa, Homo Sapiens
VEQWPYRAVA

SEQ ID NO: 113036 - protein, 11 aa, Homo Sapiens
AEAAAAPTVAP

SEQ ID NO: 113037 - protein, 11 aa, Homo Sapiens
AEAESAQTRVA

SEQ ID NO: 113038 - protein, 11 aa, Homo Sapiens
AEAGPLASVPA

SEQ ID NO: 113039 - protein, 11 aa, Homo Sapiens
AEAPHLVQVDA

SEQ ID NO: 113040 - protein, 11 aa, Homo Sapiens
AEAPSESKPAA

SEQ ID NO: 113041 - protein, 11 aa, Homo Sapiens
AEASASAAYKA

SEQ ID NO: 113042 - protein, 11 aa, Homo Sapiens
AEASYARDACA

SEQ ID NO: 113043 - protein, 11 aa, Homo Sapiens
AEDSGLHIIAA

SEQ ID NO: 113044 - protein, 11 aa, Homo Sapiens
AEDVLSGKVSA

SEQ ID NO: 113045 - protein, 11 aa, Homo Sapiens
AEEAARLSVAA

SEQ ID NO: 113046 - protein, 11 aa, Homo Sapiens
AEEAGAALRTA

SEQ ID NO: 113047 - protein, 11 aa, Homo Sapiens
AEEANSPDVTA

SEQ ID NO: 113048 - protein, 11 aa, Homo Sapiens
AEEAPYDAIHV

SEQ ID NO: 113049 - protein, 11 aa, Homo Sapiens
AEEDPAHAFEA

SEQ ID NO: 113050 - protein, 11 aa, Homo Sapiens
AEEEAATRIPA

SEQ ID NO: 113051 - protein, 11 aa, Homo Sapiens
AEEEAYKSELF

SEQ ID NO: 113052 - protein, 11 aa, Homo Sapiens
AEEEETSIKAA

SEQ ID NO: 113053 - protein, 11 aa, Homo Sapiens
AEEGTAKLIEF

SEQ ID NO: 113054 - protein, 11 aa, Homo Sapiens
AEEIAGKWLQA

SEQ ID NO: 113055 - protein, 11 aa, Homo Sapiens
AEEILEKGLKV

SEQ ID NO: 113056 - protein, 11 aa, Homo Sapiens
AEEKAAVTSLF

SEQ ID NO: 113057 - protein, 11 aa, Homo Sapiens
AEEKLTHKMEA

SEQ ID NO: 113058 - protein, 11 aa, Homo Sapiens
AEEQFILSQVA

SEQ ID NO: 113059 - protein, 11 aa, Homo Sapiens
AEEQPPFGVYA

SEQ ID NO: 113060 - protein, 11 aa, Homo Sapiens
AEERIEGRVAA

SEQ ID NO: 113061 - protein, 11 aa, Homo Sapiens
AEEVLLGVHAA

SEQ ID NO: 113062 - protein, 11 aa, Homo Sapiens
AEGRPTPTIEW

SEQ ID NO: 113063 - protein, 11 aa, Homo Sapiens
AEHDLWHIIKF

SEQ ID NO: 113064 - protein, 11 aa, Homo Sapiens
AEHDSILAEKA

SEQ ID NO: 113065 - protein, 11 aa, Homo Sapiens
AEHKHIEVIRM

SEQ ID NO: 113066 - protein, 11 aa, Homo Sapiens
AEIDEEPVSKA

SEQ ID NO: 113067 - protein, 11 aa, Homo Sapiens
AEIEYLEKTLP

SEQ ID NO: 113068 - protein, 11 aa, Homo Sapiens
AEILELAGNAA

SEQ ID NO: 113069 - protein, 11 aa, Homo Sapiens
AEILNGKEISA

SEQ ID NO: 113070 - protein, 11 aa, Homo Sapiens
AEIPAGPGREP

SEQ ID NO: 113071 - protein, 11 aa, Homo Sapiens
AEIRYEGILYT

SEQ ID NO: 113072 - protein, 11 aa, Homo Sapiens
AEIRYLVEKPK

SEQ ID NO: 113073 - protein, 11 aa, Homo Sapiens
AEIVLGNVQNA

SEQ ID NO: 113074 - protein, 11 aa, Homo Sapiens
AEKIASIGQTA

SEQ ID NO: 113075 - protein, 11 aa, Homo Sapiens
AEKRDPQELVA

SEQ ID NO: 113076 - protein, 11 aa, Homo Sapiens
AELNGKDGFIP

SEQ ID NO: 113077 - protein, 11 aa, Homo Sapiens
AELPAAAQPSA

SEQ ID NO: 113078 - protein, 11 aa, Homo Sapiens
AEMPADSGYPA

SEQ ID NO: 113079 - protein, 11 aa, Homo Sapiens
AEMVALVEQRA

SEQ ID NO: 113080 - protein, 11 aa, Homo Sapiens
AENEAETKLQA

SEQ ID NO: 113081 - protein, 11 aa, Homo Sapiens
AEPLEIILHLP

SEQ ID NO: 113082 - protein, 11 aa, Homo Sapiens
AEQDELSQRLA

SEQ ID NO: 113083 - protein, 11 aa, Homo Sapiens
AEQDRAYLEGL

SEQ ID NO: 113084 - protein, 11 aa, Homo Sapiens
AEQEPTAEQLA

SEQ ID NO: 113085 - protein, 11 aa, Homo Sapiens
AEQGKFALEVA

SEQ ID NO: 113086 - protein, 11 aa, Homo Sapiens
AEQLWHQDQVA

SEQ ID NO: 113087 - protein, 11 aa, Homo Sapiens
AERDLERAEVA

SEQ ID NO: 113088 - protein, 11 aa, Homo Sapiens
AESADIARAEV

SEQ ID NO: 113089 - protein, 11 aa, Homo Sapiens
AESASFAAVVA

SEQ ID NO: 113090 - protein, 11 aa, Homo Sapiens
AESGTPSLTAA

SEQ ID NO: 113091 - protein, 11 aa, Homo Sapiens
AESIHTGLEVA

SEQ ID NO: 113092 - protein, 11 aa, Homo Sapiens
AESWGTGRAVA

SEQ ID NO: 113093 - protein, 11 aa, Homo Sapiens
AETDKITLEVA

SEQ ID NO: 113094 - protein, 11 aa, Homo Sapiens
AEVGSDGERVA

SEQ ID NO: 113095 - protein, 11 aa, Homo Sapiens
AEYGEIKNIHL

SEQ ID NO: 113096 - protein, 11 aa, Homo Sapiens
CEYLIGQHVTA

SEQ ID NO: 113097 - protein, 11 aa, Homo Sapiens
EEAFHQGLISA

SEQ ID NO: 113098 - protein, 11 aa, Homo Sapiens
EEASGIPSRTA

SEQ ID NO: 113099 - protein, 11 aa, Homo Sapiens
EEDPQTSREIF

SEQ ID NO: 113100 - protein, 11 aa, Homo Sapiens
EEEGTGVVHQA

SEQ ID NO: 113101 - protein, 11 aa, Homo Sapiens
EEEKASKEFAA

SEQ ID NO: 113102 - protein, 11 aa, Homo Sapiens
EEELFPESERP

SEQ ID NO: 113103 - protein, 11 aa, Homo Sapiens
EEFDKFLEERA

SEQ ID NO: 113104 - protein, 11 aa, Homo Sapiens
EEMIETKGRAA

SEQ ID NO: 113105 - protein, 11 aa, Homo Sapiens
EENASQSTVKV

SEQ ID NO: 113106 - protein, 11 aa, Homo Sapiens
EENQSVVVDFL

SEQ ID NO: 113107 - protein, 11 aa, Homo Sapiens
EEQVSGAKVIA

SEQ ID NO: 113108 - protein, 11 aa, Homo Sapiens
EESLNIVKYTA

SEQ ID NO: 113109 - protein, 11 aa, Homo Sapiens
HENEALWREVA

SEQ ID NO: 113110 - protein, 11 aa, Homo Sapiens
KEATYGERVVA

SEQ ID NO: 113111 - protein, 11 aa, Homo Sapiens
KEIENTYANVA

SEQ ID NO: 113112 - protein, 11 aa, Homo Sapiens
KEIEYVETVTS

SEQ ID NO: 113113 - protein, 11 aa, Homo Sapiens
KVQALEEANND

SEQ ID NO: 113114 - protein, 11 aa, Homo Sapiens
LAGPPFGAEAA

SEQ ID NO: 113115 - protein, 11 aa, Homo Sapiens
LEMLTGQERVA

SEQ ID NO: 113116 - protein, 11 aa, Homo Sapiens
LEQYPTRPHIA

SEQ ID NO: 113117 - protein, 11 aa, Homo Sapiens
MDAAAAALPAA

SEQ ID NO: 113118 - protein, 11 aa, Homo Sapiens
MEEMHQVAIAA

SEQ ID NO: 113119 - protein, 11 aa, Homo Sapiens
MEEMYKKAHAA

SEQ ID NO: 113120 - protein, 11 aa, Homo Sapiens
MEIEEEKKRTA

SEQ ID NO: 113121 - protein, 11 aa, Homo Sapiens
MEQQTISIAKA

SEQ ID NO: 113122 - protein, 11 aa, Homo Sapiens
NEQQSVLQRIA

SEQ ID NO: 113123 - protein, 11 aa, Homo Sapiens
PSTPSATVHTP

SEQ ID NO: 113124 - protein, 11 aa, Homo Sapiens
QEATASKVIVA

SEQ ID NO: 113125 - protein, 11 aa, Homo Sapiens
QEELDTLFTTA

SEQ ID NO: 113126 - protein, 11 aa, Homo Sapiens
QEQAQTTDWRA

SEQ ID NO: 113127 - protein, 11 aa, Homo Sapiens
QEQEKQQKVEF

SEQ ID NO: 113128 - protein, 11 aa, Homo Sapiens
QEQRLQGEVVA

SEQ ID NO: 113129 - protein, 11 aa, Homo Sapiens
QEYLSGRSILA

SEQ ID NO: 113130 - protein, 11 aa, Homo Sapiens
REAPHLEKQPA

SEQ ID NO: 113131 - protein, 11 aa, Homo Sapiens
REEEEKLLHLA

SEQ ID NO: 113132 - protein, 11 aa, Homo Sapiens
RENEYLTLQVP

SEQ ID NO: 113133 - protein, 11 aa, Homo Sapiens
REYALNVGTIA

SEQ ID NO: 113134 - protein, 11 aa, Homo Sapiens
SCTNTTSSSSE

SEQ ID NO: 113135 - protein, 11 aa, Homo Sapiens
SEAFLGGHSVA

SEQ ID NO: 113136 - protein, 11 aa, Homo Sapiens
SEAPPTNQATA

SEQ ID NO: 113137 - protein, 11 aa, Homo Sapiens
SECEQLVKEVA

SEQ ID NO: 113138 - protein, 11 aa, Homo Sapiens
SEEDRVVVIRF

SEQ ID NO: 113139 - protein, 11 aa, Homo Sapiens
SEEEFERIHQA

SEQ ID NO: 113140 - protein, 11 aa, Homo Sapiens
SEEMYVPRVVT

SEQ ID NO: 113141 - protein, 11 aa, Homo Sapiens
SEEQYNKIVIP

SEQ ID NO: 113142 - protein, 11 aa, Homo Sapiens
SEHKLSTDHIP

SEQ ID NO: 113143 - protein, 11 aa, Homo Sapiens
SEHTGPGWESA

SEQ ID NO: 113144 - protein, 11 aa, Homo Sapiens
SEIDESVKLIP

SEQ ID NO: 113145 - protein, 11 aa, Homo Sapiens
SELELSAHNAA

SEQ ID NO: 113146 - protein, 11 aa, Homo Sapiens
SEMRYGIEILP

SEQ ID NO: 113147 - protein, 11 aa, Homo Sapiens
SEQLDLPVRQA

SEQ ID NO: 113148 - protein, 11 aa, Homo Sapiens
SEQTEALIHRA

SEQ ID NO: 113149 - protein, 11 aa, Homo Sapiens
SESSTILVVRY

SEQ ID NO: 113150 - protein, 11 aa, Homo Sapiens
TEDPHTVLVEF

SEQ ID NO: 113151 - protein, 11 aa, Homo Sapiens
VEKLFAEDTEA

SEQ ID NO: 113152 - protein, 11 aa, Homo Sapiens
VESGDLQKEIA

SEQ ID NO: 113153 - protein, 11 aa, Homo Sapiens
YEAGHLSFYSA

SEQ ID NO: 113154 - protein, 8 aa, Homo Sapiens
AKAPFAAH

SEQ ID NO: 113155 - protein, 8 aa, Homo Sapiens
AKDYTKAL

SEQ ID NO: 113156 - protein, 8 aa, Homo Sapiens
AKSGTKAF

SEQ ID NO: 113157 - protein, 8 aa, Homo Sapiens
ALATWLSF

SEQ ID NO: 113158 - protein, 8 aa, Homo Sapiens
AQMLQMEY

SEQ ID NO: 113159 - protein, 8 aa, Homo Sapiens
ASNIGISH

SEQ ID NO: 113160 - protein, 8 aa, Homo Sapiens
ASNIWAAY

SEQ ID NO: 113161 - protein, 8 aa, Homo Sapiens
ATAVWHAY

SEQ ID NO: 113162 - protein, 8 aa, Homo Sapiens
CAKHGIEY

SEQ ID NO: 113163 - protein, 8 aa, Homo Sapiens
EEQLQQIR

SEQ ID NO: 113164 - protein, 8 aa, Homo Sapiens
FAHWGQEL

SEQ ID NO: 113165 - protein, 8 aa, Homo Sapiens
FAMNGKSF

SEQ ID NO: 113166 - protein, 8 aa, Homo Sapiens
FAWLYQEY

SEQ ID NO: 113167 - protein, 8 aa, Homo Sapiens
FFKDGLEM

SEQ ID NO: 113168 - protein, 8 aa, Homo Sapiens
FIHISTAY

SEQ ID NO: 113169 - protein, 8 aa, Homo Sapiens
FLFVASEF

SEQ ID NO: 113170 - protein, 8 aa, Homo Sapiens
FLKENSEY

SEQ ID NO: 113171 - protein, 8 aa, Homo Sapiens
FLLQIKDR

SEQ ID NO: 113172 - protein, 8 aa, Homo Sapiens
FLQEWEVY

SEQ ID NO: 113173 - protein, 8 aa, Homo Sapiens
FMHVSTAY

SEQ ID NO: 113174 - protein, 8 aa, Homo Sapiens
FMNNWEVY

SEQ ID NO: 113175 - protein, 8 aa, Homo Sapiens
FQHVGKAF

SEQ ID NO: 113176 - protein, 8 aa, Homo Sapiens
FSHNGMAL

SEQ ID NO: 113177 - protein, 8 aa, Homo Sapiens
FSKDWSFY

SEQ ID NO: 113178 - protein, 8 aa, Homo Sapiens
FSKVGREL

SEQ ID NO: 113179 - protein, 8 aa, Homo Sapiens
FSNLWKSY

SEQ ID NO: 113180 - protein, 8 aa, Homo Sapiens
FTMVGKTF

SEQ ID NO: 113181 - protein, 8 aa, Homo Sapiens
FTNEAREM

SEQ ID NO: 113182 - protein, 8 aa, Homo Sapiens
GFKVGINY

SEQ ID NO: 113183 - protein, 8 aa, Homo Sapiens
GKAPGTPH

SEQ ID NO: 113184 - protein, 8 aa, Homo Sapiens
HGTNWVEY

SEQ ID NO: 113185 - protein, 8 aa, Homo Sapiens
HQFLQNEY

SEQ ID NO: 113186 - protein, 8 aa, Homo Sapiens
IAHVLPAL

SEQ ID NO: 113187 - protein, 8 aa, Homo Sapiens
IANTARAY

SEQ ID NO: 113188 - protein, 8 aa, Homo Sapiens
ILAHWACY

SEQ ID NO: 113189 - protein, 8 aa, Homo Sapiens
ILNTWISL

SEQ ID NO: 113190 - protein, 8 aa, Homo Sapiens
IQTAVTSY

SEQ ID NO: 113191 - protein, 8 aa, Homo Sapiens
IRDGVRAY

SEQ ID NO: 113192 - protein, 8 aa, Homo Sapiens
ISHEGHVY

SEQ ID NO: 113193 - protein, 8 aa, Homo Sapiens
LAFVSPSL

SEQ ID NO: 113194 - protein, 8 aa, Homo Sapiens
LAKVGIAL

SEQ ID NO: 113195 - protein, 8 aa, Homo Sapiens
LAMVGSAM

SEQ ID NO: 113196 - protein, 8 aa, Homo Sapiens
LIKKDVNY

SEQ ID NO: 113197 - protein, 8 aa, Homo Sapiens
LQNSWESY

SEQ ID NO: 113198 - protein, 8 aa, Homo Sapiens
LSGVWVAY

SEQ ID NO: 113199 - protein, 8 aa, Homo Sapiens
LSHLQNEY

SEQ ID NO: 113200 - protein, 8 aa, Homo Sapiens
LSKVSPSF

SEQ ID NO: 113201 - protein, 8 aa, Homo Sapiens
LSQLWKEY

SEQ ID NO: 113202 - protein, 8 aa, Homo Sapiens
LSRETIEY

SEQ ID NO: 113203 - protein, 8 aa, Homo Sapiens
LTRELPSF

SEQ ID NO: 113204 - protein, 8 aa, Homo Sapiens
MKDFNHSY

SEQ ID NO: 113205 - protein, 8 aa, Homo Sapiens
MKKIRESY

SEQ ID NO: 113206 - protein, 8 aa, Homo Sapiens
MSMTGVSF

SEQ ID NO: 113207 - protein, 8 aa, Homo Sapiens
RATQIPSY

SEQ ID NO: 113208 - protein, 8 aa, Homo Sapiens
SQRVWAEY

SEQ ID NO: 113209 - protein, 8 aa, Homo Sapiens
TAWRWPEF

SEQ ID NO: 113210 - protein, 8 aa, Homo Sapiens
TEELAYLK

SEQ ID NO: 113211 - protein, 8 aa, Homo Sapiens
TGHVGTVY

SEQ ID NO: 113212 - protein, 8 aa, Homo Sapiens
TLHNWLSF

SEQ ID NO: 113213 - protein, 8 aa, Homo Sapiens
TMAQWTRY

SEQ ID NO: 113214 - protein, 8 aa, Homo Sapiens
TQNHWFTY

SEQ ID NO: 113215 - protein, 8 aa, Homo Sapiens
TSGHWQHY

SEQ ID NO: 113216 - protein, 8 aa, Homo Sapiens
VAHLWQEF

SEQ ID NO: 113217 - protein, 8 aa, Homo Sapiens
VAKVGVSM

SEQ ID NO: 113218 - protein, 8 aa, Homo Sapiens
VAYEAPSL

SEQ ID NO: 113219 - protein, 8 aa, Homo Sapiens
VGNKWEAY

SEQ ID NO: 113220 - protein, 8 aa, Homo Sapiens
VGNVWRQY

SEQ ID NO: 113221 - protein, 8 aa, Homo Sapiens
VINNSTSY

SEQ ID NO: 113222 - protein, 8 aa, Homo Sapiens
VLKEGSEY

SEQ ID NO: 113223 - protein, 8 aa, Homo Sapiens
VLKEGVEY

SEQ ID NO: 113224 - protein, 8 aa, Homo Sapiens
VLNCGIAY

SEQ ID NO: 113225 - protein, 8 aa, Homo Sapiens
VLRVAAEF

SEQ ID NO: 113226 - protein, 8 aa, Homo Sapiens
VMRLTISY

SEQ ID NO: 113227 - protein, 8 aa, Homo Sapiens
VQALWKQF

SEQ ID NO: 113228 - protein, 8 aa, Homo Sapiens
VQQVAAEY

SEQ ID NO: 113229 - protein, 8 aa, Homo Sapiens
VQQVQHVY

SEQ ID NO: 113230 - protein, 8 aa, Homo Sapiens
VRDMIREV

SEQ ID NO: 113231 - protein, 8 aa, Homo Sapiens
VSKEWIAY

SEQ ID NO: 113232 - protein, 8 aa, Homo Sapiens
VSQVGKEL

SEQ ID NO: 113233 - protein, 8 aa, Homo Sapiens
YAQQWNQY

SEQ ID NO: 113234 - protein, 8 aa, Homo Sapiens
YFMVGTAF

SEQ ID NO: 113235 - protein, 8 aa, Homo Sapiens
YIHVGAQL

SEQ ID NO: 113236 - protein, 8 aa, Homo Sapiens
YLYVAPAY

SEQ ID NO: 113237 - protein, 8 aa, Homo Sapiens
YSAAWAEY

SEQ ID NO: 113238 - protein, 8 aa, Homo Sapiens
YSGHYIAH

SEQ ID NO: 113239 - protein, 8 aa, Homo Sapiens
YSHIYSSY

SEQ ID NO: 113240 - protein, 9 aa, Homo Sapiens
AAAAAAAAY

SEQ ID NO: 113241 - protein, 9 aa, Homo Sapiens
AAAAPRAVA

SEQ ID NO: 113242 - protein, 9 aa, Homo Sapiens
AAAGGLHEF

SEQ ID NO: 113243 - protein, 9 aa, Homo Sapiens
AAAGPGAAL

SEQ ID NO: 113244 - protein, 9 aa, Homo Sapiens
AAANPTLAF

SEQ ID NO: 113245 - protein, 9 aa, Homo Sapiens
AAAPAGTTF

SEQ ID NO: 113246 - protein, 9 aa, Homo Sapiens
AAARPKSAF

SEQ ID NO: 113247 - protein, 9 aa, Homo Sapiens
AAATGLHPA

SEQ ID NO: 113248 - protein, 9 aa, Homo Sapiens
AAATRTTSF

SEQ ID NO: 113249 - protein, 9 aa, Homo Sapiens
AAAVPRAAF

SEQ ID NO: 113250 - protein, 9 aa, Homo Sapiens
AAAVPTRSY

SEQ ID NO: 113251 - protein, 9 aa, Homo Sapiens
AAFADALEF

SEQ ID NO: 113252 - protein, 9 aa, Homo Sapiens
AAFPGASLY

SEQ ID NO: 113253 - protein, 9 aa, Homo Sapiens
AAGEPGTSM

SEQ ID NO: 113254 - protein, 9 aa, Homo Sapiens
AAHLPTQPH

SEQ ID NO: 113255 - protein, 9 aa, Homo Sapiens
AAHTVTAAY

SEQ ID NO: 113256 - protein, 9 aa, Homo Sapiens
AAHVAGAAY

SEQ ID NO: 113257 - protein, 9 aa, Homo Sapiens
AAIDIYTDM

SEQ ID NO: 113258 - protein, 9 aa, Homo Sapiens
AAIDPRVQY

SEQ ID NO: 113259 - protein, 9 aa, Homo Sapiens
AAIKINKPQ

SEQ ID NO: 113260 - protein, 9 aa, Homo Sapiens
AAIKPGTPL

SEQ ID NO: 113261 - protein, 9 aa, Homo Sapiens
AAIQDIAAF

SEQ ID NO: 113262 - protein, 9 aa, Homo Sapiens
AAIWQYESL

SEQ ID NO: 113263 - protein, 9 aa, Homo Sapiens
AAKAAGVSF

SEQ ID NO: 113264 - protein, 9 aa, Homo Sapiens
AAKAGLLAL

SEQ ID NO: 113265 - protein, 9 aa, Homo Sapiens
AAKDKLSEL

SEQ ID NO: 113266 - protein, 9 aa, Homo Sapiens
AAKDKLTEL

SEQ ID NO: 113267 - protein, 9 aa, Homo Sapiens
AAKDKYREL

SEQ ID NO: 113268 - protein, 9 aa, Homo Sapiens
AAKDYNQKL

SEQ ID NO: 113269 - protein, 9 aa, Homo Sapiens
AAKFKTPEL

SEQ ID NO: 113270 - protein, 9 aa, Homo Sapiens
AAKGVNKEF

SEQ ID NO: 113271 - protein, 9 aa, Homo Sapiens
AAKPEMAAL

SEQ ID NO: 113272 - protein, 9 aa, Homo Sapiens
AAKPHNPGF

SEQ ID NO: 113273 - protein, 9 aa, Homo Sapiens
AAKPPPLSA

SEQ ID NO: 113274 - protein, 9 aa, Homo Sapiens
AAKQINIDF

SEQ ID NO: 113275 - protein, 9 aa, Homo Sapiens
AAMPRPVSY

SEQ ID NO: 113276 - protein, 9 aa, Homo Sapiens
AAMVTAVAY

SEQ ID NO: 113277 - protein, 9 aa, Homo Sapiens
AANPHSFVF

SEQ ID NO: 113278 - protein, 9 aa, Homo Sapiens
AAPAYSRAL

SEQ ID NO: 113279 - protein, 9 aa, Homo Sapiens
AAPGPSAAF

SEQ ID NO: 113280 - protein, 9 aa, Homo Sapiens
AAPIRLLAA

SEQ ID NO: 113281 - protein, 9 aa, Homo Sapiens
AAQEGAVAF

SEQ ID NO: 113282 - protein, 9 aa, Homo Sapiens
AAQTVGNTY

SEQ ID NO: 113283 - protein, 9 aa, Homo Sapiens
AARAALRVY

SEQ ID NO: 113284 - protein, 9 aa, Homo Sapiens
AARDFLQTF

SEQ ID NO: 113285 - protein, 9 aa, Homo Sapiens
AAREHVLAY

SEQ ID NO: 113286 - protein, 9 aa, Homo Sapiens
AARFVSTPF

SEQ ID NO: 113287 - protein, 9 aa, Homo Sapiens
AARPATSTL

SEQ ID NO: 113288 - protein, 9 aa, Homo Sapiens
AARSGPLAM

SEQ ID NO: 113289 - protein, 9 aa, Homo Sapiens
AARVIIEKY

SEQ ID NO: 113290 - protein, 9 aa, Homo Sapiens
AARVPGVEH

SEQ ID NO: 113291 - protein, 9 aa, Homo Sapiens
AASPVVAEY

SEQ ID NO: 113292 - protein, 9 aa, Homo Sapiens
AAVAPGHPL

SEQ ID NO: 113293 - protein, 9 aa, Homo Sapiens
AAVDAGMAM

SEQ ID NO: 113294 - protein, 9 aa, Homo Sapiens
AAVDRTTEL

SEQ ID NO: 113295 - protein, 9 aa, Homo Sapiens
AAVGTGSSY

SEQ ID NO: 113296 - protein, 9 aa, Homo Sapiens
AAVPEVAVY

SEQ ID NO: 113297 - protein, 9 aa, Homo Sapiens
AFRPQLPAY

SEQ ID NO: 113298 - protein, 9 aa, Homo Sapiens
AGAPPGTAY

SEQ ID NO: 113299 - protein, 9 aa, Homo Sapiens
AGFASRQPY

SEQ ID NO: 113300 - protein, 9 aa, Homo Sapiens
AGHPAFVNY

SEQ ID NO: 113301 - protein, 9 aa, Homo Sapiens
AGIFPRLSF

SEQ ID NO: 113302 - protein, 9 aa, Homo Sapiens
AGMPITEVF

SEQ ID NO: 113303 - protein, 9 aa, Homo Sapiens
AGPMPGSSY

SEQ ID NO: 113304 - protein, 9 aa, Homo Sapiens
AGRLLLENY

SEQ ID NO: 113305 - protein, 9 aa, Homo Sapiens
AIFPNGAAY

SEQ ID NO: 113306 - protein, 9 aa, Homo Sapiens
AIIDILTHY

SEQ ID NO: 113307 - protein, 9 aa, Homo Sapiens
AIIDTVINY

SEQ ID NO: 113308 - protein, 9 aa, Homo Sapiens
AIIDYLTDH

SEQ ID NO: 113309 - protein, 9 aa, Homo Sapiens
AIIEEYLHL

SEQ ID NO: 113310 - protein, 9 aa, Homo Sapiens
AIIERLKEH

SEQ ID NO: 113311 - protein, 9 aa, Homo Sapiens
AIIERTASF

SEQ ID NO: 113312 - protein, 9 aa, Homo Sapiens
AIIHGLSSL

SEQ ID NO: 113313 - protein, 9 aa, Homo Sapiens
AIIPSHLAY

SEQ ID NO: 113314 - protein, 9 aa, Homo Sapiens
AIITPQTCY

SEQ ID NO: 113315 - protein, 9 aa, Homo Sapiens
AIKDKQVKY

SEQ ID NO: 113316 - protein, 9 aa, Homo Sapiens
AIKPTSKEF

SEQ ID NO: 113317 - protein, 9 aa, Homo Sapiens
AIKQDAQSL

SEQ ID NO: 113318 - protein, 9 aa, Homo Sapiens
AIMGNSSEF

SEQ ID NO: 113319 - protein, 9 aa, Homo Sapiens
AIRDGVIEA

SEQ ID NO: 113320 - protein, 9 aa, Homo Sapiens
AIRQQIESY

SEQ ID NO: 113321 - protein, 9 aa, Homo Sapiens
AIVHAVHAY

SEQ ID NO: 113322 - protein, 9 aa, Homo Sapiens
AIYGGSASY

SEQ ID NO: 113323 - protein, 9 aa, Homo Sapiens
ALAGPAAAL

SEQ ID NO: 113324 - protein, 9 aa, Homo Sapiens
ALAPAGFSY

SEQ ID NO: 113325 - protein, 9 aa, Homo Sapiens
ALAVIITSY

SEQ ID NO: 113326 - protein, 9 aa, Homo Sapiens
ALIPYWTVY

SEQ ID NO: 113327 - protein, 9 aa, Homo Sapiens
ALISDYKEY

SEQ ID NO: 113328 - protein, 9 aa, Homo Sapiens
ALKECLTAY

SEQ ID NO: 113329 - protein, 9 aa, Homo Sapiens
ALKNPSEEY

SEQ ID NO: 113330 - protein, 9 aa, Homo Sapiens
ALKNVTVSF

SEQ ID NO: 113331 - protein, 9 aa, Homo Sapiens
ALKPGLSAY

SEQ ID NO: 113332 - protein, 9 aa, Homo Sapiens
ALKPPYSAF

SEQ ID NO: 113333 - protein, 9 aa, Homo Sapiens
ALNTIVTVY

SEQ ID NO: 113334 - protein, 9 aa, Homo Sapiens
ALNVDLTEF

SEQ ID NO: 113335 - protein, 9 aa, Homo Sapiens
ALQDLLSEY

SEQ ID NO: 113336 - protein, 9 aa, Homo Sapiens
ALQEACEAY

SEQ ID NO: 113337 - protein, 9 aa, Homo Sapiens
ALQEASEAY

SEQ ID NO: 113338 - protein, 9 aa, Homo Sapiens
ALVPSVWLY

SEQ ID NO: 113339 - protein, 9 aa, Homo Sapiens
AMKETFKSY

SEQ ID NO: 113340 - protein, 9 aa, Homo Sapiens
AMKKVFRVY

SEQ ID NO: 113341 - protein, 9 aa, Homo Sapiens
AMKSKLPVL

SEQ ID NO: 113342 - protein, 9 aa, Homo Sapiens
AMNPTNTVF

SEQ ID NO: 113343 - protein, 9 aa, Homo Sapiens
AMRPGLEGY

SEQ ID NO: 113344 - protein, 9 aa, Homo Sapiens
AMYPIRSAY

SEQ ID NO: 113345 - protein, 9 aa, Homo Sapiens
AQAEVYKEL

SEQ ID NO: 113346 - protein, 9 aa, Homo Sapiens
AQKNHIPVF

SEQ ID NO: 113347 - protein, 9 aa, Homo Sapiens
ASICVTQAF

SEQ ID NO: 113348 - protein, 9 aa, Homo Sapiens
ASIPYFHAM

SEQ ID NO: 113349 - protein, 9 aa, Homo Sapiens
ASISNISPH

SEQ ID NO: 113350 - protein, 9 aa, Homo Sapiens
ATAAAAAAY

SEQ ID NO: 113351 - protein, 9 aa, Homo Sapiens
ATAQPPAPL

SEQ ID NO: 113352 - protein, 9 aa, Homo Sapiens
AVAAGTPAP

SEQ ID NO: 113353 - protein, 9 aa, Homo Sapiens
AVAPPGCSH

SEQ ID NO: 113354 - protein, 9 aa, Homo Sapiens
AVHDITVAY

SEQ ID NO: 113355 - protein, 9 aa, Homo Sapiens
AVIAPKSSY

SEQ ID NO: 113356 - protein, 9 aa, Homo Sapiens
AVIEDTWHY

SEQ ID NO: 113357 - protein, 9 aa, Homo Sapiens
AVIKSNHSY

SEQ ID NO: 113358 - protein, 9 aa, Homo Sapiens
AVKVSPVSY

SEQ ID NO: 113359 - protein, 9 aa, Homo Sapiens
AVNALQSVY

SEQ ID NO: 113360 - protein, 9 aa, Homo Sapiens
AVNGHTNSF

SEQ ID NO: 113361 - protein, 9 aa, Homo Sapiens
AVRDGLRAV

SEQ ID NO: 113362 - protein, 9 aa, Homo Sapiens
AVRENIEEF

SEQ ID NO: 113363 - protein, 9 aa, Homo Sapiens
AVRPGLPAY

SEQ ID NO: 113364 - protein, 9 aa, Homo Sapiens
AVRSGIVEY

SEQ ID NO: 113365 - protein, 9 aa, Homo Sapiens
AVVPKTKEV

SEQ ID NO: 113366 - protein, 9 aa, Homo Sapiens
AYFPYFITY

SEQ ID NO: 113367 - protein, 9 aa, Homo Sapiens
AYSGHYIAH

SEQ ID NO: 113368 - protein, 9 aa, Homo Sapiens
CAADIKSAY

SEQ ID NO: 113369 - protein, 9 aa, Homo Sapiens
CAIAQAESL

SEQ ID NO: 113370 - protein, 9 aa, Homo Sapiens
CPMRNTPEY

SEQ ID NO: 113371 - protein, 9 aa, Homo Sapiens
CSHAAVSAY

SEQ ID NO: 113372 - protein, 9 aa, Homo Sapiens
CVKPDVHVY

SEQ ID NO: 113373 - protein, 9 aa, Homo Sapiens
FAADIISVL

SEQ ID NO: 113374 - protein, 9 aa, Homo Sapiens
FAAHLRCTY

SEQ ID NO: 113375 - protein, 9 aa, Homo Sapiens
FAANVYEAF

SEQ ID NO: 113376 - protein, 9 aa, Homo Sapiens
FAAVAAAAY

SEQ ID NO: 113377 - protein, 9 aa, Homo Sapiens
FACEKNENL

SEQ ID NO: 113378 - protein, 9 aa, Homo Sapiens
FAFDPSVNY

SEQ ID NO: 113379 - protein, 9 aa, Homo Sapiens
FAFEHSEEY

SEQ ID NO: 113380 - protein, 9 aa, Homo Sapiens
FAFLTGVGL

SEQ ID NO: 113381 - protein, 9 aa, Homo Sapiens
FAFVTDNTY

SEQ ID NO: 113382 - protein, 9 aa, Homo Sapiens
FAHASGMQY

SEQ ID NO: 113383 - protein, 9 aa, Homo Sapiens
FAHEVGHNF

SEQ ID NO: 113384 - protein, 9 aa, Homo Sapiens
FAHHASCHF

SEQ ID NO: 113385 - protein, 9 aa, Homo Sapiens
FAHLINVEF

SEQ ID NO: 113386 - protein, 9 aa, Homo Sapiens
FAHLPKSTF

SEQ ID NO: 113387 - protein, 9 aa, Homo Sapiens
FAIQRTTNF

SEQ ID NO: 113388 - protein, 9 aa, Homo Sapiens
FAKDFMTYL

SEQ ID NO: 113389 - protein, 9 aa, Homo Sapiens
FAKELQRSF

SEQ ID NO: 113390 - protein, 9 aa, Homo Sapiens
FAKEVSHEM

SEQ ID NO: 113391 - protein, 9 aa, Homo Sapiens
FAKKTFISY

SEQ ID NO: 113392 - protein, 9 aa, Homo Sapiens
FAKPENIDL

SEQ ID NO: 113393 - protein, 9 aa, Homo Sapiens
FAKPFLASL

SEQ ID NO: 113394 - protein, 9 aa, Homo Sapiens
FANIDQETY

SEQ ID NO: 113395 - protein, 9 aa, Homo Sapiens
FANLPNQVY

SEQ ID NO: 113396 - protein, 9 aa, Homo Sapiens
FAQEALTVL

SEQ ID NO: 113397 - protein, 9 aa, Homo Sapiens
FASIPGLEF

SEQ ID NO: 113398 - protein, 9 aa, Homo Sapiens
FATFPSSAF

SEQ ID NO: 113399 - protein, 9 aa, Homo Sapiens
FATPPSSTY

SEQ ID NO: 113400 - protein, 9 aa, Homo Sapiens
FAVPENSSV

SEQ ID NO: 113401 - protein, 9 aa, Homo Sapiens
FAYHYPYTY

SEQ ID NO: 113402 - protein, 9 aa, Homo Sapiens
FGHTSIVAY

SEQ ID NO: 113403 - protein, 9 aa, Homo Sapiens
FGKAPGTPH

SEQ ID NO: 113404 - protein, 9 aa, Homo Sapiens
FIAPGYSMI

SEQ ID NO: 113405 - protein, 9 aa, Homo Sapiens
FIIQGLRSV

SEQ ID NO: 113406 - protein, 9 aa, Homo Sapiens
FIISRTQAL

SEQ ID NO: 113407 - protein, 9 aa, Homo Sapiens
FIKDGSSTY

SEQ ID NO: 113408 - protein, 9 aa, Homo Sapiens
FIKDRILVY

SEQ ID NO: 113409 - protein, 9 aa, Homo Sapiens
FIKEGNAEM

SEQ ID NO: 113410 - protein, 9 aa, Homo Sapiens
FIMDRAQAL

SEQ ID NO: 113411 - protein, 9 aa, Homo Sapiens
FIMGKTIEF

SEQ ID NO: 113412 - protein, 9 aa, Homo Sapiens
FINGDISSL

SEQ ID NO: 113413 - protein, 9 aa, Homo Sapiens
FINYVKNCF

SEQ ID NO: 113414 - protein, 9 aa, Homo Sapiens
FIRPWCTSL

SEQ ID NO: 113415 - protein, 9 aa, Homo Sapiens
FIRVVGSEF

SEQ ID NO: 113416 - protein, 9 aa, Homo Sapiens
FLAPLVTEY

SEQ ID NO: 113417 - protein, 9 aa, Homo Sapiens
FLHESLVEY

SEQ ID NO: 113418 - protein, 9 aa, Homo Sapiens
FLIDKVNAF

SEQ ID NO: 113419 - protein, 9 aa, Homo Sapiens
FLIDRSPEY

SEQ ID NO: 113420 - protein, 9 aa, Homo Sapiens
FLKEIVETF

SEQ ID NO: 113421 - protein, 9 aa, Homo Sapiens
FLKEVVETF

SEQ ID NO: 113422 - protein, 9 aa, Homo Sapiens
FLNKASAVY

SEQ ID NO: 113423 - protein, 9 aa, Homo Sapiens
FLPQAWLAY

SEQ ID NO: 113424 - protein, 9 aa, Homo Sapiens
FLRDHLRCL

SEQ ID NO: 113425 - protein, 9 aa, Homo Sapiens
FLRDKIASY

SEQ ID NO: 113426 - protein, 9 aa, Homo Sapiens
FLRHMILAY

SEQ ID NO: 113427 - protein, 9 aa, Homo Sapiens
FMAQALQEY

SEQ ID NO: 113428 - protein, 9 aa, Homo Sapiens
FMKEVGSHF

SEQ ID NO: 113429 - protein, 9 aa, Homo Sapiens
FMKRDLTEF

SEQ ID NO: 113430 - protein, 9 aa, Homo Sapiens
FMPHVTEAY

SEQ ID NO: 113431 - protein, 9 aa, Homo Sapiens
FNKNKFVEY

SEQ ID NO: 113432 - protein, 9 aa, Homo Sapiens
FQAPTAKEM

SEQ ID NO: 113433 - protein, 9 aa, Homo Sapiens
FQMGPTQAY

SEQ ID NO: 113434 - protein, 9 aa, Homo Sapiens
FQNKIHVSY

SEQ ID NO: 113435 - protein, 9 aa, Homo Sapiens
FQNVQQVEY

SEQ ID NO: 113436 - protein, 9 aa, Homo Sapiens
FQRNIKKEY

SEQ ID NO: 113437 - protein, 9 aa, Homo Sapiens
FQYESKVFY

SEQ ID NO: 113438 - protein, 9 aa, Homo Sapiens
FSAPLFLSH

SEQ ID NO: 113439 - protein, 9 aa, Homo Sapiens
FSAPPGSEL

SEQ ID NO: 113440 - protein, 9 aa, Homo Sapiens
FSHRIYVAY

SEQ ID NO: 113441 - protein, 9 aa, Homo Sapiens
FSKDIVENY

SEQ ID NO: 113442 - protein, 9 aa, Homo Sapiens
FSKDKLVAL

SEQ ID NO: 113443 - protein, 9 aa, Homo Sapiens
FSKLVGSAF

SEQ ID NO: 113444 - protein, 9 aa, Homo Sapiens
FSNFWYHSY

SEQ ID NO: 113445 - protein, 9 aa, Homo Sapiens
FSNPYSIEY

SEQ ID NO: 113446 - protein, 9 aa, Homo Sapiens
FSRGGMISF

SEQ ID NO: 113447 - protein, 9 aa, Homo Sapiens
FSRSSRQEY

SEQ ID NO: 113448 - protein, 9 aa, Homo Sapiens
FSYQHAIEE

SEQ ID NO: 113449 - protein, 9 aa, Homo Sapiens
FTHLSLQEF

SEQ ID NO: 113450 - protein, 9 aa, Homo Sapiens
FTITKTVEY

SEQ ID NO: 113451 - protein, 9 aa, Homo Sapiens
FTRSINITH

SEQ ID NO: 113452 - protein, 9 aa, Homo Sapiens
FTVPHTHVF

SEQ ID NO: 113453 - protein, 9 aa, Homo Sapiens
FVKDSGACF

SEQ ID NO: 113454 - protein, 9 aa, Homo Sapiens
FVKGQFHEY

SEQ ID NO: 113455 - protein, 9 aa, Homo Sapiens
FVNPHVSSF

SEQ ID NO: 113456 - protein, 9 aa, Homo Sapiens
FVRDMIREV

SEQ ID NO: 113457 - protein, 9 aa, Homo Sapiens
GAIEQYNAL

SEQ ID NO: 113458 - protein, 9 aa, Homo Sapiens
GAITKYSAL

SEQ ID NO: 113459 - protein, 9 aa, Homo Sapiens
GAVTKTHVM

SEQ ID NO: 113460 - protein, 9 aa, Homo Sapiens
GGPGGVGGL

SEQ ID NO: 113461 - protein, 9 aa, Homo Sapiens
GGVTGLSQY

SEQ ID NO: 113462 - protein, 9 aa, Homo Sapiens
GIFGKGSAY

SEQ ID NO: 113463 - protein, 9 aa, Homo Sapiens
GIHVAEVTY

SEQ ID NO: 113464 - protein, 9 aa, Homo Sapiens
GIIRPGTAF

SEQ ID NO: 113465 - protein, 9 aa, Homo Sapiens
GLIPKFVSF

SEQ ID NO: 113466 - protein, 9 aa, Homo Sapiens
GMIGKFSAL

SEQ ID NO: 113467 - protein, 9 aa, Homo Sapiens
GQKPWSQHY

SEQ ID NO: 113468 - protein, 9 aa, Homo Sapiens
GSIGGYNAH

SEQ ID NO: 113469 - protein, 9 aa, Homo Sapiens
GVIQPGRGF

SEQ ID NO: 113470 - protein, 9 aa, Homo Sapiens
GVISGLQEY

SEQ ID NO: 113471 - protein, 9 aa, Homo Sapiens
GVKKPTKAL

SEQ ID NO: 113472 - protein, 9 aa, Homo Sapiens
GVKSVGQGY

SEQ ID NO: 113473 - protein, 9 aa, Homo Sapiens
HAFVTEVAY

SEQ ID NO: 113474 - protein, 9 aa, Homo Sapiens
HAIPPTAIM

SEQ ID NO: 113475 - protein, 9 aa, Homo Sapiens
HAIPPTLAM

SEQ ID NO: 113476 - protein, 9 aa, Homo Sapiens
HAIQKYLEI

SEQ ID NO: 113477 - protein, 9 aa, Homo Sapiens
HAKTNISSY

SEQ ID NO: 113478 - protein, 9 aa, Homo Sapiens
HARDFTVSA

SEQ ID NO: 113479 - protein, 9 aa, Homo Sapiens
HARGNLASY

SEQ ID NO: 113480 - protein, 9 aa, Homo Sapiens
HFREKLPSY

SEQ ID NO: 113481 - protein, 9 aa, Homo Sapiens
HGIDPTGTY

SEQ ID NO: 113482 - protein, 9 aa, Homo Sapiens
HIASFLSVF

SEQ ID NO: 113483 - protein, 9 aa, Homo Sapiens
HIIAGAGEL

SEQ ID NO: 113484 - protein, 9 aa, Homo Sapiens
HIIENIVAV

SEQ ID NO: 113485 - protein, 9 aa, Homo Sapiens
HIIHDFQPH

SEQ ID NO: 113486 - protein, 9 aa, Homo Sapiens
HIITGVAVF

SEQ ID NO: 113487 - protein, 9 aa, Homo Sapiens
HIRGAIREY

SEQ ID NO: 113488 - protein, 9 aa, Homo Sapiens
HLHPIQTSF

SEQ ID NO: 113489 - protein, 9 aa, Homo Sapiens
HLHVQETKF

SEQ ID NO: 113490 - protein, 9 aa, Homo Sapiens
HLKEDQTEY

SEQ ID NO: 113491 - protein, 9 aa, Homo Sapiens
HLPPPSVAY

SEQ ID NO: 113492 - protein, 9 aa, Homo Sapiens
HLRDYFEEY

SEQ ID NO: 113493 - protein, 9 aa, Homo Sapiens
HLRDYFEQY

SEQ ID NO: 113494 - protein, 9 aa, Homo Sapiens
HLRNPSAAF

SEQ ID NO: 113495 - protein, 9 aa, Homo Sapiens
HMPDPWAEF

SEQ ID NO: 113496 - protein, 9 aa, Homo Sapiens
HQITVLHVY

SEQ ID NO: 113497 - protein, 9 aa, Homo Sapiens
HWHLWKKTY

SEQ ID NO: 113498 - protein, 9 aa, Homo Sapiens
IAAVPATAM

SEQ ID NO: 113499 - protein, 9 aa, Homo Sapiens
IAFDPRSAY

SEQ ID NO: 113500 - protein, 9 aa, Homo Sapiens
IAIEPGAAL

SEQ ID NO: 113501 - protein, 9 aa, Homo Sapiens
IAIPVTVAF

SEQ ID NO: 113502 - protein, 9 aa, Homo Sapiens
IAISRTPVL

SEQ ID NO: 113503 - protein, 9 aa, Homo Sapiens
IAKAGIPVY

SEQ ID NO: 113504 - protein, 9 aa, Homo Sapiens
IAKDEIGEF

SEQ ID NO: 113505 - protein, 9 aa, Homo Sapiens
IAKSGTKAF

SEQ ID NO: 113506 - protein, 9 aa, Homo Sapiens
IAKSGTSEF

SEQ ID NO: 113507 - protein, 9 aa, Homo Sapiens
IAPGVTHEL

SEQ ID NO: 113508 - protein, 9 aa, Homo Sapiens
IAVDRYLAI

SEQ ID NO: 113509 - protein, 9 aa, Homo Sapiens
ICRPLPVTF

SEQ ID NO: 113510 - protein, 9 aa, Homo Sapiens
IGAGHSSEF

SEQ ID NO: 113511 - protein, 9 aa, Homo Sapiens
IIADPKTDH

SEQ ID NO: 113512 - protein, 9 aa, Homo Sapiens
IIAEPGRYY

SEQ ID NO: 113513 - protein, 9 aa, Homo Sapiens
IIKENKVPY

SEQ ID NO: 113514 - protein, 9 aa, Homo Sapiens
IIRDRLIQF

SEQ ID NO: 113515 - protein, 9 aa, Homo Sapiens
IIRKPVTVH

SEQ ID NO: 113516 - protein, 9 aa, Homo Sapiens
ILGPPGSVY

SEQ ID NO: 113517 - protein, 9 aa, Homo Sapiens
ILHLISTVY

SEQ ID NO: 113518 - protein, 9 aa, Homo Sapiens
ILHSIFSSY

SEQ ID NO: 113519 - protein, 9 aa, Homo Sapiens
ILKDDNHSL

SEQ ID NO: 113520 - protein, 9 aa, Homo Sapiens
ILKDSISSY

SEQ ID NO: 113521 - protein, 9 aa, Homo Sapiens
ILMDPSPEY

SEQ ID NO: 113522 - protein, 9 aa, Homo Sapiens
ILPKCRTSY

SEQ ID NO: 113523 - protein, 9 aa, Homo Sapiens
ILPPGWQSY

SEQ ID NO: 113524 - protein, 9 aa, Homo Sapiens
ILQDYTHEF

SEQ ID NO: 113525 - protein, 9 aa, Homo Sapiens
ILRKDIPSF

SEQ ID NO: 113526 - protein, 9 aa, Homo Sapiens
ILYNIKQEY

SEQ ID NO: 113527 - protein, 9 aa, Homo Sapiens
IMKGGSKEY

SEQ ID NO: 113528 - protein, 9 aa, Homo Sapiens
IMKKIRESY

SEQ ID NO: 113529 - protein, 9 aa, Homo Sapiens
IMNDKLTEY

SEQ ID NO: 113530 - protein, 9 aa, Homo Sapiens
IMRELDVSY

SEQ ID NO: 113531 - protein, 9 aa, Homo Sapiens
ISAEHLTSH

SEQ ID NO: 113532 - protein, 9 aa, Homo Sapiens
ISAPHMHAY

SEQ ID NO: 113533 - protein, 9 aa, Homo Sapiens
ISAPSMPEY

SEQ ID NO: 113534 - protein, 9 aa, Homo Sapiens
ISGPLSPAY

SEQ ID NO: 113535 - protein, 9 aa, Homo Sapiens
ISHFIPSYH

SEQ ID NO: 113536 - protein, 9 aa, Homo Sapiens
ISHSWEESF

SEQ ID NO: 113537 - protein, 9 aa, Homo Sapiens
ISNPKTAEF

SEQ ID NO: 113538 - protein, 9 aa, Homo Sapiens
ISPSHIWIF

SEQ ID NO: 113539 - protein, 9 aa, Homo Sapiens
ISRETGEPY

SEQ ID NO: 113540 - protein, 9 aa, Homo Sapiens
ISREWTQKY

SEQ ID NO: 113541 - protein, 9 aa, Homo Sapiens
ISRGEMDSF

SEQ ID NO: 113542 - protein, 9 aa, Homo Sapiens
ISRWPLPEY

SEQ ID NO: 113543 - protein, 9 aa, Homo Sapiens
ISTPVIRTF

SEQ ID NO: 113544 - protein, 9 aa, Homo Sapiens
ITAPPGTAA

SEQ ID NO: 113545 - protein, 9 aa, Homo Sapiens
ITKADAAEF

SEQ ID NO: 113546 - protein, 9 aa, Homo Sapiens
IVIDPKNPL

SEQ ID NO: 113547 - protein, 9 aa, Homo Sapiens
IVKNVGREY

SEQ ID NO: 113548 - protein, 9 aa, Homo Sapiens
KAKPVGSPL

SEQ ID NO: 113549 - protein, 9 aa, Homo Sapiens
KAMGIMNSF

SEQ ID NO: 113550 - protein, 9 aa, Homo Sapiens
KAPGSTSNL

SEQ ID NO: 113551 - protein, 9 aa, Homo Sapiens
KAPVTKVAA

SEQ ID NO: 113552 - protein, 9 aa, Homo Sapiens
KFKFPGRQK

SEQ ID NO: 113553 - protein, 9 aa, Homo Sapiens
KMIEKYESL

SEQ ID NO: 113554 - protein, 9 aa, Homo Sapiens
KMIENYEAL

SEQ ID NO: 113555 - protein, 9 aa, Homo Sapiens
KMKEIAEAY

SEQ ID NO: 113556 - protein, 9 aa, Homo Sapiens
KMKPLWIMY

SEQ ID NO: 113557 - protein, 9 aa, Homo Sapiens
KPRHDLPPY

SEQ ID NO: 113558 - protein, 9 aa, Homo Sapiens
KSFPGGKEY

SEQ ID NO: 113559 - protein, 9 aa, Homo Sapiens
KSFVSSQSF

SEQ ID NO: 113560 - protein, 9 aa, Homo Sapiens
KSKNPGEAL

SEQ ID NO: 113561 - protein, 9 aa, Homo Sapiens
KSMFQRTTY

SEQ ID NO: 113562 - protein, 9 aa, Homo Sapiens
KSVRPGASY

SEQ ID NO: 113563 - protein, 9 aa, Homo Sapiens
KTKDPTAAL

SEQ ID NO: 113564 - protein, 9 aa, Homo Sapiens
KTKEIEQVY

SEQ ID NO: 113565 - protein, 9 aa, Homo Sapiens
LAAARLAAA

SEQ ID NO: 113566 - protein, 9 aa, Homo Sapiens
LAADCAHEL

SEQ ID NO: 113567 - protein, 9 aa, Homo Sapiens
LAAGPSAAA

SEQ ID NO: 113568 - protein, 9 aa, Homo Sapiens
LAIEGAQAF

SEQ ID NO: 113569 - protein, 9 aa, Homo Sapiens
LAIPITNTY

SEQ ID NO: 113570 - protein, 9 aa, Homo Sapiens
LAIRDTASY

SEQ ID NO: 113571 - protein, 9 aa, Homo Sapiens
LAKAPFAAH

SEQ ID NO: 113572 - protein, 9 aa, Homo Sapiens
LAKEGLYQY

SEQ ID NO: 113573 - protein, 9 aa, Homo Sapiens
LAKELGCSY

SEQ ID NO: 113574 - protein, 9 aa, Homo Sapiens
LAKEVGTSY

SEQ ID NO: 113575 - protein, 9 aa, Homo Sapiens
LAKGEVTEM

SEQ ID NO: 113576 - protein, 9 aa, Homo Sapiens
LAKGGTVEY

SEQ ID NO: 113577 - protein, 9 aa, Homo Sapiens
LAKVENACY

SEQ ID NO: 113578 - protein, 9 aa, Homo Sapiens
LAMPPGNSH

SEQ ID NO: 113579 - protein, 9 aa, Homo Sapiens
LAQKPGAPL

SEQ ID NO: 113580 - protein, 9 aa, Homo Sapiens
LAQTTRTAY

SEQ ID NO: 113581 - protein, 9 aa, Homo Sapiens
LARCSIVSY

SEQ ID NO: 113582 - protein, 9 aa, Homo Sapiens
LARDFLDEY

SEQ ID NO: 113583 - protein, 9 aa, Homo Sapiens
LARDLKEAY

SEQ ID NO: 113584 - protein, 9 aa, Homo Sapiens
LARGIDSSY

SEQ ID NO: 113585 - protein, 9 aa, Homo Sapiens
LARPLPVEY

SEQ ID NO: 113586 - protein, 9 aa, Homo Sapiens
LARTSSAEY

SEQ ID NO: 113587 - protein, 9 aa, Homo Sapiens
LASPIYTHF

SEQ ID NO: 113588 - protein, 9 aa, Homo Sapiens
LAVDGLMEM

SEQ ID NO: 113589 - protein, 9 aa, Homo Sapiens
LAVGLTSCF

SEQ ID NO: 113590 - protein, 9 aa, Homo Sapiens
LAVPDMSSL

SEQ ID NO: 113591 - protein, 9 aa, Homo Sapiens
LGGPASSAY

SEQ ID NO: 113592 - protein, 9 aa, Homo Sapiens
LGHGGLTSF

SEQ ID NO: 113593 - protein, 9 aa, Homo Sapiens
LGIPNTAHF

SEQ ID NO: 113594 - protein, 9 aa, Homo Sapiens
LIHVPLETF

SEQ ID NO: 113595 - protein, 9 aa, Homo Sapiens
LIIAGTSAY

SEQ ID NO: 113596 - protein, 9 aa, Homo Sapiens
LIIANTMAF

SEQ ID NO: 113597 - protein, 9 aa, Homo Sapiens
LIISNTKSL

SEQ ID NO: 113598 - protein, 9 aa, Homo Sapiens
LIISPTREL

SEQ ID NO: 113599 - protein, 9 aa, Homo Sapiens
LIKETTTGY

SEQ ID NO: 113600 - protein, 9 aa, Homo Sapiens
LIKTPTKSF

SEQ ID NO: 113601 - protein, 9 aa, Homo Sapiens
LIMDGASAF

SEQ ID NO: 113602 - protein, 9 aa, Homo Sapiens
LIRDKVAGH

SEQ ID NO: 113603 - protein, 9 aa, Homo Sapiens
LIRDNRVVY

SEQ ID NO: 113604 - protein, 9 aa, Homo Sapiens
LIREYIVEY

SEQ ID NO: 113605 - protein, 9 aa, Homo Sapiens
LIRGALEAY

SEQ ID NO: 113606 - protein, 9 aa, Homo Sapiens
LIRQGVLEH

SEQ ID NO: 113607 - protein, 9 aa, Homo Sapiens
LIYDGKVEM

SEQ ID NO: 113608 - protein, 9 aa, Homo Sapiens
LIYGTPRAA

SEQ ID NO: 113609 - protein, 9 aa, Homo Sapiens
LLGPSYREM

SEQ ID NO: 113610 - protein, 9 aa, Homo Sapiens
LLKDSLNEY

SEQ ID NO: 113611 - protein, 9 aa, Homo Sapiens
LLKQIQEAY

SEQ ID NO: 113612 - protein, 9 aa, Homo Sapiens
LLKSPGACF

SEQ ID NO: 113613 - protein, 9 aa, Homo Sapiens
LLMPHSAQF

SEQ ID NO: 113614 - protein, 9 aa, Homo Sapiens
LLQEPRHEY

SEQ ID NO: 113615 - protein, 9 aa, Homo Sapiens
LLRDATACY

SEQ ID NO: 113616 - protein, 9 aa, Homo Sapiens
LMIDVTKSY

SEQ ID NO: 113617 - protein, 9 aa, Homo Sapiens
LQIDNARLA

SEQ ID NO: 113618 - protein, 9 aa, Homo Sapiens
LQPDRWTEY

SEQ ID NO: 113619 - protein, 9 aa, Homo Sapiens
LSAPIHTQM

SEQ ID NO: 113620 - protein, 9 aa, Homo Sapiens
LSFPTTKTY

SEQ ID NO: 113621 - protein, 9 aa, Homo Sapiens
LSGPLKEQY

SEQ ID NO: 113622 - protein, 9 aa, Homo Sapiens
LSHGSTTSY

SEQ ID NO: 113623 - protein, 9 aa, Homo Sapiens
LSHTQASAF

SEQ ID NO: 113624 - protein, 9 aa, Homo Sapiens
LSKCPWKEY

SEQ ID NO: 113625 - protein, 9 aa, Homo Sapiens
LSKDDIENM

SEQ ID NO: 113626 - protein, 9 aa, Homo Sapiens
LSKDPGENY

SEQ ID NO: 113627 - protein, 9 aa, Homo Sapiens
LSKDSILSL

SEQ ID NO: 113628 - protein, 9 aa, Homo Sapiens
LSKGDGLEF

SEQ ID NO: 113629 - protein, 9 aa, Homo Sapiens
LSKGPGLEV

SEQ ID NO: 113630 - protein, 9 aa, Homo Sapiens
LSKLIHQSY

SEQ ID NO: 113631 - protein, 9 aa, Homo Sapiens
LSKLPCGEY

SEQ ID NO: 113632 - protein, 9 aa, Homo Sapiens
LSKLTDIQY

SEQ ID NO: 113633 - protein, 9 aa, Homo Sapiens
LSNITVETY

SEQ ID NO: 113634 - protein, 9 aa, Homo Sapiens
LSNTWNEKY

SEQ ID NO: 113635 - protein, 9 aa, Homo Sapiens
LTRDTIASH

SEQ ID NO: 113636 - protein, 9 aa, Homo Sapiens
LVREIAQDF

SEQ ID NO: 113637 - protein, 9 aa, Homo Sapiens
MAAMPQTVY

SEQ ID NO: 113638 - protein, 9 aa, Homo Sapiens
MAISGLSSF

SEQ ID NO: 113639 - protein, 9 aa, Homo Sapiens
MAKGSLVDY

SEQ ID NO: 113640 - protein, 9 aa, Homo Sapiens
MARSPGRAY

SEQ ID NO: 113641 - protein, 9 aa, Homo Sapiens
MGRDPGVSF

SEQ ID NO: 113642 - protein, 9 aa, Homo Sapiens
MIIENFEAL

SEQ ID NO: 113643 - protein, 9 aa, Homo Sapiens
MISEPRISY

SEQ ID NO: 113644 - protein, 9 aa, Homo Sapiens
MLHQILTPF

SEQ ID NO: 113645 - protein, 9 aa, Homo Sapiens
MLRDIIREY

SEQ ID NO: 113646 - protein, 9 aa, Homo Sapiens
MLRESLKEY

SEQ ID NO: 113647 - protein, 9 aa, Homo Sapiens
MMNAIKESY

SEQ ID NO: 113648 - protein, 9 aa, Homo Sapiens
MSAGPRYEY

SEQ ID NO: 113649 - protein, 9 aa, Homo Sapiens
MSKAPSNTF

SEQ ID NO: 113650 - protein, 9 aa, Homo Sapiens
MTKKPGMFF

SEQ ID NO: 113651 - protein, 9 aa, Homo Sapiens
NAHYPKQSF

SEQ ID NO: 113652 - protein, 9 aa, Homo Sapiens
NAIEAYTEH

SEQ ID NO: 113653 - protein, 9 aa, Homo Sapiens
NAIEGLTEY

SEQ ID NO: 113654 - protein, 9 aa, Homo Sapiens
NAISVTTSY

SEQ ID NO: 113655 - protein, 9 aa, Homo Sapiens
NAKCPNLEF

SEQ ID NO: 113656 - protein, 9 aa, Homo Sapiens
NAKGYTIPL

SEQ ID NO: 113657 - protein, 9 aa, Homo Sapiens
NASPVISSV

SEQ ID NO: 113658 - protein, 9 aa, Homo Sapiens
NIICGITSV

SEQ ID NO: 113659 - protein, 9 aa, Homo Sapiens
NIKSPALAF

SEQ ID NO: 113660 - protein, 9 aa, Homo Sapiens
NIREIEIDY

SEQ ID NO: 113661 - protein, 9 aa, Homo Sapiens
NIVDKTASF

SEQ ID NO: 113662 - protein, 9 aa, Homo Sapiens
NIVENLLMI

SEQ ID NO: 113663 - protein, 9 aa, Homo Sapiens
NMNDLVSEY

SEQ ID NO: 113664 - protein, 9 aa, Homo Sapiens
NQKPPSAEY

SEQ ID NO: 113665 - protein, 9 aa, Homo Sapiens
NSYVPVTAY

SEQ ID NO: 113666 - protein, 9 aa, Homo Sapiens
NTIDPSHPM

SEQ ID NO: 113667 - protein, 9 aa, Homo Sapiens
NTKEPPLSL

SEQ ID NO: 113668 - protein, 9 aa, Homo Sapiens
NVIDKLAQF

SEQ ID NO: 113669 - protein, 9 aa, Homo Sapiens
QAFPGGHSM

SEQ ID NO: 113670 - protein, 9 aa, Homo Sapiens
QAPQPQSSL

SEQ ID NO: 113671 - protein, 9 aa, Homo Sapiens
QIKPDMETY

SEQ ID NO: 113672 - protein, 9 aa, Homo Sapiens
QLGPVGGVF

SEQ ID NO: 113673 - protein, 9 aa, Homo Sapiens
QSKTIKVSY

SEQ ID NO: 113674 - protein, 9 aa, Homo Sapiens
RAIEIYTDM

SEQ ID NO: 113675 - protein, 9 aa, Homo Sapiens
RARELLVSY

SEQ ID NO: 113676 - protein, 9 aa, Homo Sapiens
RIHFPLATY

SEQ ID NO: 113677 - protein, 9 aa, Homo Sapiens
RIHVAVTEM

SEQ ID NO: 113678 - protein, 9 aa, Homo Sapiens
RIKPNAITY

SEQ ID NO: 113679 - protein, 9 aa, Homo Sapiens
RINPQTTEF

SEQ ID NO: 113680 - protein, 9 aa, Homo Sapiens
RIVDALNEF

SEQ ID NO: 113681 - protein, 9 aa, Homo Sapiens
RLKNPTVEY

SEQ ID NO: 113682 - protein, 9 aa, Homo Sapiens
RLRDDIKEY

SEQ ID NO: 113683 - protein, 9 aa, Homo Sapiens
RMQEGSEVY

SEQ ID NO: 113684 - protein, 9 aa, Homo Sapiens
RVRDDVAEY

SEQ ID NO: 113685 - protein, 9 aa, Homo Sapiens
SAAFPGASL

SEQ ID NO: 113686 - protein, 9 aa, Homo Sapiens
SAAMPGASL

SEQ ID NO: 113687 - protein, 9 aa, Homo Sapiens
SAAQPGVAF

SEQ ID NO: 113688 - protein, 9 aa, Homo Sapiens
SAIASTKVM

SEQ ID NO: 113689 - protein, 9 aa, Homo Sapiens
SAITNTGVF

SEQ ID NO: 113690 - protein, 9 aa, Homo Sapiens
SAKITIAAY

SEQ ID NO: 113691 - protein, 9 aa, Homo Sapiens
SAKNPWQEY

SEQ ID NO: 113692 - protein, 9 aa, Homo Sapiens
SAKPEISAM

SEQ ID NO: 113693 - protein, 9 aa, Homo Sapiens
SAKPQTTVF

SEQ ID NO: 113694 - protein, 9 aa, Homo Sapiens
SAKSGAVTF

SEQ ID NO: 113695 - protein, 9 aa, Homo Sapiens
SAKSPTATF

SEQ ID NO: 113696 - protein, 9 aa, Homo Sapiens
SAKTPGFSV

SEQ ID NO: 113697 - protein, 9 aa, Homo Sapiens
SAKTPSSTY

SEQ ID NO: 113698 - protein, 9 aa, Homo Sapiens
SAKVANASY

SEQ ID NO: 113699 - protein, 9 aa, Homo Sapiens
SALVTGQSY

SEQ ID NO: 113700 - protein, 9 aa, Homo Sapiens
SAMPTSSSF

SEQ ID NO: 113701 - protein, 9 aa, Homo Sapiens
SAMSNPRAM

SEQ ID NO: 113702 - protein, 9 aa, Homo Sapiens
SAMYSRKAM

SEQ ID NO: 113703 - protein, 9 aa, Homo Sapiens
SANVSKVSF

SEQ ID NO: 113704 - protein, 9 aa, Homo Sapiens
SAPASQASL

SEQ ID NO: 113705 - protein, 9 aa, Homo Sapiens
SARDAALAY

SEQ ID NO: 113706 - protein, 9 aa, Homo Sapiens
SARPKLKAF

SEQ ID NO: 113707 - protein, 9 aa, Homo Sapiens
SASVQNHEF

SEQ ID NO: 113708 - protein, 9 aa, Homo Sapiens
SAVPSTSTM

SEQ ID NO: 113709 - protein, 9 aa, Homo Sapiens
SGGPGPRVY

SEQ ID NO: 113710 - protein, 9 aa, Homo Sapiens
SGICGLSPH

SEQ ID NO: 113711 - protein, 9 aa, Homo Sapiens
SGMGKTAVF

SEQ ID NO: 113712 - protein, 9 aa, Homo Sapiens
SGRYISSSY

SEQ ID NO: 113713 - protein, 9 aa, Homo Sapiens
SIFDDFSHY

SEQ ID NO: 113714 - protein, 9 aa, Homo Sapiens
SIIPGSAAY

SEQ ID NO: 113715 - protein, 9 aa, Homo Sapiens
SIITGVAAM

SEQ ID NO: 113716 - protein, 9 aa, Homo Sapiens
SIKDNSFQY

SEQ ID NO: 113717 - protein, 9 aa, Homo Sapiens
SIKDYFLEF

SEQ ID NO: 113718 - protein, 9 aa, Homo Sapiens
SIKETVEAY

SEQ ID NO: 113719 - protein, 9 aa, Homo Sapiens
SILEKTSAY

SEQ ID NO: 113720 - protein, 9 aa, Homo Sapiens
SIMEHNVAY

SEQ ID NO: 113721 - protein, 9 aa, Homo Sapiens
SIPDIKTAF

SEQ ID NO: 113722 - protein, 9 aa, Homo Sapiens
SIRDGVRAY

SEQ ID NO: 113723 - protein, 9 aa, Homo Sapiens
SIREAGGAF

SEQ ID NO: 113724 - protein, 9 aa, Homo Sapiens
SIRPGLSPY

SEQ ID NO: 113725 - protein, 9 aa, Homo Sapiens
SIRSELIPY

SEQ ID NO: 113726 - protein, 9 aa, Homo Sapiens
SLAEPGSAY

SEQ ID NO: 113727 - protein, 9 aa, Homo Sapiens
SLAPPSMEY

SEQ ID NO: 113728 - protein, 9 aa, Homo Sapiens
SLARPGHPM

SEQ ID NO: 113729 - protein, 9 aa, Homo Sapiens
SLFVSNHAY

SEQ ID NO: 113730 - protein, 9 aa, Homo Sapiens
SLKTPGTSL

SEQ ID NO: 113731 - protein, 9 aa, Homo Sapiens
SLRFIDVEF

SEQ ID NO: 113732 - protein, 9 aa, Homo Sapiens
SMHLQLTCF

SEQ ID NO: 113733 - protein, 9 aa, Homo Sapiens
SMIDKYQAL

SEQ ID NO: 113734 - protein, 9 aa, Homo Sapiens
SMVDHTSAF

SEQ ID NO: 113735 - protein, 9 aa, Homo Sapiens
SMYPVWKSF

SEQ ID NO: 113736 - protein, 9 aa, Homo Sapiens
SQFGGGSQY

SEQ ID NO: 113737 - protein, 9 aa, Homo Sapiens
SQFIFEHSY

SEQ ID NO: 113738 - protein, 9 aa, Homo Sapiens
SQGPVKHVY

SEQ ID NO: 113739 - protein, 9 aa, Homo Sapiens
SQIDRICEM

SEQ ID NO: 113740 - protein, 9 aa, Homo Sapiens
SSAPPRTAF

SEQ ID NO: 113741 - protein, 9 aa, Homo Sapiens
SSFFAKIPY

SEQ ID NO: 113742 - protein, 9 aa, Homo Sapiens
SSHLVLVTF

SEQ ID NO: 113743 - protein, 9 aa, Homo Sapiens
SSHQSSATF

SEQ ID NO: 113744 - protein, 9 aa, Homo Sapiens
SSHVTNVAF

SEQ ID NO: 113745 - protein, 9 aa, Homo Sapiens
SSHVTNVSF

SEQ ID NO: 113746 - protein, 9 aa, Homo Sapiens
SSIGKLSEY

SEQ ID NO: 113747 - protein, 9 aa, Homo Sapiens
SSKEPPSAY

SEQ ID NO: 113748 - protein, 9 aa, Homo Sapiens
SSMKPTLSH

SEQ ID NO: 113749 - protein, 9 aa, Homo Sapiens
SSYVTITSH

SEQ ID NO: 113750 - protein, 9 aa, Homo Sapiens
STHVTISTY

SEQ ID NO: 113751 - protein, 9 aa, Homo Sapiens
STKEPGRTL

SEQ ID NO: 113752 - protein, 9 aa, Homo Sapiens
STKPPGTFL

SEQ ID NO: 113753 - protein, 9 aa, Homo Sapiens
SVKDGAICY

SEQ ID NO: 113754 - protein, 9 aa, Homo Sapiens
SVKEWTITY

SEQ ID NO: 113755 - protein, 9 aa, Homo Sapiens
SVKPASSSF

SEQ ID NO: 113756 - protein, 9 aa, Homo Sapiens
SVKSPNQSL

SEQ ID NO: 113757 - protein, 9 aa, Homo Sapiens
TAAAVGAVF

SEQ ID NO: 113758 - protein, 9 aa, Homo Sapiens
TAAPPAQPL

SEQ ID NO: 113759 - protein, 9 aa, Homo Sapiens
TAHQINIGY

SEQ ID NO: 113760 - protein, 9 aa, Homo Sapiens
TAIDRYLCL

SEQ ID NO: 113761 - protein, 9 aa, Homo Sapiens
TAISRYMEL

SEQ ID NO: 113762 - protein, 9 aa, Homo Sapiens
TAKATVAAF

SEQ ID NO: 113763 - protein, 9 aa, Homo Sapiens
TAKDCLLVY

SEQ ID NO: 113764 - protein, 9 aa, Homo Sapiens
TAKSPATCY

SEQ ID NO: 113765 - protein, 9 aa, Homo Sapiens
TAKSVTCTY

SEQ ID NO: 113766 - protein, 9 aa, Homo Sapiens
TAMPKLLSY

SEQ ID NO: 113767 - protein, 9 aa, Homo Sapiens
TAMPYLTSY

SEQ ID NO: 113768 - protein, 9 aa, Homo Sapiens
TARDSILSH

SEQ ID NO: 113769 - protein, 9 aa, Homo Sapiens
TARYIYISY

SEQ ID NO: 113770 - protein, 9 aa, Homo Sapiens
TGMVPGSEF

SEQ ID NO: 113771 - protein, 9 aa, Homo Sapiens
TIIDKSKSV

SEQ ID NO: 113772 - protein, 9 aa, Homo Sapiens
TIIECLHSF

SEQ ID NO: 113773 - protein, 9 aa, Homo Sapiens
TIIPKVLAM

SEQ ID NO: 113774 - protein, 9 aa, Homo Sapiens
TIISAYRAL

SEQ ID NO: 113775 - protein, 9 aa, Homo Sapiens
TIKSATISY

SEQ ID NO: 113776 - protein, 9 aa, Homo Sapiens
TILGGLNEF

SEQ ID NO: 113777 - protein, 9 aa, Homo Sapiens
TIMAHVTEF

SEQ ID NO: 113778 - protein, 9 aa, Homo Sapiens
TINGHNAEV

SEQ ID NO: 113779 - protein, 9 aa, Homo Sapiens
TLITGLEEY

SEQ ID NO: 113780 - protein, 9 aa, Homo Sapiens
TLKDHIMSH

SEQ ID NO: 113781 - protein, 9 aa, Homo Sapiens
TLKEAGTHY

SEQ ID NO: 113782 - protein, 9 aa, Homo Sapiens
TLKEDWIAY

SEQ ID NO: 113783 - protein, 9 aa, Homo Sapiens
TLKLTTPTY

SEQ ID NO: 113784 - protein, 9 aa, Homo Sapiens
TLKQKWVEY

SEQ ID NO: 113785 - protein, 9 aa, Homo Sapiens
TLKTPGKSF

SEQ ID NO: 113786 - protein, 9 aa, Homo Sapiens
TLNEKLTAL

SEQ ID NO: 113787 - protein, 9 aa, Homo Sapiens
TLRAQLTEF

SEQ ID NO: 113788 - protein, 9 aa, Homo Sapiens
TLTPIIQEY

SEQ ID NO: 113789 - protein, 9 aa, Homo Sapiens
TMKDFNHSY

SEQ ID NO: 113790 - protein, 9 aa, Homo Sapiens
TMKPMNVEY

SEQ ID NO: 113791 - protein, 9 aa, Homo Sapiens
TMVGKTFTY

SEQ ID NO: 113792 - protein, 9 aa, Homo Sapiens
TSHVSAQSF

SEQ ID NO: 113793 - protein, 9 aa, Homo Sapiens
TSKVPSAPH

SEQ ID NO: 113794 - protein, 9 aa, Homo Sapiens
TSREIQTAV

SEQ ID NO: 113795 - protein, 9 aa, Homo Sapiens
TTKAPTGPF

SEQ ID NO: 113796 - protein, 9 aa, Homo Sapiens
TVRDHVHCL

SEQ ID NO: 113797 - protein, 9 aa, Homo Sapiens
TYPENWRAF

SEQ ID NO: 113798 - protein, 9 aa, Homo Sapiens
VAAAPGTPA

SEQ ID NO: 113799 - protein, 9 aa, Homo Sapiens
VAFPSSSVY

SEQ ID NO: 113800 - protein, 9 aa, Homo Sapiens
VAIAGLMEV

SEQ ID NO: 113801 - protein, 9 aa, Homo Sapiens
VAIKAYTAV

SEQ ID NO: 113802 - protein, 9 aa, Homo Sapiens
VAIPSYICY

SEQ ID NO: 113803 - protein, 9 aa, Homo Sapiens
VAKAPSLTF

SEQ ID NO: 113804 - protein, 9 aa, Homo Sapiens
VAKAPSQAL

SEQ ID NO: 113805 - protein, 9 aa, Homo Sapiens
VAKAVTQAL

SEQ ID NO: 113806 - protein, 9 aa, Homo Sapiens
VAKMGITEY

SEQ ID NO: 113807 - protein, 9 aa, Homo Sapiens
VAKPPVMSF

SEQ ID NO: 113808 - protein, 9 aa, Homo Sapiens
VAKSKLREL

SEQ ID NO: 113809 - protein, 9 aa, Homo Sapiens
VAKSQLLSY

SEQ ID NO: 113810 - protein, 9 aa, Homo Sapiens
VAKTNTVSY

SEQ ID NO: 113811 - protein, 9 aa, Homo Sapiens
VAKTPRNTY

SEQ ID NO: 113812 - protein, 9 aa, Homo Sapiens
VAKWATVTF

SEQ ID NO: 113813 - protein, 9 aa, Homo Sapiens
VANPNSAIF

SEQ ID NO: 113814 - protein, 9 aa, Homo Sapiens
VARDLRAEF

SEQ ID NO: 113815 - protein, 9 aa, Homo Sapiens
VARGNLGVY

SEQ ID NO: 113816 - protein, 9 aa, Homo Sapiens
VARLIAIFF

SEQ ID NO: 113817 - protein, 9 aa, Homo Sapiens
VARPDVVEM

SEQ ID NO: 113818 - protein, 9 aa, Homo Sapiens
VARPPGQDF

SEQ ID NO: 113819 - protein, 9 aa, Homo Sapiens
VAVDGINAL

SEQ ID NO: 113820 - protein, 9 aa, Homo Sapiens
VAVEPGAAV

SEQ ID NO: 113821 - protein, 9 aa, Homo Sapiens
VAVNKPAEF

SEQ ID NO: 113822 - protein, 9 aa, Homo Sapiens
VAYGKGTYF

SEQ ID NO: 113823 - protein, 9 aa, Homo Sapiens
VAYVSSVAL

SEQ ID NO: 113824 - protein, 9 aa, Homo Sapiens
VGIDLGTTY

SEQ ID NO: 113825 - protein, 9 aa, Homo Sapiens
VGIDPLSSY

SEQ ID NO: 113826 - protein, 9 aa, Homo Sapiens
VGYPGKYTY

SEQ ID NO: 113827 - protein, 9 aa, Homo Sapiens
VIFAGGQAY

SEQ ID NO: 113828 - protein, 9 aa, Homo Sapiens
VIHLILECY

SEQ ID NO: 113829 - protein, 9 aa, Homo Sapiens
VIIDDRHVY

SEQ ID NO: 113830 - protein, 9 aa, Homo Sapiens
VIIKGTQVY

SEQ ID NO: 113831 - protein, 9 aa, Homo Sapiens
VIINSFAEH

SEQ ID NO: 113832 - protein, 9 aa, Homo Sapiens
VIKEQNREL

SEQ ID NO: 113833 - protein, 9 aa, Homo Sapiens
VIKESGPPH

SEQ ID NO: 113834 - protein, 9 aa, Homo Sapiens
VILPPLSPY

SEQ ID NO: 113835 - protein, 9 aa, Homo Sapiens
VIRDEVEKY

SEQ ID NO: 113836 - protein, 9 aa, Homo Sapiens
VIRDFAGPY

SEQ ID NO: 113837 - protein, 9 aa, Homo Sapiens
VIRELKEQY

SEQ ID NO: 113838 - protein, 9 aa, Homo Sapiens
VIRGNIVKH

SEQ ID NO: 113839 - protein, 9 aa, Homo Sapiens
VIRQQCVEY

SEQ ID NO: 113840 - protein, 9 aa, Homo Sapiens
VIVGGIDSM

SEQ ID NO: 113841 - protein, 9 aa, Homo Sapiens
VIVGGSSEY

SEQ ID NO: 113842 - protein, 9 aa, Homo Sapiens
VIVSTRSPY

SEQ ID NO: 113843 - protein, 9 aa, Homo Sapiens
VLAALLDHV

SEQ ID NO: 113844 - protein, 9 aa, Homo Sapiens
VLAEKAAAY

SEQ ID NO: 113845 - protein, 9 aa, Homo Sapiens
VLFEHAVGY

SEQ ID NO: 113846 - protein, 9 aa, Homo Sapiens
VLIEATKAF

SEQ ID NO: 113847 - protein, 9 aa, Homo Sapiens
VLKAAAHHY

SEQ ID NO: 113848 - protein, 9 aa, Homo Sapiens
VLKEKIAKY

SEQ ID NO: 113849 - protein, 9 aa, Homo Sapiens
VLKGGLSSF

SEQ ID NO: 113850 - protein, 9 aa, Homo Sapiens
VLKIIREEY

SEQ ID NO: 113851 - protein, 9 aa, Homo Sapiens
VLKLTPVAY

SEQ ID NO: 113852 - protein, 9 aa, Homo Sapiens
VLKLVDISY

SEQ ID NO: 113853 - protein, 9 aa, Homo Sapiens
VLKNLATAY

SEQ ID NO: 113854 - protein, 9 aa, Homo Sapiens
VLKPNIISY

SEQ ID NO: 113855 - protein, 9 aa, Homo Sapiens
VLKQEQEEY

SEQ ID NO: 113856 - protein, 9 aa, Homo Sapiens
VLMPKVMHY

SEQ ID NO: 113857 - protein, 9 aa, Homo Sapiens
VLNIHLTAY

SEQ ID NO: 113858 - protein, 9 aa, Homo Sapiens
VLRDVVQAY

SEQ ID NO: 113859 - protein, 9 aa, Homo Sapiens
VLREIAEEY

SEQ ID NO: 113860 - protein, 9 aa, Homo Sapiens
VLRPFPASY

SEQ ID NO: 113861 - protein, 9 aa, Homo Sapiens
VLYPHLSTY

SEQ ID NO: 113862 - protein, 9 aa, Homo Sapiens
VMINKATPY

SEQ ID NO: 113863 - protein, 9 aa, Homo Sapiens
VMKDSAPEL

SEQ ID NO: 113864 - protein, 9 aa, Homo Sapiens
VQGPVGTDF

SEQ ID NO: 113865 - protein, 9 aa, Homo Sapiens
VQPSKFNSY

SEQ ID NO: 113866 - protein, 9 aa, Homo Sapiens
VSHLIATEY

SEQ ID NO: 113867 - protein, 9 aa, Homo Sapiens
VSHWQQQSY

SEQ ID NO: 113868 - protein, 9 aa, Homo Sapiens
VSKPCFTAY

SEQ ID NO: 113869 - protein, 9 aa, Homo Sapiens
VTKGNIAQM

SEQ ID NO: 113870 - protein, 9 aa, Homo Sapiens
VTKPVGGNY

SEQ ID NO: 113871 - protein, 9 aa, Homo Sapiens
VTLEWFPPI

SEQ ID NO: 113872 - protein, 9 aa, Homo Sapiens
VTRPHLQAY

SEQ ID NO: 113873 - protein, 9 aa, Homo Sapiens
VTYVPVTTF

SEQ ID NO: 113874 - protein, 9 aa, Homo Sapiens
VVHTPETSV

SEQ ID NO: 113875 - protein, 9 aa, Homo Sapiens
VVHVPLEAY

SEQ ID NO: 113876 - protein, 9 aa, Homo Sapiens
VVIGNIGAL

SEQ ID NO: 113877 - protein, 9 aa, Homo Sapiens
VVKMPSGEF

SEQ ID NO: 113878 - protein, 9 aa, Homo Sapiens
VVKPPGSSL

SEQ ID NO: 113879 - protein, 9 aa, Homo Sapiens
VVPTAILAF

SEQ ID NO: 113880 - protein, 9 aa, Homo Sapiens
WARPLSVSF

SEQ ID NO: 113881 - protein, 9 aa, Homo Sapiens
YAAGVHSVL

SEQ ID NO: 113882 - protein, 9 aa, Homo Sapiens
YAALHGEFY

SEQ ID NO: 113883 - protein, 9 aa, Homo Sapiens
YAALPGQQH

SEQ ID NO: 113884 - protein, 9 aa, Homo Sapiens
YAANPGQLF

SEQ ID NO: 113885 - protein, 9 aa, Homo Sapiens
YAAQASQAL

SEQ ID NO: 113886 - protein, 9 aa, Homo Sapiens
YAAQNLLSH

SEQ ID NO: 113887 - protein, 9 aa, Homo Sapiens
YAFDFARQS

SEQ ID NO: 113888 - protein, 9 aa, Homo Sapiens
YAFGGGCEL

SEQ ID NO: 113889 - protein, 9 aa, Homo Sapiens
YAFPKAVSV

SEQ ID NO: 113890 - protein, 9 aa, Homo Sapiens
YAIDNPLHY

SEQ ID NO: 113891 - protein, 9 aa, Homo Sapiens
YAIGNAPEL

SEQ ID NO: 113892 - protein, 9 aa, Homo Sapiens
YAIGVSHPL

SEQ ID NO: 113893 - protein, 9 aa, Homo Sapiens
YAKDDPLEF

SEQ ID NO: 113894 - protein, 9 aa, Homo Sapiens
YAKDGRVSY

SEQ ID NO: 113895 - protein, 9 aa, Homo Sapiens
YAKDKTCFY

SEQ ID NO: 113896 - protein, 9 aa, Homo Sapiens
YAKDMLTSL

SEQ ID NO: 113897 - protein, 9 aa, Homo Sapiens
YAKDYTKAL

SEQ ID NO: 113898 - protein, 9 aa, Homo Sapiens
YAKEKLESF

SEQ ID NO: 113899 - protein, 9 aa, Homo Sapiens
YAKGFGGQY

SEQ ID NO: 113900 - protein, 9 aa, Homo Sapiens
YAKIVEIPF

SEQ ID NO: 113901 - protein, 9 aa, Homo Sapiens
YAKRPGIGL

SEQ ID NO: 113902 - protein, 9 aa, Homo Sapiens
YAMDELRSL

SEQ ID NO: 113903 - protein, 9 aa, Homo Sapiens
YANDFASEY

SEQ ID NO: 113904 - protein, 9 aa, Homo Sapiens
YANEVGEAF

SEQ ID NO: 113905 - protein, 9 aa, Homo Sapiens
YARDETEFY

SEQ ID NO: 113906 - protein, 9 aa, Homo Sapiens
YARVVGSEY

SEQ ID NO: 113907 - protein, 9 aa, Homo Sapiens
YASSPGGVY

SEQ ID NO: 113908 - protein, 9 aa, Homo Sapiens
YATLYYREH

SEQ ID NO: 113909 - protein, 9 aa, Homo Sapiens
YAVPALEAH

SEQ ID NO: 113910 - protein, 9 aa, Homo Sapiens
YAVSELAGH

SEQ ID NO: 113911 - protein, 9 aa, Homo Sapiens
YAYPATAAA

SEQ ID NO: 113912 - protein, 9 aa, Homo Sapiens
YAYPYSYYY

SEQ ID NO: 113913 - protein, 9 aa, Homo Sapiens
YFHCTLIGY

SEQ ID NO: 113914 - protein, 9 aa, Homo Sapiens
YFKPMMKEF

SEQ ID NO: 113915 - protein, 9 aa, Homo Sapiens
YGPPVRTEY

SEQ ID NO: 113916 - protein, 9 aa, Homo Sapiens
YIAAFLSHF

SEQ ID NO: 113917 - protein, 9 aa, Homo Sapiens
YIISGLTGF

SEQ ID NO: 113918 - protein, 9 aa, Homo Sapiens
YIKEYVTCH

SEQ ID NO: 113919 - protein, 9 aa, Homo Sapiens
YIKGPSLSY

SEQ ID NO: 113920 - protein, 9 aa, Homo Sapiens
YIRDLALEY

SEQ ID NO: 113921 - protein, 9 aa, Homo Sapiens
YIRGSTIKY

SEQ ID NO: 113922 - protein, 9 aa, Homo Sapiens
YLFEWRTQY

SEQ ID NO: 113923 - protein, 9 aa, Homo Sapiens
YLKNMVTQY

SEQ ID NO: 113924 - protein, 9 aa, Homo Sapiens
YLKNSVVAY

SEQ ID NO: 113925 - protein, 9 aa, Homo Sapiens
YLKRPGLTY

SEQ ID NO: 113926 - protein, 9 aa, Homo Sapiens
YLRDALPEY

SEQ ID NO: 113927 - protein, 9 aa, Homo Sapiens
YLRELLTTM

SEQ ID NO: 113928 - protein, 9 aa, Homo Sapiens
YLREVMQDY

SEQ ID NO: 113929 - protein, 9 aa, Homo Sapiens
YLRPSLFVY

SEQ ID NO: 113930 - protein, 9 aa, Homo Sapiens
YLYGQTTTY

SEQ ID NO: 113931 - protein, 9 aa, Homo Sapiens
YMADRLLSF

SEQ ID NO: 113932 - protein, 9 aa, Homo Sapiens
YMIDAGTEF

SEQ ID NO: 113933 - protein, 9 aa, Homo Sapiens
YMKDLPTSF

SEQ ID NO: 113934 - protein, 9 aa, Homo Sapiens
YMRGFMTAH

SEQ ID NO: 113935 - protein, 9 aa, Homo Sapiens
YMRPDIVAL

SEQ ID NO: 113936 - protein, 9 aa, Homo Sapiens
YNRDFKISF

SEQ ID NO: 113937 - protein, 9 aa, Homo Sapiens
YQAEAREAL

SEQ ID NO: 113938 - protein, 9 aa, Homo Sapiens
YQFTGIKKY

SEQ ID NO: 113939 - protein, 9 aa, Homo Sapiens
YQHLITNSF

SEQ ID NO: 113940 - protein, 9 aa, Homo Sapiens
YSKDQLQTF

SEQ ID NO: 113941 - protein, 9 aa, Homo Sapiens
YSKLPGVSL

SEQ ID NO: 113942 - protein, 9 aa, Homo Sapiens
YSKPSIMAH

SEQ ID NO: 113943 - protein, 9 aa, Homo Sapiens
YSKRVYIAY

SEQ ID NO: 113944 - protein, 9 aa, Homo Sapiens
YSMPSTHAM

SEQ ID NO: 113945 - protein, 9 aa, Homo Sapiens
YSRYPPREY

SEQ ID NO: 113946 - protein, 9 aa, Homo Sapiens
YTRPGLPTF

SEQ ID NO: 113947 - protein, 9 aa, Homo Sapiens
YVIQHVLEH

SEQ ID NO: 113948 - protein, 9 aa, Homo Sapiens
YVKGGLSTF

SEQ ID NO: 113949 - protein, 9 aa, Homo Sapiens
YVKRPGAAL

SEQ ID NO: 113950 - protein, 9 aa, Homo Sapiens
YVKSIVQEY

SEQ ID NO: 113951 - protein, 9 aa, Homo Sapiens
YVPEHWEYY

SEQ ID NO: 113952 - protein, 9 aa, Homo Sapiens
YVRDCVEAL

SEQ ID NO: 113953 - protein, 9 aa, Homo Sapiens
YVTTSTRTY

SEQ ID NO: 113954 - protein, 9 aa, Homo Sapiens
YYKPDSPEY

SEQ ID NO: 113955 - protein, 10 aa, Homo Sapiens
AAAPHSIESF

SEQ ID NO: 113956 - protein, 10 aa, Homo Sapiens
AAFDASRTSF

SEQ ID NO: 113957 - protein, 10 aa, Homo Sapiens
AAFGGNPKSV

SEQ ID NO: 113958 - protein, 10 aa, Homo Sapiens
AALTHHPAAM

SEQ ID NO: 113959 - protein, 10 aa, Homo Sapiens
AAVNFQLNSH

SEQ ID NO: 113960 - protein, 10 aa, Homo Sapiens
AAYASQPAAY

SEQ ID NO: 113961 - protein, 10 aa, Homo Sapiens
AAYGGYPTAH

SEQ ID NO: 113962 - protein, 10 aa, Homo Sapiens
AAYNGHCEAL

SEQ ID NO: 113963 - protein, 10 aa, Homo Sapiens
AGAPWTLMTY

SEQ ID NO: 113964 - protein, 10 aa, Homo Sapiens
AIKPGTSVEY

SEQ ID NO: 113965 - protein, 10 aa, Homo Sapiens
ALIEFIRSEY

SEQ ID NO: 113966 - protein, 10 aa, Homo Sapiens
ALPDSELAEY

SEQ ID NO: 113967 - protein, 10 aa, Homo Sapiens
ALPQHKLTCF

SEQ ID NO: 113968 - protein, 10 aa, Homo Sapiens
ALYPRAWTVY

SEQ ID NO: 113969 - protein, 10 aa, Homo Sapiens
ALYTEKFEEF

SEQ ID NO: 113970 - protein, 10 aa, Homo Sapiens
AQAPCGQAAY

SEQ ID NO: 113971 - protein, 10 aa, Homo Sapiens
AQRQEIRTAY

SEQ ID NO: 113972 - protein, 10 aa, Homo Sapiens
ASFDGRISVY

SEQ ID NO: 113973 - protein, 10 aa, Homo Sapiens
ATPVFNPTVF

SEQ ID NO: 113974 - protein, 10 aa, Homo Sapiens
CASQAGMTAY

SEQ ID NO: 113975 - protein, 10 aa, Homo Sapiens
CMKIPTGQEY

SEQ ID NO: 113976 - protein, 10 aa, Homo Sapiens
CSVPFTPIEF

SEQ ID NO: 113977 - protein, 10 aa, Homo Sapiens
FAIGSQVSEH

SEQ ID NO: 113978 - protein, 10 aa, Homo Sapiens
FAKGPTLTVY

SEQ ID NO: 113979 - protein, 10 aa, Homo Sapiens
FAKTFVGTPY

SEQ ID NO: 113980 - protein, 10 aa, Homo Sapiens
FAQPFSLKEY

SEQ ID NO: 113981 - protein, 10 aa, Homo Sapiens
FAWEPNGSKF

SEQ ID NO: 113982 - protein, 10 aa, Homo Sapiens
FAYGGHPYPF

SEQ ID NO: 113983 - protein, 10 aa, Homo Sapiens
FAYGQNKTAF

SEQ ID NO: 113984 - protein, 10 aa, Homo Sapiens
FAYSDSRVGF

SEQ ID NO: 113985 - protein, 10 aa, Homo Sapiens
FIIDTRDAGY

SEQ ID NO: 113986 - protein, 10 aa, Homo Sapiens
FLPKHKANAY

SEQ ID NO: 113987 - protein, 10 aa, Homo Sapiens
FQKPKGTIEY

SEQ ID NO: 113988 - protein, 10 aa, Homo Sapiens
FQPPFQPGRM

SEQ ID NO: 113989 - protein, 10 aa, Homo Sapiens
FQYPVRPASM

SEQ ID NO: 113990 - protein, 10 aa, Homo Sapiens
FSFGGKLVTF

SEQ ID NO: 113991 - protein, 10 aa, Homo Sapiens
GIPTHHPRVY

SEQ ID NO: 113992 - protein, 10 aa, Homo Sapiens
GVGFSYHNFD

SEQ ID NO: 113993 - protein, 10 aa, Homo Sapiens
GVIEKLLTSY

SEQ ID NO: 113994 - protein, 10 aa, Homo Sapiens
HGIDPTGTYH

SEQ ID NO: 113995 - protein, 10 aa, Homo Sapiens
HLPEHEVMPH

SEQ ID NO: 113996 - protein, 10 aa, Homo Sapiens
HMKPLPYYSY

SEQ ID NO: 113997 - protein, 10 aa, Homo Sapiens
IAQPHHGVPY

SEQ ID NO: 113998 - protein, 10 aa, Homo Sapiens
IEITTERPKK

SEQ ID NO: 113999 - protein, 10 aa, Homo Sapiens
IIYPGAFVDL

SEQ ID NO: 114000 - protein, 10 aa, Homo Sapiens
ISHDTFGTTY

SEQ ID NO: 114001 - protein, 10 aa, Homo Sapiens
ISPEHVIQAL

SEQ ID NO: 114002 - protein, 10 aa, Homo Sapiens
ISPPWDFREF

SEQ ID NO: 114003 - protein, 10 aa, Homo Sapiens
ITKPPDGSAF

SEQ ID NO: 114004 - protein, 10 aa, Homo Sapiens
KAADFQLHTH

SEQ ID NO: 114005 - protein, 10 aa, Homo Sapiens
KANPFGGASH

SEQ ID NO: 114006 - protein, 10 aa, Homo Sapiens
KIKAPTPTCF

SEQ ID NO: 114007 - protein, 10 aa, Homo Sapiens
KIPNFWVTTF

SEQ ID NO: 114008 - protein, 10 aa, Homo Sapiens
KIYEGAYHVL

SEQ ID NO: 114009 - protein, 10 aa, Homo Sapiens
KLPEFTKSEY

SEQ ID NO: 114010 - protein, 10 aa, Homo Sapiens
KLYEGVPLPF

SEQ ID NO: 114011 - protein, 10 aa, Homo Sapiens
KQIDRQLTAY

SEQ ID NO: 114012 - protein, 10 aa, Homo Sapiens
LAADFEIGHF

SEQ ID NO: 114013 - protein, 10 aa, Homo Sapiens
LAIVHAVHAY

SEQ ID NO: 114014 - protein, 10 aa, Homo Sapiens
LAVHPSGVAL

SEQ ID NO: 114015 - protein, 10 aa, Homo Sapiens
LEEIQQKVMQ

SEQ ID NO: 114016 - protein, 10 aa, Homo Sapiens
LGVPFNIASY

SEQ ID NO: 114017 - protein, 10 aa, Homo Sapiens
LIKPPDNNEF

SEQ ID NO: 114018 - protein, 10 aa, Homo Sapiens
LLPQHQVPAY

SEQ ID NO: 114019 - protein, 10 aa, Homo Sapiens
LMPEFQFGTY

SEQ ID NO: 114020 - protein, 10 aa, Homo Sapiens
LMPQFSTIEY

SEQ ID NO: 114021 - protein, 10 aa, Homo Sapiens
LQGRVNPVEY

SEQ ID NO: 114022 - protein, 10 aa, Homo Sapiens
LSFPRNNISY

SEQ ID NO: 114023 - protein, 10 aa, Homo Sapiens
LSPAGKLVAY

SEQ ID NO: 114024 - protein, 10 aa, Homo Sapiens
MAYEGQYDAY

SEQ ID NO: 114025 - protein, 10 aa, Homo Sapiens
MAYGASFLSF

SEQ ID NO: 114026 - protein, 10 aa, Homo Sapiens
NGIGHPLPPY

SEQ ID NO: 114027 - protein, 10 aa, Homo Sapiens
PTFTASQYRA

SEQ ID NO: 114028 - protein, 10 aa, Homo Sapiens
QAGPATGQAY

SEQ ID NO: 114029 - protein, 10 aa, Homo Sapiens
QGIPFKPGTF

SEQ ID NO: 114030 - protein, 10 aa, Homo Sapiens
QMPPWNQTEF

SEQ ID NO: 114031 - protein, 10 aa, Homo Sapiens
RAFPYGNVAF

SEQ ID NO: 114032 - protein, 10 aa, Homo Sapiens
RIPEFNMAAF

SEQ ID NO: 114033 - protein, 10 aa, Homo Sapiens
RIYPYAAISY

SEQ ID NO: 114034 - protein, 10 aa, Homo Sapiens
RLPETELGEY

SEQ ID NO: 114035 - protein, 10 aa, Homo Sapiens
RSGDFTTSSY

SEQ ID NO: 114036 - protein, 10 aa, Homo Sapiens
RTVDWALAEY

SEQ ID NO: 114037 - protein, 10 aa, Homo Sapiens
RVFEGPYKEY

SEQ ID NO: 114038 - protein, 10 aa, Homo Sapiens
RVIPAALKAF

SEQ ID NO: 114039 - protein, 10 aa, Homo Sapiens
SACRTSGQTF

SEQ ID NO: 114040 - protein, 10 aa, Homo Sapiens
SAVEKKLAEY

SEQ ID NO: 114041 - protein, 10 aa, Homo Sapiens
SAYPYYASAF

SEQ ID NO: 114042 - protein, 10 aa, Homo Sapiens
SAYSGHYIAH

SEQ ID NO: 114043 - protein, 10 aa, Homo Sapiens
SIIEKETKEY

SEQ ID NO: 114044 - protein, 10 aa, Homo Sapiens
SIRPDNMSEY

SEQ ID NO: 114045 - protein, 10 aa, Homo Sapiens
SLPNFKQNEF

SEQ ID NO: 114046 - protein, 10 aa, Homo Sapiens
SLVVIQQPSL

SEQ ID NO: 114047 - protein, 10 aa, Homo Sapiens
SQIPGPTAAY

SEQ ID NO: 114048 - protein, 10 aa, Homo Sapiens
SSPGRDLPPF

SEQ ID NO: 114049 - protein, 10 aa, Homo Sapiens
TAFPGGAKEL

SEQ ID NO: 114050 - protein, 10 aa, Homo Sapiens
TKTGMLSRAT

SEQ ID NO: 114051 - protein, 10 aa, Homo Sapiens
TLFPFEAEAY

SEQ ID NO: 114052 - protein, 10 aa, Homo Sapiens
TLPPHHPYPH

SEQ ID NO: 114053 - protein, 10 aa, Homo Sapiens
TTKVGPNATY

SEQ ID NO: 114054 - protein, 10 aa, Homo Sapiens
VAAMPRPVSY

SEQ ID NO: 114055 - protein, 10 aa, Homo Sapiens
VAMNPTNTVF

SEQ ID NO: 114056 - protein, 10 aa, Homo Sapiens
VIFPLIYSEM

SEQ ID NO: 114057 - protein, 10 aa, Homo Sapiens
VIVPHLTESY

SEQ ID NO: 114058 - protein, 10 aa, Homo Sapiens
VLAPHLTRAY

SEQ ID NO: 114059 - protein, 10 aa, Homo Sapiens
VLKPGMVVTF

SEQ ID NO: 114060 - protein, 10 aa, Homo Sapiens
VLPHQPLATY

SEQ ID NO: 114061 - protein, 10 aa, Homo Sapiens
VLVQHNLVSY

SEQ ID NO: 114062 - protein, 10 aa, Homo Sapiens
VMFPGNSPSY

SEQ ID NO: 114063 - protein, 10 aa, Homo Sapiens
VQFDGTNSAF

SEQ ID NO: 114064 - protein, 10 aa, Homo Sapiens
VQPTFTASQY

SEQ ID NO: 114065 - protein, 10 aa, Homo Sapiens
VQPVFNLAAY

SEQ ID NO: 114066 - protein, 10 aa, Homo Sapiens
VSNMLLAEAY

SEQ ID NO: 114067 - protein, 10 aa, Homo Sapiens
YAAPFAMMSH

SEQ ID NO: 114068 - protein, 10 aa, Homo Sapiens
YAAPHPLQSY

SEQ ID NO: 114069 - protein, 10 aa, Homo Sapiens
YAFAGMYHVF

SEQ ID NO: 114070 - protein, 10 aa, Homo Sapiens
YAFPKAVSVF

SEQ ID NO: 114071 - protein, 10 aa, Homo Sapiens
YINPAKLTPY

SEQ ID NO: 114072 - protein, 10 aa, Homo Sapiens
YINPYQPNEY

SEQ ID NO: 114073 - protein, 10 aa, Homo Sapiens
YIPEHSPEYY

SEQ ID NO: 114074 - protein, 10 aa, Homo Sapiens
YLAPFSLSNY

SEQ ID NO: 114075 - protein, 10 aa, Homo Sapiens
YLPDFRFTPF

SEQ ID NO: 114076 - protein, 10 aa, Homo Sapiens
YLPQHTIETY

SEQ ID NO: 114077 - protein, 10 aa, Homo Sapiens
YLRGEPFHEY

SEQ ID NO: 114078 - protein, 10 aa, Homo Sapiens
YLRPGQAAAF

SEQ ID NO: 114079 - protein, 10 aa, Homo Sapiens
YMIDPSGVSY

SEQ ID NO: 114080 - protein, 10 aa, Homo Sapiens
YMNPYQLNAY

SEQ ID NO: 114081 - protein, 10 aa, Homo Sapiens
YSPDHTNNSF

SEQ ID NO: 114082 - protein, 10 aa, Homo Sapiens
YSYAGGRGSY

SEQ ID NO: 114083 - protein, 10 aa, Homo Sapiens
YVIPHPVHAF

SEQ ID NO: 114084 - protein, 10 aa, Homo Sapiens
YVNPANTHQF

SEQ ID NO: 114085 - protein, 11 aa, Homo Sapiens
ALRPSTSRSLY

SEQ ID NO: 114086 - protein, 11 aa, Homo Sapiens
ATIDPDTISAL

SEQ ID NO: 114087 - protein, 11 aa, Homo Sapiens
AVRDISEASVF

SEQ ID NO: 114088 - protein, 11 aa, Homo Sapiens
FAKKAGAHSVY

SEQ ID NO: 114089 - protein, 11 aa, Homo Sapiens
FAVDPEKIQLY

SEQ ID NO: 114090 - protein, 11 aa, Homo Sapiens
FAYDGKDYLTL

SEQ ID NO: 114091 - protein, 11 aa, Homo Sapiens
FSKYPASSSVF

SEQ ID NO: 114092 - protein, 11 aa, Homo Sapiens
GIHETTFNSIM

SEQ ID NO: 114093 - protein, 11 aa, Homo Sapiens
IGPPGSGKTTY

SEQ ID NO: 114094 - protein, 11 aa, Homo Sapiens
KLIEPGFLTAF

SEQ ID NO: 114095 - protein, 11 aa, Homo Sapiens
KQAKEFLEYVY

SEQ ID NO: 114096 - protein, 11 aa, Homo Sapiens
LAAAAAASYQV

SEQ ID NO: 114097 - protein, 11 aa, Homo Sapiens
MAALASLMGAL

SEQ ID NO: 114098 - protein, 11 aa, Homo Sapiens
RIMDPDVITGY

SEQ ID NO: 114099 - protein, 11 aa, Homo Sapiens
SAKDARGMTPF

SEQ ID NO: 114100 - protein, 11 aa, Homo Sapiens
SAVNPEHLSYF

SEQ ID NO: 114101 - protein, 11 aa, Homo Sapiens
SAYDGKDYIAL

SEQ ID NO: 114102 - protein, 11 aa, Homo Sapiens
SSINPDHLSYF

SEQ ID NO: 114103 - protein, 11 aa, Homo Sapiens
SSINPDHLTYF

SEQ ID NO: 114104 - protein, 11 aa, Homo Sapiens
SSTISSNVASK

SEQ ID NO: 114105 - protein, 11 aa, Homo Sapiens
STINPDHLSYF

SEQ ID NO: 114106 - protein, 11 aa, Homo Sapiens
SVIDSAELQAY

SEQ ID NO: 114107 - protein, 11 aa, Homo Sapiens
TIFEGGKATCF

SEQ ID NO: 114108 - protein, 11 aa, Homo Sapiens
TTIDPRWLVEF

SEQ ID NO: 114109 - protein, 11 aa, Homo Sapiens
VLRPPGGGSNF

SEQ ID NO: 114110 - protein, 11 aa, Homo Sapiens
YAVDPAQLQAL

SEQ ID NO: 114111 - protein, 11 aa, Homo Sapiens
YAYAAQNLLSH

SEQ ID NO: 114112 - protein, 11 aa, Homo Sapiens
YAYDGKDYIAL

SEQ ID NO: 114113 - protein, 11 aa, Homo Sapiens
YAYPATAAAPM

SEQ ID NO: 114114 - protein, 8 aa, Homo Sapiens
ADDHTVKL

SEQ ID NO: 114115 - protein, 8 aa, Homo Sapiens
AEAAAAVV

SEQ ID NO: 114116 - protein, 8 aa, Homo Sapiens
AEAGPIVI

SEQ ID NO: 114117 - protein, 8 aa, Homo Sapiens
AEAKFREI

SEQ ID NO: 114118 - protein, 8 aa, Homo Sapiens
AEAPHIVV

SEQ ID NO: 114119 - protein, 8 aa, Homo Sapiens
AEAPTALV

SEQ ID NO: 114120 - protein, 8 aa, Homo Sapiens
AEAQPMAV

SEQ ID NO: 114121 - protein, 8 aa, Homo Sapiens
AEAVGVKI

SEQ ID NO: 114122 - protein, 8 aa, Homo Sapiens
AEAVVNTV

SEQ ID NO: 114123 - protein, 8 aa, Homo Sapiens
AEDKSWRV

SEQ ID NO: 114124 - protein, 8 aa, Homo Sapiens
AEEKAVLI

SEQ ID NO: 114125 - protein, 8 aa, Homo Sapiens
AEEVWARV

SEQ ID NO: 114126 - protein, 8 aa, Homo Sapiens
AEFEVHEV

SEQ ID NO: 114127 - protein, 8 aa, Homo Sapiens
AEFHVQRV

SEQ ID NO: 114128 - protein, 8 aa, Homo Sapiens
AEFVVQKI

SEQ ID NO: 114129 - protein, 8 aa, Homo Sapiens
AEGPETKI

SEQ ID NO: 114130 - protein, 8 aa, Homo Sapiens
AEGSVTSV

SEQ ID NO: 114131 - protein, 8 aa, Homo Sapiens
AEGYFISI

SEQ ID NO: 114132 - protein, 8 aa, Homo Sapiens
AEHPIVIV

SEQ ID NO: 114133 - protein, 8 aa, Homo Sapiens
AEHPTIKI

SEQ ID NO: 114134 - protein, 8 aa, Homo Sapiens
AEHRMLVV

SEQ ID NO: 114135 - protein, 8 aa, Homo Sapiens
AEHRPPKI

SEQ ID NO: 114136 - protein, 8 aa, Homo Sapiens
AEIAHSQV

SEQ ID NO: 114137 - protein, 8 aa, Homo Sapiens
AEIATRLA

SEQ ID NO: 114138 - protein, 8 aa, Homo Sapiens
AEIAVNAV

SEQ ID NO: 114139 - protein, 8 aa, Homo Sapiens
AEIDAHLV

SEQ ID NO: 114140 - protein, 8 aa, Homo Sapiens
AEIDFRLV

SEQ ID NO: 114141 - protein, 8 aa, Homo Sapiens
AEIGFLTV

SEQ ID NO: 114142 - protein, 8 aa, Homo Sapiens
AEIITNQI

SEQ ID NO: 114143 - protein, 8 aa, Homo Sapiens
AEIKVKLI

SEQ ID NO: 114144 - protein, 8 aa, Homo Sapiens
AEILTTKV

SEQ ID NO: 114145 - protein, 8 aa, Homo Sapiens
AEIPLRMV

SEQ ID NO: 114146 - protein, 8 aa, Homo Sapiens
AEIRHVLV

SEQ ID NO: 114147 - protein, 8 aa, Homo Sapiens
AEIRVHTV

SEQ ID NO: 114148 - protein, 8 aa, Homo Sapiens
AEIVTKTI

SEQ ID NO: 114149 - protein, 8 aa, Homo Sapiens
AEIVTPEI

SEQ ID NO: 114150 - protein, 8 aa, Homo Sapiens
AEKKVVKI

SEQ ID NO: 114151 - protein, 8 aa, Homo Sapiens
AELFLDTV

SEQ ID NO: 114152 - protein, 8 aa, Homo Sapiens
AELFVETI

SEQ ID NO: 114153 - protein, 8 aa, Homo Sapiens
AELKSSTV

SEQ ID NO: 114154 - protein, 8 aa, Homo Sapiens
AELKTESV

SEQ ID NO: 114155 - protein, 8 aa, Homo Sapiens
AELLFNTI

SEQ ID NO: 114156 - protein, 8 aa, Homo Sapiens
AELTVIKV

SEQ ID NO: 114157 - protein, 8 aa, Homo Sapiens
AELVFKCV

SEQ ID NO: 114158 - protein, 8 aa, Homo Sapiens
AEMAQNAV

SEQ ID NO: 114159 - protein, 8 aa, Homo Sapiens
AEMAVSRV

SEQ ID NO: 114160 - protein, 8 aa, Homo Sapiens
AEMKAQEV

SEQ ID NO: 114161 - protein, 8 aa, Homo Sapiens
AEMTTRMV

SEQ ID NO: 114162 - protein, 8 aa, Homo Sapiens
AENIFKSV

SEQ ID NO: 114163 - protein, 8 aa, Homo Sapiens
AENVSSKV

SEQ ID NO: 114164 - protein, 8 aa, Homo Sapiens
AEPHVSGV

SEQ ID NO: 114165 - protein, 8 aa, Homo Sapiens
AEQLMTLI

SEQ ID NO: 114166 - protein, 8 aa, Homo Sapiens
AERIFSEV

SEQ ID NO: 114167 - protein, 8 aa, Homo Sapiens
AERKFKQV

SEQ ID NO: 114168 - protein, 8 aa, Homo Sapiens
AERKSPEI

SEQ ID NO: 114169 - protein, 8 aa, Homo Sapiens
AERLFNLV

SEQ ID NO: 114170 - protein, 8 aa, Homo Sapiens
AESHVSGI

SEQ ID NO: 114171 - protein, 8 aa, Homo Sapiens
AESPTVHV

SEQ ID NO: 114172 - protein, 8 aa, Homo Sapiens
AESPVIEV

SEQ ID NO: 114173 - protein, 8 aa, Homo Sapiens
AETAVSVI

SEQ ID NO: 114174 - protein, 8 aa, Homo Sapiens
AETSQRLV

SEQ ID NO: 114175 - protein, 8 aa, Homo Sapiens
AETYLHRI

SEQ ID NO: 114176 - protein, 8 aa, Homo Sapiens
AEVIPLAL

SEQ ID NO: 114177 - protein, 8 aa, Homo Sapiens
AEVPTMAV

SEQ ID NO: 114178 - protein, 8 aa, Homo Sapiens
AEVPTQLV

SEQ ID NO: 114179 - protein, 8 aa, Homo Sapiens
AEVSLMEV

SEQ ID NO: 114180 - protein, 8 aa, Homo Sapiens
AEVVVTEI

SEQ ID NO: 114181 - protein, 8 aa, Homo Sapiens
AEYIQKNV

SEQ ID NO: 114182 - protein, 8 aa, Homo Sapiens
AEYLTPVL

SEQ ID NO: 114183 - protein, 8 aa, Homo Sapiens
AEYPTISI

SEQ ID NO: 114184 - protein, 8 aa, Homo Sapiens
AEYRHPTV

SEQ ID NO: 114185 - protein, 8 aa, Homo Sapiens
AEYVPEKV

SEQ ID NO: 114186 - protein, 8 aa, Homo Sapiens
CEYIVKKI

SEQ ID NO: 114187 - protein, 8 aa, Homo Sapiens
DPDKRISI

SEQ ID NO: 114188 - protein, 8 aa, Homo Sapiens
DRQQQITV

SEQ ID NO: 114189 - protein, 8 aa, Homo Sapiens
EAASQGLK

SEQ ID NO: 114190 - protein, 8 aa, Homo Sapiens
EALITKIG

SEQ ID NO: 114191 - protein, 8 aa, Homo Sapiens
EATLLQKL

SEQ ID NO: 114192 - protein, 8 aa, Homo Sapiens
ELQTHPEL

SEQ ID NO: 114193 - protein, 8 aa, Homo Sapiens
EQTLPTKL

SEQ ID NO: 114194 - protein, 8 aa, Homo Sapiens
ESLRLILV

SEQ ID NO: 114195 - protein, 8 aa, Homo Sapiens
FEAQVVRV

SEQ ID NO: 114196 - protein, 8 aa, Homo Sapiens
FEELTNLI

SEQ ID NO: 114197 - protein, 8 aa, Homo Sapiens
FEEVWGVI

SEQ ID NO: 114198 - protein, 8 aa, Homo Sapiens
FEFRPELV

SEQ ID NO: 114199 - protein, 8 aa, Homo Sapiens
FEGGVSSV

SEQ ID NO: 114200 - protein, 8 aa, Homo Sapiens
FEGLITTI

SEQ ID NO: 114201 - protein, 8 aa, Homo Sapiens
FEHKAQHI

SEQ ID NO: 114202 - protein, 8 aa, Homo Sapiens
FEHVTSEI

SEQ ID NO: 114203 - protein, 8 aa, Homo Sapiens
FEKVAAGV

SEQ ID NO: 114204 - protein, 8 aa, Homo Sapiens
FEMAVAKV

SEQ ID NO: 114205 - protein, 8 aa, Homo Sapiens
FEVGARKV

SEQ ID NO: 114206 - protein, 8 aa, Homo Sapiens
FEVILTRI

SEQ ID NO: 114207 - protein, 8 aa, Homo Sapiens
FEWVAERV

SEQ ID NO: 114208 - protein, 8 aa, Homo Sapiens
FEWVVNRI

SEQ ID NO: 114209 - protein, 8 aa, Homo Sapiens
FEYILSHV

SEQ ID NO: 114210 - protein, 8 aa, Homo Sapiens
FEYKGKKV

SEQ ID NO: 114211 - protein, 8 aa, Homo Sapiens
FEYKPEVI

SEQ ID NO: 114212 - protein, 8 aa, Homo Sapiens
GEAEFNRI

SEQ ID NO: 114213 - protein, 8 aa, Homo Sapiens
GEAMLRKI

SEQ ID NO: 114214 - protein, 8 aa, Homo Sapiens
GEFELMHV

SEQ ID NO: 114215 - protein, 8 aa, Homo Sapiens
GEFGVRNV

SEQ ID NO: 114216 - protein, 8 aa, Homo Sapiens
GEFKFTNV

SEQ ID NO: 114217 - protein, 8 aa, Homo Sapiens
GEFKVHRV

SEQ ID NO: 114218 - protein, 8 aa, Homo Sapiens
GEFRTTTV

SEQ ID NO: 114219 - protein, 8 aa, Homo Sapiens
GEGNIRSV

SEQ ID NO: 114220 - protein, 8 aa, Homo Sapiens
GEGPIAVI

SEQ ID NO: 114221 - protein, 8 aa, Homo Sapiens
GEGPSSLI

SEQ ID NO: 114222 - protein, 8 aa, Homo Sapiens
GEGVIVKI

SEQ ID NO: 114223 - protein, 8 aa, Homo Sapiens
GEIILHSV

SEQ ID NO: 114224 - protein, 8 aa, Homo Sapiens
GEIPVVAI

SEQ ID NO: 114225 - protein, 8 aa, Homo Sapiens
GEIRTITV

SEQ ID NO: 114226 - protein, 8 aa, Homo Sapiens
GEISMEKV

SEQ ID NO: 114227 - protein, 8 aa, Homo Sapiens
GEISSPVI

SEQ ID NO: 114228 - protein, 8 aa, Homo Sapiens
GELHSKLI

SEQ ID NO: 114229 - protein, 8 aa, Homo Sapiens
GELKITSV

SEQ ID NO: 114230 - protein, 8 aa, Homo Sapiens
GELVTEGV

SEQ ID NO: 114231 - protein, 8 aa, Homo Sapiens
GEMKGSAI

SEQ ID NO: 114232 - protein, 8 aa, Homo Sapiens
GERPQITI

SEQ ID NO: 114233 - protein, 8 aa, Homo Sapiens
GESKFITV

SEQ ID NO: 114234 - protein, 8 aa, Homo Sapiens
GESTVRTI

SEQ ID NO: 114235 - protein, 8 aa, Homo Sapiens
GETPTTEV

SEQ ID NO: 114236 - protein, 8 aa, Homo Sapiens
GETRICKI

SEQ ID NO: 114237 - protein, 8 aa, Homo Sapiens
GEVLISRV

SEQ ID NO: 114238 - protein, 8 aa, Homo Sapiens
GEVPISFV

SEQ ID NO: 114239 - protein, 8 aa, Homo Sapiens
GEVPVLNV

SEQ ID NO: 114240 - protein, 8 aa, Homo Sapiens
GEVRFSAV

SEQ ID NO: 114241 - protein, 8 aa, Homo Sapiens
GEVSFINI

SEQ ID NO: 114242 - protein, 8 aa, Homo Sapiens
GEVTFKSI

SEQ ID NO: 114243 - protein, 8 aa, Homo Sapiens
GEVTVRVV

SEQ ID NO: 114244 - protein, 8 aa, Homo Sapiens
GEVVTIRV

SEQ ID NO: 114245 - protein, 8 aa, Homo Sapiens
GEWEPPVI

SEQ ID NO: 114246 - protein, 8 aa, Homo Sapiens
GEYAVRAI

SEQ ID NO: 114247 - protein, 8 aa, Homo Sapiens
GEYLFERL

SEQ ID NO: 114248 - protein, 8 aa, Homo Sapiens
HEAEFSKI

SEQ ID NO: 114249 - protein, 8 aa, Homo Sapiens
HEAIVKNV

SEQ ID NO: 114250 - protein, 8 aa, Homo Sapiens
HEAPMTKI

SEQ ID NO: 114251 - protein, 8 aa, Homo Sapiens
HEAPTTKI

SEQ ID NO: 114252 - protein, 8 aa, Homo Sapiens
HEDLTVKI

SEQ ID NO: 114253 - protein, 8 aa, Homo Sapiens
HEDPVIAV

SEQ ID NO: 114254 - protein, 8 aa, Homo Sapiens
HEFLQTEI

SEQ ID NO: 114255 - protein, 8 aa, Homo Sapiens
HEGETSYI

SEQ ID NO: 114256 - protein, 8 aa, Homo Sapiens
HEGFVRGI

SEQ ID NO: 114257 - protein, 8 aa, Homo Sapiens
HEGKPLKL

SEQ ID NO: 114258 - protein, 8 aa, Homo Sapiens
HEICSNLV

SEQ ID NO: 114259 - protein, 8 aa, Homo Sapiens
HEIEVETI

SEQ ID NO: 114260 - protein, 8 aa, Homo Sapiens
HEIKTIKI

SEQ ID NO: 114261 - protein, 8 aa, Homo Sapiens
HEITVLII

SEQ ID NO: 114262 - protein, 8 aa, Homo Sapiens
HEKIFNTV

SEQ ID NO: 114263 - protein, 8 aa, Homo Sapiens
HELITLEI

SEQ ID NO: 114264 - protein, 8 aa, Homo Sapiens
HESKPVNV

SEQ ID NO: 114265 - protein, 8 aa, Homo Sapiens
HETTFNSI

SEQ ID NO: 114266 - protein, 8 aa, Homo Sapiens
HEYTTKEI

SEQ ID NO: 114267 - protein, 8 aa, Homo Sapiens
HEYVHGDI

SEQ ID NO: 114268 - protein, 8 aa, Homo Sapiens
HIAGILAR

SEQ ID NO: 114269 - protein, 8 aa, Homo Sapiens
IEALLHTV

SEQ ID NO: 114270 - protein, 8 aa, Homo Sapiens
IEAQIREI

SEQ ID NO: 114271 - protein, 8 aa, Homo Sapiens
IEDLVVHI

SEQ ID NO: 114272 - protein, 8 aa, Homo Sapiens
IEDRVKKI

SEQ ID NO: 114273 - protein, 8 aa, Homo Sapiens
IEEPSAKI

SEQ ID NO: 114274 - protein, 8 aa, Homo Sapiens
IEEYVHRI

SEQ ID NO: 114275 - protein, 8 aa, Homo Sapiens
IEFICKTI

SEQ ID NO: 114276 - protein, 8 aa, Homo Sapiens
IEHISSLI

SEQ ID NO: 114277 - protein, 8 aa, Homo Sapiens
IEHLTTLL

SEQ ID NO: 114278 - protein, 8 aa, Homo Sapiens
IEHVFNII

SEQ ID NO: 114279 - protein, 8 aa, Homo Sapiens
IEHYARQV

SEQ ID NO: 114280 - protein, 8 aa, Homo Sapiens
IEIGVQHI

SEQ ID NO: 114281 - protein, 8 aa, Homo Sapiens
IEISGPKV

SEQ ID NO: 114282 - protein, 8 aa, Homo Sapiens
IEIYVQKV

SEQ ID NO: 114283 - protein, 8 aa, Homo Sapiens
IEKLFQSV

SEQ ID NO: 114284 - protein, 8 aa, Homo Sapiens
IEKNIELF

SEQ ID NO: 114285 - protein, 8 aa, Homo Sapiens
IELDMRTI

SEQ ID NO: 114286 - protein, 8 aa, Homo Sapiens
IENESVKI

SEQ ID NO: 114287 - protein, 8 aa, Homo Sapiens
IERATRLV

SEQ ID NO: 114288 - protein, 8 aa, Homo Sapiens
IERIHREV

SEQ ID NO: 114289 - protein, 8 aa, Homo Sapiens
IERLINLL

SEQ ID NO: 114290 - protein, 8 aa, Homo Sapiens
IESSSPEV

SEQ ID NO: 114291 - protein, 8 aa, Homo Sapiens
IESTTQKI

SEQ ID NO: 114292 - protein, 8 aa, Homo Sapiens
IETRVILV

SEQ ID NO: 114293 - protein, 8 aa, Homo Sapiens
IEVETHKV

SEQ ID NO: 114294 - protein, 8 aa, Homo Sapiens
IEVGVVTV

SEQ ID NO: 114295 - protein, 8 aa, Homo Sapiens
IEVLQPLI

SEQ ID NO: 114296 - protein, 8 aa, Homo Sapiens
IEVSFREL

SEQ ID NO: 114297 - protein, 8 aa, Homo Sapiens
IREFLQKI

SEQ ID NO: 114298 - protein, 8 aa, Homo Sapiens
KEAELRQV

SEQ ID NO: 114299 - protein, 8 aa, Homo Sapiens
KEAVLNGL

SEQ ID NO: 114300 - protein, 8 aa, Homo Sapiens
KEFEFSQL

SEQ ID NO: 114301 - protein, 8 aa, Homo Sapiens
KEFENPEV

SEQ ID NO: 114302 - protein, 8 aa, Homo Sapiens
KEFITALI

SEQ ID NO: 114303 - protein, 8 aa, Homo Sapiens
KEFVFDTI

SEQ ID NO: 114304 - protein, 8 aa, Homo Sapiens
KEGPSPKV

SEQ ID NO: 114305 - protein, 8 aa, Homo Sapiens
KEHIAASV

SEQ ID NO: 114306 - protein, 8 aa, Homo Sapiens
KEILLKAV

SEQ ID NO: 114307 - protein, 8 aa, Homo Sapiens
KEIPVTVV

SEQ ID NO: 114308 - protein, 8 aa, Homo Sapiens
KELDSKTI

SEQ ID NO: 114309 - protein, 8 aa, Homo Sapiens
KEQEFRSI

SEQ ID NO: 114310 - protein, 8 aa, Homo Sapiens
KETIAKCI

SEQ ID NO: 114311 - protein, 8 aa, Homo Sapiens
KEVKVSSV

SEQ ID NO: 114312 - protein, 8 aa, Homo Sapiens
KEYLVSLI

SEQ ID NO: 114313 - protein, 8 aa, Homo Sapiens
LEAAIRTV

SEQ ID NO: 114314 - protein, 8 aa, Homo Sapiens
LEAFVKMV

SEQ ID NO: 114315 - protein, 8 aa, Homo Sapiens
LEAFVRMV

SEQ ID NO: 114316 - protein, 8 aa, Homo Sapiens
LEEKTRLI

SEQ ID NO: 114317 - protein, 8 aa, Homo Sapiens
LEFKGRKI

SEQ ID NO: 114318 - protein, 8 aa, Homo Sapiens
LEFYLRKI

SEQ ID NO: 114319 - protein, 8 aa, Homo Sapiens
LEHNFSAI

SEQ ID NO: 114320 - protein, 8 aa, Homo Sapiens
LEKIISQL

SEQ ID NO: 114321 - protein, 8 aa, Homo Sapiens
LEKKFHTV

SEQ ID NO: 114322 - protein, 8 aa, Homo Sapiens
LEKLGILI

SEQ ID NO: 114323 - protein, 8 aa, Homo Sapiens
LEKPSRTV

SEQ ID NO: 114324 - protein, 8 aa, Homo Sapiens
LELGFSKV

SEQ ID NO: 114325 - protein, 8 aa, Homo Sapiens
LENEVSRQ

SEQ ID NO: 114326 - protein, 8 aa, Homo Sapiens
LENVAITV

SEQ ID NO: 114327 - protein, 8 aa, Homo Sapiens
LESFLKQV

SEQ ID NO: 114328 - protein, 8 aa, Homo Sapiens
LETTVQKV

SEQ ID NO: 114329 - protein, 8 aa, Homo Sapiens
LEVLVKGV

SEQ ID NO: 114330 - protein, 8 aa, Homo Sapiens
LEVRLQAV

SEQ ID NO: 114331 - protein, 8 aa, Homo Sapiens
LEWKIIYV

SEQ ID NO: 114332 - protein, 8 aa, Homo Sapiens
LEYEARQI

SEQ ID NO: 114333 - protein, 8 aa, Homo Sapiens
LEYPTISL

SEQ ID NO: 114334 - protein, 8 aa, Homo Sapiens
LEYRVTQV

SEQ ID NO: 114335 - protein, 8 aa, Homo Sapiens
MEFPTAEV

SEQ ID NO: 114336 - protein, 8 aa, Homo Sapiens
MEFQVPVI

SEQ ID NO: 114337 - protein, 8 aa, Homo Sapiens
MEHGTVTV

SEQ ID NO: 114338 - protein, 8 aa, Homo Sapiens
MEIKITTV

SEQ ID NO: 114339 - protein, 8 aa, Homo Sapiens
MEIMTREV

SEQ ID NO: 114340 - protein, 8 aa, Homo Sapiens
MEIPVTLI

SEQ ID NO: 114341 - protein, 8 aa, Homo Sapiens
MELSQPEV

SEQ ID NO: 114342 - protein, 8 aa, Homo Sapiens
MEQQSISI

SEQ ID NO: 114343 - protein, 8 aa, Homo Sapiens
MEQQTISI

SEQ ID NO: 114344 - protein, 8 aa, Homo Sapiens
MEVQTKKV

SEQ ID NO: 114345 - protein, 8 aa, Homo Sapiens
MEWDTQVV

SEQ ID NO: 114346 - protein, 8 aa, Homo Sapiens
NEIPTKNI

SEQ ID NO: 114347 - protein, 8 aa, Homo Sapiens
NEQPPVVL

SEQ ID NO: 114348 - protein, 8 aa, Homo Sapiens
NEVNFREI

SEQ ID NO: 114349 - protein, 8 aa, Homo Sapiens
QEAYVRVV

SEQ ID NO: 114350 - protein, 8 aa, Homo Sapiens
QEHHTLRV

SEQ ID NO: 114351 - protein, 8 aa, Homo Sapiens
QEHQIVLV

SEQ ID NO: 114352 - protein, 8 aa, Homo Sapiens
QELPTTLV

SEQ ID NO: 114353 - protein, 8 aa, Homo Sapiens
QEYLFERI

SEQ ID NO: 114354 - protein, 8 aa, Homo Sapiens
QEYPTLKV

SEQ ID NO: 114355 - protein, 8 aa, Homo Sapiens
REAAFRNI

SEQ ID NO: 114356 - protein, 8 aa, Homo Sapiens
READFARV

SEQ ID NO: 114357 - protein, 8 aa, Homo Sapiens
RECESVLV

SEQ ID NO: 114358 - protein, 8 aa, Homo Sapiens
REDAARAI

SEQ ID NO: 114359 - protein, 8 aa, Homo Sapiens
REELNREL

SEQ ID NO: 114360 - protein, 8 aa, Homo Sapiens
REFEPDAI

SEQ ID NO: 114361 - protein, 8 aa, Homo Sapiens
REFKLSKV

SEQ ID NO: 114362 - protein, 8 aa, Homo Sapiens
REFLFNAI

SEQ ID NO: 114363 - protein, 8 aa, Homo Sapiens
REFQTSAI

SEQ ID NO: 114364 - protein, 8 aa, Homo Sapiens
REFQTSVV

SEQ ID NO: 114365 - protein, 8 aa, Homo Sapiens
REHPSLRL

SEQ ID NO: 114366 - protein, 8 aa, Homo Sapiens
REHPVPLL

SEQ ID NO: 114367 - protein, 8 aa, Homo Sapiens
REIEGRAI

SEQ ID NO: 114368 - protein, 8 aa, Homo Sapiens
REIGVRNI

SEQ ID NO: 114369 - protein, 8 aa, Homo Sapiens
REIIINAV

SEQ ID NO: 114370 - protein, 8 aa, Homo Sapiens
REIQQRVV

SEQ ID NO: 114371 - protein, 8 aa, Homo Sapiens
REIVQQLI

SEQ ID NO: 114372 - protein, 8 aa, Homo Sapiens
REKELAKV

SEQ ID NO: 114373 - protein, 8 aa, Homo Sapiens
RELEFNEI

SEQ ID NO: 114374 - protein, 8 aa, Homo Sapiens
RELEVRQV

SEQ ID NO: 114375 - protein, 8 aa, Homo Sapiens
RELKLSKV

SEQ ID NO: 114376 - protein, 8 aa, Homo Sapiens
RELQLQEV

SEQ ID NO: 114377 - protein, 8 aa, Homo Sapiens
RELVSRQV

SEQ ID NO: 114378 - protein, 8 aa, Homo Sapiens
RENLSVEI

SEQ ID NO: 114379 - protein, 8 aa, Homo Sapiens
RENTQTTI

SEQ ID NO: 114380 - protein, 8 aa, Homo Sapiens
RETAPRTI

SEQ ID NO: 114381 - protein, 8 aa, Homo Sapiens
REVLINNI

SEQ ID NO: 114382 - protein, 8 aa, Homo Sapiens
REYIGRSV

SEQ ID NO: 114383 - protein, 8 aa, Homo Sapiens
REYMVEKI

SEQ ID NO: 114384 - protein, 8 aa, Homo Sapiens
SEAAPLLV

SEQ ID NO: 114385 - protein, 8 aa, Homo Sapiens
SEAIVTVI

SEQ ID NO: 114386 - protein, 8 aa, Homo Sapiens
SEAKPLAV

SEQ ID NO: 114387 - protein, 8 aa, Homo Sapiens
SEAKSVKV

SEQ ID NO: 114388 - protein, 8 aa, Homo Sapiens
SEAYLVGL

SEQ ID NO: 114389 - protein, 8 aa, Homo Sapiens
SEDATIKV

SEQ ID NO: 114390 - protein, 8 aa, Homo Sapiens
SEDKSIKV

SEQ ID NO: 114391 - protein, 8 aa, Homo Sapiens
SEDKSIRV

SEQ ID NO: 114392 - protein, 8 aa, Homo Sapiens
SEDRIITI

SEQ ID NO: 114393 - protein, 8 aa, Homo Sapiens
SEFETHNV

SEQ ID NO: 114394 - protein, 8 aa, Homo Sapiens
SEFSPRSV

SEQ ID NO: 114395 - protein, 8 aa, Homo Sapiens
SEHPGLSI

SEQ ID NO: 114396 - protein, 8 aa, Homo Sapiens
SEIATTGV

SEQ ID NO: 114397 - protein, 8 aa, Homo Sapiens
SEIESVKI

SEQ ID NO: 114398 - protein, 8 aa, Homo Sapiens
SEIGTKQI

SEQ ID NO: 114399 - protein, 8 aa, Homo Sapiens
SEIKLDGV

SEQ ID NO: 114400 - protein, 8 aa, Homo Sapiens
SEILHRVI

SEQ ID NO: 114401 - protein, 8 aa, Homo Sapiens
SEIVGKRI

SEQ ID NO: 114402 - protein, 8 aa, Homo Sapiens
SEKLFRTV

SEQ ID NO: 114403 - protein, 8 aa, Homo Sapiens
SELITKAV

SEQ ID NO: 114404 - protein, 8 aa, Homo Sapiens
SELPALGI

SEQ ID NO: 114405 - protein, 8 aa, Homo Sapiens
SELPAVCI

SEQ ID NO: 114406 - protein, 8 aa, Homo Sapiens
SELPSVNI

SEQ ID NO: 114407 - protein, 8 aa, Homo Sapiens
SELRSVLV

SEQ ID NO: 114408 - protein, 8 aa, Homo Sapiens
SENPSVYV

SEQ ID NO: 114409 - protein, 8 aa, Homo Sapiens
SESDFRQV

SEQ ID NO: 114410 - protein, 8 aa, Homo Sapiens
SETQFSHL

SEQ ID NO: 114411 - protein, 8 aa, Homo Sapiens
SEVEIIHV

SEQ ID NO: 114412 - protein, 8 aa, Homo Sapiens
SEVELMKV

SEQ ID NO: 114413 - protein, 8 aa, Homo Sapiens
SEVESLRL

SEQ ID NO: 114414 - protein, 8 aa, Homo Sapiens
SEVEVIHV

SEQ ID NO: 114415 - protein, 8 aa, Homo Sapiens
SEVLLRHI

SEQ ID NO: 114416 - protein, 8 aa, Homo Sapiens
SEVPMVLV

SEQ ID NO: 114417 - protein, 8 aa, Homo Sapiens
SEWRNLGV

SEQ ID NO: 114418 - protein, 8 aa, Homo Sapiens
SEYIATKI

SEQ ID NO: 114419 - protein, 8 aa, Homo Sapiens
SEYITHEI

SEQ ID NO: 114420 - protein, 8 aa, Homo Sapiens
SEYLHINI

SEQ ID NO: 114421 - protein, 8 aa, Homo Sapiens
TEAEVRGL

SEQ ID NO: 114422 - protein, 8 aa, Homo Sapiens
TEAKPAVV

SEQ ID NO: 114423 - protein, 8 aa, Homo Sapiens
TEDLVLKI

SEQ ID NO: 114424 - protein, 8 aa, Homo Sapiens
TEFIFTTI

SEQ ID NO: 114425 - protein, 8 aa, Homo Sapiens
TEFPGVVV

SEQ ID NO: 114426 - protein, 8 aa, Homo Sapiens
TEFPSKQV

SEQ ID NO: 114427 - protein, 8 aa, Homo Sapiens
TEFRSLVI

SEQ ID NO: 114428 - protein, 8 aa, Homo Sapiens
TEGKGLIV

SEQ ID NO: 114429 - protein, 8 aa, Homo Sapiens
TEIEQTKI

SEQ ID NO: 114430 - protein, 8 aa, Homo Sapiens
TEIQHKSI

SEQ ID NO: 114431 - protein, 8 aa, Homo Sapiens
TEISTKEV

SEQ ID NO: 114432 - protein, 8 aa, Homo Sapiens
TEKLSIMI

SEQ ID NO: 114433 - protein, 8 aa, Homo Sapiens
TEKPTVTV

SEQ ID NO: 114434 - protein, 8 aa, Homo Sapiens
TETDLRVV

SEQ ID NO: 114435 - protein, 8 aa, Homo Sapiens
TETIAPKI

SEQ ID NO: 114436 - protein, 8 aa, Homo Sapiens
TEVFLHVV

SEQ ID NO: 114437 - protein, 8 aa, Homo Sapiens
TEVLVSKV

SEQ ID NO: 114438 - protein, 8 aa, Homo Sapiens
TEVPSLVV

SEQ ID NO: 114439 - protein, 8 aa, Homo Sapiens
TEVPTASI

SEQ ID NO: 114440 - protein, 8 aa, Homo Sapiens
TEYPVKIV

SEQ ID NO: 114441 - protein, 8 aa, Homo Sapiens
TEYQPRAV

SEQ ID NO: 114442 - protein, 8 aa, Homo Sapiens
TVGNNKTL

SEQ ID NO: 114443 - protein, 8 aa, Homo Sapiens
VEAAFQTI

SEQ ID NO: 114444 - protein, 8 aa, Homo Sapiens
VEAIVKNV

SEQ ID NO: 114445 - protein, 8 aa, Homo Sapiens
VEDPVRKV

SEQ ID NO: 114446 - protein, 8 aa, Homo Sapiens
VEHVVVYV

SEQ ID NO: 114447 - protein, 8 aa, Homo Sapiens
VEIILHVV

SEQ ID NO: 114448 - protein, 8 aa, Homo Sapiens
VEIQTPKI

SEQ ID NO: 114449 - protein, 8 aa, Homo Sapiens
VEKDAVFI

SEQ ID NO: 114450 - protein, 8 aa, Homo Sapiens
VENKTAQI

SEQ ID NO: 114451 - protein, 8 aa, Homo Sapiens
VESELRSI

SEQ ID NO: 114452 - protein, 8 aa, Homo Sapiens
VESLFRVI

SEQ ID NO: 114453 - protein, 8 aa, Homo Sapiens
VETAITKV

SEQ ID NO: 114454 - protein, 8 aa, Homo Sapiens
VEYAFKAI

SEQ ID NO: 114455 - protein, 8 aa, Homo Sapiens
VEYQMKSV

SEQ ID NO: 114456 - protein, 8 aa, Homo Sapiens
WEGVFRCI

SEQ ID NO: 114457 - protein, 8 aa, Homo Sapiens
WEVPLPKV

SEQ ID NO: 114458 - protein, 8 aa, Homo Sapiens
YEAAVKKV

SEQ ID NO: 114459 - protein, 8 aa, Homo Sapiens
YEAKCVKV

SEQ ID NO: 114460 - protein, 8 aa, Homo Sapiens
YEDISRGL

SEQ ID NO: 114461 - protein, 8 aa, Homo Sapiens
YEDLINKI

SEQ ID NO: 114462 - protein, 8 aa, Homo Sapiens
YEDMVRQV

SEQ ID NO: 114463 - protein, 8 aa, Homo Sapiens
YEEFLSKV

SEQ ID NO: 114464 - protein, 8 aa, Homo Sapiens
YEEIVKEV

SEQ ID NO: 114465 - protein, 8 aa, Homo Sapiens
YEELVRMV

SEQ ID NO: 114466 - protein, 8 aa, Homo Sapiens
YEFDFSKV

SEQ ID NO: 114467 - protein, 8 aa, Homo Sapiens
YEFKPIVV

SEQ ID NO: 114468 - protein, 8 aa, Homo Sapiens
YEFSSHIV

SEQ ID NO: 114469 - protein, 8 aa, Homo Sapiens
YEGKVSSV

SEQ ID NO: 114470 - protein, 8 aa, Homo Sapiens
YEGSPIKV

SEQ ID NO: 114471 - protein, 8 aa, Homo Sapiens
YEGSVAKV

SEQ ID NO: 114472 - protein, 8 aa, Homo Sapiens
YEIEIVHI

SEQ ID NO: 114473 - protein, 8 aa, Homo Sapiens
YEILLHEV

SEQ ID NO: 114474 - protein, 8 aa, Homo Sapiens
YERIYNEI

SEQ ID NO: 114475 - protein, 8 aa, Homo Sapiens
YEYQPLQI

SEQ ID NO: 114476 - protein, 9 aa, Homo Sapiens
ADFAKVLEL

SEQ ID NO: 114477 - protein, 9 aa, Homo Sapiens
AEAAALEVL

SEQ ID NO: 114478 - protein, 9 aa, Homo Sapiens
AEAAGLHKV

SEQ ID NO: 114479 - protein, 9 aa, Homo Sapiens
AEAAGTTFV

SEQ ID NO: 114480 - protein, 9 aa, Homo Sapiens
AEAALKKEV

SEQ ID NO: 114481 - protein, 9 aa, Homo Sapiens
AEAATPYGI

SEQ ID NO: 114482 - protein, 9 aa, Homo Sapiens
AEAAVPRTI

SEQ ID NO: 114483 - protein, 9 aa, Homo Sapiens
AEADKTIKV

SEQ ID NO: 114484 - protein, 9 aa, Homo Sapiens
AEADLRALL

SEQ ID NO: 114485 - protein, 9 aa, Homo Sapiens
AEAEAVREV

SEQ ID NO: 114486 - protein, 9 aa, Homo Sapiens
AEAEFYRQV

SEQ ID NO: 114487 - protein, 9 aa, Homo Sapiens
AEAEGLRAA

SEQ ID NO: 114488 - protein, 9 aa, Homo Sapiens
AEAEIIQLL

SEQ ID NO: 114489 - protein, 9 aa, Homo Sapiens
AEAEKIRKI

SEQ ID NO: 114490 - protein, 9 aa, Homo Sapiens
AEAEKSQLI

SEQ ID NO: 114491 - protein, 9 aa, Homo Sapiens
AEAEPPSEV

SEQ ID NO: 114492 - protein, 9 aa, Homo Sapiens
AEAERLLLI

SEQ ID NO: 114493 - protein, 9 aa, Homo Sapiens
AEAFKAKNV

SEQ ID NO: 114494 - protein, 9 aa, Homo Sapiens
AEAGGMHTV

SEQ ID NO: 114495 - protein, 9 aa, Homo Sapiens
AEAGHLNIL

SEQ ID NO: 114496 - protein, 9 aa, Homo Sapiens
AEAGPLASV

SEQ ID NO: 114497 - protein, 9 aa, Homo Sapiens
AEAHARIHL

SEQ ID NO: 114498 - protein, 9 aa, Homo Sapiens
AEAHRIQQI

SEQ ID NO: 114499 - protein, 9 aa, Homo Sapiens
AEAIHSPQV

SEQ ID NO: 114500 - protein, 9 aa, Homo Sapiens
AEAISGHSV

SEQ ID NO: 114501 - protein, 9 aa, Homo Sapiens
AEAKARAEI

SEQ ID NO: 114502 - protein, 9 aa, Homo Sapiens
AEAKKLAAI

SEQ ID NO: 114503 - protein, 9 aa, Homo Sapiens
AEALATHIL

SEQ ID NO: 114504 - protein, 9 aa, Homo Sapiens
AEALIKVFV

SEQ ID NO: 114505 - protein, 9 aa, Homo Sapiens
AEALLHPFF

SEQ ID NO: 114506 - protein, 9 aa, Homo Sapiens
AEALPKQSV

SEQ ID NO: 114507 - protein, 9 aa, Homo Sapiens
AEALRISDV

SEQ ID NO: 114508 - protein, 9 aa, Homo Sapiens
AEALRQPVL

SEQ ID NO: 114509 - protein, 9 aa, Homo Sapiens
AEALRVVKI

SEQ ID NO: 114510 - protein, 9 aa, Homo Sapiens
AEANAFSVL

SEQ ID NO: 114511 - protein, 9 aa, Homo Sapiens
AEANHFIDL

SEQ ID NO: 114512 - protein, 9 aa, Homo Sapiens
AEAPAGPAL

SEQ ID NO: 114513 - protein, 9 aa, Homo Sapiens
AEAPGLVDV

SEQ ID NO: 114514 - protein, 9 aa, Homo Sapiens
AEAPHLVQV

SEQ ID NO: 114515 - protein, 9 aa, Homo Sapiens
AEAPNMAVV

SEQ ID NO: 114516 - protein, 9 aa, Homo Sapiens
AEAPPPSVV

SEQ ID NO: 114517 - protein, 9 aa, Homo Sapiens
AEAPSCLII

SEQ ID NO: 114518 - protein, 9 aa, Homo Sapiens
AEAPSQVRL

SEQ ID NO: 114519 - protein, 9 aa, Homo Sapiens
AEAQGSTTL

SEQ ID NO: 114520 - protein, 9 aa, Homo Sapiens
AEAQKLGKP

SEQ ID NO: 114521 - protein, 9 aa, Homo Sapiens
AEAQKSSLV

SEQ ID NO: 114522 - protein, 9 aa, Homo Sapiens
AEAQQLITI

SEQ ID NO: 114523 - protein, 9 aa, Homo Sapiens
AEARHNPSI

SEQ ID NO: 114524 - protein, 9 aa, Homo Sapiens
AEARPFEVL

SEQ ID NO: 114525 - protein, 9 aa, Homo Sapiens
AEASMISKL

SEQ ID NO: 114526 - protein, 9 aa, Homo Sapiens
AEASVMTQL

SEQ ID NO: 114527 - protein, 9 aa, Homo Sapiens
AEATLPTVI

SEQ ID NO: 114528 - protein, 9 aa, Homo Sapiens
AEAVFASEV

SEQ ID NO: 114529 - protein, 9 aa, Homo Sapiens
AEAVGASRV

SEQ ID NO: 114530 - protein, 9 aa, Homo Sapiens
AEAVLYEHL

SEQ ID NO: 114531 - protein, 9 aa, Homo Sapiens
AEAYHFFIL

SEQ ID NO: 114532 - protein, 9 aa, Homo Sapiens
AEAYLGKKV

SEQ ID NO: 114533 - protein, 9 aa, Homo Sapiens
AEAYLGKTV

SEQ ID NO: 114534 - protein, 9 aa, Homo Sapiens
AEAYLKPVV

SEQ ID NO: 114535 - protein, 9 aa, Homo Sapiens
AECGAFRTG

SEQ ID NO: 114536 - protein, 9 aa, Homo Sapiens
AECGKAFTI

SEQ ID NO: 114537 - protein, 9 aa, Homo Sapiens
AECGPQQEL

SEQ ID NO: 114538 - protein, 9 aa, Homo Sapiens
AECHGVIYV

SEQ ID NO: 114539 - protein, 9 aa, Homo Sapiens
AECKSVPGI

SEQ ID NO: 114540 - protein, 9 aa, Homo Sapiens
AECLEKFTV

SEQ ID NO: 114541 - protein, 9 aa, Homo Sapiens
AECLVIGQI

SEQ ID NO: 114542 - protein, 9 aa, Homo Sapiens
AECRVLQKL

SEQ ID NO: 114543 - protein, 9 aa, Homo Sapiens
AEDAPWKKI

SEQ ID NO: 114544 - protein, 9 aa, Homo Sapiens
AEDDRHYNI

SEQ ID NO: 114545 - protein, 9 aa, Homo Sapiens
AEDEGTQRL

SEQ ID NO: 114546 - protein, 9 aa, Homo Sapiens
AEDENGKIV

SEQ ID NO: 114547 - protein, 9 aa, Homo Sapiens
AEDEWKAQV

SEQ ID NO: 114548 - protein, 9 aa, Homo Sapiens
AEDFYDCRV

SEQ ID NO: 114549 - protein, 9 aa, Homo Sapiens
AEDGPTTRF

SEQ ID NO: 114550 - protein, 9 aa, Homo Sapiens
AEDGSRVYV

SEQ ID NO: 114551 - protein, 9 aa, Homo Sapiens
AEDHINFTI

SEQ ID NO: 114552 - protein, 9 aa, Homo Sapiens
AEDKDTPAL

SEQ ID NO: 114553 - protein, 9 aa, Homo Sapiens
AEDKKGHLI

SEQ ID NO: 114554 - protein, 9 aa, Homo Sapiens
AEDKPRAQL

SEQ ID NO: 114555 - protein, 9 aa, Homo Sapiens
AEDKVFNEI

SEQ ID NO: 114556 - protein, 9 aa, Homo Sapiens
AEDLRREMI

SEQ ID NO: 114557 - protein, 9 aa, Homo Sapiens
AEDPAGLKV

SEQ ID NO: 114558 - protein, 9 aa, Homo Sapiens
AEDPETQVV

SEQ ID NO: 114559 - protein, 9 aa, Homo Sapiens
AEDPPMVVV

SEQ ID NO: 114560 - protein, 9 aa, Homo Sapiens
AEDPRMIKV

SEQ ID NO: 114561 - protein, 9 aa, Homo Sapiens
AEDPSKSYV

SEQ ID NO: 114562 - protein, 9 aa, Homo Sapiens
AEDVATYKV

SEQ ID NO: 114563 - protein, 9 aa, Homo Sapiens
AEDYIFKAV

SEQ ID NO: 114564 - protein, 9 aa, Homo Sapiens
AEEAGKTMV

SEQ ID NO: 114565 - protein, 9 aa, Homo Sapiens
AEEAPCKEV

SEQ ID NO: 114566 - protein, 9 aa, Homo Sapiens
AEEARLLHV

SEQ ID NO: 114567 - protein, 9 aa, Homo Sapiens
AEECFFERV

SEQ ID NO: 114568 - protein, 9 aa, Homo Sapiens
AEEEAATRI

SEQ ID NO: 114569 - protein, 9 aa, Homo Sapiens
AEEESERLL

SEQ ID NO: 114570 - protein, 9 aa, Homo Sapiens
AEEIKVARI

SEQ ID NO: 114571 - protein, 9 aa, Homo Sapiens
AEEIRYTHI

SEQ ID NO: 114572 - protein, 9 aa, Homo Sapiens
AEEIYKAFV

SEQ ID NO: 114573 - protein, 9 aa, Homo Sapiens
AEEKLQASV

SEQ ID NO: 114574 - protein, 9 aa, Homo Sapiens
AEELGASKV

SEQ ID NO: 114575 - protein, 9 aa, Homo Sapiens
AEENGFRYI

SEQ ID NO: 114576 - protein, 9 aa, Homo Sapiens
AEENLFKLI

SEQ ID NO: 114577 - protein, 9 aa, Homo Sapiens
AEETGVHII

SEQ ID NO: 114578 - protein, 9 aa, Homo Sapiens
AEETSSPVI

SEQ ID NO: 114579 - protein, 9 aa, Homo Sapiens
AEEYGARVV

SEQ ID NO: 114580 - protein, 9 aa, Homo Sapiens
AEFEDLDSL

SEQ ID NO: 114581 - protein, 9 aa, Homo Sapiens
AEFEEPRVI

SEQ ID NO: 114582 - protein, 9 aa, Homo Sapiens
AEFERQRKI

SEQ ID NO: 114583 - protein, 9 aa, Homo Sapiens
AEFEVVRTI

SEQ ID NO: 114584 - protein, 9 aa, Homo Sapiens
AEFEWENKV

SEQ ID NO: 114585 - protein, 9 aa, Homo Sapiens
AEFFSSENV

SEQ ID NO: 114586 - protein, 9 aa, Homo Sapiens
AEFHQIEGV

SEQ ID NO: 114587 - protein, 9 aa, Homo Sapiens
AEFHVCPEL

SEQ ID NO: 114588 - protein, 9 aa, Homo Sapiens
AEFIKFTVI

SEQ ID NO: 114589 - protein, 9 aa, Homo Sapiens
AEFIVAKAI

SEQ ID NO: 114590 - protein, 9 aa, Homo Sapiens
AEFKASKEI

SEQ ID NO: 114591 - protein, 9 aa, Homo Sapiens
AEFKNITRI

SEQ ID NO: 114592 - protein, 9 aa, Homo Sapiens
AEFKQIRSI

SEQ ID NO: 114593 - protein, 9 aa, Homo Sapiens
AEFKRAVKV

SEQ ID NO: 114594 - protein, 9 aa, Homo Sapiens
AEFLFNQCI

SEQ ID NO: 114595 - protein, 9 aa, Homo Sapiens
AEFNRIMSL

SEQ ID NO: 114596 - protein, 9 aa, Homo Sapiens
AEFPHSFLV

SEQ ID NO: 114597 - protein, 9 aa, Homo Sapiens
AEFQELLKV

SEQ ID NO: 114598 - protein, 9 aa, Homo Sapiens
AEFVGGVLV

SEQ ID NO: 114599 - protein, 9 aa, Homo Sapiens
AEFVGVSHL

SEQ ID NO: 114600 - protein, 9 aa, Homo Sapiens
AEFVSTPEL

SEQ ID NO: 114601 - protein, 9 aa, Homo Sapiens
AEGDLVRLL

SEQ ID NO: 114602 - protein, 9 aa, Homo Sapiens
AEGEGISKV

SEQ ID NO: 114603 - protein, 9 aa, Homo Sapiens
AEGEKVKQV

SEQ ID NO: 114604 - protein, 9 aa, Homo Sapiens
AEGKPYLHV

SEQ ID NO: 114605 - protein, 9 aa, Homo Sapiens
AEGLNLHTI

SEQ ID NO: 114606 - protein, 9 aa, Homo Sapiens
AEGLTLAQV

SEQ ID NO: 114607 - protein, 9 aa, Homo Sapiens
AEGPEVICA

SEQ ID NO: 114608 - protein, 9 aa, Homo Sapiens
AEGPKVSIV

SEQ ID NO: 114609 - protein, 9 aa, Homo Sapiens
AEGPPRLAI

SEQ ID NO: 114610 - protein, 9 aa, Homo Sapiens
AEGPRAVFV

SEQ ID NO: 114611 - protein, 9 aa, Homo Sapiens
AEGPVAVVV

SEQ ID NO: 114612 - protein, 9 aa, Homo Sapiens
AEGPVVEKI

SEQ ID NO: 114613 - protein, 9 aa, Homo Sapiens
AEGRPTPTI

SEQ ID NO: 114614 - protein, 9 aa, Homo Sapiens
AEGTFPGKI

SEQ ID NO: 114615 - protein, 9 aa, Homo Sapiens
AEGTITGVI

SEQ ID NO: 114616 - protein, 9 aa, Homo Sapiens
AEGTNFRTV

SEQ ID NO: 114617 - protein, 9 aa, Homo Sapiens
AEGTSTRLI

SEQ ID NO: 114618 - protein, 9 aa, Homo Sapiens
AEHAVVGEI

SEQ ID NO: 114619 - protein, 9 aa, Homo Sapiens
AEHDLWHII

SEQ ID NO: 114620 - protein, 9 aa, Homo Sapiens
AEHFAMMVI

SEQ ID NO: 114621 - protein, 9 aa, Homo Sapiens
AEHIKSLLI

SEQ ID NO: 114622 - protein, 9 aa, Homo Sapiens
AEHKEFITA

SEQ ID NO: 114623 - protein, 9 aa, Homo Sapiens
AEHKHIEVI

SEQ ID NO: 114624 - protein, 9 aa, Homo Sapiens
AEHNFVAKA

SEQ ID NO: 114625 - protein, 9 aa, Homo Sapiens
AEHNPQYLI

SEQ ID NO: 114626 - protein, 9 aa, Homo Sapiens
AEHPAGHLV

SEQ ID NO: 114627 - protein, 9 aa, Homo Sapiens
AEHPGFMKT

SEQ ID NO: 114628 - protein, 9 aa, Homo Sapiens
AEHPQSPCV

SEQ ID NO: 114629 - protein, 9 aa, Homo Sapiens
AEHPVYNMV

SEQ ID NO: 114630 - protein, 9 aa, Homo Sapiens
AEIAALRFL

SEQ ID NO: 114631 - protein, 9 aa, Homo Sapiens
AEIAAQRTI

SEQ ID NO: 114632 - protein, 9 aa, Homo Sapiens
AEIAPFVEI

SEQ ID NO: 114633 - protein, 9 aa, Homo Sapiens
AEIAQLMSL

SEQ ID NO: 114634 - protein, 9 aa, Homo Sapiens
AEIDASNIV

SEQ ID NO: 114635 - protein, 9 aa, Homo Sapiens
AEIDSIHQL

SEQ ID NO: 114636 - protein, 9 aa, Homo Sapiens
AEIEALEKM

SEQ ID NO: 114637 - protein, 9 aa, Homo Sapiens
AEIEHFIHI

SEQ ID NO: 114638 - protein, 9 aa, Homo Sapiens
AEIEKFDKS

SEQ ID NO: 114639 - protein, 9 aa, Homo Sapiens
AEIENLQSL

SEQ ID NO: 114640 - protein, 9 aa, Homo Sapiens
AEIERETSV

SEQ ID NO: 114641 - protein, 9 aa, Homo Sapiens
AEIHLPHFI

SEQ ID NO: 114642 - protein, 9 aa, Homo Sapiens
AEIIKQLKI

SEQ ID NO: 114643 - protein, 9 aa, Homo Sapiens
AEIIRFLTN

SEQ ID NO: 114644 - protein, 9 aa, Homo Sapiens
AEIKNSLKI

SEQ ID NO: 114645 - protein, 9 aa, Homo Sapiens
AEIKRKLGI

SEQ ID NO: 114646 - protein, 9 aa, Homo Sapiens
AEIKSGLCV

SEQ ID NO: 114647 - protein, 9 aa, Homo Sapiens
AEIKTTNEV

SEQ ID NO: 114648 - protein, 9 aa, Homo Sapiens
AEILMKTLL

SEQ ID NO: 114649 - protein, 9 aa, Homo Sapiens
AEILNGKEI

SEQ ID NO: 114650 - protein, 9 aa, Homo Sapiens
AEIMKTLEV

SEQ ID NO: 114651 - protein, 9 aa, Homo Sapiens
AEIMQAVRL

SEQ ID NO: 114652 - protein, 9 aa, Homo Sapiens
AEINATMSV

SEQ ID NO: 114653 - protein, 9 aa, Homo Sapiens
AEINEIIRV

SEQ ID NO: 114654 - protein, 9 aa, Homo Sapiens
AEINGTMNA

SEQ ID NO: 114655 - protein, 9 aa, Homo Sapiens
AEINKSDHV

SEQ ID NO: 114656 - protein, 9 aa, Homo Sapiens
AEINNIIKI

SEQ ID NO: 114657 - protein, 9 aa, Homo Sapiens
AEIPGVRSV

SEQ ID NO: 114658 - protein, 9 aa, Homo Sapiens
AEIPLVVCI

SEQ ID NO: 114659 - protein, 9 aa, Homo Sapiens
AEIQFAQRL

SEQ ID NO: 114660 - protein, 9 aa, Homo Sapiens
AEIQGNVKV

SEQ ID NO: 114661 - protein, 9 aa, Homo Sapiens
AEIRHEVSV

SEQ ID NO: 114662 - protein, 9 aa, Homo Sapiens
AEIRHVLVT

SEQ ID NO: 114663 - protein, 9 aa, Homo Sapiens
AEIRQQIPV

SEQ ID NO: 114664 - protein, 9 aa, Homo Sapiens
AEIRRFSSV

SEQ ID NO: 114665 - protein, 9 aa, Homo Sapiens
AEISAQPRI

SEQ ID NO: 114666 - protein, 9 aa, Homo Sapiens
AEISKYLTL

SEQ ID NO: 114667 - protein, 9 aa, Homo Sapiens
AEISQPPAL

SEQ ID NO: 114668 - protein, 9 aa, Homo Sapiens
AEISTLAKM

SEQ ID NO: 114669 - protein, 9 aa, Homo Sapiens
AEITDKLGL

SEQ ID NO: 114670 - protein, 9 aa, Homo Sapiens
AEITELIHI

SEQ ID NO: 114671 - protein, 9 aa, Homo Sapiens
AEITNGNAV

SEQ ID NO: 114672 - protein, 9 aa, Homo Sapiens
AEITYGQKV

SEQ ID NO: 114673 - protein, 9 aa, Homo Sapiens
AEIVKQTHI

SEQ ID NO: 114674 - protein, 9 aa, Homo Sapiens
AEIVTPFNI

SEQ ID NO: 114675 - protein, 9 aa, Homo Sapiens
AEIYEQEYI

SEQ ID NO: 114676 - protein, 9 aa, Homo Sapiens
AEIYGVTHT

SEQ ID NO: 114677 - protein, 9 aa, Homo Sapiens
AEKAFQEGI

SEQ ID NO: 114678 - protein, 9 aa, Homo Sapiens
AEKAFTRSI

SEQ ID NO: 114679 - protein, 9 aa, Homo Sapiens
AEKAGMVHL

SEQ ID NO: 114680 - protein, 9 aa, Homo Sapiens
AEKALFRAL

SEQ ID NO: 114681 - protein, 9 aa, Homo Sapiens
AEKEFNETM

SEQ ID NO: 114682 - protein, 9 aa, Homo Sapiens
AEKELTASV

SEQ ID NO: 114683 - protein, 9 aa, Homo Sapiens
AEKELVTII

SEQ ID NO: 114684 - protein, 9 aa, Homo Sapiens
AEKEMTSVV

SEQ ID NO: 114685 - protein, 9 aa, Homo Sapiens
AEKGGSLVV

SEQ ID NO: 114686 - protein, 9 aa, Homo Sapiens
AEKGPMIVL

SEQ ID NO: 114687 - protein, 9 aa, Homo Sapiens
AEKGVARVV

SEQ ID NO: 114688 - protein, 9 aa, Homo Sapiens
AEKIPGEST

SEQ ID NO: 114689 - protein, 9 aa, Homo Sapiens
AEKKEMKTI

SEQ ID NO: 114690 - protein, 9 aa, Homo Sapiens
AEKLDEIYV

SEQ ID NO: 114691 - protein, 9 aa, Homo Sapiens
AEKLEALSV

SEQ ID NO: 114692 - protein, 9 aa, Homo Sapiens
AEKLGFAGL

SEQ ID NO: 114693 - protein, 9 aa, Homo Sapiens
AEKLGGSAV

SEQ ID NO: 114694 - protein, 9 aa, Homo Sapiens
AEKLPGATV

SEQ ID NO: 114695 - protein, 9 aa, Homo Sapiens
AEKLQRITV

SEQ ID NO: 114696 - protein, 9 aa, Homo Sapiens
AEKLVTQII

SEQ ID NO: 114697 - protein, 9 aa, Homo Sapiens
AEKLYLRSI

SEQ ID NO: 114698 - protein, 9 aa, Homo Sapiens
AEKNFELVI

SEQ ID NO: 114699 - protein, 9 aa, Homo Sapiens
AEKNFLTTV

SEQ ID NO: 114700 - protein, 9 aa, Homo Sapiens
AEKNGLVKI

SEQ ID NO: 114701 - protein, 9 aa, Homo Sapiens
AEKNGYVTV

SEQ ID NO: 114702 - protein, 9 aa, Homo Sapiens
AEKPVGALL

SEQ ID NO: 114703 - protein, 9 aa, Homo Sapiens
AEKPVLTAV

SEQ ID NO: 114704 - protein, 9 aa, Homo Sapiens
AEKQPSQEV

SEQ ID NO: 114705 - protein, 9 aa, Homo Sapiens
AEKSDFEAV

SEQ ID NO: 114706 - protein, 9 aa, Homo Sapiens
AEKSEQPTL

SEQ ID NO: 114707 - protein, 9 aa, Homo Sapiens
AEKSPLQTI

SEQ ID NO: 114708 - protein, 9 aa, Homo Sapiens
AEKSPSVHI

SEQ ID NO: 114709 - protein, 9 aa, Homo Sapiens
AEKTGICKI

SEQ ID NO: 114710 - protein, 9 aa, Homo Sapiens
AEKTPYVVV

SEQ ID NO: 114711 - protein, 9 aa, Homo Sapiens
AEKVDAVRI

SEQ ID NO: 114712 - protein, 9 aa, Homo Sapiens
AEKVHFILV

SEQ ID NO: 114713 - protein, 9 aa, Homo Sapiens
AEKWEVAEV

SEQ ID NO: 114714 - protein, 9 aa, Homo Sapiens
AELADREKI

SEQ ID NO: 114715 - protein, 9 aa, Homo Sapiens
AELAEHREV

SEQ ID NO: 114716 - protein, 9 aa, Homo Sapiens
AELARRSLA

SEQ ID NO: 114717 - protein, 9 aa, Homo Sapiens
AELCRPLLV

SEQ ID NO: 114718 - protein, 9 aa, Homo Sapiens
AELDIPQSV

SEQ ID NO: 114719 - protein, 9 aa, Homo Sapiens
AELDKLTSV

SEQ ID NO: 114720 - protein, 9 aa, Homo Sapiens
AELDPSIAV

SEQ ID NO: 114721 - protein, 9 aa, Homo Sapiens
AELDQLLAV

SEQ ID NO: 114722 - protein, 9 aa, Homo Sapiens
AELEGKLRV

SEQ ID NO: 114723 - protein, 9 aa, Homo Sapiens
AELEGREQV

SEQ ID NO: 114724 - protein, 9 aa, Homo Sapiens
AELFHLSGI

SEQ ID NO: 114725 - protein, 9 aa, Homo Sapiens
AELFIPPKI

SEQ ID NO: 114726 - protein, 9 aa, Homo Sapiens
AELGKLYSV

SEQ ID NO: 114727 - protein, 9 aa, Homo Sapiens
AELHQNVNV

SEQ ID NO: 114728 - protein, 9 aa, Homo Sapiens
AELHSTEKV

SEQ ID NO: 114729 - protein, 9 aa, Homo Sapiens
AELIMSRCI

SEQ ID NO: 114730 - protein, 9 aa, Homo Sapiens
AELLLIPKV

SEQ ID NO: 114731 - protein, 9 aa, Homo Sapiens
AELLQKIEV

SEQ ID NO: 114732 - protein, 9 aa, Homo Sapiens
AELLSGKRL

SEQ ID NO: 114733 - protein, 9 aa, Homo Sapiens
AELMGLKQV

SEQ ID NO: 114734 - protein, 9 aa, Homo Sapiens
AELNFFQRI

SEQ ID NO: 114735 - protein, 9 aa, Homo Sapiens
AELPAKILV

SEQ ID NO: 114736 - protein, 9 aa, Homo Sapiens
AELPGSSAV

SEQ ID NO: 114737 - protein, 9 aa, Homo Sapiens
AELQELLTI

SEQ ID NO: 114738 - protein, 9 aa, Homo Sapiens
AELQELLTV

SEQ ID NO: 114739 - protein, 9 aa, Homo Sapiens
AELQEVVKV

SEQ ID NO: 114740 - protein, 9 aa, Homo Sapiens
AELQRVQKV

SEQ ID NO: 114741 - protein, 9 aa, Homo Sapiens
AELRNASAV

SEQ ID NO: 114742 - protein, 9 aa, Homo Sapiens
AELRRVDAL

SEQ ID NO: 114743 - protein, 9 aa, Homo Sapiens
AELSEFRMV

SEQ ID NO: 114744 - protein, 9 aa, Homo Sapiens
AELTKVFEI

SEQ ID NO: 114745 - protein, 9 aa, Homo Sapiens
AEMAKVSEI

SEQ ID NO: 114746 - protein, 9 aa, Homo Sapiens
AEMANILVI

SEQ ID NO: 114747 - protein, 9 aa, Homo Sapiens
AEMEKATEV

SEQ ID NO: 114748 - protein, 9 aa, Homo Sapiens
AEMENYAHL

SEQ ID NO: 114749 - protein, 9 aa, Homo Sapiens
AEMLEDLHI

SEQ ID NO: 114750 - protein, 9 aa, Homo Sapiens
AEMLKENKV

SEQ ID NO: 114751 - protein, 9 aa, Homo Sapiens
AEMRPFIEI

SEQ ID NO: 114752 - protein, 9 aa, Homo Sapiens
AEMVFATRV

SEQ ID NO: 114753 - protein, 9 aa, Homo Sapiens
AENDFLHSL

SEQ ID NO: 114754 - protein, 9 aa, Homo Sapiens
AENDKDVKI

SEQ ID NO: 114755 - protein, 9 aa, Homo Sapiens
AENELGVVV

SEQ ID NO: 114756 - protein, 9 aa, Homo Sapiens
AENESMAKI

SEQ ID NO: 114757 - protein, 9 aa, Homo Sapiens
AENEYQTAI

SEQ ID NO: 114758 - protein, 9 aa, Homo Sapiens
AENFFVETL

SEQ ID NO: 114759 - protein, 9 aa, Homo Sapiens
AENFPFCTI

SEQ ID NO: 114760 - protein, 9 aa, Homo Sapiens
AENGPGIKI

SEQ ID NO: 114761 - protein, 9 aa, Homo Sapiens
AENKPGLQI

SEQ ID NO: 114762 - protein, 9 aa, Homo Sapiens
AENLFRAFL

SEQ ID NO: 114763 - protein, 9 aa, Homo Sapiens
AENLQALFV

SEQ ID NO: 114764 - protein, 9 aa, Homo Sapiens
AENNHLEAV

SEQ ID NO: 114765 - protein, 9 aa, Homo Sapiens
AENNVFHLV

SEQ ID NO: 114766 - protein, 9 aa, Homo Sapiens
AENPDIFAV

SEQ ID NO: 114767 - protein, 9 aa, Homo Sapiens
AENPFLTHL

SEQ ID NO: 114768 - protein, 9 aa, Homo Sapiens
AENPGKYNI

SEQ ID NO: 114769 - protein, 9 aa, Homo Sapiens
AENPPSGSV

SEQ ID NO: 114770 - protein, 9 aa, Homo Sapiens
AENPVENHI

SEQ ID NO: 114771 - protein, 9 aa, Homo Sapiens
AENQRITAV

SEQ ID NO: 114772 - protein, 9 aa, Homo Sapiens
AENVAGHQI

SEQ ID NO: 114773 - protein, 9 aa, Homo Sapiens
AENVAVPEA

SEQ ID NO: 114774 - protein, 9 aa, Homo Sapiens
AENVGKPTI

SEQ ID NO: 114775 - protein, 9 aa, Homo Sapiens
AENVPQTEV

SEQ ID NO: 114776 - protein, 9 aa, Homo Sapiens
AEPDIISTI

SEQ ID NO: 114777 - protein, 9 aa, Homo Sapiens
AEPEKVLRV

SEQ ID NO: 114778 - protein, 9 aa, Homo Sapiens
AEPESVLLV

SEQ ID NO: 114779 - protein, 9 aa, Homo Sapiens
AEPFFIRCI

SEQ ID NO: 114780 - protein, 9 aa, Homo Sapiens
AEPGNLAGV

SEQ ID NO: 114781 - protein, 9 aa, Homo Sapiens
AEPHRPLKI

SEQ ID NO: 114782 - protein, 9 aa, Homo Sapiens
AEPIRMLEI

SEQ ID NO: 114783 - protein, 9 aa, Homo Sapiens
AEPKLAFVI

SEQ ID NO: 114784 - protein, 9 aa, Homo Sapiens
AEPNLKQTI

SEQ ID NO: 114785 - protein, 9 aa, Homo Sapiens
AEPSKLNSI

SEQ ID NO: 114786 - protein, 9 aa, Homo Sapiens
AEQDFWRAV

SEQ ID NO: 114787 - protein, 9 aa, Homo Sapiens
AEQFRLEQI

SEQ ID NO: 114788 - protein, 9 aa, Homo Sapiens
AEQGKALLI

SEQ ID NO: 114789 - protein, 9 aa, Homo Sapiens
AEQIGELFI

SEQ ID NO: 114790 - protein, 9 aa, Homo Sapiens
AEQKRLKTV

SEQ ID NO: 114791 - protein, 9 aa, Homo Sapiens
AEQLAWLRV

SEQ ID NO: 114792 - protein, 9 aa, Homo Sapiens
AEQLPVAQI

SEQ ID NO: 114793 - protein, 9 aa, Homo Sapiens
AEQPSVKLC

SEQ ID NO: 114794 - protein, 9 aa, Homo Sapiens
AEQPTALTV

SEQ ID NO: 114795 - protein, 9 aa, Homo Sapiens
AEQRVPLSV

SEQ ID NO: 114796 - protein, 9 aa, Homo Sapiens
AEQTFEQAI

SEQ ID NO: 114797 - protein, 9 aa, Homo Sapiens
AERDKALRV

SEQ ID NO: 114798 - protein, 9 aa, Homo Sapiens
AEREIVRDI

SEQ ID NO: 114799 - protein, 9 aa, Homo Sapiens
AERENFHRL

SEQ ID NO: 114800 - protein, 9 aa, Homo Sapiens
AEREQEEAI

SEQ ID NO: 114801 - protein, 9 aa, Homo Sapiens
AERERGITI

SEQ ID NO: 114802 - protein, 9 aa, Homo Sapiens
AERESAEVV

SEQ ID NO: 114803 - protein, 9 aa, Homo Sapiens
AERFHFEAL

SEQ ID NO: 114804 - protein, 9 aa, Homo Sapiens
AERIGVDHV

SEQ ID NO: 114805 - protein, 9 aa, Homo Sapiens
AERIIILKI

SEQ ID NO: 114806 - protein, 9 aa, Homo Sapiens
AERINNINI

SEQ ID NO: 114807 - protein, 9 aa, Homo Sapiens
AERLFENQL

SEQ ID NO: 114808 - protein, 9 aa, Homo Sapiens
AERLGMGLV

SEQ ID NO: 114809 - protein, 9 aa, Homo Sapiens
AERLTTELI

SEQ ID NO: 114810 - protein, 9 aa, Homo Sapiens
AERPGEAAV

SEQ ID NO: 114811 - protein, 9 aa, Homo Sapiens
AERPTVARI

SEQ ID NO: 114812 - protein, 9 aa, Homo Sapiens
AERSGLRVV

SEQ ID NO: 114813 - protein, 9 aa, Homo Sapiens
AERVGLHKV

SEQ ID NO: 114814 - protein, 9 aa, Homo Sapiens
AERWIVNLI

SEQ ID NO: 114815 - protein, 9 aa, Homo Sapiens
AERYGINTT

SEQ ID NO: 114816 - protein, 9 aa, Homo Sapiens
AESCIKSTV

SEQ ID NO: 114817 - protein, 9 aa, Homo Sapiens
AESDKPVVI

SEQ ID NO: 114818 - protein, 9 aa, Homo Sapiens
AESGCKIQI

SEQ ID NO: 114819 - protein, 9 aa, Homo Sapiens
AESHIILVL

SEQ ID NO: 114820 - protein, 9 aa, Homo Sapiens
AESIANQRI

SEQ ID NO: 114821 - protein, 9 aa, Homo Sapiens
AESIHLWEV

SEQ ID NO: 114822 - protein, 9 aa, Homo Sapiens
AESKEISNV

SEQ ID NO: 114823 - protein, 9 aa, Homo Sapiens
AESKLQTEV

SEQ ID NO: 114824 - protein, 9 aa, Homo Sapiens
AESLHKTIV

SEQ ID NO: 114825 - protein, 9 aa, Homo Sapiens
AESLIAKKI

SEQ ID NO: 114826 - protein, 9 aa, Homo Sapiens
AESLPPPTL

SEQ ID NO: 114827 - protein, 9 aa, Homo Sapiens
AESLQLVTV

SEQ ID NO: 114828 - protein, 9 aa, Homo Sapiens
AESPGFSQA

SEQ ID NO: 114829 - protein, 9 aa, Homo Sapiens
AESPSFLSL

SEQ ID NO: 114830 - protein, 9 aa, Homo Sapiens
AESPSRDVV

SEQ ID NO: 114831 - protein, 9 aa, Homo Sapiens
AESQDLRHV

SEQ ID NO: 114832 - protein, 9 aa, Homo Sapiens
AESTGTVRV

SEQ ID NO: 114833 - protein, 9 aa, Homo Sapiens
AETASPVAV

SEQ ID NO: 114834 - protein, 9 aa, Homo Sapiens
AETAVQLFI

SEQ ID NO: 114835 - protein, 9 aa, Homo Sapiens
AETDRLSYV

SEQ ID NO: 114836 - protein, 9 aa, Homo Sapiens
AETEPIVKM

SEQ ID NO: 114837 - protein, 9 aa, Homo Sapiens
AETEQHIKV

SEQ ID NO: 114838 - protein, 9 aa, Homo Sapiens
AETGCKIMV

SEQ ID NO: 114839 - protein, 9 aa, Homo Sapiens
AETGKVVII

SEQ ID NO: 114840 - protein, 9 aa, Homo Sapiens
AETGLLSAI

SEQ ID NO: 114841 - protein, 9 aa, Homo Sapiens
AETGQVQKI

SEQ ID NO: 114842 - protein, 9 aa, Homo Sapiens
AETGVGKTV

SEQ ID NO: 114843 - protein, 9 aa, Homo Sapiens
AETIAWVRI

SEQ ID NO: 114844 - protein, 9 aa, Homo Sapiens
AETILKNNI

SEQ ID NO: 114845 - protein, 9 aa, Homo Sapiens
AETILLKAV

SEQ ID NO: 114846 - protein, 9 aa, Homo Sapiens
AETKQEAVV

SEQ ID NO: 114847 - protein, 9 aa, Homo Sapiens
AETLLNSEV

SEQ ID NO: 114848 - protein, 9 aa, Homo Sapiens
AETLPALKI

SEQ ID NO: 114849 - protein, 9 aa, Homo Sapiens
AETLQKCLI

SEQ ID NO: 114850 - protein, 9 aa, Homo Sapiens
AETLSKQSI

SEQ ID NO: 114851 - protein, 9 aa, Homo Sapiens
AETPEGHAV

SEQ ID NO: 114852 - protein, 9 aa, Homo Sapiens
AETPGAEKI

SEQ ID NO: 114853 - protein, 9 aa, Homo Sapiens
AETPQAKKI

SEQ ID NO: 114854 - protein, 9 aa, Homo Sapiens
AETPVHKQI

SEQ ID NO: 114855 - protein, 9 aa, Homo Sapiens
AETRPPIRV

SEQ ID NO: 114856 - protein, 9 aa, Homo Sapiens
AETVRPEEV

SEQ ID NO: 114857 - protein, 9 aa, Homo Sapiens
AETVTKGGI

SEQ ID NO: 114858 - protein, 9 aa, Homo Sapiens
AEVAGQFVI

SEQ ID NO: 114859 - protein, 9 aa, Homo Sapiens
AEVAGSKVV

SEQ ID NO: 114860 - protein, 9 aa, Homo Sapiens
AEVAPVAQV

SEQ ID NO: 114861 - protein, 9 aa, Homo Sapiens
AEVDKLELM

SEQ ID NO: 114862 - protein, 9 aa, Homo Sapiens
AEVDKVARL

SEQ ID NO: 114863 - protein, 9 aa, Homo Sapiens
AEVDRLLEI

SEQ ID NO: 114864 - protein, 9 aa, Homo Sapiens
AEVEKIIAV

SEQ ID NO: 114865 - protein, 9 aa, Homo Sapiens
AEVEKNETV

SEQ ID NO: 114866 - protein, 9 aa, Homo Sapiens
AEVELASRV

SEQ ID NO: 114867 - protein, 9 aa, Homo Sapiens
AEVERARQV

SEQ ID NO: 114868 - protein, 9 aa, Homo Sapiens
AEVERLKGL

SEQ ID NO: 114869 - protein, 9 aa, Homo Sapiens
AEVERVKDV

SEQ ID NO: 114870 - protein, 9 aa, Homo Sapiens
AEVFHVPLL

SEQ ID NO: 114871 - protein, 9 aa, Homo Sapiens
AEVGGVPYL

SEQ ID NO: 114872 - protein, 9 aa, Homo Sapiens
AEVGIIESI

SEQ ID NO: 114873 - protein, 9 aa, Homo Sapiens
AEVGRKLLL

SEQ ID NO: 114874 - protein, 9 aa, Homo Sapiens
AEVGRVLQV

SEQ ID NO: 114875 - protein, 9 aa, Homo Sapiens
AEVGVPVSV

SEQ ID NO: 114876 - protein, 9 aa, Homo Sapiens
AEVHKAITI

SEQ ID NO: 114877 - protein, 9 aa, Homo Sapiens
AEVHRLVVV

SEQ ID NO: 114878 - protein, 9 aa, Homo Sapiens
AEVINAREV

SEQ ID NO: 114879 - protein, 9 aa, Homo Sapiens
AEVKAAAEI

SEQ ID NO: 114880 - protein, 9 aa, Homo Sapiens
AEVKDTTRV

SEQ ID NO: 114881 - protein, 9 aa, Homo Sapiens
AEVKPEVKI

SEQ ID NO: 114882 - protein, 9 aa, Homo Sapiens
AEVKPILQA

SEQ ID NO: 114883 - protein, 9 aa, Homo Sapiens
AEVLEAHTI

SEQ ID NO: 114884 - protein, 9 aa, Homo Sapiens
AEVLPSHKV

SEQ ID NO: 114885 - protein, 9 aa, Homo Sapiens
AEVLRTMEL

SEQ ID NO: 114886 - protein, 9 aa, Homo Sapiens
AEVLTVKEV

SEQ ID NO: 114887 - protein, 9 aa, Homo Sapiens
AEVPGAGAV

SEQ ID NO: 114888 - protein, 9 aa, Homo Sapiens
AEVPLLDEV

SEQ ID NO: 114889 - protein, 9 aa, Homo Sapiens
AEVPTGTNV

SEQ ID NO: 114890 - protein, 9 aa, Homo Sapiens
AEVQHQLHV

SEQ ID NO: 114891 - protein, 9 aa, Homo Sapiens
AEVRAVQEI

SEQ ID NO: 114892 - protein, 9 aa, Homo Sapiens
AEVRKIIRV

SEQ ID NO: 114893 - protein, 9 aa, Homo Sapiens
AEVRVINLI

SEQ ID NO: 114894 - protein, 9 aa, Homo Sapiens
AEVSPMYGV

SEQ ID NO: 114895 - protein, 9 aa, Homo Sapiens
AEVSQWTRL

SEQ ID NO: 114896 - protein, 9 aa, Homo Sapiens
AEVTELHVI

SEQ ID NO: 114897 - protein, 9 aa, Homo Sapiens
AEVTIACKV

SEQ ID NO: 114898 - protein, 9 aa, Homo Sapiens
AEVTSGARV

SEQ ID NO: 114899 - protein, 9 aa, Homo Sapiens
AEVTTKSQI

SEQ ID NO: 114900 - protein, 9 aa, Homo Sapiens
AEVVKAPQV

SEQ ID NO: 114901 - protein, 9 aa, Homo Sapiens
AEVYKELRL

SEQ ID NO: 114902 - protein, 9 aa, Homo Sapiens
AEVYRILSV

SEQ ID NO: 114903 - protein, 9 aa, Homo Sapiens
AEWEANPLI

SEQ ID NO: 114904 - protein, 9 aa, Homo Sapiens
AEWIQQNNI

SEQ ID NO: 114905 - protein, 9 aa, Homo Sapiens
AEWLGVLKA

SEQ ID NO: 114906 - protein, 9 aa, Homo Sapiens
AEWPKEQFI

SEQ ID NO: 114907 - protein, 9 aa, Homo Sapiens
AEYAGRLGV

SEQ ID NO: 114908 - protein, 9 aa, Homo Sapiens
AEYAHPLET

SEQ ID NO: 114909 - protein, 9 aa, Homo Sapiens
AEYDLTTRI

SEQ ID NO: 114910 - protein, 9 aa, Homo Sapiens
AEYDRPNLL

SEQ ID NO: 114911 - protein, 9 aa, Homo Sapiens
AEYFCKPTV

SEQ ID NO: 114912 - protein, 9 aa, Homo Sapiens
AEYGEIKNI

SEQ ID NO: 114913 - protein, 9 aa, Homo Sapiens
AEYGGHDQI

SEQ ID NO: 114914 - protein, 9 aa, Homo Sapiens
AEYGGHQRL

SEQ ID NO: 114915 - protein, 9 aa, Homo Sapiens
AEYGHFVDI

SEQ ID NO: 114916 - protein, 9 aa, Homo Sapiens
AEYISTVKT

SEQ ID NO: 114917 - protein, 9 aa, Homo Sapiens
AEYKGRVTL

SEQ ID NO: 114918 - protein, 9 aa, Homo Sapiens
AEYKRYLEM

SEQ ID NO: 114919 - protein, 9 aa, Homo Sapiens
AEYLGANSV

SEQ ID NO: 114920 - protein, 9 aa, Homo Sapiens
AEYLGSCLL

SEQ ID NO: 114921 - protein, 9 aa, Homo Sapiens
AEYLILHLI

SEQ ID NO: 114922 - protein, 9 aa, Homo Sapiens
AEYLKLEFI

SEQ ID NO: 114923 - protein, 9 aa, Homo Sapiens
AEYLYFFRV

SEQ ID NO: 114924 - protein, 9 aa, Homo Sapiens
AEYNGRLAA

SEQ ID NO: 114925 - protein, 9 aa, Homo Sapiens
AEYNRYTWV

SEQ ID NO: 114926 - protein, 9 aa, Homo Sapiens
AEYNVNNLV

SEQ ID NO: 114927 - protein, 9 aa, Homo Sapiens
AEYPDGRII

SEQ ID NO: 114928 - protein, 9 aa, Homo Sapiens
AEYPEGFEI

SEQ ID NO: 114929 - protein, 9 aa, Homo Sapiens
AEYQDLTFL

SEQ ID NO: 114930 - protein, 9 aa, Homo Sapiens
AEYQELLDV

SEQ ID NO: 114931 - protein, 9 aa, Homo Sapiens
AEYRHLRKL

SEQ ID NO: 114932 - protein, 9 aa, Homo Sapiens
AEYVGRLGI

SEQ ID NO: 114933 - protein, 9 aa, Homo Sapiens
CEGGGVTRV

SEQ ID NO: 114934 - protein, 9 aa, Homo Sapiens
DAREILKQI

SEQ ID NO: 114935 - protein, 9 aa, Homo Sapiens
DTSPFAKSL

SEQ ID NO: 114936 - protein, 9 aa, Homo Sapiens
EAEIRAKQL

SEQ ID NO: 114937 - protein, 9 aa, Homo Sapiens
EAGPGRALV

SEQ ID NO: 114938 - protein, 9 aa, Homo Sapiens
EAILLHFST

SEQ ID NO: 114939 - protein, 9 aa, Homo Sapiens
EEAKKFGTI

SEQ ID NO: 114940 - protein, 9 aa, Homo Sapiens
EEAPLYSKV

SEQ ID NO: 114941 - protein, 9 aa, Homo Sapiens
EEARAFNRI

SEQ ID NO: 114942 - protein, 9 aa, Homo Sapiens
EECPAVRLI

SEQ ID NO: 114943 - protein, 9 aa, Homo Sapiens
EEDQGSKLI

SEQ ID NO: 114944 - protein, 9 aa, Homo Sapiens
EEFGDFRLV

SEQ ID NO: 114945 - protein, 9 aa, Homo Sapiens
EEFLSKVSI

SEQ ID NO: 114946 - protein, 9 aa, Homo Sapiens
EEFNQPLSV

SEQ ID NO: 114947 - protein, 9 aa, Homo Sapiens
EEFPGGLTI

SEQ ID NO: 114948 - protein, 9 aa, Homo Sapiens
EEFQNVRII

SEQ ID NO: 114949 - protein, 9 aa, Homo Sapiens
EEFTIFNRV

SEQ ID NO: 114950 - protein, 9 aa, Homo Sapiens
EEGPPVTTV

SEQ ID NO: 114951 - protein, 9 aa, Homo Sapiens
EEIAQVATI

SEQ ID NO: 114952 - protein, 9 aa, Homo Sapiens
EEIDRALGI

SEQ ID NO: 114953 - protein, 9 aa, Homo Sapiens
EEIEREVNI

SEQ ID NO: 114954 - protein, 9 aa, Homo Sapiens
EEILKFLCI

SEQ ID NO: 114955 - protein, 9 aa, Homo Sapiens
EEINYLTRI

SEQ ID NO: 114956 - protein, 9 aa, Homo Sapiens
EEIQNLIKI

SEQ ID NO: 114957 - protein, 9 aa, Homo Sapiens
EEISGIVEV

SEQ ID NO: 114958 - protein, 9 aa, Homo Sapiens
EELDKWAKI

SEQ ID NO: 114959 - protein, 9 aa, Homo Sapiens
EELEYFNHI

SEQ ID NO: 114960 - protein, 9 aa, Homo Sapiens
EEVPEFTKI

SEQ ID NO: 114961 - protein, 9 aa, Homo Sapiens
EEVTGCKTV

SEQ ID NO: 114962 - protein, 9 aa, Homo Sapiens
EEYFMRETV

SEQ ID NO: 114963 - protein, 9 aa, Homo Sapiens
EEYGKIDTI

SEQ ID NO: 114964 - protein, 9 aa, Homo Sapiens
EEYGKILEV

SEQ ID NO: 114965 - protein, 9 aa, Homo Sapiens
EEYQNPHTV

SEQ ID NO: 114966 - protein, 9 aa, Homo Sapiens
ELSERLELV

SEQ ID NO: 114967 - protein, 9 aa, Homo Sapiens
ESNVQILKL

SEQ ID NO: 114968 - protein, 9 aa, Homo Sapiens
ETALRLTEL

SEQ ID NO: 114969 - protein, 9 aa, Homo Sapiens
EVIEEVNKV

SEQ ID NO: 114970 - protein, 9 aa, Homo Sapiens
EVIEPSDTL

SEQ ID NO: 114971 - protein, 9 aa, Homo Sapiens
FEAPNQEKV

SEQ ID NO: 114972 - protein, 9 aa, Homo Sapiens
FEAPTIVKV

SEQ ID NO: 114973 - protein, 9 aa, Homo Sapiens
FEAQFQKNV

SEQ ID NO: 114974 - protein, 9 aa, Homo Sapiens
FEASDPRII

SEQ ID NO: 114975 - protein, 9 aa, Homo Sapiens
FECDTKLYT

SEQ ID NO: 114976 - protein, 9 aa, Homo Sapiens
FECIGNVKV

SEQ ID NO: 114977 - protein, 9 aa, Homo Sapiens
FEDDAIQLV

SEQ ID NO: 114978 - protein, 9 aa, Homo Sapiens
FEDDDITHV

SEQ ID NO: 114979 - protein, 9 aa, Homo Sapiens
FEDEKPALL

SEQ ID NO: 114980 - protein, 9 aa, Homo Sapiens
FEDETIRNI

SEQ ID NO: 114981 - protein, 9 aa, Homo Sapiens
FEDGQKIVV

SEQ ID NO: 114982 - protein, 9 aa, Homo Sapiens
FEDKLIQSV

SEQ ID NO: 114983 - protein, 9 aa, Homo Sapiens
FEDKWFRKI

SEQ ID NO: 114984 - protein, 9 aa, Homo Sapiens
FEDNDFVFV

SEQ ID NO: 114985 - protein, 9 aa, Homo Sapiens
FEDPKFEVI

SEQ ID NO: 114986 - protein, 9 aa, Homo Sapiens
FEDPQRREV

SEQ ID NO: 114987 - protein, 9 aa, Homo Sapiens
FEDPRLILI

SEQ ID NO: 114988 - protein, 9 aa, Homo Sapiens
FEDQMVYTV

SEQ ID NO: 114989 - protein, 9 aa, Homo Sapiens
FEDRGFVQV

SEQ ID NO: 114990 - protein, 9 aa, Homo Sapiens
FEDTNLCAI

SEQ ID NO: 114991 - protein, 9 aa, Homo Sapiens
FEEASNQLI

SEQ ID NO: 114992 - protein, 9 aa, Homo Sapiens
FEEIPIAHI

SEQ ID NO: 114993 - protein, 9 aa, Homo Sapiens
FEEKDFSQI

SEQ ID NO: 114994 - protein, 9 aa, Homo Sapiens
FEFDIHQVI

SEQ ID NO: 114995 - protein, 9 aa, Homo Sapiens
FEFDTKTSA

SEQ ID NO: 114996 - protein, 9 aa, Homo Sapiens
FEFEYQTKV

SEQ ID NO: 114997 - protein, 9 aa, Homo Sapiens
FEGAVIRTV

SEQ ID NO: 114998 - protein, 9 aa, Homo Sapiens
FEGDTGLIV

SEQ ID NO: 114999 - protein, 9 aa, Homo Sapiens
FEGEKGAVV

SEQ ID NO: 115000 - protein, 9 aa, Homo Sapiens
FEGGPRPWI

SEQ ID NO: 115001 - protein, 9 aa, Homo Sapiens
FEGHFKCEV

SEQ ID NO: 115002 - protein, 9 aa, Homo Sapiens
FEGTSTKTV

SEQ ID NO: 115003 - protein, 9 aa, Homo Sapiens
FEHAHNMRV

SEQ ID NO: 115004 - protein, 9 aa, Homo Sapiens
FEHENKFYI

SEQ ID NO: 115005 - protein, 9 aa, Homo Sapiens
FEHGDTNEV

SEQ ID NO: 115006 - protein, 9 aa, Homo Sapiens
FEHHGQVRL

SEQ ID NO: 115007 - protein, 9 aa, Homo Sapiens
FEHLAPVLV

SEQ ID NO: 115008 - protein, 9 aa, Homo Sapiens
FEHQRAPRV

SEQ ID NO: 115009 - protein, 9 aa, Homo Sapiens
FEHSDIVVI

SEQ ID NO: 115010 - protein, 9 aa, Homo Sapiens
FEIERDLRL

SEQ ID NO: 115011 - protein, 9 aa, Homo Sapiens
FEIKDKMLI

SEQ ID NO: 115012 - protein, 9 aa, Homo Sapiens
FEILPGLSV

SEQ ID NO: 115013 - protein, 9 aa, Homo Sapiens
FEIPKGTQV

SEQ ID NO: 115014 - protein, 9 aa, Homo Sapiens
FEISNRALI

SEQ ID NO: 115015 - protein, 9 aa, Homo Sapiens
FEKTLTPII

SEQ ID NO: 115016 - protein, 9 aa, Homo Sapiens
FELPEIKKV

SEQ ID NO: 115017 - protein, 9 aa, Homo Sapiens
FEMKELPQL

SEQ ID NO: 115018 - protein, 9 aa, Homo Sapiens
FENETAKKV

SEQ ID NO: 115019 - protein, 9 aa, Homo Sapiens
FENKPMILL

SEQ ID NO: 115020 - protein, 9 aa, Homo Sapiens
FENMGAYTV

SEQ ID NO: 115021 - protein, 9 aa, Homo Sapiens
FEQFLLPVI

SEQ ID NO: 115022 - protein, 9 aa, Homo Sapiens
FEQFLQERI

SEQ ID NO: 115023 - protein, 9 aa, Homo Sapiens
FEQFLREKV

SEQ ID NO: 115024 - protein, 9 aa, Homo Sapiens
FEQGGARVV

SEQ ID NO: 115025 - protein, 9 aa, Homo Sapiens
FEQKGFRLV

SEQ ID NO: 115026 - protein, 9 aa, Homo Sapiens
FEQVSGVTV

SEQ ID NO: 115027 - protein, 9 aa, Homo Sapiens
FERATFLVI

SEQ ID NO: 115028 - protein, 9 aa, Homo Sapiens
FEREFYSEI

SEQ ID NO: 115029 - protein, 9 aa, Homo Sapiens
FERKLDQTI

SEQ ID NO: 115030 - protein, 9 aa, Homo Sapiens
FERNKAIKV

SEQ ID NO: 115031 - protein, 9 aa, Homo Sapiens
FERPQYAEI

SEQ ID NO: 115032 - protein, 9 aa, Homo Sapiens
FESDLHSLL

SEQ ID NO: 115033 - protein, 9 aa, Homo Sapiens
FESGNLRKV

SEQ ID NO: 115034 - protein, 9 aa, Homo Sapiens
FESGNMTQV

SEQ ID NO: 115035 - protein, 9 aa, Homo Sapiens
FESKGTGRI

SEQ ID NO: 115036 - protein, 9 aa, Homo Sapiens
FESPNILRI

SEQ ID NO: 115037 - protein, 9 aa, Homo Sapiens
FETEPVSKL

SEQ ID NO: 115038 - protein, 9 aa, Homo Sapiens
FETIVKQQI

SEQ ID NO: 115039 - protein, 9 aa, Homo Sapiens
FETPGSILV

SEQ ID NO: 115040 - protein, 9 aa, Homo Sapiens
FETPLRVDV

SEQ ID NO: 115041 - protein, 9 aa, Homo Sapiens
FEVDSRVYL

SEQ ID NO: 115042 - protein, 9 aa, Homo Sapiens
FEVIFPERI

SEQ ID NO: 115043 - protein, 9 aa, Homo Sapiens
FEVKKGDRI

SEQ ID NO: 115044 - protein, 9 aa, Homo Sapiens
FEVKKWNAV

SEQ ID NO: 115045 - protein, 9 aa, Homo Sapiens
FEVPAGKKV

SEQ ID NO: 115046 - protein, 9 aa, Homo Sapiens
FEVTGQETV

SEQ ID NO: 115047 - protein, 9 aa, Homo Sapiens
FEWDRKLEL

SEQ ID NO: 115048 - protein, 9 aa, Homo Sapiens
FEWENKVTV

SEQ ID NO: 115049 - protein, 9 aa, Homo Sapiens
FEYPEYQKI

SEQ ID NO: 115050 - protein, 9 aa, Homo Sapiens
FEYRKDNKV

SEQ ID NO: 115051 - protein, 9 aa, Homo Sapiens
FEYVINEVI

SEQ ID NO: 115052 - protein, 9 aa, Homo Sapiens
GEAAFPVMV

SEQ ID NO: 115053 - protein, 9 aa, Homo Sapiens
GEAEGLMKV

SEQ ID NO: 115054 - protein, 9 aa, Homo Sapiens
GEAELELRV

SEQ ID NO: 115055 - protein, 9 aa, Homo Sapiens
GEAEPRTVV

SEQ ID NO: 115056 - protein, 9 aa, Homo Sapiens
GEAGPHAMV

SEQ ID NO: 115057 - protein, 9 aa, Homo Sapiens
GEAGPIHHL

SEQ ID NO: 115058 - protein, 9 aa, Homo Sapiens
GEAGPVGNM

SEQ ID NO: 115059 - protein, 9 aa, Homo Sapiens
GEALAPRQV

SEQ ID NO: 115060 - protein, 9 aa, Homo Sapiens
GEALPFSHL

SEQ ID NO: 115061 - protein, 9 aa, Homo Sapiens
GEANPINMV

SEQ ID NO: 115062 - protein, 9 aa, Homo Sapiens
GEAPALVAV

SEQ ID NO: 115063 - protein, 9 aa, Homo Sapiens
GEAPFAQRI

SEQ ID NO: 115064 - protein, 9 aa, Homo Sapiens
GEAPSKTLV

SEQ ID NO: 115065 - protein, 9 aa, Homo Sapiens
GEAPVLIMI

SEQ ID NO: 115066 - protein, 9 aa, Homo Sapiens
GEAPVPASV

SEQ ID NO: 115067 - protein, 9 aa, Homo Sapiens
GEAQPTKSL

SEQ ID NO: 115068 - protein, 9 aa, Homo Sapiens
GEAQRLIEI

SEQ ID NO: 115069 - protein, 9 aa, Homo Sapiens
GEARKQVEV

SEQ ID NO: 115070 - protein, 9 aa, Homo Sapiens
GEARPGPTA

SEQ ID NO: 115071 - protein, 9 aa, Homo Sapiens
GEASFPVMV

SEQ ID NO: 115072 - protein, 9 aa, Homo Sapiens
GEAVFARCL

SEQ ID NO: 115073 - protein, 9 aa, Homo Sapiens
GEAVGARLI

SEQ ID NO: 115074 - protein, 9 aa, Homo Sapiens
GECGKAFRV

SEQ ID NO: 115075 - protein, 9 aa, Homo Sapiens
GECHTENEI

SEQ ID NO: 115076 - protein, 9 aa, Homo Sapiens
GEDFKLGTI

SEQ ID NO: 115077 - protein, 9 aa, Homo Sapiens
GEDGFLLKI

SEQ ID NO: 115078 - protein, 9 aa, Homo Sapiens
GEDHQITEV

SEQ ID NO: 115079 - protein, 9 aa, Homo Sapiens
GEDKGGYVI

SEQ ID NO: 115080 - protein, 9 aa, Homo Sapiens
GEDKGIKAL

SEQ ID NO: 115081 - protein, 9 aa, Homo Sapiens
GEDLPTIVI

SEQ ID NO: 115082 - protein, 9 aa, Homo Sapiens
GEDPYPHKF

SEQ ID NO: 115083 - protein, 9 aa, Homo Sapiens
GEDSSFLVV

SEQ ID NO: 115084 - protein, 9 aa, Homo Sapiens
GEDVRSALL

SEQ ID NO: 115085 - protein, 9 aa, Homo Sapiens
GEEALLRYV

SEQ ID NO: 115086 - protein, 9 aa, Homo Sapiens
GEEHAFLTV

SEQ ID NO: 115087 - protein, 9 aa, Homo Sapiens
GEEHPIRVV

SEQ ID NO: 115088 - protein, 9 aa, Homo Sapiens
GEEIRFRVV

SEQ ID NO: 115089 - protein, 9 aa, Homo Sapiens
GEELVTKPV

SEQ ID NO: 115090 - protein, 9 aa, Homo Sapiens
GEENGAHTI

SEQ ID NO: 115091 - protein, 9 aa, Homo Sapiens
GEERLRSTI

SEQ ID NO: 115092 - protein, 9 aa, Homo Sapiens
GEEVAMRTV

SEQ ID NO: 115093 - protein, 9 aa, Homo Sapiens
GEEVAVKKV

SEQ ID NO: 115094 - protein, 9 aa, Homo Sapiens
GEEWKGYVV

SEQ ID NO: 115095 - protein, 9 aa, Homo Sapiens
GEFADPFKL

SEQ ID NO: 115096 - protein, 9 aa, Homo Sapiens
GEFAKLSKI

SEQ ID NO: 115097 - protein, 9 aa, Homo Sapiens
GEFDLVQRI

SEQ ID NO: 115098 - protein, 9 aa, Homo Sapiens
GEFEGFVAV

SEQ ID NO: 115099 - protein, 9 aa, Homo Sapiens
GEFEKKYVA

SEQ ID NO: 115100 - protein, 9 aa, Homo Sapiens
GEFFKQIGI

SEQ ID NO: 115101 - protein, 9 aa, Homo Sapiens
GEFGEIEAI

SEQ ID NO: 115102 - protein, 9 aa, Homo Sapiens
GEFGGFGSV

SEQ ID NO: 115103 - protein, 9 aa, Homo Sapiens
GEFGGFSEV

SEQ ID NO: 115104 - protein, 9 aa, Homo Sapiens
GEFGKPYFI

SEQ ID NO: 115105 - protein, 9 aa, Homo Sapiens
GEFHKMREV

SEQ ID NO: 115106 - protein, 9 aa, Homo Sapiens
GEFHLWYQV

SEQ ID NO: 115107 - protein, 9 aa, Homo Sapiens
GEFIIGRVI

SEQ ID NO: 115108 - protein, 9 aa, Homo Sapiens
GEFILKTYV

SEQ ID NO: 115109 - protein, 9 aa, Homo Sapiens
GEFKKYLEV

SEQ ID NO: 115110 - protein, 9 aa, Homo Sapiens
GEFLEVTCI

SEQ ID NO: 115111 - protein, 9 aa, Homo Sapiens
GEFPCQNDI

SEQ ID NO: 115112 - protein, 9 aa, Homo Sapiens
GEFPVRVQV

SEQ ID NO: 115113 - protein, 9 aa, Homo Sapiens
GEFPYLGRL

SEQ ID NO: 115114 - protein, 9 aa, Homo Sapiens
GEFRAVTEL

SEQ ID NO: 115115 - protein, 9 aa, Homo Sapiens
GEFTHEMQV

SEQ ID NO: 115116 - protein, 9 aa, Homo Sapiens
GEFTSARAV

SEQ ID NO: 115117 - protein, 9 aa, Homo Sapiens
GEFVDDYTV

SEQ ID NO: 115118 - protein, 9 aa, Homo Sapiens
GEGAEPLKV

SEQ ID NO: 115119 - protein, 9 aa, Homo Sapiens
GEGDIVPKI

SEQ ID NO: 115120 - protein, 9 aa, Homo Sapiens
GEGEPVKEV

SEQ ID NO: 115121 - protein, 9 aa, Homo Sapiens
GEGFQTVRV

SEQ ID NO: 115122 - protein, 9 aa, Homo Sapiens
GEGKPTPAL

SEQ ID NO: 115123 - protein, 9 aa, Homo Sapiens
GEGKSTTTI

SEQ ID NO: 115124 - protein, 9 aa, Homo Sapiens
GEGKSTVTI

SEQ ID NO: 115125 - protein, 9 aa, Homo Sapiens
GEGPQSQKI

SEQ ID NO: 115126 - protein, 9 aa, Homo Sapiens
GEGTFGRVV

SEQ ID NO: 115127 - protein, 9 aa, Homo Sapiens
GEHCDFTIL

SEQ ID NO: 115128 - protein, 9 aa, Homo Sapiens
GEHGLIIRV

SEQ ID NO: 115129 - protein, 9 aa, Homo Sapiens
GEHHSTPSL

SEQ ID NO: 115130 - protein, 9 aa, Homo Sapiens
GEHKIMDYI

SEQ ID NO: 115131 - protein, 9 aa, Homo Sapiens
GEHLGTLKV

SEQ ID NO: 115132 - protein, 9 aa, Homo Sapiens
GEHPFYHCL

SEQ ID NO: 115133 - protein, 9 aa, Homo Sapiens
GEHPGVAGI

SEQ ID NO: 115134 - protein, 9 aa, Homo Sapiens
GEHTLLVTV

SEQ ID NO: 115135 - protein, 9 aa, Homo Sapiens
GEHVKAIEI

SEQ ID NO: 115136 - protein, 9 aa, Homo Sapiens
GEIAPRTVV

SEQ ID NO: 115137 - protein, 9 aa, Homo Sapiens
GEIDKRVEV

SEQ ID NO: 115138 - protein, 9 aa, Homo Sapiens
GEIDKVQYI

SEQ ID NO: 115139 - protein, 9 aa, Homo Sapiens
GEIDRARAI

SEQ ID NO: 115140 - protein, 9 aa, Homo Sapiens
GEIERLINL

SEQ ID NO: 115141 - protein, 9 aa, Homo Sapiens
GEIGHFDSV

SEQ ID NO: 115142 - protein, 9 aa, Homo Sapiens
GEIGTKTTL

SEQ ID NO: 115143 - protein, 9 aa, Homo Sapiens
GEIIGKRGI

SEQ ID NO: 115144 - protein, 9 aa, Homo Sapiens
GEIKEPLEI

SEQ ID NO: 115145 - protein, 9 aa, Homo Sapiens
GEIKGFTGI

SEQ ID NO: 115146 - protein, 9 aa, Homo Sapiens
GEIKHVSSL

SEQ ID NO: 115147 - protein, 9 aa, Homo Sapiens
GEIKWIDFV

SEQ ID NO: 115148 - protein, 9 aa, Homo Sapiens
GEILNEVKI

SEQ ID NO: 115149 - protein, 9 aa, Homo Sapiens
GEILRVIEI

SEQ ID NO: 115150 - protein, 9 aa, Homo Sapiens
GEIPKQVKV

SEQ ID NO: 115151 - protein, 9 aa, Homo Sapiens
GEIPTLKTL

SEQ ID NO: 115152 - protein, 9 aa, Homo Sapiens
GEIPWSQEL

SEQ ID NO: 115153 - protein, 9 aa, Homo Sapiens
GEIQAGAKL

SEQ ID NO: 115154 - protein, 9 aa, Homo Sapiens
GEIRELKQL

SEQ ID NO: 115155 - protein, 9 aa, Homo Sapiens
GEIRGFETA

SEQ ID NO: 115156 - protein, 9 aa, Homo Sapiens
GEIRTITVV

SEQ ID NO: 115157 - protein, 9 aa, Homo Sapiens
GEISPQREV

SEQ ID NO: 115158 - protein, 9 aa, Homo Sapiens
GEISRMREV

SEQ ID NO: 115159 - protein, 9 aa, Homo Sapiens
GEISTIDKV

SEQ ID NO: 115160 - protein, 9 aa, Homo Sapiens
GEITGEVRM

SEQ ID NO: 115161 - protein, 9 aa, Homo Sapiens
GEITGHNKV

SEQ ID NO: 115162 - protein, 9 aa, Homo Sapiens
GEITLRGLV

SEQ ID NO: 115163 - protein, 9 aa, Homo Sapiens
GEITSRAAV

SEQ ID NO: 115164 - protein, 9 aa, Homo Sapiens
GEITTGPRV

SEQ ID NO: 115165 - protein, 9 aa, Homo Sapiens
GEIVALKKV

SEQ ID NO: 115166 - protein, 9 aa, Homo Sapiens
GEIVQQVRV

SEQ ID NO: 115167 - protein, 9 aa, Homo Sapiens
GEIVRNILI

SEQ ID NO: 115168 - protein, 9 aa, Homo Sapiens
GEIYTGTSV

SEQ ID NO: 115169 - protein, 9 aa, Homo Sapiens
GEKELILTV

SEQ ID NO: 115170 - protein, 9 aa, Homo Sapiens
GEKGKNIKI

SEQ ID NO: 115171 - protein, 9 aa, Homo Sapiens
GEKGPACLV

SEQ ID NO: 115172 - protein, 9 aa, Homo Sapiens
GEKPFTCEI

SEQ ID NO: 115173 - protein, 9 aa, Homo Sapiens
GEKPFVCKI

SEQ ID NO: 115174 - protein, 9 aa, Homo Sapiens
GEKQPELQI

SEQ ID NO: 115175 - protein, 9 aa, Homo Sapiens
GEKSESISV

SEQ ID NO: 115176 - protein, 9 aa, Homo Sapiens
GEKTAGINV

SEQ ID NO: 115177 - protein, 9 aa, Homo Sapiens
GEKTSNLRV

SEQ ID NO: 115178 - protein, 9 aa, Homo Sapiens
GEKVGVGKI

SEQ ID NO: 115179 - protein, 9 aa, Homo Sapiens
GEKVNIISV

SEQ ID NO: 115180 - protein, 9 aa, Homo Sapiens
GEKVWQIRV

SEQ ID NO: 115181 - protein, 9 aa, Homo Sapiens
GELALKKKI

SEQ ID NO: 115182 - protein, 9 aa, Homo Sapiens
GELAQHSRV

SEQ ID NO: 115183 - protein, 9 aa, Homo Sapiens
GELARAVVL

SEQ ID NO: 115184 - protein, 9 aa, Homo Sapiens
GELDHVVEI

SEQ ID NO: 115185 - protein, 9 aa, Homo Sapiens
GELEEMRKV

SEQ ID NO: 115186 - protein, 9 aa, Homo Sapiens
GELEYATKI

SEQ ID NO: 115187 - protein, 9 aa, Homo Sapiens
GELGDFRAV

SEQ ID NO: 115188 - protein, 9 aa, Homo Sapiens
GELGGFAAI

SEQ ID NO: 115189 - protein, 9 aa, Homo Sapiens
GELGKLDLI

SEQ ID NO: 115190 - protein, 9 aa, Homo Sapiens
GELIPKSKV

SEQ ID NO: 115191 - protein, 9 aa, Homo Sapiens
GELLPARKI

SEQ ID NO: 115192 - protein, 9 aa, Homo Sapiens
GELLPQIFV

SEQ ID NO: 115193 - protein, 9 aa, Homo Sapiens
GELPEHAKI

SEQ ID NO: 115194 - protein, 9 aa, Homo Sapiens
GELPFLTHV

SEQ ID NO: 115195 - protein, 9 aa, Homo Sapiens
GELPITVSV

SEQ ID NO: 115196 - protein, 9 aa, Homo Sapiens
GELPNGTRV

SEQ ID NO: 115197 - protein, 9 aa, Homo Sapiens
GELPSWILM

SEQ ID NO: 115198 - protein, 9 aa, Homo Sapiens
GELQHASAV

SEQ ID NO: 115199 - protein, 9 aa, Homo Sapiens
GELRHITKL

SEQ ID NO: 115200 - protein, 9 aa, Homo Sapiens
GELSKVTKV

SEQ ID NO: 115201 - protein, 9 aa, Homo Sapiens
GELSLPVHL

SEQ ID NO: 115202 - protein, 9 aa, Homo Sapiens
GELVKAIVV

SEQ ID NO: 115203 - protein, 9 aa, Homo Sapiens
GELVRLILV

SEQ ID NO: 115204 - protein, 9 aa, Homo Sapiens
GELWNKFFV

SEQ ID NO: 115205 - protein, 9 aa, Homo Sapiens
GELYNEVKV

SEQ ID NO: 115206 - protein, 9 aa, Homo Sapiens
GEMCAFNKV

SEQ ID NO: 115207 - protein, 9 aa, Homo Sapiens
GEMDSFSLI

SEQ ID NO: 115208 - protein, 9 aa, Homo Sapiens
GEMERDCQI

SEQ ID NO: 115209 - protein, 9 aa, Homo Sapiens
GEMQKQAQL

SEQ ID NO: 115210 - protein, 9 aa, Homo Sapiens
GEMVALPPV

SEQ ID NO: 115211 - protein, 9 aa, Homo Sapiens
GENEDLLKL

SEQ ID NO: 115212 - protein, 9 aa, Homo Sapiens
GENIEPVKI

SEQ ID NO: 115213 - protein, 9 aa, Homo Sapiens
GENLFEIHI

SEQ ID NO: 115214 - protein, 9 aa, Homo Sapiens
GENLKVLTV

SEQ ID NO: 115215 - protein, 9 aa, Homo Sapiens
GENLVSMTV

SEQ ID NO: 115216 - protein, 9 aa, Homo Sapiens
GENMFLRCV

SEQ ID NO: 115217 - protein, 9 aa, Homo Sapiens
GENPFACKV

SEQ ID NO: 115218 - protein, 9 aa, Homo Sapiens
GENPLQVLV

SEQ ID NO: 115219 - protein, 9 aa, Homo Sapiens
GENSRTCMI

SEQ ID NO: 115220 - protein, 9 aa, Homo Sapiens
GENVHIYLI

SEQ ID NO: 115221 - protein, 9 aa, Homo Sapiens
GEPDKLSMV

SEQ ID NO: 115222 - protein, 9 aa, Homo Sapiens
GEPEPTPVV

SEQ ID NO: 115223 - protein, 9 aa, Homo Sapiens
GEPGPVRSV

SEQ ID NO: 115224 - protein, 9 aa, Homo Sapiens
GEPLHSLII

SEQ ID NO: 115225 - protein, 9 aa, Homo Sapiens
GEPSHSVKV

SEQ ID NO: 115226 - protein, 9 aa, Homo Sapiens
GEPVSVVTV

SEQ ID NO: 115227 - protein, 9 aa, Homo Sapiens
GEQNMMTKV

SEQ ID NO: 115228 - protein, 9 aa, Homo Sapiens
GEQRLIHKI

SEQ ID NO: 115229 - protein, 9 aa, Homo Sapiens
GEREIWNQI

SEQ ID NO: 115230 - protein, 9 aa, Homo Sapiens
GERIRLEKV

SEQ ID NO: 115231 - protein, 9 aa, Homo Sapiens
GERPSNEEI

SEQ ID NO: 115232 - protein, 9 aa, Homo Sapiens
GESAGAASV

SEQ ID NO: 115233 - protein, 9 aa, Homo Sapiens
GESAILDRV

SEQ ID NO: 115234 - protein, 9 aa, Homo Sapiens
GESDPMKGV

SEQ ID NO: 115235 - protein, 9 aa, Homo Sapiens
GESFGISRI

SEQ ID NO: 115236 - protein, 9 aa, Homo Sapiens
GESGKSTIV

SEQ ID NO: 115237 - protein, 9 aa, Homo Sapiens
GESGPMGNI

SEQ ID NO: 115238 - protein, 9 aa, Homo Sapiens
GESKDLLFI

SEQ ID NO: 115239 - protein, 9 aa, Homo Sapiens
GESLDLLKV

SEQ ID NO: 115240 - protein, 9 aa, Homo Sapiens
GESPELLLV

SEQ ID NO: 115241 - protein, 9 aa, Homo Sapiens
GESVPEPRI

SEQ ID NO: 115242 - protein, 9 aa, Homo Sapiens
GESVQGSHV

SEQ ID NO: 115243 - protein, 9 aa, Homo Sapiens
GETEKKCFI

SEQ ID NO: 115244 - protein, 9 aa, Homo Sapiens
GETEKRCFI

SEQ ID NO: 115245 - protein, 9 aa, Homo Sapiens
GETEVLKVI

SEQ ID NO: 115246 - protein, 9 aa, Homo Sapiens
GETHPFTKL

SEQ ID NO: 115247 - protein, 9 aa, Homo Sapiens
GETIHIPTM

SEQ ID NO: 115248 - protein, 9 aa, Homo Sapiens
GETINTRLI

SEQ ID NO: 115249 - protein, 9 aa, Homo Sapiens
GETKVWQYI

SEQ ID NO: 115250 - protein, 9 aa, Homo Sapiens
GETNLKTHV

SEQ ID NO: 115251 - protein, 9 aa, Homo Sapiens
GETPQVAVI

SEQ ID NO: 115252 - protein, 9 aa, Homo Sapiens
GETQLVQEV

SEQ ID NO: 115253 - protein, 9 aa, Homo Sapiens
GETTFMAKL

SEQ ID NO: 115254 - protein, 9 aa, Homo Sapiens
GETTPCSKV

SEQ ID NO: 115255 - protein, 9 aa, Homo Sapiens
GETVKIVRI

SEQ ID NO: 115256 - protein, 9 aa, Homo Sapiens
GETYNGHLV

SEQ ID NO: 115257 - protein, 9 aa, Homo Sapiens
GEVAMGRVV

SEQ ID NO: 115258 - protein, 9 aa, Homo Sapiens
GEVDFKEFI

SEQ ID NO: 115259 - protein, 9 aa, Homo Sapiens
GEVDKRELI

SEQ ID NO: 115260 - protein, 9 aa, Homo Sapiens
GEVEKLLKT

SEQ ID NO: 115261 - protein, 9 aa, Homo Sapiens
GEVENGRCI

SEQ ID NO: 115262 - protein, 9 aa, Homo Sapiens
GEVESAKLI

SEQ ID NO: 115263 - protein, 9 aa, Homo Sapiens
GEVFKTYNV

SEQ ID NO: 115264 - protein, 9 aa, Homo Sapiens
GEVFPTTEV

SEQ ID NO: 115265 - protein, 9 aa, Homo Sapiens
GEVGKTTGI

SEQ ID NO: 115266 - protein, 9 aa, Homo Sapiens
GEVGRWLVI

SEQ ID NO: 115267 - protein, 9 aa, Homo Sapiens
GEVHPSEMI

SEQ ID NO: 115268 - protein, 9 aa, Homo Sapiens
GEVHTGTTI

SEQ ID NO: 115269 - protein, 9 aa, Homo Sapiens
GEVMPVVVV

SEQ ID NO: 115270 - protein, 9 aa, Homo Sapiens
GEVPFNHEI

SEQ ID NO: 115271 - protein, 9 aa, Homo Sapiens
GEVRTHIRV

SEQ ID NO: 115272 - protein, 9 aa, Homo Sapiens
GEVVAIKKI

SEQ ID NO: 115273 - protein, 9 aa, Homo Sapiens
GEWDKALSI

SEQ ID NO: 115274 - protein, 9 aa, Homo Sapiens
GEWERAAAV

SEQ ID NO: 115275 - protein, 9 aa, Homo Sapiens
GEWGAFNDI

SEQ ID NO: 115276 - protein, 9 aa, Homo Sapiens
GEWIKPGAI

SEQ ID NO: 115277 - protein, 9 aa, Homo Sapiens
GEWPDQPRI

SEQ ID NO: 115278 - protein, 9 aa, Homo Sapiens
GEWSDQPRI

SEQ ID NO: 115279 - protein, 9 aa, Homo Sapiens
GEWVGLCKI

SEQ ID NO: 115280 - protein, 9 aa, Homo Sapiens
GEYAKLEKI

SEQ ID NO: 115281 - protein, 9 aa, Homo Sapiens
GEYEDVSRV

SEQ ID NO: 115282 - protein, 9 aa, Homo Sapiens
GEYFAIKAL

SEQ ID NO: 115283 - protein, 9 aa, Homo Sapiens
GEYGGWYKA

SEQ ID NO: 115284 - protein, 9 aa, Homo Sapiens
GEYGKFFVT

SEQ ID NO: 115285 - protein, 9 aa, Homo Sapiens
GEYGNLVTI

SEQ ID NO: 115286 - protein, 9 aa, Homo Sapiens
GEYIAPEKI

SEQ ID NO: 115287 - protein, 9 aa, Homo Sapiens
GEYIKTWRP

SEQ ID NO: 115288 - protein, 9 aa, Homo Sapiens
GEYKAPQCI

SEQ ID NO: 115289 - protein, 9 aa, Homo Sapiens
GEYKMILVV

SEQ ID NO: 115290 - protein, 9 aa, Homo Sapiens
GEYLGNNRL

SEQ ID NO: 115291 - protein, 9 aa, Homo Sapiens
GEYMDKNNV

SEQ ID NO: 115292 - protein, 9 aa, Homo Sapiens
GEYPKLLRL

SEQ ID NO: 115293 - protein, 9 aa, Homo Sapiens
GEYQRMGVM

SEQ ID NO: 115294 - protein, 9 aa, Homo Sapiens
GEYSDPVTL

SEQ ID NO: 115295 - protein, 9 aa, Homo Sapiens
GEYSGIEHV

SEQ ID NO: 115296 - protein, 9 aa, Homo Sapiens
GEYSKVLAI

SEQ ID NO: 115297 - protein, 9 aa, Homo Sapiens
GEYTHIRNI

SEQ ID NO: 115298 - protein, 9 aa, Homo Sapiens
GEYTYYFRV

SEQ ID NO: 115299 - protein, 9 aa, Homo Sapiens
GEYWCEVTV

SEQ ID NO: 115300 - protein, 9 aa, Homo Sapiens
HEAAALNAV

SEQ ID NO: 115301 - protein, 9 aa, Homo Sapiens
HEAAFPIAV

SEQ ID NO: 115302 - protein, 9 aa, Homo Sapiens
HEAEIETRI

SEQ ID NO: 115303 - protein, 9 aa, Homo Sapiens
HEAEPVRTL

SEQ ID NO: 115304 - protein, 9 aa, Homo Sapiens
HEAERINNI

SEQ ID NO: 115305 - protein, 9 aa, Homo Sapiens
HEAFPLRVI

SEQ ID NO: 115306 - protein, 9 aa, Homo Sapiens
HEAHKFLKV

SEQ ID NO: 115307 - protein, 9 aa, Homo Sapiens
HEAMEQQSI

SEQ ID NO: 115308 - protein, 9 aa, Homo Sapiens
HEAMEQQTI

SEQ ID NO: 115309 - protein, 9 aa, Homo Sapiens
HEAQLSEKI

SEQ ID NO: 115310 - protein, 9 aa, Homo Sapiens
HECASINRI

SEQ ID NO: 115311 - protein, 9 aa, Homo Sapiens
HEDKNLVHV

SEQ ID NO: 115312 - protein, 9 aa, Homo Sapiens
HEEGYFTAI

SEQ ID NO: 115313 - protein, 9 aa, Homo Sapiens
HEEKVFRAV

SEQ ID NO: 115314 - protein, 9 aa, Homo Sapiens
HEEQPRPFV

SEQ ID NO: 115315 - protein, 9 aa, Homo Sapiens
HEFFHILNL

SEQ ID NO: 115316 - protein, 9 aa, Homo Sapiens
HEFGAITFV

SEQ ID NO: 115317 - protein, 9 aa, Homo Sapiens
HEFLRLSQV

SEQ ID NO: 115318 - protein, 9 aa, Homo Sapiens
HEFSTICKI

SEQ ID NO: 115319 - protein, 9 aa, Homo Sapiens
HEFTDLNLV

SEQ ID NO: 115320 - protein, 9 aa, Homo Sapiens
HEFTTSARI

SEQ ID NO: 115321 - protein, 9 aa, Homo Sapiens
HEGDIILKI

SEQ ID NO: 115322 - protein, 9 aa, Homo Sapiens
HEGLPGLAV

SEQ ID NO: 115323 - protein, 9 aa, Homo Sapiens
HEGLPQPLI

SEQ ID NO: 115324 - protein, 9 aa, Homo Sapiens
HEHIEILTV

SEQ ID NO: 115325 - protein, 9 aa, Homo Sapiens
HEIDRYTAI

SEQ ID NO: 115326 - protein, 9 aa, Homo Sapiens
HEIDYILLV

SEQ ID NO: 115327 - protein, 9 aa, Homo Sapiens
HEIGFGSKV

SEQ ID NO: 115328 - protein, 9 aa, Homo Sapiens
HEIPSLQSI

SEQ ID NO: 115329 - protein, 9 aa, Homo Sapiens
HEIQNLTLI

SEQ ID NO: 115330 - protein, 9 aa, Homo Sapiens
HEIVPGSLI

SEQ ID NO: 115331 - protein, 9 aa, Homo Sapiens
HEKISSPKV

SEQ ID NO: 115332 - protein, 9 aa, Homo Sapiens
HELAFSRLI

SEQ ID NO: 115333 - protein, 9 aa, Homo Sapiens
HELEQMQLI

SEQ ID NO: 115334 - protein, 9 aa, Homo Sapiens
HELFSKSFI

SEQ ID NO: 115335 - protein, 9 aa, Homo Sapiens
HELFTPPVI

SEQ ID NO: 115336 - protein, 9 aa, Homo Sapiens
HELMFSTKI

SEQ ID NO: 115337 - protein, 9 aa, Homo Sapiens
HELPEFNLI

SEQ ID NO: 115338 - protein, 9 aa, Homo Sapiens
HELVYEAII

SEQ ID NO: 115339 - protein, 9 aa, Homo Sapiens
HEMLPASLI

SEQ ID NO: 115340 - protein, 9 aa, Homo Sapiens
HENAFIVFI

SEQ ID NO: 115341 - protein, 9 aa, Homo Sapiens
HENDAIHKI

SEQ ID NO: 115342 - protein, 9 aa, Homo Sapiens
HENPDLAKV

SEQ ID NO: 115343 - protein, 9 aa, Homo Sapiens
HEQALFIYV

SEQ ID NO: 115344 - protein, 9 aa, Homo Sapiens
HEQEYKNNI

SEQ ID NO: 115345 - protein, 9 aa, Homo Sapiens
HEQLRAVIV

SEQ ID NO: 115346 - protein, 9 aa, Homo Sapiens
HEQLSVAEI

SEQ ID NO: 115347 - protein, 9 aa, Homo Sapiens
HEQLTVAEI

SEQ ID NO: 115348 - protein, 9 aa, Homo Sapiens
HEQSRIITV

SEQ ID NO: 115349 - protein, 9 aa, Homo Sapiens
HERAAILSV

SEQ ID NO: 115350 - protein, 9 aa, Homo Sapiens
HERANLLEI

SEQ ID NO: 115351 - protein, 9 aa, Homo Sapiens
HERFPFEIV

SEQ ID NO: 115352 - protein, 9 aa, Homo Sapiens
HESAAHAIV

SEQ ID NO: 115353 - protein, 9 aa, Homo Sapiens
HESACGRTV

SEQ ID NO: 115354 - protein, 9 aa, Homo Sapiens
HESGASIKI

SEQ ID NO: 115355 - protein, 9 aa, Homo Sapiens
HESPAVKLM

SEQ ID NO: 115356 - protein, 9 aa, Homo Sapiens
HESRQITQV

SEQ ID NO: 115357 - protein, 9 aa, Homo Sapiens
HETDNMNQI

SEQ ID NO: 115358 - protein, 9 aa, Homo Sapiens
HETLFILGV

SEQ ID NO: 115359 - protein, 9 aa, Homo Sapiens
HETPKQPVV

SEQ ID NO: 115360 - protein, 9 aa, Homo Sapiens
HEVAPPRLV

SEQ ID NO: 115361 - protein, 9 aa, Homo Sapiens
HEVDELTQI

SEQ ID NO: 115362 - protein, 9 aa, Homo Sapiens
HEVDKLYKV

SEQ ID NO: 115363 - protein, 9 aa, Homo Sapiens
HEVFNHREV

SEQ ID NO: 115364 - protein, 9 aa, Homo Sapiens
HEVKEVAGI

SEQ ID NO: 115365 - protein, 9 aa, Homo Sapiens
HEVMEQQTI

SEQ ID NO: 115366 - protein, 9 aa, Homo Sapiens
HEVNRILKV

SEQ ID NO: 115367 - protein, 9 aa, Homo Sapiens
HEVPFPANI

SEQ ID NO: 115368 - protein, 9 aa, Homo Sapiens
HEVPGHQSV

SEQ ID NO: 115369 - protein, 9 aa, Homo Sapiens
HEVSLQESI

SEQ ID NO: 115370 - protein, 9 aa, Homo Sapiens
HEVSNGSVV

SEQ ID NO: 115371 - protein, 9 aa, Homo Sapiens
HEWLQQHGI

SEQ ID NO: 115372 - protein, 9 aa, Homo Sapiens
HEYFPEMQI

SEQ ID NO: 115373 - protein, 9 aa, Homo Sapiens
HEYPPGLLV

SEQ ID NO: 115374 - protein, 9 aa, Homo Sapiens
HEYPWILSA

SEQ ID NO: 115375 - protein, 9 aa, Homo Sapiens
HEYVAQNGI

SEQ ID NO: 115376 - protein, 9 aa, Homo Sapiens
HEYVPWVTV

SEQ ID NO: 115377 - protein, 9 aa, Homo Sapiens
IEAAIERKI

SEQ ID NO: 115378 - protein, 9 aa, Homo Sapiens
IEAAQLLQI

SEQ ID NO: 115379 - protein, 9 aa, Homo Sapiens
IEAEGLKEM

SEQ ID NO: 115380 - protein, 9 aa, Homo Sapiens
IEAEKVAQV

SEQ ID NO: 115381 - protein, 9 aa, Homo Sapiens
IEAELTRRV

SEQ ID NO: 115382 - protein, 9 aa, Homo Sapiens
IEAGLPQKV

SEQ ID NO: 115383 - protein, 9 aa, Homo Sapiens
IEAKFYEEV

SEQ ID NO: 115384 - protein, 9 aa, Homo Sapiens
IEAPSSTCV

SEQ ID NO: 115385 - protein, 9 aa, Homo Sapiens
IEAVLLNSL

SEQ ID NO: 115386 - protein, 9 aa, Homo Sapiens
IEDAGFHKV

SEQ ID NO: 115387 - protein, 9 aa, Homo Sapiens
IEDDTILKT

SEQ ID NO: 115388 - protein, 9 aa, Homo Sapiens
IEDEKMVVV

SEQ ID NO: 115389 - protein, 9 aa, Homo Sapiens
IEDEVTRQV

SEQ ID NO: 115390 - protein, 9 aa, Homo Sapiens
IEDGKVVTV

SEQ ID NO: 115391 - protein, 9 aa, Homo Sapiens
IEDGSIHRI

SEQ ID NO: 115392 - protein, 9 aa, Homo Sapiens
IEDHFDVTV

SEQ ID NO: 115393 - protein, 9 aa, Homo Sapiens
IEDPKLGKV

SEQ ID NO: 115394 - protein, 9 aa, Homo Sapiens
IEDPVRPEV

SEQ ID NO: 115395 - protein, 9 aa, Homo Sapiens
IEDRPMPKL

SEQ ID NO: 115396 - protein, 9 aa, Homo Sapiens
IEDSRVYEL

SEQ ID NO: 115397 - protein, 9 aa, Homo Sapiens
IEDVPCGNI

SEQ ID NO: 115398 - protein, 9 aa, Homo Sapiens
IEEDRKLLI

SEQ ID NO: 115399 - protein, 9 aa, Homo Sapiens
IEESGEHII

SEQ ID NO: 115400 - protein, 9 aa, Homo Sapiens
IEEVGIYRI

SEQ ID NO: 115401 - protein, 9 aa, Homo Sapiens
IEFDEHINV

SEQ ID NO: 115402 - protein, 9 aa, Homo Sapiens
IEFNPPKTV

SEQ ID NO: 115403 - protein, 9 aa, Homo Sapiens
IEFSDKESV

SEQ ID NO: 115404 - protein, 9 aa, Homo Sapiens
IEFSIPDSL

SEQ ID NO: 115405 - protein, 9 aa, Homo Sapiens
IEFTYTAKL

SEQ ID NO: 115406 - protein, 9 aa, Homo Sapiens
IEGPSKAEI

SEQ ID NO: 115407 - protein, 9 aa, Homo Sapiens
IEGTPLETI

SEQ ID NO: 115408 - protein, 9 aa, Homo Sapiens
IEHDKREMI

SEQ ID NO: 115409 - protein, 9 aa, Homo Sapiens
IEHHLASNV

SEQ ID NO: 115410 - protein, 9 aa, Homo Sapiens
IEHIIENIV

SEQ ID NO: 115411 - protein, 9 aa, Homo Sapiens
IEHNKLRTI

SEQ ID NO: 115412 - protein, 9 aa, Homo Sapiens
IEIAKNYNV

SEQ ID NO: 115413 - protein, 9 aa, Homo Sapiens
IEIDPHRTV

SEQ ID NO: 115414 - protein, 9 aa, Homo Sapiens
IEIDSPYEI

SEQ ID NO: 115415 - protein, 9 aa, Homo Sapiens
IEIEKGEAV

SEQ ID NO: 115416 - protein, 9 aa, Homo Sapiens
IEIERILSV

SEQ ID NO: 115417 - protein, 9 aa, Homo Sapiens
IEIETPTQI

SEQ ID NO: 115418 - protein, 9 aa, Homo Sapiens
IEIGDTIRV

SEQ ID NO: 115419 - protein, 9 aa, Homo Sapiens
IEIGPDGRV

SEQ ID NO: 115420 - protein, 9 aa, Homo Sapiens
IEIGYVCSV

SEQ ID NO: 115421 - protein, 9 aa, Homo Sapiens
IEILGVRNV

SEQ ID NO: 115422 - protein, 9 aa, Homo Sapiens
IEKDIAAHI

SEQ ID NO: 115423 - protein, 9 aa, Homo Sapiens
IEKEGVTLV

SEQ ID NO: 115424 - protein, 9 aa, Homo Sapiens
IEKEHVEEI

SEQ ID NO: 115425 - protein, 9 aa, Homo Sapiens
IEKEKPLLI

SEQ ID NO: 115426 - protein, 9 aa, Homo Sapiens
IEKEYLERV

SEQ ID NO: 115427 - protein, 9 aa, Homo Sapiens
IEKKATATI

SEQ ID NO: 115428 - protein, 9 aa, Homo Sapiens
IEKLFPDAI

SEQ ID NO: 115429 - protein, 9 aa, Homo Sapiens
IEKLGGLVI

SEQ ID NO: 115430 - protein, 9 aa, Homo Sapiens
IEKPGGIIV

SEQ ID NO: 115431 - protein, 9 aa, Homo Sapiens
IEKSGWLFI

SEQ ID NO: 115432 - protein, 9 aa, Homo Sapiens
IEKTGKIKI

SEQ ID NO: 115433 - protein, 9 aa, Homo Sapiens
IELKNGTQV

SEQ ID NO: 115434 - protein, 9 aa, Homo Sapiens
IELPNIQKV

SEQ ID NO: 115435 - protein, 9 aa, Homo Sapiens
IEMAYARQI

SEQ ID NO: 115436 - protein, 9 aa, Homo Sapiens
IEMDKGTYI

SEQ ID NO: 115437 - protein, 9 aa, Homo Sapiens
IEMETKTSI

SEQ ID NO: 115438 - protein, 9 aa, Homo Sapiens
IENGHIFTV

SEQ ID NO: 115439 - protein, 9 aa, Homo Sapiens
IENSIVHRV

SEQ ID NO: 115440 - protein, 9 aa, Homo Sapiens
IENVIFNRV

SEQ ID NO: 115441 - protein, 9 aa, Homo Sapiens
IENVPCEFV

SEQ ID NO: 115442 - protein, 9 aa, Homo Sapiens
IEPEHVNTV

SEQ ID NO: 115443 - protein, 9 aa, Homo Sapiens
IEPELNNLI

SEQ ID NO: 115444 - protein, 9 aa, Homo Sapiens
IEQDTDTKI

SEQ ID NO: 115445 - protein, 9 aa, Homo Sapiens
IEQHPVVVI

SEQ ID NO: 115446 - protein, 9 aa, Homo Sapiens
IEQYYSTQI

SEQ ID NO: 115447 - protein, 9 aa, Homo Sapiens
IERALQPCI

SEQ ID NO: 115448 - protein, 9 aa, Homo Sapiens
IEREDIEFI

SEQ ID NO: 115449 - protein, 9 aa, Homo Sapiens
IESDKIVEI

SEQ ID NO: 115450 - protein, 9 aa, Homo Sapiens
IESKHEVTI

SEQ ID NO: 115451 - protein, 9 aa, Homo Sapiens
IESNHPIVL

SEQ ID NO: 115452 - protein, 9 aa, Homo Sapiens
IESNHPVVI

SEQ ID NO: 115453 - protein, 9 aa, Homo Sapiens
IESPAFSTL

SEQ ID NO: 115454 - protein, 9 aa, Homo Sapiens
IESTYGTHI

SEQ ID NO: 115455 - protein, 9 aa, Homo Sapiens
IETASGNKV

SEQ ID NO: 115456 - protein, 9 aa, Homo Sapiens
IETFYNTSI

SEQ ID NO: 115457 - protein, 9 aa, Homo Sapiens
IETINFHEV

SEQ ID NO: 115458 - protein, 9 aa, Homo Sapiens
IETPPTRNI

SEQ ID NO: 115459 - protein, 9 aa, Homo Sapiens
IETVQKETI

SEQ ID NO: 115460 - protein, 9 aa, Homo Sapiens
IEVDPVLTV

SEQ ID NO: 115461 - protein, 9 aa, Homo Sapiens
IEVDSSPSV

SEQ ID NO: 115462 - protein, 9 aa, Homo Sapiens
IEVEAPITV

SEQ ID NO: 115463 - protein, 9 aa, Homo Sapiens
IEVEKPFAI

SEQ ID NO: 115464 - protein, 9 aa, Homo Sapiens
IEVENKNNL

SEQ ID NO: 115465 - protein, 9 aa, Homo Sapiens
IEVNPQTRI

SEQ ID NO: 115466 - protein, 9 aa, Homo Sapiens
IEVTPQSKI

SEQ ID NO: 115467 - protein, 9 aa, Homo Sapiens
IEYAKPTRL

SEQ ID NO: 115468 - protein, 9 aa, Homo Sapiens
IEYARQLEM

SEQ ID NO: 115469 - protein, 9 aa, Homo Sapiens
IEYEPFRKN

SEQ ID NO: 115470 - protein, 9 aa, Homo Sapiens
IEYGDMQLI

SEQ ID NO: 115471 - protein, 9 aa, Homo Sapiens
IEYPTLHVV

SEQ ID NO: 115472 - protein, 9 aa, Homo Sapiens
IEYQFVERL

SEQ ID NO: 115473 - protein, 9 aa, Homo Sapiens
IPADLPVVV

SEQ ID NO: 115474 - protein, 9 aa, Homo Sapiens
KDYPFYLTV

SEQ ID NO: 115475 - protein, 9 aa, Homo Sapiens
KEAAYHPEV

SEQ ID NO: 115476 - protein, 9 aa, Homo Sapiens
KEAEFLQKL

SEQ ID NO: 115477 - protein, 9 aa, Homo Sapiens
KEAEFQRHV

SEQ ID NO: 115478 - protein, 9 aa, Homo Sapiens
KEAEKSPQL

SEQ ID NO: 115479 - protein, 9 aa, Homo Sapiens
KEAEKVARV

SEQ ID NO: 115480 - protein, 9 aa, Homo Sapiens
KEAELRSGI

SEQ ID NO: 115481 - protein, 9 aa, Homo Sapiens
KEAELRTWI

SEQ ID NO: 115482 - protein, 9 aa, Homo Sapiens
KEAGDLSTL

SEQ ID NO: 115483 - protein, 9 aa, Homo Sapiens
KEAGKFSAV

SEQ ID NO: 115484 - protein, 9 aa, Homo Sapiens
KEAHEPLAV

SEQ ID NO: 115485 - protein, 9 aa, Homo Sapiens
KEAIKSSLI

SEQ ID NO: 115486 - protein, 9 aa, Homo Sapiens
KEALVQVEV

SEQ ID NO: 115487 - protein, 9 aa, Homo Sapiens
KEALYALTV

SEQ ID NO: 115488 - protein, 9 aa, Homo Sapiens
KEAPAKVEV

SEQ ID NO: 115489 - protein, 9 aa, Homo Sapiens
KEAPAPPKA

SEQ ID NO: 115490 - protein, 9 aa, Homo Sapiens
KEAPPMEKP

SEQ ID NO: 115491 - protein, 9 aa, Homo Sapiens
KEAQPVVVI

SEQ ID NO: 115492 - protein, 9 aa, Homo Sapiens
KEASTTVRV

SEQ ID NO: 115493 - protein, 9 aa, Homo Sapiens
KEATSIKRV

SEQ ID NO: 115494 - protein, 9 aa, Homo Sapiens
KEAVTGITV

SEQ ID NO: 115495 - protein, 9 aa, Homo Sapiens
KECDFQTKF

SEQ ID NO: 115496 - protein, 9 aa, Homo Sapiens
KECENVKEI

SEQ ID NO: 115497 - protein, 9 aa, Homo Sapiens
KECGKAFRV

SEQ ID NO: 115498 - protein, 9 aa, Homo Sapiens
KECGKAFSI

SEQ ID NO: 115499 - protein, 9 aa, Homo Sapiens
KECGKAFTV

SEQ ID NO: 115500 - protein, 9 aa, Homo Sapiens
KECQEKLQV

SEQ ID NO: 115501 - protein, 9 aa, Homo Sapiens
KEDDAPRTI

SEQ ID NO: 115502 - protein, 9 aa, Homo Sapiens
KEDDVRQYV

SEQ ID NO: 115503 - protein, 9 aa, Homo Sapiens
KEDGAFSFV

SEQ ID NO: 115504 - protein, 9 aa, Homo Sapiens
KEDIPRQLV

SEQ ID NO: 115505 - protein, 9 aa, Homo Sapiens
KEDIQKETV

SEQ ID NO: 115506 - protein, 9 aa, Homo Sapiens
KEDPKALAV

SEQ ID NO: 115507 - protein, 9 aa, Homo Sapiens
KEDSQILKI

SEQ ID NO: 115508 - protein, 9 aa, Homo Sapiens
KEDTKELVV

SEQ ID NO: 115509 - protein, 9 aa, Homo Sapiens
KEDVKPYQV

SEQ ID NO: 115510 - protein, 9 aa, Homo Sapiens
KEDVRILKV

SEQ ID NO: 115511 - protein, 9 aa, Homo Sapiens
KEEEPVKKI

SEQ ID NO: 115512 - protein, 9 aa, Homo Sapiens
KEEEPVKKV

SEQ ID NO: 115513 - protein, 9 aa, Homo Sapiens
KEEQAERLV

SEQ ID NO: 115514 - protein, 9 aa, Homo Sapiens
KEEVTTREV

SEQ ID NO: 115515 - protein, 9 aa, Homo Sapiens
KEFAQIIKI

SEQ ID NO: 115516 - protein, 9 aa, Homo Sapiens
KEFDGKSLV

SEQ ID NO: 115517 - protein, 9 aa, Homo Sapiens
KEFEGKTLV

SEQ ID NO: 115518 - protein, 9 aa, Homo Sapiens
KEFEKASKI

SEQ ID NO: 115519 - protein, 9 aa, Homo Sapiens
KEFGAVSKV

SEQ ID NO: 115520 - protein, 9 aa, Homo Sapiens
KEFIGQQLI

SEQ ID NO: 115521 - protein, 9 aa, Homo Sapiens
KEFKEVEKV

SEQ ID NO: 115522 - protein, 9 aa, Homo Sapiens
KEFKSQLFV

SEQ ID NO: 115523 - protein, 9 aa, Homo Sapiens
KEFLMENRV

SEQ ID NO: 115524 - protein, 9 aa, Homo Sapiens
KEFLVVASV

SEQ ID NO: 115525 - protein, 9 aa, Homo Sapiens
KEFQDLREV

SEQ ID NO: 115526 - protein, 9 aa, Homo Sapiens
KEFQEGLKI

SEQ ID NO: 115527 - protein, 9 aa, Homo Sapiens
KEFQLFQGV

SEQ ID NO: 115528 - protein, 9 aa, Homo Sapiens
KEFSGHSSL

SEQ ID NO: 115529 - protein, 9 aa, Homo Sapiens
KEFSKCLFI

SEQ ID NO: 115530 - protein, 9 aa, Homo Sapiens
KEFSPFGTI

SEQ ID NO: 115531 - protein, 9 aa, Homo Sapiens
KEFSSEARV

SEQ ID NO: 115532 - protein, 9 aa, Homo Sapiens
KEFVGKPTI

SEQ ID NO: 115533 - protein, 9 aa, Homo Sapiens
KEGDIVTLI

SEQ ID NO: 115534 - protein, 9 aa, Homo Sapiens
KEGEIIHLI

SEQ ID NO: 115535 - protein, 9 aa, Homo Sapiens
KEGENRAVI

SEQ ID NO: 115536 - protein, 9 aa, Homo Sapiens
KEGFPITAI

SEQ ID NO: 115537 - protein, 9 aa, Homo Sapiens
KEGKPPISV

SEQ ID NO: 115538 - protein, 9 aa, Homo Sapiens
KEGLPTRAL

SEQ ID NO: 115539 - protein, 9 aa, Homo Sapiens
KEGLVMVEV

SEQ ID NO: 115540 - protein, 9 aa, Homo Sapiens
KEGPITKHI

SEQ ID NO: 115541 - protein, 9 aa, Homo Sapiens
KEGVFAKEV

SEQ ID NO: 115542 - protein, 9 aa, Homo Sapiens
KEHEAITKV

SEQ ID NO: 115543 - protein, 9 aa, Homo Sapiens
KEHEVTIFV

SEQ ID NO: 115544 - protein, 9 aa, Homo Sapiens
KEHFEVNVV

SEQ ID NO: 115545 - protein, 9 aa, Homo Sapiens
KEHLYFETV

SEQ ID NO: 115546 - protein, 9 aa, Homo Sapiens
KEHNSKLTI

SEQ ID NO: 115547 - protein, 9 aa, Homo Sapiens
KEHPFILNL

SEQ ID NO: 115548 - protein, 9 aa, Homo Sapiens
KEHPLFKKL

SEQ ID NO: 115549 - protein, 9 aa, Homo Sapiens
KEHTGRLVI

SEQ ID NO: 115550 - protein, 9 aa, Homo Sapiens
KEIAEVNEI

SEQ ID NO: 115551 - protein, 9 aa, Homo Sapiens
KEICAVSRI

SEQ ID NO: 115552 - protein, 9 aa, Homo Sapiens
KEIDTSTKV

SEQ ID NO: 115553 - protein, 9 aa, Homo Sapiens
KEIEDFDSL

SEQ ID NO: 115554 - protein, 9 aa, Homo Sapiens
KEIEQEAAV

SEQ ID NO: 115555 - protein, 9 aa, Homo Sapiens
KEIERFQEI

SEQ ID NO: 115556 - protein, 9 aa, Homo Sapiens
KEIEYVETV

SEQ ID NO: 115557 - protein, 9 aa, Homo Sapiens
KEIFFNILV

SEQ ID NO: 115558 - protein, 9 aa, Homo Sapiens
KEIFLRELI

SEQ ID NO: 115559 - protein, 9 aa, Homo Sapiens
KEIGDIAGV

SEQ ID NO: 115560 - protein, 9 aa, Homo Sapiens
KEIGGLTQV

SEQ ID NO: 115561 - protein, 9 aa, Homo Sapiens
KEIGNCTQI

SEQ ID NO: 115562 - protein, 9 aa, Homo Sapiens
KEIGQLKAI

SEQ ID NO: 115563 - protein, 9 aa, Homo Sapiens
KEIIGLEGV

SEQ ID NO: 115564 - protein, 9 aa, Homo Sapiens
KEILPAAEI

SEQ ID NO: 115565 - protein, 9 aa, Homo Sapiens
KEINFCRKV

SEQ ID NO: 115566 - protein, 9 aa, Homo Sapiens
KEIPIPFYL

SEQ ID NO: 115567 - protein, 9 aa, Homo Sapiens
KEIPRIFQI

SEQ ID NO: 115568 - protein, 9 aa, Homo Sapiens
KEISDLHYL

SEQ ID NO: 115569 - protein, 9 aa, Homo Sapiens
KEISESRVV

SEQ ID NO: 115570 - protein, 9 aa, Homo Sapiens
KEISITHHV

SEQ ID NO: 115571 - protein, 9 aa, Homo Sapiens
KEITEGKTV

SEQ ID NO: 115572 - protein, 9 aa, Homo Sapiens
KEIVDDTKV

SEQ ID NO: 115573 - protein, 9 aa, Homo Sapiens
KEIVGVVNV

SEQ ID NO: 115574 - protein, 9 aa, Homo Sapiens
KEKASWSSL

SEQ ID NO: 115575 - protein, 9 aa, Homo Sapiens
KEKEFEETM

SEQ ID NO: 115576 - protein, 9 aa, Homo Sapiens
KEKESTVHI

SEQ ID NO: 115577 - protein, 9 aa, Homo Sapiens
KEKVPGITI

SEQ ID NO: 115578 - protein, 9 aa, Homo Sapiens
KELATVRTI

SEQ ID NO: 115579 - protein, 9 aa, Homo Sapiens
KELDGFLSI

SEQ ID NO: 115580 - protein, 9 aa, Homo Sapiens
KELDHPRIV

SEQ ID NO: 115581 - protein, 9 aa, Homo Sapiens
KELEENLNI

SEQ ID NO: 115582 - protein, 9 aa, Homo Sapiens
KELEHLSHI

SEQ ID NO: 115583 - protein, 9 aa, Homo Sapiens
KELELPENI

SEQ ID NO: 115584 - protein, 9 aa, Homo Sapiens
KELEYIVSV

SEQ ID NO: 115585 - protein, 9 aa, Homo Sapiens
KELFFEDSI

SEQ ID NO: 115586 - protein, 9 aa, Homo Sapiens
KELGILSKI

SEQ ID NO: 115587 - protein, 9 aa, Homo Sapiens
KELIKPPTI

SEQ ID NO: 115588 - protein, 9 aa, Homo Sapiens
KELKGFKTI

SEQ ID NO: 115589 - protein, 9 aa, Homo Sapiens
KELKKSLKI

SEQ ID NO: 115590 - protein, 9 aa, Homo Sapiens
KELKLLQTI

SEQ ID NO: 115591 - protein, 9 aa, Homo Sapiens
KELLLKRTV

SEQ ID NO: 115592 - protein, 9 aa, Homo Sapiens
KELLRVAQI

SEQ ID NO: 115593 - protein, 9 aa, Homo Sapiens
KELLYVPLI

SEQ ID NO: 115594 - protein, 9 aa, Homo Sapiens
KELPQVSFV

SEQ ID NO: 115595 - protein, 9 aa, Homo Sapiens
KELQAEATV

SEQ ID NO: 115596 - protein, 9 aa, Homo Sapiens
KELRKFRKI

SEQ ID NO: 115597 - protein, 9 aa, Homo Sapiens
KELSEALTR

SEQ ID NO: 115598 - protein, 9 aa, Homo Sapiens
KELSELVSI

SEQ ID NO: 115599 - protein, 9 aa, Homo Sapiens
KELWAHKEV

SEQ ID NO: 115600 - protein, 9 aa, Homo Sapiens
KEMDSNTVI

SEQ ID NO: 115601 - protein, 9 aa, Homo Sapiens
KEMEKSFEV

SEQ ID NO: 115602 - protein, 9 aa, Homo Sapiens
KEMEQLLEM

SEQ ID NO: 115603 - protein, 9 aa, Homo Sapiens
KEMGGHHIV

SEQ ID NO: 115604 - protein, 9 aa, Homo Sapiens
KEMNPALGI

SEQ ID NO: 115605 - protein, 9 aa, Homo Sapiens
KEMTEVPRV

SEQ ID NO: 115606 - protein, 9 aa, Homo Sapiens
KENDQILAI

SEQ ID NO: 115607 - protein, 9 aa, Homo Sapiens
KENDRICQV

SEQ ID NO: 115608 - protein, 9 aa, Homo Sapiens
KENDRSLYI

SEQ ID NO: 115609 - protein, 9 aa, Homo Sapiens
KENEELTRI

SEQ ID NO: 115610 - protein, 9 aa, Homo Sapiens
KENERWNVI

SEQ ID NO: 115611 - protein, 9 aa, Homo Sapiens
KENGFSEKI

SEQ ID NO: 115612 - protein, 9 aa, Homo Sapiens
KENGRTLVV

SEQ ID NO: 115613 - protein, 9 aa, Homo Sapiens
KENQNIAYV

SEQ ID NO: 115614 - protein, 9 aa, Homo Sapiens
KENTPPVVI

SEQ ID NO: 115615 - protein, 9 aa, Homo Sapiens
KENVKPIKV

SEQ ID NO: 115616 - protein, 9 aa, Homo Sapiens
KEPELFQTV

SEQ ID NO: 115617 - protein, 9 aa, Homo Sapiens
KEPPLSLTI

SEQ ID NO: 115618 - protein, 9 aa, Homo Sapiens
KEQEPMPTV

SEQ ID NO: 115619 - protein, 9 aa, Homo Sapiens
KEQETALRV

SEQ ID NO: 115620 - protein, 9 aa, Homo Sapiens
KEQIKWSLL

SEQ ID NO: 115621 - protein, 9 aa, Homo Sapiens
KEQVPPPAV

SEQ ID NO: 115622 - protein, 9 aa, Homo Sapiens
KEQYYVRKV

SEQ ID NO: 115623 - protein, 9 aa, Homo Sapiens
KERELQNTV

SEQ ID NO: 115624 - protein, 9 aa, Homo Sapiens
KESDHIHII

SEQ ID NO: 115625 - protein, 9 aa, Homo Sapiens
KESEDKPEI

SEQ ID NO: 115626 - protein, 9 aa, Homo Sapiens
KESEPAEEV

SEQ ID NO: 115627 - protein, 9 aa, Homo Sapiens
KESIPFAVV

SEQ ID NO: 115628 - protein, 9 aa, Homo Sapiens
KESLPLFKI

SEQ ID NO: 115629 - protein, 9 aa, Homo Sapiens
KESNDLLLI

SEQ ID NO: 115630 - protein, 9 aa, Homo Sapiens
KESVPARTV

SEQ ID NO: 115631 - protein, 9 aa, Homo Sapiens
KETAVFINI

SEQ ID NO: 115632 - protein, 9 aa, Homo Sapiens
KETELNKVI

SEQ ID NO: 115633 - protein, 9 aa, Homo Sapiens
KETESLRKI

SEQ ID NO: 115634 - protein, 9 aa, Homo Sapiens
KETGQIVAI

SEQ ID NO: 115635 - protein, 9 aa, Homo Sapiens
KETIDNNSV

SEQ ID NO: 115636 - protein, 9 aa, Homo Sapiens
KETLPGARI

SEQ ID NO: 115637 - protein, 9 aa, Homo Sapiens
KETNIQLFV

SEQ ID NO: 115638 - protein, 9 aa, Homo Sapiens
KETQPPETV

SEQ ID NO: 115639 - protein, 9 aa, Homo Sapiens
KEVAELTRL

SEQ ID NO: 115640 - protein, 9 aa, Homo Sapiens
KEVAGLRQL

SEQ ID NO: 115641 - protein, 9 aa, Homo Sapiens
KEVAKIIYI

SEQ ID NO: 115642 - protein, 9 aa, Homo Sapiens
KEVAPVPKI

SEQ ID NO: 115643 - protein, 9 aa, Homo Sapiens
KEVDLIPKV

SEQ ID NO: 115644 - protein, 9 aa, Homo Sapiens
KEVDNLYNI

SEQ ID NO: 115645 - protein, 9 aa, Homo Sapiens
KEVEKKLTV

SEQ ID NO: 115646 - protein, 9 aa, Homo Sapiens
KEVEQFTQV

SEQ ID NO: 115647 - protein, 9 aa, Homo Sapiens
KEVERILGL

SEQ ID NO: 115648 - protein, 9 aa, Homo Sapiens
KEVEYFTGI

SEQ ID NO: 115649 - protein, 9 aa, Homo Sapiens
KEVFIRELI

SEQ ID NO: 115650 - protein, 9 aa, Homo Sapiens
KEVIKSQEV

SEQ ID NO: 115651 - protein, 9 aa, Homo Sapiens
KEVIKTNNV

SEQ ID NO: 115652 - protein, 9 aa, Homo Sapiens
KEVISVVKV

SEQ ID NO: 115653 - protein, 9 aa, Homo Sapiens
KEVNFTSEL

SEQ ID NO: 115654 - protein, 9 aa, Homo Sapiens
KEVQTVTSI

SEQ ID NO: 115655 - protein, 9 aa, Homo Sapiens
KEVTDLRKI

SEQ ID NO: 115656 - protein, 9 aa, Homo Sapiens
KEVVEAVTI

SEQ ID NO: 115657 - protein, 9 aa, Homo Sapiens
KEVYFAERV

SEQ ID NO: 115658 - protein, 9 aa, Homo Sapiens
KEVYLFERI

SEQ ID NO: 115659 - protein, 9 aa, Homo Sapiens
KEYAVNEVV

SEQ ID NO: 115660 - protein, 9 aa, Homo Sapiens
KEYDALKAA

SEQ ID NO: 115661 - protein, 9 aa, Homo Sapiens
KEYDSISRL

SEQ ID NO: 115662 - protein, 9 aa, Homo Sapiens
KEYERFSKY

SEQ ID NO: 115663 - protein, 9 aa, Homo Sapiens
KEYFEFSEF

SEQ ID NO: 115664 - protein, 9 aa, Homo Sapiens
KEYFGIVSV

SEQ ID NO: 115665 - protein, 9 aa, Homo Sapiens
KEYFPVQVV

SEQ ID NO: 115666 - protein, 9 aa, Homo Sapiens
KEYGQIESV

SEQ ID NO: 115667 - protein, 9 aa, Homo Sapiens
KEYQPHVIV

SEQ ID NO: 115668 - protein, 9 aa, Homo Sapiens
KEYTNPEQI

SEQ ID NO: 115669 - protein, 9 aa, Homo Sapiens
KEYVGIVRL

SEQ ID NO: 115670 - protein, 9 aa, Homo Sapiens
KQQLELDSI

SEQ ID NO: 115671 - protein, 9 aa, Homo Sapiens
LAQFIDKPV

SEQ ID NO: 115672 - protein, 9 aa, Homo Sapiens
LEAAAATQV

SEQ ID NO: 115673 - protein, 9 aa, Homo Sapiens
LEAAIPERV

SEQ ID NO: 115674 - protein, 9 aa, Homo Sapiens
LEADGTEKV

SEQ ID NO: 115675 - protein, 9 aa, Homo Sapiens
LEADKIRPL

SEQ ID NO: 115676 - protein, 9 aa, Homo Sapiens
LEADPIKRI

SEQ ID NO: 115677 - protein, 9 aa, Homo Sapiens
LEADRMAAL

SEQ ID NO: 115678 - protein, 9 aa, Homo Sapiens
LEAEPIRML

SEQ ID NO: 115679 - protein, 9 aa, Homo Sapiens
LEAERSTNI

SEQ ID NO: 115680 - protein, 9 aa, Homo Sapiens
LEAETGCKI

SEQ ID NO: 115681 - protein, 9 aa, Homo Sapiens
LEAHFVPLV

SEQ ID NO: 115682 - protein, 9 aa, Homo Sapiens
LEAIKALEV

SEQ ID NO: 115683 - protein, 9 aa, Homo Sapiens
LEALCPQVI

SEQ ID NO: 115684 - protein, 9 aa, Homo Sapiens
LEALVMPTL

SEQ ID NO: 115685 - protein, 9 aa, Homo Sapiens
LEALVPVTI

SEQ ID NO: 115686 - protein, 9 aa, Homo Sapiens
LEASERQSL

SEQ ID NO: 115687 - protein, 9 aa, Homo Sapiens
LEASFARTV

SEQ ID NO: 115688 - protein, 9 aa, Homo Sapiens
LEAWPALQI

SEQ ID NO: 115689 - protein, 9 aa, Homo Sapiens
LEDAFSRQV

SEQ ID NO: 115690 - protein, 9 aa, Homo Sapiens
LEDEKPVSV

SEQ ID NO: 115691 - protein, 9 aa, Homo Sapiens
LEDELRQEV

SEQ ID NO: 115692 - protein, 9 aa, Homo Sapiens
LEDGHSLVI

SEQ ID NO: 115693 - protein, 9 aa, Homo Sapiens
LEDGNFLKL

SEQ ID NO: 115694 - protein, 9 aa, Homo Sapiens
LEDIPQALV

SEQ ID NO: 115695 - protein, 9 aa, Homo Sapiens
LEDIQTREV

SEQ ID NO: 115696 - protein, 9 aa, Homo Sapiens
LEDIYRPTI

SEQ ID NO: 115697 - protein, 9 aa, Homo Sapiens
LEDKRQVSV

SEQ ID NO: 115698 - protein, 9 aa, Homo Sapiens
LEDLGVSRI

SEQ ID NO: 115699 - protein, 9 aa, Homo Sapiens
LEDLNFPEI

SEQ ID NO: 115700 - protein, 9 aa, Homo Sapiens
LEDNSIPQV

SEQ ID NO: 115701 - protein, 9 aa, Homo Sapiens
LEDPHVDII

SEQ ID NO: 115702 - protein, 9 aa, Homo Sapiens
LEDRGIRKI

SEQ ID NO: 115703 - protein, 9 aa, Homo Sapiens
LEDSNVKLV

SEQ ID NO: 115704 - protein, 9 aa, Homo Sapiens
LEDVKTAVL

SEQ ID NO: 115705 - protein, 9 aa, Homo Sapiens
LEDVNKCVI

SEQ ID NO: 115706 - protein, 9 aa, Homo Sapiens
LEDYSGLSV

SEQ ID NO: 115707 - protein, 9 aa, Homo Sapiens
LEEAGFHTV

SEQ ID NO: 115708 - protein, 9 aa, Homo Sapiens
LEEAVYRNI

SEQ ID NO: 115709 - protein, 9 aa, Homo Sapiens
LEEDKSLKV

SEQ ID NO: 115710 - protein, 9 aa, Homo Sapiens
LEEFITPIV

SEQ ID NO: 115711 - protein, 9 aa, Homo Sapiens
LEEGKEILV

SEQ ID NO: 115712 - protein, 9 aa, Homo Sapiens
LEEGRVREV

SEQ ID NO: 115713 - protein, 9 aa, Homo Sapiens
LEEKGKRVI

SEQ ID NO: 115714 - protein, 9 aa, Homo Sapiens
LEELQKRFI

SEQ ID NO: 115715 - protein, 9 aa, Homo Sapiens
LEEQASRQI

SEQ ID NO: 115716 - protein, 9 aa, Homo Sapiens
LEERFRVAI

SEQ ID NO: 115717 - protein, 9 aa, Homo Sapiens
LEETSIRYV

SEQ ID NO: 115718 - protein, 9 aa, Homo Sapiens
LEEYEQRVV

SEQ ID NO: 115719 - protein, 9 aa, Homo Sapiens
LEFDPAQRI

SEQ ID NO: 115720 - protein, 9 aa, Homo Sapiens
LEFLDRESI

SEQ ID NO: 115721 - protein, 9 aa, Homo Sapiens
LEFLSVKEI

SEQ ID NO: 115722 - protein, 9 aa, Homo Sapiens
LEFPDQPDI

SEQ ID NO: 115723 - protein, 9 aa, Homo Sapiens
LEFPQFETL

SEQ ID NO: 115724 - protein, 9 aa, Homo Sapiens
LEFPQLIRV

SEQ ID NO: 115725 - protein, 9 aa, Homo Sapiens
LEFPSGETI

SEQ ID NO: 115726 - protein, 9 aa, Homo Sapiens
LEGDIVRTI

SEQ ID NO: 115727 - protein, 9 aa, Homo Sapiens
LEGLSVRSV

SEQ ID NO: 115728 - protein, 9 aa, Homo Sapiens
LEGNFAKEV

SEQ ID NO: 115729 - protein, 9 aa, Homo Sapiens
LEGNPFLTV

SEQ ID NO: 115730 - protein, 9 aa, Homo Sapiens
LEGNPLRTI

SEQ ID NO: 115731 - protein, 9 aa, Homo Sapiens
LEGPPSRNV

SEQ ID NO: 115732 - protein, 9 aa, Homo Sapiens
LEGSEVRTI

SEQ ID NO: 115733 - protein, 9 aa, Homo Sapiens
LEHEGLVSL

SEQ ID NO: 115734 - protein, 9 aa, Homo Sapiens
LEHGADPTV

SEQ ID NO: 115735 - protein, 9 aa, Homo Sapiens
LEHGITLVI

SEQ ID NO: 115736 - protein, 9 aa, Homo Sapiens
LEHIHSNEV

SEQ ID NO: 115737 - protein, 9 aa, Homo Sapiens
LEHKIIIRV

SEQ ID NO: 115738 - protein, 9 aa, Homo Sapiens
LEHLSEETV

SEQ ID NO: 115739 - protein, 9 aa, Homo Sapiens
LEHNYFVSI

SEQ ID NO: 115740 - protein, 9 aa, Homo Sapiens
LEHPFVSSI

SEQ ID NO: 115741 - protein, 9 aa, Homo Sapiens
LEHQLQNII

SEQ ID NO: 115742 - protein, 9 aa, Homo Sapiens
LEHQVFTVL

SEQ ID NO: 115743 - protein, 9 aa, Homo Sapiens
LEHSGIGRI

SEQ ID NO: 115744 - protein, 9 aa, Homo Sapiens
LEHSLPHSV

SEQ ID NO: 115745 - protein, 9 aa, Homo Sapiens
LEHSPFSYL

SEQ ID NO: 115746 - protein, 9 aa, Homo Sapiens
LEHTGFSKA

SEQ ID NO: 115747 - protein, 9 aa, Homo Sapiens
LEHTTLRKV

SEQ ID NO: 115748 - protein, 9 aa, Homo Sapiens
LEIARNPAM

SEQ ID NO: 115749 - protein, 9 aa, Homo Sapiens
LEIEKSLLV

SEQ ID NO: 115750 - protein, 9 aa, Homo Sapiens
LEIEPGKRI

SEQ ID NO: 115751 - protein, 9 aa, Homo Sapiens
LEIGENRLV

SEQ ID NO: 115752 - protein, 9 aa, Homo Sapiens
LEIPAATTI

SEQ ID NO: 115753 - protein, 9 aa, Homo Sapiens
LEIPAVSHV

SEQ ID NO: 115754 - protein, 9 aa, Homo Sapiens
LEIPKGEMV

SEQ ID NO: 115755 - protein, 9 aa, Homo Sapiens
LEISVGKSV

SEQ ID NO: 115756 - protein, 9 aa, Homo Sapiens
LEITARPVL

SEQ ID NO: 115757 - protein, 9 aa, Homo Sapiens
LEITKASHV

SEQ ID NO: 115758 - protein, 9 aa, Homo Sapiens
LEIVEPVTV

SEQ ID NO: 115759 - protein, 9 aa, Homo Sapiens
LEIVKMVMI

SEQ ID NO: 115760 - protein, 9 aa, Homo Sapiens
LEKEQVAHI

SEQ ID NO: 115761 - protein, 9 aa, Homo Sapiens
LEKFFETRV

SEQ ID NO: 115762 - protein, 9 aa, Homo Sapiens
LEKKIGKSI

SEQ ID NO: 115763 - protein, 9 aa, Homo Sapiens
LEKLFLQKI

SEQ ID NO: 115764 - protein, 9 aa, Homo Sapiens
LEKLNDIQL

SEQ ID NO: 115765 - protein, 9 aa, Homo Sapiens
LEKPDFINV

SEQ ID NO: 115766 - protein, 9 aa, Homo Sapiens
LEKPFAVLV

SEQ ID NO: 115767 - protein, 9 aa, Homo Sapiens
LEKSDQTNI

SEQ ID NO: 115768 - protein, 9 aa, Homo Sapiens
LEKSGDLLV

SEQ ID NO: 115769 - protein, 9 aa, Homo Sapiens
LEKSVSQKV

SEQ ID NO: 115770 - protein, 9 aa, Homo Sapiens
LEKVPAELI

SEQ ID NO: 115771 - protein, 9 aa, Homo Sapiens
LELEAPLKI

SEQ ID NO: 115772 - protein, 9 aa, Homo Sapiens
LELEKHIRV

SEQ ID NO: 115773 - protein, 9 aa, Homo Sapiens
LELEQLRSV

SEQ ID NO: 115774 - protein, 9 aa, Homo Sapiens
LELGSGVTV

SEQ ID NO: 115775 - protein, 9 aa, Homo Sapiens
LELKSACQV

SEQ ID NO: 115776 - protein, 9 aa, Homo Sapiens
LELKTATKI

SEQ ID NO: 115777 - protein, 9 aa, Homo Sapiens
LELPGQPSV

SEQ ID NO: 115778 - protein, 9 aa, Homo Sapiens
LEMEHTQQM

SEQ ID NO: 115779 - protein, 9 aa, Homo Sapiens
LEMNPGYEV

SEQ ID NO: 115780 - protein, 9 aa, Homo Sapiens
LENAGCNKI

SEQ ID NO: 115781 - protein, 9 aa, Homo Sapiens
LENDKILQI

SEQ ID NO: 115782 - protein, 9 aa, Homo Sapiens
LENENMMRV

SEQ ID NO: 115783 - protein, 9 aa, Homo Sapiens
LENFPLNTI

SEQ ID NO: 115784 - protein, 9 aa, Homo Sapiens
LENGVPCVI

SEQ ID NO: 115785 - protein, 9 aa, Homo Sapiens
LENIFDWNV

SEQ ID NO: 115786 - protein, 9 aa, Homo Sapiens
LENIRPVLV

SEQ ID NO: 115787 - protein, 9 aa, Homo Sapiens
LENITSKEI

SEQ ID NO: 115788 - protein, 9 aa, Homo Sapiens
LENNRPLLT

SEQ ID NO: 115789 - protein, 9 aa, Homo Sapiens
LENPDFREI

SEQ ID NO: 115790 - protein, 9 aa, Homo Sapiens
LENPSNIRG

SEQ ID NO: 115791 - protein, 9 aa, Homo Sapiens
LENQNKTLI

SEQ ID NO: 115792 - protein, 9 aa, Homo Sapiens
LENSGWQKI

SEQ ID NO: 115793 - protein, 9 aa, Homo Sapiens
LENSKQPSV

SEQ ID NO: 115794 - protein, 9 aa, Homo Sapiens
LENTHLLEV

SEQ ID NO: 115795 - protein, 9 aa, Homo Sapiens
LENVWLHFI

SEQ ID NO: 115796 - protein, 9 aa, Homo Sapiens
LEPGFFTHI

SEQ ID NO: 115797 - protein, 9 aa, Homo Sapiens
LEPGSIRHI

SEQ ID NO: 115798 - protein, 9 aa, Homo Sapiens
LEPSETLVV

SEQ ID NO: 115799 - protein, 9 aa, Homo Sapiens
LEQDFKVTL

SEQ ID NO: 115800 - protein, 9 aa, Homo Sapiens
LEQDFVSRV

SEQ ID NO: 115801 - protein, 9 aa, Homo Sapiens
LEQERQQEI

SEQ ID NO: 115802 - protein, 9 aa, Homo Sapiens
LEQGLFSKV

SEQ ID NO: 115803 - protein, 9 aa, Homo Sapiens
LEQHQVLEV

SEQ ID NO: 115804 - protein, 9 aa, Homo Sapiens
LEQLHAVEI

SEQ ID NO: 115805 - protein, 9 aa, Homo Sapiens
LEQLRPVTV

SEQ ID NO: 115806 - protein, 9 aa, Homo Sapiens
LEQQKPTVI

SEQ ID NO: 115807 - protein, 9 aa, Homo Sapiens
LEQSKCISI

SEQ ID NO: 115808 - protein, 9 aa, Homo Sapiens
LERELYHVI

SEQ ID NO: 115809 - protein, 9 aa, Homo Sapiens
LERESKVVV

SEQ ID NO: 115810 - protein, 9 aa, Homo Sapiens
LERTEGLSV

SEQ ID NO: 115811 - protein, 9 aa, Homo Sapiens
LERYLQRTV

SEQ ID NO: 115812 - protein, 9 aa, Homo Sapiens
LESAHVCLI

SEQ ID NO: 115813 - protein, 9 aa, Homo Sapiens
LESAPVLRT

SEQ ID NO: 115814 - protein, 9 aa, Homo Sapiens
LESDDVLRL

SEQ ID NO: 115815 - protein, 9 aa, Homo Sapiens
LESDPQQVV

SEQ ID NO: 115816 - protein, 9 aa, Homo Sapiens
LESEEFQKI

SEQ ID NO: 115817 - protein, 9 aa, Homo Sapiens
LESHWFVWV

SEQ ID NO: 115818 - protein, 9 aa, Homo Sapiens
LESKLGKTI

SEQ ID NO: 115819 - protein, 9 aa, Homo Sapiens
LESKSVQRV

SEQ ID NO: 115820 - protein, 9 aa, Homo Sapiens
LESLPATHI

SEQ ID NO: 115821 - protein, 9 aa, Homo Sapiens
LESLPEPVI

SEQ ID NO: 115822 - protein, 9 aa, Homo Sapiens
LESLPLSKL

SEQ ID NO: 115823 - protein, 9 aa, Homo Sapiens
LESLPSPTL

SEQ ID NO: 115824 - protein, 9 aa, Homo Sapiens
LESPRPALV

SEQ ID NO: 115825 - protein, 9 aa, Homo Sapiens
LESSAKSKI

SEQ ID NO: 115826 - protein, 9 aa, Homo Sapiens
LESVSLHEV

SEQ ID NO: 115827 - protein, 9 aa, Homo Sapiens
LETIFVRKV

SEQ ID NO: 115828 - protein, 9 aa, Homo Sapiens
LETMFGVKV

SEQ ID NO: 115829 - protein, 9 aa, Homo Sapiens
LETNAPESI

SEQ ID NO: 115830 - protein, 9 aa, Homo Sapiens
LETNVPLLV

SEQ ID NO: 115831 - protein, 9 aa, Homo Sapiens
LETTGGHSV

SEQ ID NO: 115832 - protein, 9 aa, Homo Sapiens
LETTKKLKI

SEQ ID NO: 115833 - protein, 9 aa, Homo Sapiens
LEVDHIRTI

SEQ ID NO: 115834 - protein, 9 aa, Homo Sapiens
LEVDTKKQI

SEQ ID NO: 115835 - protein, 9 aa, Homo Sapiens
LEVECATQL

SEQ ID NO: 115836 - protein, 9 aa, Homo Sapiens
LEVEKSLVL

SEQ ID NO: 115837 - protein, 9 aa, Homo Sapiens
LEVERVEMI

SEQ ID NO: 115838 - protein, 9 aa, Homo Sapiens
LEVGDIVKV

SEQ ID NO: 115839 - protein, 9 aa, Homo Sapiens
LEVIDIFKI

SEQ ID NO: 115840 - protein, 9 aa, Homo Sapiens
LEVILRPKI

SEQ ID NO: 115841 - protein, 9 aa, Homo Sapiens
LEVIPRTLI

SEQ ID NO: 115842 - protein, 9 aa, Homo Sapiens
LEVPATEEI

SEQ ID NO: 115843 - protein, 9 aa, Homo Sapiens
LEVPGLRSV

SEQ ID NO: 115844 - protein, 9 aa, Homo Sapiens
LEVPRSISV

SEQ ID NO: 115845 - protein, 9 aa, Homo Sapiens
LEVPSRVTV

SEQ ID NO: 115846 - protein, 9 aa, Homo Sapiens
LEVQSNPKI

SEQ ID NO: 115847 - protein, 9 aa, Homo Sapiens
LEVRKLMHV

SEQ ID NO: 115848 - protein, 9 aa, Homo Sapiens
LEVTNTIRV

SEQ ID NO: 115849 - protein, 9 aa, Homo Sapiens
LEVVDKSQV

SEQ ID NO: 115850 - protein, 9 aa, Homo Sapiens
LEWGADPHI

SEQ ID NO: 115851 - protein, 9 aa, Homo Sapiens
LEYDQDLSV

SEQ ID NO: 115852 - protein, 9 aa, Homo Sapiens
LEYEDHKTA

SEQ ID NO: 115853 - protein, 9 aa, Homo Sapiens
LEYERQLVL

SEQ ID NO: 115854 - protein, 9 aa, Homo Sapiens
LEYGLPIQV

SEQ ID NO: 115855 - protein, 9 aa, Homo Sapiens
LEYGVPVTL

SEQ ID NO: 115856 - protein, 9 aa, Homo Sapiens
LEYIHALTL

SEQ ID NO: 115857 - protein, 9 aa, Homo Sapiens
LEYNIFEGM

SEQ ID NO: 115858 - protein, 9 aa, Homo Sapiens
LEYPTISLH

SEQ ID NO: 115859 - protein, 9 aa, Homo Sapiens
LPNDHSRVI

SEQ ID NO: 115860 - protein, 9 aa, Homo Sapiens
LQIDNARLA

SEQ ID NO: 115861 - protein, 9 aa, Homo Sapiens
LSLDWKTEI

SEQ ID NO: 115862 - protein, 9 aa, Homo Sapiens
LSRGEANVL

SEQ ID NO: 115863 - protein, 9 aa, Homo Sapiens
LTQALKDNK

SEQ ID NO: 115864 - protein, 9 aa, Homo Sapiens
LTVGNNKTL

SEQ ID NO: 115865 - protein, 9 aa, Homo Sapiens
MEAPAAGLF

SEQ ID NO: 115866 - protein, 9 aa, Homo Sapiens
MEAPKIDRI

SEQ ID NO: 115867 - protein, 9 aa, Homo Sapiens
MEDGGVKLL

SEQ ID NO: 115868 - protein, 9 aa, Homo Sapiens
MEDGPIVKL

SEQ ID NO: 115869 - protein, 9 aa, Homo Sapiens
MEDKNGRFV

SEQ ID NO: 115870 - protein, 9 aa, Homo Sapiens
MEDTGHYSI

SEQ ID NO: 115871 - protein, 9 aa, Homo Sapiens
MEEIGRISI

SEQ ID NO: 115872 - protein, 9 aa, Homo Sapiens
MEEIRNLTV

SEQ ID NO: 115873 - protein, 9 aa, Homo Sapiens
MEELLQNEV

SEQ ID NO: 115874 - protein, 9 aa, Homo Sapiens
MEESGICKV

SEQ ID NO: 115875 - protein, 9 aa, Homo Sapiens
MEFAQISRV

SEQ ID NO: 115876 - protein, 9 aa, Homo Sapiens
MEFERQAEI

SEQ ID NO: 115877 - protein, 9 aa, Homo Sapiens
MEFKAVQQV

SEQ ID NO: 115878 - protein, 9 aa, Homo Sapiens
MEFPKIESV

SEQ ID NO: 115879 - protein, 9 aa, Homo Sapiens
MEGKLTHKI

SEQ ID NO: 115880 - protein, 9 aa, Homo Sapiens
MEHGTVTVV

SEQ ID NO: 115881 - protein, 9 aa, Homo Sapiens
MEHLKSLKI

SEQ ID NO: 115882 - protein, 9 aa, Homo Sapiens
MEHPGLQAI

SEQ ID NO: 115883 - protein, 9 aa, Homo Sapiens
MEHPQRQNV

SEQ ID NO: 115884 - protein, 9 aa, Homo Sapiens
MEHPYFYTV

SEQ ID NO: 115885 - protein, 9 aa, Homo Sapiens
MEIERILGV

SEQ ID NO: 115886 - protein, 9 aa, Homo Sapiens
MEKPSPLLV

SEQ ID NO: 115887 - protein, 9 aa, Homo Sapiens
MELEKPVLI

SEQ ID NO: 115888 - protein, 9 aa, Homo Sapiens
MEMFQPSAV

SEQ ID NO: 115889 - protein, 9 aa, Homo Sapiens
MENDLPQKI

SEQ ID NO: 115890 - protein, 9 aa, Homo Sapiens
MENESVKSV

SEQ ID NO: 115891 - protein, 9 aa, Homo Sapiens
MENGSITSI

SEQ ID NO: 115892 - protein, 9 aa, Homo Sapiens
MEPYYFVEV

SEQ ID NO: 115893 - protein, 9 aa, Homo Sapiens
MEQKTIILI

SEQ ID NO: 115894 - protein, 9 aa, Homo Sapiens
MEQTLPVTV

SEQ ID NO: 115895 - protein, 9 aa, Homo Sapiens
MEQVAHQTI

SEQ ID NO: 115896 - protein, 9 aa, Homo Sapiens
MEQVFEMKV

SEQ ID NO: 115897 - protein, 9 aa, Homo Sapiens
MESDKFICI

SEQ ID NO: 115898 - protein, 9 aa, Homo Sapiens
METAPHTMI

SEQ ID NO: 115899 - protein, 9 aa, Homo Sapiens
METSAKANI

SEQ ID NO: 115900 - protein, 9 aa, Homo Sapiens
MEVLPGRCV

SEQ ID NO: 115901 - protein, 9 aa, Homo Sapiens
MEVPVLPKI

SEQ ID NO: 115902 - protein, 9 aa, Homo Sapiens
MEWTSSSKI

SEQ ID NO: 115903 - protein, 9 aa, Homo Sapiens
MEYDQPLYV

SEQ ID NO: 115904 - protein, 9 aa, Homo Sapiens
MEYFSLEKI

SEQ ID NO: 115905 - protein, 9 aa, Homo Sapiens
MEYPNFEET

SEQ ID NO: 115906 - protein, 9 aa, Homo Sapiens
NEAQLLRKI

SEQ ID NO: 115907 - protein, 9 aa, Homo Sapiens
NEASATKCI

SEQ ID NO: 115908 - protein, 9 aa, Homo Sapiens
NECVVVIRV

SEQ ID NO: 115909 - protein, 9 aa, Homo Sapiens
NEDPATPRV

SEQ ID NO: 115910 - protein, 9 aa, Homo Sapiens
NEGLGQPQV

SEQ ID NO: 115911 - protein, 9 aa, Homo Sapiens
NEIDLFHCI

SEQ ID NO: 115912 - protein, 9 aa, Homo Sapiens
NEISEITSI

SEQ ID NO: 115913 - protein, 9 aa, Homo Sapiens
NEITRLTTV

SEQ ID NO: 115914 - protein, 9 aa, Homo Sapiens
NEIVKLHEI

SEQ ID NO: 115915 - protein, 9 aa, Homo Sapiens
NEKKNFHLV

SEQ ID NO: 115916 - protein, 9 aa, Homo Sapiens
NELDHIMEI

SEQ ID NO: 115917 - protein, 9 aa, Homo Sapiens
NELEKICEI

SEQ ID NO: 115918 - protein, 9 aa, Homo Sapiens
NELERNITI

SEQ ID NO: 115919 - protein, 9 aa, Homo Sapiens
NELPDFPHI

SEQ ID NO: 115920 - protein, 9 aa, Homo Sapiens
NEQPSSPRV

SEQ ID NO: 115921 - protein, 9 aa, Homo Sapiens
NEVDRMVLV

SEQ ID NO: 115922 - protein, 9 aa, Homo Sapiens
NEVPEHPCV

SEQ ID NO: 115923 - protein, 9 aa, Homo Sapiens
NEWIAVNTV

SEQ ID NO: 115924 - protein, 9 aa, Homo Sapiens
NEWVAVNTV

SEQ ID NO: 115925 - protein, 9 aa, Homo Sapiens
NEYHLFFLL

SEQ ID NO: 115926 - protein, 9 aa, Homo Sapiens
NEYLIFQKI

SEQ ID NO: 115927 - protein, 9 aa, Homo Sapiens
NEYVFRETV

SEQ ID NO: 115928 - protein, 9 aa, Homo Sapiens
PEAAEGPEV

SEQ ID NO: 115929 - protein, 9 aa, Homo Sapiens
PEARFLNVI

SEQ ID NO: 115930 - protein, 9 aa, Homo Sapiens
QEACEAYLV

SEQ ID NO: 115931 - protein, 9 aa, Homo Sapiens
QEADKCPTL

SEQ ID NO: 115932 - protein, 9 aa, Homo Sapiens
QEAEPGSRV

SEQ ID NO: 115933 - protein, 9 aa, Homo Sapiens
QEAEPLKQV

SEQ ID NO: 115934 - protein, 9 aa, Homo Sapiens
QEAEPQKQV

SEQ ID NO: 115935 - protein, 9 aa, Homo Sapiens
QEAERARFV

SEQ ID NO: 115936 - protein, 9 aa, Homo Sapiens
QEAFFQCQV

SEQ ID NO: 115937 - protein, 9 aa, Homo Sapiens
QEAKELKKV

SEQ ID NO: 115938 - protein, 9 aa, Homo Sapiens
QEALGVAVI

SEQ ID NO: 115939 - protein, 9 aa, Homo Sapiens
QEAPAVRKL

SEQ ID NO: 115940 - protein, 9 aa, Homo Sapiens
QEAPSVARI

SEQ ID NO: 115941 - protein, 9 aa, Homo Sapiens
QEASEAYLV

SEQ ID NO: 115942 - protein, 9 aa, Homo Sapiens
QEATAGFTI

SEQ ID NO: 115943 - protein, 9 aa, Homo Sapiens
QEATHFPKV

SEQ ID NO: 115944 - protein, 9 aa, Homo Sapiens
QEAVGNIKV

SEQ ID NO: 115945 - protein, 9 aa, Homo Sapiens
QEDLLREMI

SEQ ID NO: 115946 - protein, 9 aa, Homo Sapiens
QEEELTRKV

SEQ ID NO: 115947 - protein, 9 aa, Homo Sapiens
QEEKRQRVI

SEQ ID NO: 115948 - protein, 9 aa, Homo Sapiens
QEERPIRQI

SEQ ID NO: 115949 - protein, 9 aa, Homo Sapiens
QEFDIYREV

SEQ ID NO: 115950 - protein, 9 aa, Homo Sapiens
QEFGILDKV

SEQ ID NO: 115951 - protein, 9 aa, Homo Sapiens
QEFGPISYV

SEQ ID NO: 115952 - protein, 9 aa, Homo Sapiens
QEFPDLENV

SEQ ID NO: 115953 - protein, 9 aa, Homo Sapiens
QEFQNFKTL

SEQ ID NO: 115954 - protein, 9 aa, Homo Sapiens
QEFSFFDKV

SEQ ID NO: 115955 - protein, 9 aa, Homo Sapiens
QEFTELLKV

SEQ ID NO: 115956 - protein, 9 aa, Homo Sapiens
QEGDQILKV

SEQ ID NO: 115957 - protein, 9 aa, Homo Sapiens
QEGHSVPEI

SEQ ID NO: 115958 - protein, 9 aa, Homo Sapiens
QEGYKFCKI

SEQ ID NO: 115959 - protein, 9 aa, Homo Sapiens
QEHGDYSNI

SEQ ID NO: 115960 - protein, 9 aa, Homo Sapiens
QEHITTVVV

SEQ ID NO: 115961 - protein, 9 aa, Homo Sapiens
QEHLDYEII

SEQ ID NO: 115962 - protein, 9 aa, Homo Sapiens
QEHPSIRTL

SEQ ID NO: 115963 - protein, 9 aa, Homo Sapiens
QEIANQKGV

SEQ ID NO: 115964 - protein, 9 aa, Homo Sapiens
QEIEELTKI

SEQ ID NO: 115965 - protein, 9 aa, Homo Sapiens
QEIEKPVAV

SEQ ID NO: 115966 - protein, 9 aa, Homo Sapiens
QEIERLNKL

SEQ ID NO: 115967 - protein, 9 aa, Homo Sapiens
QEIEVRPGI

SEQ ID NO: 115968 - protein, 9 aa, Homo Sapiens
QEIFPAARI

SEQ ID NO: 115969 - protein, 9 aa, Homo Sapiens
QEIISKGLI

SEQ ID NO: 115970 - protein, 9 aa, Homo Sapiens
QEIKSAHKI

SEQ ID NO: 115971 - protein, 9 aa, Homo Sapiens
QEILPALCV

SEQ ID NO: 115972 - protein, 9 aa, Homo Sapiens
QEIPEPLQL

SEQ ID NO: 115973 - protein, 9 aa, Homo Sapiens
QEIPKSRGV

SEQ ID NO: 115974 - protein, 9 aa, Homo Sapiens
QEISQVCQL

SEQ ID NO: 115975 - protein, 9 aa, Homo Sapiens
QEIVTERSV

SEQ ID NO: 115976 - protein, 9 aa, Homo Sapiens
QEKLGLTRI

SEQ ID NO: 115977 - protein, 9 aa, Homo Sapiens
QEKPMHLEI

SEQ ID NO: 115978 - protein, 9 aa, Homo Sapiens
QELEQVLGI

SEQ ID NO: 115979 - protein, 9 aa, Homo Sapiens
QELNELSAI

SEQ ID NO: 115980 - protein, 9 aa, Homo Sapiens
QELPGLPLV

SEQ ID NO: 115981 - protein, 9 aa, Homo Sapiens
QELQEINRV

SEQ ID NO: 115982 - protein, 9 aa, Homo Sapiens
QELQKLRAV

SEQ ID NO: 115983 - protein, 9 aa, Homo Sapiens
QELYFFHEL

SEQ ID NO: 115984 - protein, 9 aa, Homo Sapiens
QEMINFHTI

SEQ ID NO: 115985 - protein, 9 aa, Homo Sapiens
QEMPSLEVI

SEQ ID NO: 115986 - protein, 9 aa, Homo Sapiens
QEMPWNVRM

SEQ ID NO: 115987 - protein, 9 aa, Homo Sapiens
QEMQLIHEI

SEQ ID NO: 115988 - protein, 9 aa, Homo Sapiens
QEMQQGATV

SEQ ID NO: 115989 - protein, 9 aa, Homo Sapiens
QENDFSKRI

SEQ ID NO: 115990 - protein, 9 aa, Homo Sapiens
QENGSLVEI

SEQ ID NO: 115991 - protein, 9 aa, Homo Sapiens
QENKGLREI

SEQ ID NO: 115992 - protein, 9 aa, Homo Sapiens
QENNMMVLV

SEQ ID NO: 115993 - protein, 9 aa, Homo Sapiens
QENTQTPTV

SEQ ID NO: 115994 - protein, 9 aa, Homo Sapiens
QENVSNLVI

SEQ ID NO: 115995 - protein, 9 aa, Homo Sapiens
QEQAVSPKV

SEQ ID NO: 115996 - protein, 9 aa, Homo Sapiens
QEQIGWRNV

SEQ ID NO: 115997 - protein, 9 aa, Homo Sapiens
QEQPAATKI

SEQ ID NO: 115998 - protein, 9 aa, Homo Sapiens
QEQVIAVHI

SEQ ID NO: 115999 - protein, 9 aa, Homo Sapiens
QERHLLVKV

SEQ ID NO: 116000 - protein, 9 aa, Homo Sapiens
QERPGAAAI

SEQ ID NO: 116001 - protein, 9 aa, Homo Sapiens
QESEPFSHI

SEQ ID NO: 116002 - protein, 9 aa, Homo Sapiens
QESNVQLKL

SEQ ID NO: 116003 - protein, 9 aa, Homo Sapiens
QESNVRLKL

SEQ ID NO: 116004 - protein, 9 aa, Homo Sapiens
QESPLFNNV

SEQ ID NO: 116005 - protein, 9 aa, Homo Sapiens
QESRCQPKV

SEQ ID NO: 116006 - protein, 9 aa, Homo Sapiens
QETDSSLVV

SEQ ID NO: 116007 - protein, 9 aa, Homo Sapiens
QETDVRAQI

SEQ ID NO: 116008 - protein, 9 aa, Homo Sapiens
QETELSQRI

SEQ ID NO: 116009 - protein, 9 aa, Homo Sapiens
QETSVIHKI

SEQ ID NO: 116010 - protein, 9 aa, Homo Sapiens
QEVDLQQLI

SEQ ID NO: 116011 - protein, 9 aa, Homo Sapiens
QEVEDRPEV

SEQ ID NO: 116012 - protein, 9 aa, Homo Sapiens
QEVENFKKV

SEQ ID NO: 116013 - protein, 9 aa, Homo Sapiens
QEVGKVIGI

SEQ ID NO: 116014 - protein, 9 aa, Homo Sapiens
QEVIITKFI

SEQ ID NO: 116015 - protein, 9 aa, Homo Sapiens
QEVLEMRKI

SEQ ID NO: 116016 - protein, 9 aa, Homo Sapiens
QEVLKTALI

SEQ ID NO: 116017 - protein, 9 aa, Homo Sapiens
QEVNFQEYV

SEQ ID NO: 116018 - protein, 9 aa, Homo Sapiens
QEVPEKVTV

SEQ ID NO: 116019 - protein, 9 aa, Homo Sapiens
QEVQLMTKI

SEQ ID NO: 116020 - protein, 9 aa, Homo Sapiens
QEVRCPVTV

SEQ ID NO: 116021 - protein, 9 aa, Homo Sapiens
QEVSQLNKI

SEQ ID NO: 116022 - protein, 9 aa, Homo Sapiens
QEVTHSVRI

SEQ ID NO: 116023 - protein, 9 aa, Homo Sapiens
QEWDGLVRI

SEQ ID NO: 116024 - protein, 9 aa, Homo Sapiens
QEWKIPPCI

SEQ ID NO: 116025 - protein, 9 aa, Homo Sapiens
QEYAQVIKM

SEQ ID NO: 116026 - protein, 9 aa, Homo Sapiens
QEYEEFKEL

SEQ ID NO: 116027 - protein, 9 aa, Homo Sapiens
QEYEEVKLV

SEQ ID NO: 116028 - protein, 9 aa, Homo Sapiens
QEYLSGRSI

SEQ ID NO: 116029 - protein, 9 aa, Homo Sapiens
QEYNQFCVI

SEQ ID NO: 116030 - protein, 9 aa, Homo Sapiens
QEYPDLIHI

SEQ ID NO: 116031 - protein, 9 aa, Homo Sapiens
QEYQEKLQV

SEQ ID NO: 116032 - protein, 9 aa, Homo Sapiens
QEYSCVVKM

SEQ ID NO: 116033 - protein, 9 aa, Homo Sapiens
QIKEDFTQL

SEQ ID NO: 116034 - protein, 9 aa, Homo Sapiens
QSEIRSISV

SEQ ID NO: 116035 - protein, 9 aa, Homo Sapiens
READFFWSL

SEQ ID NO: 116036 - protein, 9 aa, Homo Sapiens
READFKETL

SEQ ID NO: 116037 - protein, 9 aa, Homo Sapiens
READLIFLL

SEQ ID NO: 116038 - protein, 9 aa, Homo Sapiens
READPMTKV

SEQ ID NO: 116039 - protein, 9 aa, Homo Sapiens
READRLLSL

SEQ ID NO: 116040 - protein, 9 aa, Homo Sapiens
REAEFTKSI

SEQ ID NO: 116041 - protein, 9 aa, Homo Sapiens
REAEHGPEV

SEQ ID NO: 116042 - protein, 9 aa, Homo Sapiens
REAEIYQTV

SEQ ID NO: 116043 - protein, 9 aa, Homo Sapiens
REAELKQRV

SEQ ID NO: 116044 - protein, 9 aa, Homo Sapiens
REAELQAVL

SEQ ID NO: 116045 - protein, 9 aa, Homo Sapiens
REAELQMLL

SEQ ID NO: 116046 - protein, 9 aa, Homo Sapiens
REAEMRNSI

SEQ ID NO: 116047 - protein, 9 aa, Homo Sapiens
REAEPIPKM

SEQ ID NO: 116048 - protein, 9 aa, Homo Sapiens
REAESFTQL

SEQ ID NO: 116049 - protein, 9 aa, Homo Sapiens
REAFPAHKV

SEQ ID NO: 116050 - protein, 9 aa, Homo Sapiens
REAGITEKV

SEQ ID NO: 116051 - protein, 9 aa, Homo Sapiens
REAKFYRVV

SEQ ID NO: 116052 - protein, 9 aa, Homo Sapiens
REALTHRKI

SEQ ID NO: 116053 - protein, 9 aa, Homo Sapiens
REAPERPSL

SEQ ID NO: 116054 - protein, 9 aa, Homo Sapiens
REAPSPLMI

SEQ ID NO: 116055 - protein, 9 aa, Homo Sapiens
REAQKFALA

SEQ ID NO: 116056 - protein, 9 aa, Homo Sapiens
REASIYTGI

SEQ ID NO: 116057 - protein, 9 aa, Homo Sapiens
REATQILSV

SEQ ID NO: 116058 - protein, 9 aa, Homo Sapiens
REAVHIEKI

SEQ ID NO: 116059 - protein, 9 aa, Homo Sapiens
RECENQLVL

SEQ ID NO: 116060 - protein, 9 aa, Homo Sapiens
RECEVLKKI

SEQ ID NO: 116061 - protein, 9 aa, Homo Sapiens
RECFYIPKI

SEQ ID NO: 116062 - protein, 9 aa, Homo Sapiens
RECTIEATA

SEQ ID NO: 116063 - protein, 9 aa, Homo Sapiens
RECVAGPNI

SEQ ID NO: 116064 - protein, 9 aa, Homo Sapiens
REDAGAEKI

SEQ ID NO: 116065 - protein, 9 aa, Homo Sapiens
REDAVSKEV

SEQ ID NO: 116066 - protein, 9 aa, Homo Sapiens
REDDPVRML

SEQ ID NO: 116067 - protein, 9 aa, Homo Sapiens
REDEKPLVL

SEQ ID NO: 116068 - protein, 9 aa, Homo Sapiens
REDFKTAVV

SEQ ID NO: 116069 - protein, 9 aa, Homo Sapiens
REDGEKTFV

SEQ ID NO: 116070 - protein, 9 aa, Homo Sapiens
REDGSIVIV

SEQ ID NO: 116071 - protein, 9 aa, Homo Sapiens
REDGVTPYM

SEQ ID NO: 116072 - protein, 9 aa, Homo Sapiens
REDITEPAI

SEQ ID NO: 116073 - protein, 9 aa, Homo Sapiens
REDQINRLI

SEQ ID NO: 116074 - protein, 9 aa, Homo Sapiens
REDSITVHI

SEQ ID NO: 116075 - protein, 9 aa, Homo Sapiens
REDVWLPLM

SEQ ID NO: 116076 - protein, 9 aa, Homo Sapiens
REEEAMKQI

SEQ ID NO: 116077 - protein, 9 aa, Homo Sapiens
REEEGTLII

SEQ ID NO: 116078 - protein, 9 aa, Homo Sapiens
REEEKVSAV

SEQ ID NO: 116079 - protein, 9 aa, Homo Sapiens
REEFDLDVV

SEQ ID NO: 116080 - protein, 9 aa, Homo Sapiens
REEIGNRYI

SEQ ID NO: 116081 - protein, 9 aa, Homo Sapiens
REEINFVEI

SEQ ID NO: 116082 - protein, 9 aa, Homo Sapiens
REELQTCLI

SEQ ID NO: 116083 - protein, 9 aa, Homo Sapiens
REEVGNISI

SEQ ID NO: 116084 - protein, 9 aa, Homo Sapiens
REFAIQSQI

SEQ ID NO: 116085 - protein, 9 aa, Homo Sapiens
REFDFFNKI

SEQ ID NO: 116086 - protein, 9 aa, Homo Sapiens
REFDRCRKL

SEQ ID NO: 116087 - protein, 9 aa, Homo Sapiens
REFDVGRHI

SEQ ID NO: 116088 - protein, 9 aa, Homo Sapiens
REFEPMLQV

SEQ ID NO: 116089 - protein, 9 aa, Homo Sapiens
REFERFQEM

SEQ ID NO: 116090 - protein, 9 aa, Homo Sapiens
REFEVIAQI

SEQ ID NO: 116091 - protein, 9 aa, Homo Sapiens
REFFKLQKI

SEQ ID NO: 116092 - protein, 9 aa, Homo Sapiens
REFGKALQL

SEQ ID NO: 116093 - protein, 9 aa, Homo Sapiens
REFGNLTRM

SEQ ID NO: 116094 - protein, 9 aa, Homo Sapiens
REFLFNAIE

SEQ ID NO: 116095 - protein, 9 aa, Homo Sapiens
REFPKFFTF

SEQ ID NO: 116096 - protein, 9 aa, Homo Sapiens
REFPTHRSV

SEQ ID NO: 116097 - protein, 9 aa, Homo Sapiens
REFPTVPLV

SEQ ID NO: 116098 - protein, 9 aa, Homo Sapiens
REFPVISVV

SEQ ID NO: 116099 - protein, 9 aa, Homo Sapiens
REFQNPPQL

SEQ ID NO: 116100 - protein, 9 aa, Homo Sapiens
REFSDFIRV

SEQ ID NO: 116101 - protein, 9 aa, Homo Sapiens
REFVEREVI

SEQ ID NO: 116102 - protein, 9 aa, Homo Sapiens
REFVMQVKV

SEQ ID NO: 116103 - protein, 9 aa, Homo Sapiens
REGDLLFTV

SEQ ID NO: 116104 - protein, 9 aa, Homo Sapiens
REGDVITII

SEQ ID NO: 116105 - protein, 9 aa, Homo Sapiens
REGEWQTMI

SEQ ID NO: 116106 - protein, 9 aa, Homo Sapiens
REGLVVVKV

SEQ ID NO: 116107 - protein, 9 aa, Homo Sapiens
REGPYSISV

SEQ ID NO: 116108 - protein, 9 aa, Homo Sapiens
REGSFKETI

SEQ ID NO: 116109 - protein, 9 aa, Homo Sapiens
REGYCFTEV

SEQ ID NO: 116110 - protein, 9 aa, Homo Sapiens
REHDWNNSI

SEQ ID NO: 116111 - protein, 9 aa, Homo Sapiens
REHESLCHI

SEQ ID NO: 116112 - protein, 9 aa, Homo Sapiens
REHFVFTDI

SEQ ID NO: 116113 - protein, 9 aa, Homo Sapiens
REHGAFDAV

SEQ ID NO: 116114 - protein, 9 aa, Homo Sapiens
REHHEPVMI

SEQ ID NO: 116115 - protein, 9 aa, Homo Sapiens
REHPALRSL

SEQ ID NO: 116116 - protein, 9 aa, Homo Sapiens
REHQFYETL

SEQ ID NO: 116117 - protein, 9 aa, Homo Sapiens
REHTALLKI

SEQ ID NO: 116118 - protein, 9 aa, Homo Sapiens
REHVEAIKI

SEQ ID NO: 116119 - protein, 9 aa, Homo Sapiens
REIAEAKQI

SEQ ID NO: 116120 - protein, 9 aa, Homo Sapiens
REIALLREL

SEQ ID NO: 116121 - protein, 9 aa, Homo Sapiens
REIEATNAV

SEQ ID NO: 116122 - protein, 9 aa, Homo Sapiens
REIEELHKL

SEQ ID NO: 116123 - protein, 9 aa, Homo Sapiens
REIEGDLLL

SEQ ID NO: 116124 - protein, 9 aa, Homo Sapiens
REIEIQAHL

SEQ ID NO: 116125 - protein, 9 aa, Homo Sapiens
REINGMTGL

SEQ ID NO: 116126 - protein, 9 aa, Homo Sapiens
REINYILRV

SEQ ID NO: 116127 - protein, 9 aa, Homo Sapiens
REIPIVHRV

SEQ ID NO: 116128 - protein, 9 aa, Homo Sapiens
REIQEAIAV

SEQ ID NO: 116129 - protein, 9 aa, Homo Sapiens
REIQELGQL

SEQ ID NO: 116130 - protein, 9 aa, Homo Sapiens
REIQKVTKL

SEQ ID NO: 116131 - protein, 9 aa, Homo Sapiens
REIQTAVRL

SEQ ID NO: 116132 - protein, 9 aa, Homo Sapiens
REIVSAAKV

SEQ ID NO: 116133 - protein, 9 aa, Homo Sapiens
REKDLFRSV

SEQ ID NO: 116134 - protein, 9 aa, Homo Sapiens
REKDWVSKI

SEQ ID NO: 116135 - protein, 9 aa, Homo Sapiens
REKEFTVKI

SEQ ID NO: 116136 - protein, 9 aa, Homo Sapiens
REKEFVARV

SEQ ID NO: 116137 - protein, 9 aa, Homo Sapiens
REKITAQSI

SEQ ID NO: 116138 - protein, 9 aa, Homo Sapiens
REKLPSSEV

SEQ ID NO: 116139 - protein, 9 aa, Homo Sapiens
REKPPSSGV

SEQ ID NO: 116140 - protein, 9 aa, Homo Sapiens
REKSTLERI

SEQ ID NO: 116141 - protein, 9 aa, Homo Sapiens
REKYLYQKI

SEQ ID NO: 116142 - protein, 9 aa, Homo Sapiens
RELAHCQKV

SEQ ID NO: 116143 - protein, 9 aa, Homo Sapiens
RELAQPASV

SEQ ID NO: 116144 - protein, 9 aa, Homo Sapiens
RELDRFSVL

SEQ ID NO: 116145 - protein, 9 aa, Homo Sapiens
RELECIREI

SEQ ID NO: 116146 - protein, 9 aa, Homo Sapiens
RELEKLFQL

SEQ ID NO: 116147 - protein, 9 aa, Homo Sapiens
RELENLIGI

SEQ ID NO: 116148 - protein, 9 aa, Homo Sapiens
RELESVCVV

SEQ ID NO: 116149 - protein, 9 aa, Homo Sapiens
RELGEFRTT

SEQ ID NO: 116150 - protein, 9 aa, Homo Sapiens
RELKGAKLV

SEQ ID NO: 116151 - protein, 9 aa, Homo Sapiens
RELKKTQLI

SEQ ID NO: 116152 - protein, 9 aa, Homo Sapiens
RELPTSSAI

SEQ ID NO: 116153 - protein, 9 aa, Homo Sapiens
RELVAIKKV

SEQ ID NO: 116154 - protein, 9 aa, Homo Sapiens
RELYLSAKV

SEQ ID NO: 116155 - protein, 9 aa, Homo Sapiens
REMDEQIRL

SEQ ID NO: 116156 - protein, 9 aa, Homo Sapiens
REMDRETLI

SEQ ID NO: 116157 - protein, 9 aa, Homo Sapiens
REMENYEKI

SEQ ID NO: 116158 - protein, 9 aa, Homo Sapiens
REMGSATSV

SEQ ID NO: 116159 - protein, 9 aa, Homo Sapiens
REMIPFAVV

SEQ ID NO: 116160 - protein, 9 aa, Homo Sapiens
REMLIRVNM

SEQ ID NO: 116161 - protein, 9 aa, Homo Sapiens
REMLQQSKI

SEQ ID NO: 116162 - protein, 9 aa, Homo Sapiens
REMQESVQV

SEQ ID NO: 116163 - protein, 9 aa, Homo Sapiens
RENDCIVRI

SEQ ID NO: 116164 - protein, 9 aa, Homo Sapiens
RENENHLLV

SEQ ID NO: 116165 - protein, 9 aa, Homo Sapiens
RENFCNIHV

SEQ ID NO: 116166 - protein, 9 aa, Homo Sapiens
RENFFPVTV

SEQ ID NO: 116167 - protein, 9 aa, Homo Sapiens
RENGFNIYV

SEQ ID NO: 116168 - protein, 9 aa, Homo Sapiens
RENGKPVTV

SEQ ID NO: 116169 - protein, 9 aa, Homo Sapiens
RENKTAVVV

SEQ ID NO: 116170 - protein, 9 aa, Homo Sapiens
RENPQLKQI

SEQ ID NO: 116171 - protein, 9 aa, Homo Sapiens
RENTFVVKV

SEQ ID NO: 116172 - protein, 9 aa, Homo Sapiens
RENVAVAKL

SEQ ID NO: 116173 - protein, 9 aa, Homo Sapiens
RENVIMSQI

SEQ ID NO: 116174 - protein, 9 aa, Homo Sapiens
RENVNLAQI

SEQ ID NO: 116175 - protein, 9 aa, Homo Sapiens
REPLSLINV

SEQ ID NO: 116176 - protein, 9 aa, Homo Sapiens
REPQGFHKV

SEQ ID NO: 116177 - protein, 9 aa, Homo Sapiens
REPRPFPKL

SEQ ID NO: 116178 - protein, 9 aa, Homo Sapiens
REQDQTLLL

SEQ ID NO: 116179 - protein, 9 aa, Homo Sapiens
REQELFNRI

SEQ ID NO: 116180 - protein, 9 aa, Homo Sapiens
REQEQKVYV

SEQ ID NO: 116181 - protein, 9 aa, Homo Sapiens
REQHFHSQV

SEQ ID NO: 116182 - protein, 9 aa, Homo Sapiens
REQLKKLLV

SEQ ID NO: 116183 - protein, 9 aa, Homo Sapiens
REQSHKVYV

SEQ ID NO: 116184 - protein, 9 aa, Homo Sapiens
REQVVNETV

SEQ ID NO: 116185 - protein, 9 aa, Homo Sapiens
RERADAPSV

SEQ ID NO: 116186 - protein, 9 aa, Homo Sapiens
RERDFLKKV

SEQ ID NO: 116187 - protein, 9 aa, Homo Sapiens
RERGITIDI

SEQ ID NO: 116188 - protein, 9 aa, Homo Sapiens
RERIIPRSV

SEQ ID NO: 116189 - protein, 9 aa, Homo Sapiens
RERWNFDFV

SEQ ID NO: 116190 - protein, 9 aa, Homo Sapiens
RESDLENYI

SEQ ID NO: 116191 - protein, 9 aa, Homo Sapiens
RESERQLRL

SEQ ID NO: 116192 - protein, 9 aa, Homo Sapiens
RESHTHVSV

SEQ ID NO: 116193 - protein, 9 aa, Homo Sapiens
RESIKLVSI

SEQ ID NO: 116194 - protein, 9 aa, Homo Sapiens
RESPPTRDV

SEQ ID NO: 116195 - protein, 9 aa, Homo Sapiens
RESPRPLQL

SEQ ID NO: 116196 - protein, 9 aa, Homo Sapiens
RESQEQSLV

SEQ ID NO: 116197 - protein, 9 aa, Homo Sapiens
RESQLALIV

SEQ ID NO: 116198 - protein, 9 aa, Homo Sapiens
RETAFTHAV

SEQ ID NO: 116199 - protein, 9 aa, Homo Sapiens
RETDCGVHI

SEQ ID NO: 116200 - protein, 9 aa, Homo Sapiens
RETDVAKKI

SEQ ID NO: 116201 - protein, 9 aa, Homo Sapiens
RETEATNAI

SEQ ID NO: 116202 - protein, 9 aa, Homo Sapiens
RETEHCVSL

SEQ ID NO: 116203 - protein, 9 aa, Homo Sapiens
RETFPQRHM

SEQ ID NO: 116204 - protein, 9 aa, Homo Sapiens
RETGYPLAV

SEQ ID NO: 116205 - protein, 9 aa, Homo Sapiens
RETIIMNQI

SEQ ID NO: 116206 - protein, 9 aa, Homo Sapiens
RETIPAKLV

SEQ ID NO: 116207 - protein, 9 aa, Homo Sapiens
RETLLGKVV

SEQ ID NO: 116208 - protein, 9 aa, Homo Sapiens
RETPHSPGV

SEQ ID NO: 116209 - protein, 9 aa, Homo Sapiens
RETPRVTAV

SEQ ID NO: 116210 - protein, 9 aa, Homo Sapiens
RETSHVTMV

SEQ ID NO: 116211 - protein, 9 aa, Homo Sapiens
RETSLAENI

SEQ ID NO: 116212 - protein, 9 aa, Homo Sapiens
RETVIKQTM

SEQ ID NO: 116213 - protein, 9 aa, Homo Sapiens
REVALLRRL

SEQ ID NO: 116214 - protein, 9 aa, Homo Sapiens
REVDEIDEI

SEQ ID NO: 116215 - protein, 9 aa, Homo Sapiens
REVEHFLKA

SEQ ID NO: 116216 - protein, 9 aa, Homo Sapiens
REVEIQSHL

SEQ ID NO: 116217 - protein, 9 aa, Homo Sapiens
REVERALQL

SEQ ID NO: 116218 - protein, 9 aa, Homo Sapiens
REVFKTQGV

SEQ ID NO: 116219 - protein, 9 aa, Homo Sapiens
REVGKALLI

SEQ ID NO: 116220 - protein, 9 aa, Homo Sapiens
REVLELDSI

SEQ ID NO: 116221 - protein, 9 aa, Homo Sapiens
REVLHKFTV

SEQ ID NO: 116222 - protein, 9 aa, Homo Sapiens
REVNYIDKI

SEQ ID NO: 116223 - protein, 9 aa, Homo Sapiens
REVPECLEI

SEQ ID NO: 116224 - protein, 9 aa, Homo Sapiens
REVSQVDTI

SEQ ID NO: 116225 - protein, 9 aa, Homo Sapiens
REVVETPLL

SEQ ID NO: 116226 - protein, 9 aa, Homo Sapiens
REVVFVEDV

SEQ ID NO: 116227 - protein, 9 aa, Homo Sapiens
REVVKHPSV

SEQ ID NO: 116228 - protein, 9 aa, Homo Sapiens
REVVKPAAV

SEQ ID NO: 116229 - protein, 9 aa, Homo Sapiens
REVWLYEQV

SEQ ID NO: 116230 - protein, 9 aa, Homo Sapiens
REYATKTRI

SEQ ID NO: 116231 - protein, 9 aa, Homo Sapiens
REYDVPYHI

SEQ ID NO: 116232 - protein, 9 aa, Homo Sapiens
REYFHKLLI

SEQ ID NO: 116233 - protein, 9 aa, Homo Sapiens
REYGFLRTL

SEQ ID NO: 116234 - protein, 9 aa, Homo Sapiens
REYHTDTTV

SEQ ID NO: 116235 - protein, 9 aa, Homo Sapiens
REYLRVNVV

SEQ ID NO: 116236 - protein, 9 aa, Homo Sapiens
REYMGFIQA

SEQ ID NO: 116237 - protein, 9 aa, Homo Sapiens
REYNEYENI

SEQ ID NO: 116238 - protein, 9 aa, Homo Sapiens
REYPNLVTI

SEQ ID NO: 116239 - protein, 9 aa, Homo Sapiens
REYQDLLNV

SEQ ID NO: 116240 - protein, 9 aa, Homo Sapiens
REYQELMSV

SEQ ID NO: 116241 - protein, 9 aa, Homo Sapiens
REYRLQARI

SEQ ID NO: 116242 - protein, 9 aa, Homo Sapiens
RLDEVLRTL

SEQ ID NO: 116243 - protein, 9 aa, Homo Sapiens
RQIDQFLVV

SEQ ID NO: 116244 - protein, 9 aa, Homo Sapiens
SEADPAPLL

SEQ ID NO: 116245 - protein, 9 aa, Homo Sapiens
SEAEAKAQI

SEQ ID NO: 116246 - protein, 9 aa, Homo Sapiens
SEAEKLTLV

SEQ ID NO: 116247 - protein, 9 aa, Homo Sapiens
SEAEKVYIV

SEQ ID NO: 116248 - protein, 9 aa, Homo Sapiens
SEAFLPQSI

SEQ ID NO: 116249 - protein, 9 aa, Homo Sapiens
SEAGKSTSI

SEQ ID NO: 116250 - protein, 9 aa, Homo Sapiens
SEAGTQPQV

SEQ ID NO: 116251 - protein, 9 aa, Homo Sapiens
SEAIHPNTI

SEQ ID NO: 116252 - protein, 9 aa, Homo Sapiens
SEAIKGAVV

SEQ ID NO: 116253 - protein, 9 aa, Homo Sapiens
SEAIKTSQI

SEQ ID NO: 116254 - protein, 9 aa, Homo Sapiens
SEAKEVRGV

SEQ ID NO: 116255 - protein, 9 aa, Homo Sapiens
SEALEAARI

SEQ ID NO: 116256 - protein, 9 aa, Homo Sapiens
SEAMSVEKI

SEQ ID NO: 116257 - protein, 9 aa, Homo Sapiens
SEAPEAPLL

SEQ ID NO: 116258 - protein, 9 aa, Homo Sapiens
SEAPFLHYL

SEQ ID NO: 116259 - protein, 9 aa, Homo Sapiens
SEAPFTHKV

SEQ ID NO: 116260 - protein, 9 aa, Homo Sapiens
SEAPGPSKV

SEQ ID NO: 116261 - protein, 9 aa, Homo Sapiens
SEAPKEVNI

SEQ ID NO: 116262 - protein, 9 aa, Homo Sapiens
SEAPNEMVI

SEQ ID NO: 116263 - protein, 9 aa, Homo Sapiens
SEAPPSKMV

SEQ ID NO: 116264 - protein, 9 aa, Homo Sapiens
SEAPPTNQA

SEQ ID NO: 116265 - protein, 9 aa, Homo Sapiens
SEAQKIKEV

SEQ ID NO: 116266 - protein, 9 aa, Homo Sapiens
SEAQPARQI

SEQ ID NO: 116267 - protein, 9 aa, Homo Sapiens
SEAQPQPEV

SEQ ID NO: 116268 - protein, 9 aa, Homo Sapiens
SEASDFNKV

SEQ ID NO: 116269 - protein, 9 aa, Homo Sapiens
SEASGFCYV

SEQ ID NO: 116270 - protein, 9 aa, Homo Sapiens
SEATHIITI

SEQ ID NO: 116271 - protein, 9 aa, Homo Sapiens
SEAVNLSKV

SEQ ID NO: 116272 - protein, 9 aa, Homo Sapiens
SECGKFSQL

SEQ ID NO: 116273 - protein, 9 aa, Homo Sapiens
SECGKGFTV

SEQ ID NO: 116274 - protein, 9 aa, Homo Sapiens
SECGKTFTV

SEQ ID NO: 116275 - protein, 9 aa, Homo Sapiens
SECGPFIKL

SEQ ID NO: 116276 - protein, 9 aa, Homo Sapiens
SECIGSALI

SEQ ID NO: 116277 - protein, 9 aa, Homo Sapiens
SECKKLRGV

SEQ ID NO: 116278 - protein, 9 aa, Homo Sapiens
SECPSRVLV

SEQ ID NO: 116279 - protein, 9 aa, Homo Sapiens
SECRLLAYI

SEQ ID NO: 116280 - protein, 9 aa, Homo Sapiens
SECVLNQQV

SEQ ID NO: 116281 - protein, 9 aa, Homo Sapiens
SECVSSKSV

SEQ ID NO: 116282 - protein, 9 aa, Homo Sapiens
SEDAAFNKI

SEQ ID NO: 116283 - protein, 9 aa, Homo Sapiens
SEDDIHRSI

SEQ ID NO: 116284 - protein, 9 aa, Homo Sapiens
SEDDPILQI

SEQ ID NO: 116285 - protein, 9 aa, Homo Sapiens
SEDDRLPVI

SEQ ID NO: 116286 - protein, 9 aa, Homo Sapiens
SEDELKRSV

SEQ ID NO: 116287 - protein, 9 aa, Homo Sapiens
SEDFPRPLV

SEQ ID NO: 116288 - protein, 9 aa, Homo Sapiens
SEDGAIHVI

SEQ ID NO: 116289 - protein, 9 aa, Homo Sapiens
SEDGSLLAV

SEQ ID NO: 116290 - protein, 9 aa, Homo Sapiens
SEDGYQTCV

SEQ ID NO: 116291 - protein, 9 aa, Homo Sapiens
SEDIHIIYI

SEQ ID NO: 116292 - protein, 9 aa, Homo Sapiens
SEDIKNLVV

SEQ ID NO: 116293 - protein, 9 aa, Homo Sapiens
SEDKVRQLV

SEQ ID NO: 116294 - protein, 9 aa, Homo Sapiens
SEDPSHPSM

SEQ ID NO: 116295 - protein, 9 aa, Homo Sapiens
SEDQRTPLM

SEQ ID NO: 116296 - protein, 9 aa, Homo Sapiens
SEDSSVTQI

SEQ ID NO: 116297 - protein, 9 aa, Homo Sapiens
SEDVLRLLI

SEQ ID NO: 116298 - protein, 9 aa, Homo Sapiens
SEDVSRVLI

SEQ ID NO: 116299 - protein, 9 aa, Homo Sapiens
SEDYPRKTI

SEQ ID NO: 116300 - protein, 9 aa, Homo Sapiens
SEEDFLRQV

SEQ ID NO: 116301 - protein, 9 aa, Homo Sapiens
SEEDRVVVI

SEQ ID NO: 116302 - protein, 9 aa, Homo Sapiens
SEEELKTHI

SEQ ID NO: 116303 - protein, 9 aa, Homo Sapiens
SEEGYLAKV

SEQ ID NO: 116304 - protein, 9 aa, Homo Sapiens
SEEKRIYRV

SEQ ID NO: 116305 - protein, 9 aa, Homo Sapiens
SEELCYTLI

SEQ ID NO: 116306 - protein, 9 aa, Homo Sapiens
SEELGYRCV

SEQ ID NO: 116307 - protein, 9 aa, Homo Sapiens
SEELRSRIV

SEQ ID NO: 116308 - protein, 9 aa, Homo Sapiens
SEELRVSKV

SEQ ID NO: 116309 - protein, 9 aa, Homo Sapiens
SEEQFVHHI

SEQ ID NO: 116310 - protein, 9 aa, Homo Sapiens
SEEVVSREV

SEQ ID NO: 116311 - protein, 9 aa, Homo Sapiens
SEFATTNQI

SEQ ID NO: 116312 - protein, 9 aa, Homo Sapiens
SEFDFFERL

SEQ ID NO: 116313 - protein, 9 aa, Homo Sapiens
SEFDRQAEI

SEQ ID NO: 116314 - protein, 9 aa, Homo Sapiens
SEFEGHKRI

SEQ ID NO: 116315 - protein, 9 aa, Homo Sapiens
SEFEIVKAI

SEQ ID NO: 116316 - protein, 9 aa, Homo Sapiens
SEFGAPVSV

SEQ ID NO: 116317 - protein, 9 aa, Homo Sapiens
SEFGKLERV

SEQ ID NO: 116318 - protein, 9 aa, Homo Sapiens
SEFIDSQRV

SEQ ID NO: 116319 - protein, 9 aa, Homo Sapiens
SEFKAMDSI

SEQ ID NO: 116320 - protein, 9 aa, Homo Sapiens
SEFLIEPTV

SEQ ID NO: 116321 - protein, 9 aa, Homo Sapiens
SEFPVRLSV

SEQ ID NO: 116322 - protein, 9 aa, Homo Sapiens
SEFRAFSSF

SEQ ID NO: 116323 - protein, 9 aa, Homo Sapiens
SEFSEPSFI

SEQ ID NO: 116324 - protein, 9 aa, Homo Sapiens
SEFTGTHYI

SEQ ID NO: 116325 - protein, 9 aa, Homo Sapiens
SEFYKHIVL

SEQ ID NO: 116326 - protein, 9 aa, Homo Sapiens
SEFYTLHEV

SEQ ID NO: 116327 - protein, 9 aa, Homo Sapiens
SEGGPPLRI

SEQ ID NO: 116328 - protein, 9 aa, Homo Sapiens
SEGGQLRSI

SEQ ID NO: 116329 - protein, 9 aa, Homo Sapiens
SEGGRTPLM

SEQ ID NO: 116330 - protein, 9 aa, Homo Sapiens
SEGKLEQTV

SEQ ID NO: 116331 - protein, 9 aa, Homo Sapiens
SEGKVFINI

SEQ ID NO: 116332 - protein, 9 aa, Homo Sapiens
SEGNGSHTI

SEQ ID NO: 116333 - protein, 9 aa, Homo Sapiens
SEGPIVATL

SEQ ID NO: 116334 - protein, 9 aa, Homo Sapiens
SEGPKVVSV

SEQ ID NO: 116335 - protein, 9 aa, Homo Sapiens
SEGRDPLTI

SEQ ID NO: 116336 - protein, 9 aa, Homo Sapiens
SEGRPTIEV

SEQ ID NO: 116337 - protein, 9 aa, Homo Sapiens
SEHERQYLL

SEQ ID NO: 116338 - protein, 9 aa, Homo Sapiens
SEHGVGIYV

SEQ ID NO: 116339 - protein, 9 aa, Homo Sapiens
SEHHLQRAI

SEQ ID NO: 116340 - protein, 9 aa, Homo Sapiens
SEHKVFDLV

SEQ ID NO: 116341 - protein, 9 aa, Homo Sapiens
SEHLAAIEI

SEQ ID NO: 116342 - protein, 9 aa, Homo Sapiens
SEHPFVNGV

SEQ ID NO: 116343 - protein, 9 aa, Homo Sapiens
SEHSKVRLV

SEQ ID NO: 116344 - protein, 9 aa, Homo Sapiens
SEHSMDTLL

SEQ ID NO: 116345 - protein, 9 aa, Homo Sapiens
SEHVWVEVV

SEQ ID NO: 116346 - protein, 9 aa, Homo Sapiens
SEIDQINKV

SEQ ID NO: 116347 - protein, 9 aa, Homo Sapiens
SEIDQLFRI

SEQ ID NO: 116348 - protein, 9 aa, Homo Sapiens
SEIERQAQV

SEQ ID NO: 116349 - protein, 9 aa, Homo Sapiens
SEIEYYAML

SEQ ID NO: 116350 - protein, 9 aa, Homo Sapiens
SEIFTDNQI

SEQ ID NO: 116351 - protein, 9 aa, Homo Sapiens
SEIGDASRV

SEQ ID NO: 116352 - protein, 9 aa, Homo Sapiens
SEIHSGNSV

SEQ ID NO: 116353 - protein, 9 aa, Homo Sapiens
SEIIGSMGI

SEQ ID NO: 116354 - protein, 9 aa, Homo Sapiens
SEIIKPCSV

SEQ ID NO: 116355 - protein, 9 aa, Homo Sapiens
SEIILRQEV

SEQ ID NO: 116356 - protein, 9 aa, Homo Sapiens
SEIKGVCSV

SEQ ID NO: 116357 - protein, 9 aa, Homo Sapiens
SEIKSIPGV

SEQ ID NO: 116358 - protein, 9 aa, Homo Sapiens
SEIKTSIEV

SEQ ID NO: 116359 - protein, 9 aa, Homo Sapiens
SEILCGKEI

SEQ ID NO: 116360 - protein, 9 aa, Homo Sapiens
SEILRMERI

SEQ ID NO: 116361 - protein, 9 aa, Homo Sapiens
SEINCMIRV

SEQ ID NO: 116362 - protein, 9 aa, Homo Sapiens
SEINIAPRI

SEQ ID NO: 116363 - protein, 9 aa, Homo Sapiens
SEINSLPTI

SEQ ID NO: 116364 - protein, 9 aa, Homo Sapiens
SEIPKLPAV

SEQ ID NO: 116365 - protein, 9 aa, Homo Sapiens
SEIQNVLGV

SEQ ID NO: 116366 - protein, 9 aa, Homo Sapiens
SEIRELENI

SEQ ID NO: 116367 - protein, 9 aa, Homo Sapiens
SEIRHLLTL

SEQ ID NO: 116368 - protein, 9 aa, Homo Sapiens
SEISQVFEI

SEQ ID NO: 116369 - protein, 9 aa, Homo Sapiens
SEISSATKL

SEQ ID NO: 116370 - protein, 9 aa, Homo Sapiens
SEITGLSTA

SEQ ID NO: 116371 - protein, 9 aa, Homo Sapiens
SEIVMEHSI

SEQ ID NO: 116372 - protein, 9 aa, Homo Sapiens
SEIYLPEVV

SEQ ID NO: 116373 - protein, 9 aa, Homo Sapiens
SEKDIFDYI

SEQ ID NO: 116374 - protein, 9 aa, Homo Sapiens
SEKEATPVV

SEQ ID NO: 116375 - protein, 9 aa, Homo Sapiens
SEKEFKAYV

SEQ ID NO: 116376 - protein, 9 aa, Homo Sapiens
SEKILLLCV

SEQ ID NO: 116377 - protein, 9 aa, Homo Sapiens
SEKISLQAI

SEQ ID NO: 116378 - protein, 9 aa, Homo Sapiens
SEKLNLDSI

SEQ ID NO: 116379 - protein, 9 aa, Homo Sapiens
SEKPTVTTV

SEQ ID NO: 116380 - protein, 9 aa, Homo Sapiens
SEKQYTIYI

SEQ ID NO: 116381 - protein, 9 aa, Homo Sapiens
SEKRKQISV

SEQ ID NO: 116382 - protein, 9 aa, Homo Sapiens
SEKSNLIRI

SEQ ID NO: 116383 - protein, 9 aa, Homo Sapiens
SELADARRV

SEQ ID NO: 116384 - protein, 9 aa, Homo Sapiens
SELDASKTV

SEQ ID NO: 116385 - protein, 9 aa, Homo Sapiens
SELDLISRL

SEQ ID NO: 116386 - protein, 9 aa, Homo Sapiens
SELDVPFKV

SEQ ID NO: 116387 - protein, 9 aa, Homo Sapiens
SELEKPQKV

SEQ ID NO: 116388 - protein, 9 aa, Homo Sapiens
SELEKQKGV

SEQ ID NO: 116389 - protein, 9 aa, Homo Sapiens
SELERESKV

SEQ ID NO: 116390 - protein, 9 aa, Homo Sapiens
SELERPHKV

SEQ ID NO: 116391 - protein, 9 aa, Homo Sapiens
SELGGIWSV

SEQ ID NO: 116392 - protein, 9 aa, Homo Sapiens
SELGKICSV

SEQ ID NO: 116393 - protein, 9 aa, Homo Sapiens
SELIPGTTV

SEQ ID NO: 116394 - protein, 9 aa, Homo Sapiens
SELITHQRI

SEQ ID NO: 116395 - protein, 9 aa, Homo Sapiens
SELPHCLEV

SEQ ID NO: 116396 - protein, 9 aa, Homo Sapiens
SELPKPSSI

SEQ ID NO: 116397 - protein, 9 aa, Homo Sapiens
SELPMPLLI

SEQ ID NO: 116398 - protein, 9 aa, Homo Sapiens
SELPRIPKI

SEQ ID NO: 116399 - protein, 9 aa, Homo Sapiens
SELPTTVTV

SEQ ID NO: 116400 - protein, 9 aa, Homo Sapiens
SELRSMLEV

SEQ ID NO: 116401 - protein, 9 aa, Homo Sapiens
SELSPGRSV

SEQ ID NO: 116402 - protein, 9 aa, Homo Sapiens
SELYRPSFV

SEQ ID NO: 116403 - protein, 9 aa, Homo Sapiens
SEMAPVCAV

SEQ ID NO: 116404 - protein, 9 aa, Homo Sapiens
SEMDRVPFV

SEQ ID NO: 116405 - protein, 9 aa, Homo Sapiens
SEMERVRLV

SEQ ID NO: 116406 - protein, 9 aa, Homo Sapiens
SEMGVMPEI

SEQ ID NO: 116407 - protein, 9 aa, Homo Sapiens
SEMHSFIQI

SEQ ID NO: 116408 - protein, 9 aa, Homo Sapiens
SEMRAPPAA

SEQ ID NO: 116409 - protein, 9 aa, Homo Sapiens
SEMSRVIRV

SEQ ID NO: 116410 - protein, 9 aa, Homo Sapiens
SEMTQVKEV

SEQ ID NO: 116411 - protein, 9 aa, Homo Sapiens
SENDVIRLI

SEQ ID NO: 116412 - protein, 9 aa, Homo Sapiens
SENEDFRCI

SEQ ID NO: 116413 - protein, 9 aa, Homo Sapiens
SENEEFVEV

SEQ ID NO: 116414 - protein, 9 aa, Homo Sapiens
SENGALPVV

SEQ ID NO: 116415 - protein, 9 aa, Homo Sapiens
SENGWLKAV

SEQ ID NO: 116416 - protein, 9 aa, Homo Sapiens
SENKAFISV

SEQ ID NO: 116417 - protein, 9 aa, Homo Sapiens
SENLPERSV

SEQ ID NO: 116418 - protein, 9 aa, Homo Sapiens
SENPGNKTI

SEQ ID NO: 116419 - protein, 9 aa, Homo Sapiens
SENPPSFTI

SEQ ID NO: 116420 - protein, 9 aa, Homo Sapiens
SENPVLQNI

SEQ ID NO: 116421 - protein, 9 aa, Homo Sapiens
SENPVPLTV

SEQ ID NO: 116422 - protein, 9 aa, Homo Sapiens
SENQPFPSL

SEQ ID NO: 116423 - protein, 9 aa, Homo Sapiens
SENRDLKTV

SEQ ID NO: 116424 - protein, 9 aa, Homo Sapiens
SENVNKLLV

SEQ ID NO: 116425 - protein, 9 aa, Homo Sapiens
SEPMLSHTV

SEQ ID NO: 116426 - protein, 9 aa, Homo Sapiens
SEQEHFLIV

SEQ ID NO: 116427 - protein, 9 aa, Homo Sapiens
SEQNDILKV

SEQ ID NO: 116428 - protein, 9 aa, Homo Sapiens
SEQQALHTV

SEQ ID NO: 116429 - protein, 9 aa, Homo Sapiens
SEQSRSVNI

SEQ ID NO: 116430 - protein, 9 aa, Homo Sapiens
SEQTFMYYV

SEQ ID NO: 116431 - protein, 9 aa, Homo Sapiens
SEQTGLLKI

SEQ ID NO: 116432 - protein, 9 aa, Homo Sapiens
SERDFFQEV

SEQ ID NO: 116433 - protein, 9 aa, Homo Sapiens
SERELFNAV

SEQ ID NO: 116434 - protein, 9 aa, Homo Sapiens
SERETAVRI

SEQ ID NO: 116435 - protein, 9 aa, Homo Sapiens
SERGNLVAV

SEQ ID NO: 116436 - protein, 9 aa, Homo Sapiens
SERPKEIKV

SEQ ID NO: 116437 - protein, 9 aa, Homo Sapiens
SERYTWIVL

SEQ ID NO: 116438 - protein, 9 aa, Homo Sapiens
SESAAVKEI

SEQ ID NO: 116439 - protein, 9 aa, Homo Sapiens
SESALLKCI

SEQ ID NO: 116440 - protein, 9 aa, Homo Sapiens
SESEIVPKV

SEQ ID NO: 116441 - protein, 9 aa, Homo Sapiens
SESEKQWKA

SEQ ID NO: 116442 - protein, 9 aa, Homo Sapiens
SESFIQHIV

SEQ ID NO: 116443 - protein, 9 aa, Homo Sapiens
SESNAPLLI

SEQ ID NO: 116444 - protein, 9 aa, Homo Sapiens
SESPDHYLV

SEQ ID NO: 116445 - protein, 9 aa, Homo Sapiens
SESPGKLHV

SEQ ID NO: 116446 - protein, 9 aa, Homo Sapiens
SESPIVVVL

SEQ ID NO: 116447 - protein, 9 aa, Homo Sapiens
SESPRPCSL

SEQ ID NO: 116448 - protein, 9 aa, Homo Sapiens
SESSFFAKI

SEQ ID NO: 116449 - protein, 9 aa, Homo Sapiens
SESSTVRTV

SEQ ID NO: 116450 - protein, 9 aa, Homo Sapiens
SESVLRTQI

SEQ ID NO: 116451 - protein, 9 aa, Homo Sapiens
SETDMVRQI

SEQ ID NO: 116452 - protein, 9 aa, Homo Sapiens
SETEGTPKL

SEQ ID NO: 116453 - protein, 9 aa, Homo Sapiens
SETESMLKI

SEQ ID NO: 116454 - protein, 9 aa, Homo Sapiens
SETLIIPRV

SEQ ID NO: 116455 - protein, 9 aa, Homo Sapiens
SETPQLFTV

SEQ ID NO: 116456 - protein, 9 aa, Homo Sapiens
SETPTFAKV

SEQ ID NO: 116457 - protein, 9 aa, Homo Sapiens
SETSSVSHI

SEQ ID NO: 116458 - protein, 9 aa, Homo Sapiens
SETTSTRKI

SEQ ID NO: 116459 - protein, 9 aa, Homo Sapiens
SETVKAAKV

SEQ ID NO: 116460 - protein, 9 aa, Homo Sapiens
SEVASGQKI

SEQ ID NO: 116461 - protein, 9 aa, Homo Sapiens
SEVDKVVEV

SEQ ID NO: 116462 - protein, 9 aa, Homo Sapiens
SEVDNWRII

SEQ ID NO: 116463 - protein, 9 aa, Homo Sapiens
SEVEGVKNI

SEQ ID NO: 116464 - protein, 9 aa, Homo Sapiens
SEVEQYVKV

SEQ ID NO: 116465 - protein, 9 aa, Homo Sapiens
SEVERPASI

SEQ ID NO: 116466 - protein, 9 aa, Homo Sapiens
SEVEVKNEI

SEQ ID NO: 116467 - protein, 9 aa, Homo Sapiens
SEVFEAINI

SEQ ID NO: 116468 - protein, 9 aa, Homo Sapiens
SEVFHQAMV

SEQ ID NO: 116469 - protein, 9 aa, Homo Sapiens
SEVGDTQVV

SEQ ID NO: 116470 - protein, 9 aa, Homo Sapiens
SEVGHWRHI

SEQ ID NO: 116471 - protein, 9 aa, Homo Sapiens
SEVGKAGHI

SEQ ID NO: 116472 - protein, 9 aa, Homo Sapiens
SEVGKLLSA

SEQ ID NO: 116473 - protein, 9 aa, Homo Sapiens
SEVGKTPTL

SEQ ID NO: 116474 - protein, 9 aa, Homo Sapiens
SEVHSPPNV

SEQ ID NO: 116475 - protein, 9 aa, Homo Sapiens
SEVISQHLV

SEQ ID NO: 116476 - protein, 9 aa, Homo Sapiens
SEVKIQTHI

SEQ ID NO: 116477 - protein, 9 aa, Homo Sapiens
SEVKPKMVV

SEQ ID NO: 116478 - protein, 9 aa, Homo Sapiens
SEVKPPRDI

SEQ ID NO: 116479 - protein, 9 aa, Homo Sapiens
SEVKRIRSI

SEQ ID NO: 116480 - protein, 9 aa, Homo Sapiens
SEVLHQVFI

SEQ ID NO: 116481 - protein, 9 aa, Homo Sapiens
SEVPGGQSV

SEQ ID NO: 116482 - protein, 9 aa, Homo Sapiens
SEVPNGKEV

SEQ ID NO: 116483 - protein, 9 aa, Homo Sapiens
SEVPSSSGI

SEQ ID NO: 116484 - protein, 9 aa, Homo Sapiens
SEVQKVLQI

SEQ ID NO: 116485 - protein, 9 aa, Homo Sapiens
SEVQLKQHI

SEQ ID NO: 116486 - protein, 9 aa, Homo Sapiens
SEVSKIVTV

SEQ ID NO: 116487 - protein, 9 aa, Homo Sapiens
SEVSQLNHI

SEQ ID NO: 116488 - protein, 9 aa, Homo Sapiens
SEVSTAVRI

SEQ ID NO: 116489 - protein, 9 aa, Homo Sapiens
SEVSTVLKL

SEQ ID NO: 116490 - protein, 9 aa, Homo Sapiens
SEVSWISSI

SEQ ID NO: 116491 - protein, 9 aa, Homo Sapiens
SEVTAALRV

SEQ ID NO: 116492 - protein, 9 aa, Homo Sapiens
SEVTDPLSV

SEQ ID NO: 116493 - protein, 9 aa, Homo Sapiens
SEVTPAMQI

SEQ ID NO: 116494 - protein, 9 aa, Homo Sapiens
SEVYLFSHV

SEQ ID NO: 116495 - protein, 9 aa, Homo Sapiens
SEWDGIVTV

SEQ ID NO: 116496 - protein, 9 aa, Homo Sapiens
SEWKSGTKV

SEQ ID NO: 116497 - protein, 9 aa, Homo Sapiens
SEYARPHVM

SEQ ID NO: 116498 - protein, 9 aa, Homo Sapiens
SEYDQIRYI

SEQ ID NO: 116499 - protein, 9 aa, Homo Sapiens
SEYFRDLFI

SEQ ID NO: 116500 - protein, 9 aa, Homo Sapiens
SEYGFAEKV

SEQ ID NO: 116501 - protein, 9 aa, Homo Sapiens
SEYKINNKV

SEQ ID NO: 116502 - protein, 9 aa, Homo Sapiens
SEYLKLGYV

SEQ ID NO: 116503 - protein, 9 aa, Homo Sapiens
SEYLPTLWV

SEQ ID NO: 116504 - protein, 9 aa, Homo Sapiens
SEYMQAERI

SEQ ID NO: 116505 - protein, 9 aa, Homo Sapiens
SEYNNFKSM

SEQ ID NO: 116506 - protein, 9 aa, Homo Sapiens
SEYNPWRKL

SEQ ID NO: 116507 - protein, 9 aa, Homo Sapiens
SEYPVILSI

SEQ ID NO: 116508 - protein, 9 aa, Homo Sapiens
SEYQRFAVM

SEQ ID NO: 116509 - protein, 9 aa, Homo Sapiens
SEYSQSPKM

SEQ ID NO: 116510 - protein, 9 aa, Homo Sapiens
SEYSVHSSL

SEQ ID NO: 116511 - protein, 9 aa, Homo Sapiens
SEYTSGHSV

SEQ ID NO: 116512 - protein, 9 aa, Homo Sapiens
TEADGKSYV

SEQ ID NO: 116513 - protein, 9 aa, Homo Sapiens
TEAEKIAKV

SEQ ID NO: 116514 - protein, 9 aa, Homo Sapiens
TEAEKQMLV

SEQ ID NO: 116515 - protein, 9 aa, Homo Sapiens
TEAELIRGI

SEQ ID NO: 116516 - protein, 9 aa, Homo Sapiens
TEAEVRGLC

SEQ ID NO: 116517 - protein, 9 aa, Homo Sapiens
TEAHPLPVL

SEQ ID NO: 116518 - protein, 9 aa, Homo Sapiens
TEAIPGAKI

SEQ ID NO: 116519 - protein, 9 aa, Homo Sapiens
TEAKLVRKV

SEQ ID NO: 116520 - protein, 9 aa, Homo Sapiens
TEALPVKLI

SEQ ID NO: 116521 - protein, 9 aa, Homo Sapiens
TEAPAAVVI

SEQ ID NO: 116522 - protein, 9 aa, Homo Sapiens
TEAPPIIFA

SEQ ID NO: 116523 - protein, 9 aa, Homo Sapiens
TEAPTQVTV

SEQ ID NO: 116524 - protein, 9 aa, Homo Sapiens
TEAPVPVSV

SEQ ID NO: 116525 - protein, 9 aa, Homo Sapiens
TEASFQKVI

SEQ ID NO: 116526 - protein, 9 aa, Homo Sapiens
TECGKAFRV

SEQ ID NO: 116527 - protein, 9 aa, Homo Sapiens
TEDAKPVKI

SEQ ID NO: 116528 - protein, 9 aa, Homo Sapiens
TEDDKQLLL

SEQ ID NO: 116529 - protein, 9 aa, Homo Sapiens
TEDEVERVI

SEQ ID NO: 116530 - protein, 9 aa, Homo Sapiens
TEDHVMHLL

SEQ ID NO: 116531 - protein, 9 aa, Homo Sapiens
TEDIPIILV

SEQ ID NO: 116532 - protein, 9 aa, Homo Sapiens
TEDNGFHAI

SEQ ID NO: 116533 - protein, 9 aa, Homo Sapiens
TEDPHTVLV

SEQ ID NO: 116534 - protein, 9 aa, Homo Sapiens
TEDPNQLTV

SEQ ID NO: 116535 - protein, 9 aa, Homo Sapiens
TEDPRVFKV

SEQ ID NO: 116536 - protein, 9 aa, Homo Sapiens
TEDPSVHEI

SEQ ID NO: 116537 - protein, 9 aa, Homo Sapiens
TEDPTILRI

SEQ ID NO: 116538 - protein, 9 aa, Homo Sapiens
TEDQRFPQL

SEQ ID NO: 116539 - protein, 9 aa, Homo Sapiens
TEDSHLSTV

SEQ ID NO: 116540 - protein, 9 aa, Homo Sapiens
TEDSKRIAV

SEQ ID NO: 116541 - protein, 9 aa, Homo Sapiens
TEDSPGLKV

SEQ ID NO: 116542 - protein, 9 aa, Homo Sapiens
TEDVPMILV

SEQ ID NO: 116543 - protein, 9 aa, Homo Sapiens
TEDVPRKLL

SEQ ID NO: 116544 - protein, 9 aa, Homo Sapiens
TEDYYVHLI

SEQ ID NO: 116545 - protein, 9 aa, Homo Sapiens
TEEEKRTLI

SEQ ID NO: 116546 - protein, 9 aa, Homo Sapiens
TEEERLVTI

SEQ ID NO: 116547 - protein, 9 aa, Homo Sapiens
TEEKSVRQI

SEQ ID NO: 116548 - protein, 9 aa, Homo Sapiens
TEENKALKI

SEQ ID NO: 116549 - protein, 9 aa, Homo Sapiens
TEEVSKNLV

SEQ ID NO: 116550 - protein, 9 aa, Homo Sapiens
TEFDQLRSI

SEQ ID NO: 116551 - protein, 9 aa, Homo Sapiens
TEFDRLNEI

SEQ ID NO: 116552 - protein, 9 aa, Homo Sapiens
TEFDRQAEV

SEQ ID NO: 116553 - protein, 9 aa, Homo Sapiens
TEFGHPAAI

SEQ ID NO: 116554 - protein, 9 aa, Homo Sapiens
TEFHELEKI

SEQ ID NO: 116555 - protein, 9 aa, Homo Sapiens
TEFHHVRTL

SEQ ID NO: 116556 - protein, 9 aa, Homo Sapiens
TEFPTVLDI

SEQ ID NO: 116557 - protein, 9 aa, Homo Sapiens
TEFQHPCFL

SEQ ID NO: 116558 - protein, 9 aa, Homo Sapiens
TEFTPPGCI

SEQ ID NO: 116559 - protein, 9 aa, Homo Sapiens
TEFYEQESI

SEQ ID NO: 116560 - protein, 9 aa, Homo Sapiens
TEGIPVLIV

SEQ ID NO: 116561 - protein, 9 aa, Homo Sapiens
TEGPFVERV

SEQ ID NO: 116562 - protein, 9 aa, Homo Sapiens
TEGQGTPKL

SEQ ID NO: 116563 - protein, 9 aa, Homo Sapiens
TEGVPSTAI

SEQ ID NO: 116564 - protein, 9 aa, Homo Sapiens
TEHAHQVVV

SEQ ID NO: 116565 - protein, 9 aa, Homo Sapiens
TEHGEFLAL

SEQ ID NO: 116566 - protein, 9 aa, Homo Sapiens
TEHTEVREI

SEQ ID NO: 116567 - protein, 9 aa, Homo Sapiens
TEHYDIPKV

SEQ ID NO: 116568 - protein, 9 aa, Homo Sapiens
TEIAKFLKV

SEQ ID NO: 116569 - protein, 9 aa, Homo Sapiens
TEIDEKEYI

SEQ ID NO: 116570 - protein, 9 aa, Homo Sapiens
TEIDPICAL

SEQ ID NO: 116571 - protein, 9 aa, Homo Sapiens
TEIDWKAYM

SEQ ID NO: 116572 - protein, 9 aa, Homo Sapiens
TEIEDMPTL

SEQ ID NO: 116573 - protein, 9 aa, Homo Sapiens
TEIEGSKLV

SEQ ID NO: 116574 - protein, 9 aa, Homo Sapiens
TEIEGTQKL

SEQ ID NO: 116575 - protein, 9 aa, Homo Sapiens
TEIEKARAV

SEQ ID NO: 116576 - protein, 9 aa, Homo Sapiens
TEIEKSISA

SEQ ID NO: 116577 - protein, 9 aa, Homo Sapiens
TEIFSGKSV

SEQ ID NO: 116578 - protein, 9 aa, Homo Sapiens
TEIFYHRGV

SEQ ID NO: 116579 - protein, 9 aa, Homo Sapiens
TEIGPRMTL

SEQ ID NO: 116580 - protein, 9 aa, Homo Sapiens
TEIGTMISV

SEQ ID NO: 116581 - protein, 9 aa, Homo Sapiens
TEIHNINII

SEQ ID NO: 116582 - protein, 9 aa, Homo Sapiens
TEIIGGVVV

SEQ ID NO: 116583 - protein, 9 aa, Homo Sapiens
TEIIKTAKI

SEQ ID NO: 116584 - protein, 9 aa, Homo Sapiens
TEIIPKSAV

SEQ ID NO: 116585 - protein, 9 aa, Homo Sapiens
TEIKKIPGI

SEQ ID NO: 116586 - protein, 9 aa, Homo Sapiens
TEILGTQEI

SEQ ID NO: 116587 - protein, 9 aa, Homo Sapiens
TEINFTQKL

SEQ ID NO: 116588 - protein, 9 aa, Homo Sapiens
TEIPPGAVI

SEQ ID NO: 116589 - protein, 9 aa, Homo Sapiens
TEIPQIVEI

SEQ ID NO: 116590 - protein, 9 aa, Homo Sapiens
TEIPTAITI

SEQ ID NO: 116591 - protein, 9 aa, Homo Sapiens
TEIPTKITI

SEQ ID NO: 116592 - protein, 9 aa, Homo Sapiens
TEIQLVQSL

SEQ ID NO: 116593 - protein, 9 aa, Homo Sapiens
TEIRGPVTI

SEQ ID NO: 116594 - protein, 9 aa, Homo Sapiens
TEISSAEKV

SEQ ID NO: 116595 - protein, 9 aa, Homo Sapiens
TEITHAVVI

SEQ ID NO: 116596 - protein, 9 aa, Homo Sapiens
TEKAPEPHV

SEQ ID NO: 116597 - protein, 9 aa, Homo Sapiens
TEKDFLEAV

SEQ ID NO: 116598 - protein, 9 aa, Homo Sapiens
TEKDPSYFV

SEQ ID NO: 116599 - protein, 9 aa, Homo Sapiens
TEKEDFIEL

SEQ ID NO: 116600 - protein, 9 aa, Homo Sapiens
TEKGGLVEV

SEQ ID NO: 116601 - protein, 9 aa, Homo Sapiens
TEKHFFHKV

SEQ ID NO: 116602 - protein, 9 aa, Homo Sapiens
TEKPSLMQV

SEQ ID NO: 116603 - protein, 9 aa, Homo Sapiens
TEKQWLRAI

SEQ ID NO: 116604 - protein, 9 aa, Homo Sapiens
TEKQYIATI

SEQ ID NO: 116605 - protein, 9 aa, Homo Sapiens
TELDHIMEV

SEQ ID NO: 116606 - protein, 9 aa, Homo Sapiens
TELDRVHIV

SEQ ID NO: 116607 - protein, 9 aa, Homo Sapiens
TELIKVDKV

SEQ ID NO: 116608 - protein, 9 aa, Homo Sapiens
TELISVSEV

SEQ ID NO: 116609 - protein, 9 aa, Homo Sapiens
TELKGLSKI

SEQ ID NO: 116610 - protein, 9 aa, Homo Sapiens
TELKQVAYI

SEQ ID NO: 116611 - protein, 9 aa, Homo Sapiens
TELLTTQRV

SEQ ID NO: 116612 - protein, 9 aa, Homo Sapiens
TELPKKTEV

SEQ ID NO: 116613 - protein, 9 aa, Homo Sapiens
TELPQTSHV

SEQ ID NO: 116614 - protein, 9 aa, Homo Sapiens
TELQDVQRI

SEQ ID NO: 116615 - protein, 9 aa, Homo Sapiens
TELQQVILI

SEQ ID NO: 116616 - protein, 9 aa, Homo Sapiens
TELSGKCVV

SEQ ID NO: 116617 - protein, 9 aa, Homo Sapiens
TELTNLIKI

SEQ ID NO: 116618 - protein, 9 aa, Homo Sapiens
TELTQNALI

SEQ ID NO: 116619 - protein, 9 aa, Homo Sapiens
TEMPCQALV

SEQ ID NO: 116620 - protein, 9 aa, Homo Sapiens
TENASEVKI

SEQ ID NO: 116621 - protein, 9 aa, Homo Sapiens
TENCFWIKV

SEQ ID NO: 116622 - protein, 9 aa, Homo Sapiens
TENFYFREI

SEQ ID NO: 116623 - protein, 9 aa, Homo Sapiens
TENHLIRKI

SEQ ID NO: 116624 - protein, 9 aa, Homo Sapiens
TENIRVTVI

SEQ ID NO: 116625 - protein, 9 aa, Homo Sapiens
TENKELKTV

SEQ ID NO: 116626 - protein, 9 aa, Homo Sapiens
TENTRFCLI

SEQ ID NO: 116627 - protein, 9 aa, Homo Sapiens
TEQATVTMV

SEQ ID NO: 116628 - protein, 9 aa, Homo Sapiens
TEQDRVFFI

SEQ ID NO: 116629 - protein, 9 aa, Homo Sapiens
TEQERGVGI

SEQ ID NO: 116630 - protein, 9 aa, Homo Sapiens
TEQPSHSQV

SEQ ID NO: 116631 - protein, 9 aa, Homo Sapiens
TEQQPQPYV

SEQ ID NO: 116632 - protein, 9 aa, Homo Sapiens
TEQVIISRV

SEQ ID NO: 116633 - protein, 9 aa, Homo Sapiens
TEQYKWLEI

SEQ ID NO: 116634 - protein, 9 aa, Homo Sapiens
TERAFIHRL

SEQ ID NO: 116635 - protein, 9 aa, Homo Sapiens
TEREKFWKI

SEQ ID NO: 116636 - protein, 9 aa, Homo Sapiens
TERKDFIKT

SEQ ID NO: 116637 - protein, 9 aa, Homo Sapiens
TERLIKHAV

SEQ ID NO: 116638 - protein, 9 aa, Homo Sapiens
TERPDWQNV

SEQ ID NO: 116639 - protein, 9 aa, Homo Sapiens
TERSRVITV

SEQ ID NO: 116640 - protein, 9 aa, Homo Sapiens
TESKTVIKV

SEQ ID NO: 116641 - protein, 9 aa, Homo Sapiens
TESLFFDKV

SEQ ID NO: 116642 - protein, 9 aa, Homo Sapiens
TESLKSPKV

SEQ ID NO: 116643 - protein, 9 aa, Homo Sapiens
TESNQKLGL

SEQ ID NO: 116644 - protein, 9 aa, Homo Sapiens
TESPQRVII

SEQ ID NO: 116645 - protein, 9 aa, Homo Sapiens
TESSPVSAV

SEQ ID NO: 116646 - protein, 9 aa, Homo Sapiens
TESTPITAV

SEQ ID NO: 116647 - protein, 9 aa, Homo Sapiens
TETEKFSGV

SEQ ID NO: 116648 - protein, 9 aa, Homo Sapiens
TETEPSKTV

SEQ ID NO: 116649 - protein, 9 aa, Homo Sapiens
TETGSNINV

SEQ ID NO: 116650 - protein, 9 aa, Homo Sapiens
TETKGTVLI

SEQ ID NO: 116651 - protein, 9 aa, Homo Sapiens
TETKYGIRI

SEQ ID NO: 116652 - protein, 9 aa, Homo Sapiens
TETLHFVSI

SEQ ID NO: 116653 - protein, 9 aa, Homo Sapiens
TETNVYFKL

SEQ ID NO: 116654 - protein, 9 aa, Homo Sapiens
TETRTSCLI

SEQ ID NO: 116655 - protein, 9 aa, Homo Sapiens
TETSNALKV

SEQ ID NO: 116656 - protein, 9 aa, Homo Sapiens
TETVFVPVI

SEQ ID NO: 116657 - protein, 9 aa, Homo Sapiens
TETVLRQAI

SEQ ID NO: 116658 - protein, 9 aa, Homo Sapiens
TEVAPAKDV

SEQ ID NO: 116659 - protein, 9 aa, Homo Sapiens
TEVDKILKV

SEQ ID NO: 116660 - protein, 9 aa, Homo Sapiens
TEVGLVEKV

SEQ ID NO: 116661 - protein, 9 aa, Homo Sapiens
TEVGSVSEV

SEQ ID NO: 116662 - protein, 9 aa, Homo Sapiens
TEVKTSTVI

SEQ ID NO: 116663 - protein, 9 aa, Homo Sapiens
TEVLFNEKI

SEQ ID NO: 116664 - protein, 9 aa, Homo Sapiens
TEVLVTQEI

SEQ ID NO: 116665 - protein, 9 aa, Homo Sapiens
TEVQLQQKV

SEQ ID NO: 116666 - protein, 9 aa, Homo Sapiens
TEVREIKRI

SEQ ID NO: 116667 - protein, 9 aa, Homo Sapiens
TEVSFLDYI

SEQ ID NO: 116668 - protein, 9 aa, Homo Sapiens
TEWLKGQQI

SEQ ID NO: 116669 - protein, 9 aa, Homo Sapiens
TEYAGPLFI

SEQ ID NO: 116670 - protein, 9 aa, Homo Sapiens
TEYENFKVQ

SEQ ID NO: 116671 - protein, 9 aa, Homo Sapiens
TEYETQVKV

SEQ ID NO: 116672 - protein, 9 aa, Homo Sapiens
TEYPLHKAI

SEQ ID NO: 116673 - protein, 9 aa, Homo Sapiens
TEYSFLDYV

SEQ ID NO: 116674 - protein, 9 aa, Homo Sapiens
TEYSFLKEV

SEQ ID NO: 116675 - protein, 9 aa, Homo Sapiens
VEAALVSKI

SEQ ID NO: 116676 - protein, 9 aa, Homo Sapiens
VEACPVVRV

SEQ ID NO: 116677 - protein, 9 aa, Homo Sapiens
VEAFIIQNI

SEQ ID NO: 116678 - protein, 9 aa, Homo Sapiens
VEALNGKEV

SEQ ID NO: 116679 - protein, 9 aa, Homo Sapiens
VEALTTLEV

SEQ ID NO: 116680 - protein, 9 aa, Homo Sapiens
VEAMKLGAV

SEQ ID NO: 116681 - protein, 9 aa, Homo Sapiens
VEAPPKILV

SEQ ID NO: 116682 - protein, 9 aa, Homo Sapiens
VEAPPSVVL

SEQ ID NO: 116683 - protein, 9 aa, Homo Sapiens
VECTPSPRL

SEQ ID NO: 116684 - protein, 9 aa, Homo Sapiens
VEDKGACRL

SEQ ID NO: 116685 - protein, 9 aa, Homo Sapiens
VEDLNIIQV

SEQ ID NO: 116686 - protein, 9 aa, Homo Sapiens
VEDPQGNTI

SEQ ID NO: 116687 - protein, 9 aa, Homo Sapiens
VEDPRVLLL

SEQ ID NO: 116688 - protein, 9 aa, Homo Sapiens
VEDRGTVVA

SEQ ID NO: 116689 - protein, 9 aa, Homo Sapiens
VEEDHIPYI

SEQ ID NO: 116690 - protein, 9 aa, Homo Sapiens
VEEENIRVV

SEQ ID NO: 116691 - protein, 9 aa, Homo Sapiens
VEEEPFHTI

SEQ ID NO: 116692 - protein, 9 aa, Homo Sapiens
VEFDLKQTL

SEQ ID NO: 116693 - protein, 9 aa, Homo Sapiens
VEFGNFNNL

SEQ ID NO: 116694 - protein, 9 aa, Homo Sapiens
VEFISQSSV

SEQ ID NO: 116695 - protein, 9 aa, Homo Sapiens
VEFNGKLLA

SEQ ID NO: 116696 - protein, 9 aa, Homo Sapiens
VEFNKQVCI

SEQ ID NO: 116697 - protein, 9 aa, Homo Sapiens
VEFPHSPEI

SEQ ID NO: 116698 - protein, 9 aa, Homo Sapiens
VEFRDFLKI

SEQ ID NO: 116699 - protein, 9 aa, Homo Sapiens
VEFRSNLYI

SEQ ID NO: 116700 - protein, 9 aa, Homo Sapiens
VEGPIVTQI

SEQ ID NO: 116701 - protein, 9 aa, Homo Sapiens
VEGPSQAKI

SEQ ID NO: 116702 - protein, 9 aa, Homo Sapiens
VEGPSTCLV

SEQ ID NO: 116703 - protein, 9 aa, Homo Sapiens
VEHANIIKV

SEQ ID NO: 116704 - protein, 9 aa, Homo Sapiens
VEHFQIRNV

SEQ ID NO: 116705 - protein, 9 aa, Homo Sapiens
VEHGGFYRT

SEQ ID NO: 116706 - protein, 9 aa, Homo Sapiens
VEHPGHPEV

SEQ ID NO: 116707 - protein, 9 aa, Homo Sapiens
VEHSPFSSF

SEQ ID NO: 116708 - protein, 9 aa, Homo Sapiens
VEIDGIGRI

SEQ ID NO: 116709 - protein, 9 aa, Homo Sapiens
VEIEKAPKV

SEQ ID NO: 116710 - protein, 9 aa, Homo Sapiens
VEIENLGNL

SEQ ID NO: 116711 - protein, 9 aa, Homo Sapiens
VEIEREVLL

SEQ ID NO: 116712 - protein, 9 aa, Homo Sapiens
VEIFHPLRL

SEQ ID NO: 116713 - protein, 9 aa, Homo Sapiens
VEIGVFPLI

SEQ ID NO: 116714 - protein, 9 aa, Homo Sapiens
VEIITKEFI

SEQ ID NO: 116715 - protein, 9 aa, Homo Sapiens
VEILMRPTI

SEQ ID NO: 116716 - protein, 9 aa, Homo Sapiens
VEILNGEKV

SEQ ID NO: 116717 - protein, 9 aa, Homo Sapiens
VEILPVPYV

SEQ ID NO: 116718 - protein, 9 aa, Homo Sapiens
VEIPKNCVV

SEQ ID NO: 116719 - protein, 9 aa, Homo Sapiens
VEIPPNKAV

SEQ ID NO: 116720 - protein, 9 aa, Homo Sapiens
VEIQCPEQV

SEQ ID NO: 116721 - protein, 9 aa, Homo Sapiens
VEIQTPKII

SEQ ID NO: 116722 - protein, 9 aa, Homo Sapiens
VEIRNLHNV

SEQ ID NO: 116723 - protein, 9 aa, Homo Sapiens
VEISAKELI

SEQ ID NO: 116724 - protein, 9 aa, Homo Sapiens
VEISQVTIV

SEQ ID NO: 116725 - protein, 9 aa, Homo Sapiens
VEKESGITI

SEQ ID NO: 116726 - protein, 9 aa, Homo Sapiens
VEKGHFAEL

SEQ ID NO: 116727 - protein, 9 aa, Homo Sapiens
VEKIDFDSV

SEQ ID NO: 116728 - protein, 9 aa, Homo Sapiens
VEKILLSVV

SEQ ID NO: 116729 - protein, 9 aa, Homo Sapiens
VEKQSALLI

SEQ ID NO: 116730 - protein, 9 aa, Homo Sapiens
VELDHATLV

SEQ ID NO: 116731 - protein, 9 aa, Homo Sapiens
VELDLQRSV

SEQ ID NO: 116732 - protein, 9 aa, Homo Sapiens
VELEHSTKV

SEQ ID NO: 116733 - protein, 9 aa, Homo Sapiens
VELGPRPTV

SEQ ID NO: 116734 - protein, 9 aa, Homo Sapiens
VELKKFKRV

SEQ ID NO: 116735 - protein, 9 aa, Homo Sapiens
VELNKIPTV

SEQ ID NO: 116736 - protein, 9 aa, Homo Sapiens
VELPAVASV

SEQ ID NO: 116737 - protein, 9 aa, Homo Sapiens
VELPEQPAV

SEQ ID NO: 116738 - protein, 9 aa, Homo Sapiens
VENDGYKTI

SEQ ID NO: 116739 - protein, 9 aa, Homo Sapiens
VENEQILNV

SEQ ID NO: 116740 - protein, 9 aa, Homo Sapiens
VENKKAQLV

SEQ ID NO: 116741 - protein, 9 aa, Homo Sapiens
VENLPPHII

SEQ ID NO: 116742 - protein, 9 aa, Homo Sapiens
VENLPRTVI

SEQ ID NO: 116743 - protein, 9 aa, Homo Sapiens
VENPTATEI

SEQ ID NO: 116744 - protein, 9 aa, Homo Sapiens
VEPDHYVVV

SEQ ID NO: 116745 - protein, 9 aa, Homo Sapiens
VEPKMQVTI

SEQ ID NO: 116746 - protein, 9 aa, Homo Sapiens
VEPLHFTCV

SEQ ID NO: 116747 - protein, 9 aa, Homo Sapiens
VEQDFHLEI

SEQ ID NO: 116748 - protein, 9 aa, Homo Sapiens
VEQEIQTSV

SEQ ID NO: 116749 - protein, 9 aa, Homo Sapiens
VEQILPTLV

SEQ ID NO: 116750 - protein, 9 aa, Homo Sapiens
VEQKQNPTV

SEQ ID NO: 116751 - protein, 9 aa, Homo Sapiens
VEQQQLITV

SEQ ID NO: 116752 - protein, 9 aa, Homo Sapiens
VEQWPYRAV

SEQ ID NO: 116753 - protein, 9 aa, Homo Sapiens
VERARQVQV

SEQ ID NO: 116754 - protein, 9 aa, Homo Sapiens
VESAPMQVV

SEQ ID NO: 116755 - protein, 9 aa, Homo Sapiens
VESEAHVKI

SEQ ID NO: 116756 - protein, 9 aa, Homo Sapiens
VESEHQVKI

SEQ ID NO: 116757 - protein, 9 aa, Homo Sapiens
VESIISPKV

SEQ ID NO: 116758 - protein, 9 aa, Homo Sapiens
VESKFERTV

SEQ ID NO: 116759 - protein, 9 aa, Homo Sapiens
VESLGFCSV

SEQ ID NO: 116760 - protein, 9 aa, Homo Sapiens
VESPVICKI

SEQ ID NO: 116761 - protein, 9 aa, Homo Sapiens
VESQLPEKV

SEQ ID NO: 116762 - protein, 9 aa, Homo Sapiens
VETDQRVRV

SEQ ID NO: 116763 - protein, 9 aa, Homo Sapiens
VETESVRYV

SEQ ID NO: 116764 - protein, 9 aa, Homo Sapiens
VETGYLNSV

SEQ ID NO: 116765 - protein, 9 aa, Homo Sapiens
VETHTIHKI

SEQ ID NO: 116766 - protein, 9 aa, Homo Sapiens
VETLTETKI

SEQ ID NO: 116767 - protein, 9 aa, Homo Sapiens
VETPPMVVV

SEQ ID NO: 116768 - protein, 9 aa, Homo Sapiens
VETSRVVHI

SEQ ID NO: 116769 - protein, 9 aa, Homo Sapiens
VEVDRILEV

SEQ ID NO: 116770 - protein, 9 aa, Homo Sapiens
VEVDSGRQI

SEQ ID NO: 116771 - protein, 9 aa, Homo Sapiens
VEVGKNINI

SEQ ID NO: 116772 - protein, 9 aa, Homo Sapiens
VEVGRVAYV

SEQ ID NO: 116773 - protein, 9 aa, Homo Sapiens
VEVGSKIYV

SEQ ID NO: 116774 - protein, 9 aa, Homo Sapiens
VEVKDIELV

SEQ ID NO: 116775 - protein, 9 aa, Homo Sapiens
VEVKKFVKI

SEQ ID NO: 116776 - protein, 9 aa, Homo Sapiens
VEVKRPRGV

SEQ ID NO: 116777 - protein, 9 aa, Homo Sapiens
VEVPETPKA

SEQ ID NO: 116778 - protein, 9 aa, Homo Sapiens
VEVPGCGKI

SEQ ID NO: 116779 - protein, 9 aa, Homo Sapiens
VEVTGHAHV

SEQ ID NO: 116780 - protein, 9 aa, Homo Sapiens
VEYCPEVNV

SEQ ID NO: 116781 - protein, 9 aa, Homo Sapiens
VEYEALCKV

SEQ ID NO: 116782 - protein, 9 aa, Homo Sapiens
VEYQMKSVL

SEQ ID NO: 116783 - protein, 9 aa, Homo Sapiens
VEYVKSFNI

SEQ ID NO: 116784 - protein, 9 aa, Homo Sapiens
WEAGKPLSI

SEQ ID NO: 116785 - protein, 9 aa, Homo Sapiens
WEEDRDTVV

SEQ ID NO: 116786 - protein, 9 aa, Homo Sapiens
WEEEGFRQI

SEQ ID NO: 116787 - protein, 9 aa, Homo Sapiens
WEEERQPIL

SEQ ID NO: 116788 - protein, 9 aa, Homo Sapiens
WEIDNNPKV

SEQ ID NO: 116789 - protein, 9 aa, Homo Sapiens
WEIENNPTV

SEQ ID NO: 116790 - protein, 9 aa, Homo Sapiens
WEISQKTVL

SEQ ID NO: 116791 - protein, 9 aa, Homo Sapiens
WELEKKSAV

SEQ ID NO: 116792 - protein, 9 aa, Homo Sapiens
WETEKICQL

SEQ ID NO: 116793 - protein, 9 aa, Homo Sapiens
WEVATARCV

SEQ ID NO: 116794 - protein, 9 aa, Homo Sapiens
WEYDESHVI

SEQ ID NO: 116795 - protein, 9 aa, Homo Sapiens
YEAAKLLNV

SEQ ID NO: 116796 - protein, 9 aa, Homo Sapiens
YEAGKMLAI

SEQ ID NO: 116797 - protein, 9 aa, Homo Sapiens
YEAIFKPVM

SEQ ID NO: 116798 - protein, 9 aa, Homo Sapiens
YEALPQHKL

SEQ ID NO: 116799 - protein, 9 aa, Homo Sapiens
YEAPAYHLI

SEQ ID NO: 116800 - protein, 9 aa, Homo Sapiens
YEAPGVREA

SEQ ID NO: 116801 - protein, 9 aa, Homo Sapiens
YEASLPHQI

SEQ ID NO: 116802 - protein, 9 aa, Homo Sapiens
YEAYLPETF

SEQ ID NO: 116803 - protein, 9 aa, Homo Sapiens
YEDATKITV

SEQ ID NO: 116804 - protein, 9 aa, Homo Sapiens
YEDFHIVKL

SEQ ID NO: 116805 - protein, 9 aa, Homo Sapiens
YEDGNVQLV

SEQ ID NO: 116806 - protein, 9 aa, Homo Sapiens
YEDGSIRIF

SEQ ID NO: 116807 - protein, 9 aa, Homo Sapiens
YEDGWLIKM

SEQ ID NO: 116808 - protein, 9 aa, Homo Sapiens
YEDPGGKNV

SEQ ID NO: 116809 - protein, 9 aa, Homo Sapiens
YEDPQHHPL

SEQ ID NO: 116810 - protein, 9 aa, Homo Sapiens
YEDRGITSV

SEQ ID NO: 116811 - protein, 9 aa, Homo Sapiens
YEDRQVPEA

SEQ ID NO: 116812 - protein, 9 aa, Homo Sapiens
YEDTGLLCI

SEQ ID NO: 116813 - protein, 9 aa, Homo Sapiens
YEEDGARSI

SEQ ID NO: 116814 - protein, 9 aa, Homo Sapiens
YEEDSYSHI

SEQ ID NO: 116815 - protein, 9 aa, Homo Sapiens
YEEIMRDYI

SEQ ID NO: 116816 - protein, 9 aa, Homo Sapiens
YEEKVRPCI

SEQ ID NO: 116817 - protein, 9 aa, Homo Sapiens
YEEMFSPNI

SEQ ID NO: 116818 - protein, 9 aa, Homo Sapiens
YEEMYPPEI

SEQ ID NO: 116819 - protein, 9 aa, Homo Sapiens
YEEPNAWRI

SEQ ID NO: 116820 - protein, 9 aa, Homo Sapiens
YEEQGKPEV

SEQ ID NO: 116821 - protein, 9 aa, Homo Sapiens
YEEQRTVDP

SEQ ID NO: 116822 - protein, 9 aa, Homo Sapiens
YEERVLPSI

SEQ ID NO: 116823 - protein, 9 aa, Homo Sapiens
YEERVQAVV

SEQ ID NO: 116824 - protein, 9 aa, Homo Sapiens
YEFDTKDLV

SEQ ID NO: 116825 - protein, 9 aa, Homo Sapiens
YEFEGGVKL

SEQ ID NO: 116826 - protein, 9 aa, Homo Sapiens
YEFERTTSI

SEQ ID NO: 116827 - protein, 9 aa, Homo Sapiens
YEFKGHSLL

SEQ ID NO: 116828 - protein, 9 aa, Homo Sapiens
YEFLKSWTV

SEQ ID NO: 116829 - protein, 9 aa, Homo Sapiens
YEFQASQLL

SEQ ID NO: 116830 - protein, 9 aa, Homo Sapiens
YEFSGCRQI

SEQ ID NO: 116831 - protein, 9 aa, Homo Sapiens
YEGKFANHV

SEQ ID NO: 116832 - protein, 9 aa, Homo Sapiens
YEGLPIGKV

SEQ ID NO: 116833 - protein, 9 aa, Homo Sapiens
YEGPAKIEV

SEQ ID NO: 116834 - protein, 9 aa, Homo Sapiens
YEHPKDLKL

SEQ ID NO: 116835 - protein, 9 aa, Homo Sapiens
YEIDKTLGI

SEQ ID NO: 116836 - protein, 9 aa, Homo Sapiens
YEIHDGMNL

SEQ ID NO: 116837 - protein, 9 aa, Homo Sapiens
YEIHHGKKI

SEQ ID NO: 116838 - protein, 9 aa, Homo Sapiens
YEIKKLIYV

SEQ ID NO: 116839 - protein, 9 aa, Homo Sapiens
YEILNNPEL

SEQ ID NO: 116840 - protein, 9 aa, Homo Sapiens
YEILTPNSI

SEQ ID NO: 116841 - protein, 9 aa, Homo Sapiens
YEITEQRKI

SEQ ID NO: 116842 - protein, 9 aa, Homo Sapiens
YEKINVNEI

SEQ ID NO: 116843 - protein, 9 aa, Homo Sapiens
YEKTIAQMI

SEQ ID NO: 116844 - protein, 9 aa, Homo Sapiens
YEKVKLLEI

SEQ ID NO: 116845 - protein, 9 aa, Homo Sapiens
YELEKLWTL

SEQ ID NO: 116846 - protein, 9 aa, Homo Sapiens
YELKEGRQI

SEQ ID NO: 116847 - protein, 9 aa, Homo Sapiens
YELLFKEGV

SEQ ID NO: 116848 - protein, 9 aa, Homo Sapiens
YELLKQMSI

SEQ ID NO: 116849 - protein, 9 aa, Homo Sapiens
YELLMPHRI

SEQ ID NO: 116850 - protein, 9 aa, Homo Sapiens
YELPDGQVI

SEQ ID NO: 116851 - protein, 9 aa, Homo Sapiens
YELPENIRV

SEQ ID NO: 116852 - protein, 9 aa, Homo Sapiens
YELYDPCTV

SEQ ID NO: 116853 - protein, 9 aa, Homo Sapiens
YEMEVSQRL

SEQ ID NO: 116854 - protein, 9 aa, Homo Sapiens
YENDYPSVI

SEQ ID NO: 116855 - protein, 9 aa, Homo Sapiens
YENIPIRHH

SEQ ID NO: 116856 - protein, 9 aa, Homo Sapiens
YENPVVSRI

SEQ ID NO: 116857 - protein, 9 aa, Homo Sapiens
YENVKIPSI

SEQ ID NO: 116858 - protein, 9 aa, Homo Sapiens
YEQAARVAI

SEQ ID NO: 116859 - protein, 9 aa, Homo Sapiens
YEQAWYAKL

SEQ ID NO: 116860 - protein, 9 aa, Homo Sapiens
YEQILNTKL

SEQ ID NO: 116861 - protein, 9 aa, Homo Sapiens
YEQQMGQKV

SEQ ID NO: 116862 - protein, 9 aa, Homo Sapiens
YEQQTYQVI

SEQ ID NO: 116863 - protein, 9 aa, Homo Sapiens
YEQVSTPEI

SEQ ID NO: 116864 - protein, 9 aa, Homo Sapiens
YERDHAVVV

SEQ ID NO: 116865 - protein, 9 aa, Homo Sapiens
YERGFENIM

SEQ ID NO: 116866 - protein, 9 aa, Homo Sapiens
YERLFGTTV

SEQ ID NO: 116867 - protein, 9 aa, Homo Sapiens
YERPNETKI

SEQ ID NO: 116868 - protein, 9 aa, Homo Sapiens
YESDHPVRV

SEQ ID NO: 116869 - protein, 9 aa, Homo Sapiens
YESEHGINI

SEQ ID NO: 116870 - protein, 9 aa, Homo Sapiens
YESEKVGVA

SEQ ID NO: 116871 - protein, 9 aa, Homo Sapiens
YESINHVVV

SEQ ID NO: 116872 - protein, 9 aa, Homo Sapiens
YESLPATHI

SEQ ID NO: 116873 - protein, 9 aa, Homo Sapiens
YESQPIRQT

SEQ ID NO: 116874 - protein, 9 aa, Homo Sapiens
YETIDKELI

SEQ ID NO: 116875 - protein, 9 aa, Homo Sapiens
YETNKVTRI

SEQ ID NO: 116876 - protein, 9 aa, Homo Sapiens
YETPQGLRI

SEQ ID NO: 116877 - protein, 9 aa, Homo Sapiens
YETPTGIKV

SEQ ID NO: 116878 - protein, 9 aa, Homo Sapiens
YEVQLESKV

SEQ ID NO: 116879 - protein, 9 aa, Homo Sapiens
YEVQQVPKV

SEQ ID NO: 116880 - protein, 9 aa, Homo Sapiens
YEVRLNDTI

SEQ ID NO: 116881 - protein, 9 aa, Homo Sapiens
YEVRLTQTV

SEQ ID NO: 116882 - protein, 9 aa, Homo Sapiens
YEVVDKDSI

SEQ ID NO: 116883 - protein, 9 aa, Homo Sapiens
YEVVEKTRI

SEQ ID NO: 116884 - protein, 9 aa, Homo Sapiens
YEVVQSQRV

SEQ ID NO: 116885 - protein, 9 aa, Homo Sapiens
YEYDRKWGI

SEQ ID NO: 116886 - protein, 9 aa, Homo Sapiens
YEYKKRLTL

SEQ ID NO: 116887 - protein, 9 aa, Homo Sapiens
YEYMEEQVI

SEQ ID NO: 116888 - protein, 9 aa, Homo Sapiens
YEYSGYNYL

SEQ ID NO: 116889 - protein, 9 aa, Homo Sapiens
YEYYVQGQI

SEQ ID NO: 116890 - protein, 9 aa, Homo Sapiens
YGIYNVTMV

SEQ ID NO: 116891 - protein, 10 aa, Homo Sapiens
AAGPPISEGK

SEQ ID NO: 116892 - protein, 10 aa, Homo Sapiens
AEAAEVILRV

SEQ ID NO: 116893 - protein, 10 aa, Homo Sapiens
AEADSKLKQV

SEQ ID NO: 116894 - protein, 10 aa, Homo Sapiens
AEAEASRLTA

SEQ ID NO: 116895 - protein, 10 aa, Homo Sapiens
AEAEKSQLIM

SEQ ID NO: 116896 - protein, 10 aa, Homo Sapiens
AEAEPPSEVV

SEQ ID NO: 116897 - protein, 10 aa, Homo Sapiens
AEAEQEMQRI

SEQ ID NO: 116898 - protein, 10 aa, Homo Sapiens
AEAERTFAEV

SEQ ID NO: 116899 - protein, 10 aa, Homo Sapiens
AEAESAQTRV

SEQ ID NO: 116900 - protein, 10 aa, Homo Sapiens
AEAFPSGCTA

SEQ ID NO: 116901 - protein, 10 aa, Homo Sapiens
AEAKKLAAIT

SEQ ID NO: 116902 - protein, 10 aa, Homo Sapiens
AEAKVNGTTV

SEQ ID NO: 116903 - protein, 10 aa, Homo Sapiens
AEALVGQVLV

SEQ ID NO: 116904 - protein, 10 aa, Homo Sapiens
AEAPSQKVTV

SEQ ID NO: 116905 - protein, 10 aa, Homo Sapiens
AEAQEKLSRI

SEQ ID NO: 116906 - protein, 10 aa, Homo Sapiens
AEAQLLNKQI

SEQ ID NO: 116907 - protein, 10 aa, Homo Sapiens
AEASQLGHKV

SEQ ID NO: 116908 - protein, 10 aa, Homo Sapiens
AEAVNRAITI

SEQ ID NO: 116909 - protein, 10 aa, Homo Sapiens
AECEKLMELY

SEQ ID NO: 116910 - protein, 10 aa, Homo Sapiens
AECHLNPIIL

SEQ ID NO: 116911 - protein, 10 aa, Homo Sapiens
AECNAVRQAL

SEQ ID NO: 116912 - protein, 10 aa, Homo Sapiens
AEDAMRLYYV

SEQ ID NO: 116913 - protein, 10 aa, Homo Sapiens
AEDDVKQITV

SEQ ID NO: 116914 - protein, 10 aa, Homo Sapiens
AEDGPRVVFM

SEQ ID NO: 116915 - protein, 10 aa, Homo Sapiens
AEDGSAGVRV

SEQ ID NO: 116916 - protein, 10 aa, Homo Sapiens
AEDGSRVYVV

SEQ ID NO: 116917 - protein, 10 aa, Homo Sapiens
AEDGYSGVEV

SEQ ID NO: 116918 - protein, 10 aa, Homo Sapiens
AEDPKVTLTI

SEQ ID NO: 116919 - protein, 10 aa, Homo Sapiens
AEDPLGAIHL

SEQ ID NO: 116920 - protein, 10 aa, Homo Sapiens
AEDPQQVSTV

SEQ ID NO: 116921 - protein, 10 aa, Homo Sapiens
AEEERRKIEV

SEQ ID NO: 116922 - protein, 10 aa, Homo Sapiens
AEEKNGVVFI

SEQ ID NO: 116923 - protein, 10 aa, Homo Sapiens
AEEPRGGLKI

SEQ ID NO: 116924 - protein, 10 aa, Homo Sapiens
AEEQFILSQV

SEQ ID NO: 116925 - protein, 10 aa, Homo Sapiens
AEFEKNFKEV

SEQ ID NO: 116926 - protein, 10 aa, Homo Sapiens
AEFHQIEGVV

SEQ ID NO: 116927 - protein, 10 aa, Homo Sapiens
AEFKEAFQLF

SEQ ID NO: 116928 - protein, 10 aa, Homo Sapiens
AEFLSEHPNV

SEQ ID NO: 116929 - protein, 10 aa, Homo Sapiens
AEFNSTPAVF

SEQ ID NO: 116930 - protein, 10 aa, Homo Sapiens
AEFRDPLGYI

SEQ ID NO: 116931 - protein, 10 aa, Homo Sapiens
AEFRDYPPVL

SEQ ID NO: 116932 - protein, 10 aa, Homo Sapiens
AEFSSALVSI

SEQ ID NO: 116933 - protein, 10 aa, Homo Sapiens
AEGDIGKAEV

SEQ ID NO: 116934 - protein, 10 aa, Homo Sapiens
AEGEVTFKSI

SEQ ID NO: 116935 - protein, 10 aa, Homo Sapiens
AEGPITALTF

SEQ ID NO: 116936 - protein, 10 aa, Homo Sapiens
AEHENMKAVL

SEQ ID NO: 116937 - protein, 10 aa, Homo Sapiens
AEHLFLENDV

SEQ ID NO: 116938 - protein, 10 aa, Homo Sapiens
AEHPGDCLIF

SEQ ID NO: 116939 - protein, 10 aa, Homo Sapiens
AEHPNVTLTI

SEQ ID NO: 116940 - protein, 10 aa, Homo Sapiens
AEHPTIAKSV

SEQ ID NO: 116941 - protein, 10 aa, Homo Sapiens
AEHPTIKIFW

SEQ ID NO: 116942 - protein, 10 aa, Homo Sapiens
AEHQQLIPLV

SEQ ID NO: 116943 - protein, 10 aa, Homo Sapiens
AEHSESGQLV

SEQ ID NO: 116944 - protein, 10 aa, Homo Sapiens
AEIDAHLVAL

SEQ ID NO: 116945 - protein, 10 aa, Homo Sapiens
AEIDDKLNKI

SEQ ID NO: 116946 - protein, 10 aa, Homo Sapiens
AEIDFKYALI

SEQ ID NO: 116947 - protein, 10 aa, Homo Sapiens
AEIDLRQGRL

SEQ ID NO: 116948 - protein, 10 aa, Homo Sapiens
AEIDSIHQLV

SEQ ID NO: 116949 - protein, 10 aa, Homo Sapiens
AEIEHFIHII

SEQ ID NO: 116950 - protein, 10 aa, Homo Sapiens
AEIENLANRI

SEQ ID NO: 116951 - protein, 10 aa, Homo Sapiens
AEIEQSQRVV

SEQ ID NO: 116952 - protein, 10 aa, Homo Sapiens
AEIETDKATI

SEQ ID NO: 116953 - protein, 10 aa, Homo Sapiens
AEIHLRLGQI

SEQ ID NO: 116954 - protein, 10 aa, Homo Sapiens
AEIIGGERSV

SEQ ID NO: 116955 - protein, 10 aa, Homo Sapiens
AEIIPGVLFI

SEQ ID NO: 116956 - protein, 10 aa, Homo Sapiens
AEIKELFQYI

SEQ ID NO: 116957 - protein, 10 aa, Homo Sapiens
AEILAEIARI

SEQ ID NO: 116958 - protein, 10 aa, Homo Sapiens
AEILGSGAGI

SEQ ID NO: 116959 - protein, 10 aa, Homo Sapiens
AEILRTMKKV

SEQ ID NO: 116960 - protein, 10 aa, Homo Sapiens
AEINNIIKIV

SEQ ID NO: 116961 - protein, 10 aa, Homo Sapiens
AEIPEHFGAV

SEQ ID NO: 116962 - protein, 10 aa, Homo Sapiens
AEIQELHQSV

SEQ ID NO: 116963 - protein, 10 aa, Homo Sapiens
AEIQGNINHV

SEQ ID NO: 116964 - protein, 10 aa, Homo Sapiens
AEIQGNINKV

SEQ ID NO: 116965 - protein, 10 aa, Homo Sapiens
AEIQNGVKQI

SEQ ID NO: 116966 - protein, 10 aa, Homo Sapiens
AEIRHVLVTL

SEQ ID NO: 116967 - protein, 10 aa, Homo Sapiens
AEIVKRLNGI

SEQ ID NO: 116968 - protein, 10 aa, Homo Sapiens
AEIVPVTTTV

SEQ ID NO: 116969 - protein, 10 aa, Homo Sapiens
AEIYAKLEEI

SEQ ID NO: 116970 - protein, 10 aa, Homo Sapiens
AEKDFTVNTV

SEQ ID NO: 116971 - protein, 10 aa, Homo Sapiens
AEKDNAEIRV

SEQ ID NO: 116972 - protein, 10 aa, Homo Sapiens
AEKDSVLNIA

SEQ ID NO: 116973 - protein, 10 aa, Homo Sapiens
AEKGPMIVLV

SEQ ID NO: 116974 - protein, 10 aa, Homo Sapiens
AEKLGGSAVI

SEQ ID NO: 116975 - protein, 10 aa, Homo Sapiens
AEKNLGESEI

SEQ ID NO: 116976 - protein, 10 aa, Homo Sapiens
AEKPGSKSTI

SEQ ID NO: 116977 - protein, 10 aa, Homo Sapiens
AELAGEGISV

SEQ ID NO: 116978 - protein, 10 aa, Homo Sapiens
AELDISNNKI

SEQ ID NO: 116979 - protein, 10 aa, Homo Sapiens
AELDPGTISV

SEQ ID NO: 116980 - protein, 10 aa, Homo Sapiens
AELDRQWKKI

SEQ ID NO: 116981 - protein, 10 aa, Homo Sapiens
AELEGKSSSI

SEQ ID NO: 116982 - protein, 10 aa, Homo Sapiens
AELEKSTQTI

SEQ ID NO: 116983 - protein, 10 aa, Homo Sapiens
AELETQLQQI

SEQ ID NO: 116984 - protein, 10 aa, Homo Sapiens
AELGVPLSQV

SEQ ID NO: 116985 - protein, 10 aa, Homo Sapiens
AELHNHGIQI

SEQ ID NO: 116986 - protein, 10 aa, Homo Sapiens
AELKDLLLQV

SEQ ID NO: 116987 - protein, 10 aa, Homo Sapiens
AELNFGAITL

SEQ ID NO: 116988 - protein, 10 aa, Homo Sapiens
AELTPHQTFV

SEQ ID NO: 116989 - protein, 10 aa, Homo Sapiens
AEMDARTILL

SEQ ID NO: 116990 - protein, 10 aa, Homo Sapiens
AEMEGQQPVF

SEQ ID NO: 116991 - protein, 10 aa, Homo Sapiens
AEMEMKNRQV

SEQ ID NO: 116992 - protein, 10 aa, Homo Sapiens
AEMETQKEKI

SEQ ID NO: 116993 - protein, 10 aa, Homo Sapiens
AEMRPFIEII

SEQ ID NO: 116994 - protein, 10 aa, Homo Sapiens
AENPFLTHLI

SEQ ID NO: 116995 - protein, 10 aa, Homo Sapiens
AENSQLTERI

SEQ ID NO: 116996 - protein, 10 aa, Homo Sapiens
AEPSFPFQVA

SEQ ID NO: 116997 - protein, 10 aa, Homo Sapiens
AEQNTQITSI

SEQ ID NO: 116998 - protein, 10 aa, Homo Sapiens
AERDRWIEDL

SEQ ID NO: 116999 - protein, 10 aa, Homo Sapiens
AERPDTMLGV

SEQ ID NO: 117000 - protein, 10 aa, Homo Sapiens
AERSEASLKV

SEQ ID NO: 117001 - protein, 10 aa, Homo Sapiens
AERVGAGAPV

SEQ ID NO: 117002 - protein, 10 aa, Homo Sapiens
AESIKNQMTV

SEQ ID NO: 117003 - protein, 10 aa, Homo Sapiens
AESPAALTEV

SEQ ID NO: 117004 - protein, 10 aa, Homo Sapiens
AESRAEAARI

SEQ ID NO: 117005 - protein, 10 aa, Homo Sapiens
AESVEGVVRI

SEQ ID NO: 117006 - protein, 10 aa, Homo Sapiens
AESWGTGRAV

SEQ ID NO: 117007 - protein, 10 aa, Homo Sapiens
AETDVLFNKV

SEQ ID NO: 117008 - protein, 10 aa, Homo Sapiens
AETEPKFNSV

SEQ ID NO: 117009 - protein, 10 aa, Homo Sapiens
AETEYFVRCI

SEQ ID NO: 117010 - protein, 10 aa, Homo Sapiens
AETHFGFETV

SEQ ID NO: 117011 - protein, 10 aa, Homo Sapiens
AETQRQMAHV

SEQ ID NO: 117012 - protein, 10 aa, Homo Sapiens
AEVARAQAAL

SEQ ID NO: 117013 - protein, 10 aa, Homo Sapiens
AEVDNSKQLI

SEQ ID NO: 117014 - protein, 10 aa, Homo Sapiens
AEVDVTRDIV

SEQ ID NO: 117015 - protein, 10 aa, Homo Sapiens
AEVEDMASRI

SEQ ID NO: 117016 - protein, 10 aa, Homo Sapiens
AEVETDKATV

SEQ ID NO: 117017 - protein, 10 aa, Homo Sapiens
AEVETLKTQI

SEQ ID NO: 117018 - protein, 10 aa, Homo Sapiens
AEVGDGTTSV

SEQ ID NO: 117019 - protein, 10 aa, Homo Sapiens
AEVITKFINV

SEQ ID NO: 117020 - protein, 10 aa, Homo Sapiens
AEVKNQEVTI

SEQ ID NO: 117021 - protein, 10 aa, Homo Sapiens
AEVLQILTQV

SEQ ID NO: 117022 - protein, 10 aa, Homo Sapiens
AEVNSSGKTI

SEQ ID NO: 117023 - protein, 10 aa, Homo Sapiens
AEVPFSPGLF

SEQ ID NO: 117024 - protein, 10 aa, Homo Sapiens
AEVPTALEKI

SEQ ID NO: 117025 - protein, 10 aa, Homo Sapiens
AEVRALQAEI

SEQ ID NO: 117026 - protein, 10 aa, Homo Sapiens
AEVVHQLQEI

SEQ ID NO: 117027 - protein, 10 aa, Homo Sapiens
AEVYGIADKI

SEQ ID NO: 117028 - protein, 10 aa, Homo Sapiens
AEWRPEEGFV

SEQ ID NO: 117029 - protein, 10 aa, Homo Sapiens
AEYAHPLETL

SEQ ID NO: 117030 - protein, 10 aa, Homo Sapiens
AEYDFRNDSV

SEQ ID NO: 117031 - protein, 10 aa, Homo Sapiens
AEYDNFFQHL

SEQ ID NO: 117032 - protein, 10 aa, Homo Sapiens
AEYDTQVKEI

SEQ ID NO: 117033 - protein, 10 aa, Homo Sapiens
AEYEERAAKV

SEQ ID NO: 117034 - protein, 10 aa, Homo Sapiens
AEYEFISSGL

SEQ ID NO: 117035 - protein, 10 aa, Homo Sapiens
AEYEKTIAQM

SEQ ID NO: 117036 - protein, 10 aa, Homo Sapiens
AEYENLTNKL

SEQ ID NO: 117037 - protein, 10 aa, Homo Sapiens
AEYEPVLIEI

SEQ ID NO: 117038 - protein, 10 aa, Homo Sapiens
AEYESFLRTG

SEQ ID NO: 117039 - protein, 10 aa, Homo Sapiens
AEYISTVKTL

SEQ ID NO: 117040 - protein, 10 aa, Homo Sapiens
AEYLGANSVV

SEQ ID NO: 117041 - protein, 10 aa, Homo Sapiens
AEYPGSSAQL

SEQ ID NO: 117042 - protein, 10 aa, Homo Sapiens
AEYQAFREAI

SEQ ID NO: 117043 - protein, 10 aa, Homo Sapiens
AEYSRFVNQI

SEQ ID NO: 117044 - protein, 10 aa, Homo Sapiens
AEYSTKNNAL

SEQ ID NO: 117045 - protein, 10 aa, Homo Sapiens
AEYTHKSPRV

SEQ ID NO: 117046 - protein, 10 aa, Homo Sapiens
AIDSRGGEPL

SEQ ID NO: 117047 - protein, 10 aa, Homo Sapiens
APGEVLRSVP

SEQ ID NO: 117048 - protein, 10 aa, Homo Sapiens
EEDQGSKLIR

SEQ ID NO: 117049 - protein, 10 aa, Homo Sapiens
EEFKYLWNNI

SEQ ID NO: 117050 - protein, 10 aa, Homo Sapiens
EEHGNFLITV

SEQ ID NO: 117051 - protein, 10 aa, Homo Sapiens
EEILEKGLKV

SEQ ID NO: 117052 - protein, 10 aa, Homo Sapiens
EEYGEFYKSL

SEQ ID NO: 117053 - protein, 10 aa, Homo Sapiens
EEYNKEFAEV

SEQ ID NO: 117054 - protein, 10 aa, Homo Sapiens
ELAAPGQAKI

SEQ ID NO: 117055 - protein, 10 aa, Homo Sapiens
ELLKPTELVP

SEQ ID NO: 117056 - protein, 10 aa, Homo Sapiens
FEAQGALANI

SEQ ID NO: 117057 - protein, 10 aa, Homo Sapiens
FEAQGGLANI

SEQ ID NO: 117058 - protein, 10 aa, Homo Sapiens
FEDQNTLTSI

SEQ ID NO: 117059 - protein, 10 aa, Homo Sapiens
FEFTGSHLTV

SEQ ID NO: 117060 - protein, 10 aa, Homo Sapiens
FEIFADPRTV

SEQ ID NO: 117061 - protein, 10 aa, Homo Sapiens
FEISDIGAKI

SEQ ID NO: 117062 - protein, 10 aa, Homo Sapiens
FEISDRLIGI

SEQ ID NO: 117063 - protein, 10 aa, Homo Sapiens
FEITPEGRRI

SEQ ID NO: 117064 - protein, 10 aa, Homo Sapiens
FEMPTVCTTI

SEQ ID NO: 117065 - protein, 10 aa, Homo Sapiens
FEQGGARVVV

SEQ ID NO: 117066 - protein, 10 aa, Homo Sapiens
FEREVGRQSV

SEQ ID NO: 117067 - protein, 10 aa, Homo Sapiens
FESGDVKATV

SEQ ID NO: 117068 - protein, 10 aa, Homo Sapiens
FEVGAGQVSV

SEQ ID NO: 117069 - protein, 10 aa, Homo Sapiens
FEVLPQQVTI

SEQ ID NO: 117070 - protein, 10 aa, Homo Sapiens
GEADQKGSLV

SEQ ID NO: 117071 - protein, 10 aa, Homo Sapiens
GEAEDMLMRI

SEQ ID NO: 117072 - protein, 10 aa, Homo Sapiens
GEAELNWSRL

SEQ ID NO: 117073 - protein, 10 aa, Homo Sapiens
GEAFLPLREV

SEQ ID NO: 117074 - protein, 10 aa, Homo Sapiens
GEAGAKFIEV

SEQ ID NO: 117075 - protein, 10 aa, Homo Sapiens
GEAHPSASLI

SEQ ID NO: 117076 - protein, 10 aa, Homo Sapiens
GEALPFIQRV

SEQ ID NO: 117077 - protein, 10 aa, Homo Sapiens
GEANVPFITV

SEQ ID NO: 117078 - protein, 10 aa, Homo Sapiens
GEAPFSSTKV

SEQ ID NO: 117079 - protein, 10 aa, Homo Sapiens
GEAPKPGEEV

SEQ ID NO: 117080 - protein, 10 aa, Homo Sapiens
GEAPMHFCEV

SEQ ID NO: 117081 - protein, 10 aa, Homo Sapiens
GEATNTVTKI

SEQ ID NO: 117082 - protein, 10 aa, Homo Sapiens
GECDVFKEIL

SEQ ID NO: 117083 - protein, 10 aa, Homo Sapiens
GECRPLSKTV

SEQ ID NO: 117084 - protein, 10 aa, Homo Sapiens
GECTPTQREV

SEQ ID NO: 117085 - protein, 10 aa, Homo Sapiens
GEDPDKRISI

SEQ ID NO: 117086 - protein, 10 aa, Homo Sapiens
GEDPNGTLII

SEQ ID NO: 117087 - protein, 10 aa, Homo Sapiens
GEDPRPGGQI

SEQ ID NO: 117088 - protein, 10 aa, Homo Sapiens
GEDPRVSINV

SEQ ID NO: 117089 - protein, 10 aa, Homo Sapiens
GEEARVTQLI

SEQ ID NO: 117090 - protein, 10 aa, Homo Sapiens
GEEQRYTCHV

SEQ ID NO: 117091 - protein, 10 aa, Homo Sapiens
GEFEEFSRRI

SEQ ID NO: 117092 - protein, 10 aa, Homo Sapiens
GEFEKGGKSV

SEQ ID NO: 117093 - protein, 10 aa, Homo Sapiens
GEFFPVPESI

SEQ ID NO: 117094 - protein, 10 aa, Homo Sapiens
GEFGSVFKCV

SEQ ID NO: 117095 - protein, 10 aa, Homo Sapiens
GEFNEVFNDV

SEQ ID NO: 117096 - protein, 10 aa, Homo Sapiens
GEFPDLHRTI

SEQ ID NO: 117097 - protein, 10 aa, Homo Sapiens
GEFPFAKCFV

SEQ ID NO: 117098 - protein, 10 aa, Homo Sapiens
GEFQIVNPHL

SEQ ID NO: 117099 - protein, 10 aa, Homo Sapiens
GEFQSALPKI

SEQ ID NO: 117100 - protein, 10 aa, Homo Sapiens
GEFQSFPKVF

SEQ ID NO: 117101 - protein, 10 aa, Homo Sapiens
GEFREIGTVI

SEQ ID NO: 117102 - protein, 10 aa, Homo Sapiens
GEFSLHEQTV

SEQ ID NO: 117103 - protein, 10 aa, Homo Sapiens
GEFSTCFTEL

SEQ ID NO: 117104 - protein, 10 aa, Homo Sapiens
GEHALGTPEV

SEQ ID NO: 117105 - protein, 10 aa, Homo Sapiens
GEHGDSSVAV

SEQ ID NO: 117106 - protein, 10 aa, Homo Sapiens
GEHLPFLTSV

SEQ ID NO: 117107 - protein, 10 aa, Homo Sapiens
GEIDGNKVTL

SEQ ID NO: 117108 - protein, 10 aa, Homo Sapiens
GEIDRCLKKV

SEQ ID NO: 117109 - protein, 10 aa, Homo Sapiens
GEIFLLPARV

SEQ ID NO: 117110 - protein, 10 aa, Homo Sapiens
GEIIGKRGII

SEQ ID NO: 117111 - protein, 10 aa, Homo Sapiens
GEIKHLLGEI

SEQ ID NO: 117112 - protein, 10 aa, Homo Sapiens
GEILIGGQSV

SEQ ID NO: 117113 - protein, 10 aa, Homo Sapiens
GEIPLPKLYI

SEQ ID NO: 117114 - protein, 10 aa, Homo Sapiens
GEIQETSKKI

SEQ ID NO: 117115 - protein, 10 aa, Homo Sapiens
GEIRNLENVI

SEQ ID NO: 117116 - protein, 10 aa, Homo Sapiens
GEISDKWQYI

SEQ ID NO: 117117 - protein, 10 aa, Homo Sapiens
GEISKKVAQI

SEQ ID NO: 117118 - protein, 10 aa, Homo Sapiens
GEISSSKPAI

SEQ ID NO: 117119 - protein, 10 aa, Homo Sapiens
GEITHLQLEI

SEQ ID NO: 117120 - protein, 10 aa, Homo Sapiens
GEITRLLNHI

SEQ ID NO: 117121 - protein, 10 aa, Homo Sapiens
GEIVIGGQNI

SEQ ID NO: 117122 - protein, 10 aa, Homo Sapiens
GEIVTTIPTI

SEQ ID NO: 117123 - protein, 10 aa, Homo Sapiens
GELDLPILKV

SEQ ID NO: 117124 - protein, 10 aa, Homo Sapiens
GELERALSAV

SEQ ID NO: 117125 - protein, 10 aa, Homo Sapiens
GELGMKLSEI

SEQ ID NO: 117126 - protein, 10 aa, Homo Sapiens
GELIGNFVRV

SEQ ID NO: 117127 - protein, 10 aa, Homo Sapiens
GELIHDLLTI

SEQ ID NO: 117128 - protein, 10 aa, Homo Sapiens
GELKDLTQKV

SEQ ID NO: 117129 - protein, 10 aa, Homo Sapiens
GELPNGRHKI

SEQ ID NO: 117130 - protein, 10 aa, Homo Sapiens
GELPQGFARL

SEQ ID NO: 117131 - protein, 10 aa, Homo Sapiens
GELSARLLSI

SEQ ID NO: 117132 - protein, 10 aa, Homo Sapiens
GEMKPGRKGI

SEQ ID NO: 117133 - protein, 10 aa, Homo Sapiens
GEMKSGVPVL

SEQ ID NO: 117134 - protein, 10 aa, Homo Sapiens
GEMPAEPMTI

SEQ ID NO: 117135 - protein, 10 aa, Homo Sapiens
GENPHGVKAV

SEQ ID NO: 117136 - protein, 10 aa, Homo Sapiens
GENRDAQMLI

SEQ ID NO: 117137 - protein, 10 aa, Homo Sapiens
GENVFGVCHI

SEQ ID NO: 117138 - protein, 10 aa, Homo Sapiens
GEPGFPLNAI

SEQ ID NO: 117139 - protein, 10 aa, Homo Sapiens
GEPIGRGTKV

SEQ ID NO: 117140 - protein, 10 aa, Homo Sapiens
GEPQVQFKLV

SEQ ID NO: 117141 - protein, 10 aa, Homo Sapiens
GERDDQQVFI

SEQ ID NO: 117142 - protein, 10 aa, Homo Sapiens
GESEANVREI

SEQ ID NO: 117143 - protein, 10 aa, Homo Sapiens
GESQVDHSTI

SEQ ID NO: 117144 - protein, 10 aa, Homo Sapiens
GESSAPPRKV

SEQ ID NO: 117145 - protein, 10 aa, Homo Sapiens
GESTSKLASV

SEQ ID NO: 117146 - protein, 10 aa, Homo Sapiens
GETDWKLIAI

SEQ ID NO: 117147 - protein, 10 aa, Homo Sapiens
GETQSRTITV

SEQ ID NO: 117148 - protein, 10 aa, Homo Sapiens
GEVDLRECVV

SEQ ID NO: 117149 - protein, 10 aa, Homo Sapiens
GEVDVEQHTL

SEQ ID NO: 117150 - protein, 10 aa, Homo Sapiens
GEVEKMQILV

SEQ ID NO: 117151 - protein, 10 aa, Homo Sapiens
GEVENTPLRV

SEQ ID NO: 117152 - protein, 10 aa, Homo Sapiens
GEVHTGTTIM

SEQ ID NO: 117153 - protein, 10 aa, Homo Sapiens
GEVSGLMRKV

SEQ ID NO: 117154 - protein, 10 aa, Homo Sapiens
GEVVTTIPTI

SEQ ID NO: 117155 - protein, 10 aa, Homo Sapiens
GEWPTMPHTI

SEQ ID NO: 117156 - protein, 10 aa, Homo Sapiens
GEWYIRGQTI

SEQ ID NO: 117157 - protein, 10 aa, Homo Sapiens
GEYDFRYIFV

SEQ ID NO: 117158 - protein, 10 aa, Homo Sapiens
GEYDVTMPKV

SEQ ID NO: 117159 - protein, 10 aa, Homo Sapiens
GEYFPGTGDL

SEQ ID NO: 117160 - protein, 10 aa, Homo Sapiens
GEYFSVGSQV

SEQ ID NO: 117161 - protein, 10 aa, Homo Sapiens
GEYGGWYKAC

SEQ ID NO: 117162 - protein, 10 aa, Homo Sapiens
GEYGKFFVTI

SEQ ID NO: 117163 - protein, 10 aa, Homo Sapiens
GEYIIRCSEI

SEQ ID NO: 117164 - protein, 10 aa, Homo Sapiens
GEYKFGPLFV

SEQ ID NO: 117165 - protein, 10 aa, Homo Sapiens
GEYNNRHPNI

SEQ ID NO: 117166 - protein, 10 aa, Homo Sapiens
GEYPLTAMTL

SEQ ID NO: 117167 - protein, 10 aa, Homo Sapiens
GEYSGIEHVI

SEQ ID NO: 117168 - protein, 10 aa, Homo Sapiens
GEYSQKYSTM

SEQ ID NO: 117169 - protein, 10 aa, Homo Sapiens
HEAAFPIAVV

SEQ ID NO: 117170 - protein, 10 aa, Homo Sapiens
HEAEDLKMLI

SEQ ID NO: 117171 - protein, 10 aa, Homo Sapiens
HEIAHDGQRI

SEQ ID NO: 117172 - protein, 10 aa, Homo Sapiens
HEIERHFIEI

SEQ ID NO: 117173 - protein, 10 aa, Homo Sapiens
HEIGHGIAAI

SEQ ID NO: 117174 - protein, 10 aa, Homo Sapiens
HEILEKSGRI

SEQ ID NO: 117175 - protein, 10 aa, Homo Sapiens
HEIPSLQSIY

SEQ ID NO: 117176 - protein, 10 aa, Homo Sapiens
HEIQSDVLTI

SEQ ID NO: 117177 - protein, 10 aa, Homo Sapiens
HEISNLKNLV

SEQ ID NO: 117178 - protein, 10 aa, Homo Sapiens
HELIPGGKTI

SEQ ID NO: 117179 - protein, 10 aa, Homo Sapiens
HELNVPFFKV

SEQ ID NO: 117180 - protein, 10 aa, Homo Sapiens
HELPKYGVKV

SEQ ID NO: 117181 - protein, 10 aa, Homo Sapiens
HELPVDMETI

SEQ ID NO: 117182 - protein, 10 aa, Homo Sapiens
HELTIPNNLI

SEQ ID NO: 117183 - protein, 10 aa, Homo Sapiens
HENEALWREV

SEQ ID NO: 117184 - protein, 10 aa, Homo Sapiens
HETPAASKTV

SEQ ID NO: 117185 - protein, 10 aa, Homo Sapiens
HEVDELTQII

SEQ ID NO: 117186 - protein, 10 aa, Homo Sapiens
HEVISRQATI

SEQ ID NO: 117187 - protein, 10 aa, Homo Sapiens
HEVPYPDARI

SEQ ID NO: 117188 - protein, 10 aa, Homo Sapiens
HEYPDLVHKV

SEQ ID NO: 117189 - protein, 10 aa, Homo Sapiens
IEAVNMASKI

SEQ ID NO: 117190 - protein, 10 aa, Homo Sapiens
IEDGKGTILI

SEQ ID NO: 117191 - protein, 10 aa, Homo Sapiens
IEDNNTLVFI

SEQ ID NO: 117192 - protein, 10 aa, Homo Sapiens
IEDSHTLVTV

SEQ ID NO: 117193 - protein, 10 aa, Homo Sapiens
IEEQKIVVKV

SEQ ID NO: 117194 - protein, 10 aa, Homo Sapiens
IEEVHAVVTV

SEQ ID NO: 117195 - protein, 10 aa, Homo Sapiens
IEFDERGNVI

SEQ ID NO: 117196 - protein, 10 aa, Homo Sapiens
IEFLYNENTV

SEQ ID NO: 117197 - protein, 10 aa, Homo Sapiens
IEFSYELSKV

SEQ ID NO: 117198 - protein, 10 aa, Homo Sapiens
IEIDQKLQEI

SEQ ID NO: 117199 - protein, 10 aa, Homo Sapiens
IEIVGGATRI

SEQ ID NO: 117200 - protein, 10 aa, Homo Sapiens
IEIVPGKVFV

SEQ ID NO: 117201 - protein, 10 aa, Homo Sapiens
IEMELRQMEV

SEQ ID NO: 117202 - protein, 10 aa, Homo Sapiens
IENPADVSVI

SEQ ID NO: 117203 - protein, 10 aa, Homo Sapiens
IEPDVELQRI

SEQ ID NO: 117204 - protein, 10 aa, Homo Sapiens
IEPDYKFSTL

SEQ ID NO: 117205 - protein, 10 aa, Homo Sapiens
IEPELPMQLV

SEQ ID NO: 117206 - protein, 10 aa, Homo Sapiens
IETTHGVVHV

SEQ ID NO: 117207 - protein, 10 aa, Homo Sapiens
IEYARQLEMI

SEQ ID NO: 117208 - protein, 10 aa, Homo Sapiens
IEYDDFVECL

SEQ ID NO: 117209 - protein, 10 aa, Homo Sapiens
IEYDPVIILI

SEQ ID NO: 117210 - protein, 10 aa, Homo Sapiens
IEYIHSKNFI

SEQ ID NO: 117211 - protein, 10 aa, Homo Sapiens
KEADLDVATI

SEQ ID NO: 117212 - protein, 10 aa, Homo Sapiens
KEAEEVFERI

SEQ ID NO: 117213 - protein, 10 aa, Homo Sapiens
KEAEPIPETV

SEQ ID NO: 117214 - protein, 10 aa, Homo Sapiens
KEALPDGVNI

SEQ ID NO: 117215 - protein, 10 aa, Homo Sapiens
KEAPCVLIYI

SEQ ID NO: 117216 - protein, 10 aa, Homo Sapiens
KEATYGERVV

SEQ ID NO: 117217 - protein, 10 aa, Homo Sapiens
KEFEDAVRKV

SEQ ID NO: 117218 - protein, 10 aa, Homo Sapiens
KEFGFSGLNV

SEQ ID NO: 117219 - protein, 10 aa, Homo Sapiens
KEFKGFGTEV

SEQ ID NO: 117220 - protein, 10 aa, Homo Sapiens
KEFPELVARI

SEQ ID NO: 117221 - protein, 10 aa, Homo Sapiens
KEFSGNPIKV

SEQ ID NO: 117222 - protein, 10 aa, Homo Sapiens
KEFSPFGTIT

SEQ ID NO: 117223 - protein, 10 aa, Homo Sapiens
KEFWDGFEEV

SEQ ID NO: 117224 - protein, 10 aa, Homo Sapiens
KEGDKPSATI

SEQ ID NO: 117225 - protein, 10 aa, Homo Sapiens
KEGLSFLGGL

SEQ ID NO: 117226 - protein, 10 aa, Homo Sapiens
KEHDPRVITV

SEQ ID NO: 117227 - protein, 10 aa, Homo Sapiens
KEHPDAWTRV

SEQ ID NO: 117228 - protein, 10 aa, Homo Sapiens
KEIAAVIETV

SEQ ID NO: 117229 - protein, 10 aa, Homo Sapiens
KEIEEAMKRV

SEQ ID NO: 117230 - protein, 10 aa, Homo Sapiens
KEIEHNLSKI

SEQ ID NO: 117231 - protein, 10 aa, Homo Sapiens
KEIELPSGQL

SEQ ID NO: 117232 - protein, 10 aa, Homo Sapiens
KEIENGVYLI

SEQ ID NO: 117233 - protein, 10 aa, Homo Sapiens
KEIENTYANV

SEQ ID NO: 117234 - protein, 10 aa, Homo Sapiens
KEIEQKDNEI

SEQ ID NO: 117235 - protein, 10 aa, Homo Sapiens
KEIFETPTEI

SEQ ID NO: 117236 - protein, 10 aa, Homo Sapiens
KEIIPTSEFI

SEQ ID NO: 117237 - protein, 10 aa, Homo Sapiens
KEILGTAQSV

SEQ ID NO: 117238 - protein, 10 aa, Homo Sapiens
KEINKAQNAI

SEQ ID NO: 117239 - protein, 10 aa, Homo Sapiens
KEIQGHQPRI

SEQ ID NO: 117240 - protein, 10 aa, Homo Sapiens
KEIQSAFVSV

SEQ ID NO: 117241 - protein, 10 aa, Homo Sapiens
KEISGKIIFV

SEQ ID NO: 117242 - protein, 10 aa, Homo Sapiens
KELEFYLRKI

SEQ ID NO: 117243 - protein, 10 aa, Homo Sapiens
KELESRLQQV

SEQ ID NO: 117244 - protein, 10 aa, Homo Sapiens
KELGITALHI

SEQ ID NO: 117245 - protein, 10 aa, Homo Sapiens
KELLLQPVTI

SEQ ID NO: 117246 - protein, 10 aa, Homo Sapiens
KELPTVTTNV

SEQ ID NO: 117247 - protein, 10 aa, Homo Sapiens
KELQSAFNEI

SEQ ID NO: 117248 - protein, 10 aa, Homo Sapiens
KELSSKGVKI

SEQ ID NO: 117249 - protein, 10 aa, Homo Sapiens
KEMEAFLVSV

SEQ ID NO: 117250 - protein, 10 aa, Homo Sapiens
KEMEKSFEVV

SEQ ID NO: 117251 - protein, 10 aa, Homo Sapiens
KEMEVKPSSV

SEQ ID NO: 117252 - protein, 10 aa, Homo Sapiens
KEMPSVFQNV

SEQ ID NO: 117253 - protein, 10 aa, Homo Sapiens
KENPNQYNYI

SEQ ID NO: 117254 - protein, 10 aa, Homo Sapiens
KEPEKVNPQI

SEQ ID NO: 117255 - protein, 10 aa, Homo Sapiens
KESDLNGAQI

SEQ ID NO: 117256 - protein, 10 aa, Homo Sapiens
KETLPSNNTV

SEQ ID NO: 117257 - protein, 10 aa, Homo Sapiens
KEVDEQMLNV

SEQ ID NO: 117258 - protein, 10 aa, Homo Sapiens
KEVDSKSQVI

SEQ ID NO: 117259 - protein, 10 aa, Homo Sapiens
KEVEVQAKTV

SEQ ID NO: 117260 - protein, 10 aa, Homo Sapiens
KEWAFEESKI

SEQ ID NO: 117261 - protein, 10 aa, Homo Sapiens
KEYDGFTITI

SEQ ID NO: 117262 - protein, 10 aa, Homo Sapiens
KEYDLAKKYI

SEQ ID NO: 117263 - protein, 10 aa, Homo Sapiens
KEYEELLASV

SEQ ID NO: 117264 - protein, 10 aa, Homo Sapiens
KEYEEYVLTV

SEQ ID NO: 117265 - protein, 10 aa, Homo Sapiens
KEYEGEAILW

SEQ ID NO: 117266 - protein, 10 aa, Homo Sapiens
KEYEPEMGKV

SEQ ID NO: 117267 - protein, 10 aa, Homo Sapiens
KEYEQEFDFI

SEQ ID NO: 117268 - protein, 10 aa, Homo Sapiens
KEYPPHVQKV

SEQ ID NO: 117269 - protein, 10 aa, Homo Sapiens
KEYQKISNQV

SEQ ID NO: 117270 - protein, 10 aa, Homo Sapiens
KGEFGGFGSV

SEQ ID NO: 117271 - protein, 10 aa, Homo Sapiens
KNTVELLTDR

SEQ ID NO: 117272 - protein, 10 aa, Homo Sapiens
LEALPTGTVL

SEQ ID NO: 117273 - protein, 10 aa, Homo Sapiens
LECGLGHRTV

SEQ ID NO: 117274 - protein, 10 aa, Homo Sapiens
LEDEHLLQAI

SEQ ID NO: 117275 - protein, 10 aa, Homo Sapiens
LEDGPKRYTI

SEQ ID NO: 117276 - protein, 10 aa, Homo Sapiens
LEDLFPTTKI

SEQ ID NO: 117277 - protein, 10 aa, Homo Sapiens
LEDPSSGLGV

SEQ ID NO: 117278 - protein, 10 aa, Homo Sapiens
LEEDQAGFRI

SEQ ID NO: 117279 - protein, 10 aa, Homo Sapiens
LEEIGGGQKV

SEQ ID NO: 117280 - protein, 10 aa, Homo Sapiens
LEEKTRLINQ

SEQ ID NO: 117281 - protein, 10 aa, Homo Sapiens
LEEPRGQQEV

SEQ ID NO: 117282 - protein, 10 aa, Homo Sapiens
LEFDRIAEII

SEQ ID NO: 117283 - protein, 10 aa, Homo Sapiens
LEFDSIIQKV

SEQ ID NO: 117284 - protein, 10 aa, Homo Sapiens
LEFDTGIHYI

SEQ ID NO: 117285 - protein, 10 aa, Homo Sapiens
LEFLHANQVI

SEQ ID NO: 117286 - protein, 10 aa, Homo Sapiens
LEFLHSNQVI

SEQ ID NO: 117287 - protein, 10 aa, Homo Sapiens
LEFPAGSVHV

SEQ ID NO: 117288 - protein, 10 aa, Homo Sapiens
LEFPVEVNTV

SEQ ID NO: 117289 - protein, 10 aa, Homo Sapiens
LEGDFAWERV

SEQ ID NO: 117290 - protein, 10 aa, Homo Sapiens
LEIAQNNVEV

SEQ ID NO: 117291 - protein, 10 aa, Homo Sapiens
LEIDFPARAI

SEQ ID NO: 117292 - protein, 10 aa, Homo Sapiens
LEIDPQKVNI

SEQ ID NO: 117293 - protein, 10 aa, Homo Sapiens
LEIEEKINKI

SEQ ID NO: 117294 - protein, 10 aa, Homo Sapiens
LEIEQSMNRV

SEQ ID NO: 117295 - protein, 10 aa, Homo Sapiens
LEINGRNNLI

SEQ ID NO: 117296 - protein, 10 aa, Homo Sapiens
LEINPDHSII

SEQ ID NO: 117297 - protein, 10 aa, Homo Sapiens
LEIPHQGVQV

SEQ ID NO: 117298 - protein, 10 aa, Homo Sapiens
LEIVPNGITL

SEQ ID NO: 117299 - protein, 10 aa, Homo Sapiens
LEIWKESTTV

SEQ ID NO: 117300 - protein, 10 aa, Homo Sapiens
LEKEDLGTRI

SEQ ID NO: 117301 - protein, 10 aa, Homo Sapiens
LELDLSGQQV

SEQ ID NO: 117302 - protein, 10 aa, Homo Sapiens
LELDTIKNLV

SEQ ID NO: 117303 - protein, 10 aa, Homo Sapiens
LELQHALQAI

SEQ ID NO: 117304 - protein, 10 aa, Homo Sapiens
LEMNLGLQKI

SEQ ID NO: 117305 - protein, 10 aa, Homo Sapiens
LENDPDCRHV

SEQ ID NO: 117306 - protein, 10 aa, Homo Sapiens
LEPDKQEALI

SEQ ID NO: 117307 - protein, 10 aa, Homo Sapiens
LEPEYYFSTI

SEQ ID NO: 117308 - protein, 10 aa, Homo Sapiens
LEQGNNSRTV

SEQ ID NO: 117309 - protein, 10 aa, Homo Sapiens
LEQPVGMTTV

SEQ ID NO: 117310 - protein, 10 aa, Homo Sapiens
LERQGQGQLV

SEQ ID NO: 117311 - protein, 10 aa, Homo Sapiens
LESPPKGVTI

SEQ ID NO: 117312 - protein, 10 aa, Homo Sapiens
LEVDGQKVEV

SEQ ID NO: 117313 - protein, 10 aa, Homo Sapiens
LEVDTKKQIV

SEQ ID NO: 117314 - protein, 10 aa, Homo Sapiens
LEVEHPAAKV

SEQ ID NO: 117315 - protein, 10 aa, Homo Sapiens
LEYFKGAIPL

SEQ ID NO: 117316 - protein, 10 aa, Homo Sapiens
LEYGKAELEI

SEQ ID NO: 117317 - protein, 10 aa, Homo Sapiens
LEYGVPVTLI

SEQ ID NO: 117318 - protein, 10 aa, Homo Sapiens
LEYPDFYRKL

SEQ ID NO: 117319 - protein, 10 aa, Homo Sapiens
LEYTQILQTV

SEQ ID NO: 117320 - protein, 10 aa, Homo Sapiens
LNATCKVNLL

SEQ ID NO: 117321 - protein, 10 aa, Homo Sapiens
LSHGSSTFSL

SEQ ID NO: 117322 - protein, 10 aa, Homo Sapiens
MEADARSIYV

SEQ ID NO: 117323 - protein, 10 aa, Homo Sapiens
MEEGSIGRFI

SEQ ID NO: 117324 - protein, 10 aa, Homo Sapiens
MEHPYFYTVV

SEQ ID NO: 117325 - protein, 10 aa, Homo Sapiens
MEIQVNGGTV

SEQ ID NO: 117326 - protein, 10 aa, Homo Sapiens
MERNADKLTV

SEQ ID NO: 117327 - protein, 10 aa, Homo Sapiens
MEVELPYRYI

SEQ ID NO: 117328 - protein, 10 aa, Homo Sapiens
MEVKPSSVTA

SEQ ID NO: 117329 - protein, 10 aa, Homo Sapiens
MEYKGYLVSV

SEQ ID NO: 117330 - protein, 10 aa, Homo Sapiens
MEYLEGNNFV

SEQ ID NO: 117331 - protein, 10 aa, Homo Sapiens
MPASKQAVTV

SEQ ID NO: 117332 - protein, 10 aa, Homo Sapiens
NESELFGRTI

SEQ ID NO: 117333 - protein, 10 aa, Homo Sapiens
PEHDFSKISI

SEQ ID NO: 117334 - protein, 10 aa, Homo Sapiens
PEYDGRGVLI

SEQ ID NO: 117335 - protein, 10 aa, Homo Sapiens
PEYGGFTSYI

SEQ ID NO: 117336 - protein, 10 aa, Homo Sapiens
QEAEARFREI

SEQ ID NO: 117337 - protein, 10 aa, Homo Sapiens
QEAEMAQNAV

SEQ ID NO: 117338 - protein, 10 aa, Homo Sapiens
QEAEQLKNQI

SEQ ID NO: 117339 - protein, 10 aa, Homo Sapiens
QEAEQLRNQI

SEQ ID NO: 117340 - protein, 10 aa, Homo Sapiens
QEALNLFKSI

SEQ ID NO: 117341 - protein, 10 aa, Homo Sapiens
QEENITRALI

SEQ ID NO: 117342 - protein, 10 aa, Homo Sapiens
QEFAGRLNSV

SEQ ID NO: 117343 - protein, 10 aa, Homo Sapiens
QEFELPYVSV

SEQ ID NO: 117344 - protein, 10 aa, Homo Sapiens
QEFKEAFNMI

SEQ ID NO: 117345 - protein, 10 aa, Homo Sapiens
QEHKAEIITV

SEQ ID NO: 117346 - protein, 10 aa, Homo Sapiens
QEIASLDVKI

SEQ ID NO: 117347 - protein, 10 aa, Homo Sapiens
QEIATLDNKI

SEQ ID NO: 117348 - protein, 10 aa, Homo Sapiens
QEIDGRFTSI

SEQ ID NO: 117349 - protein, 10 aa, Homo Sapiens
QEIEVRPGIV

SEQ ID NO: 117350 - protein, 10 aa, Homo Sapiens
QEIKDLKQKI

SEQ ID NO: 117351 - protein, 10 aa, Homo Sapiens
QEINVEAKHV

SEQ ID NO: 117352 - protein, 10 aa, Homo Sapiens
QEIPDLSSNV

SEQ ID NO: 117353 - protein, 10 aa, Homo Sapiens
QEIPFRLREI

SEQ ID NO: 117354 - protein, 10 aa, Homo Sapiens
QEIQEGQINI

SEQ ID NO: 117355 - protein, 10 aa, Homo Sapiens
QEIRSQIVSV

SEQ ID NO: 117356 - protein, 10 aa, Homo Sapiens
QELDMKQRTI

SEQ ID NO: 117357 - protein, 10 aa, Homo Sapiens
QELGEARATV

SEQ ID NO: 117358 - protein, 10 aa, Homo Sapiens
QELQAKIEAL

SEQ ID NO: 117359 - protein, 10 aa, Homo Sapiens
QELQAKLAEI

SEQ ID NO: 117360 - protein, 10 aa, Homo Sapiens
QEMEKMTKKI

SEQ ID NO: 117361 - protein, 10 aa, Homo Sapiens
QEMKSRILVI

SEQ ID NO: 117362 - protein, 10 aa, Homo Sapiens
QEMPVQFQVV

SEQ ID NO: 117363 - protein, 10 aa, Homo Sapiens
QENPFLFSTI

SEQ ID NO: 117364 - protein, 10 aa, Homo Sapiens
QENPGPWGEL

SEQ ID NO: 117365 - protein, 10 aa, Homo Sapiens
QEQDPTNLYI

SEQ ID NO: 117366 - protein, 10 aa, Homo Sapiens
QERIDAWAQL

SEQ ID NO: 117367 - protein, 10 aa, Homo Sapiens
QEVAVKEQLT

SEQ ID NO: 117368 - protein, 10 aa, Homo Sapiens
QEVFEKATFI

SEQ ID NO: 117369 - protein, 10 aa, Homo Sapiens
QEVNSALSKI

SEQ ID NO: 117370 - protein, 10 aa, Homo Sapiens
QEVYIPFSAI

SEQ ID NO: 117371 - protein, 10 aa, Homo Sapiens
QEWDGKESTI

SEQ ID NO: 117372 - protein, 10 aa, Homo Sapiens
QEWDKYCHYV

SEQ ID NO: 117373 - protein, 10 aa, Homo Sapiens
QEYDALAKVI

SEQ ID NO: 117374 - protein, 10 aa, Homo Sapiens
QEYLGKFRRL

SEQ ID NO: 117375 - protein, 10 aa, Homo Sapiens
QEYLPSQITI

SEQ ID NO: 117376 - protein, 10 aa, Homo Sapiens
QEYNVGGKVI

SEQ ID NO: 117377 - protein, 10 aa, Homo Sapiens
QEYQEKGVRV

SEQ ID NO: 117378 - protein, 10 aa, Homo Sapiens
REAEDMVQKV

SEQ ID NO: 117379 - protein, 10 aa, Homo Sapiens
REAEFTKSIA

SEQ ID NO: 117380 - protein, 10 aa, Homo Sapiens
REAEHLYHTL

SEQ ID NO: 117381 - protein, 10 aa, Homo Sapiens
REAEMRNSIL

SEQ ID NO: 117382 - protein, 10 aa, Homo Sapiens
REDEFHISVI

SEQ ID NO: 117383 - protein, 10 aa, Homo Sapiens
REDGSHILTV

SEQ ID NO: 117384 - protein, 10 aa, Homo Sapiens
REDLNQVITI

SEQ ID NO: 117385 - protein, 10 aa, Homo Sapiens
REDPKEGIKI

SEQ ID NO: 117386 - protein, 10 aa, Homo Sapiens
REDVNRNVYV

SEQ ID NO: 117387 - protein, 10 aa, Homo Sapiens
REDWKPVLTI

SEQ ID NO: 117388 - protein, 10 aa, Homo Sapiens
REEDAEKAVI

SEQ ID NO: 117389 - protein, 10 aa, Homo Sapiens
REEEHKPVAV

SEQ ID NO: 117390 - protein, 10 aa, Homo Sapiens
REESGARINI

SEQ ID NO: 117391 - protein, 10 aa, Homo Sapiens
REFDAFVETL

SEQ ID NO: 117392 - protein, 10 aa, Homo Sapiens
REFDDPGQQV

SEQ ID NO: 117393 - protein, 10 aa, Homo Sapiens
REFDKRFTSV

SEQ ID NO: 117394 - protein, 10 aa, Homo Sapiens
REFEKMNQSL

SEQ ID NO: 117395 - protein, 10 aa, Homo Sapiens
REFGNLHNTV

SEQ ID NO: 117396 - protein, 10 aa, Homo Sapiens
REFKGAVREI

SEQ ID NO: 117397 - protein, 10 aa, Homo Sapiens
REFLLGFQFI

SEQ ID NO: 117398 - protein, 10 aa, Homo Sapiens
REFSDFIQAV

SEQ ID NO: 117399 - protein, 10 aa, Homo Sapiens
REGKIAGRAV

SEQ ID NO: 117400 - protein, 10 aa, Homo Sapiens
REHANKLIEV

SEQ ID NO: 117401 - protein, 10 aa, Homo Sapiens
REHEHVVECI

SEQ ID NO: 117402 - protein, 10 aa, Homo Sapiens
REHEQFQHAI

SEQ ID NO: 117403 - protein, 10 aa, Homo Sapiens
REIDKKMNSI

SEQ ID NO: 117404 - protein, 10 aa, Homo Sapiens
REIEATNAVL

SEQ ID NO: 117405 - protein, 10 aa, Homo Sapiens
REIEENQKRI

SEQ ID NO: 117406 - protein, 10 aa, Homo Sapiens
REIEGRAIRL

SEQ ID NO: 117407 - protein, 10 aa, Homo Sapiens
REIEHLSRLY

SEQ ID NO: 117408 - protein, 10 aa, Homo Sapiens
REIENEDMRV

SEQ ID NO: 117409 - protein, 10 aa, Homo Sapiens
REIFLSQPIL

SEQ ID NO: 117410 - protein, 10 aa, Homo Sapiens
REILTLLQGV

SEQ ID NO: 117411 - protein, 10 aa, Homo Sapiens
REIMGTPEYV

SEQ ID NO: 117412 - protein, 10 aa, Homo Sapiens
REINPAPYTI

SEQ ID NO: 117413 - protein, 10 aa, Homo Sapiens
REIQEREMKV

SEQ ID NO: 117414 - protein, 10 aa, Homo Sapiens
REIQQRVVRV

SEQ ID NO: 117415 - protein, 10 aa, Homo Sapiens
REISDGLVEI

SEQ ID NO: 117416 - protein, 10 aa, Homo Sapiens
REIVLSYSYI

SEQ ID NO: 117417 - protein, 10 aa, Homo Sapiens
REIVSGMKYI

SEQ ID NO: 117418 - protein, 10 aa, Homo Sapiens
REIYDIISMV

SEQ ID NO: 117419 - protein, 10 aa, Homo Sapiens
REKELAKVTI

SEQ ID NO: 117420 - protein, 10 aa, Homo Sapiens
REKLPSSEVV

SEQ ID NO: 117421 - protein, 10 aa, Homo Sapiens
RELAQQIQKV

SEQ ID NO: 117422 - protein, 10 aa, Homo Sapiens
RELDLQRNYI

SEQ ID NO: 117423 - protein, 10 aa, Homo Sapiens
RELDLRGYKI

SEQ ID NO: 117424 - protein, 10 aa, Homo Sapiens
RELDLYDNQI

SEQ ID NO: 117425 - protein, 10 aa, Homo Sapiens
RELDVSYVLV

SEQ ID NO: 117426 - protein, 10 aa, Homo Sapiens
RELENGNLEV

SEQ ID NO: 117427 - protein, 10 aa, Homo Sapiens
RELEQYGQCV

SEQ ID NO: 117428 - protein, 10 aa, Homo Sapiens
RELLPSFHEV

SEQ ID NO: 117429 - protein, 10 aa, Homo Sapiens
RELPAGINSI

SEQ ID NO: 117430 - protein, 10 aa, Homo Sapiens
RELQPGVKAV

SEQ ID NO: 117431 - protein, 10 aa, Homo Sapiens
RELVSGGRSV

SEQ ID NO: 117432 - protein, 10 aa, Homo Sapiens
REMENIIATV

SEQ ID NO: 117433 - protein, 10 aa, Homo Sapiens
REMEQKHSTI

SEQ ID NO: 117434 - protein, 10 aa, Homo Sapiens
REMPLLKSEV

SEQ ID NO: 117435 - protein, 10 aa, Homo Sapiens
REMQSVVQLI

SEQ ID NO: 117436 - protein, 10 aa, Homo Sapiens
RENGKTVIRV

SEQ ID NO: 117437 - protein, 10 aa, Homo Sapiens
RENPQLLQQI

SEQ ID NO: 117438 - protein, 10 aa, Homo Sapiens
REPDTEVITV

SEQ ID NO: 117439 - protein, 10 aa, Homo Sapiens
REPEKRPPTV

SEQ ID NO: 117440 - protein, 10 aa, Homo Sapiens
REPERIPVTV

SEQ ID NO: 117441 - protein, 10 aa, Homo Sapiens
REPQLPTAEI

SEQ ID NO: 117442 - protein, 10 aa, Homo Sapiens
REQPYYLNLI

SEQ ID NO: 117443 - protein, 10 aa, Homo Sapiens
RERHQVIQTV

SEQ ID NO: 117444 - protein, 10 aa, Homo Sapiens
RESTGAQVQV

SEQ ID NO: 117445 - protein, 10 aa, Homo Sapiens
RETADVIAKV

SEQ ID NO: 117446 - protein, 10 aa, Homo Sapiens
RETDFYLQSV

SEQ ID NO: 117447 - protein, 10 aa, Homo Sapiens
RETSHVTMVV

SEQ ID NO: 117448 - protein, 10 aa, Homo Sapiens
REVDDLGPEV

SEQ ID NO: 117449 - protein, 10 aa, Homo Sapiens
REVEVEYSTV

SEQ ID NO: 117450 - protein, 10 aa, Homo Sapiens
REVPEYLNHV

SEQ ID NO: 117451 - protein, 10 aa, Homo Sapiens
REVQAEIGKL

SEQ ID NO: 117452 - protein, 10 aa, Homo Sapiens
REVSVELAKV

SEQ ID NO: 117453 - protein, 10 aa, Homo Sapiens
REVTSPNSTV

SEQ ID NO: 117454 - protein, 10 aa, Homo Sapiens
REWEAQDMRV

SEQ ID NO: 117455 - protein, 10 aa, Homo Sapiens
REWYSAKITI

SEQ ID NO: 117456 - protein, 10 aa, Homo Sapiens
REYDTSKIEA

SEQ ID NO: 117457 - protein, 10 aa, Homo Sapiens
REYEKRVSAI

SEQ ID NO: 117458 - protein, 10 aa, Homo Sapiens
REYELRKNNF

SEQ ID NO: 117459 - protein, 10 aa, Homo Sapiens
REYHSVGVQV

SEQ ID NO: 117460 - protein, 10 aa, Homo Sapiens
REYIDRMIKI

SEQ ID NO: 117461 - protein, 10 aa, Homo Sapiens
REYPNLVTIY

SEQ ID NO: 117462 - protein, 10 aa, Homo Sapiens
REYTSRESKI

SEQ ID NO: 117463 - protein, 10 aa, Homo Sapiens
RKFVGNLELI

SEQ ID NO: 117464 - protein, 10 aa, Homo Sapiens
SEAAPLLVHV

SEQ ID NO: 117465 - protein, 10 aa, Homo Sapiens
SEAEPTLTHM

SEQ ID NO: 117466 - protein, 10 aa, Homo Sapiens
SEASPSREAI

SEQ ID NO: 117467 - protein, 10 aa, Homo Sapiens
SEASYLITSV

SEQ ID NO: 117468 - protein, 10 aa, Homo Sapiens
SECEQLVKEV

SEQ ID NO: 117469 - protein, 10 aa, Homo Sapiens
SECPWLGIRI

SEQ ID NO: 117470 - protein, 10 aa, Homo Sapiens
SEDGRSPISI

SEQ ID NO: 117471 - protein, 10 aa, Homo Sapiens
SEDHRRHIEI

SEQ ID NO: 117472 - protein, 10 aa, Homo Sapiens
SEDKEMVTTV

SEQ ID NO: 117473 - protein, 10 aa, Homo Sapiens
SEDQRQVISV

SEQ ID NO: 117474 - protein, 10 aa, Homo Sapiens
SEDRPTGLVV

SEQ ID NO: 117475 - protein, 10 aa, Homo Sapiens
SEFDFSWSKI

SEQ ID NO: 117476 - protein, 10 aa, Homo Sapiens
SEFEGGKSTV

SEQ ID NO: 117477 - protein, 10 aa, Homo Sapiens
SEFENFKTKM

SEQ ID NO: 117478 - protein, 10 aa, Homo Sapiens
SEFHKHYARI

SEQ ID NO: 117479 - protein, 10 aa, Homo Sapiens
SEFIDLSEKI

SEQ ID NO: 117480 - protein, 10 aa, Homo Sapiens
SEFKEFSQSF

SEQ ID NO: 117481 - protein, 10 aa, Homo Sapiens
SEFNFDLHTV

SEQ ID NO: 117482 - protein, 10 aa, Homo Sapiens
SEFQKAVKLV

SEQ ID NO: 117483 - protein, 10 aa, Homo Sapiens
SEFTGVWKYI

SEQ ID NO: 117484 - protein, 10 aa, Homo Sapiens
SEFVFNNPNI

SEQ ID NO: 117485 - protein, 10 aa, Homo Sapiens
SEFYKNLTSI

SEQ ID NO: 117486 - protein, 10 aa, Homo Sapiens
SEGSVSTKQI

SEQ ID NO: 117487 - protein, 10 aa, Homo Sapiens
SEHLAFERQV

SEQ ID NO: 117488 - protein, 10 aa, Homo Sapiens
SEHPNVTLTI

SEQ ID NO: 117489 - protein, 10 aa, Homo Sapiens
SEHSGPPIVI

SEQ ID NO: 117490 - protein, 10 aa, Homo Sapiens
SEIATTGVRV

SEQ ID NO: 117491 - protein, 10 aa, Homo Sapiens
SEIDQLFRIF

SEQ ID NO: 117492 - protein, 10 aa, Homo Sapiens
SEIEAKVRYV

SEQ ID NO: 117493 - protein, 10 aa, Homo Sapiens
SEIESKAPTV

SEQ ID NO: 117494 - protein, 10 aa, Homo Sapiens
SEIGGLSEQI

SEQ ID NO: 117495 - protein, 10 aa, Homo Sapiens
SEIHPGMLLI

SEQ ID NO: 117496 - protein, 10 aa, Homo Sapiens
SEILERLQKI

SEQ ID NO: 117497 - protein, 10 aa, Homo Sapiens
SEILIPLQSV

SEQ ID NO: 117498 - protein, 10 aa, Homo Sapiens
SEILKNLSQV

SEQ ID NO: 117499 - protein, 10 aa, Homo Sapiens
SEINLPGNCV

SEQ ID NO: 117500 - protein, 10 aa, Homo Sapiens
SEIPLTLHSV

SEQ ID NO: 117501 - protein, 10 aa, Homo Sapiens
SEIRAPIVTV

SEQ ID NO: 117502 - protein, 10 aa, Homo Sapiens
SEISDEFKVV

SEQ ID NO: 117503 - protein, 10 aa, Homo Sapiens
SEIVQNGRLI

SEQ ID NO: 117504 - protein, 10 aa, Homo Sapiens
SEKDAVSREI

SEQ ID NO: 117505 - protein, 10 aa, Homo Sapiens
SEKGASSPLI

SEQ ID NO: 117506 - protein, 10 aa, Homo Sapiens
SELANKLITV

SEQ ID NO: 117507 - protein, 10 aa, Homo Sapiens
SELEKKLVAI

SEQ ID NO: 117508 - protein, 10 aa, Homo Sapiens
SELGYVFQAI

SEQ ID NO: 117509 - protein, 10 aa, Homo Sapiens
SELRSICTTV

SEQ ID NO: 117510 - protein, 10 aa, Homo Sapiens
SELVSNGVQI

SEQ ID NO: 117511 - protein, 10 aa, Homo Sapiens
SEMDSVLMKI

SEQ ID NO: 117512 - protein, 10 aa, Homo Sapiens
SENELFGATI

SEQ ID NO: 117513 - protein, 10 aa, Homo Sapiens
SENPLPTVEI

SEQ ID NO: 117514 - protein, 10 aa, Homo Sapiens
SENQESFRTI

SEQ ID NO: 117515 - protein, 10 aa, Homo Sapiens
SENSYVSPRI

SEQ ID NO: 117516 - protein, 10 aa, Homo Sapiens
SEQPLPNKTI

SEQ ID NO: 117517 - protein, 10 aa, Homo Sapiens
SERDLQELSI

SEQ ID NO: 117518 - protein, 10 aa, Homo Sapiens
SERKTKFAKV

SEQ ID NO: 117519 - protein, 10 aa, Homo Sapiens
SESEAKSVKV

SEQ ID NO: 117520 - protein, 10 aa, Homo Sapiens
SESLLRGIYA

SEQ ID NO: 117521 - protein, 10 aa, Homo Sapiens
SESRPLPRVH

SEQ ID NO: 117522 - protein, 10 aa, Homo Sapiens
SESRYPQALV

SEQ ID NO: 117523 - protein, 10 aa, Homo Sapiens
SETGALKTFI

SEQ ID NO: 117524 - protein, 10 aa, Homo Sapiens
SEVANAGIKL

SEQ ID NO: 117525 - protein, 10 aa, Homo Sapiens
SEVGVGGAQV

SEQ ID NO: 117526 - protein, 10 aa, Homo Sapiens
SEVNLKLQNI

SEQ ID NO: 117527 - protein, 10 aa, Homo Sapiens
SEVPVITPYL

SEQ ID NO: 117528 - protein, 10 aa, Homo Sapiens
SEWERFISKV

SEQ ID NO: 117529 - protein, 10 aa, Homo Sapiens
SEYEATNLLI

SEQ ID NO: 117530 - protein, 10 aa, Homo Sapiens
SEYHAAFNSM

SEQ ID NO: 117531 - protein, 10 aa, Homo Sapiens
SEYHRIQHQL

SEQ ID NO: 117532 - protein, 10 aa, Homo Sapiens
SEYITHEITV

SEQ ID NO: 117533 - protein, 10 aa, Homo Sapiens
SEYLSQNPRV

SEQ ID NO: 117534 - protein, 10 aa, Homo Sapiens
SEYNVTNNSV

SEQ ID NO: 117535 - protein, 10 aa, Homo Sapiens
SEYPIVDGKL

SEQ ID NO: 117536 - protein, 10 aa, Homo Sapiens
SEYVEKFYRI

SEQ ID NO: 117537 - protein, 10 aa, Homo Sapiens
SEYVRNQQTI

SEQ ID NO: 117538 - protein, 10 aa, Homo Sapiens
SMDNNRSLDL

SEQ ID NO: 117539 - protein, 10 aa, Homo Sapiens
STLANVVTSL

SEQ ID NO: 117540 - protein, 10 aa, Homo Sapiens
TAKAAPLPSV

SEQ ID NO: 117541 - protein, 10 aa, Homo Sapiens
TEAEVRGLCI

SEQ ID NO: 117542 - protein, 10 aa, Homo Sapiens
TEAQYKFIYV

SEQ ID NO: 117543 - protein, 10 aa, Homo Sapiens
TEDGDSFLHL

SEQ ID NO: 117544 - protein, 10 aa, Homo Sapiens
TEFEERSATI

SEQ ID NO: 117545 - protein, 10 aa, Homo Sapiens
TEFQGKRMHV

SEQ ID NO: 117546 - protein, 10 aa, Homo Sapiens
TEGPETKPVL

SEQ ID NO: 117547 - protein, 10 aa, Homo Sapiens
TEHKALTSEI

SEQ ID NO: 117548 - protein, 10 aa, Homo Sapiens
TEHSGLTTGV

SEQ ID NO: 117549 - protein, 10 aa, Homo Sapiens
TEHVEAFITI

SEQ ID NO: 117550 - protein, 10 aa, Homo Sapiens
TEIAKRLNTI

SEQ ID NO: 117551 - protein, 10 aa, Homo Sapiens
TEIEDSHTLV

SEQ ID NO: 117552 - protein, 10 aa, Homo Sapiens
TEIESDLRSV

SEQ ID NO: 117553 - protein, 10 aa, Homo Sapiens
TEIGPMSCFI

SEQ ID NO: 117554 - protein, 10 aa, Homo Sapiens
TEIGQKHGLV

SEQ ID NO: 117555 - protein, 10 aa, Homo Sapiens
TEINQHPVTV

SEQ ID NO: 117556 - protein, 10 aa, Homo Sapiens
TEIPLQLVTV

SEQ ID NO: 117557 - protein, 10 aa, Homo Sapiens
TEIREIITSI

SEQ ID NO: 117558 - protein, 10 aa, Homo Sapiens
TEIREKLAKM

SEQ ID NO: 117559 - protein, 10 aa, Homo Sapiens
TELKEKLRSI

SEQ ID NO: 117560 - protein, 10 aa, Homo Sapiens
TELMNILNKV

SEQ ID NO: 117561 - protein, 10 aa, Homo Sapiens
TELQRAWATI

SEQ ID NO: 117562 - protein, 10 aa, Homo Sapiens
TEMESMKTTL

SEQ ID NO: 117563 - protein, 10 aa, Homo Sapiens
TEMQQILTRV

SEQ ID NO: 117564 - protein, 10 aa, Homo Sapiens
TENPGKSISV

SEQ ID NO: 117565 - protein, 10 aa, Homo Sapiens
TENPHGVKAV

SEQ ID NO: 117566 - protein, 10 aa, Homo Sapiens
TEPDEAFRQI

SEQ ID NO: 117567 - protein, 10 aa, Homo Sapiens
TEPYFNFTSI

SEQ ID NO: 117568 - protein, 10 aa, Homo Sapiens
TEQGGAHFSV

SEQ ID NO: 117569 - protein, 10 aa, Homo Sapiens
TEQQQRFHEI

SEQ ID NO: 117570 - protein, 10 aa, Homo Sapiens
TESSTAGLKV

SEQ ID NO: 117571 - protein, 10 aa, Homo Sapiens
TEVEKIKTTV

SEQ ID NO: 117572 - protein, 10 aa, Homo Sapiens
TEYDCKGFHI

SEQ ID NO: 117573 - protein, 10 aa, Homo Sapiens
TEYENFKVQV

SEQ ID NO: 117574 - protein, 10 aa, Homo Sapiens
TEYGVHFHRV

SEQ ID NO: 117575 - protein, 10 aa, Homo Sapiens
VEAELKSSTV

SEQ ID NO: 117576 - protein, 10 aa, Homo Sapiens
VECQSHRLTV

SEQ ID NO: 117577 - protein, 10 aa, Homo Sapiens
VEDDARGTVV

SEQ ID NO: 117578 - protein, 10 aa, Homo Sapiens
VEDDSRALNI

SEQ ID NO: 117579 - protein, 10 aa, Homo Sapiens
VEDEHSTLLI

SEQ ID NO: 117580 - protein, 10 aa, Homo Sapiens
VEDGPREILI

SEQ ID NO: 117581 - protein, 10 aa, Homo Sapiens
VEFAKQLATV

SEQ ID NO: 117582 - protein, 10 aa, Homo Sapiens
VEFRNFKIIY

SEQ ID NO: 117583 - protein, 10 aa, Homo Sapiens
VEGHGVNPSV

SEQ ID NO: 117584 - protein, 10 aa, Homo Sapiens
VEGRDVVALI

SEQ ID NO: 117585 - protein, 10 aa, Homo Sapiens
VEHQNGKVVV

SEQ ID NO: 117586 - protein, 10 aa, Homo Sapiens
VEIAKQSVTI

SEQ ID NO: 117587 - protein, 10 aa, Homo Sapiens
VEIDNKNKTI

SEQ ID NO: 117588 - protein, 10 aa, Homo Sapiens
VEISLPLSTV

SEQ ID NO: 117589 - protein, 10 aa, Homo Sapiens
VEITPTSSRI

SEQ ID NO: 117590 - protein, 10 aa, Homo Sapiens
VEIVGGATRI

SEQ ID NO: 117591 - protein, 10 aa, Homo Sapiens
VELDPSKVEV

SEQ ID NO: 117592 - protein, 10 aa, Homo Sapiens
VENPSARITI

SEQ ID NO: 117593 - protein, 10 aa, Homo Sapiens
VEQVHRGTTI

SEQ ID NO: 117594 - protein, 10 aa, Homo Sapiens
VERIWGDCTV

SEQ ID NO: 117595 - protein, 10 aa, Homo Sapiens
VESGDLQKEI

SEQ ID NO: 117596 - protein, 10 aa, Homo Sapiens
VETDGFISYI

SEQ ID NO: 117597 - protein, 10 aa, Homo Sapiens
VETQSGKTVI

SEQ ID NO: 117598 - protein, 10 aa, Homo Sapiens
VEVLPTETEI

SEQ ID NO: 117599 - protein, 10 aa, Homo Sapiens
VEWDPTGRYV

SEQ ID NO: 117600 - protein, 10 aa, Homo Sapiens
VEYETKAGRI

SEQ ID NO: 117601 - protein, 10 aa, Homo Sapiens
VEYTEKMVSI

SEQ ID NO: 117602 - protein, 10 aa, Homo Sapiens
VQLIRESLKV

SEQ ID NO: 117603 - protein, 10 aa, Homo Sapiens
VVPPFLQPEV

SEQ ID NO: 117604 - protein, 10 aa, Homo Sapiens
WEAYLSRLGV

SEQ ID NO: 117605 - protein, 10 aa, Homo Sapiens
WEDEGVRACY

SEQ ID NO: 117606 - protein, 10 aa, Homo Sapiens
WEMDNMLIQI

SEQ ID NO: 117607 - protein, 10 aa, Homo Sapiens
WESEPHPYVF

SEQ ID NO: 117608 - protein, 10 aa, Homo Sapiens
YEATTGNLHV

SEQ ID NO: 117609 - protein, 10 aa, Homo Sapiens
YEDGAFGIRI

SEQ ID NO: 117610 - protein, 10 aa, Homo Sapiens
YEEDAIVRMI

SEQ ID NO: 117611 - protein, 10 aa, Homo Sapiens
YEEDQGSKLI

SEQ ID NO: 117612 - protein, 10 aa, Homo Sapiens
YEETRGVLKV

SEQ ID NO: 117613 - protein, 10 aa, Homo Sapiens
YEFFAKRQLV

SEQ ID NO: 117614 - protein, 10 aa, Homo Sapiens
YEHDDIVSTV

SEQ ID NO: 117615 - protein, 10 aa, Homo Sapiens
YEIQKGQALI

SEQ ID NO: 117616 - protein, 10 aa, Homo Sapiens
YELDHPGFQI

SEQ ID NO: 117617 - protein, 10 aa, Homo Sapiens
YELDLGLNHV

SEQ ID NO: 117618 - protein, 10 aa, Homo Sapiens
YELLFKEGVM

SEQ ID NO: 117619 - protein, 10 aa, Homo Sapiens
YEVLDHCSSI

SEQ ID NO: 117620 - protein, 10 aa, Homo Sapiens
YEYADERLRI

SEQ ID NO: 117621 - protein, 10 aa, Homo Sapiens
YEYASKGIFV

SEQ ID NO: 117622 - protein, 10 aa, Homo Sapiens
YEYEGGHIKT

SEQ ID NO: 117623 - protein, 10 aa, Homo Sapiens
YGIYNVTMVV

SEQ ID NO: 117624 - protein, 11 aa, Homo Sapiens
AEAADVGAQMI

SEQ ID NO: 117625 - protein, 11 aa, Homo Sapiens
AEADQGLCRQI

SEQ ID NO: 117626 - protein, 11 aa, Homo Sapiens
AEAERVGLHKV

SEQ ID NO: 117627 - protein, 11 aa, Homo Sapiens
AEAVASLATRI

SEQ ID NO: 117628 - protein, 11 aa, Homo Sapiens
AEDDNIYQQKI

SEQ ID NO: 117629 - protein, 11 aa, Homo Sapiens
AEDEGTQRLTC

SEQ ID NO: 117630 - protein, 11 aa, Homo Sapiens
AEDGGLKKCKI

SEQ ID NO: 117631 - protein, 11 aa, Homo Sapiens
AEDGTTSKYFV

SEQ ID NO: 117632 - protein, 11 aa, Homo Sapiens
AEEESLKERLI

SEQ ID NO: 117633 - protein, 11 aa, Homo Sapiens
AEEPAASGRII

SEQ ID NO: 117634 - protein, 11 aa, Homo Sapiens
AEFEWENKVTV

SEQ ID NO: 117635 - protein, 11 aa, Homo Sapiens
AEFGAAGVNRL

SEQ ID NO: 117636 - protein, 11 aa, Homo Sapiens
AEFGPDSGGRV

SEQ ID NO: 117637 - protein, 11 aa, Homo Sapiens
AEFLIGQGAHV

SEQ ID NO: 117638 - protein, 11 aa, Homo Sapiens
AEFPMSPVTSV

SEQ ID NO: 117639 - protein, 11 aa, Homo Sapiens
AEFQTDSQGKI

SEQ ID NO: 117640 - protein, 11 aa, Homo Sapiens
AEFVPLIMNTI

SEQ ID NO: 117641 - protein, 11 aa, Homo Sapiens
AEFWDGKIVLV

SEQ ID NO: 117642 - protein, 11 aa, Homo Sapiens
AEGQGQGQLLI

SEQ ID NO: 117643 - protein, 11 aa, Homo Sapiens
AEHHKDICLTV

SEQ ID NO: 117644 - protein, 11 aa, Homo Sapiens
AEIDPKQLVDI

SEQ ID NO: 117645 - protein, 11 aa, Homo Sapiens
AEIDSIHQLVV

SEQ ID NO: 117646 - protein, 11 aa, Homo Sapiens
AEIEEDKARRI

SEQ ID NO: 117647 - protein, 11 aa, Homo Sapiens
AEIEETYANFI

SEQ ID NO: 117648 - protein, 11 aa, Homo Sapiens
AEIGADGIAVI

SEQ ID NO: 117649 - protein, 11 aa, Homo Sapiens
AEINSRTGSKL

SEQ ID NO: 117650 - protein, 11 aa, Homo Sapiens
AEIQHAEEFLI

SEQ ID NO: 117651 - protein, 11 aa, Homo Sapiens
AEISSKSPVAV

SEQ ID NO: 117652 - protein, 11 aa, Homo Sapiens
AEISSNSLERI

SEQ ID NO: 117653 - protein, 11 aa, Homo Sapiens
AELRPDSPAHV

SEQ ID NO: 117654 - protein, 11 aa, Homo Sapiens
AENPFQEPRTV

SEQ ID NO: 117655 - protein, 11 aa, Homo Sapiens
AENSLLAKVFI

SEQ ID NO: 117656 - protein, 11 aa, Homo Sapiens
AESEGLSLLNV

SEQ ID NO: 117657 - protein, 11 aa, Homo Sapiens
AESRQPSENSV

SEQ ID NO: 117658 - protein, 11 aa, Homo Sapiens
AESTLPGRHTV

SEQ ID NO: 117659 - protein, 11 aa, Homo Sapiens
AETGLLGAHFV

SEQ ID NO: 117660 - protein, 11 aa, Homo Sapiens
AEVDASVVREI

SEQ ID NO: 117661 - protein, 11 aa, Homo Sapiens
AEVEQNGGLFI

SEQ ID NO: 117662 - protein, 11 aa, Homo Sapiens
AEWDKSGVVTV

SEQ ID NO: 117663 - protein, 11 aa, Homo Sapiens
AEWEESQTQKI

SEQ ID NO: 117664 - protein, 11 aa, Homo Sapiens
AEWVRAGATTV

SEQ ID NO: 117665 - protein, 11 aa, Homo Sapiens
AEYAHPLETLI

SEQ ID NO: 117666 - protein, 11 aa, Homo Sapiens
AEYANYYTREV

SEQ ID NO: 117667 - protein, 11 aa, Homo Sapiens
AEYEKTIAQMI

SEQ ID NO: 117668 - protein, 11 aa, Homo Sapiens
AEYFPTKPMFV

SEQ ID NO: 117669 - protein, 11 aa, Homo Sapiens
AEYGHFVDIRI

SEQ ID NO: 117670 - protein, 11 aa, Homo Sapiens
DKGEFGGFGSV

SEQ ID NO: 117671 - protein, 11 aa, Homo Sapiens
EAHYLSYLNNL

SEQ ID NO: 117672 - protein, 11 aa, Homo Sapiens
FEAHSDYIRCI

SEQ ID NO: 117673 - protein, 11 aa, Homo Sapiens
FEELTNLIRTI

SEQ ID NO: 117674 - protein, 11 aa, Homo Sapiens
FEHFIEGGRTV

SEQ ID NO: 117675 - protein, 11 aa, Homo Sapiens
GEANAELCRYL

SEQ ID NO: 117676 - protein, 11 aa, Homo Sapiens
GEAPLHKAAKV

SEQ ID NO: 117677 - protein, 11 aa, Homo Sapiens
GEATCITEMSV

SEQ ID NO: 117678 - protein, 11 aa, Homo Sapiens
GECTPTQREVI

SEQ ID NO: 117679 - protein, 11 aa, Homo Sapiens
GEDPRVSINVV

SEQ ID NO: 117680 - protein, 11 aa, Homo Sapiens
GEDSVSGSQRI

SEQ ID NO: 117681 - protein, 11 aa, Homo Sapiens
GEFAWRDGPLL

SEQ ID NO: 117682 - protein, 11 aa, Homo Sapiens
GEFDYSGSQAI

SEQ ID NO: 117683 - protein, 11 aa, Homo Sapiens
GEFEPDGCLKI

SEQ ID NO: 117684 - protein, 11 aa, Homo Sapiens
GEFHPDGCLQI

SEQ ID NO: 117685 - protein, 11 aa, Homo Sapiens
GEFPDLHRTIV

SEQ ID NO: 117686 - protein, 11 aa, Homo Sapiens
GEFVDDYTVRV

SEQ ID NO: 117687 - protein, 11 aa, Homo Sapiens
GEHEIDYILLV

SEQ ID NO: 117688 - protein, 11 aa, Homo Sapiens
GEHGFIGCRKV

SEQ ID NO: 117689 - protein, 11 aa, Homo Sapiens
GEIDENSFHNI

SEQ ID NO: 117690 - protein, 11 aa, Homo Sapiens
GEIGFENHETV

SEQ ID NO: 117691 - protein, 11 aa, Homo Sapiens
GEIMQETGTRI

SEQ ID NO: 117692 - protein, 11 aa, Homo Sapiens
GEIPNFPRSTV

SEQ ID NO: 117693 - protein, 11 aa, Homo Sapiens
GEIRETSQTKV

SEQ ID NO: 117694 - protein, 11 aa, Homo Sapiens
GEISPGKINSV

SEQ ID NO: 117695 - protein, 11 aa, Homo Sapiens
GEIVGSQGSRL

SEQ ID NO: 117696 - protein, 11 aa, Homo Sapiens
GENPEDTKTQV

SEQ ID NO: 117697 - protein, 11 aa, Homo Sapiens
GENVFTGQSKI

SEQ ID NO: 117698 - protein, 11 aa, Homo Sapiens
GESDELIGQKV

SEQ ID NO: 117699 - protein, 11 aa, Homo Sapiens
GEYDVKYPALI

SEQ ID NO: 117700 - protein, 11 aa, Homo Sapiens
GEYEERKLIRA

SEQ ID NO: 117701 - protein, 11 aa, Homo Sapiens
GEYSSLEHESV

SEQ ID NO: 117702 - protein, 11 aa, Homo Sapiens
GGGVGKSALTI

SEQ ID NO: 117703 - protein, 11 aa, Homo Sapiens
HEKEDGAISTI

SEQ ID NO: 117704 - protein, 11 aa, Homo Sapiens
HEVDPEGDRTI

SEQ ID NO: 117705 - protein, 11 aa, Homo Sapiens
HEVMEQGRVTI

SEQ ID NO: 117706 - protein, 11 aa, Homo Sapiens
IEDPSLLNSRV

SEQ ID NO: 117707 - protein, 11 aa, Homo Sapiens
IEFQEPVPASI

SEQ ID NO: 117708 - protein, 11 aa, Homo Sapiens
IEIKNKKKLLI

SEQ ID NO: 117709 - protein, 11 aa, Homo Sapiens
IEQDTDTKITI

SEQ ID NO: 117710 - protein, 11 aa, Homo Sapiens
IEQVPQQPTYV

SEQ ID NO: 117711 - protein, 11 aa, Homo Sapiens
IESDRLALLQV

SEQ ID NO: 117712 - protein, 11 aa, Homo Sapiens
IESQDAGIKTI

SEQ ID NO: 117713 - protein, 11 aa, Homo Sapiens
IEYDPERRLGI

SEQ ID NO: 117714 - protein, 11 aa, Homo Sapiens
IVEKIDFDSVS

SEQ ID NO: 117715 - protein, 11 aa, Homo Sapiens
KDGSELILHFV

SEQ ID NO: 117716 - protein, 11 aa, Homo Sapiens
KECEYLIGQHV

SEQ ID NO: 117717 - protein, 11 aa, Homo Sapiens
KEDALVTKNLV

SEQ ID NO: 117718 - protein, 11 aa, Homo Sapiens
KEDENVPFLLV

SEQ ID NO: 117719 - protein, 11 aa, Homo Sapiens
KEDESIRKTEI

SEQ ID NO: 117720 - protein, 11 aa, Homo Sapiens
KEDPELAKSFI

SEQ ID NO: 117721 - protein, 11 aa, Homo Sapiens
KEFAPVYPIMV

SEQ ID NO: 117722 - protein, 11 aa, Homo Sapiens
KEFDGKSLVSV

SEQ ID NO: 117723 - protein, 11 aa, Homo Sapiens
KEFEGKTLVSV

SEQ ID NO: 117724 - protein, 11 aa, Homo Sapiens
KEFNFPEEAVL

SEQ ID NO: 117725 - protein, 11 aa, Homo Sapiens
KEFPGLAGVKI

SEQ ID NO: 117726 - protein, 11 aa, Homo Sapiens
KEIEHNLSKIM

SEQ ID NO: 117727 - protein, 11 aa, Homo Sapiens
KEIENGHIFTV

SEQ ID NO: 117728 - protein, 11 aa, Homo Sapiens
KEIPLSEILTV

SEQ ID NO: 117729 - protein, 11 aa, Homo Sapiens
KEISYFVAEFI

SEQ ID NO: 117730 - protein, 11 aa, Homo Sapiens
KELDPTNMTYI

SEQ ID NO: 117731 - protein, 11 aa, Homo Sapiens
KESSPLSSRKI

SEQ ID NO: 117732 - protein, 11 aa, Homo Sapiens
KEVDPQGLRTI

SEQ ID NO: 117733 - protein, 11 aa, Homo Sapiens
KEVTPEGLQMV

SEQ ID NO: 117734 - protein, 11 aa, Homo Sapiens
KEYEEDGARSI

SEQ ID NO: 117735 - protein, 11 aa, Homo Sapiens
KEYEPEMGKVI

SEQ ID NO: 117736 - protein, 11 aa, Homo Sapiens
LEDDPQGARKI

SEQ ID NO: 117737 - protein, 11 aa, Homo Sapiens
LEFIPSDQQVI

SEQ ID NO: 117738 - protein, 11 aa, Homo Sapiens
LEINPKLQTQV

SEQ ID NO: 117739 - protein, 11 aa, Homo Sapiens
LENDPDCRHVI

SEQ ID NO: 117740 - protein, 11 aa, Homo Sapiens
LEYDPAKRITL

SEQ ID NO: 117741 - protein, 11 aa, Homo Sapiens
LEYEPRSGEQV

SEQ ID NO: 117742 - protein, 11 aa, Homo Sapiens
LLAETAGMIGV

SEQ ID NO: 117743 - protein, 11 aa, Homo Sapiens
MEHDGSLFQAV

SEQ ID NO: 117744 - protein, 11 aa, Homo Sapiens
NECKQLSESQV

SEQ ID NO: 117745 - protein, 11 aa, Homo Sapiens
QEILFDPKTSV

SEQ ID NO: 117746 - protein, 11 aa, Homo Sapiens
QEILTKDSVTI

SEQ ID NO: 117747 - protein, 11 aa, Homo Sapiens
QELPSHGVPLI

SEQ ID NO: 117748 - protein, 11 aa, Homo Sapiens
QEMADSLGVRI

SEQ ID NO: 117749 - protein, 11 aa, Homo Sapiens
QERFQTEIQTV

SEQ ID NO: 117750 - protein, 11 aa, Homo Sapiens
QEVDPEGDRTI

SEQ ID NO: 117751 - protein, 11 aa, Homo Sapiens
QEVPASGLFRI

SEQ ID NO: 117752 - protein, 11 aa, Homo Sapiens
QEYIDAHPETI

SEQ ID NO: 117753 - protein, 11 aa, Homo Sapiens
RAQYESIAAKN

SEQ ID NO: 117754 - protein, 11 aa, Homo Sapiens
READAALFSEL

SEQ ID NO: 117755 - protein, 11 aa, Homo Sapiens
REAESLIAKKI

SEQ ID NO: 117756 - protein, 11 aa, Homo Sapiens
REAPVDVLTQI

SEQ ID NO: 117757 - protein, 11 aa, Homo Sapiens
RECPLFGLSGI

SEQ ID NO: 117758 - protein, 11 aa, Homo Sapiens
REDIEFICKTI

SEQ ID NO: 117759 - protein, 11 aa, Homo Sapiens
REDINSLCMTV

SEQ ID NO: 117760 - protein, 11 aa, Homo Sapiens
REDIYSSAKKV

SEQ ID NO: 117761 - protein, 11 aa, Homo Sapiens
REEPPGTFSVI

SEQ ID NO: 117762 - protein, 11 aa, Homo Sapiens
REFDRFGTIRT

SEQ ID NO: 117763 - protein, 11 aa, Homo Sapiens
REFEALRSCFA

SEQ ID NO: 117764 - protein, 11 aa, Homo Sapiens
REFLFNAIETM

SEQ ID NO: 117765 - protein, 11 aa, Homo Sapiens
REHQFTKIDTI

SEQ ID NO: 117766 - protein, 11 aa, Homo Sapiens
REIFLSQPILL

SEQ ID NO: 117767 - protein, 11 aa, Homo Sapiens
REIPSHVLSKV

SEQ ID NO: 117768 - protein, 11 aa, Homo Sapiens
REITDQEHNVV

SEQ ID NO: 117769 - protein, 11 aa, Homo Sapiens
REKEDGAFSFV

SEQ ID NO: 117770 - protein, 11 aa, Homo Sapiens
RELENLIGISC

SEQ ID NO: 117771 - protein, 11 aa, Homo Sapiens
RELGEFRTTTV

SEQ ID NO: 117772 - protein, 11 aa, Homo Sapiens
RELPAGINSIV

SEQ ID NO: 117773 - protein, 11 aa, Homo Sapiens
RERHPGSFDVV

SEQ ID NO: 117774 - protein, 11 aa, Homo Sapiens
REYDDQRALEI

SEQ ID NO: 117775 - protein, 11 aa, Homo Sapiens
REYEDNDEVHI

SEQ ID NO: 117776 - protein, 11 aa, Homo Sapiens
REYIEIITSSI

SEQ ID NO: 117777 - protein, 11 aa, Homo Sapiens
REYLSEEVQAV

SEQ ID NO: 117778 - protein, 11 aa, Homo Sapiens
REYPDGTVKTV

SEQ ID NO: 117779 - protein, 11 aa, Homo Sapiens
REYQDLLNVKM

SEQ ID NO: 117780 - protein, 11 aa, Homo Sapiens
REYSEFKRQQL

SEQ ID NO: 117781 - protein, 11 aa, Homo Sapiens
RQGVDADINGL

SEQ ID NO: 117782 - protein, 11 aa, Homo Sapiens
SEADPSGVASI

SEQ ID NO: 117783 - protein, 11 aa, Homo Sapiens
SEDKGALAKLV

SEQ ID NO: 117784 - protein, 11 aa, Homo Sapiens
SEFFTDLLNHI

SEQ ID NO: 117785 - protein, 11 aa, Homo Sapiens
SEHFRIDGPVI

SEQ ID NO: 117786 - protein, 11 aa, Homo Sapiens
SEIEEHLNCTI

SEQ ID NO: 117787 - protein, 11 aa, Homo Sapiens
SEIERMGLVMD

SEQ ID NO: 117788 - protein, 11 aa, Homo Sapiens
SEILDGNQLHI

SEQ ID NO: 117789 - protein, 11 aa, Homo Sapiens
SELDRINAQYL

SEQ ID NO: 117790 - protein, 11 aa, Homo Sapiens
SELNQKRPQYI

SEQ ID NO: 117791 - protein, 11 aa, Homo Sapiens
SETRSITNTTV

SEQ ID NO: 117792 - protein, 11 aa, Homo Sapiens
SEVFLPNSNHV

SEQ ID NO: 117793 - protein, 11 aa, Homo Sapiens
SEVSAENILTV

SEQ ID NO: 117794 - protein, 11 aa, Homo Sapiens
SEWDSSRTPII

SEQ ID NO: 117795 - protein, 11 aa, Homo Sapiens
SFEMVKGGYTL

SEQ ID NO: 117796 - protein, 11 aa, Homo Sapiens
TEDEVERVITI

SEQ ID NO: 117797 - protein, 11 aa, Homo Sapiens
TEDSGLQTQVI

SEQ ID NO: 117798 - protein, 11 aa, Homo Sapiens
TEFDYPSVGQV

SEQ ID NO: 117799 - protein, 11 aa, Homo Sapiens
TEFGGSIYQKV

SEQ ID NO: 117800 - protein, 11 aa, Homo Sapiens
TELDPASFTEI

SEQ ID NO: 117801 - protein, 11 aa, Homo Sapiens
TELEHSGIGRI

SEQ ID NO: 117802 - protein, 11 aa, Homo Sapiens
TENMPIKINLI

SEQ ID NO: 117803 - protein, 11 aa, Homo Sapiens
TETDLHGSLRV

SEQ ID NO: 117804 - protein, 11 aa, Homo Sapiens
TEVHPDYGSHI

SEQ ID NO: 117805 - protein, 11 aa, Homo Sapiens
TEYDCKGFHIV

SEQ ID NO: 117806 - protein, 11 aa, Homo Sapiens
TEYENFKVQVL

SEQ ID NO: 117807 - protein, 11 aa, Homo Sapiens
TEYEPRVINQM

SEQ ID NO: 117808 - protein, 11 aa, Homo Sapiens
TEYPEKEVTLI

SEQ ID NO: 117809 - protein, 11 aa, Homo Sapiens
VEDDARGTVVL

SEQ ID NO: 117810 - protein, 11 aa, Homo Sapiens
VEEDEAGGRFV

SEQ ID NO: 117811 - protein, 11 aa, Homo Sapiens
VEFMDDTSRSI

SEQ ID NO: 117812 - protein, 11 aa, Homo Sapiens
VEFNGKLLASI

SEQ ID NO: 117813 - protein, 11 aa, Homo Sapiens
VEFPTDPKVVV

SEQ ID NO: 117814 - protein, 11 aa, Homo Sapiens
VEIDAHIGCAM

SEQ ID NO: 117815 - protein, 11 aa, Homo Sapiens
VENEETFMNRV

SEQ ID NO: 117816 - protein, 11 aa, Homo Sapiens
VENPFFGQRYI

SEQ ID NO: 117817 - protein, 11 aa, Homo Sapiens
VEWDTTGQNLI

SEQ ID NO: 117818 - protein, 11 aa, Homo Sapiens
VEYCPEVNVMV

SEQ ID NO: 117819 - protein, 11 aa, Homo Sapiens
VEYDAEGFTKL

SEQ ID NO: 117820 - protein, 11 aa, Homo Sapiens
VEYEIDKTLGI

SEQ ID NO: 117821 - protein, 11 aa, Homo Sapiens
WEIDPKDLTFL

SEQ ID NO: 117822 - protein, 11 aa, Homo Sapiens
WLLSLGATDRQ

SEQ ID NO: 117823 - protein, 11 aa, Homo Sapiens
YEDISRGLQGT

SEQ ID NO: 117824 - protein, 11 aa, Homo Sapiens
YEEDQGSKLIR

SEQ ID NO: 117825 - protein, 11 aa, Homo Sapiens
YEFPDKDWAHI

SEQ ID NO: 117826 - protein, 11 aa, Homo Sapiens
YEIDDRDVNKI

SEQ ID NO: 117827 - protein, 11 aa, Homo Sapiens
YELDLGLNHVV

SEQ ID NO: 117828 - protein, 11 aa, Homo Sapiens
YELPDGQVITI

SEQ ID NO: 117829 - protein, 11 aa, Homo Sapiens
YEWDVAEARKI

SEQ ID NO: 117830 - protein, 11 aa, Homo Sapiens
YEYEGGHIKTA

SEQ ID NO: 117831 - protein, 11 aa, Homo Sapiens
YEYHWADGTNI

SEQ ID NO: 117832 - protein, 11 aa, Homo Sapiens
YEYIIKDKHIL

SEQ ID NO: 117833 - protein, 11 aa, Homo Sapiens
YQAELSQMQTQ

SEQ ID NO: 117834 - protein, 8 aa, Homo Sapiens
AEFLFNQC

SEQ ID NO: 117835 - protein, 8 aa, Homo Sapiens
FEFRAIEA

SEQ ID NO: 117836 - protein, 8 aa, Homo Sapiens
GEITFLEA

SEQ ID NO: 117837 - protein, 8 aa, Homo Sapiens
IEWRFTEA

SEQ ID NO: 117838 - protein, 8 aa, Homo Sapiens
IINTDTLA

SEQ ID NO: 117839 - protein, 8 aa, Homo Sapiens
LEVVRFFY

SEQ ID NO: 117840 - protein, 8 aa, Homo Sapiens
LEWPSLTA

SEQ ID NO: 117841 - protein, 8 aa, Homo Sapiens
LFTGELAE

SEQ ID NO: 117842 - protein, 8 aa, Homo Sapiens
LSENITLA

SEQ ID NO: 117843 - protein, 8 aa, Homo Sapiens
MEALLLGA

SEQ ID NO: 117844 - protein, 8 aa, Homo Sapiens
SEAIFLEA

SEQ ID NO: 117845 - protein, 8 aa, Homo Sapiens
SEFEGFSF

SEQ ID NO: 117846 - protein, 8 aa, Homo Sapiens
TEFESFSF

SEQ ID NO: 117847 - protein, 8 aa, Homo Sapiens
TEFLFHTA

SEQ ID NO: 117848 - protein, 8 aa, Homo Sapiens
TEFPGVVA

SEQ ID NO: 117849 - protein, 8 aa, Homo Sapiens
TEFPNFKY

SEQ ID NO: 117850 - protein, 9 aa, Homo Sapiens
ADFAKVLEL

SEQ ID NO: 117851 - protein, 9 aa, Homo Sapiens
ADTIFVTAP

SEQ ID NO: 117852 - protein, 9 aa, Homo Sapiens
AEAAVVAVA

SEQ ID NO: 117853 - protein, 9 aa, Homo Sapiens
AEAFRLPTA

SEQ ID NO: 117854 - protein, 9 aa, Homo Sapiens
AEAIPEPVV

SEQ ID NO: 117855 - protein, 9 aa, Homo Sapiens
AEAIPGLAA

SEQ ID NO: 117856 - protein, 9 aa, Homo Sapiens
AEAIRILAA

SEQ ID NO: 117857 - protein, 9 aa, Homo Sapiens
AEALAAFTA

SEQ ID NO: 117858 - protein, 9 aa, Homo Sapiens
AEALPSLAA

SEQ ID NO: 117859 - protein, 9 aa, Homo Sapiens
AEANAFSVL

SEQ ID NO: 117860 - protein, 9 aa, Homo Sapiens
AEAPPPKIP

SEQ ID NO: 117861 - protein, 9 aa, Homo Sapiens
AEAQLWWAA

SEQ ID NO: 117862 - protein, 9 aa, Homo Sapiens
AEARPFEVL

SEQ ID NO: 117863 - protein, 9 aa, Homo Sapiens
AEAVFASEV

SEQ ID NO: 117864 - protein, 9 aa, Homo Sapiens
AEDLNLLIA

SEQ ID NO: 117865 - protein, 9 aa, Homo Sapiens
AEFDSFVLV

SEQ ID NO: 117866 - protein, 9 aa, Homo Sapiens
AEFDTFLAS

SEQ ID NO: 117867 - protein, 9 aa, Homo Sapiens
AEFEWENKV

SEQ ID NO: 117868 - protein, 9 aa, Homo Sapiens
AEFFLSQQA

SEQ ID NO: 117869 - protein, 9 aa, Homo Sapiens
AEFIKFTVI

SEQ ID NO: 117870 - protein, 9 aa, Homo Sapiens
AEFLQKLLP

SEQ ID NO: 117871 - protein, 9 aa, Homo Sapiens
AEFLTFHYA

SEQ ID NO: 117872 - protein, 9 aa, Homo Sapiens
AEFPGLPEA

SEQ ID NO: 117873 - protein, 9 aa, Homo Sapiens
AEFQVKITA

SEQ ID NO: 117874 - protein, 9 aa, Homo Sapiens
AEFWKFSGI

SEQ ID NO: 117875 - protein, 9 aa, Homo Sapiens
AEGAFPNLA

SEQ ID NO: 117876 - protein, 9 aa, Homo Sapiens
AEGPVAVVV

SEQ ID NO: 117877 - protein, 9 aa, Homo Sapiens
AEHDLWHII

SEQ ID NO: 117878 - protein, 9 aa, Homo Sapiens
AEHFSIIRA

SEQ ID NO: 117879 - protein, 9 aa, Homo Sapiens
AEHFSMIRA

SEQ ID NO: 117880 - protein, 9 aa, Homo Sapiens
AEHGIFLPP

SEQ ID NO: 117881 - protein, 9 aa, Homo Sapiens
AEIAHLYIA

SEQ ID NO: 117882 - protein, 9 aa, Homo Sapiens
AEIAPFVEI

SEQ ID NO: 117883 - protein, 9 aa, Homo Sapiens
AEIDAHLVA

SEQ ID NO: 117884 - protein, 9 aa, Homo Sapiens
AEIDLFRAA

SEQ ID NO: 117885 - protein, 9 aa, Homo Sapiens
AEIEDPPIP

SEQ ID NO: 117886 - protein, 9 aa, Homo Sapiens
AEIEHFIHI

SEQ ID NO: 117887 - protein, 9 aa, Homo Sapiens
AEIIFNPSA

SEQ ID NO: 117888 - protein, 9 aa, Homo Sapiens
AEIIQLVNA

SEQ ID NO: 117889 - protein, 9 aa, Homo Sapiens
AEINNIIKI

SEQ ID NO: 117890 - protein, 9 aa, Homo Sapiens
AEIQGVIDA

SEQ ID NO: 117891 - protein, 9 aa, Homo Sapiens
AEKDFWELA

SEQ ID NO: 117892 - protein, 9 aa, Homo Sapiens
AELATRAIP

SEQ ID NO: 117893 - protein, 9 aa, Homo Sapiens
AELDKLTSV

SEQ ID NO: 117894 - protein, 9 aa, Homo Sapiens
AELDVPALP

SEQ ID NO: 117895 - protein, 9 aa, Homo Sapiens
AELEFAIQP

SEQ ID NO: 117896 - protein, 9 aa, Homo Sapiens
AELFWPSMA

SEQ ID NO: 117897 - protein, 9 aa, Homo Sapiens
AELLIFSVP

SEQ ID NO: 117898 - protein, 9 aa, Homo Sapiens
AELLPLVSA

SEQ ID NO: 117899 - protein, 9 aa, Homo Sapiens
AELLTKTLP

SEQ ID NO: 117900 - protein, 9 aa, Homo Sapiens
AELLVLLAA

SEQ ID NO: 117901 - protein, 9 aa, Homo Sapiens
AELPWAVKP

SEQ ID NO: 117902 - protein, 9 aa, Homo Sapiens
AELSFFGHA

SEQ ID NO: 117903 - protein, 9 aa, Homo Sapiens
AELWKNPTA

SEQ ID NO: 117904 - protein, 9 aa, Homo Sapiens
AENYFQLSV

SEQ ID NO: 117905 - protein, 9 aa, Homo Sapiens
AEQPYFIEA

SEQ ID NO: 117906 - protein, 9 aa, Homo Sapiens
AERFHFEAL

SEQ ID NO: 117907 - protein, 9 aa, Homo Sapiens
AETEFFSKA

SEQ ID NO: 117908 - protein, 9 aa, Homo Sapiens
AEVAGILEP

SEQ ID NO: 117909 - protein, 9 aa, Homo Sapiens
AEVDRQVIP

SEQ ID NO: 117910 - protein, 9 aa, Homo Sapiens
AEVEKWLGP

SEQ ID NO: 117911 - protein, 9 aa, Homo Sapiens
AEVFPPPVA

SEQ ID NO: 117912 - protein, 9 aa, Homo Sapiens
AEVGRVLQV

SEQ ID NO: 117913 - protein, 9 aa, Homo Sapiens
AEVKPILQA

SEQ ID NO: 117914 - protein, 9 aa, Homo Sapiens
AEVLTFLDA

SEQ ID NO: 117915 - protein, 9 aa, Homo Sapiens
AEVRVIAPP

SEQ ID NO: 117916 - protein, 9 aa, Homo Sapiens
AEVWWNLVP

SEQ ID NO: 117917 - protein, 9 aa, Homo Sapiens
AEVYRILSV

SEQ ID NO: 117918 - protein, 9 aa, Homo Sapiens
AEWKFLNPA

SEQ ID NO: 117919 - protein, 9 aa, Homo Sapiens
AEWLGVLKA

SEQ ID NO: 117920 - protein, 9 aa, Homo Sapiens
AEYAGLKVA

SEQ ID NO: 117921 - protein, 9 aa, Homo Sapiens
AEYEFLSFV

SEQ ID NO: 117922 - protein, 9 aa, Homo Sapiens
AEYGHFVDI

SEQ ID NO: 117923 - protein, 9 aa, Homo Sapiens
AEYLHWLLT

SEQ ID NO: 117924 - protein, 9 aa, Homo Sapiens
AEYLYFFRV

SEQ ID NO: 117925 - protein, 9 aa, Homo Sapiens
DAERQLLAP

SEQ ID NO: 117926 - protein, 9 aa, Homo Sapiens
DAKIRIFDL

SEQ ID NO: 117927 - protein, 9 aa, Homo Sapiens
DEYQFFTQA

SEQ ID NO: 117928 - protein, 9 aa, Homo Sapiens
EEFGDFRLV

SEQ ID NO: 117929 - protein, 9 aa, Homo Sapiens
EEFPAFPRA

SEQ ID NO: 117930 - protein, 9 aa, Homo Sapiens
EEFSFIPSA

SEQ ID NO: 117931 - protein, 9 aa, Homo Sapiens
EEFVFIPAA

SEQ ID NO: 117932 - protein, 9 aa, Homo Sapiens
EEHEWFIPA

SEQ ID NO: 117933 - protein, 9 aa, Homo Sapiens
EEHNFFLAP

SEQ ID NO: 117934 - protein, 9 aa, Homo Sapiens
EEIEGLISA

SEQ ID NO: 117935 - protein, 9 aa, Homo Sapiens
EEYYPFSEV

SEQ ID NO: 117936 - protein, 9 aa, Homo Sapiens
ELCTVLIGL

SEQ ID NO: 117937 - protein, 9 aa, Homo Sapiens
ELNISEIPP

SEQ ID NO: 117938 - protein, 9 aa, Homo Sapiens
ELWQVLGAP

SEQ ID NO: 117939 - protein, 9 aa, Homo Sapiens
EMLQRADPP

SEQ ID NO: 117940 - protein, 9 aa, Homo Sapiens
ESLAGILGT

SEQ ID NO: 117941 - protein, 9 aa, Homo Sapiens
FDKTFEISA

SEQ ID NO: 117942 - protein, 9 aa, Homo Sapiens
FEARFFHLA

SEQ ID NO: 117943 - protein, 9 aa, Homo Sapiens
FEARIALLP

SEQ ID NO: 117944 - protein, 9 aa, Homo Sapiens
FEFDIFTRL

SEQ ID NO: 117945 - protein, 9 aa, Homo Sapiens
FEFDTKTSA

SEQ ID NO: 117946 - protein, 9 aa, Homo Sapiens
FEFEYQTKV

SEQ ID NO: 117947 - protein, 9 aa, Homo Sapiens
FEFGVFPAI

SEQ ID NO: 117948 - protein, 9 aa, Homo Sapiens
FEFLLKLTP

SEQ ID NO: 117949 - protein, 9 aa, Homo Sapiens
FEFLTKELA

SEQ ID NO: 117950 - protein, 9 aa, Homo Sapiens
FEFPDYCTP

SEQ ID NO: 117951 - protein, 9 aa, Homo Sapiens
FEFPRPFLP

SEQ ID NO: 117952 - protein, 9 aa, Homo Sapiens
FEFTDFTLP

SEQ ID NO: 117953 - protein, 9 aa, Homo Sapiens
FEILPGLSV

SEQ ID NO: 117954 - protein, 9 aa, Homo Sapiens
FEIPTGREA

SEQ ID NO: 117955 - protein, 9 aa, Homo Sapiens
FEIRGTLLP

SEQ ID NO: 117956 - protein, 9 aa, Homo Sapiens
FEKEWIECA

SEQ ID NO: 117957 - protein, 9 aa, Homo Sapiens
FEKVFSIGP

SEQ ID NO: 117958 - protein, 9 aa, Homo Sapiens
FELLDRILP

SEQ ID NO: 117959 - protein, 9 aa, Homo Sapiens
FELPYVSVT

SEQ ID NO: 117960 - protein, 9 aa, Homo Sapiens
FENLFSKPP

SEQ ID NO: 117961 - protein, 9 aa, Homo Sapiens
FEQKGFRLV

SEQ ID NO: 117962 - protein, 9 aa, Homo Sapiens
FETEFNTQP

SEQ ID NO: 117963 - protein, 9 aa, Homo Sapiens
FETQFILSP

SEQ ID NO: 117964 - protein, 9 aa, Homo Sapiens
FEVKKWNAV

SEQ ID NO: 117965 - protein, 9 aa, Homo Sapiens
FEVPHELVA

SEQ ID NO: 117966 - protein, 9 aa, Homo Sapiens
FEWTFPTRP

SEQ ID NO: 117967 - protein, 9 aa, Homo Sapiens
FEYILSHVA

SEQ ID NO: 117968 - protein, 9 aa, Homo Sapiens
FEYPNFIRV

SEQ ID NO: 117969 - protein, 9 aa, Homo Sapiens
FEYPVQIEP

SEQ ID NO: 117970 - protein, 9 aa, Homo Sapiens
FEYSIRTTP

SEQ ID NO: 117971 - protein, 9 aa, Homo Sapiens
FEYVKVPLA

SEQ ID NO: 117972 - protein, 9 aa, Homo Sapiens
GDRIFFVSA

SEQ ID NO: 117973 - protein, 9 aa, Homo Sapiens
GEAIPALAA

SEQ ID NO: 117974 - protein, 9 aa, Homo Sapiens
GEAWPFESV

SEQ ID NO: 117975 - protein, 9 aa, Homo Sapiens
GEEFLFRTA

SEQ ID NO: 117976 - protein, 9 aa, Homo Sapiens
GEFEGFVAV

SEQ ID NO: 117977 - protein, 9 aa, Homo Sapiens
GEFGGFGSV

SEQ ID NO: 117978 - protein, 9 aa, Homo Sapiens
GEFGGFSEV

SEQ ID NO: 117979 - protein, 9 aa, Homo Sapiens
GEFHLWYQV

SEQ ID NO: 117980 - protein, 9 aa, Homo Sapiens
GEFLAFQTV

SEQ ID NO: 117981 - protein, 9 aa, Homo Sapiens
GEFLPIQPA

SEQ ID NO: 117982 - protein, 9 aa, Homo Sapiens
GEFTFLLPA

SEQ ID NO: 117983 - protein, 9 aa, Homo Sapiens
GEFVFATSL

SEQ ID NO: 117984 - protein, 9 aa, Homo Sapiens
GEHCDFTIL

SEQ ID NO: 117985 - protein, 9 aa, Homo Sapiens
GEIFDHLVA

SEQ ID NO: 117986 - protein, 9 aa, Homo Sapiens
GEIFNVQLP

SEQ ID NO: 117987 - protein, 9 aa, Homo Sapiens
GEIFSLCLP

SEQ ID NO: 117988 - protein, 9 aa, Homo Sapiens
GEILGLLGP

SEQ ID NO: 117989 - protein, 9 aa, Homo Sapiens
GEINVIGEP

SEQ ID NO: 117990 - protein, 9 aa, Homo Sapiens
GEIPKVLVA

SEQ ID NO: 117991 - protein, 9 aa, Homo Sapiens
GEIRTITVV

SEQ ID NO: 117992 - protein, 9 aa, Homo Sapiens
GEIVRLTTP

SEQ ID NO: 117993 - protein, 9 aa, Homo Sapiens
GEIVSTLLP

SEQ ID NO: 117994 - protein, 9 aa, Homo Sapiens
GEKSFFLQP

SEQ ID NO: 117995 - protein, 9 aa, Homo Sapiens
GELLFVHSA

SEQ ID NO: 117996 - protein, 9 aa, Homo Sapiens
GELMAFLLP

SEQ ID NO: 117997 - protein, 9 aa, Homo Sapiens
GELPFLTHV

SEQ ID NO: 117998 - protein, 9 aa, Homo Sapiens
GELPLSLAA

SEQ ID NO: 117999 - protein, 9 aa, Homo Sapiens
GELSDWSLP

SEQ ID NO: 118000 - protein, 9 aa, Homo Sapiens
GENFDKLLA

SEQ ID NO: 118001 - protein, 9 aa, Homo Sapiens
GENLGFWEA

SEQ ID NO: 118002 - protein, 9 aa, Homo Sapiens
GEREIWNQI

SEQ ID NO: 118003 - protein, 9 aa, Homo Sapiens
GETDPLLIA

SEQ ID NO: 118004 - protein, 9 aa, Homo Sapiens
GETIFFRGP

SEQ ID NO: 118005 - protein, 9 aa, Homo Sapiens
GETIFVERP

SEQ ID NO: 118006 - protein, 9 aa, Homo Sapiens
GETIFVTAP

SEQ ID NO: 118007 - protein, 9 aa, Homo Sapiens
GEVFDYLVA

SEQ ID NO: 118008 - protein, 9 aa, Homo Sapiens
GEVPPGPLP

SEQ ID NO: 118009 - protein, 9 aa, Homo Sapiens
GEVVLRFAA

SEQ ID NO: 118010 - protein, 9 aa, Homo Sapiens
GEYDWALQA

SEQ ID NO: 118011 - protein, 9 aa, Homo Sapiens
GEYEWVHKP

SEQ ID NO: 118012 - protein, 9 aa, Homo Sapiens
GEYGGWYKA

SEQ ID NO: 118013 - protein, 9 aa, Homo Sapiens
GEYGKFFVT

SEQ ID NO: 118014 - protein, 9 aa, Homo Sapiens
GEYKFFWTA

SEQ ID NO: 118015 - protein, 9 aa, Homo Sapiens
HELPFYGCA

SEQ ID NO: 118016 - protein, 9 aa, Homo Sapiens
HEYPWILSA

SEQ ID NO: 118017 - protein, 9 aa, Homo Sapiens
IDRLFDTSA

SEQ ID NO: 118018 - protein, 9 aa, Homo Sapiens
IEAFTPLLA

SEQ ID NO: 118019 - protein, 9 aa, Homo Sapiens
IEAKFYEEV

SEQ ID NO: 118020 - protein, 9 aa, Homo Sapiens
IEAPHFPLP

SEQ ID NO: 118021 - protein, 9 aa, Homo Sapiens
IECITGILG

SEQ ID NO: 118022 - protein, 9 aa, Homo Sapiens
IEFPYKNLP

SEQ ID NO: 118023 - protein, 9 aa, Homo Sapiens
IEIDFPRAA

SEQ ID NO: 118024 - protein, 9 aa, Homo Sapiens
IEIERILSV

SEQ ID NO: 118025 - protein, 9 aa, Homo Sapiens
IEILPVAVA

SEQ ID NO: 118026 - protein, 9 aa, Homo Sapiens
IEIYPLAEA

SEQ ID NO: 118027 - protein, 9 aa, Homo Sapiens
IELDMRTIA

SEQ ID NO: 118028 - protein, 9 aa, Homo Sapiens
IELPSMAVA

SEQ ID NO: 118029 - protein, 9 aa, Homo Sapiens
IEQEFLTEA

SEQ ID NO: 118030 - protein, 9 aa, Homo Sapiens
IERPIRIVA

SEQ ID NO: 118031 - protein, 9 aa, Homo Sapiens
IESPPAFTA

SEQ ID NO: 118032 - protein, 9 aa, Homo Sapiens
IEVSLPEAA

SEQ ID NO: 118033 - protein, 9 aa, Homo Sapiens
IEWDKPPVP

SEQ ID NO: 118034 - protein, 9 aa, Homo Sapiens
IEYDCELVP

SEQ ID NO: 118035 - protein, 9 aa, Homo Sapiens
KDLLFILTA

SEQ ID NO: 118036 - protein, 9 aa, Homo Sapiens
KDYPFYLTV

SEQ ID NO: 118037 - protein, 9 aa, Homo Sapiens
KEFEFSQLP

SEQ ID NO: 118038 - protein, 9 aa, Homo Sapiens
KEFNFPEEA

SEQ ID NO: 118039 - protein, 9 aa, Homo Sapiens
KEFPFDVQP

SEQ ID NO: 118040 - protein, 9 aa, Homo Sapiens
KEFPYGIEA

SEQ ID NO: 118041 - protein, 9 aa, Homo Sapiens
KEFQLFQGV

SEQ ID NO: 118042 - protein, 9 aa, Homo Sapiens
KEFSPFGTI

SEQ ID NO: 118043 - protein, 9 aa, Homo Sapiens
KEHLYFETV

SEQ ID NO: 118044 - protein, 9 aa, Homo Sapiens
KEIDVISIP

SEQ ID NO: 118045 - protein, 9 aa, Homo Sapiens
KEIFQTTVP

SEQ ID NO: 118046 - protein, 9 aa, Homo Sapiens
KELEFLTQA

SEQ ID NO: 118047 - protein, 9 aa, Homo Sapiens
KELIFQETA

SEQ ID NO: 118048 - protein, 9 aa, Homo Sapiens
KEVEQFTQV

SEQ ID NO: 118049 - protein, 9 aa, Homo Sapiens
KEYFGIVSV

SEQ ID NO: 118050 - protein, 9 aa, Homo Sapiens
KEYLFYAEA

SEQ ID NO: 118051 - protein, 9 aa, Homo Sapiens
KEYLFYLNV

SEQ ID NO: 118052 - protein, 9 aa, Homo Sapiens
KEYPDFNFV

SEQ ID NO: 118053 - protein, 9 aa, Homo Sapiens
KEYPFILDA

SEQ ID NO: 118054 - protein, 9 aa, Homo Sapiens
KEYWFVLTA

SEQ ID NO: 118055 - protein, 9 aa, Homo Sapiens
LAEVANFIP

SEQ ID NO: 118056 - protein, 9 aa, Homo Sapiens
LAFQMRIEL

SEQ ID NO: 118057 - protein, 9 aa, Homo Sapiens
LEAHFVPLV

SEQ ID NO: 118058 - protein, 9 aa, Homo Sapiens
LEAILAAVP

SEQ ID NO: 118059 - protein, 9 aa, Homo Sapiens
LEALPQIAA

SEQ ID NO: 118060 - protein, 9 aa, Homo Sapiens
LEAPDLLLA

SEQ ID NO: 118061 - protein, 9 aa, Homo Sapiens
LEAVLKLLP

SEQ ID NO: 118062 - protein, 9 aa, Homo Sapiens
LEAWLQREA

SEQ ID NO: 118063 - protein, 9 aa, Homo Sapiens
LEDRPRLLP

SEQ ID NO: 118064 - protein, 9 aa, Homo Sapiens
LEFEHQRAP

SEQ ID NO: 118065 - protein, 9 aa, Homo Sapiens
LEFERWLNA

SEQ ID NO: 118066 - protein, 9 aa, Homo Sapiens
LEFPFRKDL

SEQ ID NO: 118067 - protein, 9 aa, Homo Sapiens
LEFPQFETL

SEQ ID NO: 118068 - protein, 9 aa, Homo Sapiens
LEFPYGILA

SEQ ID NO: 118069 - protein, 9 aa, Homo Sapiens
LEHALFTAL

SEQ ID NO: 118070 - protein, 9 aa, Homo Sapiens
LEHGAWRLP

SEQ ID NO: 118071 - protein, 9 aa, Homo Sapiens
LEHPFVSSI

SEQ ID NO: 118072 - protein, 9 aa, Homo Sapiens
LEHQVFTVL

SEQ ID NO: 118073 - protein, 9 aa, Homo Sapiens
LEIENLNLA

SEQ ID NO: 118074 - protein, 9 aa, Homo Sapiens
LEIFLAQRA

SEQ ID NO: 118075 - protein, 9 aa, Homo Sapiens
LEIIEFRAA

SEQ ID NO: 118076 - protein, 9 aa, Homo Sapiens
LEIIQSSLP

SEQ ID NO: 118077 - protein, 9 aa, Homo Sapiens
LEIPDILNA

SEQ ID NO: 118078 - protein, 9 aa, Homo Sapiens
LEIPRLPPP

SEQ ID NO: 118079 - protein, 9 aa, Homo Sapiens
LEIVNPQAA

SEQ ID NO: 118080 - protein, 9 aa, Homo Sapiens
LEIVPFRVA

SEQ ID NO: 118081 - protein, 9 aa, Homo Sapiens
LEKIFQNAP

SEQ ID NO: 118082 - protein, 9 aa, Homo Sapiens
LELDTNLPA

SEQ ID NO: 118083 - protein, 9 aa, Homo Sapiens
LELFCKILE

SEQ ID NO: 118084 - protein, 9 aa, Homo Sapiens
LELIGHAVA

SEQ ID NO: 118085 - protein, 9 aa, Homo Sapiens
LELPGQPVA

SEQ ID NO: 118086 - protein, 9 aa, Homo Sapiens
LELPHLTSA

SEQ ID NO: 118087 - protein, 9 aa, Homo Sapiens
LELPPPGLP

SEQ ID NO: 118088 - protein, 9 aa, Homo Sapiens
LEREEFLVP

SEQ ID NO: 118089 - protein, 9 aa, Homo Sapiens
LERFPWPSL

SEQ ID NO: 118090 - protein, 9 aa, Homo Sapiens
LERPHFTLP

SEQ ID NO: 118091 - protein, 9 aa, Homo Sapiens
LESLPEPVI

SEQ ID NO: 118092 - protein, 9 aa, Homo Sapiens
LETLPFGIA

SEQ ID NO: 118093 - protein, 9 aa, Homo Sapiens
LEVKLGELP

SEQ ID NO: 118094 - protein, 9 aa, Homo Sapiens
LEVLKLLVA

SEQ ID NO: 118095 - protein, 9 aa, Homo Sapiens
LEVPGLRSV

SEQ ID NO: 118096 - protein, 9 aa, Homo Sapiens
LEVVKFTQA

SEQ ID NO: 118097 - protein, 9 aa, Homo Sapiens
LEYGLPIQV

SEQ ID NO: 118098 - protein, 9 aa, Homo Sapiens
LEYHVPVTA

SEQ ID NO: 118099 - protein, 9 aa, Homo Sapiens
LEYLAFSDS

SEQ ID NO: 118100 - protein, 9 aa, Homo Sapiens
LEYWNHLAA

SEQ ID NO: 118101 - protein, 9 aa, Homo Sapiens
LEYYDFYEV

SEQ ID NO: 118102 - protein, 9 aa, Homo Sapiens
LTQALKDNK

SEQ ID NO: 118103 - protein, 9 aa, Homo Sapiens
MEALPLLAA

SEQ ID NO: 118104 - protein, 9 aa, Homo Sapiens
MEDIKILIA

SEQ ID NO: 118105 - protein, 9 aa, Homo Sapiens
MEFQRFVTP

SEQ ID NO: 118106 - protein, 9 aa, Homo Sapiens
MEHPYFYTV

SEQ ID NO: 118107 - protein, 9 aa, Homo Sapiens
MEIERILGV

SEQ ID NO: 118108 - protein, 9 aa, Homo Sapiens
MELWPCLAA

SEQ ID NO: 118109 - protein, 9 aa, Homo Sapiens
MEVELPAAA

SEQ ID NO: 118110 - protein, 9 aa, Homo Sapiens
MEYDQPLYV

SEQ ID NO: 118111 - protein, 9 aa, Homo Sapiens
MEYPNFEET

SEQ ID NO: 118112 - protein, 9 aa, Homo Sapiens
NEFPFGCPP

SEQ ID NO: 118113 - protein, 9 aa, Homo Sapiens
NEIIFPHCA

SEQ ID NO: 118114 - protein, 9 aa, Homo Sapiens
NEYAGFLMA

SEQ ID NO: 118115 - protein, 9 aa, Homo Sapiens
PEFKFWHAA

SEQ ID NO: 118116 - protein, 9 aa, Homo Sapiens
QEFLTEALP

SEQ ID NO: 118117 - protein, 9 aa, Homo Sapiens
QEFNRLLEA

SEQ ID NO: 118118 - protein, 9 aa, Homo Sapiens
QEFPFPETP

SEQ ID NO: 118119 - protein, 9 aa, Homo Sapiens
QEFQNFKTL

SEQ ID NO: 118120 - protein, 9 aa, Homo Sapiens
QEFSFFDKV

SEQ ID NO: 118121 - protein, 9 aa, Homo Sapiens
QEFWNFCEV

SEQ ID NO: 118122 - protein, 9 aa, Homo Sapiens
QEHPVVLLP

SEQ ID NO: 118123 - protein, 9 aa, Homo Sapiens
QEIATVVVP

SEQ ID NO: 118124 - protein, 9 aa, Homo Sapiens
QEILGVLVP

SEQ ID NO: 118125 - protein, 9 aa, Homo Sapiens
QEINTLLEA

SEQ ID NO: 118126 - protein, 9 aa, Homo Sapiens
QEKYFLLQA

SEQ ID NO: 118127 - protein, 9 aa, Homo Sapiens
QELEFLRVA

SEQ ID NO: 118128 - protein, 9 aa, Homo Sapiens
QELPGLPAP

SEQ ID NO: 118129 - protein, 9 aa, Homo Sapiens
QELPRLLSA

SEQ ID NO: 118130 - protein, 9 aa, Homo Sapiens
QELSRFIAA

SEQ ID NO: 118131 - protein, 9 aa, Homo Sapiens
QEVFGLAVV

SEQ ID NO: 118132 - protein, 9 aa, Homo Sapiens
QEVFPVLAA

SEQ ID NO: 118133 - protein, 9 aa, Homo Sapiens
QEYFGSLAA

SEQ ID NO: 118134 - protein, 9 aa, Homo Sapiens
QEYNQFCVI

SEQ ID NO: 118135 - protein, 9 aa, Homo Sapiens
QEYPTLKVP

SEQ ID NO: 118136 - protein, 9 aa, Homo Sapiens
READFFWSL

SEQ ID NO: 118137 - protein, 9 aa, Homo Sapiens
REAFGFEQA

SEQ ID NO: 118138 - protein, 9 aa, Homo Sapiens
REFALRLVA

SEQ ID NO: 118139 - protein, 9 aa, Homo Sapiens
REFDFFNKI

SEQ ID NO: 118140 - protein, 9 aa, Homo Sapiens
REFGFFMVL

SEQ ID NO: 118141 - protein, 9 aa, Homo Sapiens
REFPVISVV

SEQ ID NO: 118142 - protein, 9 aa, Homo Sapiens
REFSDFIRV

SEQ ID NO: 118143 - protein, 9 aa, Homo Sapiens
REFVLLPAA

SEQ ID NO: 118144 - protein, 9 aa, Homo Sapiens
REHAPFLVA

SEQ ID NO: 118145 - protein, 9 aa, Homo Sapiens
REHPVPLLP

SEQ ID NO: 118146 - protein, 9 aa, Homo Sapiens
REIFFPETA

SEQ ID NO: 118147 - protein, 9 aa, Homo Sapiens
REILTELEA

SEQ ID NO: 118148 - protein, 9 aa, Homo Sapiens
REINTILKA

SEQ ID NO: 118149 - protein, 9 aa, Homo Sapiens
REIWNQISA

SEQ ID NO: 118150 - protein, 9 aa, Homo Sapiens
REMIPFAVV

SEQ ID NO: 118151 - protein, 9 aa, Homo Sapiens
RENVFKLLP

SEQ ID NO: 118152 - protein, 9 aa, Homo Sapiens
RESVFKLLP

SEQ ID NO: 118153 - protein, 9 aa, Homo Sapiens
REVYSILQA

SEQ ID NO: 118154 - protein, 9 aa, Homo Sapiens
REYMGFIQA

SEQ ID NO: 118155 - protein, 9 aa, Homo Sapiens
REYPNLVTI

SEQ ID NO: 118156 - protein, 9 aa, Homo Sapiens
SEFCFILKV

SEQ ID NO: 118157 - protein, 9 aa, Homo Sapiens
SEFEGFSFV

SEQ ID NO: 118158 - protein, 9 aa, Homo Sapiens
SEFISFITS

SEQ ID NO: 118159 - protein, 9 aa, Homo Sapiens
SEFMFEKAP

SEQ ID NO: 118160 - protein, 9 aa, Homo Sapiens
SEFRNPLAP

SEQ ID NO: 118161 - protein, 9 aa, Homo Sapiens
SEHCFDLIF

SEQ ID NO: 118162 - protein, 9 aa, Homo Sapiens
SEHVWVEVV

SEQ ID NO: 118163 - protein, 9 aa, Homo Sapiens
SEIAFHTIP

SEQ ID NO: 118164 - protein, 9 aa, Homo Sapiens
SEIGGITIA

SEQ ID NO: 118165 - protein, 9 aa, Homo Sapiens
SEIPKLPAV

SEQ ID NO: 118166 - protein, 9 aa, Homo Sapiens
SEIYGLMKA

SEQ ID NO: 118167 - protein, 9 aa, Homo Sapiens
SELAFPITA

SEQ ID NO: 118168 - protein, 9 aa, Homo Sapiens
SELAGLLSA

SEQ ID NO: 118169 - protein, 9 aa, Homo Sapiens
SELDRLLSA

SEQ ID NO: 118170 - protein, 9 aa, Homo Sapiens
SELERLIVP

SEQ ID NO: 118171 - protein, 9 aa, Homo Sapiens
SELFVLNAA

SEQ ID NO: 118172 - protein, 9 aa, Homo Sapiens
SELPFTIAS

SEQ ID NO: 118173 - protein, 9 aa, Homo Sapiens
SELPIVTPA

SEQ ID NO: 118174 - protein, 9 aa, Homo Sapiens
SELQQLGLP

SEQ ID NO: 118175 - protein, 9 aa, Homo Sapiens
SELTPMLAA

SEQ ID NO: 118176 - protein, 9 aa, Homo Sapiens
SEVELMKVA

SEQ ID NO: 118177 - protein, 9 aa, Homo Sapiens
SEVGKLLSA

SEQ ID NO: 118178 - protein, 9 aa, Homo Sapiens
SEVILPVPA

SEQ ID NO: 118179 - protein, 9 aa, Homo Sapiens
SEVNLFLVP

SEQ ID NO: 118180 - protein, 9 aa, Homo Sapiens
SEWKFTITP

SEQ ID NO: 118181 - protein, 9 aa, Homo Sapiens
SEYNAFWKC

SEQ ID NO: 118182 - protein, 9 aa, Homo Sapiens
SEYQWITSP

SEQ ID NO: 118183 - protein, 9 aa, Homo Sapiens
TDFAFRITP

SEQ ID NO: 118184 - protein, 9 aa, Homo Sapiens
TEALHFVAA

SEQ ID NO: 118185 - protein, 9 aa, Homo Sapiens
TEAPPIIFA

SEQ ID NO: 118186 - protein, 9 aa, Homo Sapiens
TEAPRWPLP

SEQ ID NO: 118187 - protein, 9 aa, Homo Sapiens
TEFLSIITS

SEQ ID NO: 118188 - protein, 9 aa, Homo Sapiens
TEFPLFLQT

SEQ ID NO: 118189 - protein, 9 aa, Homo Sapiens
TEFQEFLSV

SEQ ID NO: 118190 - protein, 9 aa, Homo Sapiens
TEFRNFIVW

SEQ ID NO: 118191 - protein, 9 aa, Homo Sapiens
TEIGKLLSS

SEQ ID NO: 118192 - protein, 9 aa, Homo Sapiens
TEILKSVVA

SEQ ID NO: 118193 - protein, 9 aa, Homo Sapiens
TEIPEFPIA

SEQ ID NO: 118194 - protein, 9 aa, Homo Sapiens
TEIRDMLLA

SEQ ID NO: 118195 - protein, 9 aa, Homo Sapiens
TEIVKILSA

SEQ ID NO: 118196 - protein, 9 aa, Homo Sapiens
TEIWFLDRA

SEQ ID NO: 118197 - protein, 9 aa, Homo Sapiens
TELELFKAA

SEQ ID NO: 118198 - protein, 9 aa, Homo Sapiens
TELLWPGAA

SEQ ID NO: 118199 - protein, 9 aa, Homo Sapiens
TELRFEVEA

SEQ ID NO: 118200 - protein, 9 aa, Homo Sapiens
TEQWIFLCA

SEQ ID NO: 118201 - protein, 9 aa, Homo Sapiens
TEYSFLKEV

SEQ ID NO: 118202 - protein, 9 aa, Homo Sapiens
VEAFFLVHA

SEQ ID NO: 118203 - protein, 9 aa, Homo Sapiens
VEALPLVEA

SEQ ID NO: 118204 - protein, 9 aa, Homo Sapiens
VEFEDFSQP

SEQ ID NO: 118205 - protein, 9 aa, Homo Sapiens
VEFGNFNNL

SEQ ID NO: 118206 - protein, 9 aa, Homo Sapiens
VEFHRLWSA

SEQ ID NO: 118207 - protein, 9 aa, Homo Sapiens
VEFMHYIIA

SEQ ID NO: 118208 - protein, 9 aa, Homo Sapiens
VEFNFGQRA

SEQ ID NO: 118209 - protein, 9 aa, Homo Sapiens
VEFNGKLLA

SEQ ID NO: 118210 - protein, 9 aa, Homo Sapiens
VEFPDFSST

SEQ ID NO: 118211 - protein, 9 aa, Homo Sapiens
VEHDAFIFA

SEQ ID NO: 118212 - protein, 9 aa, Homo Sapiens
VEHEDFLTV

SEQ ID NO: 118213 - protein, 9 aa, Homo Sapiens
VEIFHPLRL

SEQ ID NO: 118214 - protein, 9 aa, Homo Sapiens
VEIFKFEEA

SEQ ID NO: 118215 - protein, 9 aa, Homo Sapiens
VELFFQEVA

SEQ ID NO: 118216 - protein, 9 aa, Homo Sapiens
VELFLNSTA

SEQ ID NO: 118217 - protein, 9 aa, Homo Sapiens
VELSQLRVA

SEQ ID NO: 118218 - protein, 9 aa, Homo Sapiens
VERVIEFAA

SEQ ID NO: 118219 - protein, 9 aa, Homo Sapiens
VEVGGLLGV

SEQ ID NO: 118220 - protein, 9 aa, Homo Sapiens
VEVIKPLVA

SEQ ID NO: 118221 - protein, 9 aa, Homo Sapiens
VEVPETPKA

SEQ ID NO: 118222 - protein, 9 aa, Homo Sapiens
VEVRFVSSA

SEQ ID NO: 118223 - protein, 9 aa, Homo Sapiens
VEWSAFLEA

SEQ ID NO: 118224 - protein, 9 aa, Homo Sapiens
WEALVSPVV

SEQ ID NO: 118225 - protein, 9 aa, Homo Sapiens
WEFPINNEA

SEQ ID NO: 118226 - protein, 9 aa, Homo Sapiens
WEIDNNPKV

SEQ ID NO: 118227 - protein, 9 aa, Homo Sapiens
WEIENNPTV

SEQ ID NO: 118228 - protein, 9 aa, Homo Sapiens
WEIKTITSA

SEQ ID NO: 118229 - protein, 9 aa, Homo Sapiens
WEIRDRLLA

SEQ ID NO: 118230 - protein, 9 aa, Homo Sapiens
WELLPSAAA

SEQ ID NO: 118231 - protein, 9 aa, Homo Sapiens
WEVVPEPVA

SEQ ID NO: 118232 - protein, 9 aa, Homo Sapiens
WEVYLRETA

SEQ ID NO: 118233 - protein, 9 aa, Homo Sapiens
YEAFLVGKP

SEQ ID NO: 118234 - protein, 9 aa, Homo Sapiens
YEAPIFTIP

SEQ ID NO: 118235 - protein, 9 aa, Homo Sapiens
YEFGQIINA

SEQ ID NO: 118236 - protein, 9 aa, Homo Sapiens
YEFHLPLSP

SEQ ID NO: 118237 - protein, 9 aa, Homo Sapiens
YEFLVGKPP

SEQ ID NO: 118238 - protein, 9 aa, Homo Sapiens
YEFNVWTRP

SEQ ID NO: 118239 - protein, 9 aa, Homo Sapiens
YEIDKTLGI

SEQ ID NO: 118240 - protein, 9 aa, Homo Sapiens
YEILNNPEL

SEQ ID NO: 118241 - protein, 9 aa, Homo Sapiens
YEILRLLVT

SEQ ID NO: 118242 - protein, 9 aa, Homo Sapiens
YEIPPITPP

SEQ ID NO: 118243 - protein, 9 aa, Homo Sapiens
YEIPSNLTP

SEQ ID NO: 118244 - protein, 9 aa, Homo Sapiens
YEKILFTEA

SEQ ID NO: 118245 - protein, 9 aa, Homo Sapiens
YEKLGFPGA

SEQ ID NO: 118246 - protein, 9 aa, Homo Sapiens
YELALILKA

SEQ ID NO: 118247 - protein, 9 aa, Homo Sapiens
YELAQVLLA

SEQ ID NO: 118248 - protein, 9 aa, Homo Sapiens
YELEHLSTP

SEQ ID NO: 118249 - protein, 9 aa, Homo Sapiens
YELLFKEGV

SEQ ID NO: 118250 - protein, 9 aa, Homo Sapiens
YELQFRLGP

SEQ ID NO: 118251 - protein, 9 aa, Homo Sapiens
YELTYFLEA

SEQ ID NO: 118252 - protein, 9 aa, Homo Sapiens
YENELMLMS

SEQ ID NO: 118253 - protein, 9 aa, Homo Sapiens
YERIYNEIP

SEQ ID NO: 118254 - protein, 9 aa, Homo Sapiens
YERLFGTTV

SEQ ID NO: 118255 - protein, 9 aa, Homo Sapiens
YEVRLTQTV

SEQ ID NO: 118256 - protein, 9 aa, Homo Sapiens
YEYAYLKAI

SEQ ID NO: 118257 - protein, 9 aa, Homo Sapiens
YEYKFGFEL

SEQ ID NO: 118258 - protein, 9 aa, Homo Sapiens
YEYLLHVGA

SEQ ID NO: 118259 - protein, 9 aa, Homo Sapiens
YEYRFLEFT

SEQ ID NO: 118260 - protein, 9 aa, Homo Sapiens
YEYRHVMLP

SEQ ID NO: 118261 - protein, 9 aa, Homo Sapiens
YEYYPHVYP

SEQ ID NO: 118262 - protein, 10 aa, Homo Sapiens
AEAFGFKVNA

SEQ ID NO: 118263 - protein, 10 aa, Homo Sapiens
AEALNVFQQA

SEQ ID NO: 118264 - protein, 10 aa, Homo Sapiens
AEAQLRFIQA

SEQ ID NO: 118265 - protein, 10 aa, Homo Sapiens
AEFAPFVVFI

SEQ ID NO: 118266 - protein, 10 aa, Homo Sapiens
AEFDSFVLVT

SEQ ID NO: 118267 - protein, 10 aa, Homo Sapiens
AEFLKVFIPS

SEQ ID NO: 118268 - protein, 10 aa, Homo Sapiens
AEHPTIKIFW

SEQ ID NO: 118269 - protein, 10 aa, Homo Sapiens
AEIASSLPAA

SEQ ID NO: 118270 - protein, 10 aa, Homo Sapiens
AEIDAHLVAL

SEQ ID NO: 118271 - protein, 10 aa, Homo Sapiens
AEIDFRLVSF

SEQ ID NO: 118272 - protein, 10 aa, Homo Sapiens
AEIDSLWEIS

SEQ ID NO: 118273 - protein, 10 aa, Homo Sapiens
AEIEHFIHII

SEQ ID NO: 118274 - protein, 10 aa, Homo Sapiens
AEIEVRSLLP

SEQ ID NO: 118275 - protein, 10 aa, Homo Sapiens
AEIKVKLIEA

SEQ ID NO: 118276 - protein, 10 aa, Homo Sapiens
AEILRSLNSA

SEQ ID NO: 118277 - protein, 10 aa, Homo Sapiens
AEINNIIKIV

SEQ ID NO: 118278 - protein, 10 aa, Homo Sapiens
AEITELIHIA

SEQ ID NO: 118279 - protein, 10 aa, Homo Sapiens
AEIYEEFLAA

SEQ ID NO: 118280 - protein, 10 aa, Homo Sapiens
AELADVLTEA

SEQ ID NO: 118281 - protein, 10 aa, Homo Sapiens
AELDSVFSSA

SEQ ID NO: 118282 - protein, 10 aa, Homo Sapiens
AELGVPLSQV

SEQ ID NO: 118283 - protein, 10 aa, Homo Sapiens
AELLGFLTHA

SEQ ID NO: 118284 - protein, 10 aa, Homo Sapiens
AELYGPFTSA

SEQ ID NO: 118285 - protein, 10 aa, Homo Sapiens
AEMLYGLIHA

SEQ ID NO: 118286 - protein, 10 aa, Homo Sapiens
AEMRPFIEII

SEQ ID NO: 118287 - protein, 10 aa, Homo Sapiens
AEPDFIFRAP

SEQ ID NO: 118288 - protein, 10 aa, Homo Sapiens
AEPSFPFQVA

SEQ ID NO: 118289 - protein, 10 aa, Homo Sapiens
AEPYMIFKEA

SEQ ID NO: 118290 - protein, 10 aa, Homo Sapiens
AEQPWPPLPA

SEQ ID NO: 118291 - protein, 10 aa, Homo Sapiens
AEYDNFFQHL

SEQ ID NO: 118292 - protein, 10 aa, Homo Sapiens
AEYDRPNLLP

SEQ ID NO: 118293 - protein, 10 aa, Homo Sapiens
AEYEFISSGL

SEQ ID NO: 118294 - protein, 10 aa, Homo Sapiens
AEYIPLTPAA

SEQ ID NO: 118295 - protein, 10 aa, Homo Sapiens
AEYLLGPLYA

SEQ ID NO: 118296 - protein, 10 aa, Homo Sapiens
AEYSRFVNQI

SEQ ID NO: 118297 - protein, 10 aa, Homo Sapiens
ASIALEDLLP

SEQ ID NO: 118298 - protein, 10 aa, Homo Sapiens
EEIKDFLLTA

SEQ ID NO: 118299 - protein, 10 aa, Homo Sapiens
FEANFGKIQA

SEQ ID NO: 118300 - protein, 10 aa, Homo Sapiens
FEAPATINSA

SEQ ID NO: 118301 - protein, 10 aa, Homo Sapiens
FEEGNVKLLA

SEQ ID NO: 118302 - protein, 10 aa, Homo Sapiens
FEFGVFPAIL

SEQ ID NO: 118303 - protein, 10 aa, Homo Sapiens
FERPEGFLQA

SEQ ID NO: 118304 - protein, 10 aa, Homo Sapiens
GEADVPFYYA

SEQ ID NO: 118305 - protein, 10 aa, Homo Sapiens
GEAEAFAIGA

SEQ ID NO: 118306 - protein, 10 aa, Homo Sapiens
GEFADPFKLA

SEQ ID NO: 118307 - protein, 10 aa, Homo Sapiens
GEFEGFVAVV

SEQ ID NO: 118308 - protein, 10 aa, Homo Sapiens
GEFGGFGSVT

SEQ ID NO: 118309 - protein, 10 aa, Homo Sapiens
GEFNEVFNDV

SEQ ID NO: 118310 - protein, 10 aa, Homo Sapiens
GEFPFAKCFV

SEQ ID NO: 118311 - protein, 10 aa, Homo Sapiens
GEFQSFPKVF

SEQ ID NO: 118312 - protein, 10 aa, Homo Sapiens
GEFRQGLISA

SEQ ID NO: 118313 - protein, 10 aa, Homo Sapiens
GEHLPFLTSV

SEQ ID NO: 118314 - protein, 10 aa, Homo Sapiens
GEHVPGFCLP

SEQ ID NO: 118315 - protein, 10 aa, Homo Sapiens
GEIDTRFSFC

SEQ ID NO: 118316 - protein, 10 aa, Homo Sapiens
GEIEGFRLSA

SEQ ID NO: 118317 - protein, 10 aa, Homo Sapiens
GEIPAELRAA

SEQ ID NO: 118318 - protein, 10 aa, Homo Sapiens
GEIVTTIPTI

SEQ ID NO: 118319 - protein, 10 aa, Homo Sapiens
GELGNGNIKL

SEQ ID NO: 118320 - protein, 10 aa, Homo Sapiens
GELLERLSSA

SEQ ID NO: 118321 - protein, 10 aa, Homo Sapiens
GEWVGFTLLC

SEQ ID NO: 118322 - protein, 10 aa, Homo Sapiens
GEYDFRYIFV

SEQ ID NO: 118323 - protein, 10 aa, Homo Sapiens
GEYGKFFVTI

SEQ ID NO: 118324 - protein, 10 aa, Homo Sapiens
HEFLHEVPAA

SEQ ID NO: 118325 - protein, 10 aa, Homo Sapiens
HENILGFIAA

SEQ ID NO: 118326 - protein, 10 aa, Homo Sapiens
HEYPPGLLVA

SEQ ID NO: 118327 - protein, 10 aa, Homo Sapiens
IEFDNFIQRT

SEQ ID NO: 118328 - protein, 10 aa, Homo Sapiens
IEIELENSRP

SEQ ID NO: 118329 - protein, 10 aa, Homo Sapiens
IEVEKPFAIA

SEQ ID NO: 118330 - protein, 10 aa, Homo Sapiens
IEYDDFVECL

SEQ ID NO: 118331 - protein, 10 aa, Homo Sapiens
IEYKDFKLIY

SEQ ID NO: 118332 - protein, 10 aa, Homo Sapiens
KEFCAFSQTL

SEQ ID NO: 118333 - protein, 10 aa, Homo Sapiens
KEIDAYIVQA

SEQ ID NO: 118334 - protein, 10 aa, Homo Sapiens
KEIQGFFNIP

SEQ ID NO: 118335 - protein, 10 aa, Homo Sapiens
KEIQGFLDCA

SEQ ID NO: 118336 - protein, 10 aa, Homo Sapiens
KEMEAFLVSV

SEQ ID NO: 118337 - protein, 10 aa, Homo Sapiens
KEYAAFVLGA

SEQ ID NO: 118338 - protein, 10 aa, Homo Sapiens
KEYDFGLGAP

SEQ ID NO: 118339 - protein, 10 aa, Homo Sapiens
KEYDGFTITI

SEQ ID NO: 118340 - protein, 10 aa, Homo Sapiens
KITPLEIEVL

SEQ ID NO: 118341 - protein, 10 aa, Homo Sapiens
LEARFTGVGV

SEQ ID NO: 118342 - protein, 10 aa, Homo Sapiens
LEFAFRYVTT

SEQ ID NO: 118343 - protein, 10 aa, Homo Sapiens
LEFKEFVGLP

SEQ ID NO: 118344 - protein, 10 aa, Homo Sapiens
LEFLNRFEEA

SEQ ID NO: 118345 - protein, 10 aa, Homo Sapiens
LEFPYGILAA

SEQ ID NO: 118346 - protein, 10 aa, Homo Sapiens
LEHYFHAVVA

SEQ ID NO: 118347 - protein, 10 aa, Homo Sapiens
LEIEFKETQA

SEQ ID NO: 118348 - protein, 10 aa, Homo Sapiens
LEIEGERELP

SEQ ID NO: 118349 - protein, 10 aa, Homo Sapiens
LEIQQELKTA

SEQ ID NO: 118350 - protein, 10 aa, Homo Sapiens
LEKGMRGLSA

SEQ ID NO: 118351 - protein, 10 aa, Homo Sapiens
LELPGPLMAA

SEQ ID NO: 118352 - protein, 10 aa, Homo Sapiens
LENPSPFHSP

SEQ ID NO: 118353 - protein, 10 aa, Homo Sapiens
LEVFPEFAAA

SEQ ID NO: 118354 - protein, 10 aa, Homo Sapiens
LEYPDFYRKL

SEQ ID NO: 118355 - protein, 10 aa, Homo Sapiens
LSVAVDLSLP

SEQ ID NO: 118356 - protein, 10 aa, Homo Sapiens
MEHPYFYPVV

SEQ ID NO: 118357 - protein, 10 aa, Homo Sapiens
MEHPYFYTVV

SEQ ID NO: 118358 - protein, 10 aa, Homo Sapiens
NEYRFAWVEA

SEQ ID NO: 118359 - protein, 10 aa, Homo Sapiens
QEFAEGFVKA

SEQ ID NO: 118360 - protein, 10 aa, Homo Sapiens
QEFDYQPIAA

SEQ ID NO: 118361 - protein, 10 aa, Homo Sapiens
QEFQDAWKLP

SEQ ID NO: 118362 - protein, 10 aa, Homo Sapiens
QEFSFGNLRA

SEQ ID NO: 118363 - protein, 10 aa, Homo Sapiens
QERIDAWAQL

SEQ ID NO: 118364 - protein, 10 aa, Homo Sapiens
QEYDALAKVI

SEQ ID NO: 118365 - protein, 10 aa, Homo Sapiens
QEYGSIFTGA

SEQ ID NO: 118366 - protein, 10 aa, Homo Sapiens
QMALTGISPP

SEQ ID NO: 118367 - protein, 10 aa, Homo Sapiens
REFDAFVETL

SEQ ID NO: 118368 - protein, 10 aa, Homo Sapiens
REFSDFIQAV

SEQ ID NO: 118369 - protein, 10 aa, Homo Sapiens
REGDLLFTVA

SEQ ID NO: 118370 - protein, 10 aa, Homo Sapiens
REGPPFISEA

SEQ ID NO: 118371 - protein, 10 aa, Homo Sapiens
REHQFYETLP

SEQ ID NO: 118372 - protein, 10 aa, Homo Sapiens
REIEELLAEA

SEQ ID NO: 118373 - protein, 10 aa, Homo Sapiens
RELDPSLVSA

SEQ ID NO: 118374 - protein, 10 aa, Homo Sapiens
RELLIIGGVA

SEQ ID NO: 118375 - protein, 10 aa, Homo Sapiens
RETDFYLQSV

SEQ ID NO: 118376 - protein, 10 aa, Homo Sapiens
REYEIEFIYA

SEQ ID NO: 118377 - protein, 10 aa, Homo Sapiens
REYMGFIQAM

SEQ ID NO: 118378 - protein, 10 aa, Homo Sapiens
SEFQPSFHQA

SEQ ID NO: 118379 - protein, 10 aa, Homo Sapiens
SEFSFSKLAA

SEQ ID NO: 118380 - protein, 10 aa, Homo Sapiens
SEHCFDLIFA

SEQ ID NO: 118381 - protein, 10 aa, Homo Sapiens
SEIEKLSAAF

SEQ ID NO: 118382 - protein, 10 aa, Homo Sapiens
SELEKTFNLP

SEQ ID NO: 118383 - protein, 10 aa, Homo Sapiens
SETPFHFTLP

SEQ ID NO: 118384 - protein, 10 aa, Homo Sapiens
SEVTFALHSA

SEQ ID NO: 118385 - protein, 10 aa, Homo Sapiens
SEYNFEDLSA

SEQ ID NO: 118386 - protein, 10 aa, Homo Sapiens
TEAQHLFLQA

SEQ ID NO: 118387 - protein, 10 aa, Homo Sapiens
TEYAFAFIQV

SEQ ID NO: 118388 - protein, 10 aa, Homo Sapiens
TEYENFKVQV

SEQ ID NO: 118389 - protein, 10 aa, Homo Sapiens
TLPPPDFPPP

SEQ ID NO: 118390 - protein, 10 aa, Homo Sapiens
VEFMHYIIAA

SEQ ID NO: 118391 - protein, 10 aa, Homo Sapiens
VEFNGKLLAS

SEQ ID NO: 118392 - protein, 10 aa, Homo Sapiens
VEFRNFKIIY

SEQ ID NO: 118393 - protein, 10 aa, Homo Sapiens
VEFVKSFNLP

SEQ ID NO: 118394 - protein, 10 aa, Homo Sapiens
VEHYFFGVEA

SEQ ID NO: 118395 - protein, 10 aa, Homo Sapiens
VEIRSGFLAA

SEQ ID NO: 118396 - protein, 10 aa, Homo Sapiens
VEYNGGFHLA

SEQ ID NO: 118397 - protein, 10 aa, Homo Sapiens
WEAYLGLLQA

SEQ ID NO: 118398 - protein, 10 aa, Homo Sapiens
WEAYLSRLGV

SEQ ID NO: 118399 - protein, 10 aa, Homo Sapiens
YEFDFSKVYW

SEQ ID NO: 118400 - protein, 10 aa, Homo Sapiens
YEFPRVFSSV

SEQ ID NO: 118401 - protein, 10 aa, Homo Sapiens
YEIKQFLECA

SEQ ID NO: 118402 - protein, 10 aa, Homo Sapiens
YEILTPNSIP

SEQ ID NO: 118403 - protein, 10 aa, Homo Sapiens
YELDLGLNHV

SEQ ID NO: 118404 - protein, 10 aa, Homo Sapiens
YELLFKEGVM

SEQ ID NO: 118405 - protein, 10 aa, Homo Sapiens
YEQDFAVLTA

SEQ ID NO: 118406 - protein, 10 aa, Homo Sapiens
YEVRLTQTVA

SEQ ID NO: 118407 - protein, 11 aa, Homo Sapiens
AEADKIGLLLA

SEQ ID NO: 118408 - protein, 11 aa, Homo Sapiens
AEAERLLAPFL

SEQ ID NO: 118409 - protein, 11 aa, Homo Sapiens
AEANAFSVLQH

SEQ ID NO: 118410 - protein, 11 aa, Homo Sapiens
AEDVLSGKVSA

SEQ ID NO: 118411 - protein, 11 aa, Homo Sapiens
AEFHQIEGVVA

SEQ ID NO: 118412 - protein, 11 aa, Homo Sapiens
AEFPLGPVTTA

SEQ ID NO: 118413 - protein, 11 aa, Homo Sapiens
AEFWKFSGIVF

SEQ ID NO: 118414 - protein, 11 aa, Homo Sapiens
AEHDLWHIIKF

SEQ ID NO: 118415 - protein, 11 aa, Homo Sapiens
AEIDAHLVALA

SEQ ID NO: 118416 - protein, 11 aa, Homo Sapiens
AEIDPKQLVDI

SEQ ID NO: 118417 - protein, 11 aa, Homo Sapiens
AEILELAGNAA

SEQ ID NO: 118418 - protein, 11 aa, Homo Sapiens
AEILNGKEISA

SEQ ID NO: 118419 - protein, 11 aa, Homo Sapiens
AEIQFADYIFP

SEQ ID NO: 118420 - protein, 11 aa, Homo Sapiens
AETPGFGAVTF

SEQ ID NO: 118421 - protein, 11 aa, Homo Sapiens
AEYGHFVDIRI

SEQ ID NO: 118422 - protein, 11 aa, Homo Sapiens
AEYIPLTPAAA

SEQ ID NO: 118423 - protein, 11 aa, Homo Sapiens
FEIKDKMLIEF

SEQ ID NO: 118424 - protein, 11 aa, Homo Sapiens
FEVGPPAFRIA

SEQ ID NO: 118425 - protein, 11 aa, Homo Sapiens
GEDSSFLVVRL

SEQ ID NO: 118426 - protein, 11 aa, Homo Sapiens
GEIDTRFSFCA

SEQ ID NO: 118427 - protein, 11 aa, Homo Sapiens
GEITLRGLVLP

SEQ ID NO: 118428 - protein, 11 aa, Homo Sapiens
GEWVGFTLLCA

SEQ ID NO: 118429 - protein, 11 aa, Homo Sapiens
GEYVSLGKVEA

SEQ ID NO: 118430 - protein, 11 aa, Homo Sapiens
LEAAQGLLVEA

SEQ ID NO: 118431 - protein, 11 aa, Homo Sapiens
LEAIPTSGLTA

SEQ ID NO: 118432 - protein, 11 aa, Homo Sapiens
LEFDPAQRITL

SEQ ID NO: 118433 - protein, 11 aa, Homo Sapiens
LEHVFFQVVEF

SEQ ID NO: 118434 - protein, 11 aa, Homo Sapiens
LEIAPHALLQA

SEQ ID NO: 118435 - protein, 11 aa, Homo Sapiens
LEINFGDLGRP

SEQ ID NO: 118436 - protein, 11 aa, Homo Sapiens
LESLPEPVICY

SEQ ID NO: 118437 - protein, 11 aa, Homo Sapiens
LEYDPAKRITL

SEQ ID NO: 118438 - protein, 11 aa, Homo Sapiens
LEYDPLSNYSA

SEQ ID NO: 118439 - protein, 11 aa, Homo Sapiens
LEYGFLRLSQA

SEQ ID NO: 118440 - protein, 11 aa, Homo Sapiens
LEYIARAILSA

SEQ ID NO: 118441 - protein, 11 aa, Homo Sapiens
MEHDGSLFQAV

SEQ ID NO: 118442 - protein, 11 aa, Homo Sapiens
MERNFQPVIIF

SEQ ID NO: 118443 - protein, 11 aa, Homo Sapiens
PSGNGYKFLSP

SEQ ID NO: 118444 - protein, 11 aa, Homo Sapiens
QEIFTEQVVTA

SEQ ID NO: 118445 - protein, 11 aa, Homo Sapiens
READAALFSEL

SEQ ID NO: 118446 - protein, 11 aa, Homo Sapiens
REALFNEFVAA

SEQ ID NO: 118447 - protein, 11 aa, Homo Sapiens
REFLFNAIETM

SEQ ID NO: 118448 - protein, 11 aa, Homo Sapiens
REIEIPLGELF

SEQ ID NO: 118449 - protein, 11 aa, Homo Sapiens
REIFLSQPILL

SEQ ID NO: 118450 - protein, 11 aa, Homo Sapiens
RELENLIGISC

SEQ ID NO: 118451 - protein, 11 aa, Homo Sapiens
RELLIIGGVAA

SEQ ID NO: 118452 - protein, 11 aa, Homo Sapiens
REPPADVWTPP

SEQ ID NO: 118453 - protein, 11 aa, Homo Sapiens
RESGQLFHIDF

SEQ ID NO: 118454 - protein, 11 aa, Homo Sapiens
REYDRFYVINY

SEQ ID NO: 118455 - protein, 11 aa, Homo Sapiens
REYEIPSNLTP

SEQ ID NO: 118456 - protein, 11 aa, Homo Sapiens
REYNARLFGLA

SEQ ID NO: 118457 - protein, 11 aa, Homo Sapiens
SEEDRVVVIRF

SEQ ID NO: 118458 - protein, 11 aa, Homo Sapiens
SEIDESVKLIP

SEQ ID NO: 118459 - protein, 11 aa, Homo Sapiens
SEYSGFVNPVL

SEQ ID NO: 118460 - protein, 11 aa, Homo Sapiens
TEDPHTVLVEF

SEQ ID NO: 118461 - protein, 11 aa, Homo Sapiens
TEFFFGASGSP

SEQ ID NO: 118462 - protein, 11 aa, Homo Sapiens
TEYENFKVQVL

SEQ ID NO: 118463 - protein, 11 aa, Homo Sapiens
TVEYVTFTSIA

SEQ ID NO: 118464 - protein, 11 aa, Homo Sapiens
VEFQHIIPISA

SEQ ID NO: 118465 - protein, 11 aa, Homo Sapiens
VEYIFGIVGIP

SEQ ID NO: 118466 - protein, 11 aa, Homo Sapiens
WEYDESHVITA

SEQ ID NO: 118467 - protein, 11 aa, Homo Sapiens
YEIPGLEPITF

SEQ ID NO: 118468 - protein, 11 aa, Homo Sapiens
YELDLGLNHVV

SEQ ID NO: 118469 - protein, 8 aa, Homo Sapiens
ADILTQIL

SEQ ID NO: 118470 - protein, 8 aa, Homo Sapiens
ADLVFISV

SEQ ID NO: 118471 - protein, 8 aa, Homo Sapiens
ALVQVRVL

SEQ ID NO: 118472 - protein, 8 aa, Homo Sapiens
ASPAVLEL

SEQ ID NO: 118473 - protein, 8 aa, Homo Sapiens
ATPAIPTI

SEQ ID NO: 118474 - protein, 8 aa, Homo Sapiens
DAAEFRVV

SEQ ID NO: 118475 - protein, 8 aa, Homo Sapiens
DAAEIRLV

SEQ ID NO: 118476 - protein, 8 aa, Homo Sapiens
DAAFATLV

SEQ ID NO: 118477 - protein, 8 aa, Homo Sapiens
DAAIVDMV

SEQ ID NO: 118478 - protein, 8 aa, Homo Sapiens
DAARFPII

SEQ ID NO: 118479 - protein, 8 aa, Homo Sapiens
DADYAIKI

SEQ ID NO: 118480 - protein, 8 aa, Homo Sapiens
DAFISVQV

SEQ ID NO: 118481 - protein, 8 aa, Homo Sapiens
DAFKIWVI

SEQ ID NO: 118482 - protein, 8 aa, Homo Sapiens
DAFKTLFV

SEQ ID NO: 118483 - protein, 8 aa, Homo Sapiens
DAFNIPLI

SEQ ID NO: 118484 - protein, 8 aa, Homo Sapiens
DAFPPPRV

SEQ ID NO: 118485 - protein, 8 aa, Homo Sapiens
DAFPVGEV

SEQ ID NO: 118486 - protein, 8 aa, Homo Sapiens
DAFRFENV

SEQ ID NO: 118487 - protein, 8 aa, Homo Sapiens
DAFRQPSL

SEQ ID NO: 118488 - protein, 8 aa, Homo Sapiens
DAFRTLGL

SEQ ID NO: 118489 - protein, 8 aa, Homo Sapiens
DAFRVNVI

SEQ ID NO: 118490 - protein, 8 aa, Homo Sapiens
DAFTIKTV

SEQ ID NO: 118491 - protein, 8 aa, Homo Sapiens
DAFVFSYL

SEQ ID NO: 118492 - protein, 8 aa, Homo Sapiens
DAGLGKLI

SEQ ID NO: 118493 - protein, 8 aa, Homo Sapiens
DAIAVHVV

SEQ ID NO: 118494 - protein, 8 aa, Homo Sapiens
DAIKLMNI

SEQ ID NO: 118495 - protein, 8 aa, Homo Sapiens
DAILATLM

SEQ ID NO: 118496 - protein, 8 aa, Homo Sapiens
DAIPGLKI

SEQ ID NO: 118497 - protein, 8 aa, Homo Sapiens
DAIRILGI

SEQ ID NO: 118498 - protein, 8 aa, Homo Sapiens
DAIRLKEI

SEQ ID NO: 118499 - protein, 8 aa, Homo Sapiens
DALIVRPV

SEQ ID NO: 118500 - protein, 8 aa, Homo Sapiens
DALKVTFL

SEQ ID NO: 118501 - protein, 8 aa, Homo Sapiens
DALQGFKI

SEQ ID NO: 118502 - protein, 8 aa, Homo Sapiens
DALQILHI

SEQ ID NO: 118503 - protein, 8 aa, Homo Sapiens
DALRICIV

SEQ ID NO: 118504 - protein, 8 aa, Homo Sapiens
DALRLYLI

SEQ ID NO: 118505 - protein, 8 aa, Homo Sapiens
DALVIFQL

SEQ ID NO: 118506 - protein, 8 aa, Homo Sapiens
DALVILQL

SEQ ID NO: 118507 - protein, 8 aa, Homo Sapiens
DALVLAKM

SEQ ID NO: 118508 - protein, 8 aa, Homo Sapiens
DALVLHKV

SEQ ID NO: 118509 - protein, 8 aa, Homo Sapiens
DAMGMNMI

SEQ ID NO: 118510 - protein, 8 aa, Homo Sapiens
DAMRLYYV

SEQ ID NO: 118511 - protein, 8 aa, Homo Sapiens
DAMYVKLI

SEQ ID NO: 118512 - protein, 8 aa, Homo Sapiens
DANLLPLV

SEQ ID NO: 118513 - protein, 8 aa, Homo Sapiens
DAPDTLLL

SEQ ID NO: 118514 - protein, 8 aa, Homo Sapiens
DAPDVFTV

SEQ ID NO: 118515 - protein, 8 aa, Homo Sapiens
DAPESIQF

SEQ ID NO: 118516 - protein, 8 aa, Homo Sapiens
DAPGVPRI

SEQ ID NO: 118517 - protein, 8 aa, Homo Sapiens
DAPIGPHL

SEQ ID NO: 118518 - protein, 8 aa, Homo Sapiens
DAPLDLKI

SEQ ID NO: 118519 - protein, 8 aa, Homo Sapiens
DAPLSPLL

SEQ ID NO: 118520 - protein, 8 aa, Homo Sapiens
DAPVALVV

SEQ ID NO: 118521 - protein, 8 aa, Homo Sapiens
DAPYIFIV

SEQ ID NO: 118522 - protein, 8 aa, Homo Sapiens
DARTFYII

SEQ ID NO: 118523 - protein, 8 aa, Homo Sapiens
DARVAITI

SEQ ID NO: 118524 - protein, 8 aa, Homo Sapiens
DASLVFKV

SEQ ID NO: 118525 - protein, 8 aa, Homo Sapiens
DATVFTCI

SEQ ID NO: 118526 - protein, 8 aa, Homo Sapiens
DAVKILKL

SEQ ID NO: 118527 - protein, 8 aa, Homo Sapiens
DAVKMTII

SEQ ID NO: 118528 - protein, 8 aa, Homo Sapiens
DAVQLNVI

SEQ ID NO: 118529 - protein, 8 aa, Homo Sapiens
DAVRIVHI

SEQ ID NO: 118530 - protein, 8 aa, Homo Sapiens
DAVVMPKI

SEQ ID NO: 118531 - protein, 8 aa, Homo Sapiens
DAWKLPKI

SEQ ID NO: 118532 - protein, 8 aa, Homo Sapiens
DAWLVHSV

SEQ ID NO: 118533 - protein, 8 aa, Homo Sapiens
DAYIPLQI

SEQ ID NO: 118534 - protein, 8 aa, Homo Sapiens
DAYLPLRL

SEQ ID NO: 118535 - protein, 8 aa, Homo Sapiens
DAYLQILI

SEQ ID NO: 118536 - protein, 8 aa, Homo Sapiens
DAYLVHLI

SEQ ID NO: 118537 - protein, 8 aa, Homo Sapiens
DAYVLPKL

SEQ ID NO: 118538 - protein, 8 aa, Homo Sapiens
DFIRILVI

SEQ ID NO: 118539 - protein, 8 aa, Homo Sapiens
DGATILKL

SEQ ID NO: 118540 - protein, 8 aa, Homo Sapiens
DGFKANLV

SEQ ID NO: 118541 - protein, 8 aa, Homo Sapiens
DGFTPLAV

SEQ ID NO: 118542 - protein, 8 aa, Homo Sapiens
DGFTVPQI

SEQ ID NO: 118543 - protein, 8 aa, Homo Sapiens
DGIVIVKV

SEQ ID NO: 118544 - protein, 8 aa, Homo Sapiens
DGIVNPTI

SEQ ID NO: 118545 - protein, 8 aa, Homo Sapiens
DGLCTRLI

SEQ ID NO: 118546 - protein, 8 aa, Homo Sapiens
DGLITPTI

SEQ ID NO: 118547 - protein, 8 aa, Homo Sapiens
DGLVLPVI

SEQ ID NO: 118548 - protein, 8 aa, Homo Sapiens
DGLVVLKI

SEQ ID NO: 118549 - protein, 8 aa, Homo Sapiens
DGPGILRI

SEQ ID NO: 118550 - protein, 8 aa, Homo Sapiens
DGPRVFRV

SEQ ID NO: 118551 - protein, 8 aa, Homo Sapiens
DGTVLPTL

SEQ ID NO: 118552 - protein, 8 aa, Homo Sapiens
DGVAVLKV

SEQ ID NO: 118553 - protein, 8 aa, Homo Sapiens
DGVLIWKI

SEQ ID NO: 118554 - protein, 8 aa, Homo Sapiens
DGVPVIKV

SEQ ID NO: 118555 - protein, 8 aa, Homo Sapiens
DGWPAMGI

SEQ ID NO: 118556 - protein, 8 aa, Homo Sapiens
DGWTPLHV

SEQ ID NO: 118557 - protein, 8 aa, Homo Sapiens
DGYLMICV

SEQ ID NO: 118558 - protein, 8 aa, Homo Sapiens
DMYLAPHV

SEQ ID NO: 118559 - protein, 8 aa, Homo Sapiens
DMYLVPKL

SEQ ID NO: 118560 - protein, 8 aa, Homo Sapiens
DPFFMPEI

SEQ ID NO: 118561 - protein, 8 aa, Homo Sapiens
DPFILDVI

SEQ ID NO: 118562 - protein, 8 aa, Homo Sapiens
DPFTVPTI

SEQ ID NO: 118563 - protein, 8 aa, Homo Sapiens
DPFVAFHI

SEQ ID NO: 118564 - protein, 8 aa, Homo Sapiens
DPGPILRI

SEQ ID NO: 118565 - protein, 8 aa, Homo Sapiens
DPMVQCII

SEQ ID NO: 118566 - protein, 8 aa, Homo Sapiens
DPPIIIFV

SEQ ID NO: 118567 - protein, 8 aa, Homo Sapiens
DPPVLPTV

SEQ ID NO: 118568 - protein, 8 aa, Homo Sapiens
DPRIIRLI

SEQ ID NO: 118569 - protein, 8 aa, Homo Sapiens
DPSLAPYI

SEQ ID NO: 118570 - protein, 8 aa, Homo Sapiens
DPTQLPKI

SEQ ID NO: 118571 - protein, 8 aa, Homo Sapiens
DPTVLPLL

SEQ ID NO: 118572 - protein, 8 aa, Homo Sapiens
DPVGVLYI

SEQ ID NO: 118573 - protein, 8 aa, Homo Sapiens
DPWLLPEI

SEQ ID NO: 118574 - protein, 8 aa, Homo Sapiens
DPYCLLGI

SEQ ID NO: 118575 - protein, 8 aa, Homo Sapiens
DPYKVYRI

SEQ ID NO: 118576 - protein, 8 aa, Homo Sapiens
DPYLLPHI

SEQ ID NO: 118577 - protein, 8 aa, Homo Sapiens
DPYLLPHM

SEQ ID NO: 118578 - protein, 8 aa, Homo Sapiens
DPYPLLVV

SEQ ID NO: 118579 - protein, 8 aa, Homo Sapiens
DPYRALDI

SEQ ID NO: 118580 - protein, 8 aa, Homo Sapiens
DPYTFAEI

SEQ ID NO: 118581 - protein, 8 aa, Homo Sapiens
DQYKFYSV

SEQ ID NO: 118582 - protein, 8 aa, Homo Sapiens
DSALLPAV

SEQ ID NO: 118583 - protein, 8 aa, Homo Sapiens
DSIVLQSV

SEQ ID NO: 118584 - protein, 8 aa, Homo Sapiens
DSLITPHV

SEQ ID NO: 118585 - protein, 8 aa, Homo Sapiens
DSLVILTI

SEQ ID NO: 118586 - protein, 8 aa, Homo Sapiens
DSLVLNNI

SEQ ID NO: 118587 - protein, 8 aa, Homo Sapiens
DSQILPKI

SEQ ID NO: 118588 - protein, 8 aa, Homo Sapiens
DTFRIPLI

SEQ ID NO: 118589 - protein, 8 aa, Homo Sapiens
DVPGVPKI

SEQ ID NO: 118590 - protein, 8 aa, Homo Sapiens
DVPQVSLI

SEQ ID NO: 118591 - protein, 8 aa, Homo Sapiens
EALPVKLI

SEQ ID NO: 118592 - protein, 8 aa, Homo Sapiens
EALVMPTL

SEQ ID NO: 118593 - protein, 8 aa, Homo Sapiens
EAPAVLLC

SEQ ID NO: 118594 - protein, 8 aa, Homo Sapiens
EAWPALQI

SEQ ID NO: 118595 - protein, 8 aa, Homo Sapiens
EPFIFHEV

SEQ ID NO: 118596 - protein, 8 aa, Homo Sapiens
EPPLSLTI

SEQ ID NO: 118597 - protein, 8 aa, Homo Sapiens
EPPQVLEI

SEQ ID NO: 118598 - protein, 8 aa, Homo Sapiens
EQFLLPVI

SEQ ID NO: 118599 - protein, 8 aa, Homo Sapiens
FALGILKI

SEQ ID NO: 118600 - protein, 8 aa, Homo Sapiens
FAPMSPRI

SEQ ID NO: 118601 - protein, 8 aa, Homo Sapiens
FAYTVKYV

SEQ ID NO: 118602 - protein, 8 aa, Homo Sapiens
FGPVASVV

SEQ ID NO: 118603 - protein, 8 aa, Homo Sapiens
FGYRTLTV

SEQ ID NO: 118604 - protein, 8 aa, Homo Sapiens
FPAIAQEI

SEQ ID NO: 118605 - protein, 8 aa, Homo Sapiens
FPALLVRI

SEQ ID NO: 118606 - protein, 8 aa, Homo Sapiens
FPAVSALV

SEQ ID NO: 118607 - protein, 8 aa, Homo Sapiens
FPAVTVEV

SEQ ID NO: 118608 - protein, 8 aa, Homo Sapiens
FPFHFVEV

SEQ ID NO: 118609 - protein, 8 aa, Homo Sapiens
FPFIPIQV

SEQ ID NO: 118610 - protein, 8 aa, Homo Sapiens
FPFKPPSI

SEQ ID NO: 118611 - protein, 8 aa, Homo Sapiens
FPFLFQHI

SEQ ID NO: 118612 - protein, 8 aa, Homo Sapiens
FPFQPGSV

SEQ ID NO: 118613 - protein, 8 aa, Homo Sapiens
FPFSLQHI

SEQ ID NO: 118614 - protein, 8 aa, Homo Sapiens
FPFVAVSI

SEQ ID NO: 118615 - protein, 8 aa, Homo Sapiens
FPGLAIKI

SEQ ID NO: 118616 - protein, 8 aa, Homo Sapiens
FPHPLPSL

SEQ ID NO: 118617 - protein, 8 aa, Homo Sapiens
FPHVLPLI

SEQ ID NO: 118618 - protein, 8 aa, Homo Sapiens
FPLIISSV

SEQ ID NO: 118619 - protein, 8 aa, Homo Sapiens
FPNILKEI

SEQ ID NO: 118620 - protein, 8 aa, Homo Sapiens
FPRPEPFV

SEQ ID NO: 118621 - protein, 8 aa, Homo Sapiens
FPSPILKV

SEQ ID NO: 118622 - protein, 8 aa, Homo Sapiens
FPSYLETV

SEQ ID NO: 118623 - protein, 8 aa, Homo Sapiens
FPTLQPTV

SEQ ID NO: 118624 - protein, 8 aa, Homo Sapiens
FPVEVNTV

SEQ ID NO: 118625 - protein, 8 aa, Homo Sapiens
FPVFATVI

SEQ ID NO: 118626 - protein, 8 aa, Homo Sapiens
FPVILYEV

SEQ ID NO: 118627 - protein, 8 aa, Homo Sapiens
FPVVVHSV

SEQ ID NO: 118628 - protein, 8 aa, Homo Sapiens
FPYAFKEV

SEQ ID NO: 118629 - protein, 8 aa, Homo Sapiens
FPYIQKGL

SEQ ID NO: 118630 - protein, 8 aa, Homo Sapiens
FPYKIPAV

SEQ ID NO: 118631 - protein, 8 aa, Homo Sapiens
FPYPFQVV

SEQ ID NO: 118632 - protein, 8 aa, Homo Sapiens
FPYSSHLI

SEQ ID NO: 118633 - protein, 8 aa, Homo Sapiens
FPYVLKEI

SEQ ID NO: 118634 - protein, 8 aa, Homo Sapiens
FPYVTMDI

SEQ ID NO: 118635 - protein, 8 aa, Homo Sapiens
GEGLGKII

SEQ ID NO: 118636 - protein, 8 aa, Homo Sapiens
GVEKIIKI

SEQ ID NO: 118637 - protein, 8 aa, Homo Sapiens
HAFKISKI

SEQ ID NO: 118638 - protein, 8 aa, Homo Sapiens
HATIIPKV

SEQ ID NO: 118639 - protein, 8 aa, Homo Sapiens
HAVLLQVI

SEQ ID NO: 118640 - protein, 8 aa, Homo Sapiens
HGLLLPHI

SEQ ID NO: 118641 - protein, 8 aa, Homo Sapiens
HGLTVPLI

SEQ ID NO: 118642 - protein, 8 aa, Homo Sapiens
HGVFLPLV

SEQ ID NO: 118643 - protein, 8 aa, Homo Sapiens
HPFHVIRI

SEQ ID NO: 118644 - protein, 8 aa, Homo Sapiens
HPLVILNI

SEQ ID NO: 118645 - protein, 8 aa, Homo Sapiens
HPYMFQHI

SEQ ID NO: 118646 - protein, 8 aa, Homo Sapiens
IAAVLPKV

SEQ ID NO: 118647 - protein, 8 aa, Homo Sapiens
IAFLSPKV

SEQ ID NO: 118648 - protein, 8 aa, Homo Sapiens
IAPETLRV

SEQ ID NO: 118649 - protein, 8 aa, Homo Sapiens
IAPLVKSL

SEQ ID NO: 118650 - protein, 8 aa, Homo Sapiens
IAPVLLVV

SEQ ID NO: 118651 - protein, 8 aa, Homo Sapiens
IAPVTLKV

SEQ ID NO: 118652 - protein, 8 aa, Homo Sapiens
IAPYSVEI

SEQ ID NO: 118653 - protein, 8 aa, Homo Sapiens
IATILREI

SEQ ID NO: 118654 - protein, 8 aa, Homo Sapiens
IAVKALQI

SEQ ID NO: 118655 - protein, 8 aa, Homo Sapiens
IAYILQGV

SEQ ID NO: 118656 - protein, 8 aa, Homo Sapiens
IAYIMPGL

SEQ ID NO: 118657 - protein, 8 aa, Homo Sapiens
IGYLIPLM

SEQ ID NO: 118658 - protein, 8 aa, Homo Sapiens
IIPPLFTV

SEQ ID NO: 118659 - protein, 8 aa, Homo Sapiens
IPADLRII

SEQ ID NO: 118660 - protein, 8 aa, Homo Sapiens
IPAEVPHI

SEQ ID NO: 118661 - protein, 8 aa, Homo Sapiens
IPAYFVTV

SEQ ID NO: 118662 - protein, 8 aa, Homo Sapiens
IPFGTALV

SEQ ID NO: 118663 - protein, 8 aa, Homo Sapiens
IPFIPMGV

SEQ ID NO: 118664 - protein, 8 aa, Homo Sapiens
IPFISKEL

SEQ ID NO: 118665 - protein, 8 aa, Homo Sapiens
IPFPVEKI

SEQ ID NO: 118666 - protein, 8 aa, Homo Sapiens
IPFQPRHL

SEQ ID NO: 118667 - protein, 8 aa, Homo Sapiens
IPFSPYRV

SEQ ID NO: 118668 - protein, 8 aa, Homo Sapiens
IPHEVPQI

SEQ ID NO: 118669 - protein, 8 aa, Homo Sapiens
IPHSFALI

SEQ ID NO: 118670 - protein, 8 aa, Homo Sapiens
IPIAVSGV

SEQ ID NO: 118671 - protein, 8 aa, Homo Sapiens
IPIFLPEV

SEQ ID NO: 118672 - protein, 8 aa, Homo Sapiens
IPITVRHI

SEQ ID NO: 118673 - protein, 8 aa, Homo Sapiens
IPLLINHL

SEQ ID NO: 118674 - protein, 8 aa, Homo Sapiens
IPLLVQGV

SEQ ID NO: 118675 - protein, 8 aa, Homo Sapiens
IPMEMTRV

SEQ ID NO: 118676 - protein, 8 aa, Homo Sapiens
IPNIFQKI

SEQ ID NO: 118677 - protein, 8 aa, Homo Sapiens
IPNRIPKI

SEQ ID NO: 118678 - protein, 8 aa, Homo Sapiens
IPPHAVMV

SEQ ID NO: 118679 - protein, 8 aa, Homo Sapiens
IPPIAIFL

SEQ ID NO: 118680 - protein, 8 aa, Homo Sapiens
IPPLGLKV

SEQ ID NO: 118681 - protein, 8 aa, Homo Sapiens
IPPPVIMV

SEQ ID NO: 118682 - protein, 8 aa, Homo Sapiens
IPPYVPRF

SEQ ID NO: 118683 - protein, 8 aa, Homo Sapiens
IPQIMPSI

SEQ ID NO: 118684 - protein, 8 aa, Homo Sapiens
IPQLVSNI

SEQ ID NO: 118685 - protein, 8 aa, Homo Sapiens
IPRLIPVI

SEQ ID NO: 118686 - protein, 8 aa, Homo Sapiens
IPTVFVAV

SEQ ID NO: 118687 - protein, 8 aa, Homo Sapiens
IPVHLPNI

SEQ ID NO: 118688 - protein, 8 aa, Homo Sapiens
IPVVHASI

SEQ ID NO: 118689 - protein, 8 aa, Homo Sapiens
IPVVVRQV

SEQ ID NO: 118690 - protein, 8 aa, Homo Sapiens
IPWGPASI

SEQ ID NO: 118691 - protein, 8 aa, Homo Sapiens
IPWKVPGL

SEQ ID NO: 118692 - protein, 8 aa, Homo Sapiens
IPYAQPPL

SEQ ID NO: 118693 - protein, 8 aa, Homo Sapiens
IPYESPIF

SEQ ID NO: 118694 - protein, 8 aa, Homo Sapiens
IPYGMRFI

SEQ ID NO: 118695 - protein, 8 aa, Homo Sapiens
IPYHIVNI

SEQ ID NO: 118696 - protein, 8 aa, Homo Sapiens
IPYIPTLI

SEQ ID NO: 118697 - protein, 8 aa, Homo Sapiens
IPYITNVL

SEQ ID NO: 118698 - protein, 8 aa, Homo Sapiens
IPYKTILL

SEQ ID NO: 118699 - protein, 8 aa, Homo Sapiens
IPYLPELI

SEQ ID NO: 118700 - protein, 8 aa, Homo Sapiens
IPYLVVKV

SEQ ID NO: 118701 - protein, 8 aa, Homo Sapiens
IPYNFICV

SEQ ID NO: 118702 - protein, 8 aa, Homo Sapiens
ISPGKLVW

SEQ ID NO: 118703 - protein, 8 aa, Homo Sapiens
LAAALAHI

SEQ ID NO: 118704 - protein, 8 aa, Homo Sapiens
LAPLAKVI

SEQ ID NO: 118705 - protein, 8 aa, Homo Sapiens
LAPLIQVI

SEQ ID NO: 118706 - protein, 8 aa, Homo Sapiens
LAPPALVV

SEQ ID NO: 118707 - protein, 8 aa, Homo Sapiens
LAPVVKEI

SEQ ID NO: 118708 - protein, 8 aa, Homo Sapiens
LGYVPIMV

SEQ ID NO: 118709 - protein, 8 aa, Homo Sapiens
LMPLVVVL

SEQ ID NO: 118710 - protein, 8 aa, Homo Sapiens
LPAFSPLM

SEQ ID NO: 118711 - protein, 8 aa, Homo Sapiens
LPAFVRVV

SEQ ID NO: 118712 - protein, 8 aa, Homo Sapiens
LPAFVSVV

SEQ ID NO: 118713 - protein, 8 aa, Homo Sapiens
LPAHAVII

SEQ ID NO: 118714 - protein, 8 aa, Homo Sapiens
LPALLQQI

SEQ ID NO: 118715 - protein, 8 aa, Homo Sapiens
LPALVSQI

SEQ ID NO: 118716 - protein, 8 aa, Homo Sapiens
LPAPAPVI

SEQ ID NO: 118717 - protein, 8 aa, Homo Sapiens
LPATIARI

SEQ ID NO: 118718 - protein, 8 aa, Homo Sapiens
LPAVSLEV

SEQ ID NO: 118719 - protein, 8 aa, Homo Sapiens
LPEVLAVI

SEQ ID NO: 118720 - protein, 8 aa, Homo Sapiens
LPFAAAQI

SEQ ID NO: 118721 - protein, 8 aa, Homo Sapiens
LPFEASYI

SEQ ID NO: 118722 - protein, 8 aa, Homo Sapiens
LPFFAIQI

SEQ ID NO: 118723 - protein, 8 aa, Homo Sapiens
LPFGMNII

SEQ ID NO: 118724 - protein, 8 aa, Homo Sapiens
LPFQLSSV

SEQ ID NO: 118725 - protein, 8 aa, Homo Sapiens
LPFQQFEI

SEQ ID NO: 118726 - protein, 8 aa, Homo Sapiens
LPFRVLLV

SEQ ID NO: 118727 - protein, 8 aa, Homo Sapiens
LPFSFEHI

SEQ ID NO: 118728 - protein, 8 aa, Homo Sapiens
LPFSPLVI

SEQ ID NO: 118729 - protein, 8 aa, Homo Sapiens
LPFSQPKV

SEQ ID NO: 118730 - protein, 8 aa, Homo Sapiens
LPFTIPEL

SEQ ID NO: 118731 - protein, 8 aa, Homo Sapiens
LPFTMKKI

SEQ ID NO: 118732 - protein, 8 aa, Homo Sapiens
LPFTPKNI

SEQ ID NO: 118733 - protein, 8 aa, Homo Sapiens
LPFVLQEI

SEQ ID NO: 118734 - protein, 8 aa, Homo Sapiens
LPHAGPII

SEQ ID NO: 118735 - protein, 8 aa, Homo Sapiens
LPHAILRL

SEQ ID NO: 118736 - protein, 8 aa, Homo Sapiens
LPHEILEM

SEQ ID NO: 118737 - protein, 8 aa, Homo Sapiens
LPHLVVSI

SEQ ID NO: 118738 - protein, 8 aa, Homo Sapiens
LPHPGLKV

SEQ ID NO: 118739 - protein, 8 aa, Homo Sapiens
LPHPGLQV

SEQ ID NO: 118740 - protein, 8 aa, Homo Sapiens
LPHVVPTL

SEQ ID NO: 118741 - protein, 8 aa, Homo Sapiens
LPILVNII

SEQ ID NO: 118742 - protein, 8 aa, Homo Sapiens
LPILVQHI

SEQ ID NO: 118743 - protein, 8 aa, Homo Sapiens
LPIRVLLV

SEQ ID NO: 118744 - protein, 8 aa, Homo Sapiens
LPITVAHV

SEQ ID NO: 118745 - protein, 8 aa, Homo Sapiens
LPIVTPAL

SEQ ID NO: 118746 - protein, 8 aa, Homo Sapiens
LPIYAVTV

SEQ ID NO: 118747 - protein, 8 aa, Homo Sapiens
LPLALRTV

SEQ ID NO: 118748 - protein, 8 aa, Homo Sapiens
LPLKVLVV

SEQ ID NO: 118749 - protein, 8 aa, Homo Sapiens
LPLLLTAV

SEQ ID NO: 118750 - protein, 8 aa, Homo Sapiens
LPLLVRVI

SEQ ID NO: 118751 - protein, 8 aa, Homo Sapiens
LPLPIPTV

SEQ ID NO: 118752 - protein, 8 aa, Homo Sapiens
LPLVVSFI

SEQ ID NO: 118753 - protein, 8 aa, Homo Sapiens
LPMFIIVV

SEQ ID NO: 118754 - protein, 8 aa, Homo Sapiens
LPMHPLQI

SEQ ID NO: 118755 - protein, 8 aa, Homo Sapiens
LPMSVIIV

SEQ ID NO: 118756 - protein, 8 aa, Homo Sapiens
LPNRALLV

SEQ ID NO: 118757 - protein, 8 aa, Homo Sapiens
LPNVYEVI

SEQ ID NO: 118758 - protein, 8 aa, Homo Sapiens
LPPEAITI

SEQ ID NO: 118759 - protein, 8 aa, Homo Sapiens
LPPEVLSI

SEQ ID NO: 118760 - protein, 8 aa, Homo Sapiens
LPPEVNRI

SEQ ID NO: 118761 - protein, 8 aa, Homo Sapiens
LPPHIIRL

SEQ ID NO: 118762 - protein, 8 aa, Homo Sapiens
LPPHILEV

SEQ ID NO: 118763 - protein, 8 aa, Homo Sapiens
LPPKVLEL

SEQ ID NO: 118764 - protein, 8 aa, Homo Sapiens
LPPLLSPL

SEQ ID NO: 118765 - protein, 8 aa, Homo Sapiens
LPPLSPYF

SEQ ID NO: 118766 - protein, 8 aa, Homo Sapiens
LPPLVDVI

SEQ ID NO: 118767 - protein, 8 aa, Homo Sapiens
LPPLVPAI

SEQ ID NO: 118768 - protein, 8 aa, Homo Sapiens
LPPNVQII

SEQ ID NO: 118769 - protein, 8 aa, Homo Sapiens
LPPPIMLI

SEQ ID NO: 118770 - protein, 8 aa, Homo Sapiens
LPPSVLAV

SEQ ID NO: 118771 - protein, 8 aa, Homo Sapiens
LPPTVITI

SEQ ID NO: 118772 - protein, 8 aa, Homo Sapiens
LPPVLTTV

SEQ ID NO: 118773 - protein, 8 aa, Homo Sapiens
LPPVMLLI

SEQ ID NO: 118774 - protein, 8 aa, Homo Sapiens
LPPYTFQI

SEQ ID NO: 118775 - protein, 8 aa, Homo Sapiens
LPQIAAKI

SEQ ID NO: 118776 - protein, 8 aa, Homo Sapiens
LPQTLPEI

SEQ ID NO: 118777 - protein, 8 aa, Homo Sapiens
LPRIFTSI

SEQ ID NO: 118778 - protein, 8 aa, Homo Sapiens
LPRPLPAV

SEQ ID NO: 118779 - protein, 8 aa, Homo Sapiens
LPRPVPLV

SEQ ID NO: 118780 - protein, 8 aa, Homo Sapiens
LPSILPGL

SEQ ID NO: 118781 - protein, 8 aa, Homo Sapiens
LPSITNVI

SEQ ID NO: 118782 - protein, 8 aa, Homo Sapiens
LPSYTPTI

SEQ ID NO: 118783 - protein, 8 aa, Homo Sapiens
LPTILVEI

SEQ ID NO: 118784 - protein, 8 aa, Homo Sapiens
LPTSVPQI

SEQ ID NO: 118785 - protein, 8 aa, Homo Sapiens
LPTSVVTI

SEQ ID NO: 118786 - protein, 8 aa, Homo Sapiens
LPTTMGVV

SEQ ID NO: 118787 - protein, 8 aa, Homo Sapiens
LPTVLLKL

SEQ ID NO: 118788 - protein, 8 aa, Homo Sapiens
LPVAFKVV

SEQ ID NO: 118789 - protein, 8 aa, Homo Sapiens
LPVEVQEV

SEQ ID NO: 118790 - protein, 8 aa, Homo Sapiens
LPVFQPGV

SEQ ID NO: 118791 - protein, 8 aa, Homo Sapiens
LPVILDII

SEQ ID NO: 118792 - protein, 8 aa, Homo Sapiens
LPVITKEL

SEQ ID NO: 118793 - protein, 8 aa, Homo Sapiens
LPVRLANI

SEQ ID NO: 118794 - protein, 8 aa, Homo Sapiens
LPVSLPQI

SEQ ID NO: 118795 - protein, 8 aa, Homo Sapiens
LPWKFEHI

SEQ ID NO: 118796 - protein, 8 aa, Homo Sapiens
LPWKPVFI

SEQ ID NO: 118797 - protein, 8 aa, Homo Sapiens
LPWLEARI

SEQ ID NO: 118798 - protein, 8 aa, Homo Sapiens
LPWQAAFI

SEQ ID NO: 118799 - protein, 8 aa, Homo Sapiens
LPWQIVQI

SEQ ID NO: 118800 - protein, 8 aa, Homo Sapiens
LPWVVAEV

SEQ ID NO: 118801 - protein, 8 aa, Homo Sapiens
LPYAITIV

SEQ ID NO: 118802 - protein, 8 aa, Homo Sapiens
LPYAVEEL

SEQ ID NO: 118803 - protein, 8 aa, Homo Sapiens
LPYAVGKL

SEQ ID NO: 118804 - protein, 8 aa, Homo Sapiens
LPYEDVAI

SEQ ID NO: 118805 - protein, 8 aa, Homo Sapiens
LPYFLRYI

SEQ ID NO: 118806 - protein, 8 aa, Homo Sapiens
LPYIFPNI

SEQ ID NO: 118807 - protein, 8 aa, Homo Sapiens
LPYKPQVI

SEQ ID NO: 118808 - protein, 8 aa, Homo Sapiens
LPYLFHVV

SEQ ID NO: 118809 - protein, 8 aa, Homo Sapiens
LPYLIHDI

SEQ ID NO: 118810 - protein, 8 aa, Homo Sapiens
LPYLPHYI

SEQ ID NO: 118811 - protein, 8 aa, Homo Sapiens
LPYLQGQV

SEQ ID NO: 118812 - protein, 8 aa, Homo Sapiens
LPYLVPKL

SEQ ID NO: 118813 - protein, 8 aa, Homo Sapiens
LPYLVSNV

SEQ ID NO: 118814 - protein, 8 aa, Homo Sapiens
LPYNGVTV

SEQ ID NO: 118815 - protein, 8 aa, Homo Sapiens
LPYNPMMV

SEQ ID NO: 118816 - protein, 8 aa, Homo Sapiens
LPYNTSLV

SEQ ID NO: 118817 - protein, 8 aa, Homo Sapiens
LPYPIHQV

SEQ ID NO: 118818 - protein, 8 aa, Homo Sapiens
LPYQIKKI

SEQ ID NO: 118819 - protein, 8 aa, Homo Sapiens
LPYQPPAL

SEQ ID NO: 118820 - protein, 8 aa, Homo Sapiens
LPYQVVEV

SEQ ID NO: 118821 - protein, 8 aa, Homo Sapiens
LPYSNITV

SEQ ID NO: 118822 - protein, 8 aa, Homo Sapiens
LPYSPRVL

SEQ ID NO: 118823 - protein, 8 aa, Homo Sapiens
LPYSVTLI

SEQ ID NO: 118824 - protein, 8 aa, Homo Sapiens
LPYVALLI

SEQ ID NO: 118825 - protein, 8 aa, Homo Sapiens
LPYVAPEL

SEQ ID NO: 118826 - protein, 8 aa, Homo Sapiens
LPYVGNLI

SEQ ID NO: 118827 - protein, 8 aa, Homo Sapiens
LPYVGTSV

SEQ ID NO: 118828 - protein, 8 aa, Homo Sapiens
LPYVLENV

SEQ ID NO: 118829 - protein, 8 aa, Homo Sapiens
LSPVVPQI

SEQ ID NO: 118830 - protein, 8 aa, Homo Sapiens
MAFLLPLI

SEQ ID NO: 118831 - protein, 8 aa, Homo Sapiens
MAFLPHHI

SEQ ID NO: 118832 - protein, 8 aa, Homo Sapiens
MAFWLPTI

SEQ ID NO: 118833 - protein, 8 aa, Homo Sapiens
MAYGFRNI

SEQ ID NO: 118834 - protein, 8 aa, Homo Sapiens
MGVIVHII

SEQ ID NO: 118835 - protein, 8 aa, Homo Sapiens
MPAVFHTV

SEQ ID NO: 118836 - protein, 8 aa, Homo Sapiens
MPFFAKTV

SEQ ID NO: 118837 - protein, 8 aa, Homo Sapiens
MPIKINLI

SEQ ID NO: 118838 - protein, 8 aa, Homo Sapiens
MPILISKI

SEQ ID NO: 118839 - protein, 8 aa, Homo Sapiens
MPIYVTGI

SEQ ID NO: 118840 - protein, 8 aa, Homo Sapiens
MPPPVGMV

SEQ ID NO: 118841 - protein, 8 aa, Homo Sapiens
MPRLIAKV

SEQ ID NO: 118842 - protein, 8 aa, Homo Sapiens
MPSDVLEV

SEQ ID NO: 118843 - protein, 8 aa, Homo Sapiens
MPTDVLEV

SEQ ID NO: 118844 - protein, 8 aa, Homo Sapiens
MPTIFNLI

SEQ ID NO: 118845 - protein, 8 aa, Homo Sapiens
MPVQFQVV

SEQ ID NO: 118846 - protein, 8 aa, Homo Sapiens
MPWLADLV

SEQ ID NO: 118847 - protein, 8 aa, Homo Sapiens
MPYMQPVM

SEQ ID NO: 118848 - protein, 8 aa, Homo Sapiens
MPYTPICI

SEQ ID NO: 118849 - protein, 8 aa, Homo Sapiens
MPYTQNFI

SEQ ID NO: 118850 - protein, 8 aa, Homo Sapiens
MPYVIEFI

SEQ ID NO: 118851 - protein, 8 aa, Homo Sapiens
MSQILPCI

SEQ ID NO: 118852 - protein, 8 aa, Homo Sapiens
NAAIIMKI

SEQ ID NO: 118853 - protein, 8 aa, Homo Sapiens
NAAIIMKV

SEQ ID NO: 118854 - protein, 8 aa, Homo Sapiens
NAFATPTI

SEQ ID NO: 118855 - protein, 8 aa, Homo Sapiens
NAPAIIFI

SEQ ID NO: 118856 - protein, 8 aa, Homo Sapiens
NAPCVIFI

SEQ ID NO: 118857 - protein, 8 aa, Homo Sapiens
NGIKVLLI

SEQ ID NO: 118858 - protein, 8 aa, Homo Sapiens
NPFLFSTI

SEQ ID NO: 118859 - protein, 8 aa, Homo Sapiens
NPPKILTV

SEQ ID NO: 118860 - protein, 8 aa, Homo Sapiens
NPYIVRMI

SEQ ID NO: 118861 - protein, 8 aa, Homo Sapiens
PDGRIIKV

SEQ ID NO: 118862 - protein, 8 aa, Homo Sapiens
PEPILIPR

SEQ ID NO: 118863 - protein, 8 aa, Homo Sapiens
PLSPIITL

SEQ ID NO: 118864 - protein, 8 aa, Homo Sapiens
PSLADALI

SEQ ID NO: 118865 - protein, 8 aa, Homo Sapiens
QALEVLKI

SEQ ID NO: 118866 - protein, 8 aa, Homo Sapiens
QAPVVPYM

SEQ ID NO: 118867 - protein, 8 aa, Homo Sapiens
SAFEQLVV

SEQ ID NO: 118868 - protein, 8 aa, Homo Sapiens
SAPAVLVV

SEQ ID NO: 118869 - protein, 8 aa, Homo Sapiens
SAPEVLLV

SEQ ID NO: 118870 - protein, 8 aa, Homo Sapiens
SAVELPKI

SEQ ID NO: 118871 - protein, 8 aa, Homo Sapiens
SAYEVIKL

SEQ ID NO: 118872 - protein, 8 aa, Homo Sapiens
SPFSFHHV

SEQ ID NO: 118873 - protein, 8 aa, Homo Sapiens
SPPTVLVI

SEQ ID NO: 118874 - protein, 8 aa, Homo Sapiens
SPPVILLI

SEQ ID NO: 118875 - protein, 8 aa, Homo Sapiens
TAASVLRI

SEQ ID NO: 118876 - protein, 8 aa, Homo Sapiens
TALGILVV

SEQ ID NO: 118877 - protein, 8 aa, Homo Sapiens
TALKIMKV

SEQ ID NO: 118878 - protein, 8 aa, Homo Sapiens
TALKVLEI

SEQ ID NO: 118879 - protein, 8 aa, Homo Sapiens
TALSLLIV

SEQ ID NO: 118880 - protein, 8 aa, Homo Sapiens
TAPLVVVV

SEQ ID NO: 118881 - protein, 8 aa, Homo Sapiens
TAPVVALF

SEQ ID NO: 118882 - protein, 8 aa, Homo Sapiens
TATYLPEV

SEQ ID NO: 118883 - protein, 8 aa, Homo Sapiens
TAYYALVV

SEQ ID NO: 118884 - protein, 8 aa, Homo Sapiens
TGLTILRI

SEQ ID NO: 118885 - protein, 8 aa, Homo Sapiens
TPFLIFII

SEQ ID NO: 118886 - protein, 8 aa, Homo Sapiens
TPPLAPVV

SEQ ID NO: 118887 - protein, 8 aa, Homo Sapiens
TPPVVLRL

SEQ ID NO: 118888 - protein, 8 aa, Homo Sapiens
TPVRLPSI

SEQ ID NO: 118889 - protein, 8 aa, Homo Sapiens
TPWQPPTV

SEQ ID NO: 118890 - protein, 8 aa, Homo Sapiens
TPYALPVI

SEQ ID NO: 118891 - protein, 8 aa, Homo Sapiens
TSPKALVI

SEQ ID NO: 118892 - protein, 8 aa, Homo Sapiens
VAHLALQI

SEQ ID NO: 118893 - protein, 8 aa, Homo Sapiens
VAPIVVVI

SEQ ID NO: 118894 - protein, 8 aa, Homo Sapiens
VAPTSLVV

SEQ ID NO: 118895 - protein, 8 aa, Homo Sapiens
VAVKILKV

SEQ ID NO: 118896 - protein, 8 aa, Homo Sapiens
VAWLVAHV

SEQ ID NO: 118897 - protein, 8 aa, Homo Sapiens
VAWVGQQV

SEQ ID NO: 118898 - protein, 8 aa, Homo Sapiens
VGPFVSKI

SEQ ID NO: 118899 - protein, 8 aa, Homo Sapiens
VPAALKVV

SEQ ID NO: 118900 - protein, 8 aa, Homo Sapiens
VPAEFECI

SEQ ID NO: 118901 - protein, 8 aa, Homo Sapiens
VPAFVRMI

SEQ ID NO: 118902 - protein, 8 aa, Homo Sapiens
VPAKLPEI

SEQ ID NO: 118903 - protein, 8 aa, Homo Sapiens
VPAPVPLM

SEQ ID NO: 118904 - protein, 8 aa, Homo Sapiens
VPATLFEI

SEQ ID NO: 118905 - protein, 8 aa, Homo Sapiens
VPATVPSI

SEQ ID NO: 118906 - protein, 8 aa, Homo Sapiens
VPELIRTI

SEQ ID NO: 118907 - protein, 8 aa, Homo Sapiens
VPFLVSVL

SEQ ID NO: 118908 - protein, 8 aa, Homo Sapiens
VPFPISLI

SEQ ID NO: 118909 - protein, 8 aa, Homo Sapiens
VPFPLNSV

SEQ ID NO: 118910 - protein, 8 aa, Homo Sapiens
VPFQVPEI

SEQ ID NO: 118911 - protein, 8 aa, Homo Sapiens
VPFSHVNI

SEQ ID NO: 118912 - protein, 8 aa, Homo Sapiens
VPFSLDSV

SEQ ID NO: 118913 - protein, 8 aa, Homo Sapiens
VPFSVPKI

SEQ ID NO: 118914 - protein, 8 aa, Homo Sapiens
VPHVLPFI

SEQ ID NO: 118915 - protein, 8 aa, Homo Sapiens
VPIEIPTI

SEQ ID NO: 118916 - protein, 8 aa, Homo Sapiens
VPILAPRI

SEQ ID NO: 118917 - protein, 8 aa, Homo Sapiens
VPILISEI

SEQ ID NO: 118918 - protein, 8 aa, Homo Sapiens
VPLEMLEI

SEQ ID NO: 118919 - protein, 8 aa, Homo Sapiens
VPLIIFTI

SEQ ID NO: 118920 - protein, 8 aa, Homo Sapiens
VPLLVKVI

SEQ ID NO: 118921 - protein, 8 aa, Homo Sapiens
VPPETLHI

SEQ ID NO: 118922 - protein, 8 aa, Homo Sapiens
VPPFTIEV

SEQ ID NO: 118923 - protein, 8 aa, Homo Sapiens
VPPKISLL

SEQ ID NO: 118924 - protein, 8 aa, Homo Sapiens
VPPLVPKV

SEQ ID NO: 118925 - protein, 8 aa, Homo Sapiens
VPPNGLVV

SEQ ID NO: 118926 - protein, 8 aa, Homo Sapiens
VPPVSPEL

SEQ ID NO: 118927 - protein, 8 aa, Homo Sapiens
VPQQALVI

SEQ ID NO: 118928 - protein, 8 aa, Homo Sapiens
VPSPVLRI

SEQ ID NO: 118929 - protein, 8 aa, Homo Sapiens
VPSVQPIV

SEQ ID NO: 118930 - protein, 8 aa, Homo Sapiens
VPSYIPLV

SEQ ID NO: 118931 - protein, 8 aa, Homo Sapiens
VPVITPYL

SEQ ID NO: 118932 - protein, 8 aa, Homo Sapiens
VPYAGINI

SEQ ID NO: 118933 - protein, 8 aa, Homo Sapiens
VPYEPPEV

SEQ ID NO: 118934 - protein, 8 aa, Homo Sapiens
VPYEPPQV

SEQ ID NO: 118935 - protein, 8 aa, Homo Sapiens
VPYGLPCI

SEQ ID NO: 118936 - protein, 8 aa, Homo Sapiens
VPYLFKKV

SEQ ID NO: 118937 - protein, 8 aa, Homo Sapiens
VPYLMEAI

SEQ ID NO: 118938 - protein, 8 aa, Homo Sapiens
VPYPLPKI

SEQ ID NO: 118939 - protein, 8 aa, Homo Sapiens
VPYPTASL

SEQ ID NO: 118940 - protein, 8 aa, Homo Sapiens
VPYRLNEI

SEQ ID NO: 118941 - protein, 8 aa, Homo Sapiens
VPYRVVGL

SEQ ID NO: 118942 - protein, 8 aa, Homo Sapiens
WAMKALLI

SEQ ID NO: 118943 - protein, 8 aa, Homo Sapiens
WAPSVVKI

SEQ ID NO: 118944 - protein, 8 aa, Homo Sapiens
WPLVAALL

SEQ ID NO: 118945 - protein, 8 aa, Homo Sapiens
YAFAFIQV

SEQ ID NO: 118946 - protein, 8 aa, Homo Sapiens
YAIKILAI

SEQ ID NO: 118947 - protein, 8 aa, Homo Sapiens
YALEVEKI

SEQ ID NO: 118948 - protein, 8 aa, Homo Sapiens
YAYLPLHV

SEQ ID NO: 118949 - protein, 8 aa, Homo Sapiens
YGYSLKGI

SEQ ID NO: 118950 - protein, 8 aa, Homo Sapiens
YPAELNNI

SEQ ID NO: 118951 - protein, 8 aa, Homo Sapiens
YPASSLVV

SEQ ID NO: 118952 - protein, 8 aa, Homo Sapiens
YPDRVPVI

SEQ ID NO: 118953 - protein, 8 aa, Homo Sapiens
YPFAISLI

SEQ ID NO: 118954 - protein, 8 aa, Homo Sapiens
YPFAPLIL

SEQ ID NO: 118955 - protein, 8 aa, Homo Sapiens
YPFEPPQI

SEQ ID NO: 118956 - protein, 8 aa, Homo Sapiens
YPFKPPKI

SEQ ID NO: 118957 - protein, 8 aa, Homo Sapiens
YPFKPPKV

SEQ ID NO: 118958 - protein, 8 aa, Homo Sapiens
YPFKPPMI

SEQ ID NO: 118959 - protein, 8 aa, Homo Sapiens
YPFKSPSI

SEQ ID NO: 118960 - protein, 8 aa, Homo Sapiens
YPFLLMVV

SEQ ID NO: 118961 - protein, 8 aa, Homo Sapiens
YPFLLPVI

SEQ ID NO: 118962 - protein, 8 aa, Homo Sapiens
YPFNPPKV

SEQ ID NO: 118963 - protein, 8 aa, Homo Sapiens
YPFQIHSI

SEQ ID NO: 118964 - protein, 8 aa, Homo Sapiens
YPFTLRVV

SEQ ID NO: 118965 - protein, 8 aa, Homo Sapiens
YPFVVLNI

SEQ ID NO: 118966 - protein, 8 aa, Homo Sapiens
YPHEVPQI

SEQ ID NO: 118967 - protein, 8 aa, Homo Sapiens
YPLALNRI

SEQ ID NO: 118968 - protein, 8 aa, Homo Sapiens
YPLILKEL

SEQ ID NO: 118969 - protein, 8 aa, Homo Sapiens
YPLLIIRE

SEQ ID NO: 118970 - protein, 8 aa, Homo Sapiens
YPLLILFV

SEQ ID NO: 118971 - protein, 8 aa, Homo Sapiens
YPLLLQSI

SEQ ID NO: 118972 - protein, 8 aa, Homo Sapiens
YPLLLREI

SEQ ID NO: 118973 - protein, 8 aa, Homo Sapiens
YPLPAVKV

SEQ ID NO: 118974 - protein, 8 aa, Homo Sapiens
YPMLIRTI

SEQ ID NO: 118975 - protein, 8 aa, Homo Sapiens
YPNVFKKI

SEQ ID NO: 118976 - protein, 8 aa, Homo Sapiens
YPPGAILV

SEQ ID NO: 118977 - protein, 8 aa, Homo Sapiens
YPPGVKEI

SEQ ID NO: 118978 - protein, 8 aa, Homo Sapiens
YPPLVNCV

SEQ ID NO: 118979 - protein, 8 aa, Homo Sapiens
YPPSPWTI

SEQ ID NO: 118980 - protein, 8 aa, Homo Sapiens
YPQLLPGI

SEQ ID NO: 118981 - protein, 8 aa, Homo Sapiens
YPTTFVMV

SEQ ID NO: 118982 - protein, 8 aa, Homo Sapiens
YPVELLLV

SEQ ID NO: 118983 - protein, 8 aa, Homo Sapiens
YPVIIHLI

SEQ ID NO: 118984 - protein, 8 aa, Homo Sapiens
YPWGTVQV

SEQ ID NO: 118985 - protein, 8 aa, Homo Sapiens
YPWGVAEV

SEQ ID NO: 118986 - protein, 8 aa, Homo Sapiens
YPWGVVQV

SEQ ID NO: 118987 - protein, 8 aa, Homo Sapiens
YPWVHVVI

SEQ ID NO: 118988 - protein, 8 aa, Homo Sapiens
YPYIAKIL

SEQ ID NO: 118989 - protein, 8 aa, Homo Sapiens
YPYIFHVL

SEQ ID NO: 118990 - protein, 8 aa, Homo Sapiens
YPYIPAHI

SEQ ID NO: 118991 - protein, 8 aa, Homo Sapiens
YPYNAPTV

SEQ ID NO: 118992 - protein, 8 aa, Homo Sapiens
YPYQAPLV

SEQ ID NO: 118993 - protein, 8 aa, Homo Sapiens
YPYVAVML

SEQ ID NO: 118994 - protein, 8 aa, Homo Sapiens
YPYVIQEL

SEQ ID NO: 118995 - protein, 9 aa, Homo Sapiens
AAWLQVLPV

SEQ ID NO: 118996 - protein, 9 aa, Homo Sapiens
ADAPVALVV

SEQ ID NO: 118997 - protein, 9 aa, Homo Sapiens
ADAVPLPPP

SEQ ID NO: 118998 - protein, 9 aa, Homo Sapiens
ALAPPAALL

SEQ ID NO: 118999 - protein, 9 aa, Homo Sapiens
CPFTGNVSI

SEQ ID NO: 119000 - protein, 9 aa, Homo Sapiens
DAAAFFKSV

SEQ ID NO: 119001 - protein, 9 aa, Homo Sapiens
DAAAKALRI

SEQ ID NO: 119002 - protein, 9 aa, Homo Sapiens
DAAEFAISI

SEQ ID NO: 119003 - protein, 9 aa, Homo Sapiens
DAALDFKNV

SEQ ID NO: 119004 - protein, 9 aa, Homo Sapiens
DAANVMVYV

SEQ ID NO: 119005 - protein, 9 aa, Homo Sapiens
DAENAMRYI

SEQ ID NO: 119006 - protein, 9 aa, Homo Sapiens
DAFANFANF

SEQ ID NO: 119007 - protein, 9 aa, Homo Sapiens
DAFFSDTQI

SEQ ID NO: 119008 - protein, 9 aa, Homo Sapiens
DAFHFVSYV

SEQ ID NO: 119009 - protein, 9 aa, Homo Sapiens
DAFIFKSDV

SEQ ID NO: 119010 - protein, 9 aa, Homo Sapiens
DAFPDQVAI

SEQ ID NO: 119011 - protein, 9 aa, Homo Sapiens
DAFPEAIIV

SEQ ID NO: 119012 - protein, 9 aa, Homo Sapiens
DAFPNIDKI

SEQ ID NO: 119013 - protein, 9 aa, Homo Sapiens
DAFPNIEKV

SEQ ID NO: 119014 - protein, 9 aa, Homo Sapiens
DAFPSIDKI

SEQ ID NO: 119015 - protein, 9 aa, Homo Sapiens
DAFQKLLIV

SEQ ID NO: 119016 - protein, 9 aa, Homo Sapiens
DAFQLAVNV

SEQ ID NO: 119017 - protein, 9 aa, Homo Sapiens
DAFQLERAI

SEQ ID NO: 119018 - protein, 9 aa, Homo Sapiens
DAFQQTLII

SEQ ID NO: 119019 - protein, 9 aa, Homo Sapiens
DAFRQPSLF

SEQ ID NO: 119020 - protein, 9 aa, Homo Sapiens
DAFSFTSKV

SEQ ID NO: 119021 - protein, 9 aa, Homo Sapiens
DAFSRQLLI

SEQ ID NO: 119022 - protein, 9 aa, Homo Sapiens
DAFTFRHFL

SEQ ID NO: 119023 - protein, 9 aa, Homo Sapiens
DAFWWTPLM

SEQ ID NO: 119024 - protein, 9 aa, Homo Sapiens
DAHEFLIAA

SEQ ID NO: 119025 - protein, 9 aa, Homo Sapiens
DAHEFLNYL

SEQ ID NO: 119026 - protein, 9 aa, Homo Sapiens
DAHELFHVI

SEQ ID NO: 119027 - protein, 9 aa, Homo Sapiens
DAHIYLNHI

SEQ ID NO: 119028 - protein, 9 aa, Homo Sapiens
DAIAEIRAI

SEQ ID NO: 119029 - protein, 9 aa, Homo Sapiens
DAIARLKEV

SEQ ID NO: 119030 - protein, 9 aa, Homo Sapiens
DAIHQLGFI

SEQ ID NO: 119031 - protein, 9 aa, Homo Sapiens
DAIITKASI

SEQ ID NO: 119032 - protein, 9 aa, Homo Sapiens
DAIKVFVRI

SEQ ID NO: 119033 - protein, 9 aa, Homo Sapiens
DAIRSLASV

SEQ ID NO: 119034 - protein, 9 aa, Homo Sapiens
DAIRVFANI

SEQ ID NO: 119035 - protein, 9 aa, Homo Sapiens
DAKILSNVI

SEQ ID NO: 119036 - protein, 9 aa, Homo Sapiens
DALAEIERI

SEQ ID NO: 119037 - protein, 9 aa, Homo Sapiens
DALAFNSAI

SEQ ID NO: 119038 - protein, 9 aa, Homo Sapiens
DALAKVTKI

SEQ ID NO: 119039 - protein, 9 aa, Homo Sapiens
DALAMGLCV

SEQ ID NO: 119040 - protein, 9 aa, Homo Sapiens
DALDHVIDI

SEQ ID NO: 119041 - protein, 9 aa, Homo Sapiens
DALDKIRLI

SEQ ID NO: 119042 - protein, 9 aa, Homo Sapiens
DALDVANKI

SEQ ID NO: 119043 - protein, 9 aa, Homo Sapiens
DALEDFKKV

SEQ ID NO: 119044 - protein, 9 aa, Homo Sapiens
DALGKLISI

SEQ ID NO: 119045 - protein, 9 aa, Homo Sapiens
DALHNLFYI

SEQ ID NO: 119046 - protein, 9 aa, Homo Sapiens
DALISSPIL

SEQ ID NO: 119047 - protein, 9 aa, Homo Sapiens
DALIVLIHL

SEQ ID NO: 119048 - protein, 9 aa, Homo Sapiens
DALKAITEV

SEQ ID NO: 119049 - protein, 9 aa, Homo Sapiens
DALKVTFLI

SEQ ID NO: 119050 - protein, 9 aa, Homo Sapiens
DALKVTVGV

SEQ ID NO: 119051 - protein, 9 aa, Homo Sapiens
DALLEQAMI

SEQ ID NO: 119052 - protein, 9 aa, Homo Sapiens
DALLIHDTV

SEQ ID NO: 119053 - protein, 9 aa, Homo Sapiens
DALLIIPKV

SEQ ID NO: 119054 - protein, 9 aa, Homo Sapiens
DALLKFSHI

SEQ ID NO: 119055 - protein, 9 aa, Homo Sapiens
DALLQCMNV

SEQ ID NO: 119056 - protein, 9 aa, Homo Sapiens
DALLQMITI

SEQ ID NO: 119057 - protein, 9 aa, Homo Sapiens
DALMKSLQV

SEQ ID NO: 119058 - protein, 9 aa, Homo Sapiens
DALNAPLHI

SEQ ID NO: 119059 - protein, 9 aa, Homo Sapiens
DALNIETAI

SEQ ID NO: 119060 - protein, 9 aa, Homo Sapiens
DALNIREAI

SEQ ID NO: 119061 - protein, 9 aa, Homo Sapiens
DALNRPLNI

SEQ ID NO: 119062 - protein, 9 aa, Homo Sapiens
DALQYLQKV

SEQ ID NO: 119063 - protein, 9 aa, Homo Sapiens
DALRAIQCV

SEQ ID NO: 119064 - protein, 9 aa, Homo Sapiens
DALRSGLTV

SEQ ID NO: 119065 - protein, 9 aa, Homo Sapiens
DALRSILTI

SEQ ID NO: 119066 - protein, 9 aa, Homo Sapiens
DALSKMVII

SEQ ID NO: 119067 - protein, 9 aa, Homo Sapiens
DALVTKNLV

SEQ ID NO: 119068 - protein, 9 aa, Homo Sapiens
DAMFPVTHI

SEQ ID NO: 119069 - protein, 9 aa, Homo Sapiens
DAMFSVSFI

SEQ ID NO: 119070 - protein, 9 aa, Homo Sapiens
DAMGHTIVL

SEQ ID NO: 119071 - protein, 9 aa, Homo Sapiens
DAMKYTIVV

SEQ ID NO: 119072 - protein, 9 aa, Homo Sapiens
DAMSILETI

SEQ ID NO: 119073 - protein, 9 aa, Homo Sapiens
DANDVVITV

SEQ ID NO: 119074 - protein, 9 aa, Homo Sapiens
DANIFPALI

SEQ ID NO: 119075 - protein, 9 aa, Homo Sapiens
DANPFLQSV

SEQ ID NO: 119076 - protein, 9 aa, Homo Sapiens
DANVQIASI

SEQ ID NO: 119077 - protein, 9 aa, Homo Sapiens
DAPFVINAI

SEQ ID NO: 119078 - protein, 9 aa, Homo Sapiens
DAPHPPLKI

SEQ ID NO: 119079 - protein, 9 aa, Homo Sapiens
DAPIQLSKI

SEQ ID NO: 119080 - protein, 9 aa, Homo Sapiens
DAPISPASI

SEQ ID NO: 119081 - protein, 9 aa, Homo Sapiens
DAPLNIRSI

SEQ ID NO: 119082 - protein, 9 aa, Homo Sapiens
DAPLSPMLY

SEQ ID NO: 119083 - protein, 9 aa, Homo Sapiens
DAPWPVRKI

SEQ ID NO: 119084 - protein, 9 aa, Homo Sapiens
DAQGLQLLV

SEQ ID NO: 119085 - protein, 9 aa, Homo Sapiens
DAQGQFLTV

SEQ ID NO: 119086 - protein, 9 aa, Homo Sapiens
DAREIVNNV

SEQ ID NO: 119087 - protein, 9 aa, Homo Sapiens
DARELELVI

SEQ ID NO: 119088 - protein, 9 aa, Homo Sapiens
DAREVMILI

SEQ ID NO: 119089 - protein, 9 aa, Homo Sapiens
DARIFLNEI

SEQ ID NO: 119090 - protein, 9 aa, Homo Sapiens
DARIGSFTI

SEQ ID NO: 119091 - protein, 9 aa, Homo Sapiens
DARLFTEKI

SEQ ID NO: 119092 - protein, 9 aa, Homo Sapiens
DARWWAVVV

SEQ ID NO: 119093 - protein, 9 aa, Homo Sapiens
DASPVQAVF

SEQ ID NO: 119094 - protein, 9 aa, Homo Sapiens
DATKLLPSV

SEQ ID NO: 119095 - protein, 9 aa, Homo Sapiens
DAVASLLIV

SEQ ID NO: 119096 - protein, 9 aa, Homo Sapiens
DAVKFFVAV

SEQ ID NO: 119097 - protein, 9 aa, Homo Sapiens
DAVKFFVSV

SEQ ID NO: 119098 - protein, 9 aa, Homo Sapiens
DAVLYLLEI

SEQ ID NO: 119099 - protein, 9 aa, Homo Sapiens
DAVNLALLM

SEQ ID NO: 119100 - protein, 9 aa, Homo Sapiens
DAVRVLREI

SEQ ID NO: 119101 - protein, 9 aa, Homo Sapiens
DAVTFITYV

SEQ ID NO: 119102 - protein, 9 aa, Homo Sapiens
DAWAQLNSI

SEQ ID NO: 119103 - protein, 9 aa, Homo Sapiens
DAWKELTIV

SEQ ID NO: 119104 - protein, 9 aa, Homo Sapiens
DAWLRAQVI

SEQ ID NO: 119105 - protein, 9 aa, Homo Sapiens
DAYALNHTL

SEQ ID NO: 119106 - protein, 9 aa, Homo Sapiens
DAYAQYLWI

SEQ ID NO: 119107 - protein, 9 aa, Homo Sapiens
DAYDNFDNI

SEQ ID NO: 119108 - protein, 9 aa, Homo Sapiens
DAYEFFTSL

SEQ ID NO: 119109 - protein, 9 aa, Homo Sapiens
DAYEIRLLM

SEQ ID NO: 119110 - protein, 9 aa, Homo Sapiens
DAYETTLHV

SEQ ID NO: 119111 - protein, 9 aa, Homo Sapiens
DAYIQEHLL

SEQ ID NO: 119112 - protein, 9 aa, Homo Sapiens
DAYKGLFEV

SEQ ID NO: 119113 - protein, 9 aa, Homo Sapiens
DAYKIRIRI

SEQ ID NO: 119114 - protein, 9 aa, Homo Sapiens
DAYLFLLCL

SEQ ID NO: 119115 - protein, 9 aa, Homo Sapiens
DAYLQRILA

SEQ ID NO: 119116 - protein, 9 aa, Homo Sapiens
DAYPNGLQV

SEQ ID NO: 119117 - protein, 9 aa, Homo Sapiens
DAYPQRIKF

SEQ ID NO: 119118 - protein, 9 aa, Homo Sapiens
DAYQVLSTL

SEQ ID NO: 119119 - protein, 9 aa, Homo Sapiens
DAYRALQKL

SEQ ID NO: 119120 - protein, 9 aa, Homo Sapiens
DAYSFSRKI

SEQ ID NO: 119121 - protein, 9 aa, Homo Sapiens
DAYTHPQFV

SEQ ID NO: 119122 - protein, 9 aa, Homo Sapiens
DAYTVLTRI

SEQ ID NO: 119123 - protein, 9 aa, Homo Sapiens
DAYVGYMTI

SEQ ID NO: 119124 - protein, 9 aa, Homo Sapiens
DAYVLPKLY

SEQ ID NO: 119125 - protein, 9 aa, Homo Sapiens
DAYYKLRHI

SEQ ID NO: 119126 - protein, 9 aa, Homo Sapiens
DGFAFQNLV

SEQ ID NO: 119127 - protein, 9 aa, Homo Sapiens
DGFIPKNYI

SEQ ID NO: 119128 - protein, 9 aa, Homo Sapiens
DGFISNLTI

SEQ ID NO: 119129 - protein, 9 aa, Homo Sapiens
DGFLFLNTL

SEQ ID NO: 119130 - protein, 9 aa, Homo Sapiens
DGLLRVLTV

SEQ ID NO: 119131 - protein, 9 aa, Homo Sapiens
DGLNYIPKI

SEQ ID NO: 119132 - protein, 9 aa, Homo Sapiens
DGLRDLPSI

SEQ ID NO: 119133 - protein, 9 aa, Homo Sapiens
DGLTVHLVI

SEQ ID NO: 119134 - protein, 9 aa, Homo Sapiens
DGRIFGESI

SEQ ID NO: 119135 - protein, 9 aa, Homo Sapiens
DGRLTICTI

SEQ ID NO: 119136 - protein, 9 aa, Homo Sapiens
DGRLVINRV

SEQ ID NO: 119137 - protein, 9 aa, Homo Sapiens
DGRVYYICI

SEQ ID NO: 119138 - protein, 9 aa, Homo Sapiens
DGYAFQNLI

SEQ ID NO: 119139 - protein, 9 aa, Homo Sapiens
DGYEQAARV

SEQ ID NO: 119140 - protein, 9 aa, Homo Sapiens
DGYEVENLI

SEQ ID NO: 119141 - protein, 9 aa, Homo Sapiens
DGYLLLKSV

SEQ ID NO: 119142 - protein, 9 aa, Homo Sapiens
DGYVVKETI

SEQ ID NO: 119143 - protein, 9 aa, Homo Sapiens
DIFEFLNHV

SEQ ID NO: 119144 - protein, 9 aa, Homo Sapiens
DIKDTEPLI

SEQ ID NO: 119145 - protein, 9 aa, Homo Sapiens
DIYSKFDVI

SEQ ID NO: 119146 - protein, 9 aa, Homo Sapiens
DLREQILRV

SEQ ID NO: 119147 - protein, 9 aa, Homo Sapiens
DLYPGIPVI

SEQ ID NO: 119148 - protein, 9 aa, Homo Sapiens
DMYEQFQNI

SEQ ID NO: 119149 - protein, 9 aa, Homo Sapiens
DPAASLPII

SEQ ID NO: 119150 - protein, 9 aa, Homo Sapiens
DPALDLKVI

SEQ ID NO: 119151 - protein, 9 aa, Homo Sapiens
DPFAFIHKI

SEQ ID NO: 119152 - protein, 9 aa, Homo Sapiens
DPFAGRNVI

SEQ ID NO: 119153 - protein, 9 aa, Homo Sapiens
DPFDLSHNV

SEQ ID NO: 119154 - protein, 9 aa, Homo Sapiens
DPFIIIHSI

SEQ ID NO: 119155 - protein, 9 aa, Homo Sapiens
DPFLSEKSV

SEQ ID NO: 119156 - protein, 9 aa, Homo Sapiens
DPFPVPLVI

SEQ ID NO: 119157 - protein, 9 aa, Homo Sapiens
DPFPWQQKV

SEQ ID NO: 119158 - protein, 9 aa, Homo Sapiens
DPFQYQLVI

SEQ ID NO: 119159 - protein, 9 aa, Homo Sapiens
DPIVMGVTV

SEQ ID NO: 119160 - protein, 9 aa, Homo Sapiens
DPKVQINAI

SEQ ID NO: 119161 - protein, 9 aa, Homo Sapiens
DPLDKSIVI

SEQ ID NO: 119162 - protein, 9 aa, Homo Sapiens
DPLGYIAKI

SEQ ID NO: 119163 - protein, 9 aa, Homo Sapiens
DPLLKVSII

SEQ ID NO: 119164 - protein, 9 aa, Homo Sapiens
DPLQQICKI

SEQ ID NO: 119165 - protein, 9 aa, Homo Sapiens
DPLRVIILV

SEQ ID NO: 119166 - protein, 9 aa, Homo Sapiens
DPLSFIGRI

SEQ ID NO: 119167 - protein, 9 aa, Homo Sapiens
DPMEILITV

SEQ ID NO: 119168 - protein, 9 aa, Homo Sapiens
DPPIARLSV

SEQ ID NO: 119169 - protein, 9 aa, Homo Sapiens
DPPPPMETI

SEQ ID NO: 119170 - protein, 9 aa, Homo Sapiens
DPRVSINVV

SEQ ID NO: 119171 - protein, 9 aa, Homo Sapiens
DPSDIYAVI

SEQ ID NO: 119172 - protein, 9 aa, Homo Sapiens
DPSMVILEV

SEQ ID NO: 119173 - protein, 9 aa, Homo Sapiens
DPSSIVPLI

SEQ ID NO: 119174 - protein, 9 aa, Homo Sapiens
DPTEHIPEI

SEQ ID NO: 119175 - protein, 9 aa, Homo Sapiens
DPVHAVVYI

SEQ ID NO: 119176 - protein, 9 aa, Homo Sapiens
DPYEVSYRI

SEQ ID NO: 119177 - protein, 9 aa, Homo Sapiens
DPYGFLTTV

SEQ ID NO: 119178 - protein, 9 aa, Homo Sapiens
DPYITQPII

SEQ ID NO: 119179 - protein, 9 aa, Homo Sapiens
DPYKVYRIV

SEQ ID NO: 119180 - protein, 9 aa, Homo Sapiens
DSFEFKAHV

SEQ ID NO: 119181 - protein, 9 aa, Homo Sapiens
DSFLHLAII

SEQ ID NO: 119182 - protein, 9 aa, Homo Sapiens
DSYEFLKAI

SEQ ID NO: 119183 - protein, 9 aa, Homo Sapiens
DSYINVQEI

SEQ ID NO: 119184 - protein, 9 aa, Homo Sapiens
DSYPVVNLI

SEQ ID NO: 119185 - protein, 9 aa, Homo Sapiens
DVFNVPLVI

SEQ ID NO: 119186 - protein, 9 aa, Homo Sapiens
DVFPHLPLI

SEQ ID NO: 119187 - protein, 9 aa, Homo Sapiens
DVHIQINSI

SEQ ID NO: 119188 - protein, 9 aa, Homo Sapiens
DVLSKLLVV

SEQ ID NO: 119189 - protein, 9 aa, Homo Sapiens
DVREIVNNI

SEQ ID NO: 119190 - protein, 9 aa, Homo Sapiens
EAAEVILRV

SEQ ID NO: 119191 - protein, 9 aa, Homo Sapiens
EAFYNVITV

SEQ ID NO: 119192 - protein, 9 aa, Homo Sapiens
EALAYFITV

SEQ ID NO: 119193 - protein, 9 aa, Homo Sapiens
EALHAFLLV

SEQ ID NO: 119194 - protein, 9 aa, Homo Sapiens
EAMTQIIRV

SEQ ID NO: 119195 - protein, 9 aa, Homo Sapiens
EAYLSRLGV

SEQ ID NO: 119196 - protein, 9 aa, Homo Sapiens
EAYPHFMSI

SEQ ID NO: 119197 - protein, 9 aa, Homo Sapiens
EAYTSVLTV

SEQ ID NO: 119198 - protein, 9 aa, Homo Sapiens
EGDNVTLVV

SEQ ID NO: 119199 - protein, 9 aa, Homo Sapiens
EPFADFHRV

SEQ ID NO: 119200 - protein, 9 aa, Homo Sapiens
EPLEIILHL

SEQ ID NO: 119201 - protein, 9 aa, Homo Sapiens
EPRIEIVVV

SEQ ID NO: 119202 - protein, 9 aa, Homo Sapiens
EPYFNFTSI

SEQ ID NO: 119203 - protein, 9 aa, Homo Sapiens
FAFRYVTTI

SEQ ID NO: 119204 - protein, 9 aa, Homo Sapiens
FAMPYFIQV

SEQ ID NO: 119205 - protein, 9 aa, Homo Sapiens
FAQAPQLSV

SEQ ID NO: 119206 - protein, 9 aa, Homo Sapiens
FAYLRDLLI

SEQ ID NO: 119207 - protein, 9 aa, Homo Sapiens
FAYSSRIAI

SEQ ID NO: 119208 - protein, 9 aa, Homo Sapiens
FAYTARISV

SEQ ID NO: 119209 - protein, 9 aa, Homo Sapiens
FAYTSQITV

SEQ ID NO: 119210 - protein, 9 aa, Homo Sapiens
FAYVQIKTI

SEQ ID NO: 119211 - protein, 9 aa, Homo Sapiens
FPAAIEHTI

SEQ ID NO: 119212 - protein, 9 aa, Homo Sapiens
FPAAPAPKM

SEQ ID NO: 119213 - protein, 9 aa, Homo Sapiens
FPAAPLLTV

SEQ ID NO: 119214 - protein, 9 aa, Homo Sapiens
FPAEFYPHI

SEQ ID NO: 119215 - protein, 9 aa, Homo Sapiens
FPANVMDVI

SEQ ID NO: 119216 - protein, 9 aa, Homo Sapiens
FPAPILRAV

SEQ ID NO: 119217 - protein, 9 aa, Homo Sapiens
FPAPTPKNI

SEQ ID NO: 119218 - protein, 9 aa, Homo Sapiens
FPDNFVREI

SEQ ID NO: 119219 - protein, 9 aa, Homo Sapiens
FPDPNVKYV

SEQ ID NO: 119220 - protein, 9 aa, Homo Sapiens
FPEDVVRVI

SEQ ID NO: 119221 - protein, 9 aa, Homo Sapiens
FPEEEWRHV

SEQ ID NO: 119222 - protein, 9 aa, Homo Sapiens
FPEPNPRVI

SEQ ID NO: 119223 - protein, 9 aa, Homo Sapiens
FPFDQQFNI

SEQ ID NO: 119224 - protein, 9 aa, Homo Sapiens
FPFGCPPTV

SEQ ID NO: 119225 - protein, 9 aa, Homo Sapiens
FPFGFFTTV

SEQ ID NO: 119226 - protein, 9 aa, Homo Sapiens
FPFGKIGTV

SEQ ID NO: 119227 - protein, 9 aa, Homo Sapiens
FPFGYVSNI

SEQ ID NO: 119228 - protein, 9 aa, Homo Sapiens
FPFIVLVTV

SEQ ID NO: 119229 - protein, 9 aa, Homo Sapiens
FPFKPPQRI

SEQ ID NO: 119230 - protein, 9 aa, Homo Sapiens
FPFPGVMLI

SEQ ID NO: 119231 - protein, 9 aa, Homo Sapiens
FPFPKPALI

SEQ ID NO: 119232 - protein, 9 aa, Homo Sapiens
FPFPKPDLI

SEQ ID NO: 119233 - protein, 9 aa, Homo Sapiens
FPFPTPPSV

SEQ ID NO: 119234 - protein, 9 aa, Homo Sapiens
FPHLQDAQV

SEQ ID NO: 119235 - protein, 9 aa, Homo Sapiens
FPHLQLLDV

SEQ ID NO: 119236 - protein, 9 aa, Homo Sapiens
FPHSLLSVI

SEQ ID NO: 119237 - protein, 9 aa, Homo Sapiens
FPIDHFTHI

SEQ ID NO: 119238 - protein, 9 aa, Homo Sapiens
FPKYCEPVV

SEQ ID NO: 119239 - protein, 9 aa, Homo Sapiens
FPLATESNI

SEQ ID NO: 119240 - protein, 9 aa, Homo Sapiens
FPLDAFQEI

SEQ ID NO: 119241 - protein, 9 aa, Homo Sapiens
FPLPTPLSV

SEQ ID NO: 119242 - protein, 9 aa, Homo Sapiens
FPLQQKILV

SEQ ID NO: 119243 - protein, 9 aa, Homo Sapiens
FPMSPVTSV

SEQ ID NO: 119244 - protein, 9 aa, Homo Sapiens
FPNIHPPQI

SEQ ID NO: 119245 - protein, 9 aa, Homo Sapiens
FPNLDSPNV

SEQ ID NO: 119246 - protein, 9 aa, Homo Sapiens
FPNPEATFV

SEQ ID NO: 119247 - protein, 9 aa, Homo Sapiens
FPNVEIVTI

SEQ ID NO: 119248 - protein, 9 aa, Homo Sapiens
FPPPVADFI

SEQ ID NO: 119249 - protein, 9 aa, Homo Sapiens
FPPPVSPRL

SEQ ID NO: 119250 - protein, 9 aa, Homo Sapiens
FPRHIEPEL

SEQ ID NO: 119251 - protein, 9 aa, Homo Sapiens
FPSEDILLV

SEQ ID NO: 119252 - protein, 9 aa, Homo Sapiens
FPSEYVPTV

SEQ ID NO: 119253 - protein, 9 aa, Homo Sapiens
FPSPHILQI

SEQ ID NO: 119254 - protein, 9 aa, Homo Sapiens
FPTAPTRVV

SEQ ID NO: 119255 - protein, 9 aa, Homo Sapiens
FPVQGVHTV

SEQ ID NO: 119256 - protein, 9 aa, Homo Sapiens
FPVQTITTV

SEQ ID NO: 119257 - protein, 9 aa, Homo Sapiens
FPWNKNVEV

SEQ ID NO: 119258 - protein, 9 aa, Homo Sapiens
FPWPKVLKI

SEQ ID NO: 119259 - protein, 9 aa, Homo Sapiens
FPWSEIRNI

SEQ ID NO: 119260 - protein, 9 aa, Homo Sapiens
FPWSGLIYI

SEQ ID NO: 119261 - protein, 9 aa, Homo Sapiens
FPYAFKEVI

SEQ ID NO: 119262 - protein, 9 aa, Homo Sapiens
FPYDANIQI

SEQ ID NO: 119263 - protein, 9 aa, Homo Sapiens
FPYFFESRI

SEQ ID NO: 119264 - protein, 9 aa, Homo Sapiens
FPYGLFELV

SEQ ID NO: 119265 - protein, 9 aa, Homo Sapiens
FPYGSFPYV

SEQ ID NO: 119266 - protein, 9 aa, Homo Sapiens
FPYMTHPSV

SEQ ID NO: 119267 - protein, 9 aa, Homo Sapiens
FPYSLLIFV

SEQ ID NO: 119268 - protein, 9 aa, Homo Sapiens
FPYTTILSI

SEQ ID NO: 119269 - protein, 9 aa, Homo Sapiens
FPYVVVPRV

SEQ ID NO: 119270 - protein, 9 aa, Homo Sapiens
FPYYPSPGV

SEQ ID NO: 119271 - protein, 9 aa, Homo Sapiens
FSPFHASVL

SEQ ID NO: 119272 - protein, 9 aa, Homo Sapiens
FVNDIFERI

SEQ ID NO: 119273 - protein, 9 aa, Homo Sapiens
GDFLPPDEL

SEQ ID NO: 119274 - protein, 9 aa, Homo Sapiens
GVPLIIFTI

SEQ ID NO: 119275 - protein, 9 aa, Homo Sapiens
GYPYNAPTV

SEQ ID NO: 119276 - protein, 9 aa, Homo Sapiens
HACGVIATI

SEQ ID NO: 119277 - protein, 9 aa, Homo Sapiens
HAFSFPLLI

SEQ ID NO: 119278 - protein, 9 aa, Homo Sapiens
HAFWGGSVV

SEQ ID NO: 119279 - protein, 9 aa, Homo Sapiens
HANPILLLV

SEQ ID NO: 119280 - protein, 9 aa, Homo Sapiens
HAYIGVSLV

SEQ ID NO: 119281 - protein, 9 aa, Homo Sapiens
HGFAGVILI

SEQ ID NO: 119282 - protein, 9 aa, Homo Sapiens
HPDGKILII

SEQ ID NO: 119283 - protein, 9 aa, Homo Sapiens
HPDSHQLFI

SEQ ID NO: 119284 - protein, 9 aa, Homo Sapiens
HPFEAQTLI

SEQ ID NO: 119285 - protein, 9 aa, Homo Sapiens
HPFFYVPEI

SEQ ID NO: 119286 - protein, 9 aa, Homo Sapiens
HPHPFLNSV

SEQ ID NO: 119287 - protein, 9 aa, Homo Sapiens
HPNSAVLMV

SEQ ID NO: 119288 - protein, 9 aa, Homo Sapiens
HPPSHWPLI

SEQ ID NO: 119289 - protein, 9 aa, Homo Sapiens
HPSPVVLKV

SEQ ID NO: 119290 - protein, 9 aa, Homo Sapiens
HPYEVAEVI

SEQ ID NO: 119291 - protein, 9 aa, Homo Sapiens
HPYRLILTV

SEQ ID NO: 119292 - protein, 9 aa, Homo Sapiens
HVIDVKFLY

SEQ ID NO: 119293 - protein, 9 aa, Homo Sapiens
IAFEFPVLV

SEQ ID NO: 119294 - protein, 9 aa, Homo Sapiens
IAFFILTTI

SEQ ID NO: 119295 - protein, 9 aa, Homo Sapiens
IAFFTTASV

SEQ ID NO: 119296 - protein, 9 aa, Homo Sapiens
IAFHTIPVI

SEQ ID NO: 119297 - protein, 9 aa, Homo Sapiens
IAFLMINAV

SEQ ID NO: 119298 - protein, 9 aa, Homo Sapiens
IAFPTSISV

SEQ ID NO: 119299 - protein, 9 aa, Homo Sapiens
IALPHGQLV

SEQ ID NO: 119300 - protein, 9 aa, Homo Sapiens
IAMDLILKM

SEQ ID NO: 119301 - protein, 9 aa, Homo Sapiens
IANHQVLII

SEQ ID NO: 119302 - protein, 9 aa, Homo Sapiens
IAPKITSVI

SEQ ID NO: 119303 - protein, 9 aa, Homo Sapiens
IASPVIAAV

SEQ ID NO: 119304 - protein, 9 aa, Homo Sapiens
IAVNAVLTV

SEQ ID NO: 119305 - protein, 9 aa, Homo Sapiens
IAYDNIKVV

SEQ ID NO: 119306 - protein, 9 aa, Homo Sapiens
IAYKFGKTV

SEQ ID NO: 119307 - protein, 9 aa, Homo Sapiens
IGYPFLVSV

SEQ ID NO: 119308 - protein, 9 aa, Homo Sapiens
IPAAAFSLV

SEQ ID NO: 119309 - protein, 9 aa, Homo Sapiens
IPADLRIIS

SEQ ID NO: 119310 - protein, 9 aa, Homo Sapiens
IPASDLPQV

SEQ ID NO: 119311 - protein, 9 aa, Homo Sapiens
IPDGGVHII

SEQ ID NO: 119312 - protein, 9 aa, Homo Sapiens
IPDGGVHIV

SEQ ID NO: 119313 - protein, 9 aa, Homo Sapiens
IPDTMAHLI

SEQ ID NO: 119314 - protein, 9 aa, Homo Sapiens
IPFAGKVEV

SEQ ID NO: 119315 - protein, 9 aa, Homo Sapiens
IPFEFPLHL

SEQ ID NO: 119316 - protein, 9 aa, Homo Sapiens
IPFFREIIV

SEQ ID NO: 119317 - protein, 9 aa, Homo Sapiens
IPFFSIPVV

SEQ ID NO: 119318 - protein, 9 aa, Homo Sapiens
IPFGDITDI

SEQ ID NO: 119319 - protein, 9 aa, Homo Sapiens
IPFIGVVKV

SEQ ID NO: 119320 - protein, 9 aa, Homo Sapiens
IPFNQALVF

SEQ ID NO: 119321 - protein, 9 aa, Homo Sapiens
IPFSKPVKV

SEQ ID NO: 119322 - protein, 9 aa, Homo Sapiens
IPFSSKLNI

SEQ ID NO: 119323 - protein, 9 aa, Homo Sapiens
IPFVAPPLV

SEQ ID NO: 119324 - protein, 9 aa, Homo Sapiens
IPHIHKSLI

SEQ ID NO: 119325 - protein, 9 aa, Homo Sapiens
IPHPLIMGV

SEQ ID NO: 119326 - protein, 9 aa, Homo Sapiens
IPIPTLPSV

SEQ ID NO: 119327 - protein, 9 aa, Homo Sapiens
IPISNILMV

SEQ ID NO: 119328 - protein, 9 aa, Homo Sapiens
IPKNNPPTL

SEQ ID NO: 119329 - protein, 9 aa, Homo Sapiens
IPLEILVQI

SEQ ID NO: 119330 - protein, 9 aa, Homo Sapiens
IPLKEMPAV

SEQ ID NO: 119331 - protein, 9 aa, Homo Sapiens
IPLPLEPQV

SEQ ID NO: 119332 - protein, 9 aa, Homo Sapiens
IPLPTKILV

SEQ ID NO: 119333 - protein, 9 aa, Homo Sapiens
IPLSEILTV

SEQ ID NO: 119334 - protein, 9 aa, Homo Sapiens
IPMELVNEV

SEQ ID NO: 119335 - protein, 9 aa, Homo Sapiens
IPNEKIRNI

SEQ ID NO: 119336 - protein, 9 aa, Homo Sapiens
IPNFDVREI

SEQ ID NO: 119337 - protein, 9 aa, Homo Sapiens
IPNFPRSTV

SEQ ID NO: 119338 - protein, 9 aa, Homo Sapiens
IPPEIIMKV

SEQ ID NO: 119339 - protein, 9 aa, Homo Sapiens
IPPIQVTKV

SEQ ID NO: 119340 - protein, 9 aa, Homo Sapiens
IPPLATHTI

SEQ ID NO: 119341 - protein, 9 aa, Homo Sapiens
IPPPLSPPR

SEQ ID NO: 119342 - protein, 9 aa, Homo Sapiens
IPPTALNSI

SEQ ID NO: 119343 - protein, 9 aa, Homo Sapiens
IPQARFLLV

SEQ ID NO: 119344 - protein, 9 aa, Homo Sapiens
IPRSFMMEV

SEQ ID NO: 119345 - protein, 9 aa, Homo Sapiens
IPRSITVLV

SEQ ID NO: 119346 - protein, 9 aa, Homo Sapiens
IPRVPSLSV

SEQ ID NO: 119347 - protein, 9 aa, Homo Sapiens
IPRVQVAQI

SEQ ID NO: 119348 - protein, 9 aa, Homo Sapiens
IPTDKLLVI

SEQ ID NO: 119349 - protein, 9 aa, Homo Sapiens
IPTLKISLI

SEQ ID NO: 119350 - protein, 9 aa, Homo Sapiens
IPVEFKLVI

SEQ ID NO: 119351 - protein, 9 aa, Homo Sapiens
IPVSQISTI

SEQ ID NO: 119352 - protein, 9 aa, Homo Sapiens
IPVSWMPVI

SEQ ID NO: 119353 - protein, 9 aa, Homo Sapiens
IPWEVKASI

SEQ ID NO: 119354 - protein, 9 aa, Homo Sapiens
IPWIAIPLV

SEQ ID NO: 119355 - protein, 9 aa, Homo Sapiens
IPWLQYNEV

SEQ ID NO: 119356 - protein, 9 aa, Homo Sapiens
IPWPGTLAI

SEQ ID NO: 119357 - protein, 9 aa, Homo Sapiens
IPYEGFASL

SEQ ID NO: 119358 - protein, 9 aa, Homo Sapiens
IPYHIVNIV

SEQ ID NO: 119359 - protein, 9 aa, Homo Sapiens
IPYPRPIHL

SEQ ID NO: 119360 - protein, 9 aa, Homo Sapiens
IPYPSYAIF

SEQ ID NO: 119361 - protein, 9 aa, Homo Sapiens
IPYQDLPHL

SEQ ID NO: 119362 - protein, 9 aa, Homo Sapiens
IPYSPDVQI

SEQ ID NO: 119363 - protein, 9 aa, Homo Sapiens
IPYTFEDRI

SEQ ID NO: 119364 - protein, 9 aa, Homo Sapiens
KPYNVYITV

SEQ ID NO: 119365 - protein, 9 aa, Homo Sapiens
LALPAIAVI

SEQ ID NO: 119366 - protein, 9 aa, Homo Sapiens
LAPITLNTI

SEQ ID NO: 119367 - protein, 9 aa, Homo Sapiens
LAPPSPSLV

SEQ ID NO: 119368 - protein, 9 aa, Homo Sapiens
LAYPGSATI

SEQ ID NO: 119369 - protein, 9 aa, Homo Sapiens
LEGVRTPVL

SEQ ID NO: 119370 - protein, 9 aa, Homo Sapiens
LGYDTRVTI

SEQ ID NO: 119371 - protein, 9 aa, Homo Sapiens
LPAADVKNI

SEQ ID NO: 119372 - protein, 9 aa, Homo Sapiens
LPADFGRLV

SEQ ID NO: 119373 - protein, 9 aa, Homo Sapiens
LPADWAPLF

SEQ ID NO: 119374 - protein, 9 aa, Homo Sapiens
LPAEFFEVL

SEQ ID NO: 119375 - protein, 9 aa, Homo Sapiens
LPAELINQI

SEQ ID NO: 119376 - protein, 9 aa, Homo Sapiens
LPAGILPMV

SEQ ID NO: 119377 - protein, 9 aa, Homo Sapiens
LPAGINSIV

SEQ ID NO: 119378 - protein, 9 aa, Homo Sapiens
LPANLYPTV

SEQ ID NO: 119379 - protein, 9 aa, Homo Sapiens
LPANPIPVI

SEQ ID NO: 119380 - protein, 9 aa, Homo Sapiens
LPAPAVEHI

SEQ ID NO: 119381 - protein, 9 aa, Homo Sapiens
LPAPHLTLP

SEQ ID NO: 119382 - protein, 9 aa, Homo Sapiens
LPAQPMISV

SEQ ID NO: 119383 - protein, 9 aa, Homo Sapiens
LPASIPHVI

SEQ ID NO: 119384 - protein, 9 aa, Homo Sapiens
LPCTPVLVV

SEQ ID NO: 119385 - protein, 9 aa, Homo Sapiens
LPDGQVITI

SEQ ID NO: 119386 - protein, 9 aa, Homo Sapiens
LPDGRIIKV

SEQ ID NO: 119387 - protein, 9 aa, Homo Sapiens
LPDGRTLIV

SEQ ID NO: 119388 - protein, 9 aa, Homo Sapiens
LPDHVSIIL

SEQ ID NO: 119389 - protein, 9 aa, Homo Sapiens
LPDNSILVV

SEQ ID NO: 119390 - protein, 9 aa, Homo Sapiens
LPEDKPRLI

SEQ ID NO: 119391 - protein, 9 aa, Homo Sapiens
LPEITVRSV

SEQ ID NO: 119392 - protein, 9 aa, Homo Sapiens
LPEPKVRIV

SEQ ID NO: 119393 - protein, 9 aa, Homo Sapiens
LPEPSIRSV

SEQ ID NO: 119394 - protein, 9 aa, Homo Sapiens
LPFAAAGAL

SEQ ID NO: 119395 - protein, 9 aa, Homo Sapiens
LPFDHSRVI

SEQ ID NO: 119396 - protein, 9 aa, Homo Sapiens
LPFDLQRNV

SEQ ID NO: 119397 - protein, 9 aa, Homo Sapiens
LPFDRFSEV

SEQ ID NO: 119398 - protein, 9 aa, Homo Sapiens
LPFEIKNFV

SEQ ID NO: 119399 - protein, 9 aa, Homo Sapiens
LPFEPVPVI

SEQ ID NO: 119400 - protein, 9 aa, Homo Sapiens
LPFEVLQHI

SEQ ID NO: 119401 - protein, 9 aa, Homo Sapiens
LPFGKVTNI

SEQ ID NO: 119402 - protein, 9 aa, Homo Sapiens
LPFGVPASI

SEQ ID NO: 119403 - protein, 9 aa, Homo Sapiens
LPFLKNTVI

SEQ ID NO: 119404 - protein, 9 aa, Homo Sapiens
LPFLTNVTL

SEQ ID NO: 119405 - protein, 9 aa, Homo Sapiens
LPFPFPSKL

SEQ ID NO: 119406 - protein, 9 aa, Homo Sapiens
LPFPTVLRV

SEQ ID NO: 119407 - protein, 9 aa, Homo Sapiens
LPFQACLKV

SEQ ID NO: 119408 - protein, 9 aa, Homo Sapiens
LPFQKGYLV

SEQ ID NO: 119409 - protein, 9 aa, Homo Sapiens
LPFRALLQI

SEQ ID NO: 119410 - protein, 9 aa, Homo Sapiens
LPFRVIPLV

SEQ ID NO: 119411 - protein, 9 aa, Homo Sapiens
LPFSHPLFI

SEQ ID NO: 119412 - protein, 9 aa, Homo Sapiens
LPFTKPKVI

SEQ ID NO: 119413 - protein, 9 aa, Homo Sapiens
LPFTPLSYI

SEQ ID NO: 119414 - protein, 9 aa, Homo Sapiens
LPFVGKESI

SEQ ID NO: 119415 - protein, 9 aa, Homo Sapiens
LPFYFVQKI

SEQ ID NO: 119416 - protein, 9 aa, Homo Sapiens
LPGELFHVV

SEQ ID NO: 119417 - protein, 9 aa, Homo Sapiens
LPGPILQSI

SEQ ID NO: 119418 - protein, 9 aa, Homo Sapiens
LPHDPSFAI

SEQ ID NO: 119419 - protein, 9 aa, Homo Sapiens
LPHELCTLI

SEQ ID NO: 119420 - protein, 9 aa, Homo Sapiens
LPHFTSEHI

SEQ ID NO: 119421 - protein, 9 aa, Homo Sapiens
LPHHRVIEV

SEQ ID NO: 119422 - protein, 9 aa, Homo Sapiens
LPHLEAVVI

SEQ ID NO: 119423 - protein, 9 aa, Homo Sapiens
LPHLPQSEI

SEQ ID NO: 119424 - protein, 9 aa, Homo Sapiens
LPHLPSLEI

SEQ ID NO: 119425 - protein, 9 aa, Homo Sapiens
LPHPIIVSI

SEQ ID NO: 119426 - protein, 9 aa, Homo Sapiens
LPHPYAIAV

SEQ ID NO: 119427 - protein, 9 aa, Homo Sapiens
LPHRDFLQI

SEQ ID NO: 119428 - protein, 9 aa, Homo Sapiens
LPHVFVNCV

SEQ ID NO: 119429 - protein, 9 aa, Homo Sapiens
LPHVPLGVI

SEQ ID NO: 119430 - protein, 9 aa, Homo Sapiens
LPIANVARI

SEQ ID NO: 119431 - protein, 9 aa, Homo Sapiens
LPIAPSHVI

SEQ ID NO: 119432 - protein, 9 aa, Homo Sapiens
LPIDDVLRI

SEQ ID NO: 119433 - protein, 9 aa, Homo Sapiens
LPIDVQLYI

SEQ ID NO: 119434 - protein, 9 aa, Homo Sapiens
LPIGIPYSI

SEQ ID NO: 119435 - protein, 9 aa, Homo Sapiens
LPIHTVETI

SEQ ID NO: 119436 - protein, 9 aa, Homo Sapiens
LPIPESQVI

SEQ ID NO: 119437 - protein, 9 aa, Homo Sapiens
LPIPVPIFV

SEQ ID NO: 119438 - protein, 9 aa, Homo Sapiens
LPIQPAQHI

SEQ ID NO: 119439 - protein, 9 aa, Homo Sapiens
LPISHPPQI

SEQ ID NO: 119440 - protein, 9 aa, Homo Sapiens
LPISHPRFV

SEQ ID NO: 119441 - protein, 9 aa, Homo Sapiens
LPIVPQLQV

SEQ ID NO: 119442 - protein, 9 aa, Homo Sapiens
LPIVTPALR

SEQ ID NO: 119443 - protein, 9 aa, Homo Sapiens
LPKEPQGII

SEQ ID NO: 119444 - protein, 9 aa, Homo Sapiens
LPKLHIVKV

SEQ ID NO: 119445 - protein, 9 aa, Homo Sapiens
LPKNPDLRI

SEQ ID NO: 119446 - protein, 9 aa, Homo Sapiens
LPKPSSIEI

SEQ ID NO: 119447 - protein, 9 aa, Homo Sapiens
LPKSIYSQI

SEQ ID NO: 119448 - protein, 9 aa, Homo Sapiens
LPLAHHLLV

SEQ ID NO: 119449 - protein, 9 aa, Homo Sapiens
LPLAHVLEL

SEQ ID NO: 119450 - protein, 9 aa, Homo Sapiens
LPLDQRLLI

SEQ ID NO: 119451 - protein, 9 aa, Homo Sapiens
LPLDRYILV

SEQ ID NO: 119452 - protein, 9 aa, Homo Sapiens
LPLEDSPVI

SEQ ID NO: 119453 - protein, 9 aa, Homo Sapiens
LPLEKAIHI

SEQ ID NO: 119454 - protein, 9 aa, Homo Sapiens
LPLENGRFI

SEQ ID NO: 119455 - protein, 9 aa, Homo Sapiens
LPLEVCNIV

SEQ ID NO: 119456 - protein, 9 aa, Homo Sapiens
LPLFFVITV

SEQ ID NO: 119457 - protein, 9 aa, Homo Sapiens
LPLKTLESI

SEQ ID NO: 119458 - protein, 9 aa, Homo Sapiens
LPLLIADTL

SEQ ID NO: 119459 - protein, 9 aa, Homo Sapiens
LPLLRVLSI

SEQ ID NO: 119460 - protein, 9 aa, Homo Sapiens
LPLLVQRTI

SEQ ID NO: 119461 - protein, 9 aa, Homo Sapiens
LPLMKFLEV

SEQ ID NO: 119462 - protein, 9 aa, Homo Sapiens
LPLNIERNI

SEQ ID NO: 119463 - protein, 9 aa, Homo Sapiens
LPLPASPVV

SEQ ID NO: 119464 - protein, 9 aa, Homo Sapiens
LPLPHFDTI

SEQ ID NO: 119465 - protein, 9 aa, Homo Sapiens
LPLQENVTI

SEQ ID NO: 119466 - protein, 9 aa, Homo Sapiens
LPLRFWVNI

SEQ ID NO: 119467 - protein, 9 aa, Homo Sapiens
LPLSGVPLM

SEQ ID NO: 119468 - protein, 9 aa, Homo Sapiens
LPLSIFIQI

SEQ ID NO: 119469 - protein, 9 aa, Homo Sapiens
LPLSMIVAI

SEQ ID NO: 119470 - protein, 9 aa, Homo Sapiens
LPLSSLTHV

SEQ ID NO: 119471 - protein, 9 aa, Homo Sapiens
LPMDYVQRV

SEQ ID NO: 119472 - protein, 9 aa, Homo Sapiens
LPMGSIKNV

SEQ ID NO: 119473 - protein, 9 aa, Homo Sapiens
LPMVLVLLL

SEQ ID NO: 119474 - protein, 9 aa, Homo Sapiens
LPNAPKALI

SEQ ID NO: 119475 - protein, 9 aa, Homo Sapiens
LPNAVITRI

SEQ ID NO: 119476 - protein, 9 aa, Homo Sapiens
LPNDVVLQI

SEQ ID NO: 119477 - protein, 9 aa, Homo Sapiens
LPNIPVQTI

SEQ ID NO: 119478 - protein, 9 aa, Homo Sapiens
LPNKVDPLV

SEQ ID NO: 119479 - protein, 9 aa, Homo Sapiens
LPNLQTVTV

SEQ ID NO: 119480 - protein, 9 aa, Homo Sapiens
LPNNRELYI

SEQ ID NO: 119481 - protein, 9 aa, Homo Sapiens
LPNPTLVTI

SEQ ID NO: 119482 - protein, 9 aa, Homo Sapiens
LPPAALHLI

SEQ ID NO: 119483 - protein, 9 aa, Homo Sapiens
LPPDLSYIV

SEQ ID NO: 119484 - protein, 9 aa, Homo Sapiens
LPPDVWMKI

SEQ ID NO: 119485 - protein, 9 aa, Homo Sapiens
LPPGFYPHI

SEQ ID NO: 119486 - protein, 9 aa, Homo Sapiens
LPPIKVLVV

SEQ ID NO: 119487 - protein, 9 aa, Homo Sapiens
LPPLHVAKL

SEQ ID NO: 119488 - protein, 9 aa, Homo Sapiens
LPPNHILEI

SEQ ID NO: 119489 - protein, 9 aa, Homo Sapiens
LPPNLYPTV

SEQ ID NO: 119490 - protein, 9 aa, Homo Sapiens
LPPPFVPTL

SEQ ID NO: 119491 - protein, 9 aa, Homo Sapiens
LPPPLAPNI

SEQ ID NO: 119492 - protein, 9 aa, Homo Sapiens
LPPPPHLPP

SEQ ID NO: 119493 - protein, 9 aa, Homo Sapiens
LPPPPHPSV

SEQ ID NO: 119494 - protein, 9 aa, Homo Sapiens
LPPPPMQYI

SEQ ID NO: 119495 - protein, 9 aa, Homo Sapiens
LPPPPPPHL

SEQ ID NO: 119496 - protein, 9 aa, Homo Sapiens
LPPPPQQKI

SEQ ID NO: 119497 - protein, 9 aa, Homo Sapiens
LPPPTPSQI

SEQ ID NO: 119498 - protein, 9 aa, Homo Sapiens
LPPPVQTQI

SEQ ID NO: 119499 - protein, 9 aa, Homo Sapiens
LPPQAFNHI

SEQ ID NO: 119500 - protein, 9 aa, Homo Sapiens
LPPSALQSV

SEQ ID NO: 119501 - protein, 9 aa, Homo Sapiens
LPPSVVATV

SEQ ID NO: 119502 - protein, 9 aa, Homo Sapiens
LPPVPVPKI

SEQ ID NO: 119503 - protein, 9 aa, Homo Sapiens
LPPVVFLLI

SEQ ID NO: 119504 - protein, 9 aa, Homo Sapiens
LPQDVILKF

SEQ ID NO: 119505 - protein, 9 aa, Homo Sapiens
LPQEIGNLK

SEQ ID NO: 119506 - protein, 9 aa, Homo Sapiens
LPRDHPAVI

SEQ ID NO: 119507 - protein, 9 aa, Homo Sapiens
LPREISLDL

SEQ ID NO: 119508 - protein, 9 aa, Homo Sapiens
LPRLSLNGV

SEQ ID NO: 119509 - protein, 9 aa, Homo Sapiens
LPRNLPVTI

SEQ ID NO: 119510 - protein, 9 aa, Homo Sapiens
LPSDPFSRV

SEQ ID NO: 119511 - protein, 9 aa, Homo Sapiens
LPSEITRTI

SEQ ID NO: 119512 - protein, 9 aa, Homo Sapiens
LPSELIVHI

SEQ ID NO: 119513 - protein, 9 aa, Homo Sapiens
LPSGAVFVI

SEQ ID NO: 119514 - protein, 9 aa, Homo Sapiens
LPSHGVPLI

SEQ ID NO: 119515 - protein, 9 aa, Homo Sapiens
LPSNTSLVI

SEQ ID NO: 119516 - protein, 9 aa, Homo Sapiens
LPSPISPDI

SEQ ID NO: 119517 - protein, 9 aa, Homo Sapiens
LPSPPAVAV

SEQ ID NO: 119518 - protein, 9 aa, Homo Sapiens
LPSQVSRVV

SEQ ID NO: 119519 - protein, 9 aa, Homo Sapiens
LPSSLYLKI

SEQ ID NO: 119520 - protein, 9 aa, Homo Sapiens
LPSSVLHII

SEQ ID NO: 119521 - protein, 9 aa, Homo Sapiens
LPTDVMTTV

SEQ ID NO: 119522 - protein, 9 aa, Homo Sapiens
LPTHDLPLI

SEQ ID NO: 119523 - protein, 9 aa, Homo Sapiens
LPTTALPTV

SEQ ID NO: 119524 - protein, 9 aa, Homo Sapiens
LPVAVKHVV

SEQ ID NO: 119525 - protein, 9 aa, Homo Sapiens
LPVDAVISV

SEQ ID NO: 119526 - protein, 9 aa, Homo Sapiens
LPVEAMVTI

SEQ ID NO: 119527 - protein, 9 aa, Homo Sapiens
LPVNAQNYV

SEQ ID NO: 119528 - protein, 9 aa, Homo Sapiens
LPVPAFNVI

SEQ ID NO: 119529 - protein, 9 aa, Homo Sapiens
LPVPLHPQV

SEQ ID NO: 119530 - protein, 9 aa, Homo Sapiens
LPVVLPPIM

SEQ ID NO: 119531 - protein, 9 aa, Homo Sapiens
LPVVVISNI

SEQ ID NO: 119532 - protein, 9 aa, Homo Sapiens
LPVVVISNV

SEQ ID NO: 119533 - protein, 9 aa, Homo Sapiens
LPWASVLRV

SEQ ID NO: 119534 - protein, 9 aa, Homo Sapiens
LPWEEREKI

SEQ ID NO: 119535 - protein, 9 aa, Homo Sapiens
LPWESMPSL

SEQ ID NO: 119536 - protein, 9 aa, Homo Sapiens
LPWGPALLI

SEQ ID NO: 119537 - protein, 9 aa, Homo Sapiens
LPWISILTV

SEQ ID NO: 119538 - protein, 9 aa, Homo Sapiens
LPWIVPMSL

SEQ ID NO: 119539 - protein, 9 aa, Homo Sapiens
LPWKSLTSI

SEQ ID NO: 119540 - protein, 9 aa, Homo Sapiens
LPWPFQGTI

SEQ ID NO: 119541 - protein, 9 aa, Homo Sapiens
LPWPFRNKV

SEQ ID NO: 119542 - protein, 9 aa, Homo Sapiens
LPWSNPLKV

SEQ ID NO: 119543 - protein, 9 aa, Homo Sapiens
LPWTAEQVV

SEQ ID NO: 119544 - protein, 9 aa, Homo Sapiens
LPYAGDVSM

SEQ ID NO: 119545 - protein, 9 aa, Homo Sapiens
LPYAITIVA

SEQ ID NO: 119546 - protein, 9 aa, Homo Sapiens
LPYDAFVVF

SEQ ID NO: 119547 - protein, 9 aa, Homo Sapiens
LPYELAINI

SEQ ID NO: 119548 - protein, 9 aa, Homo Sapiens
LPYGEGLRI

SEQ ID NO: 119549 - protein, 9 aa, Homo Sapiens
LPYGFIQEL

SEQ ID NO: 119550 - protein, 9 aa, Homo Sapiens
LPYGLERAI

SEQ ID NO: 119551 - protein, 9 aa, Homo Sapiens
LPYHIYPFI

SEQ ID NO: 119552 - protein, 9 aa, Homo Sapiens
LPYHVAVLL

SEQ ID NO: 119553 - protein, 9 aa, Homo Sapiens
LPYKIAYYI

SEQ ID NO: 119554 - protein, 9 aa, Homo Sapiens
LPYLALLTI

SEQ ID NO: 119555 - protein, 9 aa, Homo Sapiens
LPYLASLGI

SEQ ID NO: 119556 - protein, 9 aa, Homo Sapiens
LPYLNKVVV

SEQ ID NO: 119557 - protein, 9 aa, Homo Sapiens
LPYLVSNVI

SEQ ID NO: 119558 - protein, 9 aa, Homo Sapiens
LPYNMPLAY

SEQ ID NO: 119559 - protein, 9 aa, Homo Sapiens
LPYPAPEGI

SEQ ID NO: 119560 - protein, 9 aa, Homo Sapiens
LPYPFASEI

SEQ ID NO: 119561 - protein, 9 aa, Homo Sapiens
LPYPVKIKV

SEQ ID NO: 119562 - protein, 9 aa, Homo Sapiens
LPYRLVFAV

SEQ ID NO: 119563 - protein, 9 aa, Homo Sapiens
LPYRWQMLI

SEQ ID NO: 119564 - protein, 9 aa, Homo Sapiens
LPYSFIIGV

SEQ ID NO: 119565 - protein, 9 aa, Homo Sapiens
LPYSIRVLL

SEQ ID NO: 119566 - protein, 9 aa, Homo Sapiens
LPYSPRVLV

SEQ ID NO: 119567 - protein, 9 aa, Homo Sapiens
LPYSQISGL

SEQ ID NO: 119568 - protein, 9 aa, Homo Sapiens
LPYTQSVQI

SEQ ID NO: 119569 - protein, 9 aa, Homo Sapiens
LPYVGMVTI

SEQ ID NO: 119570 - protein, 9 aa, Homo Sapiens
LPYVSVTSL

SEQ ID NO: 119571 - protein, 9 aa, Homo Sapiens
LPYWVPLSL

SEQ ID NO: 119572 - protein, 9 aa, Homo Sapiens
LPYYIGISI

SEQ ID NO: 119573 - protein, 9 aa, Homo Sapiens
MAFLTQRTI

SEQ ID NO: 119574 - protein, 9 aa, Homo Sapiens
MALIQHSTI

SEQ ID NO: 119575 - protein, 9 aa, Homo Sapiens
MALQSILSI

SEQ ID NO: 119576 - protein, 9 aa, Homo Sapiens
MANPRELRI

SEQ ID NO: 119577 - protein, 9 aa, Homo Sapiens
MAPLALHLL

SEQ ID NO: 119578 - protein, 9 aa, Homo Sapiens
MAWAVVNEI

SEQ ID NO: 119579 - protein, 9 aa, Homo Sapiens
MAYARQIYI

SEQ ID NO: 119580 - protein, 9 aa, Homo Sapiens
MAYPDLNEI

SEQ ID NO: 119581 - protein, 9 aa, Homo Sapiens
MGYSHSLVI

SEQ ID NO: 119582 - protein, 9 aa, Homo Sapiens
MPALAPPEV

SEQ ID NO: 119583 - protein, 9 aa, Homo Sapiens
MPFESAVVI

SEQ ID NO: 119584 - protein, 9 aa, Homo Sapiens
MPFNLIPVI

SEQ ID NO: 119585 - protein, 9 aa, Homo Sapiens
MPFRGDTVI

SEQ ID NO: 119586 - protein, 9 aa, Homo Sapiens
MPHLSMQQV

SEQ ID NO: 119587 - protein, 9 aa, Homo Sapiens
MPHNQFIKM

SEQ ID NO: 119588 - protein, 9 aa, Homo Sapiens
MPISQLLMI

SEQ ID NO: 119589 - protein, 9 aa, Homo Sapiens
MPKPDPTVI

SEQ ID NO: 119590 - protein, 9 aa, Homo Sapiens
MPLESAVNV

SEQ ID NO: 119591 - protein, 9 aa, Homo Sapiens
MPLLTPRYI

SEQ ID NO: 119592 - protein, 9 aa, Homo Sapiens
MPLNVADLI

SEQ ID NO: 119593 - protein, 9 aa, Homo Sapiens
MPLPVLQAI

SEQ ID NO: 119594 - protein, 9 aa, Homo Sapiens
MPLQLLLLL

SEQ ID NO: 119595 - protein, 9 aa, Homo Sapiens
MPLSTIREV

SEQ ID NO: 119596 - protein, 9 aa, Homo Sapiens
MPLVKSVTV

SEQ ID NO: 119597 - protein, 9 aa, Homo Sapiens
MPMNVADLI

SEQ ID NO: 119598 - protein, 9 aa, Homo Sapiens
MPNENIPEL

SEQ ID NO: 119599 - protein, 9 aa, Homo Sapiens
MPNTRPPII

SEQ ID NO: 119600 - protein, 9 aa, Homo Sapiens
MPPPPLQHV

SEQ ID NO: 119601 - protein, 9 aa, Homo Sapiens
MPPPPPQGV

SEQ ID NO: 119602 - protein, 9 aa, Homo Sapiens
MPQIETRVI

SEQ ID NO: 119603 - protein, 9 aa, Homo Sapiens
MPQNRTIYV

SEQ ID NO: 119604 - protein, 9 aa, Homo Sapiens
MPRDILIVV

SEQ ID NO: 119605 - protein, 9 aa, Homo Sapiens
MPTLPPPSV

SEQ ID NO: 119606 - protein, 9 aa, Homo Sapiens
MPVIPMNTI

SEQ ID NO: 119607 - protein, 9 aa, Homo Sapiens
MPYEDIRNV

SEQ ID NO: 119608 - protein, 9 aa, Homo Sapiens
MPYEFDIRV

SEQ ID NO: 119609 - protein, 9 aa, Homo Sapiens
MPYGSLYNV

SEQ ID NO: 119610 - protein, 9 aa, Homo Sapiens
MPYGWLTEI

SEQ ID NO: 119611 - protein, 9 aa, Homo Sapiens
MPYHIQRTI

SEQ ID NO: 119612 - protein, 9 aa, Homo Sapiens
MPYLIGIHL

SEQ ID NO: 119613 - protein, 9 aa, Homo Sapiens
MPYNYPVLL

SEQ ID NO: 119614 - protein, 9 aa, Homo Sapiens
MPYQEIKNV

SEQ ID NO: 119615 - protein, 9 aa, Homo Sapiens
MTYERILYI

SEQ ID NO: 119616 - protein, 9 aa, Homo Sapiens
NAFQYVNSI

SEQ ID NO: 119617 - protein, 9 aa, Homo Sapiens
NAIETMPCV

SEQ ID NO: 119618 - protein, 9 aa, Homo Sapiens
NALDKVLSV

SEQ ID NO: 119619 - protein, 9 aa, Homo Sapiens
NALGVILQV

SEQ ID NO: 119620 - protein, 9 aa, Homo Sapiens
NAYEYFTKI

SEQ ID NO: 119621 - protein, 9 aa, Homo Sapiens
NAYFLLPKV

SEQ ID NO: 119622 - protein, 9 aa, Homo Sapiens
NAYPNTPYI

SEQ ID NO: 119623 - protein, 9 aa, Homo Sapiens
NPLPSKETI

SEQ ID NO: 119624 - protein, 9 aa, Homo Sapiens
NPYIGGLGI

SEQ ID NO: 119625 - protein, 9 aa, Homo Sapiens
NPYLLALTI

SEQ ID NO: 119626 - protein, 9 aa, Homo Sapiens
NPYQFDVLV

SEQ ID NO: 119627 - protein, 9 aa, Homo Sapiens
NSAPAVLEI

SEQ ID NO: 119628 - protein, 9 aa, Homo Sapiens
NVPYPLPKI

SEQ ID NO: 119629 - protein, 9 aa, Homo Sapiens
PIRLLAAAA

SEQ ID NO: 119630 - protein, 9 aa, Homo Sapiens
PRAKIITVL

SEQ ID NO: 119631 - protein, 9 aa, Homo Sapiens
PSEIVGKRI

SEQ ID NO: 119632 - protein, 9 aa, Homo Sapiens
QAIERYLVV

SEQ ID NO: 119633 - protein, 9 aa, Homo Sapiens
QALDARLEV

SEQ ID NO: 119634 - protein, 9 aa, Homo Sapiens
QALGITTKI

SEQ ID NO: 119635 - protein, 9 aa, Homo Sapiens
QALPWVRYI

SEQ ID NO: 119636 - protein, 9 aa, Homo Sapiens
QPFEDTPVV

SEQ ID NO: 119637 - protein, 9 aa, Homo Sapiens
QPLPRIVTI

SEQ ID NO: 119638 - protein, 9 aa, Homo Sapiens
QPLPVILHV

SEQ ID NO: 119639 - protein, 9 aa, Homo Sapiens
QPPPPPLWI

SEQ ID NO: 119640 - protein, 9 aa, Homo Sapiens
QPYGGFLDI

SEQ ID NO: 119641 - protein, 9 aa, Homo Sapiens
QPYLFTRHV

SEQ ID NO: 119642 - protein, 9 aa, Homo Sapiens
QPYPEILVV

SEQ ID NO: 119643 - protein, 9 aa, Homo Sapiens
QPYSKLPGV

SEQ ID NO: 119644 - protein, 9 aa, Homo Sapiens
REPLGLRVW

SEQ ID NO: 119645 - protein, 9 aa, Homo Sapiens
SAFDHFASV

SEQ ID NO: 119646 - protein, 9 aa, Homo Sapiens
SAFPFPVTV

SEQ ID NO: 119647 - protein, 9 aa, Homo Sapiens
SALPWNITV

SEQ ID NO: 119648 - protein, 9 aa, Homo Sapiens
SANHNILQI

SEQ ID NO: 119649 - protein, 9 aa, Homo Sapiens
SAWRVISSI

SEQ ID NO: 119650 - protein, 9 aa, Homo Sapiens
SAYESLMEI

SEQ ID NO: 119651 - protein, 9 aa, Homo Sapiens
SAYLVAEKV

SEQ ID NO: 119652 - protein, 9 aa, Homo Sapiens
SDAIPGLKI

SEQ ID NO: 119653 - protein, 9 aa, Homo Sapiens
SDAPGVPRI

SEQ ID NO: 119654 - protein, 9 aa, Homo Sapiens
SPAPPLLHV

SEQ ID NO: 119655 - protein, 9 aa, Homo Sapiens
SPFALQNTI

SEQ ID NO: 119656 - protein, 9 aa, Homo Sapiens
SPFPDIPKV

SEQ ID NO: 119657 - protein, 9 aa, Homo Sapiens
SPIAMFLTI

SEQ ID NO: 119658 - protein, 9 aa, Homo Sapiens
SPIENIQRV

SEQ ID NO: 119659 - protein, 9 aa, Homo Sapiens
SPLDIYPKI

SEQ ID NO: 119660 - protein, 9 aa, Homo Sapiens
SPLDSIHTI

SEQ ID NO: 119661 - protein, 9 aa, Homo Sapiens
SPLPQYVTV

SEQ ID NO: 119662 - protein, 9 aa, Homo Sapiens
SPMDTFLLI

SEQ ID NO: 119663 - protein, 9 aa, Homo Sapiens
SPYDMLESI

SEQ ID NO: 119664 - protein, 9 aa, Homo Sapiens
SPYHGFTIV

SEQ ID NO: 119665 - protein, 9 aa, Homo Sapiens
SPYPGLRLI

SEQ ID NO: 119666 - protein, 9 aa, Homo Sapiens
TAFAFHLRV

SEQ ID NO: 119667 - protein, 9 aa, Homo Sapiens
TAFAHLREV

SEQ ID NO: 119668 - protein, 9 aa, Homo Sapiens
TAFPFQVEV

SEQ ID NO: 119669 - protein, 9 aa, Homo Sapiens
TAFSRLILI

SEQ ID NO: 119670 - protein, 9 aa, Homo Sapiens
TAFVEPLVI

SEQ ID NO: 119671 - protein, 9 aa, Homo Sapiens
TAIHNFPTV

SEQ ID NO: 119672 - protein, 9 aa, Homo Sapiens
TAKLPAPSI

SEQ ID NO: 119673 - protein, 9 aa, Homo Sapiens
TALAIYHVI

SEQ ID NO: 119674 - protein, 9 aa, Homo Sapiens
TALALQLVM

SEQ ID NO: 119675 - protein, 9 aa, Homo Sapiens
TALAQIMTI

SEQ ID NO: 119676 - protein, 9 aa, Homo Sapiens
TALERVVRI

SEQ ID NO: 119677 - protein, 9 aa, Homo Sapiens
TALNRFLQV

SEQ ID NO: 119678 - protein, 9 aa, Homo Sapiens
TALPMVPIV

SEQ ID NO: 119679 - protein, 9 aa, Homo Sapiens
TALVIHQRI

SEQ ID NO: 119680 - protein, 9 aa, Homo Sapiens
TANLITVTV

SEQ ID NO: 119681 - protein, 9 aa, Homo Sapiens
TAPPPLPRI

SEQ ID NO: 119682 - protein, 9 aa, Homo Sapiens
TAPVNIAVI

SEQ ID NO: 119683 - protein, 9 aa, Homo Sapiens
TAVESFLTI

SEQ ID NO: 119684 - protein, 9 aa, Homo Sapiens
TAYIHQVTV

SEQ ID NO: 119685 - protein, 9 aa, Homo Sapiens
TAYLFSRFV

SEQ ID NO: 119686 - protein, 9 aa, Homo Sapiens
TAYNLIHTI

SEQ ID NO: 119687 - protein, 9 aa, Homo Sapiens
TAYPQVVVV

SEQ ID NO: 119688 - protein, 9 aa, Homo Sapiens
TAYPSLRLI

SEQ ID NO: 119689 - protein, 9 aa, Homo Sapiens
TGPLVLNRV

SEQ ID NO: 119690 - protein, 9 aa, Homo Sapiens
TGPPVSELI

SEQ ID NO: 119691 - protein, 9 aa, Homo Sapiens
TGYLNTVTV

SEQ ID NO: 119692 - protein, 9 aa, Homo Sapiens
TIRYPDPLI

SEQ ID NO: 119693 - protein, 9 aa, Homo Sapiens
TPESKIRFV

SEQ ID NO: 119694 - protein, 9 aa, Homo Sapiens
TPFEGILII

SEQ ID NO: 119695 - protein, 9 aa, Homo Sapiens
TPFGGRLLV

SEQ ID NO: 119696 - protein, 9 aa, Homo Sapiens
TPFHVMLLI

SEQ ID NO: 119697 - protein, 9 aa, Homo Sapiens
TPFPYNPLI

SEQ ID NO: 119698 - protein, 9 aa, Homo Sapiens
TPHDFIEHI

SEQ ID NO: 119699 - protein, 9 aa, Homo Sapiens
TPINRIPIM

SEQ ID NO: 119700 - protein, 9 aa, Homo Sapiens
TPLASFTTV

SEQ ID NO: 119701 - protein, 9 aa, Homo Sapiens
TPLQIKSVV

SEQ ID NO: 119702 - protein, 9 aa, Homo Sapiens
TPRVIIQTV

SEQ ID NO: 119703 - protein, 9 aa, Homo Sapiens
TPYHVNLLL

SEQ ID NO: 119704 - protein, 9 aa, Homo Sapiens
TPYNYPVPV

SEQ ID NO: 119705 - protein, 9 aa, Homo Sapiens
TPYQSKWTI

SEQ ID NO: 119706 - protein, 9 aa, Homo Sapiens
TPYWMAPEV

SEQ ID NO: 119707 - protein, 9 aa, Homo Sapiens
TVLPFVSTV

SEQ ID NO: 119708 - protein, 9 aa, Homo Sapiens
VAAAVDLII

SEQ ID NO: 119709 - protein, 9 aa, Homo Sapiens
VAAPPSIQI

SEQ ID NO: 119710 - protein, 9 aa, Homo Sapiens
VAHQQLIQI

SEQ ID NO: 119711 - protein, 9 aa, Homo Sapiens
VAIESTPMI

SEQ ID NO: 119712 - protein, 9 aa, Homo Sapiens
VALARALFI

SEQ ID NO: 119713 - protein, 9 aa, Homo Sapiens
VALDKVIEI

SEQ ID NO: 119714 - protein, 9 aa, Homo Sapiens
VALEHFVLV

SEQ ID NO: 119715 - protein, 9 aa, Homo Sapiens
VALFFAVLI

SEQ ID NO: 119716 - protein, 9 aa, Homo Sapiens
VALKIIRNV

SEQ ID NO: 119717 - protein, 9 aa, Homo Sapiens
VALLVGEKV

SEQ ID NO: 119718 - protein, 9 aa, Homo Sapiens
VALPMVLVL

SEQ ID NO: 119719 - protein, 9 aa, Homo Sapiens
VALPVFLVI

SEQ ID NO: 119720 - protein, 9 aa, Homo Sapiens
VALPVLMNI

SEQ ID NO: 119721 - protein, 9 aa, Homo Sapiens
VALPVYLLI

SEQ ID NO: 119722 - protein, 9 aa, Homo Sapiens
VALSLKISI

SEQ ID NO: 119723 - protein, 9 aa, Homo Sapiens
VALVVPVSI

SEQ ID NO: 119724 - protein, 9 aa, Homo Sapiens
VAPGALLGL

SEQ ID NO: 119725 - protein, 9 aa, Homo Sapiens
VAPLATVNI

SEQ ID NO: 119726 - protein, 9 aa, Homo Sapiens
VARLEKIKI

SEQ ID NO: 119727 - protein, 9 aa, Homo Sapiens
VAVAPRLVV

SEQ ID NO: 119728 - protein, 9 aa, Homo Sapiens
VAVEPRSLI

SEQ ID NO: 119729 - protein, 9 aa, Homo Sapiens
VAWEVANKV

SEQ ID NO: 119730 - protein, 9 aa, Homo Sapiens
VFLAMLLVL

SEQ ID NO: 119731 - protein, 9 aa, Homo Sapiens
VPAATFQSI

SEQ ID NO: 119732 - protein, 9 aa, Homo Sapiens
VPAGGVLTI

SEQ ID NO: 119733 - protein, 9 aa, Homo Sapiens
VPAPSVPSV

SEQ ID NO: 119734 - protein, 9 aa, Homo Sapiens
VPASVVSRI

SEQ ID NO: 119735 - protein, 9 aa, Homo Sapiens
VPDQPHPEI

SEQ ID NO: 119736 - protein, 9 aa, Homo Sapiens
VPDTSRIYV

SEQ ID NO: 119737 - protein, 9 aa, Homo Sapiens
VPFAPIVFI

SEQ ID NO: 119738 - protein, 9 aa, Homo Sapiens
VPFENKLYL

SEQ ID NO: 119739 - protein, 9 aa, Homo Sapiens
VPFERPAVI

SEQ ID NO: 119740 - protein, 9 aa, Homo Sapiens
VPFITEHII

SEQ ID NO: 119741 - protein, 9 aa, Homo Sapiens
VPFIVPLSV

SEQ ID NO: 119742 - protein, 9 aa, Homo Sapiens
VPFLNPYTV

SEQ ID NO: 119743 - protein, 9 aa, Homo Sapiens
VPFPDTYEI

SEQ ID NO: 119744 - protein, 9 aa, Homo Sapiens
VPFPEGFVI

SEQ ID NO: 119745 - protein, 9 aa, Homo Sapiens
VPFSHVNIV

SEQ ID NO: 119746 - protein, 9 aa, Homo Sapiens
VPFSQVVCI

SEQ ID NO: 119747 - protein, 9 aa, Homo Sapiens
VPFVGKVHI

SEQ ID NO: 119748 - protein, 9 aa, Homo Sapiens
VPHFPTPSI

SEQ ID NO: 119749 - protein, 9 aa, Homo Sapiens
VPIEQIPLV

SEQ ID NO: 119750 - protein, 9 aa, Homo Sapiens
VPIFPQPLI

SEQ ID NO: 119751 - protein, 9 aa, Homo Sapiens
VPIKPLPNV

SEQ ID NO: 119752 - protein, 9 aa, Homo Sapiens
VPILAPRIF

SEQ ID NO: 119753 - protein, 9 aa, Homo Sapiens
VPITRSGDL

SEQ ID NO: 119754 - protein, 9 aa, Homo Sapiens
VPIVMLPKI

SEQ ID NO: 119755 - protein, 9 aa, Homo Sapiens
VPKALEPYV

SEQ ID NO: 119756 - protein, 9 aa, Homo Sapiens
VPLALHPVV

SEQ ID NO: 119757 - protein, 9 aa, Homo Sapiens
VPLDKQITI

SEQ ID NO: 119758 - protein, 9 aa, Homo Sapiens
VPLDPMEHV

SEQ ID NO: 119759 - protein, 9 aa, Homo Sapiens
VPLEIMIKF

SEQ ID NO: 119760 - protein, 9 aa, Homo Sapiens
VPLETIVII

SEQ ID NO: 119761 - protein, 9 aa, Homo Sapiens
VPLEVFEYI

SEQ ID NO: 119762 - protein, 9 aa, Homo Sapiens
VPLGVISRI

SEQ ID NO: 119763 - protein, 9 aa, Homo Sapiens
VPLIIPVSV

SEQ ID NO: 119764 - protein, 9 aa, Homo Sapiens
VPLIIVNSI

SEQ ID NO: 119765 - protein, 9 aa, Homo Sapiens
VPLKDIVAI

SEQ ID NO: 119766 - protein, 9 aa, Homo Sapiens
VPLLKSLEV

SEQ ID NO: 119767 - protein, 9 aa, Homo Sapiens
VPLPNVPSI

SEQ ID NO: 119768 - protein, 9 aa, Homo Sapiens
VPLPPPMAI

SEQ ID NO: 119769 - protein, 9 aa, Homo Sapiens
VPLPRLLEV

SEQ ID NO: 119770 - protein, 9 aa, Homo Sapiens
VPLQPVTQN

SEQ ID NO: 119771 - protein, 9 aa, Homo Sapiens
VPLRVSPYV

SEQ ID NO: 119772 - protein, 9 aa, Homo Sapiens
VPLSQVKSI

SEQ ID NO: 119773 - protein, 9 aa, Homo Sapiens
VPLSSPLKV

SEQ ID NO: 119774 - protein, 9 aa, Homo Sapiens
VPLVAGLVI

SEQ ID NO: 119775 - protein, 9 aa, Homo Sapiens
VPLVVLISI

SEQ ID NO: 119776 - protein, 9 aa, Homo Sapiens
VPMPYTLKV

SEQ ID NO: 119777 - protein, 9 aa, Homo Sapiens
VPMRPGILV

SEQ ID NO: 119778 - protein, 9 aa, Homo Sapiens
VPMTPLRTV

SEQ ID NO: 119779 - protein, 9 aa, Homo Sapiens
VPNEHIMNV

SEQ ID NO: 119780 - protein, 9 aa, Homo Sapiens
VPNHLIWLI

SEQ ID NO: 119781 - protein, 9 aa, Homo Sapiens
VPNLEIPTV

SEQ ID NO: 119782 - protein, 9 aa, Homo Sapiens
VPNLKPLTV

SEQ ID NO: 119783 - protein, 9 aa, Homo Sapiens
VPNLQTVSV

SEQ ID NO: 119784 - protein, 9 aa, Homo Sapiens
VPNNKITVV

SEQ ID NO: 119785 - protein, 9 aa, Homo Sapiens
VPNPRIKLI

SEQ ID NO: 119786 - protein, 9 aa, Homo Sapiens
VPPAALISI

SEQ ID NO: 119787 - protein, 9 aa, Homo Sapiens
VPPEILNNV

SEQ ID NO: 119788 - protein, 9 aa, Homo Sapiens
VPPENIIYI

SEQ ID NO: 119789 - protein, 9 aa, Homo Sapiens
VPPEWVPII

SEQ ID NO: 119790 - protein, 9 aa, Homo Sapiens
VPPLATNTV

SEQ ID NO: 119791 - protein, 9 aa, Homo Sapiens
VPPLVPKVL

SEQ ID NO: 119792 - protein, 9 aa, Homo Sapiens
VPPPLAKAI

SEQ ID NO: 119793 - protein, 9 aa, Homo Sapiens
VPPSPANFI

SEQ ID NO: 119794 - protein, 9 aa, Homo Sapiens
VPQLQNNTI

SEQ ID NO: 119795 - protein, 9 aa, Homo Sapiens
VPRQNVPVI

SEQ ID NO: 119796 - protein, 9 aa, Homo Sapiens
VPRWSPPSI

SEQ ID NO: 119797 - protein, 9 aa, Homo Sapiens
VPSDLYPLV

SEQ ID NO: 119798 - protein, 9 aa, Homo Sapiens
VPSTAIREI

SEQ ID NO: 119799 - protein, 9 aa, Homo Sapiens
VPVEPVLTV

SEQ ID NO: 119800 - protein, 9 aa, Homo Sapiens
VPVEQVLLI

SEQ ID NO: 119801 - protein, 9 aa, Homo Sapiens
VPVFWPILV

SEQ ID NO: 119802 - protein, 9 aa, Homo Sapiens
VPVGFFLLI

SEQ ID NO: 119803 - protein, 9 aa, Homo Sapiens
VPVGKVLKV

SEQ ID NO: 119804 - protein, 9 aa, Homo Sapiens
VPVGRQPII

SEQ ID NO: 119805 - protein, 9 aa, Homo Sapiens
VPVMPLTSI

SEQ ID NO: 119806 - protein, 9 aa, Homo Sapiens
VPVWSGMNV

SEQ ID NO: 119807 - protein, 9 aa, Homo Sapiens
VPWPVDIVI

SEQ ID NO: 119808 - protein, 9 aa, Homo Sapiens
VPYAGVLAV

SEQ ID NO: 119809 - protein, 9 aa, Homo Sapiens
VPYEKGFAL

SEQ ID NO: 119810 - protein, 9 aa, Homo Sapiens
VPYGTPLSV

SEQ ID NO: 119811 - protein, 9 aa, Homo Sapiens
VPYIGIVTI

SEQ ID NO: 119812 - protein, 9 aa, Homo Sapiens
VPYLKIFTV

SEQ ID NO: 119813 - protein, 9 aa, Homo Sapiens
VPYLVGQVV

SEQ ID NO: 119814 - protein, 9 aa, Homo Sapiens
VPYPTASLV

SEQ ID NO: 119815 - protein, 9 aa, Homo Sapiens
VPYPVALHV

SEQ ID NO: 119816 - protein, 9 aa, Homo Sapiens
VPYRLLPGI

SEQ ID NO: 119817 - protein, 9 aa, Homo Sapiens
VPYVINVTL

SEQ ID NO: 119818 - protein, 9 aa, Homo Sapiens
WAYPRQVFI

SEQ ID NO: 119819 - protein, 9 aa, Homo Sapiens
WPFSIQDVV

SEQ ID NO: 119820 - protein, 9 aa, Homo Sapiens
WPREGILRV

SEQ ID NO: 119821 - protein, 9 aa, Homo Sapiens
YAFAHILTV

SEQ ID NO: 119822 - protein, 9 aa, Homo Sapiens
YAFGKFPTV

SEQ ID NO: 119823 - protein, 9 aa, Homo Sapiens
YAFNMKATV

SEQ ID NO: 119824 - protein, 9 aa, Homo Sapiens
YAFPKAVSV

SEQ ID NO: 119825 - protein, 9 aa, Homo Sapiens
YAFPKSITV

SEQ ID NO: 119826 - protein, 9 aa, Homo Sapiens
YAFVGFDCI

SEQ ID NO: 119827 - protein, 9 aa, Homo Sapiens
YAHFPINVV

SEQ ID NO: 119828 - protein, 9 aa, Homo Sapiens
YALNHTLSV

SEQ ID NO: 119829 - protein, 9 aa, Homo Sapiens
YAPPPFLHI

SEQ ID NO: 119830 - protein, 9 aa, Homo Sapiens
YAYDAKIEI

SEQ ID NO: 119831 - protein, 9 aa, Homo Sapiens
YAYDGKDYI

SEQ ID NO: 119832 - protein, 9 aa, Homo Sapiens
YAYPGVLLI

SEQ ID NO: 119833 - protein, 9 aa, Homo Sapiens
YAYRSVPSI

SEQ ID NO: 119834 - protein, 9 aa, Homo Sapiens
YIIEREPLI

SEQ ID NO: 119835 - protein, 9 aa, Homo Sapiens
YPAGFMDVI

SEQ ID NO: 119836 - protein, 9 aa, Homo Sapiens
YPALIGNLV

SEQ ID NO: 119837 - protein, 9 aa, Homo Sapiens
YPANSIVVV

SEQ ID NO: 119838 - protein, 9 aa, Homo Sapiens
YPAPAGLHI

SEQ ID NO: 119839 - protein, 9 aa, Homo Sapiens
YPASPWSHI

SEQ ID NO: 119840 - protein, 9 aa, Homo Sapiens
YPASSLVVV

SEQ ID NO: 119841 - protein, 9 aa, Homo Sapiens
YPDRNLPTI

SEQ ID NO: 119842 - protein, 9 aa, Homo Sapiens
YPDSHQLFV

SEQ ID NO: 119843 - protein, 9 aa, Homo Sapiens
YPEAITRLV

SEQ ID NO: 119844 - protein, 9 aa, Homo Sapiens
YPESLVRVV

SEQ ID NO: 119845 - protein, 9 aa, Homo Sapiens
YPESVIRLI

SEQ ID NO: 119846 - protein, 9 aa, Homo Sapiens
YPFANKESI

SEQ ID NO: 119847 - protein, 9 aa, Homo Sapiens
YPFFRGVTI

SEQ ID NO: 119848 - protein, 9 aa, Homo Sapiens
YPFPVPPLL

SEQ ID NO: 119849 - protein, 9 aa, Homo Sapiens
YPFTADQEI

SEQ ID NO: 119850 - protein, 9 aa, Homo Sapiens
YPGIIVSNI

SEQ ID NO: 119851 - protein, 9 aa, Homo Sapiens
YPIGTNAIV

SEQ ID NO: 119852 - protein, 9 aa, Homo Sapiens
YPKEADIVI

SEQ ID NO: 119853 - protein, 9 aa, Homo Sapiens
YPLCQFQYI

SEQ ID NO: 119854 - protein, 9 aa, Homo Sapiens
YPLDLLLKL

SEQ ID NO: 119855 - protein, 9 aa, Homo Sapiens
YPLEDATHI

SEQ ID NO: 119856 - protein, 9 aa, Homo Sapiens
YPLEDLPSL

SEQ ID NO: 119857 - protein, 9 aa, Homo Sapiens
YPLEVTKLI

SEQ ID NO: 119858 - protein, 9 aa, Homo Sapiens
YPLGDIKIV

SEQ ID NO: 119859 - protein, 9 aa, Homo Sapiens
YPLKEIVVI

SEQ ID NO: 119860 - protein, 9 aa, Homo Sapiens
YPLLLKELV

SEQ ID NO: 119861 - protein, 9 aa, Homo Sapiens
YPLQTVQSI

SEQ ID NO: 119862 - protein, 9 aa, Homo Sapiens
YPLTQLVVV

SEQ ID NO: 119863 - protein, 9 aa, Homo Sapiens
YPLYTIVFI

SEQ ID NO: 119864 - protein, 9 aa, Homo Sapiens
YPLYTQITV

SEQ ID NO: 119865 - protein, 9 aa, Homo Sapiens
YPMRIDESI

SEQ ID NO: 119866 - protein, 9 aa, Homo Sapiens
YPNLQLREI

SEQ ID NO: 119867 - protein, 9 aa, Homo Sapiens
YPPAPFMHI

SEQ ID NO: 119868 - protein, 9 aa, Homo Sapiens
YPPGAFVSV

SEQ ID NO: 119869 - protein, 9 aa, Homo Sapiens
YPPNIAVKV

SEQ ID NO: 119870 - protein, 9 aa, Homo Sapiens
YPPPEVRNI

SEQ ID NO: 119871 - protein, 9 aa, Homo Sapiens
YPPSMEAVV

SEQ ID NO: 119872 - protein, 9 aa, Homo Sapiens
YPPSQIAQL

SEQ ID NO: 119873 - protein, 9 aa, Homo Sapiens
YPPWPGKIV

SEQ ID NO: 119874 - protein, 9 aa, Homo Sapiens
YPQAVFLEV

SEQ ID NO: 119875 - protein, 9 aa, Homo Sapiens
YPQDYQFYI

SEQ ID NO: 119876 - protein, 9 aa, Homo Sapiens
YPRQLESLI

SEQ ID NO: 119877 - protein, 9 aa, Homo Sapiens
YPSETFTRV

SEQ ID NO: 119878 - protein, 9 aa, Homo Sapiens
YPSLPAQQV

SEQ ID NO: 119879 - protein, 9 aa, Homo Sapiens
YPSLPTMTV

SEQ ID NO: 119880 - protein, 9 aa, Homo Sapiens
YPSPTGVLI

SEQ ID NO: 119881 - protein, 9 aa, Homo Sapiens
YPTQLFRTV

SEQ ID NO: 119882 - protein, 9 aa, Homo Sapiens
YPTSKAVYI

SEQ ID NO: 119883 - protein, 9 aa, Homo Sapiens
YPVPKPALI

SEQ ID NO: 119884 - protein, 9 aa, Homo Sapiens
YPYHYAPFL

SEQ ID NO: 119885 - protein, 9 aa, Homo Sapiens
YPYPHTLYL

SEQ ID NO: 119886 - protein, 9 aa, Homo Sapiens
YPYPVSNSV

SEQ ID NO: 119887 - protein, 9 aa, Homo Sapiens
YPYPYPHTL

SEQ ID NO: 119888 - protein, 9 aa, Homo Sapiens
YPYQERVFL

SEQ ID NO: 119889 - protein, 9 aa, Homo Sapiens
YPYVEVNSI

SEQ ID NO: 119890 - protein, 9 aa, Homo Sapiens
YPYVGILHV

SEQ ID NO: 119891 - protein, 10 aa, Homo Sapiens
DADPNFDRLI

SEQ ID NO: 119892 - protein, 10 aa, Homo Sapiens
DAFLEAAKKI

SEQ ID NO: 119893 - protein, 10 aa, Homo Sapiens
DAFRQPSLFY

SEQ ID NO: 119894 - protein, 10 aa, Homo Sapiens
DALRPPLQNI

SEQ ID NO: 119895 - protein, 10 aa, Homo Sapiens
DALRPSVVSI

SEQ ID NO: 119896 - protein, 10 aa, Homo Sapiens
DAPVALVVHM

SEQ ID NO: 119897 - protein, 10 aa, Homo Sapiens
DAYHNAELFF

SEQ ID NO: 119898 - protein, 10 aa, Homo Sapiens
DAYQVILDGV

SEQ ID NO: 119899 - protein, 10 aa, Homo Sapiens
DAYSKRFISV

SEQ ID NO: 119900 - protein, 10 aa, Homo Sapiens
DAYVLPKLYV

SEQ ID NO: 119901 - protein, 10 aa, Homo Sapiens
DGLAPPQHLI

SEQ ID NO: 119902 - protein, 10 aa, Homo Sapiens
DPLVPPQLTI

SEQ ID NO: 119903 - protein, 10 aa, Homo Sapiens
DPYGFLTTVI

SEQ ID NO: 119904 - protein, 10 aa, Homo Sapiens
FPDPNGTRLV

SEQ ID NO: 119905 - protein, 10 aa, Homo Sapiens
FPFPETPTKV

SEQ ID NO: 119906 - protein, 10 aa, Homo Sapiens
FPFYGKPMRI

SEQ ID NO: 119907 - protein, 10 aa, Homo Sapiens
FPNEFAKLTV

SEQ ID NO: 119908 - protein, 10 aa, Homo Sapiens
FPSEIVGKRI

SEQ ID NO: 119909 - protein, 10 aa, Homo Sapiens
FPYNKNGFKV

SEQ ID NO: 119910 - protein, 10 aa, Homo Sapiens
HPFPGPGLAI

SEQ ID NO: 119911 - protein, 10 aa, Homo Sapiens
IPFLGAGIKI

SEQ ID NO: 119912 - protein, 10 aa, Homo Sapiens
IPLPLGTVTI

SEQ ID NO: 119913 - protein, 10 aa, Homo Sapiens
IPYAQPPLGR

SEQ ID NO: 119914 - protein, 10 aa, Homo Sapiens
IPYFSANAVI

SEQ ID NO: 119915 - protein, 10 aa, Homo Sapiens
IPYTGPFNLL

SEQ ID NO: 119916 - protein, 10 aa, Homo Sapiens
ISNNVTLLSL

SEQ ID NO: 119917 - protein, 10 aa, Homo Sapiens
KADAPVALVV

SEQ ID NO: 119918 - protein, 10 aa, Homo Sapiens
LALIPSGVTV

SEQ ID NO: 119919 - protein, 10 aa, Homo Sapiens
LPFLQPGRLV

SEQ ID NO: 119920 - protein, 10 aa, Homo Sapiens
LPFPAQPPVV

SEQ ID NO: 119921 - protein, 10 aa, Homo Sapiens
LPGYVPKTSL

SEQ ID NO: 119922 - protein, 10 aa, Homo Sapiens
LPLAGPPITV

SEQ ID NO: 119923 - protein, 10 aa, Homo Sapiens
LPLEGWNHVV

SEQ ID NO: 119924 - protein, 10 aa, Homo Sapiens
LPLQPPTEPG

SEQ ID NO: 119925 - protein, 10 aa, Homo Sapiens
LPLSAHGIVV

SEQ ID NO: 119926 - protein, 10 aa, Homo Sapiens
LPLSGVPLMI

SEQ ID NO: 119927 - protein, 10 aa, Homo Sapiens
LPRVTPFYAV

SEQ ID NO: 119928 - protein, 10 aa, Homo Sapiens
LPTETFIPVI

SEQ ID NO: 119929 - protein, 10 aa, Homo Sapiens
LPYAMKPIDY

SEQ ID NO: 119930 - protein, 10 aa, Homo Sapiens
LPYHETRIFV

SEQ ID NO: 119931 - protein, 10 aa, Homo Sapiens
LPYPEAIFEI

SEQ ID NO: 119932 - protein, 10 aa, Homo Sapiens
LPYPNNLNSV

SEQ ID NO: 119933 - protein, 10 aa, Homo Sapiens
LPYTGAETRI

SEQ ID NO: 119934 - protein, 10 aa, Homo Sapiens
LPYVGMVTII

SEQ ID NO: 119935 - protein, 10 aa, Homo Sapiens
LPYYSKFILI

SEQ ID NO: 119936 - protein, 10 aa, Homo Sapiens
LSLHSLGLSL

SEQ ID NO: 119937 - protein, 10 aa, Homo Sapiens
MPRGPTLGHV

SEQ ID NO: 119938 - protein, 10 aa, Homo Sapiens
MPRPSVPPLV

SEQ ID NO: 119939 - protein, 10 aa, Homo Sapiens
SAYGPGLVSI

SEQ ID NO: 119940 - protein, 10 aa, Homo Sapiens
SPYPWPLNHI

SEQ ID NO: 119941 - protein, 10 aa, Homo Sapiens
VAGPVGLLSV

SEQ ID NO: 119942 - protein, 10 aa, Homo Sapiens
VAYQHAFLYI

SEQ ID NO: 119943 - protein, 10 aa, Homo Sapiens
VPAGFLLATI

SEQ ID NO: 119944 - protein, 10 aa, Homo Sapiens
VPILLAAASL

SEQ ID NO: 119945 - protein, 10 aa, Homo Sapiens
VPIPRSPYTV

SEQ ID NO: 119946 - protein, 10 aa, Homo Sapiens
VPLDGRPMNI

SEQ ID NO: 119947 - protein, 10 aa, Homo Sapiens
VPLPAENVTI

SEQ ID NO: 119948 - protein, 10 aa, Homo Sapiens
VPYPLPKIDL

SEQ ID NO: 119949 - protein, 10 aa, Homo Sapiens
YPETLGRLLI

SEQ ID NO: 119950 - protein, 10 aa, Homo Sapiens
YPFDFQGARI

SEQ ID NO: 119951 - protein, 10 aa, Homo Sapiens
YPFIFPLHKV

SEQ ID NO: 119952 - protein, 10 aa, Homo Sapiens
YPFNNGDLTI

SEQ ID NO: 119953 - protein, 10 aa, Homo Sapiens
YPHEVPQISI

SEQ ID NO: 119954 - protein, 10 aa, Homo Sapiens
YPIVDGKLSI

SEQ ID NO: 119955 - protein, 10 aa, Homo Sapiens
YPLERGFIYV

SEQ ID NO: 119956 - protein, 10 aa, Homo Sapiens
YPYEYEGGHI

SEQ ID NO: 119957 - protein, 10 aa, Homo Sapiens
YPYEYLGGHI

SEQ ID NO: 119958 - protein, 10 aa, Homo Sapiens
YPYGPVENKI

SEQ ID NO: 119959 - protein, 10 aa, Homo Sapiens
YPYPYPHTLY

SEQ ID NO: 119960 - protein, 11 aa, Homo Sapiens
DAFRQPSLFYH

SEQ ID NO: 119961 - protein, 11 aa, Homo Sapiens
DAPKAGQLEAW

SEQ ID NO: 119962 - protein, 11 aa, Homo Sapiens
DAWQDGAVLQI

SEQ ID NO: 119963 - protein, 11 aa, Homo Sapiens
DAYALNHTLSV

SEQ ID NO: 119964 - protein, 11 aa, Homo Sapiens
DAYLQSLAKKI

SEQ ID NO: 119965 - protein, 11 aa, Homo Sapiens
DAYVLPKLYVK

SEQ ID NO: 119966 - protein, 11 aa, Homo Sapiens
FPFNPLDFESF

SEQ ID NO: 119967 - protein, 11 aa, Homo Sapiens
FPYEASTPTGI

SEQ ID NO: 119968 - protein, 11 aa, Homo Sapiens
GKADAPVALVV

SEQ ID NO: 119969 - protein, 11 aa, Homo Sapiens
IPIQINVGTTV

SEQ ID NO: 119970 - protein, 11 aa, Homo Sapiens
IPYAQPPLGRL

SEQ ID NO: 119971 - protein, 11 aa, Homo Sapiens
IPYHSEVPVSL

SEQ ID NO: 119972 - protein, 11 aa, Homo Sapiens
IPYPLSENNQV

SEQ ID NO: 119973 - protein, 11 aa, Homo Sapiens
LPFPFPSKLYI

SEQ ID NO: 119974 - protein, 11 aa, Homo Sapiens
LPFVSRGPLTV

SEQ ID NO: 119975 - protein, 11 aa, Homo Sapiens
LPIPESQVITI

SEQ ID NO: 119976 - protein, 11 aa, Homo Sapiens
LPNSTERAITI

SEQ ID NO: 119977 - protein, 11 aa, Homo Sapiens
LPRPIQDILTI

SEQ ID NO: 119978 - protein, 11 aa, Homo Sapiens
LPYCPGKTLVV

SEQ ID NO: 119979 - protein, 11 aa, Homo Sapiens
LPYLIDGAHKI

SEQ ID NO: 119980 - protein, 11 aa, Homo Sapiens
LPYSPTKTLSV

SEQ ID NO: 119981 - protein, 11 aa, Homo Sapiens
MPYEDGIYSVI

SEQ ID NO: 119982 - protein, 11 aa, Homo Sapiens
MPYPAPNVPVV

SEQ ID NO: 119983 - protein, 11 aa, Homo Sapiens
QPYMPTVSATI

SEQ ID NO: 119984 - protein, 11 aa, Homo Sapiens
VAADAVASLLI

SEQ ID NO: 119985 - protein, 11 aa, Homo Sapiens
VPFEPSKPPVI

SEQ ID NO: 119986 - protein, 11 aa, Homo Sapiens
VPYPLPKIDLI

SEQ ID NO: 119987 - protein, 11 aa, Homo Sapiens
VPYSTSASLYI

SEQ ID NO: 119988 - protein, 11 aa, Homo Sapiens
YPFINSRIITV

SEQ ID NO: 119989 - protein, 11 aa, Homo Sapiens
YPIEIDPHRTV

SEQ ID NO: 119990 - protein, 11 aa, Homo Sapiens
YPLQGPGLLSV

SEQ ID NO: 119991 - protein, 11 aa, Homo Sapiens
YPYPYPHTLYL

SEQ ID NO: 119992 - protein, 8 aa, Homo Sapiens
AASLLPVL

SEQ ID NO: 119993 - protein, 8 aa, Homo Sapiens
AEYIQKNV

SEQ ID NO: 119994 - protein, 8 aa, Homo Sapiens
AFLKVSSV

SEQ ID NO: 119995 - protein, 8 aa, Homo Sapiens
AFMPVLKV

SEQ ID NO: 119996 - protein, 8 aa, Homo Sapiens
AFPKAVSV

SEQ ID NO: 119997 - protein, 8 aa, Homo Sapiens
AFPQAAKI

SEQ ID NO: 119998 - protein, 8 aa, Homo Sapiens
AMFPVTHI

SEQ ID NO: 119999 - protein, 8 aa, Homo Sapiens
AMIALNTV

SEQ ID NO: 120000 - protein, 8 aa, Homo Sapiens
AMIKGLQV

SEQ ID NO: 120001 - protein, 8 aa, Homo Sapiens
AMKEDPTV

SEQ ID NO: 120002 - protein, 8 aa, Homo Sapiens
AMLGVTTV

SEQ ID NO: 120003 - protein, 8 aa, Homo Sapiens
AMPLISLV

SEQ ID NO: 120004 - protein, 8 aa, Homo Sapiens
AMRQVNTI

SEQ ID NO: 120005 - protein, 8 aa, Homo Sapiens
AMVRVISV

SEQ ID NO: 120006 - protein, 8 aa, Homo Sapiens
AMYPPSMI

SEQ ID NO: 120007 - protein, 8 aa, Homo Sapiens
AQAALQAV

SEQ ID NO: 120008 - protein, 8 aa, Homo Sapiens
AQAEALRI

SEQ ID NO: 120009 - protein, 8 aa, Homo Sapiens
AQAELMKV

SEQ ID NO: 120010 - protein, 8 aa, Homo Sapiens
AQARAAEI

SEQ ID NO: 120011 - protein, 8 aa, Homo Sapiens
AQAVFPAI

SEQ ID NO: 120012 - protein, 8 aa, Homo Sapiens
AQAVIREV

SEQ ID NO: 120013 - protein, 8 aa, Homo Sapiens
AQCYIKYI

SEQ ID NO: 120014 - protein, 8 aa, Homo Sapiens
AQELMPVV

SEQ ID NO: 120015 - protein, 8 aa, Homo Sapiens
AQFAARAI

SEQ ID NO: 120016 - protein, 8 aa, Homo Sapiens
AQFAQPEI

SEQ ID NO: 120017 - protein, 8 aa, Homo Sapiens
AQFETKKL

SEQ ID NO: 120018 - protein, 8 aa, Homo Sapiens
AQFKFTVL

SEQ ID NO: 120019 - protein, 8 aa, Homo Sapiens
AQFKLLLV

SEQ ID NO: 120020 - protein, 8 aa, Homo Sapiens
AQFKQLLI

SEQ ID NO: 120021 - protein, 8 aa, Homo Sapiens
AQFSVQKV

SEQ ID NO: 120022 - protein, 8 aa, Homo Sapiens
AQHALTSV

SEQ ID NO: 120023 - protein, 8 aa, Homo Sapiens
AQHLQAAV

SEQ ID NO: 120024 - protein, 8 aa, Homo Sapiens
AQILLKAL

SEQ ID NO: 120025 - protein, 8 aa, Homo Sapiens
AQIQQKSI

SEQ ID NO: 120026 - protein, 8 aa, Homo Sapiens
AQIQVQHV

SEQ ID NO: 120027 - protein, 8 aa, Homo Sapiens
AQIRTIAI

SEQ ID NO: 120028 - protein, 8 aa, Homo Sapiens
AQITMKVI

SEQ ID NO: 120029 - protein, 8 aa, Homo Sapiens
AQITTLLV

SEQ ID NO: 120030 - protein, 8 aa, Homo Sapiens
AQIVTRSV

SEQ ID NO: 120031 - protein, 8 aa, Homo Sapiens
AQIYVDKV

SEQ ID NO: 120032 - protein, 8 aa, Homo Sapiens
AQKALAKV

SEQ ID NO: 120033 - protein, 8 aa, Homo Sapiens
AQKQLRSI

SEQ ID NO: 120034 - protein, 8 aa, Homo Sapiens
AQLAVTKI

SEQ ID NO: 120035 - protein, 8 aa, Homo Sapiens
AQLGALFI

SEQ ID NO: 120036 - protein, 8 aa, Homo Sapiens
AQLIVQAI

SEQ ID NO: 120037 - protein, 8 aa, Homo Sapiens
AQLLQLKV

SEQ ID NO: 120038 - protein, 8 aa, Homo Sapiens
AQLRVSEI

SEQ ID NO: 120039 - protein, 8 aa, Homo Sapiens
AQLSVKQV

SEQ ID NO: 120040 - protein, 8 aa, Homo Sapiens
AQLTQRSV

SEQ ID NO: 120041 - protein, 8 aa, Homo Sapiens
AQLVQLRV

SEQ ID NO: 120042 - protein, 8 aa, Homo Sapiens
AQMLIRIV

SEQ ID NO: 120043 - protein, 8 aa, Homo Sapiens
AQNISKTI

SEQ ID NO: 120044 - protein, 8 aa, Homo Sapiens
AQNPSLFV

SEQ ID NO: 120045 - protein, 8 aa, Homo Sapiens
AQQIQKVV

SEQ ID NO: 120046 - protein, 8 aa, Homo Sapiens
AQQVCHAI

SEQ ID NO: 120047 - protein, 8 aa, Homo Sapiens
AQRLATVV

SEQ ID NO: 120048 - protein, 8 aa, Homo Sapiens
AQRLMQLI

SEQ ID NO: 120049 - protein, 8 aa, Homo Sapiens
AQRLVRVL

SEQ ID NO: 120050 - protein, 8 aa, Homo Sapiens
AQSKILFV

SEQ ID NO: 120051 - protein, 8 aa, Homo Sapiens
AQSTQPVV

SEQ ID NO: 120052 - protein, 8 aa, Homo Sapiens
AQSYAKRI

SEQ ID NO: 120053 - protein, 8 aa, Homo Sapiens
AQTALTVV

SEQ ID NO: 120054 - protein, 8 aa, Homo Sapiens
AQTFIQRV

SEQ ID NO: 120055 - protein, 8 aa, Homo Sapiens
AQTFLSEI

SEQ ID NO: 120056 - protein, 8 aa, Homo Sapiens
AQTPIAVI

SEQ ID NO: 120057 - protein, 8 aa, Homo Sapiens
AQTTLRNV

SEQ ID NO: 120058 - protein, 8 aa, Homo Sapiens
AQTVVLCV

SEQ ID NO: 120059 - protein, 8 aa, Homo Sapiens
AQVATKNV

SEQ ID NO: 120060 - protein, 8 aa, Homo Sapiens
AQVHIPSI

SEQ ID NO: 120061 - protein, 8 aa, Homo Sapiens
AQVKQLEM

SEQ ID NO: 120062 - protein, 8 aa, Homo Sapiens
AQVKVAEV

SEQ ID NO: 120063 - protein, 8 aa, Homo Sapiens
AQVKVLFV

SEQ ID NO: 120064 - protein, 8 aa, Homo Sapiens
AQVLIREV

SEQ ID NO: 120065 - protein, 8 aa, Homo Sapiens
AQVLLHNV

SEQ ID NO: 120066 - protein, 8 aa, Homo Sapiens
AQVLLQKV

SEQ ID NO: 120067 - protein, 8 aa, Homo Sapiens
AQYEANKV

SEQ ID NO: 120068 - protein, 8 aa, Homo Sapiens
AQYFLDKI

SEQ ID NO: 120069 - protein, 8 aa, Homo Sapiens
AQYKFFIV

SEQ ID NO: 120070 - protein, 8 aa, Homo Sapiens
AQYKFIYV

SEQ ID NO: 120071 - protein, 8 aa, Homo Sapiens
AQYNFILV

SEQ ID NO: 120072 - protein, 8 aa, Homo Sapiens
AQYPITAV

SEQ ID NO: 120073 - protein, 8 aa, Homo Sapiens
AQYQFTGI

SEQ ID NO: 120074 - protein, 8 aa, Homo Sapiens
AQYSGAQV

SEQ ID NO: 120075 - protein, 8 aa, Homo Sapiens
AQYSPQQL

SEQ ID NO: 120076 - protein, 8 aa, Homo Sapiens
AQYVLLAL

SEQ ID NO: 120077 - protein, 8 aa, Homo Sapiens
ASIALARI

SEQ ID NO: 120078 - protein, 8 aa, Homo Sapiens
ASIDLPGI

SEQ ID NO: 120079 - protein, 8 aa, Homo Sapiens
ASLPLPLL

SEQ ID NO: 120080 - protein, 8 aa, Homo Sapiens
ASPAVLEL

SEQ ID NO: 120081 - protein, 8 aa, Homo Sapiens
ASPSVLVV

SEQ ID NO: 120082 - protein, 8 aa, Homo Sapiens
ASPTALLI

SEQ ID NO: 120083 - protein, 8 aa, Homo Sapiens
ASVKISKV

SEQ ID NO: 120084 - protein, 8 aa, Homo Sapiens
ASYPIPLV

SEQ ID NO: 120085 - protein, 8 aa, Homo Sapiens
CEYIVKKI

SEQ ID NO: 120086 - protein, 8 aa, Homo Sapiens
CMRYIATI

SEQ ID NO: 120087 - protein, 8 aa, Homo Sapiens
CQIPLFGI

SEQ ID NO: 120088 - protein, 8 aa, Homo Sapiens
CQLRVLEV

SEQ ID NO: 120089 - protein, 8 aa, Homo Sapiens
CQTIIPKI

SEQ ID NO: 120090 - protein, 8 aa, Homo Sapiens
CQYRVSML

SEQ ID NO: 120091 - protein, 8 aa, Homo Sapiens
CSFRVLVV

SEQ ID NO: 120092 - protein, 8 aa, Homo Sapiens
CSLLVRLV

SEQ ID NO: 120093 - protein, 8 aa, Homo Sapiens
CSSVHPSV

SEQ ID NO: 120094 - protein, 8 aa, Homo Sapiens
CYIAILNI

SEQ ID NO: 120095 - protein, 8 aa, Homo Sapiens
DAPVALVV

SEQ ID NO: 120096 - protein, 8 aa, Homo Sapiens
DFIRILVI

SEQ ID NO: 120097 - protein, 8 aa, Homo Sapiens
DMYLAPHV

SEQ ID NO: 120098 - protein, 8 aa, Homo Sapiens
DQYKFYSV

SEQ ID NO: 120099 - protein, 8 aa, Homo Sapiens
EAWPALQI

SEQ ID NO: 120100 - protein, 8 aa, Homo Sapiens
EEFITPIV

SEQ ID NO: 120101 - protein, 8 aa, Homo Sapiens
EEIAALVI

SEQ ID NO: 120102 - protein, 8 aa, Homo Sapiens
EEIPALKI

SEQ ID NO: 120103 - protein, 8 aa, Homo Sapiens
EEYEQRVV

SEQ ID NO: 120104 - protein, 8 aa, Homo Sapiens
EFPIAPEI

SEQ ID NO: 120105 - protein, 8 aa, Homo Sapiens
EFPTVLDI

SEQ ID NO: 120106 - protein, 8 aa, Homo Sapiens
EFPTVPLV

SEQ ID NO: 120107 - protein, 8 aa, Homo Sapiens
EFYRALYI

SEQ ID NO: 120108 - protein, 8 aa, Homo Sapiens
ELKLLQSL

SEQ ID NO: 120109 - protein, 8 aa, Homo Sapiens
EMVALPPV

SEQ ID NO: 120110 - protein, 8 aa, Homo Sapiens
EMYVPRVV

SEQ ID NO: 120111 - protein, 8 aa, Homo Sapiens
EQFILSQV

SEQ ID NO: 120112 - protein, 8 aa, Homo Sapiens
EQFLLPVI

SEQ ID NO: 120113 - protein, 8 aa, Homo Sapiens
EQIEIIRI

SEQ ID NO: 120114 - protein, 8 aa, Homo Sapiens
EQIKIKKI

SEQ ID NO: 120115 - protein, 8 aa, Homo Sapiens
EQIKVLEV

SEQ ID NO: 120116 - protein, 8 aa, Homo Sapiens
EQILIQWI

SEQ ID NO: 120117 - protein, 8 aa, Homo Sapiens
EQKIVVKV

SEQ ID NO: 120118 - protein, 8 aa, Homo Sapiens
EQLALPVL

SEQ ID NO: 120119 - protein, 8 aa, Homo Sapiens
EQLAWLRV

SEQ ID NO: 120120 - protein, 8 aa, Homo Sapiens
EQLELERI

SEQ ID NO: 120121 - protein, 8 aa, Homo Sapiens
EQLIIPQV

SEQ ID NO: 120122 - protein, 8 aa, Homo Sapiens
EQLKVTTI

SEQ ID NO: 120123 - protein, 8 aa, Homo Sapiens
EQLQLREI

SEQ ID NO: 120124 - protein, 8 aa, Homo Sapiens
EQQKVRTI

SEQ ID NO: 120125 - protein, 8 aa, Homo Sapiens
EQRAIAKI

SEQ ID NO: 120126 - protein, 8 aa, Homo Sapiens
EQRIVQQV

SEQ ID NO: 120127 - protein, 8 aa, Homo Sapiens
EQRKIPLV

SEQ ID NO: 120128 - protein, 8 aa, Homo Sapiens
EQRVPLSV

SEQ ID NO: 120129 - protein, 8 aa, Homo Sapiens
EQRVVKRI

SEQ ID NO: 120130 - protein, 8 aa, Homo Sapiens
EQRYTCHV

SEQ ID NO: 120131 - protein, 8 aa, Homo Sapiens
EQVSTPEI

SEQ ID NO: 120132 - protein, 8 aa, Homo Sapiens
EQWQTMEI

SEQ ID NO: 120133 - protein, 8 aa, Homo Sapiens
EQWTPSHV

SEQ ID NO: 120134 - protein, 8 aa, Homo Sapiens
EQYCIRKV

SEQ ID NO: 120135 - protein, 8 aa, Homo Sapiens
EQYEHASI

SEQ ID NO: 120136 - protein, 8 aa, Homo Sapiens
EQYLLKMV

SEQ ID NO: 120137 - protein, 8 aa, Homo Sapiens
EQYRIRQV

SEQ ID NO: 120138 - protein, 8 aa, Homo Sapiens
EQYVTKTV

SEQ ID NO: 120139 - protein, 8 aa, Homo Sapiens
EQYYVRKV

SEQ ID NO: 120140 - protein, 8 aa, Homo Sapiens
ESILLPRI

SEQ ID NO: 120141 - protein, 8 aa, Homo Sapiens
ESLRLILV

SEQ ID NO: 120142 - protein, 8 aa, Homo Sapiens
EYLTAEIL

SEQ ID NO: 120143 - protein, 8 aa, Homo Sapiens
FEILTPKI

SEQ ID NO: 120144 - protein, 8 aa, Homo Sapiens
FELDLPTV

SEQ ID NO: 120145 - protein, 8 aa, Homo Sapiens
FEVILTRI

SEQ ID NO: 120146 - protein, 8 aa, Homo Sapiens
FEYILSHV

SEQ ID NO: 120147 - protein, 8 aa, Homo Sapiens
FEYKPEVI

SEQ ID NO: 120148 - protein, 8 aa, Homo Sapiens
FEYQVRSI

SEQ ID NO: 120149 - protein, 8 aa, Homo Sapiens
FGYKGLKI

SEQ ID NO: 120150 - protein, 8 aa, Homo Sapiens
FMPLVIKV

SEQ ID NO: 120151 - protein, 8 aa, Homo Sapiens
FMYKPKKV

SEQ ID NO: 120152 - protein, 8 aa, Homo Sapiens
FNEKSKEL

SEQ ID NO: 120153 - protein, 8 aa, Homo Sapiens
FQALLTVV

SEQ ID NO: 120154 - protein, 8 aa, Homo Sapiens
FQHPARLV

SEQ ID NO: 120155 - protein, 8 aa, Homo Sapiens
FQHVFLVV

SEQ ID NO: 120156 - protein, 8 aa, Homo Sapiens
FQHVFVIV

SEQ ID NO: 120157 - protein, 8 aa, Homo Sapiens
FQHVKPCI

SEQ ID NO: 120158 - protein, 8 aa, Homo Sapiens
FQITPKTV

SEQ ID NO: 120159 - protein, 8 aa, Homo Sapiens
FQKEVAQV

SEQ ID NO: 120160 - protein, 8 aa, Homo Sapiens
FQQYLPVV

SEQ ID NO: 120161 - protein, 8 aa, Homo Sapiens
FQRLTVTI

SEQ ID NO: 120162 - protein, 8 aa, Homo Sapiens
FQRLVREI

SEQ ID NO: 120163 - protein, 8 aa, Homo Sapiens
FQTEIQTV

SEQ ID NO: 120164 - protein, 8 aa, Homo Sapiens
FQTIHKTI

SEQ ID NO: 120165 - protein, 8 aa, Homo Sapiens
FQTILTEI

SEQ ID NO: 120166 - protein, 8 aa, Homo Sapiens
FQVLQPQV

SEQ ID NO: 120167 - protein, 8 aa, Homo Sapiens
FQYAVRVI

SEQ ID NO: 120168 - protein, 8 aa, Homo Sapiens
FQYFVKVV

SEQ ID NO: 120169 - protein, 8 aa, Homo Sapiens
FSFAHQTI

SEQ ID NO: 120170 - protein, 8 aa, Homo Sapiens
FTGKVLLV

SEQ ID NO: 120171 - protein, 8 aa, Homo Sapiens
GEYAVRAI

SEQ ID NO: 120172 - protein, 8 aa, Homo Sapiens
GMFKIARV

SEQ ID NO: 120173 - protein, 8 aa, Homo Sapiens
GQELARVV

SEQ ID NO: 120174 - protein, 8 aa, Homo Sapiens
GQERFRTI

SEQ ID NO: 120175 - protein, 8 aa, Homo Sapiens
GQFIARAV

SEQ ID NO: 120176 - protein, 8 aa, Homo Sapiens
GQFKIGLI

SEQ ID NO: 120177 - protein, 8 aa, Homo Sapiens
GQFKTYAI

SEQ ID NO: 120178 - protein, 8 aa, Homo Sapiens
GQFLVRII

SEQ ID NO: 120179 - protein, 8 aa, Homo Sapiens
GQFVTEEV

SEQ ID NO: 120180 - protein, 8 aa, Homo Sapiens
GQIAILYV

SEQ ID NO: 120181 - protein, 8 aa, Homo Sapiens
GQICLPII

SEQ ID NO: 120182 - protein, 8 aa, Homo Sapiens
GQIFKPII

SEQ ID NO: 120183 - protein, 8 aa, Homo Sapiens
GQIKLREI

SEQ ID NO: 120184 - protein, 8 aa, Homo Sapiens
GQILMPNI

SEQ ID NO: 120185 - protein, 8 aa, Homo Sapiens
GQIVQSKI

SEQ ID NO: 120186 - protein, 8 aa, Homo Sapiens
GQKITHVV

SEQ ID NO: 120187 - protein, 8 aa, Homo Sapiens
GQLELKSV

SEQ ID NO: 120188 - protein, 8 aa, Homo Sapiens
GQLHVLRV

SEQ ID NO: 120189 - protein, 8 aa, Homo Sapiens
GQLKSLTI

SEQ ID NO: 120190 - protein, 8 aa, Homo Sapiens
GQLKSVTI

SEQ ID NO: 120191 - protein, 8 aa, Homo Sapiens
GQLLIKTV

SEQ ID NO: 120192 - protein, 8 aa, Homo Sapiens
GQQVIRSV

SEQ ID NO: 120193 - protein, 8 aa, Homo Sapiens
GQRCGVEV

SEQ ID NO: 120194 - protein, 8 aa, Homo Sapiens
GQREPLTV

SEQ ID NO: 120195 - protein, 8 aa, Homo Sapiens
GQRVIPRI

SEQ ID NO: 120196 - protein, 8 aa, Homo Sapiens
GQVAVRNV

SEQ ID NO: 120197 - protein, 8 aa, Homo Sapiens
GQVCLPVI

SEQ ID NO: 120198 - protein, 8 aa, Homo Sapiens
GQVIIHNI

SEQ ID NO: 120199 - protein, 8 aa, Homo Sapiens
GQVQVLKV

SEQ ID NO: 120200 - protein, 8 aa, Homo Sapiens
GQWEVKKI

SEQ ID NO: 120201 - protein, 8 aa, Homo Sapiens
GQYAGHVV

SEQ ID NO: 120202 - protein, 8 aa, Homo Sapiens
GQYFEPVV

SEQ ID NO: 120203 - protein, 8 aa, Homo Sapiens
GQYKSKLV

SEQ ID NO: 120204 - protein, 8 aa, Homo Sapiens
GQYPPPTV

SEQ ID NO: 120205 - protein, 8 aa, Homo Sapiens
GQYSFLVV

SEQ ID NO: 120206 - protein, 8 aa, Homo Sapiens
GSFILPHI

SEQ ID NO: 120207 - protein, 8 aa, Homo Sapiens
GSTLTPKI

SEQ ID NO: 120208 - protein, 8 aa, Homo Sapiens
HAFIQPEI

SEQ ID NO: 120209 - protein, 8 aa, Homo Sapiens
HAFKISKI

SEQ ID NO: 120210 - protein, 8 aa, Homo Sapiens
HARVQTCI

SEQ ID NO: 120211 - protein, 8 aa, Homo Sapiens
HATIIPKV

SEQ ID NO: 120212 - protein, 8 aa, Homo Sapiens
HAVYALKV

SEQ ID NO: 120213 - protein, 8 aa, Homo Sapiens
HAYIIAKV

SEQ ID NO: 120214 - protein, 8 aa, Homo Sapiens
HEITVLII

SEQ ID NO: 120215 - protein, 8 aa, Homo Sapiens
HEYLVACI

SEQ ID NO: 120216 - protein, 8 aa, Homo Sapiens
HEYTTKEI

SEQ ID NO: 120217 - protein, 8 aa, Homo Sapiens
HGHPQPQV

SEQ ID NO: 120218 - protein, 8 aa, Homo Sapiens
HGIEFSVI

SEQ ID NO: 120219 - protein, 8 aa, Homo Sapiens
HGIILKYI

SEQ ID NO: 120220 - protein, 8 aa, Homo Sapiens
HGIPMSHV

SEQ ID NO: 120221 - protein, 8 aa, Homo Sapiens
HGKILNGV

SEQ ID NO: 120222 - protein, 8 aa, Homo Sapiens
HGLEMRTI

SEQ ID NO: 120223 - protein, 8 aa, Homo Sapiens
HGLTVPLI

SEQ ID NO: 120224 - protein, 8 aa, Homo Sapiens
HGMIMLRI

SEQ ID NO: 120225 - protein, 8 aa, Homo Sapiens
HGMTLKSV

SEQ ID NO: 120226 - protein, 8 aa, Homo Sapiens
HGPKALKV

SEQ ID NO: 120227 - protein, 8 aa, Homo Sapiens
HGPKAVTI

SEQ ID NO: 120228 - protein, 8 aa, Homo Sapiens
HGSYVLRV

SEQ ID NO: 120229 - protein, 8 aa, Homo Sapiens
HGVELLKI

SEQ ID NO: 120230 - protein, 8 aa, Homo Sapiens
HGVFLPLV

SEQ ID NO: 120231 - protein, 8 aa, Homo Sapiens
HGVVHVTI

SEQ ID NO: 120232 - protein, 8 aa, Homo Sapiens
HGYIFSSL

SEQ ID NO: 120233 - protein, 8 aa, Homo Sapiens
HMFAPRHV

SEQ ID NO: 120234 - protein, 8 aa, Homo Sapiens
HMQIVHKI

SEQ ID NO: 120235 - protein, 8 aa, Homo Sapiens
HMQQQPVV

SEQ ID NO: 120236 - protein, 8 aa, Homo Sapiens
HMYVQPVV

SEQ ID NO: 120237 - protein, 8 aa, Homo Sapiens
HQAKMREI

SEQ ID NO: 120238 - protein, 8 aa, Homo Sapiens
HQALINQV

SEQ ID NO: 120239 - protein, 8 aa, Homo Sapiens
HQALVRKL

SEQ ID NO: 120240 - protein, 8 aa, Homo Sapiens
HQAVLRCL

SEQ ID NO: 120241 - protein, 8 aa, Homo Sapiens
HQAVMRCL

SEQ ID NO: 120242 - protein, 8 aa, Homo Sapiens
HQAWLQSI

SEQ ID NO: 120243 - protein, 8 aa, Homo Sapiens
HQCSLKSV

SEQ ID NO: 120244 - protein, 8 aa, Homo Sapiens
HQDILSTI

SEQ ID NO: 120245 - protein, 8 aa, Homo Sapiens
HQEVLREI

SEQ ID NO: 120246 - protein, 8 aa, Homo Sapiens
HQEYLNSI

SEQ ID NO: 120247 - protein, 8 aa, Homo Sapiens
HQFETLDV

SEQ ID NO: 120248 - protein, 8 aa, Homo Sapiens
HQFLMDTI

SEQ ID NO: 120249 - protein, 8 aa, Homo Sapiens
HQFLQYHV

SEQ ID NO: 120250 - protein, 8 aa, Homo Sapiens
HQFLVSET

SEQ ID NO: 120251 - protein, 8 aa, Homo Sapiens
HQFQMQLL

SEQ ID NO: 120252 - protein, 8 aa, Homo Sapiens
HQFRMLVV

SEQ ID NO: 120253 - protein, 8 aa, Homo Sapiens
HQFSPHIL

SEQ ID NO: 120254 - protein, 8 aa, Homo Sapiens
HQFSTLRI

SEQ ID NO: 120255 - protein, 8 aa, Homo Sapiens
HQFYPTVV

SEQ ID NO: 120256 - protein, 8 aa, Homo Sapiens
HQGILSRV

SEQ ID NO: 120257 - protein, 8 aa, Homo Sapiens
HQHEMSVL

SEQ ID NO: 120258 - protein, 8 aa, Homo Sapiens
HQHMVKYI

SEQ ID NO: 120259 - protein, 8 aa, Homo Sapiens
HQHNPVQV

SEQ ID NO: 120260 - protein, 8 aa, Homo Sapiens
HQHQVELI

SEQ ID NO: 120261 - protein, 8 aa, Homo Sapiens
HQHTISTL

SEQ ID NO: 120262 - protein, 8 aa, Homo Sapiens
HQIAQMGV

SEQ ID NO: 120263 - protein, 8 aa, Homo Sapiens
HQIIHAGV

SEQ ID NO: 120264 - protein, 8 aa, Homo Sapiens
HQIIQRHL

SEQ ID NO: 120265 - protein, 8 aa, Homo Sapiens
HQIIVQNV

SEQ ID NO: 120266 - protein, 8 aa, Homo Sapiens
HQILTPFL

SEQ ID NO: 120267 - protein, 8 aa, Homo Sapiens
HQIMPKEI

SEQ ID NO: 120268 - protein, 8 aa, Homo Sapiens
HQINLIKV

SEQ ID NO: 120269 - protein, 8 aa, Homo Sapiens
HQITVLHV

SEQ ID NO: 120270 - protein, 8 aa, Homo Sapiens
HQKEITVI

SEQ ID NO: 120271 - protein, 8 aa, Homo Sapiens
HQKIQYVV

SEQ ID NO: 120272 - protein, 8 aa, Homo Sapiens
HQKQISSL

SEQ ID NO: 120273 - protein, 8 aa, Homo Sapiens
HQLAALYI

SEQ ID NO: 120274 - protein, 8 aa, Homo Sapiens
HQLAMTVV

SEQ ID NO: 120275 - protein, 8 aa, Homo Sapiens
HQLILAFL

SEQ ID NO: 120276 - protein, 8 aa, Homo Sapiens
HQLILSKL

SEQ ID NO: 120277 - protein, 8 aa, Homo Sapiens
HQLIVVDI

SEQ ID NO: 120278 - protein, 8 aa, Homo Sapiens
HQLKQLLL

SEQ ID NO: 120279 - protein, 8 aa, Homo Sapiens
HQLKTKVV

SEQ ID NO: 120280 - protein, 8 aa, Homo Sapiens
HQLLALAI

SEQ ID NO: 120281 - protein, 8 aa, Homo Sapiens
HQLPIKTV

SEQ ID NO: 120282 - protein, 8 aa, Homo Sapiens
HQLQPRRV

SEQ ID NO: 120283 - protein, 8 aa, Homo Sapiens
HQLSLRTV

SEQ ID NO: 120284 - protein, 8 aa, Homo Sapiens
HQLVPLQV

SEQ ID NO: 120285 - protein, 8 aa, Homo Sapiens
HQLYVLQV

SEQ ID NO: 120286 - protein, 8 aa, Homo Sapiens
HQMEMERI

SEQ ID NO: 120287 - protein, 8 aa, Homo Sapiens
HQMVVRAL

SEQ ID NO: 120288 - protein, 8 aa, Homo Sapiens
HQNLVTGV

SEQ ID NO: 120289 - protein, 8 aa, Homo Sapiens
HQNMARAI

SEQ ID NO: 120290 - protein, 8 aa, Homo Sapiens
HQQEISKI

SEQ ID NO: 120291 - protein, 8 aa, Homo Sapiens
HQQHTTVI

SEQ ID NO: 120292 - protein, 8 aa, Homo Sapiens
HQQKLTEI

SEQ ID NO: 120293 - protein, 8 aa, Homo Sapiens
HQQLIPLV

SEQ ID NO: 120294 - protein, 8 aa, Homo Sapiens
HQQLPPLV

SEQ ID NO: 120295 - protein, 8 aa, Homo Sapiens
HQQSIPAV

SEQ ID NO: 120296 - protein, 8 aa, Homo Sapiens
HQQTLQRV

SEQ ID NO: 120297 - protein, 8 aa, Homo Sapiens
HQQVVSRI

SEQ ID NO: 120298 - protein, 8 aa, Homo Sapiens
HQREIQVM

SEQ ID NO: 120299 - protein, 8 aa, Homo Sapiens
HQREITSL

SEQ ID NO: 120300 - protein, 8 aa, Homo Sapiens
HQRIHPGI

SEQ ID NO: 120301 - protein, 8 aa, Homo Sapiens
HQRIPQSV

SEQ ID NO: 120302 - protein, 8 aa, Homo Sapiens
HQRITEEL

SEQ ID NO: 120303 - protein, 8 aa, Homo Sapiens
HQRYDVLI

SEQ ID NO: 120304 - protein, 8 aa, Homo Sapiens
HQSVEPVV

SEQ ID NO: 120305 - protein, 8 aa, Homo Sapiens
HQSVTKVV

SEQ ID NO: 120306 - protein, 8 aa, Homo Sapiens
HQTELSNL

SEQ ID NO: 120307 - protein, 8 aa, Homo Sapiens
HQTGLKVV

SEQ ID NO: 120308 - protein, 8 aa, Homo Sapiens
HQTISALI

SEQ ID NO: 120309 - protein, 8 aa, Homo Sapiens
HQTLLVVV

SEQ ID NO: 120310 - protein, 8 aa, Homo Sapiens
HQVLMKTV

SEQ ID NO: 120311 - protein, 8 aa, Homo Sapiens
HQVQVNHI

SEQ ID NO: 120312 - protein, 8 aa, Homo Sapiens
HQVTTRNL

SEQ ID NO: 120313 - protein, 8 aa, Homo Sapiens
HQVVLPVL

SEQ ID NO: 120314 - protein, 8 aa, Homo Sapiens
HQVVTHLL

SEQ ID NO: 120315 - protein, 8 aa, Homo Sapiens
HQVVVANI

SEQ ID NO: 120316 - protein, 8 aa, Homo Sapiens
HQWFGNIV

SEQ ID NO: 120317 - protein, 8 aa, Homo Sapiens
HQYIAKCL

SEQ ID NO: 120318 - protein, 8 aa, Homo Sapiens
HQYIFSHI

SEQ ID NO: 120319 - protein, 8 aa, Homo Sapiens
HQYITKMT

SEQ ID NO: 120320 - protein, 8 aa, Homo Sapiens
HQYPFVVL

SEQ ID NO: 120321 - protein, 8 aa, Homo Sapiens
HQYRLLHT

SEQ ID NO: 120322 - protein, 8 aa, Homo Sapiens
HQYTGSAL

SEQ ID NO: 120323 - protein, 8 aa, Homo Sapiens
HQYTPEMI

SEQ ID NO: 120324 - protein, 8 aa, Homo Sapiens
HQYVVPKI

SEQ ID NO: 120325 - protein, 8 aa, Homo Sapiens
HSDYIRCI

SEQ ID NO: 120326 - protein, 8 aa, Homo Sapiens
HSFISNAV

SEQ ID NO: 120327 - protein, 8 aa, Homo Sapiens
HSFTQPRL

SEQ ID NO: 120328 - protein, 8 aa, Homo Sapiens
HSHLALSV

SEQ ID NO: 120329 - protein, 8 aa, Homo Sapiens
HSIATRVI

SEQ ID NO: 120330 - protein, 8 aa, Homo Sapiens
HSILIANI

SEQ ID NO: 120331 - protein, 8 aa, Homo Sapiens
HSIQIMKV

SEQ ID NO: 120332 - protein, 8 aa, Homo Sapiens
HSKIVAGV

SEQ ID NO: 120333 - protein, 8 aa, Homo Sapiens
HSKLIAKV

SEQ ID NO: 120334 - protein, 8 aa, Homo Sapiens
HSLKLWRI

SEQ ID NO: 120335 - protein, 8 aa, Homo Sapiens
HSLQVAGI

SEQ ID NO: 120336 - protein, 8 aa, Homo Sapiens
HSLYTPVI

SEQ ID NO: 120337 - protein, 8 aa, Homo Sapiens
HSMITRKV

SEQ ID NO: 120338 - protein, 8 aa, Homo Sapiens
HSMKMEEI

SEQ ID NO: 120339 - protein, 8 aa, Homo Sapiens
HSPKVNLV

SEQ ID NO: 120340 - protein, 8 aa, Homo Sapiens
HSPSVAKI

SEQ ID NO: 120341 - protein, 8 aa, Homo Sapiens
HSPYVAQI

SEQ ID NO: 120342 - protein, 8 aa, Homo Sapiens
HSQELPAI

SEQ ID NO: 120343 - protein, 8 aa, Homo Sapiens
HSQLMQLI

SEQ ID NO: 120344 - protein, 8 aa, Homo Sapiens
HSRALVGI

SEQ ID NO: 120345 - protein, 8 aa, Homo Sapiens
HSRPVPKL

SEQ ID NO: 120346 - protein, 8 aa, Homo Sapiens
HSTIMPRL

SEQ ID NO: 120347 - protein, 8 aa, Homo Sapiens
HSVCVNQI

SEQ ID NO: 120348 - protein, 8 aa, Homo Sapiens
HSVFQLQI

SEQ ID NO: 120349 - protein, 8 aa, Homo Sapiens
HSVTVPLV

SEQ ID NO: 120350 - protein, 8 aa, Homo Sapiens
HSWAPLKV

SEQ ID NO: 120351 - protein, 8 aa, Homo Sapiens
HSWLILQV

SEQ ID NO: 120352 - protein, 8 aa, Homo Sapiens
HSYAVSSV

SEQ ID NO: 120353 - protein, 8 aa, Homo Sapiens
HSYILVKI

SEQ ID NO: 120354 - protein, 8 aa, Homo Sapiens
HSYLSRLI

SEQ ID NO: 120355 - protein, 8 aa, Homo Sapiens
HSYSPITV

SEQ ID NO: 120356 - protein, 8 aa, Homo Sapiens
HSYSPRAI

SEQ ID NO: 120357 - protein, 8 aa, Homo Sapiens
IEFICKTI

SEQ ID NO: 120358 - protein, 8 aa, Homo Sapiens
IEKIMAQI

SEQ ID NO: 120359 - protein, 8 aa, Homo Sapiens
IERATRLV

SEQ ID NO: 120360 - protein, 8 aa, Homo Sapiens
IEVLQPLI

SEQ ID NO: 120361 - protein, 8 aa, Homo Sapiens
IFIRILQV

SEQ ID NO: 120362 - protein, 8 aa, Homo Sapiens
IFLKTRVV

SEQ ID NO: 120363 - protein, 8 aa, Homo Sapiens
IFYKTKEI

SEQ ID NO: 120364 - protein, 8 aa, Homo Sapiens
IGLQHKSV

SEQ ID NO: 120365 - protein, 8 aa, Homo Sapiens
IGYLIPLM

SEQ ID NO: 120366 - protein, 8 aa, Homo Sapiens
IKQLLSEL

SEQ ID NO: 120367 - protein, 8 aa, Homo Sapiens
IMDRILQI

SEQ ID NO: 120368 - protein, 8 aa, Homo Sapiens
IMMNTPVI

SEQ ID NO: 120369 - protein, 8 aa, Homo Sapiens
IMRQTLEI

SEQ ID NO: 120370 - protein, 8 aa, Homo Sapiens
IMRSPQMV

SEQ ID NO: 120371 - protein, 8 aa, Homo Sapiens
IMYKGRTV

SEQ ID NO: 120372 - protein, 8 aa, Homo Sapiens
IQFEVRRV

SEQ ID NO: 120373 - protein, 8 aa, Homo Sapiens
IQFKLEKI

SEQ ID NO: 120374 - protein, 8 aa, Homo Sapiens
IQFPIQKI

SEQ ID NO: 120375 - protein, 8 aa, Homo Sapiens
IQHIQNAI

SEQ ID NO: 120376 - protein, 8 aa, Homo Sapiens
IQHLIPKI

SEQ ID NO: 120377 - protein, 8 aa, Homo Sapiens
IQHQTIHI

SEQ ID NO: 120378 - protein, 8 aa, Homo Sapiens
IQHQVLVV

SEQ ID NO: 120379 - protein, 8 aa, Homo Sapiens
IQKLSKAV

SEQ ID NO: 120380 - protein, 8 aa, Homo Sapiens
IQKLTKAV

SEQ ID NO: 120381 - protein, 8 aa, Homo Sapiens
IQKTIQMV

SEQ ID NO: 120382 - protein, 8 aa, Homo Sapiens
IQKVHPAI

SEQ ID NO: 120383 - protein, 8 aa, Homo Sapiens
IQLELDTV

SEQ ID NO: 120384 - protein, 8 aa, Homo Sapiens
IQLKTSVI

SEQ ID NO: 120385 - protein, 8 aa, Homo Sapiens
IQMSVQRI

SEQ ID NO: 120386 - protein, 8 aa, Homo Sapiens
IQNRIIEV

SEQ ID NO: 120387 - protein, 8 aa, Homo Sapiens
IQQPQPLI

SEQ ID NO: 120388 - protein, 8 aa, Homo Sapiens
IQREVSLM

SEQ ID NO: 120389 - protein, 8 aa, Homo Sapiens
IQRVAAGV

SEQ ID NO: 120390 - protein, 8 aa, Homo Sapiens
IQRVGQAV

SEQ ID NO: 120391 - protein, 8 aa, Homo Sapiens
IQSIIAII

SEQ ID NO: 120392 - protein, 8 aa, Homo Sapiens
IQSIMAIV

SEQ ID NO: 120393 - protein, 8 aa, Homo Sapiens
IQTELHHV

SEQ ID NO: 120394 - protein, 8 aa, Homo Sapiens
IQTKVNYV

SEQ ID NO: 120395 - protein, 8 aa, Homo Sapiens
IQTMLRQI

SEQ ID NO: 120396 - protein, 8 aa, Homo Sapiens
IQVAVHKI

SEQ ID NO: 120397 - protein, 8 aa, Homo Sapiens
IQVVVATV

SEQ ID NO: 120398 - protein, 8 aa, Homo Sapiens
IQWIVVRI

SEQ ID NO: 120399 - protein, 8 aa, Homo Sapiens
IQYALRTL

SEQ ID NO: 120400 - protein, 8 aa, Homo Sapiens
IRMISVNI

SEQ ID NO: 120401 - protein, 8 aa, Homo Sapiens
ISKIQPSV

SEQ ID NO: 120402 - protein, 8 aa, Homo Sapiens
ISPASPKI

SEQ ID NO: 120403 - protein, 8 aa, Homo Sapiens
ITLNRHVI

SEQ ID NO: 120404 - protein, 8 aa, Homo Sapiens
KAWKALEI

SEQ ID NO: 120405 - protein, 8 aa, Homo Sapiens
KEIKGRTV

SEQ ID NO: 120406 - protein, 8 aa, Homo Sapiens
KFLKILQV

SEQ ID NO: 120407 - protein, 8 aa, Homo Sapiens
KMFQVHQV

SEQ ID NO: 120408 - protein, 8 aa, Homo Sapiens
KMIGIKKV

SEQ ID NO: 120409 - protein, 8 aa, Homo Sapiens
KMLKVKIV

SEQ ID NO: 120410 - protein, 8 aa, Homo Sapiens
KMMKIAEI

SEQ ID NO: 120411 - protein, 8 aa, Homo Sapiens
KMPEVITI

SEQ ID NO: 120412 - protein, 8 aa, Homo Sapiens
KMPSVIKI

SEQ ID NO: 120413 - protein, 8 aa, Homo Sapiens
KMSVQPTV

SEQ ID NO: 120414 - protein, 8 aa, Homo Sapiens
KQFESKII

SEQ ID NO: 120415 - protein, 8 aa, Homo Sapiens
KQIEINTI

SEQ ID NO: 120416 - protein, 8 aa, Homo Sapiens
KQIIKPFI

SEQ ID NO: 120417 - protein, 8 aa, Homo Sapiens
KQIVLTGI

SEQ ID NO: 120418 - protein, 8 aa, Homo Sapiens
KQLIAKKI

SEQ ID NO: 120419 - protein, 8 aa, Homo Sapiens
KQLQLTTV

SEQ ID NO: 120420 - protein, 8 aa, Homo Sapiens
KQLSILKV

SEQ ID NO: 120421 - protein, 8 aa, Homo Sapiens
KQLYLRSV

SEQ ID NO: 120422 - protein, 8 aa, Homo Sapiens
KQMLVSEV

SEQ ID NO: 120423 - protein, 8 aa, Homo Sapiens
KQMRILMV

SEQ ID NO: 120424 - protein, 8 aa, Homo Sapiens
KQVQQPSV

SEQ ID NO: 120425 - protein, 8 aa, Homo Sapiens
KQYEILCV

SEQ ID NO: 120426 - protein, 8 aa, Homo Sapiens
KQYVLLSI

SEQ ID NO: 120427 - protein, 8 aa, Homo Sapiens
KQYYALEV

SEQ ID NO: 120428 - protein, 8 aa, Homo Sapiens
KSLKILRI

SEQ ID NO: 120429 - protein, 8 aa, Homo Sapiens
KYYLAPKI

SEQ ID NO: 120430 - protein, 8 aa, Homo Sapiens
LAPLAKVI

SEQ ID NO: 120431 - protein, 8 aa, Homo Sapiens
LEKLLPPV

SEQ ID NO: 120432 - protein, 8 aa, Homo Sapiens
LERTFIAI

SEQ ID NO: 120433 - protein, 8 aa, Homo Sapiens
LETTALFV

SEQ ID NO: 120434 - protein, 8 aa, Homo Sapiens
LEYEARQI

SEQ ID NO: 120435 - protein, 8 aa, Homo Sapiens
LEYIARAI

SEQ ID NO: 120436 - protein, 8 aa, Homo Sapiens
LEYRVTQV

SEQ ID NO: 120437 - protein, 8 aa, Homo Sapiens
LFLQTPKI

SEQ ID NO: 120438 - protein, 8 aa, Homo Sapiens
LFLRTPKI

SEQ ID NO: 120439 - protein, 8 aa, Homo Sapiens
LGLAMMVA

SEQ ID NO: 120440 - protein, 8 aa, Homo Sapiens
LGYEMVQV

SEQ ID NO: 120441 - protein, 8 aa, Homo Sapiens
LLQAIAQL

SEQ ID NO: 120442 - protein, 8 aa, Homo Sapiens
LLRQLLKL

SEQ ID NO: 120443 - protein, 8 aa, Homo Sapiens
LMPPVKQV

SEQ ID NO: 120444 - protein, 8 aa, Homo Sapiens
LMRKVPRV

SEQ ID NO: 120445 - protein, 8 aa, Homo Sapiens
LNRKIVQV

SEQ ID NO: 120446 - protein, 8 aa, Homo Sapiens
LPFRVLLV

SEQ ID NO: 120447 - protein, 8 aa, Homo Sapiens
LPYIFPNI

SEQ ID NO: 120448 - protein, 8 aa, Homo Sapiens
LPYQVVEV

SEQ ID NO: 120449 - protein, 8 aa, Homo Sapiens
LQAALARV

SEQ ID NO: 120450 - protein, 8 aa, Homo Sapiens
LQFIFTNI

SEQ ID NO: 120451 - protein, 8 aa, Homo Sapiens
LQFKVVRV

SEQ ID NO: 120452 - protein, 8 aa, Homo Sapiens
LQFLAPKI

SEQ ID NO: 120453 - protein, 8 aa, Homo Sapiens
LQFPVGRI

SEQ ID NO: 120454 - protein, 8 aa, Homo Sapiens
LQFPVGRV

SEQ ID NO: 120455 - protein, 8 aa, Homo Sapiens
LQFQFAEV

SEQ ID NO: 120456 - protein, 8 aa, Homo Sapiens
LQHELQTI

SEQ ID NO: 120457 - protein, 8 aa, Homo Sapiens
LQHPFVTV

SEQ ID NO: 120458 - protein, 8 aa, Homo Sapiens
LQIIINCV

SEQ ID NO: 120459 - protein, 8 aa, Homo Sapiens
LQKELKKV

SEQ ID NO: 120460 - protein, 8 aa, Homo Sapiens
LQKEMQVI

SEQ ID NO: 120461 - protein, 8 aa, Homo Sapiens
LQKQILKI

SEQ ID NO: 120462 - protein, 8 aa, Homo Sapiens
LQKVMNHI

SEQ ID NO: 120463 - protein, 8 aa, Homo Sapiens
LQLKMIGI

SEQ ID NO: 120464 - protein, 8 aa, Homo Sapiens
LQLKPRTV

SEQ ID NO: 120465 - protein, 8 aa, Homo Sapiens
LQLQIPRI

SEQ ID NO: 120466 - protein, 8 aa, Homo Sapiens
LQQAKDEI

SEQ ID NO: 120467 - protein, 8 aa, Homo Sapiens
LQQAKEDL

SEQ ID NO: 120468 - protein, 8 aa, Homo Sapiens
LQRIHAEI

SEQ ID NO: 120469 - protein, 8 aa, Homo Sapiens
LQRKQMVI

SEQ ID NO: 120470 - protein, 8 aa, Homo Sapiens
LQRLKPEI

SEQ ID NO: 120471 - protein, 8 aa, Homo Sapiens
LQRTMNEI

SEQ ID NO: 120472 - protein, 8 aa, Homo Sapiens
LQRVIDTI

SEQ ID NO: 120473 - protein, 8 aa, Homo Sapiens
LQRVIDYI

SEQ ID NO: 120474 - protein, 8 aa, Homo Sapiens
LQTAFRTV

SEQ ID NO: 120475 - protein, 8 aa, Homo Sapiens
LQTALLVV

SEQ ID NO: 120476 - protein, 8 aa, Homo Sapiens
LQVAIKVI

SEQ ID NO: 120477 - protein, 8 aa, Homo Sapiens
LQVLVNAI

SEQ ID NO: 120478 - protein, 8 aa, Homo Sapiens
LQVTQPTV

SEQ ID NO: 120479 - protein, 8 aa, Homo Sapiens
LQWPSLTV

SEQ ID NO: 120480 - protein, 8 aa, Homo Sapiens
LQYEFTKL

SEQ ID NO: 120481 - protein, 8 aa, Homo Sapiens
LQYIFAHV

SEQ ID NO: 120482 - protein, 8 aa, Homo Sapiens
LQYKPTVI

SEQ ID NO: 120483 - protein, 8 aa, Homo Sapiens
LQYQQPSI

SEQ ID NO: 120484 - protein, 8 aa, Homo Sapiens
LQYSLTKI

SEQ ID NO: 120485 - protein, 8 aa, Homo Sapiens
LQYTPPVV

SEQ ID NO: 120486 - protein, 8 aa, Homo Sapiens
LRQHIAEL

SEQ ID NO: 120487 - protein, 8 aa, Homo Sapiens
LSAPLPLL

SEQ ID NO: 120488 - protein, 8 aa, Homo Sapiens
LSFILHTI

SEQ ID NO: 120489 - protein, 8 aa, Homo Sapiens
LSFTMPQI

SEQ ID NO: 120490 - protein, 8 aa, Homo Sapiens
LSHLSLIV

SEQ ID NO: 120491 - protein, 8 aa, Homo Sapiens
LSPVVPQI

SEQ ID NO: 120492 - protein, 8 aa, Homo Sapiens
LSRPQPEI

SEQ ID NO: 120493 - protein, 8 aa, Homo Sapiens
LSYAVRKV

SEQ ID NO: 120494 - protein, 8 aa, Homo Sapiens
LYPKVAKI

SEQ ID NO: 120495 - protein, 8 aa, Homo Sapiens
MEFQVPVI

SEQ ID NO: 120496 - protein, 8 aa, Homo Sapiens
MEYSTKKV

SEQ ID NO: 120497 - protein, 8 aa, Homo Sapiens
MGYKTIMV

SEQ ID NO: 120498 - protein, 8 aa, Homo Sapiens
MGYVHRSV

SEQ ID NO: 120499 - protein, 8 aa, Homo Sapiens
MQFRSILI

SEQ ID NO: 120500 - protein, 8 aa, Homo Sapiens
MQHPPSTI

SEQ ID NO: 120501 - protein, 8 aa, Homo Sapiens
MQIFLPRI

SEQ ID NO: 120502 - protein, 8 aa, Homo Sapiens
MQIFVKTL

SEQ ID NO: 120503 - protein, 8 aa, Homo Sapiens
MQIRIHQI

SEQ ID NO: 120504 - protein, 8 aa, Homo Sapiens
MQKEITAL

SEQ ID NO: 120505 - protein, 8 aa, Homo Sapiens
MQLKALEI

SEQ ID NO: 120506 - protein, 8 aa, Homo Sapiens
MQQILTRV

SEQ ID NO: 120507 - protein, 8 aa, Homo Sapiens
MQRHIRLV

SEQ ID NO: 120508 - protein, 8 aa, Homo Sapiens
MQRSTLSV

SEQ ID NO: 120509 - protein, 8 aa, Homo Sapiens
MQTEFHHV

SEQ ID NO: 120510 - protein, 8 aa, Homo Sapiens
MQTEVHHV

SEQ ID NO: 120511 - protein, 8 aa, Homo Sapiens
MQVTLKTL

SEQ ID NO: 120512 - protein, 8 aa, Homo Sapiens
MQWRALVL

SEQ ID NO: 120513 - protein, 8 aa, Homo Sapiens
MQWVLPKI

SEQ ID NO: 120514 - protein, 8 aa, Homo Sapiens
MSQILPCI

SEQ ID NO: 120515 - protein, 8 aa, Homo Sapiens
MSYLFRNI

SEQ ID NO: 120516 - protein, 8 aa, Homo Sapiens
NAFATPTI

SEQ ID NO: 120517 - protein, 8 aa, Homo Sapiens
NMLKILAI

SEQ ID NO: 120518 - protein, 8 aa, Homo Sapiens
NMLKVNLI

SEQ ID NO: 120519 - protein, 8 aa, Homo Sapiens
NMPAVKAI

SEQ ID NO: 120520 - protein, 8 aa, Homo Sapiens
NMPKVKTI

SEQ ID NO: 120521 - protein, 8 aa, Homo Sapiens
NMYGFRKV

SEQ ID NO: 120522 - protein, 8 aa, Homo Sapiens
NQFRVDYI

SEQ ID NO: 120523 - protein, 8 aa, Homo Sapiens
NQFVVHTV

SEQ ID NO: 120524 - protein, 8 aa, Homo Sapiens
NQIILNKV

SEQ ID NO: 120525 - protein, 8 aa, Homo Sapiens
NQIRLTNV

SEQ ID NO: 120526 - protein, 8 aa, Homo Sapiens
NQISLPRL

SEQ ID NO: 120527 - protein, 8 aa, Homo Sapiens
NQLELLRV

SEQ ID NO: 120528 - protein, 8 aa, Homo Sapiens
NQMLVPVI

SEQ ID NO: 120529 - protein, 8 aa, Homo Sapiens
NQQLALKV

SEQ ID NO: 120530 - protein, 8 aa, Homo Sapiens
NQRNVPGI

SEQ ID NO: 120531 - protein, 8 aa, Homo Sapiens
NQTPLPLI

SEQ ID NO: 120532 - protein, 8 aa, Homo Sapiens
NQTVMTTI

SEQ ID NO: 120533 - protein, 8 aa, Homo Sapiens
NQVEQLRV

SEQ ID NO: 120534 - protein, 8 aa, Homo Sapiens
NQVVKPRV

SEQ ID NO: 120535 - protein, 8 aa, Homo Sapiens
NQYIAEMV

SEQ ID NO: 120536 - protein, 8 aa, Homo Sapiens
NQYKFILL

SEQ ID NO: 120537 - protein, 8 aa, Homo Sapiens
NQYQFDKV

SEQ ID NO: 120538 - protein, 8 aa, Homo Sapiens
NSMLVSIV

SEQ ID NO: 120539 - protein, 8 aa, Homo Sapiens
NSRLVCKI

SEQ ID NO: 120540 - protein, 8 aa, Homo Sapiens
NSYVSPRI

SEQ ID NO: 120541 - protein, 8 aa, Homo Sapiens
PFPTVLRV

SEQ ID NO: 120542 - protein, 8 aa, Homo Sapiens
PWPKVLKI

SEQ ID NO: 120543 - protein, 8 aa, Homo Sapiens
QAIKGMHI

SEQ ID NO: 120544 - protein, 8 aa, Homo Sapiens
QALEVLKI

SEQ ID NO: 120545 - protein, 8 aa, Homo Sapiens
QALILKIA

SEQ ID NO: 120546 - protein, 8 aa, Homo Sapiens
QAMVVRKV

SEQ ID NO: 120547 - protein, 8 aa, Homo Sapiens
QFLTGRKI

SEQ ID NO: 120548 - protein, 8 aa, Homo Sapiens
QFQAVLRV

SEQ ID NO: 120549 - protein, 8 aa, Homo Sapiens
QGIELHCI

SEQ ID NO: 120550 - protein, 8 aa, Homo Sapiens
QGYTVARI

SEQ ID NO: 120551 - protein, 8 aa, Homo Sapiens
QHSNLTQV

SEQ ID NO: 120552 - protein, 8 aa, Homo Sapiens
QKDKTSVI

SEQ ID NO: 120553 - protein, 8 aa, Homo Sapiens
QLLKALEV

SEQ ID NO: 120554 - protein, 8 aa, Homo Sapiens
QMILDKKF

SEQ ID NO: 120555 - protein, 8 aa, Homo Sapiens
QMLKARSV

SEQ ID NO: 120556 - protein, 8 aa, Homo Sapiens
QMPSDKTI

SEQ ID NO: 120557 - protein, 8 aa, Homo Sapiens
QMPTVIYV

SEQ ID NO: 120558 - protein, 8 aa, Homo Sapiens
QMTVIRKV

SEQ ID NO: 120559 - protein, 8 aa, Homo Sapiens
QMVIGFLV

SEQ ID NO: 120560 - protein, 8 aa, Homo Sapiens
QNRLVRLV

SEQ ID NO: 120561 - protein, 8 aa, Homo Sapiens
QQFKILNV

SEQ ID NO: 120562 - protein, 8 aa, Homo Sapiens
QQFLLKVV

SEQ ID NO: 120563 - protein, 8 aa, Homo Sapiens
QQFQEPFV

SEQ ID NO: 120564 - protein, 8 aa, Homo Sapiens
QQFTSRRV

SEQ ID NO: 120565 - protein, 8 aa, Homo Sapiens
QQFYQPKI

SEQ ID NO: 120566 - protein, 8 aa, Homo Sapiens
QQHHQPMV

SEQ ID NO: 120567 - protein, 8 aa, Homo Sapiens
QQHIHTSV

SEQ ID NO: 120568 - protein, 8 aa, Homo Sapiens
QQHKLLKV

SEQ ID NO: 120569 - protein, 8 aa, Homo Sapiens
QQHSPQQI

SEQ ID NO: 120570 - protein, 8 aa, Homo Sapiens
QQHYTNKI

SEQ ID NO: 120571 - protein, 8 aa, Homo Sapiens
QQIELLEV

SEQ ID NO: 120572 - protein, 8 aa, Homo Sapiens
QQIEQKSI

SEQ ID NO: 120573 - protein, 8 aa, Homo Sapiens
QQIHLEKV

SEQ ID NO: 120574 - protein, 8 aa, Homo Sapiens
QQIKLWKV

SEQ ID NO: 120575 - protein, 8 aa, Homo Sapiens
QQIKTWNI

SEQ ID NO: 120576 - protein, 8 aa, Homo Sapiens
QQIKVATL

SEQ ID NO: 120577 - protein, 8 aa, Homo Sapiens
QQIQAQLV

SEQ ID NO: 120578 - protein, 8 aa, Homo Sapiens
QQIQIQTV

SEQ ID NO: 120579 - protein, 8 aa, Homo Sapiens
QQIRINEV

SEQ ID NO: 120580 - protein, 8 aa, Homo Sapiens
QQIRVLLM

SEQ ID NO: 120581 - protein, 8 aa, Homo Sapiens
QQISILTV

SEQ ID NO: 120582 - protein, 8 aa, Homo Sapiens
QQITQTEV

SEQ ID NO: 120583 - protein, 8 aa, Homo Sapiens
QQKAGRTI

SEQ ID NO: 120584 - protein, 8 aa, Homo Sapiens
QQKELEKV

SEQ ID NO: 120585 - protein, 8 aa, Homo Sapiens
QQKKAAII

SEQ ID NO: 120586 - protein, 8 aa, Homo Sapiens
QQLALQWV

SEQ ID NO: 120587 - protein, 8 aa, Homo Sapiens
QQLEMYSI

SEQ ID NO: 120588 - protein, 8 aa, Homo Sapiens
QQLKQKMV

SEQ ID NO: 120589 - protein, 8 aa, Homo Sapiens
QQLLQKKV

SEQ ID NO: 120590 - protein, 8 aa, Homo Sapiens
QQLQQRLQ

SEQ ID NO: 120591 - protein, 8 aa, Homo Sapiens
QQLQQRQI

SEQ ID NO: 120592 - protein, 8 aa, Homo Sapiens
QQLRLVRI

SEQ ID NO: 120593 - protein, 8 aa, Homo Sapiens
QQLTHHSV

SEQ ID NO: 120594 - protein, 8 aa, Homo Sapiens
QQLVLRTV

SEQ ID NO: 120595 - protein, 8 aa, Homo Sapiens
QQLVSHEV

SEQ ID NO: 120596 - protein, 8 aa, Homo Sapiens
QQNPQPLI

SEQ ID NO: 120597 - protein, 8 aa, Homo Sapiens
QQPIVRKV

SEQ ID NO: 120598 - protein, 8 aa, Homo Sapiens
QQPKSLKV

SEQ ID NO: 120599 - protein, 8 aa, Homo Sapiens
QQQRFHEI

SEQ ID NO: 120600 - protein, 8 aa, Homo Sapiens
QQQTMLRV

SEQ ID NO: 120601 - protein, 8 aa, Homo Sapiens
QQQVIRKI

SEQ ID NO: 120602 - protein, 8 aa, Homo Sapiens
QQREKPRV

SEQ ID NO: 120603 - protein, 8 aa, Homo Sapiens
QQRIESKV

SEQ ID NO: 120604 - protein, 8 aa, Homo Sapiens
QQSKILKV

SEQ ID NO: 120605 - protein, 8 aa, Homo Sapiens
QQSVLQRI

SEQ ID NO: 120606 - protein, 8 aa, Homo Sapiens
QQVAIKKI

SEQ ID NO: 120607 - protein, 8 aa, Homo Sapiens
QQVFIQKV

SEQ ID NO: 120608 - protein, 8 aa, Homo Sapiens
QQVILVQV

SEQ ID NO: 120609 - protein, 8 aa, Homo Sapiens
QQVLVRKL

SEQ ID NO: 120610 - protein, 8 aa, Homo Sapiens
QQVQIHQI

SEQ ID NO: 120611 - protein, 8 aa, Homo Sapiens
QQVQQVHV

SEQ ID NO: 120612 - protein, 8 aa, Homo Sapiens
QQVRFKTV

SEQ ID NO: 120613 - protein, 8 aa, Homo Sapiens
QQVVIHLI

SEQ ID NO: 120614 - protein, 8 aa, Homo Sapiens
QQWPVRSI

SEQ ID NO: 120615 - protein, 8 aa, Homo Sapiens
QQYENLVV

SEQ ID NO: 120616 - protein, 8 aa, Homo Sapiens
QQYRALTV

SEQ ID NO: 120617 - protein, 8 aa, Homo Sapiens
QSCEALRV

SEQ ID NO: 120618 - protein, 8 aa, Homo Sapiens
QSKILKVI

SEQ ID NO: 120619 - protein, 8 aa, Homo Sapiens
QSLATPVV

SEQ ID NO: 120620 - protein, 8 aa, Homo Sapiens
QSLRLRTI

SEQ ID NO: 120621 - protein, 8 aa, Homo Sapiens
QSTLLREI

SEQ ID NO: 120622 - protein, 8 aa, Homo Sapiens
QSTQVPTI

SEQ ID NO: 120623 - protein, 8 aa, Homo Sapiens
QSTRLPLI

SEQ ID NO: 120624 - protein, 8 aa, Homo Sapiens
QSVYISKI

SEQ ID NO: 120625 - protein, 8 aa, Homo Sapiens
QSYKVRLV

SEQ ID NO: 120626 - protein, 8 aa, Homo Sapiens
QSYVVNRV

SEQ ID NO: 120627 - protein, 8 aa, Homo Sapiens
QTPKVLVV

SEQ ID NO: 120628 - protein, 8 aa, Homo Sapiens
QTPQILVK

SEQ ID NO: 120629 - protein, 8 aa, Homo Sapiens
QTYAVPLI

SEQ ID NO: 120630 - protein, 8 aa, Homo Sapiens
RAPLVPKV

SEQ ID NO: 120631 - protein, 8 aa, Homo Sapiens
RCLMALKV

SEQ ID NO: 120632 - protein, 8 aa, Homo Sapiens
REFQTSVV

SEQ ID NO: 120633 - protein, 8 aa, Homo Sapiens
RFIQLLKV

SEQ ID NO: 120634 - protein, 8 aa, Homo Sapiens
RFMKITVI

SEQ ID NO: 120635 - protein, 8 aa, Homo Sapiens
RGYKLPKV

SEQ ID NO: 120636 - protein, 8 aa, Homo Sapiens
RMPIARKI

SEQ ID NO: 120637 - protein, 8 aa, Homo Sapiens
RMYPPPLI

SEQ ID NO: 120638 - protein, 8 aa, Homo Sapiens
RQAFIRKV

SEQ ID NO: 120639 - protein, 8 aa, Homo Sapiens
RQALMPTL

SEQ ID NO: 120640 - protein, 8 aa, Homo Sapiens
RQDYARLV

SEQ ID NO: 120641 - protein, 8 aa, Homo Sapiens
RQFAAQTV

SEQ ID NO: 120642 - protein, 8 aa, Homo Sapiens
RQFSHRAI

SEQ ID NO: 120643 - protein, 8 aa, Homo Sapiens
RQFTVRKV

SEQ ID NO: 120644 - protein, 8 aa, Homo Sapiens
RQFVPIKV

SEQ ID NO: 120645 - protein, 8 aa, Homo Sapiens
RQHLQQSI

SEQ ID NO: 120646 - protein, 8 aa, Homo Sapiens
RQHPQPYI

SEQ ID NO: 120647 - protein, 8 aa, Homo Sapiens
RQHVLTRI

SEQ ID NO: 120648 - protein, 8 aa, Homo Sapiens
RQIEIPKV

SEQ ID NO: 120649 - protein, 8 aa, Homo Sapiens
RQIGQRTI

SEQ ID NO: 120650 - protein, 8 aa, Homo Sapiens
RQIKINEV

SEQ ID NO: 120651 - protein, 8 aa, Homo Sapiens
RQILAPVV

SEQ ID NO: 120652 - protein, 8 aa, Homo Sapiens
RQISLNKV

SEQ ID NO: 120653 - protein, 8 aa, Homo Sapiens
RQIVLAKV

SEQ ID NO: 120654 - protein, 8 aa, Homo Sapiens
RQKALRMV

SEQ ID NO: 120655 - protein, 8 aa, Homo Sapiens
RQKEIPRV

SEQ ID NO: 120656 - protein, 8 aa, Homo Sapiens
RQKLDPKI

SEQ ID NO: 120657 - protein, 8 aa, Homo Sapiens
RQKLVRNI

SEQ ID NO: 120658 - protein, 8 aa, Homo Sapiens
RQLAVLNV

SEQ ID NO: 120659 - protein, 8 aa, Homo Sapiens
RQLEIKQI

SEQ ID NO: 120660 - protein, 8 aa, Homo Sapiens
RQLIHRSV

SEQ ID NO: 120661 - protein, 8 aa, Homo Sapiens
RQLKIKEV

SEQ ID NO: 120662 - protein, 8 aa, Homo Sapiens
RQLTLRKL

SEQ ID NO: 120663 - protein, 8 aa, Homo Sapiens
RQLVFNEI

SEQ ID NO: 120664 - protein, 8 aa, Homo Sapiens
RQLYSKVI

SEQ ID NO: 120665 - protein, 8 aa, Homo Sapiens
RQMELVSV

SEQ ID NO: 120666 - protein, 8 aa, Homo Sapiens
RQMFVQRV

SEQ ID NO: 120667 - protein, 8 aa, Homo Sapiens
RQMVFNEI

SEQ ID NO: 120668 - protein, 8 aa, Homo Sapiens
RQQIKPAV

SEQ ID NO: 120669 - protein, 8 aa, Homo Sapiens
RQQQQLLI

SEQ ID NO: 120670 - protein, 8 aa, Homo Sapiens
RQRIILRV

SEQ ID NO: 120671 - protein, 8 aa, Homo Sapiens
RQSIIRKV

SEQ ID NO: 120672 - protein, 8 aa, Homo Sapiens
RQVKLVNI

SEQ ID NO: 120673 - protein, 8 aa, Homo Sapiens
RQVLALRI

SEQ ID NO: 120674 - protein, 8 aa, Homo Sapiens
RQVLIRQI

SEQ ID NO: 120675 - protein, 8 aa, Homo Sapiens
RQWLIEQI

SEQ ID NO: 120676 - protein, 8 aa, Homo Sapiens
RQYMFSSL

SEQ ID NO: 120677 - protein, 8 aa, Homo Sapiens
RQYRMKKL

SEQ ID NO: 120678 - protein, 8 aa, Homo Sapiens
RQYVVRAV

SEQ ID NO: 120679 - protein, 8 aa, Homo Sapiens
RQYYLSKI

SEQ ID NO: 120680 - protein, 8 aa, Homo Sapiens
RQYYPVTI

SEQ ID NO: 120681 - protein, 8 aa, Homo Sapiens
RSFQTSAI

SEQ ID NO: 120682 - protein, 8 aa, Homo Sapiens
RYIHILMI

SEQ ID NO: 120683 - protein, 8 aa, Homo Sapiens
SAPAVLEI

SEQ ID NO: 120684 - protein, 8 aa, Homo Sapiens
SAPAVLVV

SEQ ID NO: 120685 - protein, 8 aa, Homo Sapiens
SAPEVLLV

SEQ ID NO: 120686 - protein, 8 aa, Homo Sapiens
SAVELPKI

SEQ ID NO: 120687 - protein, 8 aa, Homo Sapiens
SAYRVKTV

SEQ ID NO: 120688 - protein, 8 aa, Homo Sapiens
SEYITHEI

SEQ ID NO: 120689 - protein, 8 aa, Homo Sapiens
SFFKSLVI

SEQ ID NO: 120690 - protein, 8 aa, Homo Sapiens
SFPGANII

SEQ ID NO: 120691 - protein, 8 aa, Homo Sapiens
SFPMTPSI

SEQ ID NO: 120692 - protein, 8 aa, Homo Sapiens
SFPTAKYI

SEQ ID NO: 120693 - protein, 8 aa, Homo Sapiens
SFPVILSI

SEQ ID NO: 120694 - protein, 8 aa, Homo Sapiens
SFSKAFGQ

SEQ ID NO: 120695 - protein, 8 aa, Homo Sapiens
SFYKIRTI

SEQ ID NO: 120696 - protein, 8 aa, Homo Sapiens
SGTVLPAV

SEQ ID NO: 120697 - protein, 8 aa, Homo Sapiens
SGYAPLSV

SEQ ID NO: 120698 - protein, 8 aa, Homo Sapiens
SHVVTTSV

SEQ ID NO: 120699 - protein, 8 aa, Homo Sapiens
SMFEPPQV

SEQ ID NO: 120700 - protein, 8 aa, Homo Sapiens
SMFSPASI

SEQ ID NO: 120701 - protein, 8 aa, Homo Sapiens
SMIGTSTI

SEQ ID NO: 120702 - protein, 8 aa, Homo Sapiens
SMKIMHEI

SEQ ID NO: 120703 - protein, 8 aa, Homo Sapiens
SMLRISTI

SEQ ID NO: 120704 - protein, 8 aa, Homo Sapiens
SMPDVLKI

SEQ ID NO: 120705 - protein, 8 aa, Homo Sapiens
SMPRGVVV

SEQ ID NO: 120706 - protein, 8 aa, Homo Sapiens
SMPTEKKI

SEQ ID NO: 120707 - protein, 8 aa, Homo Sapiens
SMPTVTQI

SEQ ID NO: 120708 - protein, 8 aa, Homo Sapiens
SMYQTKAV

SEQ ID NO: 120709 - protein, 8 aa, Homo Sapiens
SNIVIPLI

SEQ ID NO: 120710 - protein, 8 aa, Homo Sapiens
SQALILKI

SEQ ID NO: 120711 - protein, 8 aa, Homo Sapiens
SQAMLNAV

SEQ ID NO: 120712 - protein, 8 aa, Homo Sapiens
SQASMKQV

SEQ ID NO: 120713 - protein, 8 aa, Homo Sapiens
SQCLSKLV

SEQ ID NO: 120714 - protein, 8 aa, Homo Sapiens
SQFAFESV

SEQ ID NO: 120715 - protein, 8 aa, Homo Sapiens
SQFCLQRI

SEQ ID NO: 120716 - protein, 8 aa, Homo Sapiens
SQFELLKV

SEQ ID NO: 120717 - protein, 8 aa, Homo Sapiens
SQFIADVI

SEQ ID NO: 120718 - protein, 8 aa, Homo Sapiens
SQFIEPKI

SEQ ID NO: 120719 - protein, 8 aa, Homo Sapiens
SQFLVSSV

SEQ ID NO: 120720 - protein, 8 aa, Homo Sapiens
SQFQIHHL

SEQ ID NO: 120721 - protein, 8 aa, Homo Sapiens
SQFTLQCV

SEQ ID NO: 120722 - protein, 8 aa, Homo Sapiens
SQFVMEGV

SEQ ID NO: 120723 - protein, 8 aa, Homo Sapiens
SQHMTEVV

SEQ ID NO: 120724 - protein, 8 aa, Homo Sapiens
SQHPGLLV

SEQ ID NO: 120725 - protein, 8 aa, Homo Sapiens
SQHVSPKI

SEQ ID NO: 120726 - protein, 8 aa, Homo Sapiens
SQICAKAV

SEQ ID NO: 120727 - protein, 8 aa, Homo Sapiens
SQIEKPKI

SEQ ID NO: 120728 - protein, 8 aa, Homo Sapiens
SQIFARKV

SEQ ID NO: 120729 - protein, 8 aa, Homo Sapiens
SQIITSVV

SEQ ID NO: 120730 - protein, 8 aa, Homo Sapiens
SQIKLYNI

SEQ ID NO: 120731 - protein, 8 aa, Homo Sapiens
SQILVNQI

SEQ ID NO: 120732 - protein, 8 aa, Homo Sapiens
SQIPLSKI

SEQ ID NO: 120733 - protein, 8 aa, Homo Sapiens
SQITPHAI

SEQ ID NO: 120734 - protein, 8 aa, Homo Sapiens
SQIVFRSV

SEQ ID NO: 120735 - protein, 8 aa, Homo Sapiens
SQIYLHHI

SEQ ID NO: 120736 - protein, 8 aa, Homo Sapiens
SQKIKPQV

SEQ ID NO: 120737 - protein, 8 aa, Homo Sapiens
SQKKTVTI

SEQ ID NO: 120738 - protein, 8 aa, Homo Sapiens
SQLAVLKV

SEQ ID NO: 120739 - protein, 8 aa, Homo Sapiens
SQLILHLI

SEQ ID NO: 120740 - protein, 8 aa, Homo Sapiens
SQLILQKI

SEQ ID NO: 120741 - protein, 8 aa, Homo Sapiens
SQLKLWNV

SEQ ID NO: 120742 - protein, 8 aa, Homo Sapiens
SQLKTVCV

SEQ ID NO: 120743 - protein, 8 aa, Homo Sapiens
SQLLLAHV

SEQ ID NO: 120744 - protein, 8 aa, Homo Sapiens
SQLLVHVL

SEQ ID NO: 120745 - protein, 8 aa, Homo Sapiens
SQLQALHI

SEQ ID NO: 120746 - protein, 8 aa, Homo Sapiens
SQLQLRCV

SEQ ID NO: 120747 - protein, 8 aa, Homo Sapiens
SQLQVHMV

SEQ ID NO: 120748 - protein, 8 aa, Homo Sapiens
SQLRVAKV

SEQ ID NO: 120749 - protein, 8 aa, Homo Sapiens
SQLSVPEI

SEQ ID NO: 120750 - protein, 8 aa, Homo Sapiens
SQLTTHKI

SEQ ID NO: 120751 - protein, 8 aa, Homo Sapiens
SQMIVKEI

SEQ ID NO: 120752 - protein, 8 aa, Homo Sapiens
SQMPIRKI

SEQ ID NO: 120753 - protein, 8 aa, Homo Sapiens
SQMTFHKI

SEQ ID NO: 120754 - protein, 8 aa, Homo Sapiens
SQNILPTI

SEQ ID NO: 120755 - protein, 8 aa, Homo Sapiens
SQPPVFKV

SEQ ID NO: 120756 - protein, 8 aa, Homo Sapiens
SQQLQLRV

SEQ ID NO: 120757 - protein, 8 aa, Homo Sapiens
SQQRLAQV

SEQ ID NO: 120758 - protein, 8 aa, Homo Sapiens
SQRAGLQV

SEQ ID NO: 120759 - protein, 8 aa, Homo Sapiens
SQRELDTV

SEQ ID NO: 120760 - protein, 8 aa, Homo Sapiens
SQRFTVQI

SEQ ID NO: 120761 - protein, 8 aa, Homo Sapiens
SQRITNQV

SEQ ID NO: 120762 - protein, 8 aa, Homo Sapiens
SQRLFRKI

SEQ ID NO: 120763 - protein, 8 aa, Homo Sapiens
SQRLQTQI

SEQ ID NO: 120764 - protein, 8 aa, Homo Sapiens
SQRPVLKV

SEQ ID NO: 120765 - protein, 8 aa, Homo Sapiens
SQRSVTSV

SEQ ID NO: 120766 - protein, 8 aa, Homo Sapiens
SQRYQVGV

SEQ ID NO: 120767 - protein, 8 aa, Homo Sapiens
SQRYVVAV

SEQ ID NO: 120768 - protein, 8 aa, Homo Sapiens
SQSLLPAI

SEQ ID NO: 120769 - protein, 8 aa, Homo Sapiens
SQTILKPL

SEQ ID NO: 120770 - protein, 8 aa, Homo Sapiens
SQTIQPKV

SEQ ID NO: 120771 - protein, 8 aa, Homo Sapiens
SQTKLKEV

SEQ ID NO: 120772 - protein, 8 aa, Homo Sapiens
SQTLQRSI

SEQ ID NO: 120773 - protein, 8 aa, Homo Sapiens
SQTPLPTI

SEQ ID NO: 120774 - protein, 8 aa, Homo Sapiens
SQTTVLVV

SEQ ID NO: 120775 - protein, 8 aa, Homo Sapiens
SQVALKII

SEQ ID NO: 120776 - protein, 8 aa, Homo Sapiens
SQVAVQKV

SEQ ID NO: 120777 - protein, 8 aa, Homo Sapiens
SQVIFNSV

SEQ ID NO: 120778 - protein, 8 aa, Homo Sapiens
SQVKATVI

SEQ ID NO: 120779 - protein, 8 aa, Homo Sapiens
SQVLLRCL

SEQ ID NO: 120780 - protein, 8 aa, Homo Sapiens
SQVLSQKI

SEQ ID NO: 120781 - protein, 8 aa, Homo Sapiens
SQVQVPQI

SEQ ID NO: 120782 - protein, 8 aa, Homo Sapiens
SQWEVSQV

SEQ ID NO: 120783 - protein, 8 aa, Homo Sapiens
SQYIFTEM

SEQ ID NO: 120784 - protein, 8 aa, Homo Sapiens
SQYKQLTI

SEQ ID NO: 120785 - protein, 8 aa, Homo Sapiens
SQYKSHFV

SEQ ID NO: 120786 - protein, 8 aa, Homo Sapiens
SQYLMHEV

SEQ ID NO: 120787 - protein, 8 aa, Homo Sapiens
SQYNIRGV

SEQ ID NO: 120788 - protein, 8 aa, Homo Sapiens
SQYPELLV

SEQ ID NO: 120789 - protein, 8 aa, Homo Sapiens
SQYPLEKV

SEQ ID NO: 120790 - protein, 8 aa, Homo Sapiens
SQYQLNSI

SEQ ID NO: 120791 - protein, 8 aa, Homo Sapiens
SQYRALSV

SEQ ID NO: 120792 - protein, 8 aa, Homo Sapiens
SQYYIRAV

SEQ ID NO: 120793 - protein, 8 aa, Homo Sapiens
SSFAHAQV

SEQ ID NO: 120794 - protein, 8 aa, Homo Sapiens
SSFVFSTV

SEQ ID NO: 120795 - protein, 8 aa, Homo Sapiens
SSFVTKSV

SEQ ID NO: 120796 - protein, 8 aa, Homo Sapiens
SSHLVATV

SEQ ID NO: 120797 - protein, 8 aa, Homo Sapiens
SSPEALTV

SEQ ID NO: 120798 - protein, 8 aa, Homo Sapiens
SSPSVLEI

SEQ ID NO: 120799 - protein, 8 aa, Homo Sapiens
SSTPLPTI

SEQ ID NO: 120800 - protein, 8 aa, Homo Sapiens
SSYIVKNI

SEQ ID NO: 120801 - protein, 8 aa, Homo Sapiens
SSYIVSQI

SEQ ID NO: 120802 - protein, 8 aa, Homo Sapiens
SSYPTRLI

SEQ ID NO: 120803 - protein, 8 aa, Homo Sapiens
SSYPTTTI

SEQ ID NO: 120804 - protein, 8 aa, Homo Sapiens
SSYPVALI

SEQ ID NO: 120805 - protein, 8 aa, Homo Sapiens
SSYVVKKV

SEQ ID NO: 120806 - protein, 8 aa, Homo Sapiens
TAPLAPTI

SEQ ID NO: 120807 - protein, 8 aa, Homo Sapiens
TAPLVVVV

SEQ ID NO: 120808 - protein, 8 aa, Homo Sapiens
TAPTASKI

SEQ ID NO: 120809 - protein, 8 aa, Homo Sapiens
TAYVSPTV

SEQ ID NO: 120810 - protein, 8 aa, Homo Sapiens
TAYYALVV

SEQ ID NO: 120811 - protein, 8 aa, Homo Sapiens
TEFIFTTI

SEQ ID NO: 120812 - protein, 8 aa, Homo Sapiens
TEYPVKIV

SEQ ID NO: 120813 - protein, 8 aa, Homo Sapiens
TEYQPRAV

SEQ ID NO: 120814 - protein, 8 aa, Homo Sapiens
TFGKVILV

SEQ ID NO: 120815 - protein, 8 aa, Homo Sapiens
TGFIFQKV

SEQ ID NO: 120816 - protein, 8 aa, Homo Sapiens
TGLTILRI

SEQ ID NO: 120817 - protein, 8 aa, Homo Sapiens
TGTEMRTV

SEQ ID NO: 120818 - protein, 8 aa, Homo Sapiens
TGYTTRNI

SEQ ID NO: 120819 - protein, 8 aa, Homo Sapiens
TIQVLPTV

SEQ ID NO: 120820 - protein, 8 aa, Homo Sapiens
TMFVQRQV

SEQ ID NO: 120821 - protein, 8 aa, Homo Sapiens
TMIKIVLI

SEQ ID NO: 120822 - protein, 8 aa, Homo Sapiens
TMKKLPIV

SEQ ID NO: 120823 - protein, 8 aa, Homo Sapiens
TMLATKTV

SEQ ID NO: 120824 - protein, 8 aa, Homo Sapiens
TMPVTMLI

SEQ ID NO: 120825 - protein, 8 aa, Homo Sapiens
TMPVVPSV

SEQ ID NO: 120826 - protein, 8 aa, Homo Sapiens
TMVETKKV

SEQ ID NO: 120827 - protein, 8 aa, Homo Sapiens
TQFKWIHI

SEQ ID NO: 120828 - protein, 8 aa, Homo Sapiens
TQFLPRTI

SEQ ID NO: 120829 - protein, 8 aa, Homo Sapiens
TQFSHLTV

SEQ ID NO: 120830 - protein, 8 aa, Homo Sapiens
TQFVLSTL

SEQ ID NO: 120831 - protein, 8 aa, Homo Sapiens
TQHTPTSI

SEQ ID NO: 120832 - protein, 8 aa, Homo Sapiens
TQIISKKI

SEQ ID NO: 120833 - protein, 8 aa, Homo Sapiens
TQIQALKV

SEQ ID NO: 120834 - protein, 8 aa, Homo Sapiens
TQIYIKLV

SEQ ID NO: 120835 - protein, 8 aa, Homo Sapiens
TQLAVNKI

SEQ ID NO: 120836 - protein, 8 aa, Homo Sapiens
TQLTTEKI

SEQ ID NO: 120837 - protein, 8 aa, Homo Sapiens
TQMKLMAI

SEQ ID NO: 120838 - protein, 8 aa, Homo Sapiens
TQNVVTKV

SEQ ID NO: 120839 - protein, 8 aa, Homo Sapiens
TQQILPYI

SEQ ID NO: 120840 - protein, 8 aa, Homo Sapiens
TQQKVPTI

SEQ ID NO: 120841 - protein, 8 aa, Homo Sapiens
TQRAFKEV

SEQ ID NO: 120842 - protein, 8 aa, Homo Sapiens
TQRAQPAV

SEQ ID NO: 120843 - protein, 8 aa, Homo Sapiens
TQRISLEI

SEQ ID NO: 120844 - protein, 8 aa, Homo Sapiens
TQRNVEVI

SEQ ID NO: 120845 - protein, 8 aa, Homo Sapiens
TQRSFQKI

SEQ ID NO: 120846 - protein, 8 aa, Homo Sapiens
TQRVISFI

SEQ ID NO: 120847 - protein, 8 aa, Homo Sapiens
TQTLLKEI

SEQ ID NO: 120848 - protein, 8 aa, Homo Sapiens
TQTPSLKV

SEQ ID NO: 120849 - protein, 8 aa, Homo Sapiens
TQTVIHTV

SEQ ID NO: 120850 - protein, 8 aa, Homo Sapiens
TQTVISSI

SEQ ID NO: 120851 - protein, 8 aa, Homo Sapiens
TQVKKPVI

SEQ ID NO: 120852 - protein, 8 aa, Homo Sapiens
TQVLIKLI

SEQ ID NO: 120853 - protein, 8 aa, Homo Sapiens
TQVLLYRI

SEQ ID NO: 120854 - protein, 8 aa, Homo Sapiens
TQVQQMQV

SEQ ID NO: 120855 - protein, 8 aa, Homo Sapiens
TQVQTTLV

SEQ ID NO: 120856 - protein, 8 aa, Homo Sapiens
TQVRIQTV

SEQ ID NO: 120857 - protein, 8 aa, Homo Sapiens
TQVTVQKI

SEQ ID NO: 120858 - protein, 8 aa, Homo Sapiens
TQVVISRI

SEQ ID NO: 120859 - protein, 8 aa, Homo Sapiens
TQVVVSRI

SEQ ID NO: 120860 - protein, 8 aa, Homo Sapiens
TQWITKPV

SEQ ID NO: 120861 - protein, 8 aa, Homo Sapiens
TQWRVRMI

SEQ ID NO: 120862 - protein, 8 aa, Homo Sapiens
TQYGLERI

SEQ ID NO: 120863 - protein, 8 aa, Homo Sapiens
TQYIPLSI

SEQ ID NO: 120864 - protein, 8 aa, Homo Sapiens
TQYRFTII

SEQ ID NO: 120865 - protein, 8 aa, Homo Sapiens
TQYTFSSI

SEQ ID NO: 120866 - protein, 8 aa, Homo Sapiens
TQYTTHHI

SEQ ID NO: 120867 - protein, 8 aa, Homo Sapiens
TSFILRAV

SEQ ID NO: 120868 - protein, 8 aa, Homo Sapiens
TSPEALEI

SEQ ID NO: 120869 - protein, 8 aa, Homo Sapiens
TSPKALVI

SEQ ID NO: 120870 - protein, 8 aa, Homo Sapiens
TSPQASII

SEQ ID NO: 120871 - protein, 8 aa, Homo Sapiens
TSPTVLYV

SEQ ID NO: 120872 - protein, 8 aa, Homo Sapiens
TVGNNKTL

SEQ ID NO: 120873 - protein, 8 aa, Homo Sapiens
VAIPLPGV

SEQ ID NO: 120874 - protein, 8 aa, Homo Sapiens
VEIEQKVV

SEQ ID NO: 120875 - protein, 8 aa, Homo Sapiens
VEIILHVV

SEQ ID NO: 120876 - protein, 8 aa, Homo Sapiens
VEIQTPKI

SEQ ID NO: 120877 - protein, 8 aa, Homo Sapiens
VERVKPRI

SEQ ID NO: 120878 - protein, 8 aa, Homo Sapiens
VEVIKPLV

SEQ ID NO: 120879 - protein, 8 aa, Homo Sapiens
VEYAFKAI

SEQ ID NO: 120880 - protein, 8 aa, Homo Sapiens
VEYITRYI

SEQ ID NO: 120881 - protein, 8 aa, Homo Sapiens
VEYQMKSV

SEQ ID NO: 120882 - protein, 8 aa, Homo Sapiens
VFFMPATV

SEQ ID NO: 120883 - protein, 8 aa, Homo Sapiens
VFIELNHI

SEQ ID NO: 120884 - protein, 8 aa, Homo Sapiens
VFIKAVHV

SEQ ID NO: 120885 - protein, 8 aa, Homo Sapiens
VFIQVHCI

SEQ ID NO: 120886 - protein, 8 aa, Homo Sapiens
VFLEIHNI

SEQ ID NO: 120887 - protein, 8 aa, Homo Sapiens
VFLRVSEV

SEQ ID NO: 120888 - protein, 8 aa, Homo Sapiens
VFLSVPCI

SEQ ID NO: 120889 - protein, 8 aa, Homo Sapiens
VFPKAKQV

SEQ ID NO: 120890 - protein, 8 aa, Homo Sapiens
VFPTIATI

SEQ ID NO: 120891 - protein, 8 aa, Homo Sapiens
VFPVVPRL

SEQ ID NO: 120892 - protein, 8 aa, Homo Sapiens
VGFVLLTV

SEQ ID NO: 120893 - protein, 8 aa, Homo Sapiens
VGILITTI

SEQ ID NO: 120894 - protein, 8 aa, Homo Sapiens
VGTTIAEL

SEQ ID NO: 120895 - protein, 8 aa, Homo Sapiens
VGYILSVV

SEQ ID NO: 120896 - protein, 8 aa, Homo Sapiens
VGYLQPLV

SEQ ID NO: 120897 - protein, 8 aa, Homo Sapiens
VGYRVTQI

SEQ ID NO: 120898 - protein, 8 aa, Homo Sapiens
VGYYIFRV

SEQ ID NO: 120899 - protein, 8 aa, Homo Sapiens
VMAEALGV

SEQ ID NO: 120900 - protein, 8 aa, Homo Sapiens
VMFTPLTV

SEQ ID NO: 120901 - protein, 8 aa, Homo Sapiens
VMKTEPSI

SEQ ID NO: 120902 - protein, 8 aa, Homo Sapiens
VMLHALLI

SEQ ID NO: 120903 - protein, 8 aa, Homo Sapiens
VMLKAIRI

SEQ ID NO: 120904 - protein, 8 aa, Homo Sapiens
VMLVQPRV

SEQ ID NO: 120905 - protein, 8 aa, Homo Sapiens
VMMGILTI

SEQ ID NO: 120906 - protein, 8 aa, Homo Sapiens
VMPEVNKV

SEQ ID NO: 120907 - protein, 8 aa, Homo Sapiens
VMQKTPII

SEQ ID NO: 120908 - protein, 8 aa, Homo Sapiens
VMSILPKI

SEQ ID NO: 120909 - protein, 8 aa, Homo Sapiens
VMTDLPVI

SEQ ID NO: 120910 - protein, 8 aa, Homo Sapiens
VMVISPVI

SEQ ID NO: 120911 - protein, 8 aa, Homo Sapiens
VMYGFKGV

SEQ ID NO: 120912 - protein, 8 aa, Homo Sapiens
VMYRVIQV

SEQ ID NO: 120913 - protein, 8 aa, Homo Sapiens
VPYPLPKI

SEQ ID NO: 120914 - protein, 8 aa, Homo Sapiens
VQATPSKV

SEQ ID NO: 120915 - protein, 8 aa, Homo Sapiens
VQAVIPTI

SEQ ID NO: 120916 - protein, 8 aa, Homo Sapiens
VQDLAKAV

SEQ ID NO: 120917 - protein, 8 aa, Homo Sapiens
VQFASQEI

SEQ ID NO: 120918 - protein, 8 aa, Homo Sapiens
VQFCARKV

SEQ ID NO: 120919 - protein, 8 aa, Homo Sapiens
VQFKLVLV

SEQ ID NO: 120920 - protein, 8 aa, Homo Sapiens
VQFLIYQI

SEQ ID NO: 120921 - protein, 8 aa, Homo Sapiens
VQFQPNTV

SEQ ID NO: 120922 - protein, 8 aa, Homo Sapiens
VQFVFDAV

SEQ ID NO: 120923 - protein, 8 aa, Homo Sapiens
VQIEQLYV

SEQ ID NO: 120924 - protein, 8 aa, Homo Sapiens
VQIKQETI

SEQ ID NO: 120925 - protein, 8 aa, Homo Sapiens
VQIPIMLV

SEQ ID NO: 120926 - protein, 8 aa, Homo Sapiens
VQIPVSAV

SEQ ID NO: 120927 - protein, 8 aa, Homo Sapiens
VQIRIFKI

SEQ ID NO: 120928 - protein, 8 aa, Homo Sapiens
VQIRIKLM

SEQ ID NO: 120929 - protein, 8 aa, Homo Sapiens
VQIRILDV

SEQ ID NO: 120930 - protein, 8 aa, Homo Sapiens
VQIVSKKV

SEQ ID NO: 120931 - protein, 8 aa, Homo Sapiens
VQKAVTAI

SEQ ID NO: 120932 - protein, 8 aa, Homo Sapiens
VQKELQSI

SEQ ID NO: 120933 - protein, 8 aa, Homo Sapiens
VQKKLESI

SEQ ID NO: 120934 - protein, 8 aa, Homo Sapiens
VQKLSRVI

SEQ ID NO: 120935 - protein, 8 aa, Homo Sapiens
VQKLVQKV

SEQ ID NO: 120936 - protein, 8 aa, Homo Sapiens
VQKLVVVI

SEQ ID NO: 120937 - protein, 8 aa, Homo Sapiens
VQKSVRTI

SEQ ID NO: 120938 - protein, 8 aa, Homo Sapiens
VQKVLGSV

SEQ ID NO: 120939 - protein, 8 aa, Homo Sapiens
VQLAVNRV

SEQ ID NO: 120940 - protein, 8 aa, Homo Sapiens
VQLETLSI

SEQ ID NO: 120941 - protein, 8 aa, Homo Sapiens
VQLLIPRI

SEQ ID NO: 120942 - protein, 8 aa, Homo Sapiens
VQLRLNSI

SEQ ID NO: 120943 - protein, 8 aa, Homo Sapiens
VQMALSKV

SEQ ID NO: 120944 - protein, 8 aa, Homo Sapiens
VQMEPKVV

SEQ ID NO: 120945 - protein, 8 aa, Homo Sapiens
VQNAVIKI

SEQ ID NO: 120946 - protein, 8 aa, Homo Sapiens
VQNGIALV

SEQ ID NO: 120947 - protein, 8 aa, Homo Sapiens
VQQVSLVI

SEQ ID NO: 120948 - protein, 8 aa, Homo Sapiens
VQRAVCML

SEQ ID NO: 120949 - protein, 8 aa, Homo Sapiens
VQRCVVRI

SEQ ID NO: 120950 - protein, 8 aa, Homo Sapiens
VQRHLTAV

SEQ ID NO: 120951 - protein, 8 aa, Homo Sapiens
VQRIAERV

SEQ ID NO: 120952 - protein, 8 aa, Homo Sapiens
VQRILPCL

SEQ ID NO: 120953 - protein, 8 aa, Homo Sapiens
VQRKMPCV

SEQ ID NO: 120954 - protein, 8 aa, Homo Sapiens
VQRKVICI

SEQ ID NO: 120955 - protein, 8 aa, Homo Sapiens
VQRLEPVI

SEQ ID NO: 120956 - protein, 8 aa, Homo Sapiens
VQRSFTQV

SEQ ID NO: 120957 - protein, 8 aa, Homo Sapiens
VQRVASVM

SEQ ID NO: 120958 - protein, 8 aa, Homo Sapiens
VQRVQNEV

SEQ ID NO: 120959 - protein, 8 aa, Homo Sapiens
VQSLKRKI

SEQ ID NO: 120960 - protein, 8 aa, Homo Sapiens
VQSQLRHI

SEQ ID NO: 120961 - protein, 8 aa, Homo Sapiens
VQSQPPRV

SEQ ID NO: 120962 - protein, 8 aa, Homo Sapiens
VQTCINLI

SEQ ID NO: 120963 - protein, 8 aa, Homo Sapiens
VQTCLKRI

SEQ ID NO: 120964 - protein, 8 aa, Homo Sapiens
VQTVLPLV

SEQ ID NO: 120965 - protein, 8 aa, Homo Sapiens
VQVALSRV

SEQ ID NO: 120966 - protein, 8 aa, Homo Sapiens
VQVAVAHV

SEQ ID NO: 120967 - protein, 8 aa, Homo Sapiens
VQVEQSKV

SEQ ID NO: 120968 - protein, 8 aa, Homo Sapiens
VQVEVITI

SEQ ID NO: 120969 - protein, 8 aa, Homo Sapiens
VQVLIEHI

SEQ ID NO: 120970 - protein, 8 aa, Homo Sapiens
VQVSTSNI

SEQ ID NO: 120971 - protein, 8 aa, Homo Sapiens
VQYEINLL

SEQ ID NO: 120972 - protein, 8 aa, Homo Sapiens
VQYFLHVV

SEQ ID NO: 120973 - protein, 8 aa, Homo Sapiens
VQYKATSL

SEQ ID NO: 120974 - protein, 8 aa, Homo Sapiens
VQYKFSHL

SEQ ID NO: 120975 - protein, 8 aa, Homo Sapiens
VQYLVKEV

SEQ ID NO: 120976 - protein, 8 aa, Homo Sapiens
VQYPPKKV

SEQ ID NO: 120977 - protein, 8 aa, Homo Sapiens
VQYQAPQL

SEQ ID NO: 120978 - protein, 8 aa, Homo Sapiens
VSKILPRV

SEQ ID NO: 120979 - protein, 8 aa, Homo Sapiens
VSPRVLEV

SEQ ID NO: 120980 - protein, 8 aa, Homo Sapiens
VSTYIKKI

SEQ ID NO: 120981 - protein, 8 aa, Homo Sapiens
VSYKPQKI

SEQ ID NO: 120982 - protein, 8 aa, Homo Sapiens
VSYLFSHV

SEQ ID NO: 120983 - protein, 8 aa, Homo Sapiens
YAPAAATV

SEQ ID NO: 120984 - protein, 8 aa, Homo Sapiens
YAYRHPLI

SEQ ID NO: 120985 - protein, 8 aa, Homo Sapiens
YDYILPQV

SEQ ID NO: 120986 - protein, 8 aa, Homo Sapiens
YEILLHEV

SEQ ID NO: 120987 - protein, 8 aa, Homo Sapiens
YEKQLAQI

SEQ ID NO: 120988 - protein, 8 aa, Homo Sapiens
YEYQPLQI

SEQ ID NO: 120989 - protein, 8 aa, Homo Sapiens
YEYVYRCI

SEQ ID NO: 120990 - protein, 8 aa, Homo Sapiens
YFPVVKLV

SEQ ID NO: 120991 - protein, 8 aa, Homo Sapiens
YGHKLPVI

SEQ ID NO: 120992 - protein, 8 aa, Homo Sapiens
YMFATKVV

SEQ ID NO: 120993 - protein, 8 aa, Homo Sapiens
YMLKANLI

SEQ ID NO: 120994 - protein, 8 aa, Homo Sapiens
YQFRLIVI

SEQ ID NO: 120995 - protein, 8 aa, Homo Sapiens
YQFRMEEI

SEQ ID NO: 120996 - protein, 8 aa, Homo Sapiens
YQGPVLLI

SEQ ID NO: 120997 - protein, 8 aa, Homo Sapiens
YQHKFPEV

SEQ ID NO: 120998 - protein, 8 aa, Homo Sapiens
YQIAVTKV

SEQ ID NO: 120999 - protein, 8 aa, Homo Sapiens
YQIHLKSV

SEQ ID NO: 121000 - protein, 8 aa, Homo Sapiens
YQIIMTMI

SEQ ID NO: 121001 - protein, 8 aa, Homo Sapiens
YQIRLESV

SEQ ID NO: 121002 - protein, 8 aa, Homo Sapiens
YQLPLSKI

SEQ ID NO: 121003 - protein, 8 aa, Homo Sapiens
YQNKCRLI

SEQ ID NO: 121004 - protein, 8 aa, Homo Sapiens
YQQALSRV

SEQ ID NO: 121005 - protein, 8 aa, Homo Sapiens
YQRAPRNI

SEQ ID NO: 121006 - protein, 8 aa, Homo Sapiens
YQRETPQV

SEQ ID NO: 121007 - protein, 8 aa, Homo Sapiens
YQRLLHEV

SEQ ID NO: 121008 - protein, 8 aa, Homo Sapiens
YQTELTFI

SEQ ID NO: 121009 - protein, 8 aa, Homo Sapiens
YQTKAVII

SEQ ID NO: 121010 - protein, 8 aa, Homo Sapiens
YQTSPPKV

SEQ ID NO: 121011 - protein, 8 aa, Homo Sapiens
YQYGFNLV

SEQ ID NO: 121012 - protein, 8 aa, Homo Sapiens
YQYMHETI

SEQ ID NO: 121013 - protein, 8 aa, Homo Sapiens
YSFSFHVV

SEQ ID NO: 121014 - protein, 8 aa, Homo Sapiens
YSHIMALI

SEQ ID NO: 121015 - protein, 8 aa, Homo Sapiens
YSIVIRQI

SEQ ID NO: 121016 - protein, 8 aa, Homo Sapiens
YSKMLAKV

SEQ ID NO: 121017 - protein, 8 aa, Homo Sapiens
YSSEQLLI

SEQ ID NO: 121018 - protein, 9 aa, Homo Sapiens
AAAPPAKEI

SEQ ID NO: 121019 - protein, 9 aa, Homo Sapiens
AAKDPSPSV

SEQ ID NO: 121020 - protein, 9 aa, Homo Sapiens
AAPAYSRAL

SEQ ID NO: 121021 - protein, 9 aa, Homo Sapiens
AFIKRTPVI

SEQ ID NO: 121022 - protein, 9 aa, Homo Sapiens
AFYKAQPVI

SEQ ID NO: 121023 - protein, 9 aa, Homo Sapiens
ALYEQSLHI

SEQ ID NO: 121024 - protein, 9 aa, Homo Sapiens
AMAASPHAV

SEQ ID NO: 121025 - protein, 9 aa, Homo Sapiens
AMAKPQVVV

SEQ ID NO: 121026 - protein, 9 aa, Homo Sapiens
AMAPGTVTV

SEQ ID NO: 121027 - protein, 9 aa, Homo Sapiens
AMAPTSPQI

SEQ ID NO: 121028 - protein, 9 aa, Homo Sapiens
AMAPVTTRI

SEQ ID NO: 121029 - protein, 9 aa, Homo Sapiens
AMFGKLMTI

SEQ ID NO: 121030 - protein, 9 aa, Homo Sapiens
AMFRPFVEV

SEQ ID NO: 121031 - protein, 9 aa, Homo Sapiens
AMIERITFI

SEQ ID NO: 121032 - protein, 9 aa, Homo Sapiens
AMINRFQFV

SEQ ID NO: 121033 - protein, 9 aa, Homo Sapiens
AMLAVLHTV

SEQ ID NO: 121034 - protein, 9 aa, Homo Sapiens
AMLERQFTV

SEQ ID NO: 121035 - protein, 9 aa, Homo Sapiens
AMNSQILEV

SEQ ID NO: 121036 - protein, 9 aa, Homo Sapiens
AMYEHKIFV

SEQ ID NO: 121037 - protein, 9 aa, Homo Sapiens
AMYFIQQKV

SEQ ID NO: 121038 - protein, 9 aa, Homo Sapiens
AMYKKSLHI

SEQ ID NO: 121039 - protein, 9 aa, Homo Sapiens
AQALAKLTI

SEQ ID NO: 121040 - protein, 9 aa, Homo Sapiens
AQFEHTLLV

SEQ ID NO: 121041 - protein, 9 aa, Homo Sapiens
AQFGYYFRV

SEQ ID NO: 121042 - protein, 9 aa, Homo Sapiens
AQFPESFTV

SEQ ID NO: 121043 - protein, 9 aa, Homo Sapiens
AQFRFYRHV

SEQ ID NO: 121044 - protein, 9 aa, Homo Sapiens
AQHCFIKSI

SEQ ID NO: 121045 - protein, 9 aa, Homo Sapiens
AQHIVPCTI

SEQ ID NO: 121046 - protein, 9 aa, Homo Sapiens
AQHKFLVAV

SEQ ID NO: 121047 - protein, 9 aa, Homo Sapiens
AQHMNISTV

SEQ ID NO: 121048 - protein, 9 aa, Homo Sapiens
AQHPNIVTV

SEQ ID NO: 121049 - protein, 9 aa, Homo Sapiens
AQILQILTV

SEQ ID NO: 121050 - protein, 9 aa, Homo Sapiens
AQILRLLHI

SEQ ID NO: 121051 - protein, 9 aa, Homo Sapiens
AQIRYLTQV

SEQ ID NO: 121052 - protein, 9 aa, Homo Sapiens
AQKISVRTV

SEQ ID NO: 121053 - protein, 9 aa, Homo Sapiens
AQKSPAPKV

SEQ ID NO: 121054 - protein, 9 aa, Homo Sapiens
AQLELISRI

SEQ ID NO: 121055 - protein, 9 aa, Homo Sapiens
AQLLNMPVV

SEQ ID NO: 121056 - protein, 9 aa, Homo Sapiens
AQLLVACKV

SEQ ID NO: 121057 - protein, 9 aa, Homo Sapiens
AQNARALKI

SEQ ID NO: 121058 - protein, 9 aa, Homo Sapiens
AQNLIGISI

SEQ ID NO: 121059 - protein, 9 aa, Homo Sapiens
AQQEIKATV

SEQ ID NO: 121060 - protein, 9 aa, Homo Sapiens
AQRAFILTV

SEQ ID NO: 121061 - protein, 9 aa, Homo Sapiens
AQRAVELFI

SEQ ID NO: 121062 - protein, 9 aa, Homo Sapiens
AQRFILRHV

SEQ ID NO: 121063 - protein, 9 aa, Homo Sapiens
AQRIMTLSV

SEQ ID NO: 121064 - protein, 9 aa, Homo Sapiens
AQRSFRVSI

SEQ ID NO: 121065 - protein, 9 aa, Homo Sapiens
AQRVQENMI

SEQ ID NO: 121066 - protein, 9 aa, Homo Sapiens
AQVALVNEV

SEQ ID NO: 121067 - protein, 9 aa, Homo Sapiens
AQVPMNMTI

SEQ ID NO: 121068 - protein, 9 aa, Homo Sapiens
AQYAQRASV

SEQ ID NO: 121069 - protein, 9 aa, Homo Sapiens
AQYDGAYKV

SEQ ID NO: 121070 - protein, 9 aa, Homo Sapiens
AQYEHDLEV

SEQ ID NO: 121071 - protein, 9 aa, Homo Sapiens
AQYENPPHI

SEQ ID NO: 121072 - protein, 9 aa, Homo Sapiens
AQYGKKVMV

SEQ ID NO: 121073 - protein, 9 aa, Homo Sapiens
AQYHLMLHI

SEQ ID NO: 121074 - protein, 9 aa, Homo Sapiens
AQYKFVYQV

SEQ ID NO: 121075 - protein, 9 aa, Homo Sapiens
AQYLINARL

SEQ ID NO: 121076 - protein, 9 aa, Homo Sapiens
AQYLINVRL

SEQ ID NO: 121077 - protein, 9 aa, Homo Sapiens
AQYLLQNSV

SEQ ID NO: 121078 - protein, 9 aa, Homo Sapiens
AQYPKGRSV

SEQ ID NO: 121079 - protein, 9 aa, Homo Sapiens
AQYRLVTEI

SEQ ID NO: 121080 - protein, 9 aa, Homo Sapiens
ARLGVISKV

SEQ ID NO: 121081 - protein, 9 aa, Homo Sapiens
ASYRAQPSV

SEQ ID NO: 121082 - protein, 9 aa, Homo Sapiens
ASYVNLPTI

SEQ ID NO: 121083 - protein, 9 aa, Homo Sapiens
ATYVFLHTV

SEQ ID NO: 121084 - protein, 9 aa, Homo Sapiens
AVRVPAPSI

SEQ ID NO: 121085 - protein, 9 aa, Homo Sapiens
CSYVVTRTI

SEQ ID NO: 121086 - protein, 9 aa, Homo Sapiens
DQYPYLKSV

SEQ ID NO: 121087 - protein, 9 aa, Homo Sapiens
ELGAQLLEL

SEQ ID NO: 121088 - protein, 9 aa, Homo Sapiens
EMEKNVRLL

SEQ ID NO: 121089 - protein, 9 aa, Homo Sapiens
EMLKTIKTV

SEQ ID NO: 121090 - protein, 9 aa, Homo Sapiens
EMYNRPVEV

SEQ ID NO: 121091 - protein, 9 aa, Homo Sapiens
EQFKFKNMV

SEQ ID NO: 121092 - protein, 9 aa, Homo Sapiens
EQIELHNSI

SEQ ID NO: 121093 - protein, 9 aa, Homo Sapiens
EQRLFTEKV

SEQ ID NO: 121094 - protein, 9 aa, Homo Sapiens
EQYAAKVSI

SEQ ID NO: 121095 - protein, 9 aa, Homo Sapiens
EQYGKIEVI

SEQ ID NO: 121096 - protein, 9 aa, Homo Sapiens
EQYKFPVVI

SEQ ID NO: 121097 - protein, 9 aa, Homo Sapiens
EQYLFLVRV

SEQ ID NO: 121098 - protein, 9 aa, Homo Sapiens
EQYPTRPHI

SEQ ID NO: 121099 - protein, 9 aa, Homo Sapiens
EQYRQVISV

SEQ ID NO: 121100 - protein, 9 aa, Homo Sapiens
ERLKIRGSL

SEQ ID NO: 121101 - protein, 9 aa, Homo Sapiens
ESFTFRNHV

SEQ ID NO: 121102 - protein, 9 aa, Homo Sapiens
ESRQFPVTV

SEQ ID NO: 121103 - protein, 9 aa, Homo Sapiens
FALYPINIS

SEQ ID NO: 121104 - protein, 9 aa, Homo Sapiens
FEFEYQTKV

SEQ ID NO: 121105 - protein, 9 aa, Homo Sapiens
FEWENKVTV

SEQ ID NO: 121106 - protein, 9 aa, Homo Sapiens
FPYAFKEVI

SEQ ID NO: 121107 - protein, 9 aa, Homo Sapiens
FQKAIQETV

SEQ ID NO: 121108 - protein, 9 aa, Homo Sapiens
FQNTFPHSI

SEQ ID NO: 121109 - protein, 9 aa, Homo Sapiens
FQRTNALTV

SEQ ID NO: 121110 - protein, 9 aa, Homo Sapiens
FRVPTANVS

SEQ ID NO: 121111 - protein, 9 aa, Homo Sapiens
FSYAFPKAV

SEQ ID NO: 121112 - protein, 9 aa, Homo Sapiens
GFYPGQVLI

SEQ ID NO: 121113 - protein, 9 aa, Homo Sapiens
GFYPGSIEV

SEQ ID NO: 121114 - protein, 9 aa, Homo Sapiens
GGLYAKLVQ

SEQ ID NO: 121115 - protein, 9 aa, Homo Sapiens
GLMRKVPRV

SEQ ID NO: 121116 - protein, 9 aa, Homo Sapiens
GLQYIFAHV

SEQ ID NO: 121117 - protein, 9 aa, Homo Sapiens
GLYSRQLYV

SEQ ID NO: 121118 - protein, 9 aa, Homo Sapiens
GMDPITRQV

SEQ ID NO: 121119 - protein, 9 aa, Homo Sapiens
GMMPPQPGI

SEQ ID NO: 121120 - protein, 9 aa, Homo Sapiens
GMRDCINTI

SEQ ID NO: 121121 - protein, 9 aa, Homo Sapiens
GMYDGSALI

SEQ ID NO: 121122 - protein, 9 aa, Homo Sapiens
GMYIFLHTV

SEQ ID NO: 121123 - protein, 9 aa, Homo Sapiens
GMYLISKYI

SEQ ID NO: 121124 - protein, 9 aa, Homo Sapiens
GMYPNLVHV

SEQ ID NO: 121125 - protein, 9 aa, Homo Sapiens
GMYVFLHAV

SEQ ID NO: 121126 - protein, 9 aa, Homo Sapiens
GNQIETPSI

SEQ ID NO: 121127 - protein, 9 aa, Homo Sapiens
GQDDKIRVV

SEQ ID NO: 121128 - protein, 9 aa, Homo Sapiens
GQDMFRETI

SEQ ID NO: 121129 - protein, 9 aa, Homo Sapiens
GQFNFVHVI

SEQ ID NO: 121130 - protein, 9 aa, Homo Sapiens
GQFPFYDSI

SEQ ID NO: 121131 - protein, 9 aa, Homo Sapiens
GQHAFYQLI

SEQ ID NO: 121132 - protein, 9 aa, Homo Sapiens
GQHCFIREV

SEQ ID NO: 121133 - protein, 9 aa, Homo Sapiens
GQKEGEPRI

SEQ ID NO: 121134 - protein, 9 aa, Homo Sapiens
GQKHFGATV

SEQ ID NO: 121135 - protein, 9 aa, Homo Sapiens
GQLLVKPTI

SEQ ID NO: 121136 - protein, 9 aa, Homo Sapiens
GQQIQIQTV

SEQ ID NO: 121137 - protein, 9 aa, Homo Sapiens
GQRIQNVNV

SEQ ID NO: 121138 - protein, 9 aa, Homo Sapiens
GQSPPLPRI

SEQ ID NO: 121139 - protein, 9 aa, Homo Sapiens
GQTIIHHHI

SEQ ID NO: 121140 - protein, 9 aa, Homo Sapiens
GQYYAIKKI

SEQ ID NO: 121141 - protein, 9 aa, Homo Sapiens
GSRLYAHTI

SEQ ID NO: 121142 - protein, 9 aa, Homo Sapiens
GSYVFENTV

SEQ ID NO: 121143 - protein, 9 aa, Homo Sapiens
GTQYTFSSI

SEQ ID NO: 121144 - protein, 9 aa, Homo Sapiens
HACGVIATI

SEQ ID NO: 121145 - protein, 9 aa, Homo Sapiens
HAHPFFFTI

SEQ ID NO: 121146 - protein, 9 aa, Homo Sapiens
HAPEIVSTV

SEQ ID NO: 121147 - protein, 9 aa, Homo Sapiens
HGHLYVNKV

SEQ ID NO: 121148 - protein, 9 aa, Homo Sapiens
HGYEKYNTI

SEQ ID NO: 121149 - protein, 9 aa, Homo Sapiens
HMAKAFKEV

SEQ ID NO: 121150 - protein, 9 aa, Homo Sapiens
HMHIHISTV

SEQ ID NO: 121151 - protein, 9 aa, Homo Sapiens
HQALHSISV

SEQ ID NO: 121152 - protein, 9 aa, Homo Sapiens
HQAQLISKI

SEQ ID NO: 121153 - protein, 9 aa, Homo Sapiens
HQATFRLNV

SEQ ID NO: 121154 - protein, 9 aa, Homo Sapiens
HQFIQEENI

SEQ ID NO: 121155 - protein, 9 aa, Homo Sapiens
HQFQLDITV

SEQ ID NO: 121156 - protein, 9 aa, Homo Sapiens
HQHEEIQNV

SEQ ID NO: 121157 - protein, 9 aa, Homo Sapiens
HQHEYFFLI

SEQ ID NO: 121158 - protein, 9 aa, Homo Sapiens
HQIFHVLVV

SEQ ID NO: 121159 - protein, 9 aa, Homo Sapiens
HQIIMPSAI

SEQ ID NO: 121160 - protein, 9 aa, Homo Sapiens
HQIMHLLSV

SEQ ID NO: 121161 - protein, 9 aa, Homo Sapiens
HQIQNVVTV

SEQ ID NO: 121162 - protein, 9 aa, Homo Sapiens
HQKGGIPNV

SEQ ID NO: 121163 - protein, 9 aa, Homo Sapiens
HQKVLNVSI

SEQ ID NO: 121164 - protein, 9 aa, Homo Sapiens
HQLFHIFVV

SEQ ID NO: 121165 - protein, 9 aa, Homo Sapiens
HQLNICSKV

SEQ ID NO: 121166 - protein, 9 aa, Homo Sapiens
HQLPLPHNV

SEQ ID NO: 121167 - protein, 9 aa, Homo Sapiens
HQLRFTCRV

SEQ ID NO: 121168 - protein, 9 aa, Homo Sapiens
HQLSQHVTV

SEQ ID NO: 121169 - protein, 9 aa, Homo Sapiens
HQMEFPCNI

SEQ ID NO: 121170 - protein, 9 aa, Homo Sapiens
HQMETHYRV

SEQ ID NO: 121171 - protein, 9 aa, Homo Sapiens
HQMQLVDSI

SEQ ID NO: 121172 - protein, 9 aa, Homo Sapiens
HQNDKQISI

SEQ ID NO: 121173 - protein, 9 aa, Homo Sapiens
HQNGSMAAV

SEQ ID NO: 121174 - protein, 9 aa, Homo Sapiens
HQNKILSSV

SEQ ID NO: 121175 - protein, 9 aa, Homo Sapiens
HQNQAKLVV

SEQ ID NO: 121176 - protein, 9 aa, Homo Sapiens
HQNVFPNHI

SEQ ID NO: 121177 - protein, 9 aa, Homo Sapiens
HQNVNVKNI

SEQ ID NO: 121178 - protein, 9 aa, Homo Sapiens
HQQQVAQAV

SEQ ID NO: 121179 - protein, 9 aa, Homo Sapiens
HQQTFLNQL

SEQ ID NO: 121180 - protein, 9 aa, Homo Sapiens
HQRLEPATL

SEQ ID NO: 121181 - protein, 9 aa, Homo Sapiens
HQRQVYLQI

SEQ ID NO: 121182 - protein, 9 aa, Homo Sapiens
HQRSFDIGI

SEQ ID NO: 121183 - protein, 9 aa, Homo Sapiens
HQRSFTETM

SEQ ID NO: 121184 - protein, 9 aa, Homo Sapiens
HQRTFVLEV

SEQ ID NO: 121185 - protein, 9 aa, Homo Sapiens
HQRVLYIDI

SEQ ID NO: 121186 - protein, 9 aa, Homo Sapiens
HQTIVMQFI

SEQ ID NO: 121187 - protein, 9 aa, Homo Sapiens
HQTPLHLAV

SEQ ID NO: 121188 - protein, 9 aa, Homo Sapiens
HQVMINQFV

SEQ ID NO: 121189 - protein, 9 aa, Homo Sapiens
HQVPAVSSV

SEQ ID NO: 121190 - protein, 9 aa, Homo Sapiens
HQVPQANTI

SEQ ID NO: 121191 - protein, 9 aa, Homo Sapiens
HQYDGLVEL

SEQ ID NO: 121192 - protein, 9 aa, Homo Sapiens
HQYFHICFV

SEQ ID NO: 121193 - protein, 9 aa, Homo Sapiens
HQYIFSHIL

SEQ ID NO: 121194 - protein, 9 aa, Homo Sapiens
HQYITKMTA

SEQ ID NO: 121195 - protein, 9 aa, Homo Sapiens
HQYKVRAYI

SEQ ID NO: 121196 - protein, 9 aa, Homo Sapiens
HQYPNFKDI

SEQ ID NO: 121197 - protein, 9 aa, Homo Sapiens
HQYVVGDTI

SEQ ID NO: 121198 - protein, 9 aa, Homo Sapiens
HSFIFFNKV

SEQ ID NO: 121199 - protein, 9 aa, Homo Sapiens
HSHLLYSTI

SEQ ID NO: 121200 - protein, 9 aa, Homo Sapiens
HSLQMLHTI

SEQ ID NO: 121201 - protein, 9 aa, Homo Sapiens
HSNEVIMTI

SEQ ID NO: 121202 - protein, 9 aa, Homo Sapiens
HSQLMRLMV

SEQ ID NO: 121203 - protein, 9 aa, Homo Sapiens
HSRCSVASI

SEQ ID NO: 121204 - protein, 9 aa, Homo Sapiens
HSRFIFNYV

SEQ ID NO: 121205 - protein, 9 aa, Homo Sapiens
HSYLQENKI

SEQ ID NO: 121206 - protein, 9 aa, Homo Sapiens
HSYLSKEEI

SEQ ID NO: 121207 - protein, 9 aa, Homo Sapiens
HSYVIGFVV

SEQ ID NO: 121208 - protein, 9 aa, Homo Sapiens
HVYELLNTI

SEQ ID NO: 121209 - protein, 9 aa, Homo Sapiens
IAYKFGKTV

SEQ ID NO: 121210 - protein, 9 aa, Homo Sapiens
IGYKIKTLI

SEQ ID NO: 121211 - protein, 9 aa, Homo Sapiens
IQDEIRSVI

SEQ ID NO: 121212 - protein, 9 aa, Homo Sapiens
IQHVFQNLI

SEQ ID NO: 121213 - protein, 9 aa, Homo Sapiens
IQKLFSERI

SEQ ID NO: 121214 - protein, 9 aa, Homo Sapiens
IQKLHIRTV

SEQ ID NO: 121215 - protein, 9 aa, Homo Sapiens
IQKRFGLNI

SEQ ID NO: 121216 - protein, 9 aa, Homo Sapiens
IQLGITHTV

SEQ ID NO: 121217 - protein, 9 aa, Homo Sapiens
IQRGPVRGI

SEQ ID NO: 121218 - protein, 9 aa, Homo Sapiens
IQRIFLITL

SEQ ID NO: 121219 - protein, 9 aa, Homo Sapiens
IQYDRTLLV

SEQ ID NO: 121220 - protein, 9 aa, Homo Sapiens
IQYIRPVFV

SEQ ID NO: 121221 - protein, 9 aa, Homo Sapiens
IQYLSKIKI

SEQ ID NO: 121222 - protein, 9 aa, Homo Sapiens
IQYQAVPQI

SEQ ID NO: 121223 - protein, 9 aa, Homo Sapiens
KDVDGAYMT

SEQ ID NO: 121224 - protein, 9 aa, Homo Sapiens
KFFEMVNTI

SEQ ID NO: 121225 - protein, 9 aa, Homo Sapiens
KFYESIMKI

SEQ ID NO: 121226 - protein, 9 aa, Homo Sapiens
KIYEGQVEV

SEQ ID NO: 121227 - protein, 9 aa, Homo Sapiens
KLLEQALVI

SEQ ID NO: 121228 - protein, 9 aa, Homo Sapiens
KLYEQHHVV

SEQ ID NO: 121229 - protein, 9 aa, Homo Sapiens
KLYGKPIRV

SEQ ID NO: 121230 - protein, 9 aa, Homo Sapiens
KMAPALRKV

SEQ ID NO: 121231 - protein, 9 aa, Homo Sapiens
KMAPPPKEV

SEQ ID NO: 121232 - protein, 9 aa, Homo Sapiens
KMFEVDMKI

SEQ ID NO: 121233 - protein, 9 aa, Homo Sapiens
KMMDVTVTI

SEQ ID NO: 121234 - protein, 9 aa, Homo Sapiens
KMYGKIIRV

SEQ ID NO: 121235 - protein, 9 aa, Homo Sapiens
KQFHHQLRV

SEQ ID NO: 121236 - protein, 9 aa, Homo Sapiens
KQFLVKVLI

SEQ ID NO: 121237 - protein, 9 aa, Homo Sapiens
KQIDQFLVV

SEQ ID NO: 121238 - protein, 9 aa, Homo Sapiens
KQRLTPKLF

SEQ ID NO: 121239 - protein, 9 aa, Homo Sapiens
KQYDKALEI

SEQ ID NO: 121240 - protein, 9 aa, Homo Sapiens
KQYQAGQTV

SEQ ID NO: 121241 - protein, 9 aa, Homo Sapiens
KQYQIVERI

SEQ ID NO: 121242 - protein, 9 aa, Homo Sapiens
LEHPFVSSI

SEQ ID NO: 121243 - protein, 9 aa, Homo Sapiens
LLYGHTVTV

SEQ ID NO: 121244 - protein, 9 aa, Homo Sapiens
LMAPAPSTV

SEQ ID NO: 121245 - protein, 9 aa, Homo Sapiens
LMKDCEAEV

SEQ ID NO: 121246 - protein, 9 aa, Homo Sapiens
LMNAVVQTV

SEQ ID NO: 121247 - protein, 9 aa, Homo Sapiens
LPHVFVNCV

SEQ ID NO: 121248 - protein, 9 aa, Homo Sapiens
LPYLVSNVI

SEQ ID NO: 121249 - protein, 9 aa, Homo Sapiens
LQFDGIHVV

SEQ ID NO: 121250 - protein, 9 aa, Homo Sapiens
LQSEKTITL

SEQ ID NO: 121251 - protein, 9 aa, Homo Sapiens
LSFPFHESI

SEQ ID NO: 121252 - protein, 9 aa, Homo Sapiens
LSRLSVNSV

SEQ ID NO: 121253 - protein, 9 aa, Homo Sapiens
LSYDGRLVI

SEQ ID NO: 121254 - protein, 9 aa, Homo Sapiens
MLFGHPLLV

SEQ ID NO: 121255 - protein, 9 aa, Homo Sapiens
MMLLRPLLV

SEQ ID NO: 121256 - protein, 9 aa, Homo Sapiens
MMPAVFHTV

SEQ ID NO: 121257 - protein, 9 aa, Homo Sapiens
MMPPPVGMV

SEQ ID NO: 121258 - protein, 9 aa, Homo Sapiens
MMQQPARSV

SEQ ID NO: 121259 - protein, 9 aa, Homo Sapiens
MMYQTGMKI

SEQ ID NO: 121260 - protein, 9 aa, Homo Sapiens
MQIFVKTLT

SEQ ID NO: 121261 - protein, 9 aa, Homo Sapiens
MQKAPMTTV

SEQ ID NO: 121262 - protein, 9 aa, Homo Sapiens
MQNPRQYKI

SEQ ID NO: 121263 - protein, 9 aa, Homo Sapiens
MQYLPQHTI

SEQ ID NO: 121264 - protein, 9 aa, Homo Sapiens
MQYPISINV

SEQ ID NO: 121265 - protein, 9 aa, Homo Sapiens
MQYQVLNEV

SEQ ID NO: 121266 - protein, 9 aa, Homo Sapiens
MSLMIRQTI

SEQ ID NO: 121267 - protein, 9 aa, Homo Sapiens
NAALQAAEL

SEQ ID NO: 121268 - protein, 9 aa, Homo Sapiens
NEYVFRETV

SEQ ID NO: 121269 - protein, 9 aa, Homo Sapiens
NGQICLPII

SEQ ID NO: 121270 - protein, 9 aa, Homo Sapiens
NMYGKVVTV

SEQ ID NO: 121271 - protein, 9 aa, Homo Sapiens
NNCLEILRV

SEQ ID NO: 121272 - protein, 9 aa, Homo Sapiens
NQFPGFKEV

SEQ ID NO: 121273 - protein, 9 aa, Homo Sapiens
NQIQMKETV

SEQ ID NO: 121274 - protein, 9 aa, Homo Sapiens
NQLKNTNTI

SEQ ID NO: 121275 - protein, 9 aa, Homo Sapiens
NQRVLVTSV

SEQ ID NO: 121276 - protein, 9 aa, Homo Sapiens
NQRVLWWSI

SEQ ID NO: 121277 - protein, 9 aa, Homo Sapiens
NQTIFEQTI

SEQ ID NO: 121278 - protein, 9 aa, Homo Sapiens
NQVAVNTTI

SEQ ID NO: 121279 - protein, 9 aa, Homo Sapiens
NQYRLIVNV

SEQ ID NO: 121280 - protein, 9 aa, Homo Sapiens
NSRAFTNLV

SEQ ID NO: 121281 - protein, 9 aa, Homo Sapiens
NSYPVTMSI

SEQ ID NO: 121282 - protein, 9 aa, Homo Sapiens
QMKKVVKTV

SEQ ID NO: 121283 - protein, 9 aa, Homo Sapiens
QMLAVVETI

SEQ ID NO: 121284 - protein, 9 aa, Homo Sapiens
QMLEETRQV

SEQ ID NO: 121285 - protein, 9 aa, Homo Sapiens
QMLENQMEV

SEQ ID NO: 121286 - protein, 9 aa, Homo Sapiens
QMLESKRNV

SEQ ID NO: 121287 - protein, 9 aa, Homo Sapiens
QMLTRILVI

SEQ ID NO: 121288 - protein, 9 aa, Homo Sapiens
QMPETTETV

SEQ ID NO: 121289 - protein, 9 aa, Homo Sapiens
QMYQLFSRV

SEQ ID NO: 121290 - protein, 9 aa, Homo Sapiens
QMYRTEIRM

SEQ ID NO: 121291 - protein, 9 aa, Homo Sapiens
QQALMRSTV

SEQ ID NO: 121292 - protein, 9 aa, Homo Sapiens
QQAQPQQTV

SEQ ID NO: 121293 - protein, 9 aa, Homo Sapiens
QQFQYAVRV

SEQ ID NO: 121294 - protein, 9 aa, Homo Sapiens
QQHAQFPII

SEQ ID NO: 121295 - protein, 9 aa, Homo Sapiens
QQHLYRVNI

SEQ ID NO: 121296 - protein, 9 aa, Homo Sapiens
QQHVIETLI

SEQ ID NO: 121297 - protein, 9 aa, Homo Sapiens
QQIAFKNLV

SEQ ID NO: 121298 - protein, 9 aa, Homo Sapiens
QQIQKQLLI

SEQ ID NO: 121299 - protein, 9 aa, Homo Sapiens
QQISFVNSI

SEQ ID NO: 121300 - protein, 9 aa, Homo Sapiens
QQKVLHETI

SEQ ID NO: 121301 - protein, 9 aa, Homo Sapiens
QQKVVITKV

SEQ ID NO: 121302 - protein, 9 aa, Homo Sapiens
QQLCIFWKV

SEQ ID NO: 121303 - protein, 9 aa, Homo Sapiens
QQLEFLNEI

SEQ ID NO: 121304 - protein, 9 aa, Homo Sapiens
QQLEIVCLI

SEQ ID NO: 121305 - protein, 9 aa, Homo Sapiens
QQLQIIHRV

SEQ ID NO: 121306 - protein, 9 aa, Homo Sapiens
QQMENRPSV

SEQ ID NO: 121307 - protein, 9 aa, Homo Sapiens
QQRAIIPCI

SEQ ID NO: 121308 - protein, 9 aa, Homo Sapiens
QQRAQTLRV

SEQ ID NO: 121309 - protein, 9 aa, Homo Sapiens
QQRLIREQI

SEQ ID NO: 121310 - protein, 9 aa, Homo Sapiens
QQRLVVVSV

SEQ ID NO: 121311 - protein, 9 aa, Homo Sapiens
QQVIQHNTI

SEQ ID NO: 121312 - protein, 9 aa, Homo Sapiens
QQVQRLPFL

SEQ ID NO: 121313 - protein, 9 aa, Homo Sapiens
QQYECVAEI

SEQ ID NO: 121314 - protein, 9 aa, Homo Sapiens
QQYQWLEKV

SEQ ID NO: 121315 - protein, 9 aa, Homo Sapiens
QQYVFINQM

SEQ ID NO: 121316 - protein, 9 aa, Homo Sapiens
QSHTFISSV

SEQ ID NO: 121317 - protein, 9 aa, Homo Sapiens
QSYIFPSSI

SEQ ID NO: 121318 - protein, 9 aa, Homo Sapiens
RAIGIITHI

SEQ ID NO: 121319 - protein, 9 aa, Homo Sapiens
RAYLFAHAV

SEQ ID NO: 121320 - protein, 9 aa, Homo Sapiens
RAYQKQPTI

SEQ ID NO: 121321 - protein, 9 aa, Homo Sapiens
REYPNLVTI

SEQ ID NO: 121322 - protein, 9 aa, Homo Sapiens
RFFEVRRVV

SEQ ID NO: 121323 - protein, 9 aa, Homo Sapiens
RGFSKPISI

SEQ ID NO: 121324 - protein, 9 aa, Homo Sapiens
RLYDTHITV

SEQ ID NO: 121325 - protein, 9 aa, Homo Sapiens
RLYSKQITI

SEQ ID NO: 121326 - protein, 9 aa, Homo Sapiens
RMARTPQTV

SEQ ID NO: 121327 - protein, 9 aa, Homo Sapiens
RMFDGKFVV

SEQ ID NO: 121328 - protein, 9 aa, Homo Sapiens
RMFFGKNKV

SEQ ID NO: 121329 - protein, 9 aa, Homo Sapiens
RMFFHFSEI

SEQ ID NO: 121330 - protein, 9 aa, Homo Sapiens
RMGFPQHTI

SEQ ID NO: 121331 - protein, 9 aa, Homo Sapiens
RMITAMNTI

SEQ ID NO: 121332 - protein, 9 aa, Homo Sapiens
RMLAHPLHV

SEQ ID NO: 121333 - protein, 9 aa, Homo Sapiens
RMLPHAPGV

SEQ ID NO: 121334 - protein, 9 aa, Homo Sapiens
RMNPNSPSI

SEQ ID NO: 121335 - protein, 9 aa, Homo Sapiens
RMYEKALQI

SEQ ID NO: 121336 - protein, 9 aa, Homo Sapiens
RMYSYPARV

SEQ ID NO: 121337 - protein, 9 aa, Homo Sapiens
RQFDNFKRV

SEQ ID NO: 121338 - protein, 9 aa, Homo Sapiens
RQFLLKSLI

SEQ ID NO: 121339 - protein, 9 aa, Homo Sapiens
RQFPGSHRV

SEQ ID NO: 121340 - protein, 9 aa, Homo Sapiens
RQHEIVLKV

SEQ ID NO: 121341 - protein, 9 aa, Homo Sapiens
RQHLQATGV

SEQ ID NO: 121342 - protein, 9 aa, Homo Sapiens
RQHVIDVQI

SEQ ID NO: 121343 - protein, 9 aa, Homo Sapiens
RQIDQFLVV

SEQ ID NO: 121344 - protein, 9 aa, Homo Sapiens
RQKLQLEKV

SEQ ID NO: 121345 - protein, 9 aa, Homo Sapiens
RQLEKIKTI

SEQ ID NO: 121346 - protein, 9 aa, Homo Sapiens
RQLGHALLV

SEQ ID NO: 121347 - protein, 9 aa, Homo Sapiens
RQLPSQKTV

SEQ ID NO: 121348 - protein, 9 aa, Homo Sapiens
RQMIMIRSI

SEQ ID NO: 121349 - protein, 9 aa, Homo Sapiens
RQMSVNSSI

SEQ ID NO: 121350 - protein, 9 aa, Homo Sapiens
RQMTVIRKV

SEQ ID NO: 121351 - protein, 9 aa, Homo Sapiens
RQNLVALTV

SEQ ID NO: 121352 - protein, 9 aa, Homo Sapiens
RQVVLKYTV

SEQ ID NO: 121353 - protein, 9 aa, Homo Sapiens
RQYLAINQI

SEQ ID NO: 121354 - protein, 9 aa, Homo Sapiens
RQYLILRNI

SEQ ID NO: 121355 - protein, 9 aa, Homo Sapiens
RQYPETKII

SEQ ID NO: 121356 - protein, 9 aa, Homo Sapiens
RSVLIANTV

SEQ ID NO: 121357 - protein, 9 aa, Homo Sapiens
SAWRVISSI

SEQ ID NO: 121358 - protein, 9 aa, Homo Sapiens
SAYLVAEKV

SEQ ID NO: 121359 - protein, 9 aa, Homo Sapiens
SEYPVILSI

SEQ ID NO: 121360 - protein, 9 aa, Homo Sapiens
SFHEFCTSV

SEQ ID NO: 121361 - protein, 9 aa, Homo Sapiens
SFYEHIITV

SEQ ID NO: 121362 - protein, 9 aa, Homo Sapiens
SFYPYIHVV

SEQ ID NO: 121363 - protein, 9 aa, Homo Sapiens
SGRTFLHTV

SEQ ID NO: 121364 - protein, 9 aa, Homo Sapiens
SLYGGTITI

SEQ ID NO: 121365 - protein, 9 aa, Homo Sapiens
SLYPIAVLI

SEQ ID NO: 121366 - protein, 9 aa, Homo Sapiens
SMFGAGLTV

SEQ ID NO: 121367 - protein, 9 aa, Homo Sapiens
SMHDRSLKV

SEQ ID NO: 121368 - protein, 9 aa, Homo Sapiens
SMYDKVLML

SEQ ID NO: 121369 - protein, 9 aa, Homo Sapiens
SNQMLVPVI

SEQ ID NO: 121370 - protein, 9 aa, Homo Sapiens
SQARFGQSV

SEQ ID NO: 121371 - protein, 9 aa, Homo Sapiens
SQCPHIVRI

SEQ ID NO: 121372 - protein, 9 aa, Homo Sapiens
SQDPGTHVV

SEQ ID NO: 121373 - protein, 9 aa, Homo Sapiens
SQFAFESVV

SEQ ID NO: 121374 - protein, 9 aa, Homo Sapiens
SQFMYDEHI

SEQ ID NO: 121375 - protein, 9 aa, Homo Sapiens
SQFPKHLIV

SEQ ID NO: 121376 - protein, 9 aa, Homo Sapiens
SQFSYQHAI

SEQ ID NO: 121377 - protein, 9 aa, Homo Sapiens
SQHKFASNV

SEQ ID NO: 121378 - protein, 9 aa, Homo Sapiens
SQIPAQPSV

SEQ ID NO: 121379 - protein, 9 aa, Homo Sapiens
SQIQYMNTV

SEQ ID NO: 121380 - protein, 9 aa, Homo Sapiens
SQLELKSLI

SEQ ID NO: 121381 - protein, 9 aa, Homo Sapiens
SQLVIHQRI

SEQ ID NO: 121382 - protein, 9 aa, Homo Sapiens
SQMGIRSSI

SEQ ID NO: 121383 - protein, 9 aa, Homo Sapiens
SQNPYHNAV

SEQ ID NO: 121384 - protein, 9 aa, Homo Sapiens
SQQLVHVTV

SEQ ID NO: 121385 - protein, 9 aa, Homo Sapiens
SQRSFVEFI

SEQ ID NO: 121386 - protein, 9 aa, Homo Sapiens
SQRTITVGV

SEQ ID NO: 121387 - protein, 9 aa, Homo Sapiens
SQVEILQRV

SEQ ID NO: 121388 - protein, 9 aa, Homo Sapiens
SQWSPALTI

SEQ ID NO: 121389 - protein, 9 aa, Homo Sapiens
SQYLTRITI

SEQ ID NO: 121390 - protein, 9 aa, Homo Sapiens
SQYPFPVTL

SEQ ID NO: 121391 - protein, 9 aa, Homo Sapiens
SQYPGAKYI

SEQ ID NO: 121392 - protein, 9 aa, Homo Sapiens
SQYPWSQRV

SEQ ID NO: 121393 - protein, 9 aa, Homo Sapiens
SQYSGQLKV

SEQ ID NO: 121394 - protein, 9 aa, Homo Sapiens
SSRIIKNNI

SEQ ID NO: 121395 - protein, 9 aa, Homo Sapiens
SSRLILSNV

SEQ ID NO: 121396 - protein, 9 aa, Homo Sapiens
SSWRVISSI

SEQ ID NO: 121397 - protein, 9 aa, Homo Sapiens
TFLPFIHTI

SEQ ID NO: 121398 - protein, 9 aa, Homo Sapiens
TGYLNTVTV

SEQ ID NO: 121399 - protein, 9 aa, Homo Sapiens
TIRYPDPLI

SEQ ID NO: 121400 - protein, 9 aa, Homo Sapiens
TMCATTRTI

SEQ ID NO: 121401 - protein, 9 aa, Homo Sapiens
TQHCFKTMV

SEQ ID NO: 121402 - protein, 9 aa, Homo Sapiens
TQKKPSISI

SEQ ID NO: 121403 - protein, 9 aa, Homo Sapiens
TQKTFLTEV

SEQ ID NO: 121404 - protein, 9 aa, Homo Sapiens
TQLPQSMKI

SEQ ID NO: 121405 - protein, 9 aa, Homo Sapiens
TQLTIHQRV

SEQ ID NO: 121406 - protein, 9 aa, Homo Sapiens
TQRIFQEAV

SEQ ID NO: 121407 - protein, 9 aa, Homo Sapiens
TQRNCIRTI

SEQ ID NO: 121408 - protein, 9 aa, Homo Sapiens
TQRTFLKEV

SEQ ID NO: 121409 - protein, 9 aa, Homo Sapiens
TQYEFQVRV

SEQ ID NO: 121410 - protein, 9 aa, Homo Sapiens
TQYIFTEKL

SEQ ID NO: 121411 - protein, 9 aa, Homo Sapiens
TQYKFRLTA

SEQ ID NO: 121412 - protein, 9 aa, Homo Sapiens
TQYSAVRTV

SEQ ID NO: 121413 - protein, 9 aa, Homo Sapiens
TSFIFFNKV

SEQ ID NO: 121414 - protein, 9 aa, Homo Sapiens
TSQYLMHEV

SEQ ID NO: 121415 - protein, 9 aa, Homo Sapiens
TSREIQTAV

SEQ ID NO: 121416 - protein, 9 aa, Homo Sapiens
VAPGKDLTK

SEQ ID NO: 121417 - protein, 9 aa, Homo Sapiens
VFFPEEPKV

SEQ ID NO: 121418 - protein, 9 aa, Homo Sapiens
VFPRPEPFV

SEQ ID NO: 121419 - protein, 9 aa, Homo Sapiens
VFRDQEPKI

SEQ ID NO: 121420 - protein, 9 aa, Homo Sapiens
VFYGHHAKI

SEQ ID NO: 121421 - protein, 9 aa, Homo Sapiens
VLYDRPLKI

SEQ ID NO: 121422 - protein, 9 aa, Homo Sapiens
VLYENKVAV

SEQ ID NO: 121423 - protein, 9 aa, Homo Sapiens
VMADIRELI

SEQ ID NO: 121424 - protein, 9 aa, Homo Sapiens
VMEQGRVTI

SEQ ID NO: 121425 - protein, 9 aa, Homo Sapiens
VMEYHPRII

SEQ ID NO: 121426 - protein, 9 aa, Homo Sapiens
VMFGGKQVV

SEQ ID NO: 121427 - protein, 9 aa, Homo Sapiens
VMFKTPVSI

SEQ ID NO: 121428 - protein, 9 aa, Homo Sapiens
VMGPQEKKV

SEQ ID NO: 121429 - protein, 9 aa, Homo Sapiens
VMHPFWNTI

SEQ ID NO: 121430 - protein, 9 aa, Homo Sapiens
VMKHADPRI

SEQ ID NO: 121431 - protein, 9 aa, Homo Sapiens
VMKKIIETV

SEQ ID NO: 121432 - protein, 9 aa, Homo Sapiens
VMRIMDPEI

SEQ ID NO: 121433 - protein, 9 aa, Homo Sapiens
VMTIPIPIV

SEQ ID NO: 121434 - protein, 9 aa, Homo Sapiens
VMYGKVYRI

SEQ ID NO: 121435 - protein, 9 aa, Homo Sapiens
VQFLVPQSI

SEQ ID NO: 121436 - protein, 9 aa, Homo Sapiens
VQFVFDNKV

SEQ ID NO: 121437 - protein, 9 aa, Homo Sapiens
VQHIPSPKV

SEQ ID NO: 121438 - protein, 9 aa, Homo Sapiens
VQHNIQKTV

SEQ ID NO: 121439 - protein, 9 aa, Homo Sapiens
VQHVVMTAI

SEQ ID NO: 121440 - protein, 9 aa, Homo Sapiens
VQKFFLEEI

SEQ ID NO: 121441 - protein, 9 aa, Homo Sapiens
VQKLYEHIV

SEQ ID NO: 121442 - protein, 9 aa, Homo Sapiens
VQLKKLPKV

SEQ ID NO: 121443 - protein, 9 aa, Homo Sapiens
VQNPQAQTI

SEQ ID NO: 121444 - protein, 9 aa, Homo Sapiens
VQPPPPCKI

SEQ ID NO: 121445 - protein, 9 aa, Homo Sapiens
VQQLVLRTV

SEQ ID NO: 121446 - protein, 9 aa, Homo Sapiens
VQREYQLVV

SEQ ID NO: 121447 - protein, 9 aa, Homo Sapiens
VQRLEPVIM

SEQ ID NO: 121448 - protein, 9 aa, Homo Sapiens
VQRQMVVSV

SEQ ID NO: 121449 - protein, 9 aa, Homo Sapiens
VQRRFVQEV

SEQ ID NO: 121450 - protein, 9 aa, Homo Sapiens
VQRSQVSSI

SEQ ID NO: 121451 - protein, 9 aa, Homo Sapiens
VQRTMLELI

SEQ ID NO: 121452 - protein, 9 aa, Homo Sapiens
VQRTQAPAV

SEQ ID NO: 121453 - protein, 9 aa, Homo Sapiens
VQTVLPLVM

SEQ ID NO: 121454 - protein, 9 aa, Homo Sapiens
VQVPVPVTV

SEQ ID NO: 121455 - protein, 9 aa, Homo Sapiens
VQVTFGRTI

SEQ ID NO: 121456 - protein, 9 aa, Homo Sapiens
VQYAAVRRV

SEQ ID NO: 121457 - protein, 9 aa, Homo Sapiens
VQYAYFKKV

SEQ ID NO: 121458 - protein, 9 aa, Homo Sapiens
VQYDGRRVV

SEQ ID NO: 121459 - protein, 9 aa, Homo Sapiens
VQYEMRTLY

SEQ ID NO: 121460 - protein, 9 aa, Homo Sapiens
VQYIVLQNI

SEQ ID NO: 121461 - protein, 9 aa, Homo Sapiens
VQYKGHVEI

SEQ ID NO: 121462 - protein, 9 aa, Homo Sapiens
VQYNEPLKV

SEQ ID NO: 121463 - protein, 9 aa, Homo Sapiens
VQYNMKIVI

SEQ ID NO: 121464 - protein, 9 aa, Homo Sapiens
VQYPYQLYI

SEQ ID NO: 121465 - protein, 9 aa, Homo Sapiens
VQYQVIPQI

SEQ ID NO: 121466 - protein, 9 aa, Homo Sapiens
VSAPPMPSV

SEQ ID NO: 121467 - protein, 9 aa, Homo Sapiens
VSHAIIRTI

SEQ ID NO: 121468 - protein, 9 aa, Homo Sapiens
VSLLVQRTI

SEQ ID NO: 121469 - protein, 9 aa, Homo Sapiens
VSRVVTQNI

SEQ ID NO: 121470 - protein, 9 aa, Homo Sapiens
VSYPGKNKI

SEQ ID NO: 121471 - protein, 9 aa, Homo Sapiens
VVYGGKSTI

SEQ ID NO: 121472 - protein, 9 aa, Homo Sapiens
YERLFGTTV

SEQ ID NO: 121473 - protein, 9 aa, Homo Sapiens
YMCPNSSTV

SEQ ID NO: 121474 - protein, 9 aa, Homo Sapiens
YQFGEIRTI

SEQ ID NO: 121475 - protein, 9 aa, Homo Sapiens
YQHGIFQSI

SEQ ID NO: 121476 - protein, 9 aa, Homo Sapiens
YQHIVTTLV

SEQ ID NO: 121477 - protein, 9 aa, Homo Sapiens
YQHLLVNSI

SEQ ID NO: 121478 - protein, 9 aa, Homo Sapiens
YQHMLANSI

SEQ ID NO: 121479 - protein, 9 aa, Homo Sapiens
YQHSPSSTV

SEQ ID NO: 121480 - protein, 9 aa, Homo Sapiens
YQKTFSTRI

SEQ ID NO: 121481 - protein, 9 aa, Homo Sapiens
YQYMLEHVI

SEQ ID NO: 121482 - protein, 9 aa, Homo Sapiens
YQYPRPLLI

SEQ ID NO: 121483 - protein, 9 aa, Homo Sapiens
YQYPVIIHL

SEQ ID NO: 121484 - protein, 9 aa, Homo Sapiens
YQYTTLTSV

SEQ ID NO: 121485 - protein, 9 aa, Homo Sapiens
YSKAFTLTI

SEQ ID NO: 121486 - protein, 9 aa, Homo Sapiens
YSKIFTENI

SEQ ID NO: 121487 - protein, 9 aa, Homo Sapiens
YSQVFKETV

SEQ ID NO: 121488 - protein, 10 aa, Homo Sapiens
AVDSRTGKLT

SEQ ID NO: 121489 - protein, 10 aa, Homo Sapiens
DNQYRLIVNV

SEQ ID NO: 121490 - protein, 10 aa, Homo Sapiens
EEQLQQIRAE

SEQ ID NO: 121491 - protein, 10 aa, Homo Sapiens
GQAGALRALG

SEQ ID NO: 121492 - protein, 10 aa, Homo Sapiens
GQILMPNIGY

SEQ ID NO: 121493 - protein, 10 aa, Homo Sapiens
GSNQYLFSVI

SEQ ID NO: 121494 - protein, 10 aa, Homo Sapiens
HQHPHPPVGP

SEQ ID NO: 121495 - protein, 10 aa, Homo Sapiens
HQRTFVLEVM

SEQ ID NO: 121496 - protein, 10 aa, Homo Sapiens
HQVVLPVLGY

SEQ ID NO: 121497 - protein, 10 aa, Homo Sapiens
HSTIMPRLSE

SEQ ID NO: 121498 - protein, 10 aa, Homo Sapiens
KMLKPTGRVV

SEQ ID NO: 121499 - protein, 10 aa, Homo Sapiens
QLPNVPHSLP

SEQ ID NO: 121500 - protein, 10 aa, Homo Sapiens
RMYPFQIHSI

SEQ ID NO: 121501 - protein, 10 aa, Homo Sapiens
RQYPWGTVQV

SEQ ID NO: 121502 - protein, 10 aa, Homo Sapiens
RQYPWGVAEV

SEQ ID NO: 121503 - protein, 10 aa, Homo Sapiens
RQYPWGVVQV

SEQ ID NO: 121504 - protein, 10 aa, Homo Sapiens
SQRPGAHLTV

SEQ ID NO: 121505 - protein, 10 aa, Homo Sapiens
SQYSFAGSSI

SEQ ID NO: 121506 - protein, 10 aa, Homo Sapiens
TISSNVASKA

SEQ ID NO: 121507 - protein, 10 aa, Homo Sapiens
TKSQIPLSKI

SEQ ID NO: 121508 - protein, 10 aa, Homo Sapiens
TSNQMLVPVI

SEQ ID NO: 121509 - protein, 10 aa, Homo Sapiens
TTSQYLMHEV

SEQ ID NO: 121510 - protein, 10 aa, Homo Sapiens
VMFGGKQVVV

SEQ ID NO: 121511 - protein, 10 aa, Homo Sapiens
YDAEISQIHQ

SEQ ID NO: 121512 - protein, 11 aa, Homo Sapiens
AAVEEILPSLK

SEQ ID NO: 121513 - protein, 11 aa, Homo Sapiens
AEQNRKDAEAW

SEQ ID NO: 121514 - protein, 11 aa, Homo Sapiens
AQYDPAKPNYI

SEQ ID NO: 121515 - protein, 11 aa, Homo Sapiens
DPASLPRVLRV

SEQ ID NO: 121516 - protein, 11 aa, Homo Sapiens
GAGKNRAGLEL

SEQ ID NO: 121517 - protein, 11 aa, Homo Sapiens
GLGSGGSIRSS

SEQ ID NO: 121518 - protein, 11 aa, Homo Sapiens
IGGNAYQHSKV

SEQ ID NO: 121519 - protein, 11 aa, Homo Sapiens
ITSNQMLVPVI

SEQ ID NO: 121520 - protein, 11 aa, Homo Sapiens
KKDVDNAYMIK

SEQ ID NO: 121521 - protein, 11 aa, Homo Sapiens
KQGTQYTFSSI

SEQ ID NO: 121522 - protein, 11 aa, Homo Sapiens
RGSQQYRALTV

SEQ ID NO: 121523 - protein, 11 aa, Homo Sapiens
SDNQYRLIVNV

SEQ ID NO: 121524 - protein, 11 aa, Homo Sapiens
TKPNQYKPTYV

SEQ ID NO: 121525 - protein, 11 aa, Homo Sapiens
TVDEKNYTKAM

SEQ ID NO: 121526 - protein, 8 aa, Homo Sapiens
DAAQGYRY

SEQ ID NO: 121527 - protein, 8 aa, Homo Sapiens
DAGIGYLF

SEQ ID NO: 121528 - protein, 8 aa, Homo Sapiens
DAHGSFCF

SEQ ID NO: 121529 - protein, 8 aa, Homo Sapiens
DPSQPQQW

SEQ ID NO: 121530 - protein, 8 aa, Homo Sapiens
DPVLGDKW

SEQ ID NO: 121531 - protein, 8 aa, Homo Sapiens
DVGPTAEW

SEQ ID NO: 121532 - protein, 8 aa, Homo Sapiens
EEQLQQIR

SEQ ID NO: 121533 - protein, 8 aa, Homo Sapiens
EPVNSSKW

SEQ ID NO: 121534 - protein, 8 aa, Homo Sapiens
FPGKAFSW

SEQ ID NO: 121535 - protein, 8 aa, Homo Sapiens
FPGPIFHL

SEQ ID NO: 121536 - protein, 8 aa, Homo Sapiens
FPGPSKPF

SEQ ID NO: 121537 - protein, 8 aa, Homo Sapiens
FPHTTPSM

SEQ ID NO: 121538 - protein, 8 aa, Homo Sapiens
FPIDSHTW

SEQ ID NO: 121539 - protein, 8 aa, Homo Sapiens
FPIGSSGF

SEQ ID NO: 121540 - protein, 8 aa, Homo Sapiens
FPLKVFGY

SEQ ID NO: 121541 - protein, 8 aa, Homo Sapiens
FPLSVQKF

SEQ ID NO: 121542 - protein, 8 aa, Homo Sapiens
FPSSGRFW

SEQ ID NO: 121543 - protein, 8 aa, Homo Sapiens
FPTISLEF

SEQ ID NO: 121544 - protein, 8 aa, Homo Sapiens
FPYKGYIW

SEQ ID NO: 121545 - protein, 8 aa, Homo Sapiens
HASHGFMW

SEQ ID NO: 121546 - protein, 8 aa, Homo Sapiens
HASTSWYW

SEQ ID NO: 121547 - protein, 8 aa, Homo Sapiens
HPSKGYWW

SEQ ID NO: 121548 - protein, 8 aa, Homo Sapiens
IANVAHTF

SEQ ID NO: 121549 - protein, 8 aa, Homo Sapiens
IPAESYTF

SEQ ID NO: 121550 - protein, 8 aa, Homo Sapiens
IPGSVLLW

SEQ ID NO: 121551 - protein, 8 aa, Homo Sapiens
IPYKDTFW

SEQ ID NO: 121552 - protein, 8 aa, Homo Sapiens
LPADTQAW

SEQ ID NO: 121553 - protein, 8 aa, Homo Sapiens
LPAEARER

SEQ ID NO: 121554 - protein, 8 aa, Homo Sapiens
LPDQSFLW

SEQ ID NO: 121555 - protein, 8 aa, Homo Sapiens
LPFNTFKF

SEQ ID NO: 121556 - protein, 8 aa, Homo Sapiens
LPGKTYSF

SEQ ID NO: 121557 - protein, 8 aa, Homo Sapiens
LPGPYIKW

SEQ ID NO: 121558 - protein, 8 aa, Homo Sapiens
LPGSSHSF

SEQ ID NO: 121559 - protein, 8 aa, Homo Sapiens
LPHGGEGW

SEQ ID NO: 121560 - protein, 8 aa, Homo Sapiens
LPHTGYIY

SEQ ID NO: 121561 - protein, 8 aa, Homo Sapiens
LPLESLGW

SEQ ID NO: 121562 - protein, 8 aa, Homo Sapiens
LPPGAEHW

SEQ ID NO: 121563 - protein, 8 aa, Homo Sapiens
LPPPAYGF

SEQ ID NO: 121564 - protein, 8 aa, Homo Sapiens
LPRTDYSF

SEQ ID NO: 121565 - protein, 8 aa, Homo Sapiens
LPSASKGW

SEQ ID NO: 121566 - protein, 8 aa, Homo Sapiens
LPTVGELW

SEQ ID NO: 121567 - protein, 8 aa, Homo Sapiens
LPVEGGFW

SEQ ID NO: 121568 - protein, 8 aa, Homo Sapiens
LQWLLLLF

SEQ ID NO: 121569 - protein, 8 aa, Homo Sapiens
MACQGHKW

SEQ ID NO: 121570 - protein, 8 aa, Homo Sapiens
MPAEQAFW

SEQ ID NO: 121571 - protein, 8 aa, Homo Sapiens
MPDAAHGI

SEQ ID NO: 121572 - protein, 8 aa, Homo Sapiens
MPDLSLSF

SEQ ID NO: 121573 - protein, 8 aa, Homo Sapiens
MPGEDLKF

SEQ ID NO: 121574 - protein, 8 aa, Homo Sapiens
MPGKELEW

SEQ ID NO: 121575 - protein, 8 aa, Homo Sapiens
MPHSTSRW

SEQ ID NO: 121576 - protein, 8 aa, Homo Sapiens
MPIQSHVI

SEQ ID NO: 121577 - protein, 8 aa, Homo Sapiens
MPIRSLTF

SEQ ID NO: 121578 - protein, 8 aa, Homo Sapiens
MPSSSHLF

SEQ ID NO: 121579 - protein, 8 aa, Homo Sapiens
NPGPGPRW

SEQ ID NO: 121580 - protein, 8 aa, Homo Sapiens
PDDHARKI

SEQ ID NO: 121581 - protein, 8 aa, Homo Sapiens
PHSAHQKY

SEQ ID NO: 121582 - protein, 8 aa, Homo Sapiens
PSHTKIKY

SEQ ID NO: 121583 - protein, 8 aa, Homo Sapiens
PVGRVHRL

SEQ ID NO: 121584 - protein, 8 aa, Homo Sapiens
PYNHQHEY

SEQ ID NO: 121585 - protein, 8 aa, Homo Sapiens
SPANSFHF

SEQ ID NO: 121586 - protein, 8 aa, Homo Sapiens
SPLTSYRW

SEQ ID NO: 121587 - protein, 8 aa, Homo Sapiens
SPVRAFQW

SEQ ID NO: 121588 - protein, 8 aa, Homo Sapiens
SVTEIQEK

SEQ ID NO: 121589 - protein, 8 aa, Homo Sapiens
TEVTGHRW

SEQ ID NO: 121590 - protein, 8 aa, Homo Sapiens
TPAASSIW

SEQ ID NO: 121591 - protein, 8 aa, Homo Sapiens
TPAGEFKW

SEQ ID NO: 121592 - protein, 8 aa, Homo Sapiens
TPGPAFKI

SEQ ID NO: 121593 - protein, 8 aa, Homo Sapiens
TPLEAACW

SEQ ID NO: 121594 - protein, 8 aa, Homo Sapiens
TWSALPVL

SEQ ID NO: 121595 - protein, 8 aa, Homo Sapiens
VPAESHIY

SEQ ID NO: 121596 - protein, 8 aa, Homo Sapiens
VPATSHHF

SEQ ID NO: 121597 - protein, 8 aa, Homo Sapiens
VPGLTFHW

SEQ ID NO: 121598 - protein, 8 aa, Homo Sapiens
VPGPGGIW

SEQ ID NO: 121599 - protein, 8 aa, Homo Sapiens
VPLMSAHW

SEQ ID NO: 121600 - protein, 8 aa, Homo Sapiens
VPSNAELW

SEQ ID NO: 121601 - protein, 8 aa, Homo Sapiens
WPLAVRKW

SEQ ID NO: 121602 - protein, 8 aa, Homo Sapiens
YATQSHQW

SEQ ID NO: 121603 - protein, 8 aa, Homo Sapiens
YPASDPRW

SEQ ID NO: 121604 - protein, 8 aa, Homo Sapiens
YPASSSVF

SEQ ID NO: 121605 - protein, 8 aa, Homo Sapiens
YPCSSSHF

SEQ ID NO: 121606 - protein, 8 aa, Homo Sapiens
YPGPAVVL

SEQ ID NO: 121607 - protein, 8 aa, Homo Sapiens
YPGPGNHF

SEQ ID NO: 121608 - protein, 8 aa, Homo Sapiens
YPGPSHRI

SEQ ID NO: 121609 - protein, 8 aa, Homo Sapiens
YPGSSYIF

SEQ ID NO: 121610 - protein, 8 aa, Homo Sapiens
YPHEAPSW

SEQ ID NO: 121611 - protein, 8 aa, Homo Sapiens
YPHPDWIW

SEQ ID NO: 121612 - protein, 8 aa, Homo Sapiens
YPLKPTWW

SEQ ID NO: 121613 - protein, 8 aa, Homo Sapiens
YPLNSYEL

SEQ ID NO: 121614 - protein, 8 aa, Homo Sapiens
YPLSSKRW

SEQ ID NO: 121615 - protein, 8 aa, Homo Sapiens
YPMKSEKI

SEQ ID NO: 121616 - protein, 9 aa, Homo Sapiens
AAAAATAAW

SEQ ID NO: 121617 - protein, 9 aa, Homo Sapiens
AACDLVQRF

SEQ ID NO: 121618 - protein, 9 aa, Homo Sapiens
AADETLRLW

SEQ ID NO: 121619 - protein, 9 aa, Homo Sapiens
AADSAVRLW

SEQ ID NO: 121620 - protein, 9 aa, Homo Sapiens
AANPHSFVF

SEQ ID NO: 121621 - protein, 9 aa, Homo Sapiens
AANPIESQW

SEQ ID NO: 121622 - protein, 9 aa, Homo Sapiens
AAPAYSRAL

SEQ ID NO: 121623 - protein, 9 aa, Homo Sapiens
AAPTSAAAL

SEQ ID NO: 121624 - protein, 9 aa, Homo Sapiens
AAQDFFQRW

SEQ ID NO: 121625 - protein, 9 aa, Homo Sapiens
AASPHYQEW

SEQ ID NO: 121626 - protein, 9 aa, Homo Sapiens
AASSISSPW

SEQ ID NO: 121627 - protein, 9 aa, Homo Sapiens
APAAGYHVW

SEQ ID NO: 121628 - protein, 9 aa, Homo Sapiens
APADQSQSW

SEQ ID NO: 121629 - protein, 9 aa, Homo Sapiens
APAGDAGRW

SEQ ID NO: 121630 - protein, 9 aa, Homo Sapiens
APAPIHNQF

SEQ ID NO: 121631 - protein, 9 aa, Homo Sapiens
APAPSTVHF

SEQ ID NO: 121632 - protein, 9 aa, Homo Sapiens
APFSKVITF

SEQ ID NO: 121633 - protein, 9 aa, Homo Sapiens
APIASIHSF

SEQ ID NO: 121634 - protein, 9 aa, Homo Sapiens
APLEDEATL

SEQ ID NO: 121635 - protein, 9 aa, Homo Sapiens
APLKLQMEF

SEQ ID NO: 121636 - protein, 9 aa, Homo Sapiens
APLSLAEGW

SEQ ID NO: 121637 - protein, 9 aa, Homo Sapiens
APLSTIINW

SEQ ID NO: 121638 - protein, 9 aa, Homo Sapiens
APMECQESW

SEQ ID NO: 121639 - protein, 9 aa, Homo Sapiens
APMHDLLLW

SEQ ID NO: 121640 - protein, 9 aa, Homo Sapiens
APNEMVYRF

SEQ ID NO: 121641 - protein, 9 aa, Homo Sapiens
APSADAPMF

SEQ ID NO: 121642 - protein, 9 aa, Homo Sapiens
APSDTVLMF

SEQ ID NO: 121643 - protein, 9 aa, Homo Sapiens
APTAQATEW

SEQ ID NO: 121644 - protein, 9 aa, Homo Sapiens
APTDCVSSF

SEQ ID NO: 121645 - protein, 9 aa, Homo Sapiens
APVEVTHNF

SEQ ID NO: 121646 - protein, 9 aa, Homo Sapiens
APVPLYNSF

SEQ ID NO: 121647 - protein, 9 aa, Homo Sapiens
ASRDTVIVW

SEQ ID NO: 121648 - protein, 9 aa, Homo Sapiens
ATADTVIIY

SEQ ID NO: 121649 - protein, 9 aa, Homo Sapiens
CPALIKSIW

SEQ ID NO: 121650 - protein, 9 aa, Homo Sapiens
CPDPSLSVW

SEQ ID NO: 121651 - protein, 9 aa, Homo Sapiens
CPDPYIQRF

SEQ ID NO: 121652 - protein, 9 aa, Homo Sapiens
CPFQGTVAF

SEQ ID NO: 121653 - protein, 9 aa, Homo Sapiens
CPFTGNVSI

SEQ ID NO: 121654 - protein, 9 aa, Homo Sapiens
CPIPSTDEF

SEQ ID NO: 121655 - protein, 9 aa, Homo Sapiens
CPNDYHQLF

SEQ ID NO: 121656 - protein, 9 aa, Homo Sapiens
CPNPTKQIW

SEQ ID NO: 121657 - protein, 9 aa, Homo Sapiens
CPTENVAKI

SEQ ID NO: 121658 - protein, 9 aa, Homo Sapiens
CPTSWVTDW

SEQ ID NO: 121659 - protein, 9 aa, Homo Sapiens
CPVLVGNKW

SEQ ID NO: 121660 - protein, 9 aa, Homo Sapiens
CPVPHLHRW

SEQ ID NO: 121661 - protein, 9 aa, Homo Sapiens
DADPHFHHF

SEQ ID NO: 121662 - protein, 9 aa, Homo Sapiens
DADSLQRAW

SEQ ID NO: 121663 - protein, 9 aa, Homo Sapiens
DAFNVPVFW

SEQ ID NO: 121664 - protein, 9 aa, Homo Sapiens
DAFQHMQHF

SEQ ID NO: 121665 - protein, 9 aa, Homo Sapiens
DAGPPTHAF

SEQ ID NO: 121666 - protein, 9 aa, Homo Sapiens
DAHVDSTTY

SEQ ID NO: 121667 - protein, 9 aa, Homo Sapiens
DALEKNQQW

SEQ ID NO: 121668 - protein, 9 aa, Homo Sapiens
DALPEYSTF

SEQ ID NO: 121669 - protein, 9 aa, Homo Sapiens
DAMQLNDKW

SEQ ID NO: 121670 - protein, 9 aa, Homo Sapiens
DANPETHAF

SEQ ID NO: 121671 - protein, 9 aa, Homo Sapiens
DANPLKTLW

SEQ ID NO: 121672 - protein, 9 aa, Homo Sapiens
DANSKQLLY

SEQ ID NO: 121673 - protein, 9 aa, Homo Sapiens
DASALRILF

SEQ ID NO: 121674 - protein, 9 aa, Homo Sapiens
DASKVVTVF

SEQ ID NO: 121675 - protein, 9 aa, Homo Sapiens
DASPVQAVF

SEQ ID NO: 121676 - protein, 9 aa, Homo Sapiens
DAWIEHDVW

SEQ ID NO: 121677 - protein, 9 aa, Homo Sapiens
DAYALNHTL

SEQ ID NO: 121678 - protein, 9 aa, Homo Sapiens
DAYPEIEKF

SEQ ID NO: 121679 - protein, 9 aa, Homo Sapiens
DAYTHLETF

SEQ ID NO: 121680 - protein, 9 aa, Homo Sapiens
DFFRDPLNW

SEQ ID NO: 121681 - protein, 9 aa, Homo Sapiens
DLFQDYERW

SEQ ID NO: 121682 - protein, 9 aa, Homo Sapiens
DLWLEREVF

SEQ ID NO: 121683 - protein, 9 aa, Homo Sapiens
DPDEVARLW

SEQ ID NO: 121684 - protein, 9 aa, Homo Sapiens
DPDEVARRW

SEQ ID NO: 121685 - protein, 9 aa, Homo Sapiens
DPDKDVLGW

SEQ ID NO: 121686 - protein, 9 aa, Homo Sapiens
DPDKDVQGW

SEQ ID NO: 121687 - protein, 9 aa, Homo Sapiens
DPDSHFPAW

SEQ ID NO: 121688 - protein, 9 aa, Homo Sapiens
DPFIDLNYM

SEQ ID NO: 121689 - protein, 9 aa, Homo Sapiens
DPFKDIILY

SEQ ID NO: 121690 - protein, 9 aa, Homo Sapiens
DPFRDLHSL

SEQ ID NO: 121691 - protein, 9 aa, Homo Sapiens
DPHKADLVW

SEQ ID NO: 121692 - protein, 9 aa, Homo Sapiens
DPHQQIYTF

SEQ ID NO: 121693 - protein, 9 aa, Homo Sapiens
DPIPAAHSF

SEQ ID NO: 121694 - protein, 9 aa, Homo Sapiens
DPLNMHVTW

SEQ ID NO: 121695 - protein, 9 aa, Homo Sapiens
DPLSDYNVW

SEQ ID NO: 121696 - protein, 9 aa, Homo Sapiens
DPQDFIQEW

SEQ ID NO: 121697 - protein, 9 aa, Homo Sapiens
DPSGAYFAW

SEQ ID NO: 121698 - protein, 9 aa, Homo Sapiens
DPSGNAHKW

SEQ ID NO: 121699 - protein, 9 aa, Homo Sapiens
DPSGNYGGW

SEQ ID NO: 121700 - protein, 9 aa, Homo Sapiens
DPSGTYHAW

SEQ ID NO: 121701 - protein, 9 aa, Homo Sapiens
DPVDIYKSW

SEQ ID NO: 121702 - protein, 9 aa, Homo Sapiens
EAAAFDDEW

SEQ ID NO: 121703 - protein, 9 aa, Homo Sapiens
EAASVPVVY

SEQ ID NO: 121704 - protein, 9 aa, Homo Sapiens
EADGGLKSW

SEQ ID NO: 121705 - protein, 9 aa, Homo Sapiens
EAEPQGAAW

SEQ ID NO: 121706 - protein, 9 aa, Homo Sapiens
EAFRGVHRY

SEQ ID NO: 121707 - protein, 9 aa, Homo Sapiens
EAIKQASEW

SEQ ID NO: 121708 - protein, 9 aa, Homo Sapiens
EAINVEQAF

SEQ ID NO: 121709 - protein, 9 aa, Homo Sapiens
EAIQDLWQW

SEQ ID NO: 121710 - protein, 9 aa, Homo Sapiens
EAIRISPTF

SEQ ID NO: 121711 - protein, 9 aa, Homo Sapiens
EALALTQTW

SEQ ID NO: 121712 - protein, 9 aa, Homo Sapiens
EALDVCEKW

SEQ ID NO: 121713 - protein, 9 aa, Homo Sapiens
EALHASHGF

SEQ ID NO: 121714 - protein, 9 aa, Homo Sapiens
EAMPFPLNF

SEQ ID NO: 121715 - protein, 9 aa, Homo Sapiens
EAMRLGPGW

SEQ ID NO: 121716 - protein, 9 aa, Homo Sapiens
EANAIALKY

SEQ ID NO: 121717 - protein, 9 aa, Homo Sapiens
EANSNAVRF

SEQ ID NO: 121718 - protein, 9 aa, Homo Sapiens
EASAVTVRF

SEQ ID NO: 121719 - protein, 9 aa, Homo Sapiens
EASEGCYRW

SEQ ID NO: 121720 - protein, 9 aa, Homo Sapiens
EASPSSLHF

SEQ ID NO: 121721 - protein, 9 aa, Homo Sapiens
EATYINHNF

SEQ ID NO: 121722 - protein, 9 aa, Homo Sapiens
EAVDKYFKL

SEQ ID NO: 121723 - protein, 9 aa, Homo Sapiens
EAVGNIVKF

SEQ ID NO: 121724 - protein, 9 aa, Homo Sapiens
EAYPDHTQF

SEQ ID NO: 121725 - protein, 9 aa, Homo Sapiens
EGNPDTHSW

SEQ ID NO: 121726 - protein, 9 aa, Homo Sapiens
ELFEGVQKW

SEQ ID NO: 121727 - protein, 9 aa, Homo Sapiens
EPDPHVVRI

SEQ ID NO: 121728 - protein, 9 aa, Homo Sapiens
EPEGEGQAW

SEQ ID NO: 121729 - protein, 9 aa, Homo Sapiens
EPEGGFSKW

SEQ ID NO: 121730 - protein, 9 aa, Homo Sapiens
EPEGTSHEF

SEQ ID NO: 121731 - protein, 9 aa, Homo Sapiens
EPHCFQVTW

SEQ ID NO: 121732 - protein, 9 aa, Homo Sapiens
EPHSKPIKF

SEQ ID NO: 121733 - protein, 9 aa, Homo Sapiens
EPNCETQKW

SEQ ID NO: 121734 - protein, 9 aa, Homo Sapiens
EPNPDDPLM

SEQ ID NO: 121735 - protein, 9 aa, Homo Sapiens
EPNPESLEL

SEQ ID NO: 121736 - protein, 9 aa, Homo Sapiens
EPPGFLHSW

SEQ ID NO: 121737 - protein, 9 aa, Homo Sapiens
EPQEDTRLW

SEQ ID NO: 121738 - protein, 9 aa, Homo Sapiens
EPQPGARRW

SEQ ID NO: 121739 - protein, 9 aa, Homo Sapiens
EPSAVALEL

SEQ ID NO: 121740 - protein, 9 aa, Homo Sapiens
EPSDLIVKI

SEQ ID NO: 121741 - protein, 9 aa, Homo Sapiens
EPSESNMRW

SEQ ID NO: 121742 - protein, 9 aa, Homo Sapiens
EPSTEAPRW

SEQ ID NO: 121743 - protein, 9 aa, Homo Sapiens
EPTNVRYLW

SEQ ID NO: 121744 - protein, 9 aa, Homo Sapiens
EPVELAQEF

SEQ ID NO: 121745 - protein, 9 aa, Homo Sapiens
EPVEQFSKL

SEQ ID NO: 121746 - protein, 9 aa, Homo Sapiens
EPVNLFQHL

SEQ ID NO: 121747 - protein, 9 aa, Homo Sapiens
FADGHLILW

SEQ ID NO: 121748 - protein, 9 aa, Homo Sapiens
FAVPDKVLW

SEQ ID NO: 121749 - protein, 9 aa, Homo Sapiens
FLWKEPATM

SEQ ID NO: 121750 - protein, 9 aa, Homo Sapiens
FPAAPAPKM

SEQ ID NO: 121751 - protein, 9 aa, Homo Sapiens
FPAAPIPTL

SEQ ID NO: 121752 - protein, 9 aa, Homo Sapiens
FPAEKESEW

SEQ ID NO: 121753 - protein, 9 aa, Homo Sapiens
FPAEKGQLF

SEQ ID NO: 121754 - protein, 9 aa, Homo Sapiens
FPAELENRI

SEQ ID NO: 121755 - protein, 9 aa, Homo Sapiens
FPAGKVPAF

SEQ ID NO: 121756 - protein, 9 aa, Homo Sapiens
FPAGTNSRW

SEQ ID NO: 121757 - protein, 9 aa, Homo Sapiens
FPAHILDCL

SEQ ID NO: 121758 - protein, 9 aa, Homo Sapiens
FPAKELHTI

SEQ ID NO: 121759 - protein, 9 aa, Homo Sapiens
FPAKVTAHW

SEQ ID NO: 121760 - protein, 9 aa, Homo Sapiens
FPAKVVSRL

SEQ ID NO: 121761 - protein, 9 aa, Homo Sapiens
FPANNIVKF

SEQ ID NO: 121762 - protein, 9 aa, Homo Sapiens
FPANVMDVI

SEQ ID NO: 121763 - protein, 9 aa, Homo Sapiens
FPATGCQKL

SEQ ID NO: 121764 - protein, 9 aa, Homo Sapiens
FPATPLLDY

SEQ ID NO: 121765 - protein, 9 aa, Homo Sapiens
FPAVDPEKI

SEQ ID NO: 121766 - protein, 9 aa, Homo Sapiens
FPAVGEPNI

SEQ ID NO: 121767 - protein, 9 aa, Homo Sapiens
FPCTTAPKI

SEQ ID NO: 121768 - protein, 9 aa, Homo Sapiens
FPDFSEQRW

SEQ ID NO: 121769 - protein, 9 aa, Homo Sapiens
FPDKPITQY

SEQ ID NO: 121770 - protein, 9 aa, Homo Sapiens
FPDPNVKYV

SEQ ID NO: 121771 - protein, 9 aa, Homo Sapiens
FPDRALSSW

SEQ ID NO: 121772 - protein, 9 aa, Homo Sapiens
FPDSGHFNV

SEQ ID NO: 121773 - protein, 9 aa, Homo Sapiens
FPDVEKAEW

SEQ ID NO: 121774 - protein, 9 aa, Homo Sapiens
FPEALARLL

SEQ ID NO: 121775 - protein, 9 aa, Homo Sapiens
FPEEDKKTY

SEQ ID NO: 121776 - protein, 9 aa, Homo Sapiens
FPEEIQQQI

SEQ ID NO: 121777 - protein, 9 aa, Homo Sapiens
FPEELTQTF

SEQ ID NO: 121778 - protein, 9 aa, Homo Sapiens
FPEGSVELY

SEQ ID NO: 121779 - protein, 9 aa, Homo Sapiens
FPEHIFPAL

SEQ ID NO: 121780 - protein, 9 aa, Homo Sapiens
FPEHRAAEI

SEQ ID NO: 121781 - protein, 9 aa, Homo Sapiens
FPEPEHSSF

SEQ ID NO: 121782 - protein, 9 aa, Homo Sapiens
FPEPNPRVI

SEQ ID NO: 121783 - protein, 9 aa, Homo Sapiens
FPESCNHVF

SEQ ID NO: 121784 - protein, 9 aa, Homo Sapiens
FPEYTHQLF

SEQ ID NO: 121785 - protein, 9 aa, Homo Sapiens
FPFAVANQL

SEQ ID NO: 121786 - protein, 9 aa, Homo Sapiens
FPFDVAVKF

SEQ ID NO: 121787 - protein, 9 aa, Homo Sapiens
FPFFDIAHY

SEQ ID NO: 121788 - protein, 9 aa, Homo Sapiens
FPFGYVSNI

SEQ ID NO: 121789 - protein, 9 aa, Homo Sapiens
FPFKHPDEW

SEQ ID NO: 121790 - protein, 9 aa, Homo Sapiens
FPFPKPDLI

SEQ ID NO: 121791 - protein, 9 aa, Homo Sapiens
FPFSRPELL

SEQ ID NO: 121792 - protein, 9 aa, Homo Sapiens
FPGDQDLRF

SEQ ID NO: 121793 - protein, 9 aa, Homo Sapiens
FPHDNVEDL

SEQ ID NO: 121794 - protein, 9 aa, Homo Sapiens
FPHGDLTEF

SEQ ID NO: 121795 - protein, 9 aa, Homo Sapiens
FPHHVSPGF

SEQ ID NO: 121796 - protein, 9 aa, Homo Sapiens
FPHLTVVLL

SEQ ID NO: 121797 - protein, 9 aa, Homo Sapiens
FPHMPCAYL

SEQ ID NO: 121798 - protein, 9 aa, Homo Sapiens
FPHPHIHEY

SEQ ID NO: 121799 - protein, 9 aa, Homo Sapiens
FPHRQPLRY

SEQ ID NO: 121800 - protein, 9 aa, Homo Sapiens
FPHSAHQKY

SEQ ID NO: 121801 - protein, 9 aa, Homo Sapiens
FPHYGFPTY

SEQ ID NO: 121802 - protein, 9 aa, Homo Sapiens
FPIDHFTHI

SEQ ID NO: 121803 - protein, 9 aa, Homo Sapiens
FPIEVRHYL

SEQ ID NO: 121804 - protein, 9 aa, Homo Sapiens
FPIEYHDIW

SEQ ID NO: 121805 - protein, 9 aa, Homo Sapiens
FPIHVQTSL

SEQ ID NO: 121806 - protein, 9 aa, Homo Sapiens
FPIPDLQKY

SEQ ID NO: 121807 - protein, 9 aa, Homo Sapiens
FPIPGEPGF

SEQ ID NO: 121808 - protein, 9 aa, Homo Sapiens
FPIPLINRL

SEQ ID NO: 121809 - protein, 9 aa, Homo Sapiens
FPITASQKI

SEQ ID NO: 121810 - protein, 9 aa, Homo Sapiens
FPLATESNI

SEQ ID NO: 121811 - protein, 9 aa, Homo Sapiens
FPLCRTPQF

SEQ ID NO: 121812 - protein, 9 aa, Homo Sapiens
FPLDKMTYL

SEQ ID NO: 121813 - protein, 9 aa, Homo Sapiens
FPLEAITAF

SEQ ID NO: 121814 - protein, 9 aa, Homo Sapiens
FPLMTIEEF

SEQ ID NO: 121815 - protein, 9 aa, Homo Sapiens
FPLSPDPRW

SEQ ID NO: 121816 - protein, 9 aa, Homo Sapiens
FPLTISERW

SEQ ID NO: 121817 - protein, 9 aa, Homo Sapiens
FPMAHPPNL

SEQ ID NO: 121818 - protein, 9 aa, Homo Sapiens
FPMAKLLYL

SEQ ID NO: 121819 - protein, 9 aa, Homo Sapiens
FPMEIRQYL

SEQ ID NO: 121820 - protein, 9 aa, Homo Sapiens
FPMELRQFL

SEQ ID NO: 121821 - protein, 9 aa, Homo Sapiens
FPMTMDEKY

SEQ ID NO: 121822 - protein, 9 aa, Homo Sapiens
FPNAIEHTL

SEQ ID NO: 121823 - protein, 9 aa, Homo Sapiens
FPNIHPPQI

SEQ ID NO: 121824 - protein, 9 aa, Homo Sapiens
FPNKPPLTF

SEQ ID NO: 121825 - protein, 9 aa, Homo Sapiens
FPNKQGYVL

SEQ ID NO: 121826 - protein, 9 aa, Homo Sapiens
FPNNYVTKI

SEQ ID NO: 121827 - protein, 9 aa, Homo Sapiens
FPNSFNDKF

SEQ ID NO: 121828 - protein, 9 aa, Homo Sapiens
FPNVSSFEW

SEQ ID NO: 121829 - protein, 9 aa, Homo Sapiens
FPPEANYLF

SEQ ID NO: 121830 - protein, 9 aa, Homo Sapiens
FPPESNYLF

SEQ ID NO: 121831 - protein, 9 aa, Homo Sapiens
FPQCVFDHW

SEQ ID NO: 121832 - protein, 9 aa, Homo Sapiens
FPQDQIRLW

SEQ ID NO: 121833 - protein, 9 aa, Homo Sapiens
FPQEGMHQM

SEQ ID NO: 121834 - protein, 9 aa, Homo Sapiens
FPQFEPQRY

SEQ ID NO: 121835 - protein, 9 aa, Homo Sapiens
FPQFYPLGI

SEQ ID NO: 121836 - protein, 9 aa, Homo Sapiens
FPQIEINKM

SEQ ID NO: 121837 - protein, 9 aa, Homo Sapiens
FPQLDSTSF

SEQ ID NO: 121838 - protein, 9 aa, Homo Sapiens
FPQPEKESF

SEQ ID NO: 121839 - protein, 9 aa, Homo Sapiens
FPQTALVSF

SEQ ID NO: 121840 - protein, 9 aa, Homo Sapiens
FPRHIEPEL

SEQ ID NO: 121841 - protein, 9 aa, Homo Sapiens
FPSADVRTW

SEQ ID NO: 121842 - protein, 9 aa, Homo Sapiens
FPSAKDPTW

SEQ ID NO: 121843 - protein, 9 aa, Homo Sapiens
FPSEDILLV

SEQ ID NO: 121844 - protein, 9 aa, Homo Sapiens
FPSEITDTV

SEQ ID NO: 121845 - protein, 9 aa, Homo Sapiens
FPSEVVGKM

SEQ ID NO: 121846 - protein, 9 aa, Homo Sapiens
FPSEYVPTV

SEQ ID NO: 121847 - protein, 9 aa, Homo Sapiens
FPSGSVHSF

SEQ ID NO: 121848 - protein, 9 aa, Homo Sapiens
FPSIYDVKY

SEQ ID NO: 121849 - protein, 9 aa, Homo Sapiens
FPSLELGHW

SEQ ID NO: 121850 - protein, 9 aa, Homo Sapiens
FPSLQRLVY

SEQ ID NO: 121851 - protein, 9 aa, Homo Sapiens
FPSPIRLEF

SEQ ID NO: 121852 - protein, 9 aa, Homo Sapiens
FPSTAEHTL

SEQ ID NO: 121853 - protein, 9 aa, Homo Sapiens
FPSTTTPQI

SEQ ID NO: 121854 - protein, 9 aa, Homo Sapiens
FPSTVSTVY

SEQ ID NO: 121855 - protein, 9 aa, Homo Sapiens
FPTESTWRW

SEQ ID NO: 121856 - protein, 9 aa, Homo Sapiens
FPTGNIHMF

SEQ ID NO: 121857 - protein, 9 aa, Homo Sapiens
FPVEIKSFY

SEQ ID NO: 121858 - protein, 9 aa, Homo Sapiens
FPVEKQLDL

SEQ ID NO: 121859 - protein, 9 aa, Homo Sapiens
FPVEVNTVL

SEQ ID NO: 121860 - protein, 9 aa, Homo Sapiens
FPVGDVNNF

SEQ ID NO: 121861 - protein, 9 aa, Homo Sapiens
FPVGPGTGF

SEQ ID NO: 121862 - protein, 9 aa, Homo Sapiens
FPVGRVHRL

SEQ ID NO: 121863 - protein, 9 aa, Homo Sapiens
FPVPKGESW

SEQ ID NO: 121864 - protein, 9 aa, Homo Sapiens
FPVSEQRLW

SEQ ID NO: 121865 - protein, 9 aa, Homo Sapiens
FPVSYNDKF

SEQ ID NO: 121866 - protein, 9 aa, Homo Sapiens
FPWEKPTTL

SEQ ID NO: 121867 - protein, 9 aa, Homo Sapiens
FPWSEIRNI

SEQ ID NO: 121868 - protein, 9 aa, Homo Sapiens
FPYAFKEVI

SEQ ID NO: 121869 - protein, 9 aa, Homo Sapiens
FPYAQRQFL

SEQ ID NO: 121870 - protein, 9 aa, Homo Sapiens
FPYGDASKF

SEQ ID NO: 121871 - protein, 9 aa, Homo Sapiens
FPYGTTVTY

SEQ ID NO: 121872 - protein, 9 aa, Homo Sapiens
FPYPDPSQW

SEQ ID NO: 121873 - protein, 9 aa, Homo Sapiens
FPYPFQVVY

SEQ ID NO: 121874 - protein, 9 aa, Homo Sapiens
FPYPYAERL

SEQ ID NO: 121875 - protein, 9 aa, Homo Sapiens
FSLPAQPLW

SEQ ID NO: 121876 - protein, 9 aa, Homo Sapiens
FVGPVVGGW

SEQ ID NO: 121877 - protein, 9 aa, Homo Sapiens
FVILRDEKW

SEQ ID NO: 121878 - protein, 9 aa, Homo Sapiens
FVIPLDPRW

SEQ ID NO: 121879 - protein, 9 aa, Homo Sapiens
GADPGNKKW

SEQ ID NO: 121880 - protein, 9 aa, Homo Sapiens
GAVRENYTW

SEQ ID NO: 121881 - protein, 9 aa, Homo Sapiens
GDTLLIENI

SEQ ID NO: 121882 - protein, 9 aa, Homo Sapiens
GPAAIREGW

SEQ ID NO: 121883 - protein, 9 aa, Homo Sapiens
GPCPAAPIF

SEQ ID NO: 121884 - protein, 9 aa, Homo Sapiens
GPFETVHRW

SEQ ID NO: 121885 - protein, 9 aa, Homo Sapiens
GPNDALLRW

SEQ ID NO: 121886 - protein, 9 aa, Homo Sapiens
GPVEVISHW

SEQ ID NO: 121887 - protein, 9 aa, Homo Sapiens
HAAAPTSTL

SEQ ID NO: 121888 - protein, 9 aa, Homo Sapiens
HAADLSLWW

SEQ ID NO: 121889 - protein, 9 aa, Homo Sapiens
HAADVFEAY

SEQ ID NO: 121890 - protein, 9 aa, Homo Sapiens
HAAGFAYTY

SEQ ID NO: 121891 - protein, 9 aa, Homo Sapiens
HAAHIISEL

SEQ ID NO: 121892 - protein, 9 aa, Homo Sapiens
HAANIVTAI

SEQ ID NO: 121893 - protein, 9 aa, Homo Sapiens
HAAPQPQKL

SEQ ID NO: 121894 - protein, 9 aa, Homo Sapiens
HAASDTVGW

SEQ ID NO: 121895 - protein, 9 aa, Homo Sapiens
HAASESLKF

SEQ ID NO: 121896 - protein, 9 aa, Homo Sapiens
HAATIRLIF

SEQ ID NO: 121897 - protein, 9 aa, Homo Sapiens
HAATTSLSW

SEQ ID NO: 121898 - protein, 9 aa, Homo Sapiens
HAAVPTPGY

SEQ ID NO: 121899 - protein, 9 aa, Homo Sapiens
HAAYNLLFF

SEQ ID NO: 121900 - protein, 9 aa, Homo Sapiens
HACALAASL

SEQ ID NO: 121901 - protein, 9 aa, Homo Sapiens
HACGVIATI

SEQ ID NO: 121902 - protein, 9 aa, Homo Sapiens
HADDSFLVL

SEQ ID NO: 121903 - protein, 9 aa, Homo Sapiens
HADGSLNQW

SEQ ID NO: 121904 - protein, 9 aa, Homo Sapiens
HADGTIVRY

SEQ ID NO: 121905 - protein, 9 aa, Homo Sapiens
HADHSSLTL

SEQ ID NO: 121906 - protein, 9 aa, Homo Sapiens
HADINLLYW

SEQ ID NO: 121907 - protein, 9 aa, Homo Sapiens
HADPTELAL

SEQ ID NO: 121908 - protein, 9 aa, Homo Sapiens
HADTTKWEW

SEQ ID NO: 121909 - protein, 9 aa, Homo Sapiens
HADVATVMW

SEQ ID NO: 121910 - protein, 9 aa, Homo Sapiens
HAEMCFLSW

SEQ ID NO: 121911 - protein, 9 aa, Homo Sapiens
HAFEIIHLL

SEQ ID NO: 121912 - protein, 9 aa, Homo Sapiens
HAFVELHEF

SEQ ID NO: 121913 - protein, 9 aa, Homo Sapiens
HAGNINFKW

SEQ ID NO: 121914 - protein, 9 aa, Homo Sapiens
HAGPIVSVW

SEQ ID NO: 121915 - protein, 9 aa, Homo Sapiens
HAGPTAHEL

SEQ ID NO: 121916 - protein, 9 aa, Homo Sapiens
HAGPVINTL

SEQ ID NO: 121917 - protein, 9 aa, Homo Sapiens
HAGSLLLKM

SEQ ID NO: 121918 - protein, 9 aa, Homo Sapiens
HAHVDKVTY

SEQ ID NO: 121919 - protein, 9 aa, Homo Sapiens
HAHYIAQCW

SEQ ID NO: 121920 - protein, 9 aa, Homo Sapiens
HAIDGTNNW

SEQ ID NO: 121921 - protein, 9 aa, Homo Sapiens
HAIDIICGF

SEQ ID NO: 121922 - protein, 9 aa, Homo Sapiens
HAIEDKETI

SEQ ID NO: 121923 - protein, 9 aa, Homo Sapiens
HAIPLRSSW

SEQ ID NO: 121924 - protein, 9 aa, Homo Sapiens
HALICISHW

SEQ ID NO: 121925 - protein, 9 aa, Homo Sapiens
HAMEEVKKF

SEQ ID NO: 121926 - protein, 9 aa, Homo Sapiens
HAMGGVPAW

SEQ ID NO: 121927 - protein, 9 aa, Homo Sapiens
HANDQTVIF

SEQ ID NO: 121928 - protein, 9 aa, Homo Sapiens
HANNTVSNF

SEQ ID NO: 121929 - protein, 9 aa, Homo Sapiens
HANSVDTSF

SEQ ID NO: 121930 - protein, 9 aa, Homo Sapiens
HAQDYVLTY

SEQ ID NO: 121931 - protein, 9 aa, Homo Sapiens
HAQLSEVLW

SEQ ID NO: 121932 - protein, 9 aa, Homo Sapiens
HARPEEPSW

SEQ ID NO: 121933 - protein, 9 aa, Homo Sapiens
HASCHVQFF

SEQ ID NO: 121934 - protein, 9 aa, Homo Sapiens
HASMLNIWW

SEQ ID NO: 121935 - protein, 9 aa, Homo Sapiens
HASQVCRNW

SEQ ID NO: 121936 - protein, 9 aa, Homo Sapiens
HASRTMPLL

SEQ ID NO: 121937 - protein, 9 aa, Homo Sapiens
HASSEQLYF

SEQ ID NO: 121938 - protein, 9 aa, Homo Sapiens
HATGHHYTW

SEQ ID NO: 121939 - protein, 9 aa, Homo Sapiens
HATKAIYRW

SEQ ID NO: 121940 - protein, 9 aa, Homo Sapiens
HATTALLHY

SEQ ID NO: 121941 - protein, 9 aa, Homo Sapiens
HAVEGAEQW

SEQ ID NO: 121942 - protein, 9 aa, Homo Sapiens
HAVHVALVL

SEQ ID NO: 121943 - protein, 9 aa, Homo Sapiens
HAVPIYEGF

SEQ ID NO: 121944 - protein, 9 aa, Homo Sapiens
HAVQTVETM

SEQ ID NO: 121945 - protein, 9 aa, Homo Sapiens
HAVSPIAKY

SEQ ID NO: 121946 - protein, 9 aa, Homo Sapiens
HAYDGKDYI

SEQ ID NO: 121947 - protein, 9 aa, Homo Sapiens
HAYIHSVQF

SEQ ID NO: 121948 - protein, 9 aa, Homo Sapiens
HAYLHDQFW

SEQ ID NO: 121949 - protein, 9 aa, Homo Sapiens
HGDSSVAVW

SEQ ID NO: 121950 - protein, 9 aa, Homo Sapiens
HGSDICTSW

SEQ ID NO: 121951 - protein, 9 aa, Homo Sapiens
HLAWVQEEW

SEQ ID NO: 121952 - protein, 9 aa, Homo Sapiens
HLSDVVLRF

SEQ ID NO: 121953 - protein, 9 aa, Homo Sapiens
HPAPDQQGL

SEQ ID NO: 121954 - protein, 9 aa, Homo Sapiens
HPASSDPRF

SEQ ID NO: 121955 - protein, 9 aa, Homo Sapiens
HPATVFILF

SEQ ID NO: 121956 - protein, 9 aa, Homo Sapiens
HPCITKTFF

SEQ ID NO: 121957 - protein, 9 aa, Homo Sapiens
HPCLYILTF

SEQ ID NO: 121958 - protein, 9 aa, Homo Sapiens
HPDCLMLNF

SEQ ID NO: 121959 - protein, 9 aa, Homo Sapiens
HPDEPLYSF

SEQ ID NO: 121960 - protein, 9 aa, Homo Sapiens
HPDESGSKF

SEQ ID NO: 121961 - protein, 9 aa, Homo Sapiens
HPDGKILII

SEQ ID NO: 121962 - protein, 9 aa, Homo Sapiens
HPDKDVRLL

SEQ ID NO: 121963 - protein, 9 aa, Homo Sapiens
HPDPNNENI

SEQ ID NO: 121964 - protein, 9 aa, Homo Sapiens
HPDPNWKNF

SEQ ID NO: 121965 - protein, 9 aa, Homo Sapiens
HPDQAQAIL

SEQ ID NO: 121966 - protein, 9 aa, Homo Sapiens
HPDRSQPAF

SEQ ID NO: 121967 - protein, 9 aa, Homo Sapiens
HPDSHQLFI

SEQ ID NO: 121968 - protein, 9 aa, Homo Sapiens
HPDTWNPAW

SEQ ID NO: 121969 - protein, 9 aa, Homo Sapiens
HPEEHIRIW

SEQ ID NO: 121970 - protein, 9 aa, Homo Sapiens
HPEHAFYEF

SEQ ID NO: 121971 - protein, 9 aa, Homo Sapiens
HPERGIRQW

SEQ ID NO: 121972 - protein, 9 aa, Homo Sapiens
HPETRSAFL

SEQ ID NO: 121973 - protein, 9 aa, Homo Sapiens
HPETWQPSW

SEQ ID NO: 121974 - protein, 9 aa, Homo Sapiens
HPEVTPLRF

SEQ ID NO: 121975 - protein, 9 aa, Homo Sapiens
HPFAPPICF

SEQ ID NO: 121976 - protein, 9 aa, Homo Sapiens
HPFEAQTLI

SEQ ID NO: 121977 - protein, 9 aa, Homo Sapiens
HPFEDGAKL

SEQ ID NO: 121978 - protein, 9 aa, Homo Sapiens
HPFFKNDQW

SEQ ID NO: 121979 - protein, 9 aa, Homo Sapiens
HPFFKTINW

SEQ ID NO: 121980 - protein, 9 aa, Homo Sapiens
HPFFSKIDW

SEQ ID NO: 121981 - protein, 9 aa, Homo Sapiens
HPFKIFTKM

SEQ ID NO: 121982 - protein, 9 aa, Homo Sapiens
HPFLTALKY

SEQ ID NO: 121983 - protein, 9 aa, Homo Sapiens
HPFPFHPSL

SEQ ID NO: 121984 - protein, 9 aa, Homo Sapiens
HPGDQAYEF

SEQ ID NO: 121985 - protein, 9 aa, Homo Sapiens
HPGSSALHY

SEQ ID NO: 121986 - protein, 9 aa, Homo Sapiens
HPGSTTLRI

SEQ ID NO: 121987 - protein, 9 aa, Homo Sapiens
HPGTHTVLW

SEQ ID NO: 121988 - protein, 9 aa, Homo Sapiens
HPHDLVILM

SEQ ID NO: 121989 - protein, 9 aa, Homo Sapiens
HPHEVMQRM

SEQ ID NO: 121990 - protein, 9 aa, Homo Sapiens
HPHGSYSRL

SEQ ID NO: 121991 - protein, 9 aa, Homo Sapiens
HPHIFPYLL

SEQ ID NO: 121992 - protein, 9 aa, Homo Sapiens
HPHKIIVMY

SEQ ID NO: 121993 - protein, 9 aa, Homo Sapiens
HPHPEDIKF

SEQ ID NO: 121994 - protein, 9 aa, Homo Sapiens
HPHPVVPKM

SEQ ID NO: 121995 - protein, 9 aa, Homo Sapiens
HPHVYSPVI

SEQ ID NO: 121996 - protein, 9 aa, Homo Sapiens
HPIDRSVDF

SEQ ID NO: 121997 - protein, 9 aa, Homo Sapiens
HPIEVSVGH

SEQ ID NO: 121998 - protein, 9 aa, Homo Sapiens
HPIHADNCL

SEQ ID NO: 121999 - protein, 9 aa, Homo Sapiens
HPIKQVDVL

SEQ ID NO: 122000 - protein, 9 aa, Homo Sapiens
HPILNDPIY

SEQ ID NO: 122001 - protein, 9 aa, Homo Sapiens
HPIPGEYKF

SEQ ID NO: 122002 - protein, 9 aa, Homo Sapiens
HPIQTQAQY

SEQ ID NO: 122003 - protein, 9 aa, Homo Sapiens
HPIRIADGY

SEQ ID NO: 122004 - protein, 9 aa, Homo Sapiens
HPIRLFCRY

SEQ ID NO: 122005 - protein, 9 aa, Homo Sapiens
HPISSEELL

SEQ ID NO: 122006 - protein, 9 aa, Homo Sapiens
HPLDLRVQF

SEQ ID NO: 122007 - protein, 9 aa, Homo Sapiens
HPLDYELTY

SEQ ID NO: 122008 - protein, 9 aa, Homo Sapiens
HPLEDRNTI

SEQ ID NO: 122009 - protein, 9 aa, Homo Sapiens
HPLEGTHEL

SEQ ID NO: 122010 - protein, 9 aa, Homo Sapiens
HPLGDIVAF

SEQ ID NO: 122011 - protein, 9 aa, Homo Sapiens
HPLGIVQGF

SEQ ID NO: 122012 - protein, 9 aa, Homo Sapiens
HPLGMAIFL

SEQ ID NO: 122013 - protein, 9 aa, Homo Sapiens
HPLHNDPNL

SEQ ID NO: 122014 - protein, 9 aa, Homo Sapiens
HPLPEVAHV

SEQ ID NO: 122015 - protein, 9 aa, Homo Sapiens
HPLPGTQLL

SEQ ID NO: 122016 - protein, 9 aa, Homo Sapiens
HPMAYQLQL

SEQ ID NO: 122017 - protein, 9 aa, Homo Sapiens
HPMDHPSAF

SEQ ID NO: 122018 - protein, 9 aa, Homo Sapiens
HPMPRVNEI

SEQ ID NO: 122019 - protein, 9 aa, Homo Sapiens
HPMRAIFMI

SEQ ID NO: 122020 - protein, 9 aa, Homo Sapiens
HPNAKVLLH

SEQ ID NO: 122021 - protein, 9 aa, Homo Sapiens
HPNALNLQL

SEQ ID NO: 122022 - protein, 9 aa, Homo Sapiens
HPNDDDVHF

SEQ ID NO: 122023 - protein, 9 aa, Homo Sapiens
HPNEGALVL

SEQ ID NO: 122024 - protein, 9 aa, Homo Sapiens
HPNEMVRRW

SEQ ID NO: 122025 - protein, 9 aa, Homo Sapiens
HPNGLQVMY

SEQ ID NO: 122026 - protein, 9 aa, Homo Sapiens
HPNPDVLKI

SEQ ID NO: 122027 - protein, 9 aa, Homo Sapiens
HPNPPSVLF

SEQ ID NO: 122028 - protein, 9 aa, Homo Sapiens
HPNSAVLMV

SEQ ID NO: 122029 - protein, 9 aa, Homo Sapiens
HPNSLMKKI

SEQ ID NO: 122030 - protein, 9 aa, Homo Sapiens
HPNSNLLDL

SEQ ID NO: 122031 - protein, 9 aa, Homo Sapiens
HPNTIQEYM

SEQ ID NO: 122032 - protein, 9 aa, Homo Sapiens
HPNYVDCYL

SEQ ID NO: 122033 - protein, 9 aa, Homo Sapiens
HPPNYIVLW

SEQ ID NO: 122034 - protein, 9 aa, Homo Sapiens
HPQDGRSAW

SEQ ID NO: 122035 - protein, 9 aa, Homo Sapiens
HPQEVYNEY

SEQ ID NO: 122036 - protein, 9 aa, Homo Sapiens
HPQPGAVEL

SEQ ID NO: 122037 - protein, 9 aa, Homo Sapiens
HPQTIIAGW

SEQ ID NO: 122038 - protein, 9 aa, Homo Sapiens
HPQTLSHAD

SEQ ID NO: 122039 - protein, 9 aa, Homo Sapiens
HPQYEVVEI

SEQ ID NO: 122040 - protein, 9 aa, Homo Sapiens
HPSASYNQL

SEQ ID NO: 122041 - protein, 9 aa, Homo Sapiens
HPSDIEVDL

SEQ ID NO: 122042 - protein, 9 aa, Homo Sapiens
HPSESLEKM

SEQ ID NO: 122043 - protein, 9 aa, Homo Sapiens
HPSFHNINF

SEQ ID NO: 122044 - protein, 9 aa, Homo Sapiens
HPSGATPTL

SEQ ID NO: 122045 - protein, 9 aa, Homo Sapiens
HPSGLSLHL

SEQ ID NO: 122046 - protein, 9 aa, Homo Sapiens
HPSHVQPAY

SEQ ID NO: 122047 - protein, 9 aa, Homo Sapiens
HPSINKQEW

SEQ ID NO: 122048 - protein, 9 aa, Homo Sapiens
HPSLIPLFV

SEQ ID NO: 122049 - protein, 9 aa, Homo Sapiens
HPSNVLHFF

SEQ ID NO: 122050 - protein, 9 aa, Homo Sapiens
HPSPVVLKV

SEQ ID NO: 122051 - protein, 9 aa, Homo Sapiens
HPSQTVELF

SEQ ID NO: 122052 - protein, 9 aa, Homo Sapiens
HPTADVQTF

SEQ ID NO: 122053 - protein, 9 aa, Homo Sapiens
HPTAFVVSY

SEQ ID NO: 122054 - protein, 9 aa, Homo Sapiens
HPTAHAPMM

SEQ ID NO: 122055 - protein, 9 aa, Homo Sapiens
HPTDDTTTL

SEQ ID NO: 122056 - protein, 9 aa, Homo Sapiens
HPTDPLTSF

SEQ ID NO: 122057 - protein, 9 aa, Homo Sapiens
HPTDVDYRV

SEQ ID NO: 122058 - protein, 9 aa, Homo Sapiens
HPTERCFVF

SEQ ID NO: 122059 - protein, 9 aa, Homo Sapiens
HPTGKMFIL

SEQ ID NO: 122060 - protein, 9 aa, Homo Sapiens
HPTIISESF

SEQ ID NO: 122061 - protein, 9 aa, Homo Sapiens
HPTLIQRTY

SEQ ID NO: 122062 - protein, 9 aa, Homo Sapiens
HPTSHVSLL

SEQ ID NO: 122063 - protein, 9 aa, Homo Sapiens
HPTSVISGY

SEQ ID NO: 122064 - protein, 9 aa, Homo Sapiens
HPTTISPRY

SEQ ID NO: 122065 - protein, 9 aa, Homo Sapiens
HPTTLAVGI

SEQ ID NO: 122066 - protein, 9 aa, Homo Sapiens
HPTVVISAY

SEQ ID NO: 122067 - protein, 9 aa, Homo Sapiens
HPVDFLDAF

SEQ ID NO: 122068 - protein, 9 aa, Homo Sapiens
HPVDQANTL

SEQ ID NO: 122069 - protein, 9 aa, Homo Sapiens
HPVHPDIKL

SEQ ID NO: 122070 - protein, 9 aa, Homo Sapiens
HPVNLTWPF

SEQ ID NO: 122071 - protein, 9 aa, Homo Sapiens
HPVPVPADW

SEQ ID NO: 122072 - protein, 9 aa, Homo Sapiens
HPVSALMEI

SEQ ID NO: 122073 - protein, 9 aa, Homo Sapiens
HPVSLEQYL

SEQ ID NO: 122074 - protein, 9 aa, Homo Sapiens
HPVSQESSW

SEQ ID NO: 122075 - protein, 9 aa, Homo Sapiens
HPVSREWTL

SEQ ID NO: 122076 - protein, 9 aa, Homo Sapiens
HPVTGQFLY

SEQ ID NO: 122077 - protein, 9 aa, Homo Sapiens
HPWTHTERF

SEQ ID NO: 122078 - protein, 9 aa, Homo Sapiens
HPYEVAEVI

SEQ ID NO: 122079 - protein, 9 aa, Homo Sapiens
HPYIYRVTF

SEQ ID NO: 122080 - protein, 9 aa, Homo Sapiens
HPYPHNHYM

SEQ ID NO: 122081 - protein, 9 aa, Homo Sapiens
HPYQFLLKY

SEQ ID NO: 122082 - protein, 9 aa, Homo Sapiens
HPYQPDPKM

SEQ ID NO: 122083 - protein, 9 aa, Homo Sapiens
HSGPVIPVY

SEQ ID NO: 122084 - protein, 9 aa, Homo Sapiens
HSYPGASGW

SEQ ID NO: 122085 - protein, 9 aa, Homo Sapiens
HTNPVGTEW

SEQ ID NO: 122086 - protein, 9 aa, Homo Sapiens
HVGAFGELW

SEQ ID NO: 122087 - protein, 9 aa, Homo Sapiens
HVGPILVGW

SEQ ID NO: 122088 - protein, 9 aa, Homo Sapiens
HVSGAVLTF

SEQ ID NO: 122089 - protein, 9 aa, Homo Sapiens
HVSLVQLTL

SEQ ID NO: 122090 - protein, 9 aa, Homo Sapiens
HVSTVNPNY

SEQ ID NO: 122091 - protein, 9 aa, Homo Sapiens
HVVIVVQDW

SEQ ID NO: 122092 - protein, 9 aa, Homo Sapiens
IAAPDSRRW

SEQ ID NO: 122093 - protein, 9 aa, Homo Sapiens
IAAQTGTRW

SEQ ID NO: 122094 - protein, 9 aa, Homo Sapiens
IADEDRGNW

SEQ ID NO: 122095 - protein, 9 aa, Homo Sapiens
IAHLFNVEW

SEQ ID NO: 122096 - protein, 9 aa, Homo Sapiens
IAMDLILKM

SEQ ID NO: 122097 - protein, 9 aa, Homo Sapiens
IAPETRRSI

SEQ ID NO: 122098 - protein, 9 aa, Homo Sapiens
IAQSLEHSW

SEQ ID NO: 122099 - protein, 9 aa, Homo Sapiens
IAVPRNDEW

SEQ ID NO: 122100 - protein, 9 aa, Homo Sapiens
IIISTPEKW

SEQ ID NO: 122101 - protein, 9 aa, Homo Sapiens
IPAATTIAY

SEQ ID NO: 122102 - protein, 9 aa, Homo Sapiens
IPAAVKLTY

SEQ ID NO: 122103 - protein, 9 aa, Homo Sapiens
IPAEDVPLL

SEQ ID NO: 122104 - protein, 9 aa, Homo Sapiens
IPAEFSGVW

SEQ ID NO: 122105 - protein, 9 aa, Homo Sapiens
IPAESYTFF

SEQ ID NO: 122106 - protein, 9 aa, Homo Sapiens
IPAGTELTF

SEQ ID NO: 122107 - protein, 9 aa, Homo Sapiens
IPANVVLKW

SEQ ID NO: 122108 - protein, 9 aa, Homo Sapiens
IPAQHITLF

SEQ ID NO: 122109 - protein, 9 aa, Homo Sapiens
IPASKVSKW

SEQ ID NO: 122110 - protein, 9 aa, Homo Sapiens
IPCPTVVLL

SEQ ID NO: 122111 - protein, 9 aa, Homo Sapiens
IPDASKLQF

SEQ ID NO: 122112 - protein, 9 aa, Homo Sapiens
IPDEVIKKW

SEQ ID NO: 122113 - protein, 9 aa, Homo Sapiens
IPDIKKDRW

SEQ ID NO: 122114 - protein, 9 aa, Homo Sapiens
IPDIQAHEW

SEQ ID NO: 122115 - protein, 9 aa, Homo Sapiens
IPDKQYTDW

SEQ ID NO: 122116 - protein, 9 aa, Homo Sapiens
IPDLSEYKW

SEQ ID NO: 122117 - protein, 9 aa, Homo Sapiens
IPDQVIRVF

SEQ ID NO: 122118 - protein, 9 aa, Homo Sapiens
IPDTLQELF

SEQ ID NO: 122119 - protein, 9 aa, Homo Sapiens
IPDTMAHLI

SEQ ID NO: 122120 - protein, 9 aa, Homo Sapiens
IPFEFPLHL

SEQ ID NO: 122121 - protein, 9 aa, Homo Sapiens
IPFISPKRW

SEQ ID NO: 122122 - protein, 9 aa, Homo Sapiens
IPFNQALVF

SEQ ID NO: 122123 - protein, 9 aa, Homo Sapiens
IPFRPSIQF

SEQ ID NO: 122124 - protein, 9 aa, Homo Sapiens
IPFTGNVKL

SEQ ID NO: 122125 - protein, 9 aa, Homo Sapiens
IPFVDPDSW

SEQ ID NO: 122126 - protein, 9 aa, Homo Sapiens
IPHDVLPDW

SEQ ID NO: 122127 - protein, 9 aa, Homo Sapiens
IPHHIIVKF

SEQ ID NO: 122128 - protein, 9 aa, Homo Sapiens
IPIEGATEW

SEQ ID NO: 122129 - protein, 9 aa, Homo Sapiens
IPIEPDYKF

SEQ ID NO: 122130 - protein, 9 aa, Homo Sapiens
IPLHYLLSY

SEQ ID NO: 122131 - protein, 9 aa, Homo Sapiens
IPMTPTSSF

SEQ ID NO: 122132 - protein, 9 aa, Homo Sapiens
IPNEIIHAL

SEQ ID NO: 122133 - protein, 9 aa, Homo Sapiens
IPNENEAQF

SEQ ID NO: 122134 - protein, 9 aa, Homo Sapiens
IPNENELQF

SEQ ID NO: 122135 - protein, 9 aa, Homo Sapiens
IPNFDVREI

SEQ ID NO: 122136 - protein, 9 aa, Homo Sapiens
IPRIDYDRI

SEQ ID NO: 122137 - protein, 9 aa, Homo Sapiens
IPRPDGIEW

SEQ ID NO: 122138 - protein, 9 aa, Homo Sapiens
IPSAEVEKW

SEQ ID NO: 122139 - protein, 9 aa, Homo Sapiens
IPSDLACRL

SEQ ID NO: 122140 - protein, 9 aa, Homo Sapiens
IPSELFSSF

SEQ ID NO: 122141 - protein, 9 aa, Homo Sapiens
IPSQLNVNF

SEQ ID NO: 122142 - protein, 9 aa, Homo Sapiens
IPSRLPLLL

SEQ ID NO: 122143 - protein, 9 aa, Homo Sapiens
IPSSKLLFL

SEQ ID NO: 122144 - protein, 9 aa, Homo Sapiens
IPSSVPATF

SEQ ID NO: 122145 - protein, 9 aa, Homo Sapiens
IPSSWRLLF

SEQ ID NO: 122146 - protein, 9 aa, Homo Sapiens
IPSTCSEIW

SEQ ID NO: 122147 - protein, 9 aa, Homo Sapiens
IPTEQVNEL

SEQ ID NO: 122148 - protein, 9 aa, Homo Sapiens
IPTKQTQTF

SEQ ID NO: 122149 - protein, 9 aa, Homo Sapiens
IPTRVITNF

SEQ ID NO: 122150 - protein, 9 aa, Homo Sapiens
IPVAIRTQI

SEQ ID NO: 122151 - protein, 9 aa, Homo Sapiens
IPVGGTYLI

SEQ ID NO: 122152 - protein, 9 aa, Homo Sapiens
IPVSQISTI

SEQ ID NO: 122153 - protein, 9 aa, Homo Sapiens
IPYEGFASL

SEQ ID NO: 122154 - protein, 9 aa, Homo Sapiens
IPYPGCEFF

SEQ ID NO: 122155 - protein, 9 aa, Homo Sapiens
IPYPRPIHL

SEQ ID NO: 122156 - protein, 9 aa, Homo Sapiens
IPYQDRESY

SEQ ID NO: 122157 - protein, 9 aa, Homo Sapiens
IPYSPDVQI

SEQ ID NO: 122158 - protein, 9 aa, Homo Sapiens
ITTTINPRF

SEQ ID NO: 122159 - protein, 9 aa, Homo Sapiens
KAPGSTSNL

SEQ ID NO: 122160 - protein, 9 aa, Homo Sapiens
KPFIDREWW

SEQ ID NO: 122161 - protein, 9 aa, Homo Sapiens
KPFQAVFKF

SEQ ID NO: 122162 - protein, 9 aa, Homo Sapiens
KPIESFNEY

SEQ ID NO: 122163 - protein, 9 aa, Homo Sapiens
KPIPKSDKF

SEQ ID NO: 122164 - protein, 9 aa, Homo Sapiens
KPNDQSSRW

SEQ ID NO: 122165 - protein, 9 aa, Homo Sapiens
KPNGLILQY

SEQ ID NO: 122166 - protein, 9 aa, Homo Sapiens
KPNKTRVIW

SEQ ID NO: 122167 - protein, 9 aa, Homo Sapiens
KPTHVVVTL

SEQ ID NO: 122168 - protein, 9 aa, Homo Sapiens
KPVELRTKW

SEQ ID NO: 122169 - protein, 9 aa, Homo Sapiens
LAASVISKW

SEQ ID NO: 122170 - protein, 9 aa, Homo Sapiens
LACSAGDTW

SEQ ID NO: 122171 - protein, 9 aa, Homo Sapiens
LAEEGFYKF

SEQ ID NO: 122172 - protein, 9 aa, Homo Sapiens
LAHGADVNW

SEQ ID NO: 122173 - protein, 9 aa, Homo Sapiens
LASDPDCRW

SEQ ID NO: 122174 - protein, 9 aa, Homo Sapiens
LATASSPKF

SEQ ID NO: 122175 - protein, 9 aa, Homo Sapiens
LATTILQHW

SEQ ID NO: 122176 - protein, 9 aa, Homo Sapiens
LPAAARPLW

SEQ ID NO: 122177 - protein, 9 aa, Homo Sapiens
LPAACLLQL

SEQ ID NO: 122178 - protein, 9 aa, Homo Sapiens
LPAAGKTTW

SEQ ID NO: 122179 - protein, 9 aa, Homo Sapiens
LPAALLSRF

SEQ ID NO: 122180 - protein, 9 aa, Homo Sapiens
LPADCQIHL

SEQ ID NO: 122181 - protein, 9 aa, Homo Sapiens
LPADTVQRI

SEQ ID NO: 122182 - protein, 9 aa, Homo Sapiens
LPADVQNYY

SEQ ID NO: 122183 - protein, 9 aa, Homo Sapiens
LPADWAPLF

SEQ ID NO: 122184 - protein, 9 aa, Homo Sapiens
LPAEFFEVL

SEQ ID NO: 122185 - protein, 9 aa, Homo Sapiens
LPAEHQFSF

SEQ ID NO: 122186 - protein, 9 aa, Homo Sapiens
LPAESNEKI

SEQ ID NO: 122187 - protein, 9 aa, Homo Sapiens
LPAEYATHF

SEQ ID NO: 122188 - protein, 9 aa, Homo Sapiens
LPAGIVAVL

SEQ ID NO: 122189 - protein, 9 aa, Homo Sapiens
LPAGSKKNW

SEQ ID NO: 122190 - protein, 9 aa, Homo Sapiens
LPAKILVEF

SEQ ID NO: 122191 - protein, 9 aa, Homo Sapiens
LPALFTDLY

SEQ ID NO: 122192 - protein, 9 aa, Homo Sapiens
LPALKDRKW

SEQ ID NO: 122193 - protein, 9 aa, Homo Sapiens
LPAPGVPAW

SEQ ID NO: 122194 - protein, 9 aa, Homo Sapiens
LPAPPKIYF

SEQ ID NO: 122195 - protein, 9 aa, Homo Sapiens
LPAPPTQNM

SEQ ID NO: 122196 - protein, 9 aa, Homo Sapiens
LPAQQVHNY

SEQ ID NO: 122197 - protein, 9 aa, Homo Sapiens
LPASEGEVW

SEQ ID NO: 122198 - protein, 9 aa, Homo Sapiens
LPASVHPQL

SEQ ID NO: 122199 - protein, 9 aa, Homo Sapiens
LPATPWGVW

SEQ ID NO: 122200 - protein, 9 aa, Homo Sapiens
LPCKDAPEL

SEQ ID NO: 122201 - protein, 9 aa, Homo Sapiens
LPCKFTSQF

SEQ ID NO: 122202 - protein, 9 aa, Homo Sapiens
LPCPDSQKL

SEQ ID NO: 122203 - protein, 9 aa, Homo Sapiens
LPDDISHGY

SEQ ID NO: 122204 - protein, 9 aa, Homo Sapiens
LPDDKLTLF

SEQ ID NO: 122205 - protein, 9 aa, Homo Sapiens
LPDDSKDTW

SEQ ID NO: 122206 - protein, 9 aa, Homo Sapiens
LPDEIYHVY

SEQ ID NO: 122207 - protein, 9 aa, Homo Sapiens
LPDEKVELF

SEQ ID NO: 122208 - protein, 9 aa, Homo Sapiens
LPDEVRERW

SEQ ID NO: 122209 - protein, 9 aa, Homo Sapiens
LPDGPAGSW

SEQ ID NO: 122210 - protein, 9 aa, Homo Sapiens
LPDGQVITI

SEQ ID NO: 122211 - protein, 9 aa, Homo Sapiens
LPDGSTIEI

SEQ ID NO: 122212 - protein, 9 aa, Homo Sapiens
LPDGSYEDW

SEQ ID NO: 122213 - protein, 9 aa, Homo Sapiens
LPDHPHFHW

SEQ ID NO: 122214 - protein, 9 aa, Homo Sapiens
LPDKGAQRL

SEQ ID NO: 122215 - protein, 9 aa, Homo Sapiens
LPDLDSENW

SEQ ID NO: 122216 - protein, 9 aa, Homo Sapiens
LPDNAKQCF

SEQ ID NO: 122217 - protein, 9 aa, Homo Sapiens
LPDPGFQKI

SEQ ID NO: 122218 - protein, 9 aa, Homo Sapiens
LPDPIIIHL

SEQ ID NO: 122219 - protein, 9 aa, Homo Sapiens
LPDPNLITF

SEQ ID NO: 122220 - protein, 9 aa, Homo Sapiens
LPDQSFLWN

SEQ ID NO: 122221 - protein, 9 aa, Homo Sapiens
LPDTLKVTY

SEQ ID NO: 122222 - protein, 9 aa, Homo Sapiens
LPDTQTPSW

SEQ ID NO: 122223 - protein, 9 aa, Homo Sapiens
LPDVSLQEF

SEQ ID NO: 122224 - protein, 9 aa, Homo Sapiens
LPEAHQRTW

SEQ ID NO: 122225 - protein, 9 aa, Homo Sapiens
LPEDFYHFW

SEQ ID NO: 122226 - protein, 9 aa, Homo Sapiens
LPEDKPRLI

SEQ ID NO: 122227 - protein, 9 aa, Homo Sapiens
LPEDLYHLI

SEQ ID NO: 122228 - protein, 9 aa, Homo Sapiens
LPEDVGHCF

SEQ ID NO: 122229 - protein, 9 aa, Homo Sapiens
LPEEEHEFF

SEQ ID NO: 122230 - protein, 9 aa, Homo Sapiens
LPEEHARFY

SEQ ID NO: 122231 - protein, 9 aa, Homo Sapiens
LPEEPITRW

SEQ ID NO: 122232 - protein, 9 aa, Homo Sapiens
LPEHNLITW

SEQ ID NO: 122233 - protein, 9 aa, Homo Sapiens
LPEPVTLRW

SEQ ID NO: 122234 - protein, 9 aa, Homo Sapiens
LPFDKETGF

SEQ ID NO: 122235 - protein, 9 aa, Homo Sapiens
LPFEGKCYY

SEQ ID NO: 122236 - protein, 9 aa, Homo Sapiens
LPFEGKVNL

SEQ ID NO: 122237 - protein, 9 aa, Homo Sapiens
LPFEPVPVI

SEQ ID NO: 122238 - protein, 9 aa, Homo Sapiens
LPFEVLQHI

SEQ ID NO: 122239 - protein, 9 aa, Homo Sapiens
LPFFNDRPW

SEQ ID NO: 122240 - protein, 9 aa, Homo Sapiens
LPFGKVTNI

SEQ ID NO: 122241 - protein, 9 aa, Homo Sapiens
LPFGPTAYF

SEQ ID NO: 122242 - protein, 9 aa, Homo Sapiens
LPFIPPQRW

SEQ ID NO: 122243 - protein, 9 aa, Homo Sapiens
LPFLEASTL

SEQ ID NO: 122244 - protein, 9 aa, Homo Sapiens
LPFPFPSKL

SEQ ID NO: 122245 - protein, 9 aa, Homo Sapiens
LPFPIIQQY

SEQ ID NO: 122246 - protein, 9 aa, Homo Sapiens
LPFQFAHHL

SEQ ID NO: 122247 - protein, 9 aa, Homo Sapiens
LPFQVANVW

SEQ ID NO: 122248 - protein, 9 aa, Homo Sapiens
LPGAGKTTW

SEQ ID NO: 122249 - protein, 9 aa, Homo Sapiens
LPGDTALLL

SEQ ID NO: 122250 - protein, 9 aa, Homo Sapiens
LPGGPTLTF

SEQ ID NO: 122251 - protein, 9 aa, Homo Sapiens
LPGLTQVRW

SEQ ID NO: 122252 - protein, 9 aa, Homo Sapiens
LPGNPNAVW

SEQ ID NO: 122253 - protein, 9 aa, Homo Sapiens
LPGPHYYTW

SEQ ID NO: 122254 - protein, 9 aa, Homo Sapiens
LPGPSLDQW

SEQ ID NO: 122255 - protein, 9 aa, Homo Sapiens
LPGSGKTQW

SEQ ID NO: 122256 - protein, 9 aa, Homo Sapiens
LPHEDLPFW

SEQ ID NO: 122257 - protein, 9 aa, Homo Sapiens
LPHELCTLI

SEQ ID NO: 122258 - protein, 9 aa, Homo Sapiens
LPHHVHLTW

SEQ ID NO: 122259 - protein, 9 aa, Homo Sapiens
LPHITDVSW

SEQ ID NO: 122260 - protein, 9 aa, Homo Sapiens
LPHQPLATY

SEQ ID NO: 122261 - protein, 9 aa, Homo Sapiens
LPHSGEAQL

SEQ ID NO: 122262 - protein, 9 aa, Homo Sapiens
LPHSVNSKL

SEQ ID NO: 122263 - protein, 9 aa, Homo Sapiens
LPIDDVLRI

SEQ ID NO: 122264 - protein, 9 aa, Homo Sapiens
LPIDESNTI

SEQ ID NO: 122265 - protein, 9 aa, Homo Sapiens
LPISKIDQW

SEQ ID NO: 122266 - protein, 9 aa, Homo Sapiens
LPLAHVLEL

SEQ ID NO: 122267 - protein, 9 aa, Homo Sapiens
LPLEEAYRF

SEQ ID NO: 122268 - protein, 9 aa, Homo Sapiens
LPLEEHYRF

SEQ ID NO: 122269 - protein, 9 aa, Homo Sapiens
LPLEPEQFL

SEQ ID NO: 122270 - protein, 9 aa, Homo Sapiens
LPLHIAPRW

SEQ ID NO: 122271 - protein, 9 aa, Homo Sapiens
LPLHVATLL

SEQ ID NO: 122272 - protein, 9 aa, Homo Sapiens
LPLHVLPLY

SEQ ID NO: 122273 - protein, 9 aa, Homo Sapiens
LPLLRTVLW

SEQ ID NO: 122274 - protein, 9 aa, Homo Sapiens
LPLLSPVTF

SEQ ID NO: 122275 - protein, 9 aa, Homo Sapiens
LPLLSVYQL

SEQ ID NO: 122276 - protein, 9 aa, Homo Sapiens
LPLNSVYVY

SEQ ID NO: 122277 - protein, 9 aa, Homo Sapiens
LPLPEVQCF

SEQ ID NO: 122278 - protein, 9 aa, Homo Sapiens
LPLPHFDTI

SEQ ID NO: 122279 - protein, 9 aa, Homo Sapiens
LPLPVLEKW

SEQ ID NO: 122280 - protein, 9 aa, Homo Sapiens
LPLPVVQLL

SEQ ID NO: 122281 - protein, 9 aa, Homo Sapiens
LPLQENVTI

SEQ ID NO: 122282 - protein, 9 aa, Homo Sapiens
LPLQTVQRL

SEQ ID NO: 122283 - protein, 9 aa, Homo Sapiens
LPNAVITRI

SEQ ID NO: 122284 - protein, 9 aa, Homo Sapiens
LPNDGDEKY

SEQ ID NO: 122285 - protein, 9 aa, Homo Sapiens
LPNDKTLLY

SEQ ID NO: 122286 - protein, 9 aa, Homo Sapiens
LPNDVISSL

SEQ ID NO: 122287 - protein, 9 aa, Homo Sapiens
LPNELIELL

SEQ ID NO: 122288 - protein, 9 aa, Homo Sapiens
LPNGLDVTF

SEQ ID NO: 122289 - protein, 9 aa, Homo Sapiens
LPNGPTAHF

SEQ ID NO: 122290 - protein, 9 aa, Homo Sapiens
LPNIQAVLL

SEQ ID NO: 122291 - protein, 9 aa, Homo Sapiens
LPNNAKLEM

SEQ ID NO: 122292 - protein, 9 aa, Homo Sapiens
LPNNIVDVW

SEQ ID NO: 122293 - protein, 9 aa, Homo Sapiens
LPNNRELYI

SEQ ID NO: 122294 - protein, 9 aa, Homo Sapiens
LPNQTVLKI

SEQ ID NO: 122295 - protein, 9 aa, Homo Sapiens
LPNSIASRF

SEQ ID NO: 122296 - protein, 9 aa, Homo Sapiens
LPNTDVPIL

SEQ ID NO: 122297 - protein, 9 aa, Homo Sapiens
LPQAQQPQW

SEQ ID NO: 122298 - protein, 9 aa, Homo Sapiens
LPQDVILKF

SEQ ID NO: 122299 - protein, 9 aa, Homo Sapiens
LPQNAPNYW

SEQ ID NO: 122300 - protein, 9 aa, Homo Sapiens
LPQPLILRW

SEQ ID NO: 122301 - protein, 9 aa, Homo Sapiens
LPRDEADEL

SEQ ID NO: 122302 - protein, 9 aa, Homo Sapiens
LPSDFEHTI

SEQ ID NO: 122303 - protein, 9 aa, Homo Sapiens
LPSDHSVKY

SEQ ID NO: 122304 - protein, 9 aa, Homo Sapiens
LPSDKALVL

SEQ ID NO: 122305 - protein, 9 aa, Homo Sapiens
LPSDVQTAI

SEQ ID NO: 122306 - protein, 9 aa, Homo Sapiens
LPSDVSILY

SEQ ID NO: 122307 - protein, 9 aa, Homo Sapiens
LPSDVVTGY

SEQ ID NO: 122308 - protein, 9 aa, Homo Sapiens
LPSEHQTIL

SEQ ID NO: 122309 - protein, 9 aa, Homo Sapiens
LPSEIEVKY

SEQ ID NO: 122310 - protein, 9 aa, Homo Sapiens
LPSEKAIFL

SEQ ID NO: 122311 - protein, 9 aa, Homo Sapiens
LPSELIVHI

SEQ ID NO: 122312 - protein, 9 aa, Homo Sapiens
LPSEMQTRI

SEQ ID NO: 122313 - protein, 9 aa, Homo Sapiens
LPSEQQEQW

SEQ ID NO: 122314 - protein, 9 aa, Homo Sapiens
LPSETIQTY

SEQ ID NO: 122315 - protein, 9 aa, Homo Sapiens
LPSGAILSL

SEQ ID NO: 122316 - protein, 9 aa, Homo Sapiens
LPSGAVFVI

SEQ ID NO: 122317 - protein, 9 aa, Homo Sapiens
LPSGEVVKI

SEQ ID NO: 122318 - protein, 9 aa, Homo Sapiens
LPSHGRVQW

SEQ ID NO: 122319 - protein, 9 aa, Homo Sapiens
LPSHGVPLI

SEQ ID NO: 122320 - protein, 9 aa, Homo Sapiens
LPSHLNISY

SEQ ID NO: 122321 - protein, 9 aa, Homo Sapiens
LPSHTKIKY

SEQ ID NO: 122322 - protein, 9 aa, Homo Sapiens
LPSHVVTML

SEQ ID NO: 122323 - protein, 9 aa, Homo Sapiens
LPSKTKVAW

SEQ ID NO: 122324 - protein, 9 aa, Homo Sapiens
LPSLADFSP

SEQ ID NO: 122325 - protein, 9 aa, Homo Sapiens
LPSLDKPGW

SEQ ID NO: 122326 - protein, 9 aa, Homo Sapiens
LPSLPMTSW

SEQ ID NO: 122327 - protein, 9 aa, Homo Sapiens
LPSLVPLRI

SEQ ID NO: 122328 - protein, 9 aa, Homo Sapiens
LPSNDSSKF

SEQ ID NO: 122329 - protein, 9 aa, Homo Sapiens
LPSPAHHLW

SEQ ID NO: 122330 - protein, 9 aa, Homo Sapiens
LPSPHPVRY

SEQ ID NO: 122331 - protein, 9 aa, Homo Sapiens
LPSPLQPSW

SEQ ID NO: 122332 - protein, 9 aa, Homo Sapiens
LPSPSTPRF

SEQ ID NO: 122333 - protein, 9 aa, Homo Sapiens
LPSQLAHRL

SEQ ID NO: 122334 - protein, 9 aa, Homo Sapiens
LPSSEVVKF

SEQ ID NO: 122335 - protein, 9 aa, Homo Sapiens
LPSSFVEKL

SEQ ID NO: 122336 - protein, 9 aa, Homo Sapiens
LPSSHVARL

SEQ ID NO: 122337 - protein, 9 aa, Homo Sapiens
LPSSLYLKI

SEQ ID NO: 122338 - protein, 9 aa, Homo Sapiens
LPSSNYSNI

SEQ ID NO: 122339 - protein, 9 aa, Homo Sapiens
LPSSSPEHL

SEQ ID NO: 122340 - protein, 9 aa, Homo Sapiens
LPSSTKSGW

SEQ ID NO: 122341 - protein, 9 aa, Homo Sapiens
LPSSVISAI

SEQ ID NO: 122342 - protein, 9 aa, Homo Sapiens
LPSTTIVSM

SEQ ID NO: 122343 - protein, 9 aa, Homo Sapiens
LPTASASKF

SEQ ID NO: 122344 - protein, 9 aa, Homo Sapiens
LPTDTLQEL

SEQ ID NO: 122345 - protein, 9 aa, Homo Sapiens
LPTEEPSVW

SEQ ID NO: 122346 - protein, 9 aa, Homo Sapiens
LPTEQEVRF

SEQ ID NO: 122347 - protein, 9 aa, Homo Sapiens
LPTFQSPEF

SEQ ID NO: 122348 - protein, 9 aa, Homo Sapiens
LPTGAAFRW

SEQ ID NO: 122349 - protein, 9 aa, Homo Sapiens
LPTGIPIVY

SEQ ID NO: 122350 - protein, 9 aa, Homo Sapiens
LPTGVYLNF

SEQ ID NO: 122351 - protein, 9 aa, Homo Sapiens
LPTYGVHYY

SEQ ID NO: 122352 - protein, 9 aa, Homo Sapiens
LPVALPARW

SEQ ID NO: 122353 - protein, 9 aa, Homo Sapiens
LPVALQTRL

SEQ ID NO: 122354 - protein, 9 aa, Homo Sapiens
LPVDFHIKM

SEQ ID NO: 122355 - protein, 9 aa, Homo Sapiens
LPVDFVECL

SEQ ID NO: 122356 - protein, 9 aa, Homo Sapiens
LPVDIRQYL

SEQ ID NO: 122357 - protein, 9 aa, Homo Sapiens
LPVDLAEEL

SEQ ID NO: 122358 - protein, 9 aa, Homo Sapiens
LPVDSSHGF

SEQ ID NO: 122359 - protein, 9 aa, Homo Sapiens
LPVEEFNEL

SEQ ID NO: 122360 - protein, 9 aa, Homo Sapiens
LPVEHVNQL

SEQ ID NO: 122361 - protein, 9 aa, Homo Sapiens
LPVIIFTTF

SEQ ID NO: 122362 - protein, 9 aa, Homo Sapiens
LPVLSTDKF

SEQ ID NO: 122363 - protein, 9 aa, Homo Sapiens
LPVNESFGF

SEQ ID NO: 122364 - protein, 9 aa, Homo Sapiens
LPVPAFNVI

SEQ ID NO: 122365 - protein, 9 aa, Homo Sapiens
LPVPDPILL

SEQ ID NO: 122366 - protein, 9 aa, Homo Sapiens
LPVPVIPSF

SEQ ID NO: 122367 - protein, 9 aa, Homo Sapiens
LPVRYLQEF

SEQ ID NO: 122368 - protein, 9 aa, Homo Sapiens
LPVSHGAHF

SEQ ID NO: 122369 - protein, 9 aa, Homo Sapiens
LPVSQPKSW

SEQ ID NO: 122370 - protein, 9 aa, Homo Sapiens
LPWASTHSL

SEQ ID NO: 122371 - protein, 9 aa, Homo Sapiens
LPWEEREKI

SEQ ID NO: 122372 - protein, 9 aa, Homo Sapiens
LPWNITVHF

SEQ ID NO: 122373 - protein, 9 aa, Homo Sapiens
LPWVGKELY

SEQ ID NO: 122374 - protein, 9 aa, Homo Sapiens
LPYAGDVSM

SEQ ID NO: 122375 - protein, 9 aa, Homo Sapiens
LPYNDYFEY

SEQ ID NO: 122376 - protein, 9 aa, Homo Sapiens
LPYNHQHEY

SEQ ID NO: 122377 - protein, 9 aa, Homo Sapiens
LPYPFASEI

SEQ ID NO: 122378 - protein, 9 aa, Homo Sapiens
LPYPFTHHW

SEQ ID NO: 122379 - protein, 9 aa, Homo Sapiens
LPYQGHNSF

SEQ ID NO: 122380 - protein, 9 aa, Homo Sapiens
LPYTNPSKF

SEQ ID NO: 122381 - protein, 9 aa, Homo Sapiens
LVADPDCRW

SEQ ID NO: 122382 - protein, 9 aa, Homo Sapiens
LVHAVQALW

SEQ ID NO: 122383 - protein, 9 aa, Homo Sapiens
LVNNTPLNW

SEQ ID NO: 122384 - protein, 9 aa, Homo Sapiens
LVSDLQQVW

SEQ ID NO: 122385 - protein, 9 aa, Homo Sapiens
MAAAGNYAW

SEQ ID NO: 122386 - protein, 9 aa, Homo Sapiens
MAADGRLVF

SEQ ID NO: 122387 - protein, 9 aa, Homo Sapiens
MAAEPYETI

SEQ ID NO: 122388 - protein, 9 aa, Homo Sapiens
MACDTFIKI

SEQ ID NO: 122389 - protein, 9 aa, Homo Sapiens
MADHLANSW

SEQ ID NO: 122390 - protein, 9 aa, Homo Sapiens
MAGDIYSVF

SEQ ID NO: 122391 - protein, 9 aa, Homo Sapiens
MAHTGVIFF

SEQ ID NO: 122392 - protein, 9 aa, Homo Sapiens
MAIEAQQKF

SEQ ID NO: 122393 - protein, 9 aa, Homo Sapiens
MAIVGTHKF

SEQ ID NO: 122394 - protein, 9 aa, Homo Sapiens
MALEHLVVW

SEQ ID NO: 122395 - protein, 9 aa, Homo Sapiens
MANDLKEVW

SEQ ID NO: 122396 - protein, 9 aa, Homo Sapiens
MANGAVIHL

SEQ ID NO: 122397 - protein, 9 aa, Homo Sapiens
MANPRELRI

SEQ ID NO: 122398 - protein, 9 aa, Homo Sapiens
MAQHFDEVW

SEQ ID NO: 122399 - protein, 9 aa, Homo Sapiens
MARYEREQY

SEQ ID NO: 122400 - protein, 9 aa, Homo Sapiens
MATAHVTEI

SEQ ID NO: 122401 - protein, 9 aa, Homo Sapiens
MATESILHF

SEQ ID NO: 122402 - protein, 9 aa, Homo Sapiens
MAYPDLNEI

SEQ ID NO: 122403 - protein, 9 aa, Homo Sapiens
MPAAGGVLY

SEQ ID NO: 122404 - protein, 9 aa, Homo Sapiens
MPAATDNRY

SEQ ID NO: 122405 - protein, 9 aa, Homo Sapiens
MPADIATLL

SEQ ID NO: 122406 - protein, 9 aa, Homo Sapiens
MPADTNKAF

SEQ ID NO: 122407 - protein, 9 aa, Homo Sapiens
MPAEIVELH

SEQ ID NO: 122408 - protein, 9 aa, Homo Sapiens
MPAFIFEHI

SEQ ID NO: 122409 - protein, 9 aa, Homo Sapiens
MPAGEIEQF

SEQ ID NO: 122410 - protein, 9 aa, Homo Sapiens
MPAPEIVSY

SEQ ID NO: 122411 - protein, 9 aa, Homo Sapiens
MPATVFMLF

SEQ ID NO: 122412 - protein, 9 aa, Homo Sapiens
MPAVKAIIY

SEQ ID NO: 122413 - protein, 9 aa, Homo Sapiens
MPCEALVRM

SEQ ID NO: 122414 - protein, 9 aa, Homo Sapiens
MPDDHARKI

SEQ ID NO: 122415 - protein, 9 aa, Homo Sapiens
MPDDLLTTL

SEQ ID NO: 122416 - protein, 9 aa, Homo Sapiens
MPDGKIQKL

SEQ ID NO: 122417 - protein, 9 aa, Homo Sapiens
MPDGKLYNF

SEQ ID NO: 122418 - protein, 9 aa, Homo Sapiens
MPDHTDVSL

SEQ ID NO: 122419 - protein, 9 aa, Homo Sapiens
MPDHVIPEI

SEQ ID NO: 122420 - protein, 9 aa, Homo Sapiens
MPDPTPFLL

SEQ ID NO: 122421 - protein, 9 aa, Homo Sapiens
MPDSAAALL

SEQ ID NO: 122422 - protein, 9 aa, Homo Sapiens
MPDSGRPAF

SEQ ID NO: 122423 - protein, 9 aa, Homo Sapiens
MPDVVVRSF

SEQ ID NO: 122424 - protein, 9 aa, Homo Sapiens
MPEDGQVNI

SEQ ID NO: 122425 - protein, 9 aa, Homo Sapiens
MPEKLSHKL

SEQ ID NO: 122426 - protein, 9 aa, Homo Sapiens
MPEPASRCL

SEQ ID NO: 122427 - protein, 9 aa, Homo Sapiens
MPEPDAQRF

SEQ ID NO: 122428 - protein, 9 aa, Homo Sapiens
MPEPTVLSL

SEQ ID NO: 122429 - protein, 9 aa, Homo Sapiens
MPEQWARLL

SEQ ID NO: 122430 - protein, 9 aa, Homo Sapiens
MPEVRGALF

SEQ ID NO: 122431 - protein, 9 aa, Homo Sapiens
MPFNKEPKW

SEQ ID NO: 122432 - protein, 9 aa, Homo Sapiens
MPFTTVSEL

SEQ ID NO: 122433 - protein, 9 aa, Homo Sapiens
MPGGNKEAW

SEQ ID NO: 122434 - protein, 9 aa, Homo Sapiens
MPHDAIILL

SEQ ID NO: 122435 - protein, 9 aa, Homo Sapiens
MPHDLITQL

SEQ ID NO: 122436 - protein, 9 aa, Homo Sapiens
MPHEKHYTL

SEQ ID NO: 122437 - protein, 9 aa, Homo Sapiens
MPHHTPHQL

SEQ ID NO: 122438 - protein, 9 aa, Homo Sapiens
MPHNQFIKM

SEQ ID NO: 122439 - protein, 9 aa, Homo Sapiens
MPHNYSRCY

SEQ ID NO: 122440 - protein, 9 aa, Homo Sapiens
MPHQLQDTF

SEQ ID NO: 122441 - protein, 9 aa, Homo Sapiens
MPHRISSHF

SEQ ID NO: 122442 - protein, 9 aa, Homo Sapiens
MPHSSSAKL

SEQ ID NO: 122443 - protein, 9 aa, Homo Sapiens
MPIGPDVSL

SEQ ID NO: 122444 - protein, 9 aa, Homo Sapiens
MPIQGQPCF

SEQ ID NO: 122445 - protein, 9 aa, Homo Sapiens
MPKKGGRWW

SEQ ID NO: 122446 - protein, 9 aa, Homo Sapiens
MPLAFSDKY

SEQ ID NO: 122447 - protein, 9 aa, Homo Sapiens
MPLEDMNEF

SEQ ID NO: 122448 - protein, 9 aa, Homo Sapiens
MPLEEGDTF

SEQ ID NO: 122449 - protein, 9 aa, Homo Sapiens
MPLGARILF

SEQ ID NO: 122450 - protein, 9 aa, Homo Sapiens
MPLGTIHCI

SEQ ID NO: 122451 - protein, 9 aa, Homo Sapiens
MPLHVAPLL

SEQ ID NO: 122452 - protein, 9 aa, Homo Sapiens
MPLNVADLI

SEQ ID NO: 122453 - protein, 9 aa, Homo Sapiens
MPLQLLLLL

SEQ ID NO: 122454 - protein, 9 aa, Homo Sapiens
MPLRDAAKL

SEQ ID NO: 122455 - protein, 9 aa, Homo Sapiens
MPLSFPSLL

SEQ ID NO: 122456 - protein, 9 aa, Homo Sapiens
MPLTSIQCW

SEQ ID NO: 122457 - protein, 9 aa, Homo Sapiens
MPMGPDQKY

SEQ ID NO: 122458 - protein, 9 aa, Homo Sapiens
MPMLNERTW

SEQ ID NO: 122459 - protein, 9 aa, Homo Sapiens
MPMNVADLI

SEQ ID NO: 122460 - protein, 9 aa, Homo Sapiens
MPMRLDDGW

SEQ ID NO: 122461 - protein, 9 aa, Homo Sapiens
MPNENIPEL

SEQ ID NO: 122462 - protein, 9 aa, Homo Sapiens
MPNGTVQRF

SEQ ID NO: 122463 - protein, 9 aa, Homo Sapiens
MPNQHACKL

SEQ ID NO: 122464 - protein, 9 aa, Homo Sapiens
MPNQIVQIL

SEQ ID NO: 122465 - protein, 9 aa, Homo Sapiens
MPNSPAPHF

SEQ ID NO: 122466 - protein, 9 aa, Homo Sapiens
MPNVKVAVF

SEQ ID NO: 122467 - protein, 9 aa, Homo Sapiens
MPPMQAQEW

SEQ ID NO: 122468 - protein, 9 aa, Homo Sapiens
MPQEKSPGY

SEQ ID NO: 122469 - protein, 9 aa, Homo Sapiens
MPQGGGQHY

SEQ ID NO: 122470 - protein, 9 aa, Homo Sapiens
MPQGNPLLL

SEQ ID NO: 122471 - protein, 9 aa, Homo Sapiens
MPQKERESI

SEQ ID NO: 122472 - protein, 9 aa, Homo Sapiens
MPQNKSTKF

SEQ ID NO: 122473 - protein, 9 aa, Homo Sapiens
MPSEDVVSL

SEQ ID NO: 122474 - protein, 9 aa, Homo Sapiens
MPSGEFARI

SEQ ID NO: 122475 - protein, 9 aa, Homo Sapiens
MPSGIKTNI

SEQ ID NO: 122476 - protein, 9 aa, Homo Sapiens
MPSKTELIV

SEQ ID NO: 122477 - protein, 9 aa, Homo Sapiens
MPSPVSPKL

SEQ ID NO: 122478 - protein, 9 aa, Homo Sapiens
MPSQSVETY

SEQ ID NO: 122479 - protein, 9 aa, Homo Sapiens
MPSSLAHRI

SEQ ID NO: 122480 - protein, 9 aa, Homo Sapiens
MPSSVPLRA

SEQ ID NO: 122481 - protein, 9 aa, Homo Sapiens
MPSVKVSVF

SEQ ID NO: 122482 - protein, 9 aa, Homo Sapiens
MPTEQAEGF

SEQ ID NO: 122483 - protein, 9 aa, Homo Sapiens
MPTKETTKL

SEQ ID NO: 122484 - protein, 9 aa, Homo Sapiens
MPTKTIEVL

SEQ ID NO: 122485 - protein, 9 aa, Homo Sapiens
MPTMRLLSF

SEQ ID NO: 122486 - protein, 9 aa, Homo Sapiens
MPTPVIKAF

SEQ ID NO: 122487 - protein, 9 aa, Homo Sapiens
MPTQEVQEL

SEQ ID NO: 122488 - protein, 9 aa, Homo Sapiens
MPTRPVPSY

SEQ ID NO: 122489 - protein, 9 aa, Homo Sapiens
MPTSTILRL

SEQ ID NO: 122490 - protein, 9 aa, Homo Sapiens
MPVDSFNSM

SEQ ID NO: 122491 - protein, 9 aa, Homo Sapiens
MPVEKNITL

SEQ ID NO: 122492 - protein, 9 aa, Homo Sapiens
MPVFPDFKM

SEQ ID NO: 122493 - protein, 9 aa, Homo Sapiens
MPVGMTHGL

SEQ ID NO: 122494 - protein, 9 aa, Homo Sapiens
MPVGPAPGM

SEQ ID NO: 122495 - protein, 9 aa, Homo Sapiens
MPVHAAVQM

SEQ ID NO: 122496 - protein, 9 aa, Homo Sapiens
MPVIPMNTI

SEQ ID NO: 122497 - protein, 9 aa, Homo Sapiens
MPVNTNQNF

SEQ ID NO: 122498 - protein, 9 aa, Homo Sapiens
MPVPTTPEF

SEQ ID NO: 122499 - protein, 9 aa, Homo Sapiens
MPVPVILNF

SEQ ID NO: 122500 - protein, 9 aa, Homo Sapiens
MPVQDLPRL

SEQ ID NO: 122501 - protein, 9 aa, Homo Sapiens
MPVRAADKL

SEQ ID NO: 122502 - protein, 9 aa, Homo Sapiens
MPVSKPTSW

SEQ ID NO: 122503 - protein, 9 aa, Homo Sapiens
MPVSSQHRY

SEQ ID NO: 122504 - protein, 9 aa, Homo Sapiens
MPWCSPQEW

SEQ ID NO: 122505 - protein, 9 aa, Homo Sapiens
MPYLEHESF

SEQ ID NO: 122506 - protein, 9 aa, Homo Sapiens
MPYNHQHKY

SEQ ID NO: 122507 - protein, 9 aa, Homo Sapiens
MSVHLSPCF

SEQ ID NO: 122508 - protein, 9 aa, Homo Sapiens
MTNGFHMTW

SEQ ID NO: 122509 - protein, 9 aa, Homo Sapiens
MVDGTLLLL

SEQ ID NO: 122510 - protein, 9 aa, Homo Sapiens
MVDHNIYVW

SEQ ID NO: 122511 - protein, 9 aa, Homo Sapiens
MVESSRHNW

SEQ ID NO: 122512 - protein, 9 aa, Homo Sapiens
MVLDIVQHW

SEQ ID NO: 122513 - protein, 9 aa, Homo Sapiens
MVNHFIAEF

SEQ ID NO: 122514 - protein, 9 aa, Homo Sapiens
NAAADRVKW

SEQ ID NO: 122515 - protein, 9 aa, Homo Sapiens
NAAEELWKW

SEQ ID NO: 122516 - protein, 9 aa, Homo Sapiens
NAAPSHTKF

SEQ ID NO: 122517 - protein, 9 aa, Homo Sapiens
NACKIGGYW

SEQ ID NO: 122518 - protein, 9 aa, Homo Sapiens
NADGHGEVW

SEQ ID NO: 122519 - protein, 9 aa, Homo Sapiens
NADHTTLLL

SEQ ID NO: 122520 - protein, 9 aa, Homo Sapiens
NADPASHEI

SEQ ID NO: 122521 - protein, 9 aa, Homo Sapiens
NADTLALVF

SEQ ID NO: 122522 - protein, 9 aa, Homo Sapiens
NAFEELVAF

SEQ ID NO: 122523 - protein, 9 aa, Homo Sapiens
NAFKEITTM

SEQ ID NO: 122524 - protein, 9 aa, Homo Sapiens
NAGDRADFW

SEQ ID NO: 122525 - protein, 9 aa, Homo Sapiens
NAGPPSHII

SEQ ID NO: 122526 - protein, 9 aa, Homo Sapiens
NAHMDSLQW

SEQ ID NO: 122527 - protein, 9 aa, Homo Sapiens
NAIEHTLQW

SEQ ID NO: 122528 - protein, 9 aa, Homo Sapiens
NALNQVVLW

SEQ ID NO: 122529 - protein, 9 aa, Homo Sapiens
NAMDVVVQF

SEQ ID NO: 122530 - protein, 9 aa, Homo Sapiens
NANAASPLI

SEQ ID NO: 122531 - protein, 9 aa, Homo Sapiens
NANRIALDF

SEQ ID NO: 122532 - protein, 9 aa, Homo Sapiens
NASDLPLSI

SEQ ID NO: 122533 - protein, 9 aa, Homo Sapiens
NASESKLEL

SEQ ID NO: 122534 - protein, 9 aa, Homo Sapiens
NATGVAMLF

SEQ ID NO: 122535 - protein, 9 aa, Homo Sapiens
NATTIANHW

SEQ ID NO: 122536 - protein, 9 aa, Homo Sapiens
NPAASSNHW

SEQ ID NO: 122537 - protein, 9 aa, Homo Sapiens
NPADITVLF

SEQ ID NO: 122538 - protein, 9 aa, Homo Sapiens
NPADRAYSW

SEQ ID NO: 122539 - protein, 9 aa, Homo Sapiens
NPDDVFREF

SEQ ID NO: 122540 - protein, 9 aa, Homo Sapiens
NPDEGVNYF

SEQ ID NO: 122541 - protein, 9 aa, Homo Sapiens
NPDEQARQF

SEQ ID NO: 122542 - protein, 9 aa, Homo Sapiens
NPDPHFQGF

SEQ ID NO: 122543 - protein, 9 aa, Homo Sapiens
NPEYTTVSW

SEQ ID NO: 122544 - protein, 9 aa, Homo Sapiens
NPFPHSHTF

SEQ ID NO: 122545 - protein, 9 aa, Homo Sapiens
NPHPHCQVW

SEQ ID NO: 122546 - protein, 9 aa, Homo Sapiens
NPIEQDQKW

SEQ ID NO: 122547 - protein, 9 aa, Homo Sapiens
NPIIVSCGW

SEQ ID NO: 122548 - protein, 9 aa, Homo Sapiens
NPINMVSKL

SEQ ID NO: 122549 - protein, 9 aa, Homo Sapiens
NPINTFTKF

SEQ ID NO: 122550 - protein, 9 aa, Homo Sapiens
NPISTVTEL

SEQ ID NO: 122551 - protein, 9 aa, Homo Sapiens
NPLAATHEF

SEQ ID NO: 122552 - protein, 9 aa, Homo Sapiens
NPLPSKETI

SEQ ID NO: 122553 - protein, 9 aa, Homo Sapiens
NPLPTNYTW

SEQ ID NO: 122554 - protein, 9 aa, Homo Sapiens
NPNRHQMGW

SEQ ID NO: 122555 - protein, 9 aa, Homo Sapiens
NPNSGDFRF

SEQ ID NO: 122556 - protein, 9 aa, Homo Sapiens
NPNTVIILI

SEQ ID NO: 122557 - protein, 9 aa, Homo Sapiens
NPPEYEFLW

SEQ ID NO: 122558 - protein, 9 aa, Homo Sapiens
NPQHVQLLF

SEQ ID NO: 122559 - protein, 9 aa, Homo Sapiens
NPQPMTPPW

SEQ ID NO: 122560 - protein, 9 aa, Homo Sapiens
NPSEYVVCF

SEQ ID NO: 122561 - protein, 9 aa, Homo Sapiens
NPSPYHLYY

SEQ ID NO: 122562 - protein, 9 aa, Homo Sapiens
NPTDISYVY

SEQ ID NO: 122563 - protein, 9 aa, Homo Sapiens
NPTSVFSRI

SEQ ID NO: 122564 - protein, 9 aa, Homo Sapiens
NPVDIVSTL

SEQ ID NO: 122565 - protein, 9 aa, Homo Sapiens
NPVPYNSSW

SEQ ID NO: 122566 - protein, 9 aa, Homo Sapiens
NPVSWVQTF

SEQ ID NO: 122567 - protein, 9 aa, Homo Sapiens
NPYEFALKF

SEQ ID NO: 122568 - protein, 9 aa, Homo Sapiens
NPYHVVILF

SEQ ID NO: 122569 - protein, 9 aa, Homo Sapiens
NSSAVLLQW

SEQ ID NO: 122570 - protein, 9 aa, Homo Sapiens
NSSPVINHL

SEQ ID NO: 122571 - protein, 9 aa, Homo Sapiens
NTCPYVHNI

SEQ ID NO: 122572 - protein, 9 aa, Homo Sapiens
NTTAIAEAW

SEQ ID NO: 122573 - protein, 9 aa, Homo Sapiens
NVADVVIKF

SEQ ID NO: 122574 - protein, 9 aa, Homo Sapiens
NVFGVCHIF

SEQ ID NO: 122575 - protein, 9 aa, Homo Sapiens
NVVDCKLHW

SEQ ID NO: 122576 - protein, 9 aa, Homo Sapiens
NVYCGVHRY

SEQ ID NO: 122577 - protein, 9 aa, Homo Sapiens
PFKPPKVTF

SEQ ID NO: 122578 - protein, 9 aa, Homo Sapiens
PIRLLAAAA

SEQ ID NO: 122579 - protein, 9 aa, Homo Sapiens
PPHVLSSEF

SEQ ID NO: 122580 - protein, 9 aa, Homo Sapiens
PSLTGSPWP

SEQ ID NO: 122581 - protein, 9 aa, Homo Sapiens
PVSSSAWLL

SEQ ID NO: 122582 - protein, 9 aa, Homo Sapiens
PVVSGVLPE

SEQ ID NO: 122583 - protein, 9 aa, Homo Sapiens
QAADTVVIF

SEQ ID NO: 122584 - protein, 9 aa, Homo Sapiens
QAAEFREAW

SEQ ID NO: 122585 - protein, 9 aa, Homo Sapiens
QAAERPQEW

SEQ ID NO: 122586 - protein, 9 aa, Homo Sapiens
QADTTRLEL

SEQ ID NO: 122587 - protein, 9 aa, Homo Sapiens
QAESAAAVW

SEQ ID NO: 122588 - protein, 9 aa, Homo Sapiens
QAFPNTNRW

SEQ ID NO: 122589 - protein, 9 aa, Homo Sapiens
QALELPLRI

SEQ ID NO: 122590 - protein, 9 aa, Homo Sapiens
QANDDARTF

SEQ ID NO: 122591 - protein, 9 aa, Homo Sapiens
QARIEIESF

SEQ ID NO: 122592 - protein, 9 aa, Homo Sapiens
QASDGIHHW

SEQ ID NO: 122593 - protein, 9 aa, Homo Sapiens
QASDVSVKY

SEQ ID NO: 122594 - protein, 9 aa, Homo Sapiens
QASPSNTVW

SEQ ID NO: 122595 - protein, 9 aa, Homo Sapiens
QASSKILKY

SEQ ID NO: 122596 - protein, 9 aa, Homo Sapiens
QATELVHQL

SEQ ID NO: 122597 - protein, 9 aa, Homo Sapiens
QATPNFHQW

SEQ ID NO: 122598 - protein, 9 aa, Homo Sapiens
QATPTFHQW

SEQ ID NO: 122599 - protein, 9 aa, Homo Sapiens
QATRTVPVF

SEQ ID NO: 122600 - protein, 9 aa, Homo Sapiens
QAWEEPTNW

SEQ ID NO: 122601 - protein, 9 aa, Homo Sapiens
QPAPISPHL

SEQ ID NO: 122602 - protein, 9 aa, Homo Sapiens
QPATPTRTI

SEQ ID NO: 122603 - protein, 9 aa, Homo Sapiens
QPDHLFRKF

SEQ ID NO: 122604 - protein, 9 aa, Homo Sapiens
QPEELIQKW

SEQ ID NO: 122605 - protein, 9 aa, Homo Sapiens
QPEESYSHW

SEQ ID NO: 122606 - protein, 9 aa, Homo Sapiens
QPETRVSYW

SEQ ID NO: 122607 - protein, 9 aa, Homo Sapiens
QPGTFLLRF

SEQ ID NO: 122608 - protein, 9 aa, Homo Sapiens
QPHVSSPRF

SEQ ID NO: 122609 - protein, 9 aa, Homo Sapiens
QPINLIFRY

SEQ ID NO: 122610 - protein, 9 aa, Homo Sapiens
QPITPGPSI

SEQ ID NO: 122611 - protein, 9 aa, Homo Sapiens
QPLEGSDLW

SEQ ID NO: 122612 - protein, 9 aa, Homo Sapiens
QPLESGTHF

SEQ ID NO: 122613 - protein, 9 aa, Homo Sapiens
QPMEVQEGY

SEQ ID NO: 122614 - protein, 9 aa, Homo Sapiens
QPMPETPKW

SEQ ID NO: 122615 - protein, 9 aa, Homo Sapiens
QPNAQPQYL

SEQ ID NO: 122616 - protein, 9 aa, Homo Sapiens
QPNCETQKW

SEQ ID NO: 122617 - protein, 9 aa, Homo Sapiens
QPNPLPLRL

SEQ ID NO: 122618 - protein, 9 aa, Homo Sapiens
QPNTLICHI

SEQ ID NO: 122619 - protein, 9 aa, Homo Sapiens
QPSTLTDKW

SEQ ID NO: 122620 - protein, 9 aa, Homo Sapiens
QPTPHTQHW

SEQ ID NO: 122621 - protein, 9 aa, Homo Sapiens
QPVKIGCVW

SEQ ID NO: 122622 - protein, 9 aa, Homo Sapiens
QPYSKDSPF

SEQ ID NO: 122623 - protein, 9 aa, Homo Sapiens
RPAPIQAMW

SEQ ID NO: 122624 - protein, 9 aa, Homo Sapiens
RPAPVEVTY

SEQ ID NO: 122625 - protein, 9 aa, Homo Sapiens
RPFAGFEDF

SEQ ID NO: 122626 - protein, 9 aa, Homo Sapiens
RPLQDLQLW

SEQ ID NO: 122627 - protein, 9 aa, Homo Sapiens
RPLSKTVRF

SEQ ID NO: 122628 - protein, 9 aa, Homo Sapiens
RPNDIYVNM

SEQ ID NO: 122629 - protein, 9 aa, Homo Sapiens
RPNDVQLFY

SEQ ID NO: 122630 - protein, 9 aa, Homo Sapiens
RPNETDIKI

SEQ ID NO: 122631 - protein, 9 aa, Homo Sapiens
RPTDVAISF

SEQ ID NO: 122632 - protein, 9 aa, Homo Sapiens
RPVPEYQKY

SEQ ID NO: 122633 - protein, 9 aa, Homo Sapiens
RPVPKGATY

SEQ ID NO: 122634 - protein, 9 aa, Homo Sapiens
SAANIQPIF

SEQ ID NO: 122635 - protein, 9 aa, Homo Sapiens
SAAPLFFSW

SEQ ID NO: 122636 - protein, 9 aa, Homo Sapiens
SAARLYYYW

SEQ ID NO: 122637 - protein, 9 aa, Homo Sapiens
SACASSHQF

SEQ ID NO: 122638 - protein, 9 aa, Homo Sapiens
SACKNILRF

SEQ ID NO: 122639 - protein, 9 aa, Homo Sapiens
SACPFSSKF

SEQ ID NO: 122640 - protein, 9 aa, Homo Sapiens
SADEVQRFF

SEQ ID NO: 122641 - protein, 9 aa, Homo Sapiens
SADGTIKLW

SEQ ID NO: 122642 - protein, 9 aa, Homo Sapiens
SADHLIILW

SEQ ID NO: 122643 - protein, 9 aa, Homo Sapiens
SADKLIKIW

SEQ ID NO: 122644 - protein, 9 aa, Homo Sapiens
SADKTVALW

SEQ ID NO: 122645 - protein, 9 aa, Homo Sapiens
SADKTVKLW

SEQ ID NO: 122646 - protein, 9 aa, Homo Sapiens
SADNSCRLW

SEQ ID NO: 122647 - protein, 9 aa, Homo Sapiens
SADNTVILW

SEQ ID NO: 122648 - protein, 9 aa, Homo Sapiens
SADQTCKIW

SEQ ID NO: 122649 - protein, 9 aa, Homo Sapiens
SADRFVYVW

SEQ ID NO: 122650 - protein, 9 aa, Homo Sapiens
SADRNVKIW

SEQ ID NO: 122651 - protein, 9 aa, Homo Sapiens
SAFPYAHRF

SEQ ID NO: 122652 - protein, 9 aa, Homo Sapiens
SALDMTRYW

SEQ ID NO: 122653 - protein, 9 aa, Homo Sapiens
SALEKFFYF

SEQ ID NO: 122654 - protein, 9 aa, Homo Sapiens
SALPLYNLY

SEQ ID NO: 122655 - protein, 9 aa, Homo Sapiens
SAPSSDKPL

SEQ ID NO: 122656 - protein, 9 aa, Homo Sapiens
SASEVLKEW

SEQ ID NO: 122657 - protein, 9 aa, Homo Sapiens
SASPFQSAW

SEQ ID NO: 122658 - protein, 9 aa, Homo Sapiens
SASSLTSKW

SEQ ID NO: 122659 - protein, 9 aa, Homo Sapiens
SASTTTLRY

SEQ ID NO: 122660 - protein, 9 aa, Homo Sapiens
SATDTSAKW

SEQ ID NO: 122661 - protein, 9 aa, Homo Sapiens
SATEVDSRW

SEQ ID NO: 122662 - protein, 9 aa, Homo Sapiens
SAVDVHINM

SEQ ID NO: 122663 - protein, 9 aa, Homo Sapiens
SAVPDSLRW

SEQ ID NO: 122664 - protein, 9 aa, Homo Sapiens
SAVVEDVAW

SEQ ID NO: 122665 - protein, 9 aa, Homo Sapiens
SAYDGKDYI

SEQ ID NO: 122666 - protein, 9 aa, Homo Sapiens
SGPGPAAAL

SEQ ID NO: 122667 - protein, 9 aa, Homo Sapiens
SIDFTQEEW

SEQ ID NO: 122668 - protein, 9 aa, Homo Sapiens
SIPKGNSAL

SEQ ID NO: 122669 - protein, 9 aa, Homo Sapiens
SNPGGRPAL

SEQ ID NO: 122670 - protein, 9 aa, Homo Sapiens
SPAEETVVW

SEQ ID NO: 122671 - protein, 9 aa, Homo Sapiens
SPAEFVTRF

SEQ ID NO: 122672 - protein, 9 aa, Homo Sapiens
SPAGAALLW

SEQ ID NO: 122673 - protein, 9 aa, Homo Sapiens
SPAPVPVTY

SEQ ID NO: 122674 - protein, 9 aa, Homo Sapiens
SPAQILLRW

SEQ ID NO: 122675 - protein, 9 aa, Homo Sapiens
SPASSEYSW

SEQ ID NO: 122676 - protein, 9 aa, Homo Sapiens
SPCGHIGLW

SEQ ID NO: 122677 - protein, 9 aa, Homo Sapiens
SPCSELLLW

SEQ ID NO: 122678 - protein, 9 aa, Homo Sapiens
SPDATIRIW

SEQ ID NO: 122679 - protein, 9 aa, Homo Sapiens
SPDDQVYSF

SEQ ID NO: 122680 - protein, 9 aa, Homo Sapiens
SPDESHRMW

SEQ ID NO: 122681 - protein, 9 aa, Homo Sapiens
SPDGSFLLI

SEQ ID NO: 122682 - protein, 9 aa, Homo Sapiens
SPDHTNNSF

SEQ ID NO: 122683 - protein, 9 aa, Homo Sapiens
SPDSGVYEM

SEQ ID NO: 122684 - protein, 9 aa, Homo Sapiens
SPEELLLRW

SEQ ID NO: 122685 - protein, 9 aa, Homo Sapiens
SPEKGAETW

SEQ ID NO: 122686 - protein, 9 aa, Homo Sapiens
SPEPGQRTF

SEQ ID NO: 122687 - protein, 9 aa, Homo Sapiens
SPFDEFNLW

SEQ ID NO: 122688 - protein, 9 aa, Homo Sapiens
SPFDLEQQW

SEQ ID NO: 122689 - protein, 9 aa, Homo Sapiens
SPFEFGFTF

SEQ ID NO: 122690 - protein, 9 aa, Homo Sapiens
SPFHPATHW

SEQ ID NO: 122691 - protein, 9 aa, Homo Sapiens
SPFSASGGW

SEQ ID NO: 122692 - protein, 9 aa, Homo Sapiens
SPFTGTTTI

SEQ ID NO: 122693 - protein, 9 aa, Homo Sapiens
SPFVEHILW

SEQ ID NO: 122694 - protein, 9 aa, Homo Sapiens
SPHEDMRTW

SEQ ID NO: 122695 - protein, 9 aa, Homo Sapiens
SPHFKVFKW

SEQ ID NO: 122696 - protein, 9 aa, Homo Sapiens
SPHGGALVM

SEQ ID NO: 122697 - protein, 9 aa, Homo Sapiens
SPHLDKTSW

SEQ ID NO: 122698 - protein, 9 aa, Homo Sapiens
SPHPTSNHW

SEQ ID NO: 122699 - protein, 9 aa, Homo Sapiens
SPHSNVSDW

SEQ ID NO: 122700 - protein, 9 aa, Homo Sapiens
SPIDVVEKY

SEQ ID NO: 122701 - protein, 9 aa, Homo Sapiens
SPIPGFTKW

SEQ ID NO: 122702 - protein, 9 aa, Homo Sapiens
SPIQFESAW

SEQ ID NO: 122703 - protein, 9 aa, Homo Sapiens
SPIRGLPHW

SEQ ID NO: 122704 - protein, 9 aa, Homo Sapiens
SPITEYQFW

SEQ ID NO: 122705 - protein, 9 aa, Homo Sapiens
SPLDIYPKI

SEQ ID NO: 122706 - protein, 9 aa, Homo Sapiens
SPLDSIHTI

SEQ ID NO: 122707 - protein, 9 aa, Homo Sapiens
SPMDIFDMF

SEQ ID NO: 122708 - protein, 9 aa, Homo Sapiens
SPNALVLLI

SEQ ID NO: 122709 - protein, 9 aa, Homo Sapiens
SPNELILGW

SEQ ID NO: 122710 - protein, 9 aa, Homo Sapiens
SPNSISIMG

SEQ ID NO: 122711 - protein, 9 aa, Homo Sapiens
SPSAYVLEI

SEQ ID NO: 122712 - protein, 9 aa, Homo Sapiens
SPSEIVKQI

SEQ ID NO: 122713 - protein, 9 aa, Homo Sapiens
SPSGRATVW

SEQ ID NO: 122714 - protein, 9 aa, Homo Sapiens
SPSPENLKF

SEQ ID NO: 122715 - protein, 9 aa, Homo Sapiens
SPSRILLLF

SEQ ID NO: 122716 - protein, 9 aa, Homo Sapiens
SPSSDSLLF

SEQ ID NO: 122717 - protein, 9 aa, Homo Sapiens
SPSSICHQW

SEQ ID NO: 122718 - protein, 9 aa, Homo Sapiens
SPTEMVAKF

SEQ ID NO: 122719 - protein, 9 aa, Homo Sapiens
SPTENSFTL

SEQ ID NO: 122720 - protein, 9 aa, Homo Sapiens
SPTEVVERL

SEQ ID NO: 122721 - protein, 9 aa, Homo Sapiens
SPTHISRSW

SEQ ID NO: 122722 - protein, 9 aa, Homo Sapiens
SPTIIFDNW

SEQ ID NO: 122723 - protein, 9 aa, Homo Sapiens
SPTNISSLL

SEQ ID NO: 122724 - protein, 9 aa, Homo Sapiens
SPTQVVSQL

SEQ ID NO: 122725 - protein, 9 aa, Homo Sapiens
SPTSAHAFW

SEQ ID NO: 122726 - protein, 9 aa, Homo Sapiens
SPVALNVQY

SEQ ID NO: 122727 - protein, 9 aa, Homo Sapiens
SPVAQSQEF

SEQ ID NO: 122728 - protein, 9 aa, Homo Sapiens
SPVDIFAKI

SEQ ID NO: 122729 - protein, 9 aa, Homo Sapiens
SPVDSVLFY

SEQ ID NO: 122730 - protein, 9 aa, Homo Sapiens
SPVDVLQIF

SEQ ID NO: 122731 - protein, 9 aa, Homo Sapiens
SPVELQSLF

SEQ ID NO: 122732 - protein, 9 aa, Homo Sapiens
SPYDGNETL

SEQ ID NO: 122733 - protein, 9 aa, Homo Sapiens
SPYGHLPNW

SEQ ID NO: 122734 - protein, 9 aa, Homo Sapiens
SPYPEVDHF

SEQ ID NO: 122735 - protein, 9 aa, Homo Sapiens
SSEDYIHRI

SEQ ID NO: 122736 - protein, 9 aa, Homo Sapiens
SSPAPRTAL

SEQ ID NO: 122737 - protein, 9 aa, Homo Sapiens
SVGPAEPTW

SEQ ID NO: 122738 - protein, 9 aa, Homo Sapiens
SVIDSDEKW

SEQ ID NO: 122739 - protein, 9 aa, Homo Sapiens
SVTEIQEKW

SEQ ID NO: 122740 - protein, 9 aa, Homo Sapiens
SVTEVQLRF

SEQ ID NO: 122741 - protein, 9 aa, Homo Sapiens
TAAAVGAVF

SEQ ID NO: 122742 - protein, 9 aa, Homo Sapiens
TAADTVIIY

SEQ ID NO: 122743 - protein, 9 aa, Homo Sapiens
TAADVVKQW

SEQ ID NO: 122744 - protein, 9 aa, Homo Sapiens
TAAETHYTY

SEQ ID NO: 122745 - protein, 9 aa, Homo Sapiens
TAAPTGTTI

SEQ ID NO: 122746 - protein, 9 aa, Homo Sapiens
TAAPVVPEL

SEQ ID NO: 122747 - protein, 9 aa, Homo Sapiens
TAASSALGF

SEQ ID NO: 122748 - protein, 9 aa, Homo Sapiens
TACDIQTHM

SEQ ID NO: 122749 - protein, 9 aa, Homo Sapiens
TADDKKLQF

SEQ ID NO: 122750 - protein, 9 aa, Homo Sapiens
TADGNTWMW

SEQ ID NO: 122751 - protein, 9 aa, Homo Sapiens
TADITVLRW

SEQ ID NO: 122752 - protein, 9 aa, Homo Sapiens
TAEGTVFHF

SEQ ID NO: 122753 - protein, 9 aa, Homo Sapiens
TAENVAKKW

SEQ ID NO: 122754 - protein, 9 aa, Homo Sapiens
TAFEKEHLW

SEQ ID NO: 122755 - protein, 9 aa, Homo Sapiens
TAFGGFLKY

SEQ ID NO: 122756 - protein, 9 aa, Homo Sapiens
TAFPGTGGF

SEQ ID NO: 122757 - protein, 9 aa, Homo Sapiens
TAGVDGHSW

SEQ ID NO: 122758 - protein, 9 aa, Homo Sapiens
TAHSEPSLW

SEQ ID NO: 122759 - protein, 9 aa, Homo Sapiens
TAIEAQHLL

SEQ ID NO: 122760 - protein, 9 aa, Homo Sapiens
TALLQKLTW

SEQ ID NO: 122761 - protein, 9 aa, Homo Sapiens
TALSNLITW

SEQ ID NO: 122762 - protein, 9 aa, Homo Sapiens
TANDRILKY

SEQ ID NO: 122763 - protein, 9 aa, Homo Sapiens
TANGIALLW

SEQ ID NO: 122764 - protein, 9 aa, Homo Sapiens
TASADPSIW

SEQ ID NO: 122765 - protein, 9 aa, Homo Sapiens
TASAVVQHM

SEQ ID NO: 122766 - protein, 9 aa, Homo Sapiens
TASDVAQHL

SEQ ID NO: 122767 - protein, 9 aa, Homo Sapiens
TASEMILVL

SEQ ID NO: 122768 - protein, 9 aa, Homo Sapiens
TASGAKSMW

SEQ ID NO: 122769 - protein, 9 aa, Homo Sapiens
TASPTHSTW

SEQ ID NO: 122770 - protein, 9 aa, Homo Sapiens
TASPVAVSL

SEQ ID NO: 122771 - protein, 9 aa, Homo Sapiens
TASQVASTW

SEQ ID NO: 122772 - protein, 9 aa, Homo Sapiens
TASSTAHLW

SEQ ID NO: 122773 - protein, 9 aa, Homo Sapiens
TASSVALDL

SEQ ID NO: 122774 - protein, 9 aa, Homo Sapiens
TATEITESF

SEQ ID NO: 122775 - protein, 9 aa, Homo Sapiens
TAVKIAPRY

SEQ ID NO: 122776 - protein, 9 aa, Homo Sapiens
TAVPTLLKY

SEQ ID NO: 122777 - protein, 9 aa, Homo Sapiens
TAVTPQQTW

SEQ ID NO: 122778 - protein, 9 aa, Homo Sapiens
TAVVEDVSW

SEQ ID NO: 122779 - protein, 9 aa, Homo Sapiens
TAYEKINKW

SEQ ID NO: 122780 - protein, 9 aa, Homo Sapiens
TAYPGQTQY

SEQ ID NO: 122781 - protein, 9 aa, Homo Sapiens
TAYSEKHHW

SEQ ID NO: 122782 - protein, 9 aa, Homo Sapiens
TGHADTTKW

SEQ ID NO: 122783 - protein, 9 aa, Homo Sapiens
TGYAETYRW

SEQ ID NO: 122784 - protein, 9 aa, Homo Sapiens
TISPIILYF

SEQ ID NO: 122785 - protein, 9 aa, Homo Sapiens
TNIPFDVKW

SEQ ID NO: 122786 - protein, 9 aa, Homo Sapiens
TPADVFIVF

SEQ ID NO: 122787 - protein, 9 aa, Homo Sapiens
TPAEIREEF

SEQ ID NO: 122788 - protein, 9 aa, Homo Sapiens
TPAEVSHRF

SEQ ID NO: 122789 - protein, 9 aa, Homo Sapiens
TPAGVVNKY

SEQ ID NO: 122790 - protein, 9 aa, Homo Sapiens
TPAHVYYRW

SEQ ID NO: 122791 - protein, 9 aa, Homo Sapiens
TPAPPIKRW

SEQ ID NO: 122792 - protein, 9 aa, Homo Sapiens
TPAPPTHAL

SEQ ID NO: 122793 - protein, 9 aa, Homo Sapiens
TPASAGHVW

SEQ ID NO: 122794 - protein, 9 aa, Homo Sapiens
TPDEIDHVF

SEQ ID NO: 122795 - protein, 9 aa, Homo Sapiens
TPDETKLKM

SEQ ID NO: 122796 - protein, 9 aa, Homo Sapiens
TPEENQASW

SEQ ID NO: 122797 - protein, 9 aa, Homo Sapiens
TPEKEPPLW

SEQ ID NO: 122798 - protein, 9 aa, Homo Sapiens
TPFLGQHGF

SEQ ID NO: 122799 - protein, 9 aa, Homo Sapiens
TPGSSQNPW

SEQ ID NO: 122800 - protein, 9 aa, Homo Sapiens
TPHDFIEHI

SEQ ID NO: 122801 - protein, 9 aa, Homo Sapiens
TPHGLFILF

SEQ ID NO: 122802 - protein, 9 aa, Homo Sapiens
TPHPEGYLF

SEQ ID NO: 122803 - protein, 9 aa, Homo Sapiens
TPIDSTGKF

SEQ ID NO: 122804 - protein, 9 aa, Homo Sapiens
TPIKDSHLI

SEQ ID NO: 122805 - protein, 9 aa, Homo Sapiens
TPIMKTKKW

SEQ ID NO: 122806 - protein, 9 aa, Homo Sapiens
TPIPVPAYF

SEQ ID NO: 122807 - protein, 9 aa, Homo Sapiens
TPIREQHVL

SEQ ID NO: 122808 - protein, 9 aa, Homo Sapiens
TPISQAQKL

SEQ ID NO: 122809 - protein, 9 aa, Homo Sapiens
TPIYAGHSW

SEQ ID NO: 122810 - protein, 9 aa, Homo Sapiens
TPLEGDFAW

SEQ ID NO: 122811 - protein, 9 aa, Homo Sapiens
TPNDFCSFY

SEQ ID NO: 122812 - protein, 9 aa, Homo Sapiens
TPQDYNLRW

SEQ ID NO: 122813 - protein, 9 aa, Homo Sapiens
TPQSLFILF

SEQ ID NO: 122814 - protein, 9 aa, Homo Sapiens
TPSAVFRVW

SEQ ID NO: 122815 - protein, 9 aa, Homo Sapiens
TPSDKLFFW

SEQ ID NO: 122816 - protein, 9 aa, Homo Sapiens
TPSENSDLF

SEQ ID NO: 122817 - protein, 9 aa, Homo Sapiens
TPSEPIHCI

SEQ ID NO: 122818 - protein, 9 aa, Homo Sapiens
TPSGRSLWT

SEQ ID NO: 122819 - protein, 9 aa, Homo Sapiens
TPSPIIQQL

SEQ ID NO: 122820 - protein, 9 aa, Homo Sapiens
TPSPSADLL

SEQ ID NO: 122821 - protein, 9 aa, Homo Sapiens
TPSPSPHAW

SEQ ID NO: 122822 - protein, 9 aa, Homo Sapiens
TPSQGTHTF

SEQ ID NO: 122823 - protein, 9 aa, Homo Sapiens
TPSSDVLVF

SEQ ID NO: 122824 - protein, 9 aa, Homo Sapiens
TPSTGMYHF

SEQ ID NO: 122825 - protein, 9 aa, Homo Sapiens
TPTENELKF

SEQ ID NO: 122826 - protein, 9 aa, Homo Sapiens
TPTPFFHTF

SEQ ID NO: 122827 - protein, 9 aa, Homo Sapiens
TPTSVIPKL

SEQ ID NO: 122828 - protein, 9 aa, Homo Sapiens
TPVKSELLW

SEQ ID NO: 122829 - protein, 9 aa, Homo Sapiens
TPWPHIVEF

SEQ ID NO: 122830 - protein, 9 aa, Homo Sapiens
TPYHVNLLL

SEQ ID NO: 122831 - protein, 9 aa, Homo Sapiens
TQAPVVPYW

SEQ ID NO: 122832 - protein, 9 aa, Homo Sapiens
TSVPDHVVW

SEQ ID NO: 122833 - protein, 9 aa, Homo Sapiens
TVDPTKLTW

SEQ ID NO: 122834 - protein, 9 aa, Homo Sapiens
TVHQGDTSW

SEQ ID NO: 122835 - protein, 9 aa, Homo Sapiens
TVIEKTESW

SEQ ID NO: 122836 - protein, 9 aa, Homo Sapiens
TVSDAILRY

SEQ ID NO: 122837 - protein, 9 aa, Homo Sapiens
TVTEVLLKY

SEQ ID NO: 122838 - protein, 9 aa, Homo Sapiens
TVYPKPEEW

SEQ ID NO: 122839 - protein, 9 aa, Homo Sapiens
VADSNIVRW

SEQ ID NO: 122840 - protein, 9 aa, Homo Sapiens
VANLTNLVW

SEQ ID NO: 122841 - protein, 9 aa, Homo Sapiens
VLFPEPLTW

SEQ ID NO: 122842 - protein, 9 aa, Homo Sapiens
VPAAVSGRW

SEQ ID NO: 122843 - protein, 9 aa, Homo Sapiens
VPAEPKLAF

SEQ ID NO: 122844 - protein, 9 aa, Homo Sapiens
VPAHLQNSW

SEQ ID NO: 122845 - protein, 9 aa, Homo Sapiens
VPASALGSW

SEQ ID NO: 122846 - protein, 9 aa, Homo Sapiens
VPASTGLGW

SEQ ID NO: 122847 - protein, 9 aa, Homo Sapiens
VPATDPHSW

SEQ ID NO: 122848 - protein, 9 aa, Homo Sapiens
VPCPSVQLW

SEQ ID NO: 122849 - protein, 9 aa, Homo Sapiens
VPDLAPMLW

SEQ ID NO: 122850 - protein, 9 aa, Homo Sapiens
VPDPNVIKL

SEQ ID NO: 122851 - protein, 9 aa, Homo Sapiens
VPEPRPSEW

SEQ ID NO: 122852 - protein, 9 aa, Homo Sapiens
VPFNIPLEF

SEQ ID NO: 122853 - protein, 9 aa, Homo Sapiens
VPFPDTYEI

SEQ ID NO: 122854 - protein, 9 aa, Homo Sapiens
VPFPLTLRF

SEQ ID NO: 122855 - protein, 9 aa, Homo Sapiens
VPFSIFDEF

SEQ ID NO: 122856 - protein, 9 aa, Homo Sapiens
VPHSIINGY

SEQ ID NO: 122857 - protein, 9 aa, Homo Sapiens
VPISAHHRW

SEQ ID NO: 122858 - protein, 9 aa, Homo Sapiens
VPLDKQITI

SEQ ID NO: 122859 - protein, 9 aa, Homo Sapiens
VPLEIMIKF

SEQ ID NO: 122860 - protein, 9 aa, Homo Sapiens
VPLPASAKW

SEQ ID NO: 122861 - protein, 9 aa, Homo Sapiens
VPNKVIQCF

SEQ ID NO: 122862 - protein, 9 aa, Homo Sapiens
VPRKAEERW

SEQ ID NO: 122863 - protein, 9 aa, Homo Sapiens
VPSAVALVL

SEQ ID NO: 122864 - protein, 9 aa, Homo Sapiens
VPSNLALKF

SEQ ID NO: 122865 - protein, 9 aa, Homo Sapiens
VPTELALLY

SEQ ID NO: 122866 - protein, 9 aa, Homo Sapiens
VPTPIHPIF

SEQ ID NO: 122867 - protein, 9 aa, Homo Sapiens
VPTPIQPTF

SEQ ID NO: 122868 - protein, 9 aa, Homo Sapiens
VPTPTAPLL

SEQ ID NO: 122869 - protein, 9 aa, Homo Sapiens
VPTQESVKW

SEQ ID NO: 122870 - protein, 9 aa, Homo Sapiens
VPTQLVSYF

SEQ ID NO: 122871 - protein, 9 aa, Homo Sapiens
VPTTEVNAW

SEQ ID NO: 122872 - protein, 9 aa, Homo Sapiens
VPVDLQHQF

SEQ ID NO: 122873 - protein, 9 aa, Homo Sapiens
VPVEEQEEF

SEQ ID NO: 122874 - protein, 9 aa, Homo Sapiens
VPVGFGESW

SEQ ID NO: 122875 - protein, 9 aa, Homo Sapiens
VPVKVTDRF

SEQ ID NO: 122876 - protein, 9 aa, Homo Sapiens
VPVPGESTW

SEQ ID NO: 122877 - protein, 9 aa, Homo Sapiens
VPVSVVECF

SEQ ID NO: 122878 - protein, 9 aa, Homo Sapiens
VPVWIIHYY

SEQ ID NO: 122879 - protein, 9 aa, Homo Sapiens
VPYKDEELY

SEQ ID NO: 122880 - protein, 9 aa, Homo Sapiens
WPFLIDKRW

SEQ ID NO: 122881 - protein, 9 aa, Homo Sapiens
WPHEDAAQF

SEQ ID NO: 122882 - protein, 9 aa, Homo Sapiens
WPNAEVDRF

SEQ ID NO: 122883 - protein, 9 aa, Homo Sapiens
YADLVKQAW

SEQ ID NO: 122884 - protein, 9 aa, Homo Sapiens
YADVGGKQF

SEQ ID NO: 122885 - protein, 9 aa, Homo Sapiens
YAEPAVLKW

SEQ ID NO: 122886 - protein, 9 aa, Homo Sapiens
YAEPAVLQW

SEQ ID NO: 122887 - protein, 9 aa, Homo Sapiens
YAFDFARQS

SEQ ID NO: 122888 - protein, 9 aa, Homo Sapiens
YAFNGTQRF

SEQ ID NO: 122889 - protein, 9 aa, Homo Sapiens
YAGPEVDIW

SEQ ID NO: 122890 - protein, 9 aa, Homo Sapiens
YARDETEFY

SEQ ID NO: 122891 - protein, 9 aa, Homo Sapiens
YASDCASFF

SEQ ID NO: 122892 - protein, 9 aa, Homo Sapiens
YGTEIISKW

SEQ ID NO: 122893 - protein, 9 aa, Homo Sapiens
YMFVDENTF

SEQ ID NO: 122894 - protein, 9 aa, Homo Sapiens
YPAAPLPGF

SEQ ID NO: 122895 - protein, 9 aa, Homo Sapiens
YPAAVPQAL

SEQ ID NO: 122896 - protein, 9 aa, Homo Sapiens
YPADLAHKI

SEQ ID NO: 122897 - protein, 9 aa, Homo Sapiens
YPAESPDYF

SEQ ID NO: 122898 - protein, 9 aa, Homo Sapiens
YPAGFMDVI

SEQ ID NO: 122899 - protein, 9 aa, Homo Sapiens
YPAHMYQVY

SEQ ID NO: 122900 - protein, 9 aa, Homo Sapiens
YPAPAGLHI

SEQ ID NO: 122901 - protein, 9 aa, Homo Sapiens
YPAPGLKTF

SEQ ID NO: 122902 - protein, 9 aa, Homo Sapiens
YPAQGVQQF

SEQ ID NO: 122903 - protein, 9 aa, Homo Sapiens
YPAQITPKM

SEQ ID NO: 122904 - protein, 9 aa, Homo Sapiens
YPASTVQIL

SEQ ID NO: 122905 - protein, 9 aa, Homo Sapiens
YPDEKSVCL

SEQ ID NO: 122906 - protein, 9 aa, Homo Sapiens
YPDFAPQKF

SEQ ID NO: 122907 - protein, 9 aa, Homo Sapiens
YPDINFNRL

SEQ ID NO: 122908 - protein, 9 aa, Homo Sapiens
YPDPMVRGF

SEQ ID NO: 122909 - protein, 9 aa, Homo Sapiens
YPDPRGAPW

SEQ ID NO: 122910 - protein, 9 aa, Homo Sapiens
YPDRIMNTF

SEQ ID NO: 122911 - protein, 9 aa, Homo Sapiens
YPDSHQLFV

SEQ ID NO: 122912 - protein, 9 aa, Homo Sapiens
YPDSSQSRF

SEQ ID NO: 122913 - protein, 9 aa, Homo Sapiens
YPEGKLPHW

SEQ ID NO: 122914 - protein, 9 aa, Homo Sapiens
YPENIVPSF

SEQ ID NO: 122915 - protein, 9 aa, Homo Sapiens
YPESIPRKF

SEQ ID NO: 122916 - protein, 9 aa, Homo Sapiens
YPETLVNLI

SEQ ID NO: 122917 - protein, 9 aa, Homo Sapiens
YPFKDVNNW

SEQ ID NO: 122918 - protein, 9 aa, Homo Sapiens
YPFSSEQKW

SEQ ID NO: 122919 - protein, 9 aa, Homo Sapiens
YPFYKTDPF

SEQ ID NO: 122920 - protein, 9 aa, Homo Sapiens
YPGDIKIKW

SEQ ID NO: 122921 - protein, 9 aa, Homo Sapiens
YPGPGGGGW

SEQ ID NO: 122922 - protein, 9 aa, Homo Sapiens
YPGPGNHFW

SEQ ID NO: 122923 - protein, 9 aa, Homo Sapiens
YPGSIEVRW

SEQ ID NO: 122924 - protein, 9 aa, Homo Sapiens
YPHAFNVKF

SEQ ID NO: 122925 - protein, 9 aa, Homo Sapiens
YPHDGKIFF

SEQ ID NO: 122926 - protein, 9 aa, Homo Sapiens
YPHEPTAVF

SEQ ID NO: 122927 - protein, 9 aa, Homo Sapiens
YPIAVDCSW

SEQ ID NO: 122928 - protein, 9 aa, Homo Sapiens
YPLCQFQYI

SEQ ID NO: 122929 - protein, 9 aa, Homo Sapiens
YPLDLLLKL

SEQ ID NO: 122930 - protein, 9 aa, Homo Sapiens
YPLEDATHI

SEQ ID NO: 122931 - protein, 9 aa, Homo Sapiens
YPLEDHTEF

SEQ ID NO: 122932 - protein, 9 aa, Homo Sapiens
YPLEKGHLF

SEQ ID NO: 122933 - protein, 9 aa, Homo Sapiens
YPLEKIGFW

SEQ ID NO: 122934 - protein, 9 aa, Homo Sapiens
YPLQEVERF

SEQ ID NO: 122935 - protein, 9 aa, Homo Sapiens
YPMPFCDRW

SEQ ID NO: 122936 - protein, 9 aa, Homo Sapiens
YPNEEKDAW

SEQ ID NO: 122937 - protein, 9 aa, Homo Sapiens
YPNERFELL

SEQ ID NO: 122938 - protein, 9 aa, Homo Sapiens
YPNGVVVHY

SEQ ID NO: 122939 - protein, 9 aa, Homo Sapiens
YPNIEETHW

SEQ ID NO: 122940 - protein, 9 aa, Homo Sapiens
YPNKYESVI

SEQ ID NO: 122941 - protein, 9 aa, Homo Sapiens
YPNPEYDNW

SEQ ID NO: 122942 - protein, 9 aa, Homo Sapiens
YPNSHTHYF

SEQ ID NO: 122943 - protein, 9 aa, Homo Sapiens
YPNSQCNHY

SEQ ID NO: 122944 - protein, 9 aa, Homo Sapiens
YPNTLLRTW

SEQ ID NO: 122945 - protein, 9 aa, Homo Sapiens
YPNVGKSSF

SEQ ID NO: 122946 - protein, 9 aa, Homo Sapiens
YPNVNIHNF

SEQ ID NO: 122947 - protein, 9 aa, Homo Sapiens
YPPHPDYTW

SEQ ID NO: 122948 - protein, 9 aa, Homo Sapiens
YPQEDYESF

SEQ ID NO: 122949 - protein, 9 aa, Homo Sapiens
YPQEVIPTF

SEQ ID NO: 122950 - protein, 9 aa, Homo Sapiens
YPRSDVDLY

SEQ ID NO: 122951 - protein, 9 aa, Homo Sapiens
YPSEFATYL

SEQ ID NO: 122952 - protein, 9 aa, Homo Sapiens
YPSEFSTYL

SEQ ID NO: 122953 - protein, 9 aa, Homo Sapiens
YPSETFTRV

SEQ ID NO: 122954 - protein, 9 aa, Homo Sapiens
YPSETTVKY

SEQ ID NO: 122955 - protein, 9 aa, Homo Sapiens
YPSLPTPLL

SEQ ID NO: 122956 - protein, 9 aa, Homo Sapiens
YPSPHAVMY

SEQ ID NO: 122957 - protein, 9 aa, Homo Sapiens
YPSPTGVLI

SEQ ID NO: 122958 - protein, 9 aa, Homo Sapiens
YPSSDNSLY

SEQ ID NO: 122959 - protein, 9 aa, Homo Sapiens
YPTEKGLSF

SEQ ID NO: 122960 - protein, 9 aa, Homo Sapiens
YPTEVQHLI

SEQ ID NO: 122961 - protein, 9 aa, Homo Sapiens
YPTKVDPFY

SEQ ID NO: 122962 - protein, 9 aa, Homo Sapiens
YPTSKAVYI

SEQ ID NO: 122963 - protein, 9 aa, Homo Sapiens
YPTSVPVLY

SEQ ID NO: 122964 - protein, 9 aa, Homo Sapiens
YPVDDGCRI

SEQ ID NO: 122965 - protein, 9 aa, Homo Sapiens
YPVDLGDKF

SEQ ID NO: 122966 - protein, 9 aa, Homo Sapiens
YPVEHPDKF

SEQ ID NO: 122967 - protein, 9 aa, Homo Sapiens
YPVEIHEYL

SEQ ID NO: 122968 - protein, 9 aa, Homo Sapiens
YPVNTPERW

SEQ ID NO: 122969 - protein, 9 aa, Homo Sapiens
YPVPDVSTY

SEQ ID NO: 122970 - protein, 9 aa, Homo Sapiens
YPWWEQQGF

SEQ ID NO: 122971 - protein, 9 aa, Homo Sapiens
YPYEHSYGL

SEQ ID NO: 122972 - protein, 9 aa, Homo Sapiens
YPYPYPHTL

SEQ ID NO: 122973 - protein, 9 aa, Homo Sapiens
YPYQERVFL

SEQ ID NO: 122974 - protein, 9 aa, Homo Sapiens
YPYTETQMY

SEQ ID NO: 122975 - protein, 9 aa, Homo Sapiens
YVHPVNLTW

SEQ ID NO: 122976 - protein, 9 aa, Homo Sapiens
YVLGTATRW

SEQ ID NO: 122977 - protein, 10 aa, Homo Sapiens
AAVDLISDEW

SEQ ID NO: 122978 - protein, 10 aa, Homo Sapiens
AGHINPLIIY

SEQ ID NO: 122979 - protein, 10 aa, Homo Sapiens
ALAPILDDGW

SEQ ID NO: 122980 - protein, 10 aa, Homo Sapiens
APAETPHEKW

SEQ ID NO: 122981 - protein, 10 aa, Homo Sapiens
APANISNSTW

SEQ ID NO: 122982 - protein, 10 aa, Homo Sapiens
APDPCDPQRW

SEQ ID NO: 122983 - protein, 10 aa, Homo Sapiens
APIAGETKVW

SEQ ID NO: 122984 - protein, 10 aa, Homo Sapiens
APINSKSDEW

SEQ ID NO: 122985 - protein, 10 aa, Homo Sapiens
APIPTVEEKW

SEQ ID NO: 122986 - protein, 10 aa, Homo Sapiens
APIRPDIVNF

SEQ ID NO: 122987 - protein, 10 aa, Homo Sapiens
APSPEEKEEW

SEQ ID NO: 122988 - protein, 10 aa, Homo Sapiens
CALWGLAEDS

SEQ ID NO: 122989 - protein, 10 aa, Homo Sapiens
DIMKDKDNFW

SEQ ID NO: 122990 - protein, 10 aa, Homo Sapiens
DPQNDKPSKW

SEQ ID NO: 122991 - protein, 10 aa, Homo Sapiens
DPYADGDPAW

SEQ ID NO: 122992 - protein, 10 aa, Homo Sapiens
EADGLSTNHW

SEQ ID NO: 122993 - protein, 10 aa, Homo Sapiens
EAEGVIVGHW

SEQ ID NO: 122994 - protein, 10 aa, Homo Sapiens
EAFRKDMIRW

SEQ ID NO: 122995 - protein, 10 aa, Homo Sapiens
EAISDLQQLW

SEQ ID NO: 122996 - protein, 10 aa, Homo Sapiens
EALKCNYEHW

SEQ ID NO: 122997 - protein, 10 aa, Homo Sapiens
EALRLPYEQW

SEQ ID NO: 122998 - protein, 10 aa, Homo Sapiens
EAVSHLLQDW

SEQ ID NO: 122999 - protein, 10 aa, Homo Sapiens
EAVSRILEEW

SEQ ID NO: 123000 - protein, 10 aa, Homo Sapiens
EAYNPETDTW

SEQ ID NO: 123001 - protein, 10 aa, Homo Sapiens
EGCAQGLQKW

SEQ ID NO: 123002 - protein, 10 aa, Homo Sapiens
EPEGTATDRW

SEQ ID NO: 123003 - protein, 10 aa, Homo Sapiens
EPMPTKETGW

SEQ ID NO: 123004 - protein, 10 aa, Homo Sapiens
EPYGQLNPKW

SEQ ID NO: 123005 - protein, 10 aa, Homo Sapiens
FANPEDCVAF

SEQ ID NO: 123006 - protein, 10 aa, Homo Sapiens
FASHLGDQTW

SEQ ID NO: 123007 - protein, 10 aa, Homo Sapiens
FASTQPTHSW

SEQ ID NO: 123008 - protein, 10 aa, Homo Sapiens
FAYKDPEKNW

SEQ ID NO: 123009 - protein, 10 aa, Homo Sapiens
FPAGIYDTKY

SEQ ID NO: 123010 - protein, 10 aa, Homo Sapiens
FPAKPGSLTL

SEQ ID NO: 123011 - protein, 10 aa, Homo Sapiens
FPAPAKAVVY

SEQ ID NO: 123012 - protein, 10 aa, Homo Sapiens
FPAPEERIKW

SEQ ID NO: 123013 - protein, 10 aa, Homo Sapiens
FPAPGKTVTL

SEQ ID NO: 123014 - protein, 10 aa, Homo Sapiens
FPASIPITKF

SEQ ID NO: 123015 - protein, 10 aa, Homo Sapiens
FPATPFGAQW

SEQ ID NO: 123016 - protein, 10 aa, Homo Sapiens
FPDEDSYQKF

SEQ ID NO: 123017 - protein, 10 aa, Homo Sapiens
FPDPEKPCKM

SEQ ID NO: 123018 - protein, 10 aa, Homo Sapiens
FPDPEPVRNL

SEQ ID NO: 123019 - protein, 10 aa, Homo Sapiens
FPDPNVKYVF

SEQ ID NO: 123020 - protein, 10 aa, Homo Sapiens
FPDPQRQRKL

SEQ ID NO: 123021 - protein, 10 aa, Homo Sapiens
FPDTGSDHSY

SEQ ID NO: 123022 - protein, 10 aa, Homo Sapiens
FPDVPDKENF

SEQ ID NO: 123023 - protein, 10 aa, Homo Sapiens
FPEALARLLL

SEQ ID NO: 123024 - protein, 10 aa, Homo Sapiens
FPEDVVRVIF

SEQ ID NO: 123025 - protein, 10 aa, Homo Sapiens
FPEEDDPTNW

SEQ ID NO: 123026 - protein, 10 aa, Homo Sapiens
FPEEVIATIF

SEQ ID NO: 123027 - protein, 10 aa, Homo Sapiens
FPEHMANVEL

SEQ ID NO: 123028 - protein, 10 aa, Homo Sapiens
FPEHYAPSVF

SEQ ID NO: 123029 - protein, 10 aa, Homo Sapiens
FPEPSRPPLF

SEQ ID NO: 123030 - protein, 10 aa, Homo Sapiens
FPEQANNNEW

SEQ ID NO: 123031 - protein, 10 aa, Homo Sapiens
FPESDNLFKW

SEQ ID NO: 123032 - protein, 10 aa, Homo Sapiens
FPFEKGSVQY

SEQ ID NO: 123033 - protein, 10 aa, Homo Sapiens
FPFHEVIQEF

SEQ ID NO: 123034 - protein, 10 aa, Homo Sapiens
FPFPETPTKV

SEQ ID NO: 123035 - protein, 10 aa, Homo Sapiens
FPFYGKPMRI

SEQ ID NO: 123036 - protein, 10 aa, Homo Sapiens
FPGFHGSEMW

SEQ ID NO: 123037 - protein, 10 aa, Homo Sapiens
FPHDNVEDLI

SEQ ID NO: 123038 - protein, 10 aa, Homo Sapiens
FPHHGTFEVI

SEQ ID NO: 123039 - protein, 10 aa, Homo Sapiens
FPHHVIPDSF

SEQ ID NO: 123040 - protein, 10 aa, Homo Sapiens
FPHLLQPVLW

SEQ ID NO: 123041 - protein, 10 aa, Homo Sapiens
FPHNFQETTY

SEQ ID NO: 123042 - protein, 10 aa, Homo Sapiens
FPHPVNQVTF

SEQ ID NO: 123043 - protein, 10 aa, Homo Sapiens
FPIGEKQDIW

SEQ ID NO: 123044 - protein, 10 aa, Homo Sapiens
FPISEETIKL

SEQ ID NO: 123045 - protein, 10 aa, Homo Sapiens
FPLIYSEMKY

SEQ ID NO: 123046 - protein, 10 aa, Homo Sapiens
FPLREPGVNW

SEQ ID NO: 123047 - protein, 10 aa, Homo Sapiens
FPLSSPISKF

SEQ ID NO: 123048 - protein, 10 aa, Homo Sapiens
FPMTHGNTGF

SEQ ID NO: 123049 - protein, 10 aa, Homo Sapiens
FPNRVVFQEF

SEQ ID NO: 123050 - protein, 10 aa, Homo Sapiens
FPQPPGAARW

SEQ ID NO: 123051 - protein, 10 aa, Homo Sapiens
FPQTFAGPII

SEQ ID NO: 123052 - protein, 10 aa, Homo Sapiens
FPSEYVPTVF

SEQ ID NO: 123053 - protein, 10 aa, Homo Sapiens
FPSPFDPLTL

SEQ ID NO: 123054 - protein, 10 aa, Homo Sapiens
FPSSVAALRF

SEQ ID NO: 123055 - protein, 10 aa, Homo Sapiens
FPTEAERQQW

SEQ ID NO: 123056 - protein, 10 aa, Homo Sapiens
FPTGYIFDRF

SEQ ID NO: 123057 - protein, 10 aa, Homo Sapiens
FPVAGQKLIY

SEQ ID NO: 123058 - protein, 10 aa, Homo Sapiens
FPVKPHNKSF

SEQ ID NO: 123059 - protein, 10 aa, Homo Sapiens
FPVPGSGLVL

SEQ ID NO: 123060 - protein, 10 aa, Homo Sapiens
FPVRDGKIKL

SEQ ID NO: 123061 - protein, 10 aa, Homo Sapiens
FPWGDGNHTL

SEQ ID NO: 123062 - protein, 10 aa, Homo Sapiens
FPYADGPHQF

SEQ ID NO: 123063 - protein, 10 aa, Homo Sapiens
FPYEESKEKF

SEQ ID NO: 123064 - protein, 10 aa, Homo Sapiens
GPQQDPRLYW

SEQ ID NO: 123065 - protein, 10 aa, Homo Sapiens
GTEYTGPKLY

SEQ ID NO: 123066 - protein, 10 aa, Homo Sapiens
HAADPIITRW

SEQ ID NO: 123067 - protein, 10 aa, Homo Sapiens
HAAPILYAVW

SEQ ID NO: 123068 - protein, 10 aa, Homo Sapiens
HAARIINDLL

SEQ ID NO: 123069 - protein, 10 aa, Homo Sapiens
HACALAASLW

SEQ ID NO: 123070 - protein, 10 aa, Homo Sapiens
HADDTQPARL

SEQ ID NO: 123071 - protein, 10 aa, Homo Sapiens
HAENNEFITW

SEQ ID NO: 123072 - protein, 10 aa, Homo Sapiens
HAGFFVEDNF

SEQ ID NO: 123073 - protein, 10 aa, Homo Sapiens
HAGSLVSVMW

SEQ ID NO: 123074 - protein, 10 aa, Homo Sapiens
HAGVVPDLLW

SEQ ID NO: 123075 - protein, 10 aa, Homo Sapiens
HAHISEQAVW

SEQ ID NO: 123076 - protein, 10 aa, Homo Sapiens
HAIEESVVLI

SEQ ID NO: 123077 - protein, 10 aa, Homo Sapiens
HALESSFVGW

SEQ ID NO: 123078 - protein, 10 aa, Homo Sapiens
HALVAGIDRY

SEQ ID NO: 123079 - protein, 10 aa, Homo Sapiens
HALVGSPIIW

SEQ ID NO: 123080 - protein, 10 aa, Homo Sapiens
HAVGNVELYL

SEQ ID NO: 123081 - protein, 10 aa, Homo Sapiens
HAVGPEAHTI

SEQ ID NO: 123082 - protein, 10 aa, Homo Sapiens
HAVKNDFQIW

SEQ ID NO: 123083 - protein, 10 aa, Homo Sapiens
HIDPNVDYQF

SEQ ID NO: 123084 - protein, 10 aa, Homo Sapiens
HIWPDDITKW

SEQ ID NO: 123085 - protein, 10 aa, Homo Sapiens
HLHNMPPSAL

SEQ ID NO: 123086 - protein, 10 aa, Homo Sapiens
HPAAVFGCDW

SEQ ID NO: 123087 - protein, 10 aa, Homo Sapiens
HPAGHLVLKW

SEQ ID NO: 123088 - protein, 10 aa, Homo Sapiens
HPALLSDGKW

SEQ ID NO: 123089 - protein, 10 aa, Homo Sapiens
HPASPRGSSF

SEQ ID NO: 123090 - protein, 10 aa, Homo Sapiens
HPCGADVPSY

SEQ ID NO: 123091 - protein, 10 aa, Homo Sapiens
HPDCANVKQW

SEQ ID NO: 123092 - protein, 10 aa, Homo Sapiens
HPDGNFGAMW

SEQ ID NO: 123093 - protein, 10 aa, Homo Sapiens
HPDPDSSVKI

SEQ ID NO: 123094 - protein, 10 aa, Homo Sapiens
HPDPFANKSL

SEQ ID NO: 123095 - protein, 10 aa, Homo Sapiens
HPDPTRLLLF

SEQ ID NO: 123096 - protein, 10 aa, Homo Sapiens
HPDTIYSVDW

SEQ ID NO: 123097 - protein, 10 aa, Homo Sapiens
HPDVTEPMRF

SEQ ID NO: 123098 - protein, 10 aa, Homo Sapiens
HPEASIQAVF

SEQ ID NO: 123099 - protein, 10 aa, Homo Sapiens
HPEPLAGRHF

SEQ ID NO: 123100 - protein, 10 aa, Homo Sapiens
HPEQDAGKVF

SEQ ID NO: 123101 - protein, 10 aa, Homo Sapiens
HPEYTCIYRF

SEQ ID NO: 123102 - protein, 10 aa, Homo Sapiens
HPFLSGAETF

SEQ ID NO: 123103 - protein, 10 aa, Homo Sapiens
HPFLYDRETY

SEQ ID NO: 123104 - protein, 10 aa, Homo Sapiens
HPFPGPGLAI

SEQ ID NO: 123105 - protein, 10 aa, Homo Sapiens
HPFTNKPTTF

SEQ ID NO: 123106 - protein, 10 aa, Homo Sapiens
HPGVFRGDKW

SEQ ID NO: 123107 - protein, 10 aa, Homo Sapiens
HPIDDLQSAY

SEQ ID NO: 123108 - protein, 10 aa, Homo Sapiens
HPIDGFLQSL

SEQ ID NO: 123109 - protein, 10 aa, Homo Sapiens
HPIEGSTTVF

SEQ ID NO: 123110 - protein, 10 aa, Homo Sapiens
HPIHQGITEL

SEQ ID NO: 123111 - protein, 10 aa, Homo Sapiens
HPIIPEQSTF

SEQ ID NO: 123112 - protein, 10 aa, Homo Sapiens
HPISDHEATL

SEQ ID NO: 123113 - protein, 10 aa, Homo Sapiens
HPITSIEYQW

SEQ ID NO: 123114 - protein, 10 aa, Homo Sapiens
HPKYPDGKTF

SEQ ID NO: 123115 - protein, 10 aa, Homo Sapiens
HPMYGAGHKF

SEQ ID NO: 123116 - protein, 10 aa, Homo Sapiens
HPNNVVSVKY

SEQ ID NO: 123117 - protein, 10 aa, Homo Sapiens
HPNPGSITHL

SEQ ID NO: 123118 - protein, 10 aa, Homo Sapiens
HPNYHKEPFL

SEQ ID NO: 123119 - protein, 10 aa, Homo Sapiens
HPNYLGDLIM

SEQ ID NO: 123120 - protein, 10 aa, Homo Sapiens
HPQPGSANSL

SEQ ID NO: 123121 - protein, 10 aa, Homo Sapiens
HPSDESGYRW

SEQ ID NO: 123122 - protein, 10 aa, Homo Sapiens
HPSSVPGPDF

SEQ ID NO: 123123 - protein, 10 aa, Homo Sapiens
HPTLGPKITY

SEQ ID NO: 123124 - protein, 10 aa, Homo Sapiens
HPVKSGIHKW

SEQ ID NO: 123125 - protein, 10 aa, Homo Sapiens
HPVLSKDRNF

SEQ ID NO: 123126 - protein, 10 aa, Homo Sapiens
HPVSDHEATL

SEQ ID NO: 123127 - protein, 10 aa, Homo Sapiens
HPVSEYKAHF

SEQ ID NO: 123128 - protein, 10 aa, Homo Sapiens
HPVTGEPATW

SEQ ID NO: 123129 - protein, 10 aa, Homo Sapiens
HPVVDRSIKI

SEQ ID NO: 123130 - protein, 10 aa, Homo Sapiens
HPVYILKGGY

SEQ ID NO: 123131 - protein, 10 aa, Homo Sapiens
HPYHFKPKKI

SEQ ID NO: 123132 - protein, 10 aa, Homo Sapiens
HPYPTTKLMW

SEQ ID NO: 123133 - protein, 10 aa, Homo Sapiens
HPYQMEGLNW

SEQ ID NO: 123134 - protein, 10 aa, Homo Sapiens
HPYTEKPRLW

SEQ ID NO: 123135 - protein, 10 aa, Homo Sapiens
HTAPVLDIAW

SEQ ID NO: 123136 - protein, 10 aa, Homo Sapiens
HVAPVTSVEW

SEQ ID NO: 123137 - protein, 10 aa, Homo Sapiens
HVATEPVATW

SEQ ID NO: 123138 - protein, 10 aa, Homo Sapiens
HVEEKAVHSW

SEQ ID NO: 123139 - protein, 10 aa, Homo Sapiens
HVFSDGVTNW

SEQ ID NO: 123140 - protein, 10 aa, Homo Sapiens
HVNPYIGLFF

SEQ ID NO: 123141 - protein, 10 aa, Homo Sapiens
HVSRIPDYLW

SEQ ID NO: 123142 - protein, 10 aa, Homo Sapiens
IAANEENRKW

SEQ ID NO: 123143 - protein, 10 aa, Homo Sapiens
IPEEELTDNW

SEQ ID NO: 123144 - protein, 10 aa, Homo Sapiens
IPEGYVPEHW

SEQ ID NO: 123145 - protein, 10 aa, Homo Sapiens
IPEPEAAVLF

SEQ ID NO: 123146 - protein, 10 aa, Homo Sapiens
IPESLKSITW

SEQ ID NO: 123147 - protein, 10 aa, Homo Sapiens
IPFDPKFITY

SEQ ID NO: 123148 - protein, 10 aa, Homo Sapiens
IPFQAGLPRW

SEQ ID NO: 123149 - protein, 10 aa, Homo Sapiens
IPICHGNLIF

SEQ ID NO: 123150 - protein, 10 aa, Homo Sapiens
IPIGAYEPRW

SEQ ID NO: 123151 - protein, 10 aa, Homo Sapiens
IPLDDPTLLF

SEQ ID NO: 123152 - protein, 10 aa, Homo Sapiens
IPLDGETWSY

SEQ ID NO: 123153 - protein, 10 aa, Homo Sapiens
IPLPLGTVTI

SEQ ID NO: 123154 - protein, 10 aa, Homo Sapiens
IPMPGHPVNF

SEQ ID NO: 123155 - protein, 10 aa, Homo Sapiens
IPSPPPRPKN

SEQ ID NO: 123156 - protein, 10 aa, Homo Sapiens
IPSTGDATEW

SEQ ID NO: 123157 - protein, 10 aa, Homo Sapiens
IPTEEKPYKW

SEQ ID NO: 123158 - protein, 10 aa, Homo Sapiens
IPYAGETLKW

SEQ ID NO: 123159 - protein, 10 aa, Homo Sapiens
IPYTGPFNLL

SEQ ID NO: 123160 - protein, 10 aa, Homo Sapiens
IVWDEKKNQW

SEQ ID NO: 123161 - protein, 10 aa, Homo Sapiens
LALFNPDVCW

SEQ ID NO: 123162 - protein, 10 aa, Homo Sapiens
LALPPGAEHW

SEQ ID NO: 123163 - protein, 10 aa, Homo Sapiens
LPADITEDEF

SEQ ID NO: 123164 - protein, 10 aa, Homo Sapiens
LPAPAACGSF

SEQ ID NO: 123165 - protein, 10 aa, Homo Sapiens
LPDADTLLHF

SEQ ID NO: 123166 - protein, 10 aa, Homo Sapiens
LPDLSGPHSY

SEQ ID NO: 123167 - protein, 10 aa, Homo Sapiens
LPDNYTQDTW

SEQ ID NO: 123168 - protein, 10 aa, Homo Sapiens
LPEELVHAGW

SEQ ID NO: 123169 - protein, 10 aa, Homo Sapiens
LPEESGGRHL

SEQ ID NO: 123170 - protein, 10 aa, Homo Sapiens
LPEGAESRVW

SEQ ID NO: 123171 - protein, 10 aa, Homo Sapiens
LPEGEDLNEW

SEQ ID NO: 123172 - protein, 10 aa, Homo Sapiens
LPELEPPTTL

SEQ ID NO: 123173 - protein, 10 aa, Homo Sapiens
LPENYKQLTW

SEQ ID NO: 123174 - protein, 10 aa, Homo Sapiens
LPEPGHSHRF

SEQ ID NO: 123175 - protein, 10 aa, Homo Sapiens
LPFEGKCYYF

SEQ ID NO: 123176 - protein, 10 aa, Homo Sapiens
LPFLPDLEEL

SEQ ID NO: 123177 - protein, 10 aa, Homo Sapiens
LPFPNPERNF

SEQ ID NO: 123178 - protein, 10 aa, Homo Sapiens
LPHPYAIAVF

SEQ ID NO: 123179 - protein, 10 aa, Homo Sapiens
LPIAIINDRF

SEQ ID NO: 123180 - protein, 10 aa, Homo Sapiens
LPIAPDLEHF

SEQ ID NO: 123181 - protein, 10 aa, Homo Sapiens
LPIDGANDLF

SEQ ID NO: 123182 - protein, 10 aa, Homo Sapiens
LPIDPNEPTY

SEQ ID NO: 123183 - protein, 10 aa, Homo Sapiens
LPIEAVYHRY

SEQ ID NO: 123184 - protein, 10 aa, Homo Sapiens
LPIENDVYKY

SEQ ID NO: 123185 - protein, 10 aa, Homo Sapiens
LPIGDVATQY

SEQ ID NO: 123186 - protein, 10 aa, Homo Sapiens
LPIKDGKLVF

SEQ ID NO: 123187 - protein, 10 aa, Homo Sapiens
LPIQARLGSI

SEQ ID NO: 123188 - protein, 10 aa, Homo Sapiens
LPITDLHCGF

SEQ ID NO: 123189 - protein, 10 aa, Homo Sapiens
LPLPSNTPTF

SEQ ID NO: 123190 - protein, 10 aa, Homo Sapiens
LPNGMKEERF

SEQ ID NO: 123191 - protein, 10 aa, Homo Sapiens
LPNKDGVVRF

SEQ ID NO: 123192 - protein, 10 aa, Homo Sapiens
LPPELRGDLW

SEQ ID NO: 123193 - protein, 10 aa, Homo Sapiens
LPQEAEEERW

SEQ ID NO: 123194 - protein, 10 aa, Homo Sapiens
LPQGTSGQLW

SEQ ID NO: 123195 - protein, 10 aa, Homo Sapiens
LPQPDVFPLF

SEQ ID NO: 123196 - protein, 10 aa, Homo Sapiens
LPSHVAVDVW

SEQ ID NO: 123197 - protein, 10 aa, Homo Sapiens
LPSPVTAQKY

SEQ ID NO: 123198 - protein, 10 aa, Homo Sapiens
LPVADYFKQW

SEQ ID NO: 123199 - protein, 10 aa, Homo Sapiens
LPVTPILEGF

SEQ ID NO: 123200 - protein, 10 aa, Homo Sapiens
LPYAGDVSMF

SEQ ID NO: 123201 - protein, 10 aa, Homo Sapiens
LPYNHQHEYF

SEQ ID NO: 123202 - protein, 10 aa, Homo Sapiens
LPYRRSVPTW

SEQ ID NO: 123203 - protein, 10 aa, Homo Sapiens
LPYTGAETRI

SEQ ID NO: 123204 - protein, 10 aa, Homo Sapiens
LREESEADQW

SEQ ID NO: 123205 - protein, 10 aa, Homo Sapiens
LVAEVPKEHW

SEQ ID NO: 123206 - protein, 10 aa, Homo Sapiens
MAEGSNGNKW

SEQ ID NO: 123207 - protein, 10 aa, Homo Sapiens
MAFQNDVYEW

SEQ ID NO: 123208 - protein, 10 aa, Homo Sapiens
MPALFSDHTF

SEQ ID NO: 123209 - protein, 10 aa, Homo Sapiens
MPALRPALLW

SEQ ID NO: 123210 - protein, 10 aa, Homo Sapiens
MPANGETVTL

SEQ ID NO: 123211 - protein, 10 aa, Homo Sapiens
MPAPHTSITM

SEQ ID NO: 123212 - protein, 10 aa, Homo Sapiens
MPCPVPPARM

SEQ ID NO: 123213 - protein, 10 aa, Homo Sapiens
MPDDYGAPRF

SEQ ID NO: 123214 - protein, 10 aa, Homo Sapiens
MPDEATPHYF

SEQ ID NO: 123215 - protein, 10 aa, Homo Sapiens
MPEDVKNFYL

SEQ ID NO: 123216 - protein, 10 aa, Homo Sapiens
MPEPDAQRFF

SEQ ID NO: 123217 - protein, 10 aa, Homo Sapiens
MPESGAGSEF

SEQ ID NO: 123218 - protein, 10 aa, Homo Sapiens
MPESGPSYEF

SEQ ID NO: 123219 - protein, 10 aa, Homo Sapiens
MPFAPAIQTF

SEQ ID NO: 123220 - protein, 10 aa, Homo Sapiens
MPFEIRLPEF

SEQ ID NO: 123221 - protein, 10 aa, Homo Sapiens
MPFQRAGVNF

SEQ ID NO: 123222 - protein, 10 aa, Homo Sapiens
MPHANMNVHY

SEQ ID NO: 123223 - protein, 10 aa, Homo Sapiens
MPHAPIGLYF

SEQ ID NO: 123224 - protein, 10 aa, Homo Sapiens
MPIPGGNQRF

SEQ ID NO: 123225 - protein, 10 aa, Homo Sapiens
MPLHTIIPLL

SEQ ID NO: 123226 - protein, 10 aa, Homo Sapiens
MPNSASRDEF

SEQ ID NO: 123227 - protein, 10 aa, Homo Sapiens
MPRPDKNHQW

SEQ ID NO: 123228 - protein, 10 aa, Homo Sapiens
MPSGPSGKRW

SEQ ID NO: 123229 - protein, 10 aa, Homo Sapiens
MPSQSVEQTY

SEQ ID NO: 123230 - protein, 10 aa, Homo Sapiens
MPSSDTTVTF

SEQ ID NO: 123231 - protein, 10 aa, Homo Sapiens
MPVDPNEPTY

SEQ ID NO: 123232 - protein, 10 aa, Homo Sapiens
MPVNKVVQSF

SEQ ID NO: 123233 - protein, 10 aa, Homo Sapiens
MVLENVKEMW

SEQ ID NO: 123234 - protein, 10 aa, Homo Sapiens
NADPASHEIW

SEQ ID NO: 123235 - protein, 10 aa, Homo Sapiens
NAIQDSLTRW

SEQ ID NO: 123236 - protein, 10 aa, Homo Sapiens
NARMPEKVTW

SEQ ID NO: 123237 - protein, 10 aa, Homo Sapiens
NPDSAQPYKW

SEQ ID NO: 123238 - protein, 10 aa, Homo Sapiens
NPEDVARLIF

SEQ ID NO: 123239 - protein, 10 aa, Homo Sapiens
NPEPELLVRW

SEQ ID NO: 123240 - protein, 10 aa, Homo Sapiens
NPFGGRGLAW

SEQ ID NO: 123241 - protein, 10 aa, Homo Sapiens
NPIQGLASKW

SEQ ID NO: 123242 - protein, 10 aa, Homo Sapiens
NPISNNSQTF

SEQ ID NO: 123243 - protein, 10 aa, Homo Sapiens
NPLGGGREVW

SEQ ID NO: 123244 - protein, 10 aa, Homo Sapiens
NPPLESHVGW

SEQ ID NO: 123245 - protein, 10 aa, Homo Sapiens
NPTDIYPSKW

SEQ ID NO: 123246 - protein, 10 aa, Homo Sapiens
NPVPDGHSRW

SEQ ID NO: 123247 - protein, 10 aa, Homo Sapiens
NPYPGDVTKF

SEQ ID NO: 123248 - protein, 10 aa, Homo Sapiens
NPYSGDLTKF

SEQ ID NO: 123249 - protein, 10 aa, Homo Sapiens
NVEGAAKLLW

SEQ ID NO: 123250 - protein, 10 aa, Homo Sapiens
NVFKNDQDTW

SEQ ID NO: 123251 - protein, 10 aa, Homo Sapiens
PAASSFGSPG

SEQ ID NO: 123252 - protein, 10 aa, Homo Sapiens
QALEDHFSSF

SEQ ID NO: 123253 - protein, 10 aa, Homo Sapiens
QARVEELERW

SEQ ID NO: 123254 - protein, 10 aa, Homo Sapiens
QPAGPATHTW

SEQ ID NO: 123255 - protein, 10 aa, Homo Sapiens
QPAPPEKVGW

SEQ ID NO: 123256 - protein, 10 aa, Homo Sapiens
QPAQDIFSVY

SEQ ID NO: 123257 - protein, 10 aa, Homo Sapiens
QPDPDAIKMF

SEQ ID NO: 123258 - protein, 10 aa, Homo Sapiens
QPWEEIKTSY

SEQ ID NO: 123259 - protein, 10 aa, Homo Sapiens
RAGDPILTYF

SEQ ID NO: 123260 - protein, 10 aa, Homo Sapiens
RPIDHDLANW

SEQ ID NO: 123261 - protein, 10 aa, Homo Sapiens
SAASPHYQEW

SEQ ID NO: 123262 - protein, 10 aa, Homo Sapiens
SACDLPREVW

SEQ ID NO: 123263 - protein, 10 aa, Homo Sapiens
SACRTSGQTF

SEQ ID NO: 123264 - protein, 10 aa, Homo Sapiens
SADTCTHAYW

SEQ ID NO: 123265 - protein, 10 aa, Homo Sapiens
SATEVTGHRW

SEQ ID NO: 123266 - protein, 10 aa, Homo Sapiens
SAVASKEDSW

SEQ ID NO: 123267 - protein, 10 aa, Homo Sapiens
SAYDSKADIW

SEQ ID NO: 123268 - protein, 10 aa, Homo Sapiens
SPDGGYIPRI

SEQ ID NO: 123269 - protein, 10 aa, Homo Sapiens
SPDSAVGVQW

SEQ ID NO: 123270 - protein, 10 aa, Homo Sapiens
SPEDSWVSKW

SEQ ID NO: 123271 - protein, 10 aa, Homo Sapiens
SPEPGTAAAW

SEQ ID NO: 123272 - protein, 10 aa, Homo Sapiens
SPEQTVPYLW

SEQ ID NO: 123273 - protein, 10 aa, Homo Sapiens
SPHSAAYVLW

SEQ ID NO: 123274 - protein, 10 aa, Homo Sapiens
SPIDFHLQSW

SEQ ID NO: 123275 - protein, 10 aa, Homo Sapiens
SPIPCLPLRW

SEQ ID NO: 123276 - protein, 10 aa, Homo Sapiens
SPIPFPPLSY

SEQ ID NO: 123277 - protein, 10 aa, Homo Sapiens
SPITSSPPKW

SEQ ID NO: 123278 - protein, 10 aa, Homo Sapiens
SPMEIPKELW

SEQ ID NO: 123279 - protein, 10 aa, Homo Sapiens
SPRQAEAERW

SEQ ID NO: 123280 - protein, 10 aa, Homo Sapiens
SPSANIPEHW

SEQ ID NO: 123281 - protein, 10 aa, Homo Sapiens
SPSPGGDAAW

SEQ ID NO: 123282 - protein, 10 aa, Homo Sapiens
SPVLFQEALW

SEQ ID NO: 123283 - protein, 10 aa, Homo Sapiens
TAATAGIIGW

SEQ ID NO: 123284 - protein, 10 aa, Homo Sapiens
TADPGATMTF

SEQ ID NO: 123285 - protein, 10 aa, Homo Sapiens
TAHDDRGIRF

SEQ ID NO: 123286 - protein, 10 aa, Homo Sapiens
TAIATEQQSW

SEQ ID NO: 123287 - protein, 10 aa, Homo Sapiens
TAIESGQHYW

SEQ ID NO: 123288 - protein, 10 aa, Homo Sapiens
TALLAEGITW

SEQ ID NO: 123289 - protein, 10 aa, Homo Sapiens
TALPLTQLRW

SEQ ID NO: 123290 - protein, 10 aa, Homo Sapiens
TAQSDNKITW

SEQ ID NO: 123291 - protein, 10 aa, Homo Sapiens
TASPPTDLIW

SEQ ID NO: 123292 - protein, 10 aa, Homo Sapiens
TASRDDRSTW

SEQ ID NO: 123293 - protein, 10 aa, Homo Sapiens
TAVICQLDYW

SEQ ID NO: 123294 - protein, 10 aa, Homo Sapiens
TAWDEADVRF

SEQ ID NO: 123295 - protein, 10 aa, Homo Sapiens
TAWLEIMTKY

SEQ ID NO: 123296 - protein, 10 aa, Homo Sapiens
TPCGEGSKTW

SEQ ID NO: 123297 - protein, 10 aa, Homo Sapiens
TPCPGPFLRY

SEQ ID NO: 123298 - protein, 10 aa, Homo Sapiens
TPDPSTPSRL

SEQ ID NO: 123299 - protein, 10 aa, Homo Sapiens
TPDPTCAGRW

SEQ ID NO: 123300 - protein, 10 aa, Homo Sapiens
TPIEERGDLF

SEQ ID NO: 123301 - protein, 10 aa, Homo Sapiens
TPLYGNVHSW

SEQ ID NO: 123302 - protein, 10 aa, Homo Sapiens
TPSAEPSTSW

SEQ ID NO: 123303 - protein, 10 aa, Homo Sapiens
TPSPEEVQSW

SEQ ID NO: 123304 - protein, 10 aa, Homo Sapiens
TVYTGIDHHW

SEQ ID NO: 123305 - protein, 10 aa, Homo Sapiens
VAADALGEEW

SEQ ID NO: 123306 - protein, 10 aa, Homo Sapiens
VPAHPDSRCW

SEQ ID NO: 123307 - protein, 10 aa, Homo Sapiens
VPDPNKPQKL

SEQ ID NO: 123308 - protein, 10 aa, Homo Sapiens
VPEAGAHEEW

SEQ ID NO: 123309 - protein, 10 aa, Homo Sapiens
VPEASRPHQW

SEQ ID NO: 123310 - protein, 10 aa, Homo Sapiens
VPEKGSGDKW

SEQ ID NO: 123311 - protein, 10 aa, Homo Sapiens
VPIEQKHEVW

SEQ ID NO: 123312 - protein, 10 aa, Homo Sapiens
VPLQNPPIKW

SEQ ID NO: 123313 - protein, 10 aa, Homo Sapiens
VPNMQDKTEW

SEQ ID NO: 123314 - protein, 10 aa, Homo Sapiens
VPSPPPGHKW

SEQ ID NO: 123315 - protein, 10 aa, Homo Sapiens
VPVALRTDDW

SEQ ID NO: 123316 - protein, 10 aa, Homo Sapiens
VPVAVVPSKW

SEQ ID NO: 123317 - protein, 10 aa, Homo Sapiens
VPVPPFGCTF

SEQ ID NO: 123318 - protein, 10 aa, Homo Sapiens
VPVQVDGEAW

SEQ ID NO: 123319 - protein, 10 aa, Homo Sapiens
VPVTTKEDAW

SEQ ID NO: 123320 - protein, 10 aa, Homo Sapiens
VPWEELHNRF

SEQ ID NO: 123321 - protein, 10 aa, Homo Sapiens
VPYPDDLVGF

SEQ ID NO: 123322 - protein, 10 aa, Homo Sapiens
VSPEYFSMLL

SEQ ID NO: 123323 - protein, 10 aa, Homo Sapiens
WPDDLQNHTF

SEQ ID NO: 123324 - protein, 10 aa, Homo Sapiens
WPEEGPATAW

SEQ ID NO: 123325 - protein, 10 aa, Homo Sapiens
WPQPDKPMFF

SEQ ID NO: 123326 - protein, 10 aa, Homo Sapiens
YADPGAEVKI

SEQ ID NO: 123327 - protein, 10 aa, Homo Sapiens
YAFDVNTHKW

SEQ ID NO: 123328 - protein, 10 aa, Homo Sapiens
YAYSPLEDSW

SEQ ID NO: 123329 - protein, 10 aa, Homo Sapiens
YPDEEGPKHW

SEQ ID NO: 123330 - protein, 10 aa, Homo Sapiens
YPDRELQSQW

SEQ ID NO: 123331 - protein, 10 aa, Homo Sapiens
YPDSNGMPVW

SEQ ID NO: 123332 - protein, 10 aa, Homo Sapiens
YPESNSRAIF

SEQ ID NO: 123333 - protein, 10 aa, Homo Sapiens
YPETLGRLLI

SEQ ID NO: 123334 - protein, 10 aa, Homo Sapiens
YPFDSPQVMF

SEQ ID NO: 123335 - protein, 10 aa, Homo Sapiens
YPFHKQPPTY

SEQ ID NO: 123336 - protein, 10 aa, Homo Sapiens
YPFKPPKITF

SEQ ID NO: 123337 - protein, 10 aa, Homo Sapiens
YPFKPPKVAF

SEQ ID NO: 123338 - protein, 10 aa, Homo Sapiens
YPFKPPKVTF

SEQ ID NO: 123339 - protein, 10 aa, Homo Sapiens
YPIDPVTQEF

SEQ ID NO: 123340 - protein, 10 aa, Homo Sapiens
YPIVDGKLSI

SEQ ID NO: 123341 - protein, 10 aa, Homo Sapiens
YPLEVTKLIY

SEQ ID NO: 123342 - protein, 10 aa, Homo Sapiens
YPNGVVVHYF

SEQ ID NO: 123343 - protein, 10 aa, Homo Sapiens
YPNKLDTITW

SEQ ID NO: 123344 - protein, 10 aa, Homo Sapiens
YPNPYSKHVL

SEQ ID NO: 123345 - protein, 10 aa, Homo Sapiens
YPPPHQVFTW

SEQ ID NO: 123346 - protein, 10 aa, Homo Sapiens
YPQSVPRLFI

SEQ ID NO: 123347 - protein, 10 aa, Homo Sapiens
YPVGHMPYGW

SEQ ID NO: 123348 - protein, 10 aa, Homo Sapiens
YPYEYEGGHI

SEQ ID NO: 123349 - protein, 10 aa, Homo Sapiens
YPYNAPTVKF

SEQ ID NO: 123350 - protein, 10 aa, Homo Sapiens
YPYPPPPPEF

SEQ ID NO: 123351 - protein, 10 aa, Homo Sapiens
YPYPPVPETF

SEQ ID NO: 123352 - protein, 10 aa, Homo Sapiens
YPYPYPHTLY

SEQ ID NO: 123353 - protein, 11 aa, Homo Sapiens
AACPVLVGNKW

SEQ ID NO: 123354 - protein, 11 aa, Homo Sapiens
AAQAAATAAAM

SEQ ID NO: 123355 - protein, 11 aa, Homo Sapiens
APAPPGPGTRW

SEQ ID NO: 123356 - protein, 11 aa, Homo Sapiens
APEPLIPFHQW

SEQ ID NO: 123357 - protein, 11 aa, Homo Sapiens
APIPNAPPARW

SEQ ID NO: 123358 - protein, 11 aa, Homo Sapiens
APLAGLEKMAS

SEQ ID NO: 123359 - protein, 11 aa, Homo Sapiens
APVKENIPYSW

SEQ ID NO: 123360 - protein, 11 aa, Homo Sapiens
AQAAATAAAMA

SEQ ID NO: 123361 - protein, 11 aa, Homo Sapiens
CPEEFLTGHYW

SEQ ID NO: 123362 - protein, 11 aa, Homo Sapiens
DALAHGADVNW

SEQ ID NO: 123363 - protein, 11 aa, Homo Sapiens
EAIEEVKNGGW

SEQ ID NO: 123364 - protein, 11 aa, Homo Sapiens
EALGDNVKQYW

SEQ ID NO: 123365 - protein, 11 aa, Homo Sapiens
EALPGPHYYTW

SEQ ID NO: 123366 - protein, 11 aa, Homo Sapiens
EAWNEEGKAVW

SEQ ID NO: 123367 - protein, 11 aa, Homo Sapiens
EPIYPEVVHMF

SEQ ID NO: 123368 - protein, 11 aa, Homo Sapiens
EPVPASIPNYY

SEQ ID NO: 123369 - protein, 11 aa, Homo Sapiens
FAQTVSPAEKW

SEQ ID NO: 123370 - protein, 11 aa, Homo Sapiens
FAYKDQNENRW

SEQ ID NO: 123371 - protein, 11 aa, Homo Sapiens
FPAAIEHTIQW

SEQ ID NO: 123372 - protein, 11 aa, Homo Sapiens
FPASPPKGYFL

SEQ ID NO: 123373 - protein, 11 aa, Homo Sapiens
FPAVDDNLLKF

SEQ ID NO: 123374 - protein, 11 aa, Homo Sapiens
FPDFPTPGVVF

SEQ ID NO: 123375 - protein, 11 aa, Homo Sapiens
FPDPAGKLNQF

SEQ ID NO: 123376 - protein, 11 aa, Homo Sapiens
FPEKPCKGSGY

SEQ ID NO: 123377 - protein, 11 aa, Homo Sapiens
FPESASDAIKF

SEQ ID NO: 123378 - protein, 11 aa, Homo Sapiens
FPFKEPEKRTI

SEQ ID NO: 123379 - protein, 11 aa, Homo Sapiens
FPFLSGDNQHY

SEQ ID NO: 123380 - protein, 11 aa, Homo Sapiens
FPFNPLDFESF

SEQ ID NO: 123381 - protein, 11 aa, Homo Sapiens
FPFSQDINSHL

SEQ ID NO: 123382 - protein, 11 aa, Homo Sapiens
FPHLPGSAPSW

SEQ ID NO: 123383 - protein, 11 aa, Homo Sapiens
FPIIIHDEPTY

SEQ ID NO: 123384 - protein, 11 aa, Homo Sapiens
FPLIEVNKVYY

SEQ ID NO: 123385 - protein, 11 aa, Homo Sapiens
FPLLPQDVHLL

SEQ ID NO: 123386 - protein, 11 aa, Homo Sapiens
FPLQPGKVATF

SEQ ID NO: 123387 - protein, 11 aa, Homo Sapiens
FPNAIEHTLQW

SEQ ID NO: 123388 - protein, 11 aa, Homo Sapiens
FPNIVIKGSEL

SEQ ID NO: 123389 - protein, 11 aa, Homo Sapiens
FPNTGARIMLF

SEQ ID NO: 123390 - protein, 11 aa, Homo Sapiens
FPSTAEHTLQW

SEQ ID NO: 123391 - protein, 11 aa, Homo Sapiens
FPVETNCGHLF

SEQ ID NO: 123392 - protein, 11 aa, Homo Sapiens
FPWGDGNHTLF

SEQ ID NO: 123393 - protein, 11 aa, Homo Sapiens
FPYARDDLSLY

SEQ ID NO: 123394 - protein, 11 aa, Homo Sapiens
FPYYPSPGVLF

SEQ ID NO: 123395 - protein, 11 aa, Homo Sapiens
GPGGPGGGGQR

SEQ ID NO: 123396 - protein, 11 aa, Homo Sapiens
GPSIHPGFLPW

SEQ ID NO: 123397 - protein, 11 aa, Homo Sapiens
GVAGPKGPAGE

SEQ ID NO: 123398 - protein, 11 aa, Homo Sapiens
HAAEDSSLLIY

SEQ ID NO: 123399 - protein, 11 aa, Homo Sapiens
HACGVIATIAF

SEQ ID NO: 123400 - protein, 11 aa, Homo Sapiens
HAEDSVMDHHF

SEQ ID NO: 123401 - protein, 11 aa, Homo Sapiens
HAETATASSTW

SEQ ID NO: 123402 - protein, 11 aa, Homo Sapiens
HAIIDEQPLIF

SEQ ID NO: 123403 - protein, 11 aa, Homo Sapiens
HASDVLETSGW

SEQ ID NO: 123404 - protein, 11 aa, Homo Sapiens
HAYEGVPNGGW

SEQ ID NO: 123405 - protein, 11 aa, Homo Sapiens
HAYPDFAPQKF

SEQ ID NO: 123406 - protein, 11 aa, Homo Sapiens
HPAPFSKVITF

SEQ ID NO: 123407 - protein, 11 aa, Homo Sapiens
HPAPLCTIRTL

SEQ ID NO: 123408 - protein, 11 aa, Homo Sapiens
HPCFWIDGQYL

SEQ ID NO: 123409 - protein, 11 aa, Homo Sapiens
HPDPDAELQRM

SEQ ID NO: 123410 - protein, 11 aa, Homo Sapiens
HPDQTGTNQHF

SEQ ID NO: 123411 - protein, 11 aa, Homo Sapiens
HPENPKAVETF

SEQ ID NO: 123412 - protein, 11 aa, Homo Sapiens
HPESPNTGSHW

SEQ ID NO: 123413 - protein, 11 aa, Homo Sapiens
HPESPSTGHYW

SEQ ID NO: 123414 - protein, 11 aa, Homo Sapiens
HPFEDGAKLRI

SEQ ID NO: 123415 - protein, 11 aa, Homo Sapiens
HPIADGGTPDI

SEQ ID NO: 123416 - protein, 11 aa, Homo Sapiens
HPIPGEYKFFW

SEQ ID NO: 123417 - protein, 11 aa, Homo Sapiens
HPLPETAVRGY

SEQ ID NO: 123418 - protein, 11 aa, Homo Sapiens
HPLPRVKAETY

SEQ ID NO: 123419 - protein, 11 aa, Homo Sapiens
HPLYGHGECKW

SEQ ID NO: 123420 - protein, 11 aa, Homo Sapiens
HPQIMSPLAKW

SEQ ID NO: 123421 - protein, 11 aa, Homo Sapiens
HPVTTDIKHSI

SEQ ID NO: 123422 - protein, 11 aa, Homo Sapiens
HPYPFSGIFEI

SEQ ID NO: 123423 - protein, 11 aa, Homo Sapiens
HRGFSGLDGAK

SEQ ID NO: 123424 - protein, 11 aa, Homo Sapiens
IARREEEFDLF

SEQ ID NO: 123425 - protein, 11 aa, Homo Sapiens
IPEEILGKVSI

SEQ ID NO: 123426 - protein, 11 aa, Homo Sapiens
IPEKGLEPEHS

SEQ ID NO: 123427 - protein, 11 aa, Homo Sapiens
IPHTDPVDYEF

SEQ ID NO: 123428 - protein, 11 aa, Homo Sapiens
IPIALSGRDIL

SEQ ID NO: 123429 - protein, 11 aa, Homo Sapiens
IPLALEGKDLL

SEQ ID NO: 123430 - protein, 11 aa, Homo Sapiens
IPLAPISKSLW

SEQ ID NO: 123431 - protein, 11 aa, Homo Sapiens
IPMNPNTNDLF

SEQ ID NO: 123432 - protein, 11 aa, Homo Sapiens
IPYHSEVPVSL

SEQ ID NO: 123433 - protein, 11 aa, Homo Sapiens
IPYPTKNPFTW

SEQ ID NO: 123434 - protein, 11 aa, Homo Sapiens
IPYSEPMPLSF

SEQ ID NO: 123435 - protein, 11 aa, Homo Sapiens
LADPDEVARRW

SEQ ID NO: 123436 - protein, 11 aa, Homo Sapiens
LPAGINSIVAI

SEQ ID NO: 123437 - protein, 11 aa, Homo Sapiens
LPALEPSTRYW

SEQ ID NO: 123438 - protein, 11 aa, Homo Sapiens
LPCPLGPLTVW

SEQ ID NO: 123439 - protein, 11 aa, Homo Sapiens
LPDGTSLTQTF

SEQ ID NO: 123440 - protein, 11 aa, Homo Sapiens
LPDPGLCGPAW

SEQ ID NO: 123441 - protein, 11 aa, Homo Sapiens
LPEGKSSATKW

SEQ ID NO: 123442 - protein, 11 aa, Homo Sapiens
LPFCQPSKITY

SEQ ID NO: 123443 - protein, 11 aa, Homo Sapiens
LPFLPSTEDVY

SEQ ID NO: 123444 - protein, 11 aa, Homo Sapiens
LPFLPTPMGKG

SEQ ID NO: 123445 - protein, 11 aa, Homo Sapiens
LPFPDETHERY

SEQ ID NO: 123446 - protein, 11 aa, Homo Sapiens
LPIGDVATQYF

SEQ ID NO: 123447 - protein, 11 aa, Homo Sapiens
LPIPESQVITI

SEQ ID NO: 123448 - protein, 11 aa, Homo Sapiens
LPLFPEPLHVF

SEQ ID NO: 123449 - protein, 11 aa, Homo Sapiens
LPNAVGPPFTW

SEQ ID NO: 123450 - protein, 11 aa, Homo Sapiens
LPNHLAMMETL

SEQ ID NO: 123451 - protein, 11 aa, Homo Sapiens
LPNSTERAITI

SEQ ID NO: 123452 - protein, 11 aa, Homo Sapiens
LPVGALATEQW

SEQ ID NO: 123453 - protein, 11 aa, Homo Sapiens
LPVQAPANDSW

SEQ ID NO: 123454 - protein, 11 aa, Homo Sapiens
LPYKATENDIY

SEQ ID NO: 123455 - protein, 11 aa, Homo Sapiens
LPYNHQHEYFF

SEQ ID NO: 123456 - protein, 11 aa, Homo Sapiens
LPYPDPAIAQF

SEQ ID NO: 123457 - protein, 11 aa, Homo Sapiens
LPYRATENDIY

SEQ ID NO: 123458 - protein, 11 aa, Homo Sapiens
MAFLDSQTATF

SEQ ID NO: 123459 - protein, 11 aa, Homo Sapiens
MPAPPPKENAW

SEQ ID NO: 123460 - protein, 11 aa, Homo Sapiens
MPDPKTFKQHF

SEQ ID NO: 123461 - protein, 11 aa, Homo Sapiens
MPEEESAKVCL

SEQ ID NO: 123462 - protein, 11 aa, Homo Sapiens
MPFQDGKPFNL

SEQ ID NO: 123463 - protein, 11 aa, Homo Sapiens
MPIREGDTVTL

SEQ ID NO: 123464 - protein, 11 aa, Homo Sapiens
MPMGSLEHEGL

SEQ ID NO: 123465 - protein, 11 aa, Homo Sapiens
MPMSGNTGENF

SEQ ID NO: 123466 - protein, 11 aa, Homo Sapiens
MPNPSLAQVKI

SEQ ID NO: 123467 - protein, 11 aa, Homo Sapiens
MPPQDAFTTQW

SEQ ID NO: 123468 - protein, 11 aa, Homo Sapiens
MPQELIEASNW

SEQ ID NO: 123469 - protein, 11 aa, Homo Sapiens
MPTTSTTSTRF

SEQ ID NO: 123470 - protein, 11 aa, Homo Sapiens
MPVGPDAILRY

SEQ ID NO: 123471 - protein, 11 aa, Homo Sapiens
MPYNHQHKYFF

SEQ ID NO: 123472 - protein, 11 aa, Homo Sapiens
NAAANVLRETW

SEQ ID NO: 123473 - protein, 11 aa, Homo Sapiens
NAEKELTDRNW

SEQ ID NO: 123474 - protein, 11 aa, Homo Sapiens
NAFEESKDNTI

SEQ ID NO: 123475 - protein, 11 aa, Homo Sapiens
NALPDTLKVTY

SEQ ID NO: 123476 - protein, 11 aa, Homo Sapiens
NAVNWIESSSW

SEQ ID NO: 123477 - protein, 11 aa, Homo Sapiens
NAWLEAPPEKW

SEQ ID NO: 123478 - protein, 11 aa, Homo Sapiens
NPDPKSHDVYW

SEQ ID NO: 123479 - protein, 11 aa, Homo Sapiens
NPFQEPRTVVW

SEQ ID NO: 123480 - protein, 11 aa, Homo Sapiens
NPLQEPFKNAW

SEQ ID NO: 123481 - protein, 11 aa, Homo Sapiens
NPVCVRPTPKW

SEQ ID NO: 123482 - protein, 11 aa, Homo Sapiens
NPVDILTYVTW

SEQ ID NO: 123483 - protein, 11 aa, Homo Sapiens
PEHMAHSHSPI

SEQ ID NO: 123484 - protein, 11 aa, Homo Sapiens
PGMAPVPTGVF

SEQ ID NO: 123485 - protein, 11 aa, Homo Sapiens
QAADPAISQAW

SEQ ID NO: 123486 - protein, 11 aa, Homo Sapiens
QAAFLEERDAW

SEQ ID NO: 123487 - protein, 11 aa, Homo Sapiens
QPEAELGRLLF

SEQ ID NO: 123488 - protein, 11 aa, Homo Sapiens
QPEGPGGAASW

SEQ ID NO: 123489 - protein, 11 aa, Homo Sapiens
QPFGDTGGFHF

SEQ ID NO: 123490 - protein, 11 aa, Homo Sapiens
QPIAALHRDEW

SEQ ID NO: 123491 - protein, 11 aa, Homo Sapiens
QPMEVQEGYGF

SEQ ID NO: 123492 - protein, 11 aa, Homo Sapiens
QPVTPLGTSRW

SEQ ID NO: 123493 - protein, 11 aa, Homo Sapiens
RPAGDGTFQKW

SEQ ID NO: 123494 - protein, 11 aa, Homo Sapiens
RPFACDTKLEW

SEQ ID NO: 123495 - protein, 11 aa, Homo Sapiens
RPFEENGACKY

SEQ ID NO: 123496 - protein, 11 aa, Homo Sapiens
RPFEESGTCKY

SEQ ID NO: 123497 - protein, 11 aa, Homo Sapiens
SAAADETLRLW

SEQ ID NO: 123498 - protein, 11 aa, Homo Sapiens
SAAADSAVRLW

SEQ ID NO: 123499 - protein, 11 aa, Homo Sapiens
SAEEAMKHVYF

SEQ ID NO: 123500 - protein, 11 aa, Homo Sapiens
SAFSAAHEEQW

SEQ ID NO: 123501 - protein, 11 aa, Homo Sapiens
SALGPDIICRW

SEQ ID NO: 123502 - protein, 11 aa, Homo Sapiens
SASDDGTVRIW

SEQ ID NO: 123503 - protein, 11 aa, Homo Sapiens
SASPDATIRIW

SEQ ID NO: 123504 - protein, 11 aa, Homo Sapiens
SASQDGKLIIW

SEQ ID NO: 123505 - protein, 11 aa, Homo Sapiens
SAYNEGTLMKF

SEQ ID NO: 123506 - protein, 11 aa, Homo Sapiens
SGANIDELITF

SEQ ID NO: 123507 - protein, 11 aa, Homo Sapiens
SPEVPLPGMKW

SEQ ID NO: 123508 - protein, 11 aa, Homo Sapiens
SPFPSSIPHAF

SEQ ID NO: 123509 - protein, 11 aa, Homo Sapiens
SPLNTHAAELW

SEQ ID NO: 123510 - protein, 11 aa, Homo Sapiens
SPMFDGKVPHW

SEQ ID NO: 123511 - protein, 11 aa, Homo Sapiens
SPSSVTGNALW

SEQ ID NO: 123512 - protein, 11 aa, Homo Sapiens
TAADDHQALIW

SEQ ID NO: 123513 - protein, 11 aa, Homo Sapiens
TAAPSLKNAAF

SEQ ID NO: 123514 - protein, 11 aa, Homo Sapiens
TAAPTGTTIKF

SEQ ID NO: 123515 - protein, 11 aa, Homo Sapiens
TAEEKAIVQQW

SEQ ID NO: 123516 - protein, 11 aa, Homo Sapiens
TAEGEINNVQW

SEQ ID NO: 123517 - protein, 11 aa, Homo Sapiens
TAEGQATLERL

SEQ ID NO: 123518 - protein, 11 aa, Homo Sapiens
TAIQEIVVTHW

SEQ ID NO: 123519 - protein, 11 aa, Homo Sapiens
TASADGTIKLW

SEQ ID NO: 123520 - protein, 11 aa, Homo Sapiens
TASDDATIKAW

SEQ ID NO: 123521 - protein, 11 aa, Homo Sapiens
TAVGEGLDRVW

SEQ ID NO: 123522 - protein, 11 aa, Homo Sapiens
TKEETTPPSAS

SEQ ID NO: 123523 - protein, 11 aa, Homo Sapiens
TPEAAAQVVQW

SEQ ID NO: 123524 - protein, 11 aa, Homo Sapiens
TPIQDNVDQTY

SEQ ID NO: 123525 - protein, 11 aa, Homo Sapiens
TPIQNSLKDLW

SEQ ID NO: 123526 - protein, 11 aa, Homo Sapiens
TPLEDVGKQVW

SEQ ID NO: 123527 - protein, 11 aa, Homo Sapiens
TPLPREVLHKW

SEQ ID NO: 123528 - protein, 11 aa, Homo Sapiens
TPLQNNLHELW

SEQ ID NO: 123529 - protein, 11 aa, Homo Sapiens
TPVPSAEAFRW

SEQ ID NO: 123530 - protein, 11 aa, Homo Sapiens
TSENITQKVVW

SEQ ID NO: 123531 - protein, 11 aa, Homo Sapiens
VGGEFDLEMNF

SEQ ID NO: 123532 - protein, 11 aa, Homo Sapiens
VPAAVSHSEFW

SEQ ID NO: 123533 - protein, 11 aa, Homo Sapiens
VPEEQEHMRRW

SEQ ID NO: 123534 - protein, 11 aa, Homo Sapiens
VPEEVEAHQSW

SEQ ID NO: 123535 - protein, 11 aa, Homo Sapiens
VPEGQIILAKW

SEQ ID NO: 123536 - protein, 11 aa, Homo Sapiens
VPESSLAGHSF

SEQ ID NO: 123537 - protein, 11 aa, Homo Sapiens
VPIDLQKVDQF

SEQ ID NO: 123538 - protein, 11 aa, Homo Sapiens
VPIPGGAAPPP

SEQ ID NO: 123539 - protein, 11 aa, Homo Sapiens
VPLPGPPGPPG

SEQ ID NO: 123540 - protein, 11 aa, Homo Sapiens
VPRNPTIGDKF

SEQ ID NO: 123541 - protein, 11 aa, Homo Sapiens
VPSSELQIYTW

SEQ ID NO: 123542 - protein, 11 aa, Homo Sapiens
YGTLTSFDIHI

SEQ ID NO: 123543 - protein, 11 aa, Homo Sapiens
YMDPTGKTRTW

SEQ ID NO: 123544 - protein, 11 aa, Homo Sapiens
YPDMESDIRSW

SEQ ID NO: 123545 - protein, 11 aa, Homo Sapiens
YPDPVSIIQKY

SEQ ID NO: 123546 - protein, 11 aa, Homo Sapiens
YPETLGRLLIL

SEQ ID NO: 123547 - protein, 11 aa, Homo Sapiens
YPFESAEAQLL

SEQ ID NO: 123548 - protein, 11 aa, Homo Sapiens
YPFTGDHKQKF

SEQ ID NO: 123549 - protein, 11 aa, Homo Sapiens
YPHEPTAVFNI

SEQ ID NO: 123550 - protein, 11 aa, Homo Sapiens
YPIEHGIVTNW

SEQ ID NO: 123551 - protein, 11 aa, Homo Sapiens
YPLDLEGGSEY

SEQ ID NO: 123552 - protein, 11 aa, Homo Sapiens
YPLDPTTEHIY

SEQ ID NO: 123553 - protein, 11 aa, Homo Sapiens
YPLQDPKNLIL

SEQ ID NO: 123554 - protein, 11 aa, Homo Sapiens
YPMDLGGRNFL

SEQ ID NO: 123555 - protein, 11 aa, Homo Sapiens
YPMENGIVRNW

SEQ ID NO: 123556 - protein, 11 aa, Homo Sapiens
YPMSSTIPHNF

SEQ ID NO: 123557 - protein, 11 aa, Homo Sapiens
YPMTPAIEQRL

SEQ ID NO: 123558 - protein, 11 aa, Homo Sapiens
YPSETTVKYVF

SEQ ID NO: 123559 - protein, 11 aa, Homo Sapiens
YPSRVFVGDTF

SEQ ID NO: 123560 - protein, 11 aa, Homo Sapiens
YPVYQDYHTVW

SEQ ID NO: 123561 - protein, 8 aa, Homo Sapiens
APVILPSA

SEQ ID NO: 123562 - protein, 8 aa, Homo Sapiens
DAIRLFAA

SEQ ID NO: 123563 - protein, 8 aa, Homo Sapiens
DPTDIPVV

SEQ ID NO: 123564 - protein, 8 aa, Homo Sapiens
EAFRLPTA

SEQ ID NO: 123565 - protein, 8 aa, Homo Sapiens
EALGIPAA

SEQ ID NO: 123566 - protein, 8 aa, Homo Sapiens
EEQLQQIR

SEQ ID NO: 123567 - protein, 8 aa, Homo Sapiens
ESLLLFEA

SEQ ID NO: 123568 - protein, 8 aa, Homo Sapiens
FIFQQPEA

SEQ ID NO: 123569 - protein, 8 aa, Homo Sapiens
FPANIQVV

SEQ ID NO: 123570 - protein, 8 aa, Homo Sapiens
FPAPILRA

SEQ ID NO: 123571 - protein, 8 aa, Homo Sapiens
FPAQVPSA

SEQ ID NO: 123572 - protein, 8 aa, Homo Sapiens
FPDSLPEV

SEQ ID NO: 123573 - protein, 8 aa, Homo Sapiens
FPFHFVEV

SEQ ID NO: 123574 - protein, 8 aa, Homo Sapiens
FPFLGRVA

SEQ ID NO: 123575 - protein, 8 aa, Homo Sapiens
FPFNIHEN

SEQ ID NO: 123576 - protein, 8 aa, Homo Sapiens
FPFNPLDF

SEQ ID NO: 123577 - protein, 8 aa, Homo Sapiens
FPFNTPKT

SEQ ID NO: 123578 - protein, 8 aa, Homo Sapiens
FPFRFLNA

SEQ ID NO: 123579 - protein, 8 aa, Homo Sapiens
FPGIILAA

SEQ ID NO: 123580 - protein, 8 aa, Homo Sapiens
FPHIMPLA

SEQ ID NO: 123581 - protein, 8 aa, Homo Sapiens
FPHMLFMV

SEQ ID NO: 123582 - protein, 8 aa, Homo Sapiens
FPHPLPSL

SEQ ID NO: 123583 - protein, 8 aa, Homo Sapiens
FPHVLPLI

SEQ ID NO: 123584 - protein, 8 aa, Homo Sapiens
FPILIRQV

SEQ ID NO: 123585 - protein, 8 aa, Homo Sapiens
FPISLLQA

SEQ ID NO: 123586 - protein, 8 aa, Homo Sapiens
FPKEPVEL

SEQ ID NO: 123587 - protein, 8 aa, Homo Sapiens
FPLAKEFI

SEQ ID NO: 123588 - protein, 8 aa, Homo Sapiens
FPLIISSV

SEQ ID NO: 123589 - protein, 8 aa, Homo Sapiens
FPLLLPMA

SEQ ID NO: 123590 - protein, 8 aa, Homo Sapiens
FPSPILKV

SEQ ID NO: 123591 - protein, 8 aa, Homo Sapiens
FPTLGFVV

SEQ ID NO: 123592 - protein, 8 aa, Homo Sapiens
FPVHGFPT

SEQ ID NO: 123593 - protein, 8 aa, Homo Sapiens
FPVILYEV

SEQ ID NO: 123594 - protein, 8 aa, Homo Sapiens
FPVLFVSA

SEQ ID NO: 123595 - protein, 8 aa, Homo Sapiens
FPVLLRLA

SEQ ID NO: 123596 - protein, 8 aa, Homo Sapiens
FPVSIPAV

SEQ ID NO: 123597 - protein, 8 aa, Homo Sapiens
FPVSLPLA

SEQ ID NO: 123598 - protein, 8 aa, Homo Sapiens
FPWQSLEA

SEQ ID NO: 123599 - protein, 8 aa, Homo Sapiens
FPYAFKEV

SEQ ID NO: 123600 - protein, 8 aa, Homo Sapiens
FPYKIFKN

SEQ ID NO: 123601 - protein, 8 aa, Homo Sapiens
FPYKIPAV

SEQ ID NO: 123602 - protein, 8 aa, Homo Sapiens
HATIIPKV

SEQ ID NO: 123603 - protein, 8 aa, Homo Sapiens
HNLLLPVA

SEQ ID NO: 123604 - protein, 8 aa, Homo Sapiens
HNLLLYEA

SEQ ID NO: 123605 - protein, 8 aa, Homo Sapiens
HPFGFVAV

SEQ ID NO: 123606 - protein, 8 aa, Homo Sapiens
HPFLLLGT

SEQ ID NO: 123607 - protein, 8 aa, Homo Sapiens
HPTSIVKA

SEQ ID NO: 123608 - protein, 8 aa, Homo Sapiens
HPVLLTEA

SEQ ID NO: 123609 - protein, 8 aa, Homo Sapiens
HPWVLPVV

SEQ ID NO: 123610 - protein, 8 aa, Homo Sapiens
HPYLFPVA

SEQ ID NO: 123611 - protein, 8 aa, Homo Sapiens
IPALLESA

SEQ ID NO: 123612 - protein, 8 aa, Homo Sapiens
IPFDLPSA

SEQ ID NO: 123613 - protein, 8 aa, Homo Sapiens
IPFVITVA

SEQ ID NO: 123614 - protein, 8 aa, Homo Sapiens
IPIFLPEV

SEQ ID NO: 123615 - protein, 8 aa, Homo Sapiens
IPIVGIVA

SEQ ID NO: 123616 - protein, 8 aa, Homo Sapiens
IPNMIPQA

SEQ ID NO: 123617 - protein, 8 aa, Homo Sapiens
IPQVMAIA

SEQ ID NO: 123618 - protein, 8 aa, Homo Sapiens
IPTPIVGV

SEQ ID NO: 123619 - protein, 8 aa, Homo Sapiens
IPVRFIEA

SEQ ID NO: 123620 - protein, 8 aa, Homo Sapiens
LPALLFKA

SEQ ID NO: 123621 - protein, 8 aa, Homo Sapiens
LPFLFFST

SEQ ID NO: 123622 - protein, 8 aa, Homo Sapiens
LPFLGVLA

SEQ ID NO: 123623 - protein, 8 aa, Homo Sapiens
LPFLLYMA

SEQ ID NO: 123624 - protein, 8 aa, Homo Sapiens
LPFLTTEV

SEQ ID NO: 123625 - protein, 8 aa, Homo Sapiens
LPFSQPKV

SEQ ID NO: 123626 - protein, 8 aa, Homo Sapiens
LPHLIQDA

SEQ ID NO: 123627 - protein, 8 aa, Homo Sapiens
LPKQPVIV

SEQ ID NO: 123628 - protein, 8 aa, Homo Sapiens
LPLPIPTV

SEQ ID NO: 123629 - protein, 8 aa, Homo Sapiens
LPLPLPMA

SEQ ID NO: 123630 - protein, 8 aa, Homo Sapiens
LPMLQTVA

SEQ ID NO: 123631 - protein, 8 aa, Homo Sapiens
LPRPLPAV

SEQ ID NO: 123632 - protein, 8 aa, Homo Sapiens
LPVRLATA

SEQ ID NO: 123633 - protein, 8 aa, Homo Sapiens
LPWQGLKA

SEQ ID NO: 123634 - protein, 8 aa, Homo Sapiens
LPWWGAIA

SEQ ID NO: 123635 - protein, 8 aa, Homo Sapiens
LPYLFHVV

SEQ ID NO: 123636 - protein, 8 aa, Homo Sapiens
LPYPIHQV

SEQ ID NO: 123637 - protein, 8 aa, Homo Sapiens
MAAFVPAA

SEQ ID NO: 123638 - protein, 8 aa, Homo Sapiens
MAFKGWSA

SEQ ID NO: 123639 - protein, 8 aa, Homo Sapiens
MAFLLPLI

SEQ ID NO: 123640 - protein, 8 aa, Homo Sapiens
MAFRVPTA

SEQ ID NO: 123641 - protein, 8 aa, Homo Sapiens
MAVVIPEA

SEQ ID NO: 123642 - protein, 8 aa, Homo Sapiens
MPAFLRSA

SEQ ID NO: 123643 - protein, 8 aa, Homo Sapiens
MPFQQWEA

SEQ ID NO: 123644 - protein, 8 aa, Homo Sapiens
MPHSIMRV

SEQ ID NO: 123645 - protein, 8 aa, Homo Sapiens
MPIKINLI

SEQ ID NO: 123646 - protein, 8 aa, Homo Sapiens
MPIYPKWM

SEQ ID NO: 123647 - protein, 8 aa, Homo Sapiens
MPIYVTGI

SEQ ID NO: 123648 - protein, 8 aa, Homo Sapiens
MPQPVPTA

SEQ ID NO: 123649 - protein, 8 aa, Homo Sapiens
MPSLQPVV

SEQ ID NO: 123650 - protein, 8 aa, Homo Sapiens
MPVQFQVV

SEQ ID NO: 123651 - protein, 8 aa, Homo Sapiens
MPWVQETL

SEQ ID NO: 123652 - protein, 8 aa, Homo Sapiens
PNLFPFEK

SEQ ID NO: 123653 - protein, 8 aa, Homo Sapiens
PYLFPVAA

SEQ ID NO: 123654 - protein, 8 aa, Homo Sapiens
QNIQLPAA

SEQ ID NO: 123655 - protein, 8 aa, Homo Sapiens
SPFEWDIV

SEQ ID NO: 123656 - protein, 8 aa, Homo Sapiens
TEELAYLK

SEQ ID NO: 123657 - protein, 8 aa, Homo Sapiens
TPTPVPVV

SEQ ID NO: 123658 - protein, 8 aa, Homo Sapiens
VPFLHWEA

SEQ ID NO: 123659 - protein, 8 aa, Homo Sapiens
VPFSIPAA

SEQ ID NO: 123660 - protein, 8 aa, Homo Sapiens
VPIEIPTI

SEQ ID NO: 123661 - protein, 8 aa, Homo Sapiens
VPLIAIMA

SEQ ID NO: 123662 - protein, 8 aa, Homo Sapiens
VPTNIIAA

SEQ ID NO: 123663 - protein, 8 aa, Homo Sapiens
VPVIISRA

SEQ ID NO: 123664 - protein, 8 aa, Homo Sapiens
VPWLLLGA

SEQ ID NO: 123665 - protein, 8 aa, Homo Sapiens
WPFLGIVA

SEQ ID NO: 123666 - protein, 8 aa, Homo Sapiens
WPFREPVT

SEQ ID NO: 123667 - protein, 8 aa, Homo Sapiens
WPLLLVVA

SEQ ID NO: 123668 - protein, 8 aa, Homo Sapiens
YAFILTSA

SEQ ID NO: 123669 - protein, 8 aa, Homo Sapiens
YAFLLDKA

SEQ ID NO: 123670 - protein, 8 aa, Homo Sapiens
YPAPIPPP

SEQ ID NO: 123671 - protein, 8 aa, Homo Sapiens
YPFDFQGA

SEQ ID NO: 123672 - protein, 8 aa, Homo Sapiens
YPFELIMA

SEQ ID NO: 123673 - protein, 8 aa, Homo Sapiens
YPFKPPKV

SEQ ID NO: 123674 - protein, 8 aa, Homo Sapiens
YPFLLMVV

SEQ ID NO: 123675 - protein, 8 aa, Homo Sapiens
YPFLLPKS

SEQ ID NO: 123676 - protein, 8 aa, Homo Sapiens
YPFLLPVI

SEQ ID NO: 123677 - protein, 8 aa, Homo Sapiens
YPFQIHSI

SEQ ID NO: 123678 - protein, 8 aa, Homo Sapiens
YPIALTRA

SEQ ID NO: 123679 - protein, 8 aa, Homo Sapiens
YPLELFMA

SEQ ID NO: 123680 - protein, 8 aa, Homo Sapiens
YPLLIIRE

SEQ ID NO: 123681 - protein, 8 aa, Homo Sapiens
YPLLLQSI

SEQ ID NO: 123682 - protein, 8 aa, Homo Sapiens
YPQLLPGI

SEQ ID NO: 123683 - protein, 8 aa, Homo Sapiens
YPVLLDGV

SEQ ID NO: 123684 - protein, 8 aa, Homo Sapiens
YPYQVVRA

SEQ ID NO: 123685 - protein, 9 aa, Homo Sapiens
AAIAPIIAA

SEQ ID NO: 123686 - protein, 9 aa, Homo Sapiens
AIPALGGIS

SEQ ID NO: 123687 - protein, 9 aa, Homo Sapiens
APALLLIPA

SEQ ID NO: 123688 - protein, 9 aa, Homo Sapiens
APFQGLLQA

SEQ ID NO: 123689 - protein, 9 aa, Homo Sapiens
APIWLEHAA

SEQ ID NO: 123690 - protein, 9 aa, Homo Sapiens
APLDAYFQV

SEQ ID NO: 123691 - protein, 9 aa, Homo Sapiens
APLPHLPPA

SEQ ID NO: 123692 - protein, 9 aa, Homo Sapiens
APMPPIIHA

SEQ ID NO: 123693 - protein, 9 aa, Homo Sapiens
APNPVVFVA

SEQ ID NO: 123694 - protein, 9 aa, Homo Sapiens
APRQPGLMA

SEQ ID NO: 123695 - protein, 9 aa, Homo Sapiens
APVLLPSAA

SEQ ID NO: 123696 - protein, 9 aa, Homo Sapiens
APYPGFLSV

SEQ ID NO: 123697 - protein, 9 aa, Homo Sapiens
AYAIYELAV

SEQ ID NO: 123698 - protein, 9 aa, Homo Sapiens
CPHVVVLVA

SEQ ID NO: 123699 - protein, 9 aa, Homo Sapiens
CPHWVFNVA

SEQ ID NO: 123700 - protein, 9 aa, Homo Sapiens
CPVYPVITA

SEQ ID NO: 123701 - protein, 9 aa, Homo Sapiens
DAHEFLIAA

SEQ ID NO: 123702 - protein, 9 aa, Homo Sapiens
DAISNIFQA

SEQ ID NO: 123703 - protein, 9 aa, Homo Sapiens
DALLVGVPA

SEQ ID NO: 123704 - protein, 9 aa, Homo Sapiens
DALYPVVSA

SEQ ID NO: 123705 - protein, 9 aa, Homo Sapiens
DPFDILREA

SEQ ID NO: 123706 - protein, 9 aa, Homo Sapiens
DPFELFIAA

SEQ ID NO: 123707 - protein, 9 aa, Homo Sapiens
DPFERLISA

SEQ ID NO: 123708 - protein, 9 aa, Homo Sapiens
DPFQILVAA

SEQ ID NO: 123709 - protein, 9 aa, Homo Sapiens
DPHSGHFVA

SEQ ID NO: 123710 - protein, 9 aa, Homo Sapiens
DSFHHNVAA

SEQ ID NO: 123711 - protein, 9 aa, Homo Sapiens
EAAVPQLAA

SEQ ID NO: 123712 - protein, 9 aa, Homo Sapiens
EAFEAIKAA

SEQ ID NO: 123713 - protein, 9 aa, Homo Sapiens
EAFEAIPRA

SEQ ID NO: 123714 - protein, 9 aa, Homo Sapiens
EAFGFKVNA

SEQ ID NO: 123715 - protein, 9 aa, Homo Sapiens
EAIVRIAEA

SEQ ID NO: 123716 - protein, 9 aa, Homo Sapiens
EAKFPILSA

SEQ ID NO: 123717 - protein, 9 aa, Homo Sapiens
EALAYFITV

SEQ ID NO: 123718 - protein, 9 aa, Homo Sapiens
EALGIPAAA

SEQ ID NO: 123719 - protein, 9 aa, Homo Sapiens
EAWNGFVAA

SEQ ID NO: 123720 - protein, 9 aa, Homo Sapiens
EGFSIPVSA

SEQ ID NO: 123721 - protein, 9 aa, Homo Sapiens
EGLPPILNA

SEQ ID NO: 123722 - protein, 9 aa, Homo Sapiens
EGLPVFVVA

SEQ ID NO: 123723 - protein, 9 aa, Homo Sapiens
ELYADFIAA

SEQ ID NO: 123724 - protein, 9 aa, Homo Sapiens
ENYNKFISA

SEQ ID NO: 123725 - protein, 9 aa, Homo Sapiens
EPFADFHRV

SEQ ID NO: 123726 - protein, 9 aa, Homo Sapiens
ESFVMPWQA

SEQ ID NO: 123727 - protein, 9 aa, Homo Sapiens
EVFPEFAAA

SEQ ID NO: 123728 - protein, 9 aa, Homo Sapiens
EVTFALHSA

SEQ ID NO: 123729 - protein, 9 aa, Homo Sapiens
FAHFIQPAA

SEQ ID NO: 123730 - protein, 9 aa, Homo Sapiens
FAILQSVKA

SEQ ID NO: 123731 - protein, 9 aa, Homo Sapiens
FAKIPFEEA

SEQ ID NO: 123732 - protein, 9 aa, Homo Sapiens
FALAKGFTA

SEQ ID NO: 123733 - protein, 9 aa, Homo Sapiens
FALLQKVRA

SEQ ID NO: 123734 - protein, 9 aa, Homo Sapiens
FALPFGRTA

SEQ ID NO: 123735 - protein, 9 aa, Homo Sapiens
FALPGLLHA

SEQ ID NO: 123736 - protein, 9 aa, Homo Sapiens
FAMPYFIQV

SEQ ID NO: 123737 - protein, 9 aa, Homo Sapiens
FAVEGPKLV

SEQ ID NO: 123738 - protein, 9 aa, Homo Sapiens
FIFHSSLPT

SEQ ID NO: 123739 - protein, 9 aa, Homo Sapiens
FIKAVHVKA

SEQ ID NO: 123740 - protein, 9 aa, Homo Sapiens
FILKFPHSA

SEQ ID NO: 123741 - protein, 9 aa, Homo Sapiens
FPAAPLLTV

SEQ ID NO: 123742 - protein, 9 aa, Homo Sapiens
FPAEPMKGP

SEQ ID NO: 123743 - protein, 9 aa, Homo Sapiens
FPANVMDVI

SEQ ID NO: 123744 - protein, 9 aa, Homo Sapiens
FPAPILRAV

SEQ ID NO: 123745 - protein, 9 aa, Homo Sapiens
FPASSLLSA

SEQ ID NO: 123746 - protein, 9 aa, Homo Sapiens
FPAVVKNVA

SEQ ID NO: 123747 - protein, 9 aa, Homo Sapiens
FPEGLVIQA

SEQ ID NO: 123748 - protein, 9 aa, Homo Sapiens
FPELMGVFA

SEQ ID NO: 123749 - protein, 9 aa, Homo Sapiens
FPFAPPAAA

SEQ ID NO: 123750 - protein, 9 aa, Homo Sapiens
FPFDPERRV

SEQ ID NO: 123751 - protein, 9 aa, Homo Sapiens
FPFFNPIQT

SEQ ID NO: 123752 - protein, 9 aa, Homo Sapiens
FPFGCPPTV

SEQ ID NO: 123753 - protein, 9 aa, Homo Sapiens
FPFGFFTTV

SEQ ID NO: 123754 - protein, 9 aa, Homo Sapiens
FPFGGFIGS

SEQ ID NO: 123755 - protein, 9 aa, Homo Sapiens
FPFGKIGTV

SEQ ID NO: 123756 - protein, 9 aa, Homo Sapiens
FPFLQQEEA

SEQ ID NO: 123757 - protein, 9 aa, Homo Sapiens
FPFLVGEQV

SEQ ID NO: 123758 - protein, 9 aa, Homo Sapiens
FPFNSFLSG

SEQ ID NO: 123759 - protein, 9 aa, Homo Sapiens
FPFPTPPSV

SEQ ID NO: 123760 - protein, 9 aa, Homo Sapiens
FPFQPGSVA

SEQ ID NO: 123761 - protein, 9 aa, Homo Sapiens
FPGEQFKPA

SEQ ID NO: 123762 - protein, 9 aa, Homo Sapiens
FPGIRPYLA

SEQ ID NO: 123763 - protein, 9 aa, Homo Sapiens
FPHESTFGV

SEQ ID NO: 123764 - protein, 9 aa, Homo Sapiens
FPHFDLSHG

SEQ ID NO: 123765 - protein, 9 aa, Homo Sapiens
FPHISPCEV

SEQ ID NO: 123766 - protein, 9 aa, Homo Sapiens
FPHLQDAQV

SEQ ID NO: 123767 - protein, 9 aa, Homo Sapiens
FPHLQLLDV

SEQ ID NO: 123768 - protein, 9 aa, Homo Sapiens
FPHLRVLEA

SEQ ID NO: 123769 - protein, 9 aa, Homo Sapiens
FPIAEVFTL

SEQ ID NO: 123770 - protein, 9 aa, Homo Sapiens
FPIHAITGV

SEQ ID NO: 123771 - protein, 9 aa, Homo Sapiens
FPIKQPITV

SEQ ID NO: 123772 - protein, 9 aa, Homo Sapiens
FPIRDSWNA

SEQ ID NO: 123773 - protein, 9 aa, Homo Sapiens
FPKDLIQVV

SEQ ID NO: 123774 - protein, 9 aa, Homo Sapiens
FPKETFEGP

SEQ ID NO: 123775 - protein, 9 aa, Homo Sapiens
FPKGDVISV

SEQ ID NO: 123776 - protein, 9 aa, Homo Sapiens
FPKGTIFTA

SEQ ID NO: 123777 - protein, 9 aa, Homo Sapiens
FPLDAILNA

SEQ ID NO: 123778 - protein, 9 aa, Homo Sapiens
FPLEKALEA

SEQ ID NO: 123779 - protein, 9 aa, Homo Sapiens
FPLELTQKA

SEQ ID NO: 123780 - protein, 9 aa, Homo Sapiens
FPLLLPMAS

SEQ ID NO: 123781 - protein, 9 aa, Homo Sapiens
FPLNDLLSA

SEQ ID NO: 123782 - protein, 9 aa, Homo Sapiens
FPLPTPLSV

SEQ ID NO: 123783 - protein, 9 aa, Homo Sapiens
FPLQFGREV

SEQ ID NO: 123784 - protein, 9 aa, Homo Sapiens
FPLQLEPSA

SEQ ID NO: 123785 - protein, 9 aa, Homo Sapiens
FPLQPGKVA

SEQ ID NO: 123786 - protein, 9 aa, Homo Sapiens
FPLSAMLEA

SEQ ID NO: 123787 - protein, 9 aa, Homo Sapiens
FPLSPAVRV

SEQ ID NO: 123788 - protein, 9 aa, Homo Sapiens
FPLTKVYVV

SEQ ID NO: 123789 - protein, 9 aa, Homo Sapiens
FPLVKSALN

SEQ ID NO: 123790 - protein, 9 aa, Homo Sapiens
FPMEIRQYL

SEQ ID NO: 123791 - protein, 9 aa, Homo Sapiens
FPMELRQFL

SEQ ID NO: 123792 - protein, 9 aa, Homo Sapiens
FPMPLPRKA

SEQ ID NO: 123793 - protein, 9 aa, Homo Sapiens
FPMSPVTSV

SEQ ID NO: 123794 - protein, 9 aa, Homo Sapiens
FPNEFIVET

SEQ ID NO: 123795 - protein, 9 aa, Homo Sapiens
FPNGVLIKV

SEQ ID NO: 123796 - protein, 9 aa, Homo Sapiens
FPNIHPPQI

SEQ ID NO: 123797 - protein, 9 aa, Homo Sapiens
FPNIPVAST

SEQ ID NO: 123798 - protein, 9 aa, Homo Sapiens
FPNQYVDVA

SEQ ID NO: 123799 - protein, 9 aa, Homo Sapiens
FPNRLNLEA

SEQ ID NO: 123800 - protein, 9 aa, Homo Sapiens
FPPNIVESA

SEQ ID NO: 123801 - protein, 9 aa, Homo Sapiens
FPQEFVWEA

SEQ ID NO: 123802 - protein, 9 aa, Homo Sapiens
FPQIVSVAA

SEQ ID NO: 123803 - protein, 9 aa, Homo Sapiens
FPQLFPVSA

SEQ ID NO: 123804 - protein, 9 aa, Homo Sapiens
FPQVPYHLV

SEQ ID NO: 123805 - protein, 9 aa, Homo Sapiens
FPRNVVTSV

SEQ ID NO: 123806 - protein, 9 aa, Homo Sapiens
FPRPVTVEP

SEQ ID NO: 123807 - protein, 9 aa, Homo Sapiens
FPSDKIFEA

SEQ ID NO: 123808 - protein, 9 aa, Homo Sapiens
FPSEITDTV

SEQ ID NO: 123809 - protein, 9 aa, Homo Sapiens
FPSEYVPTV

SEQ ID NO: 123810 - protein, 9 aa, Homo Sapiens
FPSGHLLDA

SEQ ID NO: 123811 - protein, 9 aa, Homo Sapiens
FPSHDLPSV

SEQ ID NO: 123812 - protein, 9 aa, Homo Sapiens
FPSHLLVTA

SEQ ID NO: 123813 - protein, 9 aa, Homo Sapiens
FPSINVHKV

SEQ ID NO: 123814 - protein, 9 aa, Homo Sapiens
FPSNIFYEG

SEQ ID NO: 123815 - protein, 9 aa, Homo Sapiens
FPSNLEVEA

SEQ ID NO: 123816 - protein, 9 aa, Homo Sapiens
FPSSAFLRA

SEQ ID NO: 123817 - protein, 9 aa, Homo Sapiens
FPSTKISEA

SEQ ID NO: 123818 - protein, 9 aa, Homo Sapiens
FPTAATLEA

SEQ ID NO: 123819 - protein, 9 aa, Homo Sapiens
FPTAPTRVV

SEQ ID NO: 123820 - protein, 9 aa, Homo Sapiens
FPTDPKVVV

SEQ ID NO: 123821 - protein, 9 aa, Homo Sapiens
FPTHPYFSA

SEQ ID NO: 123822 - protein, 9 aa, Homo Sapiens
FPTHPYFSV

SEQ ID NO: 123823 - protein, 9 aa, Homo Sapiens
FPTIKIFGS

SEQ ID NO: 123824 - protein, 9 aa, Homo Sapiens
FPTLKFFPA

SEQ ID NO: 123825 - protein, 9 aa, Homo Sapiens
FPTLSPMVV

SEQ ID NO: 123826 - protein, 9 aa, Homo Sapiens
FPTPPSVEA

SEQ ID NO: 123827 - protein, 9 aa, Homo Sapiens
FPTTKIPNP

SEQ ID NO: 123828 - protein, 9 aa, Homo Sapiens
FPTVLDITA

SEQ ID NO: 123829 - protein, 9 aa, Homo Sapiens
FPVAMFWVS

SEQ ID NO: 123830 - protein, 9 aa, Homo Sapiens
FPVEFLIQV

SEQ ID NO: 123831 - protein, 9 aa, Homo Sapiens
FPVGKGLAA

SEQ ID NO: 123832 - protein, 9 aa, Homo Sapiens
FPVGVFVVA

SEQ ID NO: 123833 - protein, 9 aa, Homo Sapiens
FPVHGFPTL

SEQ ID NO: 123834 - protein, 9 aa, Homo Sapiens
FPVIPLLPT

SEQ ID NO: 123835 - protein, 9 aa, Homo Sapiens
FPVLLSDTA

SEQ ID NO: 123836 - protein, 9 aa, Homo Sapiens
FPVPVTVRA

SEQ ID NO: 123837 - protein, 9 aa, Homo Sapiens
FPVQGVHTV

SEQ ID NO: 123838 - protein, 9 aa, Homo Sapiens
FPVQTITTV

SEQ ID NO: 123839 - protein, 9 aa, Homo Sapiens
FPVRLLVAA

SEQ ID NO: 123840 - protein, 9 aa, Homo Sapiens
FPVSIPAVL

SEQ ID NO: 123841 - protein, 9 aa, Homo Sapiens
FPVSWDNEV

SEQ ID NO: 123842 - protein, 9 aa, Homo Sapiens
FPWINTEGV

SEQ ID NO: 123843 - protein, 9 aa, Homo Sapiens
FPWNKNVEV

SEQ ID NO: 123844 - protein, 9 aa, Homo Sapiens
FPWPQPLST

SEQ ID NO: 123845 - protein, 9 aa, Homo Sapiens
FPWQPKTGA

SEQ ID NO: 123846 - protein, 9 aa, Homo Sapiens
FPYAFKEVI

SEQ ID NO: 123847 - protein, 9 aa, Homo Sapiens
FPYAHRFPP

SEQ ID NO: 123848 - protein, 9 aa, Homo Sapiens
FPYEPFLNA

SEQ ID NO: 123849 - protein, 9 aa, Homo Sapiens
FPYGGVLAG

SEQ ID NO: 123850 - protein, 9 aa, Homo Sapiens
FPYGLFELV

SEQ ID NO: 123851 - protein, 9 aa, Homo Sapiens
FPYGSFPYV

SEQ ID NO: 123852 - protein, 9 aa, Homo Sapiens
FPYMTHPSV

SEQ ID NO: 123853 - protein, 9 aa, Homo Sapiens
FPYPVGVHA

SEQ ID NO: 123854 - protein, 9 aa, Homo Sapiens
FPYSLLIFV

SEQ ID NO: 123855 - protein, 9 aa, Homo Sapiens
FPYVLLRNA

SEQ ID NO: 123856 - protein, 9 aa, Homo Sapiens
FPYYPSPGV

SEQ ID NO: 123857 - protein, 9 aa, Homo Sapiens
FQRPPLIAA

SEQ ID NO: 123858 - protein, 9 aa, Homo Sapiens
FVADGIFKA

SEQ ID NO: 123859 - protein, 9 aa, Homo Sapiens
FVEILIPVA

SEQ ID NO: 123860 - protein, 9 aa, Homo Sapiens
FVFSFPVSV

SEQ ID NO: 123861 - protein, 9 aa, Homo Sapiens
FVIRNIVEA

SEQ ID NO: 123862 - protein, 9 aa, Homo Sapiens
FVNDIFERI

SEQ ID NO: 123863 - protein, 9 aa, Homo Sapiens
FVRDMIREV

SEQ ID NO: 123864 - protein, 9 aa, Homo Sapiens
FVSPVSVAA

SEQ ID NO: 123865 - protein, 9 aa, Homo Sapiens
HAFWGGSVV

SEQ ID NO: 123866 - protein, 9 aa, Homo Sapiens
HARDFTVSA

SEQ ID NO: 123867 - protein, 9 aa, Homo Sapiens
HATLLFNTA

SEQ ID NO: 123868 - protein, 9 aa, Homo Sapiens
HPAAFPLPV

SEQ ID NO: 123869 - protein, 9 aa, Homo Sapiens
HPADSVVSV

SEQ ID NO: 123870 - protein, 9 aa, Homo Sapiens
HPASLEFQA

SEQ ID NO: 123871 - protein, 9 aa, Homo Sapiens
HPASVIFTV

SEQ ID NO: 123872 - protein, 9 aa, Homo Sapiens
HPDYAILAA

SEQ ID NO: 123873 - protein, 9 aa, Homo Sapiens
HPEEFYNLV

SEQ ID NO: 123874 - protein, 9 aa, Homo Sapiens
HPFGAMNIV

SEQ ID NO: 123875 - protein, 9 aa, Homo Sapiens
HPHPFLNSV

SEQ ID NO: 123876 - protein, 9 aa, Homo Sapiens
HPLNIVPPP

SEQ ID NO: 123877 - protein, 9 aa, Homo Sapiens
HPLPIWTPA

SEQ ID NO: 123878 - protein, 9 aa, Homo Sapiens
HPLYQSWVI

SEQ ID NO: 123879 - protein, 9 aa, Homo Sapiens
HPNLNLFAA

SEQ ID NO: 123880 - protein, 9 aa, Homo Sapiens
HPTWALKEA

SEQ ID NO: 123881 - protein, 9 aa, Homo Sapiens
HPVAKILHA

SEQ ID NO: 123882 - protein, 9 aa, Homo Sapiens
HPVDNVIAV

SEQ ID NO: 123883 - protein, 9 aa, Homo Sapiens
HPVEIFYTP

SEQ ID NO: 123884 - protein, 9 aa, Homo Sapiens
HPVHPFLAV

SEQ ID NO: 123885 - protein, 9 aa, Homo Sapiens
HPVLLQPVA

SEQ ID NO: 123886 - protein, 9 aa, Homo Sapiens
HPWEVIVGT

SEQ ID NO: 123887 - protein, 9 aa, Homo Sapiens
HPWLFIEEA

SEQ ID NO: 123888 - protein, 9 aa, Homo Sapiens
HPWLPLMQA

SEQ ID NO: 123889 - protein, 9 aa, Homo Sapiens
HPYFYAPEL

SEQ ID NO: 123890 - protein, 9 aa, Homo Sapiens
HPYLFPVAA

SEQ ID NO: 123891 - protein, 9 aa, Homo Sapiens
HPYLPINSA

SEQ ID NO: 123892 - protein, 9 aa, Homo Sapiens
HPYRLILTV

SEQ ID NO: 123893 - protein, 9 aa, Homo Sapiens
HSMRYFYTA

SEQ ID NO: 123894 - protein, 9 aa, Homo Sapiens
HVGDFVWVA

SEQ ID NO: 123895 - protein, 9 aa, Homo Sapiens
HVYDGKFLA

SEQ ID NO: 123896 - protein, 9 aa, Homo Sapiens
IALWQFLSA

SEQ ID NO: 123897 - protein, 9 aa, Homo Sapiens
IASGIYLLA

SEQ ID NO: 123898 - protein, 9 aa, Homo Sapiens
IPAALPVAA

SEQ ID NO: 123899 - protein, 9 aa, Homo Sapiens
IPFDIFITA

SEQ ID NO: 123900 - protein, 9 aa, Homo Sapiens
IPFDLPSAA

SEQ ID NO: 123901 - protein, 9 aa, Homo Sapiens
IPFFSIPVV

SEQ ID NO: 123902 - protein, 9 aa, Homo Sapiens
IPFFSVPVA

SEQ ID NO: 123903 - protein, 9 aa, Homo Sapiens
IPFGIFSRA

SEQ ID NO: 123904 - protein, 9 aa, Homo Sapiens
IPFGITEEA

SEQ ID NO: 123905 - protein, 9 aa, Homo Sapiens
IPFGTMVAV

SEQ ID NO: 123906 - protein, 9 aa, Homo Sapiens
IPFIPQNPA

SEQ ID NO: 123907 - protein, 9 aa, Homo Sapiens
IPFSKPVKV

SEQ ID NO: 123908 - protein, 9 aa, Homo Sapiens
IPFWRNTAV

SEQ ID NO: 123909 - protein, 9 aa, Homo Sapiens
IPFYGILGA

SEQ ID NO: 123910 - protein, 9 aa, Homo Sapiens
IPFYLQPHA

SEQ ID NO: 123911 - protein, 9 aa, Homo Sapiens
IPFYLQYLA

SEQ ID NO: 123912 - protein, 9 aa, Homo Sapiens
IPHLLGDVV

SEQ ID NO: 123913 - protein, 9 aa, Homo Sapiens
IPHLVTHDA

SEQ ID NO: 123914 - protein, 9 aa, Homo Sapiens
IPHPLIMGV

SEQ ID NO: 123915 - protein, 9 aa, Homo Sapiens
IPIEVIPMA

SEQ ID NO: 123916 - protein, 9 aa, Homo Sapiens
IPIPTLPSV

SEQ ID NO: 123917 - protein, 9 aa, Homo Sapiens
IPISNILMV

SEQ ID NO: 123918 - protein, 9 aa, Homo Sapiens
IPISPISPA

SEQ ID NO: 123919 - protein, 9 aa, Homo Sapiens
IPITVLQPA

SEQ ID NO: 123920 - protein, 9 aa, Homo Sapiens
IPIVGIVAG

SEQ ID NO: 123921 - protein, 9 aa, Homo Sapiens
IPIWLYWRI

SEQ ID NO: 123922 - protein, 9 aa, Homo Sapiens
IPKILPWHA

SEQ ID NO: 123923 - protein, 9 aa, Homo Sapiens
IPLDKRLAA

SEQ ID NO: 123924 - protein, 9 aa, Homo Sapiens
IPLGFGVAA

SEQ ID NO: 123925 - protein, 9 aa, Homo Sapiens
IPLKEMPAV

SEQ ID NO: 123926 - protein, 9 aa, Homo Sapiens
IPLPDMPHA

SEQ ID NO: 123927 - protein, 9 aa, Homo Sapiens
IPLPPPPPP

SEQ ID NO: 123928 - protein, 9 aa, Homo Sapiens
IPLQDLVAA

SEQ ID NO: 123929 - protein, 9 aa, Homo Sapiens
IPMELVNEV

SEQ ID NO: 123930 - protein, 9 aa, Homo Sapiens
IPNISYITA

SEQ ID NO: 123931 - protein, 9 aa, Homo Sapiens
IPPPVPPSA

SEQ ID NO: 123932 - protein, 9 aa, Homo Sapiens
IPQQVFQEV

SEQ ID NO: 123933 - protein, 9 aa, Homo Sapiens
IPRSFMMEV

SEQ ID NO: 123934 - protein, 9 aa, Homo Sapiens
IPRVPSLSV

SEQ ID NO: 123935 - protein, 9 aa, Homo Sapiens
IPVDFKYIA

SEQ ID NO: 123936 - protein, 9 aa, Homo Sapiens
IPVYSPLSA

SEQ ID NO: 123937 - protein, 9 aa, Homo Sapiens
IPWSIPLEA

SEQ ID NO: 123938 - protein, 9 aa, Homo Sapiens
IPYAVLLEA

SEQ ID NO: 123939 - protein, 9 aa, Homo Sapiens
IPYGMRFIA

SEQ ID NO: 123940 - protein, 9 aa, Homo Sapiens
IPYHIVNIV

SEQ ID NO: 123941 - protein, 9 aa, Homo Sapiens
ISLLQREAA

SEQ ID NO: 123942 - protein, 9 aa, Homo Sapiens
ITIHLPSPV

SEQ ID NO: 123943 - protein, 9 aa, Homo Sapiens
KAINVFVSA

SEQ ID NO: 123944 - protein, 9 aa, Homo Sapiens
KPANVFITA

SEQ ID NO: 123945 - protein, 9 aa, Homo Sapiens
KPFKEFVEA

SEQ ID NO: 123946 - protein, 9 aa, Homo Sapiens
KPFLLPVEA

SEQ ID NO: 123947 - protein, 9 aa, Homo Sapiens
KPLPPIQVA

SEQ ID NO: 123948 - protein, 9 aa, Homo Sapiens
KPMEGWIAV

SEQ ID NO: 123949 - protein, 9 aa, Homo Sapiens
KPYNVYITV

SEQ ID NO: 123950 - protein, 9 aa, Homo Sapiens
LAAARLAAA

SEQ ID NO: 123951 - protein, 9 aa, Homo Sapiens
LAADIFAIA

SEQ ID NO: 123952 - protein, 9 aa, Homo Sapiens
LAATPHSLP

SEQ ID NO: 123953 - protein, 9 aa, Homo Sapiens
LAFEGHLAA

SEQ ID NO: 123954 - protein, 9 aa, Homo Sapiens
LAFGQGLAA

SEQ ID NO: 123955 - protein, 9 aa, Homo Sapiens
LAHAAFSAA

SEQ ID NO: 123956 - protein, 9 aa, Homo Sapiens
LALAPPPEA

SEQ ID NO: 123957 - protein, 9 aa, Homo Sapiens
LALLPALAA

SEQ ID NO: 123958 - protein, 9 aa, Homo Sapiens
LAMVPSHAV

SEQ ID NO: 123959 - protein, 9 aa, Homo Sapiens
LFKPPQPPA

SEQ ID NO: 123960 - protein, 9 aa, Homo Sapiens
LGMLQAVAA

SEQ ID NO: 123961 - protein, 9 aa, Homo Sapiens
LPAAKGFVA

SEQ ID NO: 123962 - protein, 9 aa, Homo Sapiens
LPAAMPITA

SEQ ID NO: 123963 - protein, 9 aa, Homo Sapiens
LPAEYLLSA

SEQ ID NO: 123964 - protein, 9 aa, Homo Sapiens
LPAFPLFSA

SEQ ID NO: 123965 - protein, 9 aa, Homo Sapiens
LPAGILPMV

SEQ ID NO: 123966 - protein, 9 aa, Homo Sapiens
LPALGFTGA

SEQ ID NO: 123967 - protein, 9 aa, Homo Sapiens
LPAPPAVSA

SEQ ID NO: 123968 - protein, 9 aa, Homo Sapiens
LPAPPHIDV

SEQ ID NO: 123969 - protein, 9 aa, Homo Sapiens
LPAQPMISV

SEQ ID NO: 123970 - protein, 9 aa, Homo Sapiens
LPAYLLVSA

SEQ ID NO: 123971 - protein, 9 aa, Homo Sapiens
LPDDVAISA

SEQ ID NO: 123972 - protein, 9 aa, Homo Sapiens
LPDLRPWTS

SEQ ID NO: 123973 - protein, 9 aa, Homo Sapiens
LPEEIREPA

SEQ ID NO: 123974 - protein, 9 aa, Homo Sapiens
LPELLGLEA

SEQ ID NO: 123975 - protein, 9 aa, Homo Sapiens
LPFDRFSEV

SEQ ID NO: 123976 - protein, 9 aa, Homo Sapiens
LPFFFGNIT

SEQ ID NO: 123977 - protein, 9 aa, Homo Sapiens
LPFGGVPTV

SEQ ID NO: 123978 - protein, 9 aa, Homo Sapiens
LPFHFPGSF

SEQ ID NO: 123979 - protein, 9 aa, Homo Sapiens
LPFLSTEQA

SEQ ID NO: 123980 - protein, 9 aa, Homo Sapiens
LPFPGPFPA

SEQ ID NO: 123981 - protein, 9 aa, Homo Sapiens
LPFPLPLFA

SEQ ID NO: 123982 - protein, 9 aa, Homo Sapiens
LPFQTLPPP

SEQ ID NO: 123983 - protein, 9 aa, Homo Sapiens
LPFRVIPLV

SEQ ID NO: 123984 - protein, 9 aa, Homo Sapiens
LPFSSMPTA

SEQ ID NO: 123985 - protein, 9 aa, Homo Sapiens
LPFVPPPAV

SEQ ID NO: 123986 - protein, 9 aa, Homo Sapiens
LPFWAYSAA

SEQ ID NO: 123987 - protein, 9 aa, Homo Sapiens
LPGELFHVV

SEQ ID NO: 123988 - protein, 9 aa, Homo Sapiens
LPGLPLVTA

SEQ ID NO: 123989 - protein, 9 aa, Homo Sapiens
LPHDLAVQA

SEQ ID NO: 123990 - protein, 9 aa, Homo Sapiens
LPHEILEMT

SEQ ID NO: 123991 - protein, 9 aa, Homo Sapiens
LPHELGDFA

SEQ ID NO: 123992 - protein, 9 aa, Homo Sapiens
LPHGFTNMA

SEQ ID NO: 123993 - protein, 9 aa, Homo Sapiens
LPHHILADV

SEQ ID NO: 123994 - protein, 9 aa, Homo Sapiens
LPHHRVIEV

SEQ ID NO: 123995 - protein, 9 aa, Homo Sapiens
LPHPNRIQA

SEQ ID NO: 123996 - protein, 9 aa, Homo Sapiens
LPHPYAIAV

SEQ ID NO: 123997 - protein, 9 aa, Homo Sapiens
LPHSQLPQA

SEQ ID NO: 123998 - protein, 9 aa, Homo Sapiens
LPHVPLGVI

SEQ ID NO: 123999 - protein, 9 aa, Homo Sapiens
LPHWLSWLP

SEQ ID NO: 124000 - protein, 9 aa, Homo Sapiens
LPIEIKAVP

SEQ ID NO: 124001 - protein, 9 aa, Homo Sapiens
LPIGTLPLA

SEQ ID NO: 124002 - protein, 9 aa, Homo Sapiens
LPIVPQLQV

SEQ ID NO: 124003 - protein, 9 aa, Homo Sapiens
LPKPPKPVS

SEQ ID NO: 124004 - protein, 9 aa, Homo Sapiens
LPLHPSWEA

SEQ ID NO: 124005 - protein, 9 aa, Homo Sapiens
LPLKPSLVA

SEQ ID NO: 124006 - protein, 9 aa, Homo Sapiens
LPLLARPAA

SEQ ID NO: 124007 - protein, 9 aa, Homo Sapiens
LPLLGLHEA

SEQ ID NO: 124008 - protein, 9 aa, Homo Sapiens
LPLPSVPAP

SEQ ID NO: 124009 - protein, 9 aa, Homo Sapiens
LPLPYGFSA

SEQ ID NO: 124010 - protein, 9 aa, Homo Sapiens
LPLPYGVSA

SEQ ID NO: 124011 - protein, 9 aa, Homo Sapiens
LPLQWVDIA

SEQ ID NO: 124012 - protein, 9 aa, Homo Sapiens
LPLRPFPAA

SEQ ID NO: 124013 - protein, 9 aa, Homo Sapiens
LPLSLLKTA

SEQ ID NO: 124014 - protein, 9 aa, Homo Sapiens
LPLTKITSA

SEQ ID NO: 124015 - protein, 9 aa, Homo Sapiens
LPLWVDKEA

SEQ ID NO: 124016 - protein, 9 aa, Homo Sapiens
LPLYGLLQA

SEQ ID NO: 124017 - protein, 9 aa, Homo Sapiens
LPMDTFTVA

SEQ ID NO: 124018 - protein, 9 aa, Homo Sapiens
LPNAVITRI

SEQ ID NO: 124019 - protein, 9 aa, Homo Sapiens
LPNFLPYNV

SEQ ID NO: 124020 - protein, 9 aa, Homo Sapiens
LPNGKPVSV

SEQ ID NO: 124021 - protein, 9 aa, Homo Sapiens
LPNHVVNVV

SEQ ID NO: 124022 - protein, 9 aa, Homo Sapiens
LPNIPVQTI

SEQ ID NO: 124023 - protein, 9 aa, Homo Sapiens
LPNIQKVEV

SEQ ID NO: 124024 - protein, 9 aa, Homo Sapiens
LPNLQTVTV

SEQ ID NO: 124025 - protein, 9 aa, Homo Sapiens
LPNLTPLSV

SEQ ID NO: 124026 - protein, 9 aa, Homo Sapiens
LPNSTIYVV

SEQ ID NO: 124027 - protein, 9 aa, Homo Sapiens
LPPEPVLNA

SEQ ID NO: 124028 - protein, 9 aa, Homo Sapiens
LPPEVYAVV

SEQ ID NO: 124029 - protein, 9 aa, Homo Sapiens
LPPLPVPGT

SEQ ID NO: 124030 - protein, 9 aa, Homo Sapiens
LPPMPPPPP

SEQ ID NO: 124031 - protein, 9 aa, Homo Sapiens
LPQELMAEA

SEQ ID NO: 124032 - protein, 9 aa, Homo Sapiens
LPQEVSIAA

SEQ ID NO: 124033 - protein, 9 aa, Homo Sapiens
LPQPAFIPA

SEQ ID NO: 124034 - protein, 9 aa, Homo Sapiens
LPQPVPLSV

SEQ ID NO: 124035 - protein, 9 aa, Homo Sapiens
LPQQILPTA

SEQ ID NO: 124036 - protein, 9 aa, Homo Sapiens
LPQSPIVRA

SEQ ID NO: 124037 - protein, 9 aa, Homo Sapiens
LPQVYPFAA

SEQ ID NO: 124038 - protein, 9 aa, Homo Sapiens
LPRDVLTRA

SEQ ID NO: 124039 - protein, 9 aa, Homo Sapiens
LPRLIDMSA

SEQ ID NO: 124040 - protein, 9 aa, Homo Sapiens
LPRNIYIVA

SEQ ID NO: 124041 - protein, 9 aa, Homo Sapiens
LPRPPMLLA

SEQ ID NO: 124042 - protein, 9 aa, Homo Sapiens
LPRPVPLVA

SEQ ID NO: 124043 - protein, 9 aa, Homo Sapiens
LPSDFTPAV

SEQ ID NO: 124044 - protein, 9 aa, Homo Sapiens
LPSDIAAEA

SEQ ID NO: 124045 - protein, 9 aa, Homo Sapiens
LPSLSPLSA

SEQ ID NO: 124046 - protein, 9 aa, Homo Sapiens
LPSPPAVAV

SEQ ID NO: 124047 - protein, 9 aa, Homo Sapiens
LPSRFIESA

SEQ ID NO: 124048 - protein, 9 aa, Homo Sapiens
LPSRVYWIA

SEQ ID NO: 124049 - protein, 9 aa, Homo Sapiens
LPTEAYISV

SEQ ID NO: 124050 - protein, 9 aa, Homo Sapiens
LPTKDLLSA

SEQ ID NO: 124051 - protein, 9 aa, Homo Sapiens
LPTKVFWIA

SEQ ID NO: 124052 - protein, 9 aa, Homo Sapiens
LPTTMGVVA

SEQ ID NO: 124053 - protein, 9 aa, Homo Sapiens
LPVAFKVVA

SEQ ID NO: 124054 - protein, 9 aa, Homo Sapiens
LPVDAVISV

SEQ ID NO: 124055 - protein, 9 aa, Homo Sapiens
LPVDVVVNA

SEQ ID NO: 124056 - protein, 9 aa, Homo Sapiens
LPVEFTIDA

SEQ ID NO: 124057 - protein, 9 aa, Homo Sapiens
LPVKLIFVA

SEQ ID NO: 124058 - protein, 9 aa, Homo Sapiens
LPVLPVAAA

SEQ ID NO: 124059 - protein, 9 aa, Homo Sapiens
LPVLPWSEV

SEQ ID NO: 124060 - protein, 9 aa, Homo Sapiens
LPVSLPTHA

SEQ ID NO: 124061 - protein, 9 aa, Homo Sapiens
LPVSNVVSV

SEQ ID NO: 124062 - protein, 9 aa, Homo Sapiens
LPVSVFESV

SEQ ID NO: 124063 - protein, 9 aa, Homo Sapiens
LPVWLENHT

SEQ ID NO: 124064 - protein, 9 aa, Homo Sapiens
LPWISILTV

SEQ ID NO: 124065 - protein, 9 aa, Homo Sapiens
LPWQGLKAA

SEQ ID NO: 124066 - protein, 9 aa, Homo Sapiens
LPWSNPLKV

SEQ ID NO: 124067 - protein, 9 aa, Homo Sapiens
LPWWGAIAA

SEQ ID NO: 124068 - protein, 9 aa, Homo Sapiens
LPYAITIVA

SEQ ID NO: 124069 - protein, 9 aa, Homo Sapiens
LPYDIPHRA

SEQ ID NO: 124070 - protein, 9 aa, Homo Sapiens
LPYHHVIHA

SEQ ID NO: 124071 - protein, 9 aa, Homo Sapiens
LPYKWVVEA

SEQ ID NO: 124072 - protein, 9 aa, Homo Sapiens
LPYLAAVYA

SEQ ID NO: 124073 - protein, 9 aa, Homo Sapiens
LPYLGVHGA

SEQ ID NO: 124074 - protein, 9 aa, Homo Sapiens
LPYNGVVLA

SEQ ID NO: 124075 - protein, 9 aa, Homo Sapiens
LPYNPMMVV

SEQ ID NO: 124076 - protein, 9 aa, Homo Sapiens
LPYSDFPRP

SEQ ID NO: 124077 - protein, 9 aa, Homo Sapiens
LPYSFIIGV

SEQ ID NO: 124078 - protein, 9 aa, Homo Sapiens
LSHEVIVSA

SEQ ID NO: 124079 - protein, 9 aa, Homo Sapiens
LVAPPLPAA

SEQ ID NO: 124080 - protein, 9 aa, Homo Sapiens
LVFYGFLAA

SEQ ID NO: 124081 - protein, 9 aa, Homo Sapiens
LVGKNFEQV

SEQ ID NO: 124082 - protein, 9 aa, Homo Sapiens
LVKDVFISA

SEQ ID NO: 124083 - protein, 9 aa, Homo Sapiens
MAAVPVAAA

SEQ ID NO: 124084 - protein, 9 aa, Homo Sapiens
MAFWGWRAA

SEQ ID NO: 124085 - protein, 9 aa, Homo Sapiens
MAILNGIVA

SEQ ID NO: 124086 - protein, 9 aa, Homo Sapiens
MALGKFRAA

SEQ ID NO: 124087 - protein, 9 aa, Homo Sapiens
MALRYPMAV

SEQ ID NO: 124088 - protein, 9 aa, Homo Sapiens
MAPPTIPSA

SEQ ID NO: 124089 - protein, 9 aa, Homo Sapiens
MAVFVVLLA

SEQ ID NO: 124090 - protein, 9 aa, Homo Sapiens
MAVVIPEAA

SEQ ID NO: 124091 - protein, 9 aa, Homo Sapiens
MLRQIIGQA

SEQ ID NO: 124092 - protein, 9 aa, Homo Sapiens
MLYEKFSPA

SEQ ID NO: 124093 - protein, 9 aa, Homo Sapiens
MPAFPLPYA

SEQ ID NO: 124094 - protein, 9 aa, Homo Sapiens
MPAGSFITA

SEQ ID NO: 124095 - protein, 9 aa, Homo Sapiens
MPALAPPEV

SEQ ID NO: 124096 - protein, 9 aa, Homo Sapiens
MPALGWAVA

SEQ ID NO: 124097 - protein, 9 aa, Homo Sapiens
MPAQLFFKT

SEQ ID NO: 124098 - protein, 9 aa, Homo Sapiens
MPATLARAA

SEQ ID NO: 124099 - protein, 9 aa, Homo Sapiens
MPDGQFKDI

SEQ ID NO: 124100 - protein, 9 aa, Homo Sapiens
MPDLPHLLA

SEQ ID NO: 124101 - protein, 9 aa, Homo Sapiens
MPDSILLEA

SEQ ID NO: 124102 - protein, 9 aa, Homo Sapiens
MPDTPRLFA

SEQ ID NO: 124103 - protein, 9 aa, Homo Sapiens
MPEEKLVEA

SEQ ID NO: 124104 - protein, 9 aa, Homo Sapiens
MPETLGQVA

SEQ ID NO: 124105 - protein, 9 aa, Homo Sapiens
MPFGNVISA

SEQ ID NO: 124106 - protein, 9 aa, Homo Sapiens
MPFGNVVSA

SEQ ID NO: 124107 - protein, 9 aa, Homo Sapiens
MPFNLIPVI

SEQ ID NO: 124108 - protein, 9 aa, Homo Sapiens
MPFPELPRP

SEQ ID NO: 124109 - protein, 9 aa, Homo Sapiens
MPFPNIRSA

SEQ ID NO: 124110 - protein, 9 aa, Homo Sapiens
MPFPVNHGA

SEQ ID NO: 124111 - protein, 9 aa, Homo Sapiens
MPFSGDIRA

SEQ ID NO: 124112 - protein, 9 aa, Homo Sapiens
MPFSPKASV

SEQ ID NO: 124113 - protein, 9 aa, Homo Sapiens
MPFTEKIMA

SEQ ID NO: 124114 - protein, 9 aa, Homo Sapiens
MPFYNPAQL

SEQ ID NO: 124115 - protein, 9 aa, Homo Sapiens
MPGSVIPPP

SEQ ID NO: 124116 - protein, 9 aa, Homo Sapiens
MPHLSMQQV

SEQ ID NO: 124117 - protein, 9 aa, Homo Sapiens
MPILIDFHA

SEQ ID NO: 124118 - protein, 9 aa, Homo Sapiens
MPKDLIYIN

SEQ ID NO: 124119 - protein, 9 aa, Homo Sapiens
MPLLKSEVA

SEQ ID NO: 124120 - protein, 9 aa, Homo Sapiens
MPLSTIREV

SEQ ID NO: 124121 - protein, 9 aa, Homo Sapiens
MPMERQMSV

SEQ ID NO: 124122 - protein, 9 aa, Homo Sapiens
MPMNVADLI

SEQ ID NO: 124123 - protein, 9 aa, Homo Sapiens
MPNDEHWKA

SEQ ID NO: 124124 - protein, 9 aa, Homo Sapiens
MPNENIPEL

SEQ ID NO: 124125 - protein, 9 aa, Homo Sapiens
MPNLLQQAV

SEQ ID NO: 124126 - protein, 9 aa, Homo Sapiens
MPNPSLAQV

SEQ ID NO: 124127 - protein, 9 aa, Homo Sapiens
MPPMPVASV

SEQ ID NO: 124128 - protein, 9 aa, Homo Sapiens
MPPPVGMVA

SEQ ID NO: 124129 - protein, 9 aa, Homo Sapiens
MPQDLRSPA

SEQ ID NO: 124130 - protein, 9 aa, Homo Sapiens
MPQFLSTEA

SEQ ID NO: 124131 - protein, 9 aa, Homo Sapiens
MPQHIKITV

SEQ ID NO: 124132 - protein, 9 aa, Homo Sapiens
MPQIPVASV

SEQ ID NO: 124133 - protein, 9 aa, Homo Sapiens
MPQLNAIIA

SEQ ID NO: 124134 - protein, 9 aa, Homo Sapiens
MPQNPHIIA

SEQ ID NO: 124135 - protein, 9 aa, Homo Sapiens
MPQVPVFTV

SEQ ID NO: 124136 - protein, 9 aa, Homo Sapiens
MPRDILIVV

SEQ ID NO: 124137 - protein, 9 aa, Homo Sapiens
MPRIYELAA

SEQ ID NO: 124138 - protein, 9 aa, Homo Sapiens
MPRWFTVQA

SEQ ID NO: 124139 - protein, 9 aa, Homo Sapiens
MPRWYFLLA

SEQ ID NO: 124140 - protein, 9 aa, Homo Sapiens
MPSDVLEVT

SEQ ID NO: 124141 - protein, 9 aa, Homo Sapiens
MPSFLSIEA

SEQ ID NO: 124142 - protein, 9 aa, Homo Sapiens
MPSIPVLNA

SEQ ID NO: 124143 - protein, 9 aa, Homo Sapiens
MPSSVPLRA

SEQ ID NO: 124144 - protein, 9 aa, Homo Sapiens
MPTDVLEVT

SEQ ID NO: 124145 - protein, 9 aa, Homo Sapiens
MPTLLLWLV

SEQ ID NO: 124146 - protein, 9 aa, Homo Sapiens
MPTLPPPSV

SEQ ID NO: 124147 - protein, 9 aa, Homo Sapiens
MPTPLVPSV

SEQ ID NO: 124148 - protein, 9 aa, Homo Sapiens
MPVDLELVA

SEQ ID NO: 124149 - protein, 9 aa, Homo Sapiens
MPVERILEA

SEQ ID NO: 124150 - protein, 9 aa, Homo Sapiens
MPVGLIAGA

SEQ ID NO: 124151 - protein, 9 aa, Homo Sapiens
MPVIPMNTI

SEQ ID NO: 124152 - protein, 9 aa, Homo Sapiens
MPVPAQPKA

SEQ ID NO: 124153 - protein, 9 aa, Homo Sapiens
MPWFKGWKV

SEQ ID NO: 124154 - protein, 9 aa, Homo Sapiens
MPWYQRRIA

SEQ ID NO: 124155 - protein, 9 aa, Homo Sapiens
MPYFLLTQA

SEQ ID NO: 124156 - protein, 9 aa, Homo Sapiens
MPYFQPSAI

SEQ ID NO: 124157 - protein, 9 aa, Homo Sapiens
MPYGSLYNV

SEQ ID NO: 124158 - protein, 9 aa, Homo Sapiens
MPYLIGVHA

SEQ ID NO: 124159 - protein, 9 aa, Homo Sapiens
MSVHLPFAV

SEQ ID NO: 124160 - protein, 9 aa, Homo Sapiens
MTVPPPPAA

SEQ ID NO: 124161 - protein, 9 aa, Homo Sapiens
MVFPKPVTA

SEQ ID NO: 124162 - protein, 9 aa, Homo Sapiens
MVMLLPTSA

SEQ ID NO: 124163 - protein, 9 aa, Homo Sapiens
NAFNRFLHA

SEQ ID NO: 124164 - protein, 9 aa, Homo Sapiens
NATWLVNSA

SEQ ID NO: 124165 - protein, 9 aa, Homo Sapiens
NIFWFFREA

SEQ ID NO: 124166 - protein, 9 aa, Homo Sapiens
NPAPPIDAV

SEQ ID NO: 124167 - protein, 9 aa, Homo Sapiens
NPFLFALEA

SEQ ID NO: 124168 - protein, 9 aa, Homo Sapiens
NPFTGFFYA

SEQ ID NO: 124169 - protein, 9 aa, Homo Sapiens
NPISSWFTA

SEQ ID NO: 124170 - protein, 9 aa, Homo Sapiens
NPLFIPVAV

SEQ ID NO: 124171 - protein, 9 aa, Homo Sapiens
NPLQVLVNA

SEQ ID NO: 124172 - protein, 9 aa, Homo Sapiens
NPVDFLSKA

SEQ ID NO: 124173 - protein, 9 aa, Homo Sapiens
NPVTGLLSA

SEQ ID NO: 124174 - protein, 9 aa, Homo Sapiens
NPYATLPRA

SEQ ID NO: 124175 - protein, 9 aa, Homo Sapiens
NPYSEFILA

SEQ ID NO: 124176 - protein, 9 aa, Homo Sapiens
NPYTIFHQA

SEQ ID NO: 124177 - protein, 9 aa, Homo Sapiens
PGLAILLSK

SEQ ID NO: 124178 - protein, 9 aa, Homo Sapiens
PITPRAAPL

SEQ ID NO: 124179 - protein, 9 aa, Homo Sapiens
PLPSPFLSA

SEQ ID NO: 124180 - protein, 9 aa, Homo Sapiens
QAVLQAVTA

SEQ ID NO: 124181 - protein, 9 aa, Homo Sapiens
QGFLSPLAA

SEQ ID NO: 124182 - protein, 9 aa, Homo Sapiens
QPFAVPHSA

SEQ ID NO: 124183 - protein, 9 aa, Homo Sapiens
QPFESYITA

SEQ ID NO: 124184 - protein, 9 aa, Homo Sapiens
QPFYPLPAA

SEQ ID NO: 124185 - protein, 9 aa, Homo Sapiens
QPHHIGVAV

SEQ ID NO: 124186 - protein, 9 aa, Homo Sapiens
QPILLELEA

SEQ ID NO: 124187 - protein, 9 aa, Homo Sapiens
QPLLKHWEA

SEQ ID NO: 124188 - protein, 9 aa, Homo Sapiens
QPLLPYSAV

SEQ ID NO: 124189 - protein, 9 aa, Homo Sapiens
QPLPVILHV

SEQ ID NO: 124190 - protein, 9 aa, Homo Sapiens
QPYMPTVSA

SEQ ID NO: 124191 - protein, 9 aa, Homo Sapiens
QSVLQRIAA

SEQ ID NO: 124192 - protein, 9 aa, Homo Sapiens
QVRDVIIAA

SEQ ID NO: 124193 - protein, 9 aa, Homo Sapiens
RPFIGMSSA

SEQ ID NO: 124194 - protein, 9 aa, Homo Sapiens
RPNDIMAEV

SEQ ID NO: 124195 - protein, 9 aa, Homo Sapiens
RPRAPIIAV

SEQ ID NO: 124196 - protein, 9 aa, Homo Sapiens
RPRPPVLSV

SEQ ID NO: 124197 - protein, 9 aa, Homo Sapiens
SAFAYAIAA

SEQ ID NO: 124198 - protein, 9 aa, Homo Sapiens
SAFEFLSSA

SEQ ID NO: 124199 - protein, 9 aa, Homo Sapiens
SAFGYFITA

SEQ ID NO: 124200 - protein, 9 aa, Homo Sapiens
SAFPFPVTV

SEQ ID NO: 124201 - protein, 9 aa, Homo Sapiens
SALALRWEA

SEQ ID NO: 124202 - protein, 9 aa, Homo Sapiens
SALEAMFTA

SEQ ID NO: 124203 - protein, 9 aa, Homo Sapiens
SALFQHITA

SEQ ID NO: 124204 - protein, 9 aa, Homo Sapiens
SAPVNFISA

SEQ ID NO: 124205 - protein, 9 aa, Homo Sapiens
SNRVIELPL

SEQ ID NO: 124206 - protein, 9 aa, Homo Sapiens
SPAAPVITA

SEQ ID NO: 124207 - protein, 9 aa, Homo Sapiens
SPFFPLVSA

SEQ ID NO: 124208 - protein, 9 aa, Homo Sapiens
SPFGSITSA

SEQ ID NO: 124209 - protein, 9 aa, Homo Sapiens
SPFGTITSA

SEQ ID NO: 124210 - protein, 9 aa, Homo Sapiens
SPFHFQPSA

SEQ ID NO: 124211 - protein, 9 aa, Homo Sapiens
SPFLSPLEA

SEQ ID NO: 124212 - protein, 9 aa, Homo Sapiens
SPFPDIPKV

SEQ ID NO: 124213 - protein, 9 aa, Homo Sapiens
SPFSSFISV

SEQ ID NO: 124214 - protein, 9 aa, Homo Sapiens
SPIEFLENA

SEQ ID NO: 124215 - protein, 9 aa, Homo Sapiens
SPIENIQRV

SEQ ID NO: 124216 - protein, 9 aa, Homo Sapiens
SPKQILDPA

SEQ ID NO: 124217 - protein, 9 aa, Homo Sapiens
SPLFSQHTA

SEQ ID NO: 124218 - protein, 9 aa, Homo Sapiens
SPLHLAVEA

SEQ ID NO: 124219 - protein, 9 aa, Homo Sapiens
SPLKHFVTA

SEQ ID NO: 124220 - protein, 9 aa, Homo Sapiens
SPLLLFLPP

SEQ ID NO: 124221 - protein, 9 aa, Homo Sapiens
SPLYLAHEV

SEQ ID NO: 124222 - protein, 9 aa, Homo Sapiens
SPMLPLPVA

SEQ ID NO: 124223 - protein, 9 aa, Homo Sapiens
SPREPGYKA

SEQ ID NO: 124224 - protein, 9 aa, Homo Sapiens
SPRPPLISV

SEQ ID NO: 124225 - protein, 9 aa, Homo Sapiens
SPVLPLTSA

SEQ ID NO: 124226 - protein, 9 aa, Homo Sapiens
SPVVPQISA

SEQ ID NO: 124227 - protein, 9 aa, Homo Sapiens
SPYAAMLAA

SEQ ID NO: 124228 - protein, 9 aa, Homo Sapiens
SPYDGLFIA

SEQ ID NO: 124229 - protein, 9 aa, Homo Sapiens
SPYHGFTIV

SEQ ID NO: 124230 - protein, 9 aa, Homo Sapiens
SPYYFLTSA

SEQ ID NO: 124231 - protein, 9 aa, Homo Sapiens
SSEFQIPTA

SEQ ID NO: 124232 - protein, 9 aa, Homo Sapiens
SVTLQAIAA

SEQ ID NO: 124233 - protein, 9 aa, Homo Sapiens
TAFLVQISA

SEQ ID NO: 124234 - protein, 9 aa, Homo Sapiens
TIPYQPMPA

SEQ ID NO: 124235 - protein, 9 aa, Homo Sapiens
TIQEILIPA

SEQ ID NO: 124236 - protein, 9 aa, Homo Sapiens
TPAHVLPSA

SEQ ID NO: 124237 - protein, 9 aa, Homo Sapiens
TPFYFKEPS

SEQ ID NO: 124238 - protein, 9 aa, Homo Sapiens
TPHFSGLAA

SEQ ID NO: 124239 - protein, 9 aa, Homo Sapiens
TPIIIIPAA

SEQ ID NO: 124240 - protein, 9 aa, Homo Sapiens
TPLLLPLAA

SEQ ID NO: 124241 - protein, 9 aa, Homo Sapiens
TPLLMQALP

SEQ ID NO: 124242 - protein, 9 aa, Homo Sapiens
TPLPAIVPA

SEQ ID NO: 124243 - protein, 9 aa, Homo Sapiens
TPMPPISSV

SEQ ID NO: 124244 - protein, 9 aa, Homo Sapiens
TPMSVLQQA

SEQ ID NO: 124245 - protein, 9 aa, Homo Sapiens
TPQSIFIFA

SEQ ID NO: 124246 - protein, 9 aa, Homo Sapiens
TPRPVIVEP

SEQ ID NO: 124247 - protein, 9 aa, Homo Sapiens
TPSIPVLTA

SEQ ID NO: 124248 - protein, 9 aa, Homo Sapiens
TPTEFFFHA

SEQ ID NO: 124249 - protein, 9 aa, Homo Sapiens
TPWFKIIAA

SEQ ID NO: 124250 - protein, 9 aa, Homo Sapiens
TPWIPVIAA

SEQ ID NO: 124251 - protein, 9 aa, Homo Sapiens
TPYNYPVPV

SEQ ID NO: 124252 - protein, 9 aa, Homo Sapiens
TVYEGFISA

SEQ ID NO: 124253 - protein, 9 aa, Homo Sapiens
VAVLQEVAA

SEQ ID NO: 124254 - protein, 9 aa, Homo Sapiens
VIRNIVEAA

SEQ ID NO: 124255 - protein, 9 aa, Homo Sapiens
VLPAAGLSA

SEQ ID NO: 124256 - protein, 9 aa, Homo Sapiens
VPAPFFLPA

SEQ ID NO: 124257 - protein, 9 aa, Homo Sapiens
VPFIVPLSV

SEQ ID NO: 124258 - protein, 9 aa, Homo Sapiens
VPFLNPYTV

SEQ ID NO: 124259 - protein, 9 aa, Homo Sapiens
VPFPSIQAV

SEQ ID NO: 124260 - protein, 9 aa, Homo Sapiens
VPFPTPLEA

SEQ ID NO: 124261 - protein, 9 aa, Homo Sapiens
VPHQPFSQA

SEQ ID NO: 124262 - protein, 9 aa, Homo Sapiens
VPIMPYPPA

SEQ ID NO: 124263 - protein, 9 aa, Homo Sapiens
VPITAVIAA

SEQ ID NO: 124264 - protein, 9 aa, Homo Sapiens
VPKPLFPVA

SEQ ID NO: 124265 - protein, 9 aa, Homo Sapiens
VPLAIVNKA

SEQ ID NO: 124266 - protein, 9 aa, Homo Sapiens
VPLFVQHDA

SEQ ID NO: 124267 - protein, 9 aa, Homo Sapiens
VPLLVLIEA

SEQ ID NO: 124268 - protein, 9 aa, Homo Sapiens
VPLSHLINA

SEQ ID NO: 124269 - protein, 9 aa, Homo Sapiens
VPMTPLRTV

SEQ ID NO: 124270 - protein, 9 aa, Homo Sapiens
VPNKFLVTA

SEQ ID NO: 124271 - protein, 9 aa, Homo Sapiens
VPNLQTVSV

SEQ ID NO: 124272 - protein, 9 aa, Homo Sapiens
VPNPYIISA

SEQ ID NO: 124273 - protein, 9 aa, Homo Sapiens
VPQPVPLIA

SEQ ID NO: 124274 - protein, 9 aa, Homo Sapiens
VPRLPATAA

SEQ ID NO: 124275 - protein, 9 aa, Homo Sapiens
VPSAVLIVA

SEQ ID NO: 124276 - protein, 9 aa, Homo Sapiens
VPVEPVLTV

SEQ ID NO: 124277 - protein, 9 aa, Homo Sapiens
VPVHFDASV

SEQ ID NO: 124278 - protein, 9 aa, Homo Sapiens
VPYGTPLSV

SEQ ID NO: 124279 - protein, 9 aa, Homo Sapiens
VPYPPLLRA

SEQ ID NO: 124280 - protein, 9 aa, Homo Sapiens
WATQGLAVA

SEQ ID NO: 124281 - protein, 9 aa, Homo Sapiens
WPELPVLSA

SEQ ID NO: 124282 - protein, 9 aa, Homo Sapiens
WPFQQPVDA

SEQ ID NO: 124283 - protein, 9 aa, Homo Sapiens
WPFQRPVDA

SEQ ID NO: 124284 - protein, 9 aa, Homo Sapiens
WPFSIQDVV

SEQ ID NO: 124285 - protein, 9 aa, Homo Sapiens
WPKDVGIVA

SEQ ID NO: 124286 - protein, 9 aa, Homo Sapiens
WPLDASFRA

SEQ ID NO: 124287 - protein, 9 aa, Homo Sapiens
YAFNMKATV

SEQ ID NO: 124288 - protein, 9 aa, Homo Sapiens
YAFVHMERA

SEQ ID NO: 124289 - protein, 9 aa, Homo Sapiens
YAKYLPHSA

SEQ ID NO: 124290 - protein, 9 aa, Homo Sapiens
YALNHTLSV

SEQ ID NO: 124291 - protein, 9 aa, Homo Sapiens
YALPAGLSA

SEQ ID NO: 124292 - protein, 9 aa, Homo Sapiens
YGFVNYVTA

SEQ ID NO: 124293 - protein, 9 aa, Homo Sapiens
YPAHAFLAA

SEQ ID NO: 124294 - protein, 9 aa, Homo Sapiens
YPALIGNLV

SEQ ID NO: 124295 - protein, 9 aa, Homo Sapiens
YPALIPITT

SEQ ID NO: 124296 - protein, 9 aa, Homo Sapiens
YPANSIVVV

SEQ ID NO: 124297 - protein, 9 aa, Homo Sapiens
YPAPQVSTA

SEQ ID NO: 124298 - protein, 9 aa, Homo Sapiens
YPASIVHQV

SEQ ID NO: 124299 - protein, 9 aa, Homo Sapiens
YPASSLVVV

SEQ ID NO: 124300 - protein, 9 aa, Homo Sapiens
YPAYISIKA

SEQ ID NO: 124301 - protein, 9 aa, Homo Sapiens
YPFFRGVTI

SEQ ID NO: 124302 - protein, 9 aa, Homo Sapiens
YPFHYAPFA

SEQ ID NO: 124303 - protein, 9 aa, Homo Sapiens
YPFIFDAQA

SEQ ID NO: 124304 - protein, 9 aa, Homo Sapiens
YPFKNLPTA

SEQ ID NO: 124305 - protein, 9 aa, Homo Sapiens
YPFKPPKVA

SEQ ID NO: 124306 - protein, 9 aa, Homo Sapiens
YPFLLPTSS

SEQ ID NO: 124307 - protein, 9 aa, Homo Sapiens
YPFPGRLLP

SEQ ID NO: 124308 - protein, 9 aa, Homo Sapiens
YPFPLSHSV

SEQ ID NO: 124309 - protein, 9 aa, Homo Sapiens
YPFVFDAQA

SEQ ID NO: 124310 - protein, 9 aa, Homo Sapiens
YPGFNPFRA

SEQ ID NO: 124311 - protein, 9 aa, Homo Sapiens
YPHGWVETA

SEQ ID NO: 124312 - protein, 9 aa, Homo Sapiens
YPIAIFIKP

SEQ ID NO: 124313 - protein, 9 aa, Homo Sapiens
YPISIFIKP

SEQ ID NO: 124314 - protein, 9 aa, Homo Sapiens
YPKLILREA

SEQ ID NO: 124315 - protein, 9 aa, Homo Sapiens
YPKNPHLRA

SEQ ID NO: 124316 - protein, 9 aa, Homo Sapiens
YPLDLLLKL

SEQ ID NO: 124317 - protein, 9 aa, Homo Sapiens
YPLEKVAEA

SEQ ID NO: 124318 - protein, 9 aa, Homo Sapiens
YPLLLKELA

SEQ ID NO: 124319 - protein, 9 aa, Homo Sapiens
YPLLLPKGV

SEQ ID NO: 124320 - protein, 9 aa, Homo Sapiens
YPLTQLVVV

SEQ ID NO: 124321 - protein, 9 aa, Homo Sapiens
YPNFSLPAA

SEQ ID NO: 124322 - protein, 9 aa, Homo Sapiens
YPNNVLSVP

SEQ ID NO: 124323 - protein, 9 aa, Homo Sapiens
YPNPVAHLP

SEQ ID NO: 124324 - protein, 9 aa, Homo Sapiens
YPNYPNPAV

SEQ ID NO: 124325 - protein, 9 aa, Homo Sapiens
YPPLGRFAV

SEQ ID NO: 124326 - protein, 9 aa, Homo Sapiens
YPQAVFLEV

SEQ ID NO: 124327 - protein, 9 aa, Homo Sapiens
YPQDPAWRA

SEQ ID NO: 124328 - protein, 9 aa, Homo Sapiens
YPQELIVPA

SEQ ID NO: 124329 - protein, 9 aa, Homo Sapiens
YPQQAIVFA

SEQ ID NO: 124330 - protein, 9 aa, Homo Sapiens
YPQQIFIQI

SEQ ID NO: 124331 - protein, 9 aa, Homo Sapiens
YPSAPFLAA

SEQ ID NO: 124332 - protein, 9 aa, Homo Sapiens
YPSEHLIQA

SEQ ID NO: 124333 - protein, 9 aa, Homo Sapiens
YPSETFTRV

SEQ ID NO: 124334 - protein, 9 aa, Homo Sapiens
YPSLPTMTV

SEQ ID NO: 124335 - protein, 9 aa, Homo Sapiens
YPSTKMVIV

SEQ ID NO: 124336 - protein, 9 aa, Homo Sapiens
YPTRPHIAA

SEQ ID NO: 124337 - protein, 9 aa, Homo Sapiens
YPTTFVMVV

SEQ ID NO: 124338 - protein, 9 aa, Homo Sapiens
YPVHLAVRA

SEQ ID NO: 124339 - protein, 9 aa, Homo Sapiens
YPVRLAVSA

SEQ ID NO: 124340 - protein, 9 aa, Homo Sapiens
YPVYQPVGP

SEQ ID NO: 124341 - protein, 9 aa, Homo Sapiens
YPWHRFPVT

SEQ ID NO: 124342 - protein, 9 aa, Homo Sapiens
YSFFSPSPA

SEQ ID NO: 124343 - protein, 9 aa, Homo Sapiens
YSFYLPIAA

SEQ ID NO: 124344 - protein, 9 aa, Homo Sapiens
YTLVTYVPV

SEQ ID NO: 124345 - protein, 9 aa, Homo Sapiens
YVASYLLAA

SEQ ID NO: 124346 - protein, 9 aa, Homo Sapiens
YVPPPFAAA

SEQ ID NO: 124347 - protein, 10 aa, Homo Sapiens
APHYPGIGPV

SEQ ID NO: 124348 - protein, 10 aa, Homo Sapiens
APSMESRPPA

SEQ ID NO: 124349 - protein, 10 aa, Homo Sapiens
AVTGWGSISA

SEQ ID NO: 124350 - protein, 10 aa, Homo Sapiens
AYDGKDYIAL

SEQ ID NO: 124351 - protein, 10 aa, Homo Sapiens
CPFSSKFFSA

SEQ ID NO: 124352 - protein, 10 aa, Homo Sapiens
DAISNIFQAA

SEQ ID NO: 124353 - protein, 10 aa, Homo Sapiens
EAFPVHGFPT

SEQ ID NO: 124354 - protein, 10 aa, Homo Sapiens
EALTPLHVAA

SEQ ID NO: 124355 - protein, 10 aa, Homo Sapiens
EVLMNTYSVV

SEQ ID NO: 124356 - protein, 10 aa, Homo Sapiens
FAAEEFKVPA

SEQ ID NO: 124357 - protein, 10 aa, Homo Sapiens
FAFEGHKLIA

SEQ ID NO: 124358 - protein, 10 aa, Homo Sapiens
FALAKGFTAA

SEQ ID NO: 124359 - protein, 10 aa, Homo Sapiens
FAVEGPKLVV

SEQ ID NO: 124360 - protein, 10 aa, Homo Sapiens
FGPGKPPPPP

SEQ ID NO: 124361 - protein, 10 aa, Homo Sapiens
FPAEFGVVAA

SEQ ID NO: 124362 - protein, 10 aa, Homo Sapiens
FPAEFYPHIV

SEQ ID NO: 124363 - protein, 10 aa, Homo Sapiens
FPAGPGRKVI

SEQ ID NO: 124364 - protein, 10 aa, Homo Sapiens
FPAHHGFVAA

SEQ ID NO: 124365 - protein, 10 aa, Homo Sapiens
FPANPANISV

SEQ ID NO: 124366 - protein, 10 aa, Homo Sapiens
FPANVMDVIA

SEQ ID NO: 124367 - protein, 10 aa, Homo Sapiens
FPAPSHVVTA

SEQ ID NO: 124368 - protein, 10 aa, Homo Sapiens
FPFDPPFVRV

SEQ ID NO: 124369 - protein, 10 aa, Homo Sapiens
FPFDQQFNIL

SEQ ID NO: 124370 - protein, 10 aa, Homo Sapiens
FPFDVTKVEV

SEQ ID NO: 124371 - protein, 10 aa, Homo Sapiens
FPFYGKPMRI

SEQ ID NO: 124372 - protein, 10 aa, Homo Sapiens
FPGGVHWVSV

SEQ ID NO: 124373 - protein, 10 aa, Homo Sapiens
FPHELEVPAL

SEQ ID NO: 124374 - protein, 10 aa, Homo Sapiens
FPHFDLSHGS

SEQ ID NO: 124375 - protein, 10 aa, Homo Sapiens
FPHGITDQVI

SEQ ID NO: 124376 - protein, 10 aa, Homo Sapiens
FPHLLQPVLW

SEQ ID NO: 124377 - protein, 10 aa, Homo Sapiens
FPHYEVPLAA

SEQ ID NO: 124378 - protein, 10 aa, Homo Sapiens
FPIEVRHYLA

SEQ ID NO: 124379 - protein, 10 aa, Homo Sapiens
FPIHLVGQLV

SEQ ID NO: 124380 - protein, 10 aa, Homo Sapiens
FPIQMEGVKL

SEQ ID NO: 124381 - protein, 10 aa, Homo Sapiens
FPKAEFVEVT

SEQ ID NO: 124382 - protein, 10 aa, Homo Sapiens
FPKPGPLEPT

SEQ ID NO: 124383 - protein, 10 aa, Homo Sapiens
FPKPVTALEY

SEQ ID NO: 124384 - protein, 10 aa, Homo Sapiens
FPKPYPNSEA

SEQ ID NO: 124385 - protein, 10 aa, Homo Sapiens
FPMEIRQYLA

SEQ ID NO: 124386 - protein, 10 aa, Homo Sapiens
FPNPQGLSEE

SEQ ID NO: 124387 - protein, 10 aa, Homo Sapiens
FPPTFAIPQA

SEQ ID NO: 124388 - protein, 10 aa, Homo Sapiens
FPQETLFLEA

SEQ ID NO: 124389 - protein, 10 aa, Homo Sapiens
FPQLRATMEA

SEQ ID NO: 124390 - protein, 10 aa, Homo Sapiens
FPRLPAGAVV

SEQ ID NO: 124391 - protein, 10 aa, Homo Sapiens
FPRPLTPLAA

SEQ ID NO: 124392 - protein, 10 aa, Homo Sapiens
FPSEYVPTVF

SEQ ID NO: 124393 - protein, 10 aa, Homo Sapiens
FPVGVFVVAV

SEQ ID NO: 124394 - protein, 10 aa, Homo Sapiens
FPVSVGVHSA

SEQ ID NO: 124395 - protein, 10 aa, Homo Sapiens
FPVYVGINEA

SEQ ID NO: 124396 - protein, 10 aa, Homo Sapiens
FPYEEHLEMA

SEQ ID NO: 124397 - protein, 10 aa, Homo Sapiens
FPYEGPLRLL

SEQ ID NO: 124398 - protein, 10 aa, Homo Sapiens
FPYEKDLIEA

SEQ ID NO: 124399 - protein, 10 aa, Homo Sapiens
FPYKIPAVVV

SEQ ID NO: 124400 - protein, 10 aa, Homo Sapiens
FPYLIAGKYA

SEQ ID NO: 124401 - protein, 10 aa, Homo Sapiens
FVNDIFERIA

SEQ ID NO: 124402 - protein, 10 aa, Homo Sapiens
GPGNIPPPPP

SEQ ID NO: 124403 - protein, 10 aa, Homo Sapiens
HALEWPSLTA

SEQ ID NO: 124404 - protein, 10 aa, Homo Sapiens
HDHFGIVEGL

SEQ ID NO: 124405 - protein, 10 aa, Homo Sapiens
HELTIPNNLI

SEQ ID NO: 124406 - protein, 10 aa, Homo Sapiens
HPAAFPLPVV

SEQ ID NO: 124407 - protein, 10 aa, Homo Sapiens
HPDEPIIISA

SEQ ID NO: 124408 - protein, 10 aa, Homo Sapiens
HPFKGFLLEA

SEQ ID NO: 124409 - protein, 10 aa, Homo Sapiens
HPFLLLGTTA

SEQ ID NO: 124410 - protein, 10 aa, Homo Sapiens
HPFPGPGLAI

SEQ ID NO: 124411 - protein, 10 aa, Homo Sapiens
HPIEPVLITA

SEQ ID NO: 124412 - protein, 10 aa, Homo Sapiens
HPIEWAINAA

SEQ ID NO: 124413 - protein, 10 aa, Homo Sapiens
HPIQGLPLAI

SEQ ID NO: 124414 - protein, 10 aa, Homo Sapiens
HPLLRPPPSA

SEQ ID NO: 124415 - protein, 10 aa, Homo Sapiens
HPNQPLTITA

SEQ ID NO: 124416 - protein, 10 aa, Homo Sapiens
HPNVTLTISA

SEQ ID NO: 124417 - protein, 10 aa, Homo Sapiens
HPREPLPPIQ

SEQ ID NO: 124418 - protein, 10 aa, Homo Sapiens
HPRVGDLILA

SEQ ID NO: 124419 - protein, 10 aa, Homo Sapiens
HPSPLSFFSA

SEQ ID NO: 124420 - protein, 10 aa, Homo Sapiens
HPSQELLASA

SEQ ID NO: 124421 - protein, 10 aa, Homo Sapiens
HPTEDLVVSA

SEQ ID NO: 124422 - protein, 10 aa, Homo Sapiens
HPVDNVIAVA

SEQ ID NO: 124423 - protein, 10 aa, Homo Sapiens
HPWETVTTAA

SEQ ID NO: 124424 - protein, 10 aa, Homo Sapiens
HPWEVIVGTV

SEQ ID NO: 124425 - protein, 10 aa, Homo Sapiens
HPYFYAPELL

SEQ ID NO: 124426 - protein, 10 aa, Homo Sapiens
HPYLFPVAAM

SEQ ID NO: 124427 - protein, 10 aa, Homo Sapiens
HSFGPMPISA

SEQ ID NO: 124428 - protein, 10 aa, Homo Sapiens
HVPDYLVPPA

SEQ ID NO: 124429 - protein, 10 aa, Homo Sapiens
IAAQGFTVAA

SEQ ID NO: 124430 - protein, 10 aa, Homo Sapiens
IPADLRIISA

SEQ ID NO: 124431 - protein, 10 aa, Homo Sapiens
IPFLVPGIRY

SEQ ID NO: 124432 - protein, 10 aa, Homo Sapiens
IPISPPPVSA

SEQ ID NO: 124433 - protein, 10 aa, Homo Sapiens
IPLYLKGGVA

SEQ ID NO: 124434 - protein, 10 aa, Homo Sapiens
IPMKIRNVSA

SEQ ID NO: 124435 - protein, 10 aa, Homo Sapiens
IPVLVPGIIF

SEQ ID NO: 124436 - protein, 10 aa, Homo Sapiens
IPVQLQRSMA

SEQ ID NO: 124437 - protein, 10 aa, Homo Sapiens
IPYQDYFYTA

SEQ ID NO: 124438 - protein, 10 aa, Homo Sapiens
IRLENEIQTY

SEQ ID NO: 124439 - protein, 10 aa, Homo Sapiens
KPYTLMSMVA

SEQ ID NO: 124440 - protein, 10 aa, Homo Sapiens
LAFLGNLVSA

SEQ ID NO: 124441 - protein, 10 aa, Homo Sapiens
LAVLLQAAEA

SEQ ID NO: 124442 - protein, 10 aa, Homo Sapiens
LGVHVDGFIA

SEQ ID NO: 124443 - protein, 10 aa, Homo Sapiens
LPAIQPRLVA

SEQ ID NO: 124444 - protein, 10 aa, Homo Sapiens
LPASIPHVIA

SEQ ID NO: 124445 - protein, 10 aa, Homo Sapiens
LPFEFRAIEA

SEQ ID NO: 124446 - protein, 10 aa, Homo Sapiens
LPFETLEVEA

SEQ ID NO: 124447 - protein, 10 aa, Homo Sapiens
LPFGSSPHRV

SEQ ID NO: 124448 - protein, 10 aa, Homo Sapiens
LPFYLIPPSA

SEQ ID NO: 124449 - protein, 10 aa, Homo Sapiens
LPHEIVVNLA

SEQ ID NO: 124450 - protein, 10 aa, Homo Sapiens
LPHPYAIAVF

SEQ ID NO: 124451 - protein, 10 aa, Homo Sapiens
LPHSAGRYAA

SEQ ID NO: 124452 - protein, 10 aa, Homo Sapiens
LPHSGDIIAT

SEQ ID NO: 124453 - protein, 10 aa, Homo Sapiens
LPIPDPGVSV

SEQ ID NO: 124454 - protein, 10 aa, Homo Sapiens
LPKEPQGIIA

SEQ ID NO: 124455 - protein, 10 aa, Homo Sapiens
LPLEGWNHVV

SEQ ID NO: 124456 - protein, 10 aa, Homo Sapiens
LPLEMAPWFA

SEQ ID NO: 124457 - protein, 10 aa, Homo Sapiens
LPLENGRFIA

SEQ ID NO: 124458 - protein, 10 aa, Homo Sapiens
LPLGAQIPAV

SEQ ID NO: 124459 - protein, 10 aa, Homo Sapiens
LPLLAGLVAA

SEQ ID NO: 124460 - protein, 10 aa, Homo Sapiens
LPLSAHGIVV

SEQ ID NO: 124461 - protein, 10 aa, Homo Sapiens
LPLVLLPPLA

SEQ ID NO: 124462 - protein, 10 aa, Homo Sapiens
LPMSVIIVGV

SEQ ID NO: 124463 - protein, 10 aa, Homo Sapiens
LPNFLDHIIA

SEQ ID NO: 124464 - protein, 10 aa, Homo Sapiens
LPNQSFPHSV

SEQ ID NO: 124465 - protein, 10 aa, Homo Sapiens
LPQEIKANVA

SEQ ID NO: 124466 - protein, 10 aa, Homo Sapiens
LPQIAAKIAA

SEQ ID NO: 124467 - protein, 10 aa, Homo Sapiens
LPSVPLSCAA

SEQ ID NO: 124468 - protein, 10 aa, Homo Sapiens
LPVDKAFYEA

SEQ ID NO: 124469 - protein, 10 aa, Homo Sapiens
LPVEVPLWLA

SEQ ID NO: 124470 - protein, 10 aa, Homo Sapiens
LPVQLQRAMA

SEQ ID NO: 124471 - protein, 10 aa, Homo Sapiens
LPVWLENHTA

SEQ ID NO: 124472 - protein, 10 aa, Homo Sapiens
LPYFDQGYEA

SEQ ID NO: 124473 - protein, 10 aa, Homo Sapiens
LPYKPYFYIA

SEQ ID NO: 124474 - protein, 10 aa, Homo Sapiens
LPYSHPGVVF

SEQ ID NO: 124475 - protein, 10 aa, Homo Sapiens
MAAESLLVTV

SEQ ID NO: 124476 - protein, 10 aa, Homo Sapiens
MARAAPLLAA

SEQ ID NO: 124477 - protein, 10 aa, Homo Sapiens
MGFTGAGIAA

SEQ ID NO: 124478 - protein, 10 aa, Homo Sapiens
MPAAHATSSA

SEQ ID NO: 124479 - protein, 10 aa, Homo Sapiens
MPAILDGEEA

SEQ ID NO: 124480 - protein, 10 aa, Homo Sapiens
MPFDPSKVVA

SEQ ID NO: 124481 - protein, 10 aa, Homo Sapiens
MPFQSGEFKA

SEQ ID NO: 124482 - protein, 10 aa, Homo Sapiens
MPGFIQKQQA

SEQ ID NO: 124483 - protein, 10 aa, Homo Sapiens
MPGYPVLAPA

SEQ ID NO: 124484 - protein, 10 aa, Homo Sapiens
MPHSIMRIDI

SEQ ID NO: 124485 - protein, 10 aa, Homo Sapiens
MPHSYPYVAL

SEQ ID NO: 124486 - protein, 10 aa, Homo Sapiens
MPIEVMMNET

SEQ ID NO: 124487 - protein, 10 aa, Homo Sapiens
MPIYPKWMGA

SEQ ID NO: 124488 - protein, 10 aa, Homo Sapiens
MPIYPTYNEV

SEQ ID NO: 124489 - protein, 10 aa, Homo Sapiens
MPLSTIREVA

SEQ ID NO: 124490 - protein, 10 aa, Homo Sapiens
MPLSVFPYYA

SEQ ID NO: 124491 - protein, 10 aa, Homo Sapiens
MPLVIKVTSA

SEQ ID NO: 124492 - protein, 10 aa, Homo Sapiens
MPNGDHIVSA

SEQ ID NO: 124493 - protein, 10 aa, Homo Sapiens
MPNPQLNIKA

SEQ ID NO: 124494 - protein, 10 aa, Homo Sapiens
MPQLNAIIAA

SEQ ID NO: 124495 - protein, 10 aa, Homo Sapiens
MPQSGTGVSV

SEQ ID NO: 124496 - protein, 10 aa, Homo Sapiens
MPRDILIVVG

SEQ ID NO: 124497 - protein, 10 aa, Homo Sapiens
MPRFTEQVEA

SEQ ID NO: 124498 - protein, 10 aa, Homo Sapiens
MPSRFPPVVF

SEQ ID NO: 124499 - protein, 10 aa, Homo Sapiens
MPTGENVISV

SEQ ID NO: 124500 - protein, 10 aa, Homo Sapiens
MPVIPALWEA

SEQ ID NO: 124501 - protein, 10 aa, Homo Sapiens
MPYEIKKVFA

SEQ ID NO: 124502 - protein, 10 aa, Homo Sapiens
MPYFLLTQAV

SEQ ID NO: 124503 - protein, 10 aa, Homo Sapiens
MSTPHVAEPA

SEQ ID NO: 124504 - protein, 10 aa, Homo Sapiens
MTIPYQPMPA

SEQ ID NO: 124505 - protein, 10 aa, Homo Sapiens
NHPYLFPVAA

SEQ ID NO: 124506 - protein, 10 aa, Homo Sapiens
NPLGMPVPAA

SEQ ID NO: 124507 - protein, 10 aa, Homo Sapiens
NPYFPGQAIA

SEQ ID NO: 124508 - protein, 10 aa, Homo Sapiens
NSFPLLLPMA

SEQ ID NO: 124509 - protein, 10 aa, Homo Sapiens
NVADLTSLRA

SEQ ID NO: 124510 - protein, 10 aa, Homo Sapiens
QPFGDHIISV

SEQ ID NO: 124511 - protein, 10 aa, Homo Sapiens
RAGASPPPVS

SEQ ID NO: 124512 - protein, 10 aa, Homo Sapiens
SIINYPKVSA

SEQ ID NO: 124513 - protein, 10 aa, Homo Sapiens
SPVPSHWMVA

SEQ ID NO: 124514 - protein, 10 aa, Homo Sapiens
TLAPGLGLPA

SEQ ID NO: 124515 - protein, 10 aa, Homo Sapiens
TPFEKGLHVV

SEQ ID NO: 124516 - protein, 10 aa, Homo Sapiens
TPFMLGALVA

SEQ ID NO: 124517 - protein, 10 aa, Homo Sapiens
TPIESLFIEA

SEQ ID NO: 124518 - protein, 10 aa, Homo Sapiens
TPLPAIVPAA

SEQ ID NO: 124519 - protein, 10 aa, Homo Sapiens
TPQEKIFIAA

SEQ ID NO: 124520 - protein, 10 aa, Homo Sapiens
TPYGYFLISA

SEQ ID NO: 124521 - protein, 10 aa, Homo Sapiens
TPYSGKLMSA

SEQ ID NO: 124522 - protein, 10 aa, Homo Sapiens
TVFSPTLPAA

SEQ ID NO: 124523 - protein, 10 aa, Homo Sapiens
VPNYKLITPA

SEQ ID NO: 124524 - protein, 10 aa, Homo Sapiens
VPYEIQKGQA

SEQ ID NO: 124525 - protein, 10 aa, Homo Sapiens
VPYRLLPGIF

SEQ ID NO: 124526 - protein, 10 aa, Homo Sapiens
YASAFHFLSA

SEQ ID NO: 124527 - protein, 10 aa, Homo Sapiens
YGYQFPGFPA

SEQ ID NO: 124528 - protein, 10 aa, Homo Sapiens
YPASLFQQQA

SEQ ID NO: 124529 - protein, 10 aa, Homo Sapiens
YPFILPHQQV

SEQ ID NO: 124530 - protein, 10 aa, Homo Sapiens
YPFKPPKVTF

SEQ ID NO: 124531 - protein, 10 aa, Homo Sapiens
YPFLLPVIQL

SEQ ID NO: 124532 - protein, 10 aa, Homo Sapiens
YPIGTNAIVA

SEQ ID NO: 124533 - protein, 10 aa, Homo Sapiens
YPLEDATHIA

SEQ ID NO: 124534 - protein, 10 aa, Homo Sapiens
YPLERGFIYV

SEQ ID NO: 124535 - protein, 10 aa, Homo Sapiens
YPNTYIFDLF

SEQ ID NO: 124536 - protein, 10 aa, Homo Sapiens
YPNYLPLYVA

SEQ ID NO: 124537 - protein, 10 aa, Homo Sapiens
YPRAQLEVSA

SEQ ID NO: 124538 - protein, 10 aa, Homo Sapiens
YPYELFQSGV

SEQ ID NO: 124539 - protein, 10 aa, Homo Sapiens
YPYNAPTVKF

SEQ ID NO: 124540 - protein, 11 aa, Homo Sapiens
APFYSSDILIA

SEQ ID NO: 124541 - protein, 11 aa, Homo Sapiens
APLDSIHSLAA

SEQ ID NO: 124542 - protein, 11 aa, Homo Sapiens
APMPYLIGVHA

SEQ ID NO: 124543 - protein, 11 aa, Homo Sapiens
ASHLPSDFTPA

SEQ ID NO: 124544 - protein, 11 aa, Homo Sapiens
DPASALSNMVA

SEQ ID NO: 124545 - protein, 11 aa, Homo Sapiens
DPVANVRFNVA

SEQ ID NO: 124546 - protein, 11 aa, Homo Sapiens
EAAAALTRMKA

SEQ ID NO: 124547 - protein, 11 aa, Homo Sapiens
EAARVAEQLRA

SEQ ID NO: 124548 - protein, 11 aa, Homo Sapiens
EAFEAIPRALA

SEQ ID NO: 124549 - protein, 11 aa, Homo Sapiens
EAFSIPGVLEA

SEQ ID NO: 124550 - protein, 11 aa, Homo Sapiens
EALPSDIAAEA

SEQ ID NO: 124551 - protein, 11 aa, Homo Sapiens
EIDVNGILRVT

SEQ ID NO: 124552 - protein, 11 aa, Homo Sapiens
EPLSYTRFSLA

SEQ ID NO: 124553 - protein, 11 aa, Homo Sapiens
FADIEISRNEA

SEQ ID NO: 124554 - protein, 11 aa, Homo Sapiens
FALNPDILCSA

SEQ ID NO: 124555 - protein, 11 aa, Homo Sapiens
FPADISSITEA

SEQ ID NO: 124556 - protein, 11 aa, Homo Sapiens
FPDFPTPGVVF

SEQ ID NO: 124557 - protein, 11 aa, Homo Sapiens
FPDRATLYVTA

SEQ ID NO: 124558 - protein, 11 aa, Homo Sapiens
FPDVSGVSRIP

SEQ ID NO: 124559 - protein, 11 aa, Homo Sapiens
FPFESGKPFKI

SEQ ID NO: 124560 - protein, 11 aa, Homo Sapiens
FPFIPDQPFRV

SEQ ID NO: 124561 - protein, 11 aa, Homo Sapiens
FPFKPPQRIEA

SEQ ID NO: 124562 - protein, 11 aa, Homo Sapiens
FPFMDLKLRAA

SEQ ID NO: 124563 - protein, 11 aa, Homo Sapiens
FPFNPLDFESF

SEQ ID NO: 124564 - protein, 11 aa, Homo Sapiens
FPFQPGSVAEV

SEQ ID NO: 124565 - protein, 11 aa, Homo Sapiens
FPFSAVVPAAL

SEQ ID NO: 124566 - protein, 11 aa, Homo Sapiens
FPHFDLSHGSA

SEQ ID NO: 124567 - protein, 11 aa, Homo Sapiens
FPLHPMMITNA

SEQ ID NO: 124568 - protein, 11 aa, Homo Sapiens
FPLIVTGQREA

SEQ ID NO: 124569 - protein, 11 aa, Homo Sapiens
FPLQFGREVLA

SEQ ID NO: 124570 - protein, 11 aa, Homo Sapiens
FPNASLIGLTA

SEQ ID NO: 124571 - protein, 11 aa, Homo Sapiens
FPNEFIVETKI

SEQ ID NO: 124572 - protein, 11 aa, Homo Sapiens
FPRAPSTSDSV

SEQ ID NO: 124573 - protein, 11 aa, Homo Sapiens
FPSEITDTVAA

SEQ ID NO: 124574 - protein, 11 aa, Homo Sapiens
FPSIFIYGHTA

SEQ ID NO: 124575 - protein, 11 aa, Homo Sapiens
FPTTSILPQTA

SEQ ID NO: 124576 - protein, 11 aa, Homo Sapiens
FPVLGGKAIEF

SEQ ID NO: 124577 - protein, 11 aa, Homo Sapiens
FPVYVLPKVEY

SEQ ID NO: 124578 - protein, 11 aa, Homo Sapiens
FPYYPSPGVLF

SEQ ID NO: 124579 - protein, 11 aa, Homo Sapiens
FVRSVHPYEVA

SEQ ID NO: 124580 - protein, 11 aa, Homo Sapiens
HAAAATYILEA

SEQ ID NO: 124581 - protein, 11 aa, Homo Sapiens
HELTIPNNLIG

SEQ ID NO: 124582 - protein, 11 aa, Homo Sapiens
HFDLSHGSAQV

SEQ ID NO: 124583 - protein, 11 aa, Homo Sapiens
HPFDLGLYNEA

SEQ ID NO: 124584 - protein, 11 aa, Homo Sapiens
HPIYLATGTSA

SEQ ID NO: 124585 - protein, 11 aa, Homo Sapiens
HPLASFSFTSA

SEQ ID NO: 124586 - protein, 11 aa, Homo Sapiens
HPLDPIDTVDF

SEQ ID NO: 124587 - protein, 11 aa, Homo Sapiens
HPLGIVQGFFA

SEQ ID NO: 124588 - protein, 11 aa, Homo Sapiens
HPLTGGGMTVA

SEQ ID NO: 124589 - protein, 11 aa, Homo Sapiens
HPNVTLTISAA

SEQ ID NO: 124590 - protein, 11 aa, Homo Sapiens
HPNYLGDLIMA

SEQ ID NO: 124591 - protein, 11 aa, Homo Sapiens
HPTASLIAKVA

SEQ ID NO: 124592 - protein, 11 aa, Homo Sapiens
HPTLLENLVFF

SEQ ID NO: 124593 - protein, 11 aa, Homo Sapiens
HPYPPGPGVAL

SEQ ID NO: 124594 - protein, 11 aa, Homo Sapiens
HSFPTLKFFPA

SEQ ID NO: 124595 - protein, 11 aa, Homo Sapiens
HSNVNLTIFTA

SEQ ID NO: 124596 - protein, 11 aa, Homo Sapiens
IPAFRGHFIAA

SEQ ID NO: 124597 - protein, 11 aa, Homo Sapiens
IPHSLPGAVAA

SEQ ID NO: 124598 - protein, 11 aa, Homo Sapiens
IPLPDEKSRVA

SEQ ID NO: 124599 - protein, 11 aa, Homo Sapiens
IPNSIMTILEA

SEQ ID NO: 124600 - protein, 11 aa, Homo Sapiens
IPSFAPVLLLA

SEQ ID NO: 124601 - protein, 11 aa, Homo Sapiens
IPVLVPGIIFS

SEQ ID NO: 124602 - protein, 11 aa, Homo Sapiens
IPWVQKPIIFD

SEQ ID NO: 124603 - protein, 11 aa, Homo Sapiens
IPYDQSGFVSA

SEQ ID NO: 124604 - protein, 11 aa, Homo Sapiens
IPYHSEVPVSL

SEQ ID NO: 124605 - protein, 11 aa, Homo Sapiens
IPYSPDVQIHA

SEQ ID NO: 124606 - protein, 11 aa, Homo Sapiens
LAMVPSHAVVA

SEQ ID NO: 124607 - protein, 11 aa, Homo Sapiens
LPAEFPDKVFA

SEQ ID NO: 124608 - protein, 11 aa, Homo Sapiens
LPAGAVVGIPA

SEQ ID NO: 124609 - protein, 11 aa, Homo Sapiens
LPALANTSVHA

SEQ ID NO: 124610 - protein, 11 aa, Homo Sapiens
LPASEIAKLLA

SEQ ID NO: 124611 - protein, 11 aa, Homo Sapiens
LPHAILRLDLA

SEQ ID NO: 124612 - protein, 11 aa, Homo Sapiens
LPLGFIVFLPA

SEQ ID NO: 124613 - protein, 11 aa, Homo Sapiens
LPLLPAPGAAA

SEQ ID NO: 124614 - protein, 11 aa, Homo Sapiens
LPLLQPRGASA

SEQ ID NO: 124615 - protein, 11 aa, Homo Sapiens
LPNSHLTEEAL

SEQ ID NO: 124616 - protein, 11 aa, Homo Sapiens
LPPVLLPGAAG

SEQ ID NO: 124617 - protein, 11 aa, Homo Sapiens
LPSASITSTSA

SEQ ID NO: 124618 - protein, 11 aa, Homo Sapiens
LPSDFTPAVHA

SEQ ID NO: 124619 - protein, 11 aa, Homo Sapiens
LPSDVVTGYLA

SEQ ID NO: 124620 - protein, 11 aa, Homo Sapiens
LPSLYPSFHSA

SEQ ID NO: 124621 - protein, 11 aa, Homo Sapiens
LPVGQHIYLSA

SEQ ID NO: 124622 - protein, 11 aa, Homo Sapiens
LPVLPWSEVTF

SEQ ID NO: 124623 - protein, 11 aa, Homo Sapiens
LPVNESFGFTA

SEQ ID NO: 124624 - protein, 11 aa, Homo Sapiens
LPVPPLSVRPA

SEQ ID NO: 124625 - protein, 11 aa, Homo Sapiens
LPVRSLTYFSA

SEQ ID NO: 124626 - protein, 11 aa, Homo Sapiens
LPWDPTGKIGP

SEQ ID NO: 124627 - protein, 11 aa, Homo Sapiens
LPWQQERDVAA

SEQ ID NO: 124628 - protein, 11 aa, Homo Sapiens
LPYTVNFKVSA

SEQ ID NO: 124629 - protein, 11 aa, Homo Sapiens
MAFWGWRAAAA

SEQ ID NO: 124630 - protein, 11 aa, Homo Sapiens
MAIGAIAGRIV

SEQ ID NO: 124631 - protein, 11 aa, Homo Sapiens
MALVASVRVPA

SEQ ID NO: 124632 - protein, 11 aa, Homo Sapiens
MAMSAGTLLTA

SEQ ID NO: 124633 - protein, 11 aa, Homo Sapiens
MIKTQSSLVPA

SEQ ID NO: 124634 - protein, 11 aa, Homo Sapiens
MPFFLEGKPKA

SEQ ID NO: 124635 - protein, 11 aa, Homo Sapiens
MPHSIMRIDIA

SEQ ID NO: 124636 - protein, 11 aa, Homo Sapiens
MPHSIMRVDIA

SEQ ID NO: 124637 - protein, 11 aa, Homo Sapiens
MPHTFFIGDHA

SEQ ID NO: 124638 - protein, 11 aa, Homo Sapiens
MPIYVTGITNH

SEQ ID NO: 124639 - protein, 11 aa, Homo Sapiens
MPKEILQIIQL

SEQ ID NO: 124640 - protein, 11 aa, Homo Sapiens
MPLFFVSPVSV

SEQ ID NO: 124641 - protein, 11 aa, Homo Sapiens
MPLHVAPLLAA

SEQ ID NO: 124642 - protein, 11 aa, Homo Sapiens
MPLQPSILREV

SEQ ID NO: 124643 - protein, 11 aa, Homo Sapiens
MPMFIVNTNVP

SEQ ID NO: 124644 - protein, 11 aa, Homo Sapiens
MPNAGLPGVGL

SEQ ID NO: 124645 - protein, 11 aa, Homo Sapiens
MPNPSLAQVKI

SEQ ID NO: 124646 - protein, 11 aa, Homo Sapiens
MPRTAALGVSF

SEQ ID NO: 124647 - protein, 11 aa, Homo Sapiens
MPRWAERLFPA

SEQ ID NO: 124648 - protein, 11 aa, Homo Sapiens
MPSEDVVSLQV

SEQ ID NO: 124649 - protein, 11 aa, Homo Sapiens
MPTNILGEIVV

SEQ ID NO: 124650 - protein, 11 aa, Homo Sapiens
MPTSGALDRVA

SEQ ID NO: 124651 - protein, 11 aa, Homo Sapiens
MPVILQDAPSA

SEQ ID NO: 124652 - protein, 11 aa, Homo Sapiens
MPWGDPNYRSA

SEQ ID NO: 124653 - protein, 11 aa, Homo Sapiens
NPLDLPERIAA

SEQ ID NO: 124654 - protein, 11 aa, Homo Sapiens
PGSGPAGGSTR

SEQ ID NO: 124655 - protein, 11 aa, Homo Sapiens
QAFSPPPNVTA

SEQ ID NO: 124656 - protein, 11 aa, Homo Sapiens
QPHDPLVPLSA

SEQ ID NO: 124657 - protein, 11 aa, Homo Sapiens
QPYAPPRDFAA

SEQ ID NO: 124658 - protein, 11 aa, Homo Sapiens
SAFLPARFYQA

SEQ ID NO: 124659 - protein, 11 aa, Homo Sapiens
SPIENIQRVAA

SEQ ID NO: 124660 - protein, 11 aa, Homo Sapiens
SPLDMKDGFLA

SEQ ID NO: 124661 - protein, 11 aa, Homo Sapiens
SSSPEVKGYWA

SEQ ID NO: 124662 - protein, 11 aa, Homo Sapiens
SSTISSNVASK

SEQ ID NO: 124663 - protein, 11 aa, Homo Sapiens
TANSKLVIITA

SEQ ID NO: 124664 - protein, 11 aa, Homo Sapiens
TAYKPKYFTSA

SEQ ID NO: 124665 - protein, 11 aa, Homo Sapiens
TLGVKQLIVGV

SEQ ID NO: 124666 - protein, 11 aa, Homo Sapiens
TPWPRGRLLTA

SEQ ID NO: 124667 - protein, 11 aa, Homo Sapiens
VPWMPPGKSSA

SEQ ID NO: 124668 - protein, 11 aa, Homo Sapiens
WPFVSDPAPTA

SEQ ID NO: 124669 - protein, 11 aa, Homo Sapiens
YLHLPPEIVPA

SEQ ID NO: 124670 - protein, 11 aa, Homo Sapiens
YPASPWSHISA

SEQ ID NO: 124671 - protein, 11 aa, Homo Sapiens
YPDSFGHYREA

SEQ ID NO: 124672 - protein, 11 aa, Homo Sapiens
YPFINSRIITV

SEQ ID NO: 124673 - protein, 11 aa, Homo Sapiens
YPFSSEQKWMA

SEQ ID NO: 124674 - protein, 11 aa, Homo Sapiens
YPHLVAGALAA

SEQ ID NO: 124675 - protein, 11 aa, Homo Sapiens
YPIEPSGVLGA

SEQ ID NO: 124676 - protein, 11 aa, Homo Sapiens
YPIGTNAIVAV

SEQ ID NO: 124677 - protein, 11 aa, Homo Sapiens
YPLDFARTRLA

SEQ ID NO: 124678 - protein, 11 aa, Homo Sapiens
YPLLLPKGVVL

SEQ ID NO: 124679 - protein, 11 aa, Homo Sapiens
YPLQGPGLLSV

SEQ ID NO: 124680 - protein, 11 aa, Homo Sapiens
YPNAELVFLEI

SEQ ID NO: 124681 - protein, 11 aa, Homo Sapiens
YPNIELSYEVV

SEQ ID NO: 124682 - protein, 11 aa, Homo Sapiens
YPREMLGPVTF

SEQ ID NO: 124683 - protein, 11 aa, Homo Sapiens
YPVEIHEYLSA

SEQ ID NO: 124684 - protein, 11 aa, Homo Sapiens
YPYGLQTFHPA

SEQ ID NO: 124685 - protein, 8 aa, Homo Sapiens
APASLTSA

SEQ ID NO: 124686 - protein, 8 aa, Homo Sapiens
APAVHPQA

SEQ ID NO: 124687 - protein, 8 aa, Homo Sapiens
APGVLPSA

SEQ ID NO: 124688 - protein, 8 aa, Homo Sapiens
APIRLLAA

SEQ ID NO: 124689 - protein, 8 aa, Homo Sapiens
APQRVPVA

SEQ ID NO: 124690 - protein, 8 aa, Homo Sapiens
APRPAPVA

SEQ ID NO: 124691 - protein, 8 aa, Homo Sapiens
APSPEPAV

SEQ ID NO: 124692 - protein, 8 aa, Homo Sapiens
APSRIPGV

SEQ ID NO: 124693 - protein, 8 aa, Homo Sapiens
APSVTPQA

SEQ ID NO: 124694 - protein, 8 aa, Homo Sapiens
APTAIKAA

SEQ ID NO: 124695 - protein, 8 aa, Homo Sapiens
APTAITEA

SEQ ID NO: 124696 - protein, 8 aa, Homo Sapiens
APTPAAPA

SEQ ID NO: 124697 - protein, 8 aa, Homo Sapiens
APVAIGVA

SEQ ID NO: 124698 - protein, 8 aa, Homo Sapiens
APVILPSA

SEQ ID NO: 124699 - protein, 8 aa, Homo Sapiens
APVLHLEA

SEQ ID NO: 124700 - protein, 8 aa, Homo Sapiens
APVNFISA

SEQ ID NO: 124701 - protein, 8 aa, Homo Sapiens
APVQQPRT

SEQ ID NO: 124702 - protein, 8 aa, Homo Sapiens
APVYLAAV

SEQ ID NO: 124703 - protein, 8 aa, Homo Sapiens
APWRPPPP

SEQ ID NO: 124704 - protein, 8 aa, Homo Sapiens
EPMKGPIA

SEQ ID NO: 124705 - protein, 8 aa, Homo Sapiens
EPQPEPVA

SEQ ID NO: 124706 - protein, 8 aa, Homo Sapiens
FPRYVTGA

SEQ ID NO: 124707 - protein, 8 aa, Homo Sapiens
FPTKIPRG

SEQ ID NO: 124708 - protein, 8 aa, Homo Sapiens
FPTSISVN

SEQ ID NO: 124709 - protein, 8 aa, Homo Sapiens
FPVCLLAS

SEQ ID NO: 124710 - protein, 8 aa, Homo Sapiens
FVGKTPEA

SEQ ID NO: 124711 - protein, 8 aa, Homo Sapiens
HPFHVIRI

SEQ ID NO: 124712 - protein, 8 aa, Homo Sapiens
HPFYTRAA

SEQ ID NO: 124713 - protein, 8 aa, Homo Sapiens
HPHLVAEA

SEQ ID NO: 124714 - protein, 8 aa, Homo Sapiens
HPLGRPPT

SEQ ID NO: 124715 - protein, 8 aa, Homo Sapiens
HPLLRPPP

SEQ ID NO: 124716 - protein, 8 aa, Homo Sapiens
HPTSIVKA

SEQ ID NO: 124717 - protein, 8 aa, Homo Sapiens
HPYLFPVA

SEQ ID NO: 124718 - protein, 8 aa, Homo Sapiens
IPDKKPMA

SEQ ID NO: 124719 - protein, 8 aa, Homo Sapiens
IPEEQPVA

SEQ ID NO: 124720 - protein, 8 aa, Homo Sapiens
IPFRIGNA

SEQ ID NO: 124721 - protein, 8 aa, Homo Sapiens
IPGVTPAA

SEQ ID NO: 124722 - protein, 8 aa, Homo Sapiens
IPHSLPGA

SEQ ID NO: 124723 - protein, 8 aa, Homo Sapiens
IPIAVSGV

SEQ ID NO: 124724 - protein, 8 aa, Homo Sapiens
IPKDPRQW

SEQ ID NO: 124725 - protein, 8 aa, Homo Sapiens
IPNRIPKI

SEQ ID NO: 124726 - protein, 8 aa, Homo Sapiens
IPQVMAIA

SEQ ID NO: 124727 - protein, 8 aa, Homo Sapiens
IPSKKPVA

SEQ ID NO: 124728 - protein, 8 aa, Homo Sapiens
IPTPIVGV

SEQ ID NO: 124729 - protein, 8 aa, Homo Sapiens
IPTTIYKA

SEQ ID NO: 124730 - protein, 8 aa, Homo Sapiens
IPVRFIEA

SEQ ID NO: 124731 - protein, 8 aa, Homo Sapiens
IPVTQASA

SEQ ID NO: 124732 - protein, 8 aa, Homo Sapiens
IPWKVPGL

SEQ ID NO: 124733 - protein, 8 aa, Homo Sapiens
IVYKIRAA

SEQ ID NO: 124734 - protein, 8 aa, Homo Sapiens
KPFPVSKA

SEQ ID NO: 124735 - protein, 8 aa, Homo Sapiens
KPGSVPLV

SEQ ID NO: 124736 - protein, 8 aa, Homo Sapiens
KPLLIRGV

SEQ ID NO: 124737 - protein, 8 aa, Homo Sapiens
KPLRIIGV

SEQ ID NO: 124738 - protein, 8 aa, Homo Sapiens
KPQNIREV

SEQ ID NO: 124739 - protein, 8 aa, Homo Sapiens
KPQNMPKA

SEQ ID NO: 124740 - protein, 8 aa, Homo Sapiens
KPWKFSSV

SEQ ID NO: 124741 - protein, 8 aa, Homo Sapiens
KPYPIAEV

SEQ ID NO: 124742 - protein, 8 aa, Homo Sapiens
LPHKGPEA

SEQ ID NO: 124743 - protein, 8 aa, Homo Sapiens
LPHQLPEA

SEQ ID NO: 124744 - protein, 8 aa, Homo Sapiens
LPKLGICA

SEQ ID NO: 124745 - protein, 8 aa, Homo Sapiens
LPNGVPKA

SEQ ID NO: 124746 - protein, 8 aa, Homo Sapiens
LPQHIREA

SEQ ID NO: 124747 - protein, 8 aa, Homo Sapiens
LPRHRLDA

SEQ ID NO: 124748 - protein, 8 aa, Homo Sapiens
LPRTPTPA

SEQ ID NO: 124749 - protein, 8 aa, Homo Sapiens
LPSKTPEG

SEQ ID NO: 124750 - protein, 8 aa, Homo Sapiens
LPSVIAGA

SEQ ID NO: 124751 - protein, 8 aa, Homo Sapiens
LPTAVPTA

SEQ ID NO: 124752 - protein, 8 aa, Homo Sapiens
LPTTICHA

SEQ ID NO: 124753 - protein, 8 aa, Homo Sapiens
LPVRLATA

SEQ ID NO: 124754 - protein, 8 aa, Homo Sapiens
LPWQGLKA

SEQ ID NO: 124755 - protein, 8 aa, Homo Sapiens
LPWRLLQA

SEQ ID NO: 124756 - protein, 8 aa, Homo Sapiens
LPYHTTDA

SEQ ID NO: 124757 - protein, 8 aa, Homo Sapiens
LVVPSRPA

SEQ ID NO: 124758 - protein, 8 aa, Homo Sapiens
MPATLARA

SEQ ID NO: 124759 - protein, 8 aa, Homo Sapiens
MPDLHPAA

SEQ ID NO: 124760 - protein, 8 aa, Homo Sapiens
MPGYLPGA

SEQ ID NO: 124761 - protein, 8 aa, Homo Sapiens
MPIYVTGI

SEQ ID NO: 124762 - protein, 8 aa, Homo Sapiens
MPQPVPTA

SEQ ID NO: 124763 - protein, 8 aa, Homo Sapiens
MPQSIVEA

SEQ ID NO: 124764 - protein, 8 aa, Homo Sapiens
MPRLIAKV

SEQ ID NO: 124765 - protein, 8 aa, Homo Sapiens
MPRLICKA

SEQ ID NO: 124766 - protein, 8 aa, Homo Sapiens
MPTTLEGA

SEQ ID NO: 124767 - protein, 8 aa, Homo Sapiens
MQPPVPGP

SEQ ID NO: 124768 - protein, 8 aa, Homo Sapiens
NPIAQPLA

SEQ ID NO: 124769 - protein, 8 aa, Homo Sapiens
NPTRQPLA

SEQ ID NO: 124770 - protein, 8 aa, Homo Sapiens
PAKKITAA

SEQ ID NO: 124771 - protein, 8 aa, Homo Sapiens
PCDKILKA

SEQ ID NO: 124772 - protein, 8 aa, Homo Sapiens
PDGRIIKV

SEQ ID NO: 124773 - protein, 8 aa, Homo Sapiens
PGPRRSGA

SEQ ID NO: 124774 - protein, 8 aa, Homo Sapiens
PHLVTHDA

SEQ ID NO: 124775 - protein, 8 aa, Homo Sapiens
PHSAGRYA

SEQ ID NO: 124776 - protein, 8 aa, Homo Sapiens
PKEKQPVA

SEQ ID NO: 124777 - protein, 8 aa, Homo Sapiens
PKPIGKLA

SEQ ID NO: 124778 - protein, 8 aa, Homo Sapiens
PLKGARIA

SEQ ID NO: 124779 - protein, 8 aa, Homo Sapiens
PTGDLPRA

SEQ ID NO: 124780 - protein, 8 aa, Homo Sapiens
PTKRPPVL

SEQ ID NO: 124781 - protein, 8 aa, Homo Sapiens
PVGPGRRA

SEQ ID NO: 124782 - protein, 8 aa, Homo Sapiens
QKPSGVSA

SEQ ID NO: 124783 - protein, 8 aa, Homo Sapiens
QPTPIQKA

SEQ ID NO: 124784 - protein, 8 aa, Homo Sapiens
QPYPLPHV

SEQ ID NO: 124785 - protein, 8 aa, Homo Sapiens
QPYRFPQA

SEQ ID NO: 124786 - protein, 8 aa, Homo Sapiens
RPFHLAAV

SEQ ID NO: 124787 - protein, 8 aa, Homo Sapiens
RPFKGEVV

SEQ ID NO: 124788 - protein, 8 aa, Homo Sapiens
RPFLLRRV

SEQ ID NO: 124789 - protein, 8 aa, Homo Sapiens
RPKVGLGA

SEQ ID NO: 124790 - protein, 8 aa, Homo Sapiens
RPLLLNSV

SEQ ID NO: 124791 - protein, 8 aa, Homo Sapiens
RPREFPTA

SEQ ID NO: 124792 - protein, 8 aa, Homo Sapiens
RPRNLAAA

SEQ ID NO: 124793 - protein, 8 aa, Homo Sapiens
RPRQLTRA

SEQ ID NO: 124794 - protein, 8 aa, Homo Sapiens
RPTCIVRA

SEQ ID NO: 124795 - protein, 8 aa, Homo Sapiens
RPTPQLRA

SEQ ID NO: 124796 - protein, 8 aa, Homo Sapiens
RPVKIRKI

SEQ ID NO: 124797 - protein, 8 aa, Homo Sapiens
RPVKLFRV

SEQ ID NO: 124798 - protein, 8 aa, Homo Sapiens
RPVLTSVA

SEQ ID NO: 124799 - protein, 8 aa, Homo Sapiens
RPVRLMKV

SEQ ID NO: 124800 - protein, 8 aa, Homo Sapiens
RPVSLREV

SEQ ID NO: 124801 - protein, 8 aa, Homo Sapiens
RPWLRPAA

SEQ ID NO: 124802 - protein, 8 aa, Homo Sapiens
RPYLLVHV

SEQ ID NO: 124803 - protein, 8 aa, Homo Sapiens
RPYRHIGV

SEQ ID NO: 124804 - protein, 8 aa, Homo Sapiens
SPAFKPAA

SEQ ID NO: 124805 - protein, 8 aa, Homo Sapiens
SPAKLQAA

SEQ ID NO: 124806 - protein, 8 aa, Homo Sapiens
SPALLRAE

SEQ ID NO: 124807 - protein, 8 aa, Homo Sapiens
SPALLREA

SEQ ID NO: 124808 - protein, 8 aa, Homo Sapiens
SPAQIKAV

SEQ ID NO: 124809 - protein, 8 aa, Homo Sapiens
SPASLSQA

SEQ ID NO: 124810 - protein, 8 aa, Homo Sapiens
SPDELPSA

SEQ ID NO: 124811 - protein, 8 aa, Homo Sapiens
SPGLLPVA

SEQ ID NO: 124812 - protein, 8 aa, Homo Sapiens
SPHLQGEA

SEQ ID NO: 124813 - protein, 8 aa, Homo Sapiens
SPHPGLVA

SEQ ID NO: 124814 - protein, 8 aa, Homo Sapiens
SPILVATA

SEQ ID NO: 124815 - protein, 8 aa, Homo Sapiens
SPISVAAA

SEQ ID NO: 124816 - protein, 8 aa, Homo Sapiens
SPLNTHAA

SEQ ID NO: 124817 - protein, 8 aa, Homo Sapiens
SPTPEPGV

SEQ ID NO: 124818 - protein, 8 aa, Homo Sapiens
SPTVITSV

SEQ ID NO: 124819 - protein, 8 aa, Homo Sapiens
SPTVIVMV

SEQ ID NO: 124820 - protein, 8 aa, Homo Sapiens
SPYKICMV

SEQ ID NO: 124821 - protein, 8 aa, Homo Sapiens
SPYLHPGA

SEQ ID NO: 124822 - protein, 8 aa, Homo Sapiens
SPYSSVSA

SEQ ID NO: 124823 - protein, 8 aa, Homo Sapiens
TAVSRPCA

SEQ ID NO: 124824 - protein, 8 aa, Homo Sapiens
TPASLLAA

SEQ ID NO: 124825 - protein, 8 aa, Homo Sapiens
TPGIIAEA

SEQ ID NO: 124826 - protein, 8 aa, Homo Sapiens
TPGLLPTA

SEQ ID NO: 124827 - protein, 8 aa, Homo Sapiens
TPHPFPAV

SEQ ID NO: 124828 - protein, 8 aa, Homo Sapiens
TPIHLASA

SEQ ID NO: 124829 - protein, 8 aa, Homo Sapiens
TPQQIAIA

SEQ ID NO: 124830 - protein, 8 aa, Homo Sapiens
TPTPVPVV

SEQ ID NO: 124831 - protein, 8 aa, Homo Sapiens
TPVRLPSI

SEQ ID NO: 124832 - protein, 8 aa, Homo Sapiens
TPYRPPAA

SEQ ID NO: 124833 - protein, 8 aa, Homo Sapiens
VKPVKVSA

SEQ ID NO: 124834 - protein, 8 aa, Homo Sapiens
VKRPLLVA

SEQ ID NO: 124835 - protein, 8 aa, Homo Sapiens
VPAVTLVA

SEQ ID NO: 124836 - protein, 8 aa, Homo Sapiens
VPFSIPAA

SEQ ID NO: 124837 - protein, 8 aa, Homo Sapiens
VPNTQPKA

SEQ ID NO: 124838 - protein, 8 aa, Homo Sapiens
VPQAKPVA

SEQ ID NO: 124839 - protein, 8 aa, Homo Sapiens
VPQETPHA

SEQ ID NO: 124840 - protein, 8 aa, Homo Sapiens
VPQRPGPP

SEQ ID NO: 124841 - protein, 8 aa, Homo Sapiens
VPRKLIVA

SEQ ID NO: 124842 - protein, 8 aa, Homo Sapiens
VPSAEPQA

SEQ ID NO: 124843 - protein, 8 aa, Homo Sapiens
VPSSQPSV

SEQ ID NO: 124844 - protein, 8 aa, Homo Sapiens
VPTKRPPV

SEQ ID NO: 124845 - protein, 8 aa, Homo Sapiens
VPTNIIAA

SEQ ID NO: 124846 - protein, 8 aa, Homo Sapiens
VPVETPEA

SEQ ID NO: 124847 - protein, 8 aa, Homo Sapiens
VPVGILSA

SEQ ID NO: 124848 - protein, 8 aa, Homo Sapiens
VPVPLLGA

SEQ ID NO: 124849 - protein, 8 aa, Homo Sapiens
VPWGGAAA

SEQ ID NO: 124850 - protein, 8 aa, Homo Sapiens
VPYLFKKV

SEQ ID NO: 124851 - protein, 8 aa, Homo Sapiens
VPYPLPKI

SEQ ID NO: 124852 - protein, 8 aa, Homo Sapiens
YPAAVPQA

SEQ ID NO: 124853 - protein, 8 aa, Homo Sapiens
YPFRVNSA

SEQ ID NO: 124854 - protein, 9 aa, Homo Sapiens
AAGPVGMAA

SEQ ID NO: 124855 - protein, 9 aa, Homo Sapiens
AAKDPSPSV

SEQ ID NO: 124856 - protein, 9 aa, Homo Sapiens
AAKLPGEGA

SEQ ID NO: 124857 - protein, 9 aa, Homo Sapiens
AAKPGMVSA

SEQ ID NO: 124858 - protein, 9 aa, Homo Sapiens
AAKPPPLSA

SEQ ID NO: 124859 - protein, 9 aa, Homo Sapiens
AAKVPGNQA

SEQ ID NO: 124860 - protein, 9 aa, Homo Sapiens
AAMPASTSA

SEQ ID NO: 124861 - protein, 9 aa, Homo Sapiens
AARLVGAAA

SEQ ID NO: 124862 - protein, 9 aa, Homo Sapiens
AHPPWAPLA

SEQ ID NO: 124863 - protein, 9 aa, Homo Sapiens
APAAATVAV

SEQ ID NO: 124864 - protein, 9 aa, Homo Sapiens
APAAGMNAA

SEQ ID NO: 124865 - protein, 9 aa, Homo Sapiens
APAEPGWKA

SEQ ID NO: 124866 - protein, 9 aa, Homo Sapiens
APAGSLPKI

SEQ ID NO: 124867 - protein, 9 aa, Homo Sapiens
APAGVFGVA

SEQ ID NO: 124868 - protein, 9 aa, Homo Sapiens
APAIGFPQA

SEQ ID NO: 124869 - protein, 9 aa, Homo Sapiens
APAPAAHVA

SEQ ID NO: 124870 - protein, 9 aa, Homo Sapiens
APAPPKAEA

SEQ ID NO: 124871 - protein, 9 aa, Homo Sapiens
APAPTPILA

SEQ ID NO: 124872 - protein, 9 aa, Homo Sapiens
APAPVIISS

SEQ ID NO: 124873 - protein, 9 aa, Homo Sapiens
APARPGPAA

SEQ ID NO: 124874 - protein, 9 aa, Homo Sapiens
APARPSVPP

SEQ ID NO: 124875 - protein, 9 aa, Homo Sapiens
APASVLPAA

SEQ ID NO: 124876 - protein, 9 aa, Homo Sapiens
APCTAIREV

SEQ ID NO: 124877 - protein, 9 aa, Homo Sapiens
APFEPLASG

SEQ ID NO: 124878 - protein, 9 aa, Homo Sapiens
APFGKISDA

SEQ ID NO: 124879 - protein, 9 aa, Homo Sapiens
APFPHGDSA

SEQ ID NO: 124880 - protein, 9 aa, Homo Sapiens
APFPKTQIA

SEQ ID NO: 124881 - protein, 9 aa, Homo Sapiens
APFQGLLQA

SEQ ID NO: 124882 - protein, 9 aa, Homo Sapiens
APGALLLEA

SEQ ID NO: 124883 - protein, 9 aa, Homo Sapiens
APGLPTARA

SEQ ID NO: 124884 - protein, 9 aa, Homo Sapiens
APGPGPASA

SEQ ID NO: 124885 - protein, 9 aa, Homo Sapiens
APGYSYTAA

SEQ ID NO: 124886 - protein, 9 aa, Homo Sapiens
APHAPGPPA

SEQ ID NO: 124887 - protein, 9 aa, Homo Sapiens
APHEILIQI

SEQ ID NO: 124888 - protein, 9 aa, Homo Sapiens
APHLLRLFV

SEQ ID NO: 124889 - protein, 9 aa, Homo Sapiens
APHPGLSEA

SEQ ID NO: 124890 - protein, 9 aa, Homo Sapiens
APHPPLSVV

SEQ ID NO: 124891 - protein, 9 aa, Homo Sapiens
APIDRVGQT

SEQ ID NO: 124892 - protein, 9 aa, Homo Sapiens
APIHKVIRI

SEQ ID NO: 124893 - protein, 9 aa, Homo Sapiens
APIIRVGGA

SEQ ID NO: 124894 - protein, 9 aa, Homo Sapiens
APIKVRLLA

SEQ ID NO: 124895 - protein, 9 aa, Homo Sapiens
APIPNAPPA

SEQ ID NO: 124896 - protein, 9 aa, Homo Sapiens
APIQPTPVA

SEQ ID NO: 124897 - protein, 9 aa, Homo Sapiens
APIQSEPRV

SEQ ID NO: 124898 - protein, 9 aa, Homo Sapiens
APITGQVSA

SEQ ID NO: 124899 - protein, 9 aa, Homo Sapiens
APIWLEHAA

SEQ ID NO: 124900 - protein, 9 aa, Homo Sapiens
APKAGPGVV

SEQ ID NO: 124901 - protein, 9 aa, Homo Sapiens
APKAGQLEA

SEQ ID NO: 124902 - protein, 9 aa, Homo Sapiens
APKDCFIEV

SEQ ID NO: 124903 - protein, 9 aa, Homo Sapiens
APKEKGITA

SEQ ID NO: 124904 - protein, 9 aa, Homo Sapiens
APKFRLHSA

SEQ ID NO: 124905 - protein, 9 aa, Homo Sapiens
APKIGSNGV

SEQ ID NO: 124906 - protein, 9 aa, Homo Sapiens
APKLGSNIA

SEQ ID NO: 124907 - protein, 9 aa, Homo Sapiens
APKPPPPPP

SEQ ID NO: 124908 - protein, 9 aa, Homo Sapiens
APKPQGTKI

SEQ ID NO: 124909 - protein, 9 aa, Homo Sapiens
APKQKIVKP

SEQ ID NO: 124910 - protein, 9 aa, Homo Sapiens
APKSPSQDV

SEQ ID NO: 124911 - protein, 9 aa, Homo Sapiens
APKSTSVFA

SEQ ID NO: 124912 - protein, 9 aa, Homo Sapiens
APLQGQLVA

SEQ ID NO: 124913 - protein, 9 aa, Homo Sapiens
APLVKSLCA

SEQ ID NO: 124914 - protein, 9 aa, Homo Sapiens
APMPPIIHA

SEQ ID NO: 124915 - protein, 9 aa, Homo Sapiens
APMPTASTA

SEQ ID NO: 124916 - protein, 9 aa, Homo Sapiens
APNEGFCSA

SEQ ID NO: 124917 - protein, 9 aa, Homo Sapiens
APNPIHLTV

SEQ ID NO: 124918 - protein, 9 aa, Homo Sapiens
APNPVVFVA

SEQ ID NO: 124919 - protein, 9 aa, Homo Sapiens
APNTPAWEA

SEQ ID NO: 124920 - protein, 9 aa, Homo Sapiens
APPRPPRAA

SEQ ID NO: 124921 - protein, 9 aa, Homo Sapiens
APQSLGSSA

SEQ ID NO: 124922 - protein, 9 aa, Homo Sapiens
APRAAREAL

SEQ ID NO: 124923 - protein, 9 aa, Homo Sapiens
APRFGGSRA

SEQ ID NO: 124924 - protein, 9 aa, Homo Sapiens
APRIALHTA

SEQ ID NO: 124925 - protein, 9 aa, Homo Sapiens
APRLQSEVA

SEQ ID NO: 124926 - protein, 9 aa, Homo Sapiens
APRPGPRAV

SEQ ID NO: 124927 - protein, 9 aa, Homo Sapiens
APRPPPKPM

SEQ ID NO: 124928 - protein, 9 aa, Homo Sapiens
APRPPVSAA

SEQ ID NO: 124929 - protein, 9 aa, Homo Sapiens
APRPWSRNA

SEQ ID NO: 124930 - protein, 9 aa, Homo Sapiens
APRQPGLMA

SEQ ID NO: 124931 - protein, 9 aa, Homo Sapiens
APRTVALTA

SEQ ID NO: 124932 - protein, 9 aa, Homo Sapiens
APSDRMPSA

SEQ ID NO: 124933 - protein, 9 aa, Homo Sapiens
APSLRARAA

SEQ ID NO: 124934 - protein, 9 aa, Homo Sapiens
APSPVQHQA

SEQ ID NO: 124935 - protein, 9 aa, Homo Sapiens
APSVGIKAA

SEQ ID NO: 124936 - protein, 9 aa, Homo Sapiens
APTAIKAAA

SEQ ID NO: 124937 - protein, 9 aa, Homo Sapiens
APTGDLPRA

SEQ ID NO: 124938 - protein, 9 aa, Homo Sapiens
APTLGLLPA

SEQ ID NO: 124939 - protein, 9 aa, Homo Sapiens
APTLPGSAA

SEQ ID NO: 124940 - protein, 9 aa, Homo Sapiens
APTPPTLVA

SEQ ID NO: 124941 - protein, 9 aa, Homo Sapiens
APVAEVPTA

SEQ ID NO: 124942 - protein, 9 aa, Homo Sapiens
APVAVEPGA

SEQ ID NO: 124943 - protein, 9 aa, Homo Sapiens
APVGIALIA

SEQ ID NO: 124944 - protein, 9 aa, Homo Sapiens
APVLFAKAA

SEQ ID NO: 124945 - protein, 9 aa, Homo Sapiens
APVLLPSAA

SEQ ID NO: 124946 - protein, 9 aa, Homo Sapiens
APVLPHTAV

SEQ ID NO: 124947 - protein, 9 aa, Homo Sapiens
APVNVTTEV

SEQ ID NO: 124948 - protein, 9 aa, Homo Sapiens
APVPGIPTA

SEQ ID NO: 124949 - protein, 9 aa, Homo Sapiens
APVPTAPAA

SEQ ID NO: 124950 - protein, 9 aa, Homo Sapiens
APVRVGTQA

SEQ ID NO: 124951 - protein, 9 aa, Homo Sapiens
APYAVGREA

SEQ ID NO: 124952 - protein, 9 aa, Homo Sapiens
APYGGPIAL

SEQ ID NO: 124953 - protein, 9 aa, Homo Sapiens
APYGTLGAV

SEQ ID NO: 124954 - protein, 9 aa, Homo Sapiens
APYPGFLSV

SEQ ID NO: 124955 - protein, 9 aa, Homo Sapiens
APYTHFTQA

SEQ ID NO: 124956 - protein, 9 aa, Homo Sapiens
APYVTFPVA

SEQ ID NO: 124957 - protein, 9 aa, Homo Sapiens
ASAPPGPPA

SEQ ID NO: 124958 - protein, 9 aa, Homo Sapiens
AVAPPSTSA

SEQ ID NO: 124959 - protein, 9 aa, Homo Sapiens
AVKFPSKSA

SEQ ID NO: 124960 - protein, 9 aa, Homo Sapiens
AVKPLGPTA

SEQ ID NO: 124961 - protein, 9 aa, Homo Sapiens
AVRIPGGPA

SEQ ID NO: 124962 - protein, 9 aa, Homo Sapiens
CPMAGTPKA

SEQ ID NO: 124963 - protein, 9 aa, Homo Sapiens
EAIGKIPAA

SEQ ID NO: 124964 - protein, 9 aa, Homo Sapiens
EPGEDFPAA

SEQ ID NO: 124965 - protein, 9 aa, Homo Sapiens
EPSAGIPKV

SEQ ID NO: 124966 - protein, 9 aa, Homo Sapiens
FPAPILRAV

SEQ ID NO: 124967 - protein, 9 aa, Homo Sapiens
FPHLRVLEA

SEQ ID NO: 124968 - protein, 9 aa, Homo Sapiens
FPKHVIECA

SEQ ID NO: 124969 - protein, 9 aa, Homo Sapiens
FPLQPGKVA

SEQ ID NO: 124970 - protein, 9 aa, Homo Sapiens
FPMPLPRKA

SEQ ID NO: 124971 - protein, 9 aa, Homo Sapiens
FPRPVTVEP

SEQ ID NO: 124972 - protein, 9 aa, Homo Sapiens
FPRTPARSV

SEQ ID NO: 124973 - protein, 9 aa, Homo Sapiens
FPSSAFLRA

SEQ ID NO: 124974 - protein, 9 aa, Homo Sapiens
FPVGKGLAA

SEQ ID NO: 124975 - protein, 9 aa, Homo Sapiens
FPVRLLVAA

SEQ ID NO: 124976 - protein, 9 aa, Homo Sapiens
FPYMTHPSV

SEQ ID NO: 124977 - protein, 9 aa, Homo Sapiens
GPALRVPVA

SEQ ID NO: 124978 - protein, 9 aa, Homo Sapiens
GPHAGKLVA

SEQ ID NO: 124979 - protein, 9 aa, Homo Sapiens
GPLPMHPAA

SEQ ID NO: 124980 - protein, 9 aa, Homo Sapiens
GPRLSAEAA

SEQ ID NO: 124981 - protein, 9 aa, Homo Sapiens
GPSGCLVPA

SEQ ID NO: 124982 - protein, 9 aa, Homo Sapiens
GPYKIILTA

SEQ ID NO: 124983 - protein, 9 aa, Homo Sapiens
GPYRAFRVA

SEQ ID NO: 124984 - protein, 9 aa, Homo Sapiens
HPAPVRGPP

SEQ ID NO: 124985 - protein, 9 aa, Homo Sapiens
HPARLTIEA

SEQ ID NO: 124986 - protein, 9 aa, Homo Sapiens
HPFERIATP

SEQ ID NO: 124987 - protein, 9 aa, Homo Sapiens
HPHPFLNSV

SEQ ID NO: 124988 - protein, 9 aa, Homo Sapiens
HPIDDLQSA

SEQ ID NO: 124989 - protein, 9 aa, Homo Sapiens
HPIHIIPAS

SEQ ID NO: 124990 - protein, 9 aa, Homo Sapiens
HPITAKAIA

SEQ ID NO: 124991 - protein, 9 aa, Homo Sapiens
HPKKPGPSL

SEQ ID NO: 124992 - protein, 9 aa, Homo Sapiens
HPKKPGVGV

SEQ ID NO: 124993 - protein, 9 aa, Homo Sapiens
HPKPEGLAA

SEQ ID NO: 124994 - protein, 9 aa, Homo Sapiens
HPKTGRISV

SEQ ID NO: 124995 - protein, 9 aa, Homo Sapiens
HPLPIWTPA

SEQ ID NO: 124996 - protein, 9 aa, Homo Sapiens
HPLSSCLTA

SEQ ID NO: 124997 - protein, 9 aa, Homo Sapiens
HPMAYQLQL

SEQ ID NO: 124998 - protein, 9 aa, Homo Sapiens
HPMPVLPKA

SEQ ID NO: 124999 - protein, 9 aa, Homo Sapiens
HPNNQKLMA

SEQ ID NO: 125000 - protein, 9 aa, Homo Sapiens
HPNQQHVVA

SEQ ID NO: 125001 - protein, 9 aa, Homo Sapiens
HPRLRPQSA

SEQ ID NO: 125002 - protein, 9 aa, Homo Sapiens
HPRTSITVV

SEQ ID NO: 125003 - protein, 9 aa, Homo Sapiens
HPSPVVLKV

SEQ ID NO: 125004 - protein, 9 aa, Homo Sapiens
HPSQELLAS

SEQ ID NO: 125005 - protein, 9 aa, Homo Sapiens
HPSTEHMVA

SEQ ID NO: 125006 - protein, 9 aa, Homo Sapiens
HPTWALKEA

SEQ ID NO: 125007 - protein, 9 aa, Homo Sapiens
HPVAKILHA

SEQ ID NO: 125008 - protein, 9 aa, Homo Sapiens
HPWLFIEEA

SEQ ID NO: 125009 - protein, 9 aa, Homo Sapiens
HPYGHQPTA

SEQ ID NO: 125010 - protein, 9 aa, Homo Sapiens
HPYKHSFRA

SEQ ID NO: 125011 - protein, 9 aa, Homo Sapiens
HPYLFPVAA

SEQ ID NO: 125012 - protein, 9 aa, Homo Sapiens
HPYLPINSA

SEQ ID NO: 125013 - protein, 9 aa, Homo Sapiens
HPYPPGPGV

SEQ ID NO: 125014 - protein, 9 aa, Homo Sapiens
HPYQRIVTA

SEQ ID NO: 125015 - protein, 9 aa, Homo Sapiens
HPYRLILTV

SEQ ID NO: 125016 - protein, 9 aa, Homo Sapiens
IAHTPGVAA

SEQ ID NO: 125017 - protein, 9 aa, Homo Sapiens
IIKEVLLEA

SEQ ID NO: 125018 - protein, 9 aa, Homo Sapiens
IIKHIGTSA

SEQ ID NO: 125019 - protein, 9 aa, Homo Sapiens
IITKDSHAL

SEQ ID NO: 125020 - protein, 9 aa, Homo Sapiens
INKKEGICA

SEQ ID NO: 125021 - protein, 9 aa, Homo Sapiens
IPAALPVAA

SEQ ID NO: 125022 - protein, 9 aa, Homo Sapiens
IPATPGIGA

SEQ ID NO: 125023 - protein, 9 aa, Homo Sapiens
IPFGITEEA

SEQ ID NO: 125024 - protein, 9 aa, Homo Sapiens
IPFWRNTAV

SEQ ID NO: 125025 - protein, 9 aa, Homo Sapiens
IPFYGILGA

SEQ ID NO: 125026 - protein, 9 aa, Homo Sapiens
IPHKKFTFA

SEQ ID NO: 125027 - protein, 9 aa, Homo Sapiens
IPHLVTHDA

SEQ ID NO: 125028 - protein, 9 aa, Homo Sapiens
IPHPLIMGV

SEQ ID NO: 125029 - protein, 9 aa, Homo Sapiens
IPIGGGTSV

SEQ ID NO: 125030 - protein, 9 aa, Homo Sapiens
IPISPISPA

SEQ ID NO: 125031 - protein, 9 aa, Homo Sapiens
IPKDKSWKA

SEQ ID NO: 125032 - protein, 9 aa, Homo Sapiens
IPKDYKTMA

SEQ ID NO: 125033 - protein, 9 aa, Homo Sapiens
IPKGLIRSA

SEQ ID NO: 125034 - protein, 9 aa, Homo Sapiens
IPKHINPVA

SEQ ID NO: 125035 - protein, 9 aa, Homo Sapiens
IPKKGFVEV

SEQ ID NO: 125036 - protein, 9 aa, Homo Sapiens
IPKKHISQI

SEQ ID NO: 125037 - protein, 9 aa, Homo Sapiens
IPKKLMHQA

SEQ ID NO: 125038 - protein, 9 aa, Homo Sapiens
IPKKMSHMA

SEQ ID NO: 125039 - protein, 9 aa, Homo Sapiens
IPKPEFPRA

SEQ ID NO: 125040 - protein, 9 aa, Homo Sapiens
IPKPEQLSA

SEQ ID NO: 125041 - protein, 9 aa, Homo Sapiens
IPKSFMISA

SEQ ID NO: 125042 - protein, 9 aa, Homo Sapiens
IPKYPTNPP

SEQ ID NO: 125043 - protein, 9 aa, Homo Sapiens
IPLDKRLAA

SEQ ID NO: 125044 - protein, 9 aa, Homo Sapiens
IPLGFGVAA

SEQ ID NO: 125045 - protein, 9 aa, Homo Sapiens
IPLKEMPAV

SEQ ID NO: 125046 - protein, 9 aa, Homo Sapiens
IPLPLEPQV

SEQ ID NO: 125047 - protein, 9 aa, Homo Sapiens
IPMRDFVCA

SEQ ID NO: 125048 - protein, 9 aa, Homo Sapiens
IPNFPRSTV

SEQ ID NO: 125049 - protein, 9 aa, Homo Sapiens
IPNNVKTAV

SEQ ID NO: 125050 - protein, 9 aa, Homo Sapiens
IPQKFHRSV

SEQ ID NO: 125051 - protein, 9 aa, Homo Sapiens
IPQKPSQPA

SEQ ID NO: 125052 - protein, 9 aa, Homo Sapiens
IPQNQKAIA

SEQ ID NO: 125053 - protein, 9 aa, Homo Sapiens
IPRQLGEVA

SEQ ID NO: 125054 - protein, 9 aa, Homo Sapiens
IPRSFLQEA

SEQ ID NO: 125055 - protein, 9 aa, Homo Sapiens
IPRSFMMEV

SEQ ID NO: 125056 - protein, 9 aa, Homo Sapiens
IPSGTILKA

SEQ ID NO: 125057 - protein, 9 aa, Homo Sapiens
IPTENSMTA

SEQ ID NO: 125058 - protein, 9 aa, Homo Sapiens
IPVGKSPMV

SEQ ID NO: 125059 - protein, 9 aa, Homo Sapiens
IPVIRPRAF

SEQ ID NO: 125060 - protein, 9 aa, Homo Sapiens
IPVKSSPQA

SEQ ID NO: 125061 - protein, 9 aa, Homo Sapiens
IPVNGGLAA

SEQ ID NO: 125062 - protein, 9 aa, Homo Sapiens
IPWGISATA

SEQ ID NO: 125063 - protein, 9 aa, Homo Sapiens
IPYAHSPSV

SEQ ID NO: 125064 - protein, 9 aa, Homo Sapiens
IPYGMRFIA

SEQ ID NO: 125065 - protein, 9 aa, Homo Sapiens
IPYHIVNIV

SEQ ID NO: 125066 - protein, 9 aa, Homo Sapiens
IPYPRPIHL

SEQ ID NO: 125067 - protein, 9 aa, Homo Sapiens
IPYQDLPHL

SEQ ID NO: 125068 - protein, 9 aa, Homo Sapiens
IPYQPMPAS

SEQ ID NO: 125069 - protein, 9 aa, Homo Sapiens
IPYRVIHNA

SEQ ID NO: 125070 - protein, 9 aa, Homo Sapiens
ITAPPGTAA

SEQ ID NO: 125071 - protein, 9 aa, Homo Sapiens
IVKPISRGA

SEQ ID NO: 125072 - protein, 9 aa, Homo Sapiens
IVKPVKVSA

SEQ ID NO: 125073 - protein, 9 aa, Homo Sapiens
KAIDYYLKA

SEQ ID NO: 125074 - protein, 9 aa, Homo Sapiens
KAKKPALVA

SEQ ID NO: 125075 - protein, 9 aa, Homo Sapiens
KGYFFPTSA

SEQ ID NO: 125076 - protein, 9 aa, Homo Sapiens
KLKPGGVGA

SEQ ID NO: 125077 - protein, 9 aa, Homo Sapiens
KPAESLPVI

SEQ ID NO: 125078 - protein, 9 aa, Homo Sapiens
KPAKQQPKL

SEQ ID NO: 125079 - protein, 9 aa, Homo Sapiens
KPALKIPQT

SEQ ID NO: 125080 - protein, 9 aa, Homo Sapiens
KPAMPMQQA

SEQ ID NO: 125081 - protein, 9 aa, Homo Sapiens
KPAMPRSVV

SEQ ID NO: 125082 - protein, 9 aa, Homo Sapiens
KPANVFITA

SEQ ID NO: 125083 - protein, 9 aa, Homo Sapiens
KPAPKVSAA

SEQ ID NO: 125084 - protein, 9 aa, Homo Sapiens
KPAPPFNVT

SEQ ID NO: 125085 - protein, 9 aa, Homo Sapiens
KPASRVLVA

SEQ ID NO: 125086 - protein, 9 aa, Homo Sapiens
KPAVPTVAS

SEQ ID NO: 125087 - protein, 9 aa, Homo Sapiens
KPEEGFRTA

SEQ ID NO: 125088 - protein, 9 aa, Homo Sapiens
KPFAYVSEA

SEQ ID NO: 125089 - protein, 9 aa, Homo Sapiens
KPFCAAAAA

SEQ ID NO: 125090 - protein, 9 aa, Homo Sapiens
KPFKEFVEA

SEQ ID NO: 125091 - protein, 9 aa, Homo Sapiens
KPFLLPVEA

SEQ ID NO: 125092 - protein, 9 aa, Homo Sapiens
KPFQEYLEA

SEQ ID NO: 125093 - protein, 9 aa, Homo Sapiens
KPGLRPRTA

SEQ ID NO: 125094 - protein, 9 aa, Homo Sapiens
KPHAIIILP

SEQ ID NO: 125095 - protein, 9 aa, Homo Sapiens
KPHPVTVTT

SEQ ID NO: 125096 - protein, 9 aa, Homo Sapiens
KPHSGFHVA

SEQ ID NO: 125097 - protein, 9 aa, Homo Sapiens
KPIFSLNTV

SEQ ID NO: 125098 - protein, 9 aa, Homo Sapiens
KPIVQIAVI

SEQ ID NO: 125099 - protein, 9 aa, Homo Sapiens
KPKAPPPSL

SEQ ID NO: 125100 - protein, 9 aa, Homo Sapiens
KPKEPPKVP

SEQ ID NO: 125101 - protein, 9 aa, Homo Sapiens
KPKEPQPEV

SEQ ID NO: 125102 - protein, 9 aa, Homo Sapiens
KPKIFIIQA

SEQ ID NO: 125103 - protein, 9 aa, Homo Sapiens
KPKIPKGVS

SEQ ID NO: 125104 - protein, 9 aa, Homo Sapiens
KPKITPVTV

SEQ ID NO: 125105 - protein, 9 aa, Homo Sapiens
KPKKPGKYI

SEQ ID NO: 125106 - protein, 9 aa, Homo Sapiens
KPKPIGKLA

SEQ ID NO: 125107 - protein, 9 aa, Homo Sapiens
KPKPPPVRA

SEQ ID NO: 125108 - protein, 9 aa, Homo Sapiens
KPKQPPKPP

SEQ ID NO: 125109 - protein, 9 aa, Homo Sapiens
KPKSLWKSV

SEQ ID NO: 125110 - protein, 9 aa, Homo Sapiens
KPKSSLPAV

SEQ ID NO: 125111 - protein, 9 aa, Homo Sapiens
KPKVIIIQA

SEQ ID NO: 125112 - protein, 9 aa, Homo Sapiens
KPKVPLKSA

SEQ ID NO: 125113 - protein, 9 aa, Homo Sapiens
KPLEKPLKL

SEQ ID NO: 125114 - protein, 9 aa, Homo Sapiens
KPLEPVSTV

SEQ ID NO: 125115 - protein, 9 aa, Homo Sapiens
KPLGKSPQV

SEQ ID NO: 125116 - protein, 9 aa, Homo Sapiens
KPLKEFVEA

SEQ ID NO: 125117 - protein, 9 aa, Homo Sapiens
KPLKGARIA

SEQ ID NO: 125118 - protein, 9 aa, Homo Sapiens
KPLPPIQVA

SEQ ID NO: 125119 - protein, 9 aa, Homo Sapiens
KPLQPARPV

SEQ ID NO: 125120 - protein, 9 aa, Homo Sapiens
KPLYLARVT

SEQ ID NO: 125121 - protein, 9 aa, Homo Sapiens
KPMEGWIAV

SEQ ID NO: 125122 - protein, 9 aa, Homo Sapiens
KPMEIARIV

SEQ ID NO: 125123 - protein, 9 aa, Homo Sapiens
KPMEKLLGL

SEQ ID NO: 125124 - protein, 9 aa, Homo Sapiens
KPMKSVLVV

SEQ ID NO: 125125 - protein, 9 aa, Homo Sapiens
KPMNEYRSV

SEQ ID NO: 125126 - protein, 9 aa, Homo Sapiens
KPNKPLILA

SEQ ID NO: 125127 - protein, 9 aa, Homo Sapiens
KPPAILPVA

SEQ ID NO: 125128 - protein, 9 aa, Homo Sapiens
KPPPPPPAP

SEQ ID NO: 125129 - protein, 9 aa, Homo Sapiens
KPQANVPSA

SEQ ID NO: 125130 - protein, 9 aa, Homo Sapiens
KPQATVVSA

SEQ ID NO: 125131 - protein, 9 aa, Homo Sapiens
KPQPSILQA

SEQ ID NO: 125132 - protein, 9 aa, Homo Sapiens
KPQRGMPKV

SEQ ID NO: 125133 - protein, 9 aa, Homo Sapiens
KPRPPPPPP

SEQ ID NO: 125134 - protein, 9 aa, Homo Sapiens
KPRPVSQLV

SEQ ID NO: 125135 - protein, 9 aa, Homo Sapiens
KPTGGLPET

SEQ ID NO: 125136 - protein, 9 aa, Homo Sapiens
KPTHFTVNA

SEQ ID NO: 125137 - protein, 9 aa, Homo Sapiens
KPVAIFKTP

SEQ ID NO: 125138 - protein, 9 aa, Homo Sapiens
KPVEAAVVA

SEQ ID NO: 125139 - protein, 9 aa, Homo Sapiens
KPVEVTESA

SEQ ID NO: 125140 - protein, 9 aa, Homo Sapiens
KPYCNEIHA

SEQ ID NO: 125141 - protein, 9 aa, Homo Sapiens
KPYEKVRIY

SEQ ID NO: 125142 - protein, 9 aa, Homo Sapiens
KPYESYIGA

SEQ ID NO: 125143 - protein, 9 aa, Homo Sapiens
KPYNVYITV

SEQ ID NO: 125144 - protein, 9 aa, Homo Sapiens
KPYPNSEAA

SEQ ID NO: 125145 - protein, 9 aa, Homo Sapiens
KPYTLMSMV

SEQ ID NO: 125146 - protein, 9 aa, Homo Sapiens
LAAARLAAA

SEQ ID NO: 125147 - protein, 9 aa, Homo Sapiens
LAAGPSAAA

SEQ ID NO: 125148 - protein, 9 aa, Homo Sapiens
LAGPLRPAA

SEQ ID NO: 125149 - protein, 9 aa, Homo Sapiens
LAHAAFSAA

SEQ ID NO: 125150 - protein, 9 aa, Homo Sapiens
LAKAVATEA

SEQ ID NO: 125151 - protein, 9 aa, Homo Sapiens
LARPAALTA

SEQ ID NO: 125152 - protein, 9 aa, Homo Sapiens
LARPPSGRA

SEQ ID NO: 125153 - protein, 9 aa, Homo Sapiens
LGLPHNQLA

SEQ ID NO: 125154 - protein, 9 aa, Homo Sapiens
LHPAPPNGL

SEQ ID NO: 125155 - protein, 9 aa, Homo Sapiens
LIKPESKVA

SEQ ID NO: 125156 - protein, 9 aa, Homo Sapiens
LIYGTPRAA

SEQ ID NO: 125157 - protein, 9 aa, Homo Sapiens
LLKERGISA

SEQ ID NO: 125158 - protein, 9 aa, Homo Sapiens
LLRGVGAAA

SEQ ID NO: 125159 - protein, 9 aa, Homo Sapiens
LNRLPGAAA

SEQ ID NO: 125160 - protein, 9 aa, Homo Sapiens
LPAEAVEAA

SEQ ID NO: 125161 - protein, 9 aa, Homo Sapiens
LPAGILPMV

SEQ ID NO: 125162 - protein, 9 aa, Homo Sapiens
LPAPPAVSA

SEQ ID NO: 125163 - protein, 9 aa, Homo Sapiens
LPASETPKA

SEQ ID NO: 125164 - protein, 9 aa, Homo Sapiens
LPATSIPTP

SEQ ID NO: 125165 - protein, 9 aa, Homo Sapiens
LPCEVKVVA

SEQ ID NO: 125166 - protein, 9 aa, Homo Sapiens
LPCFNGRVV

SEQ ID NO: 125167 - protein, 9 aa, Homo Sapiens
LPDGRIIKV

SEQ ID NO: 125168 - protein, 9 aa, Homo Sapiens
LPFDHSRVI

SEQ ID NO: 125169 - protein, 9 aa, Homo Sapiens
LPFRVIPLV

SEQ ID NO: 125170 - protein, 9 aa, Homo Sapiens
LPFSSMPTA

SEQ ID NO: 125171 - protein, 9 aa, Homo Sapiens
LPHGFTNMA

SEQ ID NO: 125172 - protein, 9 aa, Homo Sapiens
LPHHRVIEV

SEQ ID NO: 125173 - protein, 9 aa, Homo Sapiens
LPHKIHYAA

SEQ ID NO: 125174 - protein, 9 aa, Homo Sapiens
LPHPGLKVA

SEQ ID NO: 125175 - protein, 9 aa, Homo Sapiens
LPHPYAIAV

SEQ ID NO: 125176 - protein, 9 aa, Homo Sapiens
LPHSAGRYA

SEQ ID NO: 125177 - protein, 9 aa, Homo Sapiens
LPKDQQITA

SEQ ID NO: 125178 - protein, 9 aa, Homo Sapiens
LPKEKQPVA

SEQ ID NO: 125179 - protein, 9 aa, Homo Sapiens
LPKINSHPT

SEQ ID NO: 125180 - protein, 9 aa, Homo Sapiens
LPKIPSNAT

SEQ ID NO: 125181 - protein, 9 aa, Homo Sapiens
LPKPGFLGA

SEQ ID NO: 125182 - protein, 9 aa, Homo Sapiens
LPKPHGIRA

SEQ ID NO: 125183 - protein, 9 aa, Homo Sapiens
LPKPPGRGV

SEQ ID NO: 125184 - protein, 9 aa, Homo Sapiens
LPKPPKPVS

SEQ ID NO: 125185 - protein, 9 aa, Homo Sapiens
LPKPVQKPP

SEQ ID NO: 125186 - protein, 9 aa, Homo Sapiens
LPKSTVNGV

SEQ ID NO: 125187 - protein, 9 aa, Homo Sapiens
LPLGRKKGA

SEQ ID NO: 125188 - protein, 9 aa, Homo Sapiens
LPLGSRPAP

SEQ ID NO: 125189 - protein, 9 aa, Homo Sapiens
LPLLARPAA

SEQ ID NO: 125190 - protein, 9 aa, Homo Sapiens
LPLSLLKTA

SEQ ID NO: 125191 - protein, 9 aa, Homo Sapiens
LPMDYVQRV

SEQ ID NO: 125192 - protein, 9 aa, Homo Sapiens
LPMTDKRVA

SEQ ID NO: 125193 - protein, 9 aa, Homo Sapiens
LPNAVITRI

SEQ ID NO: 125194 - protein, 9 aa, Homo Sapiens
LPNQTVLKI

SEQ ID NO: 125195 - protein, 9 aa, Homo Sapiens
LPPKDGKVA

SEQ ID NO: 125196 - protein, 9 aa, Homo Sapiens
LPQGPMQNA

SEQ ID NO: 125197 - protein, 9 aa, Homo Sapiens
LPRDRQVVA

SEQ ID NO: 125198 - protein, 9 aa, Homo Sapiens
LPRDVLTRA

SEQ ID NO: 125199 - protein, 9 aa, Homo Sapiens
LPRGFPPSA

SEQ ID NO: 125200 - protein, 9 aa, Homo Sapiens
LPRKPVAGA

SEQ ID NO: 125201 - protein, 9 aa, Homo Sapiens
LPRLDTGTA

SEQ ID NO: 125202 - protein, 9 aa, Homo Sapiens
LPRPQGAAA

SEQ ID NO: 125203 - protein, 9 aa, Homo Sapiens
LPRPVPLVA

SEQ ID NO: 125204 - protein, 9 aa, Homo Sapiens
LPRRPLPPA

SEQ ID NO: 125205 - protein, 9 aa, Homo Sapiens
LPSSHALEA

SEQ ID NO: 125206 - protein, 9 aa, Homo Sapiens
LPSSLKRIA

SEQ ID NO: 125207 - protein, 9 aa, Homo Sapiens
LPSVPLSCA

SEQ ID NO: 125208 - protein, 9 aa, Homo Sapiens
LPTIRVPKA

SEQ ID NO: 125209 - protein, 9 aa, Homo Sapiens
LPVGPGRRA

SEQ ID NO: 125210 - protein, 9 aa, Homo Sapiens
LPWPGGSAA

SEQ ID NO: 125211 - protein, 9 aa, Homo Sapiens
LPWQGLKAA

SEQ ID NO: 125212 - protein, 9 aa, Homo Sapiens
LPYAITIVA

SEQ ID NO: 125213 - protein, 9 aa, Homo Sapiens
LPYDIPHRA

SEQ ID NO: 125214 - protein, 9 aa, Homo Sapiens
LPYHHVIHA

SEQ ID NO: 125215 - protein, 9 aa, Homo Sapiens
LPYHISSTA

SEQ ID NO: 125216 - protein, 9 aa, Homo Sapiens
LPYKWVVEA

SEQ ID NO: 125217 - protein, 9 aa, Homo Sapiens
LPYLGVHGA

SEQ ID NO: 125218 - protein, 9 aa, Homo Sapiens
LPYNGVTVA

SEQ ID NO: 125219 - protein, 9 aa, Homo Sapiens
LPYNGVVLA

SEQ ID NO: 125220 - protein, 9 aa, Homo Sapiens
LPYSDFPRP

SEQ ID NO: 125221 - protein, 9 aa, Homo Sapiens
LTKDRGVAA

SEQ ID NO: 125222 - protein, 9 aa, Homo Sapiens
LTKPAALAA

SEQ ID NO: 125223 - protein, 9 aa, Homo Sapiens
LVAPPLPAA

SEQ ID NO: 125224 - protein, 9 aa, Homo Sapiens
LVASVRVPA

SEQ ID NO: 125225 - protein, 9 aa, Homo Sapiens
LVGPVLGAA

SEQ ID NO: 125226 - protein, 9 aa, Homo Sapiens
LVKDVFISA

SEQ ID NO: 125227 - protein, 9 aa, Homo Sapiens
LVRPPTEQA

SEQ ID NO: 125228 - protein, 9 aa, Homo Sapiens
MAKPPGSLA

SEQ ID NO: 125229 - protein, 9 aa, Homo Sapiens
MAPLKMLAL

SEQ ID NO: 125230 - protein, 9 aa, Homo Sapiens
MAYGSSLAA

SEQ ID NO: 125231 - protein, 9 aa, Homo Sapiens
MPAAALNAA

SEQ ID NO: 125232 - protein, 9 aa, Homo Sapiens
MPADSGYPA

SEQ ID NO: 125233 - protein, 9 aa, Homo Sapiens
MPAFPLPYA

SEQ ID NO: 125234 - protein, 9 aa, Homo Sapiens
MPAGLIAGA

SEQ ID NO: 125235 - protein, 9 aa, Homo Sapiens
MPAGSFITA

SEQ ID NO: 125236 - protein, 9 aa, Homo Sapiens
MPAGTKLIA

SEQ ID NO: 125237 - protein, 9 aa, Homo Sapiens
MPAHFSDSA

SEQ ID NO: 125238 - protein, 9 aa, Homo Sapiens
MPATLARAA

SEQ ID NO: 125239 - protein, 9 aa, Homo Sapiens
MPFGNVISA

SEQ ID NO: 125240 - protein, 9 aa, Homo Sapiens
MPFGNVVSA

SEQ ID NO: 125241 - protein, 9 aa, Homo Sapiens
MPFPNIRSA

SEQ ID NO: 125242 - protein, 9 aa, Homo Sapiens
MPHSPTLRV

SEQ ID NO: 125243 - protein, 9 aa, Homo Sapiens
MPITGQLSA

SEQ ID NO: 125244 - protein, 9 aa, Homo Sapiens
MPKAEKNAV

SEQ ID NO: 125245 - protein, 9 aa, Homo Sapiens
MPKYAPKAA

SEQ ID NO: 125246 - protein, 9 aa, Homo Sapiens
MPLLKSEVA

SEQ ID NO: 125247 - protein, 9 aa, Homo Sapiens
MPLSTIREV

SEQ ID NO: 125248 - protein, 9 aa, Homo Sapiens
MPNPSLAQV

SEQ ID NO: 125249 - protein, 9 aa, Homo Sapiens
MPPLPGRAA

SEQ ID NO: 125250 - protein, 9 aa, Homo Sapiens
MPPPVGMVA

SEQ ID NO: 125251 - protein, 9 aa, Homo Sapiens
MPQDLRSPA

SEQ ID NO: 125252 - protein, 9 aa, Homo Sapiens
MPRDILIVV

SEQ ID NO: 125253 - protein, 9 aa, Homo Sapiens
MPRHRFMSA

SEQ ID NO: 125254 - protein, 9 aa, Homo Sapiens
MPRRNFPIA

SEQ ID NO: 125255 - protein, 9 aa, Homo Sapiens
MPSSVPLRA

SEQ ID NO: 125256 - protein, 9 aa, Homo Sapiens
MPVENGLRA

SEQ ID NO: 125257 - protein, 9 aa, Homo Sapiens
MPVERILEA

SEQ ID NO: 125258 - protein, 9 aa, Homo Sapiens
MPVGLIAGA

SEQ ID NO: 125259 - protein, 9 aa, Homo Sapiens
MPVPAQPKA

SEQ ID NO: 125260 - protein, 9 aa, Homo Sapiens
MPWYQRRIA

SEQ ID NO: 125261 - protein, 9 aa, Homo Sapiens
MPYFLLTQA

SEQ ID NO: 125262 - protein, 9 aa, Homo Sapiens
MPYLIGVHA

SEQ ID NO: 125263 - protein, 9 aa, Homo Sapiens
MPYSGMTGA

SEQ ID NO: 125264 - protein, 9 aa, Homo Sapiens
MVLPRKPVA

SEQ ID NO: 125265 - protein, 9 aa, Homo Sapiens
NPAIFRLIA

SEQ ID NO: 125266 - protein, 9 aa, Homo Sapiens
NPAPPIDAV

SEQ ID NO: 125267 - protein, 9 aa, Homo Sapiens
NPFGGASHA

SEQ ID NO: 125268 - protein, 9 aa, Homo Sapiens
NPFKGSSGA

SEQ ID NO: 125269 - protein, 9 aa, Homo Sapiens
NPFRSKLAA

SEQ ID NO: 125270 - protein, 9 aa, Homo Sapiens
NPLSTTSSA

SEQ ID NO: 125271 - protein, 9 aa, Homo Sapiens
NPMVVANAV

SEQ ID NO: 125272 - protein, 9 aa, Homo Sapiens
NPTQFVPAA

SEQ ID NO: 125273 - protein, 9 aa, Homo Sapiens
NPVTGLLSA

SEQ ID NO: 125274 - protein, 9 aa, Homo Sapiens
NPYATLPRA

SEQ ID NO: 125275 - protein, 9 aa, Homo Sapiens
NPYHNAVHA

SEQ ID NO: 125276 - protein, 9 aa, Homo Sapiens
NPYTIFHQA

SEQ ID NO: 125277 - protein, 9 aa, Homo Sapiens
NPYYGGESA

SEQ ID NO: 125278 - protein, 9 aa, Homo Sapiens
PHPATGKTV

SEQ ID NO: 125279 - protein, 9 aa, Homo Sapiens
PHSAGRYAA

SEQ ID NO: 125280 - protein, 9 aa, Homo Sapiens
PITPRAAPL

SEQ ID NO: 125281 - protein, 9 aa, Homo Sapiens
QPAPAIHSA

SEQ ID NO: 125282 - protein, 9 aa, Homo Sapiens
QPFAVPHSA

SEQ ID NO: 125283 - protein, 9 aa, Homo Sapiens
QPGASGMVA

SEQ ID NO: 125284 - protein, 9 aa, Homo Sapiens
QPHHIGVAV

SEQ ID NO: 125285 - protein, 9 aa, Homo Sapiens
QPHSSALTA

SEQ ID NO: 125286 - protein, 9 aa, Homo Sapiens
QPHVNGRLA

SEQ ID NO: 125287 - protein, 9 aa, Homo Sapiens
QPIFAVTSA

SEQ ID NO: 125288 - protein, 9 aa, Homo Sapiens
QPILLELEA

SEQ ID NO: 125289 - protein, 9 aa, Homo Sapiens
QPKEKISKV

SEQ ID NO: 125290 - protein, 9 aa, Homo Sapiens
QPKIHGKQV

SEQ ID NO: 125291 - protein, 9 aa, Homo Sapiens
QPKYPRKSA

SEQ ID NO: 125292 - protein, 9 aa, Homo Sapiens
QPLLPYSAV

SEQ ID NO: 125293 - protein, 9 aa, Homo Sapiens
QPLPATHAA

SEQ ID NO: 125294 - protein, 9 aa, Homo Sapiens
QPLPMAHCA

SEQ ID NO: 125295 - protein, 9 aa, Homo Sapiens
QPNSGLLQA

SEQ ID NO: 125296 - protein, 9 aa, Homo Sapiens
QPRYPVNSV

SEQ ID NO: 125297 - protein, 9 aa, Homo Sapiens
QPSAPGHSV

SEQ ID NO: 125298 - protein, 9 aa, Homo Sapiens
QPSEVLRTV

SEQ ID NO: 125299 - protein, 9 aa, Homo Sapiens
QPSHLMRQV

SEQ ID NO: 125300 - protein, 9 aa, Homo Sapiens
QPSSLLPLA

SEQ ID NO: 125301 - protein, 9 aa, Homo Sapiens
QPSWSIRTA

SEQ ID NO: 125302 - protein, 9 aa, Homo Sapiens
QPTDALLCV

SEQ ID NO: 125303 - protein, 9 aa, Homo Sapiens
QPTPQVPQV

SEQ ID NO: 125304 - protein, 9 aa, Homo Sapiens
QPTPVNIRA

SEQ ID NO: 125305 - protein, 9 aa, Homo Sapiens
QPVPPGRAA

SEQ ID NO: 125306 - protein, 9 aa, Homo Sapiens
QPWRGGAGA

SEQ ID NO: 125307 - protein, 9 aa, Homo Sapiens
QPYMPTVSA

SEQ ID NO: 125308 - protein, 9 aa, Homo Sapiens
QPYNSRPAV

SEQ ID NO: 125309 - protein, 9 aa, Homo Sapiens
QPYQPLREV

SEQ ID NO: 125310 - protein, 9 aa, Homo Sapiens
QPYSKLPGV

SEQ ID NO: 125311 - protein, 9 aa, Homo Sapiens
RAHLPTKEA

SEQ ID NO: 125312 - protein, 9 aa, Homo Sapiens
RAKLVSKIA

SEQ ID NO: 125313 - protein, 9 aa, Homo Sapiens
RIFDRAVAA

SEQ ID NO: 125314 - protein, 9 aa, Homo Sapiens
RIKPPGPTA

SEQ ID NO: 125315 - protein, 9 aa, Homo Sapiens
RLRNHMAVA

SEQ ID NO: 125316 - protein, 9 aa, Homo Sapiens
RPAAPLIGA

SEQ ID NO: 125317 - protein, 9 aa, Homo Sapiens
RPADVIFAT

SEQ ID NO: 125318 - protein, 9 aa, Homo Sapiens
RPADYLFML

SEQ ID NO: 125319 - protein, 9 aa, Homo Sapiens
RPAEKLSTA

SEQ ID NO: 125320 - protein, 9 aa, Homo Sapiens
RPAEPAFLA

SEQ ID NO: 125321 - protein, 9 aa, Homo Sapiens
RPAFVIPEV

SEQ ID NO: 125322 - protein, 9 aa, Homo Sapiens
RPALFSSSA

SEQ ID NO: 125323 - protein, 9 aa, Homo Sapiens
RPAPPPPTV

SEQ ID NO: 125324 - protein, 9 aa, Homo Sapiens
RPAPPRAPA

SEQ ID NO: 125325 - protein, 9 aa, Homo Sapiens
RPAPVAVAA

SEQ ID NO: 125326 - protein, 9 aa, Homo Sapiens
RPAPVLVSA

SEQ ID NO: 125327 - protein, 9 aa, Homo Sapiens
RPDGKLRYA

SEQ ID NO: 125328 - protein, 9 aa, Homo Sapiens
RPDKRFRLA

SEQ ID NO: 125329 - protein, 9 aa, Homo Sapiens
RPEEGRPVV

SEQ ID NO: 125330 - protein, 9 aa, Homo Sapiens
RPEHLGSSA

SEQ ID NO: 125331 - protein, 9 aa, Homo Sapiens
RPFHGISTV

SEQ ID NO: 125332 - protein, 9 aa, Homo Sapiens
RPFIGMSSA

SEQ ID NO: 125333 - protein, 9 aa, Homo Sapiens
RPFQNQTHA

SEQ ID NO: 125334 - protein, 9 aa, Homo Sapiens
RPFQSIIHA

SEQ ID NO: 125335 - protein, 9 aa, Homo Sapiens
RPFRLGTGA

SEQ ID NO: 125336 - protein, 9 aa, Homo Sapiens
RPFTNLESA

SEQ ID NO: 125337 - protein, 9 aa, Homo Sapiens
RPGPVLPAV

SEQ ID NO: 125338 - protein, 9 aa, Homo Sapiens
RPHAPGRPA

SEQ ID NO: 125339 - protein, 9 aa, Homo Sapiens
RPHAPGTPA

SEQ ID NO: 125340 - protein, 9 aa, Homo Sapiens
RPHEGTRPV

SEQ ID NO: 125341 - protein, 9 aa, Homo Sapiens
RPHRGILAV

SEQ ID NO: 125342 - protein, 9 aa, Homo Sapiens
RPIASGPVV

SEQ ID NO: 125343 - protein, 9 aa, Homo Sapiens
RPIDHWDAV

SEQ ID NO: 125344 - protein, 9 aa, Homo Sapiens
RPIDTSRLT

SEQ ID NO: 125345 - protein, 9 aa, Homo Sapiens
RPKFLSKTV

SEQ ID NO: 125346 - protein, 9 aa, Homo Sapiens
RPKGFYVET

SEQ ID NO: 125347 - protein, 9 aa, Homo Sapiens
RPKIGLPGV

SEQ ID NO: 125348 - protein, 9 aa, Homo Sapiens
RPKKPGQSF

SEQ ID NO: 125349 - protein, 9 aa, Homo Sapiens
RPKLGEREV

SEQ ID NO: 125350 - protein, 9 aa, Homo Sapiens
RPKLPDNEV

SEQ ID NO: 125351 - protein, 9 aa, Homo Sapiens
RPKMQEVVA

SEQ ID NO: 125352 - protein, 9 aa, Homo Sapiens
RPKPAPLTA

SEQ ID NO: 125353 - protein, 9 aa, Homo Sapiens
RPKPESQGI

SEQ ID NO: 125354 - protein, 9 aa, Homo Sapiens
RPKPIITSV

SEQ ID NO: 125355 - protein, 9 aa, Homo Sapiens
RPKPKIIQT

SEQ ID NO: 125356 - protein, 9 aa, Homo Sapiens
RPKPLSAVP

SEQ ID NO: 125357 - protein, 9 aa, Homo Sapiens
RPKPPNVRT

SEQ ID NO: 125358 - protein, 9 aa, Homo Sapiens
RPKPSRPTP

SEQ ID NO: 125359 - protein, 9 aa, Homo Sapiens
RPKSAFKVQ

SEQ ID NO: 125360 - protein, 9 aa, Homo Sapiens
RPKSSDVYV

SEQ ID NO: 125361 - protein, 9 aa, Homo Sapiens
RPKTGVRGL

SEQ ID NO: 125362 - protein, 9 aa, Homo Sapiens
RPLAQLREV

SEQ ID NO: 125363 - protein, 9 aa, Homo Sapiens
RPLFPGSTV

SEQ ID NO: 125364 - protein, 9 aa, Homo Sapiens
RPLHEFITA

SEQ ID NO: 125365 - protein, 9 aa, Homo Sapiens
RPLLKAITA

SEQ ID NO: 125366 - protein, 9 aa, Homo Sapiens
RPLQDEPAA

SEQ ID NO: 125367 - protein, 9 aa, Homo Sapiens
RPLTLFHTV

SEQ ID NO: 125368 - protein, 9 aa, Homo Sapiens
RPLVKPKIV

SEQ ID NO: 125369 - protein, 9 aa, Homo Sapiens
RPLVSTQPA

SEQ ID NO: 125370 - protein, 9 aa, Homo Sapiens
RPMKVGHVT

SEQ ID NO: 125371 - protein, 9 aa, Homo Sapiens
RPMSHYTTP

SEQ ID NO: 125372 - protein, 9 aa, Homo Sapiens
RPNDIMAEV

SEQ ID NO: 125373 - protein, 9 aa, Homo Sapiens
RPNLIKPAA

SEQ ID NO: 125374 - protein, 9 aa, Homo Sapiens
RPNPPPVSV

SEQ ID NO: 125375 - protein, 9 aa, Homo Sapiens
RPNWSKLVA

SEQ ID NO: 125376 - protein, 9 aa, Homo Sapiens
RPPLNPVSA

SEQ ID NO: 125377 - protein, 9 aa, Homo Sapiens
RPQELPRLA

SEQ ID NO: 125378 - protein, 9 aa, Homo Sapiens
RPQSETNVA

SEQ ID NO: 125379 - protein, 9 aa, Homo Sapiens
RPRAPIIAV

SEQ ID NO: 125380 - protein, 9 aa, Homo Sapiens
RPRDSQLYA

SEQ ID NO: 125381 - protein, 9 aa, Homo Sapiens
RPRFVSLRA

SEQ ID NO: 125382 - protein, 9 aa, Homo Sapiens
RPRGPPPPP

SEQ ID NO: 125383 - protein, 9 aa, Homo Sapiens
RPRHQGVMV

SEQ ID NO: 125384 - protein, 9 aa, Homo Sapiens
RPRPGRNPP

SEQ ID NO: 125385 - protein, 9 aa, Homo Sapiens
RPRPGTGLG

SEQ ID NO: 125386 - protein, 9 aa, Homo Sapiens
RPRPPPAAP

SEQ ID NO: 125387 - protein, 9 aa, Homo Sapiens
RPRPSWITT

SEQ ID NO: 125388 - protein, 9 aa, Homo Sapiens
RPRPTEATV

SEQ ID NO: 125389 - protein, 9 aa, Homo Sapiens
RPRPTTVTA

SEQ ID NO: 125390 - protein, 9 aa, Homo Sapiens
RPRPVVTTT

SEQ ID NO: 125391 - protein, 9 aa, Homo Sapiens
RPSFVHPGA

SEQ ID NO: 125392 - protein, 9 aa, Homo Sapiens
RPSPAISVS

SEQ ID NO: 125393 - protein, 9 aa, Homo Sapiens
RPSPAPPAA

SEQ ID NO: 125394 - protein, 9 aa, Homo Sapiens
RPSPPVQSV

SEQ ID NO: 125395 - protein, 9 aa, Homo Sapiens
RPSTLFSAA

SEQ ID NO: 125396 - protein, 9 aa, Homo Sapiens
RPTGGVGAV

SEQ ID NO: 125397 - protein, 9 aa, Homo Sapiens
RPVDPIRAA

SEQ ID NO: 125398 - protein, 9 aa, Homo Sapiens
RPVGGGPSA

SEQ ID NO: 125399 - protein, 9 aa, Homo Sapiens
RPVLPRTEA

SEQ ID NO: 125400 - protein, 9 aa, Homo Sapiens
RPVQRLPSV

SEQ ID NO: 125401 - protein, 9 aa, Homo Sapiens
RPVTPPRTA

SEQ ID NO: 125402 - protein, 9 aa, Homo Sapiens
RPWAQVLKA

SEQ ID NO: 125403 - protein, 9 aa, Homo Sapiens
RPWHKTVTI

SEQ ID NO: 125404 - protein, 9 aa, Homo Sapiens
RPWKAYLSA

SEQ ID NO: 125405 - protein, 9 aa, Homo Sapiens
RPWKGVLMV

SEQ ID NO: 125406 - protein, 9 aa, Homo Sapiens
RPWLRPAAL

SEQ ID NO: 125407 - protein, 9 aa, Homo Sapiens
RPWPNPNSA

SEQ ID NO: 125408 - protein, 9 aa, Homo Sapiens
RPYDKHISP

SEQ ID NO: 125409 - protein, 9 aa, Homo Sapiens
RPYDKNISP

SEQ ID NO: 125410 - protein, 9 aa, Homo Sapiens
RPYEPINSI

SEQ ID NO: 125411 - protein, 9 aa, Homo Sapiens
RPYERPPFA

SEQ ID NO: 125412 - protein, 9 aa, Homo Sapiens
RPYGCVLRA

SEQ ID NO: 125413 - protein, 9 aa, Homo Sapiens
RPYHTIIEI

SEQ ID NO: 125414 - protein, 9 aa, Homo Sapiens
RPYLSAVRA

SEQ ID NO: 125415 - protein, 9 aa, Homo Sapiens
RPYPVCFRP

SEQ ID NO: 125416 - protein, 9 aa, Homo Sapiens
RPYPVMRKI

SEQ ID NO: 125417 - protein, 9 aa, Homo Sapiens
RPYSHALVA

SEQ ID NO: 125418 - protein, 9 aa, Homo Sapiens
RPYSRKLEA

SEQ ID NO: 125419 - protein, 9 aa, Homo Sapiens
RPYTGKVGA

SEQ ID NO: 125420 - protein, 9 aa, Homo Sapiens
RPYVHKILV

SEQ ID NO: 125421 - protein, 9 aa, Homo Sapiens
RTKTPGPGA

SEQ ID NO: 125422 - protein, 9 aa, Homo Sapiens
RVKCVGLSA

SEQ ID NO: 125423 - protein, 9 aa, Homo Sapiens
RVQEALRVA

SEQ ID NO: 125424 - protein, 9 aa, Homo Sapiens
SAAPPGPPA

SEQ ID NO: 125425 - protein, 9 aa, Homo Sapiens
SAKTPGFSV

SEQ ID NO: 125426 - protein, 9 aa, Homo Sapiens
SPAALKPPA

SEQ ID NO: 125427 - protein, 9 aa, Homo Sapiens
SPAAPVITA

SEQ ID NO: 125428 - protein, 9 aa, Homo Sapiens
SPADRQLVA

SEQ ID NO: 125429 - protein, 9 aa, Homo Sapiens
SPAKTLPGA

SEQ ID NO: 125430 - protein, 9 aa, Homo Sapiens
SPALASRVA

SEQ ID NO: 125431 - protein, 9 aa, Homo Sapiens
SPALPSSGA

SEQ ID NO: 125432 - protein, 9 aa, Homo Sapiens
SPALTISKV

SEQ ID NO: 125433 - protein, 9 aa, Homo Sapiens
SPAPEEPKA

SEQ ID NO: 125434 - protein, 9 aa, Homo Sapiens
SPAQSISSV

SEQ ID NO: 125435 - protein, 9 aa, Homo Sapiens
SPAQVIPLA

SEQ ID NO: 125436 - protein, 9 aa, Homo Sapiens
SPASASLVA

SEQ ID NO: 125437 - protein, 9 aa, Homo Sapiens
SPASRIPPP

SEQ ID NO: 125438 - protein, 9 aa, Homo Sapiens
SPAYRDLAA

SEQ ID NO: 125439 - protein, 9 aa, Homo Sapiens
SPCLGPVAA

SEQ ID NO: 125440 - protein, 9 aa, Homo Sapiens
SPDRACRLA

SEQ ID NO: 125441 - protein, 9 aa, Homo Sapiens
SPEVGMRQA

SEQ ID NO: 125442 - protein, 9 aa, Homo Sapiens
SPFAEGTSA

SEQ ID NO: 125443 - protein, 9 aa, Homo Sapiens
SPFDQMKTA

SEQ ID NO: 125444 - protein, 9 aa, Homo Sapiens
SPFFPLVSA

SEQ ID NO: 125445 - protein, 9 aa, Homo Sapiens
SPFGSITSA

SEQ ID NO: 125446 - protein, 9 aa, Homo Sapiens
SPFGTITSA

SEQ ID NO: 125447 - protein, 9 aa, Homo Sapiens
SPFHFQPSA

SEQ ID NO: 125448 - protein, 9 aa, Homo Sapiens
SPFPDIPKV

SEQ ID NO: 125449 - protein, 9 aa, Homo Sapiens
SPFSGLQKA

SEQ ID NO: 125450 - protein, 9 aa, Homo Sapiens
SPGLHLGSA

SEQ ID NO: 125451 - protein, 9 aa, Homo Sapiens
SPHISSQTA

SEQ ID NO: 125452 - protein, 9 aa, Homo Sapiens
SPHLGPAPA

SEQ ID NO: 125453 - protein, 9 aa, Homo Sapiens
SPHLPGTSS

SEQ ID NO: 125454 - protein, 9 aa, Homo Sapiens
SPHPGLVAA

SEQ ID NO: 125455 - protein, 9 aa, Homo Sapiens
SPHPSPLGA

SEQ ID NO: 125456 - protein, 9 aa, Homo Sapiens
SPHQHGLLA

SEQ ID NO: 125457 - protein, 9 aa, Homo Sapiens
SPHQVTPQA

SEQ ID NO: 125458 - protein, 9 aa, Homo Sapiens
SPHSQVLTA

SEQ ID NO: 125459 - protein, 9 aa, Homo Sapiens
SPHSVPFLA

SEQ ID NO: 125460 - protein, 9 aa, Homo Sapiens
SPHVQVKAA

SEQ ID NO: 125461 - protein, 9 aa, Homo Sapiens
SPIEFLENA

SEQ ID NO: 125462 - protein, 9 aa, Homo Sapiens
SPIENIQRV

SEQ ID NO: 125463 - protein, 9 aa, Homo Sapiens
SPILVATAV

SEQ ID NO: 125464 - protein, 9 aa, Homo Sapiens
SPINRIVQI

SEQ ID NO: 125465 - protein, 9 aa, Homo Sapiens
SPIRYIPQV

SEQ ID NO: 125466 - protein, 9 aa, Homo Sapiens
SPITTVPKL

SEQ ID NO: 125467 - protein, 9 aa, Homo Sapiens
SPKAALRYA

SEQ ID NO: 125468 - protein, 9 aa, Homo Sapiens
SPKDVILKV

SEQ ID NO: 125469 - protein, 9 aa, Homo Sapiens
SPKFGKLVA

SEQ ID NO: 125470 - protein, 9 aa, Homo Sapiens
SPKFPGMRT

SEQ ID NO: 125471 - protein, 9 aa, Homo Sapiens
SPKGHLTRL

SEQ ID NO: 125472 - protein, 9 aa, Homo Sapiens
SPKHVYSIA

SEQ ID NO: 125473 - protein, 9 aa, Homo Sapiens
SPKKPGREI

SEQ ID NO: 125474 - protein, 9 aa, Homo Sapiens
SPKLPSLEA

SEQ ID NO: 125475 - protein, 9 aa, Homo Sapiens
SPKNTVISV

SEQ ID NO: 125476 - protein, 9 aa, Homo Sapiens
SPKPALRYA

SEQ ID NO: 125477 - protein, 9 aa, Homo Sapiens
SPKPPTRSP

SEQ ID NO: 125478 - protein, 9 aa, Homo Sapiens
SPKPVSSTV

SEQ ID NO: 125479 - protein, 9 aa, Homo Sapiens
SPKQILDPA

SEQ ID NO: 125480 - protein, 9 aa, Homo Sapiens
SPKQILDSA

SEQ ID NO: 125481 - protein, 9 aa, Homo Sapiens
SPKSPGLKA

SEQ ID NO: 125482 - protein, 9 aa, Homo Sapiens
SPKTTISVA

SEQ ID NO: 125483 - protein, 9 aa, Homo Sapiens
SPKTTITMA

SEQ ID NO: 125484 - protein, 9 aa, Homo Sapiens
SPLASGAVA

SEQ ID NO: 125485 - protein, 9 aa, Homo Sapiens
SPLATSTTA

SEQ ID NO: 125486 - protein, 9 aa, Homo Sapiens
SPLEEFKRA

SEQ ID NO: 125487 - protein, 9 aa, Homo Sapiens
SPLESWLTA

SEQ ID NO: 125488 - protein, 9 aa, Homo Sapiens
SPLFSQHTA

SEQ ID NO: 125489 - protein, 9 aa, Homo Sapiens
SPLGHSPTA

SEQ ID NO: 125490 - protein, 9 aa, Homo Sapiens
SPLHLAVEA

SEQ ID NO: 125491 - protein, 9 aa, Homo Sapiens
SPLIQKSAA

SEQ ID NO: 125492 - protein, 9 aa, Homo Sapiens
SPLKHFVTA

SEQ ID NO: 125493 - protein, 9 aa, Homo Sapiens
SPLLHNPSA

SEQ ID NO: 125494 - protein, 9 aa, Homo Sapiens
SPLNAMPRA

SEQ ID NO: 125495 - protein, 9 aa, Homo Sapiens
SPLPAHPSV

SEQ ID NO: 125496 - protein, 9 aa, Homo Sapiens
SPLSAARAA

SEQ ID NO: 125497 - protein, 9 aa, Homo Sapiens
SPLSSHPVV

SEQ ID NO: 125498 - protein, 9 aa, Homo Sapiens
SPLYLAHEV

SEQ ID NO: 125499 - protein, 9 aa, Homo Sapiens
SPMATTAAA

SEQ ID NO: 125500 - protein, 9 aa, Homo Sapiens
SPMDTVTEA

SEQ ID NO: 125501 - protein, 9 aa, Homo Sapiens
SPMPGTLTA

SEQ ID NO: 125502 - protein, 9 aa, Homo Sapiens
SPNCKLLIV

SEQ ID NO: 125503 - protein, 9 aa, Homo Sapiens
SPNEKFLLA

SEQ ID NO: 125504 - protein, 9 aa, Homo Sapiens
SPNENFKTV

SEQ ID NO: 125505 - protein, 9 aa, Homo Sapiens
SPNGKLTVA

SEQ ID NO: 125506 - protein, 9 aa, Homo Sapiens
SPNPHVRQA

SEQ ID NO: 125507 - protein, 9 aa, Homo Sapiens
SPNRYWLCA

SEQ ID NO: 125508 - protein, 9 aa, Homo Sapiens
SPNSILKAA

SEQ ID NO: 125509 - protein, 9 aa, Homo Sapiens
SPQDVTTHA

SEQ ID NO: 125510 - protein, 9 aa, Homo Sapiens
SPQGRVMTI

SEQ ID NO: 125511 - protein, 9 aa, Homo Sapiens
SPQPQIRAA

SEQ ID NO: 125512 - protein, 9 aa, Homo Sapiens
SPQPVGQQA

SEQ ID NO: 125513 - protein, 9 aa, Homo Sapiens
SPQYRLRIA

SEQ ID NO: 125514 - protein, 9 aa, Homo Sapiens
SPREPGYKA

SEQ ID NO: 125515 - protein, 9 aa, Homo Sapiens
SPRIATTTA

SEQ ID NO: 125516 - protein, 9 aa, Homo Sapiens
SPRISRPTA

SEQ ID NO: 125517 - protein, 9 aa, Homo Sapiens
SPRNLAMEA

SEQ ID NO: 125518 - protein, 9 aa, Homo Sapiens
SPRPPLISV

SEQ ID NO: 125519 - protein, 9 aa, Homo Sapiens
SPRPQAPKA

SEQ ID NO: 125520 - protein, 9 aa, Homo Sapiens
SPRVPNSSV

SEQ ID NO: 125521 - protein, 9 aa, Homo Sapiens
SPSAGVPRA

SEQ ID NO: 125522 - protein, 9 aa, Homo Sapiens
SPSDIGIIA

SEQ ID NO: 125523 - protein, 9 aa, Homo Sapiens
SPSMAVRIA

SEQ ID NO: 125524 - protein, 9 aa, Homo Sapiens
SPSPPQAEA

SEQ ID NO: 125525 - protein, 9 aa, Homo Sapiens
SPSPPSVAV

SEQ ID NO: 125526 - protein, 9 aa, Homo Sapiens
SPSQSSMVA

SEQ ID NO: 125527 - protein, 9 aa, Homo Sapiens
SPSSSSLAA

SEQ ID NO: 125528 - protein, 9 aa, Homo Sapiens
SPSVPKTSA

SEQ ID NO: 125529 - protein, 9 aa, Homo Sapiens
SPTFKKNFA

SEQ ID NO: 125530 - protein, 9 aa, Homo Sapiens
SPTHSAIPA

SEQ ID NO: 125531 - protein, 9 aa, Homo Sapiens
SPTKKVAVA

SEQ ID NO: 125532 - protein, 9 aa, Homo Sapiens
SPTNKISTA

SEQ ID NO: 125533 - protein, 9 aa, Homo Sapiens
SPVLPLTSA

SEQ ID NO: 125534 - protein, 9 aa, Homo Sapiens
SPVMVSNPA

SEQ ID NO: 125535 - protein, 9 aa, Homo Sapiens
SPVPGAPKA

SEQ ID NO: 125536 - protein, 9 aa, Homo Sapiens
SPVPIAPTA

SEQ ID NO: 125537 - protein, 9 aa, Homo Sapiens
SPVQHLVAA

SEQ ID NO: 125538 - protein, 9 aa, Homo Sapiens
SPVSSLPTA

SEQ ID NO: 125539 - protein, 9 aa, Homo Sapiens
SPVTDFREA

SEQ ID NO: 125540 - protein, 9 aa, Homo Sapiens
SPVVPQISA

SEQ ID NO: 125541 - protein, 9 aa, Homo Sapiens
SPYAAMLAA

SEQ ID NO: 125542 - protein, 9 aa, Homo Sapiens
SPYFRHSSV

SEQ ID NO: 125543 - protein, 9 aa, Homo Sapiens
SPYGGGRPG

SEQ ID NO: 125544 - protein, 9 aa, Homo Sapiens
SPYGRRIIP

SEQ ID NO: 125545 - protein, 9 aa, Homo Sapiens
SPYHGFTIV

SEQ ID NO: 125546 - protein, 9 aa, Homo Sapiens
SPYHNFDSV

SEQ ID NO: 125547 - protein, 9 aa, Homo Sapiens
SPYIPPHAA

SEQ ID NO: 125548 - protein, 9 aa, Homo Sapiens
SPYLPGRLA

SEQ ID NO: 125549 - protein, 9 aa, Homo Sapiens
SPYVHLLDA

SEQ ID NO: 125550 - protein, 9 aa, Homo Sapiens
SPYYFLTSA

SEQ ID NO: 125551 - protein, 9 aa, Homo Sapiens
SVKDGSLAA

SEQ ID NO: 125552 - protein, 9 aa, Homo Sapiens
SVRDPSPEA

SEQ ID NO: 125553 - protein, 9 aa, Homo Sapiens
TAKGPGLEA

SEQ ID NO: 125554 - protein, 9 aa, Homo Sapiens
TIRTPMAAA

SEQ ID NO: 125555 - protein, 9 aa, Homo Sapiens
TPAHVLPSA

SEQ ID NO: 125556 - protein, 9 aa, Homo Sapiens
TPAKAIAAV

SEQ ID NO: 125557 - protein, 9 aa, Homo Sapiens
TPATSVPFA

SEQ ID NO: 125558 - protein, 9 aa, Homo Sapiens
TPCDKILKA

SEQ ID NO: 125559 - protein, 9 aa, Homo Sapiens
TPFKGVRKA

SEQ ID NO: 125560 - protein, 9 aa, Homo Sapiens
TPFKLTTEA

SEQ ID NO: 125561 - protein, 9 aa, Homo Sapiens
TPFKPILEA

SEQ ID NO: 125562 - protein, 9 aa, Homo Sapiens
TPFTAIREA

SEQ ID NO: 125563 - protein, 9 aa, Homo Sapiens
TPHFSGLAA

SEQ ID NO: 125564 - protein, 9 aa, Homo Sapiens
TPHLRNLAV

SEQ ID NO: 125565 - protein, 9 aa, Homo Sapiens
TPIRGLLMA

SEQ ID NO: 125566 - protein, 9 aa, Homo Sapiens
TPKEVGDVI

SEQ ID NO: 125567 - protein, 9 aa, Homo Sapiens
TPKMPGQSV

SEQ ID NO: 125568 - protein, 9 aa, Homo Sapiens
TPKPATEAV

SEQ ID NO: 125569 - protein, 9 aa, Homo Sapiens
TPKPIPILA

SEQ ID NO: 125570 - protein, 9 aa, Homo Sapiens
TPKPPGTGP

SEQ ID NO: 125571 - protein, 9 aa, Homo Sapiens
TPKPVEPAA

SEQ ID NO: 125572 - protein, 9 aa, Homo Sapiens
TPKPVSIAT

SEQ ID NO: 125573 - protein, 9 aa, Homo Sapiens
TPLGGIQAA

SEQ ID NO: 125574 - protein, 9 aa, Homo Sapiens
TPLLHALTA

SEQ ID NO: 125575 - protein, 9 aa, Homo Sapiens
TPLLSGKAA

SEQ ID NO: 125576 - protein, 9 aa, Homo Sapiens
TPLSKLMKA

SEQ ID NO: 125577 - protein, 9 aa, Homo Sapiens
TPMAASVVA

SEQ ID NO: 125578 - protein, 9 aa, Homo Sapiens
TPMGPGRTV

SEQ ID NO: 125579 - protein, 9 aa, Homo Sapiens
TPMPPISSV

SEQ ID NO: 125580 - protein, 9 aa, Homo Sapiens
TPMSVLQQA

SEQ ID NO: 125581 - protein, 9 aa, Homo Sapiens
TPNKPSVAV

SEQ ID NO: 125582 - protein, 9 aa, Homo Sapiens
TPNQNFSTA

SEQ ID NO: 125583 - protein, 9 aa, Homo Sapiens
TPNSPRLAA

SEQ ID NO: 125584 - protein, 9 aa, Homo Sapiens
TPNTPRNLA

SEQ ID NO: 125585 - protein, 9 aa, Homo Sapiens
TPQETYRKV

SEQ ID NO: 125586 - protein, 9 aa, Homo Sapiens
TPQGHVAVA

SEQ ID NO: 125587 - protein, 9 aa, Homo Sapiens
TPQPPLLKA

SEQ ID NO: 125588 - protein, 9 aa, Homo Sapiens
TPQSIFIFA

SEQ ID NO: 125589 - protein, 9 aa, Homo Sapiens
TPRAATVKA

SEQ ID NO: 125590 - protein, 9 aa, Homo Sapiens
TPRGTTKVV

SEQ ID NO: 125591 - protein, 9 aa, Homo Sapiens
TPRPKFSVC

SEQ ID NO: 125592 - protein, 9 aa, Homo Sapiens
TPRPNPRSA

SEQ ID NO: 125593 - protein, 9 aa, Homo Sapiens
TPSSLYRVA

SEQ ID NO: 125594 - protein, 9 aa, Homo Sapiens
TPTVKHLEA

SEQ ID NO: 125595 - protein, 9 aa, Homo Sapiens
TPVATSPTA

SEQ ID NO: 125596 - protein, 9 aa, Homo Sapiens
TPVGGLLMA

SEQ ID NO: 125597 - protein, 9 aa, Homo Sapiens
TPVKAGRLV

SEQ ID NO: 125598 - protein, 9 aa, Homo Sapiens
TPVPASTSA

SEQ ID NO: 125599 - protein, 9 aa, Homo Sapiens
TPVSGTPQA

SEQ ID NO: 125600 - protein, 9 aa, Homo Sapiens
TPVTTSPSA

SEQ ID NO: 125601 - protein, 9 aa, Homo Sapiens
TPVYLGATA

SEQ ID NO: 125602 - protein, 9 aa, Homo Sapiens
TPWFKIIAA

SEQ ID NO: 125603 - protein, 9 aa, Homo Sapiens
TPYNYPVPV

SEQ ID NO: 125604 - protein, 9 aa, Homo Sapiens
TPYPKLKTA

SEQ ID NO: 125605 - protein, 9 aa, Homo Sapiens
TPYRPPAAA

SEQ ID NO: 125606 - protein, 9 aa, Homo Sapiens
TPYTGILYA

SEQ ID NO: 125607 - protein, 9 aa, Homo Sapiens
TPYVAKISA

SEQ ID NO: 125608 - protein, 9 aa, Homo Sapiens
TPYWMAPEV

SEQ ID NO: 125609 - protein, 9 aa, Homo Sapiens
TPYYVAPEV

SEQ ID NO: 125610 - protein, 9 aa, Homo Sapiens
TVKGVSLSS

SEQ ID NO: 125611 - protein, 9 aa, Homo Sapiens
TVKPPTSVA

SEQ ID NO: 125612 - protein, 9 aa, Homo Sapiens
TVYEGFISA

SEQ ID NO: 125613 - protein, 9 aa, Homo Sapiens
VAKPPGWSA

SEQ ID NO: 125614 - protein, 9 aa, Homo Sapiens
VAKVTGGAA

SEQ ID NO: 125615 - protein, 9 aa, Homo Sapiens
VEKPVGVAA

SEQ ID NO: 125616 - protein, 9 aa, Homo Sapiens
VPAEGAPTA

SEQ ID NO: 125617 - protein, 9 aa, Homo Sapiens
VPAGGAVAV

SEQ ID NO: 125618 - protein, 9 aa, Homo Sapiens
VPAGSGLSA

SEQ ID NO: 125619 - protein, 9 aa, Homo Sapiens
VPAKKITAA

SEQ ID NO: 125620 - protein, 9 aa, Homo Sapiens
VPAKWIHEA

SEQ ID NO: 125621 - protein, 9 aa, Homo Sapiens
VPALTGTTA

SEQ ID NO: 125622 - protein, 9 aa, Homo Sapiens
VPAPFFLPA

SEQ ID NO: 125623 - protein, 9 aa, Homo Sapiens
VPAPGGPAA

SEQ ID NO: 125624 - protein, 9 aa, Homo Sapiens
VPAPSPLSA

SEQ ID NO: 125625 - protein, 9 aa, Homo Sapiens
VPAPSVPSV

SEQ ID NO: 125626 - protein, 9 aa, Homo Sapiens
VPAQSRPCV

SEQ ID NO: 125627 - protein, 9 aa, Homo Sapiens
VPCQVLRMA

SEQ ID NO: 125628 - protein, 9 aa, Homo Sapiens
VPEKPRVPA

SEQ ID NO: 125629 - protein, 9 aa, Homo Sapiens
VPFAAPATA

SEQ ID NO: 125630 - protein, 9 aa, Homo Sapiens
VPFAATATA

SEQ ID NO: 125631 - protein, 9 aa, Homo Sapiens
VPFKDMPAT

SEQ ID NO: 125632 - protein, 9 aa, Homo Sapiens
VPFLNPYTV

SEQ ID NO: 125633 - protein, 9 aa, Homo Sapiens
VPFPTPLEA

SEQ ID NO: 125634 - protein, 9 aa, Homo Sapiens
VPHCVPISA

SEQ ID NO: 125635 - protein, 9 aa, Homo Sapiens
VPHQPFSQA

SEQ ID NO: 125636 - protein, 9 aa, Homo Sapiens
VPHRATVYA

SEQ ID NO: 125637 - protein, 9 aa, Homo Sapiens
VPIAGRHAV

SEQ ID NO: 125638 - protein, 9 aa, Homo Sapiens
VPIMPYPPA

SEQ ID NO: 125639 - protein, 9 aa, Homo Sapiens
VPIRLIINA

SEQ ID NO: 125640 - protein, 9 aa, Homo Sapiens
VPKEPQNPP

SEQ ID NO: 125641 - protein, 9 aa, Homo Sapiens
VPKKPPPSP

SEQ ID NO: 125642 - protein, 9 aa, Homo Sapiens
VPKPIGGVV

SEQ ID NO: 125643 - protein, 9 aa, Homo Sapiens
VPKPPPAKP

SEQ ID NO: 125644 - protein, 9 aa, Homo Sapiens
VPKVVGSAV

SEQ ID NO: 125645 - protein, 9 aa, Homo Sapiens
VPLATAPMA

SEQ ID NO: 125646 - protein, 9 aa, Homo Sapiens
VPLDHRVHA

SEQ ID NO: 125647 - protein, 9 aa, Homo Sapiens
VPLSHLINA

SEQ ID NO: 125648 - protein, 9 aa, Homo Sapiens
VPMPYTLKV

SEQ ID NO: 125649 - protein, 9 aa, Homo Sapiens
VPMQDPRAA

SEQ ID NO: 125650 - protein, 9 aa, Homo Sapiens
VPMTPLRTV

SEQ ID NO: 125651 - protein, 9 aa, Homo Sapiens
VPNKFLVTA

SEQ ID NO: 125652 - protein, 9 aa, Homo Sapiens
VPNNKITVV

SEQ ID NO: 125653 - protein, 9 aa, Homo Sapiens
VPNPYIISA

SEQ ID NO: 125654 - protein, 9 aa, Homo Sapiens
VPNVHGALA

SEQ ID NO: 125655 - protein, 9 aa, Homo Sapiens
VPQERQPEA

SEQ ID NO: 125656 - protein, 9 aa, Homo Sapiens
VPQGLLKAA

SEQ ID NO: 125657 - protein, 9 aa, Homo Sapiens
VPREPGVHT

SEQ ID NO: 125658 - protein, 9 aa, Homo Sapiens
VPRLPATAA

SEQ ID NO: 125659 - protein, 9 aa, Homo Sapiens
VPRPAARVA

SEQ ID NO: 125660 - protein, 9 aa, Homo Sapiens
VPRPASVSA

SEQ ID NO: 125661 - protein, 9 aa, Homo Sapiens
VPRPPSLLA

SEQ ID NO: 125662 - protein, 9 aa, Homo Sapiens
VPRPPSNPP

SEQ ID NO: 125663 - protein, 9 aa, Homo Sapiens
VPSAHQPSA

SEQ ID NO: 125664 - protein, 9 aa, Homo Sapiens
VPSAVLIVA

SEQ ID NO: 125665 - protein, 9 aa, Homo Sapiens
VPSPRLAAA

SEQ ID NO: 125666 - protein, 9 aa, Homo Sapiens
VPSPVAISA

SEQ ID NO: 125667 - protein, 9 aa, Homo Sapiens
VPSSPPTKR

SEQ ID NO: 125668 - protein, 9 aa, Homo Sapiens
VPSYPSKSA

SEQ ID NO: 125669 - protein, 9 aa, Homo Sapiens
VPTDYSVSA

SEQ ID NO: 125670 - protein, 9 aa, Homo Sapiens
VPTKRPPVL

SEQ ID NO: 125671 - protein, 9 aa, Homo Sapiens
VPVAGNPAV

SEQ ID NO: 125672 - protein, 9 aa, Homo Sapiens
VPVDTGVAA

SEQ ID NO: 125673 - protein, 9 aa, Homo Sapiens
VPVQPGSSV

SEQ ID NO: 125674 - protein, 9 aa, Homo Sapiens
VPVSTINHA

SEQ ID NO: 125675 - protein, 9 aa, Homo Sapiens
VPVTLIGEA

SEQ ID NO: 125676 - protein, 9 aa, Homo Sapiens
VPYDPGLKA

SEQ ID NO: 125677 - protein, 9 aa, Homo Sapiens
VPYGEFKSV

SEQ ID NO: 125678 - protein, 9 aa, Homo Sapiens
VPYGTPLSV

SEQ ID NO: 125679 - protein, 9 aa, Homo Sapiens
VPYGVGKAA

SEQ ID NO: 125680 - protein, 9 aa, Homo Sapiens
VPYLVGQVV

SEQ ID NO: 125681 - protein, 9 aa, Homo Sapiens
VPYPPLLRA

SEQ ID NO: 125682 - protein, 9 aa, Homo Sapiens
WGKVGGHAA

SEQ ID NO: 125683 - protein, 9 aa, Homo Sapiens
WPKDVGIVA

SEQ ID NO: 125684 - protein, 9 aa, Homo Sapiens
YARASGVCA

SEQ ID NO: 125685 - protein, 9 aa, Homo Sapiens
YPAPQVSTA

SEQ ID NO: 125686 - protein, 9 aa, Homo Sapiens
YPCSKFIIA

SEQ ID NO: 125687 - protein, 9 aa, Homo Sapiens
YPDTAGPEA

SEQ ID NO: 125688 - protein, 9 aa, Homo Sapiens
YPFKNLPTA

SEQ ID NO: 125689 - protein, 9 aa, Homo Sapiens
YPHGWVETA

SEQ ID NO: 125690 - protein, 9 aa, Homo Sapiens
YPKGLGSTV

SEQ ID NO: 125691 - protein, 9 aa, Homo Sapiens
YPKNPHLRA

SEQ ID NO: 125692 - protein, 9 aa, Homo Sapiens
YPKQSFTMV

SEQ ID NO: 125693 - protein, 9 aa, Homo Sapiens
YPKTPTGSP

SEQ ID NO: 125694 - protein, 9 aa, Homo Sapiens
YPNFAGPHA

SEQ ID NO: 125695 - protein, 9 aa, Homo Sapiens
YPNGHFVRV

SEQ ID NO: 125696 - protein, 9 aa, Homo Sapiens
YPNKGVGQA

SEQ ID NO: 125697 - protein, 9 aa, Homo Sapiens
YPRPGTPAA

SEQ ID NO: 125698 - protein, 9 aa, Homo Sapiens
YPSAPFLAA

SEQ ID NO: 125699 - protein, 9 aa, Homo Sapiens
YPSEHLIQA

SEQ ID NO: 125700 - protein, 9 aa, Homo Sapiens
YPTQLFRTV

SEQ ID NO: 125701 - protein, 9 aa, Homo Sapiens
YPWHRFPVT

SEQ ID NO: 125702 - protein, 9 aa, Homo Sapiens
YPYSCFKTV

SEQ ID NO: 125703 - protein, 10 aa, Homo Sapiens
AAPAPAAHVA

SEQ ID NO: 125704 - protein, 10 aa, Homo Sapiens
AGPARLSPAA

SEQ ID NO: 125705 - protein, 10 aa, Homo Sapiens
APAAATVAVA

SEQ ID NO: 125706 - protein, 10 aa, Homo Sapiens
APANVGLTSA

SEQ ID NO: 125707 - protein, 10 aa, Homo Sapiens
APAPAEKTPV

SEQ ID NO: 125708 - protein, 10 aa, Homo Sapiens
APDGTRNLTA

SEQ ID NO: 125709 - protein, 10 aa, Homo Sapiens
APFQNILPRV

SEQ ID NO: 125710 - protein, 10 aa, Homo Sapiens
APHIVVGTPG

SEQ ID NO: 125711 - protein, 10 aa, Homo Sapiens
APHTWPHIVA

SEQ ID NO: 125712 - protein, 10 aa, Homo Sapiens
APHWAVWLLA

SEQ ID NO: 125713 - protein, 10 aa, Homo Sapiens
APKAGPGVVR

SEQ ID NO: 125714 - protein, 10 aa, Homo Sapiens
APKGSVLQEA

SEQ ID NO: 125715 - protein, 10 aa, Homo Sapiens
APKIANGKAA

SEQ ID NO: 125716 - protein, 10 aa, Homo Sapiens
APKMPVVTSV

SEQ ID NO: 125717 - protein, 10 aa, Homo Sapiens
APKPPPASQP

SEQ ID NO: 125718 - protein, 10 aa, Homo Sapiens
APKPSSRPSL

SEQ ID NO: 125719 - protein, 10 aa, Homo Sapiens
APKWFDGQRA

SEQ ID NO: 125720 - protein, 10 aa, Homo Sapiens
APMLSTVHSA

SEQ ID NO: 125721 - protein, 10 aa, Homo Sapiens
APNLVPGVGA

SEQ ID NO: 125722 - protein, 10 aa, Homo Sapiens
APPEYHRKAV

SEQ ID NO: 125723 - protein, 10 aa, Homo Sapiens
APPSAVGSSA

SEQ ID NO: 125724 - protein, 10 aa, Homo Sapiens
APQETRGIPS

SEQ ID NO: 125725 - protein, 10 aa, Homo Sapiens
APRAPRALAA

SEQ ID NO: 125726 - protein, 10 aa, Homo Sapiens
APREPVGWPA

SEQ ID NO: 125727 - protein, 10 aa, Homo Sapiens
APRGAAGRPL

SEQ ID NO: 125728 - protein, 10 aa, Homo Sapiens
APRGPPQVTS

SEQ ID NO: 125729 - protein, 10 aa, Homo Sapiens
APRSFHPPAA

SEQ ID NO: 125730 - protein, 10 aa, Homo Sapiens
APSGGRLLSA

SEQ ID NO: 125731 - protein, 10 aa, Homo Sapiens
APSKATLIEA

SEQ ID NO: 125732 - protein, 10 aa, Homo Sapiens
APSWKCLPAA

SEQ ID NO: 125733 - protein, 10 aa, Homo Sapiens
APTSVPGARL

SEQ ID NO: 125734 - protein, 10 aa, Homo Sapiens
APVAAHTVTA

SEQ ID NO: 125735 - protein, 10 aa, Homo Sapiens
APVGPRAAMS

SEQ ID NO: 125736 - protein, 10 aa, Homo Sapiens
APYDAIHVGA

SEQ ID NO: 125737 - protein, 10 aa, Homo Sapiens
APYDPRVLAA

SEQ ID NO: 125738 - protein, 10 aa, Homo Sapiens
APYFKGTAVV

SEQ ID NO: 125739 - protein, 10 aa, Homo Sapiens
APYGNPKNMA

SEQ ID NO: 125740 - protein, 10 aa, Homo Sapiens
AVKKNPGIAA

SEQ ID NO: 125741 - protein, 10 aa, Homo Sapiens
EKPSYHPIAP

SEQ ID NO: 125742 - protein, 10 aa, Homo Sapiens
EVKPSSVTAA

SEQ ID NO: 125743 - protein, 10 aa, Homo Sapiens
FGPGKPPPPP

SEQ ID NO: 125744 - protein, 10 aa, Homo Sapiens
FPKPYPNSEA

SEQ ID NO: 125745 - protein, 10 aa, Homo Sapiens
FPKQPGTSGA

SEQ ID NO: 125746 - protein, 10 aa, Homo Sapiens
FPRDHKSVTA

SEQ ID NO: 125747 - protein, 10 aa, Homo Sapiens
GPFPGKFNEV

SEQ ID NO: 125748 - protein, 10 aa, Homo Sapiens
GPWVGTGLAA

SEQ ID NO: 125749 - protein, 10 aa, Homo Sapiens
GPYGGAQPSA

SEQ ID NO: 125750 - protein, 10 aa, Homo Sapiens
HPAAFPLPVV

SEQ ID NO: 125751 - protein, 10 aa, Homo Sapiens
HPAPTRKIAV

SEQ ID NO: 125752 - protein, 10 aa, Homo Sapiens
HPFKGFLLEA

SEQ ID NO: 125753 - protein, 10 aa, Homo Sapiens
HPLLRPPPSA

SEQ ID NO: 125754 - protein, 10 aa, Homo Sapiens
HPQPGSANSL

SEQ ID NO: 125755 - protein, 10 aa, Homo Sapiens
HPREPLPPIQ

SEQ ID NO: 125756 - protein, 10 aa, Homo Sapiens
HPRSPNVLSV

SEQ ID NO: 125757 - protein, 10 aa, Homo Sapiens
HPRVPSLTTV

SEQ ID NO: 125758 - protein, 10 aa, Homo Sapiens
HPRYSSRIQA

SEQ ID NO: 125759 - protein, 10 aa, Homo Sapiens
HPSQELLASA

SEQ ID NO: 125760 - protein, 10 aa, Homo Sapiens
HPTDASMIEA

SEQ ID NO: 125761 - protein, 10 aa, Homo Sapiens
HPTEDLVVSA

SEQ ID NO: 125762 - protein, 10 aa, Homo Sapiens
HPWETVTTAA

SEQ ID NO: 125763 - protein, 10 aa, Homo Sapiens
HPYLFPVAAM

SEQ ID NO: 125764 - protein, 10 aa, Homo Sapiens
HTPAHVLPSA

SEQ ID NO: 125765 - protein, 10 aa, Homo Sapiens
HVDPHQRLTA

SEQ ID NO: 125766 - protein, 10 aa, Homo Sapiens
IPADLRIISA

SEQ ID NO: 125767 - protein, 10 aa, Homo Sapiens
IPASDLPQVR

SEQ ID NO: 125768 - protein, 10 aa, Homo Sapiens
IPCELRVTSA

SEQ ID NO: 125769 - protein, 10 aa, Homo Sapiens
IPFLVPGIRY

SEQ ID NO: 125770 - protein, 10 aa, Homo Sapiens
IPISPISPAF

SEQ ID NO: 125771 - protein, 10 aa, Homo Sapiens
IPKDYKTMAA

SEQ ID NO: 125772 - protein, 10 aa, Homo Sapiens
IPKDYKTMTA

SEQ ID NO: 125773 - protein, 10 aa, Homo Sapiens
IPKHINPVAA

SEQ ID NO: 125774 - protein, 10 aa, Homo Sapiens
IPKPLNPALW

SEQ ID NO: 125775 - protein, 10 aa, Homo Sapiens
IPLEKADHPA

SEQ ID NO: 125776 - protein, 10 aa, Homo Sapiens
IPLYLKGGVA

SEQ ID NO: 125777 - protein, 10 aa, Homo Sapiens
IPMKIRNVSA

SEQ ID NO: 125778 - protein, 10 aa, Homo Sapiens
IPRGIPLDAA

SEQ ID NO: 125779 - protein, 10 aa, Homo Sapiens
IPRHPMPFAA

SEQ ID NO: 125780 - protein, 10 aa, Homo Sapiens
IPVECSQRSA

SEQ ID NO: 125781 - protein, 10 aa, Homo Sapiens
IPYAHSPSVR

SEQ ID NO: 125782 - protein, 10 aa, Homo Sapiens
IPYDQSPGPK

SEQ ID NO: 125783 - protein, 10 aa, Homo Sapiens
IPYTGPFNLL

SEQ ID NO: 125784 - protein, 10 aa, Homo Sapiens
IVCDVPSASA

SEQ ID NO: 125785 - protein, 10 aa, Homo Sapiens
IVKTAPKVSA

SEQ ID NO: 125786 - protein, 10 aa, Homo Sapiens
KLKTITGNSA

SEQ ID NO: 125787 - protein, 10 aa, Homo Sapiens
KPAPPFNVTV

SEQ ID NO: 125788 - protein, 10 aa, Homo Sapiens
KPATLTTTSA

SEQ ID NO: 125789 - protein, 10 aa, Homo Sapiens
KPFAFGNSSA

SEQ ID NO: 125790 - protein, 10 aa, Homo Sapiens
KPFKLSGLSF

SEQ ID NO: 125791 - protein, 10 aa, Homo Sapiens
KPHCSRNPVL

SEQ ID NO: 125792 - protein, 10 aa, Homo Sapiens
KPHGPRTLYA

SEQ ID NO: 125793 - protein, 10 aa, Homo Sapiens
KPHQIGGIRF

SEQ ID NO: 125794 - protein, 10 aa, Homo Sapiens
KPIDFVLNKV

SEQ ID NO: 125795 - protein, 10 aa, Homo Sapiens
KPIEMQLTSA

SEQ ID NO: 125796 - protein, 10 aa, Homo Sapiens
KPIPIIPTAL

SEQ ID NO: 125797 - protein, 10 aa, Homo Sapiens
KPKAAKPKVV

SEQ ID NO: 125798 - protein, 10 aa, Homo Sapiens
KPKDVSLWAA

SEQ ID NO: 125799 - protein, 10 aa, Homo Sapiens
KPKEVKPKIP

SEQ ID NO: 125800 - protein, 10 aa, Homo Sapiens
KPKEVTTVKV

SEQ ID NO: 125801 - protein, 10 aa, Homo Sapiens
KPKPAGVLGA

SEQ ID NO: 125802 - protein, 10 aa, Homo Sapiens
KPKPGHTPIF

SEQ ID NO: 125803 - protein, 10 aa, Homo Sapiens
KPKPVKPVTF

SEQ ID NO: 125804 - protein, 10 aa, Homo Sapiens
KPKVMEGTVA

SEQ ID NO: 125805 - protein, 10 aa, Homo Sapiens
KPLANRIKEA

SEQ ID NO: 125806 - protein, 10 aa, Homo Sapiens
KPLQPLPNTA

SEQ ID NO: 125807 - protein, 10 aa, Homo Sapiens
KPLRPLGKAA

SEQ ID NO: 125808 - protein, 10 aa, Homo Sapiens
KPMEIARIVA

SEQ ID NO: 125809 - protein, 10 aa, Homo Sapiens
KPMKSVLVVA

SEQ ID NO: 125810 - protein, 10 aa, Homo Sapiens
KPNPNQIISV

SEQ ID NO: 125811 - protein, 10 aa, Homo Sapiens
KPQSINTVSA

SEQ ID NO: 125812 - protein, 10 aa, Homo Sapiens
KPRPPQGLVR

SEQ ID NO: 125813 - protein, 10 aa, Homo Sapiens
KPRTPMPSSV

SEQ ID NO: 125814 - protein, 10 aa, Homo Sapiens
KPSPFTPVSA

SEQ ID NO: 125815 - protein, 10 aa, Homo Sapiens
KPSSSLAVAA

SEQ ID NO: 125816 - protein, 10 aa, Homo Sapiens
KPYTLMSMVA

SEQ ID NO: 125817 - protein, 10 aa, Homo Sapiens
KVKDIVINEA

SEQ ID NO: 125818 - protein, 10 aa, Homo Sapiens
KVKEPSVQEA

SEQ ID NO: 125819 - protein, 10 aa, Homo Sapiens
LKGHPGLPGL

SEQ ID NO: 125820 - protein, 10 aa, Homo Sapiens
LPAARAGPVA

SEQ ID NO: 125821 - protein, 10 aa, Homo Sapiens
LPAASQPQVF

SEQ ID NO: 125822 - protein, 10 aa, Homo Sapiens
LPHSAGRYAA

SEQ ID NO: 125823 - protein, 10 aa, Homo Sapiens
LPKAGKFGPA

SEQ ID NO: 125824 - protein, 10 aa, Homo Sapiens
LPKDVSPTQA

SEQ ID NO: 125825 - protein, 10 aa, Homo Sapiens
LPKEDPTAVA

SEQ ID NO: 125826 - protein, 10 aa, Homo Sapiens
LPKEPQGIIA

SEQ ID NO: 125827 - protein, 10 aa, Homo Sapiens
LPKPHGIRAL

SEQ ID NO: 125828 - protein, 10 aa, Homo Sapiens
LPNQSFPHSV

SEQ ID NO: 125829 - protein, 10 aa, Homo Sapiens
LPQSYIHTSA

SEQ ID NO: 125830 - protein, 10 aa, Homo Sapiens
LPRRPLPPAA

SEQ ID NO: 125831 - protein, 10 aa, Homo Sapiens
LPSGCYGRVA

SEQ ID NO: 125832 - protein, 10 aa, Homo Sapiens
LPSGEVVKIA

SEQ ID NO: 125833 - protein, 10 aa, Homo Sapiens
LPVFQPGVKL

SEQ ID NO: 125834 - protein, 10 aa, Homo Sapiens
LPVHYIPVAP

SEQ ID NO: 125835 - protein, 10 aa, Homo Sapiens
LPYEHGPKGA

SEQ ID NO: 125836 - protein, 10 aa, Homo Sapiens
LPYSHPGVVF

SEQ ID NO: 125837 - protein, 10 aa, Homo Sapiens
LVKDVFISAA

SEQ ID NO: 125838 - protein, 10 aa, Homo Sapiens
MPFQGSGKSA

SEQ ID NO: 125839 - protein, 10 aa, Homo Sapiens
MPHPATGKTV

SEQ ID NO: 125840 - protein, 10 aa, Homo Sapiens
MPLLKSEVAA

SEQ ID NO: 125841 - protein, 10 aa, Homo Sapiens
MPNGDHIVSA

SEQ ID NO: 125842 - protein, 10 aa, Homo Sapiens
MPNGTPHPTA

SEQ ID NO: 125843 - protein, 10 aa, Homo Sapiens
MPNPQLNIKA

SEQ ID NO: 125844 - protein, 10 aa, Homo Sapiens
MPQIPRDNKA

SEQ ID NO: 125845 - protein, 10 aa, Homo Sapiens
MPQMCKATSA

SEQ ID NO: 125846 - protein, 10 aa, Homo Sapiens
MPQSGTGVSV

SEQ ID NO: 125847 - protein, 10 aa, Homo Sapiens
MPRFTEQVEA

SEQ ID NO: 125848 - protein, 10 aa, Homo Sapiens
MPSRFPPVVF

SEQ ID NO: 125849 - protein, 10 aa, Homo Sapiens
MPVEAKCINA

SEQ ID NO: 125850 - protein, 10 aa, Homo Sapiens
MPVQFKPKSA

SEQ ID NO: 125851 - protein, 10 aa, Homo Sapiens
MPVRGGTRLA

SEQ ID NO: 125852 - protein, 10 aa, Homo Sapiens
MPVSPISQGA

SEQ ID NO: 125853 - protein, 10 aa, Homo Sapiens
NPKVQASLSA

SEQ ID NO: 125854 - protein, 10 aa, Homo Sapiens
NPSPAVCLVA

SEQ ID NO: 125855 - protein, 10 aa, Homo Sapiens
NPSPSTSISA

SEQ ID NO: 125856 - protein, 10 aa, Homo Sapiens
NPYFPGQAIA

SEQ ID NO: 125857 - protein, 10 aa, Homo Sapiens
NPYNGGGRVA

SEQ ID NO: 125858 - protein, 10 aa, Homo Sapiens
NQIKSGTPYR

SEQ ID NO: 125859 - protein, 10 aa, Homo Sapiens
PRGPAGPAAQ

SEQ ID NO: 125860 - protein, 10 aa, Homo Sapiens
PRLGELAVAA

SEQ ID NO: 125861 - protein, 10 aa, Homo Sapiens
PRPASGPIRP

SEQ ID NO: 125862 - protein, 10 aa, Homo Sapiens
QPFASLISKA

SEQ ID NO: 125863 - protein, 10 aa, Homo Sapiens
QPHHLLLPAA

SEQ ID NO: 125864 - protein, 10 aa, Homo Sapiens
QPHIAGVFSA

SEQ ID NO: 125865 - protein, 10 aa, Homo Sapiens
QPMAGCARVA

SEQ ID NO: 125866 - protein, 10 aa, Homo Sapiens
QPNRYTNRVV

SEQ ID NO: 125867 - protein, 10 aa, Homo Sapiens
QPRPPSNRTV

SEQ ID NO: 125868 - protein, 10 aa, Homo Sapiens
QPYYATRVNA

SEQ ID NO: 125869 - protein, 10 aa, Homo Sapiens
QRPGAAAARP

SEQ ID NO: 125870 - protein, 10 aa, Homo Sapiens
QVMQGMGVSA

SEQ ID NO: 125871 - protein, 10 aa, Homo Sapiens
RIRHWIGCGA

SEQ ID NO: 125872 - protein, 10 aa, Homo Sapiens
RPAAAPPAGA

SEQ ID NO: 125873 - protein, 10 aa, Homo Sapiens
RPADVIFATV

SEQ ID NO: 125874 - protein, 10 aa, Homo Sapiens
RPAPALAPAA

SEQ ID NO: 125875 - protein, 10 aa, Homo Sapiens
RPAPHFERTA

SEQ ID NO: 125876 - protein, 10 aa, Homo Sapiens
RPAPLPAAVV

SEQ ID NO: 125877 - protein, 10 aa, Homo Sapiens
RPAPPLRPSA

SEQ ID NO: 125878 - protein, 10 aa, Homo Sapiens
RPAPVAVAAA

SEQ ID NO: 125879 - protein, 10 aa, Homo Sapiens
RPFEGFQRKA

SEQ ID NO: 125880 - protein, 10 aa, Homo Sapiens
RPFGGLIRDV

SEQ ID NO: 125881 - protein, 10 aa, Homo Sapiens
RPFNLAERKA

SEQ ID NO: 125882 - protein, 10 aa, Homo Sapiens
RPFSGRRLPV

SEQ ID NO: 125883 - protein, 10 aa, Homo Sapiens
RPIEGRVVNA

SEQ ID NO: 125884 - protein, 10 aa, Homo Sapiens
RPIPNQPPTA

SEQ ID NO: 125885 - protein, 10 aa, Homo Sapiens
RPITPPRNSA

SEQ ID NO: 125886 - protein, 10 aa, Homo Sapiens
RPKDDIKLTA

SEQ ID NO: 125887 - protein, 10 aa, Homo Sapiens
RPKIGLPGVA

SEQ ID NO: 125888 - protein, 10 aa, Homo Sapiens
RPKIPGSREA

SEQ ID NO: 125889 - protein, 10 aa, Homo Sapiens
RPKPPIPAKP

SEQ ID NO: 125890 - protein, 10 aa, Homo Sapiens
RPKPPNVRTA

SEQ ID NO: 125891 - protein, 10 aa, Homo Sapiens
RPKPPSATSI

SEQ ID NO: 125892 - protein, 10 aa, Homo Sapiens
RPKPSASEVL

SEQ ID NO: 125893 - protein, 10 aa, Homo Sapiens
RPKQPGPVKL

SEQ ID NO: 125894 - protein, 10 aa, Homo Sapiens
RPLFPSTGAA

SEQ ID NO: 125895 - protein, 10 aa, Homo Sapiens
RPLPGALGVA

SEQ ID NO: 125896 - protein, 10 aa, Homo Sapiens
RPLSGSGISA

SEQ ID NO: 125897 - protein, 10 aa, Homo Sapiens
RPMGLRFKKA

SEQ ID NO: 125898 - protein, 10 aa, Homo Sapiens
RPNAFGMAQA

SEQ ID NO: 125899 - protein, 10 aa, Homo Sapiens
RPNDSRMLVA

SEQ ID NO: 125900 - protein, 10 aa, Homo Sapiens
RPNQDGTLIA

SEQ ID NO: 125901 - protein, 10 aa, Homo Sapiens
RPPGARLTTT

SEQ ID NO: 125902 - protein, 10 aa, Homo Sapiens
RPQSGRVLSA

SEQ ID NO: 125903 - protein, 10 aa, Homo Sapiens
RPRAVYAVEA

SEQ ID NO: 125904 - protein, 10 aa, Homo Sapiens
RPRDSQLYAV

SEQ ID NO: 125905 - protein, 10 aa, Homo Sapiens
RPRHQGVMVG

SEQ ID NO: 125906 - protein, 10 aa, Homo Sapiens
RPRPGDSLPS

SEQ ID NO: 125907 - protein, 10 aa, Homo Sapiens
RPRPHSAPSL

SEQ ID NO: 125908 - protein, 10 aa, Homo Sapiens
RPRPPPFLGP

SEQ ID NO: 125909 - protein, 10 aa, Homo Sapiens
RPRPPPVEQV

SEQ ID NO: 125910 - protein, 10 aa, Homo Sapiens
RPRPPQKALP

SEQ ID NO: 125911 - protein, 10 aa, Homo Sapiens
RPRTEVSLSA

SEQ ID NO: 125912 - protein, 10 aa, Homo Sapiens
RPRVTEPISA

SEQ ID NO: 125913 - protein, 10 aa, Homo Sapiens
RPSLIPPVTF

SEQ ID NO: 125914 - protein, 10 aa, Homo Sapiens
RPSSEVIKDA

SEQ ID NO: 125915 - protein, 10 aa, Homo Sapiens
RPSSLHGLAA

SEQ ID NO: 125916 - protein, 10 aa, Homo Sapiens
RPVHPALPFA

SEQ ID NO: 125917 - protein, 10 aa, Homo Sapiens
RPVIRPNVGF

SEQ ID NO: 125918 - protein, 10 aa, Homo Sapiens
RPVLPRTEAA

SEQ ID NO: 125919 - protein, 10 aa, Homo Sapiens
RPYEKGRLII

SEQ ID NO: 125920 - protein, 10 aa, Homo Sapiens
RPYGCVLRAA

SEQ ID NO: 125921 - protein, 10 aa, Homo Sapiens
RVAPRSGLAA

SEQ ID NO: 125922 - protein, 10 aa, Homo Sapiens
RVKPFSENEA

SEQ ID NO: 125923 - protein, 10 aa, Homo Sapiens
RVRDVFEAKA

SEQ ID NO: 125924 - protein, 10 aa, Homo Sapiens
RVRLSTGREA

SEQ ID NO: 125925 - protein, 10 aa, Homo Sapiens
SAKPPAKVEA

SEQ ID NO: 125926 - protein, 10 aa, Homo Sapiens
SPARPVSPAP

SEQ ID NO: 125927 - protein, 10 aa, Homo Sapiens
SPDGRWLISA

SEQ ID NO: 125928 - protein, 10 aa, Homo Sapiens
SPFHFQPSAA

SEQ ID NO: 125929 - protein, 10 aa, Homo Sapiens
SPHAHISEQA

SEQ ID NO: 125930 - protein, 10 aa, Homo Sapiens
SPHLPGTSSA

SEQ ID NO: 125931 - protein, 10 aa, Homo Sapiens
SPHPPSEVTA

SEQ ID NO: 125932 - protein, 10 aa, Homo Sapiens
SPIENIQRVA

SEQ ID NO: 125933 - protein, 10 aa, Homo Sapiens
SPITGEKIPA

SEQ ID NO: 125934 - protein, 10 aa, Homo Sapiens
SPKAALRYAA

SEQ ID NO: 125935 - protein, 10 aa, Homo Sapiens
SPKPALRYAA

SEQ ID NO: 125936 - protein, 10 aa, Homo Sapiens
SPKPCLAQPA

SEQ ID NO: 125937 - protein, 10 aa, Homo Sapiens
SPKQILDSAA

SEQ ID NO: 125938 - protein, 10 aa, Homo Sapiens
SPLATQIPQA

SEQ ID NO: 125939 - protein, 10 aa, Homo Sapiens
SPLRSPIRSA

SEQ ID NO: 125940 - protein, 10 aa, Homo Sapiens
SPLTPRPLSA

SEQ ID NO: 125941 - protein, 10 aa, Homo Sapiens
SPLWRGGGVA

SEQ ID NO: 125942 - protein, 10 aa, Homo Sapiens
SPMPFHPSQV

SEQ ID NO: 125943 - protein, 10 aa, Homo Sapiens
SPMSADRVVA

SEQ ID NO: 125944 - protein, 10 aa, Homo Sapiens
SPNDRLIPAV

SEQ ID NO: 125945 - protein, 10 aa, Homo Sapiens
SPNLIGATGA

SEQ ID NO: 125946 - protein, 10 aa, Homo Sapiens
SPNPFSVHTA

SEQ ID NO: 125947 - protein, 10 aa, Homo Sapiens
SPNRYWLCAA

SEQ ID NO: 125948 - protein, 10 aa, Homo Sapiens
SPRLFSNHAA

SEQ ID NO: 125949 - protein, 10 aa, Homo Sapiens
SPRPALVRSA

SEQ ID NO: 125950 - protein, 10 aa, Homo Sapiens
SPSPKLQNSA

SEQ ID NO: 125951 - protein, 10 aa, Homo Sapiens
SPSPPFGHSA

SEQ ID NO: 125952 - protein, 10 aa, Homo Sapiens
SPVDPGARQA

SEQ ID NO: 125953 - protein, 10 aa, Homo Sapiens
SPVPSHWMVA

SEQ ID NO: 125954 - protein, 10 aa, Homo Sapiens
SPYKDLLDPA

SEQ ID NO: 125955 - protein, 10 aa, Homo Sapiens
SPYSNVFHVV

SEQ ID NO: 125956 - protein, 10 aa, Homo Sapiens
TAKSGTGIAA

SEQ ID NO: 125957 - protein, 10 aa, Homo Sapiens
TARPPPSMSA

SEQ ID NO: 125958 - protein, 10 aa, Homo Sapiens
TPAHVLPSAA

SEQ ID NO: 125959 - protein, 10 aa, Homo Sapiens
TPAPVEKSPA

SEQ ID NO: 125960 - protein, 10 aa, Homo Sapiens
TPFQGQGHGA

SEQ ID NO: 125961 - protein, 10 aa, Homo Sapiens
TPFTGPFISV

SEQ ID NO: 125962 - protein, 10 aa, Homo Sapiens
TPHTVTAISA

SEQ ID NO: 125963 - protein, 10 aa, Homo Sapiens
TPKGPGQVPT

SEQ ID NO: 125964 - protein, 10 aa, Homo Sapiens
TPKMPGQSVR

SEQ ID NO: 125965 - protein, 10 aa, Homo Sapiens
TPKPIPILAA

SEQ ID NO: 125966 - protein, 10 aa, Homo Sapiens
TPLPAIVPAA

SEQ ID NO: 125967 - protein, 10 aa, Homo Sapiens
TPNTPRNLAA

SEQ ID NO: 125968 - protein, 10 aa, Homo Sapiens
TPREPNRWAV

SEQ ID NO: 125969 - protein, 10 aa, Homo Sapiens
TPRPLTSARA

SEQ ID NO: 125970 - protein, 10 aa, Homo Sapiens
TPSPVIRSTA

SEQ ID NO: 125971 - protein, 10 aa, Homo Sapiens
TPVQRTPLSA

SEQ ID NO: 125972 - protein, 10 aa, Homo Sapiens
TPYGYFLISA

SEQ ID NO: 125973 - protein, 10 aa, Homo Sapiens
TPYPGFKSHV

SEQ ID NO: 125974 - protein, 10 aa, Homo Sapiens
TPYSGKLMSA

SEQ ID NO: 125975 - protein, 10 aa, Homo Sapiens
TQARAPVTAA

SEQ ID NO: 125976 - protein, 10 aa, Homo Sapiens
VPAPSPLSAA

SEQ ID NO: 125977 - protein, 10 aa, Homo Sapiens
VPFKPQIPEA

SEQ ID NO: 125978 - protein, 10 aa, Homo Sapiens
VPHQPDNLAA

SEQ ID NO: 125979 - protein, 10 aa, Homo Sapiens
VPKEGKVVDA

SEQ ID NO: 125980 - protein, 10 aa, Homo Sapiens
VPKGNTAVSV

SEQ ID NO: 125981 - protein, 10 aa, Homo Sapiens
VPKKPGPPVL

SEQ ID NO: 125982 - protein, 10 aa, Homo Sapiens
VPKLPAVHPA

SEQ ID NO: 125983 - protein, 10 aa, Homo Sapiens
VPKNSDPWAA

SEQ ID NO: 125984 - protein, 10 aa, Homo Sapiens
VPKNYKLVAA

SEQ ID NO: 125985 - protein, 10 aa, Homo Sapiens
VPKPIGGVVV

SEQ ID NO: 125986 - protein, 10 aa, Homo Sapiens
VPKPSSVQSV

SEQ ID NO: 125987 - protein, 10 aa, Homo Sapiens
VPKSAVQQVA

SEQ ID NO: 125988 - protein, 10 aa, Homo Sapiens
VPNAGILPLV

SEQ ID NO: 125989 - protein, 10 aa, Homo Sapiens
VPNYKLITPA

SEQ ID NO: 125990 - protein, 10 aa, Homo Sapiens
VPQAQPTKPA

SEQ ID NO: 125991 - protein, 10 aa, Homo Sapiens
VPQLVTGRCA

SEQ ID NO: 125992 - protein, 10 aa, Homo Sapiens
VPRPPDTVST

SEQ ID NO: 125993 - protein, 10 aa, Homo Sapiens
VPRPPSNPPA

SEQ ID NO: 125994 - protein, 10 aa, Homo Sapiens
VPRQPTVTSV

SEQ ID NO: 125995 - protein, 10 aa, Homo Sapiens
VPRTVSSTTA

SEQ ID NO: 125996 - protein, 10 aa, Homo Sapiens
VPYRLLPGIF

SEQ ID NO: 125997 - protein, 10 aa, Homo Sapiens
WPKDVGIVAL

SEQ ID NO: 125998 - protein, 10 aa, Homo Sapiens
WRRIPGGYSA

SEQ ID NO: 125999 - protein, 10 aa, Homo Sapiens
YPALGPRLAA

SEQ ID NO: 126000 - protein, 10 aa, Homo Sapiens
YPKAEPMPSA

SEQ ID NO: 126001 - protein, 10 aa, Homo Sapiens
YPRVSSAVKA

SEQ ID NO: 126002 - protein, 10 aa, Homo Sapiens
YPYGDGNRSV

SEQ ID NO: 126003 - protein, 11 aa, Homo Sapiens
APILNIPIVQF

SEQ ID NO: 126004 - protein, 11 aa, Homo Sapiens
APKGPSRESVV

SEQ ID NO: 126005 - protein, 11 aa, Homo Sapiens
APKSPSQDVKA

SEQ ID NO: 126006 - protein, 11 aa, Homo Sapiens
APKSTSVFAVA

SEQ ID NO: 126007 - protein, 11 aa, Homo Sapiens
APLDSIHSLAA

SEQ ID NO: 126008 - protein, 11 aa, Homo Sapiens
APMPYLIGVHA

SEQ ID NO: 126009 - protein, 11 aa, Homo Sapiens
APRAPRALAAA

SEQ ID NO: 126010 - protein, 11 aa, Homo Sapiens
APRGPGAELQA

SEQ ID NO: 126011 - protein, 11 aa, Homo Sapiens
APRLCSISVTA

SEQ ID NO: 126012 - protein, 11 aa, Homo Sapiens
APRPASGPIRP

SEQ ID NO: 126013 - protein, 11 aa, Homo Sapiens
APSNGLSVRSA

SEQ ID NO: 126014 - protein, 11 aa, Homo Sapiens
APTGSGKTICA

SEQ ID NO: 126015 - protein, 11 aa, Homo Sapiens
APTSAGKTLVA

SEQ ID NO: 126016 - protein, 11 aa, Homo Sapiens
APVNIAGSRTA

SEQ ID NO: 126017 - protein, 11 aa, Homo Sapiens
APYAKGFGVAA

SEQ ID NO: 126018 - protein, 11 aa, Homo Sapiens
APYDPHFPAPA

SEQ ID NO: 126019 - protein, 11 aa, Homo Sapiens
EPKNPPPPINF

SEQ ID NO: 126020 - protein, 11 aa, Homo Sapiens
FPHFDLSHGSA

SEQ ID NO: 126021 - protein, 11 aa, Homo Sapiens
GVAALYKFRVA

SEQ ID NO: 126022 - protein, 11 aa, Homo Sapiens
HNPGYPKYLGT

SEQ ID NO: 126023 - protein, 11 aa, Homo Sapiens
HPKPVPGFQVA

SEQ ID NO: 126024 - protein, 11 aa, Homo Sapiens
HPKVNVPGSQA

SEQ ID NO: 126025 - protein, 11 aa, Homo Sapiens
HPLASFSFTSA

SEQ ID NO: 126026 - protein, 11 aa, Homo Sapiens
HPVHRQYFITA

SEQ ID NO: 126027 - protein, 11 aa, Homo Sapiens
HPYPPGPGVAL

SEQ ID NO: 126028 - protein, 11 aa, Homo Sapiens
IPAFRGHFIAA

SEQ ID NO: 126029 - protein, 11 aa, Homo Sapiens
IPAGTVTVNAA

SEQ ID NO: 126030 - protein, 11 aa, Homo Sapiens
IPHSLPGAVAA

SEQ ID NO: 126031 - protein, 11 aa, Homo Sapiens
IPKPSKDGVTV

SEQ ID NO: 126032 - protein, 11 aa, Homo Sapiens
IPLPDEKSRVA

SEQ ID NO: 126033 - protein, 11 aa, Homo Sapiens
IPNSIMTILEA

SEQ ID NO: 126034 - protein, 11 aa, Homo Sapiens
IPQSVPGVQTL

SEQ ID NO: 126035 - protein, 11 aa, Homo Sapiens
IPYDQSGFVSA

SEQ ID NO: 126036 - protein, 11 aa, Homo Sapiens
IPYSPDVQIHA

SEQ ID NO: 126037 - protein, 11 aa, Homo Sapiens
KPFEQVKGITL

SEQ ID NO: 126038 - protein, 11 aa, Homo Sapiens
KPFQPALPLVV

SEQ ID NO: 126039 - protein, 11 aa, Homo Sapiens
KPHKHLPPAAL

SEQ ID NO: 126040 - protein, 11 aa, Homo Sapiens
KPHQIGGIRFL

SEQ ID NO: 126041 - protein, 11 aa, Homo Sapiens
KPKPNGRTVEV

SEQ ID NO: 126042 - protein, 11 aa, Homo Sapiens
KPKVMEGTVAA

SEQ ID NO: 126043 - protein, 11 aa, Homo Sapiens
KPLDAPAVNKA

SEQ ID NO: 126044 - protein, 11 aa, Homo Sapiens
KPLDIPDGRRA

SEQ ID NO: 126045 - protein, 11 aa, Homo Sapiens
KPLSSLTPLIA

SEQ ID NO: 126046 - protein, 11 aa, Homo Sapiens
KPREAFGFEQA

SEQ ID NO: 126047 - protein, 11 aa, Homo Sapiens
KPRPPQGLVRV

SEQ ID NO: 126048 - protein, 11 aa, Homo Sapiens
KPRTVATPLNQ

SEQ ID NO: 126049 - protein, 11 aa, Homo Sapiens
KPVPLNSGVRF

SEQ ID NO: 126050 - protein, 11 aa, Homo Sapiens
KPYPNSEAARA

SEQ ID NO: 126051 - protein, 11 aa, Homo Sapiens
LPDATSSHRTV

SEQ ID NO: 126052 - protein, 11 aa, Homo Sapiens
LPKKSFEQISA

SEQ ID NO: 126053 - protein, 11 aa, Homo Sapiens
LPKPRMRGLLA

SEQ ID NO: 126054 - protein, 11 aa, Homo Sapiens
LPRESCTAHAA

SEQ ID NO: 126055 - protein, 11 aa, Homo Sapiens
LPYCPGKTLVV

SEQ ID NO: 126056 - protein, 11 aa, Homo Sapiens
MPHPATGKTVA

SEQ ID NO: 126057 - protein, 11 aa, Homo Sapiens
MPNGTPHPTAA

SEQ ID NO: 126058 - protein, 11 aa, Homo Sapiens
MPNPSLAQVKI

SEQ ID NO: 126059 - protein, 11 aa, Homo Sapiens
MPRWAERLFPA

SEQ ID NO: 126060 - protein, 11 aa, Homo Sapiens
MPSRFPPVVFY

SEQ ID NO: 126061 - protein, 11 aa, Homo Sapiens
NPKDNNQFASA

SEQ ID NO: 126062 - protein, 11 aa, Homo Sapiens
QAAVRPKGEAA

SEQ ID NO: 126063 - protein, 11 aa, Homo Sapiens
QPHDPLVPLSA

SEQ ID NO: 126064 - protein, 11 aa, Homo Sapiens
QPRNSLPASPA

SEQ ID NO: 126065 - protein, 11 aa, Homo Sapiens
QPYAPPRDFAA

SEQ ID NO: 126066 - protein, 11 aa, Homo Sapiens
QPYSKLPGVSL

SEQ ID NO: 126067 - protein, 11 aa, Homo Sapiens
QPYYATRVNAA

SEQ ID NO: 126068 - protein, 11 aa, Homo Sapiens
REAGAAALRNV

SEQ ID NO: 126069 - protein, 11 aa, Homo Sapiens
RMFHIRAVILR

SEQ ID NO: 126070 - protein, 11 aa, Homo Sapiens
RPAGALVALVV

SEQ ID NO: 126071 - protein, 11 aa, Homo Sapiens
RPALPVSYLQA

SEQ ID NO: 126072 - protein, 11 aa, Homo Sapiens
RPALVGVVKEA

SEQ ID NO: 126073 - protein, 11 aa, Homo Sapiens
RPCSPQNKISF

SEQ ID NO: 126074 - protein, 11 aa, Homo Sapiens
RPGPVLPAVAV

SEQ ID NO: 126075 - protein, 11 aa, Homo Sapiens
RPHAPHSPIKF

SEQ ID NO: 126076 - protein, 11 aa, Homo Sapiens
RPHSSLRELLA

SEQ ID NO: 126077 - protein, 11 aa, Homo Sapiens
RPICSVPGARV

SEQ ID NO: 126078 - protein, 11 aa, Homo Sapiens
RPKAKGGLASL

SEQ ID NO: 126079 - protein, 11 aa, Homo Sapiens
RPKGLEGERPA

SEQ ID NO: 126080 - protein, 11 aa, Homo Sapiens
RPKLNEGVVEF

SEQ ID NO: 126081 - protein, 11 aa, Homo Sapiens
RPKPIITSVPK

SEQ ID NO: 126082 - protein, 11 aa, Homo Sapiens
RPKPSSSPVIF

SEQ ID NO: 126083 - protein, 11 aa, Homo Sapiens
RPKSAFKVQNA

SEQ ID NO: 126084 - protein, 11 aa, Homo Sapiens
RPKSSQIGAVV

SEQ ID NO: 126085 - protein, 11 aa, Homo Sapiens
RPKTVRDTLLA

SEQ ID NO: 126086 - protein, 11 aa, Homo Sapiens
RPNFNIKGIRF

SEQ ID NO: 126087 - protein, 11 aa, Homo Sapiens
RPNGVITGLAA

SEQ ID NO: 126088 - protein, 11 aa, Homo Sapiens
RPNSLVGITSA

SEQ ID NO: 126089 - protein, 11 aa, Homo Sapiens
RPRDLEDFFSA

SEQ ID NO: 126090 - protein, 11 aa, Homo Sapiens
RPREALSTNEC

SEQ ID NO: 126091 - protein, 11 aa, Homo Sapiens
RPSELLAGVKA

SEQ ID NO: 126092 - protein, 11 aa, Homo Sapiens
RPVQRLPSVAL

SEQ ID NO: 126093 - protein, 11 aa, Homo Sapiens
RPYAPINANAI

SEQ ID NO: 126094 - protein, 11 aa, Homo Sapiens
RPYQPLGALVV

SEQ ID NO: 126095 - protein, 11 aa, Homo Sapiens
RVRSFLRGLPA

SEQ ID NO: 126096 - protein, 11 aa, Homo Sapiens
SPDEGALVRAA

SEQ ID NO: 126097 - protein, 11 aa, Homo Sapiens
SPIENIQRVAA

SEQ ID NO: 126098 - protein, 11 aa, Homo Sapiens
SPKGSEGYLAA

SEQ ID NO: 126099 - protein, 11 aa, Homo Sapiens
SPKKPGREIEL

SEQ ID NO: 126100 - protein, 11 aa, Homo Sapiens
SPKPAIKSISA

SEQ ID NO: 126101 - protein, 11 aa, Homo Sapiens
SPKRPPSPIKF

SEQ ID NO: 126102 - protein, 11 aa, Homo Sapiens
SPMAERSMMSA

SEQ ID NO: 126103 - protein, 11 aa, Homo Sapiens
SPREVFFRVAA

SEQ ID NO: 126104 - protein, 11 aa, Homo Sapiens
SPRGFPLGLSA

SEQ ID NO: 126105 - protein, 11 aa, Homo Sapiens
SPRHLPSCSPA

SEQ ID NO: 126106 - protein, 11 aa, Homo Sapiens
SPRIATTTASA

SEQ ID NO: 126107 - protein, 11 aa, Homo Sapiens
SPRNLGFETSA

SEQ ID NO: 126108 - protein, 11 aa, Homo Sapiens
SPRQSDVMIVA

SEQ ID NO: 126109 - protein, 11 aa, Homo Sapiens
SPRSGQRCWAA

SEQ ID NO: 126110 - protein, 11 aa, Homo Sapiens
SPRTAEGVLAA

SEQ ID NO: 126111 - protein, 11 aa, Homo Sapiens
SPRTPVSPVKF

SEQ ID NO: 126112 - protein, 11 aa, Homo Sapiens
SPTSPNALPPA

SEQ ID NO: 126113 - protein, 11 aa, Homo Sapiens
SPVSSKTESVS

SEQ ID NO: 126114 - protein, 11 aa, Homo Sapiens
SPYSGPKFNSA

SEQ ID NO: 126115 - protein, 11 aa, Homo Sapiens
TPADRSGWTSA

SEQ ID NO: 126116 - protein, 11 aa, Homo Sapiens
TPDPSTPSRLA

SEQ ID NO: 126117 - protein, 11 aa, Homo Sapiens
TPHPVLTPVAA

SEQ ID NO: 126118 - protein, 11 aa, Homo Sapiens
TPKLTRNESVA

SEQ ID NO: 126119 - protein, 11 aa, Homo Sapiens
TPKPPGTGPVP

SEQ ID NO: 126120 - protein, 11 aa, Homo Sapiens
TPKTTGARVEL

SEQ ID NO: 126121 - protein, 11 aa, Homo Sapiens
TPKTVTPASSA

SEQ ID NO: 126122 - protein, 11 aa, Homo Sapiens
TPMPPISSVLL

SEQ ID NO: 126123 - protein, 11 aa, Homo Sapiens
TPRSIHDGVAA

SEQ ID NO: 126124 - protein, 11 aa, Homo Sapiens
TPVQRTPLSAA

SEQ ID NO: 126125 - protein, 11 aa, Homo Sapiens
TPYQSKWTICA

SEQ ID NO: 126126 - protein, 11 aa, Homo Sapiens
VPAGGAVAVSA

SEQ ID NO: 126127 - protein, 11 aa, Homo Sapiens
VPDSSGPERIL

SEQ ID NO: 126128 - protein, 11 aa, Homo Sapiens
VPIEQIPLVKL

SEQ ID NO: 126129 - protein, 11 aa, Homo Sapiens
VPIPNSPFKVA

SEQ ID NO: 126130 - protein, 11 aa, Homo Sapiens
VPKENSTLNCA

SEQ ID NO: 126131 - protein, 11 aa, Homo Sapiens
VPKPFSGPVRL

SEQ ID NO: 126132 - protein, 11 aa, Homo Sapiens
VPKPIGGVVVF

SEQ ID NO: 126133 - protein, 11 aa, Homo Sapiens
VPRNPELPNAA

SEQ ID NO: 126134 - protein, 11 aa, Homo Sapiens
VPRPVLRALSF

SEQ ID NO: 126135 - protein, 11 aa, Homo Sapiens
VPYGTPLSVNF

SEQ ID NO: 126136 - protein, 11 aa, Homo Sapiens
VPYPLPKIDLI

SEQ ID NO: 126137 - protein, 8 aa, Homo Sapiens
APASLTSA

SEQ ID NO: 126138 - protein, 8 aa, Homo Sapiens
APGVLPSA

SEQ ID NO: 126139 - protein, 8 aa, Homo Sapiens
APIRLLAA

SEQ ID NO: 126140 - protein, 8 aa, Homo Sapiens
APRPAPVA

SEQ ID NO: 126141 - protein, 8 aa, Homo Sapiens
APTAIKAA

SEQ ID NO: 126142 - protein, 8 aa, Homo Sapiens
APTAITEA

SEQ ID NO: 126143 - protein, 8 aa, Homo Sapiens
APVAVWAA

SEQ ID NO: 126144 - protein, 8 aa, Homo Sapiens
APWGGPAA

SEQ ID NO: 126145 - protein, 8 aa, Homo Sapiens
FPVCLLAS

SEQ ID NO: 126146 - protein, 8 aa, Homo Sapiens
HPFYTRAA

SEQ ID NO: 126147 - protein, 8 aa, Homo Sapiens
HPHLVAEA

SEQ ID NO: 126148 - protein, 8 aa, Homo Sapiens
IFFNVHSA

SEQ ID NO: 126149 - protein, 8 aa, Homo Sapiens
IPQVMAIA

SEQ ID NO: 126150 - protein, 8 aa, Homo Sapiens
IPTPIVGV

SEQ ID NO: 126151 - protein, 8 aa, Homo Sapiens
IPTTIYKA

SEQ ID NO: 126152 - protein, 8 aa, Homo Sapiens
IPVRFIEA

SEQ ID NO: 126153 - protein, 8 aa, Homo Sapiens
LPMLQTVA

SEQ ID NO: 126154 - protein, 8 aa, Homo Sapiens
LPVRLATA

SEQ ID NO: 126155 - protein, 8 aa, Homo Sapiens
MPIYVTGI

SEQ ID NO: 126156 - protein, 8 aa, Homo Sapiens
MPQPVPTA

SEQ ID NO: 126157 - protein, 8 aa, Homo Sapiens
MPQSIVEA

SEQ ID NO: 126158 - protein, 8 aa, Homo Sapiens
MPTTLEGA

SEQ ID NO: 126159 - protein, 8 aa, Homo Sapiens
MQPPVPGP

SEQ ID NO: 126160 - protein, 8 aa, Homo Sapiens
NPIAQPLA

SEQ ID NO: 126161 - protein, 8 aa, Homo Sapiens
PAKKITAA

SEQ ID NO: 126162 - protein, 8 aa, Homo Sapiens
PYLFPVAA

SEQ ID NO: 126163 - protein, 8 aa, Homo Sapiens
QPVKLQEA

SEQ ID NO: 126164 - protein, 8 aa, Homo Sapiens
QPYRFPQA

SEQ ID NO: 126165 - protein, 8 aa, Homo Sapiens
RPRNLAAA

SEQ ID NO: 126166 - protein, 8 aa, Homo Sapiens
RPVKIRKI

SEQ ID NO: 126167 - protein, 8 aa, Homo Sapiens
RPVKLFRV

SEQ ID NO: 126168 - protein, 8 aa, Homo Sapiens
RPWLRPAA

SEQ ID NO: 126169 - protein, 8 aa, Homo Sapiens
RPYLAFAA

SEQ ID NO: 126170 - protein, 8 aa, Homo Sapiens
RPYLLVHV

SEQ ID NO: 126171 - protein, 8 aa, Homo Sapiens
RPYQMEVA

SEQ ID NO: 126172 - protein, 8 aa, Homo Sapiens
SPAKLQAA

SEQ ID NO: 126173 - protein, 8 aa, Homo Sapiens
SPALLRAE

SEQ ID NO: 126174 - protein, 8 aa, Homo Sapiens
SPFPLEAV

SEQ ID NO: 126175 - protein, 8 aa, Homo Sapiens
SPILVATA

SEQ ID NO: 126176 - protein, 8 aa, Homo Sapiens
SPLNTHAA

SEQ ID NO: 126177 - protein, 8 aa, Homo Sapiens
SPTFQHAV

SEQ ID NO: 126178 - protein, 8 aa, Homo Sapiens
TPFLLVGT

SEQ ID NO: 126179 - protein, 8 aa, Homo Sapiens
TPTPVPVV

SEQ ID NO: 126180 - protein, 8 aa, Homo Sapiens
VPAGGAVA

SEQ ID NO: 126181 - protein, 8 aa, Homo Sapiens
VPAVTLVA

SEQ ID NO: 126182 - protein, 8 aa, Homo Sapiens
VPFSIPAA

SEQ ID NO: 126183 - protein, 8 aa, Homo Sapiens
VPLIAIMA

SEQ ID NO: 126184 - protein, 8 aa, Homo Sapiens
VPTNIIAA

SEQ ID NO: 126185 - protein, 8 aa, Homo Sapiens
VPVETPEA

SEQ ID NO: 126186 - protein, 8 aa, Homo Sapiens
VPWGGAAA

SEQ ID NO: 126187 - protein, 8 aa, Homo Sapiens
YPIALTRA

SEQ ID NO: 126188 - protein, 9 aa, Homo Sapiens
AAAAAVDPH

SEQ ID NO: 126189 - protein, 9 aa, Homo Sapiens
AAFAGRATA

SEQ ID NO: 126190 - protein, 9 aa, Homo Sapiens
AAFSHPQAA

SEQ ID NO: 126191 - protein, 9 aa, Homo Sapiens
AAGPPLVAA

SEQ ID NO: 126192 - protein, 9 aa, Homo Sapiens
AAGPVGMAA

SEQ ID NO: 126193 - protein, 9 aa, Homo Sapiens
APAAATVAV

SEQ ID NO: 126194 - protein, 9 aa, Homo Sapiens
APAAGMNAA

SEQ ID NO: 126195 - protein, 9 aa, Homo Sapiens
APAEPGWKA

SEQ ID NO: 126196 - protein, 9 aa, Homo Sapiens
APAGCLSQA

SEQ ID NO: 126197 - protein, 9 aa, Homo Sapiens
APALLLIPA

SEQ ID NO: 126198 - protein, 9 aa, Homo Sapiens
APAPAAHVA

SEQ ID NO: 126199 - protein, 9 aa, Homo Sapiens
APAPPKAEA

SEQ ID NO: 126200 - protein, 9 aa, Homo Sapiens
APAPPVYEA

SEQ ID NO: 126201 - protein, 9 aa, Homo Sapiens
APAPQGCAV

SEQ ID NO: 126202 - protein, 9 aa, Homo Sapiens
APAPTPVSA

SEQ ID NO: 126203 - protein, 9 aa, Homo Sapiens
APAPVIISS

SEQ ID NO: 126204 - protein, 9 aa, Homo Sapiens
APARPGPAA

SEQ ID NO: 126205 - protein, 9 aa, Homo Sapiens
APARPSVPP

SEQ ID NO: 126206 - protein, 9 aa, Homo Sapiens
APASVPAQA

SEQ ID NO: 126207 - protein, 9 aa, Homo Sapiens
APCKQRISV

SEQ ID NO: 126208 - protein, 9 aa, Homo Sapiens
APCTAIREV

SEQ ID NO: 126209 - protein, 9 aa, Homo Sapiens
APDEKYVAA

SEQ ID NO: 126210 - protein, 9 aa, Homo Sapiens
APELQGVEV

SEQ ID NO: 126211 - protein, 9 aa, Homo Sapiens
APFEPLASG

SEQ ID NO: 126212 - protein, 9 aa, Homo Sapiens
APFGKISDA

SEQ ID NO: 126213 - protein, 9 aa, Homo Sapiens
APFPFPQLA

SEQ ID NO: 126214 - protein, 9 aa, Homo Sapiens
APFPHGDSA

SEQ ID NO: 126215 - protein, 9 aa, Homo Sapiens
APFPKTQIA

SEQ ID NO: 126216 - protein, 9 aa, Homo Sapiens
APFQGLLQA

SEQ ID NO: 126217 - protein, 9 aa, Homo Sapiens
APGGEFREA

SEQ ID NO: 126218 - protein, 9 aa, Homo Sapiens
APGGWLQVA

SEQ ID NO: 126219 - protein, 9 aa, Homo Sapiens
APGKNFQQA

SEQ ID NO: 126220 - protein, 9 aa, Homo Sapiens
APGLPTARA

SEQ ID NO: 126221 - protein, 9 aa, Homo Sapiens
APGNPVLAV

SEQ ID NO: 126222 - protein, 9 aa, Homo Sapiens
APGPATREA

SEQ ID NO: 126223 - protein, 9 aa, Homo Sapiens
APGPGPASA

SEQ ID NO: 126224 - protein, 9 aa, Homo Sapiens
APGPGTPCA

SEQ ID NO: 126225 - protein, 9 aa, Homo Sapiens
APGTLKTLA

SEQ ID NO: 126226 - protein, 9 aa, Homo Sapiens
APGYSYTAA

SEQ ID NO: 126227 - protein, 9 aa, Homo Sapiens
APHEILIQI

SEQ ID NO: 126228 - protein, 9 aa, Homo Sapiens
APHPGLSEA

SEQ ID NO: 126229 - protein, 9 aa, Homo Sapiens
APHVPATGA

SEQ ID NO: 126230 - protein, 9 aa, Homo Sapiens
APIQSEPRV

SEQ ID NO: 126231 - protein, 9 aa, Homo Sapiens
APITGQVSA

SEQ ID NO: 126232 - protein, 9 aa, Homo Sapiens
APIWLEHAA

SEQ ID NO: 126233 - protein, 9 aa, Homo Sapiens
APKAGPGVV

SEQ ID NO: 126234 - protein, 9 aa, Homo Sapiens
APLDAYFQV

SEQ ID NO: 126235 - protein, 9 aa, Homo Sapiens
APMPPIIHA

SEQ ID NO: 126236 - protein, 9 aa, Homo Sapiens
APMPTASTA

SEQ ID NO: 126237 - protein, 9 aa, Homo Sapiens
APNEGFCSA

SEQ ID NO: 126238 - protein, 9 aa, Homo Sapiens
APNLQNQQV

SEQ ID NO: 126239 - protein, 9 aa, Homo Sapiens
APNPIHLTV

SEQ ID NO: 126240 - protein, 9 aa, Homo Sapiens
APNPVVFVA

SEQ ID NO: 126241 - protein, 9 aa, Homo Sapiens
APQPLKESA

SEQ ID NO: 126242 - protein, 9 aa, Homo Sapiens
APQSLGSSA

SEQ ID NO: 126243 - protein, 9 aa, Homo Sapiens
APRFGGSRA

SEQ ID NO: 126244 - protein, 9 aa, Homo Sapiens
APRIALHTA

SEQ ID NO: 126245 - protein, 9 aa, Homo Sapiens
APRLQSEVA

SEQ ID NO: 126246 - protein, 9 aa, Homo Sapiens
APRPPPKPM

SEQ ID NO: 126247 - protein, 9 aa, Homo Sapiens
APRPPVSAA

SEQ ID NO: 126248 - protein, 9 aa, Homo Sapiens
APRQPGLMA

SEQ ID NO: 126249 - protein, 9 aa, Homo Sapiens
APRTVALTA

SEQ ID NO: 126250 - protein, 9 aa, Homo Sapiens
APSPPPAPV

SEQ ID NO: 126251 - protein, 9 aa, Homo Sapiens
APSPVQHQA

SEQ ID NO: 126252 - protein, 9 aa, Homo Sapiens
APSRVVVVA

SEQ ID NO: 126253 - protein, 9 aa, Homo Sapiens
APSSSFAAA

SEQ ID NO: 126254 - protein, 9 aa, Homo Sapiens
APSTIIFHL

SEQ ID NO: 126255 - protein, 9 aa, Homo Sapiens
APSVGIKAA

SEQ ID NO: 126256 - protein, 9 aa, Homo Sapiens
APTAIKAAA

SEQ ID NO: 126257 - protein, 9 aa, Homo Sapiens
APTGDLPRA

SEQ ID NO: 126258 - protein, 9 aa, Homo Sapiens
APTKPQSPA

SEQ ID NO: 126259 - protein, 9 aa, Homo Sapiens
APTLPGSAA

SEQ ID NO: 126260 - protein, 9 aa, Homo Sapiens
APTPPTLVA

SEQ ID NO: 126261 - protein, 9 aa, Homo Sapiens
APVAEVPTA

SEQ ID NO: 126262 - protein, 9 aa, Homo Sapiens
APVLPHTAV

SEQ ID NO: 126263 - protein, 9 aa, Homo Sapiens
APVNVTTEV

SEQ ID NO: 126264 - protein, 9 aa, Homo Sapiens
APVPTAPAA

SEQ ID NO: 126265 - protein, 9 aa, Homo Sapiens
APVTGMVSG

SEQ ID NO: 126266 - protein, 9 aa, Homo Sapiens
APYPGFLSV

SEQ ID NO: 126267 - protein, 9 aa, Homo Sapiens
APYTHFTQA

SEQ ID NO: 126268 - protein, 9 aa, Homo Sapiens
APYVTFPVA

SEQ ID NO: 126269 - protein, 9 aa, Homo Sapiens
ASAPPGPPA

SEQ ID NO: 126270 - protein, 9 aa, Homo Sapiens
ASFHNGVAA

SEQ ID NO: 126271 - protein, 9 aa, Homo Sapiens
ATVLQAVSA

SEQ ID NO: 126272 - protein, 9 aa, Homo Sapiens
AVAPPSTSA

SEQ ID NO: 126273 - protein, 9 aa, Homo Sapiens
AVFFQSHSA

SEQ ID NO: 126274 - protein, 9 aa, Homo Sapiens
AVPRPGAPA

SEQ ID NO: 126275 - protein, 9 aa, Homo Sapiens
CPPLQPVSV

SEQ ID NO: 126276 - protein, 9 aa, Homo Sapiens
DPPSNPVAA

SEQ ID NO: 126277 - protein, 9 aa, Homo Sapiens
FPAPILRAV

SEQ ID NO: 126278 - protein, 9 aa, Homo Sapiens
FPFFNPIQT

SEQ ID NO: 126279 - protein, 9 aa, Homo Sapiens
FPGEQFKPA

SEQ ID NO: 126280 - protein, 9 aa, Homo Sapiens
FPHLQDAQV

SEQ ID NO: 126281 - protein, 9 aa, Homo Sapiens
FPMSPVTSV

SEQ ID NO: 126282 - protein, 9 aa, Homo Sapiens
FPRPVTVEP

SEQ ID NO: 126283 - protein, 9 aa, Homo Sapiens
FPSAAATAA

SEQ ID NO: 126284 - protein, 9 aa, Homo Sapiens
FPTTCLERA

SEQ ID NO: 126285 - protein, 9 aa, Homo Sapiens
FPVGKGLAA

SEQ ID NO: 126286 - protein, 9 aa, Homo Sapiens
FPVGVFVVA

SEQ ID NO: 126287 - protein, 9 aa, Homo Sapiens
FPWPQPLST

SEQ ID NO: 126288 - protein, 9 aa, Homo Sapiens
FPYPVGVHA

SEQ ID NO: 126289 - protein, 9 aa, Homo Sapiens
GPFDEFQIA

SEQ ID NO: 126290 - protein, 9 aa, Homo Sapiens
GPFGQIFRP

SEQ ID NO: 126291 - protein, 9 aa, Homo Sapiens
GPHANPVAV

SEQ ID NO: 126292 - protein, 9 aa, Homo Sapiens
GPRLSAEAA

SEQ ID NO: 126293 - protein, 9 aa, Homo Sapiens
GPSGCLVPA

SEQ ID NO: 126294 - protein, 9 aa, Homo Sapiens
GPTLQGKAV

SEQ ID NO: 126295 - protein, 9 aa, Homo Sapiens
GPYKIILTA

SEQ ID NO: 126296 - protein, 9 aa, Homo Sapiens
HAGLNAVAA

SEQ ID NO: 126297 - protein, 9 aa, Homo Sapiens
HPADSVVSV

SEQ ID NO: 126298 - protein, 9 aa, Homo Sapiens
HPAPVRGPP

SEQ ID NO: 126299 - protein, 9 aa, Homo Sapiens
HPARLTIEA

SEQ ID NO: 126300 - protein, 9 aa, Homo Sapiens
HPHLRKVSV

SEQ ID NO: 126301 - protein, 9 aa, Homo Sapiens
HPHPFLNSV

SEQ ID NO: 126302 - protein, 9 aa, Homo Sapiens
HPIHIIPAS

SEQ ID NO: 126303 - protein, 9 aa, Homo Sapiens
HPKKPGVGV

SEQ ID NO: 126304 - protein, 9 aa, Homo Sapiens
HPLFQAKSA

SEQ ID NO: 126305 - protein, 9 aa, Homo Sapiens
HPLLVKVKA

SEQ ID NO: 126306 - protein, 9 aa, Homo Sapiens
HPLPPTPSV

SEQ ID NO: 126307 - protein, 9 aa, Homo Sapiens
HPMPHPPQA

SEQ ID NO: 126308 - protein, 9 aa, Homo Sapiens
HPMPVLPKA

SEQ ID NO: 126309 - protein, 9 aa, Homo Sapiens
HPQFLKNQV

SEQ ID NO: 126310 - protein, 9 aa, Homo Sapiens
HPQRQNVAV

SEQ ID NO: 126311 - protein, 9 aa, Homo Sapiens
HPQVNIYSV

SEQ ID NO: 126312 - protein, 9 aa, Homo Sapiens
HPREVVILA

SEQ ID NO: 126313 - protein, 9 aa, Homo Sapiens
HPSPVVLKV

SEQ ID NO: 126314 - protein, 9 aa, Homo Sapiens
HPSQELLAS

SEQ ID NO: 126315 - protein, 9 aa, Homo Sapiens
HPTKGFASV

SEQ ID NO: 126316 - protein, 9 aa, Homo Sapiens
HPTWALKEA

SEQ ID NO: 126317 - protein, 9 aa, Homo Sapiens
HPVAKILHA

SEQ ID NO: 126318 - protein, 9 aa, Homo Sapiens
HPVEPVTSV

SEQ ID NO: 126319 - protein, 9 aa, Homo Sapiens
HPVHPFLAV

SEQ ID NO: 126320 - protein, 9 aa, Homo Sapiens
HPVLLQPVA

SEQ ID NO: 126321 - protein, 9 aa, Homo Sapiens
HPVYCVNVV

SEQ ID NO: 126322 - protein, 9 aa, Homo Sapiens
HPWETVTTA

SEQ ID NO: 126323 - protein, 9 aa, Homo Sapiens
HPWLFIEEA

SEQ ID NO: 126324 - protein, 9 aa, Homo Sapiens
HPYKHSFRA

SEQ ID NO: 126325 - protein, 9 aa, Homo Sapiens
HPYLFPVAA

SEQ ID NO: 126326 - protein, 9 aa, Homo Sapiens
HPYLPINSA

SEQ ID NO: 126327 - protein, 9 aa, Homo Sapiens
HPYQRIVTA

SEQ ID NO: 126328 - protein, 9 aa, Homo Sapiens
HPYRLILTV

SEQ ID NO: 126329 - protein, 9 aa, Homo Sapiens
IAHTPGVAA

SEQ ID NO: 126330 - protein, 9 aa, Homo Sapiens
IARPACLAA

SEQ ID NO: 126331 - protein, 9 aa, Homo Sapiens
IIKEVLLEA

SEQ ID NO: 126332 - protein, 9 aa, Homo Sapiens
IINEPTAAA

SEQ ID NO: 126333 - protein, 9 aa, Homo Sapiens
IIRDEGISA

SEQ ID NO: 126334 - protein, 9 aa, Homo Sapiens
IPAALPVAA

SEQ ID NO: 126335 - protein, 9 aa, Homo Sapiens
IPAEKIDGV

SEQ ID NO: 126336 - protein, 9 aa, Homo Sapiens
IPASGDYVA

SEQ ID NO: 126337 - protein, 9 aa, Homo Sapiens
IPATPGIGA

SEQ ID NO: 126338 - protein, 9 aa, Homo Sapiens
IPFGIFSRA

SEQ ID NO: 126339 - protein, 9 aa, Homo Sapiens
IPFGITEEA

SEQ ID NO: 126340 - protein, 9 aa, Homo Sapiens
IPFSKPVKV

SEQ ID NO: 126341 - protein, 9 aa, Homo Sapiens
IPFWRNTAV

SEQ ID NO: 126342 - protein, 9 aa, Homo Sapiens
IPFYGILGA

SEQ ID NO: 126343 - protein, 9 aa, Homo Sapiens
IPHKKFTFA

SEQ ID NO: 126344 - protein, 9 aa, Homo Sapiens
IPHLVTHDA

SEQ ID NO: 126345 - protein, 9 aa, Homo Sapiens
IPHPLIMGV

SEQ ID NO: 126346 - protein, 9 aa, Homo Sapiens
IPIKKSDPV

SEQ ID NO: 126347 - protein, 9 aa, Homo Sapiens
IPISNILMV

SEQ ID NO: 126348 - protein, 9 aa, Homo Sapiens
IPKDKSWKA

SEQ ID NO: 126349 - protein, 9 aa, Homo Sapiens
IPKHINPVA

SEQ ID NO: 126350 - protein, 9 aa, Homo Sapiens
IPKKEIHTV

SEQ ID NO: 126351 - protein, 9 aa, Homo Sapiens
IPKKLMHQA

SEQ ID NO: 126352 - protein, 9 aa, Homo Sapiens
IPLDKRLAA

SEQ ID NO: 126353 - protein, 9 aa, Homo Sapiens
IPLGFGVAA

SEQ ID NO: 126354 - protein, 9 aa, Homo Sapiens
IPLTLLPAA

SEQ ID NO: 126355 - protein, 9 aa, Homo Sapiens
IPMELVNEV

SEQ ID NO: 126356 - protein, 9 aa, Homo Sapiens
IPMRDFVCA

SEQ ID NO: 126357 - protein, 9 aa, Homo Sapiens
IPMVNKVLV

SEQ ID NO: 126358 - protein, 9 aa, Homo Sapiens
IPQEAYNAV

SEQ ID NO: 126359 - protein, 9 aa, Homo Sapiens
IPQELNNIT

SEQ ID NO: 126360 - protein, 9 aa, Homo Sapiens
IPQLMKEEA

SEQ ID NO: 126361 - protein, 9 aa, Homo Sapiens
IPQLNSKAV

SEQ ID NO: 126362 - protein, 9 aa, Homo Sapiens
IPQQVFQEV

SEQ ID NO: 126363 - protein, 9 aa, Homo Sapiens
IPQSIIECV

SEQ ID NO: 126364 - protein, 9 aa, Homo Sapiens
IPRNQLQSV

SEQ ID NO: 126365 - protein, 9 aa, Homo Sapiens
IPRNTVVPT

SEQ ID NO: 126366 - protein, 9 aa, Homo Sapiens
IPRSFLQEA

SEQ ID NO: 126367 - protein, 9 aa, Homo Sapiens
IPRSFMMEV

SEQ ID NO: 126368 - protein, 9 aa, Homo Sapiens
IPSGTILKA

SEQ ID NO: 126369 - protein, 9 aa, Homo Sapiens
IPTENSMTA

SEQ ID NO: 126370 - protein, 9 aa, Homo Sapiens
IPTEVRSKA

SEQ ID NO: 126371 - protein, 9 aa, Homo Sapiens
IPTVNPVAI

SEQ ID NO: 126372 - protein, 9 aa, Homo Sapiens
IPVESIEEV

SEQ ID NO: 126373 - protein, 9 aa, Homo Sapiens
IPVNGGLAA

SEQ ID NO: 126374 - protein, 9 aa, Homo Sapiens
IPWGISATA

SEQ ID NO: 126375 - protein, 9 aa, Homo Sapiens
IPYAHSPSV

SEQ ID NO: 126376 - protein, 9 aa, Homo Sapiens
IPYHIVNIV

SEQ ID NO: 126377 - protein, 9 aa, Homo Sapiens
IPYLSKHRA

SEQ ID NO: 126378 - protein, 9 aa, Homo Sapiens
IPYRVIHNA

SEQ ID NO: 126379 - protein, 9 aa, Homo Sapiens
ITAPPGTAA

SEQ ID NO: 126380 - protein, 9 aa, Homo Sapiens
IVNLPGCSA

SEQ ID NO: 126381 - protein, 9 aa, Homo Sapiens
IVNVPQPAA

SEQ ID NO: 126382 - protein, 9 aa, Homo Sapiens
KAIFTGHSA

SEQ ID NO: 126383 - protein, 9 aa, Homo Sapiens
KAINVFVSA

SEQ ID NO: 126384 - protein, 9 aa, Homo Sapiens
KAQLQQVEA

SEQ ID NO: 126385 - protein, 9 aa, Homo Sapiens
KGYFFPTSA

SEQ ID NO: 126386 - protein, 9 aa, Homo Sapiens
KPAEFTVDA

SEQ ID NO: 126387 - protein, 9 aa, Homo Sapiens
KPALKIPQT

SEQ ID NO: 126388 - protein, 9 aa, Homo Sapiens
KPAMPMQQA

SEQ ID NO: 126389 - protein, 9 aa, Homo Sapiens
KPANVFITA

SEQ ID NO: 126390 - protein, 9 aa, Homo Sapiens
KPAPPFNVT

SEQ ID NO: 126391 - protein, 9 aa, Homo Sapiens
KPAPVIHPA

SEQ ID NO: 126392 - protein, 9 aa, Homo Sapiens
KPAVPTVAS

SEQ ID NO: 126393 - protein, 9 aa, Homo Sapiens
KPEEQWWSA

SEQ ID NO: 126394 - protein, 9 aa, Homo Sapiens
KPFAYVSEA

SEQ ID NO: 126395 - protein, 9 aa, Homo Sapiens
KPFKEFVEA

SEQ ID NO: 126396 - protein, 9 aa, Homo Sapiens
KPFKYIVTC

SEQ ID NO: 126397 - protein, 9 aa, Homo Sapiens
KPFLFDTKP

SEQ ID NO: 126398 - protein, 9 aa, Homo Sapiens
KPFLLPVEA

SEQ ID NO: 126399 - protein, 9 aa, Homo Sapiens
KPFYQKREV

SEQ ID NO: 126400 - protein, 9 aa, Homo Sapiens
KPGSPYRSV

SEQ ID NO: 126401 - protein, 9 aa, Homo Sapiens
KPHAIIILP

SEQ ID NO: 126402 - protein, 9 aa, Homo Sapiens
KPHDIFEAN

SEQ ID NO: 126403 - protein, 9 aa, Homo Sapiens
KPHSGFHVA

SEQ ID NO: 126404 - protein, 9 aa, Homo Sapiens
KPIFSLNTV

SEQ ID NO: 126405 - protein, 9 aa, Homo Sapiens
KPKEPPKVP

SEQ ID NO: 126406 - protein, 9 aa, Homo Sapiens
KPKEPQPEV

SEQ ID NO: 126407 - protein, 9 aa, Homo Sapiens
KPKIFIIQA

SEQ ID NO: 126408 - protein, 9 aa, Homo Sapiens
KPKIPKGVS

SEQ ID NO: 126409 - protein, 9 aa, Homo Sapiens
KPKITPVTV

SEQ ID NO: 126410 - protein, 9 aa, Homo Sapiens
KPKPIGKLA

SEQ ID NO: 126411 - protein, 9 aa, Homo Sapiens
KPKPPPVRA

SEQ ID NO: 126412 - protein, 9 aa, Homo Sapiens
KPKVPLKSA

SEQ ID NO: 126413 - protein, 9 aa, Homo Sapiens
KPLEPVSTV

SEQ ID NO: 126414 - protein, 9 aa, Homo Sapiens
KPLHPLLVV

SEQ ID NO: 126415 - protein, 9 aa, Homo Sapiens
KPLKEFVEA

SEQ ID NO: 126416 - protein, 9 aa, Homo Sapiens
KPLKGARIA

SEQ ID NO: 126417 - protein, 9 aa, Homo Sapiens
KPLPLGVRA

SEQ ID NO: 126418 - protein, 9 aa, Homo Sapiens
KPLPPIQVA

SEQ ID NO: 126419 - protein, 9 aa, Homo Sapiens
KPLQPARPV

SEQ ID NO: 126420 - protein, 9 aa, Homo Sapiens
KPLYLARVT

SEQ ID NO: 126421 - protein, 9 aa, Homo Sapiens
KPMASFVTT

SEQ ID NO: 126422 - protein, 9 aa, Homo Sapiens
KPMEGWIAV

SEQ ID NO: 126423 - protein, 9 aa, Homo Sapiens
KPMFTQVCV

SEQ ID NO: 126424 - protein, 9 aa, Homo Sapiens
KPMKSVLVV

SEQ ID NO: 126425 - protein, 9 aa, Homo Sapiens
KPMNEYRSV

SEQ ID NO: 126426 - protein, 9 aa, Homo Sapiens
KPNKPLILA

SEQ ID NO: 126427 - protein, 9 aa, Homo Sapiens
KPPAILPVA

SEQ ID NO: 126428 - protein, 9 aa, Homo Sapiens
KPPPPPPAP

SEQ ID NO: 126429 - protein, 9 aa, Homo Sapiens
KPPPPPPPP

SEQ ID NO: 126430 - protein, 9 aa, Homo Sapiens
KPQATVVSA

SEQ ID NO: 126431 - protein, 9 aa, Homo Sapiens
KPQEVFWAS

SEQ ID NO: 126432 - protein, 9 aa, Homo Sapiens
KPQNILVTS

SEQ ID NO: 126433 - protein, 9 aa, Homo Sapiens
KPQPLINHA

SEQ ID NO: 126434 - protein, 9 aa, Homo Sapiens
KPQPSILQA

SEQ ID NO: 126435 - protein, 9 aa, Homo Sapiens
KPRPIIPML

SEQ ID NO: 126436 - protein, 9 aa, Homo Sapiens
KPRPPPPPP

SEQ ID NO: 126437 - protein, 9 aa, Homo Sapiens
KPSDPAPKV

SEQ ID NO: 126438 - protein, 9 aa, Homo Sapiens
KPSESIYSA

SEQ ID NO: 126439 - protein, 9 aa, Homo Sapiens
KPSGISTIV

SEQ ID NO: 126440 - protein, 9 aa, Homo Sapiens
KPSPDHIQA

SEQ ID NO: 126441 - protein, 9 aa, Homo Sapiens
KPTGGLPET

SEQ ID NO: 126442 - protein, 9 aa, Homo Sapiens
KPTHFTVNA

SEQ ID NO: 126443 - protein, 9 aa, Homo Sapiens
KPTLVILRI

SEQ ID NO: 126444 - protein, 9 aa, Homo Sapiens
KPTVQPWIA

SEQ ID NO: 126445 - protein, 9 aa, Homo Sapiens
KPVEAAVVA

SEQ ID NO: 126446 - protein, 9 aa, Homo Sapiens
KPVEVTESA

SEQ ID NO: 126447 - protein, 9 aa, Homo Sapiens
KPVLPHKVA

SEQ ID NO: 126448 - protein, 9 aa, Homo Sapiens
KPYAHILSV

SEQ ID NO: 126449 - protein, 9 aa, Homo Sapiens
KPYCNEIHA

SEQ ID NO: 126450 - protein, 9 aa, Homo Sapiens
KPYESYIGA

SEQ ID NO: 126451 - protein, 9 aa, Homo Sapiens
KPYNVYITV

SEQ ID NO: 126452 - protein, 9 aa, Homo Sapiens
KPYPNSEAA

SEQ ID NO: 126453 - protein, 9 aa, Homo Sapiens
KVLLIENVA

SEQ ID NO: 126454 - protein, 9 aa, Homo Sapiens
LAAARLAAA

SEQ ID NO: 126455 - protein, 9 aa, Homo Sapiens
LALHQKITA

SEQ ID NO: 126456 - protein, 9 aa, Homo Sapiens
LLFHNAVSA

SEQ ID NO: 126457 - protein, 9 aa, Homo Sapiens
LPAAKGFVA

SEQ ID NO: 126458 - protein, 9 aa, Homo Sapiens
LPAAMPITA

SEQ ID NO: 126459 - protein, 9 aa, Homo Sapiens
LPAEAVEAA

SEQ ID NO: 126460 - protein, 9 aa, Homo Sapiens
LPAGILPMV

SEQ ID NO: 126461 - protein, 9 aa, Homo Sapiens
LPAPPAVSA

SEQ ID NO: 126462 - protein, 9 aa, Homo Sapiens
LPASETPKA

SEQ ID NO: 126463 - protein, 9 aa, Homo Sapiens
LPCEVKVVA

SEQ ID NO: 126464 - protein, 9 aa, Homo Sapiens
LPELLGLEA

SEQ ID NO: 126465 - protein, 9 aa, Homo Sapiens
LPFDRFSEV

SEQ ID NO: 126466 - protein, 9 aa, Homo Sapiens
LPFGGVPTV

SEQ ID NO: 126467 - protein, 9 aa, Homo Sapiens
LPFRVIPLV

SEQ ID NO: 126468 - protein, 9 aa, Homo Sapiens
LPFSSMPTA

SEQ ID NO: 126469 - protein, 9 aa, Homo Sapiens
LPHEILEMT

SEQ ID NO: 126470 - protein, 9 aa, Homo Sapiens
LPHGFTNMA

SEQ ID NO: 126471 - protein, 9 aa, Homo Sapiens
LPHNTHRVV

SEQ ID NO: 126472 - protein, 9 aa, Homo Sapiens
LPHPIIVSI

SEQ ID NO: 126473 - protein, 9 aa, Homo Sapiens
LPHPNRIQA

SEQ ID NO: 126474 - protein, 9 aa, Homo Sapiens
LPHRHPVNA

SEQ ID NO: 126475 - protein, 9 aa, Homo Sapiens
LPHSAGRYA

SEQ ID NO: 126476 - protein, 9 aa, Homo Sapiens
LPHSHDVSA

SEQ ID NO: 126477 - protein, 9 aa, Homo Sapiens
LPHSQLPQA

SEQ ID NO: 126478 - protein, 9 aa, Homo Sapiens
LPIGTLPLA

SEQ ID NO: 126479 - protein, 9 aa, Homo Sapiens
LPKEKQPVA

SEQ ID NO: 126480 - protein, 9 aa, Homo Sapiens
LPKHLLHSV

SEQ ID NO: 126481 - protein, 9 aa, Homo Sapiens
LPKPHGIRA

SEQ ID NO: 126482 - protein, 9 aa, Homo Sapiens
LPKPPGRGV

SEQ ID NO: 126483 - protein, 9 aa, Homo Sapiens
LPKPPKPVS

SEQ ID NO: 126484 - protein, 9 aa, Homo Sapiens
LPLAVTKEA

SEQ ID NO: 126485 - protein, 9 aa, Homo Sapiens
LPLHPSWEA

SEQ ID NO: 126486 - protein, 9 aa, Homo Sapiens
LPLSLLKTA

SEQ ID NO: 126487 - protein, 9 aa, Homo Sapiens
LPMDYVQRV

SEQ ID NO: 126488 - protein, 9 aa, Homo Sapiens
LPNANYPSA

SEQ ID NO: 126489 - protein, 9 aa, Homo Sapiens
LPNAVITRI

SEQ ID NO: 126490 - protein, 9 aa, Homo Sapiens
LPNFLPYNV

SEQ ID NO: 126491 - protein, 9 aa, Homo Sapiens
LPNLQTVTV

SEQ ID NO: 126492 - protein, 9 aa, Homo Sapiens
LPNQPVEKA

SEQ ID NO: 126493 - protein, 9 aa, Homo Sapiens
LPRDVLTRA

SEQ ID NO: 126494 - protein, 9 aa, Homo Sapiens
LPRKPVAGA

SEQ ID NO: 126495 - protein, 9 aa, Homo Sapiens
LPRLIDMSA

SEQ ID NO: 126496 - protein, 9 aa, Homo Sapiens
LPRPQGAAA

SEQ ID NO: 126497 - protein, 9 aa, Homo Sapiens
LPRPVPLVA

SEQ ID NO: 126498 - protein, 9 aa, Homo Sapiens
LPRRPLPPA

SEQ ID NO: 126499 - protein, 9 aa, Homo Sapiens
LPSDIAAEA

SEQ ID NO: 126500 - protein, 9 aa, Homo Sapiens
LPSELIVHI

SEQ ID NO: 126501 - protein, 9 aa, Homo Sapiens
LPSPPAVAV

SEQ ID NO: 126502 - protein, 9 aa, Homo Sapiens
LPSRFIESA

SEQ ID NO: 126503 - protein, 9 aa, Homo Sapiens
LPSVPLSCA

SEQ ID NO: 126504 - protein, 9 aa, Homo Sapiens
LPTKDLLSA

SEQ ID NO: 126505 - protein, 9 aa, Homo Sapiens
LPTKPTQGA

SEQ ID NO: 126506 - protein, 9 aa, Homo Sapiens
LPTTMGVVA

SEQ ID NO: 126507 - protein, 9 aa, Homo Sapiens
LPVAFKVVA

SEQ ID NO: 126508 - protein, 9 aa, Homo Sapiens
LPVDAVISV

SEQ ID NO: 126509 - protein, 9 aa, Homo Sapiens
LPVDVVVNA

SEQ ID NO: 126510 - protein, 9 aa, Homo Sapiens
LPVLPVAAA

SEQ ID NO: 126511 - protein, 9 aa, Homo Sapiens
LPVSLPTHA

SEQ ID NO: 126512 - protein, 9 aa, Homo Sapiens
LPVSNVVSV

SEQ ID NO: 126513 - protein, 9 aa, Homo Sapiens
LPWQGLKAA

SEQ ID NO: 126514 - protein, 9 aa, Homo Sapiens
LPWWGAIAA

SEQ ID NO: 126515 - protein, 9 aa, Homo Sapiens
LPYAITIVA

SEQ ID NO: 126516 - protein, 9 aa, Homo Sapiens
LPYDIPHRA

SEQ ID NO: 126517 - protein, 9 aa, Homo Sapiens
LPYHHVIHA

SEQ ID NO: 126518 - protein, 9 aa, Homo Sapiens
LPYKWVVEA

SEQ ID NO: 126519 - protein, 9 aa, Homo Sapiens
LPYNGVTVA

SEQ ID NO: 126520 - protein, 9 aa, Homo Sapiens
LPYNGVVLA

SEQ ID NO: 126521 - protein, 9 aa, Homo Sapiens
LVAPPLPAA

SEQ ID NO: 126522 - protein, 9 aa, Homo Sapiens
LVGPVLGAA

SEQ ID NO: 126523 - protein, 9 aa, Homo Sapiens
LVKDVFISA

SEQ ID NO: 126524 - protein, 9 aa, Homo Sapiens
LVRPPTEQA

SEQ ID NO: 126525 - protein, 9 aa, Homo Sapiens
LVRPVVPSA

SEQ ID NO: 126526 - protein, 9 aa, Homo Sapiens
LVYQGYLAA

SEQ ID NO: 126527 - protein, 9 aa, Homo Sapiens
MPAAALNAA

SEQ ID NO: 126528 - protein, 9 aa, Homo Sapiens
MPADSGYPA

SEQ ID NO: 126529 - protein, 9 aa, Homo Sapiens
MPAFPLPYA

SEQ ID NO: 126530 - protein, 9 aa, Homo Sapiens
MPAGLIAGA

SEQ ID NO: 126531 - protein, 9 aa, Homo Sapiens
MPAGSFITA

SEQ ID NO: 126532 - protein, 9 aa, Homo Sapiens
MPAHFSDSA

SEQ ID NO: 126533 - protein, 9 aa, Homo Sapiens
MPATLARAA

SEQ ID NO: 126534 - protein, 9 aa, Homo Sapiens
MPCVFVTEV

SEQ ID NO: 126535 - protein, 9 aa, Homo Sapiens
MPFGNVISA

SEQ ID NO: 126536 - protein, 9 aa, Homo Sapiens
MPFGNVVSA

SEQ ID NO: 126537 - protein, 9 aa, Homo Sapiens
MPFPNIRSA

SEQ ID NO: 126538 - protein, 9 aa, Homo Sapiens
MPHEDCITA

SEQ ID NO: 126539 - protein, 9 aa, Homo Sapiens
MPHKFVIAV

SEQ ID NO: 126540 - protein, 9 aa, Homo Sapiens
MPHYDIDSA

SEQ ID NO: 126541 - protein, 9 aa, Homo Sapiens
MPILIDFHA

SEQ ID NO: 126542 - protein, 9 aa, Homo Sapiens
MPKAEKNAV

SEQ ID NO: 126543 - protein, 9 aa, Homo Sapiens
MPLLKSEVA

SEQ ID NO: 126544 - protein, 9 aa, Homo Sapiens
MPMERQMSV

SEQ ID NO: 126545 - protein, 9 aa, Homo Sapiens
MPNHIHMGA

SEQ ID NO: 126546 - protein, 9 aa, Homo Sapiens
MPPPVGMVA

SEQ ID NO: 126547 - protein, 9 aa, Homo Sapiens
MPQDLRSPA

SEQ ID NO: 126548 - protein, 9 aa, Homo Sapiens
MPQIPVASV

SEQ ID NO: 126549 - protein, 9 aa, Homo Sapiens
MPQNPHIIA

SEQ ID NO: 126550 - protein, 9 aa, Homo Sapiens
MPRDILIVV

SEQ ID NO: 126551 - protein, 9 aa, Homo Sapiens
MPRQLSAAA

SEQ ID NO: 126552 - protein, 9 aa, Homo Sapiens
MPSDVLEVT

SEQ ID NO: 126553 - protein, 9 aa, Homo Sapiens
MPSKVNYQA

SEQ ID NO: 126554 - protein, 9 aa, Homo Sapiens
MPTDVLEVT

SEQ ID NO: 126555 - protein, 9 aa, Homo Sapiens
MPTLPPPSV

SEQ ID NO: 126556 - protein, 9 aa, Homo Sapiens
MPTQPQVQA

SEQ ID NO: 126557 - protein, 9 aa, Homo Sapiens
MPTRPGEQA

SEQ ID NO: 126558 - protein, 9 aa, Homo Sapiens
MPVGLIAGA

SEQ ID NO: 126559 - protein, 9 aa, Homo Sapiens
MPVPAQPKA

SEQ ID NO: 126560 - protein, 9 aa, Homo Sapiens
MPWFKGWKV

SEQ ID NO: 126561 - protein, 9 aa, Homo Sapiens
MPYFLLTQA

SEQ ID NO: 126562 - protein, 9 aa, Homo Sapiens
MPYLIGVHA

SEQ ID NO: 126563 - protein, 9 aa, Homo Sapiens
MPYSGMTGA

SEQ ID NO: 126564 - protein, 9 aa, Homo Sapiens
NPAPPIDAV

SEQ ID NO: 126565 - protein, 9 aa, Homo Sapiens
NPFCRFKAV

SEQ ID NO: 126566 - protein, 9 aa, Homo Sapiens
NPFGGASHA

SEQ ID NO: 126567 - protein, 9 aa, Homo Sapiens
NPFKGSSGA

SEQ ID NO: 126568 - protein, 9 aa, Homo Sapiens
NPFRSKLAA

SEQ ID NO: 126569 - protein, 9 aa, Homo Sapiens
NPGVPVPAA

SEQ ID NO: 126570 - protein, 9 aa, Homo Sapiens
NPKEFYHEV

SEQ ID NO: 126571 - protein, 9 aa, Homo Sapiens
NPLETRNIA

SEQ ID NO: 126572 - protein, 9 aa, Homo Sapiens
NPLFIPVAV

SEQ ID NO: 126573 - protein, 9 aa, Homo Sapiens
NPMGIGVTA

SEQ ID NO: 126574 - protein, 9 aa, Homo Sapiens
NPNELSVSA

SEQ ID NO: 126575 - protein, 9 aa, Homo Sapiens
NPNQYNYIA

SEQ ID NO: 126576 - protein, 9 aa, Homo Sapiens
NPTCPKVAA

SEQ ID NO: 126577 - protein, 9 aa, Homo Sapiens
NPVTGLLSA

SEQ ID NO: 126578 - protein, 9 aa, Homo Sapiens
NPYATLPRA

SEQ ID NO: 126579 - protein, 9 aa, Homo Sapiens
NPYHNAVHA

SEQ ID NO: 126580 - protein, 9 aa, Homo Sapiens
NPYSEFILA

SEQ ID NO: 126581 - protein, 9 aa, Homo Sapiens
NPYTIFHQA

SEQ ID NO: 126582 - protein, 9 aa, Homo Sapiens
NPYYGGESA

SEQ ID NO: 126583 - protein, 9 aa, Homo Sapiens
PITPRAAPL

SEQ ID NO: 126584 - protein, 9 aa, Homo Sapiens
QPANKGFRA

SEQ ID NO: 126585 - protein, 9 aa, Homo Sapiens
QPAPAIHSA

SEQ ID NO: 126586 - protein, 9 aa, Homo Sapiens
QPFESYITA

SEQ ID NO: 126587 - protein, 9 aa, Homo Sapiens
QPFGAAVST

SEQ ID NO: 126588 - protein, 9 aa, Homo Sapiens
QPFSKPVSV

SEQ ID NO: 126589 - protein, 9 aa, Homo Sapiens
QPGEALAEA

SEQ ID NO: 126590 - protein, 9 aa, Homo Sapiens
QPHHIGVAV

SEQ ID NO: 126591 - protein, 9 aa, Homo Sapiens
QPHSSALTA

SEQ ID NO: 126592 - protein, 9 aa, Homo Sapiens
QPHTILRVV

SEQ ID NO: 126593 - protein, 9 aa, Homo Sapiens
QPIFAVTSA

SEQ ID NO: 126594 - protein, 9 aa, Homo Sapiens
QPILLELEA

SEQ ID NO: 126595 - protein, 9 aa, Homo Sapiens
QPINLIFRY

SEQ ID NO: 126596 - protein, 9 aa, Homo Sapiens
QPITPGPSI

SEQ ID NO: 126597 - protein, 9 aa, Homo Sapiens
QPLEVLEAV

SEQ ID NO: 126598 - protein, 9 aa, Homo Sapiens
QPLLKHWEA

SEQ ID NO: 126599 - protein, 9 aa, Homo Sapiens
QPLLPYSAV

SEQ ID NO: 126600 - protein, 9 aa, Homo Sapiens
QPLPATHAA

SEQ ID NO: 126601 - protein, 9 aa, Homo Sapiens
QPLPMAHCA

SEQ ID NO: 126602 - protein, 9 aa, Homo Sapiens
QPLPVILHV

SEQ ID NO: 126603 - protein, 9 aa, Homo Sapiens
QPLYQPSHA

SEQ ID NO: 126604 - protein, 9 aa, Homo Sapiens
QPNTLICHI

SEQ ID NO: 126605 - protein, 9 aa, Homo Sapiens
QPQAPGVEA

SEQ ID NO: 126606 - protein, 9 aa, Homo Sapiens
QPQPQPYAV

SEQ ID NO: 126607 - protein, 9 aa, Homo Sapiens
QPRDPVRPP

SEQ ID NO: 126608 - protein, 9 aa, Homo Sapiens
QPRYPVNSV

SEQ ID NO: 126609 - protein, 9 aa, Homo Sapiens
QPSAPGHSV

SEQ ID NO: 126610 - protein, 9 aa, Homo Sapiens
QPSEVLRTV

SEQ ID NO: 126611 - protein, 9 aa, Homo Sapiens
QPSSLLPLA

SEQ ID NO: 126612 - protein, 9 aa, Homo Sapiens
QPTDALLCV

SEQ ID NO: 126613 - protein, 9 aa, Homo Sapiens
QPTPVNIRA

SEQ ID NO: 126614 - protein, 9 aa, Homo Sapiens
QPTSVLDKA

SEQ ID NO: 126615 - protein, 9 aa, Homo Sapiens
QPVCPSYTV

SEQ ID NO: 126616 - protein, 9 aa, Homo Sapiens
QPVSGTQVV

SEQ ID NO: 126617 - protein, 9 aa, Homo Sapiens
QPWRGGAGA

SEQ ID NO: 126618 - protein, 9 aa, Homo Sapiens
QPWTPVPQA

SEQ ID NO: 126619 - protein, 9 aa, Homo Sapiens
QPYGGFLDI

SEQ ID NO: 126620 - protein, 9 aa, Homo Sapiens
QPYMPTVSA

SEQ ID NO: 126621 - protein, 9 aa, Homo Sapiens
QPYQPLREV

SEQ ID NO: 126622 - protein, 9 aa, Homo Sapiens
QPYSKLPGV

SEQ ID NO: 126623 - protein, 9 aa, Homo Sapiens
QVRDVIIAA

SEQ ID NO: 126624 - protein, 9 aa, Homo Sapiens
RAFQQSTAA

SEQ ID NO: 126625 - protein, 9 aa, Homo Sapiens
RALLQAQQA

SEQ ID NO: 126626 - protein, 9 aa, Homo Sapiens
RARPPPPPP

SEQ ID NO: 126627 - protein, 9 aa, Homo Sapiens
RIFDRAVAA

SEQ ID NO: 126628 - protein, 9 aa, Homo Sapiens
RNQLQSVAA

SEQ ID NO: 126629 - protein, 9 aa, Homo Sapiens
RPAAPLIGA

SEQ ID NO: 126630 - protein, 9 aa, Homo Sapiens
RPADVIFAT

SEQ ID NO: 126631 - protein, 9 aa, Homo Sapiens
RPADYLFML

SEQ ID NO: 126632 - protein, 9 aa, Homo Sapiens
RPAEKLSTA

SEQ ID NO: 126633 - protein, 9 aa, Homo Sapiens
RPAFVIPEV

SEQ ID NO: 126634 - protein, 9 aa, Homo Sapiens
RPALFSSSA

SEQ ID NO: 126635 - protein, 9 aa, Homo Sapiens
RPALVEQTA

SEQ ID NO: 126636 - protein, 9 aa, Homo Sapiens
RPAPLPAAV

SEQ ID NO: 126637 - protein, 9 aa, Homo Sapiens
RPAPPPPTV

SEQ ID NO: 126638 - protein, 9 aa, Homo Sapiens
RPAPPRAPA

SEQ ID NO: 126639 - protein, 9 aa, Homo Sapiens
RPCDISRQL

SEQ ID NO: 126640 - protein, 9 aa, Homo Sapiens
RPFDLPLQP

SEQ ID NO: 126641 - protein, 9 aa, Homo Sapiens
RPFHGISTV

SEQ ID NO: 126642 - protein, 9 aa, Homo Sapiens
RPFIGMSSA

SEQ ID NO: 126643 - protein, 9 aa, Homo Sapiens
RPFNTYPRA

SEQ ID NO: 126644 - protein, 9 aa, Homo Sapiens
RPFPAAHHA

SEQ ID NO: 126645 - protein, 9 aa, Homo Sapiens
RPFQNQTHA

SEQ ID NO: 126646 - protein, 9 aa, Homo Sapiens
RPFQSIIHA

SEQ ID NO: 126647 - protein, 9 aa, Homo Sapiens
RPFRLGTGA

SEQ ID NO: 126648 - protein, 9 aa, Homo Sapiens
RPFTNLESA

SEQ ID NO: 126649 - protein, 9 aa, Homo Sapiens
RPFVAINYA

SEQ ID NO: 126650 - protein, 9 aa, Homo Sapiens
RPGDPGFCA

SEQ ID NO: 126651 - protein, 9 aa, Homo Sapiens
RPGLRLWKA

SEQ ID NO: 126652 - protein, 9 aa, Homo Sapiens
RPGPGVPAT

SEQ ID NO: 126653 - protein, 9 aa, Homo Sapiens
RPGPVLPAV

SEQ ID NO: 126654 - protein, 9 aa, Homo Sapiens
RPHAPGRPA

SEQ ID NO: 126655 - protein, 9 aa, Homo Sapiens
RPHPLPAER

SEQ ID NO: 126656 - protein, 9 aa, Homo Sapiens
RPHPLRPEA

SEQ ID NO: 126657 - protein, 9 aa, Homo Sapiens
RPHRGILAV

SEQ ID NO: 126658 - protein, 9 aa, Homo Sapiens
RPHSALLAV

SEQ ID NO: 126659 - protein, 9 aa, Homo Sapiens
RPHSVPSSV

SEQ ID NO: 126660 - protein, 9 aa, Homo Sapiens
RPHTVLTVI

SEQ ID NO: 126661 - protein, 9 aa, Homo Sapiens
RPIASGPVV

SEQ ID NO: 126662 - protein, 9 aa, Homo Sapiens
RPIDHWDAV

SEQ ID NO: 126663 - protein, 9 aa, Homo Sapiens
RPIPNQPPT

SEQ ID NO: 126664 - protein, 9 aa, Homo Sapiens
RPISGQKEV

SEQ ID NO: 126665 - protein, 9 aa, Homo Sapiens
RPKGFYVET

SEQ ID NO: 126666 - protein, 9 aa, Homo Sapiens
RPKMQEVVA

SEQ ID NO: 126667 - protein, 9 aa, Homo Sapiens
RPKPESQGI

SEQ ID NO: 126668 - protein, 9 aa, Homo Sapiens
RPKPIITSV

SEQ ID NO: 126669 - protein, 9 aa, Homo Sapiens
RPKPPNVRT

SEQ ID NO: 126670 - protein, 9 aa, Homo Sapiens
RPKSAFKVQ

SEQ ID NO: 126671 - protein, 9 aa, Homo Sapiens
RPLAQLREV

SEQ ID NO: 126672 - protein, 9 aa, Homo Sapiens
RPLATAYKA

SEQ ID NO: 126673 - protein, 9 aa, Homo Sapiens
RPLFGETSA

SEQ ID NO: 126674 - protein, 9 aa, Homo Sapiens
RPLFPSTGA

SEQ ID NO: 126675 - protein, 9 aa, Homo Sapiens
RPLGAGQEV

SEQ ID NO: 126676 - protein, 9 aa, Homo Sapiens
RPLHEFITA

SEQ ID NO: 126677 - protein, 9 aa, Homo Sapiens
RPLLKAITA

SEQ ID NO: 126678 - protein, 9 aa, Homo Sapiens
RPLQDEPAA

SEQ ID NO: 126679 - protein, 9 aa, Homo Sapiens
RPLSRLQAA

SEQ ID NO: 126680 - protein, 9 aa, Homo Sapiens
RPLTLFHTV

SEQ ID NO: 126681 - protein, 9 aa, Homo Sapiens
RPMKVGHVT

SEQ ID NO: 126682 - protein, 9 aa, Homo Sapiens
RPNDIMAEV

SEQ ID NO: 126683 - protein, 9 aa, Homo Sapiens
RPNERVDTV

SEQ ID NO: 126684 - protein, 9 aa, Homo Sapiens
RPNETFHLA

SEQ ID NO: 126685 - protein, 9 aa, Homo Sapiens
RPNGVITGL

SEQ ID NO: 126686 - protein, 9 aa, Homo Sapiens
RPNLIKPAA

SEQ ID NO: 126687 - protein, 9 aa, Homo Sapiens
RPNPPPVSV

SEQ ID NO: 126688 - protein, 9 aa, Homo Sapiens
RPPPIGAEV

SEQ ID NO: 126689 - protein, 9 aa, Homo Sapiens
RPQDIIVFV

SEQ ID NO: 126690 - protein, 9 aa, Homo Sapiens
RPQEIDEAA

SEQ ID NO: 126691 - protein, 9 aa, Homo Sapiens
RPQSETNVA

SEQ ID NO: 126692 - protein, 9 aa, Homo Sapiens
RPRAPIIAV

SEQ ID NO: 126693 - protein, 9 aa, Homo Sapiens
RPRDEVQEV

SEQ ID NO: 126694 - protein, 9 aa, Homo Sapiens
RPRDSQLYA

SEQ ID NO: 126695 - protein, 9 aa, Homo Sapiens
RPRFVSLRA

SEQ ID NO: 126696 - protein, 9 aa, Homo Sapiens
RPRHQGVMV

SEQ ID NO: 126697 - protein, 9 aa, Homo Sapiens
RPRIAGITA

SEQ ID NO: 126698 - protein, 9 aa, Homo Sapiens
RPRITHPPP

SEQ ID NO: 126699 - protein, 9 aa, Homo Sapiens
RPRPGTGLG

SEQ ID NO: 126700 - protein, 9 aa, Homo Sapiens
RPRPPPVEQ

SEQ ID NO: 126701 - protein, 9 aa, Homo Sapiens
RPRPPVSST

SEQ ID NO: 126702 - protein, 9 aa, Homo Sapiens
RPRPVVTTT

SEQ ID NO: 126703 - protein, 9 aa, Homo Sapiens
RPRTAGPAV

SEQ ID NO: 126704 - protein, 9 aa, Homo Sapiens
RPRYLEIRA

SEQ ID NO: 126705 - protein, 9 aa, Homo Sapiens
RPSDIKFKP

SEQ ID NO: 126706 - protein, 9 aa, Homo Sapiens
RPSFVHPGA

SEQ ID NO: 126707 - protein, 9 aa, Homo Sapiens
RPSHFLNFA

SEQ ID NO: 126708 - protein, 9 aa, Homo Sapiens
RPSLNIATV

SEQ ID NO: 126709 - protein, 9 aa, Homo Sapiens
RPSPAPPAA

SEQ ID NO: 126710 - protein, 9 aa, Homo Sapiens
RPSPPVQSV

SEQ ID NO: 126711 - protein, 9 aa, Homo Sapiens
RPSQVVAET

SEQ ID NO: 126712 - protein, 9 aa, Homo Sapiens
RPSSTFNTV

SEQ ID NO: 126713 - protein, 9 aa, Homo Sapiens
RPSTDFTQA

SEQ ID NO: 126714 - protein, 9 aa, Homo Sapiens
RPVGGGPSA

SEQ ID NO: 126715 - protein, 9 aa, Homo Sapiens
RPVHHVVPP

SEQ ID NO: 126716 - protein, 9 aa, Homo Sapiens
RPVHLDQAA

SEQ ID NO: 126717 - protein, 9 aa, Homo Sapiens
RPVLPRTEA

SEQ ID NO: 126718 - protein, 9 aa, Homo Sapiens
RPVNDMNIA

SEQ ID NO: 126719 - protein, 9 aa, Homo Sapiens
RPVPGYEPG

SEQ ID NO: 126720 - protein, 9 aa, Homo Sapiens
RPVQRLPSV

SEQ ID NO: 126721 - protein, 9 aa, Homo Sapiens
RPVTPPRTA

SEQ ID NO: 126722 - protein, 9 aa, Homo Sapiens
RPWKGVLMV

SEQ ID NO: 126723 - protein, 9 aa, Homo Sapiens
RPWLDPAAA

SEQ ID NO: 126724 - protein, 9 aa, Homo Sapiens
RPWPNPNSA

SEQ ID NO: 126725 - protein, 9 aa, Homo Sapiens
RPYDKNISP

SEQ ID NO: 126726 - protein, 9 aa, Homo Sapiens
RPYEPINSI

SEQ ID NO: 126727 - protein, 9 aa, Homo Sapiens
RPYFPKDEA

SEQ ID NO: 126728 - protein, 9 aa, Homo Sapiens
RPYGCVLRA

SEQ ID NO: 126729 - protein, 9 aa, Homo Sapiens
RPYHTIIEI

SEQ ID NO: 126730 - protein, 9 aa, Homo Sapiens
RPYLQRKDV

SEQ ID NO: 126731 - protein, 9 aa, Homo Sapiens
RPYLSAVRA

SEQ ID NO: 126732 - protein, 9 aa, Homo Sapiens
RPYSHALVA

SEQ ID NO: 126733 - protein, 9 aa, Homo Sapiens
RPYSVPPCV

SEQ ID NO: 126734 - protein, 9 aa, Homo Sapiens
RPYTGKVGA

SEQ ID NO: 126735 - protein, 9 aa, Homo Sapiens
RPYVHKILV

SEQ ID NO: 126736 - protein, 9 aa, Homo Sapiens
RVAYRPISA

SEQ ID NO: 126737 - protein, 9 aa, Homo Sapiens
RVKCVGLSA

SEQ ID NO: 126738 - protein, 9 aa, Homo Sapiens
RVKVSQAAA

SEQ ID NO: 126739 - protein, 9 aa, Homo Sapiens
RVREIIINA

SEQ ID NO: 126740 - protein, 9 aa, Homo Sapiens
SAPVNFISA

SEQ ID NO: 126741 - protein, 9 aa, Homo Sapiens
SPAALKPPA

SEQ ID NO: 126742 - protein, 9 aa, Homo Sapiens
SPAAPVITA

SEQ ID NO: 126743 - protein, 9 aa, Homo Sapiens
SPAARLHCA

SEQ ID NO: 126744 - protein, 9 aa, Homo Sapiens
SPAGILVDA

SEQ ID NO: 126745 - protein, 9 aa, Homo Sapiens
SPAHAVDAV

SEQ ID NO: 126746 - protein, 9 aa, Homo Sapiens
SPAHVLLAA

SEQ ID NO: 126747 - protein, 9 aa, Homo Sapiens
SPAKTLPGA

SEQ ID NO: 126748 - protein, 9 aa, Homo Sapiens
SPAPPLLHV

SEQ ID NO: 126749 - protein, 9 aa, Homo Sapiens
SPAQVIPLA

SEQ ID NO: 126750 - protein, 9 aa, Homo Sapiens
SPAYRDLAA

SEQ ID NO: 126751 - protein, 9 aa, Homo Sapiens
SPCNNNINA

SEQ ID NO: 126752 - protein, 9 aa, Homo Sapiens
SPDSPVTSA

SEQ ID NO: 126753 - protein, 9 aa, Homo Sapiens
SPEAHTVEA

SEQ ID NO: 126754 - protein, 9 aa, Homo Sapiens
SPESPVLAA

SEQ ID NO: 126755 - protein, 9 aa, Homo Sapiens
SPFAEGTSA

SEQ ID NO: 126756 - protein, 9 aa, Homo Sapiens
SPFENTENA

SEQ ID NO: 126757 - protein, 9 aa, Homo Sapiens
SPFFPLVSA

SEQ ID NO: 126758 - protein, 9 aa, Homo Sapiens
SPFGSITSA

SEQ ID NO: 126759 - protein, 9 aa, Homo Sapiens
SPFGTITSA

SEQ ID NO: 126760 - protein, 9 aa, Homo Sapiens
SPFHFQPSA

SEQ ID NO: 126761 - protein, 9 aa, Homo Sapiens
SPFPDIPKV

SEQ ID NO: 126762 - protein, 9 aa, Homo Sapiens
SPFPPAKSA

SEQ ID NO: 126763 - protein, 9 aa, Homo Sapiens
SPFRVNVGA

SEQ ID NO: 126764 - protein, 9 aa, Homo Sapiens
SPFSGLQKA

SEQ ID NO: 126765 - protein, 9 aa, Homo Sapiens
SPFSSFISV

SEQ ID NO: 126766 - protein, 9 aa, Homo Sapiens
SPGLQKEAV

SEQ ID NO: 126767 - protein, 9 aa, Homo Sapiens
SPHFPHTAA

SEQ ID NO: 126768 - protein, 9 aa, Homo Sapiens
SPHISSQTA

SEQ ID NO: 126769 - protein, 9 aa, Homo Sapiens
SPHLGPAPA

SEQ ID NO: 126770 - protein, 9 aa, Homo Sapiens
SPHPGLVAA

SEQ ID NO: 126771 - protein, 9 aa, Homo Sapiens
SPHPSPLGA

SEQ ID NO: 126772 - protein, 9 aa, Homo Sapiens
SPHQVTPQA

SEQ ID NO: 126773 - protein, 9 aa, Homo Sapiens
SPHRPILQA

SEQ ID NO: 126774 - protein, 9 aa, Homo Sapiens
SPHSQVLTA

SEQ ID NO: 126775 - protein, 9 aa, Homo Sapiens
SPHTKMDVA

SEQ ID NO: 126776 - protein, 9 aa, Homo Sapiens
SPHVQVKAA

SEQ ID NO: 126777 - protein, 9 aa, Homo Sapiens
SPIEFLENA

SEQ ID NO: 126778 - protein, 9 aa, Homo Sapiens
SPIENIQRV

SEQ ID NO: 126779 - protein, 9 aa, Homo Sapiens
SPILVATAV

SEQ ID NO: 126780 - protein, 9 aa, Homo Sapiens
SPIVKSTEA

SEQ ID NO: 126781 - protein, 9 aa, Homo Sapiens
SPKDVILKV

SEQ ID NO: 126782 - protein, 9 aa, Homo Sapiens
SPKGTIENI

SEQ ID NO: 126783 - protein, 9 aa, Homo Sapiens
SPKLPSLEA

SEQ ID NO: 126784 - protein, 9 aa, Homo Sapiens
SPKPVSSTV

SEQ ID NO: 126785 - protein, 9 aa, Homo Sapiens
SPKQILDPA

SEQ ID NO: 126786 - protein, 9 aa, Homo Sapiens
SPKSPGLKA

SEQ ID NO: 126787 - protein, 9 aa, Homo Sapiens
SPKTTISVA

SEQ ID NO: 126788 - protein, 9 aa, Homo Sapiens
SPKTTITMA

SEQ ID NO: 126789 - protein, 9 aa, Homo Sapiens
SPLASGAVA

SEQ ID NO: 126790 - protein, 9 aa, Homo Sapiens
SPLATSTTA

SEQ ID NO: 126791 - protein, 9 aa, Homo Sapiens
SPLFSQHTA

SEQ ID NO: 126792 - protein, 9 aa, Homo Sapiens
SPLHLAVEA

SEQ ID NO: 126793 - protein, 9 aa, Homo Sapiens
SPLKHFVTA

SEQ ID NO: 126794 - protein, 9 aa, Homo Sapiens
SPLLHNPSA

SEQ ID NO: 126795 - protein, 9 aa, Homo Sapiens
SPLLQAHHA

SEQ ID NO: 126796 - protein, 9 aa, Homo Sapiens
SPLNAMPRA

SEQ ID NO: 126797 - protein, 9 aa, Homo Sapiens
SPLPAHPSV

SEQ ID NO: 126798 - protein, 9 aa, Homo Sapiens
SPLPQYVTV

SEQ ID NO: 126799 - protein, 9 aa, Homo Sapiens
SPLPTPFGA

SEQ ID NO: 126800 - protein, 9 aa, Homo Sapiens
SPLQKALLA

SEQ ID NO: 126801 - protein, 9 aa, Homo Sapiens
SPLSAARAA

SEQ ID NO: 126802 - protein, 9 aa, Homo Sapiens
SPLSSHPVV

SEQ ID NO: 126803 - protein, 9 aa, Homo Sapiens
SPLWTSIGA

SEQ ID NO: 126804 - protein, 9 aa, Homo Sapiens
SPLYLAHEV

SEQ ID NO: 126805 - protein, 9 aa, Homo Sapiens
SPMDTVTEA

SEQ ID NO: 126806 - protein, 9 aa, Homo Sapiens
SPMIPSIVV

SEQ ID NO: 126807 - protein, 9 aa, Homo Sapiens
SPMPGTLTA

SEQ ID NO: 126808 - protein, 9 aa, Homo Sapiens
SPMSQTETV

SEQ ID NO: 126809 - protein, 9 aa, Homo Sapiens
SPNEVKVVA

SEQ ID NO: 126810 - protein, 9 aa, Homo Sapiens
SPNGQFVAP

SEQ ID NO: 126811 - protein, 9 aa, Homo Sapiens
SPNLPHRDA

SEQ ID NO: 126812 - protein, 9 aa, Homo Sapiens
SPNRYWLCA

SEQ ID NO: 126813 - protein, 9 aa, Homo Sapiens
SPNSILKAA

SEQ ID NO: 126814 - protein, 9 aa, Homo Sapiens
SPNSYFMDV

SEQ ID NO: 126815 - protein, 9 aa, Homo Sapiens
SPPEVIRAA

SEQ ID NO: 126816 - protein, 9 aa, Homo Sapiens
SPPKIHVSA

SEQ ID NO: 126817 - protein, 9 aa, Homo Sapiens
SPQAPTLQV

SEQ ID NO: 126818 - protein, 9 aa, Homo Sapiens
SPQPVGQQA

SEQ ID NO: 126819 - protein, 9 aa, Homo Sapiens
SPREPGYKA

SEQ ID NO: 126820 - protein, 9 aa, Homo Sapiens
SPREVFFRV

SEQ ID NO: 126821 - protein, 9 aa, Homo Sapiens
SPRLLGAAA

SEQ ID NO: 126822 - protein, 9 aa, Homo Sapiens
SPRNLAMEA

SEQ ID NO: 126823 - protein, 9 aa, Homo Sapiens
SPRPPLISV

SEQ ID NO: 126824 - protein, 9 aa, Homo Sapiens
SPRPVVVET

SEQ ID NO: 126825 - protein, 9 aa, Homo Sapiens
SPRVPNSSV

SEQ ID NO: 126826 - protein, 9 aa, Homo Sapiens
SPSAGVPRA

SEQ ID NO: 126827 - protein, 9 aa, Homo Sapiens
SPSDIGIIA

SEQ ID NO: 126828 - protein, 9 aa, Homo Sapiens
SPSEPGRAV

SEQ ID NO: 126829 - protein, 9 aa, Homo Sapiens
SPSKNYVMA

SEQ ID NO: 126830 - protein, 9 aa, Homo Sapiens
SPSPPQAEA

SEQ ID NO: 126831 - protein, 9 aa, Homo Sapiens
SPSPPSVAV

SEQ ID NO: 126832 - protein, 9 aa, Homo Sapiens
SPSPRWVAA

SEQ ID NO: 126833 - protein, 9 aa, Homo Sapiens
SPSTVFFGA

SEQ ID NO: 126834 - protein, 9 aa, Homo Sapiens
SPSTVIHGA

SEQ ID NO: 126835 - protein, 9 aa, Homo Sapiens
SPSVPKTSA

SEQ ID NO: 126836 - protein, 9 aa, Homo Sapiens
SPTGGFVDA

SEQ ID NO: 126837 - protein, 9 aa, Homo Sapiens
SPTLLLAEA

SEQ ID NO: 126838 - protein, 9 aa, Homo Sapiens
SPTRPPVAA

SEQ ID NO: 126839 - protein, 9 aa, Homo Sapiens
SPTSVRQMA

SEQ ID NO: 126840 - protein, 9 aa, Homo Sapiens
SPTTSHVGA

SEQ ID NO: 126841 - protein, 9 aa, Homo Sapiens
SPVAQPVTV

SEQ ID NO: 126842 - protein, 9 aa, Homo Sapiens
SPVGNRVTV

SEQ ID NO: 126843 - protein, 9 aa, Homo Sapiens
SPVLPLTSA

SEQ ID NO: 126844 - protein, 9 aa, Homo Sapiens
SPVMVSNPA

SEQ ID NO: 126845 - protein, 9 aa, Homo Sapiens
SPVPIAPTA

SEQ ID NO: 126846 - protein, 9 aa, Homo Sapiens
SPVPSHWMV

SEQ ID NO: 126847 - protein, 9 aa, Homo Sapiens
SPVSSLPTA

SEQ ID NO: 126848 - protein, 9 aa, Homo Sapiens
SPVTDFREA

SEQ ID NO: 126849 - protein, 9 aa, Homo Sapiens
SPVVPQISA

SEQ ID NO: 126850 - protein, 9 aa, Homo Sapiens
SPYAAMLAA

SEQ ID NO: 126851 - protein, 9 aa, Homo Sapiens
SPYGGGRPG

SEQ ID NO: 126852 - protein, 9 aa, Homo Sapiens
SPYHGFTIV

SEQ ID NO: 126853 - protein, 9 aa, Homo Sapiens
SPYHNFDSV

SEQ ID NO: 126854 - protein, 9 aa, Homo Sapiens
SPYIPPHAA

SEQ ID NO: 126855 - protein, 9 aa, Homo Sapiens
SPYYFLTSA

SEQ ID NO: 126856 - protein, 9 aa, Homo Sapiens
SVPSNPVAA

SEQ ID NO: 126857 - protein, 9 aa, Homo Sapiens
TIRTPMAAA

SEQ ID NO: 126858 - protein, 9 aa, Homo Sapiens
TPADIWSTA

SEQ ID NO: 126859 - protein, 9 aa, Homo Sapiens
TPAGAAVSA

SEQ ID NO: 126860 - protein, 9 aa, Homo Sapiens
TPAHVLPSA

SEQ ID NO: 126861 - protein, 9 aa, Homo Sapiens
TPAKAIAAV

SEQ ID NO: 126862 - protein, 9 aa, Homo Sapiens
TPCDKILKA

SEQ ID NO: 126863 - protein, 9 aa, Homo Sapiens
TPFKGVRKA

SEQ ID NO: 126864 - protein, 9 aa, Homo Sapiens
TPFKLTTEA

SEQ ID NO: 126865 - protein, 9 aa, Homo Sapiens
TPFKPILEA

SEQ ID NO: 126866 - protein, 9 aa, Homo Sapiens
TPFTAIREA

SEQ ID NO: 126867 - protein, 9 aa, Homo Sapiens
TPFYFKEPS

SEQ ID NO: 126868 - protein, 9 aa, Homo Sapiens
TPGRAQISA

SEQ ID NO: 126869 - protein, 9 aa, Homo Sapiens
TPHAIVILP

SEQ ID NO: 126870 - protein, 9 aa, Homo Sapiens
TPHDFIEHI

SEQ ID NO: 126871 - protein, 9 aa, Homo Sapiens
TPHFSGLAA

SEQ ID NO: 126872 - protein, 9 aa, Homo Sapiens
TPHLRNLAV

SEQ ID NO: 126873 - protein, 9 aa, Homo Sapiens
TPHTVILFA

SEQ ID NO: 126874 - protein, 9 aa, Homo Sapiens
TPHVPYRES

SEQ ID NO: 126875 - protein, 9 aa, Homo Sapiens
TPHYIYPPA

SEQ ID NO: 126876 - protein, 9 aa, Homo Sapiens
TPIGVQAEA

SEQ ID NO: 126877 - protein, 9 aa, Homo Sapiens
TPIRGLLMA

SEQ ID NO: 126878 - protein, 9 aa, Homo Sapiens
TPIRRDFSA

SEQ ID NO: 126879 - protein, 9 aa, Homo Sapiens
TPKMPGQSV

SEQ ID NO: 126880 - protein, 9 aa, Homo Sapiens
TPKPVEPAA

SEQ ID NO: 126881 - protein, 9 aa, Homo Sapiens
TPLASFTTV

SEQ ID NO: 126882 - protein, 9 aa, Homo Sapiens
TPLGGIQAA

SEQ ID NO: 126883 - protein, 9 aa, Homo Sapiens
TPLLMQALP

SEQ ID NO: 126884 - protein, 9 aa, Homo Sapiens
TPLLSGKAA

SEQ ID NO: 126885 - protein, 9 aa, Homo Sapiens
TPLPGGHAA

SEQ ID NO: 126886 - protein, 9 aa, Homo Sapiens
TPLRPLDPT

SEQ ID NO: 126887 - protein, 9 aa, Homo Sapiens
TPLSKLMKA

SEQ ID NO: 126888 - protein, 9 aa, Homo Sapiens
TPLYTDNTA

SEQ ID NO: 126889 - protein, 9 aa, Homo Sapiens
TPMAASVVA

SEQ ID NO: 126890 - protein, 9 aa, Homo Sapiens
TPMGPGRTV

SEQ ID NO: 126891 - protein, 9 aa, Homo Sapiens
TPMPPISSV

SEQ ID NO: 126892 - protein, 9 aa, Homo Sapiens
TPMSVLQQA

SEQ ID NO: 126893 - protein, 9 aa, Homo Sapiens
TPNKPSVAV

SEQ ID NO: 126894 - protein, 9 aa, Homo Sapiens
TPNRATFVV

SEQ ID NO: 126895 - protein, 9 aa, Homo Sapiens
TPQEDYVEA

SEQ ID NO: 126896 - protein, 9 aa, Homo Sapiens
TPQGHVAVA

SEQ ID NO: 126897 - protein, 9 aa, Homo Sapiens
TPQLNAIIA

SEQ ID NO: 126898 - protein, 9 aa, Homo Sapiens
TPQPPLLKA

SEQ ID NO: 126899 - protein, 9 aa, Homo Sapiens
TPQSIFIFA

SEQ ID NO: 126900 - protein, 9 aa, Homo Sapiens
TPRAATVKA

SEQ ID NO: 126901 - protein, 9 aa, Homo Sapiens
TPSAGAVAA

SEQ ID NO: 126902 - protein, 9 aa, Homo Sapiens
TPSIPVLTA

SEQ ID NO: 126903 - protein, 9 aa, Homo Sapiens
TPTEFFFHA

SEQ ID NO: 126904 - protein, 9 aa, Homo Sapiens
TPTFTYKAA

SEQ ID NO: 126905 - protein, 9 aa, Homo Sapiens
TPTGTHPLA

SEQ ID NO: 126906 - protein, 9 aa, Homo Sapiens
TPTKGGWKV

SEQ ID NO: 126907 - protein, 9 aa, Homo Sapiens
TPTPPFQQA

SEQ ID NO: 126908 - protein, 9 aa, Homo Sapiens
TPTSYIIEA

SEQ ID NO: 126909 - protein, 9 aa, Homo Sapiens
TPVGGLLMA

SEQ ID NO: 126910 - protein, 9 aa, Homo Sapiens
TPVKGGTVA

SEQ ID NO: 126911 - protein, 9 aa, Homo Sapiens
TPVLIPKGA

SEQ ID NO: 126912 - protein, 9 aa, Homo Sapiens
TPVLPAPTA

SEQ ID NO: 126913 - protein, 9 aa, Homo Sapiens
TPVNSICSV

SEQ ID NO: 126914 - protein, 9 aa, Homo Sapiens
TPVPPPSAA

SEQ ID NO: 126915 - protein, 9 aa, Homo Sapiens
TPVSYMHTA

SEQ ID NO: 126916 - protein, 9 aa, Homo Sapiens
TPWFKIIAA

SEQ ID NO: 126917 - protein, 9 aa, Homo Sapiens
TPYNYPVPV

SEQ ID NO: 126918 - protein, 9 aa, Homo Sapiens
TPYPKLKTA

SEQ ID NO: 126919 - protein, 9 aa, Homo Sapiens
TPYRPPAAA

SEQ ID NO: 126920 - protein, 9 aa, Homo Sapiens
TPYTGILYA

SEQ ID NO: 126921 - protein, 9 aa, Homo Sapiens
TVYEGFISA

SEQ ID NO: 126922 - protein, 9 aa, Homo Sapiens
VAVLQEVAA

SEQ ID NO: 126923 - protein, 9 aa, Homo Sapiens
VIRNIVEAA

SEQ ID NO: 126924 - protein, 9 aa, Homo Sapiens
VPAEGAPTA

SEQ ID NO: 126925 - protein, 9 aa, Homo Sapiens
VPAGGAVAV

SEQ ID NO: 126926 - protein, 9 aa, Homo Sapiens
VPAGSGLSA

SEQ ID NO: 126927 - protein, 9 aa, Homo Sapiens
VPAKKITAA

SEQ ID NO: 126928 - protein, 9 aa, Homo Sapiens
VPAKWIHEA

SEQ ID NO: 126929 - protein, 9 aa, Homo Sapiens
VPANPYHTA

SEQ ID NO: 126930 - protein, 9 aa, Homo Sapiens
VPAPAHLVA

SEQ ID NO: 126931 - protein, 9 aa, Homo Sapiens
VPAPAPAAA

SEQ ID NO: 126932 - protein, 9 aa, Homo Sapiens
VPAPFFLPA

SEQ ID NO: 126933 - protein, 9 aa, Homo Sapiens
VPAPGGPAA

SEQ ID NO: 126934 - protein, 9 aa, Homo Sapiens
VPAPSPLSA

SEQ ID NO: 126935 - protein, 9 aa, Homo Sapiens
VPAPSVPSV

SEQ ID NO: 126936 - protein, 9 aa, Homo Sapiens
VPCQVLRMA

SEQ ID NO: 126937 - protein, 9 aa, Homo Sapiens
VPFAAPATA

SEQ ID NO: 126938 - protein, 9 aa, Homo Sapiens
VPFIVPLSV

SEQ ID NO: 126939 - protein, 9 aa, Homo Sapiens
VPFKDMPAT

SEQ ID NO: 126940 - protein, 9 aa, Homo Sapiens
VPFLNPYTV

SEQ ID NO: 126941 - protein, 9 aa, Homo Sapiens
VPFPTPLEA

SEQ ID NO: 126942 - protein, 9 aa, Homo Sapiens
VPFQNAATA

SEQ ID NO: 126943 - protein, 9 aa, Homo Sapiens
VPHCVPISA

SEQ ID NO: 126944 - protein, 9 aa, Homo Sapiens
VPHNVQVAA

SEQ ID NO: 126945 - protein, 9 aa, Homo Sapiens
VPHQPFSQA

SEQ ID NO: 126946 - protein, 9 aa, Homo Sapiens
VPHRATVYA

SEQ ID NO: 126947 - protein, 9 aa, Homo Sapiens
VPHRSYVST

SEQ ID NO: 126948 - protein, 9 aa, Homo Sapiens
VPIKPLPNV

SEQ ID NO: 126949 - protein, 9 aa, Homo Sapiens
VPIMPYPPA

SEQ ID NO: 126950 - protein, 9 aa, Homo Sapiens
VPIPKSHEA

SEQ ID NO: 126951 - protein, 9 aa, Homo Sapiens
VPIRLIINA

SEQ ID NO: 126952 - protein, 9 aa, Homo Sapiens
VPITAVIAA

SEQ ID NO: 126953 - protein, 9 aa, Homo Sapiens
VPKAQKETV

SEQ ID NO: 126954 - protein, 9 aa, Homo Sapiens
VPKPEEEVA

SEQ ID NO: 126955 - protein, 9 aa, Homo Sapiens
VPLAIVNKA

SEQ ID NO: 126956 - protein, 9 aa, Homo Sapiens
VPLDHRVHA

SEQ ID NO: 126957 - protein, 9 aa, Homo Sapiens
VPLFVQHDA

SEQ ID NO: 126958 - protein, 9 aa, Homo Sapiens
VPLSHLINA

SEQ ID NO: 126959 - protein, 9 aa, Homo Sapiens
VPMSALKSV

SEQ ID NO: 126960 - protein, 9 aa, Homo Sapiens
VPMTPLRTV

SEQ ID NO: 126961 - protein, 9 aa, Homo Sapiens
VPNDKYYGA

SEQ ID NO: 126962 - protein, 9 aa, Homo Sapiens
VPNKFLVTA

SEQ ID NO: 126963 - protein, 9 aa, Homo Sapiens
VPNKIINRA

SEQ ID NO: 126964 - protein, 9 aa, Homo Sapiens
VPNLQTVSV

SEQ ID NO: 126965 - protein, 9 aa, Homo Sapiens
VPNPYIISA

SEQ ID NO: 126966 - protein, 9 aa, Homo Sapiens
VPQAKPVAV

SEQ ID NO: 126967 - protein, 9 aa, Homo Sapiens
VPQGLLKAA

SEQ ID NO: 126968 - protein, 9 aa, Homo Sapiens
VPQSVTECV

SEQ ID NO: 126969 - protein, 9 aa, Homo Sapiens
VPQTPLHTA

SEQ ID NO: 126970 - protein, 9 aa, Homo Sapiens
VPRLPATAA

SEQ ID NO: 126971 - protein, 9 aa, Homo Sapiens
VPRPASVSA

SEQ ID NO: 126972 - protein, 9 aa, Homo Sapiens
VPRQPTVTS

SEQ ID NO: 126973 - protein, 9 aa, Homo Sapiens
VPSAVLIVA

SEQ ID NO: 126974 - protein, 9 aa, Homo Sapiens
VPSLFSKSA

SEQ ID NO: 126975 - protein, 9 aa, Homo Sapiens
VPSLQGEKA

SEQ ID NO: 126976 - protein, 9 aa, Homo Sapiens
VPSPRLAAA

SEQ ID NO: 126977 - protein, 9 aa, Homo Sapiens
VPSPVAISA

SEQ ID NO: 126978 - protein, 9 aa, Homo Sapiens
VPSSPPTKR

SEQ ID NO: 126979 - protein, 9 aa, Homo Sapiens
VPSYPSKSA

SEQ ID NO: 126980 - protein, 9 aa, Homo Sapiens
VPTDYSVSA

SEQ ID NO: 126981 - protein, 9 aa, Homo Sapiens
VPTEPLPAP

SEQ ID NO: 126982 - protein, 9 aa, Homo Sapiens
VPTPAPISA

SEQ ID NO: 126983 - protein, 9 aa, Homo Sapiens
VPTPIHPIF

SEQ ID NO: 126984 - protein, 9 aa, Homo Sapiens
VPTTAAATA

SEQ ID NO: 126985 - protein, 9 aa, Homo Sapiens
VPVDTGVAA

SEQ ID NO: 126986 - protein, 9 aa, Homo Sapiens
VPVEPVLTV

SEQ ID NO: 126987 - protein, 9 aa, Homo Sapiens
VPVSTINHA

SEQ ID NO: 126988 - protein, 9 aa, Homo Sapiens
VPWGGAAAV

SEQ ID NO: 126989 - protein, 9 aa, Homo Sapiens
VPYGTPLSV

SEQ ID NO: 126990 - protein, 9 aa, Homo Sapiens
VPYGVGKAA

SEQ ID NO: 126991 - protein, 9 aa, Homo Sapiens
VPYLVGQVV

SEQ ID NO: 126992 - protein, 9 aa, Homo Sapiens
VPYPPLLRA

SEQ ID NO: 126993 - protein, 9 aa, Homo Sapiens
VVAPSIIAA

SEQ ID NO: 126994 - protein, 9 aa, Homo Sapiens
VVRPAHISA

SEQ ID NO: 126995 - protein, 9 aa, Homo Sapiens
YPAPQVSTA

SEQ ID NO: 126996 - protein, 9 aa, Homo Sapiens
YPFKNLPTA

SEQ ID NO: 126997 - protein, 9 aa, Homo Sapiens
YPGFNPFRA

SEQ ID NO: 126998 - protein, 9 aa, Homo Sapiens
YPHGWVETA

SEQ ID NO: 126999 - protein, 9 aa, Homo Sapiens
YPISIFIKP

SEQ ID NO: 127000 - protein, 9 aa, Homo Sapiens
YPKNPHLRA

SEQ ID NO: 127001 - protein, 9 aa, Homo Sapiens
YPLDLLLKL

SEQ ID NO: 127002 - protein, 9 aa, Homo Sapiens
YPLEKVAEA

SEQ ID NO: 127003 - protein, 9 aa, Homo Sapiens
YPLLLKELA

SEQ ID NO: 127004 - protein, 9 aa, Homo Sapiens
YPNFAGPHA

SEQ ID NO: 127005 - protein, 9 aa, Homo Sapiens
YPNFSLPAA

SEQ ID NO: 127006 - protein, 9 aa, Homo Sapiens
YPNYPNPAV

SEQ ID NO: 127007 - protein, 9 aa, Homo Sapiens
YPQELIVPA

SEQ ID NO: 127008 - protein, 9 aa, Homo Sapiens
YPRPGTPAA

SEQ ID NO: 127009 - protein, 9 aa, Homo Sapiens
YPSAPFLAA

SEQ ID NO: 127010 - protein, 9 aa, Homo Sapiens
YPTHVKVTA

SEQ ID NO: 127011 - protein, 9 aa, Homo Sapiens
YPVHLAVRA

SEQ ID NO: 127012 - protein, 9 aa, Homo Sapiens
YSFYLPIAA

SEQ ID NO: 127013 - protein, 10 aa, Homo Sapiens
AAAAAAKVPA

SEQ ID NO: 127014 - protein, 10 aa, Homo Sapiens
AAAAPAAPAA

SEQ ID NO: 127015 - protein, 10 aa, Homo Sapiens
AAGGPQRIPA

SEQ ID NO: 127016 - protein, 10 aa, Homo Sapiens
AAPAPAAHVA

SEQ ID NO: 127017 - protein, 10 aa, Homo Sapiens
AAVPTNIIAA

SEQ ID NO: 127018 - protein, 10 aa, Homo Sapiens
AGPARLSPAA

SEQ ID NO: 127019 - protein, 10 aa, Homo Sapiens
APAAATVAVA

SEQ ID NO: 127020 - protein, 10 aa, Homo Sapiens
APAAAVVRAA

SEQ ID NO: 127021 - protein, 10 aa, Homo Sapiens
APAAGSAPAA

SEQ ID NO: 127022 - protein, 10 aa, Homo Sapiens
APAAPLQVHA

SEQ ID NO: 127023 - protein, 10 aa, Homo Sapiens
APAERRQRAA

SEQ ID NO: 127024 - protein, 10 aa, Homo Sapiens
APAGGFQNIA

SEQ ID NO: 127025 - protein, 10 aa, Homo Sapiens
APAPAEKTPV

SEQ ID NO: 127026 - protein, 10 aa, Homo Sapiens
APAPGLGAAA

SEQ ID NO: 127027 - protein, 10 aa, Homo Sapiens
APASGQLPSA

SEQ ID NO: 127028 - protein, 10 aa, Homo Sapiens
APAVLLGGVA

SEQ ID NO: 127029 - protein, 10 aa, Homo Sapiens
APCSLFPYQA

SEQ ID NO: 127030 - protein, 10 aa, Homo Sapiens
APFAAHGYGA

SEQ ID NO: 127031 - protein, 10 aa, Homo Sapiens
APFQNILPRV

SEQ ID NO: 127032 - protein, 10 aa, Homo Sapiens
APFQTSQASA

SEQ ID NO: 127033 - protein, 10 aa, Homo Sapiens
APFVPVGIAG

SEQ ID NO: 127034 - protein, 10 aa, Homo Sapiens
APGPAPPVSA

SEQ ID NO: 127035 - protein, 10 aa, Homo Sapiens
APGPPLHIGA

SEQ ID NO: 127036 - protein, 10 aa, Homo Sapiens
APHDFANIKA

SEQ ID NO: 127037 - protein, 10 aa, Homo Sapiens
APHEILIQIV

SEQ ID NO: 127038 - protein, 10 aa, Homo Sapiens
APHIIVGTPG

SEQ ID NO: 127039 - protein, 10 aa, Homo Sapiens
APHIVVGTPG

SEQ ID NO: 127040 - protein, 10 aa, Homo Sapiens
APIAPLKITV

SEQ ID NO: 127041 - protein, 10 aa, Homo Sapiens
APKGSVLQEA

SEQ ID NO: 127042 - protein, 10 aa, Homo Sapiens
APLNLGMIAA

SEQ ID NO: 127043 - protein, 10 aa, Homo Sapiens
APMAGLMEKA

SEQ ID NO: 127044 - protein, 10 aa, Homo Sapiens
APMGREGVTA

SEQ ID NO: 127045 - protein, 10 aa, Homo Sapiens
APQPAAPVGA

SEQ ID NO: 127046 - protein, 10 aa, Homo Sapiens
APRSFHPPAA

SEQ ID NO: 127047 - protein, 10 aa, Homo Sapiens
APRSLPAAMA

SEQ ID NO: 127048 - protein, 10 aa, Homo Sapiens
APRTPEVRAA

SEQ ID NO: 127049 - protein, 10 aa, Homo Sapiens
APSAKGTISA

SEQ ID NO: 127050 - protein, 10 aa, Homo Sapiens
APSEARTTPA

SEQ ID NO: 127051 - protein, 10 aa, Homo Sapiens
APSGGRLLSA

SEQ ID NO: 127052 - protein, 10 aa, Homo Sapiens
APSKATLIEA

SEQ ID NO: 127053 - protein, 10 aa, Homo Sapiens
APSPSHPISA

SEQ ID NO: 127054 - protein, 10 aa, Homo Sapiens
APTEYASICV

SEQ ID NO: 127055 - protein, 10 aa, Homo Sapiens
APTKALVNQV

SEQ ID NO: 127056 - protein, 10 aa, Homo Sapiens
APTSFLPPEA

SEQ ID NO: 127057 - protein, 10 aa, Homo Sapiens
APVAAHTVTA

SEQ ID NO: 127058 - protein, 10 aa, Homo Sapiens
APVAVEPGAA

SEQ ID NO: 127059 - protein, 10 aa, Homo Sapiens
APVHPPNRSA

SEQ ID NO: 127060 - protein, 10 aa, Homo Sapiens
APVVLVGDHA

SEQ ID NO: 127061 - protein, 10 aa, Homo Sapiens
APYDAIHVGA

SEQ ID NO: 127062 - protein, 10 aa, Homo Sapiens
ATNKERLFAA

SEQ ID NO: 127063 - protein, 10 aa, Homo Sapiens
AVKKNPGIAA

SEQ ID NO: 127064 - protein, 10 aa, Homo Sapiens
CPFSSKFFSA

SEQ ID NO: 127065 - protein, 10 aa, Homo Sapiens
FPANVMDVIA

SEQ ID NO: 127066 - protein, 10 aa, Homo Sapiens
FPKPYPNSEA

SEQ ID NO: 127067 - protein, 10 aa, Homo Sapiens
FPPTFAIPQA

SEQ ID NO: 127068 - protein, 10 aa, Homo Sapiens
GPFPGKFNEV

SEQ ID NO: 127069 - protein, 10 aa, Homo Sapiens
GPWVGTGLAA

SEQ ID NO: 127070 - protein, 10 aa, Homo Sapiens
GPYGGAQPSA

SEQ ID NO: 127071 - protein, 10 aa, Homo Sapiens
HPAAFPLPVV

SEQ ID NO: 127072 - protein, 10 aa, Homo Sapiens
HPFKGFLLEA

SEQ ID NO: 127073 - protein, 10 aa, Homo Sapiens
HPFPGPGLAI

SEQ ID NO: 127074 - protein, 10 aa, Homo Sapiens
HPIEPVLITA

SEQ ID NO: 127075 - protein, 10 aa, Homo Sapiens
HPIHIIPASA

SEQ ID NO: 127076 - protein, 10 aa, Homo Sapiens
HPIQTSFQEA

SEQ ID NO: 127077 - protein, 10 aa, Homo Sapiens
HPKPEGLAAA

SEQ ID NO: 127078 - protein, 10 aa, Homo Sapiens
HPLLRPPPSA

SEQ ID NO: 127079 - protein, 10 aa, Homo Sapiens
HPNPPVVHSA

SEQ ID NO: 127080 - protein, 10 aa, Homo Sapiens
HPNQPLTITA

SEQ ID NO: 127081 - protein, 10 aa, Homo Sapiens
HPQPGSANSL

SEQ ID NO: 127082 - protein, 10 aa, Homo Sapiens
HPREPLPPIQ

SEQ ID NO: 127083 - protein, 10 aa, Homo Sapiens
HPSKALIASA

SEQ ID NO: 127084 - protein, 10 aa, Homo Sapiens
HPSPLSFFSA

SEQ ID NO: 127085 - protein, 10 aa, Homo Sapiens
HPSPVVLKVY

SEQ ID NO: 127086 - protein, 10 aa, Homo Sapiens
HPSQELLASA

SEQ ID NO: 127087 - protein, 10 aa, Homo Sapiens
HPTDASMIEA

SEQ ID NO: 127088 - protein, 10 aa, Homo Sapiens
HPTEDLVVSA

SEQ ID NO: 127089 - protein, 10 aa, Homo Sapiens
HPVEDGIMDA

SEQ ID NO: 127090 - protein, 10 aa, Homo Sapiens
HPWETVTTAA

SEQ ID NO: 127091 - protein, 10 aa, Homo Sapiens
HPYLFPVAAM

SEQ ID NO: 127092 - protein, 10 aa, Homo Sapiens
HPYRLILTVA

SEQ ID NO: 127093 - protein, 10 aa, Homo Sapiens
IPADLRIISA

SEQ ID NO: 127094 - protein, 10 aa, Homo Sapiens
IPAGGRPPAA

SEQ ID NO: 127095 - protein, 10 aa, Homo Sapiens
IPAHDSPLAA

SEQ ID NO: 127096 - protein, 10 aa, Homo Sapiens
IPCELRVTSA

SEQ ID NO: 127097 - protein, 10 aa, Homo Sapiens
IPHPLIMGVI

SEQ ID NO: 127098 - protein, 10 aa, Homo Sapiens
IPKDYKTMAA

SEQ ID NO: 127099 - protein, 10 aa, Homo Sapiens
IPKHINPVAA

SEQ ID NO: 127100 - protein, 10 aa, Homo Sapiens
IPLYLKGGVA

SEQ ID NO: 127101 - protein, 10 aa, Homo Sapiens
IPMKIRNVSA

SEQ ID NO: 127102 - protein, 10 aa, Homo Sapiens
IPQLVSNISA

SEQ ID NO: 127103 - protein, 10 aa, Homo Sapiens
IPRGIPLDAA

SEQ ID NO: 127104 - protein, 10 aa, Homo Sapiens
IPRPVDGVEV

SEQ ID NO: 127105 - protein, 10 aa, Homo Sapiens
IPSYIRDSAA

SEQ ID NO: 127106 - protein, 10 aa, Homo Sapiens
IPTNTMHYGS

SEQ ID NO: 127107 - protein, 10 aa, Homo Sapiens
IPVPVSPISA

SEQ ID NO: 127108 - protein, 10 aa, Homo Sapiens
IPVQLQRSMA

SEQ ID NO: 127109 - protein, 10 aa, Homo Sapiens
IPVTEIAIAA

SEQ ID NO: 127110 - protein, 10 aa, Homo Sapiens
IPYQDYFYTA

SEQ ID NO: 127111 - protein, 10 aa, Homo Sapiens
IPYTGPFNLL

SEQ ID NO: 127112 - protein, 10 aa, Homo Sapiens
IVCDVPSASA

SEQ ID NO: 127113 - protein, 10 aa, Homo Sapiens
KPAGPLGATA

SEQ ID NO: 127114 - protein, 10 aa, Homo Sapiens
KPAPPFNVTV

SEQ ID NO: 127115 - protein, 10 aa, Homo Sapiens
KPAPPQTEQV

SEQ ID NO: 127116 - protein, 10 aa, Homo Sapiens
KPATLTTTSA

SEQ ID NO: 127117 - protein, 10 aa, Homo Sapiens
KPIDFVLNKV

SEQ ID NO: 127118 - protein, 10 aa, Homo Sapiens
KPIEMQLTSA

SEQ ID NO: 127119 - protein, 10 aa, Homo Sapiens
KPIFSLNTVA

SEQ ID NO: 127120 - protein, 10 aa, Homo Sapiens
KPKEVTTVKV

SEQ ID NO: 127121 - protein, 10 aa, Homo Sapiens
KPKGTFKDYV

SEQ ID NO: 127122 - protein, 10 aa, Homo Sapiens
KPKPAGVLGA

SEQ ID NO: 127123 - protein, 10 aa, Homo Sapiens
KPLANRIKEA

SEQ ID NO: 127124 - protein, 10 aa, Homo Sapiens
KPLDLRPKKT

SEQ ID NO: 127125 - protein, 10 aa, Homo Sapiens
KPLQPLPNTA

SEQ ID NO: 127126 - protein, 10 aa, Homo Sapiens
KPLRPLGKAA

SEQ ID NO: 127127 - protein, 10 aa, Homo Sapiens
KPMEIARIVA

SEQ ID NO: 127128 - protein, 10 aa, Homo Sapiens
KPMKSVLVVA

SEQ ID NO: 127129 - protein, 10 aa, Homo Sapiens
KPMQPGPHVV

SEQ ID NO: 127130 - protein, 10 aa, Homo Sapiens
KPNEGAIVEV

SEQ ID NO: 127131 - protein, 10 aa, Homo Sapiens
KPNPNQIISV

SEQ ID NO: 127132 - protein, 10 aa, Homo Sapiens
KPPAILPVAA

SEQ ID NO: 127133 - protein, 10 aa, Homo Sapiens
KPQGHIGVDA

SEQ ID NO: 127134 - protein, 10 aa, Homo Sapiens
KPQSINTVSA

SEQ ID NO: 127135 - protein, 10 aa, Homo Sapiens
KPRPIIPMLY

SEQ ID NO: 127136 - protein, 10 aa, Homo Sapiens
KPSELLKAEA

SEQ ID NO: 127137 - protein, 10 aa, Homo Sapiens
KPSPFTPVSA

SEQ ID NO: 127138 - protein, 10 aa, Homo Sapiens
KPSVNSFISA

SEQ ID NO: 127139 - protein, 10 aa, Homo Sapiens
KPTETLLNTV

SEQ ID NO: 127140 - protein, 10 aa, Homo Sapiens
KPTTALLDKV

SEQ ID NO: 127141 - protein, 10 aa, Homo Sapiens
KPVYIPEVEL

SEQ ID NO: 127142 - protein, 10 aa, Homo Sapiens
KPYNVYITVA

SEQ ID NO: 127143 - protein, 10 aa, Homo Sapiens
KPYTLMSMVA

SEQ ID NO: 127144 - protein, 10 aa, Homo Sapiens
KPYTVVDVSA

SEQ ID NO: 127145 - protein, 10 aa, Homo Sapiens
LPAASQPQVF

SEQ ID NO: 127146 - protein, 10 aa, Homo Sapiens
LPAHREGISA

SEQ ID NO: 127147 - protein, 10 aa, Homo Sapiens
LPAQSGSHAA

SEQ ID NO: 127148 - protein, 10 aa, Homo Sapiens
LPASIPHVIA

SEQ ID NO: 127149 - protein, 10 aa, Homo Sapiens
LPFYLIPPSA

SEQ ID NO: 127150 - protein, 10 aa, Homo Sapiens
LPHPYAIAVF

SEQ ID NO: 127151 - protein, 10 aa, Homo Sapiens
LPHSAGRYAA

SEQ ID NO: 127152 - protein, 10 aa, Homo Sapiens
LPHSGYSDSA

SEQ ID NO: 127153 - protein, 10 aa, Homo Sapiens
LPIPDPGVSV

SEQ ID NO: 127154 - protein, 10 aa, Homo Sapiens
LPKAGKFGPA

SEQ ID NO: 127155 - protein, 10 aa, Homo Sapiens
LPKEDPTAVA

SEQ ID NO: 127156 - protein, 10 aa, Homo Sapiens
LPLSAHGIVV

SEQ ID NO: 127157 - protein, 10 aa, Homo Sapiens
LPNHQVIHTA

SEQ ID NO: 127158 - protein, 10 aa, Homo Sapiens
LPNQSFPHSV

SEQ ID NO: 127159 - protein, 10 aa, Homo Sapiens
LPPPDHGAPA

SEQ ID NO: 127160 - protein, 10 aa, Homo Sapiens
LPQEIKANVA

SEQ ID NO: 127161 - protein, 10 aa, Homo Sapiens
LPQSREKIIA

SEQ ID NO: 127162 - protein, 10 aa, Homo Sapiens
LPRGAAKAIA

SEQ ID NO: 127163 - protein, 10 aa, Homo Sapiens
LPRRPLPPAA

SEQ ID NO: 127164 - protein, 10 aa, Homo Sapiens
LPSGCYGRVA

SEQ ID NO: 127165 - protein, 10 aa, Homo Sapiens
LPVDKAFYEA

SEQ ID NO: 127166 - protein, 10 aa, Homo Sapiens
LPVGAVINCA

SEQ ID NO: 127167 - protein, 10 aa, Homo Sapiens
LPVQLQRAMA

SEQ ID NO: 127168 - protein, 10 aa, Homo Sapiens
LPVWLENHTA

SEQ ID NO: 127169 - protein, 10 aa, Homo Sapiens
LVYQEPIPTA

SEQ ID NO: 127170 - protein, 10 aa, Homo Sapiens
MAAANGIGRL

SEQ ID NO: 127171 - protein, 10 aa, Homo Sapiens
MAMESTATAA

SEQ ID NO: 127172 - protein, 10 aa, Homo Sapiens
MPAEHVAVQV

SEQ ID NO: 127173 - protein, 10 aa, Homo Sapiens
MPAPPPKENA

SEQ ID NO: 127174 - protein, 10 aa, Homo Sapiens
MPCSVIRPIL

SEQ ID NO: 127175 - protein, 10 aa, Homo Sapiens
MPHLVNGDAA

SEQ ID NO: 127176 - protein, 10 aa, Homo Sapiens
MPHPATGKTV

SEQ ID NO: 127177 - protein, 10 aa, Homo Sapiens
MPIYPTYNEV

SEQ ID NO: 127178 - protein, 10 aa, Homo Sapiens
MPLHTIIPLL

SEQ ID NO: 127179 - protein, 10 aa, Homo Sapiens
MPLSVFPYYA

SEQ ID NO: 127180 - protein, 10 aa, Homo Sapiens
MPNGDHIVSA

SEQ ID NO: 127181 - protein, 10 aa, Homo Sapiens
MPNGTPHPTA

SEQ ID NO: 127182 - protein, 10 aa, Homo Sapiens
MPNPQLNIKA

SEQ ID NO: 127183 - protein, 10 aa, Homo Sapiens
MPQLNAIIAA

SEQ ID NO: 127184 - protein, 10 aa, Homo Sapiens
MPQMCKATSA

SEQ ID NO: 127185 - protein, 10 aa, Homo Sapiens
MPQSGTGVSV

SEQ ID NO: 127186 - protein, 10 aa, Homo Sapiens
MPRFTEQVEA

SEQ ID NO: 127187 - protein, 10 aa, Homo Sapiens
MPTTLEGAEA

SEQ ID NO: 127188 - protein, 10 aa, Homo Sapiens
MPVEAKCINA

SEQ ID NO: 127189 - protein, 10 aa, Homo Sapiens
MPVQFKPKSA

SEQ ID NO: 127190 - protein, 10 aa, Homo Sapiens
NHPYLFPVAA

SEQ ID NO: 127191 - protein, 10 aa, Homo Sapiens
NPLGMPVPAA

SEQ ID NO: 127192 - protein, 10 aa, Homo Sapiens
NPLHELKAAA

SEQ ID NO: 127193 - protein, 10 aa, Homo Sapiens
NPSPSTSISA

SEQ ID NO: 127194 - protein, 10 aa, Homo Sapiens
NPYFPGQAIA

SEQ ID NO: 127195 - protein, 10 aa, Homo Sapiens
NSVPSNPVAA

SEQ ID NO: 127196 - protein, 10 aa, Homo Sapiens
PARFKNTEAI

SEQ ID NO: 127197 - protein, 10 aa, Homo Sapiens
PVRQGALQGG

SEQ ID NO: 127198 - protein, 10 aa, Homo Sapiens
QAAAPVLTPA

SEQ ID NO: 127199 - protein, 10 aa, Homo Sapiens
QFPAPKSAST

SEQ ID NO: 127200 - protein, 10 aa, Homo Sapiens
QPFGDHIISV

SEQ ID NO: 127201 - protein, 10 aa, Homo Sapiens
QPHHLLLPAA

SEQ ID NO: 127202 - protein, 10 aa, Homo Sapiens
QPPSLPAVSA

SEQ ID NO: 127203 - protein, 10 aa, Homo Sapiens
QPWPQPVPAL

SEQ ID NO: 127204 - protein, 10 aa, Homo Sapiens
QPYYATRVNA

SEQ ID NO: 127205 - protein, 10 aa, Homo Sapiens
QVMQGMGVSA

SEQ ID NO: 127206 - protein, 10 aa, Homo Sapiens
RPAAAPPAGA

SEQ ID NO: 127207 - protein, 10 aa, Homo Sapiens
RPADVIFATV

SEQ ID NO: 127208 - protein, 10 aa, Homo Sapiens
RPALVEQTAA

SEQ ID NO: 127209 - protein, 10 aa, Homo Sapiens
RPAPHFERTA

SEQ ID NO: 127210 - protein, 10 aa, Homo Sapiens
RPAPLPAAVV

SEQ ID NO: 127211 - protein, 10 aa, Homo Sapiens
RPAPPLRPSA

SEQ ID NO: 127212 - protein, 10 aa, Homo Sapiens
RPAPVAVAAA

SEQ ID NO: 127213 - protein, 10 aa, Homo Sapiens
RPASYQSVSV

SEQ ID NO: 127214 - protein, 10 aa, Homo Sapiens
RPAVVMQGSA

SEQ ID NO: 127215 - protein, 10 aa, Homo Sapiens
RPDSTHMVEA

SEQ ID NO: 127216 - protein, 10 aa, Homo Sapiens
RPELLCGAVA

SEQ ID NO: 127217 - protein, 10 aa, Homo Sapiens
RPFEGFQRKA

SEQ ID NO: 127218 - protein, 10 aa, Homo Sapiens
RPFHNGVKCL

SEQ ID NO: 127219 - protein, 10 aa, Homo Sapiens
RPFKGEVVDA

SEQ ID NO: 127220 - protein, 10 aa, Homo Sapiens
RPFLNSISKA

SEQ ID NO: 127221 - protein, 10 aa, Homo Sapiens
RPFSGRRLPV

SEQ ID NO: 127222 - protein, 10 aa, Homo Sapiens
RPFTIPYLTA

SEQ ID NO: 127223 - protein, 10 aa, Homo Sapiens
RPGPGVPATW

SEQ ID NO: 127224 - protein, 10 aa, Homo Sapiens
RPGPVLPAVA

SEQ ID NO: 127225 - protein, 10 aa, Homo Sapiens
RPHSASAARP

SEQ ID NO: 127226 - protein, 10 aa, Homo Sapiens
RPIPNQPPTA

SEQ ID NO: 127227 - protein, 10 aa, Homo Sapiens
RPISLGHVVV

SEQ ID NO: 127228 - protein, 10 aa, Homo Sapiens
RPITPPRNSA

SEQ ID NO: 127229 - protein, 10 aa, Homo Sapiens
RPIWLRESTV

SEQ ID NO: 127230 - protein, 10 aa, Homo Sapiens
RPIYIKDYVT

SEQ ID NO: 127231 - protein, 10 aa, Homo Sapiens
RPKPPNVRTA

SEQ ID NO: 127232 - protein, 10 aa, Homo Sapiens
RPLFPLPAAF

SEQ ID NO: 127233 - protein, 10 aa, Homo Sapiens
RPLFPSTGAA

SEQ ID NO: 127234 - protein, 10 aa, Homo Sapiens
RPLGVSITKA

SEQ ID NO: 127235 - protein, 10 aa, Homo Sapiens
RPLPVTFHRA

SEQ ID NO: 127236 - protein, 10 aa, Homo Sapiens
RPLQDYGISV

SEQ ID NO: 127237 - protein, 10 aa, Homo Sapiens
RPLSGLMETA

SEQ ID NO: 127238 - protein, 10 aa, Homo Sapiens
RPLSGSGISA

SEQ ID NO: 127239 - protein, 10 aa, Homo Sapiens
RPLYCSPITA

SEQ ID NO: 127240 - protein, 10 aa, Homo Sapiens
RPMCIPPSYA

SEQ ID NO: 127241 - protein, 10 aa, Homo Sapiens
RPNAFGMAQA

SEQ ID NO: 127242 - protein, 10 aa, Homo Sapiens
RPNDSRMLVA

SEQ ID NO: 127243 - protein, 10 aa, Homo Sapiens
RPNSLVGITS

SEQ ID NO: 127244 - protein, 10 aa, Homo Sapiens
RPPEPRHIPA

SEQ ID NO: 127245 - protein, 10 aa, Homo Sapiens
RPRAPIIAVT

SEQ ID NO: 127246 - protein, 10 aa, Homo Sapiens
RPRAVYAVEA

SEQ ID NO: 127247 - protein, 10 aa, Homo Sapiens
RPRDSQLYAV

SEQ ID NO: 127248 - protein, 10 aa, Homo Sapiens
RPRPPPVEQV

SEQ ID NO: 127249 - protein, 10 aa, Homo Sapiens
RPRTEVSLSA

SEQ ID NO: 127250 - protein, 10 aa, Homo Sapiens
RPRVTEPISA

SEQ ID NO: 127251 - protein, 10 aa, Homo Sapiens
RPSLLRPVSA

SEQ ID NO: 127252 - protein, 10 aa, Homo Sapiens
RPSPSIAVKA

SEQ ID NO: 127253 - protein, 10 aa, Homo Sapiens
RPSSLHGLAA

SEQ ID NO: 127254 - protein, 10 aa, Homo Sapiens
RPSTDFTQAA

SEQ ID NO: 127255 - protein, 10 aa, Homo Sapiens
RPVHPALPFA

SEQ ID NO: 127256 - protein, 10 aa, Homo Sapiens
RPVLPRTEAA

SEQ ID NO: 127257 - protein, 10 aa, Homo Sapiens
RPWEKTDKGA

SEQ ID NO: 127258 - protein, 10 aa, Homo Sapiens
RPWYSHPVYA

SEQ ID NO: 127259 - protein, 10 aa, Homo Sapiens
RPYAPINANA

SEQ ID NO: 127260 - protein, 10 aa, Homo Sapiens
RPYGCVLRAA

SEQ ID NO: 127261 - protein, 10 aa, Homo Sapiens
RPYLGYDWIA

SEQ ID NO: 127262 - protein, 10 aa, Homo Sapiens
RVAEVIFPTA

SEQ ID NO: 127263 - protein, 10 aa, Homo Sapiens
RVKCGPRLSA

SEQ ID NO: 127264 - protein, 10 aa, Homo Sapiens
RVNEVNQFAA

SEQ ID NO: 127265 - protein, 10 aa, Homo Sapiens
RVRDVFEAKA

SEQ ID NO: 127266 - protein, 10 aa, Homo Sapiens
RVRLSTGREA

SEQ ID NO: 127267 - protein, 10 aa, Homo Sapiens
SPAEVAKITA

SEQ ID NO: 127268 - protein, 10 aa, Homo Sapiens
SPARLYAIAA

SEQ ID NO: 127269 - protein, 10 aa, Homo Sapiens
SPFGLKPRSA

SEQ ID NO: 127270 - protein, 10 aa, Homo Sapiens
SPFHFQPSAA

SEQ ID NO: 127271 - protein, 10 aa, Homo Sapiens
SPHAHISEQA

SEQ ID NO: 127272 - protein, 10 aa, Homo Sapiens
SPHGLVMVGV

SEQ ID NO: 127273 - protein, 10 aa, Homo Sapiens
SPHGYLSDVA

SEQ ID NO: 127274 - protein, 10 aa, Homo Sapiens
SPHPPSEVTA

SEQ ID NO: 127275 - protein, 10 aa, Homo Sapiens
SPIENIQRVA

SEQ ID NO: 127276 - protein, 10 aa, Homo Sapiens
SPILVATAVA

SEQ ID NO: 127277 - protein, 10 aa, Homo Sapiens
SPITGEKIPA

SEQ ID NO: 127278 - protein, 10 aa, Homo Sapiens
SPKAALRYAA

SEQ ID NO: 127279 - protein, 10 aa, Homo Sapiens
SPKPALRYAA

SEQ ID NO: 127280 - protein, 10 aa, Homo Sapiens
SPKQILDPAA

SEQ ID NO: 127281 - protein, 10 aa, Homo Sapiens
SPKQILDSAA

SEQ ID NO: 127282 - protein, 10 aa, Homo Sapiens
SPLATQIPQA

SEQ ID NO: 127283 - protein, 10 aa, Homo Sapiens
SPLFSQHTAA

SEQ ID NO: 127284 - protein, 10 aa, Homo Sapiens
SPLRSPIRSA

SEQ ID NO: 127285 - protein, 10 aa, Homo Sapiens
SPLSVVKQEA

SEQ ID NO: 127286 - protein, 10 aa, Homo Sapiens
SPMSADRVVA

SEQ ID NO: 127287 - protein, 10 aa, Homo Sapiens
SPNGKYILAA

SEQ ID NO: 127288 - protein, 10 aa, Homo Sapiens
SPNKTGGFGA

SEQ ID NO: 127289 - protein, 10 aa, Homo Sapiens
SPNLASGLAA

SEQ ID NO: 127290 - protein, 10 aa, Homo Sapiens
SPNPARGHSV

SEQ ID NO: 127291 - protein, 10 aa, Homo Sapiens
SPNPFSVHTA

SEQ ID NO: 127292 - protein, 10 aa, Homo Sapiens
SPNRYWLCAA

SEQ ID NO: 127293 - protein, 10 aa, Homo Sapiens
SPQEAQIIQA

SEQ ID NO: 127294 - protein, 10 aa, Homo Sapiens
SPQSSQPPTA

SEQ ID NO: 127295 - protein, 10 aa, Homo Sapiens
SPRPALVRSA

SEQ ID NO: 127296 - protein, 10 aa, Homo Sapiens
SPSPPFGHSA

SEQ ID NO: 127297 - protein, 10 aa, Homo Sapiens
SPTACRAVAA

SEQ ID NO: 127298 - protein, 10 aa, Homo Sapiens
SPTGKEFVSA

SEQ ID NO: 127299 - protein, 10 aa, Homo Sapiens
SPVDPGARQA

SEQ ID NO: 127300 - protein, 10 aa, Homo Sapiens
SPVPSHWMVA

SEQ ID NO: 127301 - protein, 10 aa, Homo Sapiens
SPYKDLLDPA

SEQ ID NO: 127302 - protein, 10 aa, Homo Sapiens
TAAPSLKNAA

SEQ ID NO: 127303 - protein, 10 aa, Homo Sapiens
TKTGMLSRAT

SEQ ID NO: 127304 - protein, 10 aa, Homo Sapiens
TPAHVLPSAA

SEQ ID NO: 127305 - protein, 10 aa, Homo Sapiens
TPAPSAPAAA

SEQ ID NO: 127306 - protein, 10 aa, Homo Sapiens
TPAPVEKSPA

SEQ ID NO: 127307 - protein, 10 aa, Homo Sapiens
TPATSVPFAA

SEQ ID NO: 127308 - protein, 10 aa, Homo Sapiens
TPFQGQGHGA

SEQ ID NO: 127309 - protein, 10 aa, Homo Sapiens
TPFTGPFISV

SEQ ID NO: 127310 - protein, 10 aa, Homo Sapiens
TPFYFKEPSL

SEQ ID NO: 127311 - protein, 10 aa, Homo Sapiens
TPHLRNLAVA

SEQ ID NO: 127312 - protein, 10 aa, Homo Sapiens
TPHPVLTPVA

SEQ ID NO: 127313 - protein, 10 aa, Homo Sapiens
TPITGAKPSA

SEQ ID NO: 127314 - protein, 10 aa, Homo Sapiens
TPLPAIVPAA

SEQ ID NO: 127315 - protein, 10 aa, Homo Sapiens
TPMSAQGVQA

SEQ ID NO: 127316 - protein, 10 aa, Homo Sapiens
TPMYTHSIAA

SEQ ID NO: 127317 - protein, 10 aa, Homo Sapiens
TPQEKIFIAA

SEQ ID NO: 127318 - protein, 10 aa, Homo Sapiens
TPQLNAIIAA

SEQ ID NO: 127319 - protein, 10 aa, Homo Sapiens
TPRPLTSARA

SEQ ID NO: 127320 - protein, 10 aa, Homo Sapiens
TPRPPLRPGA

SEQ ID NO: 127321 - protein, 10 aa, Homo Sapiens
TPSKVWGSSA

SEQ ID NO: 127322 - protein, 10 aa, Homo Sapiens
TPSPVIRSTA

SEQ ID NO: 127323 - protein, 10 aa, Homo Sapiens
TPSSASTVSV

SEQ ID NO: 127324 - protein, 10 aa, Homo Sapiens
TPYEAFDPAA

SEQ ID NO: 127325 - protein, 10 aa, Homo Sapiens
TPYGYFLISA

SEQ ID NO: 127326 - protein, 10 aa, Homo Sapiens
TPYSGKLMSA

SEQ ID NO: 127327 - protein, 10 aa, Homo Sapiens
TQARAPVTAA

SEQ ID NO: 127328 - protein, 10 aa, Homo Sapiens
TSLLVQPISA

SEQ ID NO: 127329 - protein, 10 aa, Homo Sapiens
VPAHAVVVRA

SEQ ID NO: 127330 - protein, 10 aa, Homo Sapiens
VPAHPSGNMA

SEQ ID NO: 127331 - protein, 10 aa, Homo Sapiens
VPAKGLATSV

SEQ ID NO: 127332 - protein, 10 aa, Homo Sapiens
VPAPAHLVAT

SEQ ID NO: 127333 - protein, 10 aa, Homo Sapiens
VPAPSPLSAA

SEQ ID NO: 127334 - protein, 10 aa, Homo Sapiens
VPFKPQIPEA

SEQ ID NO: 127335 - protein, 10 aa, Homo Sapiens
VPHQPDNLAA

SEQ ID NO: 127336 - protein, 10 aa, Homo Sapiens
VPHWDPKISA

SEQ ID NO: 127337 - protein, 10 aa, Homo Sapiens
VPIEVLPTVL

SEQ ID NO: 127338 - protein, 10 aa, Homo Sapiens
VPIVPQAPAA

SEQ ID NO: 127339 - protein, 10 aa, Homo Sapiens
VPKKPGPPVL

SEQ ID NO: 127340 - protein, 10 aa, Homo Sapiens
VPKNSDPWAA

SEQ ID NO: 127341 - protein, 10 aa, Homo Sapiens
VPKSAVQQVA

SEQ ID NO: 127342 - protein, 10 aa, Homo Sapiens
VPLPEHGVSV

SEQ ID NO: 127343 - protein, 10 aa, Homo Sapiens
VPNAGILPLV

SEQ ID NO: 127344 - protein, 10 aa, Homo Sapiens
VPNYKLITPA

SEQ ID NO: 127345 - protein, 10 aa, Homo Sapiens
VPQQPTYVQA

SEQ ID NO: 127346 - protein, 10 aa, Homo Sapiens
VPRPPSNPPA

SEQ ID NO: 127347 - protein, 10 aa, Homo Sapiens
VPRQPTVTSV

SEQ ID NO: 127348 - protein, 10 aa, Homo Sapiens
VPRTVSSTTA

SEQ ID NO: 127349 - protein, 10 aa, Homo Sapiens
VPSPGLPVSA

SEQ ID NO: 127350 - protein, 10 aa, Homo Sapiens
VPTKELARQA

SEQ ID NO: 127351 - protein, 10 aa, Homo Sapiens
VPVGIAGFAA

SEQ ID NO: 127352 - protein, 10 aa, Homo Sapiens
VPVWSGMNVA

SEQ ID NO: 127353 - protein, 10 aa, Homo Sapiens
VPYCIIKGKA

SEQ ID NO: 127354 - protein, 10 aa, Homo Sapiens
VPYEIQKGQA

SEQ ID NO: 127355 - protein, 10 aa, Homo Sapiens
VPYRLLPGIF

SEQ ID NO: 127356 - protein, 10 aa, Homo Sapiens
WRRIPGGYSA

SEQ ID NO: 127357 - protein, 10 aa, Homo Sapiens
YPRTPEERAA

SEQ ID NO: 127358 - protein, 10 aa, Homo Sapiens
YPSTAVRHMA

SEQ ID NO: 127359 - protein, 11 aa, Homo Sapiens
APAPPKAEAKA

SEQ ID NO: 127360 - protein, 11 aa, Homo Sapiens
APAPVIISSSA

SEQ ID NO: 127361 - protein, 11 aa, Homo Sapiens
APCSLFPYQAA

SEQ ID NO: 127362 - protein, 11 aa, Homo Sapiens
APDGSLILVSA

SEQ ID NO: 127363 - protein, 11 aa, Homo Sapiens
APFDTVHIPEA

SEQ ID NO: 127364 - protein, 11 aa, Homo Sapiens
APHGGDLQPPA

SEQ ID NO: 127365 - protein, 11 aa, Homo Sapiens
APIRLPEHVTV

SEQ ID NO: 127366 - protein, 11 aa, Homo Sapiens
APKDVKIRISA

SEQ ID NO: 127367 - protein, 11 aa, Homo Sapiens
APLDSIHSLAA

SEQ ID NO: 127368 - protein, 11 aa, Homo Sapiens
APLEEARQFAA

SEQ ID NO: 127369 - protein, 11 aa, Homo Sapiens
APMALFYPATF

SEQ ID NO: 127370 - protein, 11 aa, Homo Sapiens
APMPYLIGIHL

SEQ ID NO: 127371 - protein, 11 aa, Homo Sapiens
APMPYLIGVHA

SEQ ID NO: 127372 - protein, 11 aa, Homo Sapiens
APNRFWASVEP

SEQ ID NO: 127373 - protein, 11 aa, Homo Sapiens
APRPASGPIRP

SEQ ID NO: 127374 - protein, 11 aa, Homo Sapiens
APSKACMLTTA

SEQ ID NO: 127375 - protein, 11 aa, Homo Sapiens
APSNGLSVRSA

SEQ ID NO: 127376 - protein, 11 aa, Homo Sapiens
APTGSGKTVAA

SEQ ID NO: 127377 - protein, 11 aa, Homo Sapiens
APTSAGKTLVA

SEQ ID NO: 127378 - protein, 11 aa, Homo Sapiens
APVAVEPGAAV

SEQ ID NO: 127379 - protein, 11 aa, Homo Sapiens
APWPPKGLVPA

SEQ ID NO: 127380 - protein, 11 aa, Homo Sapiens
APYAKGFGVAA

SEQ ID NO: 127381 - protein, 11 aa, Homo Sapiens
APYDPHFPAPA

SEQ ID NO: 127382 - protein, 11 aa, Homo Sapiens
ASPHAHISEQA

SEQ ID NO: 127383 - protein, 11 aa, Homo Sapiens
EPAPPSQGAEA

SEQ ID NO: 127384 - protein, 11 aa, Homo Sapiens
EPTDTLSKHQA

SEQ ID NO: 127385 - protein, 11 aa, Homo Sapiens
ETQITQIEHEV

SEQ ID NO: 127386 - protein, 11 aa, Homo Sapiens
FPFKPPQRIEA

SEQ ID NO: 127387 - protein, 11 aa, Homo Sapiens
FPHFDLSHGSA

SEQ ID NO: 127388 - protein, 11 aa, Homo Sapiens
GPWVGTGLAAA

SEQ ID NO: 127389 - protein, 11 aa, Homo Sapiens
HPFDLGLYNEA

SEQ ID NO: 127390 - protein, 11 aa, Homo Sapiens
HPIYLATGTSA

SEQ ID NO: 127391 - protein, 11 aa, Homo Sapiens
HPKVNVPGSQA

SEQ ID NO: 127392 - protein, 11 aa, Homo Sapiens
HPLASFSFTSA

SEQ ID NO: 127393 - protein, 11 aa, Homo Sapiens
HPLTGGGMTVA

SEQ ID NO: 127394 - protein, 11 aa, Homo Sapiens
HPQPILMGSVA

SEQ ID NO: 127395 - protein, 11 aa, Homo Sapiens
HPSHVQLKVVA

SEQ ID NO: 127396 - protein, 11 aa, Homo Sapiens
HPTASLIAKVA

SEQ ID NO: 127397 - protein, 11 aa, Homo Sapiens
IPAFRGHFIAA

SEQ ID NO: 127398 - protein, 11 aa, Homo Sapiens
IPAGTVTVNAA

SEQ ID NO: 127399 - protein, 11 aa, Homo Sapiens
IPAQGHFGISA

SEQ ID NO: 127400 - protein, 11 aa, Homo Sapiens
IPAQISPEGRA

SEQ ID NO: 127401 - protein, 11 aa, Homo Sapiens
IPCNNKGAHSV

SEQ ID NO: 127402 - protein, 11 aa, Homo Sapiens
IPHSLPGAVAA

SEQ ID NO: 127403 - protein, 11 aa, Homo Sapiens
IPIKFSEKQQA

SEQ ID NO: 127404 - protein, 11 aa, Homo Sapiens
IPKGKISIVEA

SEQ ID NO: 127405 - protein, 11 aa, Homo Sapiens
IPLKHLADRVA

SEQ ID NO: 127406 - protein, 11 aa, Homo Sapiens
IPLPDEKSRVA

SEQ ID NO: 127407 - protein, 11 aa, Homo Sapiens
IPNSIMTILEA

SEQ ID NO: 127408 - protein, 11 aa, Homo Sapiens
IPSTELAKQVI

SEQ ID NO: 127409 - protein, 11 aa, Homo Sapiens
IPYDQSGFVSA

SEQ ID NO: 127410 - protein, 11 aa, Homo Sapiens
IPYHSEVPVSL

SEQ ID NO: 127411 - protein, 11 aa, Homo Sapiens
IPYSPDVQIHA

SEQ ID NO: 127412 - protein, 11 aa, Homo Sapiens
IVNEVLKSVVA

SEQ ID NO: 127413 - protein, 11 aa, Homo Sapiens
KPASSSFGSEA

SEQ ID NO: 127414 - protein, 11 aa, Homo Sapiens
KPFELSPLVCA

SEQ ID NO: 127415 - protein, 11 aa, Homo Sapiens
KPFQPALPLVV

SEQ ID NO: 127416 - protein, 11 aa, Homo Sapiens
KPGGSLASHVA

SEQ ID NO: 127417 - protein, 11 aa, Homo Sapiens
KPHAEGAAVVA

SEQ ID NO: 127418 - protein, 11 aa, Homo Sapiens
KPHPAEGQWRA

SEQ ID NO: 127419 - protein, 11 aa, Homo Sapiens
KPKVMEGTVAA

SEQ ID NO: 127420 - protein, 11 aa, Homo Sapiens
KPLDAPAVNKA

SEQ ID NO: 127421 - protein, 11 aa, Homo Sapiens
KPLSSLTPLIA

SEQ ID NO: 127422 - protein, 11 aa, Homo Sapiens
KPMEGWIAVTV

SEQ ID NO: 127423 - protein, 11 aa, Homo Sapiens
KPMLQQGIELL

SEQ ID NO: 127424 - protein, 11 aa, Homo Sapiens
KPNEFASQINL

SEQ ID NO: 127425 - protein, 11 aa, Homo Sapiens
KPREAFGFEQA

SEQ ID NO: 127426 - protein, 11 aa, Homo Sapiens
KPTASPSSIAA

SEQ ID NO: 127427 - protein, 11 aa, Homo Sapiens
KPTAVPSIFHL

SEQ ID NO: 127428 - protein, 11 aa, Homo Sapiens
KPVPLNSGVRF

SEQ ID NO: 127429 - protein, 11 aa, Homo Sapiens
KPVVTPFGQVA

SEQ ID NO: 127430 - protein, 11 aa, Homo Sapiens
KVNENLTKFIA

SEQ ID NO: 127431 - protein, 11 aa, Homo Sapiens
KVYDNRVSVAA

SEQ ID NO: 127432 - protein, 11 aa, Homo Sapiens
LPAEFPDKVFA

SEQ ID NO: 127433 - protein, 11 aa, Homo Sapiens
LPASNLAGKEA

SEQ ID NO: 127434 - protein, 11 aa, Homo Sapiens
LPHAILRLDLA

SEQ ID NO: 127435 - protein, 11 aa, Homo Sapiens
LPHDRMTSQEA

SEQ ID NO: 127436 - protein, 11 aa, Homo Sapiens
LPHGAISEDQA

SEQ ID NO: 127437 - protein, 11 aa, Homo Sapiens
LPKSSSQEVEA

SEQ ID NO: 127438 - protein, 11 aa, Homo Sapiens
LPLLQPRGASA

SEQ ID NO: 127439 - protein, 11 aa, Homo Sapiens
LPLRPIIPLVA

SEQ ID NO: 127440 - protein, 11 aa, Homo Sapiens
LPRTVIRGSQA

SEQ ID NO: 127441 - protein, 11 aa, Homo Sapiens
LPSASITSTSA

SEQ ID NO: 127442 - protein, 11 aa, Homo Sapiens
LPSDFTPAVHA

SEQ ID NO: 127443 - protein, 11 aa, Homo Sapiens
LPSPLPAHPSV

SEQ ID NO: 127444 - protein, 11 aa, Homo Sapiens
LPTREGHHLVA

SEQ ID NO: 127445 - protein, 11 aa, Homo Sapiens
MPHPATGKTVA

SEQ ID NO: 127446 - protein, 11 aa, Homo Sapiens
MPHSIMRIDIA

SEQ ID NO: 127447 - protein, 11 aa, Homo Sapiens
MPHSIMRVDIA

SEQ ID NO: 127448 - protein, 11 aa, Homo Sapiens
MPLHVAPLLAA

SEQ ID NO: 127449 - protein, 11 aa, Homo Sapiens
MPNGTPHPTAA

SEQ ID NO: 127450 - protein, 11 aa, Homo Sapiens
MPNPSLAQVKI

SEQ ID NO: 127451 - protein, 11 aa, Homo Sapiens
MPRWAERLFPA

SEQ ID NO: 127452 - protein, 11 aa, Homo Sapiens
MPWGDPNYRSA

SEQ ID NO: 127453 - protein, 11 aa, Homo Sapiens
PLSPMLYSSSA

SEQ ID NO: 127454 - protein, 11 aa, Homo Sapiens
PSLSRPGPAAP

SEQ ID NO: 127455 - protein, 11 aa, Homo Sapiens
PSLSSLPAGAA

SEQ ID NO: 127456 - protein, 11 aa, Homo Sapiens
QAAVRPKGEAA

SEQ ID NO: 127457 - protein, 11 aa, Homo Sapiens
QPFPAHIGRSA

SEQ ID NO: 127458 - protein, 11 aa, Homo Sapiens
QPHDPLVPLSA

SEQ ID NO: 127459 - protein, 11 aa, Homo Sapiens
QPYAPPRDFAA

SEQ ID NO: 127460 - protein, 11 aa, Homo Sapiens
QPYYATRVNAA

SEQ ID NO: 127461 - protein, 11 aa, Homo Sapiens
QVFDAKNMMAA

SEQ ID NO: 127462 - protein, 11 aa, Homo Sapiens
RASLEVTQQQA

SEQ ID NO: 127463 - protein, 11 aa, Homo Sapiens
RISSIQATTAA

SEQ ID NO: 127464 - protein, 11 aa, Homo Sapiens
RPAAQPSFHQA

SEQ ID NO: 127465 - protein, 11 aa, Homo Sapiens
RPAGALVALVV

SEQ ID NO: 127466 - protein, 11 aa, Homo Sapiens
RPAGVGVVVEA

SEQ ID NO: 127467 - protein, 11 aa, Homo Sapiens
RPALAVGVTAV

SEQ ID NO: 127468 - protein, 11 aa, Homo Sapiens
RPALPVSYLQA

SEQ ID NO: 127469 - protein, 11 aa, Homo Sapiens
RPAPLSAELQA

SEQ ID NO: 127470 - protein, 11 aa, Homo Sapiens
RPAPPLRPSAA

SEQ ID NO: 127471 - protein, 11 aa, Homo Sapiens
RPAPVAVAAAA

SEQ ID NO: 127472 - protein, 11 aa, Homo Sapiens
RPAQFLPEMVA

SEQ ID NO: 127473 - protein, 11 aa, Homo Sapiens
RPAQLHIGFQA

SEQ ID NO: 127474 - protein, 11 aa, Homo Sapiens
RPCSPQNKISF

SEQ ID NO: 127475 - protein, 11 aa, Homo Sapiens
RPEDRMFHIRA

SEQ ID NO: 127476 - protein, 11 aa, Homo Sapiens
RPGPGLSQEAA

SEQ ID NO: 127477 - protein, 11 aa, Homo Sapiens
RPGPVLPAVAV

SEQ ID NO: 127478 - protein, 11 aa, Homo Sapiens
RPGVACSVSQA

SEQ ID NO: 127479 - protein, 11 aa, Homo Sapiens
RPHAPHSPIKF

SEQ ID NO: 127480 - protein, 11 aa, Homo Sapiens
RPHSSLRELLA

SEQ ID NO: 127481 - protein, 11 aa, Homo Sapiens
RPHTVLTVIQA

SEQ ID NO: 127482 - protein, 11 aa, Homo Sapiens
RPIPNQPPTAA

SEQ ID NO: 127483 - protein, 11 aa, Homo Sapiens
RPIRKGDIFLV

SEQ ID NO: 127484 - protein, 11 aa, Homo Sapiens
RPISLGHVVVA

SEQ ID NO: 127485 - protein, 11 aa, Homo Sapiens
RPKIPGSREAA

SEQ ID NO: 127486 - protein, 11 aa, Homo Sapiens
RPKLNEGVVEF

SEQ ID NO: 127487 - protein, 11 aa, Homo Sapiens
RPKPSSSPVIF

SEQ ID NO: 127488 - protein, 11 aa, Homo Sapiens
RPKSAFKVQNA

SEQ ID NO: 127489 - protein, 11 aa, Homo Sapiens
RPLLPSENITA

SEQ ID NO: 127490 - protein, 11 aa, Homo Sapiens
RPLPGALGVAA

SEQ ID NO: 127491 - protein, 11 aa, Homo Sapiens
RPNGVITGLAA

SEQ ID NO: 127492 - protein, 11 aa, Homo Sapiens
RPNSLVGITSA

SEQ ID NO: 127493 - protein, 11 aa, Homo Sapiens
RPRAPIIAVTR

SEQ ID NO: 127494 - protein, 11 aa, Homo Sapiens
RPRDLEDFFSA

SEQ ID NO: 127495 - protein, 11 aa, Homo Sapiens
RPREALSTNEC

SEQ ID NO: 127496 - protein, 11 aa, Homo Sapiens
RPRTAGPAVHL

SEQ ID NO: 127497 - protein, 11 aa, Homo Sapiens
RPSELLAGVKA

SEQ ID NO: 127498 - protein, 11 aa, Homo Sapiens
RPSQGLYSSSA

SEQ ID NO: 127499 - protein, 11 aa, Homo Sapiens
RPSSLPVGPVL

SEQ ID NO: 127500 - protein, 11 aa, Homo Sapiens
RPSTDFTQAAA

SEQ ID NO: 127501 - protein, 11 aa, Homo Sapiens
RPSTGGLGFSV

SEQ ID NO: 127502 - protein, 11 aa, Homo Sapiens
RPVTPPRGMIT

SEQ ID NO: 127503 - protein, 11 aa, Homo Sapiens
RPYLHEFLTSA

SEQ ID NO: 127504 - protein, 11 aa, Homo Sapiens
RPYQPLGALVV

SEQ ID NO: 127505 - protein, 11 aa, Homo Sapiens
SPCQTDVLRSA

SEQ ID NO: 127506 - protein, 11 aa, Homo Sapiens
SPDEGALVRAA

SEQ ID NO: 127507 - protein, 11 aa, Homo Sapiens
SPFQTPVQSSA

SEQ ID NO: 127508 - protein, 11 aa, Homo Sapiens
SPHAHISEQAV

SEQ ID NO: 127509 - protein, 11 aa, Homo Sapiens
SPHPAIQPLQA

SEQ ID NO: 127510 - protein, 11 aa, Homo Sapiens
SPHPSAAVPAA

SEQ ID NO: 127511 - protein, 11 aa, Homo Sapiens
SPIENIQRVAA

SEQ ID NO: 127512 - protein, 11 aa, Homo Sapiens
SPILVATAVAA

SEQ ID NO: 127513 - protein, 11 aa, Homo Sapiens
SPKPAIKSISA

SEQ ID NO: 127514 - protein, 11 aa, Homo Sapiens
SPLDMKDGFLA

SEQ ID NO: 127515 - protein, 11 aa, Homo Sapiens
SPLSAAAATAA

SEQ ID NO: 127516 - protein, 11 aa, Homo Sapiens
SPLSTPTSAQA

SEQ ID NO: 127517 - protein, 11 aa, Homo Sapiens
SPMAERSMMSA

SEQ ID NO: 127518 - protein, 11 aa, Homo Sapiens
SPNMANTVNAA

SEQ ID NO: 127519 - protein, 11 aa, Homo Sapiens
SPRHLPSCSPA

SEQ ID NO: 127520 - protein, 11 aa, Homo Sapiens
SPRNLGFETSA

SEQ ID NO: 127521 - protein, 11 aa, Homo Sapiens
SPRNLQPQRAA

SEQ ID NO: 127522 - protein, 11 aa, Homo Sapiens
SPRPALPALLV

SEQ ID NO: 127523 - protein, 11 aa, Homo Sapiens
SPRSGQRCWAA

SEQ ID NO: 127524 - protein, 11 aa, Homo Sapiens
SPRTAEGVLAA

SEQ ID NO: 127525 - protein, 11 aa, Homo Sapiens
SPRTPVSPVKF

SEQ ID NO: 127526 - protein, 11 aa, Homo Sapiens
SPSAAITVQRV

SEQ ID NO: 127527 - protein, 11 aa, Homo Sapiens
SPTSPNALPPA

SEQ ID NO: 127528 - protein, 11 aa, Homo Sapiens
SPVQVPGPVAA

SEQ ID NO: 127529 - protein, 11 aa, Homo Sapiens
SPVTLTKGTSA

SEQ ID NO: 127530 - protein, 11 aa, Homo Sapiens
SPYSGPKFNSA

SEQ ID NO: 127531 - protein, 11 aa, Homo Sapiens
TAYKPKYFTSA

SEQ ID NO: 127532 - protein, 11 aa, Homo Sapiens
TPAAAAAMNLA

SEQ ID NO: 127533 - protein, 11 aa, Homo Sapiens
TPFGPLSSRSA

SEQ ID NO: 127534 - protein, 11 aa, Homo Sapiens
TPFYPRSPYGA

SEQ ID NO: 127535 - protein, 11 aa, Homo Sapiens
TPHYIYPPAIV

SEQ ID NO: 127536 - protein, 11 aa, Homo Sapiens
TPKTPEEKAVA

SEQ ID NO: 127537 - protein, 11 aa, Homo Sapiens
TPLLLRGLTGS

SEQ ID NO: 127538 - protein, 11 aa, Homo Sapiens
TPNTSLGMVQA

SEQ ID NO: 127539 - protein, 11 aa, Homo Sapiens
TPRSIHDGVAA

SEQ ID NO: 127540 - protein, 11 aa, Homo Sapiens
TPSEKHMLLKV

SEQ ID NO: 127541 - protein, 11 aa, Homo Sapiens
TPSMSTITHSA

SEQ ID NO: 127542 - protein, 11 aa, Homo Sapiens
TPTSADKLRAA

SEQ ID NO: 127543 - protein, 11 aa, Homo Sapiens
TPWPRGRLLTA

SEQ ID NO: 127544 - protein, 11 aa, Homo Sapiens
TPYQSKWTICA

SEQ ID NO: 127545 - protein, 11 aa, Homo Sapiens
TVSPVLPLTSA

SEQ ID NO: 127546 - protein, 11 aa, Homo Sapiens
VPAGGAVAVSA

SEQ ID NO: 127547 - protein, 11 aa, Homo Sapiens
VPDSSGPERIL

SEQ ID NO: 127548 - protein, 11 aa, Homo Sapiens
VPIPNSPFKVA

SEQ ID NO: 127549 - protein, 11 aa, Homo Sapiens
VPKPIGGVVVF

SEQ ID NO: 127550 - protein, 11 aa, Homo Sapiens
VPNKFLVTAEI

SEQ ID NO: 127551 - protein, 11 aa, Homo Sapiens
VPSPVLCGVSF

SEQ ID NO: 127552 - protein, 11 aa, Homo Sapiens
VPTNIIAAKAA

SEQ ID NO: 127553 - protein, 11 aa, Homo Sapiens
VPVSLESKKAA

SEQ ID NO: 127554 - protein, 11 aa, Homo Sapiens
VPVVVVPEGSA

SEQ ID NO: 127555 - protein, 11 aa, Homo Sapiens
VPWMPPGKSSA

SEQ ID NO: 127556 - protein, 11 aa, Homo Sapiens
VPYPLPKIDLI

SEQ ID NO: 127557 - protein, 11 aa, Homo Sapiens
YPAAVPQALSA

SEQ ID NO: 127558 - protein, 8 aa, Homo Sapiens
AKNWAPGE

SEQ ID NO: 127559 - protein, 8 aa, Homo Sapiens
APASLTSA

SEQ ID NO: 127560 - protein, 8 aa, Homo Sapiens
APFLLNAV

SEQ ID NO: 127561 - protein, 8 aa, Homo Sapiens
APGVLPSA

SEQ ID NO: 127562 - protein, 8 aa, Homo Sapiens
APRPAPVA

SEQ ID NO: 127563 - protein, 8 aa, Homo Sapiens
APSSILQR

SEQ ID NO: 127564 - protein, 8 aa, Homo Sapiens
APTAIKAA

SEQ ID NO: 127565 - protein, 8 aa, Homo Sapiens
APTAITEA

SEQ ID NO: 127566 - protein, 8 aa, Homo Sapiens
APTPAAPA

SEQ ID NO: 127567 - protein, 8 aa, Homo Sapiens
APVAVWAA

SEQ ID NO: 127568 - protein, 8 aa, Homo Sapiens
APWGGPAA

SEQ ID NO: 127569 - protein, 8 aa, Homo Sapiens
APWPIVGL

SEQ ID NO: 127570 - protein, 8 aa, Homo Sapiens
FPVCLLAS

SEQ ID NO: 127571 - protein, 8 aa, Homo Sapiens
GVQPAAAA

SEQ ID NO: 127572 - protein, 8 aa, Homo Sapiens
HPASLFTA

SEQ ID NO: 127573 - protein, 8 aa, Homo Sapiens
HPFYTRAA

SEQ ID NO: 127574 - protein, 8 aa, Homo Sapiens
HPHLVAEA

SEQ ID NO: 127575 - protein, 8 aa, Homo Sapiens
HPTSIVKA

SEQ ID NO: 127576 - protein, 8 aa, Homo Sapiens
HPYLFPVA

SEQ ID NO: 127577 - protein, 8 aa, Homo Sapiens
IFFNVHSA

SEQ ID NO: 127578 - protein, 8 aa, Homo Sapiens
IPEPLAPA

SEQ ID NO: 127579 - protein, 8 aa, Homo Sapiens
IPEPLPAA

SEQ ID NO: 127580 - protein, 8 aa, Homo Sapiens
IPHSLPGA

SEQ ID NO: 127581 - protein, 8 aa, Homo Sapiens
IPQVMAIA

SEQ ID NO: 127582 - protein, 8 aa, Homo Sapiens
IPTPIVGV

SEQ ID NO: 127583 - protein, 8 aa, Homo Sapiens
IPTTIYKA

SEQ ID NO: 127584 - protein, 8 aa, Homo Sapiens
IPYKIEAV

SEQ ID NO: 127585 - protein, 8 aa, Homo Sapiens
KPQNMPKA

SEQ ID NO: 127586 - protein, 8 aa, Homo Sapiens
KPTALPSA

SEQ ID NO: 127587 - protein, 8 aa, Homo Sapiens
LPHQLPEA

SEQ ID NO: 127588 - protein, 8 aa, Homo Sapiens
LPMLQTVA

SEQ ID NO: 127589 - protein, 8 aa, Homo Sapiens
LPTTICHA

SEQ ID NO: 127590 - protein, 8 aa, Homo Sapiens
LPVRLATA

SEQ ID NO: 127591 - protein, 8 aa, Homo Sapiens
LQQAKDEI

SEQ ID NO: 127592 - protein, 8 aa, Homo Sapiens
MPIYVTGI

SEQ ID NO: 127593 - protein, 8 aa, Homo Sapiens
MPQPVPTA

SEQ ID NO: 127594 - protein, 8 aa, Homo Sapiens
MPTTLEGA

SEQ ID NO: 127595 - protein, 8 aa, Homo Sapiens
NPIAQPLA

SEQ ID NO: 127596 - protein, 8 aa, Homo Sapiens
PAKKITAA

SEQ ID NO: 127597 - protein, 8 aa, Homo Sapiens
PYLFPVAA

SEQ ID NO: 127598 - protein, 8 aa, Homo Sapiens
QPTETPVA

SEQ ID NO: 127599 - protein, 8 aa, Homo Sapiens
QPTPIQKA

SEQ ID NO: 127600 - protein, 8 aa, Homo Sapiens
QPYRFPQA

SEQ ID NO: 127601 - protein, 8 aa, Homo Sapiens
RPFKGEVV

SEQ ID NO: 127602 - protein, 8 aa, Homo Sapiens
RPHNLPVV

SEQ ID NO: 127603 - protein, 8 aa, Homo Sapiens
RPTCIVRA

SEQ ID NO: 127604 - protein, 8 aa, Homo Sapiens
RPVKIRKI

SEQ ID NO: 127605 - protein, 8 aa, Homo Sapiens
RPVKLFRV

SEQ ID NO: 127606 - protein, 8 aa, Homo Sapiens
RPVLTSVA

SEQ ID NO: 127607 - protein, 8 aa, Homo Sapiens
RPWLRPAA

SEQ ID NO: 127608 - protein, 8 aa, Homo Sapiens
RPWYIQGA

SEQ ID NO: 127609 - protein, 8 aa, Homo Sapiens
SPAKLQAA

SEQ ID NO: 127610 - protein, 8 aa, Homo Sapiens
SPALLRAE

SEQ ID NO: 127611 - protein, 8 aa, Homo Sapiens
SPALLREA

SEQ ID NO: 127612 - protein, 8 aa, Homo Sapiens
SPCLGPVA

SEQ ID NO: 127613 - protein, 8 aa, Homo Sapiens
SPFPLEAV

SEQ ID NO: 127614 - protein, 8 aa, Homo Sapiens
SPILVATA

SEQ ID NO: 127615 - protein, 8 aa, Homo Sapiens
SPLNTHAA

SEQ ID NO: 127616 - protein, 8 aa, Homo Sapiens
SPTFQHAV

SEQ ID NO: 127617 - protein, 8 aa, Homo Sapiens
SPVLFQEA

SEQ ID NO: 127618 - protein, 8 aa, Homo Sapiens
SPVPVPRA

SEQ ID NO: 127619 - protein, 8 aa, Homo Sapiens
TPTPVPVV

SEQ ID NO: 127620 - protein, 8 aa, Homo Sapiens
VPAGGAVA

SEQ ID NO: 127621 - protein, 8 aa, Homo Sapiens
VPFSIPAA

SEQ ID NO: 127622 - protein, 8 aa, Homo Sapiens
VPLIAIMA

SEQ ID NO: 127623 - protein, 8 aa, Homo Sapiens
VPNYLPSV

SEQ ID NO: 127624 - protein, 8 aa, Homo Sapiens
VPTNIIAA

SEQ ID NO: 127625 - protein, 8 aa, Homo Sapiens
VPVETPEA

SEQ ID NO: 127626 - protein, 8 aa, Homo Sapiens
VPVGILSA

SEQ ID NO: 127627 - protein, 8 aa, Homo Sapiens
VPWGGAAA

SEQ ID NO: 127628 - protein, 8 aa, Homo Sapiens
VTDTNVIL

SEQ ID NO: 127629 - protein, 8 aa, Homo Sapiens
YPAAVPQA

SEQ ID NO: 127630 - protein, 8 aa, Homo Sapiens
YPASLPDA

SEQ ID NO: 127631 - protein, 8 aa, Homo Sapiens
YPIALTRA

SEQ ID NO: 127632 - protein, 8 aa, Homo Sapiens
YPVLLDGV

SEQ ID NO: 127633 - protein, 9 aa, Homo Sapiens
AAFSHPQAA

SEQ ID NO: 127634 - protein, 9 aa, Homo Sapiens
AAGPPLVAA

SEQ ID NO: 127635 - protein, 9 aa, Homo Sapiens
AAGPVGMAA

SEQ ID NO: 127636 - protein, 9 aa, Homo Sapiens
AAMNGHVPA

SEQ ID NO: 127637 - protein, 9 aa, Homo Sapiens
AGPRLCSPA

SEQ ID NO: 127638 - protein, 9 aa, Homo Sapiens
APAAATVAV

SEQ ID NO: 127639 - protein, 9 aa, Homo Sapiens
APAAGMNAA

SEQ ID NO: 127640 - protein, 9 aa, Homo Sapiens
APAALFLAA

SEQ ID NO: 127641 - protein, 9 aa, Homo Sapiens
APAEPGWKA

SEQ ID NO: 127642 - protein, 9 aa, Homo Sapiens
APAEVQITA

SEQ ID NO: 127643 - protein, 9 aa, Homo Sapiens
APAGVFGVA

SEQ ID NO: 127644 - protein, 9 aa, Homo Sapiens
APALALPVA

SEQ ID NO: 127645 - protein, 9 aa, Homo Sapiens
APALLLIPA

SEQ ID NO: 127646 - protein, 9 aa, Homo Sapiens
APALPAPAA

SEQ ID NO: 127647 - protein, 9 aa, Homo Sapiens
APAPAAHVA

SEQ ID NO: 127648 - protein, 9 aa, Homo Sapiens
APAPPKAEA

SEQ ID NO: 127649 - protein, 9 aa, Homo Sapiens
APAPPPAEA

SEQ ID NO: 127650 - protein, 9 aa, Homo Sapiens
APAPPVADA

SEQ ID NO: 127651 - protein, 9 aa, Homo Sapiens
APAPPVYEA

SEQ ID NO: 127652 - protein, 9 aa, Homo Sapiens
APAPQGCAV

SEQ ID NO: 127653 - protein, 9 aa, Homo Sapiens
APAPSLFPA

SEQ ID NO: 127654 - protein, 9 aa, Homo Sapiens
APAPTPVSA

SEQ ID NO: 127655 - protein, 9 aa, Homo Sapiens
APAPVIISS

SEQ ID NO: 127656 - protein, 9 aa, Homo Sapiens
APAPVPVLA

SEQ ID NO: 127657 - protein, 9 aa, Homo Sapiens
APAPVVEAV

SEQ ID NO: 127658 - protein, 9 aa, Homo Sapiens
APARAVSAV

SEQ ID NO: 127659 - protein, 9 aa, Homo Sapiens
APARPGPAA

SEQ ID NO: 127660 - protein, 9 aa, Homo Sapiens
APARPSVPP

SEQ ID NO: 127661 - protein, 9 aa, Homo Sapiens
APASVPAQA

SEQ ID NO: 127662 - protein, 9 aa, Homo Sapiens
APCKQRISV

SEQ ID NO: 127663 - protein, 9 aa, Homo Sapiens
APCTAIREV

SEQ ID NO: 127664 - protein, 9 aa, Homo Sapiens
APDEKYVAA

SEQ ID NO: 127665 - protein, 9 aa, Homo Sapiens
APELQGVEV

SEQ ID NO: 127666 - protein, 9 aa, Homo Sapiens
APFDSRFPN

SEQ ID NO: 127667 - protein, 9 aa, Homo Sapiens
APFEPLASG

SEQ ID NO: 127668 - protein, 9 aa, Homo Sapiens
APFGKISDA

SEQ ID NO: 127669 - protein, 9 aa, Homo Sapiens
APFGRISDA

SEQ ID NO: 127670 - protein, 9 aa, Homo Sapiens
APFPHGDSA

SEQ ID NO: 127671 - protein, 9 aa, Homo Sapiens
APFPKTQIA

SEQ ID NO: 127672 - protein, 9 aa, Homo Sapiens
APFQGLLQA

SEQ ID NO: 127673 - protein, 9 aa, Homo Sapiens
APFQSMQTV

SEQ ID NO: 127674 - protein, 9 aa, Homo Sapiens
APGGEFREA

SEQ ID NO: 127675 - protein, 9 aa, Homo Sapiens
APGGWLQVA

SEQ ID NO: 127676 - protein, 9 aa, Homo Sapiens
APGLPTARA

SEQ ID NO: 127677 - protein, 9 aa, Homo Sapiens
APGNPVLAV

SEQ ID NO: 127678 - protein, 9 aa, Homo Sapiens
APGPATREA

SEQ ID NO: 127679 - protein, 9 aa, Homo Sapiens
APGPGPASA

SEQ ID NO: 127680 - protein, 9 aa, Homo Sapiens
APGPGTPCA

SEQ ID NO: 127681 - protein, 9 aa, Homo Sapiens
APGPSGQSV

SEQ ID NO: 127682 - protein, 9 aa, Homo Sapiens
APGYSYTAA

SEQ ID NO: 127683 - protein, 9 aa, Homo Sapiens
APHALLQAV

SEQ ID NO: 127684 - protein, 9 aa, Homo Sapiens
APHAPGPPA

SEQ ID NO: 127685 - protein, 9 aa, Homo Sapiens
APHEILIQI

SEQ ID NO: 127686 - protein, 9 aa, Homo Sapiens
APHLEKQPA

SEQ ID NO: 127687 - protein, 9 aa, Homo Sapiens
APHLTRAYA

SEQ ID NO: 127688 - protein, 9 aa, Homo Sapiens
APHPFPHPA

SEQ ID NO: 127689 - protein, 9 aa, Homo Sapiens
APHPGLSEA

SEQ ID NO: 127690 - protein, 9 aa, Homo Sapiens
APHPPLSVV

SEQ ID NO: 127691 - protein, 9 aa, Homo Sapiens
APHPPVADV

SEQ ID NO: 127692 - protein, 9 aa, Homo Sapiens
APHVPATGA

SEQ ID NO: 127693 - protein, 9 aa, Homo Sapiens
APIEETAAA

SEQ ID NO: 127694 - protein, 9 aa, Homo Sapiens
APIHKLEEA

SEQ ID NO: 127695 - protein, 9 aa, Homo Sapiens
APILSPEAA

SEQ ID NO: 127696 - protein, 9 aa, Homo Sapiens
APILVPHTA

SEQ ID NO: 127697 - protein, 9 aa, Homo Sapiens
APIQSEPRV

SEQ ID NO: 127698 - protein, 9 aa, Homo Sapiens
APITGQVSA

SEQ ID NO: 127699 - protein, 9 aa, Homo Sapiens
APIWLEHAA

SEQ ID NO: 127700 - protein, 9 aa, Homo Sapiens
APKAGPGVV

SEQ ID NO: 127701 - protein, 9 aa, Homo Sapiens
APKLGSNIA

SEQ ID NO: 127702 - protein, 9 aa, Homo Sapiens
APKPTSWAA

SEQ ID NO: 127703 - protein, 9 aa, Homo Sapiens
APLDAYFQV

SEQ ID NO: 127704 - protein, 9 aa, Homo Sapiens
APMPPIIHA

SEQ ID NO: 127705 - protein, 9 aa, Homo Sapiens
APMPTASTA

SEQ ID NO: 127706 - protein, 9 aa, Homo Sapiens
APNEGFCSA

SEQ ID NO: 127707 - protein, 9 aa, Homo Sapiens
APNLQNQQV

SEQ ID NO: 127708 - protein, 9 aa, Homo Sapiens
APNPVVFVA

SEQ ID NO: 127709 - protein, 9 aa, Homo Sapiens
APQPLKESA

SEQ ID NO: 127710 - protein, 9 aa, Homo Sapiens
APQSIPRSA

SEQ ID NO: 127711 - protein, 9 aa, Homo Sapiens
APQSLGSSA

SEQ ID NO: 127712 - protein, 9 aa, Homo Sapiens
APQSSAVAA

SEQ ID NO: 127713 - protein, 9 aa, Homo Sapiens
APRERLIDA

SEQ ID NO: 127714 - protein, 9 aa, Homo Sapiens
APRFGGSRA

SEQ ID NO: 127715 - protein, 9 aa, Homo Sapiens
APRIALHTA

SEQ ID NO: 127716 - protein, 9 aa, Homo Sapiens
APRLQSEVA

SEQ ID NO: 127717 - protein, 9 aa, Homo Sapiens
APRPPPKPM

SEQ ID NO: 127718 - protein, 9 aa, Homo Sapiens
APRPPVSAA

SEQ ID NO: 127719 - protein, 9 aa, Homo Sapiens
APRPTIINA

SEQ ID NO: 127720 - protein, 9 aa, Homo Sapiens
APRQPGLMA

SEQ ID NO: 127721 - protein, 9 aa, Homo Sapiens
APRSFHPPA

SEQ ID NO: 127722 - protein, 9 aa, Homo Sapiens
APRTVALTA

SEQ ID NO: 127723 - protein, 9 aa, Homo Sapiens
APSLNATTV

SEQ ID NO: 127724 - protein, 9 aa, Homo Sapiens
APSLPKQAA

SEQ ID NO: 127725 - protein, 9 aa, Homo Sapiens
APSPPPAPV

SEQ ID NO: 127726 - protein, 9 aa, Homo Sapiens
APSPVQHQA

SEQ ID NO: 127727 - protein, 9 aa, Homo Sapiens
APSRVVVVA

SEQ ID NO: 127728 - protein, 9 aa, Homo Sapiens
APSSLVAAA

SEQ ID NO: 127729 - protein, 9 aa, Homo Sapiens
APSTIIFHL

SEQ ID NO: 127730 - protein, 9 aa, Homo Sapiens
APSVGIKAA

SEQ ID NO: 127731 - protein, 9 aa, Homo Sapiens
APTAIKAAA

SEQ ID NO: 127732 - protein, 9 aa, Homo Sapiens
APTEMAKAA

SEQ ID NO: 127733 - protein, 9 aa, Homo Sapiens
APTGDLPRA

SEQ ID NO: 127734 - protein, 9 aa, Homo Sapiens
APTKPQSPA

SEQ ID NO: 127735 - protein, 9 aa, Homo Sapiens
APTLGLLPA

SEQ ID NO: 127736 - protein, 9 aa, Homo Sapiens
APTLPGSAA

SEQ ID NO: 127737 - protein, 9 aa, Homo Sapiens
APTPPTLVA

SEQ ID NO: 127738 - protein, 9 aa, Homo Sapiens
APVAEVPTA

SEQ ID NO: 127739 - protein, 9 aa, Homo Sapiens
APVGSVVSV

SEQ ID NO: 127740 - protein, 9 aa, Homo Sapiens
APVLFAKAA

SEQ ID NO: 127741 - protein, 9 aa, Homo Sapiens
APVLPHTAV

SEQ ID NO: 127742 - protein, 9 aa, Homo Sapiens
APVNVTTEV

SEQ ID NO: 127743 - protein, 9 aa, Homo Sapiens
APVPGIPTA

SEQ ID NO: 127744 - protein, 9 aa, Homo Sapiens
APVPTAPAA

SEQ ID NO: 127745 - protein, 9 aa, Homo Sapiens
APVTGMVSG

SEQ ID NO: 127746 - protein, 9 aa, Homo Sapiens
APVVPAVST

SEQ ID NO: 127747 - protein, 9 aa, Homo Sapiens
APVWYLVAA

SEQ ID NO: 127748 - protein, 9 aa, Homo Sapiens
APVYGRDLL

SEQ ID NO: 127749 - protein, 9 aa, Homo Sapiens
APWGSPTAA

SEQ ID NO: 127750 - protein, 9 aa, Homo Sapiens
APWSGRFYS

SEQ ID NO: 127751 - protein, 9 aa, Homo Sapiens
APYAVGREA

SEQ ID NO: 127752 - protein, 9 aa, Homo Sapiens
APYPGFLSV

SEQ ID NO: 127753 - protein, 9 aa, Homo Sapiens
APYTHFTQA

SEQ ID NO: 127754 - protein, 9 aa, Homo Sapiens
APYVTFPVA

SEQ ID NO: 127755 - protein, 9 aa, Homo Sapiens
ASAPPGPPA

SEQ ID NO: 127756 - protein, 9 aa, Homo Sapiens
ASFHNGVAA

SEQ ID NO: 127757 - protein, 9 aa, Homo Sapiens
ATVLQAVSA

SEQ ID NO: 127758 - protein, 9 aa, Homo Sapiens
AVAMPIPAA

SEQ ID NO: 127759 - protein, 9 aa, Homo Sapiens
AVFFQSHSA

SEQ ID NO: 127760 - protein, 9 aa, Homo Sapiens
AVFHLEHAA

SEQ ID NO: 127761 - protein, 9 aa, Homo Sapiens
AVPRPGAPA

SEQ ID NO: 127762 - protein, 9 aa, Homo Sapiens
AVTPLPVAA

SEQ ID NO: 127763 - protein, 9 aa, Homo Sapiens
DPHSGHFVA

SEQ ID NO: 127764 - protein, 9 aa, Homo Sapiens
DPPSNPVAA

SEQ ID NO: 127765 - protein, 9 aa, Homo Sapiens
ESLPRVVKR

SEQ ID NO: 127766 - protein, 9 aa, Homo Sapiens
ETILRTNKR

SEQ ID NO: 127767 - protein, 9 aa, Homo Sapiens
EVRKLIIRR

SEQ ID NO: 127768 - protein, 9 aa, Homo Sapiens
EYLEKIKQR

SEQ ID NO: 127769 - protein, 9 aa, Homo Sapiens
EYMEKIKQR

SEQ ID NO: 127770 - protein, 9 aa, Homo Sapiens
FPAPILRAV

SEQ ID NO: 127771 - protein, 9 aa, Homo Sapiens
FPFAPPAAA

SEQ ID NO: 127772 - protein, 9 aa, Homo Sapiens
FPFFNPIQT

SEQ ID NO: 127773 - protein, 9 aa, Homo Sapiens
FPGEQFKPA

SEQ ID NO: 127774 - protein, 9 aa, Homo Sapiens
FPHLQDAQV

SEQ ID NO: 127775 - protein, 9 aa, Homo Sapiens
FPHLRVLEA

SEQ ID NO: 127776 - protein, 9 aa, Homo Sapiens
FPIHAITGV

SEQ ID NO: 127777 - protein, 9 aa, Homo Sapiens
FPIKQPITV

SEQ ID NO: 127778 - protein, 9 aa, Homo Sapiens
FPKHVIECA

SEQ ID NO: 127779 - protein, 9 aa, Homo Sapiens
FPMSPVTSV

SEQ ID NO: 127780 - protein, 9 aa, Homo Sapiens
FPRPVTVEP

SEQ ID NO: 127781 - protein, 9 aa, Homo Sapiens
FPRRAFSEA

SEQ ID NO: 127782 - protein, 9 aa, Homo Sapiens
FPSAAATAA

SEQ ID NO: 127783 - protein, 9 aa, Homo Sapiens
FPTHPYFSA

SEQ ID NO: 127784 - protein, 9 aa, Homo Sapiens
FPTTCLERA

SEQ ID NO: 127785 - protein, 9 aa, Homo Sapiens
FPVGKGLAA

SEQ ID NO: 127786 - protein, 9 aa, Homo Sapiens
FPVGVFVVA

SEQ ID NO: 127787 - protein, 9 aa, Homo Sapiens
FPVRLLVAA

SEQ ID NO: 127788 - protein, 9 aa, Homo Sapiens
FPWPQPLST

SEQ ID NO: 127789 - protein, 9 aa, Homo Sapiens
FPYPVGVHA

SEQ ID NO: 127790 - protein, 9 aa, Homo Sapiens
GGPGGVGGL

SEQ ID NO: 127791 - protein, 9 aa, Homo Sapiens
GLINQIQAS

SEQ ID NO: 127792 - protein, 9 aa, Homo Sapiens
GPAAAFTAA

SEQ ID NO: 127793 - protein, 9 aa, Homo Sapiens
GPFAPVLSA

SEQ ID NO: 127794 - protein, 9 aa, Homo Sapiens
GPFDEFQIA

SEQ ID NO: 127795 - protein, 9 aa, Homo Sapiens
GPFGQIFRP

SEQ ID NO: 127796 - protein, 9 aa, Homo Sapiens
GPFSQFIKA

SEQ ID NO: 127797 - protein, 9 aa, Homo Sapiens
GPHANPVAV

SEQ ID NO: 127798 - protein, 9 aa, Homo Sapiens
GPLRSVWVA

SEQ ID NO: 127799 - protein, 9 aa, Homo Sapiens
GPRLSAEAA

SEQ ID NO: 127800 - protein, 9 aa, Homo Sapiens
GPRPPPPPP

SEQ ID NO: 127801 - protein, 9 aa, Homo Sapiens
GPSGCLVPA

SEQ ID NO: 127802 - protein, 9 aa, Homo Sapiens
GPTLQGKAV

SEQ ID NO: 127803 - protein, 9 aa, Homo Sapiens
GPTNAIFKA

SEQ ID NO: 127804 - protein, 9 aa, Homo Sapiens
HPAAFPLPV

SEQ ID NO: 127805 - protein, 9 aa, Homo Sapiens
HPARLTIEA

SEQ ID NO: 127806 - protein, 9 aa, Homo Sapiens
HPHLRKVSV

SEQ ID NO: 127807 - protein, 9 aa, Homo Sapiens
HPHPFLNSV

SEQ ID NO: 127808 - protein, 9 aa, Homo Sapiens
HPIDDLQSA

SEQ ID NO: 127809 - protein, 9 aa, Homo Sapiens
HPIHIIPAS

SEQ ID NO: 127810 - protein, 9 aa, Homo Sapiens
HPITAKAIA

SEQ ID NO: 127811 - protein, 9 aa, Homo Sapiens
HPKKPGVGV

SEQ ID NO: 127812 - protein, 9 aa, Homo Sapiens
HPKPEGLAA

SEQ ID NO: 127813 - protein, 9 aa, Homo Sapiens
HPLFQAKSA

SEQ ID NO: 127814 - protein, 9 aa, Homo Sapiens
HPLPIWTPA

SEQ ID NO: 127815 - protein, 9 aa, Homo Sapiens
HPLPPTPSV

SEQ ID NO: 127816 - protein, 9 aa, Homo Sapiens
HPMPHPPQA

SEQ ID NO: 127817 - protein, 9 aa, Homo Sapiens
HPMPVLPKA

SEQ ID NO: 127818 - protein, 9 aa, Homo Sapiens
HPNQQHVVA

SEQ ID NO: 127819 - protein, 9 aa, Homo Sapiens
HPNSVHICA

SEQ ID NO: 127820 - protein, 9 aa, Homo Sapiens
HPQFLKNQV

SEQ ID NO: 127821 - protein, 9 aa, Homo Sapiens
HPSPVVLKV

SEQ ID NO: 127822 - protein, 9 aa, Homo Sapiens
HPTWALKEA

SEQ ID NO: 127823 - protein, 9 aa, Homo Sapiens
HPVAKILHA

SEQ ID NO: 127824 - protein, 9 aa, Homo Sapiens
HPVEPVTSV

SEQ ID NO: 127825 - protein, 9 aa, Homo Sapiens
HPVHPFLAV

SEQ ID NO: 127826 - protein, 9 aa, Homo Sapiens
HPVHYDTSA

SEQ ID NO: 127827 - protein, 9 aa, Homo Sapiens
HPWLFIEEA

SEQ ID NO: 127828 - protein, 9 aa, Homo Sapiens
HPWVTGKAA

SEQ ID NO: 127829 - protein, 9 aa, Homo Sapiens
HPYKHSFRA

SEQ ID NO: 127830 - protein, 9 aa, Homo Sapiens
HPYLFPVAA

SEQ ID NO: 127831 - protein, 9 aa, Homo Sapiens
HPYLPINSA

SEQ ID NO: 127832 - protein, 9 aa, Homo Sapiens
HPYPPGPGV

SEQ ID NO: 127833 - protein, 9 aa, Homo Sapiens
HPYQRIVTA

SEQ ID NO: 127834 - protein, 9 aa, Homo Sapiens
IAHTPGVAA

SEQ ID NO: 127835 - protein, 9 aa, Homo Sapiens
IARPACLAA

SEQ ID NO: 127836 - protein, 9 aa, Homo Sapiens
IINEPTAAA

SEQ ID NO: 127837 - protein, 9 aa, Homo Sapiens
IIRDEGISA

SEQ ID NO: 127838 - protein, 9 aa, Homo Sapiens
IPAALPVAA

SEQ ID NO: 127839 - protein, 9 aa, Homo Sapiens
IPASGDYVA

SEQ ID NO: 127840 - protein, 9 aa, Homo Sapiens
IPASKLVEA

SEQ ID NO: 127841 - protein, 9 aa, Homo Sapiens
IPATPGIGA

SEQ ID NO: 127842 - protein, 9 aa, Homo Sapiens
IPFGIFSRA

SEQ ID NO: 127843 - protein, 9 aa, Homo Sapiens
IPFGITEEA

SEQ ID NO: 127844 - protein, 9 aa, Homo Sapiens
IPFGTMVAV

SEQ ID NO: 127845 - protein, 9 aa, Homo Sapiens
IPFSKPVKV

SEQ ID NO: 127846 - protein, 9 aa, Homo Sapiens
IPFWRNTAV

SEQ ID NO: 127847 - protein, 9 aa, Homo Sapiens
IPFYGILGA

SEQ ID NO: 127848 - protein, 9 aa, Homo Sapiens
IPFYLQPHA

SEQ ID NO: 127849 - protein, 9 aa, Homo Sapiens
IPHKKFTFA

SEQ ID NO: 127850 - protein, 9 aa, Homo Sapiens
IPHLLGDVV

SEQ ID NO: 127851 - protein, 9 aa, Homo Sapiens
IPHLVTHDA

SEQ ID NO: 127852 - protein, 9 aa, Homo Sapiens
IPHPLIMGV

SEQ ID NO: 127853 - protein, 9 aa, Homo Sapiens
IPIEVIPMA

SEQ ID NO: 127854 - protein, 9 aa, Homo Sapiens
IPIKKSDPV

SEQ ID NO: 127855 - protein, 9 aa, Homo Sapiens
IPISNILMV

SEQ ID NO: 127856 - protein, 9 aa, Homo Sapiens
IPISPISPA

SEQ ID NO: 127857 - protein, 9 aa, Homo Sapiens
IPITVLQPA

SEQ ID NO: 127858 - protein, 9 aa, Homo Sapiens
IPKDKSWKA

SEQ ID NO: 127859 - protein, 9 aa, Homo Sapiens
IPKHINPVA

SEQ ID NO: 127860 - protein, 9 aa, Homo Sapiens
IPKKEIHTV

SEQ ID NO: 127861 - protein, 9 aa, Homo Sapiens
IPKKLMHQA

SEQ ID NO: 127862 - protein, 9 aa, Homo Sapiens
IPKPEQLSA

SEQ ID NO: 127863 - protein, 9 aa, Homo Sapiens
IPKTINRAA

SEQ ID NO: 127864 - protein, 9 aa, Homo Sapiens
IPKYPTNPP

SEQ ID NO: 127865 - protein, 9 aa, Homo Sapiens
IPLGFGVAA

SEQ ID NO: 127866 - protein, 9 aa, Homo Sapiens
IPLPRPQSA

SEQ ID NO: 127867 - protein, 9 aa, Homo Sapiens
IPLQDLVAA

SEQ ID NO: 127868 - protein, 9 aa, Homo Sapiens
IPMELVNEV

SEQ ID NO: 127869 - protein, 9 aa, Homo Sapiens
IPMRDFVCA

SEQ ID NO: 127870 - protein, 9 aa, Homo Sapiens
IPNEIIHAL

SEQ ID NO: 127871 - protein, 9 aa, Homo Sapiens
IPNNVKTAV

SEQ ID NO: 127872 - protein, 9 aa, Homo Sapiens
IPQEAYNAV

SEQ ID NO: 127873 - protein, 9 aa, Homo Sapiens
IPQKPSQPA

SEQ ID NO: 127874 - protein, 9 aa, Homo Sapiens
IPQLMKEEA

SEQ ID NO: 127875 - protein, 9 aa, Homo Sapiens
IPQLNSKAV

SEQ ID NO: 127876 - protein, 9 aa, Homo Sapiens
IPQQVFQEV

SEQ ID NO: 127877 - protein, 9 aa, Homo Sapiens
IPQSAVDTA

SEQ ID NO: 127878 - protein, 9 aa, Homo Sapiens
IPQSIIECV

SEQ ID NO: 127879 - protein, 9 aa, Homo Sapiens
IPRNQLQSV

SEQ ID NO: 127880 - protein, 9 aa, Homo Sapiens
IPRNTVVPT

SEQ ID NO: 127881 - protein, 9 aa, Homo Sapiens
IPRQLGEVA

SEQ ID NO: 127882 - protein, 9 aa, Homo Sapiens
IPRSFLQEA

SEQ ID NO: 127883 - protein, 9 aa, Homo Sapiens
IPRSFMMEV

SEQ ID NO: 127884 - protein, 9 aa, Homo Sapiens
IPSGTILKA

SEQ ID NO: 127885 - protein, 9 aa, Homo Sapiens
IPSSVIHPA

SEQ ID NO: 127886 - protein, 9 aa, Homo Sapiens
IPTENSMTA

SEQ ID NO: 127887 - protein, 9 aa, Homo Sapiens
IPTEVRSKA

SEQ ID NO: 127888 - protein, 9 aa, Homo Sapiens
IPVDFKYIA

SEQ ID NO: 127889 - protein, 9 aa, Homo Sapiens
IPVDSAVAV

SEQ ID NO: 127890 - protein, 9 aa, Homo Sapiens
IPVESIEEV

SEQ ID NO: 127891 - protein, 9 aa, Homo Sapiens
IPVKSSPQA

SEQ ID NO: 127892 - protein, 9 aa, Homo Sapiens
IPVNGGLAA

SEQ ID NO: 127893 - protein, 9 aa, Homo Sapiens
IPWGISATA

SEQ ID NO: 127894 - protein, 9 aa, Homo Sapiens
IPWLQYNEV

SEQ ID NO: 127895 - protein, 9 aa, Homo Sapiens
IPWSIPLEA

SEQ ID NO: 127896 - protein, 9 aa, Homo Sapiens
IPYGMRFIA

SEQ ID NO: 127897 - protein, 9 aa, Homo Sapiens
IPYHIVNIV

SEQ ID NO: 127898 - protein, 9 aa, Homo Sapiens
IPYLSKHRA

SEQ ID NO: 127899 - protein, 9 aa, Homo Sapiens
IPYQPMPAS

SEQ ID NO: 127900 - protein, 9 aa, Homo Sapiens
IPYQSPVSS

SEQ ID NO: 127901 - protein, 9 aa, Homo Sapiens
IPYRPKPSS

SEQ ID NO: 127902 - protein, 9 aa, Homo Sapiens
IPYRVIHNA

SEQ ID NO: 127903 - protein, 9 aa, Homo Sapiens
ITAPPGTAA

SEQ ID NO: 127904 - protein, 9 aa, Homo Sapiens
IVKPVKVSA

SEQ ID NO: 127905 - protein, 9 aa, Homo Sapiens
IVNVPQPAA

SEQ ID NO: 127906 - protein, 9 aa, Homo Sapiens
IVRDRVTSA

SEQ ID NO: 127907 - protein, 9 aa, Homo Sapiens
IVREDLLSA

SEQ ID NO: 127908 - protein, 9 aa, Homo Sapiens
KAQLQQVEA

SEQ ID NO: 127909 - protein, 9 aa, Homo Sapiens
KPAEFTVDA

SEQ ID NO: 127910 - protein, 9 aa, Homo Sapiens
KPAKPLISV

SEQ ID NO: 127911 - protein, 9 aa, Homo Sapiens
KPAMPMQQA

SEQ ID NO: 127912 - protein, 9 aa, Homo Sapiens
KPANVFITA

SEQ ID NO: 127913 - protein, 9 aa, Homo Sapiens
KPAPPFNVT

SEQ ID NO: 127914 - protein, 9 aa, Homo Sapiens
KPAVPTVAS

SEQ ID NO: 127915 - protein, 9 aa, Homo Sapiens
KPEEQWWSA

SEQ ID NO: 127916 - protein, 9 aa, Homo Sapiens
KPFAYVSEA

SEQ ID NO: 127917 - protein, 9 aa, Homo Sapiens
KPFCAAAAA

SEQ ID NO: 127918 - protein, 9 aa, Homo Sapiens
KPFKEFVEA

SEQ ID NO: 127919 - protein, 9 aa, Homo Sapiens
KPFKYIVTC

SEQ ID NO: 127920 - protein, 9 aa, Homo Sapiens
KPFLLPVEA

SEQ ID NO: 127921 - protein, 9 aa, Homo Sapiens
KPFYQKREV

SEQ ID NO: 127922 - protein, 9 aa, Homo Sapiens
KPGSPYRSV

SEQ ID NO: 127923 - protein, 9 aa, Homo Sapiens
KPHAIIILP

SEQ ID NO: 127924 - protein, 9 aa, Homo Sapiens
KPHDIFEAN

SEQ ID NO: 127925 - protein, 9 aa, Homo Sapiens
KPHSGFHVA

SEQ ID NO: 127926 - protein, 9 aa, Homo Sapiens
KPHSQIPVS

SEQ ID NO: 127927 - protein, 9 aa, Homo Sapiens
KPIKFLVSV

SEQ ID NO: 127928 - protein, 9 aa, Homo Sapiens
KPKEPPKVP

SEQ ID NO: 127929 - protein, 9 aa, Homo Sapiens
KPKEPQPEV

SEQ ID NO: 127930 - protein, 9 aa, Homo Sapiens
KPKPIGKLA

SEQ ID NO: 127931 - protein, 9 aa, Homo Sapiens
KPKVPLKSA

SEQ ID NO: 127932 - protein, 9 aa, Homo Sapiens
KPLEKHYSV

SEQ ID NO: 127933 - protein, 9 aa, Homo Sapiens
KPLEPVSTV

SEQ ID NO: 127934 - protein, 9 aa, Homo Sapiens
KPLPPIQVA

SEQ ID NO: 127935 - protein, 9 aa, Homo Sapiens
KPLQPARPV

SEQ ID NO: 127936 - protein, 9 aa, Homo Sapiens
KPMEGWIAV

SEQ ID NO: 127937 - protein, 9 aa, Homo Sapiens
KPMFTQVCV

SEQ ID NO: 127938 - protein, 9 aa, Homo Sapiens
KPMKSVLVV

SEQ ID NO: 127939 - protein, 9 aa, Homo Sapiens
KPPPPPPAP

SEQ ID NO: 127940 - protein, 9 aa, Homo Sapiens
KPQATVVSA

SEQ ID NO: 127941 - protein, 9 aa, Homo Sapiens
KPQPSILQA

SEQ ID NO: 127942 - protein, 9 aa, Homo Sapiens
KPRPPLHLL

SEQ ID NO: 127943 - protein, 9 aa, Homo Sapiens
KPRPPPPPP

SEQ ID NO: 127944 - protein, 9 aa, Homo Sapiens
KPSESIYSA

SEQ ID NO: 127945 - protein, 9 aa, Homo Sapiens
KPTHFTVNA

SEQ ID NO: 127946 - protein, 9 aa, Homo Sapiens
KPTVQPWIA

SEQ ID NO: 127947 - protein, 9 aa, Homo Sapiens
KPVEVTESA

SEQ ID NO: 127948 - protein, 9 aa, Homo Sapiens
KPVLPHKVA

SEQ ID NO: 127949 - protein, 9 aa, Homo Sapiens
KPVLTQESA

SEQ ID NO: 127950 - protein, 9 aa, Homo Sapiens
KPYAHILSV

SEQ ID NO: 127951 - protein, 9 aa, Homo Sapiens
KPYCNEIHA

SEQ ID NO: 127952 - protein, 9 aa, Homo Sapiens
KPYESYIGA

SEQ ID NO: 127953 - protein, 9 aa, Homo Sapiens
KPYNVYITV

SEQ ID NO: 127954 - protein, 9 aa, Homo Sapiens
KPYPNSEAA

SEQ ID NO: 127955 - protein, 9 aa, Homo Sapiens
LAAARLAAA

SEQ ID NO: 127956 - protein, 9 aa, Homo Sapiens
LAGPLRPAA

SEQ ID NO: 127957 - protein, 9 aa, Homo Sapiens
LHPAPPNGL

SEQ ID NO: 127958 - protein, 9 aa, Homo Sapiens
LPAAKGFVA

SEQ ID NO: 127959 - protein, 9 aa, Homo Sapiens
LPAAMPITA

SEQ ID NO: 127960 - protein, 9 aa, Homo Sapiens
LPAEAVEAA

SEQ ID NO: 127961 - protein, 9 aa, Homo Sapiens
LPAEYLLSA

SEQ ID NO: 127962 - protein, 9 aa, Homo Sapiens
LPAGILPMV

SEQ ID NO: 127963 - protein, 9 aa, Homo Sapiens
LPAPAEVAA

SEQ ID NO: 127964 - protein, 9 aa, Homo Sapiens
LPAPPAVSA

SEQ ID NO: 127965 - protein, 9 aa, Homo Sapiens
LPAPPHIDV

SEQ ID NO: 127966 - protein, 9 aa, Homo Sapiens
LPASETPKA

SEQ ID NO: 127967 - protein, 9 aa, Homo Sapiens
LPCEVKVVA

SEQ ID NO: 127968 - protein, 9 aa, Homo Sapiens
LPCFNGRVV

SEQ ID NO: 127969 - protein, 9 aa, Homo Sapiens
LPCTVKCGI

SEQ ID NO: 127970 - protein, 9 aa, Homo Sapiens
LPDDVAISA

SEQ ID NO: 127971 - protein, 9 aa, Homo Sapiens
LPDLRPWTS

SEQ ID NO: 127972 - protein, 9 aa, Homo Sapiens
LPEEIREPA

SEQ ID NO: 127973 - protein, 9 aa, Homo Sapiens
LPEENREAA

SEQ ID NO: 127974 - protein, 9 aa, Homo Sapiens
LPELLGLEA

SEQ ID NO: 127975 - protein, 9 aa, Homo Sapiens
LPFDRFSEV

SEQ ID NO: 127976 - protein, 9 aa, Homo Sapiens
LPFGGVPTV

SEQ ID NO: 127977 - protein, 9 aa, Homo Sapiens
LPFPLPLFA

SEQ ID NO: 127978 - protein, 9 aa, Homo Sapiens
LPFRVIPLV

SEQ ID NO: 127979 - protein, 9 aa, Homo Sapiens
LPFSSMPTA

SEQ ID NO: 127980 - protein, 9 aa, Homo Sapiens
LPFVPPPAV

SEQ ID NO: 127981 - protein, 9 aa, Homo Sapiens
LPGELFHVV

SEQ ID NO: 127982 - protein, 9 aa, Homo Sapiens
LPGPLTPVA

SEQ ID NO: 127983 - protein, 9 aa, Homo Sapiens
LPHDLAVQA

SEQ ID NO: 127984 - protein, 9 aa, Homo Sapiens
LPHEILEMT

SEQ ID NO: 127985 - protein, 9 aa, Homo Sapiens
LPHGAISED

SEQ ID NO: 127986 - protein, 9 aa, Homo Sapiens
LPHGFTNMA

SEQ ID NO: 127987 - protein, 9 aa, Homo Sapiens
LPHHILADV

SEQ ID NO: 127988 - protein, 9 aa, Homo Sapiens
LPHHRVIEV

SEQ ID NO: 127989 - protein, 9 aa, Homo Sapiens
LPHKIHYAA

SEQ ID NO: 127990 - protein, 9 aa, Homo Sapiens
LPHKLRIKA

SEQ ID NO: 127991 - protein, 9 aa, Homo Sapiens
LPHPIIVSI

SEQ ID NO: 127992 - protein, 9 aa, Homo Sapiens
LPHPNRIQA

SEQ ID NO: 127993 - protein, 9 aa, Homo Sapiens
LPHPYAIAV

SEQ ID NO: 127994 - protein, 9 aa, Homo Sapiens
LPHSAGRYA

SEQ ID NO: 127995 - protein, 9 aa, Homo Sapiens
LPHSHDVSA

SEQ ID NO: 127996 - protein, 9 aa, Homo Sapiens
LPHSQLPQA

SEQ ID NO: 127997 - protein, 9 aa, Homo Sapiens
LPHSTAALA

SEQ ID NO: 127998 - protein, 9 aa, Homo Sapiens
LPIGTLPLA

SEQ ID NO: 127999 - protein, 9 aa, Homo Sapiens
LPKEKQPVA

SEQ ID NO: 128000 - protein, 9 aa, Homo Sapiens
LPKHLLHSV

SEQ ID NO: 128001 - protein, 9 aa, Homo Sapiens
LPKPHGIRA

SEQ ID NO: 128002 - protein, 9 aa, Homo Sapiens
LPKPPGRGV

SEQ ID NO: 128003 - protein, 9 aa, Homo Sapiens
LPLAVTKEA

SEQ ID NO: 128004 - protein, 9 aa, Homo Sapiens
LPLEVCNIV

SEQ ID NO: 128005 - protein, 9 aa, Homo Sapiens
LPLHPSWEA

SEQ ID NO: 128006 - protein, 9 aa, Homo Sapiens
LPLPYGVSA

SEQ ID NO: 128007 - protein, 9 aa, Homo Sapiens
LPLSLLKTA

SEQ ID NO: 128008 - protein, 9 aa, Homo Sapiens
LPLWVDKEA

SEQ ID NO: 128009 - protein, 9 aa, Homo Sapiens
LPMDYVQRV

SEQ ID NO: 128010 - protein, 9 aa, Homo Sapiens
LPNANYPSA

SEQ ID NO: 128011 - protein, 9 aa, Homo Sapiens
LPNAVITRI

SEQ ID NO: 128012 - protein, 9 aa, Homo Sapiens
LPNFLPYNV

SEQ ID NO: 128013 - protein, 9 aa, Homo Sapiens
LPNGPLLGT

SEQ ID NO: 128014 - protein, 9 aa, Homo Sapiens
LPNIQKVEV

SEQ ID NO: 128015 - protein, 9 aa, Homo Sapiens
LPNLQTVTV

SEQ ID NO: 128016 - protein, 9 aa, Homo Sapiens
LPNQPVEKA

SEQ ID NO: 128017 - protein, 9 aa, Homo Sapiens
LPQPAFIPA

SEQ ID NO: 128018 - protein, 9 aa, Homo Sapiens
LPQQPSRPS

SEQ ID NO: 128019 - protein, 9 aa, Homo Sapiens
LPRDVLTRA

SEQ ID NO: 128020 - protein, 9 aa, Homo Sapiens
LPRKPVAGA

SEQ ID NO: 128021 - protein, 9 aa, Homo Sapiens
LPRLIDMSA

SEQ ID NO: 128022 - protein, 9 aa, Homo Sapiens
LPRPPETTA

SEQ ID NO: 128023 - protein, 9 aa, Homo Sapiens
LPRPQGAAA

SEQ ID NO: 128024 - protein, 9 aa, Homo Sapiens
LPRPSAPSA

SEQ ID NO: 128025 - protein, 9 aa, Homo Sapiens
LPRPVPLVA

SEQ ID NO: 128026 - protein, 9 aa, Homo Sapiens
LPRRPLPPA

SEQ ID NO: 128027 - protein, 9 aa, Homo Sapiens
LPSDIAAEA

SEQ ID NO: 128028 - protein, 9 aa, Homo Sapiens
LPSDLTRAA

SEQ ID NO: 128029 - protein, 9 aa, Homo Sapiens
LPSELIVHI

SEQ ID NO: 128030 - protein, 9 aa, Homo Sapiens
LPSLSPLSA

SEQ ID NO: 128031 - protein, 9 aa, Homo Sapiens
LPSPPAVAV

SEQ ID NO: 128032 - protein, 9 aa, Homo Sapiens
LPSRFIESA

SEQ ID NO: 128033 - protein, 9 aa, Homo Sapiens
LPSVPLSCA

SEQ ID NO: 128034 - protein, 9 aa, Homo Sapiens
LPTESTKAV

SEQ ID NO: 128035 - protein, 9 aa, Homo Sapiens
LPTGVFQVA

SEQ ID NO: 128036 - protein, 9 aa, Homo Sapiens
LPTKDLLSA

SEQ ID NO: 128037 - protein, 9 aa, Homo Sapiens
LPTKPTQGA

SEQ ID NO: 128038 - protein, 9 aa, Homo Sapiens
LPTRIAYYA

SEQ ID NO: 128039 - protein, 9 aa, Homo Sapiens
LPTTMGVVA

SEQ ID NO: 128040 - protein, 9 aa, Homo Sapiens
LPVAFKVVA

SEQ ID NO: 128041 - protein, 9 aa, Homo Sapiens
LPVAVKHVV

SEQ ID NO: 128042 - protein, 9 aa, Homo Sapiens
LPVDAVISV

SEQ ID NO: 128043 - protein, 9 aa, Homo Sapiens
LPVDVVVNA

SEQ ID NO: 128044 - protein, 9 aa, Homo Sapiens
LPVEFTIDA

SEQ ID NO: 128045 - protein, 9 aa, Homo Sapiens
LPVLPVAAA

SEQ ID NO: 128046 - protein, 9 aa, Homo Sapiens
LPVPQKIEA

SEQ ID NO: 128047 - protein, 9 aa, Homo Sapiens
LPVRPQTNA

SEQ ID NO: 128048 - protein, 9 aa, Homo Sapiens
LPVSLPTHA

SEQ ID NO: 128049 - protein, 9 aa, Homo Sapiens
LPVSNVVSV

SEQ ID NO: 128050 - protein, 9 aa, Homo Sapiens
LPWQGLKAA

SEQ ID NO: 128051 - protein, 9 aa, Homo Sapiens
LPYAITIVA

SEQ ID NO: 128052 - protein, 9 aa, Homo Sapiens
LPYDIPHRA

SEQ ID NO: 128053 - protein, 9 aa, Homo Sapiens
LPYHHVIHA

SEQ ID NO: 128054 - protein, 9 aa, Homo Sapiens
LPYKWVVEA

SEQ ID NO: 128055 - protein, 9 aa, Homo Sapiens
LPYNGVTVA

SEQ ID NO: 128056 - protein, 9 aa, Homo Sapiens
LPYNGVVLA

SEQ ID NO: 128057 - protein, 9 aa, Homo Sapiens
LQIDNARLA

SEQ ID NO: 128058 - protein, 9 aa, Homo Sapiens
LQQVDTSTR

SEQ ID NO: 128059 - protein, 9 aa, Homo Sapiens
LTKPVEISA

SEQ ID NO: 128060 - protein, 9 aa, Homo Sapiens
LVAPPLPAA

SEQ ID NO: 128061 - protein, 9 aa, Homo Sapiens
LVGPVLGAA

SEQ ID NO: 128062 - protein, 9 aa, Homo Sapiens
LVKDVFISA

SEQ ID NO: 128063 - protein, 9 aa, Homo Sapiens
LVMGDIPAA

SEQ ID NO: 128064 - protein, 9 aa, Homo Sapiens
LVRPPTEQA

SEQ ID NO: 128065 - protein, 9 aa, Homo Sapiens
LVRPVVPSA

SEQ ID NO: 128066 - protein, 9 aa, Homo Sapiens
LVSKPFCAA

SEQ ID NO: 128067 - protein, 9 aa, Homo Sapiens
LVSPPAVSA

SEQ ID NO: 128068 - protein, 9 aa, Homo Sapiens
LVYQGYLAA

SEQ ID NO: 128069 - protein, 9 aa, Homo Sapiens
MPAAALNAA

SEQ ID NO: 128070 - protein, 9 aa, Homo Sapiens
MPADSGYPA

SEQ ID NO: 128071 - protein, 9 aa, Homo Sapiens
MPAFPLPYA

SEQ ID NO: 128072 - protein, 9 aa, Homo Sapiens
MPAGSFITA

SEQ ID NO: 128073 - protein, 9 aa, Homo Sapiens
MPAHFSDSA

SEQ ID NO: 128074 - protein, 9 aa, Homo Sapiens
MPATLARAA

SEQ ID NO: 128075 - protein, 9 aa, Homo Sapiens
MPFGNVISA

SEQ ID NO: 128076 - protein, 9 aa, Homo Sapiens
MPFGNVVSA

SEQ ID NO: 128077 - protein, 9 aa, Homo Sapiens
MPFPNIRSA

SEQ ID NO: 128078 - protein, 9 aa, Homo Sapiens
MPHEDCITA

SEQ ID NO: 128079 - protein, 9 aa, Homo Sapiens
MPILIDFHA

SEQ ID NO: 128080 - protein, 9 aa, Homo Sapiens
MPKAEKNAV

SEQ ID NO: 128081 - protein, 9 aa, Homo Sapiens
MPLLKSEVA

SEQ ID NO: 128082 - protein, 9 aa, Homo Sapiens
MPLSTIREV

SEQ ID NO: 128083 - protein, 9 aa, Homo Sapiens
MPMERQMSV

SEQ ID NO: 128084 - protein, 9 aa, Homo Sapiens
MPNDEHWKA

SEQ ID NO: 128085 - protein, 9 aa, Homo Sapiens
MPNHIHMGA

SEQ ID NO: 128086 - protein, 9 aa, Homo Sapiens
MPPPVGMVA

SEQ ID NO: 128087 - protein, 9 aa, Homo Sapiens
MPQDLRSPA

SEQ ID NO: 128088 - protein, 9 aa, Homo Sapiens
MPQIPVASV

SEQ ID NO: 128089 - protein, 9 aa, Homo Sapiens
MPQNPHIIA

SEQ ID NO: 128090 - protein, 9 aa, Homo Sapiens
MPRDILIVV

SEQ ID NO: 128091 - protein, 9 aa, Homo Sapiens
MPRQLSAAA

SEQ ID NO: 128092 - protein, 9 aa, Homo Sapiens
MPRRNFPIA

SEQ ID NO: 128093 - protein, 9 aa, Homo Sapiens
MPSDVLEVT

SEQ ID NO: 128094 - protein, 9 aa, Homo Sapiens
MPTDVLEVT

SEQ ID NO: 128095 - protein, 9 aa, Homo Sapiens
MPTLPPPSV

SEQ ID NO: 128096 - protein, 9 aa, Homo Sapiens
MPTQPQVQA

SEQ ID NO: 128097 - protein, 9 aa, Homo Sapiens
MPTRPGEQA

SEQ ID NO: 128098 - protein, 9 aa, Homo Sapiens
MPVERILEA

SEQ ID NO: 128099 - protein, 9 aa, Homo Sapiens
MPVGLIAGA

SEQ ID NO: 128100 - protein, 9 aa, Homo Sapiens
MPVPAQPKA

SEQ ID NO: 128101 - protein, 9 aa, Homo Sapiens
MPYFLLTQA

SEQ ID NO: 128102 - protein, 9 aa, Homo Sapiens
MPYLIGVHA

SEQ ID NO: 128103 - protein, 9 aa, Homo Sapiens
NPAPPIDAV

SEQ ID NO: 128104 - protein, 9 aa, Homo Sapiens
NPFGGASHA

SEQ ID NO: 128105 - protein, 9 aa, Homo Sapiens
NPGVPVPAA

SEQ ID NO: 128106 - protein, 9 aa, Homo Sapiens
NPNELSVSA

SEQ ID NO: 128107 - protein, 9 aa, Homo Sapiens
NPNQYHYVA

SEQ ID NO: 128108 - protein, 9 aa, Homo Sapiens
NPNQYNYIA

SEQ ID NO: 128109 - protein, 9 aa, Homo Sapiens
NPTCPKVAA

SEQ ID NO: 128110 - protein, 9 aa, Homo Sapiens
NPVTGLLSA

SEQ ID NO: 128111 - protein, 9 aa, Homo Sapiens
NPYATLPRA

SEQ ID NO: 128112 - protein, 9 aa, Homo Sapiens
NPYHNAVHA

SEQ ID NO: 128113 - protein, 9 aa, Homo Sapiens
NPYTIFHQA

SEQ ID NO: 128114 - protein, 9 aa, Homo Sapiens
NPYYGGESA

SEQ ID NO: 128115 - protein, 9 aa, Homo Sapiens
PAYHSSLMD

SEQ ID NO: 128116 - protein, 9 aa, Homo Sapiens
PITPRAAPL

SEQ ID NO: 128117 - protein, 9 aa, Homo Sapiens
PRKPVAGAL

SEQ ID NO: 128118 - protein, 9 aa, Homo Sapiens
PSIVHRKCF

SEQ ID NO: 128119 - protein, 9 aa, Homo Sapiens
QPAPAIHSA

SEQ ID NO: 128120 - protein, 9 aa, Homo Sapiens
QPFAVPHSA

SEQ ID NO: 128121 - protein, 9 aa, Homo Sapiens
QPFSKPVSV

SEQ ID NO: 128122 - protein, 9 aa, Homo Sapiens
QPGEALAEA

SEQ ID NO: 128123 - protein, 9 aa, Homo Sapiens
QPHHIGVAV

SEQ ID NO: 128124 - protein, 9 aa, Homo Sapiens
QPHSSALTA

SEQ ID NO: 128125 - protein, 9 aa, Homo Sapiens
QPHTILRVV

SEQ ID NO: 128126 - protein, 9 aa, Homo Sapiens
QPIFAVTSA

SEQ ID NO: 128127 - protein, 9 aa, Homo Sapiens
QPILLELEA

SEQ ID NO: 128128 - protein, 9 aa, Homo Sapiens
QPINLIFRY

SEQ ID NO: 128129 - protein, 9 aa, Homo Sapiens
QPITPGPSI

SEQ ID NO: 128130 - protein, 9 aa, Homo Sapiens
QPLLKHWEA

SEQ ID NO: 128131 - protein, 9 aa, Homo Sapiens
QPLLPYSAV

SEQ ID NO: 128132 - protein, 9 aa, Homo Sapiens
QPLPATHAA

SEQ ID NO: 128133 - protein, 9 aa, Homo Sapiens
QPLPMAHCA

SEQ ID NO: 128134 - protein, 9 aa, Homo Sapiens
QPLPVILHV

SEQ ID NO: 128135 - protein, 9 aa, Homo Sapiens
QPLYQPSHA

SEQ ID NO: 128136 - protein, 9 aa, Homo Sapiens
QPNTLICHI

SEQ ID NO: 128137 - protein, 9 aa, Homo Sapiens
QPQAPGVEA

SEQ ID NO: 128138 - protein, 9 aa, Homo Sapiens
QPQPQPYAV

SEQ ID NO: 128139 - protein, 9 aa, Homo Sapiens
QPRDPVRPP

SEQ ID NO: 128140 - protein, 9 aa, Homo Sapiens
QPSEVLRTV

SEQ ID NO: 128141 - protein, 9 aa, Homo Sapiens
QPTSVLDKA

SEQ ID NO: 128142 - protein, 9 aa, Homo Sapiens
QPVPPGRAA

SEQ ID NO: 128143 - protein, 9 aa, Homo Sapiens
QPWAQTVVV

SEQ ID NO: 128144 - protein, 9 aa, Homo Sapiens
QPWRGGAGA

SEQ ID NO: 128145 - protein, 9 aa, Homo Sapiens
QPYMPTVSA

SEQ ID NO: 128146 - protein, 9 aa, Homo Sapiens
QPYQPLREV

SEQ ID NO: 128147 - protein, 9 aa, Homo Sapiens
QPYSKLPGV

SEQ ID NO: 128148 - protein, 9 aa, Homo Sapiens
QVRDVIIAA

SEQ ID NO: 128149 - protein, 9 aa, Homo Sapiens
RAFQQSTAA

SEQ ID NO: 128150 - protein, 9 aa, Homo Sapiens
RARVPGPPA

SEQ ID NO: 128151 - protein, 9 aa, Homo Sapiens
RDIPRVTAL

SEQ ID NO: 128152 - protein, 9 aa, Homo Sapiens
RIFDRAVAA

SEQ ID NO: 128153 - protein, 9 aa, Homo Sapiens
RLPNALRAA

SEQ ID NO: 128154 - protein, 9 aa, Homo Sapiens
RNVSTGDVN

SEQ ID NO: 128155 - protein, 9 aa, Homo Sapiens
RPAAPLIGA

SEQ ID NO: 128156 - protein, 9 aa, Homo Sapiens
RPADVIFAT

SEQ ID NO: 128157 - protein, 9 aa, Homo Sapiens
RPAEKLSTA

SEQ ID NO: 128158 - protein, 9 aa, Homo Sapiens
RPAFVIPEV

SEQ ID NO: 128159 - protein, 9 aa, Homo Sapiens
RPALFSSSA

SEQ ID NO: 128160 - protein, 9 aa, Homo Sapiens
RPALVEQTA

SEQ ID NO: 128161 - protein, 9 aa, Homo Sapiens
RPAPLPAAV

SEQ ID NO: 128162 - protein, 9 aa, Homo Sapiens
RPAPPPPTV

SEQ ID NO: 128163 - protein, 9 aa, Homo Sapiens
RPAPPRAPA

SEQ ID NO: 128164 - protein, 9 aa, Homo Sapiens
RPAPVAVAA

SEQ ID NO: 128165 - protein, 9 aa, Homo Sapiens
RPATDLPEA

SEQ ID NO: 128166 - protein, 9 aa, Homo Sapiens
RPFHGISTV

SEQ ID NO: 128167 - protein, 9 aa, Homo Sapiens
RPFIGMSSA

SEQ ID NO: 128168 - protein, 9 aa, Homo Sapiens
RPFPAAHHA

SEQ ID NO: 128169 - protein, 9 aa, Homo Sapiens
RPFQNQTHA

SEQ ID NO: 128170 - protein, 9 aa, Homo Sapiens
RPFQSIIHA

SEQ ID NO: 128171 - protein, 9 aa, Homo Sapiens
RPFTNLESA

SEQ ID NO: 128172 - protein, 9 aa, Homo Sapiens
RPFVAINYA

SEQ ID NO: 128173 - protein, 9 aa, Homo Sapiens
RPGPGVPAT

SEQ ID NO: 128174 - protein, 9 aa, Homo Sapiens
RPGPVLPAV

SEQ ID NO: 128175 - protein, 9 aa, Homo Sapiens
RPHAPGRPA

SEQ ID NO: 128176 - protein, 9 aa, Homo Sapiens
RPHHAQLAV

SEQ ID NO: 128177 - protein, 9 aa, Homo Sapiens
RPHPLRPEA

SEQ ID NO: 128178 - protein, 9 aa, Homo Sapiens
RPHRGILAV

SEQ ID NO: 128179 - protein, 9 aa, Homo Sapiens
RPHSALLAV

SEQ ID NO: 128180 - protein, 9 aa, Homo Sapiens
RPHTVLTVI

SEQ ID NO: 128181 - protein, 9 aa, Homo Sapiens
RPIASGPVV

SEQ ID NO: 128182 - protein, 9 aa, Homo Sapiens
RPIDHWDAV

SEQ ID NO: 128183 - protein, 9 aa, Homo Sapiens
RPIPNQPPT

SEQ ID NO: 128184 - protein, 9 aa, Homo Sapiens
RPIQVKPAA

SEQ ID NO: 128185 - protein, 9 aa, Homo Sapiens
RPKMQEVVA

SEQ ID NO: 128186 - protein, 9 aa, Homo Sapiens
RPKPDYFAV

SEQ ID NO: 128187 - protein, 9 aa, Homo Sapiens
RPKPIITSV

SEQ ID NO: 128188 - protein, 9 aa, Homo Sapiens
RPKPPNVRT

SEQ ID NO: 128189 - protein, 9 aa, Homo Sapiens
RPLAQLREV

SEQ ID NO: 128190 - protein, 9 aa, Homo Sapiens
RPLFPSTGA

SEQ ID NO: 128191 - protein, 9 aa, Homo Sapiens
RPLHEFITA

SEQ ID NO: 128192 - protein, 9 aa, Homo Sapiens
RPLLKAITA

SEQ ID NO: 128193 - protein, 9 aa, Homo Sapiens
RPLQDEPAA

SEQ ID NO: 128194 - protein, 9 aa, Homo Sapiens
RPLSKQLSA

SEQ ID NO: 128195 - protein, 9 aa, Homo Sapiens
RPLSRLQAA

SEQ ID NO: 128196 - protein, 9 aa, Homo Sapiens
RPLTLFHTV

SEQ ID NO: 128197 - protein, 9 aa, Homo Sapiens
RPLVSTQPA

SEQ ID NO: 128198 - protein, 9 aa, Homo Sapiens
RPMKVGHVT

SEQ ID NO: 128199 - protein, 9 aa, Homo Sapiens
RPNDIMAEV

SEQ ID NO: 128200 - protein, 9 aa, Homo Sapiens
RPNGVSAVA

SEQ ID NO: 128201 - protein, 9 aa, Homo Sapiens
RPNLIKPAA

SEQ ID NO: 128202 - protein, 9 aa, Homo Sapiens
RPNPPPVSV

SEQ ID NO: 128203 - protein, 9 aa, Homo Sapiens
RPNSGIIDA

SEQ ID NO: 128204 - protein, 9 aa, Homo Sapiens
RPNWSKLVA

SEQ ID NO: 128205 - protein, 9 aa, Homo Sapiens
RPPHLYAVA

SEQ ID NO: 128206 - protein, 9 aa, Homo Sapiens
RPPLNPVSA

SEQ ID NO: 128207 - protein, 9 aa, Homo Sapiens
RPQPQPRPA

SEQ ID NO: 128208 - protein, 9 aa, Homo Sapiens
RPRAPIIAV

SEQ ID NO: 128209 - protein, 9 aa, Homo Sapiens
RPRDSQLYA

SEQ ID NO: 128210 - protein, 9 aa, Homo Sapiens
RPRFVSLRA

SEQ ID NO: 128211 - protein, 9 aa, Homo Sapiens
RPRHQGVMV

SEQ ID NO: 128212 - protein, 9 aa, Homo Sapiens
RPRITHPPP

SEQ ID NO: 128213 - protein, 9 aa, Homo Sapiens
RPRLIAELA

SEQ ID NO: 128214 - protein, 9 aa, Homo Sapiens
RPRLVAAAV

SEQ ID NO: 128215 - protein, 9 aa, Homo Sapiens
RPRNGGICV

SEQ ID NO: 128216 - protein, 9 aa, Homo Sapiens
RPRPPVLSV

SEQ ID NO: 128217 - protein, 9 aa, Homo Sapiens
RPRPPVSST

SEQ ID NO: 128218 - protein, 9 aa, Homo Sapiens
RPRPTTVTA

SEQ ID NO: 128219 - protein, 9 aa, Homo Sapiens
RPRPVLRSV

SEQ ID NO: 128220 - protein, 9 aa, Homo Sapiens
RPRPVVTTT

SEQ ID NO: 128221 - protein, 9 aa, Homo Sapiens
RPRTAGPAV

SEQ ID NO: 128222 - protein, 9 aa, Homo Sapiens
RPRYLEIRA

SEQ ID NO: 128223 - protein, 9 aa, Homo Sapiens
RPSALPFVA

SEQ ID NO: 128224 - protein, 9 aa, Homo Sapiens
RPSHFLNFA

SEQ ID NO: 128225 - protein, 9 aa, Homo Sapiens
RPSPAPPAA

SEQ ID NO: 128226 - protein, 9 aa, Homo Sapiens
RPSPPVQSV

SEQ ID NO: 128227 - protein, 9 aa, Homo Sapiens
RPSQVVAET

SEQ ID NO: 128228 - protein, 9 aa, Homo Sapiens
RPSSQYIVA

SEQ ID NO: 128229 - protein, 9 aa, Homo Sapiens
RPSSTFNTV

SEQ ID NO: 128230 - protein, 9 aa, Homo Sapiens
RPVGGGPSA

SEQ ID NO: 128231 - protein, 9 aa, Homo Sapiens
RPVHLDQAA

SEQ ID NO: 128232 - protein, 9 aa, Homo Sapiens
RPVLPRTEA

SEQ ID NO: 128233 - protein, 9 aa, Homo Sapiens
RPVNDMNIA

SEQ ID NO: 128234 - protein, 9 aa, Homo Sapiens
RPVPGYEPG

SEQ ID NO: 128235 - protein, 9 aa, Homo Sapiens
RPVQRLPSV

SEQ ID NO: 128236 - protein, 9 aa, Homo Sapiens
RPVTPPRTA

SEQ ID NO: 128237 - protein, 9 aa, Homo Sapiens
RPWKAYLSA

SEQ ID NO: 128238 - protein, 9 aa, Homo Sapiens
RPWLDPAAA

SEQ ID NO: 128239 - protein, 9 aa, Homo Sapiens
RPWPNPNSA

SEQ ID NO: 128240 - protein, 9 aa, Homo Sapiens
RPWSPAVSA

SEQ ID NO: 128241 - protein, 9 aa, Homo Sapiens
RPYDKNISP

SEQ ID NO: 128242 - protein, 9 aa, Homo Sapiens
RPYEPINSI

SEQ ID NO: 128243 - protein, 9 aa, Homo Sapiens
RPYFPKDEA

SEQ ID NO: 128244 - protein, 9 aa, Homo Sapiens
RPYGCVLRA

SEQ ID NO: 128245 - protein, 9 aa, Homo Sapiens
RPYHTIIEI

SEQ ID NO: 128246 - protein, 9 aa, Homo Sapiens
RPYLQRKDV

SEQ ID NO: 128247 - protein, 9 aa, Homo Sapiens
RPYSHALVA

SEQ ID NO: 128248 - protein, 9 aa, Homo Sapiens
RPYSRKLEA

SEQ ID NO: 128249 - protein, 9 aa, Homo Sapiens
RPYSVPPCV

SEQ ID NO: 128250 - protein, 9 aa, Homo Sapiens
RPYTGKVGA

SEQ ID NO: 128251 - protein, 9 aa, Homo Sapiens
RRPPASPPA

SEQ ID NO: 128252 - protein, 9 aa, Homo Sapiens
RRPPPPPPP

SEQ ID NO: 128253 - protein, 9 aa, Homo Sapiens
RVKCVGLSA

SEQ ID NO: 128254 - protein, 9 aa, Homo Sapiens
RVREIIINA

SEQ ID NO: 128255 - protein, 9 aa, Homo Sapiens
SPAALKPPA

SEQ ID NO: 128256 - protein, 9 aa, Homo Sapiens
SPAAPVITA

SEQ ID NO: 128257 - protein, 9 aa, Homo Sapiens
SPAGGIPST

SEQ ID NO: 128258 - protein, 9 aa, Homo Sapiens
SPAGILVDA

SEQ ID NO: 128259 - protein, 9 aa, Homo Sapiens
SPAHAVDAV

SEQ ID NO: 128260 - protein, 9 aa, Homo Sapiens
SPAHVLLAA

SEQ ID NO: 128261 - protein, 9 aa, Homo Sapiens
SPAKLQAAA

SEQ ID NO: 128262 - protein, 9 aa, Homo Sapiens
SPAKTLPGA

SEQ ID NO: 128263 - protein, 9 aa, Homo Sapiens
SPAPPLLHV

SEQ ID NO: 128264 - protein, 9 aa, Homo Sapiens
SPAQVIPLA

SEQ ID NO: 128265 - protein, 9 aa, Homo Sapiens
SPARGGIGA

SEQ ID NO: 128266 - protein, 9 aa, Homo Sapiens
SPASQLVAT

SEQ ID NO: 128267 - protein, 9 aa, Homo Sapiens
SPAYRDLAA

SEQ ID NO: 128268 - protein, 9 aa, Homo Sapiens
SPCLGPVAA

SEQ ID NO: 128269 - protein, 9 aa, Homo Sapiens
SPDSPVTSA

SEQ ID NO: 128270 - protein, 9 aa, Homo Sapiens
SPEAHTVEA

SEQ ID NO: 128271 - protein, 9 aa, Homo Sapiens
SPEKFQIEA

SEQ ID NO: 128272 - protein, 9 aa, Homo Sapiens
SPEQLCAPA

SEQ ID NO: 128273 - protein, 9 aa, Homo Sapiens
SPESPVLAA

SEQ ID NO: 128274 - protein, 9 aa, Homo Sapiens
SPFAEGTSA

SEQ ID NO: 128275 - protein, 9 aa, Homo Sapiens
SPFENTENA

SEQ ID NO: 128276 - protein, 9 aa, Homo Sapiens
SPFFPLVSA

SEQ ID NO: 128277 - protein, 9 aa, Homo Sapiens
SPFGSITSA

SEQ ID NO: 128278 - protein, 9 aa, Homo Sapiens
SPFGTITSA

SEQ ID NO: 128279 - protein, 9 aa, Homo Sapiens
SPFHFQPSA

SEQ ID NO: 128280 - protein, 9 aa, Homo Sapiens
SPFPDIPKV

SEQ ID NO: 128281 - protein, 9 aa, Homo Sapiens
SPFPPAKSA

SEQ ID NO: 128282 - protein, 9 aa, Homo Sapiens
SPFRVNVGA

SEQ ID NO: 128283 - protein, 9 aa, Homo Sapiens
SPFSGLQKA

SEQ ID NO: 128284 - protein, 9 aa, Homo Sapiens
SPFSSFISV

SEQ ID NO: 128285 - protein, 9 aa, Homo Sapiens
SPFTVGVAA

SEQ ID NO: 128286 - protein, 9 aa, Homo Sapiens
SPGDFSISV

SEQ ID NO: 128287 - protein, 9 aa, Homo Sapiens
SPGLQKEAV

SEQ ID NO: 128288 - protein, 9 aa, Homo Sapiens
SPHFPHTAA

SEQ ID NO: 128289 - protein, 9 aa, Homo Sapiens
SPHKVFYKS

SEQ ID NO: 128290 - protein, 9 aa, Homo Sapiens
SPHLGPAPA

SEQ ID NO: 128291 - protein, 9 aa, Homo Sapiens
SPHNETILA

SEQ ID NO: 128292 - protein, 9 aa, Homo Sapiens
SPHPGLVAA

SEQ ID NO: 128293 - protein, 9 aa, Homo Sapiens
SPHPSPLGA

SEQ ID NO: 128294 - protein, 9 aa, Homo Sapiens
SPHQVTPQA

SEQ ID NO: 128295 - protein, 9 aa, Homo Sapiens
SPHRPILQA

SEQ ID NO: 128296 - protein, 9 aa, Homo Sapiens
SPHSILVNG

SEQ ID NO: 128297 - protein, 9 aa, Homo Sapiens
SPHSQVLTA

SEQ ID NO: 128298 - protein, 9 aa, Homo Sapiens
SPHSVPFLA

SEQ ID NO: 128299 - protein, 9 aa, Homo Sapiens
SPHTKMDVA

SEQ ID NO: 128300 - protein, 9 aa, Homo Sapiens
SPHVAVLEA

SEQ ID NO: 128301 - protein, 9 aa, Homo Sapiens
SPHVQVKAA

SEQ ID NO: 128302 - protein, 9 aa, Homo Sapiens
SPIEFLENA

SEQ ID NO: 128303 - protein, 9 aa, Homo Sapiens
SPIENIQRV

SEQ ID NO: 128304 - protein, 9 aa, Homo Sapiens
SPILVATAV

SEQ ID NO: 128305 - protein, 9 aa, Homo Sapiens
SPKDVILKV

SEQ ID NO: 128306 - protein, 9 aa, Homo Sapiens
SPKGTIENI

SEQ ID NO: 128307 - protein, 9 aa, Homo Sapiens
SPKLPSLEA

SEQ ID NO: 128308 - protein, 9 aa, Homo Sapiens
SPKPVSSTV

SEQ ID NO: 128309 - protein, 9 aa, Homo Sapiens
SPKQILDPA

SEQ ID NO: 128310 - protein, 9 aa, Homo Sapiens
SPKQILDSA

SEQ ID NO: 128311 - protein, 9 aa, Homo Sapiens
SPKSPGLKA

SEQ ID NO: 128312 - protein, 9 aa, Homo Sapiens
SPKTTISVA

SEQ ID NO: 128313 - protein, 9 aa, Homo Sapiens
SPLASGAVA

SEQ ID NO: 128314 - protein, 9 aa, Homo Sapiens
SPLFSQHTA

SEQ ID NO: 128315 - protein, 9 aa, Homo Sapiens
SPLHLAVEA

SEQ ID NO: 128316 - protein, 9 aa, Homo Sapiens
SPLIQKSAA

SEQ ID NO: 128317 - protein, 9 aa, Homo Sapiens
SPLKHFVTA

SEQ ID NO: 128318 - protein, 9 aa, Homo Sapiens
SPLLQAHHA

SEQ ID NO: 128319 - protein, 9 aa, Homo Sapiens
SPLNAMPRA

SEQ ID NO: 128320 - protein, 9 aa, Homo Sapiens
SPLPQYVTV

SEQ ID NO: 128321 - protein, 9 aa, Homo Sapiens
SPLPTPFGA

SEQ ID NO: 128322 - protein, 9 aa, Homo Sapiens
SPLSAARAA

SEQ ID NO: 128323 - protein, 9 aa, Homo Sapiens
SPLSSHPVV

SEQ ID NO: 128324 - protein, 9 aa, Homo Sapiens
SPLWTSIGA

SEQ ID NO: 128325 - protein, 9 aa, Homo Sapiens
SPLYLAHEV

SEQ ID NO: 128326 - protein, 9 aa, Homo Sapiens
SPMATTAAA

SEQ ID NO: 128327 - protein, 9 aa, Homo Sapiens
SPMDTVTEA

SEQ ID NO: 128328 - protein, 9 aa, Homo Sapiens
SPMIPSIVV

SEQ ID NO: 128329 - protein, 9 aa, Homo Sapiens
SPMPGTLTA

SEQ ID NO: 128330 - protein, 9 aa, Homo Sapiens
SPMSQTETV

SEQ ID NO: 128331 - protein, 9 aa, Homo Sapiens
SPNEVKVVA

SEQ ID NO: 128332 - protein, 9 aa, Homo Sapiens
SPNGKLTVA

SEQ ID NO: 128333 - protein, 9 aa, Homo Sapiens
SPNGQFVAP

SEQ ID NO: 128334 - protein, 9 aa, Homo Sapiens
SPNRYWLCA

SEQ ID NO: 128335 - protein, 9 aa, Homo Sapiens
SPNSILKAA

SEQ ID NO: 128336 - protein, 9 aa, Homo Sapiens
SPNSYFMDV

SEQ ID NO: 128337 - protein, 9 aa, Homo Sapiens
SPPKIHVSA

SEQ ID NO: 128338 - protein, 9 aa, Homo Sapiens
SPPVPGPSA

SEQ ID NO: 128339 - protein, 9 aa, Homo Sapiens
SPQDVTTHA

SEQ ID NO: 128340 - protein, 9 aa, Homo Sapiens
SPQGQVLSA

SEQ ID NO: 128341 - protein, 9 aa, Homo Sapiens
SPRDGWHCA

SEQ ID NO: 128342 - protein, 9 aa, Homo Sapiens
SPREELHYA

SEQ ID NO: 128343 - protein, 9 aa, Homo Sapiens
SPREPGYKA

SEQ ID NO: 128344 - protein, 9 aa, Homo Sapiens
SPREPVLPP

SEQ ID NO: 128345 - protein, 9 aa, Homo Sapiens
SPREVFFRV

SEQ ID NO: 128346 - protein, 9 aa, Homo Sapiens
SPRIATTTA

SEQ ID NO: 128347 - protein, 9 aa, Homo Sapiens
SPRLLGAAA

SEQ ID NO: 128348 - protein, 9 aa, Homo Sapiens
SPRNLAMEA

SEQ ID NO: 128349 - protein, 9 aa, Homo Sapiens
SPRPPLISV

SEQ ID NO: 128350 - protein, 9 aa, Homo Sapiens
SPRPVVVET

SEQ ID NO: 128351 - protein, 9 aa, Homo Sapiens
SPRVPNSSV

SEQ ID NO: 128352 - protein, 9 aa, Homo Sapiens
SPSAGVPRA

SEQ ID NO: 128353 - protein, 9 aa, Homo Sapiens
SPSDIGIIA

SEQ ID NO: 128354 - protein, 9 aa, Homo Sapiens
SPSPPQAEA

SEQ ID NO: 128355 - protein, 9 aa, Homo Sapiens
SPSPPSVAV

SEQ ID NO: 128356 - protein, 9 aa, Homo Sapiens
SPSSSSLAA

SEQ ID NO: 128357 - protein, 9 aa, Homo Sapiens
SPSTVFFGA

SEQ ID NO: 128358 - protein, 9 aa, Homo Sapiens
SPSTVIHGA

SEQ ID NO: 128359 - protein, 9 aa, Homo Sapiens
SPSVPKTSA

SEQ ID NO: 128360 - protein, 9 aa, Homo Sapiens
SPTGGFVDA

SEQ ID NO: 128361 - protein, 9 aa, Homo Sapiens
SPTGRCWAA

SEQ ID NO: 128362 - protein, 9 aa, Homo Sapiens
SPTHSAIPA

SEQ ID NO: 128363 - protein, 9 aa, Homo Sapiens
SPTKKVAVA

SEQ ID NO: 128364 - protein, 9 aa, Homo Sapiens
SPTKNNIAV

SEQ ID NO: 128365 - protein, 9 aa, Homo Sapiens
SPTLLLAEA

SEQ ID NO: 128366 - protein, 9 aa, Homo Sapiens
SPTNKISTA

SEQ ID NO: 128367 - protein, 9 aa, Homo Sapiens
SPTRPPVAA

SEQ ID NO: 128368 - protein, 9 aa, Homo Sapiens
SPTSVRQMA

SEQ ID NO: 128369 - protein, 9 aa, Homo Sapiens
SPTTSHVGA

SEQ ID NO: 128370 - protein, 9 aa, Homo Sapiens
SPTYQYVTV

SEQ ID NO: 128371 - protein, 9 aa, Homo Sapiens
SPVAQPVTV

SEQ ID NO: 128372 - protein, 9 aa, Homo Sapiens
SPVENVTAA

SEQ ID NO: 128373 - protein, 9 aa, Homo Sapiens
SPVGNRVTV

SEQ ID NO: 128374 - protein, 9 aa, Homo Sapiens
SPVLPLTSA

SEQ ID NO: 128375 - protein, 9 aa, Homo Sapiens
SPVMVSNPA

SEQ ID NO: 128376 - protein, 9 aa, Homo Sapiens
SPVPIAPTA

SEQ ID NO: 128377 - protein, 9 aa, Homo Sapiens
SPVQHLVAA

SEQ ID NO: 128378 - protein, 9 aa, Homo Sapiens
SPVRGCYEA

SEQ ID NO: 128379 - protein, 9 aa, Homo Sapiens
SPVSSLPTA

SEQ ID NO: 128380 - protein, 9 aa, Homo Sapiens
SPVTDFREA

SEQ ID NO: 128381 - protein, 9 aa, Homo Sapiens
SPVTVEWKA

SEQ ID NO: 128382 - protein, 9 aa, Homo Sapiens
SPVVPQISA

SEQ ID NO: 128383 - protein, 9 aa, Homo Sapiens
SPYAAMLAA

SEQ ID NO: 128384 - protein, 9 aa, Homo Sapiens
SPYHGFTIV

SEQ ID NO: 128385 - protein, 9 aa, Homo Sapiens
SPYHNFDSV

SEQ ID NO: 128386 - protein, 9 aa, Homo Sapiens
SPYIPPHAA

SEQ ID NO: 128387 - protein, 9 aa, Homo Sapiens
SPYVHLLDA

SEQ ID NO: 128388 - protein, 9 aa, Homo Sapiens
SPYYFLTSA

SEQ ID NO: 128389 - protein, 9 aa, Homo Sapiens
SVPSNPVAA

SEQ ID NO: 128390 - protein, 9 aa, Homo Sapiens
SVTLQAIAA

SEQ ID NO: 128391 - protein, 9 aa, Homo Sapiens
TPAHVLPSA

SEQ ID NO: 128392 - protein, 9 aa, Homo Sapiens
TPAKAIAAV

SEQ ID NO: 128393 - protein, 9 aa, Homo Sapiens
TPFHHRVSV

SEQ ID NO: 128394 - protein, 9 aa, Homo Sapiens
TPFKGVRKA

SEQ ID NO: 128395 - protein, 9 aa, Homo Sapiens
TPFKLTTEA

SEQ ID NO: 128396 - protein, 9 aa, Homo Sapiens
TPFKPILEA

SEQ ID NO: 128397 - protein, 9 aa, Homo Sapiens
TPFYFKEPS

SEQ ID NO: 128398 - protein, 9 aa, Homo Sapiens
TPHAIVILP

SEQ ID NO: 128399 - protein, 9 aa, Homo Sapiens
TPHFSGLAA

SEQ ID NO: 128400 - protein, 9 aa, Homo Sapiens
TPHLRNLAV

SEQ ID NO: 128401 - protein, 9 aa, Homo Sapiens
TPHYIYPPA

SEQ ID NO: 128402 - protein, 9 aa, Homo Sapiens
TPIGVQAEA

SEQ ID NO: 128403 - protein, 9 aa, Homo Sapiens
TPIRGLLMA

SEQ ID NO: 128404 - protein, 9 aa, Homo Sapiens
TPKMPGQSV

SEQ ID NO: 128405 - protein, 9 aa, Homo Sapiens
TPKPVEPAA

SEQ ID NO: 128406 - protein, 9 aa, Homo Sapiens
TPKPVSIAT

SEQ ID NO: 128407 - protein, 9 aa, Homo Sapiens
TPLGGIQAA

SEQ ID NO: 128408 - protein, 9 aa, Homo Sapiens
TPLLSGKAA

SEQ ID NO: 128409 - protein, 9 aa, Homo Sapiens
TPLPAIVPA

SEQ ID NO: 128410 - protein, 9 aa, Homo Sapiens
TPLPGGHAA

SEQ ID NO: 128411 - protein, 9 aa, Homo Sapiens
TPLYTDNTA

SEQ ID NO: 128412 - protein, 9 aa, Homo Sapiens
TPMAASVVA

SEQ ID NO: 128413 - protein, 9 aa, Homo Sapiens
TPMGPGRTV

SEQ ID NO: 128414 - protein, 9 aa, Homo Sapiens
TPMPPISSV

SEQ ID NO: 128415 - protein, 9 aa, Homo Sapiens
TPNKPSVAV

SEQ ID NO: 128416 - protein, 9 aa, Homo Sapiens
TPNQNFSTA

SEQ ID NO: 128417 - protein, 9 aa, Homo Sapiens
TPNRATFVV

SEQ ID NO: 128418 - protein, 9 aa, Homo Sapiens
TPQEDYVEA

SEQ ID NO: 128419 - protein, 9 aa, Homo Sapiens
TPQPPLLKA

SEQ ID NO: 128420 - protein, 9 aa, Homo Sapiens
TPQSIFIFA

SEQ ID NO: 128421 - protein, 9 aa, Homo Sapiens
TPRAATVKA

SEQ ID NO: 128422 - protein, 9 aa, Homo Sapiens
TPRPVIVEP

SEQ ID NO: 128423 - protein, 9 aa, Homo Sapiens
TPSAGAVAA

SEQ ID NO: 128424 - protein, 9 aa, Homo Sapiens
TPSIPVLTA

SEQ ID NO: 128425 - protein, 9 aa, Homo Sapiens
TPTEFFFHA

SEQ ID NO: 128426 - protein, 9 aa, Homo Sapiens
TPTFTYKAA

SEQ ID NO: 128427 - protein, 9 aa, Homo Sapiens
TPTPPFQQA

SEQ ID NO: 128428 - protein, 9 aa, Homo Sapiens
TPVEEVPAA

SEQ ID NO: 128429 - protein, 9 aa, Homo Sapiens
TPVGGLLMA

SEQ ID NO: 128430 - protein, 9 aa, Homo Sapiens
TPVNSICSV

SEQ ID NO: 128431 - protein, 9 aa, Homo Sapiens
TPVYLGATA

SEQ ID NO: 128432 - protein, 9 aa, Homo Sapiens
TPWFKIIAA

SEQ ID NO: 128433 - protein, 9 aa, Homo Sapiens
TPYNYPVPV

SEQ ID NO: 128434 - protein, 9 aa, Homo Sapiens
TPYRPPAAA

SEQ ID NO: 128435 - protein, 9 aa, Homo Sapiens
TPYTGILYA

SEQ ID NO: 128436 - protein, 9 aa, Homo Sapiens
TPYVAKISA

SEQ ID NO: 128437 - protein, 9 aa, Homo Sapiens
TVARSPVAP

SEQ ID NO: 128438 - protein, 9 aa, Homo Sapiens
TVYEGFISA

SEQ ID NO: 128439 - protein, 9 aa, Homo Sapiens
VAVLQEVAA

SEQ ID NO: 128440 - protein, 9 aa, Homo Sapiens
VIRNIVEAA

SEQ ID NO: 128441 - protein, 9 aa, Homo Sapiens
VPAEGAPTA

SEQ ID NO: 128442 - protein, 9 aa, Homo Sapiens
VPAEPSPKA

SEQ ID NO: 128443 - protein, 9 aa, Homo Sapiens
VPAGGAVAV

SEQ ID NO: 128444 - protein, 9 aa, Homo Sapiens
VPAGSGLSA

SEQ ID NO: 128445 - protein, 9 aa, Homo Sapiens
VPAKKITAA

SEQ ID NO: 128446 - protein, 9 aa, Homo Sapiens
VPAKWIHEA

SEQ ID NO: 128447 - protein, 9 aa, Homo Sapiens
VPANPYHTA

SEQ ID NO: 128448 - protein, 9 aa, Homo Sapiens
VPAPAHLVA

SEQ ID NO: 128449 - protein, 9 aa, Homo Sapiens
VPAPAPAAA

SEQ ID NO: 128450 - protein, 9 aa, Homo Sapiens
VPAPFFLPA

SEQ ID NO: 128451 - protein, 9 aa, Homo Sapiens
VPAPGGPAA

SEQ ID NO: 128452 - protein, 9 aa, Homo Sapiens
VPAPSPLSA

SEQ ID NO: 128453 - protein, 9 aa, Homo Sapiens
VPAPSVPSV

SEQ ID NO: 128454 - protein, 9 aa, Homo Sapiens
VPATPRLPA

SEQ ID NO: 128455 - protein, 9 aa, Homo Sapiens
VPCQVLRMA

SEQ ID NO: 128456 - protein, 9 aa, Homo Sapiens
VPFAAPATA

SEQ ID NO: 128457 - protein, 9 aa, Homo Sapiens
VPFIVPLSV

SEQ ID NO: 128458 - protein, 9 aa, Homo Sapiens
VPFKDMPAT

SEQ ID NO: 128459 - protein, 9 aa, Homo Sapiens
VPFLNPYTV

SEQ ID NO: 128460 - protein, 9 aa, Homo Sapiens
VPFPTPLEA

SEQ ID NO: 128461 - protein, 9 aa, Homo Sapiens
VPHAITVSV

SEQ ID NO: 128462 - protein, 9 aa, Homo Sapiens
VPHCVPISA

SEQ ID NO: 128463 - protein, 9 aa, Homo Sapiens
VPHNVQVAA

SEQ ID NO: 128464 - protein, 9 aa, Homo Sapiens
VPHQPFSQA

SEQ ID NO: 128465 - protein, 9 aa, Homo Sapiens
VPHRATVYA

SEQ ID NO: 128466 - protein, 9 aa, Homo Sapiens
VPHRSYVST

SEQ ID NO: 128467 - protein, 9 aa, Homo Sapiens
VPIKPLPNV

SEQ ID NO: 128468 - protein, 9 aa, Homo Sapiens
VPIMPYPPA

SEQ ID NO: 128469 - protein, 9 aa, Homo Sapiens
VPIPKSHEA

SEQ ID NO: 128470 - protein, 9 aa, Homo Sapiens
VPIRLIINA

SEQ ID NO: 128471 - protein, 9 aa, Homo Sapiens
VPITAVIAA

SEQ ID NO: 128472 - protein, 9 aa, Homo Sapiens
VPKAQKETV

SEQ ID NO: 128473 - protein, 9 aa, Homo Sapiens
VPKPLFPVA

SEQ ID NO: 128474 - protein, 9 aa, Homo Sapiens
VPLAIVNKA

SEQ ID NO: 128475 - protein, 9 aa, Homo Sapiens
VPLFVQHDA

SEQ ID NO: 128476 - protein, 9 aa, Homo Sapiens
VPLGALNPA

SEQ ID NO: 128477 - protein, 9 aa, Homo Sapiens
VPLSHLINA

SEQ ID NO: 128478 - protein, 9 aa, Homo Sapiens
VPMKCLQQA

SEQ ID NO: 128479 - protein, 9 aa, Homo Sapiens
VPMSALKSV

SEQ ID NO: 128480 - protein, 9 aa, Homo Sapiens
VPMTPLRTV

SEQ ID NO: 128481 - protein, 9 aa, Homo Sapiens
VPNKFLVTA

SEQ ID NO: 128482 - protein, 9 aa, Homo Sapiens
VPNKIINRA

SEQ ID NO: 128483 - protein, 9 aa, Homo Sapiens
VPNLQTVSV

SEQ ID NO: 128484 - protein, 9 aa, Homo Sapiens
VPNPYIISA

SEQ ID NO: 128485 - protein, 9 aa, Homo Sapiens
VPNRHFAAA

SEQ ID NO: 128486 - protein, 9 aa, Homo Sapiens
VPNTQPKAA

SEQ ID NO: 128487 - protein, 9 aa, Homo Sapiens
VPQSVTECV

SEQ ID NO: 128488 - protein, 9 aa, Homo Sapiens
VPQTPLHTA

SEQ ID NO: 128489 - protein, 9 aa, Homo Sapiens
VPRLPATAA

SEQ ID NO: 128490 - protein, 9 aa, Homo Sapiens
VPRPASVSA

SEQ ID NO: 128491 - protein, 9 aa, Homo Sapiens
VPRQPTVTS

SEQ ID NO: 128492 - protein, 9 aa, Homo Sapiens
VPSAHQPSA

SEQ ID NO: 128493 - protein, 9 aa, Homo Sapiens
VPSAVLIVA

SEQ ID NO: 128494 - protein, 9 aa, Homo Sapiens
VPSLFSKSA

SEQ ID NO: 128495 - protein, 9 aa, Homo Sapiens
VPSLQGEKA

SEQ ID NO: 128496 - protein, 9 aa, Homo Sapiens
VPSPVAISA

SEQ ID NO: 128497 - protein, 9 aa, Homo Sapiens
VPSSPPTKR

SEQ ID NO: 128498 - protein, 9 aa, Homo Sapiens
VPSYPSKSA

SEQ ID NO: 128499 - protein, 9 aa, Homo Sapiens
VPTDYSVSA

SEQ ID NO: 128500 - protein, 9 aa, Homo Sapiens
VPTEPLPAP

SEQ ID NO: 128501 - protein, 9 aa, Homo Sapiens
VPTPAPISA

SEQ ID NO: 128502 - protein, 9 aa, Homo Sapiens
VPTPIHPIF

SEQ ID NO: 128503 - protein, 9 aa, Homo Sapiens
VPVAGNPAV

SEQ ID NO: 128504 - protein, 9 aa, Homo Sapiens
VPVDTGVAA

SEQ ID NO: 128505 - protein, 9 aa, Homo Sapiens
VPVEPVLTV

SEQ ID NO: 128506 - protein, 9 aa, Homo Sapiens
VPVSTINHA

SEQ ID NO: 128507 - protein, 9 aa, Homo Sapiens
VPWGGAAAV

SEQ ID NO: 128508 - protein, 9 aa, Homo Sapiens
VPYGEFKSV

SEQ ID NO: 128509 - protein, 9 aa, Homo Sapiens
VPYGTPLSV

SEQ ID NO: 128510 - protein, 9 aa, Homo Sapiens
VPYGVGKAA

SEQ ID NO: 128511 - protein, 9 aa, Homo Sapiens
VPYLVGQVV

SEQ ID NO: 128512 - protein, 9 aa, Homo Sapiens
VPYPPLLRA

SEQ ID NO: 128513 - protein, 9 aa, Homo Sapiens
VTIKKDVDG

SEQ ID NO: 128514 - protein, 9 aa, Homo Sapiens
VVAPSIIAA

SEQ ID NO: 128515 - protein, 9 aa, Homo Sapiens
VVRPAHISA

SEQ ID NO: 128516 - protein, 9 aa, Homo Sapiens
YPAPQVSTA

SEQ ID NO: 128517 - protein, 9 aa, Homo Sapiens
YPCSKFIIA

SEQ ID NO: 128518 - protein, 9 aa, Homo Sapiens
YPFANKESI

SEQ ID NO: 128519 - protein, 9 aa, Homo Sapiens
YPFKNLPTA

SEQ ID NO: 128520 - protein, 9 aa, Homo Sapiens
YPFPGRLLP

SEQ ID NO: 128521 - protein, 9 aa, Homo Sapiens
YPFPLSHSV

SEQ ID NO: 128522 - protein, 9 aa, Homo Sapiens
YPGFNPFRA

SEQ ID NO: 128523 - protein, 9 aa, Homo Sapiens
YPHGWVETA

SEQ ID NO: 128524 - protein, 9 aa, Homo Sapiens
YPHQVPLVL

SEQ ID NO: 128525 - protein, 9 aa, Homo Sapiens
YPKNPHLRA

SEQ ID NO: 128526 - protein, 9 aa, Homo Sapiens
YPLDHARAA

SEQ ID NO: 128527 - protein, 9 aa, Homo Sapiens
YPLDLLLKL

SEQ ID NO: 128528 - protein, 9 aa, Homo Sapiens
YPLEKVAEA

SEQ ID NO: 128529 - protein, 9 aa, Homo Sapiens
YPLLLKELA

SEQ ID NO: 128530 - protein, 9 aa, Homo Sapiens
YPNFAGPHA

SEQ ID NO: 128531 - protein, 9 aa, Homo Sapiens
YPNFSLPAA

SEQ ID NO: 128532 - protein, 9 aa, Homo Sapiens
YPNYPNPAV

SEQ ID NO: 128533 - protein, 9 aa, Homo Sapiens
YPQELIVPA

SEQ ID NO: 128534 - protein, 9 aa, Homo Sapiens
YPRPGTPAA

SEQ ID NO: 128535 - protein, 9 aa, Homo Sapiens
YPSAPFLAA

SEQ ID NO: 128536 - protein, 9 aa, Homo Sapiens
YPSEHLIQA

SEQ ID NO: 128537 - protein, 9 aa, Homo Sapiens
YPTHVKVTA

SEQ ID NO: 128538 - protein, 9 aa, Homo Sapiens
YPTRPHIAA

SEQ ID NO: 128539 - protein, 9 aa, Homo Sapiens
YPVESSKSA

SEQ ID NO: 128540 - protein, 9 aa, Homo Sapiens
YPVHLAVRA

SEQ ID NO: 128541 - protein, 9 aa, Homo Sapiens
YSFYLPIAA

SEQ ID NO: 128542 - protein, 10 aa, Homo Sapiens
AAAAAAKVPA

SEQ ID NO: 128543 - protein, 10 aa, Homo Sapiens
AAAAPAAPAA

SEQ ID NO: 128544 - protein, 10 aa, Homo Sapiens
AAGGPQRIPA

SEQ ID NO: 128545 - protein, 10 aa, Homo Sapiens
AAGPPISEGK

SEQ ID NO: 128546 - protein, 10 aa, Homo Sapiens
AAPAPAAHVA

SEQ ID NO: 128547 - protein, 10 aa, Homo Sapiens
AAPREPAIHS

SEQ ID NO: 128548 - protein, 10 aa, Homo Sapiens
AGPARLSPAA

SEQ ID NO: 128549 - protein, 10 aa, Homo Sapiens
APAAATVAVA

SEQ ID NO: 128550 - protein, 10 aa, Homo Sapiens
APAAAVVRAA

SEQ ID NO: 128551 - protein, 10 aa, Homo Sapiens
APAAPLQVHA

SEQ ID NO: 128552 - protein, 10 aa, Homo Sapiens
APAERRQRAA

SEQ ID NO: 128553 - protein, 10 aa, Homo Sapiens
APAGGFQNIA

SEQ ID NO: 128554 - protein, 10 aa, Homo Sapiens
APAKFQPASA

SEQ ID NO: 128555 - protein, 10 aa, Homo Sapiens
APALLLIPAA

SEQ ID NO: 128556 - protein, 10 aa, Homo Sapiens
APAPAAHVAG

SEQ ID NO: 128557 - protein, 10 aa, Homo Sapiens
APAPAEKTPV

SEQ ID NO: 128558 - protein, 10 aa, Homo Sapiens
APAPSLFPAA

SEQ ID NO: 128559 - protein, 10 aa, Homo Sapiens
APASVVPAPA

SEQ ID NO: 128560 - protein, 10 aa, Homo Sapiens
APAVLLGGVA

SEQ ID NO: 128561 - protein, 10 aa, Homo Sapiens
APFAAHGYGA

SEQ ID NO: 128562 - protein, 10 aa, Homo Sapiens
APFDSRFPNQ

SEQ ID NO: 128563 - protein, 10 aa, Homo Sapiens
APFQNILPRV

SEQ ID NO: 128564 - protein, 10 aa, Homo Sapiens
APFQTSQASA

SEQ ID NO: 128565 - protein, 10 aa, Homo Sapiens
APFVPVGIAG

SEQ ID NO: 128566 - protein, 10 aa, Homo Sapiens
APGPAPPVSA

SEQ ID NO: 128567 - protein, 10 aa, Homo Sapiens
APGPGLLLAA

SEQ ID NO: 128568 - protein, 10 aa, Homo Sapiens
APHALLQAVL

SEQ ID NO: 128569 - protein, 10 aa, Homo Sapiens
APHDFANIKA

SEQ ID NO: 128570 - protein, 10 aa, Homo Sapiens
APHEILIQIV

SEQ ID NO: 128571 - protein, 10 aa, Homo Sapiens
APHIIVGTPG

SEQ ID NO: 128572 - protein, 10 aa, Homo Sapiens
APHIVVGTPG

SEQ ID NO: 128573 - protein, 10 aa, Homo Sapiens
APHTWPHIVA

SEQ ID NO: 128574 - protein, 10 aa, Homo Sapiens
APIAPLKITV

SEQ ID NO: 128575 - protein, 10 aa, Homo Sapiens
APIGGIDHKP

SEQ ID NO: 128576 - protein, 10 aa, Homo Sapiens
APIYPGFPKV

SEQ ID NO: 128577 - protein, 10 aa, Homo Sapiens
APKGSVLQEA

SEQ ID NO: 128578 - protein, 10 aa, Homo Sapiens
APKSIEVYSA

SEQ ID NO: 128579 - protein, 10 aa, Homo Sapiens
APLDGCILVV

SEQ ID NO: 128580 - protein, 10 aa, Homo Sapiens
APLNLGMIAA

SEQ ID NO: 128581 - protein, 10 aa, Homo Sapiens
APLPGLPPSA

SEQ ID NO: 128582 - protein, 10 aa, Homo Sapiens
APMAGLMEKA

SEQ ID NO: 128583 - protein, 10 aa, Homo Sapiens
APMLSTVHSA

SEQ ID NO: 128584 - protein, 10 aa, Homo Sapiens
APQETRGIPS

SEQ ID NO: 128585 - protein, 10 aa, Homo Sapiens
APQLRPAGTA

SEQ ID NO: 128586 - protein, 10 aa, Homo Sapiens
APQPAAPVGA

SEQ ID NO: 128587 - protein, 10 aa, Homo Sapiens
APREPVGWPA

SEQ ID NO: 128588 - protein, 10 aa, Homo Sapiens
APRGTGIVSA

SEQ ID NO: 128589 - protein, 10 aa, Homo Sapiens
APRSFHPPAA

SEQ ID NO: 128590 - protein, 10 aa, Homo Sapiens
APRSLPAAMA

SEQ ID NO: 128591 - protein, 10 aa, Homo Sapiens
APRTPEVRAA

SEQ ID NO: 128592 - protein, 10 aa, Homo Sapiens
APSAKGTISA

SEQ ID NO: 128593 - protein, 10 aa, Homo Sapiens
APSEARTTPA

SEQ ID NO: 128594 - protein, 10 aa, Homo Sapiens
APSGGRLLSA

SEQ ID NO: 128595 - protein, 10 aa, Homo Sapiens
APSKATLIEA

SEQ ID NO: 128596 - protein, 10 aa, Homo Sapiens
APSKTLVETA

SEQ ID NO: 128597 - protein, 10 aa, Homo Sapiens
APSMESRPPA

SEQ ID NO: 128598 - protein, 10 aa, Homo Sapiens
APSPSHPISA

SEQ ID NO: 128599 - protein, 10 aa, Homo Sapiens
APSPVQQHQA

SEQ ID NO: 128600 - protein, 10 aa, Homo Sapiens
APSWKCLPAA

SEQ ID NO: 128601 - protein, 10 aa, Homo Sapiens
APTEYASICV

SEQ ID NO: 128602 - protein, 10 aa, Homo Sapiens
APTKALVNQV

SEQ ID NO: 128603 - protein, 10 aa, Homo Sapiens
APVAAHTVTA

SEQ ID NO: 128604 - protein, 10 aa, Homo Sapiens
APVAVEPGAA

SEQ ID NO: 128605 - protein, 10 aa, Homo Sapiens
APVAVWAALA

SEQ ID NO: 128606 - protein, 10 aa, Homo Sapiens
APVGPRAAMS

SEQ ID NO: 128607 - protein, 10 aa, Homo Sapiens
APVGSRPHTV

SEQ ID NO: 128608 - protein, 10 aa, Homo Sapiens
APVHEIHESA

SEQ ID NO: 128609 - protein, 10 aa, Homo Sapiens
APVHPPNRSA

SEQ ID NO: 128610 - protein, 10 aa, Homo Sapiens
APVVLVGDHA

SEQ ID NO: 128611 - protein, 10 aa, Homo Sapiens
APYDAIHVGA

SEQ ID NO: 128612 - protein, 10 aa, Homo Sapiens
APYGNPKNMA

SEQ ID NO: 128613 - protein, 10 aa, Homo Sapiens
ATNKERLFAA

SEQ ID NO: 128614 - protein, 10 aa, Homo Sapiens
AVDSRTGKLT

SEQ ID NO: 128615 - protein, 10 aa, Homo Sapiens
AVKKNPGIAA

SEQ ID NO: 128616 - protein, 10 aa, Homo Sapiens
EAGPSIVHRK

SEQ ID NO: 128617 - protein, 10 aa, Homo Sapiens
EEQLQQIRAE

SEQ ID NO: 128618 - protein, 10 aa, Homo Sapiens
EIKKPPVSER

SEQ ID NO: 128619 - protein, 10 aa, Homo Sapiens
FGPGKPPPPP

SEQ ID NO: 128620 - protein, 10 aa, Homo Sapiens
FPANVMDVIA

SEQ ID NO: 128621 - protein, 10 aa, Homo Sapiens
FPIKWTAPEA

SEQ ID NO: 128622 - protein, 10 aa, Homo Sapiens
FPKPYPNSEA

SEQ ID NO: 128623 - protein, 10 aa, Homo Sapiens
FPMEIRQYLA

SEQ ID NO: 128624 - protein, 10 aa, Homo Sapiens
FPPTFAIPQA

SEQ ID NO: 128625 - protein, 10 aa, Homo Sapiens
GAGGGFGSRS

SEQ ID NO: 128626 - protein, 10 aa, Homo Sapiens
GGGLSVSSSR

SEQ ID NO: 128627 - protein, 10 aa, Homo Sapiens
GPFPGKFNEV

SEQ ID NO: 128628 - protein, 10 aa, Homo Sapiens
GPMPFLGRAA

SEQ ID NO: 128629 - protein, 10 aa, Homo Sapiens
GPSIVHRKCF

SEQ ID NO: 128630 - protein, 10 aa, Homo Sapiens
GPVGGVFNLA

SEQ ID NO: 128631 - protein, 10 aa, Homo Sapiens
GPWVGTGLAA

SEQ ID NO: 128632 - protein, 10 aa, Homo Sapiens
GPYGGAQPSA

SEQ ID NO: 128633 - protein, 10 aa, Homo Sapiens
HPAAFPLPVV

SEQ ID NO: 128634 - protein, 10 aa, Homo Sapiens
HPDPERRPSA

SEQ ID NO: 128635 - protein, 10 aa, Homo Sapiens
HPEPASGLAA

SEQ ID NO: 128636 - protein, 10 aa, Homo Sapiens
HPFKGFLLEA

SEQ ID NO: 128637 - protein, 10 aa, Homo Sapiens
HPFPGPGLAI

SEQ ID NO: 128638 - protein, 10 aa, Homo Sapiens
HPIEPVLITA

SEQ ID NO: 128639 - protein, 10 aa, Homo Sapiens
HPIHIIPASA

SEQ ID NO: 128640 - protein, 10 aa, Homo Sapiens
HPIRPKPPSA

SEQ ID NO: 128641 - protein, 10 aa, Homo Sapiens
HPKPEGLAAA

SEQ ID NO: 128642 - protein, 10 aa, Homo Sapiens
HPLLRPPPSA

SEQ ID NO: 128643 - protein, 10 aa, Homo Sapiens
HPNPPVVHSA

SEQ ID NO: 128644 - protein, 10 aa, Homo Sapiens
HPNQPLTITA

SEQ ID NO: 128645 - protein, 10 aa, Homo Sapiens
HPNVTLTISA

SEQ ID NO: 128646 - protein, 10 aa, Homo Sapiens
HPQPGSANSL

SEQ ID NO: 128647 - protein, 10 aa, Homo Sapiens
HPREPLPPIQ

SEQ ID NO: 128648 - protein, 10 aa, Homo Sapiens
HPSKALIASA

SEQ ID NO: 128649 - protein, 10 aa, Homo Sapiens
HPSPLSFFSA

SEQ ID NO: 128650 - protein, 10 aa, Homo Sapiens
HPSPVVLKVY

SEQ ID NO: 128651 - protein, 10 aa, Homo Sapiens
HPSQELLASA

SEQ ID NO: 128652 - protein, 10 aa, Homo Sapiens
HPTDASMIEA

SEQ ID NO: 128653 - protein, 10 aa, Homo Sapiens
HPTEDLVVSA

SEQ ID NO: 128654 - protein, 10 aa, Homo Sapiens
HPTENIIASA

SEQ ID NO: 128655 - protein, 10 aa, Homo Sapiens
HPWETVTTAA

SEQ ID NO: 128656 - protein, 10 aa, Homo Sapiens
HPYLFPVAAM

SEQ ID NO: 128657 - protein, 10 aa, Homo Sapiens
HPYRLILTVA

SEQ ID NO: 128658 - protein, 10 aa, Homo Sapiens
IAAQGFTVAA

SEQ ID NO: 128659 - protein, 10 aa, Homo Sapiens
IAKGWQDVTA

SEQ ID NO: 128660 - protein, 10 aa, Homo Sapiens
IPAAAIGEKA

SEQ ID NO: 128661 - protein, 10 aa, Homo Sapiens
IPADLRIISA

SEQ ID NO: 128662 - protein, 10 aa, Homo Sapiens
IPAHDSPLAA

SEQ ID NO: 128663 - protein, 10 aa, Homo Sapiens
IPCELRVTSA

SEQ ID NO: 128664 - protein, 10 aa, Homo Sapiens
IPDGRVSVSA

SEQ ID NO: 128665 - protein, 10 aa, Homo Sapiens
IPFLVPGIRY

SEQ ID NO: 128666 - protein, 10 aa, Homo Sapiens
IPHPLIMGVI

SEQ ID NO: 128667 - protein, 10 aa, Homo Sapiens
IPHQAPGEMT

SEQ ID NO: 128668 - protein, 10 aa, Homo Sapiens
IPHSLPGAVA

SEQ ID NO: 128669 - protein, 10 aa, Homo Sapiens
IPKDYKTMAA

SEQ ID NO: 128670 - protein, 10 aa, Homo Sapiens
IPKEDGVITA

SEQ ID NO: 128671 - protein, 10 aa, Homo Sapiens
IPKHINPVAA

SEQ ID NO: 128672 - protein, 10 aa, Homo Sapiens
IPLEKADHPA

SEQ ID NO: 128673 - protein, 10 aa, Homo Sapiens
IPLYLKGGVA

SEQ ID NO: 128674 - protein, 10 aa, Homo Sapiens
IPMKIRNVSA

SEQ ID NO: 128675 - protein, 10 aa, Homo Sapiens
IPMKPYYTKV

SEQ ID NO: 128676 - protein, 10 aa, Homo Sapiens
IPQATHSVSA

SEQ ID NO: 128677 - protein, 10 aa, Homo Sapiens
IPQLVSNISA

SEQ ID NO: 128678 - protein, 10 aa, Homo Sapiens
IPRGIPLDAA

SEQ ID NO: 128679 - protein, 10 aa, Homo Sapiens
IPRHPMPFAA

SEQ ID NO: 128680 - protein, 10 aa, Homo Sapiens
IPRPVDGVEV

SEQ ID NO: 128681 - protein, 10 aa, Homo Sapiens
IPVECSQRSA

SEQ ID NO: 128682 - protein, 10 aa, Homo Sapiens
IPVETIETTV

SEQ ID NO: 128683 - protein, 10 aa, Homo Sapiens
IPVHLPNIQA

SEQ ID NO: 128684 - protein, 10 aa, Homo Sapiens
IPVLVPGIIF

SEQ ID NO: 128685 - protein, 10 aa, Homo Sapiens
IPVTEIAIAA

SEQ ID NO: 128686 - protein, 10 aa, Homo Sapiens
IPYDQSPGPK

SEQ ID NO: 128687 - protein, 10 aa, Homo Sapiens
IPYQDYFYTA

SEQ ID NO: 128688 - protein, 10 aa, Homo Sapiens
IPYTGPFNLL

SEQ ID NO: 128689 - protein, 10 aa, Homo Sapiens
IRLENEIQTY

SEQ ID NO: 128690 - protein, 10 aa, Homo Sapiens
IVCDVPSASA

SEQ ID NO: 128691 - protein, 10 aa, Homo Sapiens
IVSGSLNHAA

SEQ ID NO: 128692 - protein, 10 aa, Homo Sapiens
KPAGPLGATA

SEQ ID NO: 128693 - protein, 10 aa, Homo Sapiens
KPAPPFNVTV

SEQ ID NO: 128694 - protein, 10 aa, Homo Sapiens
KPAPPQTEQV

SEQ ID NO: 128695 - protein, 10 aa, Homo Sapiens
KPATLTTTSA

SEQ ID NO: 128696 - protein, 10 aa, Homo Sapiens
KPFVEKPVSA

SEQ ID NO: 128697 - protein, 10 aa, Homo Sapiens
KPKPAGVLGA

SEQ ID NO: 128698 - protein, 10 aa, Homo Sapiens
KPLQPLPNTA

SEQ ID NO: 128699 - protein, 10 aa, Homo Sapiens
KPLRPLGKAA

SEQ ID NO: 128700 - protein, 10 aa, Homo Sapiens
KPMEIARIVA

SEQ ID NO: 128701 - protein, 10 aa, Homo Sapiens
KPMKSVLVVA

SEQ ID NO: 128702 - protein, 10 aa, Homo Sapiens
KPNPNQIISV

SEQ ID NO: 128703 - protein, 10 aa, Homo Sapiens
KPNTTVQVPA

SEQ ID NO: 128704 - protein, 10 aa, Homo Sapiens
KPQPNIIPTV

SEQ ID NO: 128705 - protein, 10 aa, Homo Sapiens
KPQSINTVSA

SEQ ID NO: 128706 - protein, 10 aa, Homo Sapiens
KPSPFTPVSA

SEQ ID NO: 128707 - protein, 10 aa, Homo Sapiens
KPTETLLNTV

SEQ ID NO: 128708 - protein, 10 aa, Homo Sapiens
KPYTLMSMVA

SEQ ID NO: 128709 - protein, 10 aa, Homo Sapiens
KPYTVVDVSA

SEQ ID NO: 128710 - protein, 10 aa, Homo Sapiens
LAQQVQQVAA

SEQ ID NO: 128711 - protein, 10 aa, Homo Sapiens
LPAASQPQVF

SEQ ID NO: 128712 - protein, 10 aa, Homo Sapiens
LPAGINSIVA

SEQ ID NO: 128713 - protein, 10 aa, Homo Sapiens
LPAHREGISA

SEQ ID NO: 128714 - protein, 10 aa, Homo Sapiens
LPAHSDPVSA

SEQ ID NO: 128715 - protein, 10 aa, Homo Sapiens
LPAPDFKVNA

SEQ ID NO: 128716 - protein, 10 aa, Homo Sapiens
LPAPHIMPGV

SEQ ID NO: 128717 - protein, 10 aa, Homo Sapiens
LPAQSGSHAA

SEQ ID NO: 128718 - protein, 10 aa, Homo Sapiens
LPARFKNTEA

SEQ ID NO: 128719 - protein, 10 aa, Homo Sapiens
LPASAGHPRA

SEQ ID NO: 128720 - protein, 10 aa, Homo Sapiens
LPASETPKAA

SEQ ID NO: 128721 - protein, 10 aa, Homo Sapiens
LPASIPHVIA

SEQ ID NO: 128722 - protein, 10 aa, Homo Sapiens
LPFLAPGARA

SEQ ID NO: 128723 - protein, 10 aa, Homo Sapiens
LPFYLIPPSA

SEQ ID NO: 128724 - protein, 10 aa, Homo Sapiens
LPHAILRLDL

SEQ ID NO: 128725 - protein, 10 aa, Homo Sapiens
LPHEIVVNLA

SEQ ID NO: 128726 - protein, 10 aa, Homo Sapiens
LPHPYAIAVF

SEQ ID NO: 128727 - protein, 10 aa, Homo Sapiens
LPHSAGRYAA

SEQ ID NO: 128728 - protein, 10 aa, Homo Sapiens
LPHSGYSDSA

SEQ ID NO: 128729 - protein, 10 aa, Homo Sapiens
LPIDLNNKSA

SEQ ID NO: 128730 - protein, 10 aa, Homo Sapiens
LPIPDPGVSV

SEQ ID NO: 128731 - protein, 10 aa, Homo Sapiens
LPKAGKFGPA

SEQ ID NO: 128732 - protein, 10 aa, Homo Sapiens
LPKDVSPTQA

SEQ ID NO: 128733 - protein, 10 aa, Homo Sapiens
LPKEDPTAVA

SEQ ID NO: 128734 - protein, 10 aa, Homo Sapiens
LPKGRPGPVA

SEQ ID NO: 128735 - protein, 10 aa, Homo Sapiens
LPLSAHGIVV

SEQ ID NO: 128736 - protein, 10 aa, Homo Sapiens
LPNHQVIHTA

SEQ ID NO: 128737 - protein, 10 aa, Homo Sapiens
LPNQSFPHSV

SEQ ID NO: 128738 - protein, 10 aa, Homo Sapiens
LPPPDHGAPA

SEQ ID NO: 128739 - protein, 10 aa, Homo Sapiens
LPPPPPSHPA

SEQ ID NO: 128740 - protein, 10 aa, Homo Sapiens
LPQEIKANVA

SEQ ID NO: 128741 - protein, 10 aa, Homo Sapiens
LPQKVLGSPA

SEQ ID NO: 128742 - protein, 10 aa, Homo Sapiens
LPQSREKIIA

SEQ ID NO: 128743 - protein, 10 aa, Homo Sapiens
LPQSYIHTSA

SEQ ID NO: 128744 - protein, 10 aa, Homo Sapiens
LPREGPYVCS

SEQ ID NO: 128745 - protein, 10 aa, Homo Sapiens
LPRGAAKAIA

SEQ ID NO: 128746 - protein, 10 aa, Homo Sapiens
LPRRPLPPAA

SEQ ID NO: 128747 - protein, 10 aa, Homo Sapiens
LPSESMKVVA

SEQ ID NO: 128748 - protein, 10 aa, Homo Sapiens
LPSGCYGRVA

SEQ ID NO: 128749 - protein, 10 aa, Homo Sapiens
LPTDASTTAV

SEQ ID NO: 128750 - protein, 10 aa, Homo Sapiens
LPVDKAFYEA

SEQ ID NO: 128751 - protein, 10 aa, Homo Sapiens
LPVFQPGVKL

SEQ ID NO: 128752 - protein, 10 aa, Homo Sapiens
LPVGAVINCA

SEQ ID NO: 128753 - protein, 10 aa, Homo Sapiens
LPVQLQRAMA

SEQ ID NO: 128754 - protein, 10 aa, Homo Sapiens
LPVWLENHTA

SEQ ID NO: 128755 - protein, 10 aa, Homo Sapiens
LPWKPVFITA

SEQ ID NO: 128756 - protein, 10 aa, Homo Sapiens
LPYDVTPEQA

SEQ ID NO: 128757 - protein, 10 aa, Homo Sapiens
LPYKPYFYIA

SEQ ID NO: 128758 - protein, 10 aa, Homo Sapiens
LVYQEPIPTA

SEQ ID NO: 128759 - protein, 10 aa, Homo Sapiens
MAAANGIGRL

SEQ ID NO: 128760 - protein, 10 aa, Homo Sapiens
MAMESTATAA

SEQ ID NO: 128761 - protein, 10 aa, Homo Sapiens
MPAPPPKENA

SEQ ID NO: 128762 - protein, 10 aa, Homo Sapiens
MPCSVIRPIL

SEQ ID NO: 128763 - protein, 10 aa, Homo Sapiens
MPHLVNGDAA

SEQ ID NO: 128764 - protein, 10 aa, Homo Sapiens
MPIYPTYNEV

SEQ ID NO: 128765 - protein, 10 aa, Homo Sapiens
MPNGDHIVSA

SEQ ID NO: 128766 - protein, 10 aa, Homo Sapiens
MPNGTPHPTA

SEQ ID NO: 128767 - protein, 10 aa, Homo Sapiens
MPNPQLNIKA

SEQ ID NO: 128768 - protein, 10 aa, Homo Sapiens
MPPPVSPSTA

SEQ ID NO: 128769 - protein, 10 aa, Homo Sapiens
MPQLNAIIAA

SEQ ID NO: 128770 - protein, 10 aa, Homo Sapiens
MPQMCKATSA

SEQ ID NO: 128771 - protein, 10 aa, Homo Sapiens
MPQSGTGVSV

SEQ ID NO: 128772 - protein, 10 aa, Homo Sapiens
MPRFTEQVEA

SEQ ID NO: 128773 - protein, 10 aa, Homo Sapiens
MPTTLEGAEA

SEQ ID NO: 128774 - protein, 10 aa, Homo Sapiens
MPVEAKCINA

SEQ ID NO: 128775 - protein, 10 aa, Homo Sapiens
MPVQFKPKSA

SEQ ID NO: 128776 - protein, 10 aa, Homo Sapiens
NHPYLFPVAA

SEQ ID NO: 128777 - protein, 10 aa, Homo Sapiens
NPLGMPVPAA

SEQ ID NO: 128778 - protein, 10 aa, Homo Sapiens
NPMVVANAVA

SEQ ID NO: 128779 - protein, 10 aa, Homo Sapiens
NPSPSTSISA

SEQ ID NO: 128780 - protein, 10 aa, Homo Sapiens
NPYFPGQAIA

SEQ ID NO: 128781 - protein, 10 aa, Homo Sapiens
NPYNGGGRVA

SEQ ID NO: 128782 - protein, 10 aa, Homo Sapiens
NSVPSNPVAA

SEQ ID NO: 128783 - protein, 10 aa, Homo Sapiens
PARFKNTEAI

SEQ ID NO: 128784 - protein, 10 aa, Homo Sapiens
PPPPGKPQGP

SEQ ID NO: 128785 - protein, 10 aa, Homo Sapiens
PRGPAGPAAQ

SEQ ID NO: 128786 - protein, 10 aa, Homo Sapiens
PRRVEPAPAA

SEQ ID NO: 128787 - protein, 10 aa, Homo Sapiens
QAAAPVLTPA

SEQ ID NO: 128788 - protein, 10 aa, Homo Sapiens
QFPAPKSAST

SEQ ID NO: 128789 - protein, 10 aa, Homo Sapiens
QPFGDHIISV

SEQ ID NO: 128790 - protein, 10 aa, Homo Sapiens
QPHHLLLPAA

SEQ ID NO: 128791 - protein, 10 aa, Homo Sapiens
QPHIAGVFSA

SEQ ID NO: 128792 - protein, 10 aa, Homo Sapiens
QPPSLPAVSA

SEQ ID NO: 128793 - protein, 10 aa, Homo Sapiens
QPRTPSPLVL

SEQ ID NO: 128794 - protein, 10 aa, Homo Sapiens
QPWPQPVPAL

SEQ ID NO: 128795 - protein, 10 aa, Homo Sapiens
QPYYATRVNA

SEQ ID NO: 128796 - protein, 10 aa, Homo Sapiens
QVANVRFNVA

SEQ ID NO: 128797 - protein, 10 aa, Homo Sapiens
QVMQGMGVSA

SEQ ID NO: 128798 - protein, 10 aa, Homo Sapiens
RPAAAPPAGA

SEQ ID NO: 128799 - protein, 10 aa, Homo Sapiens
RPADVIFATV

SEQ ID NO: 128800 - protein, 10 aa, Homo Sapiens
RPAGPPREPV

SEQ ID NO: 128801 - protein, 10 aa, Homo Sapiens
RPALAVGVTA

SEQ ID NO: 128802 - protein, 10 aa, Homo Sapiens
RPALVEQTAA

SEQ ID NO: 128803 - protein, 10 aa, Homo Sapiens
RPAPALAPAA

SEQ ID NO: 128804 - protein, 10 aa, Homo Sapiens
RPAPHFERTA

SEQ ID NO: 128805 - protein, 10 aa, Homo Sapiens
RPAPLPAAVV

SEQ ID NO: 128806 - protein, 10 aa, Homo Sapiens
RPAPPLRPSA

SEQ ID NO: 128807 - protein, 10 aa, Homo Sapiens
RPAPVAVAAA

SEQ ID NO: 128808 - protein, 10 aa, Homo Sapiens
RPASYQSVSV

SEQ ID NO: 128809 - protein, 10 aa, Homo Sapiens
RPELLCGAVA

SEQ ID NO: 128810 - protein, 10 aa, Homo Sapiens
RPFEGFQRKA

SEQ ID NO: 128811 - protein, 10 aa, Homo Sapiens
RPFHNGVKCL

SEQ ID NO: 128812 - protein, 10 aa, Homo Sapiens
RPFLNSISKA

SEQ ID NO: 128813 - protein, 10 aa, Homo Sapiens
RPFSGRRLPV

SEQ ID NO: 128814 - protein, 10 aa, Homo Sapiens
RPFTIPYLTA

SEQ ID NO: 128815 - protein, 10 aa, Homo Sapiens
RPHDSHSFQA

SEQ ID NO: 128816 - protein, 10 aa, Homo Sapiens
RPIPNQPPTA

SEQ ID NO: 128817 - protein, 10 aa, Homo Sapiens
RPIPSALTQA

SEQ ID NO: 128818 - protein, 10 aa, Homo Sapiens
RPISLGHVVV

SEQ ID NO: 128819 - protein, 10 aa, Homo Sapiens
RPITPPRNSA

SEQ ID NO: 128820 - protein, 10 aa, Homo Sapiens
RPIWLRESTV

SEQ ID NO: 128821 - protein, 10 aa, Homo Sapiens
RPIYIKDYVT

SEQ ID NO: 128822 - protein, 10 aa, Homo Sapiens
RPKDCDVLTA

SEQ ID NO: 128823 - protein, 10 aa, Homo Sapiens
RPKDDIKLTA

SEQ ID NO: 128824 - protein, 10 aa, Homo Sapiens
RPKPPNVRTA

SEQ ID NO: 128825 - protein, 10 aa, Homo Sapiens
RPLDIDEVEA

SEQ ID NO: 128826 - protein, 10 aa, Homo Sapiens
RPLPVTFHRA

SEQ ID NO: 128827 - protein, 10 aa, Homo Sapiens
RPLQDEPAAA

SEQ ID NO: 128828 - protein, 10 aa, Homo Sapiens
RPLQDYGISV

SEQ ID NO: 128829 - protein, 10 aa, Homo Sapiens
RPLSGLMETA

SEQ ID NO: 128830 - protein, 10 aa, Homo Sapiens
RPLSGSGISA

SEQ ID NO: 128831 - protein, 10 aa, Homo Sapiens
RPLSYTVVTA

SEQ ID NO: 128832 - protein, 10 aa, Homo Sapiens
RPLYCSPITA

SEQ ID NO: 128833 - protein, 10 aa, Homo Sapiens
RPMYAHHISS

SEQ ID NO: 128834 - protein, 10 aa, Homo Sapiens
RPNAFGMAQA

SEQ ID NO: 128835 - protein, 10 aa, Homo Sapiens
RPNDSRMLVA

SEQ ID NO: 128836 - protein, 10 aa, Homo Sapiens
RPNSLVGITS

SEQ ID NO: 128837 - protein, 10 aa, Homo Sapiens
RPPDFISISA

SEQ ID NO: 128838 - protein, 10 aa, Homo Sapiens
RPPEPRHIPA

SEQ ID NO: 128839 - protein, 10 aa, Homo Sapiens
RPRAVYAVEA

SEQ ID NO: 128840 - protein, 10 aa, Homo Sapiens
RPRDSQLYAV

SEQ ID NO: 128841 - protein, 10 aa, Homo Sapiens
RPREVQETTV

SEQ ID NO: 128842 - protein, 10 aa, Homo Sapiens
RPRNGGICVA

SEQ ID NO: 128843 - protein, 10 aa, Homo Sapiens
RPRPAPGSPP

SEQ ID NO: 128844 - protein, 10 aa, Homo Sapiens
RPRPPPVEQV

SEQ ID NO: 128845 - protein, 10 aa, Homo Sapiens
RPRPVVTTTT

SEQ ID NO: 128846 - protein, 10 aa, Homo Sapiens
RPRTEVSLSA

SEQ ID NO: 128847 - protein, 10 aa, Homo Sapiens
RPRVTEPISA

SEQ ID NO: 128848 - protein, 10 aa, Homo Sapiens
RPSLLRPVSA

SEQ ID NO: 128849 - protein, 10 aa, Homo Sapiens
RPSSLHGLAA

SEQ ID NO: 128850 - protein, 10 aa, Homo Sapiens
RPVHPALPFA

SEQ ID NO: 128851 - protein, 10 aa, Homo Sapiens
RPWYSHPVYA

SEQ ID NO: 128852 - protein, 10 aa, Homo Sapiens
RPYAPINANA

SEQ ID NO: 128853 - protein, 10 aa, Homo Sapiens
RPYFPADATA

SEQ ID NO: 128854 - protein, 10 aa, Homo Sapiens
RPYGCVLRAA

SEQ ID NO: 128855 - protein, 10 aa, Homo Sapiens
RPYLGYDWIA

SEQ ID NO: 128856 - protein, 10 aa, Homo Sapiens
RQGVDADING

SEQ ID NO: 128857 - protein, 10 aa, Homo Sapiens
RVAEVIFPTA

SEQ ID NO: 128858 - protein, 10 aa, Homo Sapiens
SMDNNRSLDL

SEQ ID NO: 128859 - protein, 10 aa, Homo Sapiens
SPAEVAKITA

SEQ ID NO: 128860 - protein, 10 aa, Homo Sapiens
SPARLYAIAA

SEQ ID NO: 128861 - protein, 10 aa, Homo Sapiens
SPARPVSPAP

SEQ ID NO: 128862 - protein, 10 aa, Homo Sapiens
SPDGNRFATA

SEQ ID NO: 128863 - protein, 10 aa, Homo Sapiens
SPDGRWLISA

SEQ ID NO: 128864 - protein, 10 aa, Homo Sapiens
SPDPFGAVAA

SEQ ID NO: 128865 - protein, 10 aa, Homo Sapiens
SPFDHSRIKL

SEQ ID NO: 128866 - protein, 10 aa, Homo Sapiens
SPFGLKPRSA

SEQ ID NO: 128867 - protein, 10 aa, Homo Sapiens
SPFHFQPSAA

SEQ ID NO: 128868 - protein, 10 aa, Homo Sapiens
SPFPSSIPHA

SEQ ID NO: 128869 - protein, 10 aa, Homo Sapiens
SPHAHISEQA

SEQ ID NO: 128870 - protein, 10 aa, Homo Sapiens
SPHAVDGNTV

SEQ ID NO: 128871 - protein, 10 aa, Homo Sapiens
SPHGGLTVSA

SEQ ID NO: 128872 - protein, 10 aa, Homo Sapiens
SPHGLVMVGV

SEQ ID NO: 128873 - protein, 10 aa, Homo Sapiens
SPHGYLSDVA

SEQ ID NO: 128874 - protein, 10 aa, Homo Sapiens
SPHLPGTSSA

SEQ ID NO: 128875 - protein, 10 aa, Homo Sapiens
SPHPGVGVPT

SEQ ID NO: 128876 - protein, 10 aa, Homo Sapiens
SPHPPSEVTA

SEQ ID NO: 128877 - protein, 10 aa, Homo Sapiens
SPHSILVNGA

SEQ ID NO: 128878 - protein, 10 aa, Homo Sapiens
SPIENIQRVA

SEQ ID NO: 128879 - protein, 10 aa, Homo Sapiens
SPILVATAVA

SEQ ID NO: 128880 - protein, 10 aa, Homo Sapiens
SPIPLLLSCA

SEQ ID NO: 128881 - protein, 10 aa, Homo Sapiens
SPIRSRSPPA

SEQ ID NO: 128882 - protein, 10 aa, Homo Sapiens
SPITGEKIPA

SEQ ID NO: 128883 - protein, 10 aa, Homo Sapiens
SPKAALRYAA

SEQ ID NO: 128884 - protein, 10 aa, Homo Sapiens
SPKPALRYAA

SEQ ID NO: 128885 - protein, 10 aa, Homo Sapiens
SPKPCLAQPA

SEQ ID NO: 128886 - protein, 10 aa, Homo Sapiens
SPKQILDPAA

SEQ ID NO: 128887 - protein, 10 aa, Homo Sapiens
SPKQILDSAA

SEQ ID NO: 128888 - protein, 10 aa, Homo Sapiens
SPLATQIPQA

SEQ ID NO: 128889 - protein, 10 aa, Homo Sapiens
SPLFSQHTAA

SEQ ID NO: 128890 - protein, 10 aa, Homo Sapiens
SPLNTPHTSA

SEQ ID NO: 128891 - protein, 10 aa, Homo Sapiens
SPLRSPIRSA

SEQ ID NO: 128892 - protein, 10 aa, Homo Sapiens
SPLSAAAATA

SEQ ID NO: 128893 - protein, 10 aa, Homo Sapiens
SPLVTHQNPA

SEQ ID NO: 128894 - protein, 10 aa, Homo Sapiens
SPMPWKGVTV

SEQ ID NO: 128895 - protein, 10 aa, Homo Sapiens
SPMSADRVVA

SEQ ID NO: 128896 - protein, 10 aa, Homo Sapiens
SPNGKYILAA

SEQ ID NO: 128897 - protein, 10 aa, Homo Sapiens
SPNKTGGFGA

SEQ ID NO: 128898 - protein, 10 aa, Homo Sapiens
SPNMANTVNA

SEQ ID NO: 128899 - protein, 10 aa, Homo Sapiens
SPNPARGHSV

SEQ ID NO: 128900 - protein, 10 aa, Homo Sapiens
SPNPFSVHTA

SEQ ID NO: 128901 - protein, 10 aa, Homo Sapiens
SPNRYWLCAA

SEQ ID NO: 128902 - protein, 10 aa, Homo Sapiens
SPPAGLFTSA

SEQ ID NO: 128903 - protein, 10 aa, Homo Sapiens
SPQEAQIIQA

SEQ ID NO: 128904 - protein, 10 aa, Homo Sapiens
SPRLFSNHAA

SEQ ID NO: 128905 - protein, 10 aa, Homo Sapiens
SPRPALVRSA

SEQ ID NO: 128906 - protein, 10 aa, Homo Sapiens
SPRTAVAPSA

SEQ ID NO: 128907 - protein, 10 aa, Homo Sapiens
SPSMAVRIAA

SEQ ID NO: 128908 - protein, 10 aa, Homo Sapiens
SPSNVTLPQV

SEQ ID NO: 128909 - protein, 10 aa, Homo Sapiens
SPSPPFGHSA

SEQ ID NO: 128910 - protein, 10 aa, Homo Sapiens
SPTACRAVAA

SEQ ID NO: 128911 - protein, 10 aa, Homo Sapiens
SPTAYGVIAA

SEQ ID NO: 128912 - protein, 10 aa, Homo Sapiens
SPTGKEFVSA

SEQ ID NO: 128913 - protein, 10 aa, Homo Sapiens
SPVDPGARQA

SEQ ID NO: 128914 - protein, 10 aa, Homo Sapiens
SPVIIKEWAA

SEQ ID NO: 128915 - protein, 10 aa, Homo Sapiens
SPVPSHWMVA

SEQ ID NO: 128916 - protein, 10 aa, Homo Sapiens
SPVSSVGNSA

SEQ ID NO: 128917 - protein, 10 aa, Homo Sapiens
SPYKDLLDPA

SEQ ID NO: 128918 - protein, 10 aa, Homo Sapiens
SPYPWPLNHI

SEQ ID NO: 128919 - protein, 10 aa, Homo Sapiens
SYGGGSGGGF

SEQ ID NO: 128920 - protein, 10 aa, Homo Sapiens
TAAPSLKNAA

SEQ ID NO: 128921 - protein, 10 aa, Homo Sapiens
TPAALDGTVA

SEQ ID NO: 128922 - protein, 10 aa, Homo Sapiens
TPAHVLPSAA

SEQ ID NO: 128923 - protein, 10 aa, Homo Sapiens
TPAPSAPAAA

SEQ ID NO: 128924 - protein, 10 aa, Homo Sapiens
TPAPVEKSPA

SEQ ID NO: 128925 - protein, 10 aa, Homo Sapiens
TPFQGQGHGA

SEQ ID NO: 128926 - protein, 10 aa, Homo Sapiens
TPFTGPFISV

SEQ ID NO: 128927 - protein, 10 aa, Homo Sapiens
TPHPVLTPVA

SEQ ID NO: 128928 - protein, 10 aa, Homo Sapiens
TPHTVTAISA

SEQ ID NO: 128929 - protein, 10 aa, Homo Sapiens
TPKEVGDVIA

SEQ ID NO: 128930 - protein, 10 aa, Homo Sapiens
TPKPIPILAA

SEQ ID NO: 128931 - protein, 10 aa, Homo Sapiens
TPLPAIVPAA

SEQ ID NO: 128932 - protein, 10 aa, Homo Sapiens
TPLQSVPAPA

SEQ ID NO: 128933 - protein, 10 aa, Homo Sapiens
TPMSAQGVQA

SEQ ID NO: 128934 - protein, 10 aa, Homo Sapiens
TPMYTHSIAA

SEQ ID NO: 128935 - protein, 10 aa, Homo Sapiens
TPPLPVPPAA

SEQ ID NO: 128936 - protein, 10 aa, Homo Sapiens
TPPPFSLPSV

SEQ ID NO: 128937 - protein, 10 aa, Homo Sapiens
TPQEKIFIAA

SEQ ID NO: 128938 - protein, 10 aa, Homo Sapiens
TPRPLTSARA

SEQ ID NO: 128939 - protein, 10 aa, Homo Sapiens
TPRPPLRPGA

SEQ ID NO: 128940 - protein, 10 aa, Homo Sapiens
TPSKVWGSSA

SEQ ID NO: 128941 - protein, 10 aa, Homo Sapiens
TPSPVIRSTA

SEQ ID NO: 128942 - protein, 10 aa, Homo Sapiens
TPVLPAPTAA

SEQ ID NO: 128943 - protein, 10 aa, Homo Sapiens
TPYGYFLISA

SEQ ID NO: 128944 - protein, 10 aa, Homo Sapiens
TPYSGKLMSA

SEQ ID NO: 128945 - protein, 10 aa, Homo Sapiens
TQARAPVTAA

SEQ ID NO: 128946 - protein, 10 aa, Homo Sapiens
VLSAADKGNV

SEQ ID NO: 128947 - protein, 10 aa, Homo Sapiens
VPAHAVVVRA

SEQ ID NO: 128948 - protein, 10 aa, Homo Sapiens
VPAKGLATSV

SEQ ID NO: 128949 - protein, 10 aa, Homo Sapiens
VPAPAHLVAT

SEQ ID NO: 128950 - protein, 10 aa, Homo Sapiens
VPAPSPLSAA

SEQ ID NO: 128951 - protein, 10 aa, Homo Sapiens
VPFKPQIPEA

SEQ ID NO: 128952 - protein, 10 aa, Homo Sapiens
VPFYNGGNCV

SEQ ID NO: 128953 - protein, 10 aa, Homo Sapiens
VPGYISRSVA

SEQ ID NO: 128954 - protein, 10 aa, Homo Sapiens
VPHFPTPSIL

SEQ ID NO: 128955 - protein, 10 aa, Homo Sapiens
VPHQPDNLAA

SEQ ID NO: 128956 - protein, 10 aa, Homo Sapiens
VPHWDPKISA

SEQ ID NO: 128957 - protein, 10 aa, Homo Sapiens
VPIEVLPTVL

SEQ ID NO: 128958 - protein, 10 aa, Homo Sapiens
VPIVPQAPAA

SEQ ID NO: 128959 - protein, 10 aa, Homo Sapiens
VPKKPGPPVL

SEQ ID NO: 128960 - protein, 10 aa, Homo Sapiens
VPKNSDPWAA

SEQ ID NO: 128961 - protein, 10 aa, Homo Sapiens
VPKNYKLVAA

SEQ ID NO: 128962 - protein, 10 aa, Homo Sapiens
VPKSAVQQVA

SEQ ID NO: 128963 - protein, 10 aa, Homo Sapiens
VPNYKLITPA

SEQ ID NO: 128964 - protein, 10 aa, Homo Sapiens
VPQEAQKIQA

SEQ ID NO: 128965 - protein, 10 aa, Homo Sapiens
VPQPPPGPAA

SEQ ID NO: 128966 - protein, 10 aa, Homo Sapiens
VPQQPTYVQA

SEQ ID NO: 128967 - protein, 10 aa, Homo Sapiens
VPRPPDTVST

SEQ ID NO: 128968 - protein, 10 aa, Homo Sapiens
VPRPPSNPPA

SEQ ID NO: 128969 - protein, 10 aa, Homo Sapiens
VPRQPTVTSV

SEQ ID NO: 128970 - protein, 10 aa, Homo Sapiens
VPRTVSSTTA

SEQ ID NO: 128971 - protein, 10 aa, Homo Sapiens
VPSLPVPHPA

SEQ ID NO: 128972 - protein, 10 aa, Homo Sapiens
VPSPGLPVSA

SEQ ID NO: 128973 - protein, 10 aa, Homo Sapiens
VPVGIAGFAA

SEQ ID NO: 128974 - protein, 10 aa, Homo Sapiens
VPVVLVGNKA

SEQ ID NO: 128975 - protein, 10 aa, Homo Sapiens
VPVWSGMNVA

SEQ ID NO: 128976 - protein, 10 aa, Homo Sapiens
VPYCIIKGKA

SEQ ID NO: 128977 - protein, 10 aa, Homo Sapiens
VPYEIQKGQA

SEQ ID NO: 128978 - protein, 10 aa, Homo Sapiens
VPYRLLPGIF

SEQ ID NO: 128979 - protein, 10 aa, Homo Sapiens
WRRIPGGYSA

SEQ ID NO: 128980 - protein, 10 aa, Homo Sapiens
YLKDGPYITA

SEQ ID NO: 128981 - protein, 10 aa, Homo Sapiens
YPHGINTAIY

SEQ ID NO: 128982 - protein, 10 aa, Homo Sapiens
YPIGTNAIVA

SEQ ID NO: 128983 - protein, 10 aa, Homo Sapiens
YPKAEPMPSA

SEQ ID NO: 128984 - protein, 10 aa, Homo Sapiens
YPNFAGPHAA

SEQ ID NO: 128985 - protein, 10 aa, Homo Sapiens
YPRTPEERAA

SEQ ID NO: 128986 - protein, 10 aa, Homo Sapiens
YPSKSASVTA

SEQ ID NO: 128987 - protein, 10 aa, Homo Sapiens
YPSTAVRHMA

SEQ ID NO: 128988 - protein, 11 aa, Homo Sapiens
AAAAAAAKVPA

SEQ ID NO: 128989 - protein, 11 aa, Homo Sapiens
AALPAAALPAA

SEQ ID NO: 128990 - protein, 11 aa, Homo Sapiens
AGPAASPHLSP

SEQ ID NO: 128991 - protein, 11 aa, Homo Sapiens
APAAAPSSLAV

SEQ ID NO: 128992 - protein, 11 aa, Homo Sapiens
APAALPSSTAA

SEQ ID NO: 128993 - protein, 11 aa, Homo Sapiens
APAEEPAAAAA

SEQ ID NO: 128994 - protein, 11 aa, Homo Sapiens
APAGGDKKVIA

SEQ ID NO: 128995 - protein, 11 aa, Homo Sapiens
APAPAPTPVSA

SEQ ID NO: 128996 - protein, 11 aa, Homo Sapiens
APAPPKAEAKA

SEQ ID NO: 128997 - protein, 11 aa, Homo Sapiens
APAPPQVLPQA

SEQ ID NO: 128998 - protein, 11 aa, Homo Sapiens
APAPVIISSSA

SEQ ID NO: 128999 - protein, 11 aa, Homo Sapiens
APASVFPQNGA

SEQ ID NO: 129000 - protein, 11 aa, Homo Sapiens
APDGSLILVSA

SEQ ID NO: 129001 - protein, 11 aa, Homo Sapiens
APFDTVHIPEA

SEQ ID NO: 129002 - protein, 11 aa, Homo Sapiens
APFYSSDILIA

SEQ ID NO: 129003 - protein, 11 aa, Homo Sapiens
APHEILIQIVD

SEQ ID NO: 129004 - protein, 11 aa, Homo Sapiens
APHFVHPNDHA

SEQ ID NO: 129005 - protein, 11 aa, Homo Sapiens
APHGGDLQPPA

SEQ ID NO: 129006 - protein, 11 aa, Homo Sapiens
APIKVGDAIPA

SEQ ID NO: 129007 - protein, 11 aa, Homo Sapiens
APILNIPIVQF

SEQ ID NO: 129008 - protein, 11 aa, Homo Sapiens
APIQSPKGVEA

SEQ ID NO: 129009 - protein, 11 aa, Homo Sapiens
APIQWEERNVT

SEQ ID NO: 129010 - protein, 11 aa, Homo Sapiens
APIRLPEHVTV

SEQ ID NO: 129011 - protein, 11 aa, Homo Sapiens
APKDVKIRISA

SEQ ID NO: 129012 - protein, 11 aa, Homo Sapiens
APLAIPSAAAA

SEQ ID NO: 129013 - protein, 11 aa, Homo Sapiens
APLAVLQGHSA

SEQ ID NO: 129014 - protein, 11 aa, Homo Sapiens
APLDSIHSLAA

SEQ ID NO: 129015 - protein, 11 aa, Homo Sapiens
APLEEARQFAA

SEQ ID NO: 129016 - protein, 11 aa, Homo Sapiens
APMALFYPATF

SEQ ID NO: 129017 - protein, 11 aa, Homo Sapiens
APMPYLIGIHL

SEQ ID NO: 129018 - protein, 11 aa, Homo Sapiens
APMPYLIGVHA

SEQ ID NO: 129019 - protein, 11 aa, Homo Sapiens
APNEFQGQVIA

SEQ ID NO: 129020 - protein, 11 aa, Homo Sapiens
APNRFWASVEP

SEQ ID NO: 129021 - protein, 11 aa, Homo Sapiens
APQELNPAVTA

SEQ ID NO: 129022 - protein, 11 aa, Homo Sapiens
APRAPRALAAA

SEQ ID NO: 129023 - protein, 11 aa, Homo Sapiens
APRLCSISVTA

SEQ ID NO: 129024 - protein, 11 aa, Homo Sapiens
APRPASGPIRP

SEQ ID NO: 129025 - protein, 11 aa, Homo Sapiens
APSKAAALAAA

SEQ ID NO: 129026 - protein, 11 aa, Homo Sapiens
APSKACMLTTA

SEQ ID NO: 129027 - protein, 11 aa, Homo Sapiens
APSNGLSVRSA

SEQ ID NO: 129028 - protein, 11 aa, Homo Sapiens
APSPQVVYQVA

SEQ ID NO: 129029 - protein, 11 aa, Homo Sapiens
APTANLLQTCA

SEQ ID NO: 129030 - protein, 11 aa, Homo Sapiens
APTGSGKTVAA

SEQ ID NO: 129031 - protein, 11 aa, Homo Sapiens
APTKALVNQVA

SEQ ID NO: 129032 - protein, 11 aa, Homo Sapiens
APTPAQAQITA

SEQ ID NO: 129033 - protein, 11 aa, Homo Sapiens
APTSAGKTLVA

SEQ ID NO: 129034 - protein, 11 aa, Homo Sapiens
APVAVEPGAAV

SEQ ID NO: 129035 - protein, 11 aa, Homo Sapiens
APVAVLQGHSA

SEQ ID NO: 129036 - protein, 11 aa, Homo Sapiens
APVNIAGSRTA

SEQ ID NO: 129037 - protein, 11 aa, Homo Sapiens
APWAVTSLYEA

SEQ ID NO: 129038 - protein, 11 aa, Homo Sapiens
APWPIVGLGKF

SEQ ID NO: 129039 - protein, 11 aa, Homo Sapiens
APWPPKGLVPA

SEQ ID NO: 129040 - protein, 11 aa, Homo Sapiens
APYAKGFGVAA

SEQ ID NO: 129041 - protein, 11 aa, Homo Sapiens
APYDPHFPAPA

SEQ ID NO: 129042 - protein, 11 aa, Homo Sapiens
AVEAKKTYVRD

SEQ ID NO: 129043 - protein, 11 aa, Homo Sapiens
EIASFDKAKLK

SEQ ID NO: 129044 - protein, 11 aa, Homo Sapiens
ETQITQIEHEV

SEQ ID NO: 129045 - protein, 11 aa, Homo Sapiens
FPFKPPQRIEA

SEQ ID NO: 129046 - protein, 11 aa, Homo Sapiens
FPHFDLSHGSA

SEQ ID NO: 129047 - protein, 11 aa, Homo Sapiens
FPRAPSTSDSV

SEQ ID NO: 129048 - protein, 11 aa, Homo Sapiens
GPFPSSSATAA

SEQ ID NO: 129049 - protein, 11 aa, Homo Sapiens
GPWVGTGLAAA

SEQ ID NO: 129050 - protein, 11 aa, Homo Sapiens
HPFDLGLYNEA

SEQ ID NO: 129051 - protein, 11 aa, Homo Sapiens
HPIYLATGTSA

SEQ ID NO: 129052 - protein, 11 aa, Homo Sapiens
HPKPVPGFQVA

SEQ ID NO: 129053 - protein, 11 aa, Homo Sapiens
HPKVNVPGSQA

SEQ ID NO: 129054 - protein, 11 aa, Homo Sapiens
HPLASFSFTSA

SEQ ID NO: 129055 - protein, 11 aa, Homo Sapiens
HPNVTLTISAA

SEQ ID NO: 129056 - protein, 11 aa, Homo Sapiens
HPQPILMGSVA

SEQ ID NO: 129057 - protein, 11 aa, Homo Sapiens
HPSHVQLKVVA

SEQ ID NO: 129058 - protein, 11 aa, Homo Sapiens
HPTASLIAKVA

SEQ ID NO: 129059 - protein, 11 aa, Homo Sapiens
HPYSTTFQESA

SEQ ID NO: 129060 - protein, 11 aa, Homo Sapiens
IAKNRKDIENQ

SEQ ID NO: 129061 - protein, 11 aa, Homo Sapiens
IDNNIEQISSY

SEQ ID NO: 129062 - protein, 11 aa, Homo Sapiens
IPAFRGHFIAA

SEQ ID NO: 129063 - protein, 11 aa, Homo Sapiens
IPAGTVTVNAA

SEQ ID NO: 129064 - protein, 11 aa, Homo Sapiens
IPAQGHFGISA

SEQ ID NO: 129065 - protein, 11 aa, Homo Sapiens
IPAQISPEGRA

SEQ ID NO: 129066 - protein, 11 aa, Homo Sapiens
IPCNNKGAHSV

SEQ ID NO: 129067 - protein, 11 aa, Homo Sapiens
IPHSLPGAVAA

SEQ ID NO: 129068 - protein, 11 aa, Homo Sapiens
IPIKFSEKQQA

SEQ ID NO: 129069 - protein, 11 aa, Homo Sapiens
IPIYSKEPNSA

SEQ ID NO: 129070 - protein, 11 aa, Homo Sapiens
IPKGKISIVEA

SEQ ID NO: 129071 - protein, 11 aa, Homo Sapiens
IPLKEMPAVQL

SEQ ID NO: 129072 - protein, 11 aa, Homo Sapiens
IPLKHLADRVA

SEQ ID NO: 129073 - protein, 11 aa, Homo Sapiens
IPLPDEKSRVA

SEQ ID NO: 129074 - protein, 11 aa, Homo Sapiens
IPNPFIQQQDA

SEQ ID NO: 129075 - protein, 11 aa, Homo Sapiens
IPNSIMTILEA

SEQ ID NO: 129076 - protein, 11 aa, Homo Sapiens
IPRNQLQSVAA

SEQ ID NO: 129077 - protein, 11 aa, Homo Sapiens
IPTNAVSVVSS

SEQ ID NO: 129078 - protein, 11 aa, Homo Sapiens
IPVLVPGIIFS

SEQ ID NO: 129079 - protein, 11 aa, Homo Sapiens
IPYDQSGFVSA

SEQ ID NO: 129080 - protein, 11 aa, Homo Sapiens
IPYHSEVPVSL

SEQ ID NO: 129081 - protein, 11 aa, Homo Sapiens
IPYSPDVQIHA

SEQ ID NO: 129082 - protein, 11 aa, Homo Sapiens
IVNEVLKSVVA

SEQ ID NO: 129083 - protein, 11 aa, Homo Sapiens
KPFELSPLVCA

SEQ ID NO: 129084 - protein, 11 aa, Homo Sapiens
KPFQPALPLVV

SEQ ID NO: 129085 - protein, 11 aa, Homo Sapiens
KPKVMEGTVAA

SEQ ID NO: 129086 - protein, 11 aa, Homo Sapiens
KPLSSLTPLIA

SEQ ID NO: 129087 - protein, 11 aa, Homo Sapiens
KPMEGWIAVTV

SEQ ID NO: 129088 - protein, 11 aa, Homo Sapiens
KPREAFGFEQA

SEQ ID NO: 129089 - protein, 11 aa, Homo Sapiens
KPRPSAVTTTA

SEQ ID NO: 129090 - protein, 11 aa, Homo Sapiens
KPVVTPFGQVA

SEQ ID NO: 129091 - protein, 11 aa, Homo Sapiens
LPAEFPDKVFA

SEQ ID NO: 129092 - protein, 11 aa, Homo Sapiens
LPARTQETPSA

SEQ ID NO: 129093 - protein, 11 aa, Homo Sapiens
LPASEIAKLLA

SEQ ID NO: 129094 - protein, 11 aa, Homo Sapiens
LPASNLAGKEA

SEQ ID NO: 129095 - protein, 11 aa, Homo Sapiens
LPHAILRLDLA

SEQ ID NO: 129096 - protein, 11 aa, Homo Sapiens
LPHDRMTSQEA

SEQ ID NO: 129097 - protein, 11 aa, Homo Sapiens
LPHGAISEDQA

SEQ ID NO: 129098 - protein, 11 aa, Homo Sapiens
LPIGIPYSISF

SEQ ID NO: 129099 - protein, 11 aa, Homo Sapiens
LPKPRMRGLLA

SEQ ID NO: 129100 - protein, 11 aa, Homo Sapiens
LPKSSSQEVEA

SEQ ID NO: 129101 - protein, 11 aa, Homo Sapiens
LPLLPAPGAAA

SEQ ID NO: 129102 - protein, 11 aa, Homo Sapiens
LPLLQPRGASA

SEQ ID NO: 129103 - protein, 11 aa, Homo Sapiens
LPLRPIIPLVA

SEQ ID NO: 129104 - protein, 11 aa, Homo Sapiens
LPNQVLKSISV

SEQ ID NO: 129105 - protein, 11 aa, Homo Sapiens
LPPSTGTFQEA

SEQ ID NO: 129106 - protein, 11 aa, Homo Sapiens
LPRTVIRGSQA

SEQ ID NO: 129107 - protein, 11 aa, Homo Sapiens
LPSASITSTSA

SEQ ID NO: 129108 - protein, 11 aa, Homo Sapiens
LPSPLPAHPSV

SEQ ID NO: 129109 - protein, 11 aa, Homo Sapiens
LPTREGHHLVA

SEQ ID NO: 129110 - protein, 11 aa, Homo Sapiens
LPTSGAAATAA

SEQ ID NO: 129111 - protein, 11 aa, Homo Sapiens
LPVGQHIYLSA

SEQ ID NO: 129112 - protein, 11 aa, Homo Sapiens
LPVKLIGMNCT

SEQ ID NO: 129113 - protein, 11 aa, Homo Sapiens
LPWGSQGKPGA

SEQ ID NO: 129114 - protein, 11 aa, Homo Sapiens
LPYCPGKTLVV

SEQ ID NO: 129115 - protein, 11 aa, Homo Sapiens
MAPALLLIPAA

SEQ ID NO: 129116 - protein, 11 aa, Homo Sapiens
MIKGKTPEEIR

SEQ ID NO: 129117 - protein, 11 aa, Homo Sapiens
MPHPATGKTVA

SEQ ID NO: 129118 - protein, 11 aa, Homo Sapiens
MPHSIMRIDIA

SEQ ID NO: 129119 - protein, 11 aa, Homo Sapiens
MPHSIMRVDIA

SEQ ID NO: 129120 - protein, 11 aa, Homo Sapiens
MPIYVTGITNH

SEQ ID NO: 129121 - protein, 11 aa, Homo Sapiens
MPLHVAPLLAA

SEQ ID NO: 129122 - protein, 11 aa, Homo Sapiens
MPNGTPHPTAA

SEQ ID NO: 129123 - protein, 11 aa, Homo Sapiens
MPNPSLAQVKI

SEQ ID NO: 129124 - protein, 11 aa, Homo Sapiens
MPRWAERLFPA

SEQ ID NO: 129125 - protein, 11 aa, Homo Sapiens
MPWGDPNYRSA

SEQ ID NO: 129126 - protein, 11 aa, Homo Sapiens
NPAAAAAAVAA

SEQ ID NO: 129127 - protein, 11 aa, Homo Sapiens
NPDDRRRLLSA

SEQ ID NO: 129128 - protein, 11 aa, Homo Sapiens
PKFEVIEKPQA

SEQ ID NO: 129129 - protein, 11 aa, Homo Sapiens
PLSPMLYSSSA

SEQ ID NO: 129130 - protein, 11 aa, Homo Sapiens
PQSREKIIAAL

SEQ ID NO: 129131 - protein, 11 aa, Homo Sapiens
PSLSRPGPAAP

SEQ ID NO: 129132 - protein, 11 aa, Homo Sapiens
PSLSSLPAGAA

SEQ ID NO: 129133 - protein, 11 aa, Homo Sapiens
QPFPAHIGRSA

SEQ ID NO: 129134 - protein, 11 aa, Homo Sapiens
QPHDPLVPLSA

SEQ ID NO: 129135 - protein, 11 aa, Homo Sapiens
QPSPAQPRAEA

SEQ ID NO: 129136 - protein, 11 aa, Homo Sapiens
QPTSVLDKATA

SEQ ID NO: 129137 - protein, 11 aa, Homo Sapiens
QPYAPPRDFAA

SEQ ID NO: 129138 - protein, 11 aa, Homo Sapiens
QPYSKLPGVSL

SEQ ID NO: 129139 - protein, 11 aa, Homo Sapiens
QPYYATRVNAA

SEQ ID NO: 129140 - protein, 11 aa, Homo Sapiens
QVFDAKNMMAA

SEQ ID NO: 129141 - protein, 11 aa, Homo Sapiens
RAADALLKAVA

SEQ ID NO: 129142 - protein, 11 aa, Homo Sapiens
RASLEVTQQQA

SEQ ID NO: 129143 - protein, 11 aa, Homo Sapiens
RPAAQPSFHQA

SEQ ID NO: 129144 - protein, 11 aa, Homo Sapiens
RPAGALVALVV

SEQ ID NO: 129145 - protein, 11 aa, Homo Sapiens
RPAGVGVVVEA

SEQ ID NO: 129146 - protein, 11 aa, Homo Sapiens
RPALPVSYLQA

SEQ ID NO: 129147 - protein, 11 aa, Homo Sapiens
RPAPLSAELQA

SEQ ID NO: 129148 - protein, 11 aa, Homo Sapiens
RPAPVAVAAAA

SEQ ID NO: 129149 - protein, 11 aa, Homo Sapiens
RPAQFLPEMVA

SEQ ID NO: 129150 - protein, 11 aa, Homo Sapiens
RPAQLHIGFQA

SEQ ID NO: 129151 - protein, 11 aa, Homo Sapiens
RPGPVLPAVAV

SEQ ID NO: 129152 - protein, 11 aa, Homo Sapiens
RPHSSLRELLA

SEQ ID NO: 129153 - protein, 11 aa, Homo Sapiens
RPIPNQPPTAA

SEQ ID NO: 129154 - protein, 11 aa, Homo Sapiens
RPISLGHVVVA

SEQ ID NO: 129155 - protein, 11 aa, Homo Sapiens
RPIVIDGSNVA

SEQ ID NO: 129156 - protein, 11 aa, Homo Sapiens
RPKGLEGERPA

SEQ ID NO: 129157 - protein, 11 aa, Homo Sapiens
RPKPSSSPVIF

SEQ ID NO: 129158 - protein, 11 aa, Homo Sapiens
RPKSAFKVQNA

SEQ ID NO: 129159 - protein, 11 aa, Homo Sapiens
RPKSSQIGAVV

SEQ ID NO: 129160 - protein, 11 aa, Homo Sapiens
RPLPGALGVAA

SEQ ID NO: 129161 - protein, 11 aa, Homo Sapiens
RPNGVITGLAA

SEQ ID NO: 129162 - protein, 11 aa, Homo Sapiens
RPNSLVGITSA

SEQ ID NO: 129163 - protein, 11 aa, Homo Sapiens
RPRAPIIAVTR

SEQ ID NO: 129164 - protein, 11 aa, Homo Sapiens
RPREALSTNEC

SEQ ID NO: 129165 - protein, 11 aa, Homo Sapiens
RPREVQDPAPA

SEQ ID NO: 129166 - protein, 11 aa, Homo Sapiens
RPSELLAGVKA

SEQ ID NO: 129167 - protein, 11 aa, Homo Sapiens
RPSGAATTTAA

SEQ ID NO: 129168 - protein, 11 aa, Homo Sapiens
RPVTPPRGMIT

SEQ ID NO: 129169 - protein, 11 aa, Homo Sapiens
RQGVDADINGL

SEQ ID NO: 129170 - protein, 11 aa, Homo Sapiens
SAFLPARFYQA

SEQ ID NO: 129171 - protein, 11 aa, Homo Sapiens
SGPSIVHRKCF

SEQ ID NO: 129172 - protein, 11 aa, Homo Sapiens
SPAGSIARNSA

SEQ ID NO: 129173 - protein, 11 aa, Homo Sapiens
SPASTPSCLSA

SEQ ID NO: 129174 - protein, 11 aa, Homo Sapiens
SPCQTDVLRSA

SEQ ID NO: 129175 - protein, 11 aa, Homo Sapiens
SPDEGALVRAA

SEQ ID NO: 129176 - protein, 11 aa, Homo Sapiens
SPDGSRLLFTV

SEQ ID NO: 129177 - protein, 11 aa, Homo Sapiens
SPFPSGSEHSA

SEQ ID NO: 129178 - protein, 11 aa, Homo Sapiens
SPFQPHVPYSP

SEQ ID NO: 129179 - protein, 11 aa, Homo Sapiens
SPFQTPVQSSA

SEQ ID NO: 129180 - protein, 11 aa, Homo Sapiens
SPHAHISEQAV

SEQ ID NO: 129181 - protein, 11 aa, Homo Sapiens
SPHPAIQPLQA

SEQ ID NO: 129182 - protein, 11 aa, Homo Sapiens
SPHPSAAVPAA

SEQ ID NO: 129183 - protein, 11 aa, Homo Sapiens
SPIENIQRVAA

SEQ ID NO: 129184 - protein, 11 aa, Homo Sapiens
SPILVATAVAA

SEQ ID NO: 129185 - protein, 11 aa, Homo Sapiens
SPKPAIKSISA

SEQ ID NO: 129186 - protein, 11 aa, Homo Sapiens
SPLAIIGGNCA

SEQ ID NO: 129187 - protein, 11 aa, Homo Sapiens
SPLDMKDGFLA

SEQ ID NO: 129188 - protein, 11 aa, Homo Sapiens
SPLPDTSLLQV

SEQ ID NO: 129189 - protein, 11 aa, Homo Sapiens
SPLSAAAATAA

SEQ ID NO: 129190 - protein, 11 aa, Homo Sapiens
SPLSTPTSAQA

SEQ ID NO: 129191 - protein, 11 aa, Homo Sapiens
SPMAERSMMSA

SEQ ID NO: 129192 - protein, 11 aa, Homo Sapiens
SPNMANTVNAA

SEQ ID NO: 129193 - protein, 11 aa, Homo Sapiens
SPRHLPSCSPA

SEQ ID NO: 129194 - protein, 11 aa, Homo Sapiens
SPRNLGFETSA

SEQ ID NO: 129195 - protein, 11 aa, Homo Sapiens
SPRNLQPQRAA

SEQ ID NO: 129196 - protein, 11 aa, Homo Sapiens
SPRPALPALLV

SEQ ID NO: 129197 - protein, 11 aa, Homo Sapiens
SPRQSDVMIVA

SEQ ID NO: 129198 - protein, 11 aa, Homo Sapiens
SPRSGQRCWAA

SEQ ID NO: 129199 - protein, 11 aa, Homo Sapiens
SPRTAEGVLAA

SEQ ID NO: 129200 - protein, 11 aa, Homo Sapiens
SPRTPVSPVKF

SEQ ID NO: 129201 - protein, 11 aa, Homo Sapiens
SPSAAITVQRV

SEQ ID NO: 129202 - protein, 11 aa, Homo Sapiens
SPSELFAQHIV

SEQ ID NO: 129203 - protein, 11 aa, Homo Sapiens
SPTSPNALPPA

SEQ ID NO: 129204 - protein, 11 aa, Homo Sapiens
SPVQVPGPVAA

SEQ ID NO: 129205 - protein, 11 aa, Homo Sapiens
SPVRPLVFAAA

SEQ ID NO: 129206 - protein, 11 aa, Homo Sapiens
SPVTLTKGTSA

SEQ ID NO: 129207 - protein, 11 aa, Homo Sapiens
SPYSGPKFNSA

SEQ ID NO: 129208 - protein, 11 aa, Homo Sapiens
TAYKPKYFTSA

SEQ ID NO: 129209 - protein, 11 aa, Homo Sapiens
TPAAAAAMNLA

SEQ ID NO: 129210 - protein, 11 aa, Homo Sapiens
TPAGVIPGQTA

SEQ ID NO: 129211 - protein, 11 aa, Homo Sapiens
TPAPAAEETMN

SEQ ID NO: 129212 - protein, 11 aa, Homo Sapiens
TPDPSTPSRLA

SEQ ID NO: 129213 - protein, 11 aa, Homo Sapiens
TPFYPRSPYGA

SEQ ID NO: 129214 - protein, 11 aa, Homo Sapiens
TPHPVLTPVAA

SEQ ID NO: 129215 - protein, 11 aa, Homo Sapiens
TPHYIYPPAIV

SEQ ID NO: 129216 - protein, 11 aa, Homo Sapiens
TPWPRGRLLTA

SEQ ID NO: 129217 - protein, 11 aa, Homo Sapiens
TPYQSKWTICA

SEQ ID NO: 129218 - protein, 11 aa, Homo Sapiens
VAPGKDLTKTL

SEQ ID NO: 129219 - protein, 11 aa, Homo Sapiens
VPAGGAVAVSA

SEQ ID NO: 129220 - protein, 11 aa, Homo Sapiens
VPFQVPEILRT

SEQ ID NO: 129221 - protein, 11 aa, Homo Sapiens
VPIPWVSGTSA

SEQ ID NO: 129222 - protein, 11 aa, Homo Sapiens
VPITFQVKVTA

SEQ ID NO: 129223 - protein, 11 aa, Homo Sapiens
VPKENSTLNCA

SEQ ID NO: 129224 - protein, 11 aa, Homo Sapiens
VPKPIGGVVVF

SEQ ID NO: 129225 - protein, 11 aa, Homo Sapiens
VPMPSNKDYVV

SEQ ID NO: 129226 - protein, 11 aa, Homo Sapiens
VPRSSDFEDSA

SEQ ID NO: 129227 - protein, 11 aa, Homo Sapiens
VPTNIIAAKAA

SEQ ID NO: 129228 - protein, 11 aa, Homo Sapiens
VPVSLESKKAA

SEQ ID NO: 129229 - protein, 11 aa, Homo Sapiens
VPWMPPGKSSA

SEQ ID NO: 129230 - protein, 11 aa, Homo Sapiens
VPYPLPKIDLI

SEQ ID NO: 129231 - protein, 11 aa, Homo Sapiens
VTIKKDVDGAY

SEQ ID NO: 129232 - protein, 11 aa, Homo Sapiens
YDKKGPAAIQK

SEQ ID NO: 129233 - protein, 11 aa, Homo Sapiens
YPFSAGLPPAA

SEQ ID NO: 129234 - protein, 11 aa, Homo Sapiens
YPFSSEQKWMA

SEQ ID NO: 129235 - protein, 11 aa, Homo Sapiens
YPIGTNAIVAV

SEQ ID NO: 129236 - protein, 11 aa, Homo Sapiens
YPKACLQGITF

SEQ ID NO: 129237 - protein, 11 aa, Homo Sapiens
YPLLLPKGVVL

SEQ ID NO: 129238 - protein, 11 aa, Homo Sapiens
YPLPLRSGKEA

SEQ ID NO: 129239 - protein, 11 aa, Homo Sapiens
YVMPSSSARCA

SEQ ID NO: 129240 - protein, 8 aa, Homo Sapiens
EQYKINIY

SEQ ID NO: 129241 - protein, 8 aa, Homo Sapiens
FSFRSFIW

SEQ ID NO: 129242 - protein, 8 aa, Homo Sapiens
GSKFPVRW

SEQ ID NO: 129243 - protein, 8 aa, Homo Sapiens
HSGPFFTF

SEQ ID NO: 129244 - protein, 8 aa, Homo Sapiens
IAFLHALW

SEQ ID NO: 129245 - protein, 8 aa, Homo Sapiens
IAKIPNFW

SEQ ID NO: 129246 - protein, 8 aa, Homo Sapiens
ITAHPERW

SEQ ID NO: 129247 - protein, 8 aa, Homo Sapiens
ITKYPVLF

SEQ ID NO: 129248 - protein, 8 aa, Homo Sapiens
ITTEGKLW

SEQ ID NO: 129249 - protein, 8 aa, Homo Sapiens
KARLPLRL

SEQ ID NO: 129250 - protein, 8 aa, Homo Sapiens
KSFVLPSW

SEQ ID NO: 129251 - protein, 8 aa, Homo Sapiens
KVRDPRPW

SEQ ID NO: 129252 - protein, 8 aa, Homo Sapiens
LTGPWKLW

SEQ ID NO: 129253 - protein, 8 aa, Homo Sapiens
RIKVPVDW

SEQ ID NO: 129254 - protein, 8 aa, Homo Sapiens
RTRIGYSF

SEQ ID NO: 129255 - protein, 8 aa, Homo Sapiens
SFTTTAER

SEQ ID NO: 129256 - protein, 8 aa, Homo Sapiens
TAGAHRLW

SEQ ID NO: 129257 - protein, 8 aa, Homo Sapiens
TTKAISRW

SEQ ID NO: 129258 - protein, 8 aa, Homo Sapiens
VSDLPRQW

SEQ ID NO: 129259 - protein, 8 aa, Homo Sapiens
VSIKAIGW

SEQ ID NO: 129260 - protein, 8 aa, Homo Sapiens
VSRIPVSF

SEQ ID NO: 129261 - protein, 8 aa, Homo Sapiens
VTRLPIKW

SEQ ID NO: 129262 - protein, 8 aa, Homo Sapiens
VTRQGALW

SEQ ID NO: 129263 - protein, 9 aa, Homo Sapiens
AADETLRLW

SEQ ID NO: 129264 - protein, 9 aa, Homo Sapiens
AAEERPWLW

SEQ ID NO: 129265 - protein, 9 aa, Homo Sapiens
AAKAVLADW

SEQ ID NO: 129266 - protein, 9 aa, Homo Sapiens
AALPAAALW

SEQ ID NO: 129267 - protein, 9 aa, Homo Sapiens
AALTIIRYY

SEQ ID NO: 129268 - protein, 9 aa, Homo Sapiens
AALVIQKYW

SEQ ID NO: 129269 - protein, 9 aa, Homo Sapiens
AALVLQTIW

SEQ ID NO: 129270 - protein, 9 aa, Homo Sapiens
AANPHSFVF

SEQ ID NO: 129271 - protein, 9 aa, Homo Sapiens
AARTIQTAF

SEQ ID NO: 129272 - protein, 9 aa, Homo Sapiens
AARTWLGVW

SEQ ID NO: 129273 - protein, 9 aa, Homo Sapiens
ALGRPLPRW

SEQ ID NO: 129274 - protein, 9 aa, Homo Sapiens
ALRVLNSYW

SEQ ID NO: 129275 - protein, 9 aa, Homo Sapiens
ASAIIIQRW

SEQ ID NO: 129276 - protein, 9 aa, Homo Sapiens
ASAILFREW

SEQ ID NO: 129277 - protein, 9 aa, Homo Sapiens
ASFDGTFLW

SEQ ID NO: 129278 - protein, 9 aa, Homo Sapiens
ASFIGGIRW

SEQ ID NO: 129279 - protein, 9 aa, Homo Sapiens
ASHKGQKLW

SEQ ID NO: 129280 - protein, 9 aa, Homo Sapiens
ASLDISRKW

SEQ ID NO: 129281 - protein, 9 aa, Homo Sapiens
ASLGMILLW

SEQ ID NO: 129282 - protein, 9 aa, Homo Sapiens
ASLPEAQVW

SEQ ID NO: 129283 - protein, 9 aa, Homo Sapiens
ASLPLRVSF

SEQ ID NO: 129284 - protein, 9 aa, Homo Sapiens
ASMLIKALW

SEQ ID NO: 129285 - protein, 9 aa, Homo Sapiens
ASNYFRAMF

SEQ ID NO: 129286 - protein, 9 aa, Homo Sapiens
ASVSTVQLW

SEQ ID NO: 129287 - protein, 9 aa, Homo Sapiens
ASWVSELLW

SEQ ID NO: 129288 - protein, 9 aa, Homo Sapiens
ATADVEWRW

SEQ ID NO: 129289 - protein, 9 aa, Homo Sapiens
ATANEIHFW

SEQ ID NO: 129290 - protein, 9 aa, Homo Sapiens
ATDAAIRVW

SEQ ID NO: 129291 - protein, 9 aa, Homo Sapiens
ATFIVTNYW

SEQ ID NO: 129292 - protein, 9 aa, Homo Sapiens
ATHRIPIIW

SEQ ID NO: 129293 - protein, 9 aa, Homo Sapiens
ATIKEIVVW

SEQ ID NO: 129294 - protein, 9 aa, Homo Sapiens
ATIPNARQF

SEQ ID NO: 129295 - protein, 9 aa, Homo Sapiens
ATIRLIFHW

SEQ ID NO: 129296 - protein, 9 aa, Homo Sapiens
ATKKEITFF

SEQ ID NO: 129297 - protein, 9 aa, Homo Sapiens
ATLELTHNW

SEQ ID NO: 129298 - protein, 9 aa, Homo Sapiens
ATLKNPILW

SEQ ID NO: 129299 - protein, 9 aa, Homo Sapiens
ATNGVVVTW

SEQ ID NO: 129300 - protein, 9 aa, Homo Sapiens
ATNRITVTW

SEQ ID NO: 129301 - protein, 9 aa, Homo Sapiens
ATNVNNWHW

SEQ ID NO: 129302 - protein, 9 aa, Homo Sapiens
ATRPDYISW

SEQ ID NO: 129303 - protein, 9 aa, Homo Sapiens
ATSKYLIGW

SEQ ID NO: 129304 - protein, 9 aa, Homo Sapiens
ATVILQRAF

SEQ ID NO: 129305 - protein, 9 aa, Homo Sapiens
ATYMKPEMW

SEQ ID NO: 129306 - protein, 9 aa, Homo Sapiens
AVLALAASW

SEQ ID NO: 129307 - protein, 9 aa, Homo Sapiens
AVLPSRVYW

SEQ ID NO: 129308 - protein, 9 aa, Homo Sapiens
AVLQKVALW

SEQ ID NO: 129309 - protein, 9 aa, Homo Sapiens
AVWTRAYGW

SEQ ID NO: 129310 - protein, 9 aa, Homo Sapiens
ETLKLISGW

SEQ ID NO: 129311 - protein, 9 aa, Homo Sapiens
FADSTVRVW

SEQ ID NO: 129312 - protein, 9 aa, Homo Sapiens
FAVKLFKSW

SEQ ID NO: 129313 - protein, 9 aa, Homo Sapiens
FSEKFPTLW

SEQ ID NO: 129314 - protein, 9 aa, Homo Sapiens
FSFAEVHSW

SEQ ID NO: 129315 - protein, 9 aa, Homo Sapiens
FSFQIDRSW

SEQ ID NO: 129316 - protein, 9 aa, Homo Sapiens
FSKSDLVNW

SEQ ID NO: 129317 - protein, 9 aa, Homo Sapiens
FSLPAQPLW

SEQ ID NO: 129318 - protein, 9 aa, Homo Sapiens
FSLPNIPRW

SEQ ID NO: 129319 - protein, 9 aa, Homo Sapiens
FSRDLFIQW

SEQ ID NO: 129320 - protein, 9 aa, Homo Sapiens
FSYRDVNSW

SEQ ID NO: 129321 - protein, 9 aa, Homo Sapiens
FTKPPIGTW

SEQ ID NO: 129322 - protein, 9 aa, Homo Sapiens
FVKKLEHSW

SEQ ID NO: 129323 - protein, 9 aa, Homo Sapiens
GSASVNSRW

SEQ ID NO: 129324 - protein, 9 aa, Homo Sapiens
GSMGLRSLW

SEQ ID NO: 129325 - protein, 9 aa, Homo Sapiens
GTALLPHQW

SEQ ID NO: 129326 - protein, 9 aa, Homo Sapiens
GTFNPVSLW

SEQ ID NO: 129327 - protein, 9 aa, Homo Sapiens
GTFRGTRYF

SEQ ID NO: 129328 - protein, 9 aa, Homo Sapiens
GTHKVTVLF

SEQ ID NO: 129329 - protein, 9 aa, Homo Sapiens
GTHSLDIKW

SEQ ID NO: 129330 - protein, 9 aa, Homo Sapiens
GTIPERPGW

SEQ ID NO: 129331 - protein, 9 aa, Homo Sapiens
GTKWIANNW

SEQ ID NO: 129332 - protein, 9 aa, Homo Sapiens
GTLKERVQW

SEQ ID NO: 129333 - protein, 9 aa, Homo Sapiens
GTLKGHNGW

SEQ ID NO: 129334 - protein, 9 aa, Homo Sapiens
GTLSGHASW

SEQ ID NO: 129335 - protein, 9 aa, Homo Sapiens
GTMDIRHFF

SEQ ID NO: 129336 - protein, 9 aa, Homo Sapiens
GTMPLRNIF

SEQ ID NO: 129337 - protein, 9 aa, Homo Sapiens
GTVITPDTW

SEQ ID NO: 129338 - protein, 9 aa, Homo Sapiens
GTVLKIITF

SEQ ID NO: 129339 - protein, 9 aa, Homo Sapiens
GTYGVRAAW

SEQ ID NO: 129340 - protein, 9 aa, Homo Sapiens
GTYSPEISW

SEQ ID NO: 129341 - protein, 9 aa, Homo Sapiens
HADINLLYW

SEQ ID NO: 129342 - protein, 9 aa, Homo Sapiens
HAGNINFKW

SEQ ID NO: 129343 - protein, 9 aa, Homo Sapiens
HAGPIVSVW

SEQ ID NO: 129344 - protein, 9 aa, Homo Sapiens
HAHYIAQCW

SEQ ID NO: 129345 - protein, 9 aa, Homo Sapiens
HALALAWTF

SEQ ID NO: 129346 - protein, 9 aa, Homo Sapiens
HGLQETWYW

SEQ ID NO: 129347 - protein, 9 aa, Homo Sapiens
HLREIESRW

SEQ ID NO: 129348 - protein, 9 aa, Homo Sapiens
HSFLYQPDW

SEQ ID NO: 129349 - protein, 9 aa, Homo Sapiens
HSHFQNIFW

SEQ ID NO: 129350 - protein, 9 aa, Homo Sapiens
HSKELITAW

SEQ ID NO: 129351 - protein, 9 aa, Homo Sapiens
HSKPTTRDW

SEQ ID NO: 129352 - protein, 9 aa, Homo Sapiens
HSLESQVTF

SEQ ID NO: 129353 - protein, 9 aa, Homo Sapiens
HSQVCSILW

SEQ ID NO: 129354 - protein, 9 aa, Homo Sapiens
HSSGILPKW

SEQ ID NO: 129355 - protein, 9 aa, Homo Sapiens
HSTLVPHEW

SEQ ID NO: 129356 - protein, 9 aa, Homo Sapiens
HSYFWPLEW

SEQ ID NO: 129357 - protein, 9 aa, Homo Sapiens
HTFWGVVFF

SEQ ID NO: 129358 - protein, 9 aa, Homo Sapiens
HTGCFATIW

SEQ ID NO: 129359 - protein, 9 aa, Homo Sapiens
HTKIPFINW

SEQ ID NO: 129360 - protein, 9 aa, Homo Sapiens
HTLDINVRW

SEQ ID NO: 129361 - protein, 9 aa, Homo Sapiens
HTVGLSSTW

SEQ ID NO: 129362 - protein, 9 aa, Homo Sapiens
HTVWESEEW

SEQ ID NO: 129363 - protein, 9 aa, Homo Sapiens
HTWNGIRHL

SEQ ID NO: 129364 - protein, 9 aa, Homo Sapiens
HVRSIVDNW

SEQ ID NO: 129365 - protein, 9 aa, Homo Sapiens
IAAIIVSQW

SEQ ID NO: 129366 - protein, 9 aa, Homo Sapiens
IAAQRTINW

SEQ ID NO: 129367 - protein, 9 aa, Homo Sapiens
IAAQTGTRW

SEQ ID NO: 129368 - protein, 9 aa, Homo Sapiens
IAFFDVRTF

SEQ ID NO: 129369 - protein, 9 aa, Homo Sapiens
IAHLFNVEW

SEQ ID NO: 129370 - protein, 9 aa, Homo Sapiens
IAKVNNVVW

SEQ ID NO: 129371 - protein, 9 aa, Homo Sapiens
IALPPIAKW

SEQ ID NO: 129372 - protein, 9 aa, Homo Sapiens
IARDFNPNW

SEQ ID NO: 129373 - protein, 9 aa, Homo Sapiens
IAVPRNDEW

SEQ ID NO: 129374 - protein, 9 aa, Homo Sapiens
IGYVDTTHW

SEQ ID NO: 129375 - protein, 9 aa, Homo Sapiens
IIISTPEKW

SEQ ID NO: 129376 - protein, 9 aa, Homo Sapiens
IIMKDVPDW

SEQ ID NO: 129377 - protein, 9 aa, Homo Sapiens
IIRPQNVSW

SEQ ID NO: 129378 - protein, 9 aa, Homo Sapiens
ILRPPVEKW

SEQ ID NO: 129379 - protein, 9 aa, Homo Sapiens
ISADVHGIW

SEQ ID NO: 129380 - protein, 9 aa, Homo Sapiens
ISAIPEQRW

SEQ ID NO: 129381 - protein, 9 aa, Homo Sapiens
ISGHHPETW

SEQ ID NO: 129382 - protein, 9 aa, Homo Sapiens
ISGIKDFSW

SEQ ID NO: 129383 - protein, 9 aa, Homo Sapiens
ISGVHTVRF

SEQ ID NO: 129384 - protein, 9 aa, Homo Sapiens
ISIPIGFLF

SEQ ID NO: 129385 - protein, 9 aa, Homo Sapiens
ISKALVAYY

SEQ ID NO: 129386 - protein, 9 aa, Homo Sapiens
ISKEEAMRW

SEQ ID NO: 129387 - protein, 9 aa, Homo Sapiens
ISLLPKTSW

SEQ ID NO: 129388 - protein, 9 aa, Homo Sapiens
ISMASVAHW

SEQ ID NO: 129389 - protein, 9 aa, Homo Sapiens
ISMDPKVGW

SEQ ID NO: 129390 - protein, 9 aa, Homo Sapiens
ISMPAQNLW

SEQ ID NO: 129391 - protein, 9 aa, Homo Sapiens
ISRAVVLVF

SEQ ID NO: 129392 - protein, 9 aa, Homo Sapiens
ISRPIVNLF

SEQ ID NO: 129393 - protein, 9 aa, Homo Sapiens
ISSTVQRQL

SEQ ID NO: 129394 - protein, 9 aa, Homo Sapiens
ISTPVIRTF

SEQ ID NO: 129395 - protein, 9 aa, Homo Sapiens
ISVAEVEKW

SEQ ID NO: 129396 - protein, 9 aa, Homo Sapiens
ISVILGDRW

SEQ ID NO: 129397 - protein, 9 aa, Homo Sapiens
ISVPIFKQF

SEQ ID NO: 129398 - protein, 9 aa, Homo Sapiens
ISVPPIQKW

SEQ ID NO: 129399 - protein, 9 aa, Homo Sapiens
ISWGQGHFW

SEQ ID NO: 129400 - protein, 9 aa, Homo Sapiens
ITAGAHRLW

SEQ ID NO: 129401 - protein, 9 aa, Homo Sapiens
ITFPGIKLI

SEQ ID NO: 129402 - protein, 9 aa, Homo Sapiens
ITGPWRSLW

SEQ ID NO: 129403 - protein, 9 aa, Homo Sapiens
ITHIVNQNF

SEQ ID NO: 129404 - protein, 9 aa, Homo Sapiens
ITIPKNMHW

SEQ ID NO: 129405 - protein, 9 aa, Homo Sapiens
ITKDVVLQW

SEQ ID NO: 129406 - protein, 9 aa, Homo Sapiens
ITKTVVENI

SEQ ID NO: 129407 - protein, 9 aa, Homo Sapiens
ITNKYQLVF

SEQ ID NO: 129408 - protein, 9 aa, Homo Sapiens
ITSPVHVSF

SEQ ID NO: 129409 - protein, 9 aa, Homo Sapiens
ITTDVLYTI

SEQ ID NO: 129410 - protein, 9 aa, Homo Sapiens
ITTKAISRW

SEQ ID NO: 129411 - protein, 9 aa, Homo Sapiens
ITTSLTTKW

SEQ ID NO: 129412 - protein, 9 aa, Homo Sapiens
ITTTINPRF

SEQ ID NO: 129413 - protein, 9 aa, Homo Sapiens
ITTVIQHVF

SEQ ID NO: 129414 - protein, 9 aa, Homo Sapiens
ITTVVVQTF

SEQ ID NO: 129415 - protein, 9 aa, Homo Sapiens
ITVVSEKQF

SEQ ID NO: 129416 - protein, 9 aa, Homo Sapiens
ITYDKLNKW

SEQ ID NO: 129417 - protein, 9 aa, Homo Sapiens
ITYQHIDRW

SEQ ID NO: 129418 - protein, 9 aa, Homo Sapiens
ITYTFHSTW

SEQ ID NO: 129419 - protein, 9 aa, Homo Sapiens
KAAAILEAW

SEQ ID NO: 129420 - protein, 9 aa, Homo Sapiens
KAFDRPSLF

SEQ ID NO: 129421 - protein, 9 aa, Homo Sapiens
KAFELELSW

SEQ ID NO: 129422 - protein, 9 aa, Homo Sapiens
KAFLGGLNW

SEQ ID NO: 129423 - protein, 9 aa, Homo Sapiens
KAFLGLFFI

SEQ ID NO: 129424 - protein, 9 aa, Homo Sapiens
KAFNLRISF

SEQ ID NO: 129425 - protein, 9 aa, Homo Sapiens
KAFPFHIIF

SEQ ID NO: 129426 - protein, 9 aa, Homo Sapiens
KAGIIQDTW

SEQ ID NO: 129427 - protein, 9 aa, Homo Sapiens
KAGQVVTIW

SEQ ID NO: 129428 - protein, 9 aa, Homo Sapiens
KAIEKNVLF

SEQ ID NO: 129429 - protein, 9 aa, Homo Sapiens
KAIELLQEF

SEQ ID NO: 129430 - protein, 9 aa, Homo Sapiens
KAIGLFISF

SEQ ID NO: 129431 - protein, 9 aa, Homo Sapiens
KAINPINTF

SEQ ID NO: 129432 - protein, 9 aa, Homo Sapiens
KAKDIIRFL

SEQ ID NO: 129433 - protein, 9 aa, Homo Sapiens
KAKDLILRF

SEQ ID NO: 129434 - protein, 9 aa, Homo Sapiens
KAKEIYMTF

SEQ ID NO: 129435 - protein, 9 aa, Homo Sapiens
KAKTNVKLW

SEQ ID NO: 129436 - protein, 9 aa, Homo Sapiens
KALEVFPEF

SEQ ID NO: 129437 - protein, 9 aa, Homo Sapiens
KALSMPEKW

SEQ ID NO: 129438 - protein, 9 aa, Homo Sapiens
KALTLSVVF

SEQ ID NO: 129439 - protein, 9 aa, Homo Sapiens
KAMELIREL

SEQ ID NO: 129440 - protein, 9 aa, Homo Sapiens
KAMGIMNSF

SEQ ID NO: 129441 - protein, 9 aa, Homo Sapiens
KAMTGVEQW

SEQ ID NO: 129442 - protein, 9 aa, Homo Sapiens
KARLPLRLF

SEQ ID NO: 129443 - protein, 9 aa, Homo Sapiens
KASPTQNLF

SEQ ID NO: 129444 - protein, 9 aa, Homo Sapiens
KATDILPKW

SEQ ID NO: 129445 - protein, 9 aa, Homo Sapiens
KATPIKLIW

SEQ ID NO: 129446 - protein, 9 aa, Homo Sapiens
KAVFLVPKW

SEQ ID NO: 129447 - protein, 9 aa, Homo Sapiens
KAVSLFLCY

SEQ ID NO: 129448 - protein, 9 aa, Homo Sapiens
KIIFIDSTW

SEQ ID NO: 129449 - protein, 9 aa, Homo Sapiens
KIIPKTLTW

SEQ ID NO: 129450 - protein, 9 aa, Homo Sapiens
KIISTLPSW

SEQ ID NO: 129451 - protein, 9 aa, Homo Sapiens
KISNIIKQF

SEQ ID NO: 129452 - protein, 9 aa, Homo Sapiens
KLFDIRPIW

SEQ ID NO: 129453 - protein, 9 aa, Homo Sapiens
KLKDIRNAW

SEQ ID NO: 129454 - protein, 9 aa, Homo Sapiens
KSALVFITF

SEQ ID NO: 129455 - protein, 9 aa, Homo Sapiens
KSFADINLY

SEQ ID NO: 129456 - protein, 9 aa, Homo Sapiens
KSFDFHFGF

SEQ ID NO: 129457 - protein, 9 aa, Homo Sapiens
KSFDNIRNW

SEQ ID NO: 129458 - protein, 9 aa, Homo Sapiens
KSFEGLFYF

SEQ ID NO: 129459 - protein, 9 aa, Homo Sapiens
KSFENISKW

SEQ ID NO: 129460 - protein, 9 aa, Homo Sapiens
KSFMDFGSW

SEQ ID NO: 129461 - protein, 9 aa, Homo Sapiens
KSFVKVYNY

SEQ ID NO: 129462 - protein, 9 aa, Homo Sapiens
KSGELLATW

SEQ ID NO: 129463 - protein, 9 aa, Homo Sapiens
KSGSVQEQW

SEQ ID NO: 129464 - protein, 9 aa, Homo Sapiens
KSIDLIQKW

SEQ ID NO: 129465 - protein, 9 aa, Homo Sapiens
KSIHIVVTM

SEQ ID NO: 129466 - protein, 9 aa, Homo Sapiens
KSKDFVQVM

SEQ ID NO: 129467 - protein, 9 aa, Homo Sapiens
KSLALLLGY

SEQ ID NO: 129468 - protein, 9 aa, Homo Sapiens
KSLALLLNY

SEQ ID NO: 129469 - protein, 9 aa, Homo Sapiens
KSLEEIYLF

SEQ ID NO: 129470 - protein, 9 aa, Homo Sapiens
KSLENAIEW

SEQ ID NO: 129471 - protein, 9 aa, Homo Sapiens
KSLGVTTKF

SEQ ID NO: 129472 - protein, 9 aa, Homo Sapiens
KSLPDTELM

SEQ ID NO: 129473 - protein, 9 aa, Homo Sapiens
KSQDLELSW

SEQ ID NO: 129474 - protein, 9 aa, Homo Sapiens
KSSDIAKTF

SEQ ID NO: 129475 - protein, 9 aa, Homo Sapiens
KSSEVFTTF

SEQ ID NO: 129476 - protein, 9 aa, Homo Sapiens
KSTDVAKTF

SEQ ID NO: 129477 - protein, 9 aa, Homo Sapiens
KSVTAFFKW

SEQ ID NO: 129478 - protein, 9 aa, Homo Sapiens
KSVTLGYLF

SEQ ID NO: 129479 - protein, 9 aa, Homo Sapiens
KSWGLILLF

SEQ ID NO: 129480 - protein, 9 aa, Homo Sapiens
KSWVFGVHF

SEQ ID NO: 129481 - protein, 9 aa, Homo Sapiens
KSYVQGVTW

SEQ ID NO: 129482 - protein, 9 aa, Homo Sapiens
KTAEDMNLF

SEQ ID NO: 129483 - protein, 9 aa, Homo Sapiens
KTAEELMNF

SEQ ID NO: 129484 - protein, 9 aa, Homo Sapiens
KTAPFDSRF

SEQ ID NO: 129485 - protein, 9 aa, Homo Sapiens
KTFLFSATM

SEQ ID NO: 129486 - protein, 9 aa, Homo Sapiens
KTFLIPVLF

SEQ ID NO: 129487 - protein, 9 aa, Homo Sapiens
KTFPYQHRY

SEQ ID NO: 129488 - protein, 9 aa, Homo Sapiens
KTGETMIQW

SEQ ID NO: 129489 - protein, 9 aa, Homo Sapiens
KTHPLWRLW

SEQ ID NO: 129490 - protein, 9 aa, Homo Sapiens
KTILPLINF

SEQ ID NO: 129491 - protein, 9 aa, Homo Sapiens
KTKEVIQEW

SEQ ID NO: 129492 - protein, 9 aa, Homo Sapiens
KTKIDIIRM

SEQ ID NO: 129493 - protein, 9 aa, Homo Sapiens
KTLELPHVF

SEQ ID NO: 129494 - protein, 9 aa, Homo Sapiens
KTLIEPFTL

SEQ ID NO: 129495 - protein, 9 aa, Homo Sapiens
KTLPDILTF

SEQ ID NO: 129496 - protein, 9 aa, Homo Sapiens
KTQGPRALW

SEQ ID NO: 129497 - protein, 9 aa, Homo Sapiens
KTRIIDVVY

SEQ ID NO: 129498 - protein, 9 aa, Homo Sapiens
KTRPLIPEM

SEQ ID NO: 129499 - protein, 9 aa, Homo Sapiens
KTRQIISTI

SEQ ID NO: 129500 - protein, 9 aa, Homo Sapiens
KTRTNVPTF

SEQ ID NO: 129501 - protein, 9 aa, Homo Sapiens
KTRYIFDLF

SEQ ID NO: 129502 - protein, 9 aa, Homo Sapiens
KTVVKELTW

SEQ ID NO: 129503 - protein, 9 aa, Homo Sapiens
KVIEINPYL

SEQ ID NO: 129504 - protein, 9 aa, Homo Sapiens
KVKPNLQTF

SEQ ID NO: 129505 - protein, 9 aa, Homo Sapiens
KVLELQRKL

SEQ ID NO: 129506 - protein, 9 aa, Homo Sapiens
KVLIDIREY

SEQ ID NO: 129507 - protein, 9 aa, Homo Sapiens
KVLPIIQRW

SEQ ID NO: 129508 - protein, 9 aa, Homo Sapiens
KVPQVSTPT

SEQ ID NO: 129509 - protein, 9 aa, Homo Sapiens
KVQDITMQW

SEQ ID NO: 129510 - protein, 9 aa, Homo Sapiens
KVSDLPRQW

SEQ ID NO: 129511 - protein, 9 aa, Homo Sapiens
KVSVYLQNW

SEQ ID NO: 129512 - protein, 9 aa, Homo Sapiens
KVTELLRTF

SEQ ID NO: 129513 - protein, 9 aa, Homo Sapiens
KVVDVVRNL

SEQ ID NO: 129514 - protein, 9 aa, Homo Sapiens
KVVEIVKKL

SEQ ID NO: 129515 - protein, 9 aa, Homo Sapiens
KVWKAPSSW

SEQ ID NO: 129516 - protein, 9 aa, Homo Sapiens
KVYFIYEGY

SEQ ID NO: 129517 - protein, 9 aa, Homo Sapiens
LAALKLDEW

SEQ ID NO: 129518 - protein, 9 aa, Homo Sapiens
LAALRHAKW

SEQ ID NO: 129519 - protein, 9 aa, Homo Sapiens
LAAVRGEQW

SEQ ID NO: 129520 - protein, 9 aa, Homo Sapiens
LAKGWAPTF

SEQ ID NO: 129521 - protein, 9 aa, Homo Sapiens
LALVKPEVW

SEQ ID NO: 129522 - protein, 9 aa, Homo Sapiens
LANKLYERW

SEQ ID NO: 129523 - protein, 9 aa, Homo Sapiens
LATKIQAAW

SEQ ID NO: 129524 - protein, 9 aa, Homo Sapiens
LATTILQHW

SEQ ID NO: 129525 - protein, 9 aa, Homo Sapiens
LAWQNPPGW

SEQ ID NO: 129526 - protein, 9 aa, Homo Sapiens
LAWQNPSGW

SEQ ID NO: 129527 - protein, 9 aa, Homo Sapiens
LGRPDAEYW

SEQ ID NO: 129528 - protein, 9 aa, Homo Sapiens
LIRELFPTW

SEQ ID NO: 129529 - protein, 9 aa, Homo Sapiens
LQLPLHPSW

SEQ ID NO: 129530 - protein, 9 aa, Homo Sapiens
LSAFLPARF

SEQ ID NO: 129531 - protein, 9 aa, Homo Sapiens
LSFLGGIRW

SEQ ID NO: 129532 - protein, 9 aa, Homo Sapiens
LSFPTTKTY

SEQ ID NO: 129533 - protein, 9 aa, Homo Sapiens
LSGPFVQKW

SEQ ID NO: 129534 - protein, 9 aa, Homo Sapiens
LSIHLQHKF

SEQ ID NO: 129535 - protein, 9 aa, Homo Sapiens
LSKKLVVRW

SEQ ID NO: 129536 - protein, 9 aa, Homo Sapiens
LSKPNPPSL

SEQ ID NO: 129537 - protein, 9 aa, Homo Sapiens
LSKSDHSFF

SEQ ID NO: 129538 - protein, 9 aa, Homo Sapiens
LSLGVVKEF

SEQ ID NO: 129539 - protein, 9 aa, Homo Sapiens
LSNTVMPRF

SEQ ID NO: 129540 - protein, 9 aa, Homo Sapiens
LSQEQLRQW

SEQ ID NO: 129541 - protein, 9 aa, Homo Sapiens
LSQPKIVKW

SEQ ID NO: 129542 - protein, 9 aa, Homo Sapiens
LSRELFESW

SEQ ID NO: 129543 - protein, 9 aa, Homo Sapiens
LSSSVIREL

SEQ ID NO: 129544 - protein, 9 aa, Homo Sapiens
LSSTEILKW

SEQ ID NO: 129545 - protein, 9 aa, Homo Sapiens
LSTLVRPVF

SEQ ID NO: 129546 - protein, 9 aa, Homo Sapiens
LSVPSPFTW

SEQ ID NO: 129547 - protein, 9 aa, Homo Sapiens
LTAKVFRTY

SEQ ID NO: 129548 - protein, 9 aa, Homo Sapiens
LTIDHVPIW

SEQ ID NO: 129549 - protein, 9 aa, Homo Sapiens
LTKPFEYLF

SEQ ID NO: 129550 - protein, 9 aa, Homo Sapiens
LTLPVNHIF

SEQ ID NO: 129551 - protein, 9 aa, Homo Sapiens
LTPVVVTLW

SEQ ID NO: 129552 - protein, 9 aa, Homo Sapiens
LTRPGSSYF

SEQ ID NO: 129553 - protein, 9 aa, Homo Sapiens
LTRTELETL

SEQ ID NO: 129554 - protein, 9 aa, Homo Sapiens
LTRVEVTEF

SEQ ID NO: 129555 - protein, 9 aa, Homo Sapiens
LTSPDSEKW

SEQ ID NO: 129556 - protein, 9 aa, Homo Sapiens
LTSTLQQDW

SEQ ID NO: 129557 - protein, 9 aa, Homo Sapiens
LTSTLQVFF

SEQ ID NO: 129558 - protein, 9 aa, Homo Sapiens
LTVLVPRVW

SEQ ID NO: 129559 - protein, 9 aa, Homo Sapiens
LTVQVARVY

SEQ ID NO: 129560 - protein, 9 aa, Homo Sapiens
LTVRNLPQY

SEQ ID NO: 129561 - protein, 9 aa, Homo Sapiens
LTVVFENNW

SEQ ID NO: 129562 - protein, 9 aa, Homo Sapiens
LTYENVERW

SEQ ID NO: 129563 - protein, 9 aa, Homo Sapiens
LVHAVQALW

SEQ ID NO: 129564 - protein, 9 aa, Homo Sapiens
LVWKAQNTW

SEQ ID NO: 129565 - protein, 9 aa, Homo Sapiens
MSERQVALW

SEQ ID NO: 129566 - protein, 9 aa, Homo Sapiens
MSLPYRLVF

SEQ ID NO: 129567 - protein, 9 aa, Homo Sapiens
MSLRLNEQY

SEQ ID NO: 129568 - protein, 9 aa, Homo Sapiens
MSMVANLLY

SEQ ID NO: 129569 - protein, 9 aa, Homo Sapiens
MTHGVLEEW

SEQ ID NO: 129570 - protein, 9 aa, Homo Sapiens
MTLKDIYTW

SEQ ID NO: 129571 - protein, 9 aa, Homo Sapiens
MTNGFHMTW

SEQ ID NO: 129572 - protein, 9 aa, Homo Sapiens
NSSAVLLQW

SEQ ID NO: 129573 - protein, 9 aa, Homo Sapiens
NTAVVPQGW

SEQ ID NO: 129574 - protein, 9 aa, Homo Sapiens
QAAERPQEW

SEQ ID NO: 129575 - protein, 9 aa, Homo Sapiens
QAFPNTNRW

SEQ ID NO: 129576 - protein, 9 aa, Homo Sapiens
QSAKEQIKW

SEQ ID NO: 129577 - protein, 9 aa, Homo Sapiens
QSGIVQLLW

SEQ ID NO: 129578 - protein, 9 aa, Homo Sapiens
QSLANLIRW

SEQ ID NO: 129579 - protein, 9 aa, Homo Sapiens
QSLNMVKYW

SEQ ID NO: 129580 - protein, 9 aa, Homo Sapiens
QSLQIFRKW

SEQ ID NO: 129581 - protein, 9 aa, Homo Sapiens
QSQIKGYVW

SEQ ID NO: 129582 - protein, 9 aa, Homo Sapiens
QSSGLVRHW

SEQ ID NO: 129583 - protein, 9 aa, Homo Sapiens
QTFLSEIRW

SEQ ID NO: 129584 - protein, 9 aa, Homo Sapiens
QTFRLYREY

SEQ ID NO: 129585 - protein, 9 aa, Homo Sapiens
QTFSSKTEW

SEQ ID NO: 129586 - protein, 9 aa, Homo Sapiens
QTVSPAEKW

SEQ ID NO: 129587 - protein, 9 aa, Homo Sapiens
QTYYRIFTW

SEQ ID NO: 129588 - protein, 9 aa, Homo Sapiens
RAADVLVYL

SEQ ID NO: 129589 - protein, 9 aa, Homo Sapiens
RAAIMQALW

SEQ ID NO: 129590 - protein, 9 aa, Homo Sapiens
RAAPFSLEY

SEQ ID NO: 129591 - protein, 9 aa, Homo Sapiens
RAFHPDLEF

SEQ ID NO: 129592 - protein, 9 aa, Homo Sapiens
RAKAIIVEF

SEQ ID NO: 129593 - protein, 9 aa, Homo Sapiens
RALAHYRWW

SEQ ID NO: 129594 - protein, 9 aa, Homo Sapiens
RARELLVSY

SEQ ID NO: 129595 - protein, 9 aa, Homo Sapiens
RAVQLQELW

SEQ ID NO: 129596 - protein, 9 aa, Homo Sapiens
RAYPFHWAW

SEQ ID NO: 129597 - protein, 9 aa, Homo Sapiens
RGAQVEEIW

SEQ ID NO: 129598 - protein, 9 aa, Homo Sapiens
RILVDQQVW

SEQ ID NO: 129599 - protein, 9 aa, Homo Sapiens
RIVEPYVTW

SEQ ID NO: 129600 - protein, 9 aa, Homo Sapiens
RLIPERTVW

SEQ ID NO: 129601 - protein, 9 aa, Homo Sapiens
RMFAPTKTW

SEQ ID NO: 129602 - protein, 9 aa, Homo Sapiens
RMFLENETW

SEQ ID NO: 129603 - protein, 9 aa, Homo Sapiens
RMNEVISLW

SEQ ID NO: 129604 - protein, 9 aa, Homo Sapiens
RNVSTGDVN

SEQ ID NO: 129605 - protein, 9 aa, Homo Sapiens
RSAVFSVTY

SEQ ID NO: 129606 - protein, 9 aa, Homo Sapiens
RSFDLGRQF

SEQ ID NO: 129607 - protein, 9 aa, Homo Sapiens
RSFLTKLEW

SEQ ID NO: 129608 - protein, 9 aa, Homo Sapiens
RSFPGFQAF

SEQ ID NO: 129609 - protein, 9 aa, Homo Sapiens
RSFPSVREL

SEQ ID NO: 129610 - protein, 9 aa, Homo Sapiens
RSGPFGQIF

SEQ ID NO: 129611 - protein, 9 aa, Homo Sapiens
RSHDTLVRW

SEQ ID NO: 129612 - protein, 9 aa, Homo Sapiens
RSILAPLAW

SEQ ID NO: 129613 - protein, 9 aa, Homo Sapiens
RSKPLFHHF

SEQ ID NO: 129614 - protein, 9 aa, Homo Sapiens
RSLAYIHSF

SEQ ID NO: 129615 - protein, 9 aa, Homo Sapiens
RSLEISQSY

SEQ ID NO: 129616 - protein, 9 aa, Homo Sapiens
RSLLQENNW

SEQ ID NO: 129617 - protein, 9 aa, Homo Sapiens
RSLPEIWTL

SEQ ID NO: 129618 - protein, 9 aa, Homo Sapiens
RSLPENIQF

SEQ ID NO: 129619 - protein, 9 aa, Homo Sapiens
RSLQLSLVM

SEQ ID NO: 129620 - protein, 9 aa, Homo Sapiens
RSLQTICSW

SEQ ID NO: 129621 - protein, 9 aa, Homo Sapiens
RSLSTTNVF

SEQ ID NO: 129622 - protein, 9 aa, Homo Sapiens
RSMEDFVTW

SEQ ID NO: 129623 - protein, 9 aa, Homo Sapiens
RSMGLPLQF

SEQ ID NO: 129624 - protein, 9 aa, Homo Sapiens
RSRVFDLQF

SEQ ID NO: 129625 - protein, 9 aa, Homo Sapiens
RSVLHHFHF

SEQ ID NO: 129626 - protein, 9 aa, Homo Sapiens
RTEILNQEW

SEQ ID NO: 129627 - protein, 9 aa, Homo Sapiens
RTINVYPNF

SEQ ID NO: 129628 - protein, 9 aa, Homo Sapiens
RTKDILIRF

SEQ ID NO: 129629 - protein, 9 aa, Homo Sapiens
RTLDFDPLL

SEQ ID NO: 129630 - protein, 9 aa, Homo Sapiens
RTLDNQLFF

SEQ ID NO: 129631 - protein, 9 aa, Homo Sapiens
RTLETLKIF

SEQ ID NO: 129632 - protein, 9 aa, Homo Sapiens
RTLGEIPTY

SEQ ID NO: 129633 - protein, 9 aa, Homo Sapiens
RTLPVLLLY

SEQ ID NO: 129634 - protein, 9 aa, Homo Sapiens
RTLTFAERW

SEQ ID NO: 129635 - protein, 9 aa, Homo Sapiens
RTLVPNFTF

SEQ ID NO: 129636 - protein, 9 aa, Homo Sapiens
RTMEIESTF

SEQ ID NO: 129637 - protein, 9 aa, Homo Sapiens
RTMPIYPTY

SEQ ID NO: 129638 - protein, 9 aa, Homo Sapiens
RTSETNTLF

SEQ ID NO: 129639 - protein, 9 aa, Homo Sapiens
RTTDLLTDW

SEQ ID NO: 129640 - protein, 9 aa, Homo Sapiens
RTVEKPPKF

SEQ ID NO: 129641 - protein, 9 aa, Homo Sapiens
RTVEKTWKL

SEQ ID NO: 129642 - protein, 9 aa, Homo Sapiens
RTVIIEQSW

SEQ ID NO: 129643 - protein, 9 aa, Homo Sapiens
RTVRIWRQY

SEQ ID NO: 129644 - protein, 9 aa, Homo Sapiens
RTVYFSEQW

SEQ ID NO: 129645 - protein, 9 aa, Homo Sapiens
RTWLLKTHW

SEQ ID NO: 129646 - protein, 9 aa, Homo Sapiens
RTYDLYITY

SEQ ID NO: 129647 - protein, 9 aa, Homo Sapiens
RTYFVANEW

SEQ ID NO: 129648 - protein, 9 aa, Homo Sapiens
RTYPVQEYF

SEQ ID NO: 129649 - protein, 9 aa, Homo Sapiens
RVAHFGYHW

SEQ ID NO: 129650 - protein, 9 aa, Homo Sapiens
RVEPNIKWF

SEQ ID NO: 129651 - protein, 9 aa, Homo Sapiens
RVFLMDPAW

SEQ ID NO: 129652 - protein, 9 aa, Homo Sapiens
RVFPHEVNW

SEQ ID NO: 129653 - protein, 9 aa, Homo Sapiens
RVFPYSVFY

SEQ ID NO: 129654 - protein, 9 aa, Homo Sapiens
RVHAFLEQW

SEQ ID NO: 129655 - protein, 9 aa, Homo Sapiens
RVHPETYEW

SEQ ID NO: 129656 - protein, 9 aa, Homo Sapiens
RVIDVGSEW

SEQ ID NO: 129657 - protein, 9 aa, Homo Sapiens
RVIEFAAKF

SEQ ID NO: 129658 - protein, 9 aa, Homo Sapiens
RVIEILFSW

SEQ ID NO: 129659 - protein, 9 aa, Homo Sapiens
RVLELLKQY

SEQ ID NO: 129660 - protein, 9 aa, Homo Sapiens
RVLISTDVW

SEQ ID NO: 129661 - protein, 9 aa, Homo Sapiens
RVVDFDETW

SEQ ID NO: 129662 - protein, 9 aa, Homo Sapiens
RVWNLNHLW

SEQ ID NO: 129663 - protein, 9 aa, Homo Sapiens
RVWQWDEKW

SEQ ID NO: 129664 - protein, 9 aa, Homo Sapiens
RVYPQAVYF

SEQ ID NO: 129665 - protein, 9 aa, Homo Sapiens
RVYVDITTY

SEQ ID NO: 129666 - protein, 9 aa, Homo Sapiens
SAANIQPIF

SEQ ID NO: 129667 - protein, 9 aa, Homo Sapiens
SAAPLFFSW

SEQ ID NO: 129668 - protein, 9 aa, Homo Sapiens
SAARLYYYW

SEQ ID NO: 129669 - protein, 9 aa, Homo Sapiens
SAAYLPRMW

SEQ ID NO: 129670 - protein, 9 aa, Homo Sapiens
SADGTIKLW

SEQ ID NO: 129671 - protein, 9 aa, Homo Sapiens
SADKTVALW

SEQ ID NO: 129672 - protein, 9 aa, Homo Sapiens
SAHGIVVAW

SEQ ID NO: 129673 - protein, 9 aa, Homo Sapiens
SAIRYQEVW

SEQ ID NO: 129674 - protein, 9 aa, Homo Sapiens
SALDMTRYW

SEQ ID NO: 129675 - protein, 9 aa, Homo Sapiens
SLRLEVTEF

SEQ ID NO: 129676 - protein, 9 aa, Homo Sapiens
SSDGTIRLW

SEQ ID NO: 129677 - protein, 9 aa, Homo Sapiens
SSDNTIRFW

SEQ ID NO: 129678 - protein, 9 aa, Homo Sapiens
SSDTTVKVW

SEQ ID NO: 129679 - protein, 9 aa, Homo Sapiens
SSKALLQLW

SEQ ID NO: 129680 - protein, 9 aa, Homo Sapiens
SSKPDPSQW

SEQ ID NO: 129681 - protein, 9 aa, Homo Sapiens
SSLPTVEKW

SEQ ID NO: 129682 - protein, 9 aa, Homo Sapiens
SSLQLYRQF

SEQ ID NO: 129683 - protein, 9 aa, Homo Sapiens
SSLRVPSQW

SEQ ID NO: 129684 - protein, 9 aa, Homo Sapiens
SSRQIISHW

SEQ ID NO: 129685 - protein, 9 aa, Homo Sapiens
SSSRIRAAW

SEQ ID NO: 129686 - protein, 9 aa, Homo Sapiens
SSSSIEVHW

SEQ ID NO: 129687 - protein, 9 aa, Homo Sapiens
SSSSVRVEW

SEQ ID NO: 129688 - protein, 9 aa, Homo Sapiens
SSYPNTFEW

SEQ ID NO: 129689 - protein, 9 aa, Homo Sapiens
STDRHIRLW

SEQ ID NO: 129690 - protein, 9 aa, Homo Sapiens
STFPGFVSW

SEQ ID NO: 129691 - protein, 9 aa, Homo Sapiens
STIKIQAMW

SEQ ID NO: 129692 - protein, 9 aa, Homo Sapiens
STLPVSCAW

SEQ ID NO: 129693 - protein, 9 aa, Homo Sapiens
STYVIRDEW

SEQ ID NO: 129694 - protein, 9 aa, Homo Sapiens
SVKITQVTW

SEQ ID NO: 129695 - protein, 9 aa, Homo Sapiens
SVSSIVRQW

SEQ ID NO: 129696 - protein, 9 aa, Homo Sapiens
SVTEIQEKW

SEQ ID NO: 129697 - protein, 9 aa, Homo Sapiens
SVTGILKVW

SEQ ID NO: 129698 - protein, 9 aa, Homo Sapiens
TAADVVKQW

SEQ ID NO: 129699 - protein, 9 aa, Homo Sapiens
TAKISDFSW

SEQ ID NO: 129700 - protein, 9 aa, Homo Sapiens
TALPLLKQF

SEQ ID NO: 129701 - protein, 9 aa, Homo Sapiens
TALSNLITW

SEQ ID NO: 129702 - protein, 9 aa, Homo Sapiens
TANGIALLW

SEQ ID NO: 129703 - protein, 9 aa, Homo Sapiens
TARPVLWHW

SEQ ID NO: 129704 - protein, 9 aa, Homo Sapiens
TSKITSTAW

SEQ ID NO: 129705 - protein, 9 aa, Homo Sapiens
TSLFIARSF

SEQ ID NO: 129706 - protein, 9 aa, Homo Sapiens
TSLQLQHLF

SEQ ID NO: 129707 - protein, 9 aa, Homo Sapiens
TSTIVTLKW

SEQ ID NO: 129708 - protein, 9 aa, Homo Sapiens
TSVPDHVVW

SEQ ID NO: 129709 - protein, 9 aa, Homo Sapiens
TTAPEFRRW

SEQ ID NO: 129710 - protein, 9 aa, Homo Sapiens
TTHNIPQTF

SEQ ID NO: 129711 - protein, 9 aa, Homo Sapiens
TTKINTFNW

SEQ ID NO: 129712 - protein, 9 aa, Homo Sapiens
TTLEHQKTF

SEQ ID NO: 129713 - protein, 9 aa, Homo Sapiens
TTRELQQYW

SEQ ID NO: 129714 - protein, 9 aa, Homo Sapiens
TTSRVLKVL

SEQ ID NO: 129715 - protein, 9 aa, Homo Sapiens
TVGPKTFSW

SEQ ID NO: 129716 - protein, 9 aa, Homo Sapiens
TVYPKPEEW

SEQ ID NO: 129717 - protein, 9 aa, Homo Sapiens
VASEHFYFW

SEQ ID NO: 129718 - protein, 9 aa, Homo Sapiens
VAVLLSRTW

SEQ ID NO: 129719 - protein, 9 aa, Homo Sapiens
VIWPNPVIW

SEQ ID NO: 129720 - protein, 9 aa, Homo Sapiens
VNFTVDQIR

SEQ ID NO: 129721 - protein, 9 aa, Homo Sapiens
VSAGIQTSF

SEQ ID NO: 129722 - protein, 9 aa, Homo Sapiens
VSFAEKNGW

SEQ ID NO: 129723 - protein, 9 aa, Homo Sapiens
VSFYNQNKW

SEQ ID NO: 129724 - protein, 9 aa, Homo Sapiens
VSHPNEVSW

SEQ ID NO: 129725 - protein, 9 aa, Homo Sapiens
VSKAPAPTF

SEQ ID NO: 129726 - protein, 9 aa, Homo Sapiens
VSKPDLITF

SEQ ID NO: 129727 - protein, 9 aa, Homo Sapiens
VSKPDLITW

SEQ ID NO: 129728 - protein, 9 aa, Homo Sapiens
VSKPSAPVF

SEQ ID NO: 129729 - protein, 9 aa, Homo Sapiens
VSKTLPSTW

SEQ ID NO: 129730 - protein, 9 aa, Homo Sapiens
VSLSAGRSW

SEQ ID NO: 129731 - protein, 9 aa, Homo Sapiens
VSMIFPFHW

SEQ ID NO: 129732 - protein, 9 aa, Homo Sapiens
VSRILQEAW

SEQ ID NO: 129733 - protein, 9 aa, Homo Sapiens
VSSHVERVF

SEQ ID NO: 129734 - protein, 9 aa, Homo Sapiens
VSSKVEVVW

SEQ ID NO: 129735 - protein, 9 aa, Homo Sapiens
VSVPYVFRY

SEQ ID NO: 129736 - protein, 9 aa, Homo Sapiens
VTALAARTW

SEQ ID NO: 129737 - protein, 9 aa, Homo Sapiens
VTFLLPAGW

SEQ ID NO: 129738 - protein, 9 aa, Homo Sapiens
VTFPGIKLI

SEQ ID NO: 129739 - protein, 9 aa, Homo Sapiens
VTHSVRIGF

SEQ ID NO: 129740 - protein, 9 aa, Homo Sapiens
VTIRLLETI

SEQ ID NO: 129741 - protein, 9 aa, Homo Sapiens
VTKITLESF

SEQ ID NO: 129742 - protein, 9 aa, Homo Sapiens
VTKKTYEIW

SEQ ID NO: 129743 - protein, 9 aa, Homo Sapiens
VTLEFAQKW

SEQ ID NO: 129744 - protein, 9 aa, Homo Sapiens
VTNKSVSVW

SEQ ID NO: 129745 - protein, 9 aa, Homo Sapiens
VTNPHSSQW

SEQ ID NO: 129746 - protein, 9 aa, Homo Sapiens
VTNPHTDAW

SEQ ID NO: 129747 - protein, 9 aa, Homo Sapiens
VTPIWKLLI

SEQ ID NO: 129748 - protein, 9 aa, Homo Sapiens
VTSPLTVEW

SEQ ID NO: 129749 - protein, 9 aa, Homo Sapiens
VTTVVNPKY

SEQ ID NO: 129750 - protein, 9 aa, Homo Sapiens
VTYKNVPNW

SEQ ID NO: 129751 - protein, 9 aa, Homo Sapiens
VTYVPVTTF

SEQ ID NO: 129752 - protein, 9 aa, Homo Sapiens
VVMPIAHEF

SEQ ID NO: 129753 - protein, 9 aa, Homo Sapiens
YAAIIQLRW

SEQ ID NO: 129754 - protein, 9 aa, Homo Sapiens
YAVVLNATW

SEQ ID NO: 129755 - protein, 9 aa, Homo Sapiens
YSIRGQLSW

SEQ ID NO: 129756 - protein, 9 aa, Homo Sapiens
YTDNLVRVW

SEQ ID NO: 129757 - protein, 9 aa, Homo Sapiens
YTHEVVTLW

SEQ ID NO: 129758 - protein, 9 aa, Homo Sapiens
YTHQVVTRW

SEQ ID NO: 129759 - protein, 9 aa, Homo Sapiens
YTKFQIATW

SEQ ID NO: 129760 - protein, 9 aa, Homo Sapiens
YTNKVITLW

SEQ ID NO: 129761 - protein, 9 aa, Homo Sapiens
YTNRVVTLW

SEQ ID NO: 129762 - protein, 9 aa, Homo Sapiens
YTVRVIDVF

SEQ ID NO: 129763 - protein, 9 aa, Homo Sapiens
YTYRGPKAF

SEQ ID NO: 129764 - protein, 10 aa, Homo Sapiens
AAAAAAAAAW

SEQ ID NO: 129765 - protein, 10 aa, Homo Sapiens
AAADSAVRLW

SEQ ID NO: 129766 - protein, 10 aa, Homo Sapiens
AAALPAAALW

SEQ ID NO: 129767 - protein, 10 aa, Homo Sapiens
AAFDQRMKTW

SEQ ID NO: 129768 - protein, 10 aa, Homo Sapiens
AAKPEQIQKW

SEQ ID NO: 129769 - protein, 10 aa, Homo Sapiens
AALPDQSFLW

SEQ ID NO: 129770 - protein, 10 aa, Homo Sapiens
AHSNLNGVWH

SEQ ID NO: 129771 - protein, 10 aa, Homo Sapiens
ASADGTIKLW

SEQ ID NO: 129772 - protein, 10 aa, Homo Sapiens
ASAGNLKPVW

SEQ ID NO: 129773 - protein, 10 aa, Homo Sapiens
ASARAGIHLW

SEQ ID NO: 129774 - protein, 10 aa, Homo Sapiens
ASDDGTVRIW

SEQ ID NO: 129775 - protein, 10 aa, Homo Sapiens
ASEDRSVRIW

SEQ ID NO: 129776 - protein, 10 aa, Homo Sapiens
ASFDSTVRLW

SEQ ID NO: 129777 - protein, 10 aa, Homo Sapiens
ASFNDNIIKW

SEQ ID NO: 129778 - protein, 10 aa, Homo Sapiens
ASLDQTVRVW

SEQ ID NO: 129779 - protein, 10 aa, Homo Sapiens
ASLNLPAVSW

SEQ ID NO: 129780 - protein, 10 aa, Homo Sapiens
ASMDKTMILW

SEQ ID NO: 129781 - protein, 10 aa, Homo Sapiens
ASWDHTIRVW

SEQ ID NO: 129782 - protein, 10 aa, Homo Sapiens
ATFPDPNVKY

SEQ ID NO: 129783 - protein, 10 aa, Homo Sapiens
ATGGRIVPRF

SEQ ID NO: 129784 - protein, 10 aa, Homo Sapiens
ATILGNTERW

SEQ ID NO: 129785 - protein, 10 aa, Homo Sapiens
ATKVLGTVKW

SEQ ID NO: 129786 - protein, 10 aa, Homo Sapiens
ATLGIVQVFW

SEQ ID NO: 129787 - protein, 10 aa, Homo Sapiens
ATRDELPYTF

SEQ ID NO: 129788 - protein, 10 aa, Homo Sapiens
ATRFNLETEW

SEQ ID NO: 129789 - protein, 10 aa, Homo Sapiens
ATSGDYLRVW

SEQ ID NO: 129790 - protein, 10 aa, Homo Sapiens
ATYDFKSDLW

SEQ ID NO: 129791 - protein, 10 aa, Homo Sapiens
AVAIAAARVW

SEQ ID NO: 129792 - protein, 10 aa, Homo Sapiens
AVNKMDQVNW

SEQ ID NO: 129793 - protein, 10 aa, Homo Sapiens
AVNPRDPPSW

SEQ ID NO: 129794 - protein, 10 aa, Homo Sapiens
AVSEAVRQLW

SEQ ID NO: 129795 - protein, 10 aa, Homo Sapiens
AVTALAARTW

SEQ ID NO: 129796 - protein, 10 aa, Homo Sapiens
DLPVNLSVVW

SEQ ID NO: 129797 - protein, 10 aa, Homo Sapiens
ESLRNYYEQW

SEQ ID NO: 129798 - protein, 10 aa, Homo Sapiens
FAYKVQPRNW

SEQ ID NO: 129799 - protein, 10 aa, Homo Sapiens
FSIEKRFAYW

SEQ ID NO: 129800 - protein, 10 aa, Homo Sapiens
FSLQAPAPLM

SEQ ID NO: 129801 - protein, 10 aa, Homo Sapiens
FSRHTKAIVW

SEQ ID NO: 129802 - protein, 10 aa, Homo Sapiens
FTLREVQERW

SEQ ID NO: 129803 - protein, 10 aa, Homo Sapiens
GALPNLRELW

SEQ ID NO: 129804 - protein, 10 aa, Homo Sapiens
GALRVLNSYW

SEQ ID NO: 129805 - protein, 10 aa, Homo Sapiens
GAYKYIQELW

SEQ ID NO: 129806 - protein, 10 aa, Homo Sapiens
GSADKTVALW

SEQ ID NO: 129807 - protein, 10 aa, Homo Sapiens
GSIDSSIRCW

SEQ ID NO: 129808 - protein, 10 aa, Homo Sapiens
GSLQEGHRLW

SEQ ID NO: 129809 - protein, 10 aa, Homo Sapiens
GSSDGTIRLW

SEQ ID NO: 129810 - protein, 10 aa, Homo Sapiens
GSSDSTVRVW

SEQ ID NO: 129811 - protein, 10 aa, Homo Sapiens
GSWDGTLRLW

SEQ ID NO: 129812 - protein, 10 aa, Homo Sapiens
GSWDHTLRVW

SEQ ID NO: 129813 - protein, 10 aa, Homo Sapiens
GSWDQTVKLW

SEQ ID NO: 129814 - protein, 10 aa, Homo Sapiens
GSYDGFARIW

SEQ ID NO: 129815 - protein, 10 aa, Homo Sapiens
GSYVAPKAVW

SEQ ID NO: 129816 - protein, 10 aa, Homo Sapiens
GTFTIKSDVW

SEQ ID NO: 129817 - protein, 10 aa, Homo Sapiens
GTFTNQIHKW

SEQ ID NO: 129818 - protein, 10 aa, Homo Sapiens
GTLPPEIQAW

SEQ ID NO: 129819 - protein, 10 aa, Homo Sapiens
HAFDGFEVNW

SEQ ID NO: 129820 - protein, 10 aa, Homo Sapiens
HAKPIQDVQW

SEQ ID NO: 129821 - protein, 10 aa, Homo Sapiens
HAWMDNIREW

SEQ ID NO: 129822 - protein, 10 aa, Homo Sapiens
HSAVVEDVAW

SEQ ID NO: 129823 - protein, 10 aa, Homo Sapiens
HSGPVVAMVW

SEQ ID NO: 129824 - protein, 10 aa, Homo Sapiens
HSLDLQLQNW

SEQ ID NO: 129825 - protein, 10 aa, Homo Sapiens
HSMDPPTFTF

SEQ ID NO: 129826 - protein, 10 aa, Homo Sapiens
HSMLDINALF

SEQ ID NO: 129827 - protein, 10 aa, Homo Sapiens
HSVAQAGVQW

SEQ ID NO: 129828 - protein, 10 aa, Homo Sapiens
HSVTQAGVQW

SEQ ID NO: 129829 - protein, 10 aa, Homo Sapiens
HTADVQLHAW

SEQ ID NO: 129830 - protein, 10 aa, Homo Sapiens
HTAKISDFSW

SEQ ID NO: 129831 - protein, 10 aa, Homo Sapiens
HTAPVLDIAW

SEQ ID NO: 129832 - protein, 10 aa, Homo Sapiens
HTAVVEDVSW

SEQ ID NO: 129833 - protein, 10 aa, Homo Sapiens
HTFQNDIHVY

SEQ ID NO: 129834 - protein, 10 aa, Homo Sapiens
HTIGCNAVSW

SEQ ID NO: 129835 - protein, 10 aa, Homo Sapiens
HTLDDRTQLW

SEQ ID NO: 129836 - protein, 10 aa, Homo Sapiens
HTMTDDVTFW

SEQ ID NO: 129837 - protein, 10 aa, Homo Sapiens
HTRPVVDLAF

SEQ ID NO: 129838 - protein, 10 aa, Homo Sapiens
HTWIQDNGGW

SEQ ID NO: 129839 - protein, 10 aa, Homo Sapiens
IAANEENRKW

SEQ ID NO: 129840 - protein, 10 aa, Homo Sapiens
IGLPSGLESW

SEQ ID NO: 129841 - protein, 10 aa, Homo Sapiens
ISAPDSQVRF

SEQ ID NO: 129842 - protein, 10 aa, Homo Sapiens
ISASSLTSKW

SEQ ID NO: 129843 - protein, 10 aa, Homo Sapiens
ISATEVDSRW

SEQ ID NO: 129844 - protein, 10 aa, Homo Sapiens
ISDPYKVYRI

SEQ ID NO: 129845 - protein, 10 aa, Homo Sapiens
ISFHNIHNTF

SEQ ID NO: 129846 - protein, 10 aa, Homo Sapiens
ISFSASHRLY

SEQ ID NO: 129847 - protein, 10 aa, Homo Sapiens
ISKPGQFETF

SEQ ID NO: 129848 - protein, 10 aa, Homo Sapiens
ISLIPPEERW

SEQ ID NO: 129849 - protein, 10 aa, Homo Sapiens
ISLLAQNTSW

SEQ ID NO: 129850 - protein, 10 aa, Homo Sapiens
ISLPNGLQGF

SEQ ID NO: 129851 - protein, 10 aa, Homo Sapiens
ISLSEPRMLW

SEQ ID NO: 129852 - protein, 10 aa, Homo Sapiens
ISSGKLNEIW

SEQ ID NO: 129853 - protein, 10 aa, Homo Sapiens
ISSVRAVAVW

SEQ ID NO: 129854 - protein, 10 aa, Homo Sapiens
ISVPGLQTNW

SEQ ID NO: 129855 - protein, 10 aa, Homo Sapiens
ITAENVAKKW

SEQ ID NO: 129856 - protein, 10 aa, Homo Sapiens
ITFPNKEIAW

SEQ ID NO: 129857 - protein, 10 aa, Homo Sapiens
ITKADAAEFW

SEQ ID NO: 129858 - protein, 10 aa, Homo Sapiens
ITKEIEANEW

SEQ ID NO: 129859 - protein, 10 aa, Homo Sapiens
ITKGYVIRLY

SEQ ID NO: 129860 - protein, 10 aa, Homo Sapiens
ITLPTEASTW

SEQ ID NO: 129861 - protein, 10 aa, Homo Sapiens
ITLRQTITTF

SEQ ID NO: 129862 - protein, 10 aa, Homo Sapiens
ITTEGKLWSW

SEQ ID NO: 129863 - protein, 10 aa, Homo Sapiens
ITVDGKPPTW

SEQ ID NO: 129864 - protein, 10 aa, Homo Sapiens
ITVLARSKPG

SEQ ID NO: 129865 - protein, 10 aa, Homo Sapiens
ITVLVTGAKW

SEQ ID NO: 129866 - protein, 10 aa, Homo Sapiens
KAHPPELKKF

SEQ ID NO: 129867 - protein, 10 aa, Homo Sapiens
KAVDIVKQVW

SEQ ID NO: 129868 - protein, 10 aa, Homo Sapiens
KAVIDLNNRW

SEQ ID NO: 129869 - protein, 10 aa, Homo Sapiens
KAWAEYVVEW

SEQ ID NO: 129870 - protein, 10 aa, Homo Sapiens
KAYGPKVDIW

SEQ ID NO: 129871 - protein, 10 aa, Homo Sapiens
KGFSEEHNTW

SEQ ID NO: 129872 - protein, 10 aa, Homo Sapiens
KGFTDADNTW

SEQ ID NO: 129873 - protein, 10 aa, Homo Sapiens
KGWDGYDVQW

SEQ ID NO: 129874 - protein, 10 aa, Homo Sapiens
KGWPAVAQSW

SEQ ID NO: 129875 - protein, 10 aa, Homo Sapiens
KIKDYLEELW

SEQ ID NO: 129876 - protein, 10 aa, Homo Sapiens
KIYLPYLHEW

SEQ ID NO: 129877 - protein, 10 aa, Homo Sapiens
KLIDVTNIYW

SEQ ID NO: 129878 - protein, 10 aa, Homo Sapiens
KLMPGRIQLW

SEQ ID NO: 129879 - protein, 10 aa, Homo Sapiens
KSAEAVGVKI

SEQ ID NO: 129880 - protein, 10 aa, Homo Sapiens
KSAEKEISLW

SEQ ID NO: 129881 - protein, 10 aa, Homo Sapiens
KSAVELVQEF

SEQ ID NO: 129882 - protein, 10 aa, Homo Sapiens
KSFEGNVFMY

SEQ ID NO: 129883 - protein, 10 aa, Homo Sapiens
KSFEKAKESW

SEQ ID NO: 129884 - protein, 10 aa, Homo Sapiens
KSFSDLFKRF

SEQ ID NO: 129885 - protein, 10 aa, Homo Sapiens
KSFSDTLKTY

SEQ ID NO: 129886 - protein, 10 aa, Homo Sapiens
KSGPVVSLGW

SEQ ID NO: 129887 - protein, 10 aa, Homo Sapiens
KSIGDIFLKY

SEQ ID NO: 129888 - protein, 10 aa, Homo Sapiens
KSINSEVLKF

SEQ ID NO: 129889 - protein, 10 aa, Homo Sapiens
KSITIIGGGF

SEQ ID NO: 129890 - protein, 10 aa, Homo Sapiens
KSKESESFVF

SEQ ID NO: 129891 - protein, 10 aa, Homo Sapiens
KSKVDIPAHW

SEQ ID NO: 129892 - protein, 10 aa, Homo Sapiens
KSLEDVVRAY

SEQ ID NO: 129893 - protein, 10 aa, Homo Sapiens
KSLNIFGSSW

SEQ ID NO: 129894 - protein, 10 aa, Homo Sapiens
KSLPAEINRM

SEQ ID NO: 129895 - protein, 10 aa, Homo Sapiens
KSTPYTAVRW

SEQ ID NO: 129896 - protein, 10 aa, Homo Sapiens
KSVENLGVSY

SEQ ID NO: 129897 - protein, 10 aa, Homo Sapiens
KSVFVKNVGW

SEQ ID NO: 129898 - protein, 10 aa, Homo Sapiens
KSWQGVTIYF

SEQ ID NO: 129899 - protein, 10 aa, Homo Sapiens
KTAEEIKQIW

SEQ ID NO: 129900 - protein, 10 aa, Homo Sapiens
KTAEEVAALI

SEQ ID NO: 129901 - protein, 10 aa, Homo Sapiens
KTIPYSDKLF

SEQ ID NO: 129902 - protein, 10 aa, Homo Sapiens
KTKDGVREVF

SEQ ID NO: 129903 - protein, 10 aa, Homo Sapiens
KTLAEINQKW

SEQ ID NO: 129904 - protein, 10 aa, Homo Sapiens
KTLDQAIMKF

SEQ ID NO: 129905 - protein, 10 aa, Homo Sapiens
KTLGDFAAEY

SEQ ID NO: 129906 - protein, 10 aa, Homo Sapiens
KTLSDIFLLF

SEQ ID NO: 129907 - protein, 10 aa, Homo Sapiens
KTLTDISNQW

SEQ ID NO: 129908 - protein, 10 aa, Homo Sapiens
KTLVLSNLSY

SEQ ID NO: 129909 - protein, 10 aa, Homo Sapiens
KTNTFQGVIF

SEQ ID NO: 129910 - protein, 10 aa, Homo Sapiens
KTPEEIRKTF

SEQ ID NO: 129911 - protein, 10 aa, Homo Sapiens
KTRDDWLVSW

SEQ ID NO: 129912 - protein, 10 aa, Homo Sapiens
KTSELLVRKW

SEQ ID NO: 129913 - protein, 10 aa, Homo Sapiens
KTTPDVIFVF

SEQ ID NO: 129914 - protein, 10 aa, Homo Sapiens
KTVAGGAWTY

SEQ ID NO: 129915 - protein, 10 aa, Homo Sapiens
KTVALDGTLF

SEQ ID NO: 129916 - protein, 10 aa, Homo Sapiens
KTVTAMDVVY

SEQ ID NO: 129917 - protein, 10 aa, Homo Sapiens
KTYGEIFEKF

SEQ ID NO: 129918 - protein, 10 aa, Homo Sapiens
KTYQDIQNTI

SEQ ID NO: 129919 - protein, 10 aa, Homo Sapiens
KVFESWMHHW

SEQ ID NO: 129920 - protein, 10 aa, Homo Sapiens
KVGSVVSVGW

SEQ ID NO: 129921 - protein, 10 aa, Homo Sapiens
KVIAINDLNW

SEQ ID NO: 129922 - protein, 10 aa, Homo Sapiens
KVIDKRLWGW

SEQ ID NO: 129923 - protein, 10 aa, Homo Sapiens
KVLIDIREYW

SEQ ID NO: 129924 - protein, 10 aa, Homo Sapiens
KVLPPLEQVW

SEQ ID NO: 129925 - protein, 10 aa, Homo Sapiens
KVRAESFDTW

SEQ ID NO: 129926 - protein, 10 aa, Homo Sapiens
LALPPGAEHW

SEQ ID NO: 129927 - protein, 10 aa, Homo Sapiens
LALSPVPSHW

SEQ ID NO: 129928 - protein, 10 aa, Homo Sapiens
LGIPKDPRQW

SEQ ID NO: 129929 - protein, 10 aa, Homo Sapiens
LLFPGKAFSW

SEQ ID NO: 129930 - protein, 10 aa, Homo Sapiens
LSAIIDGKIF

SEQ ID NO: 129931 - protein, 10 aa, Homo Sapiens
LSALIDGKNF

SEQ ID NO: 129932 - protein, 10 aa, Homo Sapiens
LSFKDVAVVF

SEQ ID NO: 129933 - protein, 10 aa, Homo Sapiens
LSHGVPLPNW

SEQ ID NO: 129934 - protein, 10 aa, Homo Sapiens
LSINPNNHSW

SEQ ID NO: 129935 - protein, 10 aa, Homo Sapiens
LSIPDIKTAF

SEQ ID NO: 129936 - protein, 10 aa, Homo Sapiens
LSKGGELFAW

SEQ ID NO: 129937 - protein, 10 aa, Homo Sapiens
LSLDELHRKY

SEQ ID NO: 129938 - protein, 10 aa, Homo Sapiens
LSLPADLTKM

SEQ ID NO: 129939 - protein, 10 aa, Homo Sapiens
LSLPEDFYHF

SEQ ID NO: 129940 - protein, 10 aa, Homo Sapiens
LSMPASLGRM

SEQ ID NO: 129941 - protein, 10 aa, Homo Sapiens
LSSPDYQIRW

SEQ ID NO: 129942 - protein, 10 aa, Homo Sapiens
LSVKEPQLVW

SEQ ID NO: 129943 - protein, 10 aa, Homo Sapiens
LTFLGKYREF

SEQ ID NO: 129944 - protein, 10 aa, Homo Sapiens
LTFRDVAIEF

SEQ ID NO: 129945 - protein, 10 aa, Homo Sapiens
LTIPDGGVHI

SEQ ID NO: 129946 - protein, 10 aa, Homo Sapiens
LTLEDLEDSW

SEQ ID NO: 129947 - protein, 10 aa, Homo Sapiens
LTLNEDLRSW

SEQ ID NO: 129948 - protein, 10 aa, Homo Sapiens
LTMPDTPRLF

SEQ ID NO: 129949 - protein, 10 aa, Homo Sapiens
LTMSDVQIHW

SEQ ID NO: 129950 - protein, 10 aa, Homo Sapiens
LTRISDPEKW

SEQ ID NO: 129951 - protein, 10 aa, Homo Sapiens
LTVDGKVFSW

SEQ ID NO: 129952 - protein, 10 aa, Homo Sapiens
LVFPYTHQNW

SEQ ID NO: 129953 - protein, 10 aa, Homo Sapiens
MAAEALSRGW

SEQ ID NO: 129954 - protein, 10 aa, Homo Sapiens
MAFQNDVYEW

SEQ ID NO: 129955 - protein, 10 aa, Homo Sapiens
MTAGVDGHSW

SEQ ID NO: 129956 - protein, 10 aa, Homo Sapiens
MTFKDVEVTF

SEQ ID NO: 129957 - protein, 10 aa, Homo Sapiens
MTRPDLPVGF

SEQ ID NO: 129958 - protein, 10 aa, Homo Sapiens
NSVAASLMSW

SEQ ID NO: 129959 - protein, 10 aa, Homo Sapiens
QAINPKLLQL

SEQ ID NO: 129960 - protein, 10 aa, Homo Sapiens
QSLPDFGISY

SEQ ID NO: 129961 - protein, 10 aa, Homo Sapiens
QTLSLEADKW

SEQ ID NO: 129962 - protein, 10 aa, Homo Sapiens
QTMEDLISLW

SEQ ID NO: 129963 - protein, 10 aa, Homo Sapiens
QTQPWTTQLW

SEQ ID NO: 129964 - protein, 10 aa, Homo Sapiens
QTVSDIERGW

SEQ ID NO: 129965 - protein, 10 aa, Homo Sapiens
QTWWHGVLAW

SEQ ID NO: 129966 - protein, 10 aa, Homo Sapiens
RAAELFVETI

SEQ ID NO: 129967 - protein, 10 aa, Homo Sapiens
RAAEPVRVVW

SEQ ID NO: 129968 - protein, 10 aa, Homo Sapiens
RAIDSIHQLW

SEQ ID NO: 129969 - protein, 10 aa, Homo Sapiens
RALELEARRW

SEQ ID NO: 129970 - protein, 10 aa, Homo Sapiens
RAMQDMQLLW

SEQ ID NO: 129971 - protein, 10 aa, Homo Sapiens
RARFEEVLTW

SEQ ID NO: 129972 - protein, 10 aa, Homo Sapiens
RAYPHNLMTF

SEQ ID NO: 129973 - protein, 10 aa, Homo Sapiens
RGYPDSESTW

SEQ ID NO: 129974 - protein, 10 aa, Homo Sapiens
RMYPLKPTWW

SEQ ID NO: 129975 - protein, 10 aa, Homo Sapiens
RSFEHALMLF

SEQ ID NO: 129976 - protein, 10 aa, Homo Sapiens
RSFKETTNRW

SEQ ID NO: 129977 - protein, 10 aa, Homo Sapiens
RSFPIIPRSW

SEQ ID NO: 129978 - protein, 10 aa, Homo Sapiens
RSIEEVYYLW

SEQ ID NO: 129979 - protein, 10 aa, Homo Sapiens
RSIPAITRYW

SEQ ID NO: 129980 - protein, 10 aa, Homo Sapiens
RSIQADGLVW

SEQ ID NO: 129981 - protein, 10 aa, Homo Sapiens
RSIQLDGLVW

SEQ ID NO: 129982 - protein, 10 aa, Homo Sapiens
RSKDVAKILW

SEQ ID NO: 129983 - protein, 10 aa, Homo Sapiens
RSLINSNVGF

SEQ ID NO: 129984 - protein, 10 aa, Homo Sapiens
RSLKDALFKW

SEQ ID NO: 129985 - protein, 10 aa, Homo Sapiens
RSLNQTGVQW

SEQ ID NO: 129986 - protein, 10 aa, Homo Sapiens
RSLPEPLMTY

SEQ ID NO: 129987 - protein, 10 aa, Homo Sapiens
RSLSDLFRRY

SEQ ID NO: 129988 - protein, 10 aa, Homo Sapiens
RSLTTLSEQW

SEQ ID NO: 129989 - protein, 10 aa, Homo Sapiens
RSLVPAAVVW

SEQ ID NO: 129990 - protein, 10 aa, Homo Sapiens
RSMQLDYTTW

SEQ ID NO: 129991 - protein, 10 aa, Homo Sapiens
RSRDYQPLLW

SEQ ID NO: 129992 - protein, 10 aa, Homo Sapiens
RSSAGQAWKW

SEQ ID NO: 129993 - protein, 10 aa, Homo Sapiens
RSVDVTNTTF

SEQ ID NO: 129994 - protein, 10 aa, Homo Sapiens
RSVNIKEICW

SEQ ID NO: 129995 - protein, 10 aa, Homo Sapiens
RSVTQAGVQW

SEQ ID NO: 129996 - protein, 10 aa, Homo Sapiens
RSVVQAGVQW

SEQ ID NO: 129997 - protein, 10 aa, Homo Sapiens
RSWDQQIKLW

SEQ ID NO: 129998 - protein, 10 aa, Homo Sapiens
RSYQLEGVNW

SEQ ID NO: 129999 - protein, 10 aa, Homo Sapiens
RTAPFHLDLW

SEQ ID NO: 130000 - protein, 10 aa, Homo Sapiens
RTFTDHVMLF

SEQ ID NO: 130001 - protein, 10 aa, Homo Sapiens
RTILVDNNTW

SEQ ID NO: 130002 - protein, 10 aa, Homo Sapiens
RTIQELFEVY

SEQ ID NO: 130003 - protein, 10 aa, Homo Sapiens
RTLDNQLFFF

SEQ ID NO: 130004 - protein, 10 aa, Homo Sapiens
RTLDTIQLAF

SEQ ID NO: 130005 - protein, 10 aa, Homo Sapiens
RTLESKLVLF

SEQ ID NO: 130006 - protein, 10 aa, Homo Sapiens
RTMELLTQNW

SEQ ID NO: 130007 - protein, 10 aa, Homo Sapiens
RTMNIKSATW

SEQ ID NO: 130008 - protein, 10 aa, Homo Sapiens
RTSIETNVRF

SEQ ID NO: 130009 - protein, 10 aa, Homo Sapiens
RTTLVDNNTW

SEQ ID NO: 130010 - protein, 10 aa, Homo Sapiens
RTVFPSREFW

SEQ ID NO: 130011 - protein, 10 aa, Homo Sapiens
RTYSLVGQAW

SEQ ID NO: 130012 - protein, 10 aa, Homo Sapiens
RTYTYEKLLW

SEQ ID NO: 130013 - protein, 10 aa, Homo Sapiens
RVDPDVAQHW

SEQ ID NO: 130014 - protein, 10 aa, Homo Sapiens
RVFPDKGYSF

SEQ ID NO: 130015 - protein, 10 aa, Homo Sapiens
RVFPEKGYSF

SEQ ID NO: 130016 - protein, 10 aa, Homo Sapiens
RVINEEYKIW

SEQ ID NO: 130017 - protein, 10 aa, Homo Sapiens
RVKAEPFIKW

SEQ ID NO: 130018 - protein, 10 aa, Homo Sapiens
RVKPLHYISW

SEQ ID NO: 130019 - protein, 10 aa, Homo Sapiens
RVKSVNLDQW

SEQ ID NO: 130020 - protein, 10 aa, Homo Sapiens
RVLPLPSENW

SEQ ID NO: 130021 - protein, 10 aa, Homo Sapiens
RVLSDLDQKW

SEQ ID NO: 130022 - protein, 10 aa, Homo Sapiens
RVSPALGITW

SEQ ID NO: 130023 - protein, 10 aa, Homo Sapiens
SAASPHYQEW

SEQ ID NO: 130024 - protein, 10 aa, Homo Sapiens
SALPADTQAW

SEQ ID NO: 130025 - protein, 10 aa, Homo Sapiens
SATDAAIRVW

SEQ ID NO: 130026 - protein, 10 aa, Homo Sapiens
SKSVGQILLW

SEQ ID NO: 130027 - protein, 10 aa, Homo Sapiens
SSACLIGDAW

SEQ ID NO: 130028 - protein, 10 aa, Homo Sapiens
SSLDAHIRLW

SEQ ID NO: 130029 - protein, 10 aa, Homo Sapiens
SSSPEVKGYW

SEQ ID NO: 130030 - protein, 10 aa, Homo Sapiens
STAKEIIQHF

SEQ ID NO: 130031 - protein, 10 aa, Homo Sapiens
STLRELGQTW

SEQ ID NO: 130032 - protein, 10 aa, Homo Sapiens
TAIESGQHYW

SEQ ID NO: 130033 - protein, 10 aa, Homo Sapiens
TILPGNLQSW

SEQ ID NO: 130034 - protein, 10 aa, Homo Sapiens
TSLPEGLKDW

SEQ ID NO: 130035 - protein, 10 aa, Homo Sapiens
TSLTLKHAAW

SEQ ID NO: 130036 - protein, 10 aa, Homo Sapiens
TSRTQFEETW

SEQ ID NO: 130037 - protein, 10 aa, Homo Sapiens
TSSKPDPSQW

SEQ ID NO: 130038 - protein, 10 aa, Homo Sapiens
TSSSSVRVEW

SEQ ID NO: 130039 - protein, 10 aa, Homo Sapiens
TSYGVREVDQ

SEQ ID NO: 130040 - protein, 10 aa, Homo Sapiens
TTDGYLLRLF

SEQ ID NO: 130041 - protein, 10 aa, Homo Sapiens
TTIPHALLTW

SEQ ID NO: 130042 - protein, 10 aa, Homo Sapiens
TVLPGEIQNW

SEQ ID NO: 130043 - protein, 10 aa, Homo Sapiens
TVLPGELQSW

SEQ ID NO: 130044 - protein, 10 aa, Homo Sapiens
TVYTGIDHHW

SEQ ID NO: 130045 - protein, 10 aa, Homo Sapiens
VAAPSWLHRF

SEQ ID NO: 130046 - protein, 10 aa, Homo Sapiens
VAKPNIGENW

SEQ ID NO: 130047 - protein, 10 aa, Homo Sapiens
VARVEPNIKW

SEQ ID NO: 130048 - protein, 10 aa, Homo Sapiens
VSAEGVLHVW

SEQ ID NO: 130049 - protein, 10 aa, Homo Sapiens
VSLRLGDLVW

SEQ ID NO: 130050 - protein, 10 aa, Homo Sapiens
VSWDEKGMTW

SEQ ID NO: 130051 - protein, 10 aa, Homo Sapiens
VTARLVGVLW

SEQ ID NO: 130052 - protein, 10 aa, Homo Sapiens
VTFEDNSKYW

SEQ ID NO: 130053 - protein, 10 aa, Homo Sapiens
VTFEDVAVTF

SEQ ID NO: 130054 - protein, 10 aa, Homo Sapiens
VTFKDVAVTF

SEQ ID NO: 130055 - protein, 10 aa, Homo Sapiens
VTFPDIIRNY

SEQ ID NO: 130056 - protein, 10 aa, Homo Sapiens
VTFPFKPESW

SEQ ID NO: 130057 - protein, 10 aa, Homo Sapiens
VTFRDVAIYF

SEQ ID NO: 130058 - protein, 10 aa, Homo Sapiens
VTKDGRVFAW

SEQ ID NO: 130059 - protein, 10 aa, Homo Sapiens
VTLKNKYLDW

SEQ ID NO: 130060 - protein, 10 aa, Homo Sapiens
VTLRTGEVKW

SEQ ID NO: 130061 - protein, 10 aa, Homo Sapiens
VTNKSQIRTW

SEQ ID NO: 130062 - protein, 10 aa, Homo Sapiens
VTVPANVQRW

SEQ ID NO: 130063 - protein, 10 aa, Homo Sapiens
VVARTVAQLW

SEQ ID NO: 130064 - protein, 10 aa, Homo Sapiens
YTKIPDPSTW

SEQ ID NO: 130065 - protein, 10 aa, Homo Sapiens
YTLPNGDTAW

SEQ ID NO: 130066 - protein, 10 aa, Homo Sapiens
YTSRQIPQNF

SEQ ID NO: 130067 - protein, 11 aa, Homo Sapiens
AAFNKDALLNW

SEQ ID NO: 130068 - protein, 11 aa, Homo Sapiens
AAFPAEKESEW

SEQ ID NO: 130069 - protein, 11 aa, Homo Sapiens
AAYRNLGQNLW

SEQ ID NO: 130070 - protein, 11 aa, Homo Sapiens
ASGPHSSLSSW

SEQ ID NO: 130071 - protein, 11 aa, Homo Sapiens
ASLPAELINQI

SEQ ID NO: 130072 - protein, 11 aa, Homo Sapiens
ASLPFQVANVW

SEQ ID NO: 130073 - protein, 11 aa, Homo Sapiens
ASRVLISTDVW

SEQ ID NO: 130074 - protein, 11 aa, Homo Sapiens
ASYSGKAADVW

SEQ ID NO: 130075 - protein, 11 aa, Homo Sapiens
ATDPNILGRTW

SEQ ID NO: 130076 - protein, 11 aa, Homo Sapiens
ATIKDIREHEW

SEQ ID NO: 130077 - protein, 11 aa, Homo Sapiens
ATIPVSQISTI

SEQ ID NO: 130078 - protein, 11 aa, Homo Sapiens
ATLGNFAKATF

SEQ ID NO: 130079 - protein, 11 aa, Homo Sapiens
ATSQLIGTIFF

SEQ ID NO: 130080 - protein, 11 aa, Homo Sapiens
ATTPSAVFRVW

SEQ ID NO: 130081 - protein, 11 aa, Homo Sapiens
ATVPNTIVVNW

SEQ ID NO: 130082 - protein, 11 aa, Homo Sapiens
AVAAVLTQVVW

SEQ ID NO: 130083 - protein, 11 aa, Homo Sapiens
AVFSDAQMHIW

SEQ ID NO: 130084 - protein, 11 aa, Homo Sapiens
CSKPEQLVVTF

SEQ ID NO: 130085 - protein, 11 aa, Homo Sapiens
ETIDWKVFESW

SEQ ID NO: 130086 - protein, 11 aa, Homo Sapiens
FAYKDQNENRW

SEQ ID NO: 130087 - protein, 11 aa, Homo Sapiens
FGDPASSLFRW

SEQ ID NO: 130088 - protein, 11 aa, Homo Sapiens
FSKPDSDRFVF

SEQ ID NO: 130089 - protein, 11 aa, Homo Sapiens
GSSHLISTSSW

SEQ ID NO: 130090 - protein, 11 aa, Homo Sapiens
GSSTFHTSLYW

SEQ ID NO: 130091 - protein, 11 aa, Homo Sapiens
GSTKVLQAVQW

SEQ ID NO: 130092 - protein, 11 aa, Homo Sapiens
GTAAVFNAVNW

SEQ ID NO: 130093 - protein, 11 aa, Homo Sapiens
GTFEYEYSQRW

SEQ ID NO: 130094 - protein, 11 aa, Homo Sapiens
GTWIGKGTERW

SEQ ID NO: 130095 - protein, 11 aa, Homo Sapiens
GTYMGHTGAVW

SEQ ID NO: 130096 - protein, 11 aa, Homo Sapiens
GVSQVLNRLTF

SEQ ID NO: 130097 - protein, 11 aa, Homo Sapiens
HSAGNMLFRTW

SEQ ID NO: 130098 - protein, 11 aa, Homo Sapiens
HSFYPTPALQW

SEQ ID NO: 130099 - protein, 11 aa, Homo Sapiens
HSGLVHGLAFW

SEQ ID NO: 130100 - protein, 11 aa, Homo Sapiens
HSKENPKEFFW

SEQ ID NO: 130101 - protein, 11 aa, Homo Sapiens
HSNEQTLQRSW
